United States Patent 7,655,785 (BIOINFORMATICALLY DETECTABLE GROUP OF NOVEL REGULATORY OLIGONUCLEOTIDES AND USES THEREOF) - sequence listing, part 25

SEQ ID NO: 1012964 - RNA, 22 nt, Homo sapiens
aagguaauaauacagccaaaga

SEQ ID NO: 1012965 - RNA, 19 nt, Homo sapiens
aagguauuuuaaucaccaa

SEQ ID NO: 1012966 - RNA, 22 nt, Homo sapiens
aaggucacacaguauuaaguga

SEQ ID NO: 1012967 - RNA, 17 nt, Homo sapiens
agggaccuugucuccca

SEQ ID NO: 1012968 - RNA, 15 nt, Homo sapiens
agggagaagcaugaa

SEQ ID NO: 1012969 - RNA, 16 nt, Homo sapiens
agggagagagugcuau

SEQ ID NO: 1012970 - RNA, 18 nt, Homo sapiens
agggaggcucugucucaa

SEQ ID NO: 1012971 - RNA, 19 nt, Homo sapiens
agggagggcuccagacaca

SEQ ID NO: 1012972 - RNA, 14 nt, Homo sapiens
agggagugagugca

SEQ ID NO: 1012973 - RNA, 17 nt, Homo sapiens
agggauccguacauuca

SEQ ID NO: 1012974 - RNA, 22 nt, Homo sapiens
agggaucuugcauucccagugg

SEQ ID NO: 1012975 - RNA, 20 nt, Homo sapiens
agggaugaaagagaaggugg

SEQ ID NO: 1012976 - RNA, 21 nt, Homo sapiens
agggaugaguccccugugaga

SEQ ID NO: 1012977 - RNA, 16 nt, Homo sapiens
agggauuccccuaacc

SEQ ID NO: 1012978 - RNA, 14 nt, Homo sapiens
agggcacacacugu

SEQ ID NO: 1012979 - RNA, 14 nt, Homo sapiens
agggcagaggugga

SEQ ID NO: 1012980 - RNA, 16 nt, Homo sapiens
agggcaggaacuugca

SEQ ID NO: 1012981 - RNA, 14 nt, Homo sapiens
agggcaucaucuau

SEQ ID NO: 1012982 - RNA, 18 nt, Homo sapiens
agggcaucgaucuuccuc

SEQ ID NO: 1012983 - RNA, 15 nt, Homo sapiens
agggcaucuccagga

SEQ ID NO: 1012984 - RNA, 16 nt, Homo sapiens
agggcaucuccaggaa

SEQ ID NO: 1012985 - RNA, 18 nt, Homo sapiens
agggccaagcaccuagcc

SEQ ID NO: 1012986 - RNA, 16 nt, Homo sapiens
agggccccagcacuaa

SEQ ID NO: 1012987 - RNA, 14 nt, Homo sapiens
agggcuagaaccua

SEQ ID NO: 1012988 - RNA, 18 nt, Homo sapiens
agggcuggcaccucucaa

SEQ ID NO: 1012989 - RNA, 17 nt, Homo sapiens
aggggaucccaccccau

SEQ ID NO: 1012990 - RNA, 16 nt, Homo sapiens
aggggcacuucauuga

SEQ ID NO: 1012991 - RNA, 23 nt, Homo sapiens
aggggcccaaauucuuucagugg

SEQ ID NO: 1012992 - RNA, 12 nt, Homo sapiens
aggggccugcag

SEQ ID NO: 1012993 - RNA, 19 nt, Homo sapiens
aggggccuuugucuuguca

SEQ ID NO: 1012994 - RNA, 12 nt, Homo sapiens
aggggcucucag

SEQ ID NO: 1012995 - RNA, 14 nt, Homo sapiens
aggggcucucucau

SEQ ID NO: 1012996 - RNA, 15 nt, Homo sapiens
aggggcucucucaug

SEQ ID NO: 1012997 - RNA, 19 nt, Homo sapiens
aggggcugcugaccuccac

SEQ ID NO: 1012998 - RNA, 21 nt, Homo sapiens
agggggaggcuaaagcccaga

SEQ ID NO: 1012999 - RNA, 18 nt, Homo sapiens
agggggugugucugcuca

SEQ ID NO: 1013000 - RNA, 13 nt, Homo sapiens
aggggugggacac

SEQ ID NO: 1013001 - RNA, 14 nt, Homo sapiens
aggguaaguuguua

SEQ ID NO: 1013002 - RNA, 16 nt, Homo sapiens
aggguaccuugaacac

SEQ ID NO: 1013003 - RNA, 20 nt, Homo sapiens
aggguacuuuaagacauacu

SEQ ID NO: 1013004 - RNA, 20 nt, Homo sapiens
aggguagauaaccuguacuu

SEQ ID NO: 1013005 - RNA, 21 nt, Homo sapiens
agggucccauuucucacugag

SEQ ID NO: 1013006 - RNA, 17 nt, Homo sapiens
agggucucuagugcugu

SEQ ID NO: 1013007 - RNA, 13 nt, Homo sapiens
agggucucuucag

SEQ ID NO: 1013008 - RNA, 13 nt, Homo sapiens
agggucugcacuc

SEQ ID NO: 1013009 - RNA, 20 nt, Homo sapiens
agggucuuuucaucugggaa

SEQ ID NO: 1013010 - RNA, 22 nt, Homo sapiens
agggugaagcuauuuaucugua

SEQ ID NO: 1013011 - RNA, 14 nt, Homo sapiens
agggugauagucaa

SEQ ID NO: 1013012 - RNA, 13 nt, Homo sapiens
aggguggugaccu

SEQ ID NO: 1013013 - RNA, 11 nt, Homo sapiens
gagcaaaggcu

SEQ ID NO: 1013014 - RNA, 22 nt, Homo sapiens
gagcaagacucugucucaaaaa

SEQ ID NO: 1013015 - RNA, 15 nt, Homo sapiens
gagcacgauguggaa

SEQ ID NO: 1013016 - RNA, 17 nt, Homo sapiens
gagcacuggagugcagg

SEQ ID NO: 1013017 - RNA, 21 nt, Homo sapiens
gagcagcuuuaaacucaggga

SEQ ID NO: 1013018 - RNA, 19 nt, Homo sapiens
gagcagcuuuggaaacagg

SEQ ID NO: 1013019 - RNA, 17 nt, Homo sapiens
gagcaggaagcauucag

SEQ ID NO: 1013020 - RNA, 20 nt, Homo sapiens
gagcaggcuacugucagcuc

SEQ ID NO: 1013021 - RNA, 17 nt, Homo sapiens
gagcaggggcaggguga

SEQ ID NO: 1013022 - RNA, 17 nt, Homo sapiens
gagcaguccugccucag

SEQ ID NO: 1013023 - RNA, 20 nt, Homo sapiens
gagcagugcuugaaugaagu

SEQ ID NO: 1013024 - RNA, 14 nt, Homo sapiens
gagcagugucuucc

SEQ ID NO: 1013025 - RNA, 15 nt, Homo sapiens
gagcauuacgugagc

SEQ ID NO: 1013026 - RNA, 13 nt, Homo sapiens
gagcauucugcuc

SEQ ID NO: 1013027 - RNA, 23 nt, Homo sapiens
gagccaauugauuucaacagaau

SEQ ID NO: 1013028 - RNA, 16 nt, Homo sapiens
gagccacguauguuuu

SEQ ID NO: 1013029 - RNA, 18 nt, Homo sapiens
gagccagggcugucuucg

SEQ ID NO: 1013030 - RNA, 14 nt, Homo sapiens
gagcccccuugaca

SEQ ID NO: 1013031 - RNA, 14 nt, Homo sapiens
gagcccuuaugaca

SEQ ID NO: 1013032 - RNA, 17 nt, Homo sapiens
gagccgggucugccucu

SEQ ID NO: 1013033 - RNA, 17 nt, Homo sapiens
gagccugcaaacucacu

SEQ ID NO: 1013034 - RNA, 20 nt, Homo sapiens
gagccugcaggguggugcug

SEQ ID NO: 1013035 - RNA, 12 nt, Homo sapiens
gagcgacaguga

SEQ ID NO: 1013036 - RNA, 13 nt, Homo sapiens
gagcgacagugag

SEQ ID NO: 1013037 - RNA, 13 nt, Homo sapiens
gagcuagaaccug

SEQ ID NO: 1013038 - RNA, 12 nt, Homo sapiens
gagcuauaacuu

SEQ ID NO: 1013039 - RNA, 23 nt, Homo sapiens
gagcucacaauaaaaauggcuca

SEQ ID NO: 1013040 - RNA, 21 nt, Homo sapiens
gagcucuguuuucaugcuauu

SEQ ID NO: 1013041 - RNA, 15 nt, Homo sapiens
gagcugacacaggau

SEQ ID NO: 1013042 - RNA, 16 nt, Homo sapiens
gagcugccucugagau

SEQ ID NO: 1013043 - RNA, 22 nt, Homo sapiens
gagcuggggaugucucucauga

SEQ ID NO: 1013044 - RNA, 12 nt, Homo sapiens
gagcugucaugu

SEQ ID NO: 1013045 - RNA, 17 nt, Homo sapiens
gagcuguggacuuuguu

SEQ ID NO: 1013046 - RNA, 20 nt, Homo sapiens
gagcuguuuucccugaccuc

SEQ ID NO: 1013047 - RNA, 16 nt, Homo sapiens
gagcuuggcagcugaa

SEQ ID NO: 1013048 - RNA, 20 nt, Homo sapiens
gagcuuuuccugauguucca

SEQ ID NO: 1013049 - RNA, 22 nt, Homo sapiens
gaggaaaaguaaggugcaguuc

SEQ ID NO: 1013050 - RNA, 23 nt, Homo sapiens
gaggaaagguuugagaagcacug

SEQ ID NO: 1013051 - RNA, 13 nt, Homo sapiens
gaggaacacugca

SEQ ID NO: 1013052 - RNA, 17 nt, Homo sapiens
gaggaacacugcacucu

SEQ ID NO: 1013053 - RNA, 16 nt, Homo sapiens
gaggacaguggcagac

SEQ ID NO: 1013054 - RNA, 19 nt, Homo sapiens
gaggacauucucugaccua

SEQ ID NO: 1013055 - RNA, 22 nt, Homo sapiens
gaggacccagacccagugggga

SEQ ID NO: 1013056 - RNA, 14 nt, Homo sapiens
gaggaggccuccau

SEQ ID NO: 1013057 - RNA, 16 nt, Homo sapiens
gaggaguacaggugaa

SEQ ID NO: 1013058 - RNA, 20 nt, Homo sapiens
gaggcagcuguugcagugag

SEQ ID NO: 1013059 - RNA, 18 nt, Homo sapiens
gaggccaggcagauccca

SEQ ID NO: 1013060 - RNA, 23 nt, Homo sapiens
gaggccagggcuauagcucagga

SEQ ID NO: 1013061 - RNA, 16 nt, Homo sapiens
gaggccggaaucucag

SEQ ID NO: 1013062 - RNA, 15 nt, Homo sapiens
gaggcuaauucugca

SEQ ID NO: 1013063 - RNA, 15 nt, Homo sapiens
gaggcuccagcaucu

SEQ ID NO: 1013064 - RNA, 16 nt, Homo sapiens
gaggcugaggcaagag

SEQ ID NO: 1013065 - RNA, 18 nt, Homo sapiens
gaggcugaggcgggugga

SEQ ID NO: 1013066 - RNA, 15 nt, Homo sapiens
gaggcugcaaucaca

SEQ ID NO: 1013067 - RNA, 22 nt, Homo sapiens
gaggcugggcucccuucccacc

SEQ ID NO: 1013068 - RNA, 18 nt, Homo sapiens
gaggcugucuucucaggc

SEQ ID NO: 1013069 - RNA, 15 nt, Homo sapiens
gaggcuguucccacc

SEQ ID NO: 1013070 - RNA, 23 nt, Homo sapiens
gaggcuuagcuuugcucugccaa

SEQ ID NO: 1013071 - RNA, 15 nt, Homo sapiens
gaggcuuccagagag

SEQ ID NO: 1013072 - RNA, 20 nt, Homo sapiens
gagggaaaguaaauauuuca

SEQ ID NO: 1013073 - RNA, 15 nt, Homo sapiens
gagggagaagcauga

SEQ ID NO: 1013074 - RNA, 22 nt, Homo sapiens
gagggauaguggggucagggcu

SEQ ID NO: 1013075 - RNA, 16 nt, Homo sapiens
gagggcacacacugug

SEQ ID NO: 1013076 - RNA, 17 nt, Homo sapiens
gagggcaggcacuccca

SEQ ID NO: 1013077 - RNA, 14 nt, Homo sapiens
gagggcagggacca

SEQ ID NO: 1013078 - RNA, 17 nt, Homo sapiens
gagggccccucugccca

SEQ ID NO: 1013079 - RNA, 19 nt, Homo sapiens
gagggcugcugaccauuug

SEQ ID NO: 1013080 - RNA, 17 nt, Homo sapiens
gaggggcucucagcuca

SEQ ID NO: 1013081 - RNA, 22 nt, Homo sapiens
gagguaccagcaauauguaaau

SEQ ID NO: 1013082 - RNA, 20 nt, Homo sapiens
gaggucaaggcugcagugag

SEQ ID NO: 1013083 - RNA, 16 nt, Homo sapiens
acaaggcgaucccauc

SEQ ID NO: 1013084 - RNA, 15 nt, Homo sapiens
acaaggcugaccaag

SEQ ID NO: 1013085 - RNA, 18 nt, Homo sapiens
acaaggcugaccaagaga

SEQ ID NO: 1013086 - RNA, 22 nt, Homo sapiens
acaaggggcuccacaccuuugc

SEQ ID NO: 1013087 - RNA, 19 nt, Homo sapiens
acaagggucacaauacugu

SEQ ID NO: 1013088 - RNA, 19 nt, Homo sapiens
acaaguuagaaaacauaau

SEQ ID NO: 1013089 - RNA, 15 nt, Homo sapiens
acaauaaaacauuaa

SEQ ID NO: 1013090 - RNA, 15 nt, Homo sapiens
acaauaaagaucgcc

SEQ ID NO: 1013091 - RNA, 23 nt, Homo sapiens
acaauaaagaucgcccccaccuc

SEQ ID NO: 1013092 - RNA, 15 nt, Homo sapiens
acaauaacacugucu

SEQ ID NO: 1013093 - RNA, 18 nt, Homo sapiens
acaauaaggucaaugcca

SEQ ID NO: 1013094 - RNA, 13 nt, Homo sapiens
acaauaaucucac

SEQ ID NO: 1013095 - RNA, 24 nt, Homo sapiens
acaauccaucucucaaguagugua

SEQ ID NO: 1013096 - RNA, 23 nt, Homo sapiens
guauucagcuuuaguagauauua

SEQ ID NO: 1013097 - RNA, 20 nt, Homo sapiens
guauucauuuuuucuacccu

SEQ ID NO: 1013098 - RNA, 16 nt, Homo sapiens
guauucuacagcagau

SEQ ID NO: 1013099 - RNA, 16 nt, Homo sapiens
guauucucuuccucau

SEQ ID NO: 1013100 - RNA, 21 nt, Homo sapiens
guauugccuugugaauuugcu

SEQ ID NO: 1013101 - RNA, 20 nt, Homo sapiens
guauuguauaaguccuugca

SEQ ID NO: 1013102 - RNA, 13 nt, Homo sapiens
guauugugcauag

SEQ ID NO: 1013103 - RNA, 16 nt, Homo sapiens
guauuuuacuuuucca

SEQ ID NO: 1013104 - RNA, 13 nt, Homo sapiens
gucaaacuguaga

SEQ ID NO: 1013105 - RNA, 22 nt, Homo sapiens
gucaaaguaaaacuugcugccu

SEQ ID NO: 1013106 - RNA, 17 nt, Homo sapiens
gucaaagugaugaauau

SEQ ID NO: 1013107 - RNA, 21 nt, Homo sapiens
gucaacaucuuuuacauucug

SEQ ID NO: 1013108 - RNA, 22 nt, Homo sapiens
gucaacccaauaguuguugauu

SEQ ID NO: 1013109 - RNA, 22 nt, Homo sapiens
gucaacuucagagacuaucuga

SEQ ID NO: 1013110 - RNA, 22 nt, Homo sapiens
gucaaggauggaugcagaucca

SEQ ID NO: 1013111 - RNA, 18 nt, Homo sapiens
gucaagguuuguguuacc

SEQ ID NO: 1013112 - RNA, 16 nt, Homo sapiens
gucaaugaauuuugcu

SEQ ID NO: 1013113 - RNA, 22 nt, Homo sapiens
gucacaacaacaacaacaaaaa

SEQ ID NO: 1013114 - RNA, 18 nt, Homo sapiens
gucacagccacuugggau

SEQ ID NO: 1013115 - RNA, 18 nt, Homo sapiens
gucacauggccuaugcac

SEQ ID NO: 1013116 - RNA, 18 nt, Homo sapiens
gucaccauacacacuguu

SEQ ID NO: 1013117 - RNA, 16 nt, Homo sapiens
gucaccccucacugug

SEQ ID NO: 1013118 - RNA, 22 nt, Homo sapiens
gucacgcuuucaugaauucugu

SEQ ID NO: 1013119 - RNA, 23 nt, Homo sapiens
gucacgcuuucaugaauucuguc

SEQ ID NO: 1013120 - RNA, 22 nt, Homo sapiens
gucacuacgugacuguggcaca

SEQ ID NO: 1013121 - RNA, 13 nt, Homo sapiens
gucagaguucugc

SEQ ID NO: 1013122 - RNA, 15 nt, Homo sapiens
gucagaguucugcuc

SEQ ID NO: 1013123 - RNA, 17 nt, Homo sapiens
gucagaguucugcucua

SEQ ID NO: 1013124 - RNA, 16 nt, Homo sapiens
gucagaguugugcaca

SEQ ID NO: 1013125 - RNA, 16 nt, Homo sapiens
gucagcaugccucuag

SEQ ID NO: 1013126 - RNA, 20 nt, Homo sapiens
gucagcucccuucucuguag

SEQ ID NO: 1013127 - RNA, 19 nt, Homo sapiens
gucagggcccaagucccug

SEQ ID NO: 1013128 - RNA, 14 nt, Homo sapiens
gucaggggcagcug

SEQ ID NO: 1013129 - RNA, 20 nt, Homo sapiens
gucaggguauaaaaugacau

SEQ ID NO: 1013130 - RNA, 22 nt, Homo sapiens
gucagugcugccaguuucccaa

SEQ ID NO: 1013131 - RNA, 17 nt, Homo sapiens
gucaguggaagaagcag

SEQ ID NO: 1013132 - RNA, 18 nt, Homo sapiens
gucaguggaagaagcaga

SEQ ID NO: 1013133 - RNA, 15 nt, Homo sapiens
gucaguuagcaucau

SEQ ID NO: 1013134 - RNA, 19 nt, Homo sapiens
gucauauauggggggccaa

SEQ ID NO: 1013135 - RNA, 20 nt, Homo sapiens
gucauauauuacuagcauau

SEQ ID NO: 1013136 - RNA, 20 nt, Homo sapiens
gucaucuccaucagcuguaa

SEQ ID NO: 1013137 - RNA, 21 nt, Homo sapiens
gucaugcauaaauaugcagug

SEQ ID NO: 1013138 - RNA, 11 nt, Homo sapiens
gucauugcugu

SEQ ID NO: 1013139 - RNA, 19 nt, Homo sapiens
gucauuucaaagacucuca

SEQ ID NO: 1013140 - RNA, 21 nt, Homo sapiens
guccaagugugugugcgugug

SEQ ID NO: 1013141 - RNA, 17 nt, Homo sapiens
guccacaggaagugaag

SEQ ID NO: 1013142 - RNA, 18 nt, Homo sapiens
guccacagggcagccuga

SEQ ID NO: 1013143 - RNA, 24 nt, Homo sapiens
guccacgagcuguuuacuagggau

SEQ ID NO: 1013144 - RNA, 12 nt, Homo sapiens
guccacugugac

SEQ ID NO: 1013145 - RNA, 15 nt, Homo sapiens
guccagaauucacuu

SEQ ID NO: 1013146 - RNA, 20 nt, Homo sapiens
guccagauuuacacugggag

SEQ ID NO: 1013147 - RNA, 23 nt, Homo sapiens
guccagccgccauugccaccagg

SEQ ID NO: 1013148 - RNA, 17 nt, Homo sapiens
guccauggaaugcuuga

SEQ ID NO: 1013149 - RNA, 12 nt, Homo sapiens
gucccagucucu

SEQ ID NO: 1013150 - RNA, 19 nt, Homo sapiens
gucccauggacacuccagu

SEQ ID NO: 1013151 - RNA, 17 nt, Homo sapiens
guccccacgaacuggcc

SEQ ID NO: 1013152 - RNA, 18 nt, Homo sapiens
guccccuaaaccaaaaac

SEQ ID NO: 1013153 - RNA, 17 nt, Homo sapiens
guccccucaccuccucu

SEQ ID NO: 1013154 - RNA, 21 nt, Homo sapiens
guccccuccccggcccuacca

SEQ ID NO: 1013155 - RNA, 16 nt, Homo sapiens
guccccucuugaccca

SEQ ID NO: 1013156 - RNA, 14 nt, Homo sapiens
guccccuuccuucc

SEQ ID NO: 1013157 - RNA, 17 nt, Homo sapiens
gucccuaaaaacacaga

SEQ ID NO: 1013158 - RNA, 19 nt, Homo sapiens
gucccuuucgacuugcauu

SEQ ID NO: 1013159 - RNA, 17 nt, Homo sapiens
guccgacaaagcuacuu

SEQ ID NO: 1013160 - RNA, 20 nt, Homo sapiens
guccgcgcgccagcacagaa

SEQ ID NO: 1013161 - RNA, 24 nt, Homo sapiens
guccucacaucuuucacacuucca

SEQ ID NO: 1013162 - RNA, 12 nt, Homo sapiens
guccucagucca

SEQ ID NO: 1013163 - RNA, 16 nt, Homo sapiens
guccucaguccacugc

SEQ ID NO: 1013164 - RNA, 16 nt, Homo sapiens
guccucccagcugcca

SEQ ID NO: 1013165 - RNA, 14 nt, Homo sapiens
guccucucaacucu

SEQ ID NO: 1013166 - RNA, 23 nt, Homo sapiens
guccucuggguaggaaucagcaa

SEQ ID NO: 1013167 - RNA, 22 nt, Homo sapiens
guccugaauguuucagaccaca

SEQ ID NO: 1013168 - RNA, 17 nt, Homo sapiens
guccugccucagccucc

SEQ ID NO: 1013169 - RNA, 20 nt, Homo sapiens
guccuuagccccaucugcca

SEQ ID NO: 1013170 - RNA, 19 nt, Homo sapiens
guccuucaccucacugaaa

SEQ ID NO: 1013171 - RNA, 17 nt, Homo sapiens
guccuuggaaguuucau

SEQ ID NO: 1013172 - RNA, 16 nt, Homo sapiens
gucgaacaauucauau

SEQ ID NO: 1013173 - RNA, 13 nt, Homo sapiens
gucgaagcuuuga

SEQ ID NO: 1013174 - RNA, 23 nt, Homo sapiens
gucgagaggcaccacggccucac

SEQ ID NO: 1013175 - RNA, 18 nt, Homo sapiens
gucgcaucucagugcagg

SEQ ID NO: 1013176 - RNA, 17 nt, Homo sapiens
gucggggggacagcucc

SEQ ID NO: 1013177 - RNA, 19 nt, Homo sapiens
gucggucuccuuauccccc

SEQ ID NO: 1013178 - RNA, 19 nt, Homo sapiens
gucuaaaacauguuugcac

SEQ ID NO: 1013179 - RNA, 12 nt, Homo sapiens
gucuacacugug

SEQ ID NO: 1013180 - RNA, 17 nt, Homo sapiens
gucuacauacuuucauc

SEQ ID NO: 1013181 - RNA, 21 nt, Homo sapiens
gucuacauacuuucauccuga

SEQ ID NO: 1013182 - RNA, 18 nt, Homo sapiens
gucuaggaacauacuuca

SEQ ID NO: 1013183 - RNA, 17 nt, Homo sapiens
gucuaguuaacauuuca

SEQ ID NO: 1013184 - RNA, 18 nt, Homo sapiens
gucuaugggacucaaugc

SEQ ID NO: 1013185 - RNA, 17 nt, Homo sapiens
gucucacuauguugccc

SEQ ID NO: 1013186 - RNA, 23 nt, Homo sapiens
gucucagaaacugcgaggccagu

SEQ ID NO: 1013187 - RNA, 16 nt, Homo sapiens
gucucaguccaugaag

SEQ ID NO: 1013188 - RNA, 20 nt, Homo sapiens
gucucauaugauugugcaca

SEQ ID NO: 1013189 - RNA, 16 nt, Homo sapiens
gucucauuuagaacuu

SEQ ID NO: 1013190 - RNA, 18 nt, Homo sapiens
gucuccaucucugucuca

SEQ ID NO: 1013191 - RNA, 13 nt, Homo sapiens
gucucccagcuca

SEQ ID NO: 1013192 - RNA, 17 nt, Homo sapiens
gucucccagcucagggc

SEQ ID NO: 1013193 - RNA, 16 nt, Homo sapiens
gucuccucugcagcuc

SEQ ID NO: 1013194 - RNA, 21 nt, Homo sapiens
gucuccucugcagcucaggga

SEQ ID NO: 1013195 - RNA, 19 nt, Homo sapiens
gucuccuuugcaggcucau

SEQ ID NO: 1013196 - RNA, 13 nt, Homo sapiens
gucucgcuuuguu

SEQ ID NO: 1013197 - RNA, 19 nt, Homo sapiens
gucucuacuaaaaauacaa

SEQ ID NO: 1013198 - RNA, 11 nt, Homo sapiens
gucucuagcca

SEQ ID NO: 1013199 - RNA, 18 nt, Homo sapiens
gucucugccggcucuuuc

SEQ ID NO: 1013200 - RNA, 17 nt, Homo sapiens
gucucuuccuggucuga

SEQ ID NO: 1013201 - RNA, 18 nt, Homo sapiens
gucugaaagcagguuaac

SEQ ID NO: 1013202 - RNA, 21 nt, Homo sapiens
gucugaguaagcccucaggag

SEQ ID NO: 1013203 - RNA, 15 nt, Homo sapiens
gucugagucuugggu

SEQ ID NO: 1013204 - RNA, 18 nt, Homo sapiens
gucugaugagaacucuga

SEQ ID NO: 1013205 - RNA, 19 nt, Homo sapiens
gucugauuggcucacccaa

SEQ ID NO: 1013206 - RNA, 13 nt, Homo sapiens
gucugcacucuaa

SEQ ID NO: 1013207 - RNA, 20 nt, Homo sapiens
gucugcucggccgucuucac

SEQ ID NO: 1013208 - RNA, 17 nt, Homo sapiens
gucugggccacucaggg

SEQ ID NO: 1013209 - RNA, 21 nt, Homo sapiens
gucugggcucccugcgccuga

SEQ ID NO: 1013210 - RNA, 22 nt, Homo sapiens
gucuggugggaggacggugcaa

SEQ ID NO: 1013211 - RNA, 20 nt, Homo sapiens
gucuguagcuccucaacuca

SEQ ID NO: 1013212 - RNA, 15 nt, Homo sapiens
gucugucucugucau

SEQ ID NO: 1013213 - RNA, 13 nt, Homo sapiens
gucuguuaacuua

SEQ ID NO: 1013214 - RNA, 15 nt, Homo sapiens
gucuuaacucaccau

SEQ ID NO: 1013215 - RNA, 20 nt, Homo sapiens
gucuuaagccuuuugcucac

SEQ ID NO: 1013216 - RNA, 15 nt, Homo sapiens
gucuuaaucauuugu

SEQ ID NO: 1013217 - RNA, 23 nt, Homo sapiens
gucuuagacuugaaauacuacuu

SEQ ID NO: 1013218 - RNA, 19 nt, Homo sapiens
gucuuauuugaaggccagc

SEQ ID NO: 1013219 - RNA, 14 nt, Homo sapiens
gucuucaagcagau

SEQ ID NO: 1013220 - RNA, 23 nt, Homo sapiens
gucuucagccuagccgaccucag

SEQ ID NO: 1013221 - RNA, 14 nt, Homo sapiens
gucuucccuaccuc

SEQ ID NO: 1013222 - RNA, 18 nt, Homo sapiens
gucuuccugacacuuuaa

SEQ ID NO: 1013223 - RNA, 12 nt, Homo sapiens
gucuucucaggc

SEQ ID NO: 1013224 - RNA, 20 nt, Homo sapiens
gucuucuuuuugaaacaauu

SEQ ID NO: 1013225 - RNA, 15 nt, Homo sapiens
gucuugaaacaagca

SEQ ID NO: 1013226 - RNA, 20 nt, Homo sapiens
gagaaaccuuauuguaccuc

SEQ ID NO: 1013227 - RNA, 15 nt, Homo sapiens
gagaaacuguagucu

SEQ ID NO: 1013228 - RNA, 15 nt, Homo sapiens
gagaaagacuauuca

SEQ ID NO: 1013229 - RNA, 17 nt, Homo sapiens
gagaaaguucucauuua

SEQ ID NO: 1013230 - RNA, 15 nt, Homo sapiens
gagaaauacuuucag

SEQ ID NO: 1013231 - RNA, 15 nt, Homo sapiens
gagaaaugacuuuga

SEQ ID NO: 1013232 - RNA, 15 nt, Homo sapiens
gagaaauugacagau

SEQ ID NO: 1013233 - RNA, 16 nt, Homo sapiens
gagaaccaacaaguaa

SEQ ID NO: 1013234 - RNA, 19 nt, Homo sapiens
gagaacccggcaacaucag

SEQ ID NO: 1013235 - RNA, 22 nt, Homo sapiens
gagaaccuugugccuggcucag

SEQ ID NO: 1013236 - RNA, 20 nt, Homo sapiens
gagaacuccuaggguggcug

SEQ ID NO: 1013237 - RNA, 14 nt, Homo sapiens
gagaacucugagca

SEQ ID NO: 1013238 - RNA, 18 nt, Homo sapiens
gagaacucugagcagugc

SEQ ID NO: 1013239 - RNA, 22 nt, Homo sapiens
gagaacugccuuuggcagaguu

SEQ ID NO: 1013240 - RNA, 18 nt, Homo sapiens
gagaacuggaaagacaua

SEQ ID NO: 1013241 - RNA, 20 nt, Homo sapiens
gagaagccagcuuuccucau

SEQ ID NO: 1013242 - RNA, 22 nt, Homo sapiens
gagaaguccccuuccaucccag

SEQ ID NO: 1013243 - RNA, 21 nt, Homo sapiens
gagaaucacuugaacccagga

SEQ ID NO: 1013244 - RNA, 17 nt, Homo sapiens
gagaaucacuugcacuc

SEQ ID NO: 1013245 - RNA, 13 nt, Homo sapiens
gagaaugucagua

SEQ ID NO: 1013246 - RNA, 18 nt, Homo sapiens
gagaauugcuugaaccug

SEQ ID NO: 1013247 - RNA, 21 nt, Homo sapiens
gagacaaaaucuuaaaugcca

SEQ ID NO: 1013248 - RNA, 19 nt, Homo sapiens
gagacagaguuuucacucu

SEQ ID NO: 1013249 - RNA, 14 nt, Homo sapiens
gagacagauaacuc

SEQ ID NO: 1013250 - RNA, 22 nt, Homo sapiens
gagacagcuugaucaaaggcac

SEQ ID NO: 1013251 - RNA, 16 nt, Homo sapiens
gagacaggcccaagag

SEQ ID NO: 1013252 - RNA, 14 nt, Homo sapiens
gagacagugaggcu

SEQ ID NO: 1013253 - RNA, 16 nt, Homo sapiens
gagacaugcugacuuu

SEQ ID NO: 1013254 - RNA, 19 nt, Homo sapiens
gagacaugcugacuuucau

SEQ ID NO: 1013255 - RNA, 16 nt, Homo sapiens
gagaccaggcaaagca

SEQ ID NO: 1013256 - RNA, 17 nt, Homo sapiens
gagaccuaccucagguu

SEQ ID NO: 1013257 - RNA, 13 nt, Homo sapiens
gagacuccgucuc

SEQ ID NO: 1013258 - RNA, 16 nt, Homo sapiens
gagacuccgucucaaa

SEQ ID NO: 1013259 - RNA, 18 nt, Homo sapiens
gagacuccgucucaagga

SEQ ID NO: 1013260 - RNA, 19 nt, Homo sapiens
gagacuccuaggcaggaca

SEQ ID NO: 1013261 - RNA, 22 nt, Homo sapiens
gagacuugaggagggagggcuu

SEQ ID NO: 1013262 - RNA, 17 nt, Homo sapiens
gagacuuuacauggaug

SEQ ID NO: 1013263 - RNA, 21 nt, Homo sapiens
gagagaacaacuacugugauc

SEQ ID NO: 1013264 - RNA, 20 nt, Homo sapiens
gagagaagggacacauucaa

SEQ ID NO: 1013265 - RNA, 20 nt, Homo sapiens
gagagaaucccuagucuuca

SEQ ID NO: 1013266 - RNA, 19 nt, Homo sapiens
gagagaccagcagcccaag

SEQ ID NO: 1013267 - RNA, 13 nt, Homo sapiens
gagagaccaggca

SEQ ID NO: 1013268 - RNA, 15 nt, Homo sapiens
gagagaggcugggau

SEQ ID NO: 1013269 - RNA, 14 nt, Homo sapiens
gagagauggaauaa

SEQ ID NO: 1013270 - RNA, 16 nt, Homo sapiens
gagagcaaaugcuauu

SEQ ID NO: 1013271 - RNA, 20 nt, Homo sapiens
gagagccgacuccacuuuca

SEQ ID NO: 1013272 - RNA, 22 nt, Homo sapiens
gagagcucgcuuugagugacug

SEQ ID NO: 1013273 - RNA, 22 nt, Homo sapiens
gagagcuguucccaaauuuucu

SEQ ID NO: 1013274 - RNA, 23 nt, Homo sapiens
gagagcuuucuguccuuuuggca

SEQ ID NO: 1013275 - RNA, 23 nt, Homo sapiens
gagaggaaaaguaaggugcaguu

SEQ ID NO: 1013276 - RNA, 17 nt, Homo sapiens
gagaggaagcucucuuu

SEQ ID NO: 1013277 - RNA, 18 nt, Homo sapiens
gagaggagccaggacugu

SEQ ID NO: 1013278 - RNA, 19 nt, Homo sapiens
gagaguacaccccaacagc

SEQ ID NO: 1013279 - RNA, 16 nt, Homo sapiens
gagagucgcaucucag

SEQ ID NO: 1013280 - RNA, 14 nt, Homo sapiens
gagagucugcacuu

SEQ ID NO: 1013281 - RNA, 16 nt, Homo sapiens
gagagugaagugaaga

SEQ ID NO: 1013282 - RNA, 14 nt, Homo sapiens
gagagugagacuca

SEQ ID NO: 1013283 - RNA, 19 nt, Homo sapiens
gagagugucuucacggcag

SEQ ID NO: 1013284 - RNA, 18 nt, Homo sapiens
gagauaauucuagcuuug

SEQ ID NO: 1013285 - RNA, 14 nt, Homo sapiens
gagauagaaccugg

SEQ ID NO: 1013286 - RNA, 17 nt, Homo sapiens
gagaucauccuuuccag

SEQ ID NO: 1013287 - RNA, 20 nt, Homo sapiens
gagaucgcgccacugcacuc

SEQ ID NO: 1013288 - RNA, 21 nt, Homo sapiens
gagaucuaaggaugucacagg

SEQ ID NO: 1013289 - RNA, 21 nt, Homo sapiens
gagaugcaggauuucuucaca

SEQ ID NO: 1013290 - RNA, 19 nt, Homo sapiens
gagauggaauaaagcccuu

SEQ ID NO: 1013291 - RNA, 23 nt, Homo sapiens
gagauggccuggggaagcuguga

SEQ ID NO: 1013292 - RNA, 19 nt, Homo sapiens
gagaugggaugcuugccua

SEQ ID NO: 1013293 - RNA, 12 nt, Homo sapiens
gagaugucuucg

SEQ ID NO: 1013294 - RNA, 12 nt, Homo sapiens
gagaugucuucu

SEQ ID NO: 1013295 - RNA, 22 nt, Homo sapiens
gagauuauuuuaaucuaauucu

SEQ ID NO: 1013296 - RNA, 18 nt, Homo sapiens
gagauucuggcuaguguc

SEQ ID NO: 1013297 - RNA, 22 nt, Homo sapiens
gagauugcaccacugcacucca

SEQ ID NO: 1013298 - RNA, 20 nt, Homo sapiens
gagauugugccacuucacuc

SEQ ID NO: 1013299 - RNA, 18 nt, Homo sapiens
gagauuucuuguugcuca

SEQ ID NO: 1013300 - RNA, 19 nt, Homo sapiens
gagcaaaaucgaugcagug

SEQ ID NO: 1013301 - RNA, 21 nt, Homo sapiens
gacacagcucuucuccaggcu

SEQ ID NO: 1013302 - RNA, 19 nt, Homo sapiens
gacacauaugcaccuugug

SEQ ID NO: 1013303 - RNA, 19 nt, Homo sapiens
gacacguggugcauuuugc

SEQ ID NO: 1013304 - RNA, 20 nt, Homo sapiens
gacacuauuuaucugugcaa

SEQ ID NO: 1013305 - RNA, 21 nt, Homo sapiens
gacacuauuuaucugugcaaa

SEQ ID NO: 1013306 - RNA, 21 nt, Homo sapiens
gacacucacacggacacucaa

SEQ ID NO: 1013307 - RNA, 15 nt, Homo sapiens
gacacuguuugccca

SEQ ID NO: 1013308 - RNA, 18 nt, Homo sapiens
gacacuguuugcccagug

SEQ ID NO: 1013309 - RNA, 17 nt, Homo sapiens
gacacuuuuuggacuca

SEQ ID NO: 1013310 - RNA, 18 nt, Homo sapiens
gacacuuuuuggacucaa

SEQ ID NO: 1013311 - RNA, 20 nt, Homo sapiens
gacagaucaagcugugagac

SEQ ID NO: 1013312 - RNA, 23 nt, Homo sapiens
gacagauuccaggcgaugugcaa

SEQ ID NO: 1013313 - RNA, 19 nt, Homo sapiens
gacagcuugaucaaaggca

SEQ ID NO: 1013314 - RNA, 18 nt, Homo sapiens
gacaggauaagagggauu

SEQ ID NO: 1013315 - RNA, 16 nt, Homo sapiens
gacagugcauuugccu

SEQ ID NO: 1013316 - RNA, 21 nt, Homo sapiens
gacagugccugggaauguauu

SEQ ID NO: 1013317 - RNA, 21 nt, Homo sapiens
gacauaaaugaggaaacucca

SEQ ID NO: 1013318 - RNA, 20 nt, Homo sapiens
gacauagaauuaacacauga

SEQ ID NO: 1013319 - RNA, 16 nt, Homo sapiens
gacaucgguucauauu

SEQ ID NO: 1013320 - RNA, 14 nt, Homo sapiens
gacaucucaggggc

SEQ ID NO: 1013321 - RNA, 11 nt, Homo sapiens
gacaugcacac

SEQ ID NO: 1013322 - RNA, 14 nt, Homo sapiens
gacaugcacuauga

SEQ ID NO: 1013323 - RNA, 16 nt, Homo sapiens
gacauggaauuaccuu

SEQ ID NO: 1013324 - RNA, 23 nt, Homo sapiens
gacauggcuugccacagcucuug

SEQ ID NO: 1013325 - RNA, 15 nt, Homo sapiens
gacaugugaaaccuu

SEQ ID NO: 1013326 - RNA, 21 nt, Homo sapiens
gacauuccaagacaguauaca

SEQ ID NO: 1013327 - RNA, 14 nt, Homo sapiens
gacauuccugggca

SEQ ID NO: 1013328 - RNA, 23 nt, Homo sapiens
gacauugauacagugaagauaca

SEQ ID NO: 1013329 - RNA, 18 nt, Homo sapiens
gacauuuuuucagucaua

SEQ ID NO: 1013330 - RNA, 14 nt, Homo sapiens
gaccaaaacaaaca

SEQ ID NO: 1013331 - RNA, 21 nt, Homo sapiens
gaccaauauuguacaguuuuu

SEQ ID NO: 1013332 - RNA, 23 nt, Homo sapiens
gaccacacuuccuguccagagag

SEQ ID NO: 1013333 - RNA, 19 nt, Homo sapiens
gaccacgugagaucauuca

SEQ ID NO: 1013334 - RNA, 17 nt, Homo sapiens
gaccacuguuaucaaaa

SEQ ID NO: 1013335 - RNA, 14 nt, Homo sapiens
gaccagaaccagag

SEQ ID NO: 1013336 - RNA, 20 nt, Homo sapiens
gaccaggcaaagcaagugau

SEQ ID NO: 1013337 - RNA, 16 nt, Homo sapiens
gaccaggcaaugugac

SEQ ID NO: 1013338 - RNA, 22 nt, Homo sapiens
gaccaggcaaugugacuuugca

SEQ ID NO: 1013339 - RNA, 22 nt, Homo sapiens
gaccaguccuguuugcagggaa

SEQ ID NO: 1013340 - RNA, 15 nt, Homo sapiens
gaccaucuacauaca

SEQ ID NO: 1013341 - RNA, 17 nt, Homo sapiens
gaccauucaggacacag

SEQ ID NO: 1013342 - RNA, 13 nt, Homo sapiens
gacccaaccacuu

SEQ ID NO: 1013343 - RNA, 17 nt, Homo sapiens
gacccaccccugugcuc

SEQ ID NO: 1013344 - RNA, 13 nt, Homo sapiens
gacccagccugag

SEQ ID NO: 1013345 - RNA, 20 nt, Homo sapiens
gacccaucacgccugugcag

SEQ ID NO: 1013346 - RNA, 18 nt, Homo sapiens
gacccaugcugcccugug

SEQ ID NO: 1013347 - RNA, 21 nt, Homo sapiens
gaccccaaagagccuggagaa

SEQ ID NO: 1013348 - RNA, 19 nt, Homo sapiens
gaccccagaggauugcugc

SEQ ID NO: 1013349 - RNA, 17 nt, Homo sapiens
gaccccccuauugcugc

SEQ ID NO: 1013350 - RNA, 22 nt, Homo sapiens
gacccccgcccccugcccuccc

SEQ ID NO: 1013351 - RNA, 14 nt, Homo sapiens
gaccccgagccugg

SEQ ID NO: 1013352 - RNA, 20 nt, Homo sapiens
gaccccucaccuugcaacac

SEQ ID NO: 1013353 - RNA, 18 nt, Homo sapiens
gaccccuguucccaugcu

SEQ ID NO: 1013354 - RNA, 21 nt, Homo sapiens
gacccuacuucuuuugcucuu

SEQ ID NO: 1013355 - RNA, 20 nt, Homo sapiens
gacccucugaaugguccagg

SEQ ID NO: 1013356 - RNA, 17 nt, Homo sapiens
gacccugauacaggcau

SEQ ID NO: 1013357 - RNA, 15 nt, Homo sapiens
gacccuucccuugag

SEQ ID NO: 1013358 - RNA, 17 nt, Homo sapiens
gaccgagccucugucac

SEQ ID NO: 1013359 - RNA, 21 nt, Homo sapiens
gaccgggccgcuagaugggca

SEQ ID NO: 1013360 - RNA, 15 nt, Homo sapiens
gaccuaucacuucca

SEQ ID NO: 1013361 - RNA, 15 nt, Homo sapiens
gaccucccacugccc

SEQ ID NO: 1013362 - RNA, 16 nt, Homo sapiens
gaccucccagcccuau

SEQ ID NO: 1013363 - RNA, 18 nt, Homo sapiens
gaccuccuuacauaugca

SEQ ID NO: 1013364 - RNA, 18 nt, Homo sapiens
gaccucugccugaaguca

SEQ ID NO: 1013365 - RNA, 15 nt, Homo sapiens
gaccugccugcauuc

SEQ ID NO: 1013366 - RNA, 23 nt, Homo sapiens
gaccuggcaaggacacagaugaa

SEQ ID NO: 1013367 - RNA, 17 nt, Homo sapiens
gaccuguaaucauauaa

SEQ ID NO: 1013368 - RNA, 24 nt, Homo sapiens
gaccugucacgauugucaucagga

SEQ ID NO: 1013369 - RNA, 11 nt, Homo sapiens
gaccuguguuu

SEQ ID NO: 1013370 - RNA, 19 nt, Homo sapiens
gaccuguucaaaaaggaaa

SEQ ID NO: 1013371 - RNA, 15 nt, Homo sapiens
gaccuuaguguuucu

SEQ ID NO: 1013372 - RNA, 15 nt, Homo sapiens
gaccuuccucaucca

SEQ ID NO: 1013373 - RNA, 13 nt, Homo sapiens
cucuacaaaaagc

SEQ ID NO: 1013374 - RNA, 16 nt, Homo sapiens
cucuacagacuucucc

SEQ ID NO: 1013375 - RNA, 15 nt, Homo sapiens
cucuacccuauacaa

SEQ ID NO: 1013376 - RNA, 22 nt, Homo sapiens
cucuacccucuuagaaaaacca

SEQ ID NO: 1013377 - RNA, 20 nt, Homo sapiens
cucuacuaaaaauacaaaaa

SEQ ID NO: 1013378 - RNA, 20 nt, Homo sapiens
cucuacuaaaaauacaaaau

SEQ ID NO: 1013379 - RNA, 20 nt, Homo sapiens
cucuacucuggagguuuguu

SEQ ID NO: 1013380 - RNA, 22 nt, Homo sapiens
cucuacugaggugcuauguucu

SEQ ID NO: 1013381 - RNA, 14 nt, Homo sapiens
cucuagauugagag

SEQ ID NO: 1013382 - RNA, 13 nt, Homo sapiens
cucuagugcugug

SEQ ID NO: 1013383 - RNA, 16 nt, Homo sapiens
cucuagugcugugaaa

SEQ ID NO: 1013384 - RNA, 18 nt, Homo sapiens
cucuagugucuuuugccu

SEQ ID NO: 1013385 - RNA, 22 nt, Homo sapiens
cucuauacaaaaugauuuugaa

SEQ ID NO: 1013386 - RNA, 17 nt, Homo sapiens
cucuaugguguggcaaa

SEQ ID NO: 1013387 - RNA, 12 nt, Homo sapiens
cucucacuccag

SEQ ID NO: 1013388 - RNA, 15 nt, Homo sapiens
cucuccaagugccag

SEQ ID NO: 1013389 - RNA, 13 nt, Homo sapiens
cucuccacugaaa

SEQ ID NO: 1013390 - RNA, 18 nt, Homo sapiens
cucucccagucuacccag

SEQ ID NO: 1013391 - RNA, 18 nt, Homo sapiens
cucuccccugauuacacc

SEQ ID NO: 1013392 - RNA, 22 nt, Homo sapiens
cucucccgucagggcccaaguc

SEQ ID NO: 1013393 - RNA, 13 nt, Homo sapiens
cucucccuaggcu

SEQ ID NO: 1013394 - RNA, 14 nt, Homo sapiens
cucucucccaugga

SEQ ID NO: 1013395 - RNA, 13 nt, Homo sapiens
cucucucucucuu

SEQ ID NO: 1013396 - RNA, 15 nt, Homo sapiens
cucucucuugcuuac

SEQ ID NO: 1013397 - RNA, 15 nt, Homo sapiens
cucucuucugcucca

SEQ ID NO: 1013398 - RNA, 15 nt, Homo sapiens
cucucuugcuuacaa

SEQ ID NO: 1013399 - RNA, 13 nt, Homo sapiens
cucugaaaaccaa

SEQ ID NO: 1013400 - RNA, 15 nt, Homo sapiens
cucugaaaccagugu

SEQ ID NO: 1013401 - RNA, 19 nt, Homo sapiens
cucugaagucacaucacag

SEQ ID NO: 1013402 - RNA, 15 nt, Homo sapiens
cucugacacacagcu

SEQ ID NO: 1013403 - RNA, 23 nt, Homo sapiens
cucugaccuacucgagggacuua

SEQ ID NO: 1013404 - RNA, 15 nt, Homo sapiens
cucugaccugcacug

SEQ ID NO: 1013405 - RNA, 20 nt, Homo sapiens
cucugagcaaauguggcucc

SEQ ID NO: 1013406 - RNA, 21 nt, Homo sapiens
cucugagguuuccgaaaucag

SEQ ID NO: 1013407 - RNA, 23 nt, Homo sapiens
cucugaguaucuccucgcaagcu

SEQ ID NO: 1013408 - RNA, 22 nt, Homo sapiens
cucugagucagugguuauuuga

SEQ ID NO: 1013409 - RNA, 19 nt, Homo sapiens
cucugagucccagagccaa

SEQ ID NO: 1013410 - RNA, 12 nt, Homo sapiens
cucugauaccuc

SEQ ID NO: 1013411 - RNA, 23 nt, Homo sapiens
cucugcaaaggaaauaccaguuc

SEQ ID NO: 1013412 - RNA, 16 nt, Homo sapiens
cucugcacauacgcac

SEQ ID NO: 1013413 - RNA, 12 nt, Homo sapiens
cucugcacaugu

SEQ ID NO: 1013414 - RNA, 14 nt, Homo sapiens
cucugcacaugucu

SEQ ID NO: 1013415 - RNA, 20 nt, Homo sapiens
cucugcacaugucuuguaca

SEQ ID NO: 1013416 - RNA, 19 nt, Homo sapiens
cucugcaccguacugugga

SEQ ID NO: 1013417 - RNA, 18 nt, Homo sapiens
cucugcagacugcugcua

SEQ ID NO: 1013418 - RNA, 16 nt, Homo sapiens
cucugcagcucaggga

SEQ ID NO: 1013419 - RNA, 14 nt, Homo sapiens
cucugcauguuaca

SEQ ID NO: 1013420 - RNA, 20 nt, Homo sapiens
cucugcauuaucugagguca

SEQ ID NO: 1013421 - RNA, 15 nt, Homo sapiens
cucugcauucuagua

SEQ ID NO: 1013422 - RNA, 19 nt, Homo sapiens
cucugccagccacauccaa

SEQ ID NO: 1013423 - RNA, 20 nt, Homo sapiens
cucugcccaaacauaaagag

SEQ ID NO: 1013424 - RNA, 21 nt, Homo sapiens
cucugcccauccugccccuga

SEQ ID NO: 1013425 - RNA, 15 nt, Homo sapiens
cucugcccugcccua

SEQ ID NO: 1013426 - RNA, 18 nt, Homo sapiens
cucugccugaaccuucca

SEQ ID NO: 1013427 - RNA, 14 nt, Homo sapiens
cucugccugcauuc

SEQ ID NO: 1013428 - RNA, 17 nt, Homo sapiens
cucugcuccccugugaa

SEQ ID NO: 1013429 - RNA, 12 nt, Homo sapiens
cucugcuugcau

SEQ ID NO: 1013430 - RNA, 19 nt, Homo sapiens
cucugcuugcauccccaac

SEQ ID NO: 1013431 - RNA, 14 nt, Homo sapiens
cucuggaugccuga

SEQ ID NO: 1013432 - RNA, 22 nt, Homo sapiens
cucuggaugccugauugccaag

SEQ ID NO: 1013433 - RNA, 16 nt, Homo sapiens
cucuggcuggggagca

SEQ ID NO: 1013434 - RNA, 22 nt, Homo sapiens
cucuggcuuugccuuggcuuug

SEQ ID NO: 1013435 - RNA, 22 nt, Homo sapiens
cucugggccaagucaaagacau

SEQ ID NO: 1013436 - RNA, 15 nt, Homo sapiens
cucugggcuccagag

SEQ ID NO: 1013437 - RNA, 17 nt, Homo sapiens
cucuggggucuuuuuau

SEQ ID NO: 1013438 - RNA, 22 nt, Homo sapiens
cucuggggucuuuuuaugcauu

SEQ ID NO: 1013439 - RNA, 15 nt, Homo sapiens
cucuguaaacuucca

SEQ ID NO: 1013440 - RNA, 22 nt, Homo sapiens
cucuguagggaacucugggguc

SEQ ID NO: 1013441 - RNA, 13 nt, Homo sapiens
cucugucucaaaa

SEQ ID NO: 1013442 - RNA, 13 nt, Homo sapiens
cucugugacuccc

SEQ ID NO: 1013443 - RNA, 14 nt, Homo sapiens
cucuguugcacaug

SEQ ID NO: 1013444 - RNA, 20 nt, Homo sapiens
cucuguuuauagugacccac

SEQ ID NO: 1013445 - RNA, 16 nt, Homo sapiens
cucuguuuucaugcua

SEQ ID NO: 1013446 - RNA, 13 nt, Homo sapiens
cucuuaagccauc

SEQ ID NO: 1013447 - RNA, 17 nt, Homo sapiens
cucuuaaucaaauagca

SEQ ID NO: 1013448 - RNA, 16 nt, Homo sapiens
cucuuaguaacauaga

SEQ ID NO: 1013449 - RNA, 21 nt, Homo sapiens
cucuuaucucagucaugcaua

SEQ ID NO: 1013450 - RNA, 18 nt, Homo sapiens
cucuucaacugaccagcc

SEQ ID NO: 1013451 - RNA, 21 nt, Homo sapiens
cucuucaacugaccagccucc

SEQ ID NO: 1013452 - RNA, 14 nt, Homo sapiens
cucuucaaggacuu

SEQ ID NO: 1013453 - RNA, 22 nt, Homo sapiens
cucuuccuacccaaccacucaa

SEQ ID NO: 1013454 - RNA, 11 nt, Homo sapiens
cucuuccucau

SEQ ID NO: 1013455 - RNA, 16 nt, Homo sapiens
cucuuccugcaaggac

SEQ ID NO: 1013456 - RNA, 23 nt, Homo sapiens
cucuucuaaaaaaugauacacac

SEQ ID NO: 1013457 - RNA, 20 nt, Homo sapiens
cucuucuaaucagagcgcaa

SEQ ID NO: 1013458 - RNA, 23 nt, Homo sapiens
cucuucuccaccucccacaaagg

SEQ ID NO: 1013459 - RNA, 17 nt, Homo sapiens
cucuucugggaacuucc

SEQ ID NO: 1013460 - RNA, 20 nt, Homo sapiens
cucuucugggaacuuccuca

SEQ ID NO: 1013461 - RNA, 21 nt, Homo sapiens
cucuucuucauugcaguuauu

SEQ ID NO: 1013462 - RNA, 14 nt, Homo sapiens
cucuucuugaacac

SEQ ID NO: 1013463 - RNA, 13 nt, Homo sapiens
cucuugaggccag

SEQ ID NO: 1013464 - RNA, 13 nt, Homo sapiens
cucuugcugccac

SEQ ID NO: 1013465 - RNA, 12 nt, Homo sapiens
cucuuggcaguc

SEQ ID NO: 1013466 - RNA, 16 nt, Homo sapiens
cucuugggaagaccag

SEQ ID NO: 1013467 - RNA, 17 nt, Homo sapiens
cucuuguauaugaugau

SEQ ID NO: 1013468 - RNA, 18 nt, Homo sapiens
cucuuguauaugaugauc

SEQ ID NO: 1013469 - RNA, 21 nt, Homo sapiens
cucuugugcccuucugagccc

SEQ ID NO: 1013470 - RNA, 13 nt, Homo sapiens
cucuuguuauuau

SEQ ID NO: 1013471 - RNA, 12 nt, Homo sapiens
cucuuuaccucc

SEQ ID NO: 1013472 - RNA, 20 nt, Homo sapiens
gaagaccaagacacagauca

SEQ ID NO: 1013473 - RNA, 20 nt, Homo sapiens
gaagaccagcuuugcaguga

SEQ ID NO: 1013474 - RNA, 16 nt, Homo sapiens
gaagaccugcugaggg

SEQ ID NO: 1013475 - RNA, 17 nt, Homo sapiens
gaagacuauauuguaca

SEQ ID NO: 1013476 - RNA, 19 nt, Homo sapiens
gaagacuauauuguacaca

SEQ ID NO: 1013477 - RNA, 17 nt, Homo sapiens
gaagagaaagcacgugu

SEQ ID NO: 1013478 - RNA, 17 nt, Homo sapiens
gaagagaaugugacagg

SEQ ID NO: 1013479 - RNA, 21 nt, Homo sapiens
gaagagaggaguucaaugauc

SEQ ID NO: 1013480 - RNA, 14 nt, Homo sapiens
gaagagcuuggaaa

SEQ ID NO: 1013481 - RNA, 20 nt, Homo sapiens
gaagagggagaagcaugaaa

SEQ ID NO: 1013482 - RNA, 13 nt, Homo sapiens
gaagagggucccu

SEQ ID NO: 1013483 - RNA, 21 nt, Homo sapiens
gaagaggugagaguaagccuu

SEQ ID NO: 1013484 - RNA, 18 nt, Homo sapiens
gaagauauaacuauugcc

SEQ ID NO: 1013485 - RNA, 15 nt, Homo sapiens
gaagauaucuugaaa

SEQ ID NO: 1013486 - RNA, 19 nt, Homo sapiens
gaagaucauauacgugaaa

SEQ ID NO: 1013487 - RNA, 24 nt, Homo sapiens
gaagauccuaaaacaaaagcucau

SEQ ID NO: 1013488 - RNA, 19 nt, Homo sapiens
gaagauggcauccugugaa

SEQ ID NO: 1013489 - RNA, 20 nt, Homo sapiens
gaagauggcauccugugaag

SEQ ID NO: 1013490 - RNA, 18 nt, Homo sapiens
gaagauucuccugugcua

SEQ ID NO: 1013491 - RNA, 18 nt, Homo sapiens
gaagcaaacuaagccccc

SEQ ID NO: 1013492 - RNA, 14 nt, Homo sapiens
gaagcaacccaaau

SEQ ID NO: 1013493 - RNA, 12 nt, Homo sapiens
gaagcacugccu

SEQ ID NO: 1013494 - RNA, 23 nt, Homo sapiens
gaagcagaaauacauauuuccaa

SEQ ID NO: 1013495 - RNA, 12 nt, Homo sapiens
gaagcauuuacu

SEQ ID NO: 1013496 - RNA, 17 nt, Homo sapiens
gaagcauuuacuuugug

SEQ ID NO: 1013497 - RNA, 18 nt, Homo sapiens
gaagcauuugauuuucaa

SEQ ID NO: 1013498 - RNA, 14 nt, Homo sapiens
gaagccaaugcugu

SEQ ID NO: 1013499 - RNA, 16 nt, Homo sapiens
gaagccacuuucuaca

SEQ ID NO: 1013500 - RNA, 14 nt, Homo sapiens
gaagccccacuuga

SEQ ID NO: 1013501 - RNA, 21 nt, Homo sapiens
gaagcccuccaaaagcacuua

SEQ ID NO: 1013502 - RNA, 23 nt, Homo sapiens
gaagcccuugccugaaagcaaga

SEQ ID NO: 1013503 - RNA, 13 nt, Homo sapiens
gaagccuagggga

SEQ ID NO: 1013504 - RNA, 16 nt, Homo sapiens
gaagcucugaagucac

SEQ ID NO: 1013505 - RNA, 12 nt, Homo sapiens
gaagcugugaaa

SEQ ID NO: 1013506 - RNA, 18 nt, Homo sapiens
gaagcuguuguacauuua

SEQ ID NO: 1013507 - RNA, 16 nt, Homo sapiens
gaagcuuucaguauua

SEQ ID NO: 1013508 - RNA, 19 nt, Homo sapiens
gaaggaacucuggcuucca

SEQ ID NO: 1013509 - RNA, 12 nt, Homo sapiens
gaaggacuguga

SEQ ID NO: 1013510 - RNA, 18 nt, Homo sapiens
gaaggaggggaaccagau

SEQ ID NO: 1013511 - RNA, 16 nt, Homo sapiens
gaaggcagccaccagc

SEQ ID NO: 1013512 - RNA, 15 nt, Homo sapiens
gaaggccacauguca

SEQ ID NO: 1013513 - RNA, 22 nt, Homo sapiens
gaaggccagcccacacccagcu

SEQ ID NO: 1013514 - RNA, 14 nt, Homo sapiens
gaaggcuaugggga

SEQ ID NO: 1013515 - RNA, 17 nt, Homo sapiens
gaaggcugcuguuuacu

SEQ ID NO: 1013516 - RNA, 15 nt, Homo sapiens
gaagggacauauuca

SEQ ID NO: 1013517 - RNA, 24 nt, Homo sapiens
gaagggaccaaggcaaggcaggug

SEQ ID NO: 1013518 - RNA, 20 nt, Homo sapiens
gaaggucccaccuccauuug

SEQ ID NO: 1013519 - RNA, 21 nt, Homo sapiens
gaaggucccaccuccauuugc

SEQ ID NO: 1013520 - RNA, 12 nt, Homo sapiens
gaaggugcuguu

SEQ ID NO: 1013521 - RNA, 14 nt, Homo sapiens
gaagguuaccaaga

SEQ ID NO: 1013522 - RNA, 13 nt, Homo sapiens
gaagguugcaccu

SEQ ID NO: 1013523 - RNA, 13 nt, Homo sapiens
gaagguugcucua

SEQ ID NO: 1013524 - RNA, 18 nt, Homo sapiens
gaaguaaacagauggcac

SEQ ID NO: 1013525 - RNA, 22 nt, Homo sapiens
gaaguacucauacauguuacaa

SEQ ID NO: 1013526 - RNA, 14 nt, Homo sapiens
gaaguaugagggaa

SEQ ID NO: 1013527 - RNA, 21 nt, Homo sapiens
gaaguauuuuccuccaggcaa

SEQ ID NO: 1013528 - RNA, 22 nt, Homo sapiens
gaaguauuuuccuccaggcaaa

SEQ ID NO: 1013529 - RNA, 17 nt, Homo sapiens
gaagucuaagagugaag

SEQ ID NO: 1013530 - RNA, 15 nt, Homo sapiens
gaagucuacuuuguc

SEQ ID NO: 1013531 - RNA, 17 nt, Homo sapiens
gaagugcauccaaaggu

SEQ ID NO: 1013532 - RNA, 17 nt, Homo sapiens
gaagugugggucugugu

SEQ ID NO: 1013533 - RNA, 16 nt, Homo sapiens
gaagugugugaucugu

SEQ ID NO: 1013534 - RNA, 13 nt, Homo sapiens
gaaguguugcaug

SEQ ID NO: 1013535 - RNA, 12 nt, Homo sapiens
gaaguguuucac

SEQ ID NO: 1013536 - RNA, 12 nt, Homo sapiens
gaaguuccucaa

SEQ ID NO: 1013537 - RNA, 16 nt, Homo sapiens
gaaguuuaauugacuu

SEQ ID NO: 1013538 - RNA, 15 nt, Homo sapiens
gaaguuuacaaucaa

SEQ ID NO: 1013539 - RNA, 21 nt, Homo sapiens
gaauaaaaugaaauacuaaau

SEQ ID NO: 1013540 - RNA, 14 nt, Homo sapiens
gaauaaaauugcac

SEQ ID NO: 1013541 - RNA, 15 nt, Homo sapiens
gaauaaaauugcacu

SEQ ID NO: 1013542 - RNA, 22 nt, Homo sapiens
cuagcaucucaugagugccaag

SEQ ID NO: 1013543 - RNA, 15 nt, Homo sapiens
cuagccaucuugauc

SEQ ID NO: 1013544 - RNA, 22 nt, Homo sapiens
cuagccaucuugaucuguguuu

SEQ ID NO: 1013545 - RNA, 23 nt, Homo sapiens
cuaggcagaucacguugcaaugg

SEQ ID NO: 1013546 - RNA, 18 nt, Homo sapiens
cuaggccacaccaucucc

SEQ ID NO: 1013547 - RNA, 19 nt, Homo sapiens
cuaggccuacaugcuuugu

SEQ ID NO: 1013548 - RNA, 20 nt, Homo sapiens
cuaggcucagagaugugcac

SEQ ID NO: 1013549 - RNA, 17 nt, Homo sapiens
cuagggaggaccuuauc

SEQ ID NO: 1013550 - RNA, 14 nt, Homo sapiens
cuagggaucccuca

SEQ ID NO: 1013551 - RNA, 15 nt, Homo sapiens
cuagggaucccucau

SEQ ID NO: 1013552 - RNA, 16 nt, Homo sapiens
cuagggccaagcccag

SEQ ID NO: 1013553 - RNA, 18 nt, Homo sapiens
cuaggggucaggcuccau

SEQ ID NO: 1013554 - RNA, 23 nt, Homo sapiens
cuaggggucuuguuaagugcagu

SEQ ID NO: 1013555 - RNA, 15 nt, Homo sapiens
cuaguaagugccuuc

SEQ ID NO: 1013556 - RNA, 21 nt, Homo sapiens
cuaguauuucaugcugggaau

SEQ ID NO: 1013557 - RNA, 16 nt, Homo sapiens
cuaguccuuuacuaau

SEQ ID NO: 1013558 - RNA, 14 nt, Homo sapiens
cuagucuauucauu

SEQ ID NO: 1013559 - RNA, 19 nt, Homo sapiens
cuagucuccuuugcacuga

SEQ ID NO: 1013560 - RNA, 15 nt, Homo sapiens
cuagucugcuagcca

SEQ ID NO: 1013561 - RNA, 17 nt, Homo sapiens
cuagugaauguaaaaug

SEQ ID NO: 1013562 - RNA, 19 nt, Homo sapiens
cuagugaauguaaaaugca

SEQ ID NO: 1013563 - RNA, 22 nt, Homo sapiens
cuagugaauguaaaaugcaaaa

SEQ ID NO: 1013564 - RNA, 14 nt, Homo sapiens
cuaguguugcuugg

SEQ ID NO: 1013565 - RNA, 13 nt, Homo sapiens
cuaguuaaucaua

SEQ ID NO: 1013566 - RNA, 14 nt, Homo sapiens
cuaguuugaccuca

SEQ ID NO: 1013567 - RNA, 20 nt, Homo sapiens
cuaguuuugucaaacuguag

SEQ ID NO: 1013568 - RNA, 17 nt, Homo sapiens
cuauaaaaacaaaaacu

SEQ ID NO: 1013569 - RNA, 16 nt, Homo sapiens
cuauaaagaagaacuu

SEQ ID NO: 1013570 - RNA, 19 nt, Homo sapiens
cuauaaagaagaacuugca

SEQ ID NO: 1013571 - RNA, 20 nt, Homo sapiens
cuauaaagaagaacuugcau

SEQ ID NO: 1013572 - RNA, 16 nt, Homo sapiens
cuauaacuuacuucug

SEQ ID NO: 1013573 - RNA, 15 nt, Homo sapiens
cuauaacuuuggcca

SEQ ID NO: 1013574 - RNA, 18 nt, Homo sapiens
cuauacaaaaugauuuug

SEQ ID NO: 1013575 - RNA, 18 nt, Homo sapiens
cuauagccuaggugacag

SEQ ID NO: 1013576 - RNA, 23 nt, Homo sapiens
cuauaggugcuacaaaaacacag

SEQ ID NO: 1013577 - RNA, 17 nt, Homo sapiens
cuauauauaauucugua

SEQ ID NO: 1013578 - RNA, 19 nt, Homo sapiens
cuauauccauguacuguag

SEQ ID NO: 1013579 - RNA, 16 nt, Homo sapiens
cuauaucuguauauaa

SEQ ID NO: 1013580 - RNA, 17 nt, Homo sapiens
cuauauuguacacaccu

SEQ ID NO: 1013581 - RNA, 18 nt, Homo sapiens
cuauauuuagauuguuaa

SEQ ID NO: 1013582 - RNA, 17 nt, Homo sapiens
cuauauuuauacuguau

SEQ ID NO: 1013583 - RNA, 12 nt, Homo sapiens
cuauauuugcuu

SEQ ID NO: 1013584 - RNA, 21 nt, Homo sapiens
cuauauuugcuuuuugcuaac

SEQ ID NO: 1013585 - RNA, 15 nt, Homo sapiens
cuaucacacaguggg

SEQ ID NO: 1013586 - RNA, 20 nt, Homo sapiens
cuaucagccugucucuucca

SEQ ID NO: 1013587 - RNA, 19 nt, Homo sapiens
cuauccaaaacuaauuucc

SEQ ID NO: 1013588 - RNA, 14 nt, Homo sapiens
cuauccacagagag

SEQ ID NO: 1013589 - RNA, 11 nt, Homo sapiens
cuauccagcua

SEQ ID NO: 1013590 - RNA, 23 nt, Homo sapiens
cuaucccccgcagcgcucuccuu

SEQ ID NO: 1013591 - RNA, 20 nt, Homo sapiens
cuaucugauuuccuaauguc

SEQ ID NO: 1013592 - RNA, 20 nt, Homo sapiens
cuaucuggccuuugcaugga

SEQ ID NO: 1013593 - RNA, 15 nt, Homo sapiens
cuaucugucauacau

SEQ ID NO: 1013594 - RNA, 17 nt, Homo sapiens
cuaucuuuugcauccua

SEQ ID NO: 1013595 - RNA, 20 nt, Homo sapiens
cuaugaaauaucaugcucca

SEQ ID NO: 1013596 - RNA, 16 nt, Homo sapiens
cuaugaacuucucuca

SEQ ID NO: 1013597 - RNA, 17 nt, Homo sapiens
cuaugagcacauaggac

SEQ ID NO: 1013598 - RNA, 16 nt, Homo sapiens
cuaugauaugcuaaua

SEQ ID NO: 1013599 - RNA, 22 nt, Homo sapiens
cuaugcaacagcucucaccuac

SEQ ID NO: 1013600 - RNA, 14 nt, Homo sapiens
cuaugcacauaugg

SEQ ID NO: 1013601 - RNA, 14 nt, Homo sapiens
cuauggaagcauau

SEQ ID NO: 1013602 - RNA, 20 nt, Homo sapiens
cuauggcacccaugcaccuu

SEQ ID NO: 1013603 - RNA, 17 nt, Homo sapiens
cuauggcucuacuuuca

SEQ ID NO: 1013604 - RNA, 17 nt, Homo sapiens
cuaugggagcagcuuuu

SEQ ID NO: 1013605 - RNA, 15 nt, Homo sapiens
cuaugggggcacuga

SEQ ID NO: 1013606 - RNA, 11 nt, Homo sapiens
cuaugguucuc

SEQ ID NO: 1013607 - RNA, 16 nt, Homo sapiens
cuauguaaaugcaucu

SEQ ID NO: 1013608 - RNA, 13 nt, Homo sapiens
cuauguauauaca

SEQ ID NO: 1013609 - RNA, 20 nt, Homo sapiens
cuaugugggugggaccacag

SEQ ID NO: 1013610 - RNA, 13 nt, Homo sapiens
cuauguucuuagu

SEQ ID NO: 1013611 - RNA, 19 nt, Homo sapiens
cuauguugcccaggcaggu

SEQ ID NO: 1013612 - RNA, 22 nt, Homo sapiens
cuauguuuuuguucaaagccag

SEQ ID NO: 1013613 - RNA, 11 nt, Homo sapiens
cuauuagccag

SEQ ID NO: 1013614 - RNA, 19 nt, Homo sapiens
cuauucccuggggcugcug

SEQ ID NO: 1013615 - RNA, 21 nt, Homo sapiens
cuauucccuucuaaccugaac

SEQ ID NO: 1013616 - RNA, 17 nt, Homo sapiens
cuauucugauuacacaa

SEQ ID NO: 1013617 - RNA, 19 nt, Homo sapiens
cuauugacaagucauuuua

SEQ ID NO: 1013618 - RNA, 19 nt, Homo sapiens
cuauuugcacuguagccuc

SEQ ID NO: 1013619 - RNA, 22 nt, Homo sapiens
cuauuuuuauuuguuugugcau

SEQ ID NO: 1013620 - RNA, 21 nt, Homo sapiens
cuauuuuuguuaagcgugucu

SEQ ID NO: 1013621 - RNA, 18 nt, Homo sapiens
cucaaaacugcacuguca

SEQ ID NO: 1013622 - RNA, 13 nt, Homo sapiens
cucaaaacuuaac

SEQ ID NO: 1013623 - RNA, 21 nt, Homo sapiens
cucaaaagaaaaaaaaaagca

SEQ ID NO: 1013624 - RNA, 18 nt, Homo sapiens
cucaaaccaaaucacuga

SEQ ID NO: 1013625 - RNA, 18 nt, Homo sapiens
cucaaaccaagcaaagga

SEQ ID NO: 1013626 - RNA, 23 nt, Homo sapiens
cucaaacuccugaccuugugauu

SEQ ID NO: 1013627 - RNA, 20 nt, Homo sapiens
cucaaacucuugaccucagg

SEQ ID NO: 1013628 - RNA, 22 nt, Homo sapiens
cucaaagacaauguuauuuucc

SEQ ID NO: 1013629 - RNA, 18 nt, Homo sapiens
cucaaagugacuauucag

SEQ ID NO: 1013630 - RNA, 15 nt, Homo sapiens
cucaaauaacuaaaa

SEQ ID NO: 1013631 - RNA, 13 nt, Homo sapiens
cucaaaucuccag

SEQ ID NO: 1013632 - RNA, 17 nt, Homo sapiens
cucaaaugacccaaaga

SEQ ID NO: 1013633 - RNA, 13 nt, Homo sapiens
cucaaaugcacau

SEQ ID NO: 1013634 - RNA, 17 nt, Homo sapiens
cucaaaugcacaucuca

SEQ ID NO: 1013635 - RNA, 13 nt, Homo sapiens
cucaacauugugu

SEQ ID NO: 1013636 - RNA, 13 nt, Homo sapiens
cucaacguuacau

SEQ ID NO: 1013637 - RNA, 14 nt, Homo sapiens
cucaacguuacauu

SEQ ID NO: 1013638 - RNA, 18 nt, Homo sapiens
cucaacguugcuccccau

SEQ ID NO: 1013639 - RNA, 18 nt, Homo sapiens
cucaagaaacaacuucua

SEQ ID NO: 1013640 - RNA, 14 nt, Homo sapiens
cucaagauucagua

SEQ ID NO: 1013641 - RNA, 17 nt, Homo sapiens
cucaagccaagcagcca

SEQ ID NO: 1013642 - RNA, 19 nt, Homo sapiens
cucaagcccugcagucaca

SEQ ID NO: 1013643 - RNA, 22 nt, Homo sapiens
cucaagcccugcagucacagcu

SEQ ID NO: 1013644 - RNA, 17 nt, Homo sapiens
cucaaggaauuugcauu

SEQ ID NO: 1013645 - RNA, 14 nt, Homo sapiens
cucaagggcuuuau

SEQ ID NO: 1013646 - RNA, 17 nt, Homo sapiens
cucaagucuucccugau

SEQ ID NO: 1013647 - RNA, 15 nt, Homo sapiens
cucaauaaguuuauu

SEQ ID NO: 1013648 - RNA, 17 nt, Homo sapiens
aguuuauauacaauuau

SEQ ID NO: 1013649 - RNA, 13 nt, Homo sapiens
aguuuaucuuuca

SEQ ID NO: 1013650 - RNA, 18 nt, Homo sapiens
aguuuaugcauacaguaa

SEQ ID NO: 1013651 - RNA, 17 nt, Homo sapiens
aguuuauugacaauaau

SEQ ID NO: 1013652 - RNA, 15 nt, Homo sapiens
aguuucaucagucaa

SEQ ID NO: 1013653 - RNA, 17 nt, Homo sapiens
aguuuccaaaaccagaa

SEQ ID NO: 1013654 - RNA, 15 nt, Homo sapiens
aguuuccauauguua

SEQ ID NO: 1013655 - RNA, 14 nt, Homo sapiens
aguuucucagcucc

SEQ ID NO: 1013656 - RNA, 17 nt, Homo sapiens
aguuucucagcucccau

SEQ ID NO: 1013657 - RNA, 18 nt, Homo sapiens
aguuucucucacauuacu

SEQ ID NO: 1013658 - RNA, 15 nt, Homo sapiens
aguuucuuuccugcc

SEQ ID NO: 1013659 - RNA, 20 nt, Homo sapiens
aguuugagacaggagaccug

SEQ ID NO: 1013660 - RNA, 21 nt, Homo sapiens
aguuugcuuauguaaucucac

SEQ ID NO: 1013661 - RNA, 15 nt, Homo sapiens
aguuugggaggcuga

SEQ ID NO: 1013662 - RNA, 13 nt, Homo sapiens
aguuuuaguugca

SEQ ID NO: 1013663 - RNA, 18 nt, Homo sapiens
aguuuuauuacacauuua

SEQ ID NO: 1013664 - RNA, 23 nt, Homo sapiens
aguuuuccuucucaucugugauu

SEQ ID NO: 1013665 - RNA, 19 nt, Homo sapiens
aguuuuucagaaagcauua

SEQ ID NO: 1013666 - RNA, 17 nt, Homo sapiens
aguuuuugauagcuuua

SEQ ID NO: 1013667 - RNA, 14 nt, Homo sapiens
auaaaaaacauaau

SEQ ID NO: 1013668 - RNA, 21 nt, Homo sapiens
auaaaaagauguucagucauu

SEQ ID NO: 1013669 - RNA, 20 nt, Homo sapiens
auaaaaauaaaucaguucau

SEQ ID NO: 1013670 - RNA, 16 nt, Homo sapiens
auaaaacaggucaaua

SEQ ID NO: 1013671 - RNA, 22 nt, Homo sapiens
auaaaacgcaaagggcugaaag

SEQ ID NO: 1013672 - RNA, 19 nt, Homo sapiens
auaaaagaguuaacauccc

SEQ ID NO: 1013673 - RNA, 18 nt, Homo sapiens
auaaaagauguacuugug

SEQ ID NO: 1013674 - RNA, 15 nt, Homo sapiens
auaaaaggcaaauac

SEQ ID NO: 1013675 - RNA, 22 nt, Homo sapiens
auaaaaugacaucccauuaauu

SEQ ID NO: 1013676 - RNA, 14 nt, Homo sapiens
auaaaauuagcuug

SEQ ID NO: 1013677 - RNA, 20 nt, Homo sapiens
auaaaauuaugccauagcaa

SEQ ID NO: 1013678 - RNA, 22 nt, Homo sapiens
auaaacacccaugaaucaaaga

SEQ ID NO: 1013679 - RNA, 22 nt, Homo sapiens
auaaacauccuucaagaacucu

SEQ ID NO: 1013680 - RNA, 16 nt, Homo sapiens
auaaacaugucugccc

SEQ ID NO: 1013681 - RNA, 23 nt, Homo sapiens
auaaacauuuaacuuguuuccaa

SEQ ID NO: 1013682 - RNA, 17 nt, Homo sapiens
auaaacccaguugccau

SEQ ID NO: 1013683 - RNA, 14 nt, Homo sapiens
auaaacugcuuugc

SEQ ID NO: 1013684 - RNA, 18 nt, Homo sapiens
auaaacuuugcuguguac

SEQ ID NO: 1013685 - RNA, 19 nt, Homo sapiens
auaaagaaacuuuauucaa

SEQ ID NO: 1013686 - RNA, 17 nt, Homo sapiens
aauauccgaacuuuaau

SEQ ID NO: 1013687 - RNA, 18 nt, Homo sapiens
aauaugauuuuauuugac

SEQ ID NO: 1013688 - RNA, 14 nt, Homo sapiens
aauaugcagugaua

SEQ ID NO: 1013689 - RNA, 18 nt, Homo sapiens
aauauggguugcauuugg

SEQ ID NO: 1013690 - RNA, 20 nt, Homo sapiens
aauauggugggcacagaagu

SEQ ID NO: 1013691 - RNA, 12 nt, Homo sapiens
aauauguacaag

SEQ ID NO: 1013692 - RNA, 21 nt, Homo sapiens
aauaugucaaaggucuaaaaa

SEQ ID NO: 1013693 - RNA, 13 nt, Homo sapiens
aauaugucuuucu

SEQ ID NO: 1013694 - RNA, 22 nt, Homo sapiens
aauauuccagagacugggacua

SEQ ID NO: 1013695 - RNA, 15 nt, Homo sapiens
aauauugucauuccu

SEQ ID NO: 1013696 - RNA, 14 nt, Homo sapiens
aauauugugcaaac

SEQ ID NO: 1013697 - RNA, 14 nt, Homo sapiens
aauauuuaccagac

SEQ ID NO: 1013698 - RNA, 13 nt, Homo sapiens
aauauuuacucau

SEQ ID NO: 1013699 - RNA, 20 nt, Homo sapiens
aauauuuauuauuuucaccu

SEQ ID NO: 1013700 - RNA, 18 nt, Homo sapiens
aauauuugcaagacauag

SEQ ID NO: 1013701 - RNA, 22 nt, Homo sapiens
aauauuuguugagauuuugcag

SEQ ID NO: 1013702 - RNA, 18 nt, Homo sapiens
aauauuuuaagacuauaa

SEQ ID NO: 1013703 - RNA, 13 nt, Homo sapiens
aaucaaagcacuu

SEQ ID NO: 1013704 - RNA, 14 nt, Homo sapiens
aaucaaagcacuug

SEQ ID NO: 1013705 - RNA, 24 nt, Homo sapiens
aaucaaaugguguuuucuuaugca

SEQ ID NO: 1013706 - RNA, 14 nt, Homo sapiens
aaucaagauuuaau

SEQ ID NO: 1013707 - RNA, 20 nt, Homo sapiens
aaucaagcuagaaggccaca

SEQ ID NO: 1013708 - RNA, 20 nt, Homo sapiens
aaucaaggugauugugauua

SEQ ID NO: 1013709 - RNA, 21 nt, Homo sapiens
aaucaaggugauugugauuau

SEQ ID NO: 1013710 - RNA, 15 nt, Homo sapiens
aaucaaucacgugua

SEQ ID NO: 1013711 - RNA, 20 nt, Homo sapiens
aaucacacagccaagccagu

SEQ ID NO: 1013712 - RNA, 22 nt, Homo sapiens
aaucacacugaggaacucacaa

SEQ ID NO: 1013713 - RNA, 21 nt, Homo sapiens
aaucaccuaggggucuuguua

SEQ ID NO: 1013714 - RNA, 22 nt, Homo sapiens
aaucacucagugauugcaauuu

SEQ ID NO: 1013715 - RNA, 16 nt, Homo sapiens
aaucacuucugagaac

SEQ ID NO: 1013716 - RNA, 18 nt, Homo sapiens
aaucacuucugagaacuc

SEQ ID NO: 1013717 - RNA, 22 nt, Homo sapiens
aaucaggacagguggugcaaau

SEQ ID NO: 1013718 - RNA, 16 nt, Homo sapiens
aaucauaaaacuugau

SEQ ID NO: 1013719 - RNA, 21 nt, Homo sapiens
aaucauaguuuaaacugcauu

SEQ ID NO: 1013720 - RNA, 19 nt, Homo sapiens
aaucauauaauaaauguac

SEQ ID NO: 1013721 - RNA, 18 nt, Homo sapiens
aaucauaugguugacagu

SEQ ID NO: 1013722 - RNA, 23 nt, Homo sapiens
aaucauaugguugacaguaugca

SEQ ID NO: 1013723 - RNA, 17 nt, Homo sapiens
aaucauuuuaagugcau

SEQ ID NO: 1013724 - RNA, 18 nt, Homo sapiens
aaucauuuuaagugcaug

SEQ ID NO: 1013725 - RNA, 17 nt, Homo sapiens
aaucauuuuaauuauua

SEQ ID NO: 1013726 - RNA, 16 nt, Homo sapiens
aaucauuuugccucuu

SEQ ID NO: 1013727 - RNA, 20 nt, Homo sapiens
aauccaacccaugaugagcu

SEQ ID NO: 1013728 - RNA, 20 nt, Homo sapiens
aauccaguaggauccaguga

SEQ ID NO: 1013729 - RNA, 22 nt, Homo sapiens
aauccaguccagauauuucaca

SEQ ID NO: 1013730 - RNA, 23 nt, Homo sapiens
aauccaucacuagccaugauaac

SEQ ID NO: 1013731 - RNA, 12 nt, Homo sapiens
aauccaugaacc

SEQ ID NO: 1013732 - RNA, 20 nt, Homo sapiens
aauccaugaaccaagaccau

SEQ ID NO: 1013733 - RNA, 17 nt, Homo sapiens
aaucccacccacaugug

SEQ ID NO: 1013734 - RNA, 15 nt, Homo sapiens
aauccccacccuggg

SEQ ID NO: 1013735 - RNA, 17 nt, Homo sapiens
aauccuacacaccuaag

SEQ ID NO: 1013736 - RNA, 15 nt, Homo sapiens
aauccuagcacuuug

SEQ ID NO: 1013737 - RNA, 16 nt, Homo sapiens
aauccuagcacuuugg

SEQ ID NO: 1013738 - RNA, 18 nt, Homo sapiens
aauccuuuacuguuaguc

SEQ ID NO: 1013739 - RNA, 20 nt, Homo sapiens
aaucuaaauggaaccacucu

SEQ ID NO: 1013740 - RNA, 16 nt, Homo sapiens
aaucuaaccacaucaa

SEQ ID NO: 1013741 - RNA, 15 nt, Homo sapiens
aaucuauagaacuga

SEQ ID NO: 1013742 - RNA, 15 nt, Homo sapiens
aaucucaagcaaaca

SEQ ID NO: 1013743 - RNA, 13 nt, Homo sapiens
aaucucacuacac

SEQ ID NO: 1013744 - RNA, 21 nt, Homo sapiens
aaucucauggagaagcagaaa

SEQ ID NO: 1013745 - RNA, 14 nt, Homo sapiens
aaucuccaguuuuc

SEQ ID NO: 1013746 - RNA, 18 nt, Homo sapiens
aaucucuaaaaauccaua

SEQ ID NO: 1013747 - RNA, 16 nt, Homo sapiens
aaucucugaauuugag

SEQ ID NO: 1013748 - RNA, 17 nt, Homo sapiens
aaucucugaauuugaga

SEQ ID NO: 1013749 - RNA, 14 nt, Homo sapiens
aaucugagaaucac

SEQ ID NO: 1013750 - RNA, 18 nt, Homo sapiens
aaucugagaaucacauuu

SEQ ID NO: 1013751 - RNA, 21 nt, Homo sapiens
aaucugcccauucaucuucau

SEQ ID NO: 1013752 - RNA, 21 nt, Homo sapiens
aaucuguguucgauggcucaa

SEQ ID NO: 1013753 - RNA, 13 nt, Homo sapiens
aaucuucauuucu

SEQ ID NO: 1013754 - RNA, 22 nt, Homo sapiens
aaucuucuugauccacuucucu

SEQ ID NO: 1013755 - RNA, 17 nt, Homo sapiens
aaucuuuucacaaauaa

SEQ ID NO: 1013756 - RNA, 13 nt, Homo sapiens
aaugaacacuuaa

SEQ ID NO: 1013757 - RNA, 18 nt, Homo sapiens
aaugaaccccacugggug

SEQ ID NO: 1013758 - RNA, 20 nt, Homo sapiens
aaugaacccccaugauguaa

SEQ ID NO: 1013759 - RNA, 16 nt, Homo sapiens
aaugaagaugaugcua

SEQ ID NO: 1013760 - RNA, 20 nt, Homo sapiens
aaugaagaugaugcuauuaa

SEQ ID NO: 1013761 - RNA, 15 nt, Homo sapiens
aaugaagaugucuaa

SEQ ID NO: 1013762 - RNA, 16 nt, Homo sapiens
aaugaagcagcuuuaa

SEQ ID NO: 1013763 - RNA, 17 nt, Homo sapiens
aaugaagccuuagccag

SEQ ID NO: 1013764 - RNA, 14 nt, Homo sapiens
aaugaaguacucau

SEQ ID NO: 1013765 - RNA, 12 nt, Homo sapiens
aaugaaucuuca

SEQ ID NO: 1013766 - RNA, 14 nt, Homo sapiens
aaugaaucuucaca

SEQ ID NO: 1013767 - RNA, 18 nt, Homo sapiens
aaugaaucuucacaaaac

SEQ ID NO: 1013768 - RNA, 13 nt, Homo sapiens
aaugaauugcuaa

SEQ ID NO: 1013769 - RNA, 13 nt, Homo sapiens
aaugacauuugua

SEQ ID NO: 1013770 - RNA, 21 nt, Homo sapiens
cagcuuauaaaaucaaacaga

SEQ ID NO: 1013771 - RNA, 13 nt, Homo sapiens
cagcuuauucaca

SEQ ID NO: 1013772 - RNA, 19 nt, Homo sapiens
cagcuuguaaauagcucag

SEQ ID NO: 1013773 - RNA, 19 nt, Homo sapiens
cagugaccagucacugacc

SEQ ID NO: 1013774 - RNA, 18 nt, Homo sapiens
cagugaggcugcacccac

SEQ ID NO: 1013775 - RNA, 19 nt, Homo sapiens
cagugauagaaagaaacaa

SEQ ID NO: 1013776 - RNA, 11 nt, Homo sapiens
cagugcaagag

SEQ ID NO: 1013777 - RNA, 16 nt, Homo sapiens
cagugcauuugccuug

SEQ ID NO: 1013778 - RNA, 16 nt, Homo sapiens
cagugccccuagcuua

SEQ ID NO: 1013779 - RNA, 13 nt, Homo sapiens
cagugccucuggu

SEQ ID NO: 1013780 - RNA, 14 nt, Homo sapiens
cagugccuguaauc

SEQ ID NO: 1013781 - RNA, 21 nt, Homo sapiens
cagugcuguggccugggcaag

SEQ ID NO: 1013782 - RNA, 16 nt, Homo sapiens
cagugcuugaaugaag

SEQ ID NO: 1013783 - RNA, 18 nt, Homo sapiens
caguggaacagucuuccc

SEQ ID NO: 1013784 - RNA, 14 nt, Homo sapiens
caguggacaccagg

SEQ ID NO: 1013785 - RNA, 17 nt, Homo sapiens
caguggauugcauuucu

SEQ ID NO: 1013786 - RNA, 15 nt, Homo sapiens
caguggcccuuucaa

SEQ ID NO: 1013787 - RNA, 18 nt, Homo sapiens
caguggcugcugcccagg

SEQ ID NO: 1013788 - RNA, 18 nt, Homo sapiens
caguggcuggaucuguga

SEQ ID NO: 1013789 - RNA, 21 nt, Homo sapiens
cagugggcauggagccagugc

SEQ ID NO: 1013790 - RNA, 23 nt, Homo sapiens
cagugguauccugugacauguaa

SEQ ID NO: 1013791 - RNA, 15 nt, Homo sapiens
cagugguaugaucac

SEQ ID NO: 1013792 - RNA, 14 nt, Homo sapiens
caguguacauggaa

SEQ ID NO: 1013793 - RNA, 19 nt, Homo sapiens
caguguagcccacacuuga

SEQ ID NO: 1013794 - RNA, 20 nt, Homo sapiens
caguguagcccacacuugag

SEQ ID NO: 1013795 - RNA, 21 nt, Homo sapiens
caguguagcccacacuugaga

SEQ ID NO: 1013796 - RNA, 16 nt, Homo sapiens
caguguauguacuaag

SEQ ID NO: 1013797 - RNA, 21 nt, Homo sapiens
caguguauguacuaagcagua

SEQ ID NO: 1013798 - RNA, 20 nt, Homo sapiens
caguguccccuccacuguca

SEQ ID NO: 1013799 - RNA, 17 nt, Homo sapiens
cagugucuuuccaccuu

SEQ ID NO: 1013800 - RNA, 19 nt, Homo sapiens
caguguguuucugaucuga

SEQ ID NO: 1013801 - RNA, 20 nt, Homo sapiens
caguguuaaaugugaugaau

SEQ ID NO: 1013802 - RNA, 17 nt, Homo sapiens
caguguuauuaaugaca

SEQ ID NO: 1013803 - RNA, 21 nt, Homo sapiens
caguguuuuuguaaagugugg

SEQ ID NO: 1013804 - RNA, 22 nt, Homo sapiens
caguuaacuuuaagacugagca

SEQ ID NO: 1013805 - RNA, 14 nt, Homo sapiens
caguuagcucucaa

SEQ ID NO: 1013806 - RNA, 16 nt, Homo sapiens
caguuagguagcuuua

SEQ ID NO: 1013807 - RNA, 20 nt, Homo sapiens
caguuaugugaaugaucucu

SEQ ID NO: 1013808 - RNA, 16 nt, Homo sapiens
caguucaccuugaaga

SEQ ID NO: 1013809 - RNA, 15 nt, Homo sapiens
caguucccagaauca

SEQ ID NO: 1013810 - RNA, 17 nt, Homo sapiens
caguucugaauaugcug

SEQ ID NO: 1013811 - RNA, 14 nt, Homo sapiens
caguucugcuccuc

SEQ ID NO: 1013812 - RNA, 14 nt, Homo sapiens
caguugcuuugcag

SEQ ID NO: 1013813 - RNA, 16 nt, Homo sapiens
caguugggagcacugg

SEQ ID NO: 1013814 - RNA, 23 nt, Homo sapiens
caguuguugauugacugcaugaa

SEQ ID NO: 1013815 - RNA, 21 nt, Homo sapiens
caguuugauuguuguuuauaa

SEQ ID NO: 1013816 - RNA, 12 nt, Homo sapiens
caguuugcaauu

SEQ ID NO: 1013817 - RNA, 14 nt, Homo sapiens
caguuugcacuuau

SEQ ID NO: 1013818 - RNA, 19 nt, Homo sapiens
caguuuuacucugcugcaa

SEQ ID NO: 1013819 - RNA, 13 nt, Homo sapiens
caguuuucuugca

SEQ ID NO: 1013820 - RNA, 12 nt, Homo sapiens
caguuuuugccu

SEQ ID NO: 1013821 - RNA, 18 nt, Homo sapiens
cauaaaaaggaauccacu

SEQ ID NO: 1013822 - RNA, 21 nt, Homo sapiens
cauaaaaauaaaucaguucau

SEQ ID NO: 1013823 - RNA, 18 nt, Homo sapiens
cauaaagaagcaauaaag

SEQ ID NO: 1013824 - RNA, 21 nt, Homo sapiens
cauaaagccuuggauguauau

SEQ ID NO: 1013825 - RNA, 15 nt, Homo sapiens
cauaacagaacaaga

SEQ ID NO: 1013826 - RNA, 18 nt, Homo sapiens
cauaagcaaagacuauga

SEQ ID NO: 1013827 - RNA, 22 nt, Homo sapiens
cauaagguuucguuucuguaua

SEQ ID NO: 1013828 - RNA, 16 nt, Homo sapiens
cauaaguauuaugucu

SEQ ID NO: 1013829 - RNA, 18 nt, Homo sapiens
cauaaguuaacuuccaau

SEQ ID NO: 1013830 - RNA, 21 nt, Homo sapiens
cauaaguuuacugaaucuuca

SEQ ID NO: 1013831 - RNA, 18 nt, Homo sapiens
cauaauaaauaucuguac

SEQ ID NO: 1013832 - RNA, 19 nt, Homo sapiens
cauaaucuguacaaugaac

SEQ ID NO: 1013833 - RNA, 15 nt, Homo sapiens
cauaaugcgugcaua

SEQ ID NO: 1013834 - RNA, 21 nt, Homo sapiens
cauaauguuacauuauuauca

SEQ ID NO: 1013835 - RNA, 16 nt, Homo sapiens
cauacagagacagaua

SEQ ID NO: 1013836 - RNA, 19 nt, Homo sapiens
cauacagagacagauauac

SEQ ID NO: 1013837 - RNA, 12 nt, Homo sapiens
cauacaggccau

SEQ ID NO: 1013838 - RNA, 14 nt, Homo sapiens
cauacaguuugcac

SEQ ID NO: 1013839 - RNA, 16 nt, Homo sapiens
cauacaguuugcacuu

SEQ ID NO: 1013840 - RNA, 13 nt, Homo sapiens
cauacauguuaca

SEQ ID NO: 1013841 - RNA, 14 nt, Homo sapiens
cauacauuaucuca

SEQ ID NO: 1013842 - RNA, 13 nt, Homo sapiens
cauacggcacuga

SEQ ID NO: 1013843 - RNA, 14 nt, Homo sapiens
cauacggcacugaa

SEQ ID NO: 1013844 - RNA, 17 nt, Homo sapiens
cauacucugcuuagaau

SEQ ID NO: 1013845 - RNA, 19 nt, Homo sapiens
cauagaaauuacacccaaa

SEQ ID NO: 1013846 - RNA, 20 nt, Homo sapiens
cauagagaucauccuuucca

SEQ ID NO: 1013847 - RNA, 22 nt, Homo sapiens
cauagagaucuauguacuguaa

SEQ ID NO: 1013848 - RNA, 22 nt, Homo sapiens
cauagaggugagggaagccuga

SEQ ID NO: 1013849 - RNA, 16 nt, Homo sapiens
cauagcaaacagagga

SEQ ID NO: 1013850 - RNA, 18 nt, Homo sapiens
cauagcagcuuauucaca

SEQ ID NO: 1013851 - RNA, 19 nt, Homo sapiens
cauagcccagaucagcucc

SEQ ID NO: 1013852 - RNA, 16 nt, Homo sapiens
cauagcuccugcucca

SEQ ID NO: 1013853 - RNA, 14 nt, Homo sapiens
cauagcuggucuua

SEQ ID NO: 1013854 - RNA, 19 nt, Homo sapiens
cauaggaaguauggcauga

SEQ ID NO: 1013855 - RNA, 22 nt, Homo sapiens
cauagugaccaacauagugaaa

SEQ ID NO: 1013856 - RNA, 17 nt, Homo sapiens
cauauaaagcacuauac

SEQ ID NO: 1013857 - RNA, 19 nt, Homo sapiens
cauauaaagcacuauacag

SEQ ID NO: 1013858 - RNA, 18 nt, Homo sapiens
cauauaacgucaugugca

SEQ ID NO: 1013859 - RNA, 13 nt, Homo sapiens
cauauaccagcaa

SEQ ID NO: 1013860 - RNA, 16 nt, Homo sapiens
cauauaggacacacau

SEQ ID NO: 1013861 - RNA, 18 nt, Homo sapiens
cauauauaugucaggcaa

SEQ ID NO: 1013862 - RNA, 16 nt, Homo sapiens
cauauauuagcauuua

SEQ ID NO: 1013863 - RNA, 20 nt, Homo sapiens
cauauccaacaugugcucag

SEQ ID NO: 1013864 - RNA, 21 nt, Homo sapiens
cauaugauugugcacauacuu

SEQ ID NO: 1013865 - RNA, 16 nt, Homo sapiens
cauauguaucuauaca

SEQ ID NO: 1013866 - RNA, 15 nt, Homo sapiens
cauauuaagacauaa

SEQ ID NO: 1013867 - RNA, 21 nt, Homo sapiens
cauauucaggaagcucagggc

SEQ ID NO: 1013868 - RNA, 19 nt, Homo sapiens
cauauucuuuaaauuucau

SEQ ID NO: 1013869 - RNA, 22 nt, Homo sapiens
cauauugacuuaauugcagcuu

SEQ ID NO: 1013870 - RNA, 21 nt, Homo sapiens
cauauuggacugauaaucucu

SEQ ID NO: 1013871 - RNA, 19 nt, Homo sapiens
cauauuuuauuauagucac

SEQ ID NO: 1013872 - RNA, 21 nt, Homo sapiens
caucaagaugagagaacugga

SEQ ID NO: 1013873 - RNA, 22 nt, Homo sapiens
caucaagaugagagaacuggag

SEQ ID NO: 1013874 - RNA, 20 nt, Homo sapiens
caucaagcgaugaaacugga

SEQ ID NO: 1013875 - RNA, 22 nt, Homo sapiens
caucaaggcacugccugaugga

SEQ ID NO: 1013876 - RNA, 11 nt, Homo sapiens
caucaaugaug

SEQ ID NO: 1013877 - RNA, 12 nt, Homo sapiens
caucacaacauu

SEQ ID NO: 1013878 - RNA, 21 nt, Homo sapiens
caucacagcugaacuuguuga

SEQ ID NO: 1013879 - RNA, 22 nt, Homo sapiens
caucacaugcucaaugacucuc

SEQ ID NO: 1013880 - RNA, 17 nt, Homo sapiens
caucaccuccaccauac

SEQ ID NO: 1013881 - RNA, 18 nt, Homo sapiens
caucacgccugugcagug

SEQ ID NO: 1013882 - RNA, 15 nt, Homo sapiens
caucagacagaugga

SEQ ID NO: 1013883 - RNA, 21 nt, Homo sapiens
caucagacuccugugcaacuu

SEQ ID NO: 1013884 - RNA, 14 nt, Homo sapiens
caucagccugugua

SEQ ID NO: 1013885 - RNA, 15 nt, Homo sapiens
caucaggacucugac

SEQ ID NO: 1013886 - RNA, 15 nt, Homo sapiens
caucagggacaggau

SEQ ID NO: 1013887 - RNA, 18 nt, Homo sapiens
caucagggacaggaugac

SEQ ID NO: 1013888 - RNA, 21 nt, Homo sapiens
caucaguguccucuugcucaa

SEQ ID NO: 1013889 - RNA, 22 nt, Homo sapiens
caucaguguccucuugcucaaa

SEQ ID NO: 1013890 - RNA, 16 nt, Homo sapiens
caucauacaugacuca

SEQ ID NO: 1013891 - RNA, 18 nt, Homo sapiens
caucaucaaaaacuuugg

SEQ ID NO: 1013892 - RNA, 15 nt, Homo sapiens
caucaucacucaucu

SEQ ID NO: 1013893 - RNA, 12 nt, Homo sapiens
caucaucuaugg

SEQ ID NO: 1013894 - RNA, 17 nt, Homo sapiens
caucaucuccugccuuc

SEQ ID NO: 1013895 - RNA, 14 nt, Homo sapiens
caucaugucuggcu

SEQ ID NO: 1013896 - RNA, 15 nt, Homo sapiens
caucauuagaacaaa

SEQ ID NO: 1013897 - RNA, 19 nt, Homo sapiens
caucauuggaaaugaaacu

SEQ ID NO: 1013898 - RNA, 11 nt, Homo sapiens
cauccaaauaa

SEQ ID NO: 1013899 - RNA, 21 nt, Homo sapiens
cauccaaggagaaacagagac

SEQ ID NO: 1013900 - RNA, 22 nt, Homo sapiens
cauccaaucuaaccacaucaau

SEQ ID NO: 1013901 - RNA, 17 nt, Homo sapiens
cauccacauuguuuuaa

SEQ ID NO: 1013902 - RNA, 17 nt, Homo sapiens
cauccagaaguuccuca

SEQ ID NO: 1013903 - RNA, 15 nt, Homo sapiens
cauccagauagguua

SEQ ID NO: 1013904 - RNA, 15 nt, Homo sapiens
cauccauaaagaagc

SEQ ID NO: 1013905 - RNA, 18 nt, Homo sapiens
caucccacgcuugcuuua

SEQ ID NO: 1013906 - RNA, 20 nt, Homo sapiens
caucccagccuuggcaucua

SEQ ID NO: 1013907 - RNA, 15 nt, Homo sapiens
caucccaucaucuug

SEQ ID NO: 1013908 - RNA, 19 nt, Homo sapiens
cauccccaccugucuucaa

SEQ ID NO: 1013909 - RNA, 19 nt, Homo sapiens
cauccccuuuguguagaaa

SEQ ID NO: 1013910 - RNA, 14 nt, Homo sapiens
cauccguaucuuuu

SEQ ID NO: 1013911 - RNA, 19 nt, Homo sapiens
cauccuaugcaauauaucu

SEQ ID NO: 1013912 - RNA, 18 nt, Homo sapiens
cauccucagcuucuuccc

SEQ ID NO: 1013913 - RNA, 15 nt, Homo sapiens
cauccugugaagucc

SEQ ID NO: 1013914 - RNA, 21 nt, Homo sapiens
caucgcagcuucagcaucucc

SEQ ID NO: 1013915 - RNA, 17 nt, Homo sapiens
caucguggagacagggc

SEQ ID NO: 1013916 - RNA, 18 nt, Homo sapiens
caucuaguaggugcuuga

SEQ ID NO: 1013917 - RNA, 17 nt, Homo sapiens
ccuauaaaacaggucaa

SEQ ID NO: 1013918 - RNA, 19 nt, Homo sapiens
ccuauagucgcagcuacua

SEQ ID NO: 1013919 - RNA, 15 nt, Homo sapiens
ccuauaugcacuuau

SEQ ID NO: 1013920 - RNA, 16 nt, Homo sapiens
ccuauauuguuuucag

SEQ ID NO: 1013921 - RNA, 19 nt, Homo sapiens
ccuauauuguuuucagugu

SEQ ID NO: 1013922 - RNA, 21 nt, Homo sapiens
ccuaucagccugucucuucca

SEQ ID NO: 1013923 - RNA, 22 nt, Homo sapiens
ccuaucagccugucucuuccau

SEQ ID NO: 1013924 - RNA, 14 nt, Homo sapiens
ccuaugcacauaug

SEQ ID NO: 1013925 - RNA, 16 nt, Homo sapiens
ccuaugugauuuuaac

SEQ ID NO: 1013926 - RNA, 19 nt, Homo sapiens
ccuauugugauuugacugu

SEQ ID NO: 1013927 - RNA, 19 nt, Homo sapiens
ccuauuuagaaauggauuu

SEQ ID NO: 1013928 - RNA, 11 nt, Homo sapiens
ccuauuugcac

SEQ ID NO: 1013929 - RNA, 15 nt, Homo sapiens
ccuauuuguuuucau

SEQ ID NO: 1013930 - RNA, 14 nt, Homo sapiens
ccucaaaaugacag

SEQ ID NO: 1013931 - RNA, 13 nt, Homo sapiens
ccucaaacacugc

SEQ ID NO: 1013932 - RNA, 21 nt, Homo sapiens
ccucaaaccuaccacucagga

SEQ ID NO: 1013933 - RNA, 22 nt, Homo sapiens
ccucaaaguuggggcaggcugg

SEQ ID NO: 1013934 - RNA, 22 nt, Homo sapiens
ccucaaaugacccaaagaccaa

SEQ ID NO: 1013935 - RNA, 16 nt, Homo sapiens
ccucaaccugugauga

SEQ ID NO: 1013936 - RNA, 13 nt, Homo sapiens
ccucaaugugacc

SEQ ID NO: 1013937 - RNA, 14 nt, Homo sapiens
ccucacacagcccu

SEQ ID NO: 1013938 - RNA, 21 nt, Homo sapiens
ccucacaucuuucacacuucc

SEQ ID NO: 1013939 - RNA, 20 nt, Homo sapiens
ccucacccccagcuuugcua

SEQ ID NO: 1013940 - RNA, 22 nt, Homo sapiens
ccucacuccuguuacuuaccua

SEQ ID NO: 1013941 - RNA, 17 nt, Homo sapiens
ccucacugaaugccuca

SEQ ID NO: 1013942 - RNA, 11 nt, Homo sapiens
ccucacuuuag

SEQ ID NO: 1013943 - RNA, 15 nt, Homo sapiens
ccucagacuagcuuu

SEQ ID NO: 1013944 - RNA, 21 nt, Homo sapiens
ccucagauuccgcaccaauaa

SEQ ID NO: 1013945 - RNA, 17 nt, Homo sapiens
ccucagccauucacugc

SEQ ID NO: 1013946 - RNA, 22 nt, Homo sapiens
ccucagccucccaaagugcugg

SEQ ID NO: 1013947 - RNA, 14 nt, Homo sapiens
ccucaggcagcuca

SEQ ID NO: 1013948 - RNA, 14 nt, Homo sapiens
ccucaggcaggugg

SEQ ID NO: 1013949 - RNA, 14 nt, Homo sapiens
ccucaguccacugc

SEQ ID NO: 1013950 - RNA, 18 nt, Homo sapiens
ccucaucccgagcaccuc

SEQ ID NO: 1013951 - RNA, 21 nt, Homo sapiens
ccucaucugggggaguggaau

SEQ ID NO: 1013952 - RNA, 22 nt, Homo sapiens
ccucaucugggggaguggaaua

SEQ ID NO: 1013953 - RNA, 20 nt, Homo sapiens
ccucaugcugugugacucaa

SEQ ID NO: 1013954 - RNA, 20 nt, Homo sapiens
ccucauuaccuugugcuaau

SEQ ID NO: 1013955 - RNA, 20 nt, Homo sapiens
ccucauuccccaaccacuuc

SEQ ID NO: 1013956 - RNA, 19 nt, Homo sapiens
ccucauuugggguagcuag

SEQ ID NO: 1013957 - RNA, 16 nt, Homo sapiens
ccuccaaaagcacuua

SEQ ID NO: 1013958 - RNA, 13 nt, Homo sapiens
ccuccaaaugcca

SEQ ID NO: 1013959 - RNA, 16 nt, Homo sapiens
ccuccaccccccagaa

SEQ ID NO: 1013960 - RNA, 13 nt, Homo sapiens
ccuccacgccauu

SEQ ID NO: 1013961 - RNA, 16 nt, Homo sapiens
ccuccacgccauuucc

SEQ ID NO: 1013962 - RNA, 16 nt, Homo sapiens
ccuccagcuucuggua

SEQ ID NO: 1013963 - RNA, 15 nt, Homo sapiens
ccuccaggugcacaa

SEQ ID NO: 1013964 - RNA, 11 nt, Homo sapiens
ccuccaucuca

SEQ ID NO: 1013965 - RNA, 19 nt, Homo sapiens
ccuccaugaauaucaguua

SEQ ID NO: 1013966 - RNA, 12 nt, Homo sapiens
ccuccauucuga

SEQ ID NO: 1013967 - RNA, 12 nt, Homo sapiens
ccuccauuugca

SEQ ID NO: 1013968 - RNA, 22 nt, Homo sapiens
ccuccauuugcaauugaccucu

SEQ ID NO: 1013969 - RNA, 14 nt, Homo sapiens
ccucccacugcccc

SEQ ID NO: 1013970 - RNA, 18 nt, Homo sapiens
ccucccuggcucccauga

SEQ ID NO: 1013971 - RNA, 17 nt, Homo sapiens
ccucccuucaugcaugg

SEQ ID NO: 1013972 - RNA, 22 nt, Homo sapiens
ccuccuaccgaaaccuugccuu

SEQ ID NO: 1013973 - RNA, 19 nt, Homo sapiens
ccuccucuucugacgugcc

SEQ ID NO: 1013974 - RNA, 18 nt, Homo sapiens
ccuccugaagccacagca

SEQ ID NO: 1013975 - RNA, 15 nt, Homo sapiens
ccuccugcaccgaga

SEQ ID NO: 1013976 - RNA, 22 nt, Homo sapiens
ccuccugcuaacuccuagcuga

SEQ ID NO: 1013977 - RNA, 20 nt, Homo sapiens
ccuccuggaaaaaacaaaaa

SEQ ID NO: 1013978 - RNA, 16 nt, Homo sapiens
ccuccugggcccucuc

SEQ ID NO: 1013979 - RNA, 13 nt, Homo sapiens
ccuccuguaaaug

SEQ ID NO: 1013980 - RNA, 15 nt, Homo sapiens
ccuccugucccucau

SEQ ID NO: 1013981 - RNA, 18 nt, Homo sapiens
ccuccuuacauaugcaaa

SEQ ID NO: 1013982 - RNA, 15 nt, Homo sapiens
ccuccuuuugcuuga

SEQ ID NO: 1013983 - RNA, 16 nt, Homo sapiens
ccucgcagagaggcca

SEQ ID NO: 1013984 - RNA, 20 nt, Homo sapiens
ccucgcggcucuccagggcu

SEQ ID NO: 1013985 - RNA, 15 nt, Homo sapiens
ccucgcuucagccac

SEQ ID NO: 1013986 - RNA, 21 nt, Homo sapiens
ccucgcuuggacggcugggca

SEQ ID NO: 1013987 - RNA, 16 nt, Homo sapiens
ccucuaaaacaguccu

SEQ ID NO: 1013988 - RNA, 18 nt, Homo sapiens
ccucuaagccacucuucc

SEQ ID NO: 1013989 - RNA, 19 nt, Homo sapiens
ccucucaacucucuuugua

SEQ ID NO: 1013990 - RNA, 16 nt, Homo sapiens
ccucucaugacuugca

SEQ ID NO: 1013991 - RNA, 19 nt, Homo sapiens
ccucuccaagggcuucugc

SEQ ID NO: 1013992 - RNA, 22 nt, Homo sapiens
ccucucucacauggaacgcuuu

SEQ ID NO: 1013993 - RNA, 16 nt, Homo sapiens
ccucucucccuggacc

SEQ ID NO: 1013994 - RNA, 19 nt, Homo sapiens
ccucucucuucugcuccac

SEQ ID NO: 1013995 - RNA, 12 nt, Homo sapiens
ccucugacucag

SEQ ID NO: 1013996 - RNA, 18 nt, Homo sapiens
ccucugggccaagucaaa

SEQ ID NO: 1013997 - RNA, 22 nt, Homo sapiens
ccucugucaaugaaaaaaagua

SEQ ID NO: 1013998 - RNA, 13 nt, Homo sapiens
ccucugugaagca

SEQ ID NO: 1013999 - RNA, 23 nt, Homo sapiens
ccucuuaaaaaauaaaaacugac

SEQ ID NO: 1014000 - RNA, 19 nt, Homo sapiens
ccucuuaaagcugccugua

SEQ ID NO: 1014001 - RNA, 17 nt, Homo sapiens
ccucuuagaaaaaccac

SEQ ID NO: 1014002 - RNA, 14 nt, Homo sapiens
ccucuuccccagaa

SEQ ID NO: 1014003 - RNA, 22 nt, Homo sapiens
ccucuuccccagaaaggagacu

SEQ ID NO: 1014004 - RNA, 24 nt, Homo sapiens
ccucuuccccagaaaggagacuag

SEQ ID NO: 1014005 - RNA, 20 nt, Homo sapiens
ccucuucucaagugccuuaa

SEQ ID NO: 1014006 - RNA, 19 nt, Homo sapiens
ccucuuugucuaaaacaau

SEQ ID NO: 1014007 - RNA, 17 nt, Homo sapiens
ccugaaaaaaugccaag

SEQ ID NO: 1014008 - RNA, 15 nt, Homo sapiens
ccugaaaauucugua

SEQ ID NO: 1014009 - RNA, 14 nt, Homo sapiens
ccugaacacuguga

SEQ ID NO: 1014010 - RNA, 15 nt, Homo sapiens
ccugaacacugugac

SEQ ID NO: 1014011 - RNA, 16 nt, Homo sapiens
ccugaacuuacacaaa

SEQ ID NO: 1014012 - RNA, 18 nt, Homo sapiens
ccugaagucccagcauug

SEQ ID NO: 1014013 - RNA, 13 nt, Homo sapiens
ccugaaugaaaua

SEQ ID NO: 1014014 - RNA, 18 nt, Homo sapiens
ccugaaugguuccaugcc

SEQ ID NO: 1014015 - RNA, 22 nt, Homo sapiens
ccugaauucuuuccccaaagac

SEQ ID NO: 1014016 - RNA, 17 nt, Homo sapiens
ccugaauuuuguugcug

SEQ ID NO: 1014017 - RNA, 23 nt, Homo sapiens
ccugacaacacucauugaccuga

SEQ ID NO: 1014018 - RNA, 18 nt, Homo sapiens
ccugacccagagccuagg

SEQ ID NO: 1014019 - RNA, 17 nt, Homo sapiens
ccugacccuacuucuuu

SEQ ID NO: 1014020 - RNA, 19 nt, Homo sapiens
ccugaccugucaccgugag

SEQ ID NO: 1014021 - RNA, 16 nt, Homo sapiens
ccugacuuugugaucc

SEQ ID NO: 1014022 - RNA, 19 nt, Homo sapiens
ccugagcaacagagugaga

SEQ ID NO: 1014023 - RNA, 15 nt, Homo sapiens
ccugagccacaaaaa

SEQ ID NO: 1014024 - RNA, 20 nt, Homo sapiens
ccugagcucgguggacccag

SEQ ID NO: 1014025 - RNA, 22 nt, Homo sapiens
ccugagguuugccagcauuuag

SEQ ID NO: 1014026 - RNA, 13 nt, Homo sapiens
ccugauccucacc

SEQ ID NO: 1014027 - RNA, 18 nt, Homo sapiens
ccugaucgccaaccuuuc

SEQ ID NO: 1014028 - RNA, 19 nt, Homo sapiens
ccugaucgccaaccuuucc

SEQ ID NO: 1014029 - RNA, 21 nt, Homo sapiens
ccugaugacagagcgagauuc

SEQ ID NO: 1014030 - RNA, 15 nt, Homo sapiens
ccugauuacaccagc

SEQ ID NO: 1014031 - RNA, 22 nt, Homo sapiens
ccugcaaaaacagagguggaua

SEQ ID NO: 1014032 - RNA, 17 nt, Homo sapiens
ccugcaaaaggacucuc

SEQ ID NO: 1014033 - RNA, 21 nt, Homo sapiens
ccugcaaacucacugcucaag

SEQ ID NO: 1014034 - RNA, 14 nt, Homo sapiens
ccugcacacuuggu

SEQ ID NO: 1014035 - RNA, 21 nt, Homo sapiens
ccugcaccccugcaguuugag

SEQ ID NO: 1014036 - RNA, 14 nt, Homo sapiens
ccugcaccugacag

SEQ ID NO: 1014037 - RNA, 16 nt, Homo sapiens
ccugcagaauccagcu

SEQ ID NO: 1014038 - RNA, 14 nt, Homo sapiens
ccugcaggcagcuu

SEQ ID NO: 1014039 - RNA, 15 nt, Homo sapiens
ccugcagggccagac

SEQ ID NO: 1014040 - RNA, 21 nt, Homo sapiens
ccugcaugaaacauguucuca

SEQ ID NO: 1014041 - RNA, 18 nt, Homo sapiens
ccugcauugcugagucaa

SEQ ID NO: 1014042 - RNA, 15 nt, Homo sapiens
ccugccaacugauuu

SEQ ID NO: 1014043 - RNA, 15 nt, Homo sapiens
ccugccaggcacacu

SEQ ID NO: 1014044 - RNA, 15 nt, Homo sapiens
ccugcccaccuguca

SEQ ID NO: 1014045 - RNA, 17 nt, Homo sapiens
ccugccccucucccgcc

SEQ ID NO: 1014046 - RNA, 19 nt, Homo sapiens
ccugcccuugucccacuca

SEQ ID NO: 1014047 - RNA, 13 nt, Homo sapiens
ccugccugcauuc

SEQ ID NO: 1014048 - RNA, 10 nt, Homo sapiens
ccugccugua

SEQ ID NO: 1014049 - RNA, 20 nt, Homo sapiens
ccugccuguagcagugagaa

SEQ ID NO: 1014050 - RNA, 19 nt, Homo sapiens
ccugcucccagcagcccua

SEQ ID NO: 1014051 - RNA, 18 nt, Homo sapiens
ccugcugagggaccagcc

SEQ ID NO: 1014052 - RNA, 23 nt, Homo sapiens
ccugcugagggaccagccaagag

SEQ ID NO: 1014053 - RNA, 13 nt, Homo sapiens
ccugcugcaucuu

SEQ ID NO: 1014054 - RNA, 18 nt, Homo sapiens
ccugcuggcucuucugcc

SEQ ID NO: 1014055 - RNA, 19 nt, Homo sapiens
ccugcuucaauacccaaau

SEQ ID NO: 1014056 - RNA, 14 nt, Homo sapiens
ccuggaaggugcug

SEQ ID NO: 1014057 - RNA, 20 nt, Homo sapiens
ccuggaaucaagaugucaga

SEQ ID NO: 1014058 - RNA, 17 nt, Homo sapiens
ccuggacaguuuucugc

SEQ ID NO: 1014059 - RNA, 16 nt, Homo sapiens
ccuggagacucgugga

SEQ ID NO: 1014060 - RNA, 14 nt, Homo sapiens
ccuggagccuuuga

SEQ ID NO: 1014061 - RNA, 14 nt, Homo sapiens
ccuggagugcaguu

SEQ ID NO: 1014062 - RNA, 16 nt, Homo sapiens
cgagugcucauuucag

SEQ ID NO: 1014063 - RNA, 14 nt, Homo sapiens
cgaucccaucuuga

SEQ ID NO: 1014064 - RNA, 12 nt, Homo sapiens
cgaugugcaagu

SEQ ID NO: 1014065 - RNA, 22 nt, Homo sapiens
cgauuucacaguguguuuguga

SEQ ID NO: 1014066 - RNA, 21 nt, Homo sapiens
cgcaacccacguguaacuguc

SEQ ID NO: 1014067 - RNA, 19 nt, Homo sapiens
cgcacaauaguaaccuggg

SEQ ID NO: 1014068 - RNA, 9 nt, Homo sapiens
cgcacacac

SEQ ID NO: 1014069 - RNA, 17 nt, Homo sapiens
cgcaccaauaaagccuu

SEQ ID NO: 1014070 - RNA, 16 nt, Homo sapiens
cgcaccacuguguauu

SEQ ID NO: 1014071 - RNA, 18 nt, Homo sapiens
cgccaaggcuggagugca

SEQ ID NO: 1014072 - RNA, 20 nt, Homo sapiens
cgccacccucccacugccaa

SEQ ID NO: 1014073 - RNA, 13 nt, Homo sapiens
cgccagacuguua

SEQ ID NO: 1014074 - RNA, 14 nt, Homo sapiens
cgccagauggggcc

SEQ ID NO: 1014075 - RNA, 18 nt, Homo sapiens
cgccauuuuugugcuuuu

SEQ ID NO: 1014076 - RNA, 21 nt, Homo sapiens
cgcccacuugucccacuaucu

SEQ ID NO: 1014077 - RNA, 21 nt, Homo sapiens
cgccccucauuuaucccucaa

SEQ ID NO: 1014078 - RNA, 14 nt, Homo sapiens
cgccgugaguucuc

SEQ ID NO: 1014079 - RNA, 15 nt, Homo sapiens
cgccuaugaucccag

SEQ ID NO: 1014080 - RNA, 21 nt, Homo sapiens
cgccuugccuccucacccacc

SEQ ID NO: 1014081 - RNA, 21 nt, Homo sapiens
cgcgagccaugauguggagug

SEQ ID NO: 1014082 - RNA, 20 nt, Homo sapiens
cgcgcaccuguaaucccagc

SEQ ID NO: 1014083 - RNA, 13 nt, Homo sapiens
cgcggcucuccag

SEQ ID NO: 1014084 - RNA, 22 nt, Homo sapiens
cgcuaaaugaaaaucgugacaa

SEQ ID NO: 1014085 - RNA, 20 nt, Homo sapiens
cgcuacccgggaagggggcu

SEQ ID NO: 1014086 - RNA, 10 nt, Homo sapiens
cgcucuggac

SEQ ID NO: 1014087 - RNA, 15 nt, Homo sapiens
cgcugcaaagccaua

SEQ ID NO: 1014088 - RNA, 12 nt, Homo sapiens
cggaacaguauc

SEQ ID NO: 1014089 - RNA, 16 nt, Homo sapiens
cggaagccaacuuggc

SEQ ID NO: 1014090 - RNA, 12 nt, Homo sapiens
cggaaucucagc

SEQ ID NO: 1014091 - RNA, 23 nt, Homo sapiens
cggacugcaagcagggcucugcc

SEQ ID NO: 1014092 - RNA, 15 nt, Homo sapiens
cggagaacaaaugug

SEQ ID NO: 1014093 - RNA, 20 nt, Homo sapiens
cggagaagagcuguucacag

SEQ ID NO: 1014094 - RNA, 22 nt, Homo sapiens
cggagaagagcuguucacagcc

SEQ ID NO: 1014095 - RNA, 11 nt, Homo sapiens
cggaggucucu

SEQ ID NO: 1014096 - RNA, 14 nt, Homo sapiens
cggaucuuuggaca

SEQ ID NO: 1014097 - RNA, 20 nt, Homo sapiens
gugucuguacacguguccug

SEQ ID NO: 1014098 - RNA, 13 nt, Homo sapiens
gugucuucaggag

SEQ ID NO: 1014099 - RNA, 16 nt, Homo sapiens
gugugacaucaguggc

SEQ ID NO: 1014100 - RNA, 15 nt, Homo sapiens
gugugagugugugca

SEQ ID NO: 1014101 - RNA, 13 nt, Homo sapiens
gugugaugugcau

SEQ ID NO: 1014102 - RNA, 19 nt, Homo sapiens
gugugcauugcugugaauu

SEQ ID NO: 1014103 - RNA, 20 nt, Homo sapiens
gugugccauagaguuuaaca

SEQ ID NO: 1014104 - RNA, 21 nt, Homo sapiens
gugugccuauagucgcagcua

SEQ ID NO: 1014105 - RNA, 19 nt, Homo sapiens
gugugccugucuguuacac

SEQ ID NO: 1014106 - RNA, 15 nt, Homo sapiens
gugugcgucacugug

SEQ ID NO: 1014107 - RNA, 14 nt, Homo sapiens
gugugcgugcaugu

SEQ ID NO: 1014108 - RNA, 19 nt, Homo sapiens
gugugggcugugaguguaa

SEQ ID NO: 1014109 - RNA, 19 nt, Homo sapiens
gugugggggaagcaccaua

SEQ ID NO: 1014110 - RNA, 22 nt, Homo sapiens
gugugguccagguccuuuccac

SEQ ID NO: 1014111 - RNA, 16 nt, Homo sapiens
guguguaguaaaguau

SEQ ID NO: 1014112 - RNA, 21 nt, Homo sapiens
guguguaugugcgugugugca

SEQ ID NO: 1014113 - RNA, 14 nt, Homo sapiens
guguguauugcaau

SEQ ID NO: 1014114 - RNA, 22 nt, Homo sapiens
guguguccaccugggcauaucc

SEQ ID NO: 1014115 - RNA, 13 nt, Homo sapiens
gugugugcaugug

SEQ ID NO: 1014116 - RNA, 17 nt, Homo sapiens
gugugugcgugugucca

SEQ ID NO: 1014117 - RNA, 19 nt, Homo sapiens
gugugugggaguguguaau

SEQ ID NO: 1014118 - RNA, 14 nt, Homo sapiens
guguuaaaugugau

SEQ ID NO: 1014119 - RNA, 18 nt, Homo sapiens
guguuaagcguucaguga

SEQ ID NO: 1014120 - RNA, 21 nt, Homo sapiens
guguuacgcacacguacuuaa

SEQ ID NO: 1014121 - RNA, 23 nt, Homo sapiens
acaguagggaugaguacccaaaa

SEQ ID NO: 1014122 - RNA, 17 nt, Homo sapiens
acaguagguuggcagua

SEQ ID NO: 1014123 - RNA, 16 nt, Homo sapiens
acaguaugagucaaug

SEQ ID NO: 1014124 - RNA, 18 nt, Homo sapiens
acaguaugagucaaugug

SEQ ID NO: 1014125 - RNA, 15 nt, Homo sapiens
acaguauuacuucug

SEQ ID NO: 1014126 - RNA, 16 nt, Homo sapiens
acaguauuuugguucu

SEQ ID NO: 1014127 - RNA, 14 nt, Homo sapiens
acaguccauugaaa

SEQ ID NO: 1014128 - RNA, 18 nt, Homo sapiens
acagucuuccauuugcaa

SEQ ID NO: 1014129 - RNA, 22 nt, Homo sapiens
acagucuuguauuaaguuguua

SEQ ID NO: 1014130 - RNA, 12 nt, Homo sapiens
acagugcauauu

SEQ ID NO: 1014131 - RNA, 23 nt, Homo sapiens
acagugcauauuccuuucuauca

SEQ ID NO: 1014132 - RNA, 14 nt, Homo sapiens
acagugcauuugcc

SEQ ID NO: 1014133 - RNA, 15 nt, Homo sapiens
acagugcauuugccu

SEQ ID NO: 1014134 - RNA, 20 nt, Homo sapiens
acagugcauuugccuuguca

SEQ ID NO: 1014135 - RNA, 13 nt, Homo sapiens
acagugccugcau

SEQ ID NO: 1014136 - RNA, 20 nt, Homo sapiens
acaguggcucacgccuguaa

SEQ ID NO: 1014137 - RNA, 14 nt, Homo sapiens
acagugggaaauau

SEQ ID NO: 1014138 - RNA, 19 nt, Homo sapiens
acaguguauguacuaagca

SEQ ID NO: 1014139 - RNA, 23 nt, Homo sapiens
acaguucaauucucauuugucac

SEQ ID NO: 1014140 - RNA, 16 nt, Homo sapiens
acaguuccuucagcuu

SEQ ID NO: 1014141 - RNA, 14 nt, Homo sapiens
acaguucugaagaa

SEQ ID NO: 1014142 - RNA, 22 nt, Homo sapiens
acaguugaaaaacagcugaggg

SEQ ID NO: 1014143 - RNA, 18 nt, Homo sapiens
acaguugaaagcuguauu

SEQ ID NO: 1014144 - RNA, 12 nt, Homo sapiens
acauaaacugac

SEQ ID NO: 1014145 - RNA, 14 nt, Homo sapiens
acauaaagccuugg

SEQ ID NO: 1014146 - RNA, 21 nt, Homo sapiens
acauaaauuacuuuuucauuc

SEQ ID NO: 1014147 - RNA, 17 nt, Homo sapiens
acauaaugcgugcauac

SEQ ID NO: 1014148 - RNA, 19 nt, Homo sapiens
acauacaggccauacuuua

SEQ ID NO: 1014149 - RNA, 19 nt, Homo sapiens
acauacuccuuccaucaaa

SEQ ID NO: 1014150 - RNA, 18 nt, Homo sapiens
acauacuggccuggacug

SEQ ID NO: 1014151 - RNA, 22 nt, Homo sapiens
acauagccuauauuuacaguga

SEQ ID NO: 1014152 - RNA, 16 nt, Homo sapiens
acauauauaugucagg

SEQ ID NO: 1014153 - RNA, 20 nt, Homo sapiens
acauaucaccucauggccua

SEQ ID NO: 1014154 - RNA, 22 nt, Homo sapiens
acauauuaggaaaauauggguu

SEQ ID NO: 1014155 - RNA, 16 nt, Homo sapiens
acauauuaugucuuca

SEQ ID NO: 1014156 - RNA, 23 nt, Homo sapiens
acauauucuuuaaauuucaucuc

SEQ ID NO: 1014157 - RNA, 12 nt, Homo sapiens
acauauuugcau

SEQ ID NO: 1014158 - RNA, 16 nt, Homo sapiens
acauauuuguggaaua

SEQ ID NO: 1014159 - RNA, 16 nt, Homo sapiens
acaucacaacauuuac

SEQ ID NO: 1014160 - RNA, 15 nt, Homo sapiens
acaucacucugcugc

SEQ ID NO: 1014161 - RNA, 18 nt, Homo sapiens
acaucagcuugcccuguu

SEQ ID NO: 1014162 - RNA, 13 nt, Homo sapiens
acaucagucacaa

SEQ ID NO: 1014163 - RNA, 18 nt, Homo sapiens
acaucaguuacucugaag

SEQ ID NO: 1014164 - RNA, 19 nt, Homo sapiens
acaucaguuuaaacaaagg

SEQ ID NO: 1014165 - RNA, 22 nt, Homo sapiens
acaucauuagaacaaaggacag

SEQ ID NO: 1014166 - RNA, 22 nt, Homo sapiens
acauccaaccccccaccugcca

SEQ ID NO: 1014167 - RNA, 19 nt, Homo sapiens
acauccagauagguuacca

SEQ ID NO: 1014168 - RNA, 15 nt, Homo sapiens
acauccagucacuuu

SEQ ID NO: 1014169 - RNA, 20 nt, Homo sapiens
acauccugaccuugcacaaa

SEQ ID NO: 1014170 - RNA, 17 nt, Homo sapiens
acauccuuaagucaaaa

SEQ ID NO: 1014171 - RNA, 17 nt, Homo sapiens
acaucuaguuaaucaua

SEQ ID NO: 1014172 - RNA, 21 nt, Homo sapiens
acaucuccuguggucucugac

SEQ ID NO: 1014173 - RNA, 14 nt, Homo sapiens
acaucucugcaauc

SEQ ID NO: 1014174 - RNA, 17 nt, Homo sapiens
acaucucuuugauguca

SEQ ID NO: 1014175 - RNA, 19 nt, Homo sapiens
acaucugcccugacugaau

SEQ ID NO: 1014176 - RNA, 14 nt, Homo sapiens
acaugaagaagcua

SEQ ID NO: 1014177 - RNA, 15 nt, Homo sapiens
acaugacucagcaua

SEQ ID NO: 1014178 - RNA, 16 nt, Homo sapiens
acaugagcuauuucca

SEQ ID NO: 1014179 - RNA, 20 nt, Homo sapiens
acaugauccugcaauuccac

SEQ ID NO: 1014180 - RNA, 16 nt, Homo sapiens
acaugcaauuuugcau

SEQ ID NO: 1014181 - RNA, 23 nt, Homo sapiens
acaugcacacacacacaucucau

SEQ ID NO: 1014182 - RNA, 15 nt, Homo sapiens
acaugcacgugugug

SEQ ID NO: 1014183 - RNA, 17 nt, Homo sapiens
acaugcagcccaugccc

SEQ ID NO: 1014184 - RNA, 17 nt, Homo sapiens
acaugcauugagcucuc

SEQ ID NO: 1014185 - RNA, 10 nt, Homo sapiens
acaugccagu

SEQ ID NO: 1014186 - RNA, 16 nt, Homo sapiens
acaugcucaaugacuc

SEQ ID NO: 1014187 - RNA, 15 nt, Homo sapiens
acauggaugccaacc

SEQ ID NO: 1014188 - RNA, 20 nt, Homo sapiens
acauggccagugugauccca

SEQ ID NO: 1014189 - RNA, 14 nt, Homo sapiens
acauggccuaugca

SEQ ID NO: 1014190 - RNA, 17 nt, Homo sapiens
acauggccuaugcacau

SEQ ID NO: 1014191 - RNA, 21 nt, Homo sapiens
acauggccuaugcacauaugg

SEQ ID NO: 1014192 - RNA, 22 nt, Homo sapiens
acaugguacgaauggcagcaua

SEQ ID NO: 1014193 - RNA, 19 nt, Homo sapiens
acauguaagcauaacuuau

SEQ ID NO: 1014194 - RNA, 19 nt, Homo sapiens
acaugugccgaaugugcag

SEQ ID NO: 1014195 - RNA, 13 nt, Homo sapiens
acaugugguggga

SEQ ID NO: 1014196 - RNA, 23 nt, Homo sapiens
acauguggugggacagggaccca

SEQ ID NO: 1014197 - RNA, 22 nt, Homo sapiens
acauguguagccugugcaugua

SEQ ID NO: 1014198 - RNA, 22 nt, Homo sapiens
acaugugugcgugugcgugcau

SEQ ID NO: 1014199 - RNA, 18 nt, Homo sapiens
acauguuacugaccagca

SEQ ID NO: 1014200 - RNA, 21 nt, Homo sapiens
acauguuccuuauauuuacuc

SEQ ID NO: 1014201 - RNA, 16 nt, Homo sapiens
acauuaaaucuaugaa

SEQ ID NO: 1014202 - RNA, 24 nt, Homo sapiens
acauuaaaucuaugaaguauauaa

SEQ ID NO: 1014203 - RNA, 13 nt, Homo sapiens
acauuaacuucag

SEQ ID NO: 1014204 - RNA, 20 nt, Homo sapiens
acauuacaguuagagauuuu

SEQ ID NO: 1014205 - RNA, 20 nt, Homo sapiens
acauuacuguauauacuuug

SEQ ID NO: 1014206 - RNA, 14 nt, Homo sapiens
acauuagucauuca

SEQ ID NO: 1014207 - RNA, 14 nt, Homo sapiens
acauuaucaucuga

SEQ ID NO: 1014208 - RNA, 13 nt, Homo sapiens
acauuaucucacu

SEQ ID NO: 1014209 - RNA, 17 nt, Homo sapiens
acauucagagcuuacuu

SEQ ID NO: 1014210 - RNA, 17 nt, Homo sapiens
acauuccugaugcuucu

SEQ ID NO: 1014211 - RNA, 18 nt, Homo sapiens
acauuccugggcacaguu

SEQ ID NO: 1014212 - RNA, 16 nt, Homo sapiens
acauucgaguguuuca

SEQ ID NO: 1014213 - RNA, 23 nt, Homo sapiens
acauucucugaccuacucgaggg

SEQ ID NO: 1014214 - RNA, 21 nt, Homo sapiens
acauucuuguuuuaagugccu

SEQ ID NO: 1014215 - RNA, 23 nt, Homo sapiens
acauucuuguuuuaagugccuuu

SEQ ID NO: 1014216 - RNA, 18 nt, Homo sapiens
acauucuuuaucuugaca

SEQ ID NO: 1014217 - RNA, 16 nt, Homo sapiens
acauugcuaagaugcu

SEQ ID NO: 1014218 - RNA, 16 nt, Homo sapiens
acauugcuugugccac

SEQ ID NO: 1014219 - RNA, 20 nt, Homo sapiens
acauugcuugugccacaccc

SEQ ID NO: 1014220 - RNA, 18 nt, Homo sapiens
acauugcuuuacugucaa

SEQ ID NO: 1014221 - RNA, 22 nt, Homo sapiens
acauuuacauguauuauuucau

SEQ ID NO: 1014222 - RNA, 18 nt, Homo sapiens
acauuuauucugcucaca

SEQ ID NO: 1014223 - RNA, 16 nt, Homo sapiens
acauuuauuuuucuca

SEQ ID NO: 1014224 - RNA, 22 nt, Homo sapiens
acauuuauuuuucucaugaauc

SEQ ID NO: 1014225 - RNA, 13 nt, Homo sapiens
acauuuccaugca

SEQ ID NO: 1014226 - RNA, 18 nt, Homo sapiens
acauuucccugugcugac

SEQ ID NO: 1014227 - RNA, 22 nt, Homo sapiens
acauuugaaaucuaugaaauau

SEQ ID NO: 1014228 - RNA, 23 nt, Homo sapiens
acauuugguuuguugagccuaau

SEQ ID NO: 1014229 - RNA, 12 nt, Homo sapiens
acauuuguucca

SEQ ID NO: 1014230 - RNA, 23 nt, Homo sapiens
acauuuuacuuuuuccuggcuca

SEQ ID NO: 1014231 - RNA, 14 nt, Homo sapiens
accaaagagacugg

SEQ ID NO: 1014232 - RNA, 17 nt, Homo sapiens
accaaagccaccacauu

SEQ ID NO: 1014233 - RNA, 22 nt, Homo sapiens
accaaagccaccagacugacaa

SEQ ID NO: 1014234 - RNA, 17 nt, Homo sapiens
accaaaucagcugcuac

SEQ ID NO: 1014235 - RNA, 17 nt, Homo sapiens
accaacaguuccuucag

SEQ ID NO: 1014236 - RNA, 11 nt, Homo sapiens
accaaccuggg

SEQ ID NO: 1014237 - RNA, 13 nt, Homo sapiens
accaaccuguuac

SEQ ID NO: 1014238 - RNA, 20 nt, Homo sapiens
accaacugcugcugugcaca

SEQ ID NO: 1014239 - RNA, 15 nt, Homo sapiens
accaagacucugaaa

SEQ ID NO: 1014240 - RNA, 15 nt, Homo sapiens
accaagcuuguccaa

SEQ ID NO: 1014241 - RNA, 13 nt, Homo sapiens
uucuugcagauca

SEQ ID NO: 1014242 - RNA, 20 nt, Homo sapiens
uucuuguauauuauggaaga

SEQ ID NO: 1014243 - RNA, 20 nt, Homo sapiens
uucuuuaaaaaaacacauaa

SEQ ID NO: 1014244 - RNA, 21 nt, Homo sapiens
uucuuuaaaaaaacacauaau

SEQ ID NO: 1014245 - RNA, 17 nt, Homo sapiens
uucuuuaagucaguuca

SEQ ID NO: 1014246 - RNA, 13 nt, Homo sapiens
uucuuuauacugu

SEQ ID NO: 1014247 - RNA, 13 nt, Homo sapiens
uucuuugaaguuu

SEQ ID NO: 1014248 - RNA, 22 nt, Homo sapiens
uucuuugccuguucaguuacag

SEQ ID NO: 1014249 - RNA, 20 nt, Homo sapiens
uucuuugggauugcuaugaa

SEQ ID NO: 1014250 - RNA, 20 nt, Homo sapiens
uugaaaaaaaacccuugauu

SEQ ID NO: 1014251 - RNA, 13 nt, Homo sapiens
uugaaaaaguaua

SEQ ID NO: 1014252 - RNA, 12 nt, Homo sapiens
uugaaaaccugg

SEQ ID NO: 1014253 - RNA, 14 nt, Homo sapiens
uugaaaauguucag

SEQ ID NO: 1014254 - RNA, 13 nt, Homo sapiens
uugaaaccaaaga

SEQ ID NO: 1014255 - RNA, 16 nt, Homo sapiens
uugaaaccccaucucu

SEQ ID NO: 1014256 - RNA, 14 nt, Homo sapiens
uugaaacugaaugu

SEQ ID NO: 1014257 - RNA, 19 nt, Homo sapiens
uugaaauaagaaagugcga

SEQ ID NO: 1014258 - RNA, 16 nt, Homo sapiens
uugaaauaccagugaa

SEQ ID NO: 1014259 - RNA, 20 nt, Homo sapiens
uugaaauauaggaacuuaaa

SEQ ID NO: 1014260 - RNA, 19 nt, Homo sapiens
uugaaaucagcauacucaa

SEQ ID NO: 1014261 - RNA, 17 nt, Homo sapiens
uugaacacucaugcuga

SEQ ID NO: 1014262 - RNA, 15 nt, Homo sapiens
uugaacucuguaaaa

SEQ ID NO: 1014263 - RNA, 21 nt, Homo sapiens
uugaacucuuugaaugacaaa

SEQ ID NO: 1014264 - RNA, 21 nt, Homo sapiens
uugaacugauaguuacuguug

SEQ ID NO: 1014265 - RNA, 21 nt, Homo sapiens
uugaacuuaaauaaaugucau

SEQ ID NO: 1014266 - RNA, 16 nt, Homo sapiens
uugaagcuagugcauu

SEQ ID NO: 1014267 - RNA, 13 nt, Homo sapiens
uugaaggugcugu

SEQ ID NO: 1014268 - RNA, 16 nt, Homo sapiens
uugaauauaaacacua

SEQ ID NO: 1014269 - RNA, 15 nt, Homo sapiens
uugaaugcagggaca

SEQ ID NO: 1014270 - RNA, 21 nt, Homo sapiens
uugaauggguccauuuugccc

SEQ ID NO: 1014271 - RNA, 21 nt, Homo sapiens
uugaauguaaaaauuggucac

SEQ ID NO: 1014272 - RNA, 17 nt, Homo sapiens
uugacaaccaugagacc

SEQ ID NO: 1014273 - RNA, 20 nt, Homo sapiens
uugacacuuaaaaaugguuu

SEQ ID NO: 1014274 - RNA, 13 nt, Homo sapiens
uugacaggauuau

SEQ ID NO: 1014275 - RNA, 19 nt, Homo sapiens
uugacaguucauauguacc

SEQ ID NO: 1014276 - RNA, 13 nt, Homo sapiens
uugacaguuucaa

SEQ ID NO: 1014277 - RNA, 14 nt, Homo sapiens
uugacauaacacua

SEQ ID NO: 1014278 - RNA, 18 nt, Homo sapiens
uugacauaauuucacuga

SEQ ID NO: 1014279 - RNA, 11 nt, Homo sapiens
uugaccacaga

SEQ ID NO: 1014280 - RNA, 21 nt, Homo sapiens
uugacgacagugcauuugccu

SEQ ID NO: 1014281 - RNA, 22 nt, Homo sapiens
uugacuagggauucaggcugcu

SEQ ID NO: 1014282 - RNA, 15 nt, Homo sapiens
uugacucuccagaaa

SEQ ID NO: 1014283 - RNA, 18 nt, Homo sapiens
uugacucuugcaauccac

SEQ ID NO: 1014284 - RNA, 16 nt, Homo sapiens
uugacuggauauucau

SEQ ID NO: 1014285 - RNA, 17 nt, Homo sapiens
uugacuucgacugugac

SEQ ID NO: 1014286 - RNA, 20 nt, Homo sapiens
uugagaaauuaaguaucuga

SEQ ID NO: 1014287 - RNA, 14 nt, Homo sapiens
uugagaagcacugu

SEQ ID NO: 1014288 - RNA, 18 nt, Homo sapiens
uugagcaccgucauggcu

SEQ ID NO: 1014289 - RNA, 18 nt, Homo sapiens
uugagcccacaaagccuu

SEQ ID NO: 1014290 - RNA, 20 nt, Homo sapiens
uugagcucaggaguuugaga

SEQ ID NO: 1014291 - RNA, 15 nt, Homo sapiens
uugagcuccccaaaa

SEQ ID NO: 1014292 - RNA, 21 nt, Homo sapiens
uugagcucugcagcccaggga

SEQ ID NO: 1014293 - RNA, 22 nt, Homo sapiens
uugagcuuucaugaguuuccca

SEQ ID NO: 1014294 - RNA, 18 nt, Homo sapiens
uugaggaaacaacagcuu

SEQ ID NO: 1014295 - RNA, 23 nt, Homo sapiens
uugaggauaggaguucacuucau

SEQ ID NO: 1014296 - RNA, 20 nt, Homo sapiens
uugaggccugcccucaggga

SEQ ID NO: 1014297 - RNA, 12 nt, Homo sapiens
uugaggcuuuca

SEQ ID NO: 1014298 - RNA, 21 nt, Homo sapiens
uugagguuuccuucagacaga

SEQ ID NO: 1014299 - RNA, 20 nt, Homo sapiens
uugaguccagaaguuugaga

SEQ ID NO: 1014300 - RNA, 22 nt, Homo sapiens
uugauaagagggcacacacugu

SEQ ID NO: 1014301 - RNA, 16 nt, Homo sapiens
uugauaauugcauuca

SEQ ID NO: 1014302 - RNA, 17 nt, Homo sapiens
uugauagauuucuacac

SEQ ID NO: 1014303 - RNA, 21 nt, Homo sapiens
uugauagauuucuacacugag

SEQ ID NO: 1014304 - RNA, 19 nt, Homo sapiens
uugauaggauguggauuaa

SEQ ID NO: 1014305 - RNA, 22 nt, Homo sapiens
uugauauacuauuuucauucuc

SEQ ID NO: 1014306 - RNA, 19 nt, Homo sapiens
uugauauuuuccaaaugga

SEQ ID NO: 1014307 - RNA, 18 nt, Homo sapiens
uugauguuuguggccuca

SEQ ID NO: 1014308 - RNA, 15 nt, Homo sapiens
uugauuagacuccua

SEQ ID NO: 1014309 - RNA, 23 nt, Homo sapiens
uugauuauucugauuccacuuuu

SEQ ID NO: 1014310 - RNA, 13 nt, Homo sapiens
uugauuauuguau

SEQ ID NO: 1014311 - RNA, 22 nt, Homo sapiens
uugauucacaaugaaaugcucu

SEQ ID NO: 1014312 - RNA, 15 nt, Homo sapiens
uugauuucuuuccag

SEQ ID NO: 1014313 - RNA, 14 nt, Homo sapiens
uugcaacacacaga

SEQ ID NO: 1014314 - RNA, 17 nt, Homo sapiens
uugcaaccacugcaacg

SEQ ID NO: 1014315 - RNA, 22 nt, Homo sapiens
uugcaaccucgcuggacucuca

SEQ ID NO: 1014316 - RNA, 13 nt, Homo sapiens
uugcaaggcauuu

SEQ ID NO: 1014317 - RNA, 12 nt, Homo sapiens
uugcacuccagc

SEQ ID NO: 1014318 - RNA, 14 nt, Homo sapiens
caucguggagacag

SEQ ID NO: 1014319 - RNA, 18 nt, Homo sapiens
caucguggagacagggca

SEQ ID NO: 1014320 - RNA, 21 nt, Homo sapiens
caucguggggcucucaguucc

SEQ ID NO: 1014321 - RNA, 16 nt, Homo sapiens
caucuaaauaccugcc

SEQ ID NO: 1014322 - RNA, 21 nt, Homo sapiens
caucuagggaguaugaagaau

SEQ ID NO: 1014323 - RNA, 19 nt, Homo sapiens
caucuauaaagaagaacuu

SEQ ID NO: 1014324 - RNA, 22 nt, Homo sapiens
caucuauaaagaagaacuugca

SEQ ID NO: 1014325 - RNA, 13 nt, Homo sapiens
caucucaaggaau

SEQ ID NO: 1014326 - RNA, 19 nt, Homo sapiens
caucucaggccucccucaa

SEQ ID NO: 1014327 - RNA, 15 nt, Homo sapiens
caucucaggggccag

SEQ ID NO: 1014328 - RNA, 15 nt, Homo sapiens
caucucagugcagga

SEQ ID NO: 1014329 - RNA, 13 nt, Homo sapiens
caucucauuccaa

SEQ ID NO: 1014330 - RNA, 16 nt, Homo sapiens
caucucauuccaacuu

SEQ ID NO: 1014331 - RNA, 21 nt, Homo sapiens
caucucccagauaaugugaaa

SEQ ID NO: 1014332 - RNA, 17 nt, Homo sapiens
caucucuggaugccuga

SEQ ID NO: 1014333 - RNA, 11 nt, Homo sapiens
caucucugucu

SEQ ID NO: 1014334 - RNA, 15 nt, Homo sapiens
caucucugucucaaa

SEQ ID NO: 1014335 - RNA, 12 nt, Homo sapiens
caucucuuugau

SEQ ID NO: 1014336 - RNA, 17 nt, Homo sapiens
caucucuuuugagcuaa

SEQ ID NO: 1014337 - RNA, 12 nt, Homo sapiens
caucugacucac

SEQ ID NO: 1014338 - RNA, 14 nt, Homo sapiens
caucugcucagcag

SEQ ID NO: 1014339 - RNA, 18 nt, Homo sapiens
caucugcuuuacucugga

SEQ ID NO: 1014340 - RNA, 19 nt, Homo sapiens
caucuucaaagcuugaaga

SEQ ID NO: 1014341 - RNA, 11 nt, Homo sapiens
caucuuccaag

SEQ ID NO: 1014342 - RNA, 21 nt, Homo sapiens
caucuugaccaagcaggaagc

SEQ ID NO: 1014343 - RNA, 22 nt, Homo sapiens
caucuugcucugcugacagaca

SEQ ID NO: 1014344 - RNA, 18 nt, Homo sapiens
caucuuggggacaucucu

SEQ ID NO: 1014345 - RNA, 17 nt, Homo sapiens
caucuuggucacauaca

SEQ ID NO: 1014346 - RNA, 19 nt, Homo sapiens
caucuuggucacauacaau

SEQ ID NO: 1014347 - RNA, 18 nt, Homo sapiens
caucuuuuacauucugca

SEQ ID NO: 1014348 - RNA, 18 nt, Homo sapiens
caugaaaaaaaugauccc

SEQ ID NO: 1014349 - RNA, 18 nt, Homo sapiens
caugaaacauguucucaa

SEQ ID NO: 1014350 - RNA, 23 nt, Homo sapiens
caugaacaucuuuaggagacuaa

SEQ ID NO: 1014351 - RNA, 13 nt, Homo sapiens
caugaagaccaca

SEQ ID NO: 1014352 - RNA, 15 nt, Homo sapiens
caugaaggaugccaa

SEQ ID NO: 1014353 - RNA, 17 nt, Homo sapiens
caugaaggcagagccau

SEQ ID NO: 1014354 - RNA, 19 nt, Homo sapiens
caugaaguaauaugcacac

SEQ ID NO: 1014355 - RNA, 20 nt, Homo sapiens
caugaaguguguuuccuuca

SEQ ID NO: 1014356 - RNA, 15 nt, Homo sapiens
caugaaucaaagaca

SEQ ID NO: 1014357 - RNA, 23 nt, Homo sapiens
caugaaucccacccacaugugac

SEQ ID NO: 1014358 - RNA, 14 nt, Homo sapiens
caugaauuccuuaa

SEQ ID NO: 1014359 - RNA, 14 nt, Homo sapiens
caugaauucuguca

SEQ ID NO: 1014360 - RNA, 23 nt, Homo sapiens
caugaccaaaugcuuuuccucaa

SEQ ID NO: 1014361 - RNA, 17 nt, Homo sapiens
caugaccacauagcaug

SEQ ID NO: 1014362 - RNA, 13 nt, Homo sapiens
caugaccuggaaa

SEQ ID NO: 1014363 - RNA, 19 nt, Homo sapiens
caugacucagcauaccugc

SEQ ID NO: 1014364 - RNA, 20 nt, Homo sapiens
caugacucguauaugucuca

SEQ ID NO: 1014365 - RNA, 19 nt, Homo sapiens
caugagaccacuguuauca

SEQ ID NO: 1014366 - RNA, 22 nt, Homo sapiens
caugagauuuauaagguuuuaa

SEQ ID NO: 1014367 - RNA, 15 nt, Homo sapiens
caugaggaacuagcc

SEQ ID NO: 1014368 - RNA, 15 nt, Homo sapiens
caugaggaccaggug

SEQ ID NO: 1014369 - RNA, 17 nt, Homo sapiens
caugagguacagcagaa

SEQ ID NO: 1014370 - RNA, 20 nt, Homo sapiens
caugaucuugugacauauua

SEQ ID NO: 1014371 - RNA, 19 nt, Homo sapiens
caugauguuaaccagaaua

SEQ ID NO: 1014372 - RNA, 19 nt, Homo sapiens
caugcaaggggaaaaucuc

SEQ ID NO: 1014373 - RNA, 11 nt, Homo sapiens
caugcacacac

SEQ ID NO: 1014374 - RNA, 14 nt, Homo sapiens
caugcacacacaca

SEQ ID NO: 1014375 - RNA, 11 nt, Homo sapiens
caugcauuuga

SEQ ID NO: 1014376 - RNA, 21 nt, Homo sapiens
caugcauuuugcagcagugag

SEQ ID NO: 1014377 - RNA, 15 nt, Homo sapiens
caugccaagcacugu

SEQ ID NO: 1014378 - RNA, 14 nt, Homo sapiens
caugcccagcugcu

SEQ ID NO: 1014379 - RNA, 15 nt, Homo sapiens
caugcccccaguuac

SEQ ID NO: 1014380 - RNA, 13 nt, Homo sapiens
caugcccucaauc

SEQ ID NO: 1014381 - RNA, 23 nt, Homo sapiens
caugcccuggauccaucaggcca

SEQ ID NO: 1014382 - RNA, 18 nt, Homo sapiens
caugccgggcgcaguggc

SEQ ID NO: 1014383 - RNA, 16 nt, Homo sapiens
caugccuauuucugaa

SEQ ID NO: 1014384 - RNA, 22 nt, Homo sapiens
caugccuguaaucccagcacuu

SEQ ID NO: 1014385 - RNA, 17 nt, Homo sapiens
caugccuguagucccag

SEQ ID NO: 1014386 - RNA, 11 nt, Homo sapiens
uuuaugugcaa

SEQ ID NO: 1014387 - RNA, 18 nt, Homo sapiens
uuuaugugcucuccaaau

SEQ ID NO: 1014388 - RNA, 15 nt, Homo sapiens
uuuauugcugaauga

SEQ ID NO: 1014389 - RNA, 14 nt, Homo sapiens
uuuauugcuuguug

SEQ ID NO: 1014390 - RNA, 15 nt, Homo sapiens
uuuauuuaacuauuc

SEQ ID NO: 1014391 - RNA, 16 nt, Homo sapiens
uuuauuuaacuauuca

SEQ ID NO: 1014392 - RNA, 18 nt, Homo sapiens
uuuauuuaagcaucaaau

SEQ ID NO: 1014393 - RNA, 23 nt, Homo sapiens
uuuauuugagacagagucucacu

SEQ ID NO: 1014394 - RNA, 16 nt, Homo sapiens
uuuauuuuucucauga

SEQ ID NO: 1014395 - RNA, 13 nt, Homo sapiens
uuucaaacacaaa

SEQ ID NO: 1014396 - RNA, 12 nt, Homo sapiens
uuucaaacuuua

SEQ ID NO: 1014397 - RNA, 23 nt, Homo sapiens
uuucaaagaaggaauucuaggca

SEQ ID NO: 1014398 - RNA, 16 nt, Homo sapiens
uuucaaauugagagaa

SEQ ID NO: 1014399 - RNA, 19 nt, Homo sapiens
uuucaaguguaacuuauua

SEQ ID NO: 1014400 - RNA, 17 nt, Homo sapiens
uuucaauaaaccuaaua

SEQ ID NO: 1014401 - RNA, 17 nt, Homo sapiens
uuucaaucaaaacucag

SEQ ID NO: 1014402 - RNA, 12 nt, Homo sapiens
uuucaauugcau

SEQ ID NO: 1014403 - RNA, 20 nt, Homo sapiens
uuucacacaauacaauaagu

SEQ ID NO: 1014404 - RNA, 14 nt, Homo sapiens
uuucacauaugugu

SEQ ID NO: 1014405 - RNA, 14 nt, Homo sapiens
uuucacuaccuauc

SEQ ID NO: 1014406 - RNA, 20 nt, Homo sapiens
uuucagaagcucuucuaaaa

SEQ ID NO: 1014407 - RNA, 15 nt, Homo sapiens
uuucagaucauggca

SEQ ID NO: 1014408 - RNA, 17 nt, Homo sapiens
uuucaggauacaugugc

SEQ ID NO: 1014409 - RNA, 21 nt, Homo sapiens
uuucaggccacauggcuaaag

SEQ ID NO: 1014410 - RNA, 18 nt, Homo sapiens
uuucagguuccaaucaga

SEQ ID NO: 1014411 - RNA, 19 nt, Homo sapiens
uuucagguuccaaucagaa

SEQ ID NO: 1014412 - RNA, 19 nt, Homo sapiens
uuucauaccuaucaucuua

SEQ ID NO: 1014413 - RNA, 17 nt, Homo sapiens
uuucaucauaacauaaa

SEQ ID NO: 1014414 - RNA, 15 nt, Homo sapiens
uuucaucuaauguga

SEQ ID NO: 1014415 - RNA, 19 nt, Homo sapiens
uuucauguuuugugacuau

SEQ ID NO: 1014416 - RNA, 12 nt, Homo sapiens
uuucauucacuu

SEQ ID NO: 1014417 - RNA, 22 nt, Homo sapiens
uuucauuccuaacacagcaugu

SEQ ID NO: 1014418 - RNA, 18 nt, Homo sapiens
uuucauuguguucucuau

SEQ ID NO: 1014419 - RNA, 17 nt, Homo sapiens
uuuccaaaggccaugga

SEQ ID NO: 1014420 - RNA, 17 nt, Homo sapiens
uuucccaucuccauugu

SEQ ID NO: 1014421 - RNA, 12 nt, Homo sapiens
uuucccauuuca

SEQ ID NO: 1014422 - RNA, 13 nt, Homo sapiens
uuuccccagacac

SEQ ID NO: 1014423 - RNA, 17 nt, Homo sapiens
uuucccugcuagggguu

SEQ ID NO: 1014424 - RNA, 18 nt, Homo sapiens
uuuccuaaaugcagugaa

SEQ ID NO: 1014425 - RNA, 16 nt, Homo sapiens
uuuccuaggcagauca

SEQ ID NO: 1014426 - RNA, 15 nt, Homo sapiens
uuuccuccaggcaaa

SEQ ID NO: 1014427 - RNA, 21 nt, Homo sapiens
uuuccucuuccccuugcccuu

SEQ ID NO: 1014428 - RNA, 16 nt, Homo sapiens
uuuccuuaaacugugu

SEQ ID NO: 1014429 - RNA, 15 nt, Homo sapiens
uuuccuucagugcau

SEQ ID NO: 1014430 - RNA, 14 nt, Homo sapiens
uuuccuugcucaac

SEQ ID NO: 1014431 - RNA, 15 nt, Homo sapiens
uuuccuuucauuuac

SEQ ID NO: 1014432 - RNA, 18 nt, Homo sapiens
uuuccuuuguaaguuccu

SEQ ID NO: 1014433 - RNA, 15 nt, Homo sapiens
uuuccuuuuaugaga

SEQ ID NO: 1014434 - RNA, 20 nt, Homo sapiens
uuucgaucccugggaccaac

SEQ ID NO: 1014435 - RNA, 22 nt, Homo sapiens
uuucuauaauguugucauuuca

SEQ ID NO: 1014436 - RNA, 15 nt, Homo sapiens
uuucuauaccugucu

SEQ ID NO: 1014437 - RNA, 16 nt, Homo sapiens
uuucuaucacauauuu

SEQ ID NO: 1014438 - RNA, 12 nt, Homo sapiens
uuucucacugag

SEQ ID NO: 1014439 - RNA, 19 nt, Homo sapiens
uuucucuccaucagaauga

SEQ ID NO: 1014440 - RNA, 23 nt, Homo sapiens
uuucucuggccccaagggcaaaa

SEQ ID NO: 1014441 - RNA, 14 nt, Homo sapiens
uuucugaguuucau

SEQ ID NO: 1014442 - RNA, 22 nt, Homo sapiens
uuucugcuaaaaaguccuugau

SEQ ID NO: 1014443 - RNA, 17 nt, Homo sapiens
uuucuggaaaacugccu

SEQ ID NO: 1014444 - RNA, 20 nt, Homo sapiens
uuucuggugaugcccaaaga

SEQ ID NO: 1014445 - RNA, 16 nt, Homo sapiens
uuucugucacaucagc

SEQ ID NO: 1014446 - RNA, 19 nt, Homo sapiens
uuucuguuauuaacaaaca

SEQ ID NO: 1014447 - RNA, 16 nt, Homo sapiens
uuucuucaugcaauga

SEQ ID NO: 1014448 - RNA, 17 nt, Homo sapiens
uuucuugcagaucaaau

SEQ ID NO: 1014449 - RNA, 18 nt, Homo sapiens
uuucuuuaagucaguuca

SEQ ID NO: 1014450 - RNA, 22 nt, Homo sapiens
uuucuuuaauaguuuugauccu

SEQ ID NO: 1014451 - RNA, 19 nt, Homo sapiens
uuucuuuaccugagaccag

SEQ ID NO: 1014452 - RNA, 18 nt, Homo sapiens
uuugaaaaacaaacagaa

SEQ ID NO: 1014453 - RNA, 22 nt, Homo sapiens
uuugaaaacauauaaagcacua

SEQ ID NO: 1014454 - RNA, 15 nt, Homo sapiens
uuugaaaucuaugaa

SEQ ID NO: 1014455 - RNA, 13 nt, Homo sapiens
uuugaagcaaagc

SEQ ID NO: 1014456 - RNA, 18 nt, Homo sapiens
uuugaagcaucacauaaa

SEQ ID NO: 1014457 - RNA, 13 nt, Homo sapiens
uuugaaugacaaa

SEQ ID NO: 1014458 - RNA, 19 nt, Homo sapiens
uuugaccucauuuguaaaa

SEQ ID NO: 1014459 - RNA, 21 nt, Homo sapiens
uuugacgacagugcauuugcc

SEQ ID NO: 1014460 - RNA, 23 nt, Homo sapiens
uuugacuuugguuguguuuaaau

SEQ ID NO: 1014461 - RNA, 10 nt, Homo sapiens
uuugagacag

SEQ ID NO: 1014462 - RNA, 19 nt, Homo sapiens
uuugagacggagucucgcu

SEQ ID NO: 1014463 - RNA, 21 nt, Homo sapiens
uuugagcccacaaagccuuau

SEQ ID NO: 1014464 - RNA, 23 nt, Homo sapiens
uuugaggauaggaguucacuuca

SEQ ID NO: 1014465 - RNA, 16 nt, Homo sapiens
uuugagguuuccuuca

SEQ ID NO: 1014466 - RNA, 17 nt, Homo sapiens
uuugauaggauguggau

SEQ ID NO: 1014467 - RNA, 18 nt, Homo sapiens
uuugauaugaaguguuag

SEQ ID NO: 1014468 - RNA, 18 nt, Homo sapiens
uuugaugguaaccauaau

SEQ ID NO: 1014469 - RNA, 15 nt, Homo sapiens
uuugauuauucagug

SEQ ID NO: 1014470 - RNA, 16 nt, Homo sapiens
uuugcaccugcucucu

SEQ ID NO: 1014471 - RNA, 19 nt, Homo sapiens
uuugcacuugucuuugacu

SEQ ID NO: 1014472 - RNA, 14 nt, Homo sapiens
uuugcagaugacaa

SEQ ID NO: 1014473 - RNA, 15 nt, Homo sapiens
uuugcaguucaccug

SEQ ID NO: 1014474 - RNA, 15 nt, Homo sapiens
uuugcauguuuugua

SEQ ID NO: 1014475 - RNA, 23 nt, Homo sapiens
uuugcauuugcucuuucaucucu

SEQ ID NO: 1014476 - RNA, 22 nt, Homo sapiens
uuugccuguucaguuacagaaa

SEQ ID NO: 1014477 - RNA, 18 nt, Homo sapiens
uuugcuagcagaaaucua

SEQ ID NO: 1014478 - RNA, 16 nt, Homo sapiens
uuugcuguugcauugu

SEQ ID NO: 1014479 - RNA, 19 nt, Homo sapiens
uuugcuucaaaaacauucu

SEQ ID NO: 1014480 - RNA, 22 nt, Homo sapiens
ccaccacauuuagaacuuuggc

SEQ ID NO: 1014481 - RNA, 17 nt, Homo sapiens
ccaccaccucaccaguu

SEQ ID NO: 1014482 - RNA, 16 nt, Homo sapiens
ccaccacuucuuuuau

SEQ ID NO: 1014483 - RNA, 16 nt, Homo sapiens
ccaccagccugcacua

SEQ ID NO: 1014484 - RNA, 21 nt, Homo sapiens
ccaccaucaaccccccaaguc

SEQ ID NO: 1014485 - RNA, 19 nt, Homo sapiens
ccacccaagcuuggcagcc

SEQ ID NO: 1014486 - RNA, 20 nt, Homo sapiens
ccacccaaugcugauguccu

SEQ ID NO: 1014487 - RNA, 13 nt, Homo sapiens
ccacccacaugug

SEQ ID NO: 1014488 - RNA, 14 nt, Homo sapiens
ccacccgaugcugc

SEQ ID NO: 1014489 - RNA, 17 nt, Homo sapiens
ccacccuccugucuucc

SEQ ID NO: 1014490 - RNA, 20 nt, Homo sapiens
ccacccuccuuucaccacau

SEQ ID NO: 1014491 - RNA, 13 nt, Homo sapiens
ccaccuagacugu

SEQ ID NO: 1014492 - RNA, 15 nt, Homo sapiens
ccaccuaugugccaa

SEQ ID NO: 1014493 - RNA, 14 nt, Homo sapiens
ccaccucuucacuc

SEQ ID NO: 1014494 - RNA, 16 nt, Homo sapiens
ccaccugccugcaucu

SEQ ID NO: 1014495 - RNA, 22 nt, Homo sapiens
ccaccugccugcaucugugaaa

SEQ ID NO: 1014496 - RNA, 13 nt, Homo sapiens
ccaccugucucag

SEQ ID NO: 1014497 - RNA, 21 nt, Homo sapiens
ccaccuuccccagaaccaggg

SEQ ID NO: 1014498 - RNA, 12 nt, Homo sapiens
ccaccuucuuca

SEQ ID NO: 1014499 - RNA, 20 nt, Homo sapiens
ccacgaccuuugaagagcuu

SEQ ID NO: 1014500 - RNA, 16 nt, Homo sapiens
ccacgucaacagaauu

SEQ ID NO: 1014501 - RNA, 20 nt, Homo sapiens
ccacgucugcuaacuuggag

SEQ ID NO: 1014502 - RNA, 20 nt, Homo sapiens
ccacgugggcaaacaggcag

SEQ ID NO: 1014503 - RNA, 19 nt, Homo sapiens
ccacguucucacacccacc

SEQ ID NO: 1014504 - RNA, 22 nt, Homo sapiens
ccacuaggguccaccaggaguu

SEQ ID NO: 1014505 - RNA, 19 nt, Homo sapiens
ccacuauugcuugcacaaa

SEQ ID NO: 1014506 - RNA, 18 nt, Homo sapiens
ccacucaggggucauuca

SEQ ID NO: 1014507 - RNA, 19 nt, Homo sapiens
ccacucaggggucauucau

SEQ ID NO: 1014508 - RNA, 14 nt, Homo sapiens
ccacuccuguacac

SEQ ID NO: 1014509 - RNA, 19 nt, Homo sapiens
ccacugcacccagcuaauu

SEQ ID NO: 1014510 - RNA, 18 nt, Homo sapiens
ccacugcagaagacagua

SEQ ID NO: 1014511 - RNA, 16 nt, Homo sapiens
ccacugccucagguuc

SEQ ID NO: 1014512 - RNA, 14 nt, Homo sapiens
ccacugccugggau

SEQ ID NO: 1014513 - RNA, 19 nt, Homo sapiens
ccacugcguuguccacaag

SEQ ID NO: 1014514 - RNA, 18 nt, Homo sapiens
ccacuggaaaaguguaau

SEQ ID NO: 1014515 - RNA, 23 nt, Homo sapiens
ccacuuaccuagauucuacauau

SEQ ID NO: 1014516 - RNA, 16 nt, Homo sapiens
ccacuucucucaggau

SEQ ID NO: 1014517 - RNA, 12 nt, Homo sapiens
ccagaaaugucu

SEQ ID NO: 1014518 - RNA, 17 nt, Homo sapiens
ccagaacaguuuguaca

SEQ ID NO: 1014519 - RNA, 21 nt, Homo sapiens
ccagaaccuggacauuggcca

SEQ ID NO: 1014520 - RNA, 18 nt, Homo sapiens
ccagaacuggacucagga

SEQ ID NO: 1014521 - RNA, 19 nt, Homo sapiens
ccagaacuggacucaggau

SEQ ID NO: 1014522 - RNA, 17 nt, Homo sapiens
ccagaagcugagcacca

SEQ ID NO: 1014523 - RNA, 15 nt, Homo sapiens
ccagaaguuccucaa

SEQ ID NO: 1014524 - RNA, 19 nt, Homo sapiens
ccagacaccgccacauggc

SEQ ID NO: 1014525 - RNA, 23 nt, Homo sapiens
ccagacagcaacggggaggccaa

SEQ ID NO: 1014526 - RNA, 13 nt, Homo sapiens
ccagacagcuccc

SEQ ID NO: 1014527 - RNA, 20 nt, Homo sapiens
ccagaccauucaggacacag

SEQ ID NO: 1014528 - RNA, 13 nt, Homo sapiens
ccagacccggcug

SEQ ID NO: 1014529 - RNA, 14 nt, Homo sapiens
ccagacugucucaa

SEQ ID NO: 1014530 - RNA, 15 nt, Homo sapiens
ccagacugucucaaa

SEQ ID NO: 1014531 - RNA, 16 nt, Homo sapiens
cugacugaauguguuc

SEQ ID NO: 1014532 - RNA, 16 nt, Homo sapiens
cugacuggcacagucu

SEQ ID NO: 1014533 - RNA, 14 nt, Homo sapiens
cugacugugugugg

SEQ ID NO: 1014534 - RNA, 17 nt, Homo sapiens
cugagaaaagccucucc

SEQ ID NO: 1014535 - RNA, 20 nt, Homo sapiens
cugagaauauaauacuguau

SEQ ID NO: 1014536 - RNA, 14 nt, Homo sapiens
cugagaccaaagaa

SEQ ID NO: 1014537 - RNA, 17 nt, Homo sapiens
cugagacuuggcuccac

SEQ ID NO: 1014538 - RNA, 17 nt, Homo sapiens
cugagaggggcugucca

SEQ ID NO: 1014539 - RNA, 18 nt, Homo sapiens
cugagaugugaacacauc

SEQ ID NO: 1014540 - RNA, 23 nt, Homo sapiens
cugagcagguguucuucauuacc

SEQ ID NO: 1014541 - RNA, 21 nt, Homo sapiens
cugagcagugccagcuuucuu

SEQ ID NO: 1014542 - RNA, 17 nt, Homo sapiens
cugagccacaggcauuu

SEQ ID NO: 1014543 - RNA, 20 nt, Homo sapiens
cugagcccccacugcuucua

SEQ ID NO: 1014544 - RNA, 17 nt, Homo sapiens
cugagccccuaccccac

SEQ ID NO: 1014545 - RNA, 13 nt, Homo sapiens
cugagcucaaggu

SEQ ID NO: 1014546 - RNA, 17 nt, Homo sapiens
cugagcucgguggaccc

SEQ ID NO: 1014547 - RNA, 20 nt, Homo sapiens
cugagcugccuguaacuuga

SEQ ID NO: 1014548 - RNA, 17 nt, Homo sapiens
cugaggacacucagugu

SEQ ID NO: 1014549 - RNA, 14 nt, Homo sapiens
cugaggacauucca

SEQ ID NO: 1014550 - RNA, 14 nt, Homo sapiens
cugaggcaagagaa

SEQ ID NO: 1014551 - RNA, 22 nt, Homo sapiens
cugaggcaggaggauugcuuga

SEQ ID NO: 1014552 - RNA, 22 nt, Homo sapiens
cugaggccuccagcuucaggca

SEQ ID NO: 1014553 - RNA, 17 nt, Homo sapiens
cugaggcuccugugcua

SEQ ID NO: 1014554 - RNA, 21 nt, Homo sapiens
cugaggguccccaccugggac

SEQ ID NO: 1014555 - RNA, 16 nt, Homo sapiens
cugaggugaaagggag

SEQ ID NO: 1014556 - RNA, 20 nt, Homo sapiens
cugaggugggaggaucucuu

SEQ ID NO: 1014557 - RNA, 18 nt, Homo sapiens
cugaguaagaaaugcugc

SEQ ID NO: 1014558 - RNA, 19 nt, Homo sapiens
cugaguaagcccucaggag

SEQ ID NO: 1014559 - RNA, 17 nt, Homo sapiens
cugaguacguugugcau

SEQ ID NO: 1014560 - RNA, 19 nt, Homo sapiens
cugaguagcuggauuacag

SEQ ID NO: 1014561 - RNA, 14 nt, Homo sapiens
cugagucaccaucu

SEQ ID NO: 1014562 - RNA, 14 nt, Homo sapiens
cugaguggaucucc

SEQ ID NO: 1014563 - RNA, 13 nt, Homo sapiens
cugauaauuccag

SEQ ID NO: 1014564 - RNA, 15 nt, Homo sapiens
cugauacccagagca

SEQ ID NO: 1014565 - RNA, 16 nt, Homo sapiens
cugauacccuuugaaa

SEQ ID NO: 1014566 - RNA, 22 nt, Homo sapiens
cugauauaacaaacuacaugua

SEQ ID NO: 1014567 - RNA, 15 nt, Homo sapiens
cugaucaaugacaga

SEQ ID NO: 1014568 - RNA, 17 nt, Homo sapiens
cugauccagagcacaga

SEQ ID NO: 1014569 - RNA, 19 nt, Homo sapiens
cugauggagcucagaauuc

SEQ ID NO: 1014570 - RNA, 17 nt, Homo sapiens
cugaugguggcucuggu

SEQ ID NO: 1014571 - RNA, 18 nt, Homo sapiens
cugauguuaaaauuccau

SEQ ID NO: 1014572 - RNA, 16 nt, Homo sapiens
cugauguucaguguaa

SEQ ID NO: 1014573 - RNA, 20 nt, Homo sapiens
cugauuagaaaugaccaaua

SEQ ID NO: 1014574 - RNA, 21 nt, Homo sapiens
cugauuauuuucuacacauac

SEQ ID NO: 1014575 - RNA, 15 nt, Homo sapiens
cugauucacugcaug

SEQ ID NO: 1014576 - RNA, 17 nt, Homo sapiens
cugauuuccuaauguca

SEQ ID NO: 1014577 - RNA, 16 nt, Homo sapiens
cugauuuuuagcuuua

SEQ ID NO: 1014578 - RNA, 14 nt, Homo sapiens
cugcaaaaugaagg

SEQ ID NO: 1014579 - RNA, 19 nt, Homo sapiens
cugcaaacucacugcucaa

SEQ ID NO: 1014580 - RNA, 19 nt, Homo sapiens
cugcaaaggcgcagugcuu

SEQ ID NO: 1014581 - RNA, 13 nt, Homo sapiens
cugcaagcacugc

SEQ ID NO: 1014582 - RNA, 15 nt, Homo sapiens
cugcaagcuuuucaa

SEQ ID NO: 1014583 - RNA, 16 nt, Homo sapiens
cugcaagucagaggau

SEQ ID NO: 1014584 - RNA, 17 nt, Homo sapiens
cugcaaucacacugagg

SEQ ID NO: 1014585 - RNA, 17 nt, Homo sapiens
cugcaauuaaagugaua

SEQ ID NO: 1014586 - RNA, 17 nt, Homo sapiens
cugcaauuuuaauugau

SEQ ID NO: 1014587 - RNA, 23 nt, Homo sapiens
cugcacaugucuuguacaugugu

SEQ ID NO: 1014588 - RNA, 17 nt, Homo sapiens
cugcaccguacugugga

SEQ ID NO: 1014589 - RNA, 20 nt, Homo sapiens
cugcacuaauuugauguuua

SEQ ID NO: 1014590 - RNA, 23 nt, Homo sapiens
cugcacuaauuugauguuuacag

SEQ ID NO: 1014591 - RNA, 20 nt, Homo sapiens
cugcacucuaacccuaggca

SEQ ID NO: 1014592 - RNA, 16 nt, Homo sapiens
cugcacuuauacccau

SEQ ID NO: 1014593 - RNA, 14 nt, Homo sapiens
cugcagaaggccaa

SEQ ID NO: 1014594 - RNA, 13 nt, Homo sapiens
cugcagaauccag

SEQ ID NO: 1014595 - RNA, 16 nt, Homo sapiens
cugcaguauaaauaac

SEQ ID NO: 1014596 - RNA, 22 nt, Homo sapiens
cugcagucccuuucgacuugca

SEQ ID NO: 1014597 - RNA, 22 nt, Homo sapiens
cugcauacucauuaggauggcu

SEQ ID NO: 1014598 - RNA, 17 nt, Homo sapiens
cugcaucuuggggacau

SEQ ID NO: 1014599 - RNA, 16 nt, Homo sapiens
cugcaugaaacauguu

SEQ ID NO: 1014600 - RNA, 21 nt, Homo sapiens
cugcauguaccauuugcaugg

SEQ ID NO: 1014601 - RNA, 15 nt, Homo sapiens
cugcauguuacauaa

SEQ ID NO: 1014602 - RNA, 23 nt, Homo sapiens
cugcauuagagcccauuucaauu

SEQ ID NO: 1014603 - RNA, 13 nt, Homo sapiens
cugccacauucua

SEQ ID NO: 1014604 - RNA, 11 nt, Homo sapiens
cugccaccacc

SEQ ID NO: 1014605 - RNA, 17 nt, Homo sapiens
cugccaccagucacugu

SEQ ID NO: 1014606 - RNA, 22 nt, Homo sapiens
cugccacgccgcccuaaaagca

SEQ ID NO: 1014607 - RNA, 16 nt, Homo sapiens
cugccacucacacagc

SEQ ID NO: 1014608 - RNA, 16 nt, Homo sapiens
cugccagccuggcuuc

SEQ ID NO: 1014609 - RNA, 18 nt, Homo sapiens
cugccauguuucaaagac

SEQ ID NO: 1014610 - RNA, 20 nt, Homo sapiens
cugcccaaacauaaagagaa

SEQ ID NO: 1014611 - RNA, 14 nt, Homo sapiens
cugcccaccuguca

SEQ ID NO: 1014612 - RNA, 20 nt, Homo sapiens
cugcccaccugucaaacaaa

SEQ ID NO: 1014613 - RNA, 12 nt, Homo sapiens
cugcccccggcc

SEQ ID NO: 1014614 - RNA, 16 nt, Homo sapiens
cugccccugagcccau

SEQ ID NO: 1014615 - RNA, 16 nt, Homo sapiens
cugcccuagagcacac

SEQ ID NO: 1014616 - RNA, 16 nt, Homo sapiens
cugcccuugucccacu

SEQ ID NO: 1014617 - RNA, 17 nt, Homo sapiens
cugccuacuccaaaaug

SEQ ID NO: 1014618 - RNA, 14 nt, Homo sapiens
cugccucagccucc

SEQ ID NO: 1014619 - RNA, 23 nt, Homo sapiens
cugccuccagaauggucuuucua

SEQ ID NO: 1014620 - RNA, 19 nt, Homo sapiens
cugccuccccaacccugcc

SEQ ID NO: 1014621 - RNA, 23 nt, Homo sapiens
cugccuccuuuccccucccucag

SEQ ID NO: 1014622 - RNA, 18 nt, Homo sapiens
cugccucuguuugacaaa

SEQ ID NO: 1014623 - RNA, 16 nt, Homo sapiens
cugccugagggccccu

SEQ ID NO: 1014624 - RNA, 17 nt, Homo sapiens
cugccugcauucugaga

SEQ ID NO: 1014625 - RNA, 19 nt, Homo sapiens
cugccugcggaccagauga

SEQ ID NO: 1014626 - RNA, 20 nt, Homo sapiens
cugccugugugggacugaga

SEQ ID NO: 1014627 - RNA, 22 nt, Homo sapiens
cugccuguuauaacucugcacu

SEQ ID NO: 1014628 - RNA, 14 nt, Homo sapiens
cugccuucucagga

SEQ ID NO: 1014629 - RNA, 18 nt, Homo sapiens
cugccuucucaugaucca

SEQ ID NO: 1014630 - RNA, 23 nt, Homo sapiens
cugccuuuuaucugcccagaauu

SEQ ID NO: 1014631 - RNA, 18 nt, Homo sapiens
cugcggccccgucugugg

SEQ ID NO: 1014632 - RNA, 15 nt, Homo sapiens
cugcuaacuccuagc

SEQ ID NO: 1014633 - RNA, 18 nt, Homo sapiens
cugcuacaaagaagacau

SEQ ID NO: 1014634 - RNA, 17 nt, Homo sapiens
cugcuaccucacugggg

SEQ ID NO: 1014635 - RNA, 12 nt, Homo sapiens
cugcuauaacua

SEQ ID NO: 1014636 - RNA, 13 nt, Homo sapiens
cugcucaaguuga

SEQ ID NO: 1014637 - RNA, 14 nt, Homo sapiens
cugcuccaccacau

SEQ ID NO: 1014638 - RNA, 22 nt, Homo sapiens
cugcuccuccccuuucacaggu

SEQ ID NO: 1014639 - RNA, 14 nt, Homo sapiens
cugcucuaauauca

SEQ ID NO: 1014640 - RNA, 18 nt, Homo sapiens
cugcucuggaauuugcaa

SEQ ID NO: 1014641 - RNA, 21 nt, Homo sapiens
cugcucugucuucuuugccca

SEQ ID NO: 1014642 - RNA, 22 nt, Homo sapiens
cugcucugucuucuuugcccac

SEQ ID NO: 1014643 - RNA, 11 nt, Homo sapiens
cugcugaauaa

SEQ ID NO: 1014644 - RNA, 18 nt, Homo sapiens
cugcugaccuccacagcu

SEQ ID NO: 1014645 - RNA, 19 nt, Homo sapiens
cugcugagugcaccacuuc

SEQ ID NO: 1014646 - RNA, 13 nt, Homo sapiens
cugcugaucucag

SEQ ID NO: 1014647 - RNA, 16 nt, Homo sapiens
cugcugccauccucac

SEQ ID NO: 1014648 - RNA, 14 nt, Homo sapiens
cugcugcugaccca

SEQ ID NO: 1014649 - RNA, 17 nt, Homo sapiens
cugcugcuggaucacag

SEQ ID NO: 1014650 - RNA, 16 nt, Homo sapiens
cugcuguccagacagc

SEQ ID NO: 1014651 - RNA, 11 nt, Homo sapiens
cugcugugaau

SEQ ID NO: 1014652 - RNA, 17 nt, Homo sapiens
cugcugugcacauuuau

SEQ ID NO: 1014653 - RNA, 13 nt, Homo sapiens
cugcuuccugucu

SEQ ID NO: 1014654 - RNA, 23 nt, Homo sapiens
cugcuugaacccaggagguggag

SEQ ID NO: 1014655 - RNA, 14 nt, Homo sapiens
cugcuuuaauuuca

SEQ ID NO: 1014656 - RNA, 17 nt, Homo sapiens
cugcuuuuuaaguguua

SEQ ID NO: 1014657 - RNA, 15 nt, Homo sapiens
cuggaaaacugccuu

SEQ ID NO: 1014658 - RNA, 14 nt, Homo sapiens
cuggaacagauuca

SEQ ID NO: 1014659 - RNA, 18 nt, Homo sapiens
cuggaaggcacacgccug

SEQ ID NO: 1014660 - RNA, 12 nt, Homo sapiens
cuggacugggag

SEQ ID NO: 1014661 - RNA, 11 nt, Homo sapiens
cuggacuguca

SEQ ID NO: 1014662 - RNA, 14 nt, Homo sapiens
cuggacugugggac

SEQ ID NO: 1014663 - RNA, 18 nt, Homo sapiens
cuggacugugggacccuc

SEQ ID NO: 1014664 - RNA, 16 nt, Homo sapiens
cuggagaaaaaacaca

SEQ ID NO: 1014665 - RNA, 21 nt, Homo sapiens
cuggagaaaaaacacacuccu

SEQ ID NO: 1014666 - RNA, 19 nt, Homo sapiens
cuggagaagcucccaggaa

SEQ ID NO: 1014667 - RNA, 17 nt, Homo sapiens
cuggagacucguggacu

SEQ ID NO: 1014668 - RNA, 21 nt, Homo sapiens
cuggagagguuaaggugcaau

SEQ ID NO: 1014669 - RNA, 22 nt, Homo sapiens
cuggagagguuaaggugcaaua

SEQ ID NO: 1014670 - RNA, 17 nt, Homo sapiens
cuggagccaaguccaga

SEQ ID NO: 1014671 - RNA, 23 nt, Homo sapiens
cuggagcuggcgucugucuucaa

SEQ ID NO: 1014672 - RNA, 17 nt, Homo sapiens
cuggaggaguuccuuga

SEQ ID NO: 1014673 - RNA, 16 nt, Homo sapiens
cuggaggucacauuca

SEQ ID NO: 1014674 - RNA, 16 nt, Homo sapiens
cuggaggucaggaguu

SEQ ID NO: 1014675 - RNA, 17 nt, Homo sapiens
cuggagucaugccaagc

SEQ ID NO: 1014676 - RNA, 13 nt, Homo sapiens
cuggagucgggac

SEQ ID NO: 1014677 - RNA, 23 nt, Homo sapiens
cuggagugcaauggcgugaucuc

SEQ ID NO: 1014678 - RNA, 20 nt, Homo sapiens
cuggaucugugaggggcucu

SEQ ID NO: 1014679 - RNA, 17 nt, Homo sapiens
cuggaugaaauaacucc

SEQ ID NO: 1014680 - RNA, 22 nt, Homo sapiens
cuggaugcagccucacaguccu

SEQ ID NO: 1014681 - RNA, 13 nt, Homo sapiens
cuggaugccugau

SEQ ID NO: 1014682 - RNA, 19 nt, Homo sapiens
cuggaugucugggugaccu

SEQ ID NO: 1014683 - RNA, 19 nt, Homo sapiens
cuggcacugcuuccaguga

SEQ ID NO: 1014684 - RNA, 16 nt, Homo sapiens
cuggcagaaagcaaau

SEQ ID NO: 1014685 - RNA, 21 nt, Homo sapiens
cuggcagaaagcaaaugugac

SEQ ID NO: 1014686 - RNA, 17 nt, Homo sapiens
cuggccagcugacuccc

SEQ ID NO: 1014687 - RNA, 14 nt, Homo sapiens
cuggcccagccaaa

SEQ ID NO: 1014688 - RNA, 21 nt, Homo sapiens
cuggccccucagggucccugg

SEQ ID NO: 1014689 - RNA, 17 nt, Homo sapiens
cuggcccugugccuugg

SEQ ID NO: 1014690 - RNA, 20 nt, Homo sapiens
cuggccggagucagugccag

SEQ ID NO: 1014691 - RNA, 13 nt, Homo sapiens
cuggccgggaccc

SEQ ID NO: 1014692 - RNA, 16 nt, Homo sapiens
cuggcgacugccccug

SEQ ID NO: 1014693 - RNA, 22 nt, Homo sapiens
cuggcgagucugcuuucuucua

SEQ ID NO: 1014694 - RNA, 14 nt, Homo sapiens
cuggcgccucugca

SEQ ID NO: 1014695 - RNA, 13 nt, Homo sapiens
cuggcugagcuga

SEQ ID NO: 1014696 - RNA, 13 nt, Homo sapiens
cuggcugcaguga

SEQ ID NO: 1014697 - RNA, 13 nt, Homo sapiens
cuggcugggcaug

SEQ ID NO: 1014698 - RNA, 18 nt, Homo sapiens
cuggcuggggccuguuga

SEQ ID NO: 1014699 - RNA, 20 nt, Homo sapiens
cuggcugucaguaugacauu

SEQ ID NO: 1014700 - RNA, 18 nt, Homo sapiens
cugggaaggugaccacau

SEQ ID NO: 1014701 - RNA, 17 nt, Homo sapiens
cugggaccucccacugc

SEQ ID NO: 1014702 - RNA, 18 nt, Homo sapiens
cugggaccucccacugcc

SEQ ID NO: 1014703 - RNA, 17 nt, Homo sapiens
cugggacuacaggugug

SEQ ID NO: 1014704 - RNA, 15 nt, Homo sapiens
cugggagaaccucag

SEQ ID NO: 1014705 - RNA, 16 nt, Homo sapiens
cugggagaaccucagg

SEQ ID NO: 1014706 - RNA, 17 nt, Homo sapiens
cugggagaaccucaggc

SEQ ID NO: 1014707 - RNA, 22 nt, Homo sapiens
cugggagacuuugaagaccagu

SEQ ID NO: 1014708 - RNA, 20 nt, Homo sapiens
cugggagagccuuccagggg

SEQ ID NO: 1014709 - RNA, 15 nt, Homo sapiens
cugggagcacaggca

SEQ ID NO: 1014710 - RNA, 18 nt, Homo sapiens
cugggagcacaggcacug

SEQ ID NO: 1014711 - RNA, 20 nt, Homo sapiens
cugggagcacaggcacugca

SEQ ID NO: 1014712 - RNA, 22 nt, Homo sapiens
cugggagcacuuuguaggcauu

SEQ ID NO: 1014713 - RNA, 22 nt, Homo sapiens
cugggagcagcucugugacucc

SEQ ID NO: 1014714 - RNA, 16 nt, Homo sapiens
cugggagcccucaggc

SEQ ID NO: 1014715 - RNA, 16 nt, Homo sapiens
cugggauauuuccaua

SEQ ID NO: 1014716 - RNA, 19 nt, Homo sapiens
cugggaugacuggcuuuga

SEQ ID NO: 1014717 - RNA, 19 nt, Homo sapiens
cugggaugaugcaguuuga

SEQ ID NO: 1014718 - RNA, 22 nt, Homo sapiens
cugggauguccacagaugccuc

SEQ ID NO: 1014719 - RNA, 21 nt, Homo sapiens
cugggauguuuugagggucuu

SEQ ID NO: 1014720 - RNA, 18 nt, Homo sapiens
cugggauuacaagcguga

SEQ ID NO: 1014721 - RNA, 22 nt, Homo sapiens
cugggauuacaauugugagcca

SEQ ID NO: 1014722 - RNA, 18 nt, Homo sapiens
cugggauuacagguguga

SEQ ID NO: 1014723 - RNA, 19 nt, Homo sapiens
cugggauucccaccaaggu

SEQ ID NO: 1014724 - RNA, 15 nt, Homo sapiens
cugggcaacacagcg

SEQ ID NO: 1014725 - RNA, 22 nt, Homo sapiens
cugggcaaggaggccacgugau

SEQ ID NO: 1014726 - RNA, 23 nt, Homo sapiens
cugggcacacgccucccacuggg

SEQ ID NO: 1014727 - RNA, 14 nt, Homo sapiens
cugggcagaaggcc

SEQ ID NO: 1014728 - RNA, 18 nt, Homo sapiens
cugggcagaaggccaaga

SEQ ID NO: 1014729 - RNA, 22 nt, Homo sapiens
cugggcagcauagcaagacaca

SEQ ID NO: 1014730 - RNA, 22 nt, Homo sapiens
cugggcauauccaccaccuccc

SEQ ID NO: 1014731 - RNA, 13 nt, Homo sapiens
cugggccaaguca

SEQ ID NO: 1014732 - RNA, 16 nt, Homo sapiens
cugggccaagucaaag

SEQ ID NO: 1014733 - RNA, 19 nt, Homo sapiens
cugggccaagucaaagaca

SEQ ID NO: 1014734 - RNA, 22 nt, Homo sapiens
cugggcccucucugcucugcgu

SEQ ID NO: 1014735 - RNA, 22 nt, Homo sapiens
cugggcugcuacccagaaauca

SEQ ID NO: 1014736 - RNA, 16 nt, Homo sapiens
cugggcuggcucccuc

SEQ ID NO: 1014737 - RNA, 15 nt, Homo sapiens
cuggggccuguugaa

SEQ ID NO: 1014738 - RNA, 14 nt, Homo sapiens
cuggggcucugugc

SEQ ID NO: 1014739 - RNA, 12 nt, Homo sapiens
cugggggccaug

SEQ ID NO: 1014740 - RNA, 20 nt, Homo sapiens
cuggguaaaugcagcgugaa

SEQ ID NO: 1014741 - RNA, 14 nt, Homo sapiens
cuggguagcuguaa

SEQ ID NO: 1014742 - RNA, 23 nt, Homo sapiens
cugggucucgcuuuguugcccag

SEQ ID NO: 1014743 - RNA, 14 nt, Homo sapiens
cugggucugaguca

SEQ ID NO: 1014744 - RNA, 14 nt, Homo sapiens
cugggugaccucac

SEQ ID NO: 1014745 - RNA, 19 nt, Homo sapiens
cugggugaccucacuuuag

SEQ ID NO: 1014746 - RNA, 20 nt, Homo sapiens
cugggugcccaagcucagaa

SEQ ID NO: 1014747 - RNA, 22 nt, Homo sapiens
cuggguggcacugccaugcagg

SEQ ID NO: 1014748 - RNA, 19 nt, Homo sapiens
cuggguggccucgggacac

SEQ ID NO: 1014749 - RNA, 17 nt, Homo sapiens
cuggguuucucuguaua

SEQ ID NO: 1014750 - RNA, 20 nt, Homo sapiens
cuggguuuggaccccagcug

SEQ ID NO: 1014751 - RNA, 21 nt, Homo sapiens
cugguaacaguucauguuugc

SEQ ID NO: 1014752 - RNA, 21 nt, Homo sapiens
cugguauuccugccuccauau

SEQ ID NO: 1014753 - RNA, 13 nt, Homo sapiens
cugguccuuccag

SEQ ID NO: 1014754 - RNA, 16 nt, Homo sapiens
cuggugaaggaucuug

SEQ ID NO: 1014755 - RNA, 14 nt, Homo sapiens
cuggugacaccagc

SEQ ID NO: 1014756 - RNA, 15 nt, Homo sapiens
cuggugacaccagcc

SEQ ID NO: 1014757 - RNA, 18 nt, Homo sapiens
cuggugacaccagccuuu

SEQ ID NO: 1014758 - RNA, 20 nt, Homo sapiens
cugguggagaaagcacugac

SEQ ID NO: 1014759 - RNA, 22 nt, Homo sapiens
cugguuguugccaaacagccac

SEQ ID NO: 1014760 - RNA, 15 nt, Homo sapiens
cugguuuaauuacau

SEQ ID NO: 1014761 - RNA, 15 nt, Homo sapiens
cuguaaaccagagag

SEQ ID NO: 1014762 - RNA, 20 nt, Homo sapiens
cuguaaagcuuugugcagau

SEQ ID NO: 1014763 - RNA, 23 nt, Homo sapiens
cuguaaagguuuuuggaauuaug

SEQ ID NO: 1014764 - RNA, 15 nt, Homo sapiens
cuguaacacaagcca

SEQ ID NO: 1014765 - RNA, 23 nt, Homo sapiens
cuguaacagcggcaggguguccc

SEQ ID NO: 1014766 - RNA, 14 nt, Homo sapiens
cuguaaucacagcu

SEQ ID NO: 1014767 - RNA, 17 nt, Homo sapiens
cuguaaucccagaacuu

SEQ ID NO: 1014768 - RNA, 23 nt, Homo sapiens
cuguaaucccagcacuuugggag

SEQ ID NO: 1014769 - RNA, 18 nt, Homo sapiens
cuguaaucccagcuacuu

SEQ ID NO: 1014770 - RNA, 21 nt, Homo sapiens
cuguaaucccagcuacuuggg

SEQ ID NO: 1014771 - RNA, 14 nt, Homo sapiens
cuguaauuccagca

SEQ ID NO: 1014772 - RNA, 22 nt, Homo sapiens
cuguaauuguuguuuguaugua

SEQ ID NO: 1014773 - RNA, 19 nt, Homo sapiens
cuguacauacucaguaaaa

SEQ ID NO: 1014774 - RNA, 20 nt, Homo sapiens
cuguacauacucaguaaaau

SEQ ID NO: 1014775 - RNA, 17 nt, Homo sapiens
cuguaccgacuuugaua

SEQ ID NO: 1014776 - RNA, 16 nt, Homo sapiens
cuguaccugugcacgu

SEQ ID NO: 1014777 - RNA, 19 nt, Homo sapiens
cuguagucccagcuacuca

SEQ ID NO: 1014778 - RNA, 23 nt, Homo sapiens
cuguaguugcguggacucugcac

SEQ ID NO: 1014779 - RNA, 23 nt, Homo sapiens
cuguauaguuaggauagcauuuu

SEQ ID NO: 1014780 - RNA, 16 nt, Homo sapiens
cuguauauacaauaac

SEQ ID NO: 1014781 - RNA, 19 nt, Homo sapiens
cuguauauacaauaacaua

SEQ ID NO: 1014782 - RNA, 18 nt, Homo sapiens
cuguaucggagacaguga

SEQ ID NO: 1014783 - RNA, 17 nt, Homo sapiens
cuguaugccaagugaaa

SEQ ID NO: 1014784 - RNA, 16 nt, Homo sapiens
cuguauuaagccacuu

SEQ ID NO: 1014785 - RNA, 23 nt, Homo sapiens
cugucacaucagcuccacuuuca

SEQ ID NO: 1014786 - RNA, 18 nt, Homo sapiens
cugucacgugugggcaau

SEQ ID NO: 1014787 - RNA, 15 nt, Homo sapiens
cuguccaguucccag

SEQ ID NO: 1014788 - RNA, 18 nt, Homo sapiens
cugucccaccaugcagug

SEQ ID NO: 1014789 - RNA, 16 nt, Homo sapiens
cuguccuagucuugau

SEQ ID NO: 1014790 - RNA, 16 nt, Homo sapiens
cuguccucauguguug

SEQ ID NO: 1014791 - RNA, 18 nt, Homo sapiens
cuguccugggaaaugaag

SEQ ID NO: 1014792 - RNA, 14 nt, Homo sapiens
cuguccuugcacac

SEQ ID NO: 1014793 - RNA, 17 nt, Homo sapiens
cugucgauaaucagaga

SEQ ID NO: 1014794 - RNA, 15 nt, Homo sapiens
cugucuaacugcugu

SEQ ID NO: 1014795 - RNA, 13 nt, Homo sapiens
cugucucauauga

SEQ ID NO: 1014796 - RNA, 19 nt, Homo sapiens
cugucucaugugugcucuu

SEQ ID NO: 1014797 - RNA, 13 nt, Homo sapiens
cugucuccauggc

SEQ ID NO: 1014798 - RNA, 13 nt, Homo sapiens
cugucucugucau

SEQ ID NO: 1014799 - RNA, 22 nt, Homo sapiens
cugucuucaccugauucaacua

SEQ ID NO: 1014800 - RNA, 22 nt, Homo sapiens
cugucuucguauucccauuaga

SEQ ID NO: 1014801 - RNA, 14 nt, Homo sapiens
cugucuucucaggc

SEQ ID NO: 1014802 - RNA, 15 nt, Homo sapiens
cugucuuucacugaa

SEQ ID NO: 1014803 - RNA, 21 nt, Homo sapiens
cugugaaaugcuggcauuugc

SEQ ID NO: 1014804 - RNA, 22 nt, Homo sapiens
cugugaaaugcuggcauuugca

SEQ ID NO: 1014805 - RNA, 16 nt, Homo sapiens
cugugaauuagcucac

SEQ ID NO: 1014806 - RNA, 21 nt, Homo sapiens
cugugacucccccucuuucac

SEQ ID NO: 1014807 - RNA, 18 nt, Homo sapiens
cugugaggccccuggaca

SEQ ID NO: 1014808 - RNA, 18 nt, Homo sapiens
cugugauuagccauuuga

SEQ ID NO: 1014809 - RNA, 21 nt, Homo sapiens
cugugauucccuccugcuacu

SEQ ID NO: 1014810 - RNA, 23 nt, Homo sapiens
cugugauucgguggagacuauca

SEQ ID NO: 1014811 - RNA, 14 nt, Homo sapiens
cugugcacgcagug

SEQ ID NO: 1014812 - RNA, 22 nt, Homo sapiens
cugugcagguggggagacuggg

SEQ ID NO: 1014813 - RNA, 14 nt, Homo sapiens
cugugcccucagau

SEQ ID NO: 1014814 - RNA, 17 nt, Homo sapiens
cugugccuaacaccagc

SEQ ID NO: 1014815 - RNA, 21 nt, Homo sapiens
cugugccuuggugugcuguau

SEQ ID NO: 1014816 - RNA, 14 nt, Homo sapiens
cugugccuuuugcc

SEQ ID NO: 1014817 - RNA, 12 nt, Homo sapiens
cugugcuaauaa

SEQ ID NO: 1014818 - RNA, 15 nt, Homo sapiens
cugugcuaugaauuu

SEQ ID NO: 1014819 - RNA, 14 nt, Homo sapiens
cuuccuguccagag

SEQ ID NO: 1014820 - RNA, 16 nt, Homo sapiens
cuuccuguccagagag

SEQ ID NO: 1014821 - RNA, 16 nt, Homo sapiens
cuuccugugacuucag

SEQ ID NO: 1014822 - RNA, 20 nt, Homo sapiens
cuuccuuggaggggggagcc

SEQ ID NO: 1014823 - RNA, 19 nt, Homo sapiens
cuuccuuucuuucucucuc

SEQ ID NO: 1014824 - RNA, 13 nt, Homo sapiens
cuucgacugugac

SEQ ID NO: 1014825 - RNA, 20 nt, Homo sapiens
cuucuaaccugaacugaugg

SEQ ID NO: 1014826 - RNA, 19 nt, Homo sapiens
cuucuaccuuaaaauguaa

SEQ ID NO: 1014827 - RNA, 22 nt, Homo sapiens
cuucuauuccauggcuaacugg

SEQ ID NO: 1014828 - RNA, 17 nt, Homo sapiens
cuucucaagugccuuaa

SEQ ID NO: 1014829 - RNA, 21 nt, Homo sapiens
cuucucacccuaugugggugg

SEQ ID NO: 1014830 - RNA, 16 nt, Homo sapiens
cuacacugacacuggu

SEQ ID NO: 1014831 - RNA, 12 nt, Homo sapiens
cuacaggcacac

SEQ ID NO: 1014832 - RNA, 21 nt, Homo sapiens
cuacaugccucagugaaggac

SEQ ID NO: 1014833 - RNA, 16 nt, Homo sapiens
cuaccagacuguguau

SEQ ID NO: 1014834 - RNA, 14 nt, Homo sapiens
cuaccaucagggac

SEQ ID NO: 1014835 - RNA, 15 nt, Homo sapiens
cuaccaucagggaca

SEQ ID NO: 1014836 - RNA, 16 nt, Homo sapiens
cuacccuggcacuaua

SEQ ID NO: 1014837 - RNA, 20 nt, Homo sapiens
cuaccuagaaauacauggac

SEQ ID NO: 1014838 - RNA, 12 nt, Homo sapiens
cuaccucagguu

SEQ ID NO: 1014839 - RNA, 22 nt, Homo sapiens
cuaccucauggggguauuguau

SEQ ID NO: 1014840 - RNA, 13 nt, Homo sapiens
cuaccucuuggcu

SEQ ID NO: 1014841 - RNA, 23 nt, Homo sapiens
cuaccugcucguugccugccacu

SEQ ID NO: 1014842 - RNA, 17 nt, Homo sapiens
cuacgaauauagagggu

SEQ ID NO: 1014843 - RNA, 19 nt, Homo sapiens
cuacgugacuguggcacac

SEQ ID NO: 1014844 - RNA, 14 nt, Homo sapiens
cuacuaaaaacaca

SEQ ID NO: 1014845 - RNA, 12 nt, Homo sapiens
cuacucagggaa

SEQ ID NO: 1014846 - RNA, 16 nt, Homo sapiens
cuacucucaugcugca

SEQ ID NO: 1014847 - RNA, 18 nt, Homo sapiens
cucagccuguuccaugaa

SEQ ID NO: 1014848 - RNA, 14 nt, Homo sapiens
cucagcucuuggcu

SEQ ID NO: 1014849 - RNA, 19 nt, Homo sapiens
cucagcucuuggcuccacu

SEQ ID NO: 1014850 - RNA, 22 nt, Homo sapiens
cucaggacacuaauacaccagg

SEQ ID NO: 1014851 - RNA, 12 nt, Homo sapiens
cucaggaccagg

SEQ ID NO: 1014852 - RNA, 16 nt, Homo sapiens
cucaggaccuagggau

SEQ ID NO: 1014853 - RNA, 22 nt, Homo sapiens
cucaggauuucgugggucuguu

SEQ ID NO: 1014854 - RNA, 13 nt, Homo sapiens
cucaggcaccugc

SEQ ID NO: 1014855 - RNA, 17 nt, Homo sapiens
cucaggcaccugcacuu

SEQ ID NO: 1014856 - RNA, 16 nt, Homo sapiens
cucaggggacuugaau

SEQ ID NO: 1014857 - RNA, 13 nt, Homo sapiens
cucaggucagggu

SEQ ID NO: 1014858 - RNA, 13 nt, Homo sapiens
cucaggugaucca

SEQ ID NO: 1014859 - RNA, 15 nt, Homo sapiens
cucagucaugcauaa

SEQ ID NO: 1014860 - RNA, 14 nt, Homo sapiens
cucagucucaggag

SEQ ID NO: 1014861 - RNA, 11 nt, Homo sapiens
cucagugcagg

SEQ ID NO: 1014862 - RNA, 15 nt, Homo sapiens
cucaguucagaauca

SEQ ID NO: 1014863 - RNA, 13 nt, Homo sapiens
cucaguuccugcc

SEQ ID NO: 1014864 - RNA, 17 nt, Homo sapiens
cucaguuucacuuucac

SEQ ID NO: 1014865 - RNA, 19 nt, Homo sapiens
cucauaugauugugcacau

SEQ ID NO: 1014866 - RNA, 20 nt, Homo sapiens
cucauaugauugugcacaua

SEQ ID NO: 1014867 - RNA, 13 nt, Homo sapiens
cucaucacuggau

SEQ ID NO: 1014868 - RNA, 22 nt, Homo sapiens
cucaucaguguccucuugcuca

SEQ ID NO: 1014869 - RNA, 17 nt, Homo sapiens
cucauccccaccugucu

SEQ ID NO: 1014870 - RNA, 17 nt, Homo sapiens
cucaucccuguuccuca

SEQ ID NO: 1014871 - RNA, 15 nt, Homo sapiens
cucauccugcaggca

SEQ ID NO: 1014872 - RNA, 21 nt, Homo sapiens
cucaucugggggaguggaaua

SEQ ID NO: 1014873 - RNA, 19 nt, Homo sapiens
cucaugagugccaagcaaa

SEQ ID NO: 1014874 - RNA, 13 nt, Homo sapiens
cucaugauccaac

SEQ ID NO: 1014875 - RNA, 11 nt, Homo sapiens
cucaugaucuu

SEQ ID NO: 1014876 - RNA, 15 nt, Homo sapiens
cucaugccuguaauc

SEQ ID NO: 1014877 - RNA, 20 nt, Homo sapiens
cucaugccuguaaucccagc

SEQ ID NO: 1014878 - RNA, 19 nt, Homo sapiens
cucaugcugugugacucaa

SEQ ID NO: 1014879 - RNA, 13 nt, Homo sapiens
cucaugcuguucc

SEQ ID NO: 1014880 - RNA, 23 nt, Homo sapiens
cucauggacugaguuuauacuca

SEQ ID NO: 1014881 - RNA, 20 nt, Homo sapiens
cucauggcagcuaagccaca

SEQ ID NO: 1014882 - RNA, 21 nt, Homo sapiens
cucauggcagcuaagccacau

SEQ ID NO: 1014883 - RNA, 18 nt, Homo sapiens
cucauuaccuugugcuaa

SEQ ID NO: 1014884 - RNA, 16 nt, Homo sapiens
cucauuccaccuuccc

SEQ ID NO: 1014885 - RNA, 18 nt, Homo sapiens
cucauuccuguagucaaa

SEQ ID NO: 1014886 - RNA, 12 nt, Homo sapiens
cucauugcuugg

SEQ ID NO: 1014887 - RNA, 22 nt, Homo sapiens
cucauuguuuauuaacaaauua

SEQ ID NO: 1014888 - RNA, 17 nt, Homo sapiens
cucauuuagaacuugca

SEQ ID NO: 1014889 - RNA, 19 nt, Homo sapiens
cucauuuuagaaccaccaa

SEQ ID NO: 1014890 - RNA, 13 nt, Homo sapiens
cuccaaaagcacu

SEQ ID NO: 1014891 - RNA, 15 nt, Homo sapiens
cuccaaaagcacuua

SEQ ID NO: 1014892 - RNA, 22 nt, Homo sapiens
cuccaaaugcugacccaugcaa

SEQ ID NO: 1014893 - RNA, 18 nt, Homo sapiens
cuccaaauuuuuuuuacu

SEQ ID NO: 1014894 - RNA, 13 nt, Homo sapiens
cuccaacuggauu

SEQ ID NO: 1014895 - RNA, 18 nt, Homo sapiens
cuccaagaccuucuccuu

SEQ ID NO: 1014896 - RNA, 20 nt, Homo sapiens
cuccaagguagaauuugcaa

SEQ ID NO: 1014897 - RNA, 12 nt, Homo sapiens
cuccacagggca

SEQ ID NO: 1014898 - RNA, 12 nt, Homo sapiens
cuccacccuaua

SEQ ID NO: 1014899 - RNA, 16 nt, Homo sapiens
cuccaccuagacugua

SEQ ID NO: 1014900 - RNA, 16 nt, Homo sapiens
cuccagaagggcagcu

SEQ ID NO: 1014901 - RNA, 23 nt, Homo sapiens
cuccagacacaccugaacacauc

SEQ ID NO: 1014902 - RNA, 13 nt, Homo sapiens
cuccagacagggu

SEQ ID NO: 1014903 - RNA, 18 nt, Homo sapiens
cuccagacucucugugaa

SEQ ID NO: 1014904 - RNA, 16 nt, Homo sapiens
cuccagccagcaauga

SEQ ID NO: 1014905 - RNA, 17 nt, Homo sapiens
cuccagcccugcagcua

SEQ ID NO: 1014906 - RNA, 19 nt, Homo sapiens
cuccagcugcucugucuuc

SEQ ID NO: 1014907 - RNA, 23 nt, Homo sapiens
cuccaguauaugcugauggacca

SEQ ID NO: 1014908 - RNA, 17 nt, Homo sapiens
cuccaguauucuuguca

SEQ ID NO: 1014909 - RNA, 13 nt, Homo sapiens
cuccagucuuccg

SEQ ID NO: 1014910 - RNA, 21 nt, Homo sapiens
cuccaucaguuagagcugaca

SEQ ID NO: 1014911 - RNA, 14 nt, Homo sapiens
cuccaucucaugua

SEQ ID NO: 1014912 - RNA, 17 nt, Homo sapiens
cuccaucucauguauca

SEQ ID NO: 1014913 - RNA, 21 nt, Homo sapiens
cuccaucuccaagaaugcuga

SEQ ID NO: 1014914 - RNA, 17 nt, Homo sapiens
cuccaucuucagcuucu

SEQ ID NO: 1014915 - RNA, 20 nt, Homo sapiens
cucccaaagugcugggauua

SEQ ID NO: 1014916 - RNA, 18 nt, Homo sapiens
cucccaaccccacacgcu

SEQ ID NO: 1014917 - RNA, 21 nt, Homo sapiens
cucccaagggauggugcccug

SEQ ID NO: 1014918 - RNA, 17 nt, Homo sapiens
cucccagaacacacucc

SEQ ID NO: 1014919 - RNA, 17 nt, Homo sapiens
cucccagauaaugugaa

SEQ ID NO: 1014920 - RNA, 16 nt, Homo sapiens
cucccaggcauucccc

SEQ ID NO: 1014921 - RNA, 13 nt, Homo sapiens
cucccagugcuug

SEQ ID NO: 1014922 - RNA, 16 nt, Homo sapiens
cucccauguaccagca

SEQ ID NO: 1014923 - RNA, 19 nt, Homo sapiens
cuccccacugccuacugca

SEQ ID NO: 1014924 - RNA, 16 nt, Homo sapiens
cuccccauuagcuuuc

SEQ ID NO: 1014925 - RNA, 15 nt, Homo sapiens
cucccccuucuccca

SEQ ID NO: 1014926 - RNA, 18 nt, Homo sapiens
cuccccucagagugcaag

SEQ ID NO: 1014927 - RNA, 17 nt, Homo sapiens
cuccccugcccuggucc

SEQ ID NO: 1014928 - RNA, 18 nt, Homo sapiens
cuccccugcccuggucca

SEQ ID NO: 1014929 - RNA, 18 nt, Homo sapiens
cuccccuggggacagcaa

SEQ ID NO: 1014930 - RNA, 15 nt, Homo sapiens
cuccccuucacaugc

SEQ ID NO: 1014931 - RNA, 17 nt, Homo sapiens
cuccccuucacucccac

SEQ ID NO: 1014932 - RNA, 22 nt, Homo sapiens
cuccccuuuuauaccugcucuu

SEQ ID NO: 1014933 - RNA, 16 nt, Homo sapiens
cucccgccacauuuua

SEQ ID NO: 1014934 - RNA, 16 nt, Homo sapiens
cucccuaggagaccaa

SEQ ID NO: 1014935 - RNA, 21 nt, Homo sapiens
cucccuaggcugcccacucuc

SEQ ID NO: 1014936 - RNA, 16 nt, Homo sapiens
cucccuagggccuuca

SEQ ID NO: 1014937 - RNA, 13 nt, Homo sapiens
cucccucauucca

SEQ ID NO: 1014938 - RNA, 16 nt, Homo sapiens
cucccucugaccugca

SEQ ID NO: 1014939 - RNA, 18 nt, Homo sapiens
cucccucugcugaucuca

SEQ ID NO: 1014940 - RNA, 17 nt, Homo sapiens
cucccugaaguaagcaa

SEQ ID NO: 1014941 - RNA, 19 nt, Homo sapiens
cucccugguucugaugaug

SEQ ID NO: 1014942 - RNA, 19 nt, Homo sapiens
cucccuuguggcuuccuca

SEQ ID NO: 1014943 - RNA, 12 nt, Homo sapiens
cucccuuugaaa

SEQ ID NO: 1014944 - RNA, 14 nt, Homo sapiens
cuccgaggccagua

SEQ ID NO: 1014945 - RNA, 16 nt, Homo sapiens
cuccgcgccuugccuc

SEQ ID NO: 1014946 - RNA, 22 nt, Homo sapiens
cuccuaacccuuaucaccagcu

SEQ ID NO: 1014947 - RNA, 14 nt, Homo sapiens
cuccuauacucuau

SEQ ID NO: 1014948 - RNA, 24 nt, Homo sapiens
cuccucaucaucacucaucugcca

SEQ ID NO: 1014949 - RNA, 19 nt, Homo sapiens
cuccucccaggaacugggc

SEQ ID NO: 1014950 - RNA, 21 nt, Homo sapiens
cuccucccaggaacugggcca

SEQ ID NO: 1014951 - RNA, 14 nt, Homo sapiens
cuccuccccuuuca

SEQ ID NO: 1014952 - RNA, 22 nt, Homo sapiens
cuccuccuacccuuccagugcc

SEQ ID NO: 1014953 - RNA, 19 nt, Homo sapiens
cuccucuacaauuugccau

SEQ ID NO: 1014954 - RNA, 22 nt, Homo sapiens
cuccucuguccaggcacugcug

SEQ ID NO: 1014955 - RNA, 14 nt, Homo sapiens
cuccucuugccacu

SEQ ID NO: 1014956 - RNA, 17 nt, Homo sapiens
cuccugaccaaguagau

SEQ ID NO: 1014957 - RNA, 20 nt, Homo sapiens
cuccugaccucaggugaucc

SEQ ID NO: 1014958 - RNA, 20 nt, Homo sapiens
cuccugaguaguugggauua

SEQ ID NO: 1014959 - RNA, 18 nt, Homo sapiens
cuccugccccaugcugcc

SEQ ID NO: 1014960 - RNA, 23 nt, Homo sapiens
cuccuggaaaggcucagucucag

SEQ ID NO: 1014961 - RNA, 19 nt, Homo sapiens
cuccuggaagcgagcuuug

SEQ ID NO: 1014962 - RNA, 16 nt, Homo sapiens
cuccuggcccacugca

SEQ ID NO: 1014963 - RNA, 23 nt, Homo sapiens
cuccuggcuggggccuguugaag

SEQ ID NO: 1014964 - RNA, 16 nt, Homo sapiens
cuccugggcuacaagg

SEQ ID NO: 1014965 - RNA, 20 nt, Homo sapiens
cuccugugcuagaugugcaa

SEQ ID NO: 1014966 - RNA, 15 nt, Homo sapiens
cuccuguguacaggg

SEQ ID NO: 1014967 - RNA, 18 nt, Homo sapiens
cuccuguuagcuguuauu

SEQ ID NO: 1014968 - RNA, 16 nt, Homo sapiens
cuccuuagagacauca

SEQ ID NO: 1014969 - RNA, 13 nt, Homo sapiens
cuccuucaaugca

SEQ ID NO: 1014970 - RNA, 16 nt, Homo sapiens
cuccuuccaccucccu

SEQ ID NO: 1014971 - RNA, 20 nt, Homo sapiens
cuccuugagagaccaggcaa

SEQ ID NO: 1014972 - RNA, 19 nt, Homo sapiens
cuccuugggaggccccacu

SEQ ID NO: 1014973 - RNA, 22 nt, Homo sapiens
cuccuugggaggccccacuggg

SEQ ID NO: 1014974 - RNA, 14 nt, Homo sapiens
cuccuugucugugc

SEQ ID NO: 1014975 - RNA, 13 nt, Homo sapiens
cuccuuguguuac

SEQ ID NO: 1014976 - RNA, 24 nt, Homo sapiens
cuccuuucaccacaugugcacaug

SEQ ID NO: 1014977 - RNA, 14 nt, Homo sapiens
cuccuuucucuuau

SEQ ID NO: 1014978 - RNA, 23 nt, Homo sapiens
cuccuuuugcuugaaaccaaaga

SEQ ID NO: 1014979 - RNA, 18 nt, Homo sapiens
cucgaacuccugaccuca

SEQ ID NO: 1014980 - RNA, 15 nt, Homo sapiens
cucgacucacugcaa

SEQ ID NO: 1014981 - RNA, 16 nt, Homo sapiens
cucgaggcggaucuuu

SEQ ID NO: 1014982 - RNA, 16 nt, Homo sapiens
cucgaugaagcccaau

SEQ ID NO: 1014983 - RNA, 22 nt, Homo sapiens
cucgcccggcccgaucuuucua

SEQ ID NO: 1014984 - RNA, 14 nt, Homo sapiens
cucgccgucuguga

SEQ ID NO: 1014985 - RNA, 22 nt, Homo sapiens
cuucucagaaggcaaaugacuu

SEQ ID NO: 1014986 - RNA, 19 nt, Homo sapiens
cuucucagcucccauuucu

SEQ ID NO: 1014987 - RNA, 20 nt, Homo sapiens
cuucucagcucccauuucua

SEQ ID NO: 1014988 - RNA, 12 nt, Homo sapiens
cuucucauuucu

SEQ ID NO: 1014989 - RNA, 12 nt, Homo sapiens
cuucuccaucuc

SEQ ID NO: 1014990 - RNA, 14 nt, Homo sapiens
cuucuccaugagac

SEQ ID NO: 1014991 - RNA, 18 nt, Homo sapiens
cuucucuucacagucaca

SEQ ID NO: 1014992 - RNA, 15 nt, Homo sapiens
cuucucuuccuguaa

SEQ ID NO: 1014993 - RNA, 13 nt, Homo sapiens
cuucucuuuggaa

SEQ ID NO: 1014994 - RNA, 13 nt, Homo sapiens
cuucugaccacac

SEQ ID NO: 1014995 - RNA, 21 nt, Homo sapiens
cuucugaccacagcaucauuu

SEQ ID NO: 1014996 - RNA, 18 nt, Homo sapiens
cuucugaggacauuccaa

SEQ ID NO: 1014997 - RNA, 18 nt, Homo sapiens
cuucugccuucucaggaa

SEQ ID NO: 1014998 - RNA, 20 nt, Homo sapiens
cuucuggggguagaucucaa

SEQ ID NO: 1014999 - RNA, 22 nt, Homo sapiens
cuucuguggaccacugcaugag

SEQ ID NO: 1015000 - RNA, 12 nt, Homo sapiens
cuucugugugac

SEQ ID NO: 1015001 - RNA, 19 nt, Homo sapiens
cuucuuggucucaguguca

SEQ ID NO: 1015002 - RNA, 10 nt, Homo sapiens
cuucuuuaaa

SEQ ID NO: 1015003 - RNA, 20 nt, Homo sapiens
cuucuuuaaaaaaacacaua

SEQ ID NO: 1015004 - RNA, 19 nt, Homo sapiens
cuucuuugauaauguuaaa

SEQ ID NO: 1015005 - RNA, 17 nt, Homo sapiens
cuucuuuuggcuuccau

SEQ ID NO: 1015006 - RNA, 17 nt, Homo sapiens
cuucuuuuugcuucaaa

SEQ ID NO: 1015007 - RNA, 23 nt, Homo sapiens
cuugaaaagacaucaagcacaga

SEQ ID NO: 1015008 - RNA, 22 nt, Homo sapiens
cuugaaacaagcaacagaugga

SEQ ID NO: 1015009 - RNA, 13 nt, Homo sapiens
cuugaaaccaaag

SEQ ID NO: 1015010 - RNA, 16 nt, Homo sapiens
cuugaaacugagaugu

SEQ ID NO: 1015011 - RNA, 12 nt, Homo sapiens
cuugaaauacca

SEQ ID NO: 1015012 - RNA, 22 nt, Homo sapiens
cuugaaauaccagugaaccaaa

SEQ ID NO: 1015013 - RNA, 19 nt, Homo sapiens
cuugaacacucaugcugaa

SEQ ID NO: 1015014 - RNA, 17 nt, Homo sapiens
cuugaaccacaguucua

SEQ ID NO: 1015015 - RNA, 13 nt, Homo sapiens
cuugaacccaaga

SEQ ID NO: 1015016 - RNA, 16 nt, Homo sapiens
cuugaagacacugaaa

SEQ ID NO: 1015017 - RNA, 13 nt, Homo sapiens
cuugaaucaaagc

SEQ ID NO: 1015018 - RNA, 17 nt, Homo sapiens
cuugacagaacacuguc

SEQ ID NO: 1015019 - RNA, 14 nt, Homo sapiens
cuugacagggcaca

SEQ ID NO: 1015020 - RNA, 23 nt, Homo sapiens
cuugaccaagcaggaagcucaga

SEQ ID NO: 1015021 - RNA, 14 nt, Homo sapiens
cuugacggcauugc

SEQ ID NO: 1015022 - RNA, 21 nt, Homo sapiens
cuugagcaaccuggcuaagau

SEQ ID NO: 1015023 - RNA, 20 nt, Homo sapiens
cuugagccaguaauuggucc

SEQ ID NO: 1015024 - RNA, 18 nt, Homo sapiens
cuugagcuuggcagcuga

SEQ ID NO: 1015025 - RNA, 18 nt, Homo sapiens
cuugaggcugcaaucaca

SEQ ID NO: 1015026 - RNA, 17 nt, Homo sapiens
cuugaguuaaccuugcu

SEQ ID NO: 1015027 - RNA, 20 nt, Homo sapiens
cuugaguuuagugaucugaa

SEQ ID NO: 1015028 - RNA, 16 nt, Homo sapiens
cuugauaaagggccaa

SEQ ID NO: 1015029 - RNA, 16 nt, Homo sapiens
cuugauaaaugccuca

SEQ ID NO: 1015030 - RNA, 16 nt, Homo sapiens
cuugauauuuuccaaa

SEQ ID NO: 1015031 - RNA, 17 nt, Homo sapiens
cuugauccacagaaaua

SEQ ID NO: 1015032 - RNA, 20 nt, Homo sapiens
cuugaugccaguaggcucaa

SEQ ID NO: 1015033 - RNA, 18 nt, Homo sapiens
cuugauggagauauuuac

SEQ ID NO: 1015034 - RNA, 15 nt, Homo sapiens
cuugaugugccauuu

SEQ ID NO: 1015035 - RNA, 15 nt, Homo sapiens
cuugauucacaauga

SEQ ID NO: 1015036 - RNA, 20 nt, Homo sapiens
cuugauuuagcacuauuuac

SEQ ID NO: 1015037 - RNA, 13 nt, Homo sapiens
cuugauuuuugcc

SEQ ID NO: 1015038 - RNA, 23 nt, Homo sapiens
cuugcaaaguaucccuacuguaa

SEQ ID NO: 1015039 - RNA, 15 nt, Homo sapiens
cuugcaauuucuacc

SEQ ID NO: 1015040 - RNA, 12 nt, Homo sapiens
cuugcacaaaca

SEQ ID NO: 1015041 - RNA, 18 nt, Homo sapiens
cuugcaccucugaccuau

SEQ ID NO: 1015042 - RNA, 14 nt, Homo sapiens
cuugcagggccguu

SEQ ID NO: 1015043 - RNA, 10 nt, Homo sapiens
cuugcauaau

SEQ ID NO: 1015044 - RNA, 13 nt, Homo sapiens
cuugcauacagag

SEQ ID NO: 1015045 - RNA, 15 nt, Homo sapiens
cuugcccaguuucag

SEQ ID NO: 1015046 - RNA, 16 nt, Homo sapiens
cuugccgucuaccuga

SEQ ID NO: 1015047 - RNA, 21 nt, Homo sapiens
cuugccugcaugaaacauguu

SEQ ID NO: 1015048 - RNA, 15 nt, Homo sapiens
cuugcgcauucucau

SEQ ID NO: 1015049 - RNA, 17 nt, Homo sapiens
cuugcucacaucuuggc

SEQ ID NO: 1015050 - RNA, 12 nt, Homo sapiens
cuugcugccaaa

SEQ ID NO: 1015051 - RNA, 16 nt, Homo sapiens
cuugcugcugagugca

SEQ ID NO: 1015052 - RNA, 22 nt, Homo sapiens
cuugcuuaugacaucacuugua

SEQ ID NO: 1015053 - RNA, 16 nt, Homo sapiens
cuuggacuugcauucc

SEQ ID NO: 1015054 - RNA, 16 nt, Homo sapiens
cuuggagccccagugc

SEQ ID NO: 1015055 - RNA, 19 nt, Homo sapiens
cuuggagccccagugccaa

SEQ ID NO: 1015056 - RNA, 16 nt, Homo sapiens
cuuggaucagaugaac

SEQ ID NO: 1015057 - RNA, 18 nt, Homo sapiens
cuuggaucagaugaacuc

SEQ ID NO: 1015058 - RNA, 15 nt, Homo sapiens
cuuggaucugccaug

SEQ ID NO: 1015059 - RNA, 19 nt, Homo sapiens
cuuggcaaauuccuaguca

SEQ ID NO: 1015060 - RNA, 19 nt, Homo sapiens
cuuggcagcccgggucauc

SEQ ID NO: 1015061 - RNA, 20 nt, Homo sapiens
cuuggccagaagggggccau

SEQ ID NO: 1015062 - RNA, 21 nt, Homo sapiens
cuuggccagaagggggccaug

SEQ ID NO: 1015063 - RNA, 20 nt, Homo sapiens
cuuggccuccccugcugaag

SEQ ID NO: 1015064 - RNA, 17 nt, Homo sapiens
cuuggcuccacugggau

SEQ ID NO: 1015065 - RNA, 13 nt, Homo sapiens
cuuggcugugagg

SEQ ID NO: 1015066 - RNA, 22 nt, Homo sapiens
cuuggcuuacugcagccuuugc

SEQ ID NO: 1015067 - RNA, 13 nt, Homo sapiens
cuugggcucccug

SEQ ID NO: 1015068 - RNA, 20 nt, Homo sapiens
cuuggggagauggaguucuu

SEQ ID NO: 1015069 - RNA, 20 nt, Homo sapiens
cuuggggcaggcagugaugc

SEQ ID NO: 1015070 - RNA, 14 nt, Homo sapiens
cuuggucucagugu

SEQ ID NO: 1015071 - RNA, 14 nt, Homo sapiens
cuuguaaagacugu

SEQ ID NO: 1015072 - RNA, 14 nt, Homo sapiens
cuuguaaaugugac

SEQ ID NO: 1015073 - RNA, 22 nt, Homo sapiens
cuugucaagguuccaacuggaa

SEQ ID NO: 1015074 - RNA, 22 nt, Homo sapiens
cuuguccacccaccuaugugcc

SEQ ID NO: 1015075 - RNA, 23 nt, Homo sapiens
cuuguccgcugggugguacccuc

SEQ ID NO: 1015076 - RNA, 18 nt, Homo sapiens
cuugucuuuggacccuga

SEQ ID NO: 1015077 - RNA, 18 nt, Homo sapiens
cuugugccuggcucagag

SEQ ID NO: 1015078 - RNA, 18 nt, Homo sapiens
cuugugguuuaugucauc

SEQ ID NO: 1015079 - RNA, 19 nt, Homo sapiens
cuugugguuuaugucauca

SEQ ID NO: 1015080 - RNA, 18 nt, Homo sapiens
cuugugugugggcuguga

SEQ ID NO: 1015081 - RNA, 20 nt, Homo sapiens
cuuguuaagugcagucugau

SEQ ID NO: 1015082 - RNA, 16 nt, Homo sapiens
cuuguuccccacugac

SEQ ID NO: 1015083 - RNA, 23 nt, Homo sapiens
cuuguuccccacugacagccucc

SEQ ID NO: 1015084 - RNA, 20 nt, Homo sapiens
cuuguugagauccccguguu

SEQ ID NO: 1015085 - RNA, 16 nt, Homo sapiens
cuuguuuacagcacua

SEQ ID NO: 1015086 - RNA, 23 nt, Homo sapiens
cuuguuucacacuagucacauuc

SEQ ID NO: 1015087 - RNA, 16 nt, Homo sapiens
cuuguuuuaugcucag

SEQ ID NO: 1015088 - RNA, 14 nt, Homo sapiens
cuuguuuucuugcc

SEQ ID NO: 1015089 - RNA, 15 nt, Homo sapiens
cuuuaaaaaaacaca

SEQ ID NO: 1015090 - RNA, 18 nt, Homo sapiens
cuuuaaaaaaacacauaa

SEQ ID NO: 1015091 - RNA, 22 nt, Homo sapiens
cuuuaaacacggggcuugcaac

SEQ ID NO: 1015092 - RNA, 16 nt, Homo sapiens
cuuuaaacucagggac

SEQ ID NO: 1015093 - RNA, 19 nt, Homo sapiens
cuuuaaagucagguccaau

SEQ ID NO: 1015094 - RNA, 12 nt, Homo sapiens
cuuuaagcacua

SEQ ID NO: 1015095 - RNA, 14 nt, Homo sapiens
cuuuaaugaauaaa

SEQ ID NO: 1015096 - RNA, 14 nt, Homo sapiens
cuuuaauggguaaa

SEQ ID NO: 1015097 - RNA, 22 nt, Homo sapiens
cuuuaauuucaugaaaagauua

SEQ ID NO: 1015098 - RNA, 15 nt, Homo sapiens
cuuuacaaaaguauu

SEQ ID NO: 1015099 - RNA, 15 nt, Homo sapiens
cuuuacaaauauguc

SEQ ID NO: 1015100 - RNA, 16 nt, Homo sapiens
cuuuacauggaugcca

SEQ ID NO: 1015101 - RNA, 18 nt, Homo sapiens
cuuuaccugagaccaguu

SEQ ID NO: 1015102 - RNA, 22 nt, Homo sapiens
cuuuacuaagaugacauugcua

SEQ ID NO: 1015103 - RNA, 20 nt, Homo sapiens
cuuuacuucauggacuucca

SEQ ID NO: 1015104 - RNA, 11 nt, Homo sapiens
cuuuacuugac

SEQ ID NO: 1015105 - RNA, 21 nt, Homo sapiens
cuuuagagaauaccaguguua

SEQ ID NO: 1015106 - RNA, 20 nt, Homo sapiens
cuuuagagccagcccauggc

SEQ ID NO: 1015107 - RNA, 22 nt, Homo sapiens
cuuuagagccagcccauggcuu

SEQ ID NO: 1015108 - RNA, 13 nt, Homo sapiens
cuuuagaugcuga

SEQ ID NO: 1015109 - RNA, 14 nt, Homo sapiens
cuuuagcuaccuca

SEQ ID NO: 1015110 - RNA, 21 nt, Homo sapiens
cuuuagcuaccucacuaugcu

SEQ ID NO: 1015111 - RNA, 19 nt, Homo sapiens
cuuuaggagacuaauggaa

SEQ ID NO: 1015112 - RNA, 21 nt, Homo sapiens
cuuuauauuuuuaacuuuaag

SEQ ID NO: 1015113 - RNA, 18 nt, Homo sapiens
cuuuaucuaauaccucug

SEQ ID NO: 1015114 - RNA, 17 nt, Homo sapiens
cuuuaucuugacauuca

SEQ ID NO: 1015115 - RNA, 17 nt, Homo sapiens
cuuuaugguuucuccag

SEQ ID NO: 1015116 - RNA, 13 nt, Homo sapiens
cuuuauguggaaa

SEQ ID NO: 1015117 - RNA, 13 nt, Homo sapiens
gaucacuacugca

SEQ ID NO: 1015118 - RNA, 19 nt, Homo sapiens
gaucauagcucauugcaag

SEQ ID NO: 1015119 - RNA, 18 nt, Homo sapiens
gaucauccacugugccau

SEQ ID NO: 1015120 - RNA, 20 nt, Homo sapiens
gaucaucuuuccuguuccag

SEQ ID NO: 1015121 - RNA, 20 nt, Homo sapiens
gaucaugccacuacacucca

SEQ ID NO: 1015122 - RNA, 19 nt, Homo sapiens
gaucauugaaauucugaga

SEQ ID NO: 1015123 - RNA, 23 nt, Homo sapiens
gaucauuugcccuuaaggacaaa

SEQ ID NO: 1015124 - RNA, 16 nt, Homo sapiens
gauccacccaccucag

SEQ ID NO: 1015125 - RNA, 18 nt, Homo sapiens
gaucccaagacaaugaaa

SEQ ID NO: 1015126 - RNA, 14 nt, Homo sapiens
gaucccaucuugau

SEQ ID NO: 1015127 - RNA, 23 nt, Homo sapiens
gauccccccacagccccugguca

SEQ ID NO: 1015128 - RNA, 13 nt, Homo sapiens
gaucccucugggc

SEQ ID NO: 1015129 - RNA, 14 nt, Homo sapiens
gauccgagucuacc

SEQ ID NO: 1015130 - RNA, 22 nt, Homo sapiens
gauccuaaaacaaaagcucauc

SEQ ID NO: 1015131 - RNA, 17 nt, Homo sapiens
gauccuaguuccaccau

SEQ ID NO: 1015132 - RNA, 23 nt, Homo sapiens
gauccucauauggcccaguguca

SEQ ID NO: 1015133 - RNA, 16 nt, Homo sapiens
gauccucccaccucag

SEQ ID NO: 1015134 - RNA, 15 nt, Homo sapiens
gauccuucaaagagu

SEQ ID NO: 1015135 - RNA, 20 nt, Homo sapiens
gauccuucaaagagucauau

SEQ ID NO: 1015136 - RNA, 20 nt, Homo sapiens
gaucgcgccacugcacucca

SEQ ID NO: 1015137 - RNA, 19 nt, Homo sapiens
gaucuaagccuuuccauaa

SEQ ID NO: 1015138 - RNA, 14 nt, Homo sapiens
gaucucgacucacu

SEQ ID NO: 1015139 - RNA, 22 nt, Homo sapiens
gaucucugcuuuggaaaucaca

SEQ ID NO: 1015140 - RNA, 20 nt, Homo sapiens
gaucuggugccuccagacau

SEQ ID NO: 1015141 - RNA, 16 nt, Homo sapiens
gaucuuaaagcauucc

SEQ ID NO: 1015142 - RNA, 18 nt, Homo sapiens
gaucuuaaagcauucccc

SEQ ID NO: 1015143 - RNA, 22 nt, Homo sapiens
gaucuuaggcaugacuguagaa

SEQ ID NO: 1015144 - RNA, 12 nt, Homo sapiens
gaucuucagagc

SEQ ID NO: 1015145 - RNA, 18 nt, Homo sapiens
gaucuucgugauacugua

SEQ ID NO: 1015146 - RNA, 16 nt, Homo sapiens
gaucuuuggacagaag

SEQ ID NO: 1015147 - RNA, 15 nt, Homo sapiens
gaugaagacaacagc

SEQ ID NO: 1015148 - RNA, 12 nt, Homo sapiens
gaugaagcuucc

SEQ ID NO: 1015149 - RNA, 17 nt, Homo sapiens
gaugaauguaugugcac

SEQ ID NO: 1015150 - RNA, 18 nt, Homo sapiens
gaugacaaaaauucaacu

SEQ ID NO: 1015151 - RNA, 22 nt, Homo sapiens
gaugacuuuuuauacuuuguaa

SEQ ID NO: 1015152 - RNA, 21 nt, Homo sapiens
gaugagaguacaccccaacag

SEQ ID NO: 1015153 - RNA, 12 nt, Homo sapiens
gaugagcauuua

SEQ ID NO: 1015154 - RNA, 14 nt, Homo sapiens
gaugaguacccaaa

SEQ ID NO: 1015155 - RNA, 18 nt, Homo sapiens
gaugaugacguccucuca

SEQ ID NO: 1015156 - RNA, 15 nt, Homo sapiens
gaugaugccucauga

SEQ ID NO: 1015157 - RNA, 23 nt, Homo sapiens
gaugauuuuggccucauuacuuu

SEQ ID NO: 1015158 - RNA, 18 nt, Homo sapiens
gaugcaaugacucaggac

SEQ ID NO: 1015159 - RNA, 18 nt, Homo sapiens
gaugcagaaaauugccua

SEQ ID NO: 1015160 - RNA, 16 nt, Homo sapiens
gaugcagagucagcag

SEQ ID NO: 1015161 - RNA, 15 nt, Homo sapiens
gaugcagauccagag

SEQ ID NO: 1015162 - RNA, 20 nt, Homo sapiens
gaugcagcauuuuguauuug

SEQ ID NO: 1015163 - RNA, 15 nt, Homo sapiens
gaugcagugcuucca

SEQ ID NO: 1015164 - RNA, 16 nt, Homo sapiens
gaugccagggacccac

SEQ ID NO: 1015165 - RNA, 21 nt, Homo sapiens
gaugccccagggaccuuugua

SEQ ID NO: 1015166 - RNA, 16 nt, Homo sapiens
gaugccuucuccagac

SEQ ID NO: 1015167 - RNA, 14 nt, Homo sapiens
gaugcuacugcugc

SEQ ID NO: 1015168 - RNA, 15 nt, Homo sapiens
gauggaagcuuccag

SEQ ID NO: 1015169 - RNA, 17 nt, Homo sapiens
gauggaauaaagcccuu

SEQ ID NO: 1015170 - RNA, 21 nt, Homo sapiens
gauggcauuuuuugcaaguua

SEQ ID NO: 1015171 - RNA, 22 nt, Homo sapiens
gauggccacugugaauaacugu

SEQ ID NO: 1015172 - RNA, 21 nt, Homo sapiens
gaugggggaaagcacaggugg

SEQ ID NO: 1015173 - RNA, 20 nt, Homo sapiens
gauguaccagcaucucccag

SEQ ID NO: 1015174 - RNA, 17 nt, Homo sapiens
gauguccacagaugccu

SEQ ID NO: 1015175 - RNA, 14 nt, Homo sapiens
gauguccucaccac

SEQ ID NO: 1015176 - RNA, 17 nt, Homo sapiens
gaugucugggugaccuc

SEQ ID NO: 1015177 - RNA, 20 nt, Homo sapiens
gaugugccuggguggacaug

SEQ ID NO: 1015178 - RNA, 13 nt, Homo sapiens
gaugugggguccc

SEQ ID NO: 1015179 - RNA, 13 nt, Homo sapiens
gauguguggacac

SEQ ID NO: 1015180 - RNA, 14 nt, Homo sapiens
gauguuccacucca

SEQ ID NO: 1015181 - RNA, 20 nt, Homo sapiens
gauguuccacuccacuuugu

SEQ ID NO: 1015182 - RNA, 18 nt, Homo sapiens
gauguugcuggacuguca

SEQ ID NO: 1015183 - RNA, 15 nt, Homo sapiens
gauguuucaaaaaau

SEQ ID NO: 1015184 - RNA, 22 nt, Homo sapiens
gauuacaagcgugagccacugc

SEQ ID NO: 1015185 - RNA, 15 nt, Homo sapiens
gauuacaggcaccca

SEQ ID NO: 1015186 - RNA, 19 nt, Homo sapiens
gauuacaggcaugagccac

SEQ ID NO: 1015187 - RNA, 21 nt, Homo sapiens
gauuaccuaguagucauuuca

SEQ ID NO: 1015188 - RNA, 21 nt, Homo sapiens
gauuacugccauucacuucau

SEQ ID NO: 1015189 - RNA, 21 nt, Homo sapiens
gauuaggacuuuuauugugaa

SEQ ID NO: 1015190 - RNA, 20 nt, Homo sapiens
gauuagucucuucuguguga

SEQ ID NO: 1015191 - RNA, 17 nt, Homo sapiens
gauuauagugacaauga

SEQ ID NO: 1015192 - RNA, 15 nt, Homo sapiens
gauuauuacuggcaa

SEQ ID NO: 1015193 - RNA, 13 nt, Homo sapiens
gauuauucagugu

SEQ ID NO: 1015194 - RNA, 22 nt, Homo sapiens
gauuauuuaauaacauuaccuu

SEQ ID NO: 1015195 - RNA, 23 nt, Homo sapiens
gauucacccccaaacagugacau

SEQ ID NO: 1015196 - RNA, 20 nt, Homo sapiens
gauucaggggucugaugaca

SEQ ID NO: 1015197 - RNA, 19 nt, Homo sapiens
gauuccaggcgaugugcaa

SEQ ID NO: 1015198 - RNA, 18 nt, Homo sapiens
gauucgaaacuccauuga

SEQ ID NO: 1015199 - RNA, 16 nt, Homo sapiens
gauucucgcuuaaaaa

SEQ ID NO: 1015200 - RNA, 18 nt, Homo sapiens
gauucuggcuagugucua

SEQ ID NO: 1015201 - RNA, 14 nt, Homo sapiens
gauucuucccacac

SEQ ID NO: 1015202 - RNA, 16 nt, Homo sapiens
gauucuuccugcuuag

SEQ ID NO: 1015203 - RNA, 17 nt, Homo sapiens
gauucuuucccaauuca

SEQ ID NO: 1015204 - RNA, 16 nt, Homo sapiens
gauugagaaguuuugu

SEQ ID NO: 1015205 - RNA, 19 nt, Homo sapiens
gauugauagaguguuauca

SEQ ID NO: 1015206 - RNA, 15 nt, Homo sapiens
gauugauuaccaagu

SEQ ID NO: 1015207 - RNA, 19 nt, Homo sapiens
gauugcaugugacucugaa

SEQ ID NO: 1015208 - RNA, 23 nt, Homo sapiens
gauugccucugaagccuauguau

SEQ ID NO: 1015209 - RNA, 16 nt, Homo sapiens
gauuggagauagggaa

SEQ ID NO: 1015210 - RNA, 13 nt, Homo sapiens
gauuggcacagac

SEQ ID NO: 1015211 - RNA, 18 nt, Homo sapiens
gauuggcaggaguuggaa

SEQ ID NO: 1015212 - RNA, 14 nt, Homo sapiens
gauuuaauucacau

SEQ ID NO: 1015213 - RNA, 15 nt, Homo sapiens
gauuuauucugccaa

SEQ ID NO: 1015214 - RNA, 13 nt, Homo sapiens
gagcuagaaccua

SEQ ID NO: 1015215 - RNA, 16 nt, Homo sapiens
gagcuagaaccuggag

SEQ ID NO: 1015216 - RNA, 18 nt, Homo sapiens
gagcuagaaccuggagag

SEQ ID NO: 1015217 - RNA, 19 nt, Homo sapiens
gagcucgcauuugucaaug

SEQ ID NO: 1015218 - RNA, 21 nt, Homo sapiens
gagcucgguggacccagggau

SEQ ID NO: 1015219 - RNA, 21 nt, Homo sapiens
gagcugaguaggaggccucca

SEQ ID NO: 1015220 - RNA, 17 nt, Homo sapiens
gagcugcucucucauga

SEQ ID NO: 1015221 - RNA, 17 nt, Homo sapiens
gagcuggcaaagguggc

SEQ ID NO: 1015222 - RNA, 16 nt, Homo sapiens
gagcugggauguuucu

SEQ ID NO: 1015223 - RNA, 16 nt, Homo sapiens
gagcugggggccauga

SEQ ID NO: 1015224 - RNA, 21 nt, Homo sapiens
gagcuucccugacucauucug

SEQ ID NO: 1015225 - RNA, 13 nt, Homo sapiens
gagcuugcaguga

SEQ ID NO: 1015226 - RNA, 15 nt, Homo sapiens
gagcuuuauguaaua

SEQ ID NO: 1015227 - RNA, 18 nt, Homo sapiens
gagcuuugguaaucucug

SEQ ID NO: 1015228 - RNA, 22 nt, Homo sapiens
gagcuuugguaaucucugugaa

SEQ ID NO: 1015229 - RNA, 13 nt, Homo sapiens
gaggaaacuuuga

SEQ ID NO: 1015230 - RNA, 17 nt, Homo sapiens
gaggaacuguccagaga

SEQ ID NO: 1015231 - RNA, 23 nt, Homo sapiens
gaggaagggcaaaaccacuagaa

SEQ ID NO: 1015232 - RNA, 13 nt, Homo sapiens
gaggaaugcuccc

SEQ ID NO: 1015233 - RNA, 15 nt, Homo sapiens
gaggacucacuugcc

SEQ ID NO: 1015234 - RNA, 19 nt, Homo sapiens
gaggacuucuggcagggaa

SEQ ID NO: 1015235 - RNA, 15 nt, Homo sapiens
gaggagaaacuggaa

SEQ ID NO: 1015236 - RNA, 18 nt, Homo sapiens
gaggagcaggggcgugga

SEQ ID NO: 1015237 - RNA, 22 nt, Homo sapiens
gaggagcgggaccuguggcucu

SEQ ID NO: 1015238 - RNA, 14 nt, Homo sapiens
gaggaguuccuuga

SEQ ID NO: 1015239 - RNA, 13 nt, Homo sapiens
gaggaucacugga

SEQ ID NO: 1015240 - RNA, 14 nt, Homo sapiens
gaggaucuggagaa

SEQ ID NO: 1015241 - RNA, 22 nt, Homo sapiens
gaggaugaauguaugugcacug

SEQ ID NO: 1015242 - RNA, 19 nt, Homo sapiens
gaggauugcuugagcucag

SEQ ID NO: 1015243 - RNA, 16 nt, Homo sapiens
gaggauuucaucucuu

SEQ ID NO: 1015244 - RNA, 17 nt, Homo sapiens
gaggcacgaaugaucuu

SEQ ID NO: 1015245 - RNA, 17 nt, Homo sapiens
gaggcagaacugcuuga

SEQ ID NO: 1015246 - RNA, 20 nt, Homo sapiens
gaggcagagguugcagugag

SEQ ID NO: 1015247 - RNA, 20 nt, Homo sapiens
gaggcaggagaaucgcuuga

SEQ ID NO: 1015248 - RNA, 15 nt, Homo sapiens
gaggcaggaggauug

SEQ ID NO: 1015249 - RNA, 19 nt, Homo sapiens
gaggcauugcacagggaga

SEQ ID NO: 1015250 - RNA, 13 nt, Homo sapiens
gaggccacgugau

SEQ ID NO: 1015251 - RNA, 18 nt, Homo sapiens
gaggccagccagugaccu

SEQ ID NO: 1015252 - RNA, 19 nt, Homo sapiens
gaggccaguaccuuuccau

SEQ ID NO: 1015253 - RNA, 15 nt, Homo sapiens
gaggccucgacccac

SEQ ID NO: 1015254 - RNA, 16 nt, Homo sapiens
gaggccuguccugacc

SEQ ID NO: 1015255 - RNA, 19 nt, Homo sapiens
gaggcgggcagaucaccag

SEQ ID NO: 1015256 - RNA, 22 nt, Homo sapiens
gaggcucugugcccccaucacc

SEQ ID NO: 1015257 - RNA, 18 nt, Homo sapiens
gaggcugagacaggagaa

SEQ ID NO: 1015258 - RNA, 16 nt, Homo sapiens
gaggcugcagaaggcc

SEQ ID NO: 1015259 - RNA, 13 nt, Homo sapiens
gaggcugcaguga

SEQ ID NO: 1015260 - RNA, 23 nt, Homo sapiens
gaggcuggaggccggaaucucag

SEQ ID NO: 1015261 - RNA, 12 nt, Homo sapiens
gaggcuggccaa

SEQ ID NO: 1015262 - RNA, 13 nt, Homo sapiens
gaggcugucuucu

SEQ ID NO: 1015263 - RNA, 14 nt, Homo sapiens
gagggaaaaugagu

SEQ ID NO: 1015264 - RNA, 18 nt, Homo sapiens
gagggaccucucccaggg

SEQ ID NO: 1015265 - RNA, 14 nt, Homo sapiens
gagggagaggugga

SEQ ID NO: 1015266 - RNA, 16 nt, Homo sapiens
gagggaggagaaugag

SEQ ID NO: 1015267 - RNA, 14 nt, Homo sapiens
gagggagugacaga

SEQ ID NO: 1015268 - RNA, 20 nt, Homo sapiens
gagggcagggacuuuggucu

SEQ ID NO: 1015269 - RNA, 16 nt, Homo sapiens
gagggcagucgauaga

SEQ ID NO: 1015270 - RNA, 17 nt, Homo sapiens
gagggccacaugggagg

SEQ ID NO: 1015271 - RNA, 22 nt, Homo sapiens
gagggcgaccccgucacagccu

SEQ ID NO: 1015272 - RNA, 20 nt, Homo sapiens
gagggcuagaaccuagaagg

SEQ ID NO: 1015273 - RNA, 18 nt, Homo sapiens
gagggcuagaaccuggag

SEQ ID NO: 1015274 - RNA, 23 nt, Homo sapiens
gagggguuuuuuuguacuuugua

SEQ ID NO: 1015275 - RNA, 23 nt, Homo sapiens
gaggguccucaguccacugcuga

SEQ ID NO: 1015276 - RNA, 21 nt, Homo sapiens
gagggugaggggcuggcacug

SEQ ID NO: 1015277 - RNA, 18 nt, Homo sapiens
gagggugggguaaccaaa

SEQ ID NO: 1015278 - RNA, 18 nt, Homo sapiens
gaggguuucugagcugcu

SEQ ID NO: 1015279 - RNA, 13 nt, Homo sapiens
gagguacucuccu

SEQ ID NO: 1015280 - RNA, 17 nt, Homo sapiens
gagguacugagagugaa

SEQ ID NO: 1015281 - RNA, 20 nt, Homo sapiens
gagguaggagaauugcuuga

SEQ ID NO: 1015282 - RNA, 23 nt, Homo sapiens
gaggucauuaaaauuacauugag

SEQ ID NO: 1015283 - RNA, 16 nt, Homo sapiens
gagguggagcaaagug

SEQ ID NO: 1015284 - RNA, 20 nt, Homo sapiens
gagguggagguugcagugag

SEQ ID NO: 1015285 - RNA, 20 nt, Homo sapiens
gaggugggaggauugcuuga

SEQ ID NO: 1015286 - RNA, 16 nt, Homo sapiens
gagguggggccuggag

SEQ ID NO: 1015287 - RNA, 15 nt, Homo sapiens
gagguuauaggucac

SEQ ID NO: 1015288 - RNA, 19 nt, Homo sapiens
gagguuuggggucugccac

SEQ ID NO: 1015289 - RNA, 21 nt, Homo sapiens
gaguaauauagugacuaugaa

SEQ ID NO: 1015290 - RNA, 16 nt, Homo sapiens
gaguaggaagacuuug

SEQ ID NO: 1015291 - RNA, 20 nt, Homo sapiens
gaguagggacucagggccau

SEQ ID NO: 1015292 - RNA, 13 nt, Homo sapiens
gagucacugccuc

SEQ ID NO: 1015293 - RNA, 22 nt, Homo sapiens
gagucagugccagguccuugcc

SEQ ID NO: 1015294 - RNA, 13 nt, Homo sapiens
gaguccacuccca

SEQ ID NO: 1015295 - RNA, 14 nt, Homo sapiens
gaguccacucccag

SEQ ID NO: 1015296 - RNA, 15 nt, Homo sapiens
gaguccucacuccca

SEQ ID NO: 1015297 - RNA, 20 nt, Homo sapiens
gaguccucguagccaucucu

SEQ ID NO: 1015298 - RNA, 11 nt, Homo sapiens
gaguccucuau

SEQ ID NO: 1015299 - RNA, 22 nt, Homo sapiens
gagucuccaacggcaagggaac

SEQ ID NO: 1015300 - RNA, 18 nt, Homo sapiens
gagucugucucugucaug

SEQ ID NO: 1015301 - RNA, 15 nt, Homo sapiens
gagucuugugugcau

SEQ ID NO: 1015302 - RNA, 15 nt, Homo sapiens
gagugaaccuaccuu

SEQ ID NO: 1015303 - RNA, 19 nt, Homo sapiens
gagugagacucugucucaa

SEQ ID NO: 1015304 - RNA, 14 nt, Homo sapiens
gagugauccuccaa

SEQ ID NO: 1015305 - RNA, 20 nt, Homo sapiens
gagugcaauggcgugaucuc

SEQ ID NO: 1015306 - RNA, 19 nt, Homo sapiens
gagugcaguggcgugaucu

SEQ ID NO: 1015307 - RNA, 23 nt, Homo sapiens
gagugcccagaacuggacucagg

SEQ ID NO: 1015308 - RNA, 18 nt, Homo sapiens
gagugcccccaacagcac

SEQ ID NO: 1015309 - RNA, 21 nt, Homo sapiens
gagugccguaacaacuguggu

SEQ ID NO: 1015310 - RNA, 14 nt, Homo sapiens
gagugcgugcucag

SEQ ID NO: 1015311 - RNA, 13 nt, Homo sapiens
gagugggaccaac

SEQ ID NO: 1015312 - RNA, 19 nt, Homo sapiens
gagugggcccaaugcacuu

SEQ ID NO: 1015313 - RNA, 23 nt, Homo sapiens
gagugggcccaaugcacuuuguu

SEQ ID NO: 1015314 - RNA, 14 nt, Homo sapiens
gaguggggaugaca

SEQ ID NO: 1015315 - RNA, 13 nt, Homo sapiens
gagugugugcaag

SEQ ID NO: 1015316 - RNA, 15 nt, Homo sapiens
uaccuaguagucauu

SEQ ID NO: 1015317 - RNA, 17 nt, Homo sapiens
uaccuaguggcccuuca

SEQ ID NO: 1015318 - RNA, 20 nt, Homo sapiens
uaccucaaccaaugccaaaa

SEQ ID NO: 1015319 - RNA, 11 nt, Homo sapiens
uaccucaaggg

SEQ ID NO: 1015320 - RNA, 14 nt, Homo sapiens
uaccucacuggggu

SEQ ID NO: 1015321 - RNA, 13 nt, Homo sapiens
uaccucagccuag

SEQ ID NO: 1015322 - RNA, 23 nt, Homo sapiens
uaccuccuaauuccacacccuca

SEQ ID NO: 1015323 - RNA, 14 nt, Homo sapiens
uaccuccugagaaa

SEQ ID NO: 1015324 - RNA, 16 nt, Homo sapiens
uaccucuuauugcaaa

SEQ ID NO: 1015325 - RNA, 14 nt, Homo sapiens
uaccucuuggcugc

SEQ ID NO: 1015326 - RNA, 20 nt, Homo sapiens
uaccugaaauaaaauucauu

SEQ ID NO: 1015327 - RNA, 18 nt, Homo sapiens
uaccugaccaacaguucc

SEQ ID NO: 1015328 - RNA, 14 nt, Homo sapiens
uaccugccucagcc

SEQ ID NO: 1015329 - RNA, 22 nt, Homo sapiens
uaccuucaauaaaguaucuaca

SEQ ID NO: 1015330 - RNA, 21 nt, Homo sapiens
uaccuucuaccucuuggcugc

SEQ ID NO: 1015331 - RNA, 17 nt, Homo sapiens
uaccuugaacacugggg

SEQ ID NO: 1015332 - RNA, 21 nt, Homo sapiens
uaccuuuuaauuaaugaaaua

SEQ ID NO: 1015333 - RNA, 22 nt, Homo sapiens
uaccuuuuauuuuaauguuucc

SEQ ID NO: 1015334 - RNA, 18 nt, Homo sapiens
uaccuuuugcuguggcaa

SEQ ID NO: 1015335 - RNA, 15 nt, Homo sapiens
uacguaucagcggcc

SEQ ID NO: 1015336 - RNA, 22 nt, Homo sapiens
uacguauuuuuucuaaugugca

SEQ ID NO: 1015337 - RNA, 17 nt, Homo sapiens
uacgugacuguggcaca

SEQ ID NO: 1015338 - RNA, 11 nt, Homo sapiens
uacgugcaaua

SEQ ID NO: 1015339 - RNA, 21 nt, Homo sapiens
uacguggcaaauuaacuugag

SEQ ID NO: 1015340 - RNA, 13 nt, Homo sapiens
uacguugugcauu

SEQ ID NO: 1015341 - RNA, 14 nt, Homo sapiens
uacguugugcauuu

SEQ ID NO: 1015342 - RNA, 20 nt, Homo sapiens
uacguuuccugagaaguguc

SEQ ID NO: 1015343 - RNA, 16 nt, Homo sapiens
uacuaagcauagcaaa

SEQ ID NO: 1015344 - RNA, 23 nt, Homo sapiens
uacuaagccacaagaaauuugau

SEQ ID NO: 1015345 - RNA, 17 nt, Homo sapiens
uacuaaggaaucuuucu

SEQ ID NO: 1015346 - RNA, 13 nt, Homo sapiens
uacuacagcaaua

SEQ ID NO: 1015347 - RNA, 13 nt, Homo sapiens
uacuagcauauga

SEQ ID NO: 1015348 - RNA, 12 nt, Homo sapiens
uacucaaaagag

SEQ ID NO: 1015349 - RNA, 23 nt, Homo sapiens
uacucaaggaauuugcauuuagu

SEQ ID NO: 1015350 - RNA, 17 nt, Homo sapiens
uacuccaggagacccac

SEQ ID NO: 1015351 - RNA, 14 nt, Homo sapiens
uacucucccauggc

SEQ ID NO: 1015352 - RNA, 14 nt, Homo sapiens
uacucuccuagaga

SEQ ID NO: 1015353 - RNA, 10 nt, Homo sapiens
uacucucuua

SEQ ID NO: 1015354 - RNA, 21 nt, Homo sapiens
uacugaaagguuacccuguaa

SEQ ID NO: 1015355 - RNA, 21 nt, Homo sapiens
uacugaacaaucaaagcacuu

SEQ ID NO: 1015356 - RNA, 15 nt, Homo sapiens
uacugaacacuucaa

SEQ ID NO: 1015357 - RNA, 22 nt, Homo sapiens
uacugaaucuucaagaccaaag

SEQ ID NO: 1015358 - RNA, 17 nt, Homo sapiens
uacugaugauguagaua

SEQ ID NO: 1015359 - RNA, 16 nt, Homo sapiens
uacugauucacugcau

SEQ ID NO: 1015360 - RNA, 17 nt, Homo sapiens
uacugauuuuugugauu

SEQ ID NO: 1015361 - RNA, 17 nt, Homo sapiens
uacugcccaauaugcag

SEQ ID NO: 1015362 - RNA, 17 nt, Homo sapiens
uacugggacugugcuca

SEQ ID NO: 1015363 - RNA, 21 nt, Homo sapiens
uacugggacugugcucagaga

SEQ ID NO: 1015364 - RNA, 21 nt, Homo sapiens
uacugggguuuuucuaagaaa

SEQ ID NO: 1015365 - RNA, 14 nt, Homo sapiens
uacuggugcaguca

SEQ ID NO: 1015366 - RNA, 13 nt, Homo sapiens
uacuguacuuaau

SEQ ID NO: 1015367 - RNA, 19 nt, Homo sapiens
uacugugaaacuggcacug

SEQ ID NO: 1015368 - RNA, 16 nt, Homo sapiens
uacuguugugaccuga

SEQ ID NO: 1015369 - RNA, 19 nt, Homo sapiens
uacuuaauuccuuucucau

SEQ ID NO: 1015370 - RNA, 13 nt, Homo sapiens
uacuuacccucac

SEQ ID NO: 1015371 - RNA, 13 nt, Homo sapiens
uacuuacguguga

SEQ ID NO: 1015372 - RNA, 18 nt, Homo sapiens
uacuuagcagcuaucucu

SEQ ID NO: 1015373 - RNA, 16 nt, Homo sapiens
uacuucaaacugagau

SEQ ID NO: 1015374 - RNA, 22 nt, Homo sapiens
uacuucaacacuucauguauug

SEQ ID NO: 1015375 - RNA, 16 nt, Homo sapiens
uacuucaagaucugaa

SEQ ID NO: 1015376 - RNA, 17 nt, Homo sapiens
uacuucauggacuucca

SEQ ID NO: 1015377 - RNA, 12 nt, Homo sapiens
uacuucucacca

SEQ ID NO: 1015378 - RNA, 20 nt, Homo sapiens
uacuucuugauaccugggau

SEQ ID NO: 1015379 - RNA, 19 nt, Homo sapiens
uacuugaaauaccagugaa

SEQ ID NO: 1015380 - RNA, 22 nt, Homo sapiens
uacuugaaauaccagugaacca

SEQ ID NO: 1015381 - RNA, 23 nt, Homo sapiens
uacuugagugguguguguuauca

SEQ ID NO: 1015382 - RNA, 16 nt, Homo sapiens
uacuugggccauagcu

SEQ ID NO: 1015383 - RNA, 12 nt, Homo sapiens
uacuuuaccucc

SEQ ID NO: 1015384 - RNA, 19 nt, Homo sapiens
uacuuugaguuagugccau

SEQ ID NO: 1015385 - RNA, 19 nt, Homo sapiens
uacuuugccuuuugcaaac

SEQ ID NO: 1015386 - RNA, 16 nt, Homo sapiens
uacuuuuaaaugucuu

SEQ ID NO: 1015387 - RNA, 20 nt, Homo sapiens
uacuuuuauaauaaaaggaa

SEQ ID NO: 1015388 - RNA, 17 nt, Homo sapiens
uacuuuucuuuccucag

SEQ ID NO: 1015389 - RNA, 22 nt, Homo sapiens
uacuuuuuucuuauuuaacuua

SEQ ID NO: 1015390 - RNA, 22 nt, Homo sapiens
uagaaaaaaaauaaaacuucaa

SEQ ID NO: 1015391 - RNA, 13 nt, Homo sapiens
uagaaaaaccacc

SEQ ID NO: 1015392 - RNA, 18 nt, Homo sapiens
uagaaaagauugggucua

SEQ ID NO: 1015393 - RNA, 15 nt, Homo sapiens
uagaaagaagaugaa

SEQ ID NO: 1015394 - RNA, 13 nt, Homo sapiens
uagaaaguagcca

SEQ ID NO: 1015395 - RNA, 12 nt, Homo sapiens
uagaaauaagcc

SEQ ID NO: 1015396 - RNA, 21 nt, Homo sapiens
uagaaauaagcccaacagaca

SEQ ID NO: 1015397 - RNA, 12 nt, Homo sapiens
uagaaauggauu

SEQ ID NO: 1015398 - RNA, 14 nt, Homo sapiens
uagaaauuccccac

SEQ ID NO: 1015399 - RNA, 18 nt, Homo sapiens
uagaaauuggcuggaugu

SEQ ID NO: 1015400 - RNA, 17 nt, Homo sapiens
uagaacacugcauuaga

SEQ ID NO: 1015401 - RNA, 19 nt, Homo sapiens
uagaaccaccaacaagcaa

SEQ ID NO: 1015402 - RNA, 11 nt, Homo sapiens
uagaaccugga

SEQ ID NO: 1015403 - RNA, 14 nt, Homo sapiens
uagaagauggcacu

SEQ ID NO: 1015404 - RNA, 22 nt, Homo sapiens
uagaagccacuauuacugggac

SEQ ID NO: 1015405 - RNA, 17 nt, Homo sapiens
uagaaggccacauguca

SEQ ID NO: 1015406 - RNA, 12 nt, Homo sapiens
uagaagggcaaa

SEQ ID NO: 1015407 - RNA, 22 nt, Homo sapiens
uagaagggccaguccugccugg

SEQ ID NO: 1015408 - RNA, 20 nt, Homo sapiens
uagaagggcuagaaccugga

SEQ ID NO: 1015409 - RNA, 22 nt, Homo sapiens
uagaaguagcaaaaaguauuga

SEQ ID NO: 1015410 - RNA, 12 nt, Homo sapiens
uagaagucacac

SEQ ID NO: 1015411 - RNA, 14 nt, Homo sapiens
uagaaguuacugaa

SEQ ID NO: 1015412 - RNA, 16 nt, Homo sapiens
uagaauagauauccac

SEQ ID NO: 1015413 - RNA, 17 nt, Homo sapiens
uagaauauccaugaccu

SEQ ID NO: 1015414 - RNA, 19 nt, Homo sapiens
uagaauuccuucaggguga

SEQ ID NO: 1015415 - RNA, 17 nt, Homo sapiens
uagaauuggagaguaaa

SEQ ID NO: 1015416 - RNA, 23 nt, Homo sapiens
uagacccgaggaaacucagaguc

SEQ ID NO: 1015417 - RNA, 13 nt, Homo sapiens
uagaccuaaaaua

SEQ ID NO: 1015418 - RNA, 14 nt, Homo sapiens
uagacuacauuuag

SEQ ID NO: 1015419 - RNA, 17 nt, Homo sapiens
uagacuucugcuuucca

SEQ ID NO: 1015420 - RNA, 19 nt, Homo sapiens
uagacuuucuuaucacuua

SEQ ID NO: 1015421 - RNA, 17 nt, Homo sapiens
uagagaaauuugccaau

SEQ ID NO: 1015422 - RNA, 22 nt, Homo sapiens
uagagacaggguuucacugugu

SEQ ID NO: 1015423 - RNA, 22 nt, Homo sapiens
uagccugccucuucucuacucu

SEQ ID NO: 1015424 - RNA, 22 nt, Homo sapiens
uagccuggauauuauucuugua

SEQ ID NO: 1015425 - RNA, 18 nt, Homo sapiens
uagccuuagaagucacac

SEQ ID NO: 1015426 - RNA, 15 nt, Homo sapiens
uagccuuugucccag

SEQ ID NO: 1015427 - RNA, 14 nt, Homo sapiens
uagcgucaguauuu

SEQ ID NO: 1015428 - RNA, 21 nt, Homo sapiens
uagcuaccucacuaugcugcu

SEQ ID NO: 1015429 - RNA, 11 nt, Homo sapiens
uagcucaggug

SEQ ID NO: 1015430 - RNA, 15 nt, Homo sapiens
uagcuuagaccucag

SEQ ID NO: 1015431 - RNA, 22 nt, Homo sapiens
uagcuuccaagagacaugcuga

SEQ ID NO: 1015432 - RNA, 17 nt, Homo sapiens
uaggaaaaguacauuua

SEQ ID NO: 1015433 - RNA, 18 nt, Homo sapiens
uaggaaaugaaugaucuu

SEQ ID NO: 1015434 - RNA, 12 nt, Homo sapiens
uaggaacauacu

SEQ ID NO: 1015435 - RNA, 15 nt, Homo sapiens
uaggaagacuuugga

SEQ ID NO: 1015436 - RNA, 13 nt, Homo sapiens
uaggaaguaggaa

SEQ ID NO: 1015437 - RNA, 16 nt, Homo sapiens
uaggaauaaauaaaaa

SEQ ID NO: 1015438 - RNA, 14 nt, Homo sapiens
uaggauaucuuggc

SEQ ID NO: 1015439 - RNA, 12 nt, Homo sapiens
uaggauugugcc

SEQ ID NO: 1015440 - RNA, 19 nt, Homo sapiens
uaggauuucuguauuugcc

SEQ ID NO: 1015441 - RNA, 15 nt, Homo sapiens
uaggcaggacaugcu

SEQ ID NO: 1015442 - RNA, 18 nt, Homo sapiens
uaggcaucacaugcucaa

SEQ ID NO: 1015443 - RNA, 16 nt, Homo sapiens
uaggcaugguggacuc

SEQ ID NO: 1015444 - RNA, 21 nt, Homo sapiens
uaggcaugguggacucgccug

SEQ ID NO: 1015445 - RNA, 14 nt, Homo sapiens
uaggcauuugcuga

SEQ ID NO: 1015446 - RNA, 19 nt, Homo sapiens
uaggcucagagaugugcac

SEQ ID NO: 1015447 - RNA, 14 nt, Homo sapiens
uagggaaaaaccag

SEQ ID NO: 1015448 - RNA, 14 nt, Homo sapiens
uagggaucccucau

SEQ ID NO: 1015449 - RNA, 15 nt, Homo sapiens
uagggaugacuguga

SEQ ID NO: 1015450 - RNA, 16 nt, Homo sapiens
uagggcaacaauacau

SEQ ID NO: 1015451 - RNA, 14 nt, Homo sapiens
uagggcaguggagu

SEQ ID NO: 1015452 - RNA, 16 nt, Homo sapiens
uagguacgucaaagca

SEQ ID NO: 1015453 - RNA, 13 nt, Homo sapiens
uaggucaagaaga

SEQ ID NO: 1015454 - RNA, 15 nt, Homo sapiens
uaggugaaaguuaau

SEQ ID NO: 1015455 - RNA, 22 nt, Homo sapiens
uaggugaaaguuaauccacugu

SEQ ID NO: 1015456 - RNA, 11 nt, Homo sapiens
uagguggcaag

SEQ ID NO: 1015457 - RNA, 19 nt, Homo sapiens
uagguucaggaagaccaca

SEQ ID NO: 1015458 - RNA, 19 nt, Homo sapiens
uagguuugauauguaguua

SEQ ID NO: 1015459 - RNA, 15 nt, Homo sapiens
uaguaacaguuguga

SEQ ID NO: 1015460 - RNA, 16 nt, Homo sapiens
uaguaacauagacaaa

SEQ ID NO: 1015461 - RNA, 19 nt, Homo sapiens
uaguaacuuuccauagggc

SEQ ID NO: 1015462 - RNA, 23 nt, Homo sapiens
uaguacuugggagaccuguaauc

SEQ ID NO: 1015463 - RNA, 20 nt, Homo sapiens
uaguauaauaauuacugguu

SEQ ID NO: 1015464 - RNA, 20 nt, Homo sapiens
uagucacauggccuaugcac

SEQ ID NO: 1015465 - RNA, 21 nt, Homo sapiens
uagucacauggccuaugcaca

SEQ ID NO: 1015466 - RNA, 18 nt, Homo sapiens
uagucagcuacuucugaa

SEQ ID NO: 1015467 - RNA, 18 nt, Homo sapiens
uagucccagcuacucaga

SEQ ID NO: 1015468 - RNA, 20 nt, Homo sapiens
uagucccagcuacuugagag

SEQ ID NO: 1015469 - RNA, 19 nt, Homo sapiens
uaguccgcuuucucuugcu

SEQ ID NO: 1015470 - RNA, 20 nt, Homo sapiens
uagucuacucuuaagccauc

SEQ ID NO: 1015471 - RNA, 18 nt, Homo sapiens
uagucuccuuugcacuga

SEQ ID NO: 1015472 - RNA, 14 nt, Homo sapiens
uagugauggagcuu

SEQ ID NO: 1015473 - RNA, 16 nt, Homo sapiens
uagugcuaguggauuu

SEQ ID NO: 1015474 - RNA, 22 nt, Homo sapiens
uaguggcuuuuuuccuccugug

SEQ ID NO: 1015475 - RNA, 13 nt, Homo sapiens
uaguggucuuugu

SEQ ID NO: 1015476 - RNA, 21 nt, Homo sapiens
uaguggugacugugggcucca

SEQ ID NO: 1015477 - RNA, 14 nt, Homo sapiens
uaguggugugauuu

SEQ ID NO: 1015478 - RNA, 14 nt, Homo sapiens
uagugguuacccag

SEQ ID NO: 1015479 - RNA, 14 nt, Homo sapiens
uaguguacaugaaa

SEQ ID NO: 1015480 - RNA, 12 nt, Homo sapiens
uagugucacuua

SEQ ID NO: 1015481 - RNA, 12 nt, Homo sapiens
uagugucuauca

SEQ ID NO: 1015482 - RNA, 21 nt, Homo sapiens
uaguguuggaaaaugugcaau

SEQ ID NO: 1015483 - RNA, 17 nt, Homo sapiens
uaguuacuccagugcca

SEQ ID NO: 1015484 - RNA, 15 nt, Homo sapiens
uaguuguaucucuuu

SEQ ID NO: 1015485 - RNA, 22 nt, Homo sapiens
uaguugugcaugccuggcacaa

SEQ ID NO: 1015486 - RNA, 16 nt, Homo sapiens
uaguuguggacauuua

SEQ ID NO: 1015487 - RNA, 22 nt, Homo sapiens
uaguuuguaugccaagugagaa

SEQ ID NO: 1015488 - RNA, 15 nt, Homo sapiens
uaguuuuacuuuuaa

SEQ ID NO: 1015489 - RNA, 13 nt, Homo sapiens
uaguuuucauaca

SEQ ID NO: 1015490 - RNA, 23 nt, Homo sapiens
uaguuuugauccuaaaucugccu

SEQ ID NO: 1015491 - RNA, 22 nt, Homo sapiens
uaguuuuuaccuaccacagugu

SEQ ID NO: 1015492 - RNA, 23 nt, Homo sapiens
uauaaaauguuuuuaaacagugu

SEQ ID NO: 1015493 - RNA, 17 nt, Homo sapiens
uauaaagaaacuuuauu

SEQ ID NO: 1015494 - RNA, 16 nt, Homo sapiens
uauaaagcaacuguua

SEQ ID NO: 1015495 - RNA, 17 nt, Homo sapiens
uauaaauaugaagcuca

SEQ ID NO: 1015496 - RNA, 18 nt, Homo sapiens
uauaaaugauggcaaaaa

SEQ ID NO: 1015497 - RNA, 15 nt, Homo sapiens
uauaaaugcuuuuaa

SEQ ID NO: 1015498 - RNA, 20 nt, Homo sapiens
uauaaauuuauuuacugcua

SEQ ID NO: 1015499 - RNA, 23 nt, Homo sapiens
uauaaauuuucccaaaacugaua

SEQ ID NO: 1015500 - RNA, 21 nt, Homo sapiens
uauaacagaauuaaaguagau

SEQ ID NO: 1015501 - RNA, 12 nt, Homo sapiens
uauaacauccac

SEQ ID NO: 1015502 - RNA, 19 nt, Homo sapiens
uauaagauucauauuuacu

SEQ ID NO: 1015503 - RNA, 17 nt, Homo sapiens
uauaagcagaagcacau

SEQ ID NO: 1015504 - RNA, 20 nt, Homo sapiens
uauaagcagaagcacauaug

SEQ ID NO: 1015505 - RNA, 18 nt, Homo sapiens
uauaagcauguauauucu

SEQ ID NO: 1015506 - RNA, 22 nt, Homo sapiens
uauaagcucaauuuaauuuugc

SEQ ID NO: 1015507 - RNA, 13 nt, Homo sapiens
uauaauacuguau

SEQ ID NO: 1015508 - RNA, 14 nt, Homo sapiens
uauaauacuguauu

SEQ ID NO: 1015509 - RNA, 16 nt, Homo sapiens
uauaauguaagcucua

SEQ ID NO: 1015510 - RNA, 14 nt, Homo sapiens
uauacaacagugcu

SEQ ID NO: 1015511 - RNA, 14 nt, Homo sapiens
uauacagcucagcu

SEQ ID NO: 1015512 - RNA, 20 nt, Homo sapiens
uauacaggccucaaggggaa

SEQ ID NO: 1015513 - RNA, 17 nt, Homo sapiens
uauacguguagcuauau

SEQ ID NO: 1015514 - RNA, 16 nt, Homo sapiens
uauacucuucaaggac

SEQ ID NO: 1015515 - RNA, 12 nt, Homo sapiens
uauacuguaaag

SEQ ID NO: 1015516 - RNA, 22 nt, Homo sapiens
uauacuuuuuucuuauuuaacu

SEQ ID NO: 1015517 - RNA, 16 nt, Homo sapiens
uauagaaaugcugguu

SEQ ID NO: 1015518 - RNA, 14 nt, Homo sapiens
uauagaaguagcaa

SEQ ID NO: 1015519 - RNA, 21 nt, Homo sapiens
uauagagggcuuaugauucag

SEQ ID NO: 1015520 - RNA, 22 nt, Homo sapiens
uauagcucaggaccugggaccu

SEQ ID NO: 1015521 - RNA, 19 nt, Homo sapiens
uauaguaugaaugcagugg

SEQ ID NO: 1015522 - RNA, 21 nt, Homo sapiens
uauagugacccacccuagauc

SEQ ID NO: 1015523 - RNA, 16 nt, Homo sapiens
uauauaacaacaaacu

SEQ ID NO: 1015524 - RNA, 22 nt, Homo sapiens
uauauaagauggaagcuuccag

SEQ ID NO: 1015525 - RNA, 13 nt, Homo sapiens
uauauacauucuu

SEQ ID NO: 1015526 - RNA, 13 nt, Homo sapiens
uauauaccaagcu

SEQ ID NO: 1015527 - RNA, 17 nt, Homo sapiens
uauauaguaugaaugca

SEQ ID NO: 1015528 - RNA, 16 nt, Homo sapiens
uauauaugugugugua

SEQ ID NO: 1015529 - RNA, 18 nt, Homo sapiens
uauauauuuuugugcaca

SEQ ID NO: 1015530 - RNA, 21 nt, Homo sapiens
uauauauuuuugugcacauuu

SEQ ID NO: 1015531 - RNA, 20 nt, Homo sapiens
uauaucaauuuccucauauc

SEQ ID NO: 1015532 - RNA, 15 nt, Homo sapiens
uauaucuauauguac

SEQ ID NO: 1015533 - RNA, 14 nt, Homo sapiens
uauauggggggcca

SEQ ID NO: 1015534 - RNA, 15 nt, Homo sapiens
uauauggggggccaa

SEQ ID NO: 1015535 - RNA, 14 nt, Homo sapiens
ucaccauguacaua

SEQ ID NO: 1015536 - RNA, 22 nt, Homo sapiens
ucaccauugcugucaaguuccu

SEQ ID NO: 1015537 - RNA, 23 nt, Homo sapiens
ucaccauuuggcaaugccaucau

SEQ ID NO: 1015538 - RNA, 22 nt, Homo sapiens
ucacccaggcaucugcuuuacu

SEQ ID NO: 1015539 - RNA, 16 nt, Homo sapiens
ucaccccccacacuca

SEQ ID NO: 1015540 - RNA, 17 nt, Homo sapiens
ucaccccccacacucac

SEQ ID NO: 1015541 - RNA, 17 nt, Homo sapiens
ucaccccucacugugac

SEQ ID NO: 1015542 - RNA, 18 nt, Homo sapiens
ucaccccugcuauaacua

SEQ ID NO: 1015543 - RNA, 15 nt, Homo sapiens
ucacccucguuucca

SEQ ID NO: 1015544 - RNA, 16 nt, Homo sapiens
ucaccgaggacaugaa

SEQ ID NO: 1015545 - RNA, 13 nt, Homo sapiens
ucaccguggaccu

SEQ ID NO: 1015546 - RNA, 15 nt, Homo sapiens
ucaccuaggggucuu

SEQ ID NO: 1015547 - RNA, 18 nt, Homo sapiens
ucaccugggcugaggcau

SEQ ID NO: 1015548 - RNA, 14 nt, Homo sapiens
ucaccuuccagugu

SEQ ID NO: 1015549 - RNA, 21 nt, Homo sapiens
ucaccuugggaugaugccuca

SEQ ID NO: 1015550 - RNA, 19 nt, Homo sapiens
ucacgaaguuuguucauca

SEQ ID NO: 1015551 - RNA, 21 nt, Homo sapiens
ucacgauugucaucaggagaa

SEQ ID NO: 1015552 - RNA, 14 nt, Homo sapiens
ucacgccacugcac

SEQ ID NO: 1015553 - RNA, 15 nt, Homo sapiens
ucacgccauugcacu

SEQ ID NO: 1015554 - RNA, 20 nt, Homo sapiens
ucacgucgucuucuguauac

SEQ ID NO: 1015555 - RNA, 23 nt, Homo sapiens
ucacuaaagcaguagaaauaaua

SEQ ID NO: 1015556 - RNA, 17 nt, Homo sapiens
ucacuacccuauucucu

SEQ ID NO: 1015557 - RNA, 22 nt, Homo sapiens
ucacuagccaugauaacugcaa

SEQ ID NO: 1015558 - RNA, 22 nt, Homo sapiens
ucacucaaucucugauucuguc

SEQ ID NO: 1015559 - RNA, 16 nt, Homo sapiens
ucacucccuccaucaa

SEQ ID NO: 1015560 - RNA, 21 nt, Homo sapiens
ucacucuauuaaaucuugcaa

SEQ ID NO: 1015561 - RNA, 17 nt, Homo sapiens
ucacucuuauugcccac

SEQ ID NO: 1015562 - RNA, 19 nt, Homo sapiens
ucacugaaaacaucuggaa

SEQ ID NO: 1015563 - RNA, 16 nt, Homo sapiens
ucacugaaaccaggug

SEQ ID NO: 1015564 - RNA, 21 nt, Homo sapiens
ucacugccccagacacagugc

SEQ ID NO: 1015565 - RNA, 17 nt, Homo sapiens
ucacugcccccagcucu

SEQ ID NO: 1015566 - RNA, 23 nt, Homo sapiens
ucacuguagaaugauuucaugcu

SEQ ID NO: 1015567 - RNA, 15 nt, Homo sapiens
ucacugucccucaaa

SEQ ID NO: 1015568 - RNA, 19 nt, Homo sapiens
ucacugucccucaaaugac

SEQ ID NO: 1015569 - RNA, 13 nt, Homo sapiens
ucacuuccuacaa

SEQ ID NO: 1015570 - RNA, 11 nt, Homo sapiens
ucacuugccca

SEQ ID NO: 1015571 - RNA, 20 nt, Homo sapiens
ucacuuuaauagaagggcaa

SEQ ID NO: 1015572 - RNA, 19 nt, Homo sapiens
ucacuuucucaguuuucau

SEQ ID NO: 1015573 - RNA, 18 nt, Homo sapiens
ucacuuuucuccaugagu

SEQ ID NO: 1015574 - RNA, 18 nt, Homo sapiens
ucacuuuuuauuuugcca

SEQ ID NO: 1015575 - RNA, 17 nt, Homo sapiens
ucacuuuuuuuuuccaa

SEQ ID NO: 1015576 - RNA, 16 nt, Homo sapiens
ucagaaacacccucac

SEQ ID NO: 1015577 - RNA, 21 nt, Homo sapiens
ucagaaacacccucacacugg

SEQ ID NO: 1015578 - RNA, 16 nt, Homo sapiens
ucagaaacacuggggc

SEQ ID NO: 1015579 - RNA, 20 nt, Homo sapiens
ucagaaacaggugcaucugg

SEQ ID NO: 1015580 - RNA, 14 nt, Homo sapiens
ucagaaacagugag

SEQ ID NO: 1015581 - RNA, 15 nt, Homo sapiens
ucagaaccauccaua

SEQ ID NO: 1015582 - RNA, 19 nt, Homo sapiens
ucagaaccucuuccccaga

SEQ ID NO: 1015583 - RNA, 22 nt, Homo sapiens
ucagaagacacugaugggcaac

SEQ ID NO: 1015584 - RNA, 13 nt, Homo sapiens
ucagaagccugag

SEQ ID NO: 1015585 - RNA, 18 nt, Homo sapiens
ucagaaggcaaaugacuu

SEQ ID NO: 1015586 - RNA, 21 nt, Homo sapiens
ucagaaggcucuucugacuac

SEQ ID NO: 1015587 - RNA, 22 nt, Homo sapiens
ucagaaucauugaaguauuuuc

SEQ ID NO: 1015588 - RNA, 17 nt, Homo sapiens
ucagaauccacucuucu

SEQ ID NO: 1015589 - RNA, 15 nt, Homo sapiens
ucagaaugucaauga

SEQ ID NO: 1015590 - RNA, 13 nt, Homo sapiens
ucagaccacaagg

SEQ ID NO: 1015591 - RNA, 16 nt, Homo sapiens
ucagacuagcuuucag

SEQ ID NO: 1015592 - RNA, 17 nt, Homo sapiens
ucagacuccugugcaac

SEQ ID NO: 1015593 - RNA, 14 nt, Homo sapiens
ucagacuuaccagg

SEQ ID NO: 1015594 - RNA, 18 nt, Homo sapiens
ucagagaaauacuuucag

SEQ ID NO: 1015595 - RNA, 22 nt, Homo sapiens
ucagagagccuuuuucuaggcc

SEQ ID NO: 1015596 - RNA, 20 nt, Homo sapiens
ucagaggauggccagugucu

SEQ ID NO: 1015597 - RNA, 22 nt, Homo sapiens
ucagaggugaaagcuauaucaa

SEQ ID NO: 1015598 - RNA, 16 nt, Homo sapiens
ucagaguauggagcuc

SEQ ID NO: 1015599 - RNA, 21 nt, Homo sapiens
ucagaguugcugcaaaccuga

SEQ ID NO: 1015600 - RNA, 14 nt, Homo sapiens
ucagaguugugcac

SEQ ID NO: 1015601 - RNA, 18 nt, Homo sapiens
ucagauaccgacuggggc

SEQ ID NO: 1015602 - RNA, 13 nt, Homo sapiens
ucagauaugauau

SEQ ID NO: 1015603 - RNA, 20 nt, Homo sapiens
ucagauauuuuuucagaaau

SEQ ID NO: 1015604 - RNA, 15 nt, Homo sapiens
ucagaucucauggga

SEQ ID NO: 1015605 - RNA, 14 nt, Homo sapiens
ucagaucugucuga

SEQ ID NO: 1015606 - RNA, 16 nt, Homo sapiens
ucagauucuucucuua

SEQ ID NO: 1015607 - RNA, 23 nt, Homo sapiens
ucagauuuuaaaaagucuucacu

SEQ ID NO: 1015608 - RNA, 16 nt, Homo sapiens
ucagcaacucgcuuua

SEQ ID NO: 1015609 - RNA, 17 nt, Homo sapiens
ucagcaagaagauccua

SEQ ID NO: 1015610 - RNA, 19 nt, Homo sapiens
ucagcacguguggccuguu

SEQ ID NO: 1015611 - RNA, 19 nt, Homo sapiens
ucagcacuccucaucauca

SEQ ID NO: 1015612 - RNA, 13 nt, Homo sapiens
ucagcaugcaucc

SEQ ID NO: 1015613 - RNA, 19 nt, Homo sapiens
ucagcauuuccacaccaag

SEQ ID NO: 1015614 - RNA, 23 nt, Homo sapiens
ucagccuacuuucacacuaagaa

SEQ ID NO: 1015615 - RNA, 20 nt, Homo sapiens
ucagccuagccgaccucagc

SEQ ID NO: 1015616 - RNA, 20 nt, Homo sapiens
ucagccucccaaagugcuga

SEQ ID NO: 1015617 - RNA, 16 nt, Homo sapiens
ucagcucccauuucua

SEQ ID NO: 1015618 - RNA, 19 nt, Homo sapiens
ucagcucccauuucuacuc

SEQ ID NO: 1015619 - RNA, 20 nt, Homo sapiens
ucagcucccauuucuacucu

SEQ ID NO: 1015620 - RNA, 13 nt, Homo sapiens
ucagcucuuggcu

SEQ ID NO: 1015621 - RNA, 18 nt, Homo sapiens
ucagcuggaucuccauuc

SEQ ID NO: 1015622 - RNA, 21 nt, Homo sapiens
ucagcuggcacugucucugcu

SEQ ID NO: 1015623 - RNA, 22 nt, Homo sapiens
ucagcuggcacugucucugcug

SEQ ID NO: 1015624 - RNA, 18 nt, Homo sapiens
ucagcuggucaaacaaac

SEQ ID NO: 1015625 - RNA, 13 nt, Homo sapiens
ucagcuuugccuu

SEQ ID NO: 1015626 - RNA, 16 nt, Homo sapiens
ucaggaagcucagggc

SEQ ID NO: 1015627 - RNA, 12 nt, Homo sapiens
ucaggacaaugu

SEQ ID NO: 1015628 - RNA, 17 nt, Homo sapiens
ucaggacaucagucuga

SEQ ID NO: 1015629 - RNA, 18 nt, Homo sapiens
ucaggaccaggcaaugug

SEQ ID NO: 1015630 - RNA, 19 nt, Homo sapiens
ucaggaggaaggcuuacac

SEQ ID NO: 1015631 - RNA, 18 nt, Homo sapiens
ucaggaguucgagaccag

SEQ ID NO: 1015632 - RNA, 20 nt, Homo sapiens
ucaggaugauacacuaugaa

SEQ ID NO: 1015633 - RNA, 13 nt, Homo sapiens
ucaggauucuguu

SEQ ID NO: 1015634 - RNA, 17 nt, Homo sapiens
ucaggcaaagugcugcu

SEQ ID NO: 1015635 - RNA, 12 nt, Homo sapiens
ucaggcaccugc

SEQ ID NO: 1015636 - RNA, 18 nt, Homo sapiens
ucaggccaacaagccaac

SEQ ID NO: 1015637 - RNA, 23 nt, Homo sapiens
ucaggccacauggcuaaagaagg

SEQ ID NO: 1015638 - RNA, 20 nt, Homo sapiens
ucaggccaucaucaguggag

SEQ ID NO: 1015639 - RNA, 19 nt, Homo sapiens
ucagggaccccugcccuug

SEQ ID NO: 1015640 - RNA, 16 nt, Homo sapiens
ucagggccaugccugc

SEQ ID NO: 1015641 - RNA, 19 nt, Homo sapiens
ucagggcccaagucccugu

SEQ ID NO: 1015642 - RNA, 16 nt, Homo sapiens
ucagggcgcacagcau

SEQ ID NO: 1015643 - RNA, 20 nt, Homo sapiens
ucagggcuaacgaccacagg

SEQ ID NO: 1015644 - RNA, 14 nt, Homo sapiens
ucaggggacucagc

SEQ ID NO: 1015645 - RNA, 13 nt, Homo sapiens
ucagggucccugg

SEQ ID NO: 1015646 - RNA, 14 nt, Homo sapiens
ucagguccaauuug

SEQ ID NO: 1015647 - RNA, 19 nt, Homo sapiens
ucaggugaaaauccaucuc

SEQ ID NO: 1015648 - RNA, 14 nt, Homo sapiens
ucaguaaacaauga

SEQ ID NO: 1015649 - RNA, 18 nt, Homo sapiens
ucaguaaacaaugaauag

SEQ ID NO: 1015650 - RNA, 16 nt, Homo sapiens
ucaguagaccuaauga

SEQ ID NO: 1015651 - RNA, 17 nt, Homo sapiens
ucagucacaaguuacag

SEQ ID NO: 1015652 - RNA, 12 nt, Homo sapiens
ucagucagggac

SEQ ID NO: 1015653 - RNA, 17 nt, Homo sapiens
ucagucauuagacuccu

SEQ ID NO: 1015654 - RNA, 14 nt, Homo sapiens
ucaguccucuuuca

SEQ ID NO: 1015655 - RNA, 13 nt, Homo sapiens
ucagucucugagc

SEQ ID NO: 1015656 - RNA, 19 nt, Homo sapiens
ucagucugggugggacuua

SEQ ID NO: 1015657 - RNA, 17 nt, Homo sapiens
ucagucuuuuccaugaa

SEQ ID NO: 1015658 - RNA, 18 nt, Homo sapiens
ucagugaauaaaccauca

SEQ ID NO: 1015659 - RNA, 23 nt, Homo sapiens
ucagugacagaguucacuauaaa

SEQ ID NO: 1015660 - RNA, 14 nt, Homo sapiens
ucagugcuccugua

SEQ ID NO: 1015661 - RNA, 21 nt, Homo sapiens
ucaguggaagaagcagaugag

SEQ ID NO: 1015662 - RNA, 15 nt, Homo sapiens
ucaguguacauggaa

SEQ ID NO: 1015663 - RNA, 20 nt, Homo sapiens
ucaguuucaauucagugcug

SEQ ID NO: 1015664 - RNA, 22 nt, Homo sapiens
ucaguuugcuagcagaaaucua

SEQ ID NO: 1015665 - RNA, 23 nt, Homo sapiens
ucauaaagucuuugaagugacuu

SEQ ID NO: 1015666 - RNA, 20 nt, Homo sapiens
ucauaaaugaagcagcuuua

SEQ ID NO: 1015667 - RNA, 14 nt, Homo sapiens
ucauaacuuuccaa

SEQ ID NO: 1015668 - RNA, 17 nt, Homo sapiens
ucauaagcgaucacuuc

SEQ ID NO: 1015669 - RNA, 18 nt, Homo sapiens
ucauaauuucuucacuca

SEQ ID NO: 1015670 - RNA, 15 nt, Homo sapiens
ucauacguccaccau

SEQ ID NO: 1015671 - RNA, 15 nt, Homo sapiens
ucauagggucucuuc

SEQ ID NO: 1015672 - RNA, 20 nt, Homo sapiens
ucauauugaugugugucuag

SEQ ID NO: 1015673 - RNA, 16 nt, Homo sapiens
ucauauuuucuuucaa

SEQ ID NO: 1015674 - RNA, 14 nt, Homo sapiens
ucauauuuuguaua

SEQ ID NO: 1015675 - RNA, 20 nt, Homo sapiens
ucauauuuuguauauaucug

SEQ ID NO: 1015676 - RNA, 19 nt, Homo sapiens
ucaucaacuuauuauauga

SEQ ID NO: 1015677 - RNA, 22 nt, Homo sapiens
ucaucaacuuauuauaugacua

SEQ ID NO: 1015678 - RNA, 12 nt, Homo sapiens
ucaucaaugaau

SEQ ID NO: 1015679 - RNA, 12 nt, Homo sapiens
ucaucacuggau

SEQ ID NO: 1015680 - RNA, 21 nt, Homo sapiens
ucaucagccuguguaggcagu

SEQ ID NO: 1015681 - RNA, 22 nt, Homo sapiens
ucaucaguauugaagcauuuua

SEQ ID NO: 1015682 - RNA, 14 nt, Homo sapiens
ucaucccacaaucu

SEQ ID NO: 1015683 - RNA, 15 nt, Homo sapiens
ucuucauuaccucag

SEQ ID NO: 1015684 - RNA, 18 nt, Homo sapiens
ucuuccaaagcacauuga

SEQ ID NO: 1015685 - RNA, 21 nt, Homo sapiens
ucuuccaacguggcccagaga

SEQ ID NO: 1015686 - RNA, 20 nt, Homo sapiens
ucuuccagaaggcaaaaaga

SEQ ID NO: 1015687 - RNA, 23 nt, Homo sapiens
ucuuccagaagugugauugggaa

SEQ ID NO: 1015688 - RNA, 13 nt, Homo sapiens
ucuucccuaccuc

SEQ ID NO: 1015689 - RNA, 14 nt, Homo sapiens
ucuucccuaccuca

SEQ ID NO: 1015690 - RNA, 15 nt, Homo sapiens
ucuucccuaccucag

SEQ ID NO: 1015691 - RNA, 21 nt, Homo sapiens
ucuucccuggguuuucugccc

SEQ ID NO: 1015692 - RNA, 21 nt, Homo sapiens
ucuuccucccucauuccaccu

SEQ ID NO: 1015693 - RNA, 22 nt, Homo sapiens
ucuuccuggcuccaacacugcu

SEQ ID NO: 1015694 - RNA, 17 nt, Homo sapiens
ucuuccuucauuguucu

SEQ ID NO: 1015695 - RNA, 16 nt, Homo sapiens
ucuucuaccauuugaa

SEQ ID NO: 1015696 - RNA, 15 nt, Homo sapiens
ucuucucagcuccca

SEQ ID NO: 1015697 - RNA, 23 nt, Homo sapiens
ucuucuccaggcuguaucccaug

SEQ ID NO: 1015698 - RNA, 18 nt, Homo sapiens
ucuucugacuacugggca

SEQ ID NO: 1015699 - RNA, 20 nt, Homo sapiens
ucuucugggaacuuccucag

SEQ ID NO: 1015700 - RNA, 17 nt, Homo sapiens
ucuucugugugaccaug

SEQ ID NO: 1015701 - RNA, 19 nt, Homo sapiens
ucuucuuacaugcauuuga

SEQ ID NO: 1015702 - RNA, 21 nt, Homo sapiens
ucuucuuuuuuuaaacauuca

SEQ ID NO: 1015703 - RNA, 21 nt, Homo sapiens
ucuugaaacauagagaucuau

SEQ ID NO: 1015704 - RNA, 13 nt, Homo sapiens
ucuugaaagcugu

SEQ ID NO: 1015705 - RNA, 17 nt, Homo sapiens
ucuugaaaucugaaugc

SEQ ID NO: 1015706 - RNA, 14 nt, Homo sapiens
ucuugaaucucuga

SEQ ID NO: 1015707 - RNA, 17 nt, Homo sapiens
ucuugacauucaaggca

SEQ ID NO: 1015708 - RNA, 17 nt, Homo sapiens
ucuugaucuguguuuua

SEQ ID NO: 1015709 - RNA, 19 nt, Homo sapiens
ucuugccccccaccccagc

SEQ ID NO: 1015710 - RNA, 13 nt, Homo sapiens
ucuugccugcaug

SEQ ID NO: 1015711 - RNA, 16 nt, Homo sapiens
ucuuggcuuugccaca

SEQ ID NO: 1015712 - RNA, 24 nt, Homo sapiens
ucuugggggguuuuuacuccagug

SEQ ID NO: 1015713 - RNA, 22 nt, Homo sapiens
ucuuggguaaggaaauggaaua

SEQ ID NO: 1015714 - RNA, 17 nt, Homo sapiens
ucuuggugaacacacau

SEQ ID NO: 1015715 - RNA, 22 nt, Homo sapiens
ucuuguaaagguccuggcaaag

SEQ ID NO: 1015716 - RNA, 18 nt, Homo sapiens
ucuugugugcauugcugu

SEQ ID NO: 1015717 - RNA, 18 nt, Homo sapiens
ucuuguuuuaagugccuu

SEQ ID NO: 1015718 - RNA, 21 nt, Homo sapiens
ucuuuaaaaaaacacauaauu

SEQ ID NO: 1015719 - RNA, 18 nt, Homo sapiens
ucuuuagagcauugccau

SEQ ID NO: 1015720 - RNA, 15 nt, Homo sapiens
ucuuuagcaguuuug

SEQ ID NO: 1015721 - RNA, 19 nt, Homo sapiens
ucuuuaggagacuaaugga

SEQ ID NO: 1015722 - RNA, 20 nt, Homo sapiens
ucuuucaggacucuaccuca

SEQ ID NO: 1015723 - RNA, 21 nt, Homo sapiens
ucuuucaggacucuaccucau

SEQ ID NO: 1015724 - RNA, 13 nt, Homo sapiens
ucuuucauggggu

SEQ ID NO: 1015725 - RNA, 14 nt, Homo sapiens
ucuuucccaauuca

SEQ ID NO: 1015726 - RNA, 20 nt, Homo sapiens
ucuuucuaacuccagugaag

SEQ ID NO: 1015727 - RNA, 22 nt, Homo sapiens
ucuuucuaacuccagugaagua

SEQ ID NO: 1015728 - RNA, 18 nt, Homo sapiens
ucuuucuaaugugugaau

SEQ ID NO: 1015729 - RNA, 16 nt, Homo sapiens
ucuuucuacaguauua

SEQ ID NO: 1015730 - RNA, 14 nt, Homo sapiens
ucuuugcuugccuc

SEQ ID NO: 1015731 - RNA, 18 nt, Homo sapiens
ucuuuggacagaagcagc

SEQ ID NO: 1015732 - RNA, 15 nt, Homo sapiens
ucuuuucacaaauaa

SEQ ID NO: 1015733 - RNA, 18 nt, Homo sapiens
ucuuuucagaucauggca

SEQ ID NO: 1015734 - RNA, 14 nt, Homo sapiens
ucuuuuccaugaac

SEQ ID NO: 1015735 - RNA, 18 nt, Homo sapiens
ucuuuucuacccuagcca

SEQ ID NO: 1015736 - RNA, 18 nt, Homo sapiens
ucuuuucugaucugcagu

SEQ ID NO: 1015737 - RNA, 18 nt, Homo sapiens
ucuuuugaaggacuccuu

SEQ ID NO: 1015738 - RNA, 16 nt, Homo sapiens
ucuuuugucccagaaa

SEQ ID NO: 1015739 - RNA, 17 nt, Homo sapiens
ugaaaaaaaguacaugu

SEQ ID NO: 1015740 - RNA, 19 nt, Homo sapiens
ugaaaaacagaaagcaucc

SEQ ID NO: 1015741 - RNA, 17 nt, Homo sapiens
ugaaaaauaagucacuu

SEQ ID NO: 1015742 - RNA, 13 nt, Homo sapiens
ugaaaaaugccuc

SEQ ID NO: 1015743 - RNA, 14 nt, Homo sapiens
ugaaaacaagccau

SEQ ID NO: 1015744 - RNA, 24 nt, Homo sapiens
ugaaaacaauucuuauugacucau

SEQ ID NO: 1015745 - RNA, 19 nt, Homo sapiens
ugaaaagauuaugaucuca

SEQ ID NO: 1015746 - RNA, 17 nt, Homo sapiens
ugaaaauaagaauuauu

SEQ ID NO: 1015747 - RNA, 15 nt, Homo sapiens
ugaaaauaugauguu

SEQ ID NO: 1015748 - RNA, 13 nt, Homo sapiens
ugaaaaucaaaua

SEQ ID NO: 1015749 - RNA, 20 nt, Homo sapiens
ugaaaaugcuguauuaguca

SEQ ID NO: 1015750 - RNA, 19 nt, Homo sapiens
ugaaaaugguccaggagaa

SEQ ID NO: 1015751 - RNA, 14 nt, Homo sapiens
ugaaaauguacuga

SEQ ID NO: 1015752 - RNA, 21 nt, Homo sapiens
ugaaaaugucagaaaccaguu

SEQ ID NO: 1015753 - RNA, 19 nt, Homo sapiens
ugaaaauguuuuucugcca

SEQ ID NO: 1015754 - RNA, 19 nt, Homo sapiens
ugaaacagcugcccugugu

SEQ ID NO: 1015755 - RNA, 12 nt, Homo sapiens
ugaaaccaaaga

SEQ ID NO: 1015756 - RNA, 22 nt, Homo sapiens
ugaaacccccacccuucugccu

SEQ ID NO: 1015757 - RNA, 15 nt, Homo sapiens
ugaaaccucaucucu

SEQ ID NO: 1015758 - RNA, 18 nt, Homo sapiens
ugaaagaggcagcuugaa

SEQ ID NO: 1015759 - RNA, 23 nt, Homo sapiens
ugaaagaguaaaggaaaugauug

SEQ ID NO: 1015760 - RNA, 11 nt, Homo sapiens
ugaaagaucuu

SEQ ID NO: 1015761 - RNA, 18 nt, Homo sapiens
ugaaagcagggacuugaa

SEQ ID NO: 1015762 - RNA, 17 nt, Homo sapiens
ugaaaggcauucucuga

SEQ ID NO: 1015763 - RNA, 13 nt, Homo sapiens
ugaaagggcaaua

SEQ ID NO: 1015764 - RNA, 14 nt, Homo sapiens
ugaaaguuaaucca

SEQ ID NO: 1015765 - RNA, 16 nt, Homo sapiens
ugaaauaacauggccu

SEQ ID NO: 1015766 - RNA, 21 nt, Homo sapiens
ugaaauaagccagacaucaac

SEQ ID NO: 1015767 - RNA, 23 nt, Homo sapiens
ugaaauaagccagacaucaacag

SEQ ID NO: 1015768 - RNA, 19 nt, Homo sapiens
ugaaauaauguacaucugg

SEQ ID NO: 1015769 - RNA, 14 nt, Homo sapiens
ugaaauaccaguga

SEQ ID NO: 1015770 - RNA, 18 nt, Homo sapiens
ugaaauaccagugaacca

SEQ ID NO: 1015771 - RNA, 23 nt, Homo sapiens
ugaaauaccagugaaccaaagag

SEQ ID NO: 1015772 - RNA, 23 nt, Homo sapiens
ugaaauacuauuuaaagccuccu

SEQ ID NO: 1015773 - RNA, 16 nt, Homo sapiens
ugaaauaucaugcucc

SEQ ID NO: 1015774 - RNA, 12 nt, Homo sapiens
ugaaauaugcau

SEQ ID NO: 1015775 - RNA, 13 nt, Homo sapiens
ugaaaucuaugaa

SEQ ID NO: 1015776 - RNA, 15 nt, Homo sapiens
ugaaaucucagaauu

SEQ ID NO: 1015777 - RNA, 17 nt, Homo sapiens
ugaaaugcaucauucuu

SEQ ID NO: 1015778 - RNA, 20 nt, Homo sapiens
ugaaaugccagaaugacuuc

SEQ ID NO: 1015779 - RNA, 16 nt, Homo sapiens
ugaaaugcuggcauuu

SEQ ID NO: 1015780 - RNA, 19 nt, Homo sapiens
ugaaaugcuggcauuugca

SEQ ID NO: 1015781 - RNA, 13 nt, Homo sapiens
ugaaauugauguu

SEQ ID NO: 1015782 - RNA, 20 nt, Homo sapiens
ugaaauuuuaaccuaugaua

SEQ ID NO: 1015783 - RNA, 12 nt, Homo sapiens
ugaacaagagcu

SEQ ID NO: 1015784 - RNA, 18 nt, Homo sapiens
ugaacaaucaaagcacuu

SEQ ID NO: 1015785 - RNA, 14 nt, Homo sapiens
ugaacacaucagcu

SEQ ID NO: 1015786 - RNA, 15 nt, Homo sapiens
ugaacacaucagcuu

SEQ ID NO: 1015787 - RNA, 23 nt, Homo sapiens
ugaacacucuacuacaugugacu

SEQ ID NO: 1015788 - RNA, 13 nt, Homo sapiens
ugaacacuggggg

SEQ ID NO: 1015789 - RNA, 13 nt, Homo sapiens
ugaacacugugac

SEQ ID NO: 1015790 - RNA, 16 nt, Homo sapiens
ugaacagccaaaugca

SEQ ID NO: 1015791 - RNA, 23 nt, Homo sapiens
ugaacauaggaaaauagaaacuu

SEQ ID NO: 1015792 - RNA, 15 nt, Homo sapiens
ugaacauugcauaua

SEQ ID NO: 1015793 - RNA, 19 nt, Homo sapiens
ugaacuagauugcaugcuu

SEQ ID NO: 1015794 - RNA, 13 nt, Homo sapiens
ugaacucagggag

SEQ ID NO: 1015795 - RNA, 22 nt, Homo sapiens
ugaacucccgccacauuuuagc

SEQ ID NO: 1015796 - RNA, 21 nt, Homo sapiens
ugaacuccuggccucaaguga

SEQ ID NO: 1015797 - RNA, 12 nt, Homo sapiens
ugaacucuuaga

SEQ ID NO: 1015798 - RNA, 20 nt, Homo sapiens
ugaacugaaaacaagccaug

SEQ ID NO: 1015799 - RNA, 13 nt, Homo sapiens
ugaacugggaccu

SEQ ID NO: 1015800 - RNA, 21 nt, Homo sapiens
ugaacuuggaaagaaaugccc

SEQ ID NO: 1015801 - RNA, 18 nt, Homo sapiens
ugaacuuucacauagcac

SEQ ID NO: 1015802 - RNA, 11 nt, Homo sapiens
ugaacuuugaa

SEQ ID NO: 1015803 - RNA, 15 nt, Homo sapiens
ugaagaaaacuccuu

SEQ ID NO: 1015804 - RNA, 22 nt, Homo sapiens
ugaagaacaguaacugccauca

SEQ ID NO: 1015805 - RNA, 17 nt, Homo sapiens
ugaagaagcaucuuccu

SEQ ID NO: 1015806 - RNA, 11 nt, Homo sapiens
ugaagacauaa

SEQ ID NO: 1015807 - RNA, 20 nt, Homo sapiens
ugaagagaaccgagcaaaga

SEQ ID NO: 1015808 - RNA, 20 nt, Homo sapiens
ugaagauaucuugaaaugaa

SEQ ID NO: 1015809 - RNA, 15 nt, Homo sapiens
ugaagaugaugcuau

SEQ ID NO: 1015810 - RNA, 21 nt, Homo sapiens
ugaagaugccagugaaacuuc

SEQ ID NO: 1015811 - RNA, 19 nt, Homo sapiens
ugaagaugggcuucaucca

SEQ ID NO: 1015812 - RNA, 23 nt, Homo sapiens
ugaagauguuucaaaaaaucuga

SEQ ID NO: 1015813 - RNA, 23 nt, Homo sapiens
ugaagcaaaucagaaacuuguga

SEQ ID NO: 1015814 - RNA, 18 nt, Homo sapiens
ugaagcaggagaaucacu

SEQ ID NO: 1015815 - RNA, 21 nt, Homo sapiens
ugaagcucuugaagacacuga

SEQ ID NO: 1015816 - RNA, 14 nt, Homo sapiens
ugaagcugaggcuc

SEQ ID NO: 1015817 - RNA, 20 nt, Homo sapiens
ugaagcugaggcucaggggu

SEQ ID NO: 1015818 - RNA, 23 nt, Homo sapiens
ugaagcuuuauacguguagcuau

SEQ ID NO: 1015819 - RNA, 15 nt, Homo sapiens
ugaaggaacauuccu

SEQ ID NO: 1015820 - RNA, 15 nt, Homo sapiens
ugaaggaucuugccu

SEQ ID NO: 1015821 - RNA, 22 nt, Homo sapiens
ugaaggaugcggcaggugcucu

SEQ ID NO: 1015822 - RNA, 14 nt, Homo sapiens
ugaaggcaugccua

SEQ ID NO: 1015823 - RNA, 14 nt, Homo sapiens
ugaaggcuguccuu

SEQ ID NO: 1015824 - RNA, 15 nt, Homo sapiens
ugaaggggaggucac

SEQ ID NO: 1015825 - RNA, 16 nt, Homo sapiens
ugaaggggaggucaca

SEQ ID NO: 1015826 - RNA, 14 nt, Homo sapiens
ugaaguaagcaaag

SEQ ID NO: 1015827 - RNA, 17 nt, Homo sapiens
ugaaguaauaugcacac

SEQ ID NO: 1015828 - RNA, 15 nt, Homo sapiens
ugaagucacacagug

SEQ ID NO: 1015829 - RNA, 12 nt, Homo sapiens
ugaagugcaaau

SEQ ID NO: 1015830 - RNA, 16 nt, Homo sapiens
ugaagugcauccaaag

SEQ ID NO: 1015831 - RNA, 19 nt, Homo sapiens
ugaagugcuuaguguacuu

SEQ ID NO: 1015832 - RNA, 21 nt, Homo sapiens
ugaaguuagggaugacuguga

SEQ ID NO: 1015833 - RNA, 15 nt, Homo sapiens
ugaaguuucacauga

SEQ ID NO: 1015834 - RNA, 16 nt, Homo sapiens
ugaaguuugaacuuca

SEQ ID NO: 1015835 - RNA, 22 nt, Homo sapiens
ugaauaaaccaucaucuugcca

SEQ ID NO: 1015836 - RNA, 21 nt, Homo sapiens
ugaauaaagccugcuuuuuaa

SEQ ID NO: 1015837 - RNA, 16 nt, Homo sapiens
ugaauaauacaguauc

SEQ ID NO: 1015838 - RNA, 20 nt, Homo sapiens
ugaauaauacaguaucucag

SEQ ID NO: 1015839 - RNA, 18 nt, Homo sapiens
ugaauagggaaguaacau

SEQ ID NO: 1015840 - RNA, 17 nt, Homo sapiens
ugaauauccccucccag

SEQ ID NO: 1015841 - RNA, 23 nt, Homo sapiens
ugaauaugauuaguaaagaaaug

SEQ ID NO: 1015842 - RNA, 23 nt, Homo sapiens
ugaauaugggguugguguucuca

SEQ ID NO: 1015843 - RNA, 13 nt, Homo sapiens
ugaauauucccaa

SEQ ID NO: 1015844 - RNA, 22 nt, Homo sapiens
ugaauauuuuucuguaguguga

SEQ ID NO: 1015845 - RNA, 18 nt, Homo sapiens
ugaaucagcugggaugac

SEQ ID NO: 1015846 - RNA, 19 nt, Homo sapiens
ugaaucccauaucuaccca

SEQ ID NO: 1015847 - RNA, 22 nt, Homo sapiens
ugaaucccucuaucucuaaaga

SEQ ID NO: 1015848 - RNA, 17 nt, Homo sapiens
ugaaucucugaauuuga

SEQ ID NO: 1015849 - RNA, 17 nt, Homo sapiens
ugaaucuuggugucuac

SEQ ID NO: 1015850 - RNA, 15 nt, Homo sapiens
ugaaucuuuuccacu

SEQ ID NO: 1015851 - RNA, 14 nt, Homo sapiens
ugaaugaucuuggc

SEQ ID NO: 1015852 - RNA, 19 nt, Homo sapiens
ugaaugcaccauggucaaa

SEQ ID NO: 1015853 - RNA, 22 nt, Homo sapiens
ugaaugcgugugcgugcaagca

SEQ ID NO: 1015854 - RNA, 11 nt, Homo sapiens
ugaaugcucaa

SEQ ID NO: 1015855 - RNA, 14 nt, Homo sapiens
ugaauggacucaaa

SEQ ID NO: 1015856 - RNA, 22 nt, Homo sapiens
ugaaugguccaggguugaucac

SEQ ID NO: 1015857 - RNA, 20 nt, Homo sapiens
ugaauguguucugucacuca

SEQ ID NO: 1015858 - RNA, 17 nt, Homo sapiens
ugaauuaguccuugcuu

SEQ ID NO: 1015859 - RNA, 18 nt, Homo sapiens
ugaauugaggacuaugga

SEQ ID NO: 1015860 - RNA, 15 nt, Homo sapiens
ugaauuucuaaaaaa

SEQ ID NO: 1015861 - RNA, 17 nt, Homo sapiens
ugaauuugccuuccuca

SEQ ID NO: 1015862 - RNA, 21 nt, Homo sapiens
ugaauuuggccugcacuaauu

SEQ ID NO: 1015863 - RNA, 23 nt, Homo sapiens
ugaauuuuaguuugguucacuua

SEQ ID NO: 1015864 - RNA, 21 nt, Homo sapiens
ugaauuuucaaguaauuguga

SEQ ID NO: 1015865 - RNA, 20 nt, Homo sapiens
ugaauuuuguguguaccugu

SEQ ID NO: 1015866 - RNA, 16 nt, Homo sapiens
ugaauuuuuaugauau

SEQ ID NO: 1015867 - RNA, 11 nt, Homo sapiens
ugacaaaaagc

SEQ ID NO: 1015868 - RNA, 14 nt, Homo sapiens
ugacaaauauuuca

SEQ ID NO: 1015869 - RNA, 18 nt, Homo sapiens
ugacaaauggagaagaaa

SEQ ID NO: 1015870 - RNA, 15 nt, Homo sapiens
ugacaauaauuucag

SEQ ID NO: 1015871 - RNA, 13 nt, Homo sapiens
ugacacacagcuc

SEQ ID NO: 1015872 - RNA, 19 nt, Homo sapiens
ugacacaguuggauuuauu

SEQ ID NO: 1015873 - RNA, 18 nt, Homo sapiens
ugacacgucugccuaccc

SEQ ID NO: 1015874 - RNA, 15 nt, Homo sapiens
ugacagaacacuguc

SEQ ID NO: 1015875 - RNA, 12 nt, Homo sapiens
ugacagagccag

SEQ ID NO: 1015876 - RNA, 13 nt, Homo sapiens
ugacagagugccu

SEQ ID NO: 1015877 - RNA, 19 nt, Homo sapiens
ugacagaguucacuauaaa

SEQ ID NO: 1015878 - RNA, 18 nt, Homo sapiens
ugacagaucaagcuguga

SEQ ID NO: 1015879 - RNA, 19 nt, Homo sapiens
ugacagcucccgggucccc

SEQ ID NO: 1015880 - RNA, 14 nt, Homo sapiens
ugacaggcaaugcu

SEQ ID NO: 1015881 - RNA, 15 nt, Homo sapiens
ugacaguaugcauua

SEQ ID NO: 1015882 - RNA, 13 nt, Homo sapiens
ugacauaauuuca

SEQ ID NO: 1015883 - RNA, 18 nt, Homo sapiens
ugacauccccacccuugg

SEQ ID NO: 1015884 - RNA, 19 nt, Homo sapiens
ugacaucucaggggccaga

SEQ ID NO: 1015885 - RNA, 16 nt, Homo sapiens
ugacaugagauuuaua

SEQ ID NO: 1015886 - RNA, 14 nt, Homo sapiens
ugacaugugacucc

SEQ ID NO: 1015887 - RNA, 14 nt, Homo sapiens
ugacauuauaugca

SEQ ID NO: 1015888 - RNA, 14 nt, Homo sapiens
ugaccaacaguucc

SEQ ID NO: 1015889 - RNA, 18 nt, Homo sapiens
ugaccacauccaccuuua

SEQ ID NO: 1015890 - RNA, 11 nt, Homo sapiens
ugaccaggaac

SEQ ID NO: 1015891 - RNA, 21 nt, Homo sapiens
ugaccaguuuaaccugaugca

SEQ ID NO: 1015892 - RNA, 12 nt, Homo sapiens
ugacccaaagac

SEQ ID NO: 1015893 - RNA, 13 nt, Homo sapiens
ugacccaaagacc

SEQ ID NO: 1015894 - RNA, 14 nt, Homo sapiens
ugacccaaugauuc

SEQ ID NO: 1015895 - RNA, 16 nt, Homo sapiens
ugacccagucagaguu

SEQ ID NO: 1015896 - RNA, 14 nt, Homo sapiens
ugaccccaaagagc

SEQ ID NO: 1015897 - RNA, 18 nt, Homo sapiens
ugaccccugcccaccucu

SEQ ID NO: 1015898 - RNA, 15 nt, Homo sapiens
ugacccuccuguugc

SEQ ID NO: 1015899 - RNA, 14 nt, Homo sapiens
ugaccucacuuuag

SEQ ID NO: 1015900 - RNA, 13 nt, Homo sapiens
ugaccuccacagc

SEQ ID NO: 1015901 - RNA, 17 nt, Homo sapiens
ugaccugugaccagcac

SEQ ID NO: 1015902 - RNA, 16 nt, Homo sapiens
ugaccugugucacuac

SEQ ID NO: 1015903 - RNA, 22 nt, Homo sapiens
ugaccuuaguguuucugugcau

SEQ ID NO: 1015904 - RNA, 21 nt, Homo sapiens
ugaccuuguaccucucuuuga

SEQ ID NO: 1015905 - RNA, 20 nt, Homo sapiens
ugacgacagugcauuugccu

SEQ ID NO: 1015906 - RNA, 22 nt, Homo sapiens
ugacuaaacaacuaccuccuca

SEQ ID NO: 1015907 - RNA, 11 nt, Homo sapiens
ugacuaaagag

SEQ ID NO: 1015908 - RNA, 23 nt, Homo sapiens
ugacucacaagaagaccagacug

SEQ ID NO: 1015909 - RNA, 13 nt, Homo sapiens
ugacucaccuguu

SEQ ID NO: 1015910 - RNA, 16 nt, Homo sapiens
ugacucagcauaccug

SEQ ID NO: 1015911 - RNA, 15 nt, Homo sapiens
ugacuccucaggguu

SEQ ID NO: 1015912 - RNA, 15 nt, Homo sapiens
ugacucucacaagau

SEQ ID NO: 1015913 - RNA, 23 nt, Homo sapiens
ugacucuccagaaagcucaucuc

SEQ ID NO: 1015914 - RNA, 22 nt, Homo sapiens
ugacugagaauauaauacugua

SEQ ID NO: 1015915 - RNA, 23 nt, Homo sapiens
ugacugagaauauaauacuguau

SEQ ID NO: 1015916 - RNA, 22 nt, Homo sapiens
ugacuuacaagugggaagcagu

SEQ ID NO: 1015917 - RNA, 13 nt, Homo sapiens
ugacuuacuguac

SEQ ID NO: 1015918 - RNA, 15 nt, Homo sapiens
ugacuuccacaccua

SEQ ID NO: 1015919 - RNA, 19 nt, Homo sapiens
ugacuucuccaggucucac

SEQ ID NO: 1015920 - RNA, 20 nt, Homo sapiens
ugacuugagaaacaaauaau

SEQ ID NO: 1015921 - RNA, 21 nt, Homo sapiens
ugacuuuauauggaugauuca

SEQ ID NO: 1015922 - RNA, 23 nt, Homo sapiens
ugagaaaccuuauuguaccucuc

SEQ ID NO: 1015923 - RNA, 17 nt, Homo sapiens
ugagaaaucguugcugc

SEQ ID NO: 1015924 - RNA, 14 nt, Homo sapiens
ugagaacugcauau

SEQ ID NO: 1015925 - RNA, 13 nt, Homo sapiens
ugagaagcacugu

SEQ ID NO: 1015926 - RNA, 18 nt, Homo sapiens
ugagaagccagcuuuccu

SEQ ID NO: 1015927 - RNA, 18 nt, Homo sapiens
ugagaaggagucagaaac

SEQ ID NO: 1015928 - RNA, 20 nt, Homo sapiens
ugagaaggcagccaccagcg

SEQ ID NO: 1015929 - RNA, 16 nt, Homo sapiens
ugagaagugcacuuua

SEQ ID NO: 1015930 - RNA, 14 nt, Homo sapiens
ugagaaucccuggc

SEQ ID NO: 1015931 - RNA, 15 nt, Homo sapiens
ugagaccaaccuggg

SEQ ID NO: 1015932 - RNA, 16 nt, Homo sapiens
ugagacccugucucaa

SEQ ID NO: 1015933 - RNA, 15 nt, Homo sapiens
ugagagaagggacac

SEQ ID NO: 1015934 - RNA, 19 nt, Homo sapiens
ugagagacaggacuagcug

SEQ ID NO: 1015935 - RNA, 23 nt, Homo sapiens
ugagaggaugaauguaugugcac

SEQ ID NO: 1015936 - RNA, 22 nt, Homo sapiens
ugagaguaucaggucucccacg

SEQ ID NO: 1015937 - RNA, 15 nt, Homo sapiens
ugagagugagacuca

SEQ ID NO: 1015938 - RNA, 15 nt, Homo sapiens
ugagaucauugcaaa

SEQ ID NO: 1015939 - RNA, 22 nt, Homo sapiens
ugagaugggagaaucacuugaa

SEQ ID NO: 1015940 - RNA, 19 nt, Homo sapiens
ugagauguauuucaacuug

SEQ ID NO: 1015941 - RNA, 16 nt, Homo sapiens
ugagauugcaccacug

SEQ ID NO: 1015942 - RNA, 17 nt, Homo sapiens
ugagauuugggcugugc

SEQ ID NO: 1015943 - RNA, 16 nt, Homo sapiens
ugagauuuugcaaucu

SEQ ID NO: 1015944 - RNA, 15 nt, Homo sapiens
ugagcaccaggggau

SEQ ID NO: 1015945 - RNA, 15 nt, Homo sapiens
ugagcagagacauga

SEQ ID NO: 1015946 - RNA, 15 nt, Homo sapiens
ugagcagguguucuu

SEQ ID NO: 1015947 - RNA, 23 nt, Homo sapiens
ugagcauccucucucacauggaa

SEQ ID NO: 1015948 - RNA, 23 nt, Homo sapiens
ugagccaccgcgccuggccaggc

SEQ ID NO: 1015949 - RNA, 13 nt, Homo sapiens
ugagccacugcac

SEQ ID NO: 1015950 - RNA, 21 nt, Homo sapiens
ugagccccuggaggcacugaa

SEQ ID NO: 1015951 - RNA, 16 nt, Homo sapiens
ugagccuacgcugaag

SEQ ID NO: 1015952 - RNA, 14 nt, Homo sapiens
ugagccucagaaua

SEQ ID NO: 1015953 - RNA, 13 nt, Homo sapiens
ugagcgacaguga

SEQ ID NO: 1015954 - RNA, 14 nt, Homo sapiens
ugagcgacagugag

SEQ ID NO: 1015955 - RNA, 14 nt, Homo sapiens
ugagcuaacuuaua

SEQ ID NO: 1015956 - RNA, 16 nt, Homo sapiens
ugagcuccccaaaaac

SEQ ID NO: 1015957 - RNA, 19 nt, Homo sapiens
ugagcuccccaaaaaccuc

SEQ ID NO: 1015958 - RNA, 15 nt, Homo sapiens
ugagcugacaucuca

SEQ ID NO: 1015959 - RNA, 22 nt, Homo sapiens
ugagcugcaacuucuuacuucc

SEQ ID NO: 1015960 - RNA, 22 nt, Homo sapiens
ugagcuuaaaaaaaaaguauac

SEQ ID NO: 1015961 - RNA, 21 nt, Homo sapiens
ugaggaauuucuguucuucca

SEQ ID NO: 1015962 - RNA, 15 nt, Homo sapiens
ugaggacaauuucau

SEQ ID NO: 1015963 - RNA, 15 nt, Homo sapiens
ugaggacagcugucc

SEQ ID NO: 1015964 - RNA, 23 nt, Homo sapiens
ugaggaccacuccuguacacuga

SEQ ID NO: 1015965 - RNA, 20 nt, Homo sapiens
ugaggagucuugugugcauu

SEQ ID NO: 1015966 - RNA, 12 nt, Homo sapiens
ugaggauuucaa

SEQ ID NO: 1015967 - RNA, 13 nt, Homo sapiens
ugaggauuucaag

SEQ ID NO: 1015968 - RNA, 17 nt, Homo sapiens
ugaggcaaccacaggca

SEQ ID NO: 1015969 - RNA, 22 nt, Homo sapiens
ugaggcagacagcagcucaggc

SEQ ID NO: 1015970 - RNA, 20 nt, Homo sapiens
ugaggcauccuuccucacac

SEQ ID NO: 1015971 - RNA, 14 nt, Homo sapiens
ugaggcugcagcga

SEQ ID NO: 1015972 - RNA, 15 nt, Homo sapiens
ugaggcuucucagcc

SEQ ID NO: 1015973 - RNA, 13 nt, Homo sapiens
ugagggacucuga

SEQ ID NO: 1015974 - RNA, 19 nt, Homo sapiens
ugagggagccuggccccau

SEQ ID NO: 1015975 - RNA, 22 nt, Homo sapiens
ugaggggcuccuggaaaggcuc

SEQ ID NO: 1015976 - RNA, 15 nt, Homo sapiens
ugaggggcucucuca

SEQ ID NO: 1015977 - RNA, 16 nt, Homo sapiens
ugaggggcucucucau

SEQ ID NO: 1015978 - RNA, 12 nt, Homo sapiens
ugaggggucccc

SEQ ID NO: 1015979 - RNA, 18 nt, Homo sapiens
ugagggucuuugcaagaa

SEQ ID NO: 1015980 - RNA, 19 nt, Homo sapiens
ugcauuaaaagaaaauaaa

SEQ ID NO: 1015981 - RNA, 17 nt, Homo sapiens
ugcauuaucuaugauau

SEQ ID NO: 1015982 - RNA, 16 nt, Homo sapiens
ugcauucccagugguc

SEQ ID NO: 1015983 - RNA, 20 nt, Homo sapiens
ugcauucugagguaaccuca

SEQ ID NO: 1015984 - RNA, 15 nt, Homo sapiens
ugcauugagcucucu

SEQ ID NO: 1015985 - RNA, 17 nt, Homo sapiens
ugcauugagcucucuca

SEQ ID NO: 1015986 - RNA, 13 nt, Homo sapiens
ugcauuuauagca

SEQ ID NO: 1015987 - RNA, 13 nt, Homo sapiens
ugcauuugccuug

SEQ ID NO: 1015988 - RNA, 21 nt, Homo sapiens
ugcauuuucccagauacuucc

SEQ ID NO: 1015989 - RNA, 16 nt, Homo sapiens
ugcauuuuuagaccau

SEQ ID NO: 1015990 - RNA, 21 nt, Homo sapiens
ugccaaccggucacccaggag

SEQ ID NO: 1015991 - RNA, 16 nt, Homo sapiens
ugccacacggcucuca

SEQ ID NO: 1015992 - RNA, 20 nt, Homo sapiens
ugccaccauggccagccaac

SEQ ID NO: 1015993 - RNA, 17 nt, Homo sapiens
ugccacucacacagcca

SEQ ID NO: 1015994 - RNA, 14 nt, Homo sapiens
ugccacucauuccu

SEQ ID NO: 1015995 - RNA, 12 nt, Homo sapiens
ugccagacaugu

SEQ ID NO: 1015996 - RNA, 14 nt, Homo sapiens
ugccagacaugugg

SEQ ID NO: 1015997 - RNA, 19 nt, Homo sapiens
ugccagcuuaucucagggg

SEQ ID NO: 1015998 - RNA, 21 nt, Homo sapiens
ugccaggccugggaccuccca

SEQ ID NO: 1015999 - RNA, 18 nt, Homo sapiens
ugccagggacugacaaaa

SEQ ID NO: 1016000 - RNA, 21 nt, Homo sapiens
ugccaguaggcucaacuaggg

SEQ ID NO: 1016001 - RNA, 11 nt, Homo sapiens
ugccagugaaa

SEQ ID NO: 1016002 - RNA, 19 nt, Homo sapiens
ugccauaaaccucaaguua

SEQ ID NO: 1016003 - RNA, 16 nt, Homo sapiens
ugccauauacucuuca

SEQ ID NO: 1016004 - RNA, 20 nt, Homo sapiens
ugccauccucaaacacugca

SEQ ID NO: 1016005 - RNA, 19 nt, Homo sapiens
ugccaucuuggacuuguca

SEQ ID NO: 1016006 - RNA, 13 nt, Homo sapiens
ugccaugugaaga

SEQ ID NO: 1016007 - RNA, 21 nt, Homo sapiens
ugcccaaccugcucuccucuu

SEQ ID NO: 1016008 - RNA, 22 nt, Homo sapiens
ugcccaauaugcaguucugcag

SEQ ID NO: 1016009 - RNA, 20 nt, Homo sapiens
ugcccaggcuggaguggagu

SEQ ID NO: 1016010 - RNA, 18 nt, Homo sapiens
ugcccagggccacucugc

SEQ ID NO: 1016011 - RNA, 14 nt, Homo sapiens
ugcccaggggagcc

SEQ ID NO: 1016012 - RNA, 16 nt, Homo sapiens
ugcccagugaccaguc

SEQ ID NO: 1016013 - RNA, 22 nt, Homo sapiens
ugcccaucccuggaaggugcug

SEQ ID NO: 1016014 - RNA, 14 nt, Homo sapiens
ugccccaccuuuau

SEQ ID NO: 1016015 - RNA, 17 nt, Homo sapiens
ugccccagacacagugc

SEQ ID NO: 1016016 - RNA, 15 nt, Homo sapiens
ugccccagagcuguu

SEQ ID NO: 1016017 - RNA, 14 nt, Homo sapiens
ugcccccuccacug

SEQ ID NO: 1016018 - RNA, 15 nt, Homo sapiens
ugcccccuccacugg

SEQ ID NO: 1016019 - RNA, 13 nt, Homo sapiens
ugcccccuuucag

SEQ ID NO: 1016020 - RNA, 15 nt, Homo sapiens
ugccccgucaccauc

SEQ ID NO: 1016021 - RNA, 12 nt, Homo sapiens
ugccccugccuu

SEQ ID NO: 1016022 - RNA, 16 nt, Homo sapiens
ugccccuggcucugac

SEQ ID NO: 1016023 - RNA, 14 nt, Homo sapiens
ugcccucagauucc

SEQ ID NO: 1016024 - RNA, 15 nt, Homo sapiens
ugcccucagauuccg

SEQ ID NO: 1016025 - RNA, 15 nt, Homo sapiens
ugcccugacaugcac

SEQ ID NO: 1016026 - RNA, 23 nt, Homo sapiens
ugcccugaguggaucuccaagga

SEQ ID NO: 1016027 - RNA, 14 nt, Homo sapiens
ugcccugcuugcaa

SEQ ID NO: 1016028 - RNA, 19 nt, Homo sapiens
ugcccugggauguccacag

SEQ ID NO: 1016029 - RNA, 22 nt, Homo sapiens
ugcccuuggccugaagucccag

SEQ ID NO: 1016030 - RNA, 16 nt, Homo sapiens
ugccgcaauacaggaa

SEQ ID NO: 1016031 - RNA, 18 nt, Homo sapiens
ugccgcagugaucaaagu

SEQ ID NO: 1016032 - RNA, 17 nt, Homo sapiens
ugccguaacaacugugg

SEQ ID NO: 1016033 - RNA, 21 nt, Homo sapiens
ugccguaacaacuguggucaa

SEQ ID NO: 1016034 - RNA, 18 nt, Homo sapiens
ugccucagccucccgagu

SEQ ID NO: 1016035 - RNA, 20 nt, Homo sapiens
ugccuccaccccccagaacc

SEQ ID NO: 1016036 - RNA, 23 nt, Homo sapiens
ugccuccucccugggcagaaagu

SEQ ID NO: 1016037 - RNA, 18 nt, Homo sapiens
ugccucugacacacagcu

SEQ ID NO: 1016038 - RNA, 16 nt, Homo sapiens
ugccugaaccuuccau

SEQ ID NO: 1016039 - RNA, 15 nt, Homo sapiens
ugccugaagucacac

SEQ ID NO: 1016040 - RNA, 15 nt, Homo sapiens
ugccugcaugaaaca

SEQ ID NO: 1016041 - RNA, 20 nt, Homo sapiens
ugccugccccccucaucuca

SEQ ID NO: 1016042 - RNA, 19 nt, Homo sapiens
ugccuggaguccuugaccg

SEQ ID NO: 1016043 - RNA, 16 nt, Homo sapiens
ugccuggccuggcaca

SEQ ID NO: 1016044 - RNA, 20 nt, Homo sapiens
ugccugggaguuuuguauuc

SEQ ID NO: 1016045 - RNA, 16 nt, Homo sapiens
ugccuguaacuugaga

SEQ ID NO: 1016046 - RNA, 18 nt, Homo sapiens
ugccugucccucucaggc

SEQ ID NO: 1016047 - RNA, 19 nt, Homo sapiens
ugccugucuguuacacugg

SEQ ID NO: 1016048 - RNA, 20 nt, Homo sapiens
ugccuguucccauucuugca

SEQ ID NO: 1016049 - RNA, 15 nt, Homo sapiens
ugccuuagucucagu

SEQ ID NO: 1016050 - RNA, 13 nt, Homo sapiens
ugccuucucagga

SEQ ID NO: 1016051 - RNA, 14 nt, Homo sapiens
ugccuucucaugau

SEQ ID NO: 1016052 - RNA, 18 nt, Homo sapiens
ugccuucucaugauccaa

SEQ ID NO: 1016053 - RNA, 15 nt, Homo sapiens
ugccuugaagccacu

SEQ ID NO: 1016054 - RNA, 18 nt, Homo sapiens
ugccuugguauagcauau

SEQ ID NO: 1016055 - RNA, 17 nt, Homo sapiens
ugccuuuuuaaugaaca

SEQ ID NO: 1016056 - RNA, 17 nt, Homo sapiens
ugcgaguauguguuugu

SEQ ID NO: 1016057 - RNA, 14 nt, Homo sapiens
ugcgcacugcauuc

SEQ ID NO: 1016058 - RNA, 16 nt, Homo sapiens
ugcgcauucucaugga

SEQ ID NO: 1016059 - RNA, 15 nt, Homo sapiens
ugcgccgagccucag

SEQ ID NO: 1016060 - RNA, 16 nt, Homo sapiens
ugcguggacucugcac

SEQ ID NO: 1016061 - RNA, 13 nt, Homo sapiens
ugcguuacuaauu

SEQ ID NO: 1016062 - RNA, 23 nt, Homo sapiens
ugcuaaauggucgcccaggagac

SEQ ID NO: 1016063 - RNA, 13 nt, Homo sapiens
ugcuaaaugugaa

SEQ ID NO: 1016064 - RNA, 23 nt, Homo sapiens
ugcuaacugugcuccucacuucc

SEQ ID NO: 1016065 - RNA, 21 nt, Homo sapiens
ugcuaauaacagugcauauuc

SEQ ID NO: 1016066 - RNA, 21 nt, Homo sapiens
ugcuaaucagggaggucauuu

SEQ ID NO: 1016067 - RNA, 18 nt, Homo sapiens
ugcuacaaaaacacagca

SEQ ID NO: 1016068 - RNA, 20 nt, Homo sapiens
ugcuacaaauacucuuagga

SEQ ID NO: 1016069 - RNA, 20 nt, Homo sapiens
ugcuagaugugcaaaugcaa

SEQ ID NO: 1016070 - RNA, 23 nt, Homo sapiens
ugcuagcucugagccaguucagu

SEQ ID NO: 1016071 - RNA, 20 nt, Homo sapiens
ugcuauaacuaugaccaugc

SEQ ID NO: 1016072 - RNA, 17 nt, Homo sapiens
ugcuauaacuauguuga

SEQ ID NO: 1016073 - RNA, 23 nt, Homo sapiens
ugcuauaggcuggagaagcucac

SEQ ID NO: 1016074 - RNA, 15 nt, Homo sapiens
ugcuaugaugauggu

SEQ ID NO: 1016075 - RNA, 19 nt, Homo sapiens
ugcuaugucaggcuuucau

SEQ ID NO: 1016076 - RNA, 19 nt, Homo sapiens
ugcuauuguagagccagag

SEQ ID NO: 1016077 - RNA, 19 nt, Homo sapiens
ugcucaaggcaaccagagg

SEQ ID NO: 1016078 - RNA, 14 nt, Homo sapiens
ugcucaauacacag

SEQ ID NO: 1016079 - RNA, 19 nt, Homo sapiens
ugcucacauaucugucauu

SEQ ID NO: 1016080 - RNA, 18 nt, Homo sapiens
ugcucccccugguggugg

SEQ ID NO: 1016081 - RNA, 17 nt, Homo sapiens
ugcuccucccauguuau

SEQ ID NO: 1016082 - RNA, 12 nt, Homo sapiens
ugcuccuuccaa

SEQ ID NO: 1016083 - RNA, 15 nt, Homo sapiens
ugcucuuagcugucu

SEQ ID NO: 1016084 - RNA, 23 nt, Homo sapiens
ugcucuuuaugaaugaaaaaaca

SEQ ID NO: 1016085 - RNA, 15 nt, Homo sapiens
ugcucuuucuugacu

SEQ ID NO: 1016086 - RNA, 17 nt, Homo sapiens
ugcugacccagccuguu

SEQ ID NO: 1016087 - RNA, 21 nt, Homo sapiens
ugcugacggaagccaacuugg

SEQ ID NO: 1016088 - RNA, 10 nt, Homo sapiens
ugcugagcaa

SEQ ID NO: 1016089 - RNA, 17 nt, Homo sapiens
ugcugaggcucugaccc

SEQ ID NO: 1016090 - RNA, 23 nt, Homo sapiens
ugcugagugcaccacuucaagug

SEQ ID NO: 1016091 - RNA, 19 nt, Homo sapiens
ugcugccaguccucugcau

SEQ ID NO: 1016092 - RNA, 17 nt, Homo sapiens
ugcugcuccagugcagg

SEQ ID NO: 1016093 - RNA, 19 nt, Homo sapiens
ugcugcugagugcaccacu

SEQ ID NO: 1016094 - RNA, 23 nt, Homo sapiens
ugcugcugagugcaccacuucaa

SEQ ID NO: 1016095 - RNA, 23 nt, Homo sapiens
ugcugcugcgcccuuaccuuccc

SEQ ID NO: 1016096 - RNA, 12 nt, Homo sapiens
ugcugcugugca

SEQ ID NO: 1016097 - RNA, 13 nt, Homo sapiens
ugcuggacuguca

SEQ ID NO: 1016098 - RNA, 16 nt, Homo sapiens
ugcuggcaaagacaga

SEQ ID NO: 1016099 - RNA, 18 nt, Homo sapiens
ugcuggcaccaccaggca

SEQ ID NO: 1016100 - RNA, 17 nt, Homo sapiens
ugcuggcagaaagcaaa

SEQ ID NO: 1016101 - RNA, 22 nt, Homo sapiens
ugcuggcauuugcaccuaccuc

SEQ ID NO: 1016102 - RNA, 23 nt, Homo sapiens
ugcugggacugagccagucccag

SEQ ID NO: 1016103 - RNA, 16 nt, Homo sapiens
ugcuggggaacuggcg

SEQ ID NO: 1016104 - RNA, 16 nt, Homo sapiens
ugcuggggccgaaaga

SEQ ID NO: 1016105 - RNA, 13 nt, Homo sapiens
ucuucacaacaga

SEQ ID NO: 1016106 - RNA, 13 nt, Homo sapiens
ucuucacagucac

SEQ ID NO: 1016107 - RNA, 19 nt, Homo sapiens
ucuucacucugaauccuca

SEQ ID NO: 1016108 - RNA, 23 nt, Homo sapiens
ucuucacuggguucccauucuga

SEQ ID NO: 1016109 - RNA, 16 nt, Homo sapiens
ucuucaggccucccuc

SEQ ID NO: 1016110 - RNA, 21 nt, Homo sapiens
gcggggacucgguaagcacuu

SEQ ID NO: 1016111 - RNA, 17 nt, Homo sapiens
gcgguggccucuuuuca

SEQ ID NO: 1016112 - RNA, 17 nt, Homo sapiens
gcguaguccgcuuucuc

SEQ ID NO: 1016113 - RNA, 16 nt, Homo sapiens
gcgugagccacugcac

SEQ ID NO: 1016114 - RNA, 14 nt, Homo sapiens
gcgugcaugugcac

SEQ ID NO: 1016115 - RNA, 18 nt, Homo sapiens
gcguggacucugcacaug

SEQ ID NO: 1016116 - RNA, 19 nt, Homo sapiens
gcgugguggcgggcaccua

SEQ ID NO: 1016117 - RNA, 19 nt, Homo sapiens
gcguguguagaguuaagaa

SEQ ID NO: 1016118 - RNA, 23 nt, Homo sapiens
gcguguguccaugugugugcaag

SEQ ID NO: 1016119 - RNA, 15 nt, Homo sapiens
gcgugugugcaagug

SEQ ID NO: 1016120 - RNA, 14 nt, Homo sapiens
gcguucuucauuca

SEQ ID NO: 1016121 - RNA, 14 nt, Homo sapiens
gcuaacucugaccu

SEQ ID NO: 1016122 - RNA, 17 nt, Homo sapiens
gcuaaggacauuuccca

SEQ ID NO: 1016123 - RNA, 20 nt, Homo sapiens
gcuaagugaaauaagccaga

SEQ ID NO: 1016124 - RNA, 19 nt, Homo sapiens
gcuaaucuucuuaugcaau

SEQ ID NO: 1016125 - RNA, 16 nt, Homo sapiens
gcuaauuuuugcaaau

SEQ ID NO: 1016126 - RNA, 19 nt, Homo sapiens
gcuacacagaucacagcuu

SEQ ID NO: 1016127 - RNA, 23 nt, Homo sapiens
gcuaccagguguucuacacucau

SEQ ID NO: 1016128 - RNA, 17 nt, Homo sapiens
gcuaccuacauacaauu

SEQ ID NO: 1016129 - RNA, 15 nt, Homo sapiens
gcuaccuacugauaa

SEQ ID NO: 1016130 - RNA, 16 nt, Homo sapiens
gcuaccucacuggggu

SEQ ID NO: 1016131 - RNA, 21 nt, Homo sapiens
gcuacucuguuccuucacauc

SEQ ID NO: 1016132 - RNA, 22 nt, Homo sapiens
gcuacugacuauggcuaccaaa

SEQ ID NO: 1016133 - RNA, 17 nt, Homo sapiens
gcuacugucucacugaa

SEQ ID NO: 1016134 - RNA, 23 nt, Homo sapiens
gcuacuuuaacaccagguuuaug

SEQ ID NO: 1016135 - RNA, 20 nt, Homo sapiens
gcuaggguggcccuugcagu

SEQ ID NO: 1016136 - RNA, 17 nt, Homo sapiens
gcuauaacuauguugau

SEQ ID NO: 1016137 - RNA, 22 nt, Homo sapiens
gcuauagacccgaggaaacuca

SEQ ID NO: 1016138 - RNA, 23 nt, Homo sapiens
gcuaucagacuguaggauuugaa

SEQ ID NO: 1016139 - RNA, 22 nt, Homo sapiens
gcuaugaaaacagcuaucucac

SEQ ID NO: 1016140 - RNA, 14 nt, Homo sapiens
gcuaugcauuugaa

SEQ ID NO: 1016141 - RNA, 20 nt, Homo sapiens
gcuauggggauagaugugug

SEQ ID NO: 1016142 - RNA, 20 nt, Homo sapiens
gcuauggugagaugcagcug

SEQ ID NO: 1016143 - RNA, 18 nt, Homo sapiens
gcuaugguucucucgcaa

SEQ ID NO: 1016144 - RNA, 22 nt, Homo sapiens
gcuaugugaagaguaagucaac

SEQ ID NO: 1016145 - RNA, 16 nt, Homo sapiens
gcuaugugacuugcau

SEQ ID NO: 1016146 - RNA, 14 nt, Homo sapiens
gcuauuacugucug

SEQ ID NO: 1016147 - RNA, 15 nt, Homo sapiens
gcuauuguagagcca

SEQ ID NO: 1016148 - RNA, 22 nt, Homo sapiens
gcuauuuuuuauuuuacuuuua

SEQ ID NO: 1016149 - RNA, 17 nt, Homo sapiens
gcucaaacaacauucca

SEQ ID NO: 1016150 - RNA, 16 nt, Homo sapiens
gcucaaaucuauucag

SEQ ID NO: 1016151 - RNA, 15 nt, Homo sapiens
gcucaauauuccuga

SEQ ID NO: 1016152 - RNA, 23 nt, Homo sapiens
gcucaauuuaauuuugcaggauu

SEQ ID NO: 1016153 - RNA, 18 nt, Homo sapiens
gcucacauaucugucauu

SEQ ID NO: 1016154 - RNA, 19 nt, Homo sapiens
gcucacuaaaaugcuaauu

SEQ ID NO: 1016155 - RNA, 14 nt, Homo sapiens
gcucagacugguug

SEQ ID NO: 1016156 - RNA, 16 nt, Homo sapiens
gcucagagaugugcac

SEQ ID NO: 1016157 - RNA, 19 nt, Homo sapiens
gcucagaucucaugggaua

SEQ ID NO: 1016158 - RNA, 15 nt, Homo sapiens
gcucagcauuuccac

SEQ ID NO: 1016159 - RNA, 18 nt, Homo sapiens
gcucaggaccaggcaaug

SEQ ID NO: 1016160 - RNA, 21 nt, Homo sapiens
gcucagggaaaagcagcucuc

SEQ ID NO: 1016161 - RNA, 22 nt, Homo sapiens
gcucagggcuaaacgggcauug

SEQ ID NO: 1016162 - RNA, 20 nt, Homo sapiens
gcucaggggcguguggcuca

SEQ ID NO: 1016163 - RNA, 17 nt, Homo sapiens
gcucauagggaagaccu

SEQ ID NO: 1016164 - RNA, 13 nt, Homo sapiens
gcucaucacugga

SEQ ID NO: 1016165 - RNA, 13 nt, Homo sapiens
gcucaucauucuc

SEQ ID NO: 1016166 - RNA, 20 nt, Homo sapiens
gcucaugaccuggaaauaaa

SEQ ID NO: 1016167 - RNA, 22 nt, Homo sapiens
gcuccaagaccuguugguucca

SEQ ID NO: 1016168 - RNA, 18 nt, Homo sapiens
gcuccacucugacuggca

SEQ ID NO: 1016169 - RNA, 13 nt, Homo sapiens
gcuccagugcagg

SEQ ID NO: 1016170 - RNA, 20 nt, Homo sapiens
gcuccaucgcugucaucuca

SEQ ID NO: 1016171 - RNA, 18 nt, Homo sapiens
ugcuguagacauuugcua

SEQ ID NO: 1016172 - RNA, 18 nt, Homo sapiens
ugcuguauccauccaugg

SEQ ID NO: 1016173 - RNA, 14 nt, Homo sapiens
ugcugucaaaacaa

SEQ ID NO: 1016174 - RNA, 22 nt, Homo sapiens
ugcugucccaaacaugcacuuc

SEQ ID NO: 1016175 - RNA, 15 nt, Homo sapiens
ugcugugugacucaa

SEQ ID NO: 1016176 - RNA, 17 nt, Homo sapiens
ugcuguuauccaugggg

SEQ ID NO: 1016177 - RNA, 14 nt, Homo sapiens
ugcuguuccaccuc

SEQ ID NO: 1016178 - RNA, 22 nt, Homo sapiens
ugcuguugucccucugcuacgu

SEQ ID NO: 1016179 - RNA, 14 nt, Homo sapiens
ugcuuaaaauagca

SEQ ID NO: 1016180 - RNA, 18 nt, Homo sapiens
ugcuuacacggaugccuu

SEQ ID NO: 1016181 - RNA, 23 nt, Homo sapiens
ugcuuagcuugagggugacuaug

SEQ ID NO: 1016182 - RNA, 19 nt, Homo sapiens
ugcuuauuguuccaagaca

SEQ ID NO: 1016183 - RNA, 19 nt, Homo sapiens
ugcuucaaaaacauucuua

SEQ ID NO: 1016184 - RNA, 23 nt, Homo sapiens
ugcuucccggcgucccuaccucc

SEQ ID NO: 1016185 - RNA, 16 nt, Homo sapiens
ugcuuccugacaauca

SEQ ID NO: 1016186 - RNA, 18 nt, Homo sapiens
ugcuugaaaaaugugcaa

SEQ ID NO: 1016187 - RNA, 18 nt, Homo sapiens
ugcuugaacccaagaggu

SEQ ID NO: 1016188 - RNA, 16 nt, Homo sapiens
ugcuugagcucaggag

SEQ ID NO: 1016189 - RNA, 14 nt, Homo sapiens
ugcuuggcugcugu

SEQ ID NO: 1016190 - RNA, 12 nt, Homo sapiens
ugcuugugccac

SEQ ID NO: 1016191 - RNA, 14 nt, Homo sapiens
ugcuuguuauuaga

SEQ ID NO: 1016192 - RNA, 23 nt, Homo sapiens
ugcuuguugggauuccugaccca

SEQ ID NO: 1016193 - RNA, 21 nt, Homo sapiens
ugcuuguuugcucaccugggg

SEQ ID NO: 1016194 - RNA, 18 nt, Homo sapiens
ugugcacugucacuuugc

SEQ ID NO: 1016195 - RNA, 23 nt, Homo sapiens
ugugcacuugcacgcccaugugu

SEQ ID NO: 1016196 - RNA, 20 nt, Homo sapiens
ugugcaguccugggaugugg

SEQ ID NO: 1016197 - RNA, 21 nt, Homo sapiens
ugugcaguguugacaguucau

SEQ ID NO: 1016198 - RNA, 22 nt, Homo sapiens
ugugcauuaaaacaaauccaua

SEQ ID NO: 1016199 - RNA, 14 nt, Homo sapiens
ugugccaugugcca

SEQ ID NO: 1016200 - RNA, 13 nt, Homo sapiens
ugugcccucagau

SEQ ID NO: 1016201 - RNA, 17 nt, Homo sapiens
ugugccugaagucccag

SEQ ID NO: 1016202 - RNA, 22 nt, Homo sapiens
ugugcgcugacaaccaccgcuc

SEQ ID NO: 1016203 - RNA, 19 nt, Homo sapiens
ugugcguguguccaugugu

SEQ ID NO: 1016204 - RNA, 18 nt, Homo sapiens
ugugcuaauaacagugca

SEQ ID NO: 1016205 - RNA, 19 nt, Homo sapiens
ugugcuaauaacagugcau

SEQ ID NO: 1016206 - RNA, 14 nt, Homo sapiens
ugugcuuguuuaca

SEQ ID NO: 1016207 - RNA, 20 nt, Homo sapiens
uguggaaaguguaaagcauu

SEQ ID NO: 1016208 - RNA, 18 nt, Homo sapiens
uguggaguccgacaaagc

SEQ ID NO: 1016209 - RNA, 15 nt, Homo sapiens
uguggaugucuuccu

SEQ ID NO: 1016210 - RNA, 20 nt, Homo sapiens
uguggcaaagccuucauugc

SEQ ID NO: 1016211 - RNA, 17 nt, Homo sapiens
uguggcauuuucacuuu

SEQ ID NO: 1016212 - RNA, 19 nt, Homo sapiens
uguggcccagggaagccaa

SEQ ID NO: 1016213 - RNA, 17 nt, Homo sapiens
uguggcucacgugagag

SEQ ID NO: 1016214 - RNA, 17 nt, Homo sapiens
ugugggacugagaugca

SEQ ID NO: 1016215 - RNA, 22 nt, Homo sapiens
ugugggugggaccacagacuca

SEQ ID NO: 1016216 - RNA, 16 nt, Homo sapiens
ugugggugucagucag

SEQ ID NO: 1016217 - RNA, 16 nt, Homo sapiens
uguggugagaucaugc

SEQ ID NO: 1016218 - RNA, 22 nt, Homo sapiens
uguggugagcagaaguggagcu

SEQ ID NO: 1016219 - RNA, 22 nt, Homo sapiens
ugugguuaaugccauggacaga

SEQ ID NO: 1016220 - RNA, 16 nt, Homo sapiens
ugugguuacaguuuga

SEQ ID NO: 1016221 - RNA, 19 nt, Homo sapiens
uguguacauuagucauuca

SEQ ID NO: 1016222 - RNA, 23 nt, Homo sapiens
uguguauauaguaugaaugcagu

SEQ ID NO: 1016223 - RNA, 9 nt, Homo sapiens
uguguauga

SEQ ID NO: 1016224 - RNA, 13 nt, Homo sapiens
uguguaugugcgu

SEQ ID NO: 1016225 - RNA, 17 nt, Homo sapiens
uguguauucuagugaau

SEQ ID NO: 1016226 - RNA, 18 nt, Homo sapiens
uguguauuuaacagggag

SEQ ID NO: 1016227 - RNA, 18 nt, Homo sapiens
uguguauuuccagugcaa

SEQ ID NO: 1016228 - RNA, 21 nt, Homo sapiens
ugugucaaacaguacacuauc

SEQ ID NO: 1016229 - RNA, 16 nt, Homo sapiens
ugugucaguggaugcu

SEQ ID NO: 1016230 - RNA, 13 nt, Homo sapiens
uguguccaugugu

SEQ ID NO: 1016231 - RNA, 19 nt, Homo sapiens
uguguccaugugugugcaa

SEQ ID NO: 1016232 - RNA, 20 nt, Homo sapiens
uguguccaugugugugcaag

SEQ ID NO: 1016233 - RNA, 21 nt, Homo sapiens
ugugugaucugugggcacauu

SEQ ID NO: 1016234 - RNA, 18 nt, Homo sapiens
uuggagcagcuucuggga

SEQ ID NO: 1016235 - RNA, 14 nt, Homo sapiens
uuggagggucccaa

SEQ ID NO: 1016236 - RNA, 16 nt, Homo sapiens
uuggauggagacucca

SEQ ID NO: 1016237 - RNA, 12 nt, Homo sapiens
uuggcaugccuu

SEQ ID NO: 1016238 - RNA, 15 nt, Homo sapiens
uuggccagugugaca

SEQ ID NO: 1016239 - RNA, 15 nt, Homo sapiens
uuggccaucucugga

SEQ ID NO: 1016240 - RNA, 16 nt, Homo sapiens
uuggcccaagcucuug

SEQ ID NO: 1016241 - RNA, 17 nt, Homo sapiens
uuggccuucagaaccau

SEQ ID NO: 1016242 - RNA, 16 nt, Homo sapiens
uuggcuacacagggau

SEQ ID NO: 1016243 - RNA, 18 nt, Homo sapiens
uuggcuccagucuuccga

SEQ ID NO: 1016244 - RNA, 15 nt, Homo sapiens
uuggcucuacccuga

SEQ ID NO: 1016245 - RNA, 15 nt, Homo sapiens
uuggcuuaucauggg

SEQ ID NO: 1016246 - RNA, 15 nt, Homo sapiens
uugggaacugcaaua

SEQ ID NO: 1016247 - RNA, 13 nt, Homo sapiens
uugggaagaccag

SEQ ID NO: 1016248 - RNA, 13 nt, Homo sapiens
uugggagcacugg

SEQ ID NO: 1016249 - RNA, 14 nt, Homo sapiens
uugggaggccaagg

SEQ ID NO: 1016250 - RNA, 21 nt, Homo sapiens
uugggcguuugaacucaggga

SEQ ID NO: 1016251 - RNA, 16 nt, Homo sapiens
uugggcuggugucacc

SEQ ID NO: 1016252 - RNA, 11 nt, Homo sapiens
uugggcuguga

SEQ ID NO: 1016253 - RNA, 13 nt, Homo sapiens
uuggggcuuuuac

SEQ ID NO: 1016254 - RNA, 13 nt, Homo sapiens
uuggggucucuuu

SEQ ID NO: 1016255 - RNA, 13 nt, Homo sapiens
uugggucuuugaa

SEQ ID NO: 1016256 - RNA, 23 nt, Homo sapiens
uuggguuaagcauuaccacucag

SEQ ID NO: 1016257 - RNA, 14 nt, Homo sapiens
uuggguucacagaa

SEQ ID NO: 1016258 - RNA, 16 nt, Homo sapiens
uugguaacauccuuuc

SEQ ID NO: 1016259 - RNA, 21 nt, Homo sapiens
uugguacuacuagaugucuuu

SEQ ID NO: 1016260 - RNA, 21 nt, Homo sapiens
uugguacuagauacugaaugu

SEQ ID NO: 1016261 - RNA, 22 nt, Homo sapiens
uuggucuucccaggcuggggcu

SEQ ID NO: 1016262 - RNA, 21 nt, Homo sapiens
uuggugagaaaucguugcugc

SEQ ID NO: 1016263 - RNA, 18 nt, Homo sapiens
uugguguaguugaacuga

SEQ ID NO: 1016264 - RNA, 18 nt, Homo sapiens
uugguuuccaaaggcauu

SEQ ID NO: 1016265 - RNA, 22 nt, Homo sapiens
uugguuuccaaaggcauuuuau

SEQ ID NO: 1016266 - RNA, 20 nt, Homo sapiens
uuguaaaauauuuaugagaa

SEQ ID NO: 1016267 - RNA, 14 nt, Homo sapiens
uuguaaaauggugu

SEQ ID NO: 1016268 - RNA, 20 nt, Homo sapiens
uuguaaauacacauagcaug

SEQ ID NO: 1016269 - RNA, 17 nt, Homo sapiens
uuguaacuaggcucaga

SEQ ID NO: 1016270 - RNA, 17 nt, Homo sapiens
uuguaacuuaugaaccu

SEQ ID NO: 1016271 - RNA, 16 nt, Homo sapiens
uuguaauaaugcuaaa

SEQ ID NO: 1016272 - RNA, 21 nt, Homo sapiens
uuguacauaaugcgugcauac

SEQ ID NO: 1016273 - RNA, 18 nt, Homo sapiens
uuguagccacuucacuuu

SEQ ID NO: 1016274 - RNA, 20 nt, Homo sapiens
uuguauaaauuuauuuacug

SEQ ID NO: 1016275 - RNA, 16 nt, Homo sapiens
uuguauauuauggaag

SEQ ID NO: 1016276 - RNA, 20 nt, Homo sapiens
uuguaucaaaugugacauua

SEQ ID NO: 1016277 - RNA, 22 nt, Homo sapiens
uuguauguuaaguuacuucacu

SEQ ID NO: 1016278 - RNA, 17 nt, Homo sapiens
uuguauuaucaacagca

SEQ ID NO: 1016279 - RNA, 19 nt, Homo sapiens
uuguauucucuccuguacc

SEQ ID NO: 1016280 - RNA, 22 nt, Homo sapiens
uuguauuuuaacucauaccuuu

SEQ ID NO: 1016281 - RNA, 14 nt, Homo sapiens
uugucaaaaaguuc

SEQ ID NO: 1016282 - RNA, 17 nt, Homo sapiens
uugucaaaaaguuccau

SEQ ID NO: 1016283 - RNA, 15 nt, Homo sapiens
uugucaaaaggaagu

SEQ ID NO: 1016284 - RNA, 22 nt, Homo sapiens
uugucaagcaguagacaagcaa

SEQ ID NO: 1016285 - RNA, 19 nt, Homo sapiens
uugucacagggacugaaaa

SEQ ID NO: 1016286 - RNA, 14 nt, Homo sapiens
uugucacaugaaac

SEQ ID NO: 1016287 - RNA, 18 nt, Homo sapiens
uugucccuaugcauauca

SEQ ID NO: 1016288 - RNA, 15 nt, Homo sapiens
uugucccucugcuac

SEQ ID NO: 1016289 - RNA, 16 nt, Homo sapiens
uugucccugugccuaa

SEQ ID NO: 1016290 - RNA, 23 nt, Homo sapiens
uugucuaaauaaguuugcaauuu

SEQ ID NO: 1016291 - RNA, 17 nt, Homo sapiens
uugucucccagcucagg

SEQ ID NO: 1016292 - RNA, 17 nt, Homo sapiens
uugucugagucuugggu

SEQ ID NO: 1016293 - RNA, 20 nt, Homo sapiens
uugucuguuuuuguaacuua

SEQ ID NO: 1016294 - RNA, 14 nt, Homo sapiens
uugugaaccccaaa

SEQ ID NO: 1016295 - RNA, 23 nt, Homo sapiens
uugugaaguggaaauguucuaaa

SEQ ID NO: 1016296 - RNA, 17 nt, Homo sapiens
uugugacccagcacugc

SEQ ID NO: 1016297 - RNA, 12 nt, Homo sapiens
uugugacuucaa

SEQ ID NO: 1016298 - RNA, 15 nt, Homo sapiens
uugugauuauuucac

SEQ ID NO: 1016299 - RNA, 14 nt, Homo sapiens
uugugauuugacug

SEQ ID NO: 1016300 - RNA, 10 nt, Homo sapiens
uugugcaaac

SEQ ID NO: 1016301 - RNA, 20 nt, Homo sapiens
uuuauuuuucauauugugcc

SEQ ID NO: 1016302 - RNA, 16 nt, Homo sapiens
uuucaaaaaaucugac

SEQ ID NO: 1016303 - RNA, 15 nt, Homo sapiens
uuucaaaacacaucu

SEQ ID NO: 1016304 - RNA, 19 nt, Homo sapiens
uuucaaagauguguugcua

SEQ ID NO: 1016305 - RNA, 13 nt, Homo sapiens
uuucaaagcuaaa

SEQ ID NO: 1016306 - RNA, 18 nt, Homo sapiens
uuucaaauuggagcuuca

SEQ ID NO: 1016307 - RNA, 18 nt, Homo sapiens
uuucaauaaaccuaauaa

SEQ ID NO: 1016308 - RNA, 15 nt, Homo sapiens
uuucacauaaaaccu

SEQ ID NO: 1016309 - RNA, 11 nt, Homo sapiens
uuucaccacau

SEQ ID NO: 1016310 - RNA, 17 nt, Homo sapiens
uuucaccacaugugcac

SEQ ID NO: 1016311 - RNA, 13 nt, Homo sapiens
uuucaccauuuga

SEQ ID NO: 1016312 - RNA, 13 nt, Homo sapiens
uuucaccuguaaa

SEQ ID NO: 1016313 - RNA, 14 nt, Homo sapiens
uuucaccuucauau

SEQ ID NO: 1016314 - RNA, 14 nt, Homo sapiens
uuucacugcugcaa

SEQ ID NO: 1016315 - RNA, 19 nt, Homo sapiens
uuucacuguguuggccagg

SEQ ID NO: 1016316 - RNA, 19 nt, Homo sapiens
uuucacuuaauaaugugua

SEQ ID NO: 1016317 - RNA, 20 nt, Homo sapiens
uuucagagaaauacuuucag

SEQ ID NO: 1016318 - RNA, 18 nt, Homo sapiens
uuucagauaaacaacaaa

SEQ ID NO: 1016319 - RNA, 12 nt, Homo sapiens
uuucagcuaaag

SEQ ID NO: 1016320 - RNA, 19 nt, Homo sapiens
uuucagcuccuucaaugca

SEQ ID NO: 1016321 - RNA, 16 nt, Homo sapiens
uuucaggccacauggc

SEQ ID NO: 1016322 - RNA, 12 nt, Homo sapiens
uuucaguauuag

SEQ ID NO: 1016323 - RNA, 23 nt, Homo sapiens
uuucaguggcuaccuacauacaa

SEQ ID NO: 1016324 - RNA, 22 nt, Homo sapiens
uuucaugaaaagauuaugaucu

SEQ ID NO: 1016325 - RNA, 15 nt, Homo sapiens
uuucauucuucucua

SEQ ID NO: 1016326 - RNA, 15 nt, Homo sapiens
uuucauugauaugaa

SEQ ID NO: 1016327 - RNA, 12 nt, Homo sapiens
uuucauugcugg

SEQ ID NO: 1016328 - RNA, 17 nt, Homo sapiens
uuucauuuacuguggcu

SEQ ID NO: 1016329 - RNA, 21 nt, Homo sapiens
uuuccaaaccuccacugcugc

SEQ ID NO: 1016330 - RNA, 23 nt, Homo sapiens
uuuccacauaaggaaacuggguu

SEQ ID NO: 1016331 - RNA, 18 nt, Homo sapiens
uuuccacuacugcuacca

SEQ ID NO: 1016332 - RNA, 21 nt, Homo sapiens
uuuccagcgggacucuucuca

SEQ ID NO: 1016333 - RNA, 14 nt, Homo sapiens
uuuccauagucaca

SEQ ID NO: 1016334 - RNA, 18 nt, Homo sapiens
uuuccauauggauuuucu

SEQ ID NO: 1016335 - RNA, 10 nt, Homo sapiens
uuuccaugau

SEQ ID NO: 1016336 - RNA, 18 nt, Homo sapiens
uuucccucccacuauuaa

SEQ ID NO: 1016337 - RNA, 15 nt, Homo sapiens
uuuccgaaaucagaa

SEQ ID NO: 1016338 - RNA, 22 nt, Homo sapiens
uuuccgcccucaaaaugacagc

SEQ ID NO: 1016339 - RNA, 18 nt, Homo sapiens
uuuccgggauagagucuu

SEQ ID NO: 1016340 - RNA, 16 nt, Homo sapiens
uuuccugcagggccag

SEQ ID NO: 1016341 - RNA, 21 nt, Homo sapiens
uuuccugcugccauccucacc

SEQ ID NO: 1016342 - RNA, 21 nt, Homo sapiens
uuuccuguguacacgugacag

SEQ ID NO: 1016343 - RNA, 12 nt, Homo sapiens
uuuccuugcuca

SEQ ID NO: 1016344 - RNA, 20 nt, Homo sapiens
uuuccuuguccugccaggau

SEQ ID NO: 1016345 - RNA, 14 nt, Homo sapiens
uuucuaaugugcau

SEQ ID NO: 1016346 - RNA, 14 nt, Homo sapiens
uuucuacaggccag

SEQ ID NO: 1016347 - RNA, 18 nt, Homo sapiens
uuucuaccuugaggucuu

SEQ ID NO: 1016348 - RNA, 18 nt, Homo sapiens
uuucuaugacacaugcaa

SEQ ID NO: 1016349 - RNA, 23 nt, Homo sapiens
uuucucagacuuuggaaaaugca

SEQ ID NO: 1016350 - RNA, 19 nt, Homo sapiens
uuucucagauggauugaua

SEQ ID NO: 1016351 - RNA, 20 nt, Homo sapiens
uuucucauguuuuccauugu

SEQ ID NO: 1016352 - RNA, 17 nt, Homo sapiens
uuucucauuaauuuugg

SEQ ID NO: 1016353 - RNA, 20 nt, Homo sapiens
uuucugaauacaaagugaug

SEQ ID NO: 1016354 - RNA, 16 nt, Homo sapiens
uuucugaucugaugca

SEQ ID NO: 1016355 - RNA, 19 nt, Homo sapiens
uuucugcuaaaaaguccuu

SEQ ID NO: 1016356 - RNA, 19 nt, Homo sapiens
uuucuggcuaugcauuuga

SEQ ID NO: 1016357 - RNA, 16 nt, Homo sapiens
uuucugucucugccuc

SEQ ID NO: 1016358 - RNA, 13 nt, Homo sapiens
uuucugugcaugg

SEQ ID NO: 1016359 - RNA, 22 nt, Homo sapiens
uuucugugggaggagaagggga

SEQ ID NO: 1016360 - RNA, 13 nt, Homo sapiens
uuucuugcaugag

SEQ ID NO: 1016361 - RNA, 13 nt, Homo sapiens
uuucuuuccucag

SEQ ID NO: 1016362 - RNA, 18 nt, Homo sapiens
uuucuuucuaacuccagu

SEQ ID NO: 1016363 - RNA, 22 nt, Homo sapiens
uuucuuuuuuuuuuaauuguga

SEQ ID NO: 1016364 - RNA, 16 nt, Homo sapiens
uuugaaaacauaaucu

SEQ ID NO: 1016365 - RNA, 13 nt, Homo sapiens
uuugaaacaguug

SEQ ID NO: 1016366 - RNA, 18 nt, Homo sapiens
uuugaaauuaaccucuca

SEQ ID NO: 1016367 - RNA, 12 nt, Homo sapiens
uuugaaguagga

SEQ ID NO: 1016368 - RNA, 18 nt, Homo sapiens
uuugaauuggacaauaau

SEQ ID NO: 1016369 - RNA, 14 nt, Homo sapiens
uuugagaaaugcau

SEQ ID NO: 1016370 - RNA, 14 nt, Homo sapiens
uuugagaaugguua

SEQ ID NO: 1016371 - RNA, 23 nt, Homo sapiens
uuugagaauuauaaaauuaacau

SEQ ID NO: 1016372 - RNA, 13 nt, Homo sapiens
uuugagacagagu

SEQ ID NO: 1016373 - RNA, 12 nt, Homo sapiens
aaaaaaauuacu

SEQ ID NO: 1016374 - RNA, 13 nt, Homo sapiens
aaaaaaauuacuu

SEQ ID NO: 1016375 - RNA, 16 nt, Homo sapiens
aaaaaacacaucuggc

SEQ ID NO: 1016376 - RNA, 19 nt, Homo sapiens
aaaaaacugaaaauacuua

SEQ ID NO: 1016377 - RNA, 17 nt, Homo sapiens
aaaaaacugcagugaaa

SEQ ID NO: 1016378 - RNA, 12 nt, Homo sapiens
aaaaaagccaaa

SEQ ID NO: 1016379 - RNA, 20 nt, Homo sapiens
aaaaaaugcugaacauugca

SEQ ID NO: 1016380 - RNA, 22 nt, Homo sapiens
aaaaacauggccuuugcuugaa

SEQ ID NO: 1016381 - RNA, 14 nt, Homo sapiens
aaaaacuucuuuaa

SEQ ID NO: 1016382 - RNA, 14 nt, Homo sapiens
aaaaagacagggcu

SEQ ID NO: 1016383 - RNA, 19 nt, Homo sapiens
aaaaagaccuaugagcaca

SEQ ID NO: 1016384 - RNA, 12 nt, Homo sapiens
aaaaagccaaaa

SEQ ID NO: 1016385 - RNA, 12 nt, Homo sapiens
aaaaagccucca

SEQ ID NO: 1016386 - RNA, 12 nt, Homo sapiens
aaaaaggcaccu

SEQ ID NO: 1016387 - RNA, 12 nt, Homo sapiens
aaaaaguuccau

SEQ ID NO: 1016388 - RNA, 17 nt, Homo sapiens
aaaaauacucacauggc

SEQ ID NO: 1016389 - RNA, 14 nt, Homo sapiens
aaaaauauguacaa

SEQ ID NO: 1016390 - RNA, 15 nt, Homo sapiens
aaaaaucagugaaua

SEQ ID NO: 1016391 - RNA, 17 nt, Homo sapiens
aaaaaucauaguacucu

SEQ ID NO: 1016392 - RNA, 17 nt, Homo sapiens
aaaaaugcugaacauug

SEQ ID NO: 1016393 - RNA, 20 nt, Homo sapiens
aaaaauguauaugcacuuau

SEQ ID NO: 1016394 - RNA, 14 nt, Homo sapiens
aaaaauucaacuca

SEQ ID NO: 1016395 - RNA, 16 nt, Homo sapiens
aaaaauucugaaugua

SEQ ID NO: 1016396 - RNA, 18 nt, Homo sapiens
aaaaauuuaagcauuguu

SEQ ID NO: 1016397 - RNA, 20 nt, Homo sapiens
aaaaauuuauuuauauuuca

SEQ ID NO: 1016398 - RNA, 19 nt, Homo sapiens
aaaacaauuguaauaaugc

SEQ ID NO: 1016399 - RNA, 14 nt, Homo sapiens
aaaacacagacauu

SEQ ID NO: 1016400 - RNA, 14 nt, Homo sapiens
aaaacacauaauuu

SEQ ID NO: 1016401 - RNA, 17 nt, Homo sapiens
aaaacaccuagcuuuau

SEQ ID NO: 1016402 - RNA, 13 nt, Homo sapiens
aaaacacugugca

SEQ ID NO: 1016403 - RNA, 20 nt, Homo sapiens
aaaacaguccuucaaacuuc

SEQ ID NO: 1016404 - RNA, 19 nt, Homo sapiens
aaaacauugauuauaagca

SEQ ID NO: 1016405 - RNA, 13 nt, Homo sapiens
aaaacauuuuacu

SEQ ID NO: 1016406 - RNA, 23 nt, Homo sapiens
aaaacauuuuacuuuaaaaggag

SEQ ID NO: 1016407 - RNA, 24 nt, Homo sapiens
aaaaccaauguucucucuucucca

SEQ ID NO: 1016408 - RNA, 16 nt, Homo sapiens
aaaaccucuaugcaau

SEQ ID NO: 1016409 - RNA, 16 nt, Homo sapiens
aaaacuaaacuuucau

SEQ ID NO: 1016410 - RNA, 21 nt, Homo sapiens
aaaacuccacagucaauauua

SEQ ID NO: 1016411 - RNA, 18 nt, Homo sapiens
aaacuccugggcucaggc

SEQ ID NO: 1016412 - RNA, 16 nt, Homo sapiens
aaacugacuuuauccu

SEQ ID NO: 1016413 - RNA, 21 nt, Homo sapiens
aaacugaggaauuucaccugu

SEQ ID NO: 1016414 - RNA, 13 nt, Homo sapiens
aaacugauuuauc

SEQ ID NO: 1016415 - RNA, 14 nt, Homo sapiens
aaacugcugugaau

SEQ ID NO: 1016416 - RNA, 18 nt, Homo sapiens
aaacugguuuguugcagc

SEQ ID NO: 1016417 - RNA, 14 nt, Homo sapiens
aaacuguacuacau

SEQ ID NO: 1016418 - RNA, 17 nt, Homo sapiens
aaacuguagucucagga

SEQ ID NO: 1016419 - RNA, 15 nt, Homo sapiens
aaacuucauggucau

SEQ ID NO: 1016420 - RNA, 21 nt, Homo sapiens
aaacuugcauacagagacaga

SEQ ID NO: 1016421 - RNA, 11 nt, Homo sapiens
aaacuugccug

SEQ ID NO: 1016422 - RNA, 17 nt, Homo sapiens
aaacuuuagaguagcau

SEQ ID NO: 1016423 - RNA, 13 nt, Homo sapiens
aaacuuuauucaa

SEQ ID NO: 1016424 - RNA, 22 nt, Homo sapiens
aaacuuuuaauuaaaugcucau

SEQ ID NO: 1016425 - RNA, 17 nt, Homo sapiens
aaagaaaauaccaagga

SEQ ID NO: 1016426 - RNA, 16 nt, Homo sapiens
aaagaaacaaccugcc

SEQ ID NO: 1016427 - RNA, 17 nt, Homo sapiens
aaagaaacaaccugcca

SEQ ID NO: 1016428 - RNA, 15 nt, Homo sapiens
aaagaaacaagaugc

SEQ ID NO: 1016429 - RNA, 15 nt, Homo sapiens
aaagaaagaaggaag

SEQ ID NO: 1016430 - RNA, 13 nt, Homo sapiens
aaagaagaacuug

SEQ ID NO: 1016431 - RNA, 14 nt, Homo sapiens
aaagaagaggagaa

SEQ ID NO: 1016432 - RNA, 22 nt, Homo sapiens
aaagaauaauaugcugccaaau

SEQ ID NO: 1016433 - RNA, 16 nt, Homo sapiens
aaagaaugcucuuuac

SEQ ID NO: 1016434 - RNA, 18 nt, Homo sapiens
aaagaaugggcaguuaca

SEQ ID NO: 1016435 - RNA, 12 nt, Homo sapiens
aaagacaauucu

SEQ ID NO: 1016436 - RNA, 15 nt, Homo sapiens
aaagacaggagguaa

SEQ ID NO: 1016437 - RNA, 14 nt, Homo sapiens
aaagacauagccaa

SEQ ID NO: 1016438 - RNA, 14 nt, Homo sapiens
aaagacuccaaaga

SEQ ID NO: 1016439 - RNA, 23 nt, Homo sapiens
aaagagagaucuugauccacaga

SEQ ID NO: 1016440 - RNA, 14 nt, Homo sapiens
aaagaguccuauuu

SEQ ID NO: 1016441 - RNA, 16 nt, Homo sapiens
aaagaguguagaucag

SEQ ID NO: 1016442 - RNA, 16 nt, Homo sapiens
aaagauacgacuuuau

SEQ ID NO: 1016443 - RNA, 16 nt, Homo sapiens
aaagaucuucuuccaa

SEQ ID NO: 1016444 - RNA, 21 nt, Homo sapiens
aaagaucuuucaggacucuac

SEQ ID NO: 1016445 - RNA, 20 nt, Homo sapiens
aaagaugaucuacucagaaa

SEQ ID NO: 1016446 - RNA, 22 nt, Homo sapiens
aaagaugcaaggaccaggacuc

SEQ ID NO: 1016447 - RNA, 16 nt, Homo sapiens
aaagauguuugucaga

SEQ ID NO: 1016448 - RNA, 23 nt, Homo sapiens
aaagauuggacaccccugcuaua

SEQ ID NO: 1016449 - RNA, 17 nt, Homo sapiens
aaagauuuguuuuguca

SEQ ID NO: 1016450 - RNA, 18 nt, Homo sapiens
aaagcaacagacuucuca

SEQ ID NO: 1016451 - RNA, 20 nt, Homo sapiens
aaagcaaguuucaucaguca

SEQ ID NO: 1016452 - RNA, 21 nt, Homo sapiens
aaagcacacucauccccucac

SEQ ID NO: 1016453 - RNA, 12 nt, Homo sapiens
aaagcacaguuu

SEQ ID NO: 1016454 - RNA, 15 nt, Homo sapiens
aaagcagauaccuca

SEQ ID NO: 1016455 - RNA, 23 nt, Homo sapiens
aaagcagggacuugaacccauau

SEQ ID NO: 1016456 - RNA, 19 nt, Homo sapiens
aaagcaguggacaccagga

SEQ ID NO: 1016457 - RNA, 17 nt, Homo sapiens
aaagcauaacaaaaaga

SEQ ID NO: 1016458 - RNA, 16 nt, Homo sapiens
aaagcaucaccucagg

SEQ ID NO: 1016459 - RNA, 15 nt, Homo sapiens
aaagcauccaugugu

SEQ ID NO: 1016460 - RNA, 23 nt, Homo sapiens
aaagccaaggucuggagaagcuc

SEQ ID NO: 1016461 - RNA, 22 nt, Homo sapiens
aaagccaucaaacacaaugccu

SEQ ID NO: 1016462 - RNA, 18 nt, Homo sapiens
aaagcccauucauuccau

SEQ ID NO: 1016463 - RNA, 16 nt, Homo sapiens
aaagccugaguuugcu

SEQ ID NO: 1016464 - RNA, 18 nt, Homo sapiens
aaagccugccucuuccag

SEQ ID NO: 1016465 - RNA, 17 nt, Homo sapiens
aaagcguggacaggugu

SEQ ID NO: 1016466 - RNA, 13 nt, Homo sapiens
aaagcugcucagg

SEQ ID NO: 1016467 - RNA, 20 nt, Homo sapiens
aaagcuuaccaaggggaaug

SEQ ID NO: 1016468 - RNA, 13 nt, Homo sapiens
aaagcuuccccaa

SEQ ID NO: 1016469 - RNA, 22 nt, Homo sapiens
aaagcuugcucacaucuuggca

SEQ ID NO: 1016470 - RNA, 23 nt, Homo sapiens
aaagcuuucauguaaacugugca

SEQ ID NO: 1016471 - RNA, 14 nt, Homo sapiens
aaagcuuugugcag

SEQ ID NO: 1016472 - RNA, 16 nt, Homo sapiens
aaaggaagacagauuu

SEQ ID NO: 1016473 - RNA, 20 nt, Homo sapiens
aaaggaagcuccacugucac

SEQ ID NO: 1016474 - RNA, 22 nt, Homo sapiens
aaaggaauccacucccaggcag

SEQ ID NO: 1016475 - RNA, 13 nt, Homo sapiens
aaaggaaucucca

SEQ ID NO: 1016476 - RNA, 17 nt, Homo sapiens
aaaggacuugacuugca

SEQ ID NO: 1016477 - RNA, 15 nt, Homo sapiens
aaaggauaugcagua

SEQ ID NO: 1016478 - RNA, 15 nt, Homo sapiens
aaagggaacagugag

SEQ ID NO: 1016479 - RNA, 10 nt, Homo sapiens
aaagggaugg

SEQ ID NO: 1016480 - RNA, 18 nt, Homo sapiens
aaagggcccagagagggu

SEQ ID NO: 1016481 - RNA, 15 nt, Homo sapiens
aaagguggacuggaa

SEQ ID NO: 1016482 - RNA, 14 nt, Homo sapiens
aaaggugucuuccu

SEQ ID NO: 1016483 - RNA, 16 nt, Homo sapiens
aaagguuagauuuugu

SEQ ID NO: 1016484 - RNA, 22 nt, Homo sapiens
aaaguagaucauguucacugca

SEQ ID NO: 1016485 - RNA, 12 nt, Homo sapiens
aaaguagcaauu

SEQ ID NO: 1016486 - RNA, 14 nt, Homo sapiens
aaaguagcaauuuc

SEQ ID NO: 1016487 - RNA, 19 nt, Homo sapiens
aaaguagguuuacauucau

SEQ ID NO: 1016488 - RNA, 16 nt, Homo sapiens
aaagucaagauuucca

SEQ ID NO: 1016489 - RNA, 22 nt, Homo sapiens
aaagucacaggucacacgaggg

SEQ ID NO: 1016490 - RNA, 23 nt, Homo sapiens
aaagucuuugaagugacuucaca

SEQ ID NO: 1016491 - RNA, 17 nt, Homo sapiens
aaagugcgaguccucca

SEQ ID NO: 1016492 - RNA, 20 nt, Homo sapiens
aaagugcugcuggaaguaga

SEQ ID NO: 1016493 - RNA, 22 nt, Homo sapiens
aaagugcugggauuacaggcgu

SEQ ID NO: 1016494 - RNA, 14 nt, Homo sapiens
aaaguggccaugcc

SEQ ID NO: 1016495 - RNA, 22 nt, Homo sapiens
aaagugucaccccucacuguga

SEQ ID NO: 1016496 - RNA, 17 nt, Homo sapiens
aaagugugucacccuuu

SEQ ID NO: 1016497 - RNA, 15 nt, Homo sapiens
aaaguuaaacauuga

SEQ ID NO: 1016498 - RNA, 12 nt, Homo sapiens
aaaguuaugaaa

SEQ ID NO: 1016499 - RNA, 23 nt, Homo sapiens
aaaguuaugguacuauguuagcc

SEQ ID NO: 1016500 - RNA, 13 nt, Homo sapiens
aaaguuugcucaa

SEQ ID NO: 1016501 - RNA, 22 nt, Homo sapiens
aaauaaaaagugacacagcagc

SEQ ID NO: 1016502 - RNA, 15 nt, Homo sapiens
aaauaaauagcuaua

SEQ ID NO: 1016503 - RNA, 16 nt, Homo sapiens
aaauaaauagcuauau

SEQ ID NO: 1016504 - RNA, 13 nt, Homo sapiens
aaauaacauggcc

SEQ ID NO: 1016505 - RNA, 18 nt, Homo sapiens
aaauaacuaaugucucua

SEQ ID NO: 1016506 - RNA, 18 nt, Homo sapiens
aaauaagcucuccccaaa

SEQ ID NO: 1016507 - RNA, 14 nt, Homo sapiens
aaauaagucacuua

SEQ ID NO: 1016508 - RNA, 21 nt, Homo sapiens
aaauacaauaaacuuacuaua

SEQ ID NO: 1016509 - RNA, 19 nt, Homo sapiens
aaauacacacucaaaucaa

SEQ ID NO: 1016510 - RNA, 21 nt, Homo sapiens
aaauaccaaaugcauuguugu

SEQ ID NO: 1016511 - RNA, 16 nt, Homo sapiens
aaauaccaaguauuua

SEQ ID NO: 1016512 - RNA, 12 nt, Homo sapiens
aaauaccaguuc

SEQ ID NO: 1016513 - RNA, 16 nt, Homo sapiens
aaauacccacuaacaa

SEQ ID NO: 1016514 - RNA, 20 nt, Homo sapiens
aaauacgguaaggauacuuu

SEQ ID NO: 1016515 - RNA, 22 nt, Homo sapiens
aaauacuguuugagguuuuuaa

SEQ ID NO: 1016516 - RNA, 17 nt, Homo sapiens
aaauagaaccacuauga

SEQ ID NO: 1016517 - RNA, 14 nt, Homo sapiens
aaauagaccucuca

SEQ ID NO: 1016518 - RNA, 21 nt, Homo sapiens
aaauaguuuggauuacuuaaa

SEQ ID NO: 1016519 - RNA, 17 nt, Homo sapiens
aaauauaauaugcacac

SEQ ID NO: 1016520 - RNA, 14 nt, Homo sapiens
aaauauacauucaa

SEQ ID NO: 1016521 - RNA, 16 nt, Homo sapiens
aaauaucugaaaugug

SEQ ID NO: 1016522 - RNA, 17 nt, Homo sapiens
aaauaugaagacauaaa

SEQ ID NO: 1016523 - RNA, 23 nt, Homo sapiens
aaauaugaagcucaccuguugcu

SEQ ID NO: 1016524 - RNA, 21 nt, Homo sapiens
aaauaugauuuuauuugacaa

SEQ ID NO: 1016525 - RNA, 22 nt, Homo sapiens
aaauauuacacaucaagcgaug

SEQ ID NO: 1016526 - RNA, 16 nt, Homo sapiens
aaauauuauugguguu

SEQ ID NO: 1016527 - RNA, 19 nt, Homo sapiens
aaauauuucaagacauuaa

SEQ ID NO: 1016528 - RNA, 15 nt, Homo sapiens
aaauauuucccucac

SEQ ID NO: 1016529 - RNA, 20 nt, Homo sapiens
aaauauuuccuuaaacugug

SEQ ID NO: 1016530 - RNA, 12 nt, Homo sapiens
aaauauuuugcu

SEQ ID NO: 1016531 - RNA, 18 nt, Homo sapiens
aaauauuuuuaugugcaa

SEQ ID NO: 1016532 - RNA, 21 nt, Homo sapiens
aaaucaaguuggcuucuaauc

SEQ ID NO: 1016533 - RNA, 20 nt, Homo sapiens
aaaucaauaaagaccacuuu

SEQ ID NO: 1016534 - RNA, 16 nt, Homo sapiens
aaaucaaugaagcaag

SEQ ID NO: 1016535 - RNA, 21 nt, Homo sapiens
aaaucauaguuuaaacugcau

SEQ ID NO: 1016536 - RNA, 21 nt, Homo sapiens
aaaucaugaagauauuuuucc

SEQ ID NO: 1016537 - RNA, 14 nt, Homo sapiens
aaaucauuucugca

SEQ ID NO: 1016538 - RNA, 21 nt, Homo sapiens
aaauccugaugagguuucuac

SEQ ID NO: 1016539 - RNA, 13 nt, Homo sapiens
aaauccuggugau

SEQ ID NO: 1016540 - RNA, 11 nt, Homo sapiens
aaauccuugau

SEQ ID NO: 1016541 - RNA, 12 nt, Homo sapiens
aaauccuugaua

SEQ ID NO: 1016542 - RNA, 21 nt, Homo sapiens
aaaucgugacaacacuugugu

SEQ ID NO: 1016543 - RNA, 13 nt, Homo sapiens
aaaucuagacuca

SEQ ID NO: 1016544 - RNA, 18 nt, Homo sapiens
aaaucuauagaacugaau

SEQ ID NO: 1016545 - RNA, 16 nt, Homo sapiens
aaaucucaauucuucc

SEQ ID NO: 1016546 - RNA, 13 nt, Homo sapiens
aaaucucacaaau

SEQ ID NO: 1016547 - RNA, 23 nt, Homo sapiens
aaaucuguaucuguagugagaua

SEQ ID NO: 1016548 - RNA, 15 nt, Homo sapiens
aaaucuuaacuugaa

SEQ ID NO: 1016549 - RNA, 14 nt, Homo sapiens
aaaucuuuuaguca

SEQ ID NO: 1016550 - RNA, 21 nt, Homo sapiens
aaaugaaggcagaaaaauguc

SEQ ID NO: 1016551 - RNA, 15 nt, Homo sapiens
aaaugaaucuucaca

SEQ ID NO: 1016552 - RNA, 14 nt, Homo sapiens
aaaugacaaaaagc

SEQ ID NO: 1016553 - RNA, 22 nt, Homo sapiens
aaaugacacaacuugucccuuu

SEQ ID NO: 1016554 - RNA, 13 nt, Homo sapiens
aaaugacccaaag

SEQ ID NO: 1016555 - RNA, 18 nt, Homo sapiens
aaaugaggguggugaaua

SEQ ID NO: 1016556 - RNA, 18 nt, Homo sapiens
aaaugaguaaacccagcu

SEQ ID NO: 1016557 - RNA, 23 nt, Homo sapiens
aaaugcccagcuuaaaggggcua

SEQ ID NO: 1016558 - RNA, 22 nt, Homo sapiens
aaaugcuguauuagucacagag

SEQ ID NO: 1016559 - RNA, 19 nt, Homo sapiens
aaauggaagacacauugaa

SEQ ID NO: 1016560 - RNA, 21 nt, Homo sapiens
aauaugguguacauucuuccu

SEQ ID NO: 1016561 - RNA, 23 nt, Homo sapiens
aauaugguugauaguuuaccuga

SEQ ID NO: 1016562 - RNA, 22 nt, Homo sapiens
aauauguauuguaaacaugugu

SEQ ID NO: 1016563 - RNA, 13 nt, Homo sapiens
aauauuaaauaca

SEQ ID NO: 1016564 - RNA, 17 nt, Homo sapiens
aauauuagggaguaaaa

SEQ ID NO: 1016565 - RNA, 12 nt, Homo sapiens
aauauuccugaa

SEQ ID NO: 1016566 - RNA, 18 nt, Homo sapiens
aauauuuaaacagcagug

SEQ ID NO: 1016567 - RNA, 15 nt, Homo sapiens
aauauuuauuuaacu

SEQ ID NO: 1016568 - RNA, 21 nt, Homo sapiens
aauauuuauuuaacuauucau

SEQ ID NO: 1016569 - RNA, 20 nt, Homo sapiens
aauauuuccuuaaacugugu

SEQ ID NO: 1016570 - RNA, 15 nt, Homo sapiens
aauauuucuuaaaaa

SEQ ID NO: 1016571 - RNA, 17 nt, Homo sapiens
aauauuugcaagacaua

SEQ ID NO: 1016572 - RNA, 15 nt, Homo sapiens
aauauuugcuaugaa

SEQ ID NO: 1016573 - RNA, 17 nt, Homo sapiens
aauauuuugcacaguua

SEQ ID NO: 1016574 - RNA, 14 nt, Homo sapiens
aaucaaaugcaauu

SEQ ID NO: 1016575 - RNA, 13 nt, Homo sapiens
aaucaaauggugu

SEQ ID NO: 1016576 - RNA, 21 nt, Homo sapiens
aaucaagacccuuuucuguau

SEQ ID NO: 1016577 - RNA, 14 nt, Homo sapiens
aaucaaugaagcaa

SEQ ID NO: 1016578 - RNA, 15 nt, Homo sapiens
aaucaaugcuauaac

SEQ ID NO: 1016579 - RNA, 14 nt, Homo sapiens
aaucacacugagga

SEQ ID NO: 1016580 - RNA, 19 nt, Homo sapiens
aaucaccaaggcugauuaa

SEQ ID NO: 1016581 - RNA, 14 nt, Homo sapiens
aaucaccacaccaa

SEQ ID NO: 1016582 - RNA, 14 nt, Homo sapiens
aaucacucuguccu

SEQ ID NO: 1016583 - RNA, 22 nt, Homo sapiens
aaucacuugcacuccggaggua

SEQ ID NO: 1016584 - RNA, 15 nt, Homo sapiens
aaucagagagcucac

SEQ ID NO: 1016585 - RNA, 20 nt, Homo sapiens
aaucagagagcucacuaaaa

SEQ ID NO: 1016586 - RNA, 14 nt, Homo sapiens
aaucagaucauuuc

SEQ ID NO: 1016587 - RNA, 15 nt, Homo sapiens
aaucagccacauucu

SEQ ID NO: 1016588 - RNA, 16 nt, Homo sapiens
aaucagccacauucua

SEQ ID NO: 1016589 - RNA, 22 nt, Homo sapiens
aaucaggcugaggugucuuaag

SEQ ID NO: 1016590 - RNA, 12 nt, Homo sapiens
aaucaguauaau

SEQ ID NO: 1016591 - RNA, 18 nt, Homo sapiens
aaucagucuauccacaga

SEQ ID NO: 1016592 - RNA, 16 nt, Homo sapiens
aaucauuaauacucuu

SEQ ID NO: 1016593 - RNA, 23 nt, Homo sapiens
aaucauugauugucagcuacuaa

SEQ ID NO: 1016594 - RNA, 16 nt, Homo sapiens
aaucauuucugcauca

SEQ ID NO: 1016595 - RNA, 15 nt, Homo sapiens
aaucauuuguucaaa

SEQ ID NO: 1016596 - RNA, 16 nt, Homo sapiens
aauccaaacuaaucca

SEQ ID NO: 1016597 - RNA, 16 nt, Homo sapiens
aauccagacccggcug

SEQ ID NO: 1016598 - RNA, 16 nt, Homo sapiens
aaucccagcuacucaa

SEQ ID NO: 1016599 - RNA, 17 nt, Homo sapiens
aaucccagcuacucaag

SEQ ID NO: 1016600 - RNA, 15 nt, Homo sapiens
aaucccagcuacuug

SEQ ID NO: 1016601 - RNA, 20 nt, Homo sapiens
aaucccuguuuaauauuuaa

SEQ ID NO: 1016602 - RNA, 14 nt, Homo sapiens
aauccgaaguauga

SEQ ID NO: 1016603 - RNA, 15 nt, Homo sapiens
aauccucucugcaag

SEQ ID NO: 1016604 - RNA, 22 nt, Homo sapiens
aauccucuucuuuauacuguaa

SEQ ID NO: 1016605 - RNA, 17 nt, Homo sapiens
aauccuuaaagaacugu

SEQ ID NO: 1016606 - RNA, 15 nt, Homo sapiens
aauccuuuacuguua

SEQ ID NO: 1016607 - RNA, 12 nt, Homo sapiens
aaucuacacucc

SEQ ID NO: 1016608 - RNA, 22 nt, Homo sapiens
aaucuagguucaggaagaccac

SEQ ID NO: 1016609 - RNA, 11 nt, Homo sapiens
aaucucacaaa

SEQ ID NO: 1016610 - RNA, 23 nt, Homo sapiens
aaucuccucuuuuagcugaugaa

SEQ ID NO: 1016611 - RNA, 16 nt, Homo sapiens
aaucucggcucacugc

SEQ ID NO: 1016612 - RNA, 13 nt, Homo sapiens
aaucucggcucau

SEQ ID NO: 1016613 - RNA, 17 nt, Homo sapiens
aaucucucagcuuuuaa

SEQ ID NO: 1016614 - RNA, 19 nt, Homo sapiens
aaucucucuuagaguccag

SEQ ID NO: 1016615 - RNA, 15 nt, Homo sapiens
aaucucuuuaccucc

SEQ ID NO: 1016616 - RNA, 23 nt, Homo sapiens
aaucugaggccuccucucucagu

SEQ ID NO: 1016617 - RNA, 18 nt, Homo sapiens
aaucugcccauucaucuu

SEQ ID NO: 1016618 - RNA, 23 nt, Homo sapiens
aaucuggagagcuagaaccugga

SEQ ID NO: 1016619 - RNA, 13 nt, Homo sapiens
aaucuguacaaug

SEQ ID NO: 1016620 - RNA, 20 nt, Homo sapiens
aaucuguguucgauggcuca

SEQ ID NO: 1016621 - RNA, 21 nt, Homo sapiens
aaucuguuaccagaggacaaa

SEQ ID NO: 1016622 - RNA, 15 nt, Homo sapiens
aaucuuaagaacuuu

SEQ ID NO: 1016623 - RNA, 17 nt, Homo sapiens
aaucuucagaccuagaa

SEQ ID NO: 1016624 - RNA, 20 nt, Homo sapiens
aaucuuuggguaacuucaaa

SEQ ID NO: 1016625 - RNA, 20 nt, Homo sapiens
aaucuuuguuacucuguaaa

SEQ ID NO: 1016626 - RNA, 14 nt, Homo sapiens
aaucuuuucacaaa

SEQ ID NO: 1016627 - RNA, 24 nt, Homo sapiens
aaugaaagcauguggcauguucau

SEQ ID NO: 1016628 - RNA, 17 nt, Homo sapiens
aaugaagaucauauacg

SEQ ID NO: 1016629 - RNA, 14 nt, Homo sapiens
aaugaagaugaugc

SEQ ID NO: 1016630 - RNA, 18 nt, Homo sapiens
aaugaauaacagccucau

SEQ ID NO: 1016631 - RNA, 12 nt, Homo sapiens
aaugaauauuua

SEQ ID NO: 1016632 - RNA, 15 nt, Homo sapiens
aaugaaucuucacaa

SEQ ID NO: 1016633 - RNA, 15 nt, Homo sapiens
aaugaauggacucaa

SEQ ID NO: 1016634 - RNA, 13 nt, Homo sapiens
aaugaauggcuaa

SEQ ID NO: 1016635 - RNA, 15 nt, Homo sapiens
aaugaauuauguuau

SEQ ID NO: 1016636 - RNA, 23 nt, Homo sapiens
aaugaauucugggaauccacagc

SEQ ID NO: 1016637 - RNA, 22 nt, Homo sapiens
aaugacacuagcuaauaucaau

SEQ ID NO: 1016638 - RNA, 14 nt, Homo sapiens
aaugacaucuucaa

SEQ ID NO: 1016639 - RNA, 16 nt, Homo sapiens
aaugacccaaagacca

SEQ ID NO: 1016640 - RNA, 19 nt, Homo sapiens
aaugacuaaaaaacaaaga

SEQ ID NO: 1016641 - RNA, 13 nt, Homo sapiens
aaugacuaaagac

SEQ ID NO: 1016642 - RNA, 16 nt, Homo sapiens
aaugacuuuauugcau

SEQ ID NO: 1016643 - RNA, 20 nt, Homo sapiens
aaugagacauaggccaugaa

SEQ ID NO: 1016644 - RNA, 16 nt, Homo sapiens
aaugagacuugcucuc

SEQ ID NO: 1016645 - RNA, 16 nt, Homo sapiens
aaugaucgggauauaa

SEQ ID NO: 1016646 - RNA, 18 nt, Homo sapiens
aaugauuuacucaauauc

SEQ ID NO: 1016647 - RNA, 14 nt, Homo sapiens
aaugcaaaguacau

SEQ ID NO: 1016648 - RNA, 18 nt, Homo sapiens
aaugcaaaguacauguau

SEQ ID NO: 1016649 - RNA, 22 nt, Homo sapiens
aaugcacugacauuguuggcca

SEQ ID NO: 1016650 - RNA, 14 nt, Homo sapiens
aaugcacuuccuua

SEQ ID NO: 1016651 - RNA, 16 nt, Homo sapiens
aaugcagagucaauga

SEQ ID NO: 1016652 - RNA, 19 nt, Homo sapiens
aaugcagggacaaaugcca

SEQ ID NO: 1016653 - RNA, 20 nt, Homo sapiens
aaugcauauccaacaugugc

SEQ ID NO: 1016654 - RNA, 14 nt, Homo sapiens
aaugcauggugcag

SEQ ID NO: 1016655 - RNA, 14 nt, Homo sapiens
aaugccaagacaug

SEQ ID NO: 1016656 - RNA, 20 nt, Homo sapiens
aaugccaaucuucaguauuu

SEQ ID NO: 1016657 - RNA, 22 nt, Homo sapiens
aaugccagagacggaagccuuu

SEQ ID NO: 1016658 - RNA, 21 nt, Homo sapiens
aaugccauccucaaacacugc

SEQ ID NO: 1016659 - RNA, 13 nt, Homo sapiens
aaugcuacugucu

SEQ ID NO: 1016660 - RNA, 23 nt, Homo sapiens
aaugcucaagaaacaacuucuac

SEQ ID NO: 1016661 - RNA, 19 nt, Homo sapiens
aaugcugcccgcucugcag

SEQ ID NO: 1016662 - RNA, 18 nt, Homo sapiens
aaugcuggagcaggcugu

SEQ ID NO: 1016663 - RNA, 17 nt, Homo sapiens
aaugcuggcauuugcac

SEQ ID NO: 1016664 - RNA, 18 nt, Homo sapiens
aaugcugugguugauauu

SEQ ID NO: 1016665 - RNA, 17 nt, Homo sapiens
aaugcuucugacuucau

SEQ ID NO: 1016666 - RNA, 14 nt, Homo sapiens
aaugcuucuucuca

SEQ ID NO: 1016667 - RNA, 14 nt, Homo sapiens
aaugcuucuuucau

SEQ ID NO: 1016668 - RNA, 19 nt, Homo sapiens
aaugcuuuuugaauguuau

SEQ ID NO: 1016669 - RNA, 17 nt, Homo sapiens
aauggaaaaaaugaugu

SEQ ID NO: 1016670 - RNA, 15 nt, Homo sapiens
aauggaauacugaaa

SEQ ID NO: 1016671 - RNA, 17 nt, Homo sapiens
aauggacaaacugccag

SEQ ID NO: 1016672 - RNA, 13 nt, Homo sapiens
aauggacuuucag

SEQ ID NO: 1016673 - RNA, 21 nt, Homo sapiens
aauggagaagaaaggccauca

SEQ ID NO: 1016674 - RNA, 20 nt, Homo sapiens
aauggagggaauaauaccua

SEQ ID NO: 1016675 - RNA, 23 nt, Homo sapiens
aauggcauaggcugacuuuugca

SEQ ID NO: 1016676 - RNA, 20 nt, Homo sapiens
aauggcucaugaccuggaaa

SEQ ID NO: 1016677 - RNA, 20 nt, Homo sapiens
aaugggagagcucuuguuau

SEQ ID NO: 1016678 - RNA, 15 nt, Homo sapiens
aauggggaucacaga

SEQ ID NO: 1016679 - RNA, 15 nt, Homo sapiens
aauggggugcaugaa

SEQ ID NO: 1016680 - RNA, 18 nt, Homo sapiens
aaugguguuguaugccuu

SEQ ID NO: 1016681 - RNA, 15 nt, Homo sapiens
aaugguuccauucuc

SEQ ID NO: 1016682 - RNA, 14 nt, Homo sapiens
aauguaaaaauugg

SEQ ID NO: 1016683 - RNA, 18 nt, Homo sapiens
aauguaaaauguugaaua

SEQ ID NO: 1016684 - RNA, 14 nt, Homo sapiens
aauguaagcuguuu

SEQ ID NO: 1016685 - RNA, 15 nt, Homo sapiens
aauguauauacccac

SEQ ID NO: 1016686 - RNA, 13 nt, Homo sapiens
aauguaugugcac

SEQ ID NO: 1016687 - RNA, 23 nt, Homo sapiens
aauguaugugcacugucacuuug

SEQ ID NO: 1016688 - RNA, 18 nt, Homo sapiens
aauguauucuuaaauuca

SEQ ID NO: 1016689 - RNA, 13 nt, Homo sapiens
aauguauugaacu

SEQ ID NO: 1016690 - RNA, 17 nt, Homo sapiens
aauguauuuguuugcaa

SEQ ID NO: 1016691 - RNA, 21 nt, Homo sapiens
aauguauuuguuugcaauuuu

SEQ ID NO: 1016692 - RNA, 14 nt, Homo sapiens
aaugucacuuaaag

SEQ ID NO: 1016693 - RNA, 19 nt, Homo sapiens
aaugucagaaaccaguuau

SEQ ID NO: 1016694 - RNA, 19 nt, Homo sapiens
aaugucaucagaacuuuuu

SEQ ID NO: 1016695 - RNA, 23 nt, Homo sapiens
aauguccuucuuuaucugugaua

SEQ ID NO: 1016696 - RNA, 14 nt, Homo sapiens
aaugucugccacac

SEQ ID NO: 1016697 - RNA, 16 nt, Homo sapiens
aaugucuggucugucc

SEQ ID NO: 1016698 - RNA, 17 nt, Homo sapiens
aaugucuggucugucca

SEQ ID NO: 1016699 - RNA, 18 nt, Homo sapiens
aaugucuucuguauucac

SEQ ID NO: 1016700 - RNA, 21 nt, Homo sapiens
aaugucuucuguauucacuua

SEQ ID NO: 1016701 - RNA, 12 nt, Homo sapiens
aaugugaacuua

SEQ ID NO: 1016702 - RNA, 18 nt, Homo sapiens
acaaguuuuaauccagaa

SEQ ID NO: 1016703 - RNA, 20 nt, Homo sapiens
acaauaaaggcugagcucuu

SEQ ID NO: 1016704 - RNA, 16 nt, Homo sapiens
acaauaaggucaaugc

SEQ ID NO: 1016705 - RNA, 17 nt, Homo sapiens
auacauuugaggggaaa

SEQ ID NO: 1016706 - RNA, 13 nt, Homo sapiens
auaccaagcuugu

SEQ ID NO: 1016707 - RNA, 14 nt, Homo sapiens
auaccaauauuuac

SEQ ID NO: 1016708 - RNA, 13 nt, Homo sapiens
auaccacugcacc

SEQ ID NO: 1016709 - RNA, 17 nt, Homo sapiens
auacccugaauuuggcc

SEQ ID NO: 1016710 - RNA, 14 nt, Homo sapiens
auaccugcccugac

SEQ ID NO: 1016711 - RNA, 22 nt, Homo sapiens
auaccugcucuuguucuacuga

SEQ ID NO: 1016712 - RNA, 20 nt, Homo sapiens
auaccuggcccugugccuug

SEQ ID NO: 1016713 - RNA, 13 nt, Homo sapiens
auacggcacugaa

SEQ ID NO: 1016714 - RNA, 15 nt, Homo sapiens
auacguguagcuaua

SEQ ID NO: 1016715 - RNA, 14 nt, Homo sapiens
auacuaaacaucau

SEQ ID NO: 1016716 - RNA, 17 nt, Homo sapiens
auacuaaacaucauuga

SEQ ID NO: 1016717 - RNA, 20 nt, Homo sapiens
auacuauauuuauacuguau

SEQ ID NO: 1016718 - RNA, 21 nt, Homo sapiens
auacuauauuuauacuguaua

SEQ ID NO: 1016719 - RNA, 17 nt, Homo sapiens
auacuauuuucauucuc

SEQ ID NO: 1016720 - RNA, 14 nt, Homo sapiens
auacucuucaagga

SEQ ID NO: 1016721 - RNA, 19 nt, Homo sapiens
auacugcaauuaaagugau

SEQ ID NO: 1016722 - RNA, 20 nt, Homo sapiens
auacugcaauuaaagugaua

SEQ ID NO: 1016723 - RNA, 21 nt, Homo sapiens
auacugcucaucauuccuuga

SEQ ID NO: 1016724 - RNA, 14 nt, Homo sapiens
auacuuaggaagga

SEQ ID NO: 1016725 - RNA, 9 nt, Homo sapiens
auacuuguc

SEQ ID NO: 1016726 - RNA, 13 nt, Homo sapiens
auacuuucaggca

SEQ ID NO: 1016727 - RNA, 15 nt, Homo sapiens
auagaaacuugcuua

SEQ ID NO: 1016728 - RNA, 19 nt, Homo sapiens
auagaagaugaaucauuga

SEQ ID NO: 1016729 - RNA, 18 nt, Homo sapiens
auagaagcaaaugacaaa

SEQ ID NO: 1016730 - RNA, 15 nt, Homo sapiens
auagaaguagcaaaa

SEQ ID NO: 1016731 - RNA, 15 nt, Homo sapiens
auagacccgaggaaa

SEQ ID NO: 1016732 - RNA, 23 nt, Homo sapiens
auagaccucucaauuucuggaaa

SEQ ID NO: 1016733 - RNA, 15 nt, Homo sapiens
auagaguauaugcac

SEQ ID NO: 1016734 - RNA, 15 nt, Homo sapiens
auagauauguagaua

SEQ ID NO: 1016735 - RNA, 17 nt, Homo sapiens
auagcaaggugcucaca

SEQ ID NO: 1016736 - RNA, 12 nt, Homo sapiens
auagcaagugaa

SEQ ID NO: 1016737 - RNA, 18 nt, Homo sapiens
auagcaccuccacauacc

SEQ ID NO: 1016738 - RNA, 22 nt, Homo sapiens
auagcacguggagcucuuggcu

SEQ ID NO: 1016739 - RNA, 17 nt, Homo sapiens
auagcagcuuauucaca

SEQ ID NO: 1016740 - RNA, 21 nt, Homo sapiens
auagcagcuuauucacaagac

SEQ ID NO: 1016741 - RNA, 15 nt, Homo sapiens
auagcauguaauggu

SEQ ID NO: 1016742 - RNA, 16 nt, Homo sapiens
auagcauuuguuuaag

SEQ ID NO: 1016743 - RNA, 12 nt, Homo sapiens
auagccacuuac

SEQ ID NO: 1016744 - RNA, 21 nt, Homo sapiens
auagccuaauacaacauguag

SEQ ID NO: 1016745 - RNA, 18 nt, Homo sapiens
auagcuauauccauguac

SEQ ID NO: 1016746 - RNA, 21 nt, Homo sapiens
auagcuccuucucucuuacau

SEQ ID NO: 1016747 - RNA, 15 nt, Homo sapiens
auaggagaggaugag

SEQ ID NO: 1016748 - RNA, 18 nt, Homo sapiens
auaggaggccaacccaaa

SEQ ID NO: 1016749 - RNA, 14 nt, Homo sapiens
auaggcaagaagca

SEQ ID NO: 1016750 - RNA, 15 nt, Homo sapiens
auaggcaugagccac

SEQ ID NO: 1016751 - RNA, 19 nt, Homo sapiens
auaggcauuugauuuugcc

SEQ ID NO: 1016752 - RNA, 22 nt, Homo sapiens
auaggcugacuuuugcagaugg

SEQ ID NO: 1016753 - RNA, 19 nt, Homo sapiens
auagggagcagaugcaaug

SEQ ID NO: 1016754 - RNA, 17 nt, Homo sapiens
auagguauauauaugcc

SEQ ID NO: 1016755 - RNA, 13 nt, Homo sapiens
auaguacuggcau

SEQ ID NO: 1016756 - RNA, 22 nt, Homo sapiens
auagucaaaccauaaacuucau

SEQ ID NO: 1016757 - RNA, 15 nt, Homo sapiens
auagucacauggccu

SEQ ID NO: 1016758 - RNA, 23 nt, Homo sapiens
auagucacauggccuaugcacau

SEQ ID NO: 1016759 - RNA, 13 nt, Homo sapiens
auaguccaaagac

SEQ ID NO: 1016760 - RNA, 13 nt, Homo sapiens
auagucuguccaa

SEQ ID NO: 1016761 - RNA, 17 nt, Homo sapiens
auagugacuaugaacuu

SEQ ID NO: 1016762 - RNA, 21 nt, Homo sapiens
auaguuugcuguugcauugua

SEQ ID NO: 1016763 - RNA, 14 nt, Homo sapiens
auauaaaaggcaaa

SEQ ID NO: 1016764 - RNA, 18 nt, Homo sapiens
auauaaacaugcuugcau

SEQ ID NO: 1016765 - RNA, 13 nt, Homo sapiens
auauaaaugccaa

SEQ ID NO: 1016766 - RNA, 18 nt, Homo sapiens
auauaaggaaagcaauaa

SEQ ID NO: 1016767 - RNA, 18 nt, Homo sapiens
auauaaguuugaaggaaa

SEQ ID NO: 1016768 - RNA, 14 nt, Homo sapiens
auauaauaugcaca

SEQ ID NO: 1016769 - RNA, 20 nt, Homo sapiens
auauaauaugcacacagugc

SEQ ID NO: 1016770 - RNA, 24 nt, Homo sapiens
auauaauucuguacauagccuaua

SEQ ID NO: 1016771 - RNA, 12 nt, Homo sapiens
auauacaaauag

SEQ ID NO: 1016772 - RNA, 20 nt, Homo sapiens
auauacuauuuucauucucu

SEQ ID NO: 1016773 - RNA, 16 nt, Homo sapiens
auauacucuucaagga

SEQ ID NO: 1016774 - RNA, 11 nt, Homo sapiens
auauacuuugg

SEQ ID NO: 1016775 - RNA, 17 nt, Homo sapiens
auauaguaugaaugcag

SEQ ID NO: 1016776 - RNA, 16 nt, Homo sapiens
auauagugacuaugaa

SEQ ID NO: 1016777 - RNA, 13 nt, Homo sapiens
auauaguuuacua

SEQ ID NO: 1016778 - RNA, 13 nt, Homo sapiens
auauauaauacug

SEQ ID NO: 1016779 - RNA, 14 nt, Homo sapiens
auauauaccacuuu

SEQ ID NO: 1016780 - RNA, 15 nt, Homo sapiens
auauauauaauuuaa

SEQ ID NO: 1016781 - RNA, 20 nt, Homo sapiens
auauauauuuuugugcacau

SEQ ID NO: 1016782 - RNA, 12 nt, Homo sapiens
auauauucccaa

SEQ ID NO: 1016783 - RNA, 16 nt, Homo sapiens
auauauuuauaacuca

SEQ ID NO: 1016784 - RNA, 22 nt, Homo sapiens
auauauuuauuuaagcuuaugu

SEQ ID NO: 1016785 - RNA, 17 nt, Homo sapiens
auauauuucagauauca

SEQ ID NO: 1016786 - RNA, 20 nt, Homo sapiens
auauauuuuugugcacauuu

SEQ ID NO: 1016787 - RNA, 20 nt, Homo sapiens
auaucaguuugcuagcagaa

SEQ ID NO: 1016788 - RNA, 15 nt, Homo sapiens
auaucaucagcauac

SEQ ID NO: 1016789 - RNA, 18 nt, Homo sapiens
auaucaucagcauaccuu

SEQ ID NO: 1016790 - RNA, 21 nt, Homo sapiens
auaucaucagcauaccuuuau

SEQ ID NO: 1016791 - RNA, 17 nt, Homo sapiens
auauccaacaugugcuc

SEQ ID NO: 1016792 - RNA, 18 nt, Homo sapiens
auauccccucccagucac

SEQ ID NO: 1016793 - RNA, 14 nt, Homo sapiens
auaucgaucucuua

SEQ ID NO: 1016794 - RNA, 17 nt, Homo sapiens
auaugaagaacugagga

SEQ ID NO: 1016795 - RNA, 13 nt, Homo sapiens
auaugaagacaua

SEQ ID NO: 1016796 - RNA, 16 nt, Homo sapiens
auaugauuaguaaaga

SEQ ID NO: 1016797 - RNA, 14 nt, Homo sapiens
auaugauugugcac

SEQ ID NO: 1016798 - RNA, 20 nt, Homo sapiens
auaugauuuaaaacauguaa

SEQ ID NO: 1016799 - RNA, 19 nt, Homo sapiens
auaugcacuuauucucaag

SEQ ID NO: 1016800 - RNA, 14 nt, Homo sapiens
acaauaaucucacu

SEQ ID NO: 1016801 - RNA, 17 nt, Homo sapiens
acaauacaugcugcuaa

SEQ ID NO: 1016802 - RNA, 23 nt, Homo sapiens
acaauaguaauucucaggccauc

SEQ ID NO: 1016803 - RNA, 14 nt, Homo sapiens
acaauaugcaaugu

SEQ ID NO: 1016804 - RNA, 15 nt, Homo sapiens
acaaucaaagcacuu

SEQ ID NO: 1016805 - RNA, 14 nt, Homo sapiens
acaaucagcuccuu

SEQ ID NO: 1016806 - RNA, 15 nt, Homo sapiens
acaaucuguauauaa

SEQ ID NO: 1016807 - RNA, 16 nt, Homo sapiens
acaaugacuaaagaca

SEQ ID NO: 1016808 - RNA, 13 nt, Homo sapiens
acaaugauacagu

SEQ ID NO: 1016809 - RNA, 20 nt, Homo sapiens
acaaugauacaguugcaugu

SEQ ID NO: 1016810 - RNA, 11 nt, Homo sapiens
acaaugcauuc

SEQ ID NO: 1016811 - RNA, 18 nt, Homo sapiens
acaauuauaucaguccuc

SEQ ID NO: 1016812 - RNA, 22 nt, Homo sapiens
acaauucucucuuauaugugua

SEQ ID NO: 1016813 - RNA, 14 nt, Homo sapiens
acaauugugaaguc

SEQ ID NO: 1016814 - RNA, 13 nt, Homo sapiens
acaauuuaccagc

SEQ ID NO: 1016815 - RNA, 21 nt, Homo sapiens
acaauuugagauguauuucaa

SEQ ID NO: 1016816 - RNA, 20 nt, Homo sapiens
acacaaacgggcucagcaaa

SEQ ID NO: 1016817 - RNA, 15 nt, Homo sapiens
acacaaauuugccug

SEQ ID NO: 1016818 - RNA, 13 nt, Homo sapiens
acacaacaacucc

SEQ ID NO: 1016819 - RNA, 19 nt, Homo sapiens
acacaagccacagaagcca

SEQ ID NO: 1016820 - RNA, 18 nt, Homo sapiens
acacaaggugcaaaucaa

SEQ ID NO: 1016821 - RNA, 11 nt, Homo sapiens
acacacacaga

SEQ ID NO: 1016822 - RNA, 15 nt, Homo sapiens
acacacauaugucau

SEQ ID NO: 1016823 - RNA, 18 nt, Homo sapiens
acacacugaggcagggaa

SEQ ID NO: 1016824 - RNA, 22 nt, Homo sapiens
acacagcccuggccucugcuca

SEQ ID NO: 1016825 - RNA, 20 nt, Homo sapiens
acacagcgagacuccgucuc

SEQ ID NO: 1016826 - RNA, 20 nt, Homo sapiens
acacagcucuucuccaggcu

SEQ ID NO: 1016827 - RNA, 21 nt, Homo sapiens
acacaggcccggcuccaggcu

SEQ ID NO: 1016828 - RNA, 19 nt, Homo sapiens
acacaguauuaagugacag

SEQ ID NO: 1016829 - RNA, 16 nt, Homo sapiens
acacagucugcaagau

SEQ ID NO: 1016830 - RNA, 19 nt, Homo sapiens
acacagucuuggcucacug

SEQ ID NO: 1016831 - RNA, 13 nt, Homo sapiens
acacauaugcacc

SEQ ID NO: 1016832 - RNA, 17 nt, Homo sapiens
acacaucaggaguucaa

SEQ ID NO: 1016833 - RNA, 15 nt, Homo sapiens
acacaugagaucuag

SEQ ID NO: 1016834 - RNA, 20 nt, Homo sapiens
acacauucuuaacacauguc

SEQ ID NO: 1016835 - RNA, 21 nt, Homo sapiens
acacauucuuaacacaugucc

SEQ ID NO: 1016836 - RNA, 13 nt, Homo sapiens
acaccacacauac

SEQ ID NO: 1016837 - RNA, 23 nt, Homo sapiens
acaccagccauacuuaucucucu

SEQ ID NO: 1016838 - RNA, 20 nt, Homo sapiens
acaccaggcugugggccuca

SEQ ID NO: 1016839 - RNA, 16 nt, Homo sapiens
acaccagguagaacac

SEQ ID NO: 1016840 - RNA, 17 nt, Homo sapiens
acaccaugauuaaccac

SEQ ID NO: 1016841 - RNA, 13 nt, Homo sapiens
acacccacagugg

SEQ ID NO: 1016842 - RNA, 19 nt, Homo sapiens
acacccagucuguucccca

SEQ ID NO: 1016843 - RNA, 22 nt, Homo sapiens
acacccccaccccuugcucuca

SEQ ID NO: 1016844 - RNA, 16 nt, Homo sapiens
acacccgacuccucaa

SEQ ID NO: 1016845 - RNA, 17 nt, Homo sapiens
acaccgagacaccaccu

SEQ ID NO: 1016846 - RNA, 19 nt, Homo sapiens
acaccguccuccacgccau

SEQ ID NO: 1016847 - RNA, 19 nt, Homo sapiens
acaccguguaaaccaaagc

SEQ ID NO: 1016848 - RNA, 16 nt, Homo sapiens
acaccucaguucccuu

SEQ ID NO: 1016849 - RNA, 23 nt, Homo sapiens
acaccucaguucccuuggccuca

SEQ ID NO: 1016850 - RNA, 13 nt, Homo sapiens
acaccucccugaa

SEQ ID NO: 1016851 - RNA, 20 nt, Homo sapiens
acaccucuccuuugugacuu

SEQ ID NO: 1016852 - RNA, 21 nt, Homo sapiens
acaccuguaaucccagcacuu

SEQ ID NO: 1016853 - RNA, 20 nt, Homo sapiens
acacgagcaggcuacuguca

SEQ ID NO: 1016854 - RNA, 21 nt, Homo sapiens
acacggaugacuuaacugcau

SEQ ID NO: 1016855 - RNA, 14 nt, Homo sapiens
acacuaacauauaa

SEQ ID NO: 1016856 - RNA, 15 nt, Homo sapiens
acacuaacauauaau

SEQ ID NO: 1016857 - RNA, 23 nt, Homo sapiens
acacuaacgauuuguuaaugaua

SEQ ID NO: 1016858 - RNA, 22 nt, Homo sapiens
acacuaagcgaauguguacaaa

SEQ ID NO: 1016859 - RNA, 17 nt, Homo sapiens
acacuaauacaccaggu

SEQ ID NO: 1016860 - RNA, 20 nt, Homo sapiens
acacuaugaagauguuucaa

SEQ ID NO: 1016861 - RNA, 16 nt, Homo sapiens
acacucaaaagcuggg

SEQ ID NO: 1016862 - RNA, 20 nt, Homo sapiens
acacucacuccacaacccaa

SEQ ID NO: 1016863 - RNA, 13 nt, Homo sapiens
acacucacugcgg

SEQ ID NO: 1016864 - RNA, 19 nt, Homo sapiens
acacucauccccucacuug

SEQ ID NO: 1016865 - RNA, 12 nt, Homo sapiens
acacucaugcug

SEQ ID NO: 1016866 - RNA, 21 nt, Homo sapiens
acacuccagugccagcaauga

SEQ ID NO: 1016867 - RNA, 15 nt, Homo sapiens
acacucuccaaacag

SEQ ID NO: 1016868 - RNA, 14 nt, Homo sapiens
acacugaagcucuu

SEQ ID NO: 1016869 - RNA, 16 nt, Homo sapiens
acacugaccuguguuc

SEQ ID NO: 1016870 - RNA, 19 nt, Homo sapiens
acacugcauguuugugauu

SEQ ID NO: 1016871 - RNA, 18 nt, Homo sapiens
acacugcugcuccagugc

SEQ ID NO: 1016872 - RNA, 22 nt, Homo sapiens
acacugcugcuccagugcagga

SEQ ID NO: 1016873 - RNA, 21 nt, Homo sapiens
acacuggaggagagaagaaug

SEQ ID NO: 1016874 - RNA, 21 nt, Homo sapiens
acacugggacuugcaaaaagg

SEQ ID NO: 1016875 - RNA, 21 nt, Homo sapiens
acacugggcuucuagaaccag

SEQ ID NO: 1016876 - RNA, 22 nt, Homo sapiens
acacugggugcccaagcucaga

SEQ ID NO: 1016877 - RNA, 21 nt, Homo sapiens
acacugguuugagcuuaguga

SEQ ID NO: 1016878 - RNA, 22 nt, Homo sapiens
acacuguaccgacuuugauaga

SEQ ID NO: 1016879 - RNA, 15 nt, Homo sapiens
acacugucuugaaga

SEQ ID NO: 1016880 - RNA, 18 nt, Homo sapiens
acacuguugucaaaaagu

SEQ ID NO: 1016881 - RNA, 14 nt, Homo sapiens
acacuuaacagaug

SEQ ID NO: 1016882 - RNA, 16 nt, Homo sapiens
acacuuaugggccaag

SEQ ID NO: 1016883 - RNA, 20 nt, Homo sapiens
acacuuggaacacaaugacu

SEQ ID NO: 1016884 - RNA, 14 nt, Homo sapiens
acacuuggaugcag

SEQ ID NO: 1016885 - RNA, 16 nt, Homo sapiens
acacuuggaugcaggg

SEQ ID NO: 1016886 - RNA, 17 nt, Homo sapiens
acagaaaaaaucgucuc

SEQ ID NO: 1016887 - RNA, 16 nt, Homo sapiens
acagaaauacaugaaa

SEQ ID NO: 1016888 - RNA, 21 nt, Homo sapiens
acagaaaugagaucaggcucu

SEQ ID NO: 1016889 - RNA, 14 nt, Homo sapiens
acagaacacugucu

SEQ ID NO: 1016890 - RNA, 21 nt, Homo sapiens
acagaacacugucuugaagac

SEQ ID NO: 1016891 - RNA, 21 nt, Homo sapiens
acagaaccuuguuauuucuca

SEQ ID NO: 1016892 - RNA, 13 nt, Homo sapiens
acagaacuaugga

SEQ ID NO: 1016893 - RNA, 23 nt, Homo sapiens
acagaagagugacauguuuacaa

SEQ ID NO: 1016894 - RNA, 13 nt, Homo sapiens
acagaagcaggcu

SEQ ID NO: 1016895 - RNA, 18 nt, Homo sapiens
acagaagccucacugcaa

SEQ ID NO: 1016896 - RNA, 16 nt, Homo sapiens
acagaaggaugaauga

SEQ ID NO: 1016897 - RNA, 17 nt, Homo sapiens
acagaaguccauggagu

SEQ ID NO: 1016898 - RNA, 20 nt, Homo sapiens
acagaauuuuaaagagcaua

SEQ ID NO: 1016899 - RNA, 13 nt, Homo sapiens
acagacaccagca

SEQ ID NO: 1016900 - RNA, 23 nt, Homo sapiens
acagacaccaucuuuugugagau

SEQ ID NO: 1016901 - RNA, 18 nt, Homo sapiens
acagaccacaucuuuauc

SEQ ID NO: 1016902 - RNA, 16 nt, Homo sapiens
acagacuggaagcaca

SEQ ID NO: 1016903 - RNA, 17 nt, Homo sapiens
acagagaaaagacauaa

SEQ ID NO: 1016904 - RNA, 18 nt, Homo sapiens
acagagagucccacugcc

SEQ ID NO: 1016905 - RNA, 20 nt, Homo sapiens
acagagcgagagucugucuc

SEQ ID NO: 1016906 - RNA, 22 nt, Homo sapiens
acagagcucuccagcuccaaga

SEQ ID NO: 1016907 - RNA, 23 nt, Homo sapiens
acagagcugccucucgguggcca

SEQ ID NO: 1016908 - RNA, 16 nt, Homo sapiens
acagagcuucccugac

SEQ ID NO: 1016909 - RNA, 18 nt, Homo sapiens
acagagcuucccugacuc

SEQ ID NO: 1016910 - RNA, 22 nt, Homo sapiens
acagagggaaacacagcagcuu

SEQ ID NO: 1016911 - RNA, 20 nt, Homo sapiens
acagagucuggcucugucac

SEQ ID NO: 1016912 - RNA, 13 nt, Homo sapiens
acagagugcauug

SEQ ID NO: 1016913 - RNA, 14 nt, Homo sapiens
acagauacuccucc

SEQ ID NO: 1016914 - RNA, 14 nt, Homo sapiens
acagauagucaaac

SEQ ID NO: 1016915 - RNA, 18 nt, Homo sapiens
acagaucaagcugugaga

SEQ ID NO: 1016916 - RNA, 12 nt, Homo sapiens
acagaucuccug

SEQ ID NO: 1016917 - RNA, 19 nt, Homo sapiens
acagaugcuuuucugucuc

SEQ ID NO: 1016918 - RNA, 21 nt, Homo sapiens
acagaugcuuuucugucucug

SEQ ID NO: 1016919 - RNA, 20 nt, Homo sapiens
acagauggcaggaugggcac

SEQ ID NO: 1016920 - RNA, 13 nt, Homo sapiens
acagaugugucag

SEQ ID NO: 1016921 - RNA, 22 nt, Homo sapiens
acagaugugugauucacagugu

SEQ ID NO: 1016922 - RNA, 22 nt, Homo sapiens
acagauuccaggcgaugugcaa

SEQ ID NO: 1016923 - RNA, 19 nt, Homo sapiens
acagcaaaacuccaucuca

SEQ ID NO: 1016924 - RNA, 16 nt, Homo sapiens
acagcacccucuccag

SEQ ID NO: 1016925 - RNA, 19 nt, Homo sapiens
acagcacccucuccagaug

SEQ ID NO: 1016926 - RNA, 20 nt, Homo sapiens
acagcacuggcucucuccag

SEQ ID NO: 1016927 - RNA, 17 nt, Homo sapiens
acagcagccccugcaca

SEQ ID NO: 1016928 - RNA, 18 nt, Homo sapiens
acagcagcucaggcacac

SEQ ID NO: 1016929 - RNA, 15 nt, Homo sapiens
acagcaggcuuucaa

SEQ ID NO: 1016930 - RNA, 22 nt, Homo sapiens
acagcauggagucacagccacu

SEQ ID NO: 1016931 - RNA, 20 nt, Homo sapiens
acagccgcuccugucugcca

SEQ ID NO: 1016932 - RNA, 15 nt, Homo sapiens
acagcuacacagauc

SEQ ID NO: 1016933 - RNA, 23 nt, Homo sapiens
acagcucaguucuagucucucug

SEQ ID NO: 1016934 - RNA, 11 nt, Homo sapiens
acagcucugca

SEQ ID NO: 1016935 - RNA, 14 nt, Homo sapiens
acagcucuucucca

SEQ ID NO: 1016936 - RNA, 15 nt, Homo sapiens
acagcuuaaucaaaa

SEQ ID NO: 1016937 - RNA, 20 nt, Homo sapiens
acagcuuccccucucuccuc

SEQ ID NO: 1016938 - RNA, 14 nt, Homo sapiens
acugcagucagcau

SEQ ID NO: 1016939 - RNA, 21 nt, Homo sapiens
acugccaucaagaugagagaa

SEQ ID NO: 1016940 - RNA, 16 nt, Homo sapiens
acugcccaauaugcag

SEQ ID NO: 1016941 - RNA, 23 nt, Homo sapiens
acugcccgagcuggugcauuaca

SEQ ID NO: 1016942 - RNA, 14 nt, Homo sapiens
acugccuaagcccu

SEQ ID NO: 1016943 - RNA, 18 nt, Homo sapiens
acugccuuccacaauuca

SEQ ID NO: 1016944 - RNA, 14 nt, Homo sapiens
acugcgacugugac

SEQ ID NO: 1016945 - RNA, 18 nt, Homo sapiens
acugcgaucuucagagca

SEQ ID NO: 1016946 - RNA, 20 nt, Homo sapiens
acugcuaggcgagugccagg

SEQ ID NO: 1016947 - RNA, 19 nt, Homo sapiens
acugcugcccagccuccaa

SEQ ID NO: 1016948 - RNA, 15 nt, Homo sapiens
acugcuuuuggucug

SEQ ID NO: 1016949 - RNA, 18 nt, Homo sapiens
acuggaacucagugugac

SEQ ID NO: 1016950 - RNA, 15 nt, Homo sapiens
acuggagcaucugac

SEQ ID NO: 1016951 - RNA, 19 nt, Homo sapiens
acuggagcaucugacucac

SEQ ID NO: 1016952 - RNA, 21 nt, Homo sapiens
acuggagcaucugacucacaa

SEQ ID NO: 1016953 - RNA, 17 nt, Homo sapiens
acuggaguccagucucu

SEQ ID NO: 1016954 - RNA, 15 nt, Homo sapiens
acuggaugaggucau

SEQ ID NO: 1016955 - RNA, 12 nt, Homo sapiens
acuggaugcaug

SEQ ID NO: 1016956 - RNA, 23 nt, Homo sapiens
acuggaugcauguuuuccagcuc

SEQ ID NO: 1016957 - RNA, 13 nt, Homo sapiens
acuggccaucucc

SEQ ID NO: 1016958 - RNA, 12 nt, Homo sapiens
acuggccuccag

SEQ ID NO: 1016959 - RNA, 22 nt, Homo sapiens
acugguauguguggaugaugcu

SEQ ID NO: 1016960 - RNA, 17 nt, Homo sapiens
acuguaacugacugccu

SEQ ID NO: 1016961 - RNA, 19 nt, Homo sapiens
acuguaaugaaucuaagca

SEQ ID NO: 1016962 - RNA, 15 nt, Homo sapiens
acuguagucucagga

SEQ ID NO: 1016963 - RNA, 19 nt, Homo sapiens
acuguauauauaauacuga

SEQ ID NO: 1016964 - RNA, 18 nt, Homo sapiens
acuguaugugggaauuua

SEQ ID NO: 1016965 - RNA, 16 nt, Homo sapiens
acuguauuaagaguga

SEQ ID NO: 1016966 - RNA, 24 nt, Homo sapiens
acuguccagagagcaacucugaga

SEQ ID NO: 1016967 - RNA, 21 nt, Homo sapiens
acugucccucaaaugacccaa

SEQ ID NO: 1016968 - RNA, 16 nt, Homo sapiens
acuguccuacccaccc

SEQ ID NO: 1016969 - RNA, 19 nt, Homo sapiens
acugugcuaauaacagugc

SEQ ID NO: 1016970 - RNA, 21 nt, Homo sapiens
acugugcuaauaacagugcau

SEQ ID NO: 1016971 - RNA, 20 nt, Homo sapiens
acugugcuccucacuuccuc

SEQ ID NO: 1016972 - RNA, 15 nt, Homo sapiens
acuguggcuucuuaa

SEQ ID NO: 1016973 - RNA, 13 nt, Homo sapiens
acuguguuggcca

SEQ ID NO: 1016974 - RNA, 13 nt, Homo sapiens
agaaauacauauu

SEQ ID NO: 1016975 - RNA, 19 nt, Homo sapiens
agaaauacccacuaacaaa

SEQ ID NO: 1016976 - RNA, 17 nt, Homo sapiens
agaaauagacaguauau

SEQ ID NO: 1016977 - RNA, 13 nt, Homo sapiens
agaaaucuagaag

SEQ ID NO: 1016978 - RNA, 12 nt, Homo sapiens
agaaaucugcca

SEQ ID NO: 1016979 - RNA, 14 nt, Homo sapiens
agaaaugacuuuga

SEQ ID NO: 1016980 - RNA, 18 nt, Homo sapiens
agaaaugcaaccaacugc

SEQ ID NO: 1016981 - RNA, 19 nt, Homo sapiens
agaaauguuguucauuauu

SEQ ID NO: 1016982 - RNA, 14 nt, Homo sapiens
agaaauuagcugug

SEQ ID NO: 1016983 - RNA, 22 nt, Homo sapiens
agaaauuccaggaaaaucugca

SEQ ID NO: 1016984 - RNA, 19 nt, Homo sapiens
agaaauuccuguagcaucu

SEQ ID NO: 1016985 - RNA, 19 nt, Homo sapiens
agaacagcauuggucccag

SEQ ID NO: 1016986 - RNA, 17 nt, Homo sapiens
agaacaguccauugaaa

SEQ ID NO: 1016987 - RNA, 22 nt, Homo sapiens
agaacaucauuagaacaaagga

SEQ ID NO: 1016988 - RNA, 14 nt, Homo sapiens
agaaccacucauaa

SEQ ID NO: 1016989 - RNA, 20 nt, Homo sapiens
agaaccccaggacgcccuca

SEQ ID NO: 1016990 - RNA, 19 nt, Homo sapiens
agaacccucaggucacaag

SEQ ID NO: 1016991 - RNA, 20 nt, Homo sapiens
agaacccugcguggggacag

SEQ ID NO: 1016992 - RNA, 16 nt, Homo sapiens
agaaccgagcaaagau

SEQ ID NO: 1016993 - RNA, 13 nt, Homo sapiens
agaaccuagaagg

SEQ ID NO: 1016994 - RNA, 12 nt, Homo sapiens
agaaccucaggc

SEQ ID NO: 1016995 - RNA, 23 nt, Homo sapiens
agaaccuggagggcuagaaccua

SEQ ID NO: 1016996 - RNA, 17 nt, Homo sapiens
agaacuauaugugaauc

SEQ ID NO: 1016997 - RNA, 16 nt, Homo sapiens
agaacuauguacuuua

SEQ ID NO: 1016998 - RNA, 12 nt, Homo sapiens
agaacucuccau

SEQ ID NO: 1016999 - RNA, 22 nt, Homo sapiens
agaacucuccaucuuauuuuca

SEQ ID NO: 1017000 - RNA, 14 nt, Homo sapiens
agaacugcagucag

SEQ ID NO: 1017001 - RNA, 22 nt, Homo sapiens
agaacuggaggaguuccuugau

SEQ ID NO: 1017002 - RNA, 17 nt, Homo sapiens
agaagaacauccaagga

SEQ ID NO: 1017003 - RNA, 15 nt, Homo sapiens
agaagacaacauuaa

SEQ ID NO: 1017004 - RNA, 18 nt, Homo sapiens
agaagacaccagagcaga

SEQ ID NO: 1017005 - RNA, 19 nt, Homo sapiens
agaagacacugaugggcaa

SEQ ID NO: 1017006 - RNA, 16 nt, Homo sapiens
agaagaggcuggugcu

SEQ ID NO: 1017007 - RNA, 11 nt, Homo sapiens
agaagaugaau

SEQ ID NO: 1017008 - RNA, 13 nt, Homo sapiens
agaagcaaucugc

SEQ ID NO: 1017009 - RNA, 14 nt, Homo sapiens
agaagcacuguucc

SEQ ID NO: 1017010 - RNA, 10 nt, Homo sapiens
agaagccauu

SEQ ID NO: 1017011 - RNA, 21 nt, Homo sapiens
agaagccugugcccugaucca

SEQ ID NO: 1017012 - RNA, 18 nt, Homo sapiens
agaaggagggagacauga

SEQ ID NO: 1017013 - RNA, 22 nt, Homo sapiens
agaaggauggcauuuuuugcaa

SEQ ID NO: 1017014 - RNA, 20 nt, Homo sapiens
agaaggauguacauuuccaa

SEQ ID NO: 1017015 - RNA, 18 nt, Homo sapiens
agaaggcagccaccagcg

SEQ ID NO: 1017016 - RNA, 22 nt, Homo sapiens
aggcugaggcagaacugcuuga

SEQ ID NO: 1017017 - RNA, 17 nt, Homo sapiens
aggcugaggcaggugga

SEQ ID NO: 1017018 - RNA, 18 nt, Homo sapiens
aggcugaucccugagauc

SEQ ID NO: 1017019 - RNA, 17 nt, Homo sapiens
aggcugcgacugaugaa

SEQ ID NO: 1017020 - RNA, 14 nt, Homo sapiens
aggcuggagcuggc

SEQ ID NO: 1017021 - RNA, 17 nt, Homo sapiens
aggcuggaguacaguga

SEQ ID NO: 1017022 - RNA, 20 nt, Homo sapiens
aggcuggagugcaauggcgu

SEQ ID NO: 1017023 - RNA, 15 nt, Homo sapiens
aggcuggcagugaca

SEQ ID NO: 1017024 - RNA, 12 nt, Homo sapiens
aggcuggcuugu

SEQ ID NO: 1017025 - RNA, 13 nt, Homo sapiens
aggcuggucucaa

SEQ ID NO: 1017026 - RNA, 18 nt, Homo sapiens
aggcuuaaucacaccguc

SEQ ID NO: 1017027 - RNA, 21 nt, Homo sapiens
aggcuucaguuuuacucugcu

SEQ ID NO: 1017028 - RNA, 21 nt, Homo sapiens
aggcuuccagagaguccucug

SEQ ID NO: 1017029 - RNA, 15 nt, Homo sapiens
aggcuucuggggcuu

SEQ ID NO: 1017030 - RNA, 22 nt, Homo sapiens
aggcuuucaagaagugccaguu

SEQ ID NO: 1017031 - RNA, 18 nt, Homo sapiens
agggaaaacauuccaucc

SEQ ID NO: 1017032 - RNA, 13 nt, Homo sapiens
agggaacagugag

SEQ ID NO: 1017033 - RNA, 18 nt, Homo sapiens
agggaagaagcauacaac

SEQ ID NO: 1017034 - RNA, 20 nt, Homo sapiens
agggaagagugcauuuuccc

SEQ ID NO: 1017035 - RNA, 19 nt, Homo sapiens
agggaagccccacuugaag

SEQ ID NO: 1017036 - RNA, 22 nt, Homo sapiens
agggaagcugucccucacuguu

SEQ ID NO: 1017037 - RNA, 21 nt, Homo sapiens
agggaaguaacauuugccuua

SEQ ID NO: 1017038 - RNA, 20 nt, Homo sapiens
agggaauggcacagcccaaa

SEQ ID NO: 1017039 - RNA, 20 nt, Homo sapiens
agggacaccaagccuuggcu

SEQ ID NO: 1017040 - RNA, 16 nt, Homo sapiens
agggacgccugggggu

SEQ ID NO: 1017041 - RNA, 21 nt, Homo sapiens
agggacucagggccaugccug

SEQ ID NO: 1017042 - RNA, 15 nt, Homo sapiens
agggacugaaaaccu

SEQ ID NO: 1017043 - RNA, 13 nt, Homo sapiens
agggacuggcaca

SEQ ID NO: 1017044 - RNA, 23 nt, Homo sapiens
agggacuucacgaaguguugcau

SEQ ID NO: 1017045 - RNA, 14 nt, Homo sapiens
agggagagccagcu

SEQ ID NO: 1017046 - RNA, 14 nt, Homo sapiens
agggagauucagac

SEQ ID NO: 1017047 - RNA, 18 nt, Homo sapiens
agggaugaguacccaaaa

SEQ ID NO: 1017048 - RNA, 20 nt, Homo sapiens
agggauggugcccuguucuc

SEQ ID NO: 1017049 - RNA, 17 nt, Homo sapiens
agggauuacccaagcaa

SEQ ID NO: 1017050 - RNA, 21 nt, Homo sapiens
agggauuuuagucacacgugg

SEQ ID NO: 1017051 - RNA, 15 nt, Homo sapiens
agggcacacacugug

SEQ ID NO: 1017052 - RNA, 22 nt, Homo sapiens
agggcacccuaguucuaccuca

SEQ ID NO: 1017053 - RNA, 12 nt, Homo sapiens
agggcacugagg

SEQ ID NO: 1017054 - RNA, 15 nt, Homo sapiens
agggcacuucacaga

SEQ ID NO: 1017055 - RNA, 16 nt, Homo sapiens
agggcagggcucugau

SEQ ID NO: 1017056 - RNA, 23 nt, Homo sapiens
agggcagggcugaggccucucau

SEQ ID NO: 1017057 - RNA, 20 nt, Homo sapiens
agggccguugcccccagacu

SEQ ID NO: 1017058 - RNA, 14 nt, Homo sapiens
agggccuggaagac

SEQ ID NO: 1017059 - RNA, 19 nt, Homo sapiens
agggccuucccugacuuac

SEQ ID NO: 1017060 - RNA, 17 nt, Homo sapiens
agggcuagaaccuggag

SEQ ID NO: 1017061 - RNA, 23 nt, Homo sapiens
agggcuagaaucuggagagcuag

SEQ ID NO: 1017062 - RNA, 23 nt, Homo sapiens
agggcugacucuaggugcccuug

SEQ ID NO: 1017063 - RNA, 14 nt, Homo sapiens
agggcugcaaaagu

SEQ ID NO: 1017064 - RNA, 15 nt, Homo sapiens
agggcuuucucagga

SEQ ID NO: 1017065 - RNA, 15 nt, Homo sapiens
aggggaaaaucucag

SEQ ID NO: 1017066 - RNA, 22 nt, Homo sapiens
aggggaagggccagucugggcu

SEQ ID NO: 1017067 - RNA, 21 nt, Homo sapiens
aggggaccacaccucccugaa

SEQ ID NO: 1017068 - RNA, 17 nt, Homo sapiens
aggggaggaucacugga

SEQ ID NO: 1017069 - RNA, 14 nt, Homo sapiens
aggggcaguggugg

SEQ ID NO: 1017070 - RNA, 18 nt, Homo sapiens
aggggccauccuguccca

SEQ ID NO: 1017071 - RNA, 20 nt, Homo sapiens
agggggccaugaggccucag

SEQ ID NO: 1017072 - RNA, 17 nt, Homo sapiens
aggggguuugggggcuu

SEQ ID NO: 1017073 - RNA, 17 nt, Homo sapiens
agggguaacuugcaccu

SEQ ID NO: 1017074 - RNA, 16 nt, Homo sapiens
aggggucagggaccaa

SEQ ID NO: 1017075 - RNA, 14 nt, Homo sapiens
aggggucauucaug

SEQ ID NO: 1017076 - RNA, 20 nt, Homo sapiens
aggggucccauagaggugag

SEQ ID NO: 1017077 - RNA, 21 nt, Homo sapiens
aggggucuuguuaagugcagu

SEQ ID NO: 1017078 - RNA, 14 nt, Homo sapiens
agggucucuucagg

SEQ ID NO: 1017079 - RNA, 14 nt, Homo sapiens
agggucugcacucu

SEQ ID NO: 1017080 - RNA, 19 nt, Homo sapiens
agggucuuuucaucuggga

SEQ ID NO: 1017081 - RNA, 16 nt, Homo sapiens
agggugcugcuucccu

SEQ ID NO: 1017082 - RNA, 23 nt, Homo sapiens
agggugggguaaccaaauguugg

SEQ ID NO: 1017083 - RNA, 17 nt, Homo sapiens
aggguuccuguagaccu

SEQ ID NO: 1017084 - RNA, 20 nt, Homo sapiens
aggguugggcccagaucugg

SEQ ID NO: 1017085 - RNA, 14 nt, Homo sapiens
agguaaugugaaua

SEQ ID NO: 1017086 - RNA, 15 nt, Homo sapiens
agguacaaguggcug

SEQ ID NO: 1017087 - RNA, 16 nt, Homo sapiens
agguacucugcacaua

SEQ ID NO: 1017088 - RNA, 21 nt, Homo sapiens
agguaucaguugcaauaauac

SEQ ID NO: 1017089 - RNA, 21 nt, Homo sapiens
aggucaaagcaaguuucauca

SEQ ID NO: 1017090 - RNA, 14 nt, Homo sapiens
aggucaaguaagaa

SEQ ID NO: 1017091 - RNA, 14 nt, Homo sapiens
aggucaaugccaga

SEQ ID NO: 1017092 - RNA, 15 nt, Homo sapiens
aggucagcgugcuua

SEQ ID NO: 1017093 - RNA, 15 nt, Homo sapiens
aggucaggaguucga

SEQ ID NO: 1017094 - RNA, 17 nt, Homo sapiens
agguccaauaaaaugcc

SEQ ID NO: 1017095 - RNA, 18 nt, Homo sapiens
aggucccaccuccauuug

SEQ ID NO: 1017096 - RNA, 20 nt, Homo sapiens
agguccucuacuuaaugaga

SEQ ID NO: 1017097 - RNA, 23 nt, Homo sapiens
agguccucuacuuaaugagauag

SEQ ID NO: 1017098 - RNA, 16 nt, Homo sapiens
agguccuggugguauu

SEQ ID NO: 1017099 - RNA, 15 nt, Homo sapiens
agguccuugcccuuu

SEQ ID NO: 1017100 - RNA, 23 nt, Homo sapiens
aggucggaccagcuuuucccaaa

SEQ ID NO: 1017101 - RNA, 15 nt, Homo sapiens
aggucucugaacuca

SEQ ID NO: 1017102 - RNA, 16 nt, Homo sapiens
aggucugaaauggagg

SEQ ID NO: 1017103 - RNA, 22 nt, Homo sapiens
aggucugcucggccgucuucac

SEQ ID NO: 1017104 - RNA, 20 nt, Homo sapiens
aggucuguacguuaccucuu

SEQ ID NO: 1017105 - RNA, 13 nt, Homo sapiens
aggugacagagug

SEQ ID NO: 1017106 - RNA, 21 nt, Homo sapiens
aggugaggauugauuaccuag

SEQ ID NO: 1017107 - RNA, 17 nt, Homo sapiens
aggugauccaccugccu

SEQ ID NO: 1017108 - RNA, 20 nt, Homo sapiens
aggugaucuaccugccucag

SEQ ID NO: 1017109 - RNA, 22 nt, Homo sapiens
aggugcccaggaaccucagggc

SEQ ID NO: 1017110 - RNA, 19 nt, Homo sapiens
aggugcuaucgcaccacug

SEQ ID NO: 1017111 - RNA, 17 nt, Homo sapiens
aggugcuugagucucca

SEQ ID NO: 1017112 - RNA, 22 nt, Homo sapiens
agguggaaacuccugugucugu

SEQ ID NO: 1017113 - RNA, 24 nt, Homo sapiens
agguggcaagcugugacuucucca

SEQ ID NO: 1017114 - RNA, 22 nt, Homo sapiens
agguggccccaguucaaucucc

SEQ ID NO: 1017115 - RNA, 16 nt, Homo sapiens
aggugggaaaugguau

SEQ ID NO: 1017116 - RNA, 21 nt, Homo sapiens
aggugggccuugcuaccucaa

SEQ ID NO: 1017117 - RNA, 14 nt, Homo sapiens
agguggggcagcuu

SEQ ID NO: 1017118 - RNA, 18 nt, Homo sapiens
agguggggggauuacccg

SEQ ID NO: 1017119 - RNA, 15 nt, Homo sapiens
agguggggucacucu

SEQ ID NO: 1017120 - RNA, 16 nt, Homo sapiens
aggugguggcacugag

SEQ ID NO: 1017121 - RNA, 20 nt, Homo sapiens
agguguucuucauuaccuca

SEQ ID NO: 1017122 - RNA, 16 nt, Homo sapiens
agguuacaagccugca

SEQ ID NO: 1017123 - RNA, 21 nt, Homo sapiens
agguuacccuguaacaugcaa

SEQ ID NO: 1017124 - RNA, 14 nt, Homo sapiens
agguuaucgaaaua

SEQ ID NO: 1017125 - RNA, 18 nt, Homo sapiens
agguuaucgaaauaacaa

SEQ ID NO: 1017126 - RNA, 23 nt, Homo sapiens
agguuccaacuggaaacccuuag

SEQ ID NO: 1017127 - RNA, 23 nt, Homo sapiens
agguucuccuugauugggacugg

SEQ ID NO: 1017128 - RNA, 19 nt, Homo sapiens
agguucuggugugaacuaa

SEQ ID NO: 1017129 - RNA, 19 nt, Homo sapiens
agguucuuagugucacuua

SEQ ID NO: 1017130 - RNA, 18 nt, Homo sapiens
agguugagcucuucuuaa

SEQ ID NO: 1017131 - RNA, 17 nt, Homo sapiens
agguugcagugagccaa

SEQ ID NO: 1017132 - RNA, 16 nt, Homo sapiens
agguuugccagcauuu

SEQ ID NO: 1017133 - RNA, 21 nt, Homo sapiens
agguuuguuuagaagaagugu

SEQ ID NO: 1017134 - RNA, 16 nt, Homo sapiens
agguuuuaaagugauu

SEQ ID NO: 1017135 - RNA, 18 nt, Homo sapiens
agguuuuuaagccuuaaa

SEQ ID NO: 1017136 - RNA, 16 nt, Homo sapiens
agguuuuuggucugac

SEQ ID NO: 1017137 - RNA, 19 nt, Homo sapiens
aguaaaacggauaccaagu

SEQ ID NO: 1017138 - RNA, 15 nt, Homo sapiens
aguaaacaccuggag

SEQ ID NO: 1017139 - RNA, 22 nt, Homo sapiens
aguaaacccagcugugagacaa

SEQ ID NO: 1017140 - RNA, 21 nt, Homo sapiens
aguaaagccguuguuuacuua

SEQ ID NO: 1017141 - RNA, 15 nt, Homo sapiens
aguaacauguguuaa

SEQ ID NO: 1017142 - RNA, 20 nt, Homo sapiens
aguaaccuuucaaucaaaac

SEQ ID NO: 1017143 - RNA, 19 nt, Homo sapiens
aguaacuuggcuuucauua

SEQ ID NO: 1017144 - RNA, 15 nt, Homo sapiens
aguaagaaaugcugc

SEQ ID NO: 1017145 - RNA, 16 nt, Homo sapiens
aguaagaaaugcugcc

SEQ ID NO: 1017146 - RNA, 18 nt, Homo sapiens
aguaagagcuggugucug

SEQ ID NO: 1017147 - RNA, 14 nt, Homo sapiens
aguaaggugcaguu

SEQ ID NO: 1017148 - RNA, 15 nt, Homo sapiens
aguaaguaucuggag

SEQ ID NO: 1017149 - RNA, 15 nt, Homo sapiens
aguaagugccuucca

SEQ ID NO: 1017150 - RNA, 14 nt, Homo sapiens
aguaaguggugaga

SEQ ID NO: 1017151 - RNA, 14 nt, Homo sapiens
aguaauaugcacac

SEQ ID NO: 1017152 - RNA, 17 nt, Homo sapiens
aguacaccccaacagca

SEQ ID NO: 1017153 - RNA, 12 nt, Homo sapiens
aguacaggugaa

SEQ ID NO: 1017154 - RNA, 19 nt, Homo sapiens
aguaccugaaaaaaugcca

SEQ ID NO: 1017155 - RNA, 14 nt, Homo sapiens
aguacguugugcau

SEQ ID NO: 1017156 - RNA, 17 nt, Homo sapiens
aguacucauacauguua

SEQ ID NO: 1017157 - RNA, 18 nt, Homo sapiens
aguagagcaaaucuauga

SEQ ID NO: 1017158 - RNA, 19 nt, Homo sapiens
aguguuuggguauauucau

SEQ ID NO: 1017159 - RNA, 15 nt, Homo sapiens
aguguuuuuuauuca

SEQ ID NO: 1017160 - RNA, 12 nt, Homo sapiens
aguuaaggguua

SEQ ID NO: 1017161 - RNA, 13 nt, Homo sapiens
aguuacacuaaaa

SEQ ID NO: 1017162 - RNA, 22 nt, Homo sapiens
aguuauaaaucaaugucacuua

SEQ ID NO: 1017163 - RNA, 19 nt, Homo sapiens
aguuaucaugcauguuaug

SEQ ID NO: 1017164 - RNA, 19 nt, Homo sapiens
aguuauggcuauaggugcu

SEQ ID NO: 1017165 - RNA, 16 nt, Homo sapiens
aguucaacucauggag

SEQ ID NO: 1017166 - RNA, 20 nt, Homo sapiens
aguucaaucucccgcugcug

SEQ ID NO: 1017167 - RNA, 17 nt, Homo sapiens
aguucaccugcacuuaa

SEQ ID NO: 1017168 - RNA, 13 nt, Homo sapiens
aguucacugcaac

SEQ ID NO: 1017169 - RNA, 13 nt, Homo sapiens
aguucagacuuuu

SEQ ID NO: 1017170 - RNA, 16 nt, Homo sapiens
aguucagagucuucag

SEQ ID NO: 1017171 - RNA, 22 nt, Homo sapiens
aguucaguggcagggcucagga

SEQ ID NO: 1017172 - RNA, 19 nt, Homo sapiens
aguucauacccuguuacca

SEQ ID NO: 1017173 - RNA, 17 nt, Homo sapiens
aguucauauguaccaug

SEQ ID NO: 1017174 - RNA, 14 nt, Homo sapiens
aguuccaccaucaa

SEQ ID NO: 1017175 - RNA, 22 nt, Homo sapiens
aguuccuuggagggacaugacu

SEQ ID NO: 1017176 - RNA, 18 nt, Homo sapiens
aguucgaggcugcaguca

SEQ ID NO: 1017177 - RNA, 18 nt, Homo sapiens
aguucuaguuugcauucc

SEQ ID NO: 1017178 - RNA, 13 nt, Homo sapiens
aguucugaauaug

SEQ ID NO: 1017179 - RNA, 15 nt, Homo sapiens
aguucuugugccaua

SEQ ID NO: 1017180 - RNA, 23 nt, Homo sapiens
aguugaaagaguccuauuugcac

SEQ ID NO: 1017181 - RNA, 14 nt, Homo sapiens
aguugauuuuacaa

SEQ ID NO: 1017182 - RNA, 18 nt, Homo sapiens
aguugauuuuacaauuga

SEQ ID NO: 1017183 - RNA, 16 nt, Homo sapiens
aguugcugaugaacuc

SEQ ID NO: 1017184 - RNA, 18 nt, Homo sapiens
aguuggucccccuuccau

SEQ ID NO: 1017185 - RNA, 14 nt, Homo sapiens
aguuuaaacaaagg

SEQ ID NO: 1017186 - RNA, 16 nt, Homo sapiens
aguuuacaaucagcca

SEQ ID NO: 1017187 - RNA, 15 nt, Homo sapiens
aguuucaaugugauu

SEQ ID NO: 1017188 - RNA, 22 nt, Homo sapiens
aguuucaaugugauucuaaugu

SEQ ID NO: 1017189 - RNA, 22 nt, Homo sapiens
aguuucacaugagcuauuucca

SEQ ID NO: 1017190 - RNA, 21 nt, Homo sapiens
aguuucagagaaauacuuuca

SEQ ID NO: 1017191 - RNA, 22 nt, Homo sapiens
aguuucagagaaauacuuucag

SEQ ID NO: 1017192 - RNA, 14 nt, Homo sapiens
aguuucaggugaca

SEQ ID NO: 1017193 - RNA, 19 nt, Homo sapiens
aguuuccaaucccauagau

SEQ ID NO: 1017194 - RNA, 21 nt, Homo sapiens
aguuucucagcucccaaggcu

SEQ ID NO: 1017195 - RNA, 23 nt, Homo sapiens
aguuugaguuacuaucaugucaa

SEQ ID NO: 1017196 - RNA, 10 nt, Homo sapiens
aguuugauau

SEQ ID NO: 1017197 - RNA, 18 nt, Homo sapiens
aguuugcaguuaugcaga

SEQ ID NO: 1017198 - RNA, 13 nt, Homo sapiens
aguuugcuuucaa

SEQ ID NO: 1017199 - RNA, 14 nt, Homo sapiens
aguuuuaacuguaa

SEQ ID NO: 1017200 - RNA, 17 nt, Homo sapiens
aguuuuauuauugcaau

SEQ ID NO: 1017201 - RNA, 20 nt, Homo sapiens
aguuuugcccuuuuuaagga

SEQ ID NO: 1017202 - RNA, 22 nt, Homo sapiens
aguuuuucagaaagcauuacau

SEQ ID NO: 1017203 - RNA, 14 nt, Homo sapiens
aguuuuucugucaa

SEQ ID NO: 1017204 - RNA, 16 nt, Homo sapiens
auaaaaaacauauaca

SEQ ID NO: 1017205 - RNA, 23 nt, Homo sapiens
auaaaaacuaaauuguaaacucc

SEQ ID NO: 1017206 - RNA, 20 nt, Homo sapiens
auaaaaagugacacagcagc

SEQ ID NO: 1017207 - RNA, 15 nt, Homo sapiens
auaaaaauaccucuu

SEQ ID NO: 1017208 - RNA, 17 nt, Homo sapiens
auaaaaccccaucucua

SEQ ID NO: 1017209 - RNA, 18 nt, Homo sapiens
auaaaauaaaugagcuau

SEQ ID NO: 1017210 - RNA, 17 nt, Homo sapiens
auaaaaucaaacagaga

SEQ ID NO: 1017211 - RNA, 18 nt, Homo sapiens
auaaaaucaaacagagac

SEQ ID NO: 1017212 - RNA, 16 nt, Homo sapiens
auaaaauuaugccaua

SEQ ID NO: 1017213 - RNA, 14 nt, Homo sapiens
auaaacacccauga

SEQ ID NO: 1017214 - RNA, 22 nt, Homo sapiens
auaaacaggaaaaugccagagc

SEQ ID NO: 1017215 - RNA, 16 nt, Homo sapiens
auaaacucaaugagcu

SEQ ID NO: 1017216 - RNA, 22 nt, Homo sapiens
auaaacugauuuaucuauuuaa

SEQ ID NO: 1017217 - RNA, 16 nt, Homo sapiens
auaaacugcuuugcaa

SEQ ID NO: 1017218 - RNA, 15 nt, Homo sapiens
auaaacuucagggau

SEQ ID NO: 1017219 - RNA, 11 nt, Homo sapiens
auaaagacagg

SEQ ID NO: 1017220 - RNA, 15 nt, Homo sapiens
auaaagacaggguuu

SEQ ID NO: 1017221 - RNA, 15 nt, Homo sapiens
auaaagaccugagaa

SEQ ID NO: 1017222 - RNA, 14 nt, Homo sapiens
auaaagcccuugaa

SEQ ID NO: 1017223 - RNA, 17 nt, Homo sapiens
auaaagcccuugaacca

SEQ ID NO: 1017224 - RNA, 18 nt, Homo sapiens
auaaagcccuugaaccag

SEQ ID NO: 1017225 - RNA, 21 nt, Homo sapiens
auaaauaguuuaugauuccac

SEQ ID NO: 1017226 - RNA, 14 nt, Homo sapiens
auaaauaugaagcu

SEQ ID NO: 1017227 - RNA, 22 nt, Homo sapiens
auaaaucgcuuuugauaaucaa

SEQ ID NO: 1017228 - RNA, 20 nt, Homo sapiens
auaaaugaggaaacuccaaa

SEQ ID NO: 1017229 - RNA, 14 nt, Homo sapiens
auaaauggacaaau

SEQ ID NO: 1017230 - RNA, 17 nt, Homo sapiens
auaaauguacauuaauu

SEQ ID NO: 1017231 - RNA, 14 nt, Homo sapiens
auaaaugugaacuu

SEQ ID NO: 1017232 - RNA, 21 nt, Homo sapiens
auaaauuaaaacaugcacaaa

SEQ ID NO: 1017233 - RNA, 23 nt, Homo sapiens
auaaauuuuauaacagaauuaaa

SEQ ID NO: 1017234 - RNA, 14 nt, Homo sapiens
auaacaaaacacuc

SEQ ID NO: 1017235 - RNA, 12 nt, Homo sapiens
auaacacugucu

SEQ ID NO: 1017236 - RNA, 12 nt, Homo sapiens
auaacagguuau

SEQ ID NO: 1017237 - RNA, 13 nt, Homo sapiens
auaacagugcaua

SEQ ID NO: 1017238 - RNA, 17 nt, Homo sapiens
auaacauccacaaagag

SEQ ID NO: 1017239 - RNA, 19 nt, Homo sapiens
auaaccagccauuggcuau

SEQ ID NO: 1017240 - RNA, 20 nt, Homo sapiens
auaaccccagcucccuagga

SEQ ID NO: 1017241 - RNA, 23 nt, Homo sapiens
auaaccguuuccuuucauuuacu

SEQ ID NO: 1017242 - RNA, 22 nt, Homo sapiens
auaaccucaaagugacuauuca

SEQ ID NO: 1017243 - RNA, 22 nt, Homo sapiens
auaacuaggcguggacuuacua

SEQ ID NO: 1017244 - RNA, 14 nt, Homo sapiens
auaacuguucucau

SEQ ID NO: 1017245 - RNA, 14 nt, Homo sapiens
auaacuuauaucau

SEQ ID NO: 1017246 - RNA, 12 nt, Homo sapiens
cagaagccucac

SEQ ID NO: 1017247 - RNA, 24 nt, Homo sapiens
cagaaggaaccagcguguauauga

SEQ ID NO: 1017248 - RNA, 19 nt, Homo sapiens
cagaaggcaaaaagacauu

SEQ ID NO: 1017249 - RNA, 18 nt, Homo sapiens
cagaagggggccaugagg

SEQ ID NO: 1017250 - RNA, 14 nt, Homo sapiens
cagaaguuccucaa

SEQ ID NO: 1017251 - RNA, 21 nt, Homo sapiens
cagaaguuugagaucagccug

SEQ ID NO: 1017252 - RNA, 23 nt, Homo sapiens
cagaauagcuuugaauguggccc

SEQ ID NO: 1017253 - RNA, 15 nt, Homo sapiens
cagaaucagaucuga

SEQ ID NO: 1017254 - RNA, 22 nt, Homo sapiens
cagaaucagaucugagcuucau

SEQ ID NO: 1017255 - RNA, 20 nt, Homo sapiens
cagaauucucagaaucucaa

SEQ ID NO: 1017256 - RNA, 16 nt, Homo sapiens
cagaauuuuaaagagc

SEQ ID NO: 1017257 - RNA, 17 nt, Homo sapiens
cagacaaaguaauuccu

SEQ ID NO: 1017258 - RNA, 12 nt, Homo sapiens
cagacaacacug

SEQ ID NO: 1017259 - RNA, 15 nt, Homo sapiens
cagacaacacuggga

SEQ ID NO: 1017260 - RNA, 21 nt, Homo sapiens
cagacaacacugggaaacaga

SEQ ID NO: 1017261 - RNA, 16 nt, Homo sapiens
cagacaacagaaguca

SEQ ID NO: 1017262 - RNA, 23 nt, Homo sapiens
cagacaacaguugcacagugccu

SEQ ID NO: 1017263 - RNA, 16 nt, Homo sapiens
cagacacuaaguuaua

SEQ ID NO: 1017264 - RNA, 23 nt, Homo sapiens
cagacacugaccauccacucuac

SEQ ID NO: 1017265 - RNA, 21 nt, Homo sapiens
cagacacuguuugcccagugu

SEQ ID NO: 1017266 - RNA, 16 nt, Homo sapiens
cagacagacaacacug

SEQ ID NO: 1017267 - RNA, 13 nt, Homo sapiens
cagacagauucca

SEQ ID NO: 1017268 - RNA, 13 nt, Homo sapiens
cagacaugugcac

SEQ ID NO: 1017269 - RNA, 19 nt, Homo sapiens
cagaccauucaggacacag

SEQ ID NO: 1017270 - RNA, 23 nt, Homo sapiens
cagaccgacguugccaucaaaac

SEQ ID NO: 1017271 - RNA, 17 nt, Homo sapiens
cagacgguucaccagcc

SEQ ID NO: 1017272 - RNA, 15 nt, Homo sapiens
cagacuccugugcaa

SEQ ID NO: 1017273 - RNA, 21 nt, Homo sapiens
cagacucuacagaggccaugg

SEQ ID NO: 1017274 - RNA, 16 nt, Homo sapiens
cagacuguaggauuug

SEQ ID NO: 1017275 - RNA, 18 nt, Homo sapiens
cagacuguaggauuugaa

SEQ ID NO: 1017276 - RNA, 14 nt, Homo sapiens
cagacuucccugaa

SEQ ID NO: 1017277 - RNA, 20 nt, Homo sapiens
cagacuucccugaauguauu

SEQ ID NO: 1017278 - RNA, 16 nt, Homo sapiens
cagagaaaagacauaa

SEQ ID NO: 1017279 - RNA, 16 nt, Homo sapiens
cagagaaauacuuuca

SEQ ID NO: 1017280 - RNA, 19 nt, Homo sapiens
cagagaaauacuuucaggc

SEQ ID NO: 1017281 - RNA, 20 nt, Homo sapiens
cagagaaucauacuuagcaa

SEQ ID NO: 1017282 - RNA, 20 nt, Homo sapiens
cagagaauucucuuauccaa

SEQ ID NO: 1017283 - RNA, 17 nt, Homo sapiens
cagagacugcuguguuu

SEQ ID NO: 1017284 - RNA, 22 nt, Homo sapiens
cagagagaggggagaagccugg

SEQ ID NO: 1017285 - RNA, 16 nt, Homo sapiens
cagagagcaacucuga

SEQ ID NO: 1017286 - RNA, 21 nt, Homo sapiens
cagagagcagcuuuaaacuca

SEQ ID NO: 1017287 - RNA, 23 nt, Homo sapiens
cagagagccauuuugugaaugga

SEQ ID NO: 1017288 - RNA, 21 nt, Homo sapiens
cagagaggccaggugcagguu

SEQ ID NO: 1017289 - RNA, 23 nt, Homo sapiens
cagagagggcagagggguaggca

SEQ ID NO: 1017290 - RNA, 21 nt, Homo sapiens
cagagauaauucuagcuuuga

SEQ ID NO: 1017291 - RNA, 16 nt, Homo sapiens
cagagcagaacuuuca

SEQ ID NO: 1017292 - RNA, 17 nt, Homo sapiens
cagagcagaacuuucac

SEQ ID NO: 1017293 - RNA, 18 nt, Homo sapiens
cagagcaggaagcauuca

SEQ ID NO: 1017294 - RNA, 20 nt, Homo sapiens
cagagcgagagucugucuca

SEQ ID NO: 1017295 - RNA, 21 nt, Homo sapiens
cagagcugaagaacuuggcac

SEQ ID NO: 1017296 - RNA, 17 nt, Homo sapiens
cagagcuggaucucuca

SEQ ID NO: 1017297 - RNA, 24 nt, Homo sapiens
cagagcuugaagaaaagcuuauuu

SEQ ID NO: 1017298 - RNA, 13 nt, Homo sapiens
cagaggacaguau

SEQ ID NO: 1017299 - RNA, 23 nt, Homo sapiens
cagaggagcggccagaagaucua

SEQ ID NO: 1017300 - RNA, 20 nt, Homo sapiens
cagagggagacuccaucuca

SEQ ID NO: 1017301 - RNA, 21 nt, Homo sapiens
cagagggagacuccaucucaa

SEQ ID NO: 1017302 - RNA, 15 nt, Homo sapiens
cagagguucauuuca

SEQ ID NO: 1017303 - RNA, 23 nt, Homo sapiens
cagagguuucuggcagccaguac

SEQ ID NO: 1017304 - RNA, 21 nt, Homo sapiens
cagaguauuggucuccucuca

SEQ ID NO: 1017305 - RNA, 17 nt, Homo sapiens
cagaguccucuaugaac

SEQ ID NO: 1017306 - RNA, 14 nt, Homo sapiens
cagagugaacacuc

SEQ ID NO: 1017307 - RNA, 24 nt, Homo sapiens
cagaguggggaugacaugcacuca

SEQ ID NO: 1017308 - RNA, 17 nt, Homo sapiens
cagaguuccccaugcag

SEQ ID NO: 1017309 - RNA, 13 nt, Homo sapiens
cagauaccucacc

SEQ ID NO: 1017310 - RNA, 23 nt, Homo sapiens
cagauaucagaaucauugaagua

SEQ ID NO: 1017311 - RNA, 12 nt, Homo sapiens
cagauauuucac

SEQ ID NO: 1017312 - RNA, 14 nt, Homo sapiens
cagaucaaauuuca

SEQ ID NO: 1017313 - RNA, 16 nt, Homo sapiens
cagaucaagcugugag

SEQ ID NO: 1017314 - RNA, 17 nt, Homo sapiens
cagaucaagcugugaga

SEQ ID NO: 1017315 - RNA, 18 nt, Homo sapiens
cagaucaagcugugagac

SEQ ID NO: 1017316 - RNA, 16 nt, Homo sapiens
cagaucacagcuucag

SEQ ID NO: 1017317 - RNA, 15 nt, Homo sapiens
cagaucauauuucac

SEQ ID NO: 1017318 - RNA, 17 nt, Homo sapiens
cagaucauauuucacaa

SEQ ID NO: 1017319 - RNA, 15 nt, Homo sapiens
cagauccccagccuc

SEQ ID NO: 1017320 - RNA, 19 nt, Homo sapiens
cagaucuggacuuggcaac

SEQ ID NO: 1017321 - RNA, 22 nt, Homo sapiens
cagaugacaaaaauucaacuca

SEQ ID NO: 1017322 - RNA, 23 nt, Homo sapiens
cagaugagaguacaccccaacag

SEQ ID NO: 1017323 - RNA, 12 nt, Homo sapiens
cagaugcaauga

SEQ ID NO: 1017324 - RNA, 20 nt, Homo sapiens
cagaugccucuagaagagac

SEQ ID NO: 1017325 - RNA, 17 nt, Homo sapiens
cagauggcaauuucacu

SEQ ID NO: 1017326 - RNA, 14 nt, Homo sapiens
cagauggcacuuug

SEQ ID NO: 1017327 - RNA, 15 nt, Homo sapiens
cagauggggccucug

SEQ ID NO: 1017328 - RNA, 22 nt, Homo sapiens
cagaugguuuuauaaucugauu

SEQ ID NO: 1017329 - RNA, 18 nt, Homo sapiens
cagauguuagaucagggg

SEQ ID NO: 1017330 - RNA, 18 nt, Homo sapiens
cagauuauuuuuccucug

SEQ ID NO: 1017331 - RNA, 19 nt, Homo sapiens
cagauugcaacaggcuggg

SEQ ID NO: 1017332 - RNA, 16 nt, Homo sapiens
cagauuuacacuggga

SEQ ID NO: 1017333 - RNA, 15 nt, Homo sapiens
cagauuuucagcaaa

SEQ ID NO: 1017334 - RNA, 18 nt, Homo sapiens
cagcaaaauuuaugcaaa

SEQ ID NO: 1017335 - RNA, 23 nt, Homo sapiens
cagcaauacuaagggaagaaaca

SEQ ID NO: 1017336 - RNA, 16 nt, Homo sapiens
cagcaaugacaucuca

SEQ ID NO: 1017337 - RNA, 21 nt, Homo sapiens
cagcaaugauuacucuuugag

SEQ ID NO: 1017338 - RNA, 21 nt, Homo sapiens
cagcacuaaagcaguggacac

SEQ ID NO: 1017339 - RNA, 15 nt, Homo sapiens
cagcacuacucugug

SEQ ID NO: 1017340 - RNA, 11 nt, Homo sapiens
cagcacuuugg

SEQ ID NO: 1017341 - RNA, 13 nt, Homo sapiens
cagcacuuuggac

SEQ ID NO: 1017342 - RNA, 21 nt, Homo sapiens
cagcacuuuggacauggcuca

SEQ ID NO: 1017343 - RNA, 16 nt, Homo sapiens
cagcagaucccagcuc

SEQ ID NO: 1017344 - RNA, 18 nt, Homo sapiens
cagcagaucccagcucac

SEQ ID NO: 1017345 - RNA, 22 nt, Homo sapiens
cagcagaucccagcucacguca

SEQ ID NO: 1017346 - RNA, 20 nt, Homo sapiens
cagcagccagcucucagcca

SEQ ID NO: 1017347 - RNA, 14 nt, Homo sapiens
cagcagcuauuuga

SEQ ID NO: 1017348 - RNA, 17 nt, Homo sapiens
cagcagcugaacagcca

SEQ ID NO: 1017349 - RNA, 17 nt, Homo sapiens
cagcauacacagaugaa

SEQ ID NO: 1017350 - RNA, 14 nt, Homo sapiens
cagcaucuaaguaa

SEQ ID NO: 1017351 - RNA, 17 nt, Homo sapiens
cagcaucuguccucauc

SEQ ID NO: 1017352 - RNA, 19 nt, Homo sapiens
cagcaugcauucauaacag

SEQ ID NO: 1017353 - RNA, 11 nt, Homo sapiens
cagcauugcuu

SEQ ID NO: 1017354 - RNA, 21 nt, Homo sapiens
cagcauuuagacccugcauuu

SEQ ID NO: 1017355 - RNA, 17 nt, Homo sapiens
cagcauuuccacaccaa

SEQ ID NO: 1017356 - RNA, 12 nt, Homo sapiens
cagccaccagcg

SEQ ID NO: 1017357 - RNA, 12 nt, Homo sapiens
cagccaccucuc

SEQ ID NO: 1017358 - RNA, 17 nt, Homo sapiens
cagccacgugcucucug

SEQ ID NO: 1017359 - RNA, 14 nt, Homo sapiens
cagccagacuggca

SEQ ID NO: 1017360 - RNA, 12 nt, Homo sapiens
cagccagugacc

SEQ ID NO: 1017361 - RNA, 20 nt, Homo sapiens
cagccauacggcacugaaca

SEQ ID NO: 1017362 - RNA, 13 nt, Homo sapiens
cagccaucccagc

SEQ ID NO: 1017363 - RNA, 13 nt, Homo sapiens
cagccaugugcug

SEQ ID NO: 1017364 - RNA, 18 nt, Homo sapiens
cagccauuaccauggaga

SEQ ID NO: 1017365 - RNA, 15 nt, Homo sapiens
cagcccacacccagc

SEQ ID NO: 1017366 - RNA, 16 nt, Homo sapiens
cagccccuccaaaggu

SEQ ID NO: 1017367 - RNA, 18 nt, Homo sapiens
cagcccgggucaucugua

SEQ ID NO: 1017368 - RNA, 13 nt, Homo sapiens
cagcccuauggau

SEQ ID NO: 1017369 - RNA, 19 nt, Homo sapiens
cagccgugaucaagggaau

SEQ ID NO: 1017370 - RNA, 20 nt, Homo sapiens
cagccuacuuucacacuaag

SEQ ID NO: 1017371 - RNA, 17 nt, Homo sapiens
cagccucagggacgacu

SEQ ID NO: 1017372 - RNA, 19 nt, Homo sapiens
cagccucauugaugucaaa

SEQ ID NO: 1017373 - RNA, 19 nt, Homo sapiens
cagccucccgaauagcugg

SEQ ID NO: 1017374 - RNA, 20 nt, Homo sapiens
cagccucccgaguagcuggg

SEQ ID NO: 1017375 - RNA, 20 nt, Homo sapiens
cagccucugggucugaguca

SEQ ID NO: 1017376 - RNA, 24 nt, Homo sapiens
cagccugcccucuucauuuagcca

SEQ ID NO: 1017377 - RNA, 15 nt, Homo sapiens
cagccugcuccagcu

SEQ ID NO: 1017378 - RNA, 18 nt, Homo sapiens
cagccuggaagagggcaa

SEQ ID NO: 1017379 - RNA, 21 nt, Homo sapiens
cagccuggccaacauggugaa

SEQ ID NO: 1017380 - RNA, 18 nt, Homo sapiens
cagccugggcaacagagc

SEQ ID NO: 1017381 - RNA, 23 nt, Homo sapiens
cagccugucccauggacacucca

SEQ ID NO: 1017382 - RNA, 14 nt, Homo sapiens
cagcguacucauca

SEQ ID NO: 1017383 - RNA, 16 nt, Homo sapiens
cagcgucccagucucu

SEQ ID NO: 1017384 - RNA, 14 nt, Homo sapiens
cagcgugaagggau

SEQ ID NO: 1017385 - RNA, 15 nt, Homo sapiens
cagcgugaagggauu

SEQ ID NO: 1017386 - RNA, 17 nt, Homo sapiens
cagcuaacaauugugaa

SEQ ID NO: 1017387 - RNA, 20 nt, Homo sapiens
cagcuaacacacagcuccca

SEQ ID NO: 1017388 - RNA, 13 nt, Homo sapiens
cagcuaaguugca

SEQ ID NO: 1017389 - RNA, 23 nt, Homo sapiens
cagcuaccucaaccaaugccaaa

SEQ ID NO: 1017390 - RNA, 14 nt, Homo sapiens
cagcuacucaggag

SEQ ID NO: 1017391 - RNA, 19 nt, Homo sapiens
cagcuagaaauaagcccaa

SEQ ID NO: 1017392 - RNA, 15 nt, Homo sapiens
cagcuaucucucagu

SEQ ID NO: 1017393 - RNA, 15 nt, Homo sapiens
cagcucacgucacac

SEQ ID NO: 1017394 - RNA, 21 nt, Homo sapiens
cagcucauuucacuuuacacg

SEQ ID NO: 1017395 - RNA, 14 nt, Homo sapiens
cagcuccacucuga

SEQ ID NO: 1017396 - RNA, 14 nt, Homo sapiens
cagcucccauuucu

SEQ ID NO: 1017397 - RNA, 21 nt, Homo sapiens
cagcuccucccuuguucucua

SEQ ID NO: 1017398 - RNA, 14 nt, Homo sapiens
cagcucugccuguu

SEQ ID NO: 1017399 - RNA, 16 nt, Homo sapiens
cagcugaacagccaaa

SEQ ID NO: 1017400 - RNA, 20 nt, Homo sapiens
cagcugaccuuugucaucuu

SEQ ID NO: 1017401 - RNA, 22 nt, Homo sapiens
cagcugauugggcaccugacca

SEQ ID NO: 1017402 - RNA, 23 nt, Homo sapiens
cagcugauugggcaccugaccac

SEQ ID NO: 1017403 - RNA, 13 nt, Homo sapiens
cagcugcaccugc

SEQ ID NO: 1017404 - RNA, 15 nt, Homo sapiens
cagcugcaccugcca

SEQ ID NO: 1017405 - RNA, 14 nt, Homo sapiens
cagcugccagagaa

SEQ ID NO: 1017406 - RNA, 18 nt, Homo sapiens
cagcugccagagaagcau

SEQ ID NO: 1017407 - RNA, 21 nt, Homo sapiens
cagcuggacaauaugaaucuu

SEQ ID NO: 1017408 - RNA, 16 nt, Homo sapiens
cagcuggccuguaauc

SEQ ID NO: 1017409 - RNA, 19 nt, Homo sapiens
cagcuggcgucaugcaaag

SEQ ID NO: 1017410 - RNA, 14 nt, Homo sapiens
cagcugggcugugg

SEQ ID NO: 1017411 - RNA, 17 nt, Homo sapiens
cagcugugacaauggca

SEQ ID NO: 1017412 - RNA, 16 nt, Homo sapiens
cagcuguugcagugag

SEQ ID NO: 1017413 - RNA, 13 nt, Homo sapiens
cagcuuauauuca

SEQ ID NO: 1017414 - RNA, 22 nt, Homo sapiens
cagcuuaucucaggggugugcg

SEQ ID NO: 1017415 - RNA, 21 nt, Homo sapiens
cagcuucaccagagcauuucc

SEQ ID NO: 1017416 - RNA, 14 nt, Homo sapiens
cagcuuccaaacau

SEQ ID NO: 1017417 - RNA, 13 nt, Homo sapiens
cagcuucgucuca

SEQ ID NO: 1017418 - RNA, 23 nt, Homo sapiens
cagcuucuggggguagaucucaa

SEQ ID NO: 1017419 - RNA, 14 nt, Homo sapiens
caggaaaaugccag

SEQ ID NO: 1017420 - RNA, 19 nt, Homo sapiens
caggaacacccgacuccuc

SEQ ID NO: 1017421 - RNA, 15 nt, Homo sapiens
caggaacucccagca

SEQ ID NO: 1017422 - RNA, 14 nt, Homo sapiens
caggaacuugcaca

SEQ ID NO: 1017423 - RNA, 15 nt, Homo sapiens
caggaacuugcacaa

SEQ ID NO: 1017424 - RNA, 23 nt, Homo sapiens
caggaacuugcacaaaaucacac

SEQ ID NO: 1017425 - RNA, 15 nt, Homo sapiens
caggaagguagaaau

SEQ ID NO: 1017426 - RNA, 21 nt, Homo sapiens
caggacacggggcaguggcaa

SEQ ID NO: 1017427 - RNA, 19 nt, Homo sapiens
caggacagguggugcaaau

SEQ ID NO: 1017428 - RNA, 14 nt, Homo sapiens
caggacgcccucac

SEQ ID NO: 1017429 - RNA, 17 nt, Homo sapiens
caggacuuggucugauu

SEQ ID NO: 1017430 - RNA, 13 nt, Homo sapiens
caggagaaucacu

SEQ ID NO: 1017431 - RNA, 13 nt, Homo sapiens
caggagaaucgcu

SEQ ID NO: 1017432 - RNA, 16 nt, Homo sapiens
caggagaaucgcuuga

SEQ ID NO: 1017433 - RNA, 18 nt, Homo sapiens
caggagacucugggaacu

SEQ ID NO: 1017434 - RNA, 21 nt, Homo sapiens
caggagacuuuacauggaugc

SEQ ID NO: 1017435 - RNA, 17 nt, Homo sapiens
caggagaucgagaccau

SEQ ID NO: 1017436 - RNA, 18 nt, Homo sapiens
caggaggcuuggaaagca

SEQ ID NO: 1017437 - RNA, 16 nt, Homo sapiens
caggagggcccuaccu

SEQ ID NO: 1017438 - RNA, 21 nt, Homo sapiens
caggagggguuaaagcugccg

SEQ ID NO: 1017439 - RNA, 20 nt, Homo sapiens
caggagguggagguugcagu

SEQ ID NO: 1017440 - RNA, 21 nt, Homo sapiens
caggagguugagguaggagaa

SEQ ID NO: 1017441 - RNA, 13 nt, Homo sapiens
caggaguacaccc

SEQ ID NO: 1017442 - RNA, 18 nt, Homo sapiens
caggagucccugccauca

SEQ ID NO: 1017443 - RNA, 19 nt, Homo sapiens
caggaguucaauaaauguc

SEQ ID NO: 1017444 - RNA, 23 nt, Homo sapiens
caggaguucucccaccaccucac

SEQ ID NO: 1017445 - RNA, 18 nt, Homo sapiens
caggaguuggaagugugu

SEQ ID NO: 1017446 - RNA, 23 nt, Homo sapiens
caggaguuggaagugugugaucu

SEQ ID NO: 1017447 - RNA, 15 nt, Homo sapiens
caggauacucuguca

SEQ ID NO: 1017448 - RNA, 15 nt, Homo sapiens
caggaucauggugua

SEQ ID NO: 1017449 - RNA, 18 nt, Homo sapiens
caggauccagaagggguu

SEQ ID NO: 1017450 - RNA, 20 nt, Homo sapiens
caggauggcacuguuggcac

SEQ ID NO: 1017451 - RNA, 21 nt, Homo sapiens
caggauuaaaagccaugaguu

SEQ ID NO: 1017452 - RNA, 17 nt, Homo sapiens
caggcaaagcaagugau

SEQ ID NO: 1017453 - RNA, 14 nt, Homo sapiens
caggcaacugaggc

SEQ ID NO: 1017454 - RNA, 19 nt, Homo sapiens
caggcacauaccacugcac

SEQ ID NO: 1017455 - RNA, 12 nt, Homo sapiens
caggcaccugca

SEQ ID NO: 1017456 - RNA, 12 nt, Homo sapiens
caggcaccugcc

SEQ ID NO: 1017457 - RNA, 16 nt, Homo sapiens
caggcacuaagacuaa

SEQ ID NO: 1017458 - RNA, 18 nt, Homo sapiens
caggcagagaaucauacu

SEQ ID NO: 1017459 - RNA, 19 nt, Homo sapiens
caggcagaucccacuugca

SEQ ID NO: 1017460 - RNA, 20 nt, Homo sapiens
caggcagaucugugccccau

SEQ ID NO: 1017461 - RNA, 13 nt, Homo sapiens
caggcagccccac

SEQ ID NO: 1017462 - RNA, 14 nt, Homo sapiens
caggcagcugccug

SEQ ID NO: 1017463 - RNA, 19 nt, Homo sapiens
caggcagcuuuuucucucc

SEQ ID NO: 1017464 - RNA, 12 nt, Homo sapiens
caggcaggccac

SEQ ID NO: 1017465 - RNA, 19 nt, Homo sapiens
caggcaugagucagucuga

SEQ ID NO: 1017466 - RNA, 15 nt, Homo sapiens
caggcauguucucug

SEQ ID NO: 1017467 - RNA, 15 nt, Homo sapiens
caggcauuugacuga

SEQ ID NO: 1017468 - RNA, 15 nt, Homo sapiens
caggccacauggcua

SEQ ID NO: 1017469 - RNA, 14 nt, Homo sapiens
caggccaccaggau

SEQ ID NO: 1017470 - RNA, 14 nt, Homo sapiens
caggccagcugccu

SEQ ID NO: 1017471 - RNA, 17 nt, Homo sapiens
caggccauacuuuacaa

SEQ ID NO: 1017472 - RNA, 19 nt, Homo sapiens
caggccccgaggacccaga

SEQ ID NO: 1017473 - RNA, 14 nt, Homo sapiens
caggccucccucaa

SEQ ID NO: 1017474 - RNA, 21 nt, Homo sapiens
caggccuugagggcgucuucu

SEQ ID NO: 1017475 - RNA, 16 nt, Homo sapiens
caggccuuucgauccc

SEQ ID NO: 1017476 - RNA, 18 nt, Homo sapiens
caggcgaggccuggagua

SEQ ID NO: 1017477 - RNA, 14 nt, Homo sapiens
caggcgaugugcaa

SEQ ID NO: 1017478 - RNA, 15 nt, Homo sapiens
caggcgaugugcaag

SEQ ID NO: 1017479 - RNA, 19 nt, Homo sapiens
caggcgauucuccugccuc

SEQ ID NO: 1017480 - RNA, 16 nt, Homo sapiens
caggcgugguggcaca

SEQ ID NO: 1017481 - RNA, 15 nt, Homo sapiens
caggcguucagcuca

SEQ ID NO: 1017482 - RNA, 19 nt, Homo sapiens
caggcuacacugacacugg

SEQ ID NO: 1017483 - RNA, 17 nt, Homo sapiens
caggcuacugucagcuc

SEQ ID NO: 1017484 - RNA, 16 nt, Homo sapiens
caggcuccaggccuca

SEQ ID NO: 1017485 - RNA, 14 nt, Homo sapiens
caggcucugaccag

SEQ ID NO: 1017486 - RNA, 17 nt, Homo sapiens
caggcuggagugcaaug

SEQ ID NO: 1017487 - RNA, 13 nt, Homo sapiens
caggcuggucuca

SEQ ID NO: 1017488 - RNA, 19 nt, Homo sapiens
caggcuuucaagaagugcc

SEQ ID NO: 1017489 - RNA, 20 nt, Homo sapiens
caggcuuucaagaagugcca

SEQ ID NO: 1017490 - RNA, 19 nt, Homo sapiens
cagggaaaauuauuugcau

SEQ ID NO: 1017491 - RNA, 22 nt, Homo sapiens
cagggaacccugcuugcacuuu

SEQ ID NO: 1017492 - RNA, 23 nt, Homo sapiens
cagggaaguggggaaguguucca

SEQ ID NO: 1017493 - RNA, 14 nt, Homo sapiens
cagggaaugaaggu

SEQ ID NO: 1017494 - RNA, 20 nt, Homo sapiens
cagggagacguacguaucag

SEQ ID NO: 1017495 - RNA, 19 nt, Homo sapiens
cagggagguggcuggguuu

SEQ ID NO: 1017496 - RNA, 18 nt, Homo sapiens
cagggagugggcuaagca

SEQ ID NO: 1017497 - RNA, 13 nt, Homo sapiens
cagggccaacuug

SEQ ID NO: 1017498 - RNA, 20 nt, Homo sapiens
cagggcccugagcucggugg

SEQ ID NO: 1017499 - RNA, 21 nt, Homo sapiens
cagggcccugcagaggggaaa

SEQ ID NO: 1017500 - RNA, 14 nt, Homo sapiens
cagggccguugccc

SEQ ID NO: 1017501 - RNA, 20 nt, Homo sapiens
cagggcgagacuccgucuca

SEQ ID NO: 1017502 - RNA, 19 nt, Homo sapiens
cagggcuauagcucaggac

SEQ ID NO: 1017503 - RNA, 21 nt, Homo sapiens
cagggcuccugccuucugucc

SEQ ID NO: 1017504 - RNA, 20 nt, Homo sapiens
cagggcucuaaugugucucu

SEQ ID NO: 1017505 - RNA, 13 nt, Homo sapiens
cagggcucugccc

SEQ ID NO: 1017506 - RNA, 23 nt, Homo sapiens
cagggcugacauuguggcacauu

SEQ ID NO: 1017507 - RNA, 19 nt, Homo sapiens
cagggcugaggccucucau

SEQ ID NO: 1017508 - RNA, 15 nt, Homo sapiens
caggggaccacaccu

SEQ ID NO: 1017509 - RNA, 17 nt, Homo sapiens
caggggaccacaccucc

SEQ ID NO: 1017510 - RNA, 18 nt, Homo sapiens
caggggucgucaccaccu

SEQ ID NO: 1017511 - RNA, 19 nt, Homo sapiens
caggguauaaaaugacauc

SEQ ID NO: 1017512 - RNA, 21 nt, Homo sapiens
cagggucucuagugcugugaa

SEQ ID NO: 1017513 - RNA, 14 nt, Homo sapiens
caggguugaucaca

SEQ ID NO: 1017514 - RNA, 21 nt, Homo sapiens
caggguuuugccauguuggcc

SEQ ID NO: 1017515 - RNA, 13 nt, Homo sapiens
caggguuuuuaga

SEQ ID NO: 1017516 - RNA, 13 nt, Homo sapiens
cagguaaggugag

SEQ ID NO: 1017517 - RNA, 17 nt, Homo sapiens
cagguaaggugagggaa

SEQ ID NO: 1017518 - RNA, 15 nt, Homo sapiens
cagguaaugagggac

SEQ ID NO: 1017519 - RNA, 13 nt, Homo sapiens
cagguaaugugaa

SEQ ID NO: 1017520 - RNA, 17 nt, Homo sapiens
cagguacaacaccuuuu

SEQ ID NO: 1017521 - RNA, 21 nt, Homo sapiens
cagguagaacacaaggucauu

SEQ ID NO: 1017522 - RNA, 22 nt, Homo sapiens
caggucuucucuccaacucuuc

SEQ ID NO: 1017523 - RNA, 14 nt, Homo sapiens
caggugaaaaucca

SEQ ID NO: 1017524 - RNA, 20 nt, Homo sapiens
caggugaaaauccaucucau

SEQ ID NO: 1017525 - RNA, 17 nt, Homo sapiens
caggugaagcaccaagc

SEQ ID NO: 1017526 - RNA, 16 nt, Homo sapiens
caggugauccacccac

SEQ ID NO: 1017527 - RNA, 17 nt, Homo sapiens
caggugaucuaccugcc

SEQ ID NO: 1017528 - RNA, 19 nt, Homo sapiens
caggugaucuaccugccuc

SEQ ID NO: 1017529 - RNA, 16 nt, Homo sapiens
caggugcagugugaca

SEQ ID NO: 1017530 - RNA, 22 nt, Homo sapiens
caggugccuccaggugugcacg

SEQ ID NO: 1017531 - RNA, 11 nt, Homo sapiens
caggugcugcu

SEQ ID NO: 1017532 - RNA, 22 nt, Homo sapiens
cagguggccccaguucaaucuc

SEQ ID NO: 1017533 - RNA, 23 nt, Homo sapiens
caggugggugguggcucuuaagg

SEQ ID NO: 1017534 - RNA, 17 nt, Homo sapiens
caggugguccugagacc

SEQ ID NO: 1017535 - RNA, 19 nt, Homo sapiens
caggugguggcugcaaggu

SEQ ID NO: 1017536 - RNA, 16 nt, Homo sapiens
caggugugaaccacca

SEQ ID NO: 1017537 - RNA, 16 nt, Homo sapiens
cagguguuuauacagc

SEQ ID NO: 1017538 - RNA, 20 nt, Homo sapiens
cagguucaagcaauucuccu

SEQ ID NO: 1017539 - RNA, 17 nt, Homo sapiens
cagguucuauuuggaau

SEQ ID NO: 1017540 - RNA, 18 nt, Homo sapiens
cagguugcuuugcccugg

SEQ ID NO: 1017541 - RNA, 17 nt, Homo sapiens
cagguuuguguuuucuu

SEQ ID NO: 1017542 - RNA, 19 nt, Homo sapiens
cagguuuugaaaauguaca

SEQ ID NO: 1017543 - RNA, 18 nt, Homo sapiens
auaugcugcucaucccca

SEQ ID NO: 1017544 - RNA, 17 nt, Homo sapiens
auauggacucugcacau

SEQ ID NO: 1017545 - RNA, 14 nt, Homo sapiens
auaugggguuggug

SEQ ID NO: 1017546 - RNA, 19 nt, Homo sapiens
auaugguguacauucuucc

SEQ ID NO: 1017547 - RNA, 20 nt, Homo sapiens
auauguaacuggaaucucaa

SEQ ID NO: 1017548 - RNA, 14 nt, Homo sapiens
auauguugcucagu

SEQ ID NO: 1017549 - RNA, 19 nt, Homo sapiens
auauuaacaacaauaacac

SEQ ID NO: 1017550 - RNA, 12 nt, Homo sapiens
auauuagcuuua

SEQ ID NO: 1017551 - RNA, 20 nt, Homo sapiens
auauucagauauaaaacagu

SEQ ID NO: 1017552 - RNA, 12 nt, Homo sapiens
auauucauauaa

SEQ ID NO: 1017553 - RNA, 13 nt, Homo sapiens
auauucauuucaa

SEQ ID NO: 1017554 - RNA, 13 nt, Homo sapiens
auauuccugcauu

SEQ ID NO: 1017555 - RNA, 17 nt, Homo sapiens
auauucugcaacacugu

SEQ ID NO: 1017556 - RNA, 13 nt, Homo sapiens
auauugcagucaa

SEQ ID NO: 1017557 - RNA, 13 nt, Homo sapiens
auauugugcaaac

SEQ ID NO: 1017558 - RNA, 20 nt, Homo sapiens
auauuguggcacaagcaaaa

SEQ ID NO: 1017559 - RNA, 16 nt, Homo sapiens
auauuguuuucagugu

SEQ ID NO: 1017560 - RNA, 14 nt, Homo sapiens
auauuuauguagau

SEQ ID NO: 1017561 - RNA, 18 nt, Homo sapiens
auauuucaggcauacuga

SEQ ID NO: 1017562 - RNA, 17 nt, Homo sapiens
auauuuccucaugugau

SEQ ID NO: 1017563 - RNA, 22 nt, Homo sapiens
auauuuguaugauccuaaugaa

SEQ ID NO: 1017564 - RNA, 23 nt, Homo sapiens
auauuuguguauauaaaccgauc

SEQ ID NO: 1017565 - RNA, 23 nt, Homo sapiens
auauuuucuggguuaaaacccca

SEQ ID NO: 1017566 - RNA, 18 nt, Homo sapiens
auauuuuguaacuauuac

SEQ ID NO: 1017567 - RNA, 15 nt, Homo sapiens
auauuuuguguauaa

SEQ ID NO: 1017568 - RNA, 19 nt, Homo sapiens
auauuuuugguugucaaua

SEQ ID NO: 1017569 - RNA, 15 nt, Homo sapiens
auauuuuugugcaca

SEQ ID NO: 1017570 - RNA, 21 nt, Homo sapiens
aucaaaauaaaaagugacaca

SEQ ID NO: 1017571 - RNA, 16 nt, Homo sapiens
aucaaagccacacucu

SEQ ID NO: 1017572 - RNA, 15 nt, Homo sapiens
aucaaaggcacacag

SEQ ID NO: 1017573 - RNA, 12 nt, Homo sapiens
aucaaauacuuu

SEQ ID NO: 1017574 - RNA, 23 nt, Homo sapiens
aucaaauggaagacacauugaaa

SEQ ID NO: 1017575 - RNA, 13 nt, Homo sapiens
aucaacauuucuc

SEQ ID NO: 1017576 - RNA, 15 nt, Homo sapiens
aucaacauuucucaa

SEQ ID NO: 1017577 - RNA, 13 nt, Homo sapiens
aucaacucugucu

SEQ ID NO: 1017578 - RNA, 21 nt, Homo sapiens
aucaagaauggggaucacaga

SEQ ID NO: 1017579 - RNA, 13 nt, Homo sapiens
aucaagacuggaa

SEQ ID NO: 1017580 - RNA, 14 nt, Homo sapiens
aucaagcagccaag

SEQ ID NO: 1017581 - RNA, 16 nt, Homo sapiens
aucaagccucugguca

SEQ ID NO: 1017582 - RNA, 13 nt, Homo sapiens
aucaagcgaugaa

SEQ ID NO: 1017583 - RNA, 15 nt, Homo sapiens
aucaagcugugagac

SEQ ID NO: 1017584 - RNA, 18 nt, Homo sapiens
aucaagugucuuccauca

SEQ ID NO: 1017585 - RNA, 21 nt, Homo sapiens
aucaauucuauuacgugcaau

SEQ ID NO: 1017586 - RNA, 11 nt, Homo sapiens
aucacaacauu

SEQ ID NO: 1017587 - RNA, 18 nt, Homo sapiens
aucacagagacauuccuc

SEQ ID NO: 1017588 - RNA, 19 nt, Homo sapiens
aucacagcuucagccagga

SEQ ID NO: 1017589 - RNA, 23 nt, Homo sapiens
aucacagggccccagaaggcagg

SEQ ID NO: 1017590 - RNA, 23 nt, Homo sapiens
aucacccuuaccaugugccugau

SEQ ID NO: 1017591 - RNA, 20 nt, Homo sapiens
aucaccgugggcucccugac

SEQ ID NO: 1017592 - RNA, 18 nt, Homo sapiens
cagaacuggacucaggau

SEQ ID NO: 1017593 - RNA, 23 nt, Homo sapiens
cagaagaaauucugcaagcuuuu

SEQ ID NO: 1017594 - RNA, 18 nt, Homo sapiens
cagaagaauauucaggac

SEQ ID NO: 1017595 - RNA, 16 nt, Homo sapiens
cagaagacacugcaaa

SEQ ID NO: 1017596 - RNA, 13 nt, Homo sapiens
cagaagaucugaa

SEQ ID NO: 1017597 - RNA, 14 nt, Homo sapiens
cagaagaucugaaa

SEQ ID NO: 1017598 - RNA, 15 nt, Homo sapiens
cagaagcagaccuca

SEQ ID NO: 1017599 - RNA, 23 nt, Homo sapiens
cagaagcaguugagucgucauca

SEQ ID NO: 1017600 - RNA, 23 nt, Homo sapiens
cagaagccuaggggagucccugu

SEQ ID NO: 1017601 - RNA, 23 nt, Homo sapiens
caguaaaaaacaacuucuuugua

SEQ ID NO: 1017602 - RNA, 10 nt, Homo sapiens
caguaacuga

SEQ ID NO: 1017603 - RNA, 20 nt, Homo sapiens
caguaacuuacccuuaggga

SEQ ID NO: 1017604 - RNA, 17 nt, Homo sapiens
caguaagaaaaagaaga

SEQ ID NO: 1017605 - RNA, 23 nt, Homo sapiens
caguagaaagcauaacaaaaaga

SEQ ID NO: 1017606 - RNA, 19 nt, Homo sapiens
caguaguggugacuguggg

SEQ ID NO: 1017607 - RNA, 17 nt, Homo sapiens
caguauauuuauaguca

SEQ ID NO: 1017608 - RNA, 20 nt, Homo sapiens
caguaucuauauauguguau

SEQ ID NO: 1017609 - RNA, 20 nt, Homo sapiens
caguaugagucaaugugcag

SEQ ID NO: 1017610 - RNA, 22 nt, Homo sapiens
caguaugagucaaugugcagug

SEQ ID NO: 1017611 - RNA, 17 nt, Homo sapiens
caguauuauguacucua

SEQ ID NO: 1017612 - RNA, 17 nt, Homo sapiens
caguauucuugucaaaa

SEQ ID NO: 1017613 - RNA, 22 nt, Homo sapiens
cagucaaacccauggagacaga

SEQ ID NO: 1017614 - RNA, 14 nt, Homo sapiens
cagucacauuccaa

SEQ ID NO: 1017615 - RNA, 11 nt, Homo sapiens
cagucagggac

SEQ ID NO: 1017616 - RNA, 14 nt, Homo sapiens
caguccaaggggac

SEQ ID NO: 1017617 - RNA, 15 nt, Homo sapiens
cagucccaucagaga

SEQ ID NO: 1017618 - RNA, 23 nt, Homo sapiens
cagucccuuacacguaccucuca

SEQ ID NO: 1017619 - RNA, 14 nt, Homo sapiens
caguccucuuucaa

SEQ ID NO: 1017620 - RNA, 19 nt, Homo sapiens
caguccugccucagccucc

SEQ ID NO: 1017621 - RNA, 14 nt, Homo sapiens
caguccuguuugca

SEQ ID NO: 1017622 - RNA, 16 nt, Homo sapiens
cagucucccuucuccc

SEQ ID NO: 1017623 - RNA, 17 nt, Homo sapiens
cagucuuccauuugcaa

SEQ ID NO: 1017624 - RNA, 22 nt, Homo sapiens
cagucuuccauuugcaagggaa

SEQ ID NO: 1017625 - RNA, 19 nt, Homo sapiens
cagucuucugucagcagua

SEQ ID NO: 1017626 - RNA, 19 nt, Homo sapiens
cagucuuggcucacugcaa

SEQ ID NO: 1017627 - RNA, 21 nt, Homo sapiens
cagugaauuagugucauguca

SEQ ID NO: 1017628 - RNA, 17 nt, Homo sapiens
cagugacgugcaccugu

SEQ ID NO: 1017629 - RNA, 20 nt, Homo sapiens
cagugagccaagauugcgcc

SEQ ID NO: 1017630 - RNA, 15 nt, Homo sapiens
cagugagccauguuc

SEQ ID NO: 1017631 - RNA, 19 nt, Homo sapiens
cagugagcugagauugugc

SEQ ID NO: 1017632 - RNA, 20 nt, Homo sapiens
cagugagcugauaucaugcc

SEQ ID NO: 1017633 - RNA, 18 nt, Homo sapiens
cagugagguuaaacuaag

SEQ ID NO: 1017634 - RNA, 15 nt, Homo sapiens
cagugaucuccauau

SEQ ID NO: 1017635 - RNA, 23 nt, Homo sapiens
cagugaugcugugcuaugaauuu

SEQ ID NO: 1017636 - RNA, 14 nt, Homo sapiens
cagugcaacacuga

SEQ ID NO: 1017637 - RNA, 19 nt, Homo sapiens
cagugcaagagacucuggc

SEQ ID NO: 1017638 - RNA, 14 nt, Homo sapiens
cagugcauuugccu

SEQ ID NO: 1017639 - RNA, 17 nt, Homo sapiens
cagugccagcaaugaca

SEQ ID NO: 1017640 - RNA, 22 nt, Homo sapiens
cagugcccacaggaucagucug

SEQ ID NO: 1017641 - RNA, 16 nt, Homo sapiens
cagugcccucauuuua

SEQ ID NO: 1017642 - RNA, 12 nt, Homo sapiens
cagugcucccuc

SEQ ID NO: 1017643 - RNA, 22 nt, Homo sapiens
cagugcuccuguaagucaaaug

SEQ ID NO: 1017644 - RNA, 19 nt, Homo sapiens
cagugcugccaguuuccca

SEQ ID NO: 1017645 - RNA, 17 nt, Homo sapiens
cagugcuguacuugaug

SEQ ID NO: 1017646 - RNA, 19 nt, Homo sapiens
caguggacucaaaacccau

SEQ ID NO: 1017647 - RNA, 19 nt, Homo sapiens
caguggcuggaucugugag

SEQ ID NO: 1017648 - RNA, 21 nt, Homo sapiens
cagugggugccccccuugcca

SEQ ID NO: 1017649 - RNA, 17 nt, Homo sapiens
cagugguauccugugac

SEQ ID NO: 1017650 - RNA, 14 nt, Homo sapiens
caguguacagucuu

SEQ ID NO: 1017651 - RNA, 18 nt, Homo sapiens
caguguccccuccacugu

SEQ ID NO: 1017652 - RNA, 19 nt, Homo sapiens
caguguccucuugcucaaa

SEQ ID NO: 1017653 - RNA, 13 nt, Homo sapiens
cagugucuuccau

SEQ ID NO: 1017654 - RNA, 23 nt, Homo sapiens
cagugugaucccaagugccaguc

SEQ ID NO: 1017655 - RNA, 20 nt, Homo sapiens
caguguuauuaaugacaaag

SEQ ID NO: 1017656 - RNA, 12 nt, Homo sapiens
caguguuuacaa

SEQ ID NO: 1017657 - RNA, 16 nt, Homo sapiens
caguguuugcaauggu

SEQ ID NO: 1017658 - RNA, 15 nt, Homo sapiens
caguuacaugcauac

SEQ ID NO: 1017659 - RNA, 16 nt, Homo sapiens
caguuacuccaguaua

SEQ ID NO: 1017660 - RNA, 17 nt, Homo sapiens
caguucaccugcacuua

SEQ ID NO: 1017661 - RNA, 20 nt, Homo sapiens
caguucagaaucacuucuga

SEQ ID NO: 1017662 - RNA, 18 nt, Homo sapiens
caguucauugcacuuuga

SEQ ID NO: 1017663 - RNA, 21 nt, Homo sapiens
caguugaaugacaacagaagc

SEQ ID NO: 1017664 - RNA, 15 nt, Homo sapiens
caguugacaaaaagc

SEQ ID NO: 1017665 - RNA, 23 nt, Homo sapiens
caguugagcuucauauaccagca

SEQ ID NO: 1017666 - RNA, 16 nt, Homo sapiens
caguugaucaaugaau

SEQ ID NO: 1017667 - RNA, 15 nt, Homo sapiens
caguugucuauucau

SEQ ID NO: 1017668 - RNA, 18 nt, Homo sapiens
caguugugucagcuacug

SEQ ID NO: 1017669 - RNA, 20 nt, Homo sapiens
caguuucagguguuuaguug

SEQ ID NO: 1017670 - RNA, 23 nt, Homo sapiens
caguuuucaggaugauacacuau

SEQ ID NO: 1017671 - RNA, 16 nt, Homo sapiens
cauaaacuucagggau

SEQ ID NO: 1017672 - RNA, 17 nt, Homo sapiens
cauaaacuucaugguca

SEQ ID NO: 1017673 - RNA, 16 nt, Homo sapiens
cauaaagaagcaauaa

SEQ ID NO: 1017674 - RNA, 18 nt, Homo sapiens
cauaaagccuuggaugua

SEQ ID NO: 1017675 - RNA, 17 nt, Homo sapiens
cauaaaugaagcagcuu

SEQ ID NO: 1017676 - RNA, 13 nt, Homo sapiens
cauaacaauuccu

SEQ ID NO: 1017677 - RNA, 21 nt, Homo sapiens
cauaacugaaaaugugcuaua

SEQ ID NO: 1017678 - RNA, 17 nt, Homo sapiens
cauaacuguucucauuu

SEQ ID NO: 1017679 - RNA, 16 nt, Homo sapiens
cauaagaaaacuaaga

SEQ ID NO: 1017680 - RNA, 17 nt, Homo sapiens
cauaagauaaaugugcu

SEQ ID NO: 1017681 - RNA, 11 nt, Homo sapiens
cauaagccuac

SEQ ID NO: 1017682 - RNA, 20 nt, Homo sapiens
cauaagccuccauuuaguuc

SEQ ID NO: 1017683 - RNA, 17 nt, Homo sapiens
cauaaguagagacugaa

SEQ ID NO: 1017684 - RNA, 19 nt, Homo sapiens
cauaagucuaaauaaauga

SEQ ID NO: 1017685 - RNA, 19 nt, Homo sapiens
cauaauauuucuuaaaaag

SEQ ID NO: 1017686 - RNA, 22 nt, Homo sapiens
cauaauguauuuaaccagucuu

SEQ ID NO: 1017687 - RNA, 16 nt, Homo sapiens
cauaauguuacauuau

SEQ ID NO: 1017688 - RNA, 16 nt, Homo sapiens
cauaauuguucuuagu

SEQ ID NO: 1017689 - RNA, 18 nt, Homo sapiens
cauaauuucuucacucaa

SEQ ID NO: 1017690 - RNA, 23 nt, Homo sapiens
cauaauuucuucacucaaucucu

SEQ ID NO: 1017691 - RNA, 21 nt, Homo sapiens
cauaauuuucuucaugcaaug

SEQ ID NO: 1017692 - RNA, 21 nt, Homo sapiens
cauacacacauaugucauaua

SEQ ID NO: 1017693 - RNA, 19 nt, Homo sapiens
cauacaggauuugaacuca

SEQ ID NO: 1017694 - RNA, 17 nt, Homo sapiens
cauacauaguacauaca

SEQ ID NO: 1017695 - RNA, 18 nt, Homo sapiens
cauacaugacucagcaua

SEQ ID NO: 1017696 - RNA, 15 nt, Homo sapiens
cauaccccuucagcu

SEQ ID NO: 1017697 - RNA, 10 nt, Homo sapiens
cauacugcug

SEQ ID NO: 1017698 - RNA, 18 nt, Homo sapiens
cauacuggccuggacugu

SEQ ID NO: 1017699 - RNA, 15 nt, Homo sapiens
cauacuuaucucucu

SEQ ID NO: 1017700 - RNA, 21 nt, Homo sapiens
cauacuuaucucucugugcug

SEQ ID NO: 1017701 - RNA, 16 nt, Homo sapiens
cauacuucuucauuca

SEQ ID NO: 1017702 - RNA, 22 nt, Homo sapiens
cauagagagcaagacgcugugc

SEQ ID NO: 1017703 - RNA, 21 nt, Homo sapiens
cauagagaucauccuuuccag

SEQ ID NO: 1017704 - RNA, 15 nt, Homo sapiens
cauagaggugaggga

SEQ ID NO: 1017705 - RNA, 23 nt, Homo sapiens
cauagaggugagggaagccugaa

SEQ ID NO: 1017706 - RNA, 13 nt, Homo sapiens
cauagcagauuug

SEQ ID NO: 1017707 - RNA, 20 nt, Homo sapiens
cauagcucaccaggacuguu

SEQ ID NO: 1017708 - RNA, 16 nt, Homo sapiens
cauagcuccuucucuc

SEQ ID NO: 1017709 - RNA, 16 nt, Homo sapiens
cauagcugugcuauga

SEQ ID NO: 1017710 - RNA, 21 nt, Homo sapiens
cauagcugugcuaugagguuu

SEQ ID NO: 1017711 - RNA, 15 nt, Homo sapiens
cauagcuuccaugag

SEQ ID NO: 1017712 - RNA, 23 nt, Homo sapiens
cauaggcccagugagaugcauuc

SEQ ID NO: 1017713 - RNA, 15 nt, Homo sapiens
cauaggucacuggcu

SEQ ID NO: 1017714 - RNA, 22 nt, Homo sapiens
cauaguagguacccaauucaau

SEQ ID NO: 1017715 - RNA, 22 nt, Homo sapiens
cauagucacauggccuaugcac

SEQ ID NO: 1017716 - RNA, 18 nt, Homo sapiens
cauaguggagagaacuga

SEQ ID NO: 1017717 - RNA, 18 nt, Homo sapiens
cauaguuuaaacugcauu

SEQ ID NO: 1017718 - RNA, 19 nt, Homo sapiens
cauauaaaagcuaugguga

SEQ ID NO: 1017719 - RNA, 13 nt, Homo sapiens
caucaggacucug

SEQ ID NO: 1017720 - RNA, 12 nt, Homo sapiens
caucagggacag

SEQ ID NO: 1017721 - RNA, 17 nt, Homo sapiens
caucagugcucccucac

SEQ ID NO: 1017722 - RNA, 17 nt, Homo sapiens
caucauucucugucuca

SEQ ID NO: 1017723 - RNA, 17 nt, Homo sapiens
caucauuuugcauucaa

SEQ ID NO: 1017724 - RNA, 18 nt, Homo sapiens
caucauuuugcauucaaa

SEQ ID NO: 1017725 - RNA, 16 nt, Homo sapiens
caucauuuuuguaucu

SEQ ID NO: 1017726 - RNA, 18 nt, Homo sapiens
cauccaaggagaaacaga

SEQ ID NO: 1017727 - RNA, 17 nt, Homo sapiens
cauccaauggacugcau

SEQ ID NO: 1017728 - RNA, 16 nt, Homo sapiens
cauccagguucagcuu

SEQ ID NO: 1017729 - RNA, 17 nt, Homo sapiens
cauccaguucaugagaa

SEQ ID NO: 1017730 - RNA, 17 nt, Homo sapiens
cauccauagcaccucca

SEQ ID NO: 1017731 - RNA, 15 nt, Homo sapiens
cauccauccaaaggc

SEQ ID NO: 1017732 - RNA, 23 nt, Homo sapiens
caucccaggaucgcaagagccau

SEQ ID NO: 1017733 - RNA, 14 nt, Homo sapiens
caucccauguauuu

SEQ ID NO: 1017734 - RNA, 12 nt, Homo sapiens
cauccccacuca

SEQ ID NO: 1017735 - RNA, 14 nt, Homo sapiens
caucccugaaggcc

SEQ ID NO: 1017736 - RNA, 15 nt, Homo sapiens
cauccggcagccugg

SEQ ID NO: 1017737 - RNA, 21 nt, Homo sapiens
cauccuagugaauguaaaaug

SEQ ID NO: 1017738 - RNA, 17 nt, Homo sapiens
cauccugaccuugcaca

SEQ ID NO: 1017739 - RNA, 22 nt, Homo sapiens
cauccugagcagugccagcuuu

SEQ ID NO: 1017740 - RNA, 18 nt, Homo sapiens
cauccugcaggcagcuuu

SEQ ID NO: 1017741 - RNA, 14 nt, Homo sapiens
cauccuucaaauaa

SEQ ID NO: 1017742 - RNA, 19 nt, Homo sapiens
cauccuugagucaaaaaau

SEQ ID NO: 1017743 - RNA, 22 nt, Homo sapiens
caucgcuuuauuggcugagaua

SEQ ID NO: 1017744 - RNA, 23 nt, Homo sapiens
caucgguucauauuaagacauaa

SEQ ID NO: 1017745 - RNA, 19 nt, Homo sapiens
caucguuuucuucacuguc

SEQ ID NO: 1017746 - RNA, 22 nt, Homo sapiens
caucuaaccucaucuucuucac

SEQ ID NO: 1017747 - RNA, 12 nt, Homo sapiens
caucucagccua

SEQ ID NO: 1017748 - RNA, 14 nt, Homo sapiens
caucucaggggcca

SEQ ID NO: 1017749 - RNA, 14 nt, Homo sapiens
caucucagugcagg

SEQ ID NO: 1017750 - RNA, 18 nt, Homo sapiens
caucucagugcuguaaaa

SEQ ID NO: 1017751 - RNA, 19 nt, Homo sapiens
caucuccaagaaugcugaa

SEQ ID NO: 1017752 - RNA, 20 nt, Homo sapiens
caucuccaagaaugcugaaa

SEQ ID NO: 1017753 - RNA, 22 nt, Homo sapiens
caucuccuguuuuuugaugcuu

SEQ ID NO: 1017754 - RNA, 13 nt, Homo sapiens
caucucuacaaaa

SEQ ID NO: 1017755 - RNA, 12 nt, Homo sapiens
caucucuacuaa

SEQ ID NO: 1017756 - RNA, 13 nt, Homo sapiens
caucucuacuaaa

SEQ ID NO: 1017757 - RNA, 17 nt, Homo sapiens
caucucucagaagggag

SEQ ID NO: 1017758 - RNA, 11 nt, Homo sapiens
caucucugcaa

SEQ ID NO: 1017759 - RNA, 16 nt, Homo sapiens
caucucuuucugcaaa

SEQ ID NO: 1017760 - RNA, 15 nt, Homo sapiens
caucugacucacaag

SEQ ID NO: 1017761 - RNA, 23 nt, Homo sapiens
caucugacucacaagaagaccag

SEQ ID NO: 1017762 - RNA, 22 nt, Homo sapiens
caucugccuccccuucacuccc

SEQ ID NO: 1017763 - RNA, 15 nt, Homo sapiens
caucugcgugacaau

SEQ ID NO: 1017764 - RNA, 13 nt, Homo sapiens
caucugcuuuacu

SEQ ID NO: 1017765 - RNA, 23 nt, Homo sapiens
caucugggaaaauaccccaucau

SEQ ID NO: 1017766 - RNA, 16 nt, Homo sapiens
caucuggguagcugua

SEQ ID NO: 1017767 - RNA, 14 nt, Homo sapiens
caucugguaacuca

SEQ ID NO: 1017768 - RNA, 14 nt, Homo sapiens
caucuguaccucug

SEQ ID NO: 1017769 - RNA, 11 nt, Homo sapiens
caucugugaau

SEQ ID NO: 1017770 - RNA, 18 nt, Homo sapiens
caucuuacuguaccuguu

SEQ ID NO: 1017771 - RNA, 14 nt, Homo sapiens
caucuuccaacuca

SEQ ID NO: 1017772 - RNA, 17 nt, Homo sapiens
caucuucccacaguggc

SEQ ID NO: 1017773 - RNA, 15 nt, Homo sapiens
caucuucucagcucc

SEQ ID NO: 1017774 - RNA, 22 nt, Homo sapiens
caucuucuggagucuccagugg

SEQ ID NO: 1017775 - RNA, 17 nt, Homo sapiens
caucuugcaaaacuaca

SEQ ID NO: 1017776 - RNA, 23 nt, Homo sapiens
caucuuggucagauuugaacucu

SEQ ID NO: 1017777 - RNA, 20 nt, Homo sapiens
caucuuugauacuuguucaa

SEQ ID NO: 1017778 - RNA, 13 nt, Homo sapiens
caugaaacauguu

SEQ ID NO: 1017779 - RNA, 20 nt, Homo sapiens
caugaaagcaucugagcuaa

SEQ ID NO: 1017780 - RNA, 13 nt, Homo sapiens
caugaaagcguaa

SEQ ID NO: 1017781 - RNA, 15 nt, Homo sapiens
caugaaccaagugga

SEQ ID NO: 1017782 - RNA, 21 nt, Homo sapiens
caugaagcccaagugaaauca

SEQ ID NO: 1017783 - RNA, 12 nt, Homo sapiens
caugaauaugau

SEQ ID NO: 1017784 - RNA, 14 nt, Homo sapiens
caugaaucaaagac

SEQ ID NO: 1017785 - RNA, 14 nt, Homo sapiens
caugaauccagucc

SEQ ID NO: 1017786 - RNA, 17 nt, Homo sapiens
caugaauccaguccaga

SEQ ID NO: 1017787 - RNA, 16 nt, Homo sapiens
caugaauuccuuaaaa

SEQ ID NO: 1017788 - RNA, 18 nt, Homo sapiens
caugaauucuuaugcuua

SEQ ID NO: 1017789 - RNA, 18 nt, Homo sapiens
caugacuuuauauggaug

SEQ ID NO: 1017790 - RNA, 17 nt, Homo sapiens
caugagaucuaggugag

SEQ ID NO: 1017791 - RNA, 21 nt, Homo sapiens
caugagccucagcauccuggc

SEQ ID NO: 1017792 - RNA, 22 nt, Homo sapiens
caugagcuauuuccauuccaga

SEQ ID NO: 1017793 - RNA, 15 nt, Homo sapiens
caugagucagucuga

SEQ ID NO: 1017794 - RNA, 18 nt, Homo sapiens
caugagucagucugauga

SEQ ID NO: 1017795 - RNA, 18 nt, Homo sapiens
caugagugauucuugaca

SEQ ID NO: 1017796 - RNA, 22 nt, Homo sapiens
caugagugauucuugacauuca

SEQ ID NO: 1017797 - RNA, 15 nt, Homo sapiens
caugauaacugcaau

SEQ ID NO: 1017798 - RNA, 14 nt, Homo sapiens
caugaucaucacaa

SEQ ID NO: 1017799 - RNA, 18 nt, Homo sapiens
caugaucaucacaaucau

SEQ ID NO: 1017800 - RNA, 20 nt, Homo sapiens
caugauggagcgcaccugcc

SEQ ID NO: 1017801 - RNA, 14 nt, Homo sapiens
caugauggugcuga

SEQ ID NO: 1017802 - RNA, 22 nt, Homo sapiens
caugauuucauuucaacuguuu

SEQ ID NO: 1017803 - RNA, 22 nt, Homo sapiens
caugauuuuuuuuuuucagucc

SEQ ID NO: 1017804 - RNA, 10 nt, Homo sapiens
caugcacaaa

SEQ ID NO: 1017805 - RNA, 13 nt, Homo sapiens
caugcaugugcuu

SEQ ID NO: 1017806 - RNA, 16 nt, Homo sapiens
caugcauguuugguua

SEQ ID NO: 1017807 - RNA, 19 nt, Homo sapiens
caugcauugagcucucuca

SEQ ID NO: 1017808 - RNA, 16 nt, Homo sapiens
caugccaaauguucca

SEQ ID NO: 1017809 - RNA, 14 nt, Homo sapiens
caugccaagcacug

SEQ ID NO: 1017810 - RNA, 17 nt, Homo sapiens
caugcccuguaccugug

SEQ ID NO: 1017811 - RNA, 22 nt, Homo sapiens
caugcuccuggcccacugcauc

SEQ ID NO: 1017812 - RNA, 18 nt, Homo sapiens
caugcugaagccaaagcc

SEQ ID NO: 1017813 - RNA, 13 nt, Homo sapiens
caugcuggggcaa

SEQ ID NO: 1017814 - RNA, 14 nt, Homo sapiens
caugcuggggcaag

SEQ ID NO: 1017815 - RNA, 19 nt, Homo sapiens
caugcuggguucugcacag

SEQ ID NO: 1017816 - RNA, 21 nt, Homo sapiens
cauggaacucauuccugccug

SEQ ID NO: 1017817 - RNA, 13 nt, Homo sapiens
cauggaauuaccu

SEQ ID NO: 1017818 - RNA, 19 nt, Homo sapiens
cauggacaaggaugaucua

SEQ ID NO: 1017819 - RNA, 19 nt, Homo sapiens
cauggacaccccuuaucca

SEQ ID NO: 1017820 - RNA, 14 nt, Homo sapiens
cauggagaaguuau

SEQ ID NO: 1017821 - RNA, 17 nt, Homo sapiens
cauggagccagugccug

SEQ ID NO: 1017822 - RNA, 17 nt, Homo sapiens
cauggagucacagccac

SEQ ID NO: 1017823 - RNA, 12 nt, Homo sapiens
cauggaugccaa

SEQ ID NO: 1017824 - RNA, 15 nt, Homo sapiens
cauggcaucaccucc

SEQ ID NO: 1017825 - RNA, 15 nt, Homo sapiens
cauggcauugaacug

SEQ ID NO: 1017826 - RNA, 14 nt, Homo sapiens
cauggccaccacca

SEQ ID NO: 1017827 - RNA, 16 nt, Homo sapiens
cauggccuaugcacau

SEQ ID NO: 1017828 - RNA, 14 nt, Homo sapiens
cauggcucacaaac

SEQ ID NO: 1017829 - RNA, 23 nt, Homo sapiens
cauggcugggauuuaaagccuuu

SEQ ID NO: 1017830 - RNA, 22 nt, Homo sapiens
cauggcuuaguuuucauacaca

SEQ ID NO: 1017831 - RNA, 19 nt, Homo sapiens
caugggcuaaugaagauca

SEQ ID NO: 1017832 - RNA, 22 nt, Homo sapiens
ccacaugugacacauaugcacc

SEQ ID NO: 1017833 - RNA, 19 nt, Homo sapiens
ccaccaccucaccaguuuc

SEQ ID NO: 1017834 - RNA, 14 nt, Homo sapiens
ccaccaggcccaca

SEQ ID NO: 1017835 - RNA, 12 nt, Homo sapiens
ccaccaggcuag

SEQ ID NO: 1017836 - RNA, 16 nt, Homo sapiens
ccaccaggcugcucag

SEQ ID NO: 1017837 - RNA, 16 nt, Homo sapiens
ccaccauccuauugca

SEQ ID NO: 1017838 - RNA, 15 nt, Homo sapiens
ccacccaacaagcca

SEQ ID NO: 1017839 - RNA, 21 nt, Homo sapiens
ccaccccagcaggacagugac

SEQ ID NO: 1017840 - RNA, 23 nt, Homo sapiens
ccacccccaaauuuucuuuuuau

SEQ ID NO: 1017841 - RNA, 16 nt, Homo sapiens
ccacccccagcucaau

SEQ ID NO: 1017842 - RNA, 17 nt, Homo sapiens
ccacccuguguugacac

SEQ ID NO: 1017843 - RNA, 22 nt, Homo sapiens
ccacccuuggaggcugucuucu

SEQ ID NO: 1017844 - RNA, 12 nt, Homo sapiens
ccacccuugugu

SEQ ID NO: 1017845 - RNA, 22 nt, Homo sapiens
ccaccucccugacccgucuaau

SEQ ID NO: 1017846 - RNA, 18 nt, Homo sapiens
ccaccucucucacuccuu

SEQ ID NO: 1017847 - RNA, 12 nt, Homo sapiens
ccaccugccauu

SEQ ID NO: 1017848 - RNA, 15 nt, Homo sapiens
ccaccugcccaucac

SEQ ID NO: 1017849 - RNA, 15 nt, Homo sapiens
ccaccuggcauuccu

SEQ ID NO: 1017850 - RNA, 17 nt, Homo sapiens
ccaccuucccuguccug

SEQ ID NO: 1017851 - RNA, 16 nt, Homo sapiens
ccaccuuccuccagac

SEQ ID NO: 1017852 - RNA, 16 nt, Homo sapiens
ccacgaccuuugaaga

SEQ ID NO: 1017853 - RNA, 18 nt, Homo sapiens
ccacgcuggagugcagug

SEQ ID NO: 1017854 - RNA, 21 nt, Homo sapiens
ccacuacacagucugcaagau

SEQ ID NO: 1017855 - RNA, 20 nt, Homo sapiens
ccacuaggguccaccaggag

SEQ ID NO: 1017856 - RNA, 22 nt, Homo sapiens
ccacucacgaauauuaugccca

SEQ ID NO: 1017857 - RNA, 16 nt, Homo sapiens
ccacuccucugacuca

SEQ ID NO: 1017858 - RNA, 22 nt, Homo sapiens
ccacugaaaauucgaaccagga

SEQ ID NO: 1017859 - RNA, 14 nt, Homo sapiens
ccacugagcuccau

SEQ ID NO: 1017860 - RNA, 21 nt, Homo sapiens
ccacugccaaagaacuuggaa

SEQ ID NO: 1017861 - RNA, 19 nt, Homo sapiens
ccacugugaagagaaccau

SEQ ID NO: 1017862 - RNA, 19 nt, Homo sapiens
ccacugugcugaauucugc

SEQ ID NO: 1017863 - RNA, 12 nt, Homo sapiens
ccacuucugcca

SEQ ID NO: 1017864 - RNA, 19 nt, Homo sapiens
ccagaaaaaaaaaaacuua

SEQ ID NO: 1017865 - RNA, 17 nt, Homo sapiens
ccagaaaagcaguggcu

SEQ ID NO: 1017866 - RNA, 17 nt, Homo sapiens
ccagaaagcucaucuca

SEQ ID NO: 1017867 - RNA, 22 nt, Homo sapiens
ccagaaauccaucuaaauaccu

SEQ ID NO: 1017868 - RNA, 12 nt, Homo sapiens
ccagaacccaga

SEQ ID NO: 1017869 - RNA, 12 nt, Homo sapiens
ccagaaccugga

SEQ ID NO: 1017870 - RNA, 14 nt, Homo sapiens
ccagaaccuggaca

SEQ ID NO: 1017871 - RNA, 17 nt, Homo sapiens
ccagaaccuguccuugc

SEQ ID NO: 1017872 - RNA, 15 nt, Homo sapiens
ccagaagaagcuuaa

SEQ ID NO: 1017873 - RNA, 16 nt, Homo sapiens
ccagaagaagcuuaag

SEQ ID NO: 1017874 - RNA, 19 nt, Homo sapiens
ccagaagauccccucagga

SEQ ID NO: 1017875 - RNA, 17 nt, Homo sapiens
ccagaagcuuccauagu

SEQ ID NO: 1017876 - RNA, 23 nt, Homo sapiens
ccagaagcuuccauaguggugca

SEQ ID NO: 1017877 - RNA, 15 nt, Homo sapiens
ccagaaggcaaaaag

SEQ ID NO: 1017878 - RNA, 23 nt, Homo sapiens
ccagaaggcauaucagucucuga

SEQ ID NO: 1017879 - RNA, 13 nt, Homo sapiens
ccagaauagcuuu

SEQ ID NO: 1017880 - RNA, 17 nt, Homo sapiens
ccagaauaucugggauu

SEQ ID NO: 1017881 - RNA, 18 nt, Homo sapiens
ccagaaugccuccugcag

SEQ ID NO: 1017882 - RNA, 13 nt, Homo sapiens
ccagacaaaugga

SEQ ID NO: 1017883 - RNA, 19 nt, Homo sapiens
ccagacccaccacaccgca

SEQ ID NO: 1017884 - RNA, 14 nt, Homo sapiens
ccagacuggcacag

SEQ ID NO: 1017885 - RNA, 17 nt, Homo sapiens
ccagacugucucaaaua

SEQ ID NO: 1017886 - RNA, 11 nt, Homo sapiens
ccagacugugg

SEQ ID NO: 1017887 - RNA, 20 nt, Homo sapiens
ccagagaggguggugaccuc

SEQ ID NO: 1017888 - RNA, 11 nt, Homo sapiens
ccagagcucag

SEQ ID NO: 1017889 - RNA, 17 nt, Homo sapiens
ccagaggcucagcacuu

SEQ ID NO: 1017890 - RNA, 20 nt, Homo sapiens
ccagagggugggcuucaggg

SEQ ID NO: 1017891 - RNA, 17 nt, Homo sapiens
ccagagucaaauuugaa

SEQ ID NO: 1017892 - RNA, 15 nt, Homo sapiens
ccagagugcugccag

SEQ ID NO: 1017893 - RNA, 19 nt, Homo sapiens
ccagauagcagggcaugaa

SEQ ID NO: 1017894 - RNA, 19 nt, Homo sapiens
ccagauauucaagucaccu

SEQ ID NO: 1017895 - RNA, 14 nt, Homo sapiens
ccagaucagguaua

SEQ ID NO: 1017896 - RNA, 13 nt, Homo sapiens
ccagaugccaggg

SEQ ID NO: 1017897 - RNA, 22 nt, Homo sapiens
ccagcaaugacaucucaggggc

SEQ ID NO: 1017898 - RNA, 16 nt, Homo sapiens
ccagcaccaacaccac

SEQ ID NO: 1017899 - RNA, 15 nt, Homo sapiens
ccagcacccugcaaa

SEQ ID NO: 1017900 - RNA, 22 nt, Homo sapiens
ccagcacuaacguaaauacaca

SEQ ID NO: 1017901 - RNA, 19 nt, Homo sapiens
ccagcacugcccaaagugc

SEQ ID NO: 1017902 - RNA, 23 nt, Homo sapiens
ccagcaguggacucaaaacccau

SEQ ID NO: 1017903 - RNA, 19 nt, Homo sapiens
ccagcaucucccaguucau

SEQ ID NO: 1017904 - RNA, 20 nt, Homo sapiens
ccagccaagagggcugcaaa

SEQ ID NO: 1017905 - RNA, 22 nt, Homo sapiens
ccagccaagagggcugcaaaag

SEQ ID NO: 1017906 - RNA, 22 nt, Homo sapiens
ccagccaccccgggcucucugc

SEQ ID NO: 1017907 - RNA, 19 nt, Homo sapiens
ccagccagauggacuccag

SEQ ID NO: 1017908 - RNA, 16 nt, Homo sapiens
ccagccagggcugcua

SEQ ID NO: 1017909 - RNA, 12 nt, Homo sapiens
ccagccaugcau

SEQ ID NO: 1017910 - RNA, 16 nt, Homo sapiens
ccagccuccaugcugc

SEQ ID NO: 1017911 - RNA, 14 nt, Homo sapiens
ccagccuggccaac

SEQ ID NO: 1017912 - RNA, 20 nt, Homo sapiens
ccagccugggcaacagagca

SEQ ID NO: 1017913 - RNA, 20 nt, Homo sapiens
ccagccugggcagcauagca

SEQ ID NO: 1017914 - RNA, 19 nt, Homo sapiens
ccagcgcccgcugggcuga

SEQ ID NO: 1017915 - RNA, 18 nt, Homo sapiens
ccagcgugugacuacucc

SEQ ID NO: 1017916 - RNA, 17 nt, Homo sapiens
ccagcuaaggacauuuc

SEQ ID NO: 1017917 - RNA, 12 nt, Homo sapiens
ccagcuaugaau

SEQ ID NO: 1017918 - RNA, 16 nt, Homo sapiens
ccagcuccccaagaaa

SEQ ID NO: 1017919 - RNA, 19 nt, Homo sapiens
ccagcucccuaggagacca

SEQ ID NO: 1017920 - RNA, 18 nt, Homo sapiens
ccagcugcucugucuucu

SEQ ID NO: 1017921 - RNA, 20 nt, Homo sapiens
ccagcuggccuguaauccca

SEQ ID NO: 1017922 - RNA, 14 nt, Homo sapiens
ccagcuuaucucag

SEQ ID NO: 1017923 - RNA, 18 nt, Homo sapiens
ccagcuucugguacucuc

SEQ ID NO: 1017924 - RNA, 17 nt, Homo sapiens
ccagcuugggcccagcu

SEQ ID NO: 1017925 - RNA, 14 nt, Homo sapiens
ccagcuuuccucau

SEQ ID NO: 1017926 - RNA, 15 nt, Homo sapiens
ccagcuuugcaguga

SEQ ID NO: 1017927 - RNA, 17 nt, Homo sapiens
ccagcuuugcagugaca

SEQ ID NO: 1017928 - RNA, 12 nt, Homo sapiens
ccaggaauuuga

SEQ ID NO: 1017929 - RNA, 14 nt, Homo sapiens
ccaggaccagcugg

SEQ ID NO: 1017930 - RNA, 22 nt, Homo sapiens
ccaggacgcuucugaaugcugc

SEQ ID NO: 1017931 - RNA, 12 nt, Homo sapiens
cuaaccacauca

SEQ ID NO: 1017932 - RNA, 16 nt, Homo sapiens
cuaaccagccugguca

SEQ ID NO: 1017933 - RNA, 18 nt, Homo sapiens
cuaacuagagcagcccug

SEQ ID NO: 1017934 - RNA, 15 nt, Homo sapiens
cuaacuauauuugcu

SEQ ID NO: 1017935 - RNA, 17 nt, Homo sapiens
cuaacuuaucaucacac

SEQ ID NO: 1017936 - RNA, 20 nt, Homo sapiens
cuaagaaauaaaacuguuaa

SEQ ID NO: 1017937 - RNA, 15 nt, Homo sapiens
cuaagaagcuugaau

SEQ ID NO: 1017938 - RNA, 21 nt, Homo sapiens
cuaagaagugaaaaucuacac

SEQ ID NO: 1017939 - RNA, 20 nt, Homo sapiens
cuaagaugagggcgcaagaa

SEQ ID NO: 1017940 - RNA, 13 nt, Homo sapiens
cuaagaugaucau

SEQ ID NO: 1017941 - RNA, 15 nt, Homo sapiens
cuaagcagaccacug

SEQ ID NO: 1017942 - RNA, 14 nt, Homo sapiens
cuaaggacauuucc

SEQ ID NO: 1017943 - RNA, 18 nt, Homo sapiens
cuaagguccccacugccu

SEQ ID NO: 1017944 - RNA, 23 nt, Homo sapiens
cuaagugauccucccaccucagc

SEQ ID NO: 1017945 - RNA, 13 nt, Homo sapiens
cuaauaacagugc

SEQ ID NO: 1017946 - RNA, 15 nt, Homo sapiens
cuaauaccucugugu

SEQ ID NO: 1017947 - RNA, 14 nt, Homo sapiens
cuaauacuaauuca

SEQ ID NO: 1017948 - RNA, 14 nt, Homo sapiens
cuaauaguuuuauu

SEQ ID NO: 1017949 - RNA, 14 nt, Homo sapiens
cuaauauggcaaaa

SEQ ID NO: 1017950 - RNA, 19 nt, Homo sapiens
cuaauauuagggaguaaaa

SEQ ID NO: 1017951 - RNA, 19 nt, Homo sapiens
cuaaucauccaaugcucaa

SEQ ID NO: 1017952 - RNA, 21 nt, Homo sapiens
cuaauccagcgacaauuugaa

SEQ ID NO: 1017953 - RNA, 21 nt, Homo sapiens
cuaauccucuuuuucuagucu

SEQ ID NO: 1017954 - RNA, 16 nt, Homo sapiens
cuaaucgaaugaacaa

SEQ ID NO: 1017955 - RNA, 21 nt, Homo sapiens
cuaaucuucuuaugcaauuuc

SEQ ID NO: 1017956 - RNA, 14 nt, Homo sapiens
cuaaugugcauuaa

SEQ ID NO: 1017957 - RNA, 22 nt, Homo sapiens
cuaaugugcauuaaaacaaauc

SEQ ID NO: 1017958 - RNA, 19 nt, Homo sapiens
cuaauuaauaaauuauuua

SEQ ID NO: 1017959 - RNA, 21 nt, Homo sapiens
cuaauucccauuuugcaaaau

SEQ ID NO: 1017960 - RNA, 15 nt, Homo sapiens
cuacaaaaaacaaca

SEQ ID NO: 1017961 - RNA, 17 nt, Homo sapiens
cuacacagaucacagcu

SEQ ID NO: 1017962 - RNA, 15 nt, Homo sapiens
cuacacauacaugua

SEQ ID NO: 1017963 - RNA, 22 nt, Homo sapiens
cuacagagcuucccugacucau

SEQ ID NO: 1017964 - RNA, 22 nt, Homo sapiens
cuacagagucuggugaagcuca

SEQ ID NO: 1017965 - RNA, 14 nt, Homo sapiens
cuacauaauuuaga

SEQ ID NO: 1017966 - RNA, 21 nt, Homo sapiens
cuacauauucuuuaaauuuca

SEQ ID NO: 1017967 - RNA, 15 nt, Homo sapiens
cuacaucuaguuaau

SEQ ID NO: 1017968 - RNA, 19 nt, Homo sapiens
cuacaucuaguuaaucaua

SEQ ID NO: 1017969 - RNA, 21 nt, Homo sapiens
cuaccaaagcaccuuagcugg

SEQ ID NO: 1017970 - RNA, 21 nt, Homo sapiens
cuaccaacgaaagacgugauu

SEQ ID NO: 1017971 - RNA, 13 nt, Homo sapiens
cuaccaucaggga

SEQ ID NO: 1017972 - RNA, 20 nt, Homo sapiens
cuaccccaaaguuugcucaa

SEQ ID NO: 1017973 - RNA, 15 nt, Homo sapiens
cuaccuaaacauguu

SEQ ID NO: 1017974 - RNA, 16 nt, Homo sapiens
cuaccucaaacuucca

SEQ ID NO: 1017975 - RNA, 19 nt, Homo sapiens
cuaccucacuaugcugcuu

SEQ ID NO: 1017976 - RNA, 13 nt, Homo sapiens
cuaccugccucag

SEQ ID NO: 1017977 - RNA, 14 nt, Homo sapiens
cuaccugucuguag

SEQ ID NO: 1017978 - RNA, 18 nt, Homo sapiens
cuacgugacuguggcaca

SEQ ID NO: 1017979 - RNA, 15 nt, Homo sapiens
cuacuaaaaaugcaa

SEQ ID NO: 1017980 - RNA, 16 nt, Homo sapiens
cuacuacaugugacug

SEQ ID NO: 1017981 - RNA, 12 nt, Homo sapiens
cuacuccaaaau

SEQ ID NO: 1017982 - RNA, 20 nt, Homo sapiens
cuacucuagggaaaaaccag

SEQ ID NO: 1017983 - RNA, 15 nt, Homo sapiens
cuacucuuaagccau

SEQ ID NO: 1017984 - RNA, 14 nt, Homo sapiens
cuacuugaaggaca

SEQ ID NO: 1017985 - RNA, 20 nt, Homo sapiens
cuacuugggaggcugaggca

SEQ ID NO: 1017986 - RNA, 17 nt, Homo sapiens
cuacuuuaacaccaggu

SEQ ID NO: 1017987 - RNA, 16 nt, Homo sapiens
cuagaaaucugccaau

SEQ ID NO: 1017988 - RNA, 13 nt, Homo sapiens
cuagaaccuggag

SEQ ID NO: 1017989 - RNA, 14 nt, Homo sapiens
cuagaacucuccau

SEQ ID NO: 1017990 - RNA, 19 nt, Homo sapiens
cuagaacucuccaucuuau

SEQ ID NO: 1017991 - RNA, 12 nt, Homo sapiens
cuagaaggccac

SEQ ID NO: 1017992 - RNA, 18 nt, Homo sapiens
cuagaaucuggagagcua

SEQ ID NO: 1017993 - RNA, 23 nt, Homo sapiens
cuagagaagaggcuggugcugug

SEQ ID NO: 1017994 - RNA, 18 nt, Homo sapiens
cuagagcacacuguagca

SEQ ID NO: 1017995 - RNA, 18 nt, Homo sapiens
cuagagccgugaugccuc

SEQ ID NO: 1017996 - RNA, 14 nt, Homo sapiens
cuagaguccucacu

SEQ ID NO: 1017997 - RNA, 17 nt, Homo sapiens
cuagaugggcauggggu

SEQ ID NO: 1017998 - RNA, 20 nt, Homo sapiens
cuagcaacccuaacaguaag

SEQ ID NO: 1017999 - RNA, 14 nt, Homo sapiens
cuagcaucccugag

SEQ ID NO: 1018000 - RNA, 21 nt, Homo sapiens
cuagcaucucaugagugccaa

SEQ ID NO: 1018001 - RNA, 13 nt, Homo sapiens
cuagccaaucaga

SEQ ID NO: 1018002 - RNA, 22 nt, Homo sapiens
cuagccaugauaacugcaauuu

SEQ ID NO: 1018003 - RNA, 18 nt, Homo sapiens
cuagcccucucacauuua

SEQ ID NO: 1018004 - RNA, 17 nt, Homo sapiens
cuagcuagaaauaugau

SEQ ID NO: 1018005 - RNA, 19 nt, Homo sapiens
cuagcuagaaauaugauuu

SEQ ID NO: 1018006 - RNA, 21 nt, Homo sapiens
cuagcugggaaggugaccaca

SEQ ID NO: 1018007 - RNA, 13 nt, Homo sapiens
cuaggagaccaag

SEQ ID NO: 1018008 - RNA, 15 nt, Homo sapiens
cuaggagaccaaggc

SEQ ID NO: 1018009 - RNA, 16 nt, Homo sapiens
cuaggaguauccucau

SEQ ID NO: 1018010 - RNA, 18 nt, Homo sapiens
cuaggcugcccacucucc

SEQ ID NO: 1018011 - RNA, 19 nt, Homo sapiens
cuagggauucaggcugcuu

SEQ ID NO: 1018012 - RNA, 13 nt, Homo sapiens
cuagguucaggaa

SEQ ID NO: 1018013 - RNA, 14 nt, Homo sapiens
cuagguuuaacuca

SEQ ID NO: 1018014 - RNA, 11 nt, Homo sapiens
cucaaacugcc

SEQ ID NO: 1018015 - RNA, 16 nt, Homo sapiens
cucaaacuuccaguca

SEQ ID NO: 1018016 - RNA, 13 nt, Homo sapiens
cucaaaggcacag

SEQ ID NO: 1018017 - RNA, 23 nt, Homo sapiens
cucaaaucuauucagacaagcaa

SEQ ID NO: 1018018 - RNA, 20 nt, Homo sapiens
cucaaaugacccaaagacca

SEQ ID NO: 1018019 - RNA, 21 nt, Homo sapiens
cucaaaugacccaaagaccaa

SEQ ID NO: 1018020 - RNA, 22 nt, Homo sapiens
cucaaaugacccaaagaccaau

SEQ ID NO: 1018021 - RNA, 20 nt, Homo sapiens
cucaaauucauggugcacug

SEQ ID NO: 1018022 - RNA, 23 nt, Homo sapiens
cucaacauguuacugaccagcaa

SEQ ID NO: 1018023 - RNA, 22 nt, Homo sapiens
cucaaccuccugggcuaaguga

SEQ ID NO: 1018024 - RNA, 19 nt, Homo sapiens
cucaacugccuacuccaaa

SEQ ID NO: 1018025 - RNA, 21 nt, Homo sapiens
cucaacugccuacuccaaaau

SEQ ID NO: 1018026 - RNA, 15 nt, Homo sapiens
cucaagauucaguag

SEQ ID NO: 1018027 - RNA, 18 nt, Homo sapiens
cucaagcccgcggggaca

SEQ ID NO: 1018028 - RNA, 15 nt, Homo sapiens
cucaaggacuugaaa

SEQ ID NO: 1018029 - RNA, 20 nt, Homo sapiens
cucaaguucugcccugguga

SEQ ID NO: 1018030 - RNA, 21 nt, Homo sapiens
cucaaguuuuucagaaagcau

SEQ ID NO: 1018031 - RNA, 16 nt, Homo sapiens
cucaauccauguucua

SEQ ID NO: 1018032 - RNA, 14 nt, Homo sapiens
cucaauuugcagua

SEQ ID NO: 1018033 - RNA, 19 nt, Homo sapiens
cucacaccacaaaucugaa

SEQ ID NO: 1018034 - RNA, 20 nt, Homo sapiens
cucacacugggacuugcaaa

SEQ ID NO: 1018035 - RNA, 14 nt, Homo sapiens
cucacagagugcau

SEQ ID NO: 1018036 - RNA, 19 nt, Homo sapiens
cucacagagugcauuguga

SEQ ID NO: 1018037 - RNA, 20 nt, Homo sapiens
cucacagagugcauugugag

SEQ ID NO: 1018038 - RNA, 17 nt, Homo sapiens
cucacauaucugucauu

SEQ ID NO: 1018039 - RNA, 16 nt, Homo sapiens
cucaccaacccagaga

SEQ ID NO: 1018040 - RNA, 19 nt, Homo sapiens
cucaccccugcccugggau

SEQ ID NO: 1018041 - RNA, 18 nt, Homo sapiens
cucacccuguaccacaaa

SEQ ID NO: 1018042 - RNA, 23 nt, Homo sapiens
cucaccuguuacuugaaauacca

SEQ ID NO: 1018043 - RNA, 18 nt, Homo sapiens
cucacgccuaugauccca

SEQ ID NO: 1018044 - RNA, 20 nt, Homo sapiens
cucacgccuguaaucccagc

SEQ ID NO: 1018045 - RNA, 17 nt, Homo sapiens
cucacgggacuauuucc

SEQ ID NO: 1018046 - RNA, 17 nt, Homo sapiens
cucacuaaaaugcuaau

SEQ ID NO: 1018047 - RNA, 15 nt, Homo sapiens
cucacuaugcugcuu

SEQ ID NO: 1018048 - RNA, 15 nt, Homo sapiens
cucacucccagucca

SEQ ID NO: 1018049 - RNA, 21 nt, Homo sapiens
cucacucccuucccauaagcu

SEQ ID NO: 1018050 - RNA, 13 nt, Homo sapiens
cucacucugucac

SEQ ID NO: 1018051 - RNA, 16 nt, Homo sapiens
cucacucuguugccca

SEQ ID NO: 1018052 - RNA, 21 nt, Homo sapiens
cucacuggaugaaauaacucc

SEQ ID NO: 1018053 - RNA, 17 nt, Homo sapiens
cucacuguugaauuuuc

SEQ ID NO: 1018054 - RNA, 22 nt, Homo sapiens
cucagaaacugcgaggccaguu

SEQ ID NO: 1018055 - RNA, 16 nt, Homo sapiens
cucagaauacagacaa

SEQ ID NO: 1018056 - RNA, 23 nt, Homo sapiens
cucagacagaaccccuacaugaa

SEQ ID NO: 1018057 - RNA, 12 nt, Homo sapiens
cucagaccugaa

SEQ ID NO: 1018058 - RNA, 19 nt, Homo sapiens
cucagagagggcaggcaug

SEQ ID NO: 1018059 - RNA, 17 nt, Homo sapiens
cucagagagggugggag

SEQ ID NO: 1018060 - RNA, 18 nt, Homo sapiens
cucagagugcaagccccu

SEQ ID NO: 1018061 - RNA, 16 nt, Homo sapiens
cucagaucacuacugc

SEQ ID NO: 1018062 - RNA, 15 nt, Homo sapiens
cucagaucauuauca

SEQ ID NO: 1018063 - RNA, 12 nt, Homo sapiens
cucagcauaccu

SEQ ID NO: 1018064 - RNA, 13 nt, Homo sapiens
cucagcauaccug

SEQ ID NO: 1018065 - RNA, 23 nt, Homo sapiens
cucagccuacuuucacacuaaga

SEQ ID NO: 1018066 - RNA, 11 nt, Homo sapiens
cucagccucag

SEQ ID NO: 1018067 - RNA, 18 nt, Homo sapiens
cucagccucccaaagugc

SEQ ID NO: 1018068 - RNA, 20 nt, Homo sapiens
cucagccucccgaguagcug

SEQ ID NO: 1018069 - RNA, 20 nt, Homo sapiens
cucagccuccugaguagcug

SEQ ID NO: 1018070 - RNA, 23 nt, Homo sapiens
cucagcucccauuucuacucuua

SEQ ID NO: 1018071 - RNA, 21 nt, Homo sapiens
cucaggaagcccccaaguuga

SEQ ID NO: 1018072 - RNA, 22 nt, Homo sapiens
cucaggauccagucccuuacac

SEQ ID NO: 1018073 - RNA, 22 nt, Homo sapiens
cucaggccacaccggccuugca

SEQ ID NO: 1018074 - RNA, 16 nt, Homo sapiens
cucagguagauuuugu

SEQ ID NO: 1018075 - RNA, 22 nt, Homo sapiens
cucaggugaaaauccaucucau

SEQ ID NO: 1018076 - RNA, 16 nt, Homo sapiens
cucaggugauccaccu

SEQ ID NO: 1018077 - RNA, 21 nt, Homo sapiens
cucaggugaucuaccugccuc

SEQ ID NO: 1018078 - RNA, 17 nt, Homo sapiens
cucaguaaaauguuuaa

SEQ ID NO: 1018079 - RNA, 15 nt, Homo sapiens
cucaguccacugcug

SEQ ID NO: 1018080 - RNA, 15 nt, Homo sapiens
cucagugauugcaau

SEQ ID NO: 1018081 - RNA, 11 nt, Homo sapiens
cucagugccac

SEQ ID NO: 1018082 - RNA, 13 nt, Homo sapiens
cucagugcuguaa

SEQ ID NO: 1018083 - RNA, 20 nt, Homo sapiens
cucaguggacuuuccacccc

SEQ ID NO: 1018084 - RNA, 21 nt, Homo sapiens
cucaguuugucagacuuuaaa

SEQ ID NO: 1018085 - RNA, 19 nt, Homo sapiens
cucaguuugugugucuuaa

SEQ ID NO: 1018086 - RNA, 12 nt, Homo sapiens
cucauagcacuu

SEQ ID NO: 1018087 - RNA, 14 nt, Homo sapiens
cucauagcauuaac

SEQ ID NO: 1018088 - RNA, 21 nt, Homo sapiens
cucauaguucucuuuaagcca

SEQ ID NO: 1018089 - RNA, 22 nt, Homo sapiens
cucauaguucucuuuaagccag

SEQ ID NO: 1018090 - RNA, 20 nt, Homo sapiens
cucauauauaucuaucuuau

SEQ ID NO: 1018091 - RNA, 13 nt, Homo sapiens
cucauaucaaucc

SEQ ID NO: 1018092 - RNA, 13 nt, Homo sapiens
cucauauugugau

SEQ ID NO: 1018093 - RNA, 21 nt, Homo sapiens
cucaucaacugaaugagguca

SEQ ID NO: 1018094 - RNA, 17 nt, Homo sapiens
cucaucaccacagggau

SEQ ID NO: 1018095 - RNA, 17 nt, Homo sapiens
cucaucaucaacccuaa

SEQ ID NO: 1018096 - RNA, 14 nt, Homo sapiens
cucaucauuccuug

SEQ ID NO: 1018097 - RNA, 14 nt, Homo sapiens
cucaucauuuccau

SEQ ID NO: 1018098 - RNA, 17 nt, Homo sapiens
cucaucccgagcaccuc

SEQ ID NO: 1018099 - RNA, 15 nt, Homo sapiens
cucaucccucuguca

SEQ ID NO: 1018100 - RNA, 15 nt, Homo sapiens
cucauccucauaccc

SEQ ID NO: 1018101 - RNA, 20 nt, Homo sapiens
cucauccuuccucauuugca

SEQ ID NO: 1018102 - RNA, 16 nt, Homo sapiens
cucaucugggggagug

SEQ ID NO: 1018103 - RNA, 15 nt, Homo sapiens
cucaucuuacuguac

SEQ ID NO: 1018104 - RNA, 16 nt, Homo sapiens
cucauuaaugacacuu

SEQ ID NO: 1018105 - RNA, 19 nt, Homo sapiens
cucauucagggauagcacu

SEQ ID NO: 1018106 - RNA, 21 nt, Homo sapiens
cucauucagggauagcacuga

SEQ ID NO: 1018107 - RNA, 18 nt, Homo sapiens
cucauugacaagaacuga

SEQ ID NO: 1018108 - RNA, 15 nt, Homo sapiens
cucauugaugucaaa

SEQ ID NO: 1018109 - RNA, 16 nt, Homo sapiens
cucauugcuuggaauu

SEQ ID NO: 1018110 - RNA, 21 nt, Homo sapiens
cucauuggacccuuccauggu

SEQ ID NO: 1018111 - RNA, 21 nt, Homo sapiens
cucauuuagaacuugcagcug

SEQ ID NO: 1018112 - RNA, 21 nt, Homo sapiens
cucauuucacuuuacacgcuc

SEQ ID NO: 1018113 - RNA, 15 nt, Homo sapiens
cucauuucaggagca

SEQ ID NO: 1018114 - RNA, 13 nt, Homo sapiens
cucauuugucaca

SEQ ID NO: 1018115 - RNA, 17 nt, Homo sapiens
cucauuuuuguuuucau

SEQ ID NO: 1018116 - RNA, 23 nt, Homo sapiens
cucauuuuuguuuucauuaucuc

SEQ ID NO: 1018117 - RNA, 14 nt, Homo sapiens
cuccaaaagcacuu

SEQ ID NO: 1018118 - RNA, 13 nt, Homo sapiens
cuccaaacccucg

SEQ ID NO: 1018119 - RNA, 13 nt, Homo sapiens
cuccaaaugagau

SEQ ID NO: 1018120 - RNA, 19 nt, Homo sapiens
cuccacauguucaacuauu

SEQ ID NO: 1018121 - RNA, 14 nt, Homo sapiens
cuccaccucuucac

SEQ ID NO: 1018122 - RNA, 16 nt, Homo sapiens
cuccaccuuccaaagg

SEQ ID NO: 1018123 - RNA, 15 nt, Homo sapiens
cuccacgccauuucc

SEQ ID NO: 1018124 - RNA, 13 nt, Homo sapiens
cuccacugucacc

SEQ ID NO: 1018125 - RNA, 22 nt, Homo sapiens
cuccagacacaccugaacacau

SEQ ID NO: 1018126 - RNA, 15 nt, Homo sapiens
cuccagacaggguuc

SEQ ID NO: 1018127 - RNA, 18 nt, Homo sapiens
cuccagagggaauugcag

SEQ ID NO: 1018128 - RNA, 22 nt, Homo sapiens
cuccagaugagaguacacccca

SEQ ID NO: 1018129 - RNA, 22 nt, Homo sapiens
cuccagccagcaaugaugucca

SEQ ID NO: 1018130 - RNA, 21 nt, Homo sapiens
cuccagccugacuuggggaga

SEQ ID NO: 1018131 - RNA, 16 nt, Homo sapiens
cuccagcucaccagcc

SEQ ID NO: 1018132 - RNA, 22 nt, Homo sapiens
cuccaggcugucuuucacugaa

SEQ ID NO: 1018133 - RNA, 17 nt, Homo sapiens
cuccagugguugcuguu

SEQ ID NO: 1018134 - RNA, 20 nt, Homo sapiens
cuccaguuuauagaccagaa

SEQ ID NO: 1018135 - RNA, 9 nt, Homo sapiens
cuccaucuc

SEQ ID NO: 1018136 - RNA, 17 nt, Homo sapiens
cuccaucuccacuccag

SEQ ID NO: 1018137 - RNA, 13 nt, Homo sapiens
cuccaucucuuaa

SEQ ID NO: 1018138 - RNA, 14 nt, Homo sapiens
cuccauucugacca

SEQ ID NO: 1018139 - RNA, 18 nt, Homo sapiens
cuccauugguguugacau

SEQ ID NO: 1018140 - RNA, 19 nt, Homo sapiens
cucccaaagugcugggauu

SEQ ID NO: 1018141 - RNA, 19 nt, Homo sapiens
cucccaaggcucugagcaa

SEQ ID NO: 1018142 - RNA, 14 nt, Homo sapiens
cucccacaaaggag

SEQ ID NO: 1018143 - RNA, 19 nt, Homo sapiens
cucccaccaccucaccagu

SEQ ID NO: 1018144 - RNA, 21 nt, Homo sapiens
cucccacugggguccagggag

SEQ ID NO: 1018145 - RNA, 23 nt, Homo sapiens
cucccacugggguccagggagca

SEQ ID NO: 1018146 - RNA, 19 nt, Homo sapiens
cucccagaacacacuccau

SEQ ID NO: 1018147 - RNA, 20 nt, Homo sapiens
cucccagaacacacuccauc

SEQ ID NO: 1018148 - RNA, 20 nt, Homo sapiens
cucccaggcuggagugcagu

SEQ ID NO: 1018149 - RNA, 15 nt, Homo sapiens
cucccagucauuuaa

SEQ ID NO: 1018150 - RNA, 22 nt, Homo sapiens
cucccaguccaaauguccucca

SEQ ID NO: 1018151 - RNA, 21 nt, Homo sapiens
cucccauccccuggacuggga

SEQ ID NO: 1018152 - RNA, 17 nt, Homo sapiens
cucccauccuaaucauc

SEQ ID NO: 1018153 - RNA, 15 nt, Homo sapiens
cucccauuucuacuc

SEQ ID NO: 1018154 - RNA, 16 nt, Homo sapiens
cuccccacacuaaccu

SEQ ID NO: 1018155 - RNA, 18 nt, Homo sapiens
cugauguccucaccacau

SEQ ID NO: 1018156 - RNA, 22 nt, Homo sapiens
cugauguguacaucccauguaa

SEQ ID NO: 1018157 - RNA, 13 nt, Homo sapiens
cugauuaaaccaa

SEQ ID NO: 1018158 - RNA, 16 nt, Homo sapiens
cugauuacacaaaaca

SEQ ID NO: 1018159 - RNA, 17 nt, Homo sapiens
cugauuaggacuuuuau

SEQ ID NO: 1018160 - RNA, 20 nt, Homo sapiens
cugauucauaauaaauaucu

SEQ ID NO: 1018161 - RNA, 12 nt, Homo sapiens
cugauugggcac

SEQ ID NO: 1018162 - RNA, 19 nt, Homo sapiens
cugauuuuggccaucagga

SEQ ID NO: 1018163 - RNA, 17 nt, Homo sapiens
cugauuuuuagcuuuac

SEQ ID NO: 1018164 - RNA, 12 nt, Homo sapiens
cugcaaagccau

SEQ ID NO: 1018165 - RNA, 16 nt, Homo sapiens
cugcaaauaaauucau

SEQ ID NO: 1018166 - RNA, 22 nt, Homo sapiens
cugcaagcuuuucaaaauugga

SEQ ID NO: 1018167 - RNA, 17 nt, Homo sapiens
cugcaagugacaucucu

SEQ ID NO: 1018168 - RNA, 21 nt, Homo sapiens
cugcacagauggauuugccug

SEQ ID NO: 1018169 - RNA, 16 nt, Homo sapiens
cugcacauaaguuaug

SEQ ID NO: 1018170 - RNA, 17 nt, Homo sapiens
cugcacccacccaggag

SEQ ID NO: 1018171 - RNA, 22 nt, Homo sapiens
cugcacuggugugagggccccu

SEQ ID NO: 1018172 - RNA, 17 nt, Homo sapiens
cugcacuuauacccaug

SEQ ID NO: 1018173 - RNA, 17 nt, Homo sapiens
cugcagaaggccaagaa

SEQ ID NO: 1018174 - RNA, 18 nt, Homo sapiens
cugcagagagaagccugu

SEQ ID NO: 1018175 - RNA, 20 nt, Homo sapiens
cugcagcagaggcacugggg

SEQ ID NO: 1018176 - RNA, 21 nt, Homo sapiens
cugcagcuuuguuuguuguca

SEQ ID NO: 1018177 - RNA, 18 nt, Homo sapiens
cugcaggccaggccagcu

SEQ ID NO: 1018178 - RNA, 20 nt, Homo sapiens
cugcaggggccgagccauuu

SEQ ID NO: 1018179 - RNA, 22 nt, Homo sapiens
cugcagggggugugucugcuca

SEQ ID NO: 1018180 - RNA, 13 nt, Homo sapiens
cugcaggugcugc

SEQ ID NO: 1018181 - RNA, 14 nt, Homo sapiens
cugcauguucugcu

SEQ ID NO: 1018182 - RNA, 17 nt, Homo sapiens
cugcauucuuucuguau

SEQ ID NO: 1018183 - RNA, 20 nt, Homo sapiens
cugcauugagaacugcauau

SEQ ID NO: 1018184 - RNA, 13 nt, Homo sapiens
cugcauugcugag

SEQ ID NO: 1018185 - RNA, 17 nt, Homo sapiens
cugccaaaccuguguag

SEQ ID NO: 1018186 - RNA, 19 nt, Homo sapiens
cugccagaagauccccuca

SEQ ID NO: 1018187 - RNA, 16 nt, Homo sapiens
cugccagccacaucca

SEQ ID NO: 1018188 - RNA, 15 nt, Homo sapiens
cugccagggagacag

SEQ ID NO: 1018189 - RNA, 23 nt, Homo sapiens
cugccaucauguuuacagaggac

SEQ ID NO: 1018190 - RNA, 21 nt, Homo sapiens
cugcccagaccccucuggcca

SEQ ID NO: 1018191 - RNA, 15 nt, Homo sapiens
cugcccaggggagcc

SEQ ID NO: 1018192 - RNA, 13 nt, Homo sapiens
cugccccaugcug

SEQ ID NO: 1018193 - RNA, 21 nt, Homo sapiens
cugcccgggaaggucaccagc

SEQ ID NO: 1018194 - RNA, 14 nt, Homo sapiens
cugcccuccaagac

SEQ ID NO: 1018195 - RNA, 17 nt, Homo sapiens
cugcccuccuuguccac

SEQ ID NO: 1018196 - RNA, 18 nt, Homo sapiens
cugcccugacaugcacac

SEQ ID NO: 1018197 - RNA, 21 nt, Homo sapiens
cugcccugggauguccacaga

SEQ ID NO: 1018198 - RNA, 18 nt, Homo sapiens
cugcccugguccagggaa

SEQ ID NO: 1018199 - RNA, 15 nt, Homo sapiens
cuggggcaggucacu

SEQ ID NO: 1018200 - RNA, 17 nt, Homo sapiens
cuggggccgaaagaaca

SEQ ID NO: 1018201 - RNA, 15 nt, Homo sapiens
cugggggacacuuuc

SEQ ID NO: 1018202 - RNA, 23 nt, Homo sapiens
cuggggggcguggagagcccggc

SEQ ID NO: 1018203 - RNA, 16 nt, Homo sapiens
cuggggucuccgaaga

SEQ ID NO: 1018204 - RNA, 20 nt, Homo sapiens
cuggguccaccccaugucac

SEQ ID NO: 1018205 - RNA, 13 nt, Homo sapiens
cugggucuuucau

SEQ ID NO: 1018206 - RNA, 12 nt, Homo sapiens
cugggugcuccc

SEQ ID NO: 1018207 - RNA, 14 nt, Homo sapiens
cuggguuccugcaa

SEQ ID NO: 1018208 - RNA, 15 nt, Homo sapiens
cugguaacauagguu

SEQ ID NO: 1018209 - RNA, 20 nt, Homo sapiens
cugguagaaaggcaguucag

SEQ ID NO: 1018210 - RNA, 15 nt, Homo sapiens
cugguauauacauau

SEQ ID NO: 1018211 - RNA, 16 nt, Homo sapiens
cugguauauccaaaag

SEQ ID NO: 1018212 - RNA, 12 nt, Homo sapiens
cugguccaugau

SEQ ID NO: 1018213 - RNA, 15 nt, Homo sapiens
cuggucccuugcagc

SEQ ID NO: 1018214 - RNA, 18 nt, Homo sapiens
cuggucucaaacuccuga

SEQ ID NO: 1018215 - RNA, 18 nt, Homo sapiens
cuggugaaggaucuugcc

SEQ ID NO: 1018216 - RNA, 20 nt, Homo sapiens
cuggugaaggaucuugccug

SEQ ID NO: 1018217 - RNA, 12 nt, Homo sapiens
cugguggccgau

SEQ ID NO: 1018218 - RNA, 21 nt, Homo sapiens
cugguugguguugcagaaggu

SEQ ID NO: 1018219 - RNA, 23 nt, Homo sapiens
cuguaaaauggaggccauugugu

SEQ ID NO: 1018220 - RNA, 18 nt, Homo sapiens
cuguaaacuuguagcauu

SEQ ID NO: 1018221 - RNA, 19 nt, Homo sapiens
cuguaagucaaaugugugc

SEQ ID NO: 1018222 - RNA, 12 nt, Homo sapiens
cuguaauagugu

SEQ ID NO: 1018223 - RNA, 17 nt, Homo sapiens
cuguaaucccagcacuu

SEQ ID NO: 1018224 - RNA, 21 nt, Homo sapiens
cuguaaucccagcacuuuggg

SEQ ID NO: 1018225 - RNA, 21 nt, Homo sapiens
cuguaaucccagcuacucggg

SEQ ID NO: 1018226 - RNA, 18 nt, Homo sapiens
cuguaauccuagcacuuu

SEQ ID NO: 1018227 - RNA, 21 nt, Homo sapiens
cuguaauccuagcacuuuggg

SEQ ID NO: 1018228 - RNA, 18 nt, Homo sapiens
cuguaaugaaacaccuuc

SEQ ID NO: 1018229 - RNA, 13 nt, Homo sapiens
cuguaaugaaucu

SEQ ID NO: 1018230 - RNA, 14 nt, Homo sapiens
cuguacuacaucua

SEQ ID NO: 1018231 - RNA, 15 nt, Homo sapiens
cuguacuuuuuccag

SEQ ID NO: 1018232 - RNA, 22 nt, Homo sapiens
cuguagaaaagggaacugaaca

SEQ ID NO: 1018233 - RNA, 23 nt, Homo sapiens
cuguagaaaugaugauguggaag

SEQ ID NO: 1018234 - RNA, 21 nt, Homo sapiens
cuguagacauuugcuaugagc

SEQ ID NO: 1018235 - RNA, 18 nt, Homo sapiens
cuguagauucuguggaac

SEQ ID NO: 1018236 - RNA, 12 nt, Homo sapiens
cuguagucccag

SEQ ID NO: 1018237 - RNA, 21 nt, Homo sapiens
cuuaauuucauagauuguguu

SEQ ID NO: 1018238 - RNA, 13 nt, Homo sapiens
cuuacacaucuca

SEQ ID NO: 1018239 - RNA, 15 nt, Homo sapiens
cuuacauaugcaaaa

SEQ ID NO: 1018240 - RNA, 23 nt, Homo sapiens
cuuaccagcagagcaccuuagac

SEQ ID NO: 1018241 - RNA, 18 nt, Homo sapiens
cuuacuaagcauagcaaa

SEQ ID NO: 1018242 - RNA, 16 nt, Homo sapiens
cuuacuagaccuguaa

SEQ ID NO: 1018243 - RNA, 18 nt, Homo sapiens
cuuacuagaccuguaacu

SEQ ID NO: 1018244 - RNA, 15 nt, Homo sapiens
cuuacuggcaaacau

SEQ ID NO: 1018245 - RNA, 15 nt, Homo sapiens
cuuacuuaggugugg

SEQ ID NO: 1018246 - RNA, 21 nt, Homo sapiens
cuuacuucccuaaugaaguua

SEQ ID NO: 1018247 - RNA, 19 nt, Homo sapiens
cuuagaauuugggggaaaa

SEQ ID NO: 1018248 - RNA, 21 nt, Homo sapiens
cuuagacauaacaaaacacuc

SEQ ID NO: 1018249 - RNA, 13 nt, Homo sapiens
cuuagaccucagc

SEQ ID NO: 1018250 - RNA, 21 nt, Homo sapiens
cuuagagugggaccaacuucc

SEQ ID NO: 1018251 - RNA, 15 nt, Homo sapiens
cuuagccuacagaug

SEQ ID NO: 1018252 - RNA, 21 nt, Homo sapiens
cuuagcucacaccugaccaau

SEQ ID NO: 1018253 - RNA, 20 nt, Homo sapiens
cuuaggacuuuccacuccug

SEQ ID NO: 1018254 - RNA, 22 nt, Homo sapiens
cuuaggcaugacuguagaauuu

SEQ ID NO: 1018255 - RNA, 15 nt, Homo sapiens
cuuaggccagcacca

SEQ ID NO: 1018256 - RNA, 14 nt, Homo sapiens
cuuaguauuugcau

SEQ ID NO: 1018257 - RNA, 16 nt, Homo sapiens
cuuauaaaaaucuuaa

SEQ ID NO: 1018258 - RNA, 14 nt, Homo sapiens
cuuauacauuugau

SEQ ID NO: 1018259 - RNA, 15 nt, Homo sapiens
cuuauacauuugaua

SEQ ID NO: 1018260 - RNA, 18 nt, Homo sapiens
cuuauagaaaguucaaaa

SEQ ID NO: 1018261 - RNA, 15 nt, Homo sapiens
cuuauaucaucagca

SEQ ID NO: 1018262 - RNA, 18 nt, Homo sapiens
cuuauauucauccaugcc

SEQ ID NO: 1018263 - RNA, 17 nt, Homo sapiens
cuuaucaguaguaucaa

SEQ ID NO: 1018264 - RNA, 22 nt, Homo sapiens
cuuaucaguaguaucaaugauu

SEQ ID NO: 1018265 - RNA, 16 nt, Homo sapiens
cuuauccagcugguga

SEQ ID NO: 1018266 - RNA, 18 nt, Homo sapiens
cuuaucuccaagaccaga

SEQ ID NO: 1018267 - RNA, 13 nt, Homo sapiens
cuuaugaaccuuu

SEQ ID NO: 1018268 - RNA, 14 nt, Homo sapiens
cuuauucucaagaa

SEQ ID NO: 1018269 - RNA, 14 nt, Homo sapiens
cuuauugacuauua

SEQ ID NO: 1018270 - RNA, 15 nt, Homo sapiens
cuuauuuuaggauua

SEQ ID NO: 1018271 - RNA, 14 nt, Homo sapiens
cuugaucaaaggca

SEQ ID NO: 1018272 - RNA, 18 nt, Homo sapiens
cuugaucaauucccuuga

SEQ ID NO: 1018273 - RNA, 16 nt, Homo sapiens
cuugauccacuucucu

SEQ ID NO: 1018274 - RNA, 18 nt, Homo sapiens
cuugaucuguauauacaa

SEQ ID NO: 1018275 - RNA, 18 nt, Homo sapiens
cuugaugcuagaaaggaa

SEQ ID NO: 1018276 - RNA, 18 nt, Homo sapiens
cuugauucagaaccauuu

SEQ ID NO: 1018277 - RNA, 15 nt, Homo sapiens
cuugcaaaacuacaa

SEQ ID NO: 1018278 - RNA, 14 nt, Homo sapiens
cuugcaagauucca

SEQ ID NO: 1018279 - RNA, 20 nt, Homo sapiens
cuugcacuccggagguagag

SEQ ID NO: 1018280 - RNA, 17 nt, Homo sapiens
cuugcagcuaguuuucu

SEQ ID NO: 1018281 - RNA, 17 nt, Homo sapiens
cuugcaguuaaggguua

SEQ ID NO: 1018282 - RNA, 23 nt, Homo sapiens
cuugccaccccacccucccugga

SEQ ID NO: 1018283 - RNA, 12 nt, Homo sapiens
cuugccagacau

SEQ ID NO: 1018284 - RNA, 16 nt, Homo sapiens
cuugcccugaccuccc

SEQ ID NO: 1018285 - RNA, 13 nt, Homo sapiens
cuugcccuuuacg

SEQ ID NO: 1018286 - RNA, 21 nt, Homo sapiens
cuugcuaaaagauuauagaag

SEQ ID NO: 1018287 - RNA, 20 nt, Homo sapiens
cuugcucaaccauggcugaa

SEQ ID NO: 1018288 - RNA, 17 nt, Homo sapiens
cuugcuccuguguaaaa

SEQ ID NO: 1018289 - RNA, 23 nt, Homo sapiens
cuugcuggacggggacuggggau

SEQ ID NO: 1018290 - RNA, 17 nt, Homo sapiens
cuugcugugugaccuca

SEQ ID NO: 1018291 - RNA, 16 nt, Homo sapiens
cuugcuugcaauaggu

SEQ ID NO: 1018292 - RNA, 23 nt, Homo sapiens
cuuggaauccuggggaacauaga

SEQ ID NO: 1018293 - RNA, 20 nt, Homo sapiens
cuuggagacaaaaucuuaaa

SEQ ID NO: 1018294 - RNA, 19 nt, Homo sapiens
cuuggaggcugucuucuca

SEQ ID NO: 1018295 - RNA, 13 nt, Homo sapiens
cuuggauguauau

SEQ ID NO: 1018296 - RNA, 13 nt, Homo sapiens
cuuggcacacucu

SEQ ID NO: 1018297 - RNA, 16 nt, Homo sapiens
cuuggcacacucucca

SEQ ID NO: 1018298 - RNA, 13 nt, Homo sapiens
cuugggacaaauc

SEQ ID NO: 1018299 - RNA, 19 nt, Homo sapiens
gaaaaaguuaaacauugaa

SEQ ID NO: 1018300 - RNA, 21 nt, Homo sapiens
gaaaaaucggcuuaccauuaa

SEQ ID NO: 1018301 - RNA, 20 nt, Homo sapiens
gaaaaauuaauuuacuagaa

SEQ ID NO: 1018302 - RNA, 20 nt, Homo sapiens
gaaaaauuccuauugugauu

SEQ ID NO: 1018303 - RNA, 16 nt, Homo sapiens
gaaaacacugugcaca

SEQ ID NO: 1018304 - RNA, 14 nt, Homo sapiens
gaaaacaucuggaa

SEQ ID NO: 1018305 - RNA, 21 nt, Homo sapiens
gaaaacaugcuacacacugca

SEQ ID NO: 1018306 - RNA, 13 nt, Homo sapiens
gaaaaccaucaca

SEQ ID NO: 1018307 - RNA, 19 nt, Homo sapiens
gaaaacgguggaggccagg

SEQ ID NO: 1018308 - RNA, 15 nt, Homo sapiens
gaaaacuaagucaga

SEQ ID NO: 1018309 - RNA, 18 nt, Homo sapiens
gaaaacuacaagccacga

SEQ ID NO: 1018310 - RNA, 15 nt, Homo sapiens
gaaaacugcaacuug

SEQ ID NO: 1018311 - RNA, 19 nt, Homo sapiens
gaaaacuuagagagguaca

SEQ ID NO: 1018312 - RNA, 21 nt, Homo sapiens
gaaaagaaaccagagucaaau

SEQ ID NO: 1018313 - RNA, 23 nt, Homo sapiens
gaaaagaacacuagagucuguca

SEQ ID NO: 1018314 - RNA, 16 nt, Homo sapiens
gaaaagauugggucua

SEQ ID NO: 1018315 - RNA, 16 nt, Homo sapiens
gaaaaggauaugcagu

SEQ ID NO: 1018316 - RNA, 16 nt, Homo sapiens
gaaaagggucuuggga

SEQ ID NO: 1018317 - RNA, 15 nt, Homo sapiens
gaaaaguaagcccuu

SEQ ID NO: 1018318 - RNA, 16 nt, Homo sapiens
gaaaaguacauuuaau

SEQ ID NO: 1018319 - RNA, 14 nt, Homo sapiens
gaaaagucuacccc

SEQ ID NO: 1018320 - RNA, 19 nt, Homo sapiens
gaaaauaaaauuuaacuca

SEQ ID NO: 1018321 - RNA, 13 nt, Homo sapiens
gauggugcugacc

SEQ ID NO: 1018322 - RNA, 15 nt, Homo sapiens
gauguagucaguuag

SEQ ID NO: 1018323 - RNA, 16 nt, Homo sapiens
gaugucaacugaccua

SEQ ID NO: 1018324 - RNA, 13 nt, Homo sapiens
gaugucaucuucc

SEQ ID NO: 1018325 - RNA, 20 nt, Homo sapiens
gauguccagaagaauauuca

SEQ ID NO: 1018326 - RNA, 13 nt, Homo sapiens
gcacccucuccag

SEQ ID NO: 1018327 - RNA, 14 nt, Homo sapiens
gcacccucuccaga

SEQ ID NO: 1018328 - RNA, 20 nt, Homo sapiens
gcacccuucccccagcacca

SEQ ID NO: 1018329 - RNA, 17 nt, Homo sapiens
gcacccuucuuuccucu

SEQ ID NO: 1018330 - RNA, 20 nt, Homo sapiens
gcaccucugaccuaucacuu

SEQ ID NO: 1018331 - RNA, 22 nt, Homo sapiens
gcaccuggcuaguuucuaacau

SEQ ID NO: 1018332 - RNA, 18 nt, Homo sapiens
gcaccuuaccaacuuucu

SEQ ID NO: 1018333 - RNA, 19 nt, Homo sapiens
gcaccuucccucucaccau

SEQ ID NO: 1018334 - RNA, 15 nt, Homo sapiens
gcacgaacaccaagu

SEQ ID NO: 1018335 - RNA, 19 nt, Homo sapiens
gcacgggcccgugacaucc

SEQ ID NO: 1018336 - RNA, 12 nt, Homo sapiens
gcacgugucuca

SEQ ID NO: 1018337 - RNA, 20 nt, Homo sapiens
gccgaaaaggauaugcagua

SEQ ID NO: 1018338 - RNA, 13 nt, Homo sapiens
gccgaaugugcag

SEQ ID NO: 1018339 - RNA, 14 nt, Homo sapiens
gccgaaugugcagg

SEQ ID NO: 1018340 - RNA, 17 nt, Homo sapiens
gccgacuccacuuucau

SEQ ID NO: 1018341 - RNA, 21 nt, Homo sapiens
gccgagauugcaccacugcac

SEQ ID NO: 1018342 - RNA, 19 nt, Homo sapiens
gccgagucugucucuguca

SEQ ID NO: 1018343 - RNA, 16 nt, Homo sapiens
gccgggcugacugccc

SEQ ID NO: 1018344 - RNA, 12 nt, Homo sapiens
gccggguacuga

SEQ ID NO: 1018345 - RNA, 14 nt, Homo sapiens
gccggucacugcag

SEQ ID NO: 1018346 - RNA, 21 nt, Homo sapiens
gccgucacuugugggggucca

SEQ ID NO: 1018347 - RNA, 23 nt, Homo sapiens
gccgucaucgcgccacuaagcca

SEQ ID NO: 1018348 - RNA, 20 nt, Homo sapiens
gccgugauuuucauugcugg

SEQ ID NO: 1018349 - RNA, 23 nt, Homo sapiens
gccuaaaaguuacuuaccacaga

SEQ ID NO: 1018350 - RNA, 14 nt, Homo sapiens
gccuacuccaaaau

SEQ ID NO: 1018351 - RNA, 19 nt, Homo sapiens
gccuaugcacauauggacu

SEQ ID NO: 1018352 - RNA, 19 nt, Homo sapiens
gccucaagaugaaggcaaa

SEQ ID NO: 1018353 - RNA, 19 nt, Homo sapiens
gccucaaugugaccagggg

SEQ ID NO: 1018354 - RNA, 23 nt, Homo sapiens
gccucacuuaugagaugccugaa

SEQ ID NO: 1018355 - RNA, 19 nt, Homo sapiens
gccucaguaagacgacaag

SEQ ID NO: 1018356 - RNA, 13 nt, Homo sapiens
gccucagugccac

SEQ ID NO: 1018357 - RNA, 13 nt, Homo sapiens
gccucaucuucaa

SEQ ID NO: 1018358 - RNA, 22 nt, Homo sapiens
gccucauuauuuuucacugccc

SEQ ID NO: 1018359 - RNA, 15 nt, Homo sapiens
gccucauugauguca

SEQ ID NO: 1018360 - RNA, 14 nt, Homo sapiens
gccucauugcuugg

SEQ ID NO: 1018361 - RNA, 21 nt, Homo sapiens
gccuccaccccccagaaccug

SEQ ID NO: 1018362 - RNA, 17 nt, Homo sapiens
gccuccagcuucaggca

SEQ ID NO: 1018363 - RNA, 21 nt, Homo sapiens
gccuccaucucauguaucauc

SEQ ID NO: 1018364 - RNA, 14 nt, Homo sapiens
gccuccaugcugcc

SEQ ID NO: 1018365 - RNA, 20 nt, Homo sapiens
gccuccauucugaccauuuc

SEQ ID NO: 1018366 - RNA, 19 nt, Homo sapiens
gccucccacccgaugcugc

SEQ ID NO: 1018367 - RNA, 18 nt, Homo sapiens
gccucccacuggggucca

SEQ ID NO: 1018368 - RNA, 21 nt, Homo sapiens
gccuccgccucaguaagacga

SEQ ID NO: 1018369 - RNA, 21 nt, Homo sapiens
gccuccucacccaccucuuca

SEQ ID NO: 1018370 - RNA, 19 nt, Homo sapiens
gccuccucuacaauuugcc

SEQ ID NO: 1018371 - RNA, 21 nt, Homo sapiens
gccuccucuguccagggcccu

SEQ ID NO: 1018372 - RNA, 16 nt, Homo sapiens
gccuccugucccucau

SEQ ID NO: 1018373 - RNA, 18 nt, Homo sapiens
gccuccuuuugcuugaaa

SEQ ID NO: 1018374 - RNA, 9 nt, Homo sapiens
gccucggga

SEQ ID NO: 1018375 - RNA, 15 nt, Homo sapiens
gccucucuguuugua

SEQ ID NO: 1018376 - RNA, 15 nt, Homo sapiens
gccucuggcucucau

SEQ ID NO: 1018377 - RNA, 16 nt, Homo sapiens
gccucugggaggccag

SEQ ID NO: 1018378 - RNA, 19 nt, Homo sapiens
gccucuuccucccucauuc

SEQ ID NO: 1018379 - RNA, 23 nt, Homo sapiens
gccucuuugugugcgucacugug

SEQ ID NO: 1018380 - RNA, 17 nt, Homo sapiens
gccugaagaacaguaac

SEQ ID NO: 1018381 - RNA, 17 nt, Homo sapiens
gccugaagccaggccau

SEQ ID NO: 1018382 - RNA, 21 nt, Homo sapiens
gccugaggucaggaguucaag

SEQ ID NO: 1018383 - RNA, 18 nt, Homo sapiens
gccugaugcucccucccc

SEQ ID NO: 1018384 - RNA, 22 nt, Homo sapiens
gccugcaaacucacugcucaag

SEQ ID NO: 1018385 - RNA, 23 nt, Homo sapiens
gccugccccaaacaaauaugcaa

SEQ ID NO: 1018386 - RNA, 23 nt, Homo sapiens
gccugcccuccccagagcacugg

SEQ ID NO: 1018387 - RNA, 20 nt, Homo sapiens
gccugcggaccagaugaaug

SEQ ID NO: 1018388 - RNA, 14 nt, Homo sapiens
gccuggacccugug

SEQ ID NO: 1018389 - RNA, 19 nt, Homo sapiens
gccuggcaagugggugaaa

SEQ ID NO: 1018390 - RNA, 20 nt, Homo sapiens
gccuggccaacauggugaaa

SEQ ID NO: 1018391 - RNA, 17 nt, Homo sapiens
gccuggccagcacccca

SEQ ID NO: 1018392 - RNA, 20 nt, Homo sapiens
gccuggccaggagcucuuca

SEQ ID NO: 1018393 - RNA, 21 nt, Homo sapiens
gccugggaccucccacugccc

SEQ ID NO: 1018394 - RNA, 15 nt, Homo sapiens
gccugggcauccuca

SEQ ID NO: 1018395 - RNA, 21 nt, Homo sapiens
gccugggcucccuugugcgug

SEQ ID NO: 1018396 - RNA, 18 nt, Homo sapiens
gccugggcuguggacaga

SEQ ID NO: 1018397 - RNA, 21 nt, Homo sapiens
gccugggcuguuggcacucac

SEQ ID NO: 1018398 - RNA, 14 nt, Homo sapiens
gccuggugcagugg

SEQ ID NO: 1018399 - RNA, 19 nt, Homo sapiens
gccuguaaucccagcacuu

SEQ ID NO: 1018400 - RNA, 22 nt, Homo sapiens
gccuguaaucccagcacuuugg

SEQ ID NO: 1018401 - RNA, 22 nt, Homo sapiens
gccuguagaugacauggugaaa

SEQ ID NO: 1018402 - RNA, 17 nt, Homo sapiens
gccugucuccuuugcag

SEQ ID NO: 1018403 - RNA, 14 nt, Homo sapiens
gccugucuuuccca

SEQ ID NO: 1018404 - RNA, 13 nt, Homo sapiens
gccugugcaugua

SEQ ID NO: 1018405 - RNA, 12 nt, Homo sapiens
gccugugccuuu

SEQ ID NO: 1018406 - RNA, 11 nt, Homo sapiens
gccuguggcau

SEQ ID NO: 1018407 - RNA, 17 nt, Homo sapiens
gccugugucccaugacc

SEQ ID NO: 1018408 - RNA, 15 nt, Homo sapiens
gccuuauuggcagcu

SEQ ID NO: 1018409 - RNA, 13 nt, Homo sapiens
gccuucaaacucc

SEQ ID NO: 1018410 - RNA, 15 nt, Homo sapiens
gccuuccacaauuca

SEQ ID NO: 1018411 - RNA, 20 nt, Homo sapiens
gccuuccauaauuaugacag

SEQ ID NO: 1018412 - RNA, 21 nt, Homo sapiens
gccuucccuaaaaucagggaa

SEQ ID NO: 1018413 - RNA, 16 nt, Homo sapiens
gccuucuccacuuugg

SEQ ID NO: 1018414 - RNA, 23 nt, Homo sapiens
gccuucuccagacaaaccagaag

SEQ ID NO: 1018415 - RNA, 15 nt, Homo sapiens
gccuugugucuacag

SEQ ID NO: 1018416 - RNA, 21 nt, Homo sapiens
gccuuuaguuuuaacaguuca

SEQ ID NO: 1018417 - RNA, 23 nt, Homo sapiens
gccuuugcuccucccauguuaug

SEQ ID NO: 1018418 - RNA, 20 nt, Homo sapiens
gcgaaaccccaucucuacua

SEQ ID NO: 1018419 - RNA, 18 nt, Homo sapiens
gcgaaggggcccuggucc

SEQ ID NO: 1018420 - RNA, 19 nt, Homo sapiens
gcgaggacauucucugacc

SEQ ID NO: 1018421 - RNA, 20 nt, Homo sapiens
gcgaucuggguucacugcaa

SEQ ID NO: 1018422 - RNA, 11 nt, Homo sapiens
gcgaugugcaa

SEQ ID NO: 1018423 - RNA, 20 nt, Homo sapiens
gcgcacagcaugagaggcuc

SEQ ID NO: 1018424 - RNA, 13 nt, Homo sapiens
gcgcacugcauuc

SEQ ID NO: 1018425 - RNA, 14 nt, Homo sapiens
gcgcaucaggccug

SEQ ID NO: 1018426 - RNA, 18 nt, Homo sapiens
gcgcaugugcgcacacac

SEQ ID NO: 1018427 - RNA, 22 nt, Homo sapiens
gcgccagccugucccauggaca

SEQ ID NO: 1018428 - RNA, 19 nt, Homo sapiens
gcgcccaguccuuccaccu

SEQ ID NO: 1018429 - RNA, 17 nt, Homo sapiens
gcgccuccuuccuugcu

SEQ ID NO: 1018430 - RNA, 22 nt, Homo sapiens
gcgccugacauucacacagaga

SEQ ID NO: 1018431 - RNA, 16 nt, Homo sapiens
gcgcugcaaagccaua

SEQ ID NO: 1018432 - RNA, 15 nt, Homo sapiens
gcggagaguacagug

SEQ ID NO: 1018433 - RNA, 19 nt, Homo sapiens
gcggccaugauggugcuga

SEQ ID NO: 1018434 - RNA, 11 nt, Homo sapiens
gcgggggcuug

SEQ ID NO: 1018435 - RNA, 15 nt, Homo sapiens
gcggucaauuugccu

SEQ ID NO: 1018436 - RNA, 18 nt, Homo sapiens
gcgucccagucucuggca

SEQ ID NO: 1018437 - RNA, 12 nt, Homo sapiens
gcgugacaauaa

SEQ ID NO: 1018438 - RNA, 12 nt, Homo sapiens
gcgugcaugugc

SEQ ID NO: 1018439 - RNA, 20 nt, Homo sapiens
gcguggacucugcacauguc

SEQ ID NO: 1018440 - RNA, 17 nt, Homo sapiens
gcguggcauagcccaga

SEQ ID NO: 1018441 - RNA, 17 nt, Homo sapiens
gcgugggagacgguggg

SEQ ID NO: 1018442 - RNA, 18 nt, Homo sapiens
gcgugucccucucggaag

SEQ ID NO: 1018443 - RNA, 21 nt, Homo sapiens
gcgugugcgugcaugugcacu

SEQ ID NO: 1018444 - RNA, 20 nt, Homo sapiens
gcuaaaauuagaugaacuca

SEQ ID NO: 1018445 - RNA, 12 nt, Homo sapiens
gcuaaauuccac

SEQ ID NO: 1018446 - RNA, 21 nt, Homo sapiens
gcuaacuuggagccccagugc

SEQ ID NO: 1018447 - RNA, 21 nt, Homo sapiens
gcuaagauagaggggcucugg

SEQ ID NO: 1018448 - RNA, 20 nt, Homo sapiens
gcuaaguugcaccaacuuug

SEQ ID NO: 1018449 - RNA, 20 nt, Homo sapiens
gcuaaucauuaagguauuau

SEQ ID NO: 1018450 - RNA, 20 nt, Homo sapiens
gcuaauugcacguguguauu

SEQ ID NO: 1018451 - RNA, 16 nt, Homo sapiens
gcuacaaaaacacagc

SEQ ID NO: 1018452 - RNA, 17 nt, Homo sapiens
gcuacaaagaagacaug

SEQ ID NO: 1018453 - RNA, 14 nt, Homo sapiens
gcuacacugacacu

SEQ ID NO: 1018454 - RNA, 21 nt, Homo sapiens
gcuacuuuauuuauacacugu

SEQ ID NO: 1018455 - RNA, 20 nt, Homo sapiens
gcuagaaauaagcccaacag

SEQ ID NO: 1018456 - RNA, 11 nt, Homo sapiens
gcuagaaccug

SEQ ID NO: 1018457 - RNA, 22 nt, Homo sapiens
gcuagacaagcuuguccaugua

SEQ ID NO: 1018458 - RNA, 17 nt, Homo sapiens
gcuagaguucuccagac

SEQ ID NO: 1018459 - RNA, 18 nt, Homo sapiens
gcuaggaacacuccuuca

SEQ ID NO: 1018460 - RNA, 22 nt, Homo sapiens
gcuaggcaugguggacucgccu

SEQ ID NO: 1018461 - RNA, 14 nt, Homo sapiens
gcuagggagugguc

SEQ ID NO: 1018462 - RNA, 15 nt, Homo sapiens
gcuagggaguggucu

SEQ ID NO: 1018463 - RNA, 15 nt, Homo sapiens
gcuaguuugaccuca

SEQ ID NO: 1018464 - RNA, 17 nt, Homo sapiens
gcuauauccauguacug

SEQ ID NO: 1018465 - RNA, 16 nt, Homo sapiens
gcuaucacacaguggg

SEQ ID NO: 1018466 - RNA, 15 nt, Homo sapiens
gcuauccaaauaacu

SEQ ID NO: 1018467 - RNA, 15 nt, Homo sapiens
gcuaucucucaguga

SEQ ID NO: 1018468 - RNA, 19 nt, Homo sapiens
gcuauucccuggggcugcu

SEQ ID NO: 1018469 - RNA, 14 nt, Homo sapiens
gcucaaccauggcu

SEQ ID NO: 1018470 - RNA, 19 nt, Homo sapiens
gcucaaugacucucuggug

SEQ ID NO: 1018471 - RNA, 18 nt, Homo sapiens
gcucaccagccccagugc

SEQ ID NO: 1018472 - RNA, 16 nt, Homo sapiens
gcucacggcacgcuug

SEQ ID NO: 1018473 - RNA, 12 nt, Homo sapiens
gcucacgugugu

SEQ ID NO: 1018474 - RNA, 20 nt, Homo sapiens
gcucacuaagaagcuugaau

SEQ ID NO: 1018475 - RNA, 13 nt, Homo sapiens
gcucacuaugaau

SEQ ID NO: 1018476 - RNA, 13 nt, Homo sapiens
gcucacuguucua

SEQ ID NO: 1018477 - RNA, 14 nt, Homo sapiens
gcucagaccagcuc

SEQ ID NO: 1018478 - RNA, 22 nt, Homo sapiens
gcucagcaaaagaugcuucuca

SEQ ID NO: 1018479 - RNA, 19 nt, Homo sapiens
gcucagcggggacagcucc

SEQ ID NO: 1018480 - RNA, 14 nt, Homo sapiens
gcucaucacuggau

SEQ ID NO: 1018481 - RNA, 20 nt, Homo sapiens
gcucaugucuauaaucccag

SEQ ID NO: 1018482 - RNA, 13 nt, Homo sapiens
gcuccaaacccuc

SEQ ID NO: 1018483 - RNA, 11 nt, Homo sapiens
gcuccacugaa

SEQ ID NO: 1018484 - RNA, 13 nt, Homo sapiens
gcuccacugggau

SEQ ID NO: 1018485 - RNA, 22 nt, Homo sapiens
gcuccacuuucagugaaagcau

SEQ ID NO: 1018486 - RNA, 14 nt, Homo sapiens
gcuccagaaauguc

SEQ ID NO: 1018487 - RNA, 21 nt, Homo sapiens
gcuccagcugcucugucuucu

SEQ ID NO: 1018488 - RNA, 15 nt, Homo sapiens
gcuccaggacucccu

SEQ ID NO: 1018489 - RNA, 19 nt, Homo sapiens
gcuccaguugucuauucau

SEQ ID NO: 1018490 - RNA, 20 nt, Homo sapiens
gcuccccuccucggcuuccu

SEQ ID NO: 1018491 - RNA, 19 nt, Homo sapiens
gcucccggagggcccugag

SEQ ID NO: 1018492 - RNA, 22 nt, Homo sapiens
gcucccucuuaacgcagcacuu

SEQ ID NO: 1018493 - RNA, 19 nt, Homo sapiens
gcucccucuuggucuuccc

SEQ ID NO: 1018494 - RNA, 24 nt, Homo sapiens
gcuccucacuuccucuucuucauu

SEQ ID NO: 1018495 - RNA, 12 nt, Homo sapiens
gcuccucaucca

SEQ ID NO: 1018496 - RNA, 22 nt, Homo sapiens
gcuccuguaucagcacuccuca

SEQ ID NO: 1018497 - RNA, 15 nt, Homo sapiens
gcuccugucugccag

SEQ ID NO: 1018498 - RNA, 17 nt, Homo sapiens
gcuccuuccugucuucc

SEQ ID NO: 1018499 - RNA, 19 nt, Homo sapiens
gcucuacccugaguucaua

SEQ ID NO: 1018500 - RNA, 20 nt, Homo sapiens
gcucuagagaaaagucuacc

SEQ ID NO: 1018501 - RNA, 19 nt, Homo sapiens
gcucucagaagguauuccu

SEQ ID NO: 1018502 - RNA, 14 nt, Homo sapiens
gcucucauugacuu

SEQ ID NO: 1018503 - RNA, 23 nt, Homo sapiens
gcucuccccaaacuugcuuuaug

SEQ ID NO: 1018504 - RNA, 21 nt, Homo sapiens
gcucuccccucagagugcaag

SEQ ID NO: 1018505 - RNA, 22 nt, Homo sapiens
gcucugcaaugggcacugggau

SEQ ID NO: 1018506 - RNA, 22 nt, Homo sapiens
gcucugcccugcccuagcucca

SEQ ID NO: 1018507 - RNA, 23 nt, Homo sapiens
ggcaauaaauauuagaagccugc

SEQ ID NO: 1018508 - RNA, 20 nt, Homo sapiens
ggcacacgccucccacuggg

SEQ ID NO: 1018509 - RNA, 20 nt, Homo sapiens
ggcacagccuucuccacugg

SEQ ID NO: 1018510 - RNA, 9 nt, Homo sapiens
ggcacauug

SEQ ID NO: 1018511 - RNA, 14 nt, Homo sapiens
ggcacccacccugg

SEQ ID NO: 1018512 - RNA, 21 nt, Homo sapiens
ggcacugaauuaaucaucuau

SEQ ID NO: 1018513 - RNA, 13 nt, Homo sapiens
ggcacugucucug

SEQ ID NO: 1018514 - RNA, 15 nt, Homo sapiens
ggcacuucauugaga

SEQ ID NO: 1018515 - RNA, 17 nt, Homo sapiens
ggcagaaaauugcacaa

SEQ ID NO: 1018516 - RNA, 17 nt, Homo sapiens
ggcagagguugugguga

SEQ ID NO: 1018517 - RNA, 18 nt, Homo sapiens
ggcagcauagcaagacac

SEQ ID NO: 1018518 - RNA, 16 nt, Homo sapiens
ggcagccacaacugca

SEQ ID NO: 1018519 - RNA, 18 nt, Homo sapiens
ggcagccacaacugcagu

SEQ ID NO: 1018520 - RNA, 16 nt, Homo sapiens
ggcagcuguugcagug

SEQ ID NO: 1018521 - RNA, 19 nt, Homo sapiens
ggcagcuguugcagugagc

SEQ ID NO: 1018522 - RNA, 16 nt, Homo sapiens
ggcaggaacuugcaca

SEQ ID NO: 1018523 - RNA, 15 nt, Homo sapiens
ggcaggaugggcacu

SEQ ID NO: 1018524 - RNA, 16 nt, Homo sapiens
ggcaggcuccaggccu

SEQ ID NO: 1018525 - RNA, 13 nt, Homo sapiens
ggcagggacaccc

SEQ ID NO: 1018526 - RNA, 21 nt, Homo sapiens
ggcagggcugaggccucucau

SEQ ID NO: 1018527 - RNA, 21 nt, Homo sapiens
ggcaggugccaugucugggaa

SEQ ID NO: 1018528 - RNA, 21 nt, Homo sapiens
ggcaguagacuauaagcagaa

SEQ ID NO: 1018529 - RNA, 15 nt, Homo sapiens
ggcaguauuaagugu

SEQ ID NO: 1018530 - RNA, 23 nt, Homo sapiens
ggcagugacagaacuaagaugau

SEQ ID NO: 1018531 - RNA, 23 nt, Homo sapiens
ggcagugaugcuggaugcuccuu

SEQ ID NO: 1018532 - RNA, 23 nt, Homo sapiens
ggcaucaccuccaccauacucca

SEQ ID NO: 1018533 - RNA, 14 nt, Homo sapiens
ggcaucuccaggaa

SEQ ID NO: 1018534 - RNA, 16 nt, Homo sapiens
ggcaucuccugugcau

SEQ ID NO: 1018535 - RNA, 19 nt, Homo sapiens
ggcaugccaaauguuccau

SEQ ID NO: 1018536 - RNA, 16 nt, Homo sapiens
ggcauggagccagugc

SEQ ID NO: 1018537 - RNA, 14 nt, Homo sapiens
ggcauucucugaag

SEQ ID NO: 1018538 - RNA, 16 nt, Homo sapiens
ggcauugcacagggag

SEQ ID NO: 1018539 - RNA, 21 nt, Homo sapiens
ggccaagaaagagucaggccu

SEQ ID NO: 1018540 - RNA, 19 nt, Homo sapiens
ggccaagcaauuccucuga

SEQ ID NO: 1018541 - RNA, 15 nt, Homo sapiens
ggccaaguuccucua

SEQ ID NO: 1018542 - RNA, 16 nt, Homo sapiens
ggccacgggucugugu

SEQ ID NO: 1018543 - RNA, 17 nt, Homo sapiens
ggccacuggccaucucc

SEQ ID NO: 1018544 - RNA, 19 nt, Homo sapiens
ggccacuggccaucuccac

SEQ ID NO: 1018545 - RNA, 15 nt, Homo sapiens
ggccagaagaucuac

SEQ ID NO: 1018546 - RNA, 17 nt, Homo sapiens
ggccaggcuggucucaa

SEQ ID NO: 1018547 - RNA, 20 nt, Homo sapiens
ggccagguacaacaccuuuu

SEQ ID NO: 1018548 - RNA, 23 nt, Homo sapiens
ggccaguauuuuuauuucuuuaa

SEQ ID NO: 1018549 - RNA, 18 nt, Homo sapiens
ggccaucugggcuucaca

SEQ ID NO: 1018550 - RNA, 16 nt, Homo sapiens
ggcccaagucccuguu

SEQ ID NO: 1018551 - RNA, 16 nt, Homo sapiens
ggcccaaugcacuuug

SEQ ID NO: 1018552 - RNA, 17 nt, Homo sapiens
ggcccacagcccagcga

SEQ ID NO: 1018553 - RNA, 17 nt, Homo sapiens
ggcccagagcaggaagc

SEQ ID NO: 1018554 - RNA, 17 nt, Homo sapiens
ggccccaguucaaucuc

SEQ ID NO: 1018555 - RNA, 14 nt, Homo sapiens
ggccccgucugugg

SEQ ID NO: 1018556 - RNA, 14 nt, Homo sapiens
ggccccucaggguc

SEQ ID NO: 1018557 - RNA, 17 nt, Homo sapiens
ggccccucaucugcuca

SEQ ID NO: 1018558 - RNA, 16 nt, Homo sapiens
ggccccugcccggcug

SEQ ID NO: 1018559 - RNA, 23 nt, Homo sapiens
ggcccgaggacgcucccugcucc

SEQ ID NO: 1018560 - RNA, 23 nt, Homo sapiens
ggcccgugacauccccacccuug

SEQ ID NO: 1018561 - RNA, 20 nt, Homo sapiens
ggcccucuugaaucucugaa

SEQ ID NO: 1018562 - RNA, 15 nt, Homo sapiens
ggcccugagcucggu

SEQ ID NO: 1018563 - RNA, 16 nt, Homo sapiens
ggcccugccuccuuug

SEQ ID NO: 1018564 - RNA, 19 nt, Homo sapiens
ggccgggugggcggcacag

SEQ ID NO: 1018565 - RNA, 12 nt, Homo sapiens
ggccucaaggga

SEQ ID NO: 1018566 - RNA, 10 nt, Homo sapiens
ggccucagaa

SEQ ID NO: 1018567 - RNA, 18 nt, Homo sapiens
ggccucccacagacucaa

SEQ ID NO: 1018568 - RNA, 12 nt, Homo sapiens
ggccucccucaa

SEQ ID NO: 1018569 - RNA, 18 nt, Homo sapiens
ggccucgaaaaccaucac

SEQ ID NO: 1018570 - RNA, 14 nt, Homo sapiens
ggccucugcaaagg

SEQ ID NO: 1018571 - RNA, 20 nt, Homo sapiens
ggccucuggcucucaugggg

SEQ ID NO: 1018572 - RNA, 14 nt, Homo sapiens
ggccugacucucag

SEQ ID NO: 1018573 - RNA, 16 nt, Homo sapiens
ggccugagccaagcua

SEQ ID NO: 1018574 - RNA, 17 nt, Homo sapiens
ggccugcccucagggau

SEQ ID NO: 1018575 - RNA, 23 nt, Homo sapiens
ggccugccuugaagccacugaag

SEQ ID NO: 1018576 - RNA, 16 nt, Homo sapiens
ggccuggagcaggccu

SEQ ID NO: 1018577 - RNA, 17 nt, Homo sapiens
ggccuggucguuuucaa

SEQ ID NO: 1018578 - RNA, 21 nt, Homo sapiens
ggccuguugaagaugcuugua

SEQ ID NO: 1018579 - RNA, 14 nt, Homo sapiens
ggccuuaaccauga

SEQ ID NO: 1018580 - RNA, 20 nt, Homo sapiens
ggcgacagagcgagacuccg

SEQ ID NO: 1018581 - RNA, 20 nt, Homo sapiens
ggcgacaguuuuccuucuca

SEQ ID NO: 1018582 - RNA, 22 nt, Homo sapiens
ggcgccccugccaccucccuga

SEQ ID NO: 1018583 - RNA, 17 nt, Homo sapiens
ggcggagcuugcaguga

SEQ ID NO: 1018584 - RNA, 16 nt, Homo sapiens
ggcgucccuaccuccu

SEQ ID NO: 1018585 - RNA, 16 nt, Homo sapiens
ggcguggggccaauac

SEQ ID NO: 1018586 - RNA, 22 nt, Homo sapiens
ggcguggggccaauacccagac

SEQ ID NO: 1018587 - RNA, 14 nt, Homo sapiens
ggcgugguggcaca

SEQ ID NO: 1018588 - RNA, 19 nt, Homo sapiens
ggcuaagcaaaaugugaua

SEQ ID NO: 1018589 - RNA, 16 nt, Homo sapiens
ggcuaaugaagaucau

SEQ ID NO: 1018590 - RNA, 16 nt, Homo sapiens
ggcuacacagggaugu

SEQ ID NO: 1018591 - RNA, 16 nt, Homo sapiens
ggcuagaacuggagag

SEQ ID NO: 1018592 - RNA, 16 nt, Homo sapiens
ggcuagugucuaucag

SEQ ID NO: 1018593 - RNA, 19 nt, Homo sapiens
ggcuauuuaaaacuuguaa

SEQ ID NO: 1018594 - RNA, 19 nt, Homo sapiens
ggcucaaacaacauuccac

SEQ ID NO: 1018595 - RNA, 17 nt, Homo sapiens
ggcucagaucucauggg

SEQ ID NO: 1018596 - RNA, 19 nt, Homo sapiens
ggcucagcggggacagcuc

SEQ ID NO: 1018597 - RNA, 11 nt, Homo sapiens
ggcucaucucu

SEQ ID NO: 1018598 - RNA, 20 nt, Homo sapiens
ggcuccagcaccauccgcca

SEQ ID NO: 1018599 - RNA, 13 nt, Homo sapiens
ggcucccucugcu

SEQ ID NO: 1018600 - RNA, 18 nt, Homo sapiens
ggcuccucugcuucucac

SEQ ID NO: 1018601 - RNA, 19 nt, Homo sapiens
ggcuccucugcuucucacg

SEQ ID NO: 1018602 - RNA, 18 nt, Homo sapiens
ggcuccugugcuacuuug

SEQ ID NO: 1018603 - RNA, 17 nt, Homo sapiens
ggcuccuucccaucgcu

SEQ ID NO: 1018604 - RNA, 21 nt, Homo sapiens
ggcucgccucaggaaugggcu

SEQ ID NO: 1018605 - RNA, 16 nt, Homo sapiens
ggcucucaacagggga

SEQ ID NO: 1018606 - RNA, 21 nt, Homo sapiens
ggcucugcaaugggcacuggg

SEQ ID NO: 1018607 - RNA, 19 nt, Homo sapiens
ggcucuucuaaucagagcg

SEQ ID NO: 1018608 - RNA, 19 nt, Homo sapiens
ggcucuucugacuacuggg

SEQ ID NO: 1018609 - RNA, 15 nt, Homo sapiens
ggcucuuuccuugcu

SEQ ID NO: 1018610 - RNA, 20 nt, Homo sapiens
gcucugcgccgagccucaga

SEQ ID NO: 1018611 - RNA, 20 nt, Homo sapiens
gcucuggaccaacccuguuu

SEQ ID NO: 1018612 - RNA, 16 nt, Homo sapiens
gcucuggaguccugcu

SEQ ID NO: 1018613 - RNA, 19 nt, Homo sapiens
gcucuggugacaccagccu

SEQ ID NO: 1018614 - RNA, 19 nt, Homo sapiens
gcucuuaggugcuucuuca

SEQ ID NO: 1018615 - RNA, 18 nt, Homo sapiens
gcucuucuaccauuugaa

SEQ ID NO: 1018616 - RNA, 19 nt, Homo sapiens
gcucuugggaagaccagcu

SEQ ID NO: 1018617 - RNA, 21 nt, Homo sapiens
gcucuuucaucucugcuugga

SEQ ID NO: 1018618 - RNA, 17 nt, Homo sapiens
gcucuuucccuuuauca

SEQ ID NO: 1018619 - RNA, 18 nt, Homo sapiens
gcucuuucccuuuaucag

SEQ ID NO: 1018620 - RNA, 22 nt, Homo sapiens
gcugaaaaaacaccuagcuuua

SEQ ID NO: 1018621 - RNA, 17 nt, Homo sapiens
gcugaaagaacauggac

SEQ ID NO: 1018622 - RNA, 22 nt, Homo sapiens
gcugaauuauuggacagucuca

SEQ ID NO: 1018623 - RNA, 20 nt, Homo sapiens
gcugaauugggagugagaug

SEQ ID NO: 1018624 - RNA, 18 nt, Homo sapiens
gcugacuagaagggccag

SEQ ID NO: 1018625 - RNA, 15 nt, Homo sapiens
gcugagagaaccuca

SEQ ID NO: 1018626 - RNA, 16 nt, Homo sapiens
gcugagagaaccucac

SEQ ID NO: 1018627 - RNA, 23 nt, Homo sapiens
gcugagauuacagacaugagccu

SEQ ID NO: 1018628 - RNA, 14 nt, Homo sapiens
gcugagauuccugg

SEQ ID NO: 1018629 - RNA, 21 nt, Homo sapiens
gcugagauugcaccacugcac

SEQ ID NO: 1018630 - RNA, 22 nt, Homo sapiens
gcugaggccucucauuccagag

SEQ ID NO: 1018631 - RNA, 19 nt, Homo sapiens
gcugagugcaccacuucaa

SEQ ID NO: 1018632 - RNA, 19 nt, Homo sapiens
gcugaucacagacaccagc

SEQ ID NO: 1018633 - RNA, 19 nt, Homo sapiens
gcugauccagagcacagau

SEQ ID NO: 1018634 - RNA, 21 nt, Homo sapiens
gcugaugaacucuuaaucaaa

SEQ ID NO: 1018635 - RNA, 14 nt, Homo sapiens
gcugcaaagccaua

SEQ ID NO: 1018636 - RNA, 17 nt, Homo sapiens
gcugcacccacccagga

SEQ ID NO: 1018637 - RNA, 21 nt, Homo sapiens
gcugcagcagaggcacugggg

SEQ ID NO: 1018638 - RNA, 17 nt, Homo sapiens
gcugcauacaguuugca

SEQ ID NO: 1018639 - RNA, 15 nt, Homo sapiens
gcugccauccucacc

SEQ ID NO: 1018640 - RNA, 22 nt, Homo sapiens
gcugccccaaccugcugaaggg

SEQ ID NO: 1018641 - RNA, 22 nt, Homo sapiens
gcugcccuccuuguccacccac

SEQ ID NO: 1018642 - RNA, 20 nt, Homo sapiens
gcugccucuugaaugcaggg

SEQ ID NO: 1018643 - RNA, 13 nt, Homo sapiens
gcugcucagggaa

SEQ ID NO: 1018644 - RNA, 16 nt, Homo sapiens
gcugcuccagugcagg

SEQ ID NO: 1018645 - RNA, 14 nt, Homo sapiens
gcugcucuggaaaa

SEQ ID NO: 1018646 - RNA, 22 nt, Homo sapiens
gcugcugcgcugcaaagccaua

SEQ ID NO: 1018647 - RNA, 14 nt, Homo sapiens
gcugcugugcacau

SEQ ID NO: 1018648 - RNA, 17 nt, Homo sapiens
gcugcuuagacauaaca

SEQ ID NO: 1018649 - RNA, 19 nt, Homo sapiens
gcugcuuagacauaacaaa

SEQ ID NO: 1018650 - RNA, 21 nt, Homo sapiens
gcugcuucuguguguggugag

SEQ ID NO: 1018651 - RNA, 19 nt, Homo sapiens
gcugcuuucuguugucauu

SEQ ID NO: 1018652 - RNA, 20 nt, Homo sapiens
gcuggaaaagggucuuggga

SEQ ID NO: 1018653 - RNA, 23 nt, Homo sapiens
gcuggagagguuaaggugcaaua

SEQ ID NO: 1018654 - RNA, 16 nt, Homo sapiens
gcuggagauguuuuag

SEQ ID NO: 1018655 - RNA, 19 nt, Homo sapiens
gcuggagccuggugcccua

SEQ ID NO: 1018656 - RNA, 19 nt, Homo sapiens
gcuggaguacagugacacg

SEQ ID NO: 1018657 - RNA, 12 nt, Homo sapiens
gcuggagugcaa

SEQ ID NO: 1018658 - RNA, 13 nt, Homo sapiens
gcuggagugcagu

SEQ ID NO: 1018659 - RNA, 14 nt, Homo sapiens
gcuggagugcagug

SEQ ID NO: 1018660 - RNA, 16 nt, Homo sapiens
gcuggcagaaagcaaa

SEQ ID NO: 1018661 - RNA, 21 nt, Homo sapiens
gcuggccuccuaugccucauc

SEQ ID NO: 1018662 - RNA, 18 nt, Homo sapiens
gcuggccucuggcucuca

SEQ ID NO: 1018663 - RNA, 13 nt, Homo sapiens
gcuggcuugcagu

SEQ ID NO: 1018664 - RNA, 22 nt, Homo sapiens
gcugggaagacgccugagcuca

SEQ ID NO: 1018665 - RNA, 20 nt, Homo sapiens
gcugggaggcaagaggggug

SEQ ID NO: 1018666 - RNA, 13 nt, Homo sapiens
gcugggauuacag

SEQ ID NO: 1018667 - RNA, 16 nt, Homo sapiens
gcugggauuuacacuu

SEQ ID NO: 1018668 - RNA, 14 nt, Homo sapiens
gcugggcucugcca

SEQ ID NO: 1018669 - RNA, 15 nt, Homo sapiens
gcuggguccagggga

SEQ ID NO: 1018670 - RNA, 13 nt, Homo sapiens
gcuggguuuacac

SEQ ID NO: 1018671 - RNA, 17 nt, Homo sapiens
gcugguugagguuucaa

SEQ ID NO: 1018672 - RNA, 18 nt, Homo sapiens
gcugguuuggaaugcuuc

SEQ ID NO: 1018673 - RNA, 14 nt, Homo sapiens
gcuguagaagaugg

SEQ ID NO: 1018674 - RNA, 19 nt, Homo sapiens
gcuguagacauuugcuaug

SEQ ID NO: 1018675 - RNA, 17 nt, Homo sapiens
gcuguauccauccaugg

SEQ ID NO: 1018676 - RNA, 15 nt, Homo sapiens
gcugucuuucacuga

SEQ ID NO: 1018677 - RNA, 18 nt, Homo sapiens
gcugugaaagaaccaaaa

SEQ ID NO: 1018678 - RNA, 22 nt, Homo sapiens
gcugugcccaaguuguggugcu

SEQ ID NO: 1018679 - RNA, 23 nt, Homo sapiens
gcuguucauguuacucaugacuc

SEQ ID NO: 1018680 - RNA, 20 nt, Homo sapiens
gcuguuuccauagggugaca

SEQ ID NO: 1018681 - RNA, 16 nt, Homo sapiens
gcuguuugaaaugcca

SEQ ID NO: 1018682 - RNA, 21 nt, Homo sapiens
gcuguuuugauuuguacugaa

SEQ ID NO: 1018683 - RNA, 18 nt, Homo sapiens
gcuuaaaacaacacucac

SEQ ID NO: 1018684 - RNA, 20 nt, Homo sapiens
gcuuaaaggggcuagaguga

SEQ ID NO: 1018685 - RNA, 20 nt, Homo sapiens
gcuuaacccauggauccuga

SEQ ID NO: 1018686 - RNA, 15 nt, Homo sapiens
gcuuaacccuggaaa

SEQ ID NO: 1018687 - RNA, 17 nt, Homo sapiens
gcuuaaugcuucuuuca

SEQ ID NO: 1018688 - RNA, 20 nt, Homo sapiens
gcuuagacuucgacucagga

SEQ ID NO: 1018689 - RNA, 18 nt, Homo sapiens
gcuuagccuccugaccug

SEQ ID NO: 1018690 - RNA, 15 nt, Homo sapiens
gcuucaauacccaaa

SEQ ID NO: 1018691 - RNA, 19 nt, Homo sapiens
gcuucacagaugugugauu

SEQ ID NO: 1018692 - RNA, 22 nt, Homo sapiens
gcuucacugguugaguguugcu

SEQ ID NO: 1018693 - RNA, 14 nt, Homo sapiens
gcuucacuguauaa

SEQ ID NO: 1018694 - RNA, 15 nt, Homo sapiens
gcuucaguggcagcu

SEQ ID NO: 1018695 - RNA, 21 nt, Homo sapiens
gcuucauaaaugaagcagcuu

SEQ ID NO: 1018696 - RNA, 23 nt, Homo sapiens
gcuucauaaaugaagcagcuuua

SEQ ID NO: 1018697 - RNA, 20 nt, Homo sapiens
gcuucauauaccagcaauau

SEQ ID NO: 1018698 - RNA, 16 nt, Homo sapiens
gcuucaucugucaagu

SEQ ID NO: 1018699 - RNA, 16 nt, Homo sapiens
gcuuccagaaaacccc

SEQ ID NO: 1018700 - RNA, 22 nt, Homo sapiens
gcuuccauuugugugugugcaa

SEQ ID NO: 1018701 - RNA, 16 nt, Homo sapiens
gcuuccgacaccucug

SEQ ID NO: 1018702 - RNA, 17 nt, Homo sapiens
gcuuccgccgucucaac

SEQ ID NO: 1018703 - RNA, 12 nt, Homo sapiens
gcuuccuaacug

SEQ ID NO: 1018704 - RNA, 22 nt, Homo sapiens
gcuucucacugccaugccagcu

SEQ ID NO: 1018705 - RNA, 20 nt, Homo sapiens
gcuucugaaugcugcuacuu

SEQ ID NO: 1018706 - RNA, 11 nt, Homo sapiens
gcuucugccau

SEQ ID NO: 1018707 - RNA, 16 nt, Homo sapiens
gcuucuggagcccuug

SEQ ID NO: 1018708 - RNA, 14 nt, Homo sapiens
gcuucuucucaggc

SEQ ID NO: 1018709 - RNA, 15 nt, Homo sapiens
gcuucuuucauuuuc

SEQ ID NO: 1018710 - RNA, 13 nt, Homo sapiens
gcuucuuuucacu

SEQ ID NO: 1018711 - RNA, 19 nt, Homo sapiens
gcuugaaaaggugaccuug

SEQ ID NO: 1018712 - RNA, 15 nt, Homo sapiens
gcuugagcccaggag

SEQ ID NO: 1018713 - RNA, 20 nt, Homo sapiens
gcuugaucaauucccuugaa

SEQ ID NO: 1018714 - RNA, 16 nt, Homo sapiens
gcuugcaagauuccaa

SEQ ID NO: 1018715 - RNA, 19 nt, Homo sapiens
gcuugcgcauucucaugga

SEQ ID NO: 1018716 - RNA, 17 nt, Homo sapiens
gcuugcugcucaucuga

SEQ ID NO: 1018717 - RNA, 23 nt, Homo sapiens
gcuuggcucccucugcugaucuc

SEQ ID NO: 1018718 - RNA, 13 nt, Homo sapiens
gcuuggcugugcc

SEQ ID NO: 1018719 - RNA, 14 nt, Homo sapiens
gcuuguguguuuca

SEQ ID NO: 1018720 - RNA, 16 nt, Homo sapiens
gcuuguuuacagcacu

SEQ ID NO: 1018721 - RNA, 19 nt, Homo sapiens
gcuuuaaaacuuauccucc

SEQ ID NO: 1018722 - RNA, 13 nt, Homo sapiens
gcuuuaccuuuau

SEQ ID NO: 1018723 - RNA, 14 nt, Homo sapiens
gcuuucaguauuag

SEQ ID NO: 1018724 - RNA, 20 nt, Homo sapiens
uugcuaaucagugucucaca

SEQ ID NO: 1018725 - RNA, 14 nt, Homo sapiens
uugcuaugaagcgu

SEQ ID NO: 1018726 - RNA, 14 nt, Homo sapiens
uugcuccuugacau

SEQ ID NO: 1018727 - RNA, 13 nt, Homo sapiens
uugcucuccuaga

SEQ ID NO: 1018728 - RNA, 15 nt, Homo sapiens
uugcuggcaaagaca

SEQ ID NO: 1018729 - RNA, 16 nt, Homo sapiens
uugcuggcaaagacag

SEQ ID NO: 1018730 - RNA, 22 nt, Homo sapiens
uugcuuaacccacaguucucca

SEQ ID NO: 1018731 - RNA, 17 nt, Homo sapiens
uugcuucaaaccccagg

SEQ ID NO: 1018732 - RNA, 18 nt, Homo sapiens
uugcuugugccacacccu

SEQ ID NO: 1018733 - RNA, 12 nt, Homo sapiens
uugcuuuccacu

SEQ ID NO: 1018734 - RNA, 13 nt, Homo sapiens
uugcuuugcccag

SEQ ID NO: 1018735 - RNA, 17 nt, Homo sapiens
uuggaaaauaaaucaau

SEQ ID NO: 1018736 - RNA, 19 nt, Homo sapiens
uuggaaaggaccaguaugc

SEQ ID NO: 1018737 - RNA, 21 nt, Homo sapiens
uuggaacuuuuauuacugggg

SEQ ID NO: 1018738 - RNA, 19 nt, Homo sapiens
uuggaagggaaacuuucaa

SEQ ID NO: 1018739 - RNA, 14 nt, Homo sapiens
uuggaauacuaaaa

SEQ ID NO: 1018740 - RNA, 20 nt, Homo sapiens
uuggacaacugcauggagcu

SEQ ID NO: 1018741 - RNA, 16 nt, Homo sapiens
uuggacagaagcagcu

SEQ ID NO: 1018742 - RNA, 19 nt, Homo sapiens
uuggacauagcgaauacaa

SEQ ID NO: 1018743 - RNA, 16 nt, Homo sapiens
uuggaccauccuauuu

SEQ ID NO: 1018744 - RNA, 17 nt, Homo sapiens
uuggacccgcucuggac

SEQ ID NO: 1018745 - RNA, 21 nt, Homo sapiens
uuggacccgcucuggaccaac

SEQ ID NO: 1018746 - RNA, 16 nt, Homo sapiens
uuggacucuugcucuu

SEQ ID NO: 1018747 - RNA, 21 nt, Homo sapiens
uuggacugauaaucucuuuaa

SEQ ID NO: 1018748 - RNA, 16 nt, Homo sapiens
uuggacuugcauuccc

SEQ ID NO: 1018749 - RNA, 19 nt, Homo sapiens
uuggagcuuuuuucuuuaa

SEQ ID NO: 1018750 - RNA, 23 nt, Homo sapiens
uuggaggagcaaaggcugagaac

SEQ ID NO: 1018751 - RNA, 20 nt, Homo sapiens
uuggagggguauuuuugccc

SEQ ID NO: 1018752 - RNA, 16 nt, Homo sapiens
uuggaugcacuuuaua

SEQ ID NO: 1018753 - RNA, 15 nt, Homo sapiens
uuggcacugagauau

SEQ ID NO: 1018754 - RNA, 21 nt, Homo sapiens
uuggccuauuccauucuggau

SEQ ID NO: 1018755 - RNA, 14 nt, Homo sapiens
uuggccucugcccu

SEQ ID NO: 1018756 - RNA, 14 nt, Homo sapiens
uuggcgggccaagg

SEQ ID NO: 1018757 - RNA, 21 nt, Homo sapiens
uuggcgggggcuuggcugugc

SEQ ID NO: 1018758 - RNA, 22 nt, Homo sapiens
uuggcugugcccucagauuccg

SEQ ID NO: 1018759 - RNA, 14 nt, Homo sapiens
uuggcuucagggga

SEQ ID NO: 1018760 - RNA, 15 nt, Homo sapiens
uuggcuuccaugaug

SEQ ID NO: 1018761 - RNA, 13 nt, Homo sapiens
uuggcuuugccag

SEQ ID NO: 1018762 - RNA, 16 nt, Homo sapiens
uugggcaccugaccac

SEQ ID NO: 1018763 - RNA, 20 nt, Homo sapiens
uuggggaugagaaagguuga

SEQ ID NO: 1018764 - RNA, 22 nt, Homo sapiens
uuggguucacagaagcacagca

SEQ ID NO: 1018765 - RNA, 17 nt, Homo sapiens
uuggucugggacuuccu

SEQ ID NO: 1018766 - RNA, 23 nt, Homo sapiens
uuggugaggaaaagcggacauca

SEQ ID NO: 1018767 - RNA, 13 nt, Homo sapiens
uugguguucucau

SEQ ID NO: 1018768 - RNA, 20 nt, Homo sapiens
uugguuucuucaacaggaga

SEQ ID NO: 1018769 - RNA, 19 nt, Homo sapiens
uugguuugaguuucucuca

SEQ ID NO: 1018770 - RNA, 18 nt, Homo sapiens
uugguuuguugagccuaa

SEQ ID NO: 1018771 - RNA, 20 nt, Homo sapiens
uuguaacgaagacacagacu

SEQ ID NO: 1018772 - RNA, 21 nt, Homo sapiens
uuguaagaaaaugagacaaaa

SEQ ID NO: 1018773 - RNA, 20 nt, Homo sapiens
uuguaagaguggaaccaaca

SEQ ID NO: 1018774 - RNA, 15 nt, Homo sapiens
uuguaagaguguaga

SEQ ID NO: 1018775 - RNA, 15 nt, Homo sapiens
uuguacuaugcuguu

SEQ ID NO: 1018776 - RNA, 21 nt, Homo sapiens
uuguagagauggggucucaca

SEQ ID NO: 1018777 - RNA, 18 nt, Homo sapiens
uuguauagacaucugccc

SEQ ID NO: 1018778 - RNA, 21 nt, Homo sapiens
uuguauauuauuucuaggaag

SEQ ID NO: 1018779 - RNA, 19 nt, Homo sapiens
uuguauauugucagauauu

SEQ ID NO: 1018780 - RNA, 19 nt, Homo sapiens
uuguaucaacacuguuacu

SEQ ID NO: 1018781 - RNA, 15 nt, Homo sapiens
uuguaugagguuuga

SEQ ID NO: 1018782 - RNA, 19 nt, Homo sapiens
uuguaugucauuuccuuca

SEQ ID NO: 1018783 - RNA, 14 nt, Homo sapiens
uuguauuacuagaa

SEQ ID NO: 1018784 - RNA, 15 nt, Homo sapiens
uuguauugcauauau

SEQ ID NO: 1018785 - RNA, 16 nt, Homo sapiens
uuguauuuaccuucua

SEQ ID NO: 1018786 - RNA, 22 nt, Homo sapiens
uugucaacaaagucacccacuu

SEQ ID NO: 1018787 - RNA, 21 nt, Homo sapiens
uugucaauauuaaauacagac

SEQ ID NO: 1018788 - RNA, 15 nt, Homo sapiens
uugucagaacuagaa

SEQ ID NO: 1018789 - RNA, 19 nt, Homo sapiens
uugucagaguucugcucua

SEQ ID NO: 1018790 - RNA, 13 nt, Homo sapiens
uuguccacccacc

SEQ ID NO: 1018791 - RNA, 16 nt, Homo sapiens
uuguccccugccugug

SEQ ID NO: 1018792 - RNA, 14 nt, Homo sapiens
uugucuuugcugua

SEQ ID NO: 1018793 - RNA, 17 nt, Homo sapiens
uugugagggacugagau

SEQ ID NO: 1018794 - RNA, 18 nt, Homo sapiens
uugugaucuaucaauagu

SEQ ID NO: 1018795 - RNA, 12 nt, Homo sapiens
uugugcauuugg

SEQ ID NO: 1018796 - RNA, 14 nt, Homo sapiens
uugugccaauaugu

SEQ ID NO: 1018797 - RNA, 23 nt, Homo sapiens
uugugcuuaguccaauuccuugc

SEQ ID NO: 1018798 - RNA, 15 nt, Homo sapiens
uuguguccacuguga

SEQ ID NO: 1018799 - RNA, 14 nt, Homo sapiens
uugugugucacaag

SEQ ID NO: 1018800 - RNA, 17 nt, Homo sapiens
uugugugugggcuguga

SEQ ID NO: 1018801 - RNA, 17 nt, Homo sapiens
uuguuaagauaugaugu

SEQ ID NO: 1018802 - RNA, 14 nt, Homo sapiens
uuguuaagugcagu

SEQ ID NO: 1018803 - RNA, 14 nt, Homo sapiens
uuguuaaucaauca

SEQ ID NO: 1018804 - RNA, 21 nt, Homo sapiens
uuguuaguaugaggcauuugu

SEQ ID NO: 1018805 - RNA, 19 nt, Homo sapiens
uuguuaucuuccacuggaa

SEQ ID NO: 1018806 - RNA, 18 nt, Homo sapiens
uuguucagggcugugauc

SEQ ID NO: 1018807 - RNA, 20 nt, Homo sapiens
uuguucauuauuggagggua

SEQ ID NO: 1018808 - RNA, 21 nt, Homo sapiens
uuguucuuuaaagucaggucc

SEQ ID NO: 1018809 - RNA, 14 nt, Homo sapiens
uuguugcagccaaa

SEQ ID NO: 1018810 - RNA, 16 nt, Homo sapiens
uuguuggauaaaucag

SEQ ID NO: 1018811 - RNA, 12 nt, Homo sapiens
uuguuucuuaag

SEQ ID NO: 1018812 - RNA, 18 nt, Homo sapiens
uuguuuucauuaucucaa

SEQ ID NO: 1018813 - RNA, 21 nt, Homo sapiens
uuuaaaaaaaaauacugaugu

SEQ ID NO: 1018814 - RNA, 20 nt, Homo sapiens
uuuaaaaccugugugccauu

SEQ ID NO: 1018815 - RNA, 17 nt, Homo sapiens
uuuaaaaguuucaaugu

SEQ ID NO: 1018816 - RNA, 14 nt, Homo sapiens
uuuaaaaucuguca

SEQ ID NO: 1018817 - RNA, 14 nt, Homo sapiens
uuuaaaauugugau

SEQ ID NO: 1018818 - RNA, 12 nt, Homo sapiens
uuuaaacaaagg

SEQ ID NO: 1018819 - RNA, 22 nt, Homo sapiens
uuuaaacacggggcuugcaacu

SEQ ID NO: 1018820 - RNA, 21 nt, Homo sapiens
uuuaaacagugucauauacaa

SEQ ID NO: 1018821 - RNA, 11 nt, Homo sapiens
uuuaaagacag

SEQ ID NO: 1018822 - RNA, 12 nt, Homo sapiens
uuuaaagacaga

SEQ ID NO: 1018823 - RNA, 17 nt, Homo sapiens
uuuaaagagcauaauaa

SEQ ID NO: 1018824 - RNA, 15 nt, Homo sapiens
uuuaaagcacaugcc

SEQ ID NO: 1018825 - RNA, 17 nt, Homo sapiens
uuuaaagcuugcucaca

SEQ ID NO: 1018826 - RNA, 10 nt, Homo sapiens
uuuaaagggu

SEQ ID NO: 1018827 - RNA, 14 nt, Homo sapiens
uuuaaaucugugau

SEQ ID NO: 1018828 - RNA, 15 nt, Homo sapiens
uuuaaaucugugaug

SEQ ID NO: 1018829 - RNA, 16 nt, Homo sapiens
uuuaaaugcaccugga

SEQ ID NO: 1018830 - RNA, 15 nt, Homo sapiens
uuuaacaacuaugau

SEQ ID NO: 1018831 - RNA, 17 nt, Homo sapiens
uuuaacuuaacauucug

SEQ ID NO: 1018832 - RNA, 14 nt, Homo sapiens
uuuaaguaauuuca

SEQ ID NO: 1018833 - RNA, 19 nt, Homo sapiens
uuuaauacaggguagauaa

SEQ ID NO: 1018834 - RNA, 15 nt, Homo sapiens
uuuaaucuuccaugg

SEQ ID NO: 1018835 - RNA, 21 nt, Homo sapiens
uuuaaugcuccaaaugcugac

SEQ ID NO: 1018836 - RNA, 21 nt, Homo sapiens
uuuaauguagccaugggacca

SEQ ID NO: 1018837 - RNA, 18 nt, Homo sapiens
uuuaaugugcuguguaaa

SEQ ID NO: 1018838 - RNA, 16 nt, Homo sapiens
uuuaauguuuccuuua

SEQ ID NO: 1018839 - RNA, 17 nt, Homo sapiens
uuuaauguuuccuuuaa

SEQ ID NO: 1018840 - RNA, 19 nt, Homo sapiens
uuuaauuaaucaugaaugu

SEQ ID NO: 1018841 - RNA, 19 nt, Homo sapiens
uuuaauugugaauuagacu

SEQ ID NO: 1018842 - RNA, 16 nt, Homo sapiens
uuuaauuugauaguau

SEQ ID NO: 1018843 - RNA, 21 nt, Homo sapiens
uuuaauuuuguacaauaaccu

SEQ ID NO: 1018844 - RNA, 19 nt, Homo sapiens
uuuguagccacuucacuuu

SEQ ID NO: 1018845 - RNA, 16 nt, Homo sapiens
uuuguaucauuaugaa

SEQ ID NO: 1018846 - RNA, 16 nt, Homo sapiens
uuugugacuuuccuaa

SEQ ID NO: 1018847 - RNA, 17 nt, Homo sapiens
uuugugggaaauccaca

SEQ ID NO: 1018848 - RNA, 14 nt, Homo sapiens
uuuguguauucuuc

SEQ ID NO: 1018849 - RNA, 20 nt, Homo sapiens
uuuguguguaccugugacua

SEQ ID NO: 1018850 - RNA, 13 nt, Homo sapiens
uuuguuccaugag

SEQ ID NO: 1018851 - RNA, 13 nt, Homo sapiens
uuuguuguucuga

SEQ ID NO: 1018852 - RNA, 16 nt, Homo sapiens
uuuuaaaaguuauuaa

SEQ ID NO: 1018853 - RNA, 22 nt, Homo sapiens
uuuuaaacagugucauauacaa

SEQ ID NO: 1018854 - RNA, 23 nt, Homo sapiens
uuuuaaauaaaaauaaguguaca

SEQ ID NO: 1018855 - RNA, 17 nt, Homo sapiens
uuuuaacaacuaugauu

SEQ ID NO: 1018856 - RNA, 21 nt, Homo sapiens
uuuuaaccaguucugucuuca

SEQ ID NO: 1018857 - RNA, 12 nt, Homo sapiens
uuuuaauugauu

SEQ ID NO: 1018858 - RNA, 17 nt, Homo sapiens
uuuuaauuuuuugucaa

SEQ ID NO: 1018859 - RNA, 16 nt, Homo sapiens
uuuuacuacuguggaa

SEQ ID NO: 1018860 - RNA, 17 nt, Homo sapiens
uuuuacuucucuauaca

SEQ ID NO: 1018861 - RNA, 18 nt, Homo sapiens
uuuuacuucucuauacaa

SEQ ID NO: 1018862 - RNA, 13 nt, Homo sapiens
uuuuagacagagu

SEQ ID NO: 1018863 - RNA, 14 nt, Homo sapiens
uuuuagcuuuacaa

SEQ ID NO: 1018864 - RNA, 22 nt, Homo sapiens
uuuuaguauaaguacauuauug

SEQ ID NO: 1018865 - RNA, 20 nt, Homo sapiens
uuuuagucauuauagauccc

SEQ ID NO: 1018866 - RNA, 20 nt, Homo sapiens
uuuuagucuaauugaauccc

SEQ ID NO: 1018867 - RNA, 20 nt, Homo sapiens
uuuuauaaaauuaagcaaug

SEQ ID NO: 1018868 - RNA, 16 nt, Homo sapiens
uuuuauacaaaugucu

SEQ ID NO: 1018869 - RNA, 21 nt, Homo sapiens
uuuuauaccgcugcauaguau

SEQ ID NO: 1018870 - RNA, 21 nt, Homo sapiens
uuuuauaugcuuacugauaua

SEQ ID NO: 1018871 - RNA, 18 nt, Homo sapiens
uuuuauauuuauugugcu

SEQ ID NO: 1018872 - RNA, 20 nt, Homo sapiens
uuuuauggaggcuuugcaua

SEQ ID NO: 1018873 - RNA, 15 nt, Homo sapiens
uuuuauuaacauuga

SEQ ID NO: 1018874 - RNA, 16 nt, Homo sapiens
uuuuauuacacauuua

SEQ ID NO: 1018875 - RNA, 18 nt, Homo sapiens
uuuuauuuacauucuugc

SEQ ID NO: 1018876 - RNA, 23 nt, Homo sapiens
uuuucaauguuagccacagugua

SEQ ID NO: 1018877 - RNA, 22 nt, Homo sapiens
uuuucaauuuugcaugcucgau

SEQ ID NO: 1018878 - RNA, 12 nt, Homo sapiens
uuuucacuugua

SEQ ID NO: 1018879 - RNA, 18 nt, Homo sapiens
uuccuguauguuguccaa

SEQ ID NO: 1018880 - RNA, 14 nt, Homo sapiens
uuccuguccagaga

SEQ ID NO: 1018881 - RNA, 12 nt, Homo sapiens
uuccugugagcu

SEQ ID NO: 1018882 - RNA, 11 nt, Homo sapiens
uuccugugauu

SEQ ID NO: 1018883 - RNA, 14 nt, Homo sapiens
uuccuucaggguga

SEQ ID NO: 1018884 - RNA, 13 nt, Homo sapiens
uuccuugaccagc

SEQ ID NO: 1018885 - RNA, 11 nt, Homo sapiens
uuccuugagaa

SEQ ID NO: 1018886 - RNA, 21 nt, Homo sapiens
uuccuugauggagauauuuac

SEQ ID NO: 1018887 - RNA, 16 nt, Homo sapiens
uuccuugauucacaau

SEQ ID NO: 1018888 - RNA, 13 nt, Homo sapiens
uuccuuucauuua

SEQ ID NO: 1018889 - RNA, 11 nt, Homo sapiens
uuccuuugaac

SEQ ID NO: 1018890 - RNA, 16 nt, Homo sapiens
uuccuuugaacuuuga

SEQ ID NO: 1018891 - RNA, 20 nt, Homo sapiens
uucgagaccagccuggccaa

SEQ ID NO: 1018892 - RNA, 23 nt, Homo sapiens
uucgggaagagaggaguucaaug

SEQ ID NO: 1018893 - RNA, 19 nt, Homo sapiens
uucgugaaguauacuguau

SEQ ID NO: 1018894 - RNA, 19 nt, Homo sapiens
uucuaaaaauaaaaguauu

SEQ ID NO: 1018895 - RNA, 17 nt, Homo sapiens
uucuaaaggcuugauau

SEQ ID NO: 1018896 - RNA, 19 nt, Homo sapiens
uucuaaguaaaaccacagc

SEQ ID NO: 1018897 - RNA, 14 nt, Homo sapiens
uuuucauuaucuca

SEQ ID NO: 1018898 - RNA, 22 nt, Homo sapiens
uuuuccaagugugcauauugua

SEQ ID NO: 1018899 - RNA, 13 nt, Homo sapiens
uuuuccaucaugu

SEQ ID NO: 1018900 - RNA, 16 nt, Homo sapiens
uuuuccauccuucaaa

SEQ ID NO: 1018901 - RNA, 18 nt, Homo sapiens
uuuuccauccuucaaaua

SEQ ID NO: 1018902 - RNA, 13 nt, Homo sapiens
uuuucccaccacc

SEQ ID NO: 1018903 - RNA, 16 nt, Homo sapiens
uuuucuaaacuuuaau

SEQ ID NO: 1018904 - RNA, 18 nt, Homo sapiens
uuuucuaaugugcauuaa

SEQ ID NO: 1018905 - RNA, 21 nt, Homo sapiens
uuuucuaggccuacaugcuuu

SEQ ID NO: 1018906 - RNA, 15 nt, Homo sapiens
uuuucuagucuucau

SEQ ID NO: 1018907 - RNA, 21 nt, Homo sapiens
uuuucucuguguuuguuccua

SEQ ID NO: 1018908 - RNA, 22 nt, Homo sapiens
uuuucugcuaaaaaguccuuga

SEQ ID NO: 1018909 - RNA, 19 nt, Homo sapiens
uuuucuucuuuuugcuuca

SEQ ID NO: 1018910 - RNA, 19 nt, Homo sapiens
uuuugaaauaagaaagugc

SEQ ID NO: 1018911 - RNA, 18 nt, Homo sapiens
uuuugacaucaaugauga

SEQ ID NO: 1018912 - RNA, 13 nt, Homo sapiens
uuuugagacagag

SEQ ID NO: 1018913 - RNA, 14 nt, Homo sapiens
uuuugagaguauau

SEQ ID NO: 1018914 - RNA, 16 nt, Homo sapiens
uuuugaugauugcuau

SEQ ID NO: 1018915 - RNA, 22 nt, Homo sapiens
uuuugcauuugaauaaagccug

SEQ ID NO: 1018916 - RNA, 14 nt, Homo sapiens
uuuugcuuggugga

SEQ ID NO: 1018917 - RNA, 21 nt, Homo sapiens
uuuuggaauuaugucugcuga

SEQ ID NO: 1018918 - RNA, 19 nt, Homo sapiens
uuuugucuaugggacucaa

SEQ ID NO: 1018919 - RNA, 16 nt, Homo sapiens
uuuugucuuugcugua

SEQ ID NO: 1018920 - RNA, 17 nt, Homo sapiens
uuuugugguccuguaaa

SEQ ID NO: 1018921 - RNA, 16 nt, Homo sapiens
uuuuuaaaaaaguaag

SEQ ID NO: 1018922 - RNA, 19 nt, Homo sapiens
uuuuuaagugcugcauuua

SEQ ID NO: 1018923 - RNA, 16 nt, Homo sapiens
uuuuuaugugcaauaa

SEQ ID NO: 1018924 - RNA, 13 nt, Homo sapiens
uuuuucagcuccu

SEQ ID NO: 1018925 - RNA, 11 nt, Homo sapiens
uuuuucaugau

SEQ ID NO: 1018926 - RNA, 22 nt, Homo sapiens
uuuuucuuugagacugggucuc

SEQ ID NO: 1018927 - RNA, 16 nt, Homo sapiens
uuuuuguaaaaacagc

SEQ ID NO: 1018928 - RNA, 11 nt, Homo sapiens
uuuuuguacug

SEQ ID NO: 1018929 - RNA, 13 nt, Homo sapiens
uuuuuuaacauuc

SEQ ID NO: 1018930 - RNA, 15 nt, Homo sapiens
uuuuuucugcaacuu

SEQ ID NO: 1018931 - RNA, 19 nt, Homo sapiens
aaaucuuuuaaaaauucaa

SEQ ID NO: 1018932 - RNA, 15 nt, Homo sapiens
aaaugaaaauguuuc

SEQ ID NO: 1018933 - RNA, 17 nt, Homo sapiens
aaaugacagauguugaa

SEQ ID NO: 1018934 - RNA, 18 nt, Homo sapiens
aaaugacccaaagaccaa

SEQ ID NO: 1018935 - RNA, 16 nt, Homo sapiens
aaaugagagaagggac

SEQ ID NO: 1018936 - RNA, 19 nt, Homo sapiens
aaaugauauauaccacuuu

SEQ ID NO: 1018937 - RNA, 21 nt, Homo sapiens
aaaugauggcaaaaacaaagg

SEQ ID NO: 1018938 - RNA, 21 nt, Homo sapiens
aaaugaugucaugucagcucc

SEQ ID NO: 1018939 - RNA, 17 nt, Homo sapiens
aaaugcaacaacaugua

SEQ ID NO: 1018940 - RNA, 11 nt, Homo sapiens
aaaugcaacuu

SEQ ID NO: 1018941 - RNA, 11 nt, Homo sapiens
aaaugccucau

SEQ ID NO: 1018942 - RNA, 17 nt, Homo sapiens
aaaugcucagaccagcu

SEQ ID NO: 1018943 - RNA, 23 nt, Homo sapiens
aaaugcugguuuuucaguuuuca

SEQ ID NO: 1018944 - RNA, 20 nt, Homo sapiens
aaaugcuguauuagucacag

SEQ ID NO: 1018945 - RNA, 18 nt, Homo sapiens
aaaugggggugcauuuga

SEQ ID NO: 1018946 - RNA, 15 nt, Homo sapiens
aaauguaauugaaua

SEQ ID NO: 1018947 - RNA, 16 nt, Homo sapiens
aaauguacauuaauua

SEQ ID NO: 1018948 - RNA, 15 nt, Homo sapiens
aaauguauccaucuu

SEQ ID NO: 1018949 - RNA, 14 nt, Homo sapiens
aaaugucaggccuu

SEQ ID NO: 1018950 - RNA, 16 nt, Homo sapiens
aaaugucaggccuucc

SEQ ID NO: 1018951 - RNA, 16 nt, Homo sapiens
aaauguccguguaaaa

SEQ ID NO: 1018952 - RNA, 21 nt, Homo sapiens
aaaugucucuuuaaugucaca

SEQ ID NO: 1018953 - RNA, 13 nt, Homo sapiens
aaaugugaugaau

SEQ ID NO: 1018954 - RNA, 17 nt, Homo sapiens
aaaugugcuauacugca

SEQ ID NO: 1018955 - RNA, 22 nt, Homo sapiens
aaauguuauuuuuuaauuauua

SEQ ID NO: 1018956 - RNA, 14 nt, Homo sapiens
aaauuaaaagcccu

SEQ ID NO: 1018957 - RNA, 17 nt, Homo sapiens
aaauuaacaguccuaac

SEQ ID NO: 1018958 - RNA, 20 nt, Homo sapiens
aaauuacacaguuaaugcca

SEQ ID NO: 1018959 - RNA, 13 nt, Homo sapiens
aaauuagcuggau

SEQ ID NO: 1018960 - RNA, 23 nt, Homo sapiens
aaauuagcuugagcaaccuggcu

SEQ ID NO: 1018961 - RNA, 15 nt, Homo sapiens
aaauuauuuaucaag

SEQ ID NO: 1018962 - RNA, 20 nt, Homo sapiens
aaauuauuugaaaacauaua

SEQ ID NO: 1018963 - RNA, 21 nt, Homo sapiens
aaauuauuugaaaacauauaa

SEQ ID NO: 1018964 - RNA, 21 nt, Homo sapiens
aaauuauuuuuguucauauaa

SEQ ID NO: 1018965 - RNA, 19 nt, Homo sapiens
aaauuccacacuaccacau

SEQ ID NO: 1018966 - RNA, 19 nt, Homo sapiens
aaauucccuggccuuucau

SEQ ID NO: 1018967 - RNA, 12 nt, Homo sapiens
aaauuccuguag

SEQ ID NO: 1018968 - RNA, 14 nt, Homo sapiens
aaauuccuguagca

SEQ ID NO: 1018969 - RNA, 21 nt, Homo sapiens
aaauucuauaggaacauauga

SEQ ID NO: 1018970 - RNA, 19 nt, Homo sapiens
aaauugaaaggcauucucu

SEQ ID NO: 1018971 - RNA, 20 nt, Homo sapiens
aaauugggaaaggaguagaa

SEQ ID NO: 1018972 - RNA, 15 nt, Homo sapiens
aaauugggcugugaa

SEQ ID NO: 1018973 - RNA, 13 nt, Homo sapiens
aaauuuauugcuu

SEQ ID NO: 1018974 - RNA, 13 nt, Homo sapiens
aaauuucacuuaa

SEQ ID NO: 1018975 - RNA, 16 nt, Homo sapiens
aaauuugaauuucagu

SEQ ID NO: 1018976 - RNA, 14 nt, Homo sapiens
aaauuugauuuuga

SEQ ID NO: 1018977 - RNA, 22 nt, Homo sapiens
aaauuugcuauucccaugcauu

SEQ ID NO: 1018978 - RNA, 14 nt, Homo sapiens
aaauuugcuucacu

SEQ ID NO: 1018979 - RNA, 23 nt, Homo sapiens
aaauuuggggguuucucaaauaa

SEQ ID NO: 1018980 - RNA, 16 nt, Homo sapiens
aacaaaagcucaucca

SEQ ID NO: 1018981 - RNA, 20 nt, Homo sapiens
aacaaaaugaauucugggaa

SEQ ID NO: 1018982 - RNA, 15 nt, Homo sapiens
aacaaacuacaugua

SEQ ID NO: 1018983 - RNA, 17 nt, Homo sapiens
aacaaagaacaagcauu

SEQ ID NO: 1018984 - RNA, 13 nt, Homo sapiens
aacaaagaacuga

SEQ ID NO: 1018985 - RNA, 14 nt, Homo sapiens
aacaaagaacugaa

SEQ ID NO: 1018986 - RNA, 13 nt, Homo sapiens
aacaaauaugcaa

SEQ ID NO: 1018987 - RNA, 14 nt, Homo sapiens
aacaaauaugcaaa

SEQ ID NO: 1018988 - RNA, 15 nt, Homo sapiens
aacaaauguauuuca

SEQ ID NO: 1018989 - RNA, 20 nt, Homo sapiens
aacaacacuggugugaccug

SEQ ID NO: 1018990 - RNA, 19 nt, Homo sapiens
aacaaccuggucacaggac

SEQ ID NO: 1018991 - RNA, 22 nt, Homo sapiens
aacaaccuggucacaggacucu

SEQ ID NO: 1018992 - RNA, 14 nt, Homo sapiens
aacaacuacuguga

SEQ ID NO: 1018993 - RNA, 12 nt, Homo sapiens
aacaagaucugc

SEQ ID NO: 1018994 - RNA, 13 nt, Homo sapiens
aacaagccuaaaa

SEQ ID NO: 1018995 - RNA, 13 nt, Homo sapiens
aacaaguacuucu

SEQ ID NO: 1018996 - RNA, 11 nt, Homo sapiens
aacaaucaaag

SEQ ID NO: 1018997 - RNA, 17 nt, Homo sapiens
aacaauuacauggcucu

SEQ ID NO: 1018998 - RNA, 14 nt, Homo sapiens
aacaauucucucuu

SEQ ID NO: 1018999 - RNA, 23 nt, Homo sapiens
aacaauuuuaggaggaccagagc

SEQ ID NO: 1019000 - RNA, 20 nt, Homo sapiens
aacacaaacgggcucagcaa

SEQ ID NO: 1019001 - RNA, 13 nt, Homo sapiens
aacacaagccaca

SEQ ID NO: 1019002 - RNA, 16 nt, Homo sapiens
aacacaagccacagaa

SEQ ID NO: 1019003 - RNA, 17 nt, Homo sapiens
aacacaauucuucuucc

SEQ ID NO: 1019004 - RNA, 15 nt, Homo sapiens
aacacacagcuccca

SEQ ID NO: 1019005 - RNA, 14 nt, Homo sapiens
aacacacaugcaca

SEQ ID NO: 1019006 - RNA, 22 nt, Homo sapiens
aacacacuuggaugcaggguuu

SEQ ID NO: 1019007 - RNA, 21 nt, Homo sapiens
aacacagcauguguauuucca

SEQ ID NO: 1019008 - RNA, 19 nt, Homo sapiens
aacacagugccuucaauaa

SEQ ID NO: 1019009 - RNA, 15 nt, Homo sapiens
aacacauuaagccuu

SEQ ID NO: 1019010 - RNA, 16 nt, Homo sapiens
aacacauuuuguauaa

SEQ ID NO: 1019011 - RNA, 16 nt, Homo sapiens
aacaccaagugucugc

SEQ ID NO: 1019012 - RNA, 21 nt, Homo sapiens
aacaccacgguagugccugaa

SEQ ID NO: 1019013 - RNA, 18 nt, Homo sapiens
aacacccaugaaucaaag

SEQ ID NO: 1019014 - RNA, 20 nt, Homo sapiens
aacacccgacuccucaaaag

SEQ ID NO: 1019015 - RNA, 19 nt, Homo sapiens
aacacccucacacugggac

SEQ ID NO: 1019016 - RNA, 15 nt, Homo sapiens
aacaccuagcuuuau

SEQ ID NO: 1019017 - RNA, 21 nt, Homo sapiens
aacaccuagcuuuauucuuca

SEQ ID NO: 1019018 - RNA, 21 nt, Homo sapiens
aacacgagcaggcuacuguca

SEQ ID NO: 1019019 - RNA, 21 nt, Homo sapiens
aacacggggcuugcaacuuag

SEQ ID NO: 1019020 - RNA, 23 nt, Homo sapiens
aacacguguuccgguggcagauu

SEQ ID NO: 1019021 - RNA, 14 nt, Homo sapiens
aacacugcacucuu

SEQ ID NO: 1019022 - RNA, 13 nt, Homo sapiens
aacacugcugcuc

SEQ ID NO: 1019023 - RNA, 18 nt, Homo sapiens
aacagaaagcauccuaaa

SEQ ID NO: 1019024 - RNA, 14 nt, Homo sapiens
aacagaagcaguug

SEQ ID NO: 1019025 - RNA, 14 nt, Homo sapiens
aacagaagcuucca

SEQ ID NO: 1019026 - RNA, 16 nt, Homo sapiens
aacagacucgauucau

SEQ ID NO: 1019027 - RNA, 15 nt, Homo sapiens
aacagacuucucaau

SEQ ID NO: 1019028 - RNA, 22 nt, Homo sapiens
aacagaggaagaauuuguuauc

SEQ ID NO: 1019029 - RNA, 13 nt, Homo sapiens
aacagaggccaug

SEQ ID NO: 1019030 - RNA, 16 nt, Homo sapiens
aacagaucuccuggca

SEQ ID NO: 1019031 - RNA, 20 nt, Homo sapiens
aacagaugugucagccagga

SEQ ID NO: 1019032 - RNA, 17 nt, Homo sapiens
aacagauuugugaacuc

SEQ ID NO: 1019033 - RNA, 13 nt, Homo sapiens
aacagcaaaucac

SEQ ID NO: 1019034 - RNA, 22 nt, Homo sapiens
aacagcacccucuccagaugag

SEQ ID NO: 1019035 - RNA, 16 nt, Homo sapiens
aacagcauaacuaaau

SEQ ID NO: 1019036 - RNA, 17 nt, Homo sapiens
aacagccacuacauuac

SEQ ID NO: 1019037 - RNA, 18 nt, Homo sapiens
aacagccccaaagucaau

SEQ ID NO: 1019038 - RNA, 20 nt, Homo sapiens
aacagccccucuggacacag

SEQ ID NO: 1019039 - RNA, 17 nt, Homo sapiens
aacagcccucaggucag

SEQ ID NO: 1019040 - RNA, 21 nt, Homo sapiens
aacagcuccccauuacccuca

SEQ ID NO: 1019041 - RNA, 20 nt, Homo sapiens
aacagcuguggcucacguga

SEQ ID NO: 1019042 - RNA, 17 nt, Homo sapiens
aacaggaaacugaucau

SEQ ID NO: 1019043 - RNA, 12 nt, Homo sapiens
aacaggcaguug

SEQ ID NO: 1019044 - RNA, 15 nt, Homo sapiens
aacaguaacugccau

SEQ ID NO: 1019045 - RNA, 21 nt, Homo sapiens
aacagucaaacccauggagac

SEQ ID NO: 1019046 - RNA, 18 nt, Homo sapiens
aacaguugugaugacuau

SEQ ID NO: 1019047 - RNA, 15 nt, Homo sapiens
aacaguuuuccauga

SEQ ID NO: 1019048 - RNA, 22 nt, Homo sapiens
aacaguuuuuuaugcuaaucag

SEQ ID NO: 1019049 - RNA, 21 nt, Homo sapiens
aacaucacugaaaugcuagcu

SEQ ID NO: 1019050 - RNA, 20 nt, Homo sapiens
aacaucaucaaggcacugcc

SEQ ID NO: 1019051 - RNA, 21 nt, Homo sapiens
aacaucaucaaggcacugccu

SEQ ID NO: 1019052 - RNA, 17 nt, Homo sapiens
aacaucuuuuacauucu

SEQ ID NO: 1019053 - RNA, 12 nt, Homo sapiens
aacauggccuuu

SEQ ID NO: 1019054 - RNA, 22 nt, Homo sapiens
aacaugguaaaaccccaucucu

SEQ ID NO: 1019055 - RNA, 20 nt, Homo sapiens
aacauguaagcauaacuuau

SEQ ID NO: 1019056 - RNA, 19 nt, Homo sapiens
aacauguaauuaaguacua

SEQ ID NO: 1019057 - RNA, 14 nt, Homo sapiens
aacaugugcucagg

SEQ ID NO: 1019058 - RNA, 19 nt, Homo sapiens
aacaugugguuaaugccau

SEQ ID NO: 1019059 - RNA, 21 nt, Homo sapiens
aacaugugguuaaugccaugg

SEQ ID NO: 1019060 - RNA, 17 nt, Homo sapiens
aacauguucucaauaaa

SEQ ID NO: 1019061 - RNA, 19 nt, Homo sapiens
aacauuaccuuacugugga

SEQ ID NO: 1019062 - RNA, 15 nt, Homo sapiens
aacauuacuaacaau

SEQ ID NO: 1019063 - RNA, 13 nt, Homo sapiens
aacauuaugccuu

SEQ ID NO: 1019064 - RNA, 14 nt, Homo sapiens
aacauuaugccuua

SEQ ID NO: 1019065 - RNA, 18 nt, Homo sapiens
aacauuauuuauucagcu

SEQ ID NO: 1019066 - RNA, 16 nt, Homo sapiens
aacauuccaaugcauu

SEQ ID NO: 1019067 - RNA, 23 nt, Homo sapiens
aacauuuacauguauuauuucau

SEQ ID NO: 1019068 - RNA, 20 nt, Homo sapiens
aacauuucucaaaugcacau

SEQ ID NO: 1019069 - RNA, 22 nt, Homo sapiens
aaccacaaagcacaguuugaac

SEQ ID NO: 1019070 - RNA, 12 nt, Homo sapiens
aaccacacugga

SEQ ID NO: 1019071 - RNA, 19 nt, Homo sapiens
aaccacaggcagcauuuag

SEQ ID NO: 1019072 - RNA, 15 nt, Homo sapiens
aaccacaucaauauu

SEQ ID NO: 1019073 - RNA, 22 nt, Homo sapiens
aaccacuaugaagcuaccucaa

SEQ ID NO: 1019074 - RNA, 13 nt, Homo sapiens
aaccacucaaauu

SEQ ID NO: 1019075 - RNA, 17 nt, Homo sapiens
aaccacuccacuggccu

SEQ ID NO: 1019076 - RNA, 16 nt, Homo sapiens
aggccagcaggggcuu

SEQ ID NO: 1019077 - RNA, 19 nt, Homo sapiens
aggccaggauggcacuguu

SEQ ID NO: 1019078 - RNA, 16 nt, Homo sapiens
aggccaggcagauccc

SEQ ID NO: 1019079 - RNA, 18 nt, Homo sapiens
aggccaggccagcugccu

SEQ ID NO: 1019080 - RNA, 16 nt, Homo sapiens
aggccagggucacuga

SEQ ID NO: 1019081 - RNA, 17 nt, Homo sapiens
aggccagggucacugaa

SEQ ID NO: 1019082 - RNA, 22 nt, Homo sapiens
aggccagugugccgaccucucu

SEQ ID NO: 1019083 - RNA, 15 nt, Homo sapiens
aggccaucaucagug

SEQ ID NO: 1019084 - RNA, 15 nt, Homo sapiens
aggcccgcucuacau

SEQ ID NO: 1019085 - RNA, 16 nt, Homo sapiens
aggccgagaagcaaga

SEQ ID NO: 1019086 - RNA, 20 nt, Homo sapiens
aggccgggcgcgguggcuca

SEQ ID NO: 1019087 - RNA, 17 nt, Homo sapiens
aggccguccucccgggc

SEQ ID NO: 1019088 - RNA, 22 nt, Homo sapiens
aggccuauaaccccagcucccu

SEQ ID NO: 1019089 - RNA, 23 nt, Homo sapiens
aggccucgaaaaccaucacauga

SEQ ID NO: 1019090 - RNA, 18 nt, Homo sapiens
aggccuggccagaugcac

SEQ ID NO: 1019091 - RNA, 23 nt, Homo sapiens
aggccuggccagaugcaccagcc

SEQ ID NO: 1019092 - RNA, 16 nt, Homo sapiens
aggccugggaccuccc

SEQ ID NO: 1019093 - RNA, 21 nt, Homo sapiens
aggccugggaccucccacugc

SEQ ID NO: 1019094 - RNA, 22 nt, Homo sapiens
aggccugggaccucccacugcc

SEQ ID NO: 1019095 - RNA, 22 nt, Homo sapiens
aggcgauccaccugucucagcc

SEQ ID NO: 1019096 - RNA, 14 nt, Homo sapiens
aggcgaugugcaag

SEQ ID NO: 1019097 - RNA, 17 nt, Homo sapiens
aggcgauucuccugccu

SEQ ID NO: 1019098 - RNA, 20 nt, Homo sapiens
aggcgcacuuuccuccuggc

SEQ ID NO: 1019099 - RNA, 18 nt, Homo sapiens
aggcgcuuggcaucacac

SEQ ID NO: 1019100 - RNA, 22 nt, Homo sapiens
aggcggaucuuuggacagaagc

SEQ ID NO: 1019101 - RNA, 23 nt, Homo sapiens
aggcguccgcgcgccagcacaga

SEQ ID NO: 1019102 - RNA, 15 nt, Homo sapiens
aggcuaaggcaggaa

SEQ ID NO: 1019103 - RNA, 12 nt, Homo sapiens
aggcuagaugau

SEQ ID NO: 1019104 - RNA, 21 nt, Homo sapiens
aggcuccuuccugucuuccug

SEQ ID NO: 1019105 - RNA, 23 nt, Homo sapiens
aggcucugcccugcccuagcucc

SEQ ID NO: 1019106 - RNA, 18 nt, Homo sapiens
aggcugagaacacuguga

SEQ ID NO: 1019107 - RNA, 18 nt, Homo sapiens
aggcugaggcagaacugc

SEQ ID NO: 1019108 - RNA, 18 nt, Homo sapiens
aggcugaggcaggaggau

SEQ ID NO: 1019109 - RNA, 20 nt, Homo sapiens
aggcugcagcgagcuaugau

SEQ ID NO: 1019110 - RNA, 18 nt, Homo sapiens
aggcuggagugcaaugca

SEQ ID NO: 1019111 - RNA, 20 nt, Homo sapiens
aggcuggagugcaguggcac

SEQ ID NO: 1019112 - RNA, 22 nt, Homo sapiens
aggcuggcagugacagaacuaa

SEQ ID NO: 1019113 - RNA, 15 nt, Homo sapiens
aggcuggcuuguccc

SEQ ID NO: 1019114 - RNA, 18 nt, Homo sapiens
aggcuggggaaguccucu

SEQ ID NO: 1019115 - RNA, 15 nt, Homo sapiens
aggcugucuucucag

SEQ ID NO: 1019116 - RNA, 17 nt, Homo sapiens
aggcugucuucucaggc

SEQ ID NO: 1019117 - RNA, 15 nt, Homo sapiens
aggcuucacccugaa

SEQ ID NO: 1019118 - RNA, 23 nt, Homo sapiens
aggcuuucagaagcucuucuaaa

SEQ ID NO: 1019119 - RNA, 17 nt, Homo sapiens
agggaaaacauuccauc

SEQ ID NO: 1019120 - RNA, 14 nt, Homo sapiens
agggaaaaugagua

SEQ ID NO: 1019121 - RNA, 18 nt, Homo sapiens
agggaacaagcauucucc

SEQ ID NO: 1019122 - RNA, 21 nt, Homo sapiens
agggaaccugguacauccagu

SEQ ID NO: 1019123 - RNA, 18 nt, Homo sapiens
agggaacgggguccuuca

SEQ ID NO: 1019124 - RNA, 21 nt, Homo sapiens
agggaagagagggguacauuu

SEQ ID NO: 1019125 - RNA, 13 nt, Homo sapiens
agggaagccaaaa

SEQ ID NO: 1019126 - RNA, 21 nt, Homo sapiens
agggaagcugucccucacugu

SEQ ID NO: 1019127 - RNA, 15 nt, Homo sapiens
agggaauaauccaga

SEQ ID NO: 1019128 - RNA, 16 nt, Homo sapiens
agggaauggagcucag

SEQ ID NO: 1019129 - RNA, 19 nt, Homo sapiens
agggaauugaggucugcuc

SEQ ID NO: 1019130 - RNA, 21 nt, Homo sapiens
agggaccccugcccuuguccc

SEQ ID NO: 1019131 - RNA, 14 nt, Homo sapiens
agggagaagggaug

SEQ ID NO: 1019132 - RNA, 15 nt, Homo sapiens
agggagaggccauga

SEQ ID NO: 1019133 - RNA, 16 nt, Homo sapiens
agggagcagaugcaau

SEQ ID NO: 1019134 - RNA, 21 nt, Homo sapiens
agggagcuaucaggaacagcu

SEQ ID NO: 1019135 - RNA, 21 nt, Homo sapiens
agggaggaaucgaggaaccag

SEQ ID NO: 1019136 - RNA, 16 nt, Homo sapiens
agggaugacugugauu

SEQ ID NO: 1019137 - RNA, 19 nt, Homo sapiens
agggaugcugccugaguca

SEQ ID NO: 1019138 - RNA, 23 nt, Homo sapiens
agggauggggcagucucugccca

SEQ ID NO: 1019139 - RNA, 18 nt, Homo sapiens
agggauuuggggcucaga

SEQ ID NO: 1019140 - RNA, 19 nt, Homo sapiens
agggauuuuagucacacgu

SEQ ID NO: 1019141 - RNA, 22 nt, Homo sapiens
agggcaaaaagucuacauacuu

SEQ ID NO: 1019142 - RNA, 23 nt, Homo sapiens
agggcagggcaucuccugugcau

SEQ ID NO: 1019143 - RNA, 18 nt, Homo sapiens
agggcaucuccugugcau

SEQ ID NO: 1019144 - RNA, 16 nt, Homo sapiens
agggccacaugggagg

SEQ ID NO: 1019145 - RNA, 20 nt, Homo sapiens
agggccagaccugccugcau

SEQ ID NO: 1019146 - RNA, 10 nt, Homo sapiens
agggccaguc

SEQ ID NO: 1019147 - RNA, 14 nt, Homo sapiens
agggcccuaccuga

SEQ ID NO: 1019148 - RNA, 17 nt, Homo sapiens
agggcgagacuccgucu

SEQ ID NO: 1019149 - RNA, 20 nt, Homo sapiens
agggcgagacuccgucucaa

SEQ ID NO: 1019150 - RNA, 23 nt, Homo sapiens
agggcuagaaccuguagagcuag

SEQ ID NO: 1019151 - RNA, 18 nt, Homo sapiens
agggcuagcaucccugag

SEQ ID NO: 1019152 - RNA, 17 nt, Homo sapiens
agggcucguuuccccac

SEQ ID NO: 1019153 - RNA, 22 nt, Homo sapiens
agggcucuuuccuccacaccau

SEQ ID NO: 1019154 - RNA, 23 nt, Homo sapiens
agggcuggaaucuggagagcuag

SEQ ID NO: 1019155 - RNA, 16 nt, Homo sapiens
agggcugucuucguau

SEQ ID NO: 1019156 - RNA, 19 nt, Homo sapiens
agggcuuggacucaagcaa

SEQ ID NO: 1019157 - RNA, 21 nt, Homo sapiens
agggcuugucauuaccagacg

SEQ ID NO: 1019158 - RNA, 19 nt, Homo sapiens
aggggaagagauuagucuc

SEQ ID NO: 1019159 - RNA, 21 nt, Homo sapiens
aggggaagagauuagucucuu

SEQ ID NO: 1019160 - RNA, 20 nt, Homo sapiens
aggggacucagcccugaggu

SEQ ID NO: 1019161 - RNA, 16 nt, Homo sapiens
aggggacuugaaucuu

SEQ ID NO: 1019162 - RNA, 17 nt, Homo sapiens
aggggagucccuguggu

SEQ ID NO: 1019163 - RNA, 21 nt, Homo sapiens
aggggauagagagagaccacu

SEQ ID NO: 1019164 - RNA, 19 nt, Homo sapiens
aggggauugaagcccucca

SEQ ID NO: 1019165 - RNA, 16 nt, Homo sapiens
aggggccgagccauuu

SEQ ID NO: 1019166 - RNA, 20 nt, Homo sapiens
agggggguugugaggccugg

SEQ ID NO: 1019167 - RNA, 13 nt, Homo sapiens
aggggucauucau

SEQ ID NO: 1019168 - RNA, 19 nt, Homo sapiens
aggggugguccugacucaa

SEQ ID NO: 1019169 - RNA, 21 nt, Homo sapiens
aggguaccuugaacacugggg

SEQ ID NO: 1019170 - RNA, 19 nt, Homo sapiens
aggguccucaguccacugc

SEQ ID NO: 1019171 - RNA, 20 nt, Homo sapiens
aggguccucaguccacugcu

SEQ ID NO: 1019172 - RNA, 20 nt, Homo sapiens
aggguccuuuaguaccugaa

SEQ ID NO: 1019173 - RNA, 15 nt, Homo sapiens
agggucugcacucua

SEQ ID NO: 1019174 - RNA, 18 nt, Homo sapiens
agggucuucccuaccuca

SEQ ID NO: 1019175 - RNA, 22 nt, Homo sapiens
agggucuugggaaauaugaaug

SEQ ID NO: 1019176 - RNA, 14 nt, Homo sapiens
agggugacuaugga

SEQ ID NO: 1019177 - RNA, 21 nt, Homo sapiens
agggugaggugcuugagucuc

SEQ ID NO: 1019178 - RNA, 13 nt, Homo sapiens
agggugagugcaa

SEQ ID NO: 1019179 - RNA, 15 nt, Homo sapiens
agggugagugcaagg

SEQ ID NO: 1019180 - RNA, 17 nt, Homo sapiens
agggugcggcugugcag

SEQ ID NO: 1019181 - RNA, 23 nt, Homo sapiens
aggguggcuggguccaggggaug

SEQ ID NO: 1019182 - RNA, 14 nt, Homo sapiens
aggguuacaaaucu

SEQ ID NO: 1019183 - RNA, 13 nt, Homo sapiens
aggguuacuaugc

SEQ ID NO: 1019184 - RNA, 19 nt, Homo sapiens
aggguugggcuggugucac

SEQ ID NO: 1019185 - RNA, 16 nt, Homo sapiens
agguacagcagaaagg

SEQ ID NO: 1019186 - RNA, 18 nt, Homo sapiens
agguacugagagugaaca

SEQ ID NO: 1019187 - RNA, 20 nt, Homo sapiens
agguagcugccccuggcucu

SEQ ID NO: 1019188 - RNA, 17 nt, Homo sapiens
agguaggaucaucccac

SEQ ID NO: 1019189 - RNA, 19 nt, Homo sapiens
agguaggggcccacuucac

SEQ ID NO: 1019190 - RNA, 20 nt, Homo sapiens
agguauauaaauuuucccaa

SEQ ID NO: 1019191 - RNA, 22 nt, Homo sapiens
agguauucguaaggaugggaag

SEQ ID NO: 1019192 - RNA, 19 nt, Homo sapiens
agguauucugcugaugcua

SEQ ID NO: 1019193 - RNA, 22 nt, Homo sapiens
aggucaaggcugcagugagcca

SEQ ID NO: 1019194 - RNA, 12 nt, Homo sapiens
aggucaccagca

SEQ ID NO: 1019195 - RNA, 20 nt, Homo sapiens
aggucagcagccucccugaa

SEQ ID NO: 1019196 - RNA, 20 nt, Homo sapiens
aggucagcgugcuuagccuc

SEQ ID NO: 1019197 - RNA, 19 nt, Homo sapiens
agguccuuuccacccugag

SEQ ID NO: 1019198 - RNA, 21 nt, Homo sapiens
aggucuaggaacauacuucag

SEQ ID NO: 1019199 - RNA, 21 nt, Homo sapiens
aggucucacgggcaugggcac

SEQ ID NO: 1019200 - RNA, 14 nt, Homo sapiens
aggugaacacuucc

SEQ ID NO: 1019201 - RNA, 23 nt, Homo sapiens
aggugaacugggagcagcucugu

SEQ ID NO: 1019202 - RNA, 21 nt, Homo sapiens
aggugacaugugaaaccuuuu

SEQ ID NO: 1019203 - RNA, 14 nt, Homo sapiens
aggugauccaccug

SEQ ID NO: 1019204 - RNA, 17 nt, Homo sapiens
aggugaucuaccugccu

SEQ ID NO: 1019205 - RNA, 19 nt, Homo sapiens
aggugcagagugcccagaa

SEQ ID NO: 1019206 - RNA, 17 nt, Homo sapiens
aggugccuccaggugug

SEQ ID NO: 1019207 - RNA, 21 nt, Homo sapiens
aggugcguguuuccugugcaa

SEQ ID NO: 1019208 - RNA, 21 nt, Homo sapiens
aggugcuacaaaaacacagca

SEQ ID NO: 1019209 - RNA, 13 nt, Homo sapiens
aggugcucugugg

SEQ ID NO: 1019210 - RNA, 22 nt, Homo sapiens
aggugcuuaagcagaagcauua

SEQ ID NO: 1019211 - RNA, 15 nt, Homo sapiens
agguggaucacugga

SEQ ID NO: 1019212 - RNA, 13 nt, Homo sapiens
agguggcacacug

SEQ ID NO: 1019213 - RNA, 19 nt, Homo sapiens
agguggcaggaccaggacu

SEQ ID NO: 1019214 - RNA, 16 nt, Homo sapiens
agguggccccaguuca

SEQ ID NO: 1019215 - RNA, 20 nt, Homo sapiens
aggugggaggaucucuugag

SEQ ID NO: 1019216 - RNA, 23 nt, Homo sapiens
agguggggcgggaaagccaguga

SEQ ID NO: 1019217 - RNA, 15 nt, Homo sapiens
agguggugaggcaau

SEQ ID NO: 1019218 - RNA, 17 nt, Homo sapiens
agugcuuaguguacuug

SEQ ID NO: 1019219 - RNA, 15 nt, Homo sapiens
agugcuuccaaggca

SEQ ID NO: 1019220 - RNA, 21 nt, Homo sapiens
agugcuugauugcguggaauu

SEQ ID NO: 1019221 - RNA, 22 nt, Homo sapiens
agugcuuguuccucucaucucc

SEQ ID NO: 1019222 - RNA, 15 nt, Homo sapiens
aguggaucuccaagg

SEQ ID NO: 1019223 - RNA, 16 nt, Homo sapiens
aguggauugcauuucu

SEQ ID NO: 1019224 - RNA, 14 nt, Homo sapiens
aguggauuuuacau

SEQ ID NO: 1019225 - RNA, 23 nt, Homo sapiens
aguggcaaccuugucucuaugcc

SEQ ID NO: 1019226 - RNA, 20 nt, Homo sapiens
aguggcacgaucucgacuca

SEQ ID NO: 1019227 - RNA, 23 nt, Homo sapiens
aguggcauggcuccagucugcug

SEQ ID NO: 1019228 - RNA, 20 nt, Homo sapiens
aguggccaugccacccuguu

SEQ ID NO: 1019229 - RNA, 16 nt, Homo sapiens
aguggcccccacagaa

SEQ ID NO: 1019230 - RNA, 23 nt, Homo sapiens
aguggcccuuucaacaaugucuu

SEQ ID NO: 1019231 - RNA, 14 nt, Homo sapiens
aguggccuggccag

SEQ ID NO: 1019232 - RNA, 18 nt, Homo sapiens
aguggcuaccuacauaca

SEQ ID NO: 1019233 - RNA, 23 nt, Homo sapiens
aguggcucacgccuaugauccca

SEQ ID NO: 1019234 - RNA, 17 nt, Homo sapiens
aguggcuucaucuguca

SEQ ID NO: 1019235 - RNA, 14 nt, Homo sapiens
agugggacuggcac

SEQ ID NO: 1019236 - RNA, 22 nt, Homo sapiens
agugggcauggagccagugccu

SEQ ID NO: 1019237 - RNA, 19 nt, Homo sapiens
aguggggagacuucuuggc

SEQ ID NO: 1019238 - RNA, 13 nt, Homo sapiens
agugggugaauaa

SEQ ID NO: 1019239 - RNA, 16 nt, Homo sapiens
agugggugguggaucu

SEQ ID NO: 1019240 - RNA, 16 nt, Homo sapiens
agugguauccugugac

SEQ ID NO: 1019241 - RNA, 21 nt, Homo sapiens
agugguccauggaaugcuuga

SEQ ID NO: 1019242 - RNA, 17 nt, Homo sapiens
aguggucuuuguaagag

SEQ ID NO: 1019243 - RNA, 21 nt, Homo sapiens
aguggugcgaucuggguucac

SEQ ID NO: 1019244 - RNA, 21 nt, Homo sapiens
agugguggcaggacaagagaa

SEQ ID NO: 1019245 - RNA, 21 nt, Homo sapiens
agugguguucagccaagugac

SEQ ID NO: 1019246 - RNA, 22 nt, Homo sapiens
aguguaagcccugcuuagcuca

SEQ ID NO: 1019247 - RNA, 12 nt, Homo sapiens
aguguacaugga

SEQ ID NO: 1019248 - RNA, 16 nt, Homo sapiens
aguguagaagcauucc

SEQ ID NO: 1019249 - RNA, 21 nt, Homo sapiens
aguguaugcacgugugcacac

SEQ ID NO: 1019250 - RNA, 12 nt, Homo sapiens
agugucacuuac

SEQ ID NO: 1019251 - RNA, 20 nt, Homo sapiens
agugucaggaggaaggcuua

SEQ ID NO: 1019252 - RNA, 22 nt, Homo sapiens
agugucaugucagcaucagcuc

SEQ ID NO: 1019253 - RNA, 21 nt, Homo sapiens
aguguccccuccacugucaca

SEQ ID NO: 1019254 - RNA, 23 nt, Homo sapiens
agugugaaacagcugcccugugu

SEQ ID NO: 1019255 - RNA, 16 nt, Homo sapiens
aguguggaaccacuga

SEQ ID NO: 1019256 - RNA, 19 nt, Homo sapiens
aguguggaaccacugacua

SEQ ID NO: 1019257 - RNA, 20 nt, Homo sapiens
agugugugcaaguaugugag

SEQ ID NO: 1019258 - RNA, 20 nt, Homo sapiens
aguguuaagcguucagugau

SEQ ID NO: 1019259 - RNA, 20 nt, Homo sapiens
aguguuccccuuccacugag

SEQ ID NO: 1019260 - RNA, 23 nt, Homo sapiens
aguguuccccuuccacugagggc

SEQ ID NO: 1019261 - RNA, 22 nt, Homo sapiens
aguguugcccaggcuggucuca

SEQ ID NO: 1019262 - RNA, 15 nt, Homo sapiens
aguguugcucucuag

SEQ ID NO: 1019263 - RNA, 21 nt, Homo sapiens
aguguuggaaaaugugcaaua

SEQ ID NO: 1019264 - RNA, 20 nt, Homo sapiens
aguguuuuuuagauacagag

SEQ ID NO: 1019265 - RNA, 20 nt, Homo sapiens
aguuaaagugaauaaccacu

SEQ ID NO: 1019266 - RNA, 21 nt, Homo sapiens
aguuaaauagaguauaugcac

SEQ ID NO: 1019267 - RNA, 13 nt, Homo sapiens
aguuaagaaccug

SEQ ID NO: 1019268 - RNA, 14 nt, Homo sapiens
aguuaagaaccuga

SEQ ID NO: 1019269 - RNA, 13 nt, Homo sapiens
aguuaauccacug

SEQ ID NO: 1019270 - RNA, 16 nt, Homo sapiens
aguuaauccacuguga

SEQ ID NO: 1019271 - RNA, 16 nt, Homo sapiens
aguuagagcugacaca

SEQ ID NO: 1019272 - RNA, 20 nt, Homo sapiens
aguuaggcuauucacaacca

SEQ ID NO: 1019273 - RNA, 22 nt, Homo sapiens
aguuagguagcuuuagggcaau

SEQ ID NO: 1019274 - RNA, 17 nt, Homo sapiens
aguuauuuuuugaauaa

SEQ ID NO: 1019275 - RNA, 12 nt, Homo sapiens
aguucaagagaa

SEQ ID NO: 1019276 - RNA, 14 nt, Homo sapiens
aguucaaugaucua

SEQ ID NO: 1019277 - RNA, 14 nt, Homo sapiens
aguucaauggcugc

SEQ ID NO: 1019278 - RNA, 19 nt, Homo sapiens
aguucacggcaaaauguca

SEQ ID NO: 1019279 - RNA, 20 nt, Homo sapiens
aguucacuucaucuucucag

SEQ ID NO: 1019280 - RNA, 18 nt, Homo sapiens
aguucauagggucucuuc

SEQ ID NO: 1019281 - RNA, 22 nt, Homo sapiens
aguuccaugaauucuugauuuc

SEQ ID NO: 1019282 - RNA, 14 nt, Homo sapiens
aguucccagaauca

SEQ ID NO: 1019283 - RNA, 15 nt, Homo sapiens
aguuccgacugccau

SEQ ID NO: 1019284 - RNA, 21 nt, Homo sapiens
aguuccucauuagcauuuugc

SEQ ID NO: 1019285 - RNA, 16 nt, Homo sapiens
aguuccuuucaauggu

SEQ ID NO: 1019286 - RNA, 17 nt, Homo sapiens
aguucgaccugcggcug

SEQ ID NO: 1019287 - RNA, 22 nt, Homo sapiens
aguucuggaagggacuuuagag

SEQ ID NO: 1019288 - RNA, 21 nt, Homo sapiens
aguucuguaaaauauacuuaa

SEQ ID NO: 1019289 - RNA, 20 nt, Homo sapiens
aguucuuaaacucagaauau

SEQ ID NO: 1019290 - RNA, 17 nt, Homo sapiens
aguugaaauucuauucu

SEQ ID NO: 1019291 - RNA, 15 nt, Homo sapiens
aguugaaugggcaca

SEQ ID NO: 1019292 - RNA, 14 nt, Homo sapiens
aguugauucagcuc

SEQ ID NO: 1019293 - RNA, 15 nt, Homo sapiens
aguugauucagcucu

SEQ ID NO: 1019294 - RNA, 14 nt, Homo sapiens
aguugccagucacc

SEQ ID NO: 1019295 - RNA, 19 nt, Homo sapiens
aguugcguggacucugcac

SEQ ID NO: 1019296 - RNA, 20 nt, Homo sapiens
aguugcguggacucugcaca

SEQ ID NO: 1019297 - RNA, 13 nt, Homo sapiens
aguugcuguaugu

SEQ ID NO: 1019298 - RNA, 18 nt, Homo sapiens
aguuggaagugugugauc

SEQ ID NO: 1019299 - RNA, 16 nt, Homo sapiens
aguugggagcacugga

SEQ ID NO: 1019300 - RNA, 14 nt, Homo sapiens
aguugucuauucau

SEQ ID NO: 1019301 - RNA, 21 nt, Homo sapiens
aguugugucagcuacugcgga

SEQ ID NO: 1019302 - RNA, 17 nt, Homo sapiens
aguuuaaacaaagggaa

SEQ ID NO: 1019303 - RNA, 15 nt, Homo sapiens
aguuuaauaccacag

SEQ ID NO: 1019304 - RNA, 17 nt, Homo sapiens
aguuuaauuaugccuuu

SEQ ID NO: 1019305 - RNA, 22 nt, Homo sapiens
aguuuauaaauuaaaacugaau

SEQ ID NO: 1019306 - RNA, 15 nt, Homo sapiens
aguuuauacuucucu

SEQ ID NO: 1019307 - RNA, 15 nt, Homo sapiens
aguuuauugacaaua

SEQ ID NO: 1019308 - RNA, 20 nt, Homo sapiens
aguuuauuuuuauacuuuca

SEQ ID NO: 1019309 - RNA, 21 nt, Homo sapiens
aguuuauuuuuauacuuucag

SEQ ID NO: 1019310 - RNA, 14 nt, Homo sapiens
aguuucacugacuu

SEQ ID NO: 1019311 - RNA, 14 nt, Homo sapiens
aguuucccuaucuc

SEQ ID NO: 1019312 - RNA, 19 nt, Homo sapiens
aguuucugaaaccgcucag

SEQ ID NO: 1019313 - RNA, 15 nt, Homo sapiens
aguuucuuagcuuuu

SEQ ID NO: 1019314 - RNA, 22 nt, Homo sapiens
aguuugaacaaaaucuccucuu

SEQ ID NO: 1019315 - RNA, 23 nt, Homo sapiens
aguuugaacucuguaaaaccuca

SEQ ID NO: 1019316 - RNA, 13 nt, Homo sapiens
aguuugagacagg

SEQ ID NO: 1019317 - RNA, 13 nt, Homo sapiens
aguuugagaccag

SEQ ID NO: 1019318 - RNA, 18 nt, Homo sapiens
aguuugauuauucagugu

SEQ ID NO: 1019319 - RNA, 17 nt, Homo sapiens
aguuugucagacuuuaa

SEQ ID NO: 1019320 - RNA, 18 nt, Homo sapiens
aguuuuaggacaaacagc

SEQ ID NO: 1019321 - RNA, 15 nt, Homo sapiens
aguuuuauuacacau

SEQ ID NO: 1019322 - RNA, 17 nt, Homo sapiens
aguuuugacaucaauga

SEQ ID NO: 1019323 - RNA, 19 nt, Homo sapiens
aguuuugucuuugcuguaa

SEQ ID NO: 1019324 - RNA, 22 nt, Homo sapiens
aguuuuuauggcuuuugugcau

SEQ ID NO: 1019325 - RNA, 20 nt, Homo sapiens
aguuuuuguucuuaauugca

SEQ ID NO: 1019326 - RNA, 17 nt, Homo sapiens
auaaaaaacauauacaa

SEQ ID NO: 1019327 - RNA, 15 nt, Homo sapiens
auaaaaagugacaca

SEQ ID NO: 1019328 - RNA, 15 nt, Homo sapiens
auaaaaauaaaucag

SEQ ID NO: 1019329 - RNA, 16 nt, Homo sapiens
auaaaaauauguacaa

SEQ ID NO: 1019330 - RNA, 19 nt, Homo sapiens
auaaaacaugggaaucucc

SEQ ID NO: 1019331 - RNA, 20 nt, Homo sapiens
auaaaagcuauggugagaug

SEQ ID NO: 1019332 - RNA, 20 nt, Homo sapiens
auaaaaguacuagcuuacuu

SEQ ID NO: 1019333 - RNA, 21 nt, Homo sapiens
auaaaauauauugguauguaa

SEQ ID NO: 1019334 - RNA, 13 nt, Homo sapiens
auaaaaugugauu

SEQ ID NO: 1019335 - RNA, 21 nt, Homo sapiens
auaaaauuaaagcugaaaacu

SEQ ID NO: 1019336 - RNA, 16 nt, Homo sapiens
auaaaauuagcuugag

SEQ ID NO: 1019337 - RNA, 20 nt, Homo sapiens
auaaacaaauaacaaugugc

SEQ ID NO: 1019338 - RNA, 18 nt, Homo sapiens
auaaacacccaugaauca

SEQ ID NO: 1019339 - RNA, 20 nt, Homo sapiens
auaaacacccaugaaucaaa

SEQ ID NO: 1019340 - RNA, 18 nt, Homo sapiens
auaaacaguagugauagu

SEQ ID NO: 1019341 - RNA, 15 nt, Homo sapiens
auaaacaugucugcc

SEQ ID NO: 1019342 - RNA, 12 nt, Homo sapiens
auaaacauuuaa

SEQ ID NO: 1019343 - RNA, 14 nt, Homo sapiens
auaaacccaguugc

SEQ ID NO: 1019344 - RNA, 19 nt, Homo sapiens
auaaaccuaauaaucugaa

SEQ ID NO: 1019345 - RNA, 14 nt, Homo sapiens
auaaaccucaaguu

SEQ ID NO: 1019346 - RNA, 13 nt, Homo sapiens
auaaagauguuau

SEQ ID NO: 1019347 - RNA, 14 nt, Homo sapiens
auaaagccacugaa

SEQ ID NO: 1019348 - RNA, 15 nt, Homo sapiens
auaaaguaugugcau

SEQ ID NO: 1019349 - RNA, 17 nt, Homo sapiens
auaaaguuggugacaga

SEQ ID NO: 1019350 - RNA, 15 nt, Homo sapiens
auaaauaaaacauuu

SEQ ID NO: 1019351 - RNA, 19 nt, Homo sapiens
auaaauaacuaaugucucu

SEQ ID NO: 1019352 - RNA, 14 nt, Homo sapiens
auaaauaugcagug

SEQ ID NO: 1019353 - RNA, 19 nt, Homo sapiens
auaaaucaaugucacuuaa

SEQ ID NO: 1019354 - RNA, 21 nt, Homo sapiens
auaaauuauuaguuuacauca

SEQ ID NO: 1019355 - RNA, 18 nt, Homo sapiens
auaaauugcuccuugaca

SEQ ID NO: 1019356 - RNA, 14 nt, Homo sapiens
auaaauuugguucu

SEQ ID NO: 1019357 - RNA, 16 nt, Homo sapiens
auaacaguuacuccag

SEQ ID NO: 1019358 - RNA, 18 nt, Homo sapiens
auaacaguuacuccagua

SEQ ID NO: 1019359 - RNA, 21 nt, Homo sapiens
auaacauggugugcuucuuaa

SEQ ID NO: 1019360 - RNA, 14 nt, Homo sapiens
auaaccacuccuaa

SEQ ID NO: 1019361 - RNA, 18 nt, Homo sapiens
auaacuaguguugcuugg

SEQ ID NO: 1019362 - RNA, 18 nt, Homo sapiens
auaugcaccuugugucug

SEQ ID NO: 1019363 - RNA, 17 nt, Homo sapiens
auaugccauaaaccuca

SEQ ID NO: 1019364 - RNA, 22 nt, Homo sapiens
auaugccauaaaccucaaguua

SEQ ID NO: 1019365 - RNA, 16 nt, Homo sapiens
auauggacucugcaca

SEQ ID NO: 1019366 - RNA, 18 nt, Homo sapiens
auauggaggaggcucugg

SEQ ID NO: 1019367 - RNA, 16 nt, Homo sapiens
auauggcagugucuuu

SEQ ID NO: 1019368 - RNA, 21 nt, Homo sapiens
auaugggguugguguucucau

SEQ ID NO: 1019369 - RNA, 16 nt, Homo sapiens
auauggugggcacaga

SEQ ID NO: 1019370 - RNA, 15 nt, Homo sapiens
auauguacuugucaa

SEQ ID NO: 1019371 - RNA, 22 nt, Homo sapiens
auauguaggugucugcacccag

SEQ ID NO: 1019372 - RNA, 23 nt, Homo sapiens
auaugugggugucagucagggac

SEQ ID NO: 1019373 - RNA, 16 nt, Homo sapiens
auauguguucauuaaa

SEQ ID NO: 1019374 - RNA, 21 nt, Homo sapiens
auauuaagaaagacuaucuaa

SEQ ID NO: 1019375 - RNA, 12 nt, Homo sapiens
auauuacuuguu

SEQ ID NO: 1019376 - RNA, 21 nt, Homo sapiens
auauuacuuguuuucacuuua

SEQ ID NO: 1019377 - RNA, 23 nt, Homo sapiens
auauuacuuguuuucacuuuauc

SEQ ID NO: 1019378 - RNA, 14 nt, Homo sapiens
auauuagggaguaa

SEQ ID NO: 1019379 - RNA, 22 nt, Homo sapiens
auauuaucacgcagaucacuaa

SEQ ID NO: 1019380 - RNA, 15 nt, Homo sapiens
auauuaugucuucau

SEQ ID NO: 1019381 - RNA, 15 nt, Homo sapiens
auauucaacucauaa

SEQ ID NO: 1019382 - RNA, 12 nt, Homo sapiens
auauucauuuca

SEQ ID NO: 1019383 - RNA, 18 nt, Homo sapiens
auauuccugcauuuguga

SEQ ID NO: 1019384 - RNA, 21 nt, Homo sapiens
auauuccugcauuugugaaau

SEQ ID NO: 1019385 - RNA, 18 nt, Homo sapiens
auauucuauuaacuuuaa

SEQ ID NO: 1019386 - RNA, 22 nt, Homo sapiens
auauucuuuaaauuucaucuca

SEQ ID NO: 1019387 - RNA, 23 nt, Homo sapiens
auauugauuucugccuuccuugc

SEQ ID NO: 1019388 - RNA, 20 nt, Homo sapiens
auauugcagcuuauauucau

SEQ ID NO: 1019389 - RNA, 18 nt, Homo sapiens
auauugcagucaaucucu

SEQ ID NO: 1019390 - RNA, 19 nt, Homo sapiens
auauuguauuacuagaaga

SEQ ID NO: 1019391 - RNA, 16 nt, Homo sapiens
auauugugauucugcc

SEQ ID NO: 1019392 - RNA, 12 nt, Homo sapiens
auauuguugccg

SEQ ID NO: 1019393 - RNA, 15 nt, Homo sapiens
auauuuauacuguau

SEQ ID NO: 1019394 - RNA, 15 nt, Homo sapiens
auauuuauagcaauc

SEQ ID NO: 1019395 - RNA, 19 nt, Homo sapiens
auauuuauagcaauccaug

SEQ ID NO: 1019396 - RNA, 18 nt, Homo sapiens
auauuuaugucuauuuaa

SEQ ID NO: 1019397 - RNA, 19 nt, Homo sapiens
auauuuauuuaacuauuca

SEQ ID NO: 1019398 - RNA, 22 nt, Homo sapiens
auauuucagauaucagaaucau

SEQ ID NO: 1019399 - RNA, 20 nt, Homo sapiens
auauuucaggcauacugaca

SEQ ID NO: 1019400 - RNA, 14 nt, Homo sapiens
auauuucuagacau

SEQ ID NO: 1019401 - RNA, 18 nt, Homo sapiens
auauuugaagcaucacau

SEQ ID NO: 1019402 - RNA, 17 nt, Homo sapiens
auauuugcuaugaagcg

SEQ ID NO: 1019403 - RNA, 22 nt, Homo sapiens
auauuuguaucacaaaucuuaa

SEQ ID NO: 1019404 - RNA, 19 nt, Homo sapiens
auauuuuaaaaucugucac

SEQ ID NO: 1019405 - RNA, 13 nt, Homo sapiens
auauuuuauacau

SEQ ID NO: 1019406 - RNA, 19 nt, Homo sapiens
auauuuuauuauagucacu

SEQ ID NO: 1019407 - RNA, 20 nt, Homo sapiens
auauuuuauuuaauccccac

SEQ ID NO: 1019408 - RNA, 16 nt, Homo sapiens
auauuuugcauaguac

SEQ ID NO: 1019409 - RNA, 18 nt, Homo sapiens
auauuuuuaugugcaaua

SEQ ID NO: 1019410 - RNA, 19 nt, Homo sapiens
auauuuuuaugugcaauaa

SEQ ID NO: 1019411 - RNA, 17 nt, Homo sapiens
auauuuuugugcacauu

SEQ ID NO: 1019412 - RNA, 21 nt, Homo sapiens
auauuuuuuaaaauaacuuca

SEQ ID NO: 1019413 - RNA, 14 nt, Homo sapiens
aucaaaacucuccu

SEQ ID NO: 1019414 - RNA, 13 nt, Homo sapiens
aucaaaagaaaga

SEQ ID NO: 1019415 - RNA, 20 nt, Homo sapiens
aucaaaagggagagaacaaa

SEQ ID NO: 1019416 - RNA, 20 nt, Homo sapiens
aucaaaauaaaaagugacac

SEQ ID NO: 1019417 - RNA, 18 nt, Homo sapiens
aucaaacacaaugccuca

SEQ ID NO: 1019418 - RNA, 19 nt, Homo sapiens
aucaaacacaaugccucau

SEQ ID NO: 1019419 - RNA, 12 nt, Homo sapiens
aucaaagcacuu

SEQ ID NO: 1019420 - RNA, 16 nt, Homo sapiens
aucaaaggcacacagc

SEQ ID NO: 1019421 - RNA, 16 nt, Homo sapiens
aucaaaucagucagug

SEQ ID NO: 1019422 - RNA, 12 nt, Homo sapiens
aucaaauuucac

SEQ ID NO: 1019423 - RNA, 18 nt, Homo sapiens
aucaacauuuguuccaug

SEQ ID NO: 1019424 - RNA, 16 nt, Homo sapiens
aucaaccaaauggagu

SEQ ID NO: 1019425 - RNA, 15 nt, Homo sapiens
aucaacccuaaaaag

SEQ ID NO: 1019426 - RNA, 13 nt, Homo sapiens
aucaagagcugcc

SEQ ID NO: 1019427 - RNA, 22 nt, Homo sapiens
aucaagauuuaauccuagagau

SEQ ID NO: 1019428 - RNA, 23 nt, Homo sapiens
aucaagugugcuuuagcuugaaa

SEQ ID NO: 1019429 - RNA, 16 nt, Homo sapiens
aucaaugaaaugaugu

SEQ ID NO: 1019430 - RNA, 18 nt, Homo sapiens
aucaaugaagcaaguaca

SEQ ID NO: 1019431 - RNA, 13 nt, Homo sapiens
aucaaugaaguag

SEQ ID NO: 1019432 - RNA, 20 nt, Homo sapiens
aucaauguucaucauguauc

SEQ ID NO: 1019433 - RNA, 12 nt, Homo sapiens
aucaauguuucu

SEQ ID NO: 1019434 - RNA, 19 nt, Homo sapiens
aucaauuauagaaagccaa

SEQ ID NO: 1019435 - RNA, 22 nt, Homo sapiens
aucaauucuauuacgugcaaua

SEQ ID NO: 1019436 - RNA, 13 nt, Homo sapiens
aucacacaacuca

SEQ ID NO: 1019437 - RNA, 18 nt, Homo sapiens
aucacaguuuugguugcu

SEQ ID NO: 1019438 - RNA, 14 nt, Homo sapiens
aucaccacagggau

SEQ ID NO: 1019439 - RNA, 15 nt, Homo sapiens
aucaccucaggccag

SEQ ID NO: 1019440 - RNA, 12 nt, Homo sapiens
aucacgaccacu

SEQ ID NO: 1019441 - RNA, 20 nt, Homo sapiens
aucacuuccuauaugcacuu

SEQ ID NO: 1019442 - RNA, 19 nt, Homo sapiens
aucagaacaucaauuccag

SEQ ID NO: 1019443 - RNA, 16 nt, Homo sapiens
aucagaacuguuggca

SEQ ID NO: 1019444 - RNA, 16 nt, Homo sapiens
aucagaccauaauguu

SEQ ID NO: 1019445 - RNA, 17 nt, Homo sapiens
aucagacuccugugcaa

SEQ ID NO: 1019446 - RNA, 18 nt, Homo sapiens
aucagacuccugugcaac

SEQ ID NO: 1019447 - RNA, 15 nt, Homo sapiens
aucagccacauucua

SEQ ID NO: 1019448 - RNA, 17 nt, Homo sapiens
aucagccugcuccagcu

SEQ ID NO: 1019449 - RNA, 14 nt, Homo sapiens
aucagcugcuacua

SEQ ID NO: 1019450 - RNA, 21 nt, Homo sapiens
aucagcuggcgucaugcaaag

SEQ ID NO: 1019451 - RNA, 21 nt, Homo sapiens
aucaggacagguggugcaaau

SEQ ID NO: 1019452 - RNA, 21 nt, Homo sapiens
aucaggacucugacgucucuu

SEQ ID NO: 1019453 - RNA, 17 nt, Homo sapiens
aucaggagaaaaagccu

SEQ ID NO: 1019454 - RNA, 21 nt, Homo sapiens
aucaggcuauguauggaauac

SEQ ID NO: 1019455 - RNA, 12 nt, Homo sapiens
aucaggucuccc

SEQ ID NO: 1019456 - RNA, 15 nt, Homo sapiens
aucagucaaugagga

SEQ ID NO: 1019457 - RNA, 12 nt, Homo sapiens
aucagucucuga

SEQ ID NO: 1019458 - RNA, 21 nt, Homo sapiens
aucagugcuccuguaagucaa

SEQ ID NO: 1019459 - RNA, 24 nt, Homo sapiens
aucaguugcaauaauacuucucaa

SEQ ID NO: 1019460 - RNA, 23 nt, Homo sapiens
aucauauaauaaauguacauuaa

SEQ ID NO: 1019461 - RNA, 18 nt, Homo sapiens
aucauauugaauguuucc

SEQ ID NO: 1019462 - RNA, 19 nt, Homo sapiens
aucaucaaaaacuuuggag

SEQ ID NO: 1019463 - RNA, 19 nt, Homo sapiens
aucaucagcauaccuuuau

SEQ ID NO: 1019464 - RNA, 19 nt, Homo sapiens
aucauccacugugccaugu

SEQ ID NO: 1019465 - RNA, 22 nt, Homo sapiens
aucaucuauaaagaagaacuug

SEQ ID NO: 1019466 - RNA, 14 nt, Homo sapiens
aucaugcauguuau

SEQ ID NO: 1019467 - RNA, 20 nt, Homo sapiens
aucaugccccuguacuccag

SEQ ID NO: 1019468 - RNA, 21 nt, Homo sapiens
aucaugguuuuucuuaguaga

SEQ ID NO: 1019469 - RNA, 13 nt, Homo sapiens
aucauguacccca

SEQ ID NO: 1019470 - RNA, 15 nt, Homo sapiens
aucauuaugaaguca

SEQ ID NO: 1019471 - RNA, 13 nt, Homo sapiens
aucauuccuugag

SEQ ID NO: 1019472 - RNA, 17 nt, Homo sapiens
aucauucucugucucau

SEQ ID NO: 1019473 - RNA, 21 nt, Homo sapiens
aucauuucaaaacucauuucc

SEQ ID NO: 1019474 - RNA, 18 nt, Homo sapiens
aucauuucugcaucagcu

SEQ ID NO: 1019475 - RNA, 19 nt, Homo sapiens
aucauuuuuaaauauaggu

SEQ ID NO: 1019476 - RNA, 16 nt, Homo sapiens
aucauuuuuguacagu

SEQ ID NO: 1019477 - RNA, 19 nt, Homo sapiens
aucauuuuuguaucuacau

SEQ ID NO: 1019478 - RNA, 17 nt, Homo sapiens
auccaacaugugcucag

SEQ ID NO: 1019479 - RNA, 20 nt, Homo sapiens
auccaacaugugcucaggga

SEQ ID NO: 1019480 - RNA, 18 nt, Homo sapiens
auccaagaaucagugaag

SEQ ID NO: 1019481 - RNA, 18 nt, Homo sapiens
auccacaaucugacauuc

SEQ ID NO: 1019482 - RNA, 15 nt, Homo sapiens
auccacccaccucag

SEQ ID NO: 1019483 - RNA, 16 nt, Homo sapiens
auccacccaccucagc

SEQ ID NO: 1019484 - RNA, 16 nt, Homo sapiens
auccacuaaaaucaaa

SEQ ID NO: 1019485 - RNA, 18 nt, Homo sapiens
auccacuucucucaggau

SEQ ID NO: 1019486 - RNA, 16 nt, Homo sapiens
auccagaaauaaugaa

SEQ ID NO: 1019487 - RNA, 18 nt, Homo sapiens
auccagccuccugcuaac

SEQ ID NO: 1019488 - RNA, 14 nt, Homo sapiens
auccagcuaugaau

SEQ ID NO: 1019489 - RNA, 16 nt, Homo sapiens
auccagucucccaacu

SEQ ID NO: 1019490 - RNA, 16 nt, Homo sapiens
auccaguuugcaauua

SEQ ID NO: 1019491 - RNA, 22 nt, Homo sapiens
auccauagcaccuccacauacc

SEQ ID NO: 1019492 - RNA, 12 nt, Homo sapiens
auccaucucuca

SEQ ID NO: 1019493 - RNA, 20 nt, Homo sapiens
auccaugcuuggguguaaca

SEQ ID NO: 1019494 - RNA, 14 nt, Homo sapiens
aucccagcuacuca

SEQ ID NO: 1019495 - RNA, 17 nt, Homo sapiens
aucccagcuacucaaga

SEQ ID NO: 1019496 - RNA, 15 nt, Homo sapiens
aucccaguggccuca

SEQ ID NO: 1019497 - RNA, 18 nt, Homo sapiens
aucccaucucuccauaua

SEQ ID NO: 1019498 - RNA, 14 nt, Homo sapiens
auccccauccucca

SEQ ID NO: 1019499 - RNA, 19 nt, Homo sapiens
auccccuccguggcaucac

SEQ ID NO: 1019500 - RNA, 17 nt, Homo sapiens
auccccuuggcugugag

SEQ ID NO: 1019501 - RNA, 22 nt, Homo sapiens
aucccgccucuucuucuucaga

SEQ ID NO: 1019502 - RNA, 17 nt, Homo sapiens
aucccuaaugcugcaga

SEQ ID NO: 1019503 - RNA, 12 nt, Homo sapiens
aucccuaccccc

SEQ ID NO: 1019504 - RNA, 19 nt, Homo sapiens
auccgaaguaugagggaaa

SEQ ID NO: 1019505 - RNA, 15 nt, Homo sapiens
auccgaggcaggguc

SEQ ID NO: 1019506 - RNA, 17 nt, Homo sapiens
augagaaggaauuugag

SEQ ID NO: 1019507 - RNA, 17 nt, Homo sapiens
augagaccacuguuauc

SEQ ID NO: 1019508 - RNA, 15 nt, Homo sapiens
augagagaacuggag

SEQ ID NO: 1019509 - RNA, 15 nt, Homo sapiens
augagcaaaaccaaa

SEQ ID NO: 1019510 - RNA, 20 nt, Homo sapiens
augagcaucccaggaucgca

SEQ ID NO: 1019511 - RNA, 18 nt, Homo sapiens
augagcauccucucucac

SEQ ID NO: 1019512 - RNA, 18 nt, Homo sapiens
augagccaccaugcccag

SEQ ID NO: 1019513 - RNA, 16 nt, Homo sapiens
augagccgcugugagc

SEQ ID NO: 1019514 - RNA, 14 nt, Homo sapiens
augagcucuuccaa

SEQ ID NO: 1019515 - RNA, 17 nt, Homo sapiens
augagcugacaucucag

SEQ ID NO: 1019516 - RNA, 22 nt, Homo sapiens
augagcuggggaugucucucau

SEQ ID NO: 1019517 - RNA, 23 nt, Homo sapiens
augagcuggggaugucucucaug

SEQ ID NO: 1019518 - RNA, 22 nt, Homo sapiens
augaggaauuucuguucuucca

SEQ ID NO: 1019519 - RNA, 20 nt, Homo sapiens
augaggagaaaggggcccca

SEQ ID NO: 1019520 - RNA, 22 nt, Homo sapiens
augaggucauagcagugcuuga

SEQ ID NO: 1019521 - RNA, 16 nt, Homo sapiens
augagguggagagugg

SEQ ID NO: 1019522 - RNA, 21 nt, Homo sapiens
augagguuucuuugacuucaa

SEQ ID NO: 1019523 - RNA, 18 nt, Homo sapiens
augagucaaugugcagug

SEQ ID NO: 1019524 - RNA, 22 nt, Homo sapiens
augaguuuuugauagcuuuauu

SEQ ID NO: 1019525 - RNA, 19 nt, Homo sapiens
augauaauauuguggugcc

SEQ ID NO: 1019526 - RNA, 15 nt, Homo sapiens
augauacagagggau

SEQ ID NO: 1019527 - RNA, 14 nt, Homo sapiens
augaucacggcuca

SEQ ID NO: 1019528 - RNA, 17 nt, Homo sapiens
augaucagcuguuuguc

SEQ ID NO: 1019529 - RNA, 22 nt, Homo sapiens
augaucaucacaaucaucauca

SEQ ID NO: 1019530 - RNA, 16 nt, Homo sapiens
augauccuaaugaaug

SEQ ID NO: 1019531 - RNA, 22 nt, Homo sapiens
augauccuaaugaaugcauaaa

SEQ ID NO: 1019532 - RNA, 18 nt, Homo sapiens
augaucuaggaagacuuu

SEQ ID NO: 1019533 - RNA, 12 nt, Homo sapiens
augaucuuggcu

SEQ ID NO: 1019534 - RNA, 22 nt, Homo sapiens
augaucuuggcuuuccuauaag

SEQ ID NO: 1019535 - RNA, 19 nt, Homo sapiens
augaugagaguuucuguua

SEQ ID NO: 1019536 - RNA, 18 nt, Homo sapiens
augaugccucaugauaug

SEQ ID NO: 1019537 - RNA, 13 nt, Homo sapiens
augauuaacuaau

SEQ ID NO: 1019538 - RNA, 12 nt, Homo sapiens
augauuaguaaa

SEQ ID NO: 1019539 - RNA, 21 nt, Homo sapiens
augauucuuuguuacaggcac

SEQ ID NO: 1019540 - RNA, 21 nt, Homo sapiens
augauuggauuauucauuuaa

SEQ ID NO: 1019541 - RNA, 21 nt, Homo sapiens
augauuguuuuugcucaaggc

SEQ ID NO: 1019542 - RNA, 15 nt, Homo sapiens
augcaaaguagcaau

SEQ ID NO: 1019543 - RNA, 19 nt, Homo sapiens
augcaaauccuaugugauu

SEQ ID NO: 1019544 - RNA, 17 nt, Homo sapiens
augcaacaacauguaua

SEQ ID NO: 1019545 - RNA, 18 nt, Homo sapiens
augcaacaacauguauaa

SEQ ID NO: 1019546 - RNA, 17 nt, Homo sapiens
augcaacaggcacucaa

SEQ ID NO: 1019547 - RNA, 21 nt, Homo sapiens
augcaacauguguacuuaauu

SEQ ID NO: 1019548 - RNA, 22 nt, Homo sapiens
augcaauauuuccucaugugau

SEQ ID NO: 1019549 - RNA, 16 nt, Homo sapiens
augcaaugacucagga

SEQ ID NO: 1019550 - RNA, 14 nt, Homo sapiens
augcaaugugcuac

SEQ ID NO: 1019551 - RNA, 13 nt, Homo sapiens
augcacacagugc

SEQ ID NO: 1019552 - RNA, 17 nt, Homo sapiens
augcacauagcuaucaa

SEQ ID NO: 1019553 - RNA, 21 nt, Homo sapiens
augcacauauggacucugcac

SEQ ID NO: 1019554 - RNA, 23 nt, Homo sapiens
augcacgugugcacacacaccac

SEQ ID NO: 1019555 - RNA, 19 nt, Homo sapiens
augcacucagcucuuggcu

SEQ ID NO: 1019556 - RNA, 22 nt, Homo sapiens
augcacuguucccccugugcag

SEQ ID NO: 1019557 - RNA, 16 nt, Homo sapiens
augcagcaucuaagua

SEQ ID NO: 1019558 - RNA, 22 nt, Homo sapiens
augcagccacugugcugaauuc

SEQ ID NO: 1019559 - RNA, 13 nt, Homo sapiens
augcagcgugaag

SEQ ID NO: 1019560 - RNA, 13 nt, Homo sapiens
augcagggacaaa

SEQ ID NO: 1019561 - RNA, 14 nt, Homo sapiens
augcagggacaaau

SEQ ID NO: 1019562 - RNA, 23 nt, Homo sapiens
augcaguuuuucagaguggaaug

SEQ ID NO: 1019563 - RNA, 23 nt, Homo sapiens
augcauauccaacaugugcucag

SEQ ID NO: 1019564 - RNA, 18 nt, Homo sapiens
augcauauccugagccau

SEQ ID NO: 1019565 - RNA, 20 nt, Homo sapiens
augcaucaaguuauugacaa

SEQ ID NO: 1019566 - RNA, 19 nt, Homo sapiens
augcaugcagccacugugc

SEQ ID NO: 1019567 - RNA, 13 nt, Homo sapiens
augcauguucaaa

SEQ ID NO: 1019568 - RNA, 20 nt, Homo sapiens
augcauguuuuccagcuccu

SEQ ID NO: 1019569 - RNA, 12 nt, Homo sapiens
augcauucugag

SEQ ID NO: 1019570 - RNA, 11 nt, Homo sapiens
augccaaaaaa

SEQ ID NO: 1019571 - RNA, 17 nt, Homo sapiens
augccaagcacugugcu

SEQ ID NO: 1019572 - RNA, 18 nt, Homo sapiens
augccaagcacugugcuc

SEQ ID NO: 1019573 - RNA, 16 nt, Homo sapiens
augccacaaaacugac

SEQ ID NO: 1019574 - RNA, 21 nt, Homo sapiens
augccagcuacuuccuccucc

SEQ ID NO: 1019575 - RNA, 19 nt, Homo sapiens
augccagugacacuuccag

SEQ ID NO: 1019576 - RNA, 15 nt, Homo sapiens
augccauagcaagau

SEQ ID NO: 1019577 - RNA, 14 nt, Homo sapiens
augcccacugagga

SEQ ID NO: 1019578 - RNA, 14 nt, Homo sapiens
augccgcuacaaaa

SEQ ID NO: 1019579 - RNA, 21 nt, Homo sapiens
augccugcauggauacuacag

SEQ ID NO: 1019580 - RNA, 17 nt, Homo sapiens
augccugguggcagcug

SEQ ID NO: 1019581 - RNA, 16 nt, Homo sapiens
augcgcacaaggcuga

SEQ ID NO: 1019582 - RNA, 16 nt, Homo sapiens
augcguuuaaucacau

SEQ ID NO: 1019583 - RNA, 21 nt, Homo sapiens
augcuaaaccuuaguacugag

SEQ ID NO: 1019584 - RNA, 20 nt, Homo sapiens
augcuaaagaaaaagucauc

SEQ ID NO: 1019585 - RNA, 22 nt, Homo sapiens
augcuaccuugugacccagcac

SEQ ID NO: 1019586 - RNA, 17 nt, Homo sapiens
augcuaguuugaccuca

SEQ ID NO: 1019587 - RNA, 16 nt, Homo sapiens
augcuauuucacucua

SEQ ID NO: 1019588 - RNA, 12 nt, Homo sapiens
augcucaagaaa

SEQ ID NO: 1019589 - RNA, 14 nt, Homo sapiens
augcucagaccagc

SEQ ID NO: 1019590 - RNA, 22 nt, Homo sapiens
augcucagcccugacuggugcu

SEQ ID NO: 1019591 - RNA, 13 nt, Homo sapiens
augcuccuuccaa

SEQ ID NO: 1019592 - RNA, 18 nt, Homo sapiens
augcugacccaugcaaua

SEQ ID NO: 1019593 - RNA, 14 nt, Homo sapiens
augcugaccugugu

SEQ ID NO: 1019594 - RNA, 18 nt, Homo sapiens
augcugcaaauaaauuca

SEQ ID NO: 1019595 - RNA, 21 nt, Homo sapiens
augcuggguucugcacagcug

SEQ ID NO: 1019596 - RNA, 17 nt, Homo sapiens
augcuguugauugcuaa

SEQ ID NO: 1019597 - RNA, 23 nt, Homo sapiens
augcuguugauugcuaaauguaa

SEQ ID NO: 1019598 - RNA, 14 nt, Homo sapiens
augcuuauaggugg

SEQ ID NO: 1019599 - RNA, 20 nt, Homo sapiens
augcuuuaaacauugguucu

SEQ ID NO: 1019600 - RNA, 18 nt, Homo sapiens
augcuuuaagugcacaac

SEQ ID NO: 1019601 - RNA, 15 nt, Homo sapiens
augcuuugcuucaaa

SEQ ID NO: 1019602 - RNA, 16 nt, Homo sapiens
auggaaaacagacuca

SEQ ID NO: 1019603 - RNA, 16 nt, Homo sapiens
auggaacucauuccug

SEQ ID NO: 1019604 - RNA, 13 nt, Homo sapiens
auggaagcauauu

SEQ ID NO: 1019605 - RNA, 13 nt, Homo sapiens
auggaagcuucca

SEQ ID NO: 1019606 - RNA, 20 nt, Homo sapiens
auggaauauuccccuaucuc

SEQ ID NO: 1019607 - RNA, 20 nt, Homo sapiens
auggaauuucucccagucau

SEQ ID NO: 1019608 - RNA, 15 nt, Homo sapiens
auggacauaagacag

SEQ ID NO: 1019609 - RNA, 18 nt, Homo sapiens
auggacaugaucuucuuu

SEQ ID NO: 1019610 - RNA, 19 nt, Homo sapiens
auggaccaggaagcccuga

SEQ ID NO: 1019611 - RNA, 21 nt, Homo sapiens
auggagacaagggcaucaucu

SEQ ID NO: 1019612 - RNA, 21 nt, Homo sapiens
auggagauauuuacaugaauu

SEQ ID NO: 1019613 - RNA, 17 nt, Homo sapiens
auggagcaugaauggua

SEQ ID NO: 1019614 - RNA, 17 nt, Homo sapiens
auggaggcaugccaaau

SEQ ID NO: 1019615 - RNA, 16 nt, Homo sapiens
auggaguauaugucaa

SEQ ID NO: 1019616 - RNA, 16 nt, Homo sapiens
auggcaaaaacaaagg

SEQ ID NO: 1019617 - RNA, 13 nt, Homo sapiens
auggccagccaac

SEQ ID NO: 1019618 - RNA, 18 nt, Homo sapiens
auggccagugugauccca

SEQ ID NO: 1019619 - RNA, 23 nt, Homo sapiens
auggccgaaaaggauaugcagua

SEQ ID NO: 1019620 - RNA, 23 nt, Homo sapiens
auggccggcuggaaaugcugggc

SEQ ID NO: 1019621 - RNA, 13 nt, Homo sapiens
auggccucaagau

SEQ ID NO: 1019622 - RNA, 20 nt, Homo sapiens
auggccucaagaucaaugaa

SEQ ID NO: 1019623 - RNA, 22 nt, Homo sapiens
auggccuggggaagcugugaaa

SEQ ID NO: 1019624 - RNA, 17 nt, Homo sapiens
auggccuuggagggcau

SEQ ID NO: 1019625 - RNA, 16 nt, Homo sapiens
auggcuaguaucaaaa

SEQ ID NO: 1019626 - RNA, 20 nt, Homo sapiens
auggcuauaaacaauuacau

SEQ ID NO: 1019627 - RNA, 17 nt, Homo sapiens
auggcucaaucuauccu

SEQ ID NO: 1019628 - RNA, 14 nt, Homo sapiens
auggcucacuauga

SEQ ID NO: 1019629 - RNA, 12 nt, Homo sapiens
auggcucagaug

SEQ ID NO: 1019630 - RNA, 14 nt, Homo sapiens
auggcucuaaaaag

SEQ ID NO: 1019631 - RNA, 18 nt, Homo sapiens
auggcuggccacugcaca

SEQ ID NO: 1019632 - RNA, 17 nt, Homo sapiens
auggcugugccucugcc

SEQ ID NO: 1019633 - RNA, 17 nt, Homo sapiens
auggcuuccuccugcgc

SEQ ID NO: 1019634 - RNA, 18 nt, Homo sapiens
auggcuugccacagcucu

SEQ ID NO: 1019635 - RNA, 19 nt, Homo sapiens
auggcuuuagcuaccucac

SEQ ID NO: 1019636 - RNA, 14 nt, Homo sapiens
augggagcuccucu

SEQ ID NO: 1019637 - RNA, 22 nt, Homo sapiens
augggaggagaggacaagggaa

SEQ ID NO: 1019638 - RNA, 12 nt, Homo sapiens
augggaugaaug

SEQ ID NO: 1019639 - RNA, 17 nt, Homo sapiens
augggauucagugcuuc

SEQ ID NO: 1019640 - RNA, 20 nt, Homo sapiens
augggcacagcaacucuaag

SEQ ID NO: 1019641 - RNA, 14 nt, Homo sapiens
augggccuggccac

SEQ ID NO: 1019642 - RNA, 19 nt, Homo sapiens
augggcucgcccaccagug

SEQ ID NO: 1019643 - RNA, 18 nt, Homo sapiens
augggcuucacuguauaa

SEQ ID NO: 1019644 - RNA, 16 nt, Homo sapiens
augggggugcauuuga

SEQ ID NO: 1019645 - RNA, 20 nt, Homo sapiens
auggguagcagagagaacaa

SEQ ID NO: 1019646 - RNA, 22 nt, Homo sapiens
augggucuggcugagcugaacc

SEQ ID NO: 1019647 - RNA, 21 nt, Homo sapiens
auggguuucuccagagggaau

SEQ ID NO: 1019648 - RNA, 21 nt, Homo sapiens
augguacuaguguuuuuuaga

SEQ ID NO: 1019649 - RNA, 20 nt, Homo sapiens
auggucaacacuuaaggguu

SEQ ID NO: 1019650 - RNA, 12 nt, Homo sapiens
cggagcuuucaa

SEQ ID NO: 1019651 - RNA, 17 nt, Homo sapiens
cggaggucucuguaaaa

SEQ ID NO: 1019652 - RNA, 10 nt, Homo sapiens
cggaucucug

SEQ ID NO: 1019653 - RNA, 13 nt, Homo sapiens
cggcaagaaggaa

SEQ ID NO: 1019654 - RNA, 15 nt, Homo sapiens
cggcauuaaagccau

SEQ ID NO: 1019655 - RNA, 14 nt, Homo sapiens
cggccacacuguac

SEQ ID NO: 1019656 - RNA, 19 nt, Homo sapiens
cggccacacuguacucugc

SEQ ID NO: 1019657 - RNA, 16 nt, Homo sapiens
cggcccaacgcaaauu

SEQ ID NO: 1019658 - RNA, 21 nt, Homo sapiens
cggccccugcugguucagggu

SEQ ID NO: 1019659 - RNA, 14 nt, Homo sapiens
cggccucccaaagu

SEQ ID NO: 1019660 - RNA, 13 nt, Homo sapiens
cggcucacugcaa

SEQ ID NO: 1019661 - RNA, 14 nt, Homo sapiens
cggcucacugcaac

SEQ ID NO: 1019662 - RNA, 23 nt, Homo sapiens
cggcugguuuuguaagaugcugg

SEQ ID NO: 1019663 - RNA, 16 nt, Homo sapiens
cgggaaagccagugac

SEQ ID NO: 1019664 - RNA, 13 nt, Homo sapiens
cgggagacucuga

SEQ ID NO: 1019665 - RNA, 15 nt, Homo sapiens
cgggagcagugucuu

SEQ ID NO: 1019666 - RNA, 22 nt, Homo sapiens
cgggaggauguucugggacaca

SEQ ID NO: 1019667 - RNA, 21 nt, Homo sapiens
cgggcgcggccagccccggcc

SEQ ID NO: 1019668 - RNA, 18 nt, Homo sapiens
cgggcugggagcucugca

SEQ ID NO: 1019669 - RNA, 16 nt, Homo sapiens
cggggaggaaccacug

SEQ ID NO: 1019670 - RNA, 15 nt, Homo sapiens
cggguggaucaccug

SEQ ID NO: 1019671 - RNA, 19 nt, Homo sapiens
cgggugggcggcuggagac

SEQ ID NO: 1019672 - RNA, 13 nt, Homo sapiens
cggguguguacac

SEQ ID NO: 1019673 - RNA, 14 nt, Homo sapiens
cgguagugccugaa

SEQ ID NO: 1019674 - RNA, 14 nt, Homo sapiens
cggucguguuguga

SEQ ID NO: 1019675 - RNA, 14 nt, Homo sapiens
cguaacaacugugg

SEQ ID NO: 1019676 - RNA, 13 nt, Homo sapiens
cguaacccaacuc

SEQ ID NO: 1019677 - RNA, 12 nt, Homo sapiens
cguacaguucuu

SEQ ID NO: 1019678 - RNA, 18 nt, Homo sapiens
cguagcuuucccaaauaa

SEQ ID NO: 1019679 - RNA, 21 nt, Homo sapiens
cguaucugcucuuaggugcuu

SEQ ID NO: 1019680 - RNA, 17 nt, Homo sapiens
cguaucuuuuaaugauc

SEQ ID NO: 1019681 - RNA, 20 nt, Homo sapiens
cguaugguggcucaugucua

SEQ ID NO: 1019682 - RNA, 11 nt, Homo sapiens
cgucacagccu

SEQ ID NO: 1019683 - RNA, 11 nt, Homo sapiens
cguccacaggg

SEQ ID NO: 1019684 - RNA, 20 nt, Homo sapiens
cguccagcuggaagggucaa

SEQ ID NO: 1019685 - RNA, 13 nt, Homo sapiens
cgucccuaccucc

SEQ ID NO: 1019686 - RNA, 18 nt, Homo sapiens
cgucuaguuaacauuuca

SEQ ID NO: 1019687 - RNA, 19 nt, Homo sapiens
cgucuaguuaacauuucaa

SEQ ID NO: 1019688 - RNA, 22 nt, Homo sapiens
cgucuuagcaagaaguaaaaug

SEQ ID NO: 1019689 - RNA, 18 nt, Homo sapiens
cgugaaggccgagaagca

SEQ ID NO: 1019690 - RNA, 22 nt, Homo sapiens
cgugaagggauuuuagucacac

SEQ ID NO: 1019691 - RNA, 22 nt, Homo sapiens
cgugauacuguacauagcuguu

SEQ ID NO: 1019692 - RNA, 15 nt, Homo sapiens
cgugaucaaagccac

SEQ ID NO: 1019693 - RNA, 15 nt, Homo sapiens
cgugauccaccugcc

SEQ ID NO: 1019694 - RNA, 19 nt, Homo sapiens
cgugauuuugcuguagaag

SEQ ID NO: 1019695 - RNA, 17 nt, Homo sapiens
cgugcacacaccagagc

SEQ ID NO: 1019696 - RNA, 13 nt, Homo sapiens
cgugcaugugcac

SEQ ID NO: 1019697 - RNA, 13 nt, Homo sapiens
cguggaaaggggc

SEQ ID NO: 1019698 - RNA, 16 nt, Homo sapiens
cguggaaagggugcug

SEQ ID NO: 1019699 - RNA, 20 nt, Homo sapiens
cguggaauugugcugaguug

SEQ ID NO: 1019700 - RNA, 17 nt, Homo sapiens
cguggacuuaccgccug

SEQ ID NO: 1019701 - RNA, 15 nt, Homo sapiens
cguggagaugucuuc

SEQ ID NO: 1019702 - RNA, 19 nt, Homo sapiens
cguggcuaagaguguccua

SEQ ID NO: 1019703 - RNA, 13 nt, Homo sapiens
cgugggaucugcc

SEQ ID NO: 1019704 - RNA, 18 nt, Homo sapiens
cgugggcaaacaggcagu

SEQ ID NO: 1019705 - RNA, 17 nt, Homo sapiens
cguguacuacaauuuaa

SEQ ID NO: 1019706 - RNA, 15 nt, Homo sapiens
cgugugacuacuccc

SEQ ID NO: 1019707 - RNA, 16 nt, Homo sapiens
cgugugcgugcaugug

SEQ ID NO: 1019708 - RNA, 13 nt, Homo sapiens
cgugugugcaagu

SEQ ID NO: 1019709 - RNA, 21 nt, Homo sapiens
cguuaaggagaugggccuuuu

SEQ ID NO: 1019710 - RNA, 15 nt, Homo sapiens
cguuaugguguuucu

SEQ ID NO: 1019711 - RNA, 13 nt, Homo sapiens
cguuccuauuguc

SEQ ID NO: 1019712 - RNA, 19 nt, Homo sapiens
cguuccuauugucauuaaa

SEQ ID NO: 1019713 - RNA, 15 nt, Homo sapiens
cguucucacacccac

SEQ ID NO: 1019714 - RNA, 17 nt, Homo sapiens
cguugcccccagacuuc

SEQ ID NO: 1019715 - RNA, 13 nt, Homo sapiens
cguuuaagacugu

SEQ ID NO: 1019716 - RNA, 15 nt, Homo sapiens
cguuucaaaaacaca

SEQ ID NO: 1019717 - RNA, 19 nt, Homo sapiens
cguuucuaugacacaugca

SEQ ID NO: 1019718 - RNA, 14 nt, Homo sapiens
cguuucuguauaca

SEQ ID NO: 1019719 - RNA, 21 nt, Homo sapiens
cguuugcauuugcagugcauc

SEQ ID NO: 1019720 - RNA, 23 nt, Homo sapiens
cguuuugugugguggcaccuccu

SEQ ID NO: 1019721 - RNA, 24 nt, Homo sapiens
cguuuuuaagguggaaacuccugu

SEQ ID NO: 1019722 - RNA, 20 nt, Homo sapiens
cuaaaaacacagacauucug

SEQ ID NO: 1019723 - RNA, 18 nt, Homo sapiens
cuaaaacuuaacauucau

SEQ ID NO: 1019724 - RNA, 12 nt, Homo sapiens
cuaaaagauuau

SEQ ID NO: 1019725 - RNA, 18 nt, Homo sapiens
cuaaaagcacacucaucc

SEQ ID NO: 1019726 - RNA, 22 nt, Homo sapiens
cuaaaauaagggcagagucaca

SEQ ID NO: 1019727 - RNA, 13 nt, Homo sapiens
cuaaaauauuauu

SEQ ID NO: 1019728 - RNA, 14 nt, Homo sapiens
cuaaaaucagggaa

SEQ ID NO: 1019729 - RNA, 15 nt, Homo sapiens
cuaaaauuagaugaa

SEQ ID NO: 1019730 - RNA, 19 nt, Homo sapiens
cuaaaauuagaugaacuca

SEQ ID NO: 1019731 - RNA, 21 nt, Homo sapiens
cuaaaauuguauagaccuaaa

SEQ ID NO: 1019732 - RNA, 14 nt, Homo sapiens
cuaaacuaucuuuu

SEQ ID NO: 1019733 - RNA, 14 nt, Homo sapiens
cuaaacucucauuu

SEQ ID NO: 1019734 - RNA, 10 nt, Homo sapiens
cuaaacugua

SEQ ID NO: 1019735 - RNA, 19 nt, Homo sapiens
cuaaagaaaaagucaucca

SEQ ID NO: 1019736 - RNA, 21 nt, Homo sapiens
cuaaagaggaaggaccaagga

SEQ ID NO: 1019737 - RNA, 19 nt, Homo sapiens
cuaaagguuguauugcaua

SEQ ID NO: 1019738 - RNA, 13 nt, Homo sapiens
cuaaauaaaugaa

SEQ ID NO: 1019739 - RNA, 16 nt, Homo sapiens
cuaaauaccugcccug

SEQ ID NO: 1019740 - RNA, 21 nt, Homo sapiens
cuaaauauugauuucugccuu

SEQ ID NO: 1019741 - RNA, 15 nt, Homo sapiens
cuaaaucucuaauau

SEQ ID NO: 1019742 - RNA, 16 nt, Homo sapiens
cuaaaugaagugcaaa

SEQ ID NO: 1019743 - RNA, 21 nt, Homo sapiens
cuaaaugaguaaacccagcug

SEQ ID NO: 1019744 - RNA, 16 nt, Homo sapiens
cuaaaugcagugaauu

SEQ ID NO: 1019745 - RNA, 19 nt, Homo sapiens
cuaaauguaacagucugau

SEQ ID NO: 1019746 - RNA, 19 nt, Homo sapiens
cuaacaaagaacaagcauu

SEQ ID NO: 1019747 - RNA, 17 nt, Homo sapiens
cuaaccagccuggucaa

SEQ ID NO: 1019748 - RNA, 21 nt, Homo sapiens
cuaaccucugagucaccaucu

SEQ ID NO: 1019749 - RNA, 16 nt, Homo sapiens
cuaaccugaacugaug

SEQ ID NO: 1019750 - RNA, 17 nt, Homo sapiens
cuaacgacuucagggca

SEQ ID NO: 1019751 - RNA, 13 nt, Homo sapiens
cuaacuccaguga

SEQ ID NO: 1019752 - RNA, 14 nt, Homo sapiens
cuaacucuggugcu

SEQ ID NO: 1019753 - RNA, 17 nt, Homo sapiens
cuaacuugucuuuggac

SEQ ID NO: 1019754 - RNA, 21 nt, Homo sapiens
cuaacuuuuuugcuauccagc

SEQ ID NO: 1019755 - RNA, 19 nt, Homo sapiens
cuaagaaauaugcacaaua

SEQ ID NO: 1019756 - RNA, 14 nt, Homo sapiens
cuaagaagggaaaa

SEQ ID NO: 1019757 - RNA, 16 nt, Homo sapiens
cuaagagaacaaugug

SEQ ID NO: 1019758 - RNA, 15 nt, Homo sapiens
cuaagagugaaguag

SEQ ID NO: 1019759 - RNA, 12 nt, Homo sapiens
cuaagaugacau

SEQ ID NO: 1019760 - RNA, 20 nt, Homo sapiens
cuaagcacgggccauaugaa

SEQ ID NO: 1019761 - RNA, 17 nt, Homo sapiens
cuaagcagaccacugau

SEQ ID NO: 1019762 - RNA, 13 nt, Homo sapiens
cuaagccacucuu

SEQ ID NO: 1019763 - RNA, 17 nt, Homo sapiens
cuaagccacucuuccaa

SEQ ID NO: 1019764 - RNA, 21 nt, Homo sapiens
cuaagccacucuuccaaaggc

SEQ ID NO: 1019765 - RNA, 17 nt, Homo sapiens
cuaagccuuuccauaag

SEQ ID NO: 1019766 - RNA, 23 nt, Homo sapiens
cuaagcgaauguguacaaagugu

SEQ ID NO: 1019767 - RNA, 16 nt, Homo sapiens
cuaagcuauucaguaa

SEQ ID NO: 1019768 - RNA, 19 nt, Homo sapiens
cuaagcuuugccagcugcu

SEQ ID NO: 1019769 - RNA, 14 nt, Homo sapiens
cuaaggaaaggaau

SEQ ID NO: 1019770 - RNA, 20 nt, Homo sapiens
cuaaggaauaugagcuuuau

SEQ ID NO: 1019771 - RNA, 15 nt, Homo sapiens
cuaagggcccaaagg

SEQ ID NO: 1019772 - RNA, 18 nt, Homo sapiens
cuaaguaaaaccacagca

SEQ ID NO: 1019773 - RNA, 23 nt, Homo sapiens
cuaagugaaauaagccagacauc

SEQ ID NO: 1019774 - RNA, 17 nt, Homo sapiens
cuaaguguaccagagaa

SEQ ID NO: 1019775 - RNA, 17 nt, Homo sapiens
cuaaguucacggcaaaa

SEQ ID NO: 1019776 - RNA, 17 nt, Homo sapiens
cuaauaaacauccuuca

SEQ ID NO: 1019777 - RNA, 19 nt, Homo sapiens
cuaauacagcaacaauuua

SEQ ID NO: 1019778 - RNA, 22 nt, Homo sapiens
cuaauagagugguacagcacug

SEQ ID NO: 1019779 - RNA, 12 nt, Homo sapiens
cuaauauauuaa

SEQ ID NO: 1019780 - RNA, 18 nt, Homo sapiens
cuaaucaauaccuacaag

SEQ ID NO: 1019781 - RNA, 18 nt, Homo sapiens
cuaaucauccaaugcuca

SEQ ID NO: 1019782 - RNA, 15 nt, Homo sapiens
cuaauggacuuucag

SEQ ID NO: 1019783 - RNA, 15 nt, Homo sapiens
cuaauuccacacccu

SEQ ID NO: 1019784 - RNA, 17 nt, Homo sapiens
cuaauuccacacccuca

SEQ ID NO: 1019785 - RNA, 18 nt, Homo sapiens
cuaauucccagaguguga

SEQ ID NO: 1019786 - RNA, 21 nt, Homo sapiens
cuaauuuauccugaaauuuca

SEQ ID NO: 1019787 - RNA, 18 nt, Homo sapiens
cuaauuugauguuuacag

SEQ ID NO: 1019788 - RNA, 15 nt, Homo sapiens
cuaauuuuucagcuc

SEQ ID NO: 1019789 - RNA, 20 nt, Homo sapiens
cuaauuuuucagcuccuuca

SEQ ID NO: 1019790 - RNA, 19 nt, Homo sapiens
cuacacaccuaagggacau

SEQ ID NO: 1019791 - RNA, 21 nt, Homo sapiens
cuacacagagcaggacugcac

SEQ ID NO: 1019792 - RNA, 14 nt, Homo sapiens
cuacacagaucaca

SEQ ID NO: 1019793 - RNA, 11 nt, Homo sapiens
cuacaguauua

SEQ ID NO: 1019794 - RNA, 23 nt, Homo sapiens
cuacaucuucugccuuagucuca

SEQ ID NO: 1019795 - RNA, 19 nt, Homo sapiens
cuacauggaguauauguca

SEQ ID NO: 1019796 - RNA, 23 nt, Homo sapiens
cucaccucauagcuaauuuuugc

SEQ ID NO: 1019797 - RNA, 16 nt, Homo sapiens
cucacgcaccucccau

SEQ ID NO: 1019798 - RNA, 12 nt, Homo sapiens
cucacgccugua

SEQ ID NO: 1019799 - RNA, 14 nt, Homo sapiens
cucacuaugcugcu

SEQ ID NO: 1019800 - RNA, 14 nt, Homo sapiens
cucacuuaucccaa

SEQ ID NO: 1019801 - RNA, 19 nt, Homo sapiens
cucacuuuucuccaugagu

SEQ ID NO: 1019802 - RNA, 13 nt, Homo sapiens
cucagaaggcaaa

SEQ ID NO: 1019803 - RNA, 15 nt, Homo sapiens
cucagaauauaccca

SEQ ID NO: 1019804 - RNA, 20 nt, Homo sapiens
cucagaauugaucauuuucc

SEQ ID NO: 1019805 - RNA, 12 nt, Homo sapiens
cucagaccagcu

SEQ ID NO: 1019806 - RNA, 16 nt, Homo sapiens
cucagacuagcuuuca

SEQ ID NO: 1019807 - RNA, 16 nt, Homo sapiens
cucagagccagucuuu

SEQ ID NO: 1019808 - RNA, 12 nt, Homo sapiens
cucagaggccag

SEQ ID NO: 1019809 - RNA, 13 nt, Homo sapiens
cucagagugcaag

SEQ ID NO: 1019810 - RNA, 14 nt, Homo sapiens
cucagaugccacuu

SEQ ID NO: 1019811 - RNA, 14 nt, Homo sapiens
cucagcaugcaucc

SEQ ID NO: 1019812 - RNA, 15 nt, Homo sapiens
cucagccaagcacag

SEQ ID NO: 1019813 - RNA, 21 nt, Homo sapiens
cucagcucccauuucuacucu

SEQ ID NO: 1019814 - RNA, 16 nt, Homo sapiens
cucagcuggaucucca

SEQ ID NO: 1019815 - RNA, 15 nt, Homo sapiens
cucaggaauguuugc

SEQ ID NO: 1019816 - RNA, 17 nt, Homo sapiens
cucaggacugcaacagg

SEQ ID NO: 1019817 - RNA, 13 nt, Homo sapiens
cucaggagacaau

SEQ ID NO: 1019818 - RNA, 17 nt, Homo sapiens
cucagggacagagccau

SEQ ID NO: 1019819 - RNA, 21 nt, Homo sapiens
cucagggacuggcacacuggc

SEQ ID NO: 1019820 - RNA, 14 nt, Homo sapiens
cucaggucccugca

SEQ ID NO: 1019821 - RNA, 21 nt, Homo sapiens
cucaggugaaaauccaucuca

SEQ ID NO: 1019822 - RNA, 18 nt, Homo sapiens
cucagucaugcauaaaua

SEQ ID NO: 1019823 - RNA, 24 nt, Homo sapiens
cucaguccacugcugaggacacuc

SEQ ID NO: 1019824 - RNA, 21 nt, Homo sapiens
cucagucccuaaaaacacaga

SEQ ID NO: 1019825 - RNA, 18 nt, Homo sapiens
cucagucucugagcagug

SEQ ID NO: 1019826 - RNA, 23 nt, Homo sapiens
cucagucuuaaaaaaauaugccu

SEQ ID NO: 1019827 - RNA, 15 nt, Homo sapiens
cucagugaacuguga

SEQ ID NO: 1019828 - RNA, 21 nt, Homo sapiens
cucaguguccaguugcagcug

SEQ ID NO: 1019829 - RNA, 21 nt, Homo sapiens
cucauagcuaauuuuugcaaa

SEQ ID NO: 1019830 - RNA, 13 nt, Homo sapiens
cucauaguauggu

SEQ ID NO: 1019831 - RNA, 17 nt, Homo sapiens
cucauaugauugugcac

SEQ ID NO: 1019832 - RNA, 14 nt, Homo sapiens
cucaucaggccauu

SEQ ID NO: 1019833 - RNA, 23 nt, Homo sapiens
cucaucaggccauugucccugaa

SEQ ID NO: 1019834 - RNA, 20 nt, Homo sapiens
cucaucagucuccauacccc

SEQ ID NO: 1019835 - RNA, 23 nt, Homo sapiens
cucaucaguguccucuugcucaa

SEQ ID NO: 1019836 - RNA, 21 nt, Homo sapiens
cucauccccaccugucuucaa

SEQ ID NO: 1019837 - RNA, 14 nt, Homo sapiens
cucaucccuguucc

SEQ ID NO: 1019838 - RNA, 15 nt, Homo sapiens
cucaucucuccucca

SEQ ID NO: 1019839 - RNA, 13 nt, Homo sapiens
cucaucugugauu

SEQ ID NO: 1019840 - RNA, 19 nt, Homo sapiens
cucaugagaaguugauaua

SEQ ID NO: 1019841 - RNA, 14 nt, Homo sapiens
cucaugauauguca

SEQ ID NO: 1019842 - RNA, 14 nt, Homo sapiens
cucaugcuguucca

SEQ ID NO: 1019843 - RNA, 14 nt, Homo sapiens
cucaugugaucaca

SEQ ID NO: 1019844 - RNA, 20 nt, Homo sapiens
cucauuacuacucagccuuc

SEQ ID NO: 1019845 - RNA, 17 nt, Homo sapiens
cucauuauuuuucacug

SEQ ID NO: 1019846 - RNA, 12 nt, Homo sapiens
cucauucaaaag

SEQ ID NO: 1019847 - RNA, 21 nt, Homo sapiens
cucauucauuuauucauucau

SEQ ID NO: 1019848 - RNA, 15 nt, Homo sapiens
cucauuccagaggaa

SEQ ID NO: 1019849 - RNA, 13 nt, Homo sapiens
cucauugacaaga

SEQ ID NO: 1019850 - RNA, 20 nt, Homo sapiens
cucauuucuggaaagugcaa

SEQ ID NO: 1019851 - RNA, 20 nt, Homo sapiens
cucauuuugcucaacauggu

SEQ ID NO: 1019852 - RNA, 16 nt, Homo sapiens
cuccaaaacuccugcc

SEQ ID NO: 1019853 - RNA, 22 nt, Homo sapiens
cuccaaagaaauguaagggaaa

SEQ ID NO: 1019854 - RNA, 17 nt, Homo sapiens
cuccaaauagcauuagu

SEQ ID NO: 1019855 - RNA, 13 nt, Homo sapiens
cuccaagcuccau

SEQ ID NO: 1019856 - RNA, 16 nt, Homo sapiens
cuccaauuaaggauuu

SEQ ID NO: 1019857 - RNA, 20 nt, Homo sapiens
cuccacauguucaacuauua

SEQ ID NO: 1019858 - RNA, 12 nt, Homo sapiens
cuccacugcugc

SEQ ID NO: 1019859 - RNA, 21 nt, Homo sapiens
cuccacuggaggggucuccuc

SEQ ID NO: 1019860 - RNA, 19 nt, Homo sapiens
cuccacuggccuccuggca

SEQ ID NO: 1019861 - RNA, 13 nt, Homo sapiens
cuccacugucaca

SEQ ID NO: 1019862 - RNA, 19 nt, Homo sapiens
cuccagaaagcucaucuca

SEQ ID NO: 1019863 - RNA, 23 nt, Homo sapiens
cuccagaauggucuuucuaaugu

SEQ ID NO: 1019864 - RNA, 21 nt, Homo sapiens
cuccagagggccuucccugac

SEQ ID NO: 1019865 - RNA, 20 nt, Homo sapiens
cuccagccugggugacagaa

SEQ ID NO: 1019866 - RNA, 22 nt, Homo sapiens
cuccagcucaccagccccagug

SEQ ID NO: 1019867 - RNA, 19 nt, Homo sapiens
cuccagcugaucacagaca

SEQ ID NO: 1019868 - RNA, 20 nt, Homo sapiens
cuccagcugggcucugcaau

SEQ ID NO: 1019869 - RNA, 14 nt, Homo sapiens
cuccaggaaugccu

SEQ ID NO: 1019870 - RNA, 16 nt, Homo sapiens
cuccaggaucuauuga

SEQ ID NO: 1019871 - RNA, 14 nt, Homo sapiens
cuccaggcucuuug

SEQ ID NO: 1019872 - RNA, 22 nt, Homo sapiens
cuccagguggcucugaggugcc

SEQ ID NO: 1019873 - RNA, 23 nt, Homo sapiens
cuccaggugugcacguggcaugu

SEQ ID NO: 1019874 - RNA, 13 nt, Homo sapiens
cuccaguagaaag

SEQ ID NO: 1019875 - RNA, 13 nt, Homo sapiens
cuccagugccagc

SEQ ID NO: 1019876 - RNA, 23 nt, Homo sapiens
cuccaucuccaagaaugcugaaa

SEQ ID NO: 1019877 - RNA, 10 nt, Homo sapiens
cuccaucucu

SEQ ID NO: 1019878 - RNA, 16 nt, Homo sapiens
cuccaugagacacauc

SEQ ID NO: 1019879 - RNA, 19 nt, Homo sapiens
cuccaugcugccuccagaa

SEQ ID NO: 1019880 - RNA, 21 nt, Homo sapiens
cuccauguagaagccacuauu

SEQ ID NO: 1019881 - RNA, 16 nt, Homo sapiens
cuccauguuugaugua

SEQ ID NO: 1019882 - RNA, 16 nt, Homo sapiens
cuccauucaggauucu

SEQ ID NO: 1019883 - RNA, 22 nt, Homo sapiens
cuccauugguguugacauacau

SEQ ID NO: 1019884 - RNA, 20 nt, Homo sapiens
cuccauuguucagaugcuuc

SEQ ID NO: 1019885 - RNA, 16 nt, Homo sapiens
cuccauuucacuugac

SEQ ID NO: 1019886 - RNA, 18 nt, Homo sapiens
cucccaaagugcugagau

SEQ ID NO: 1019887 - RNA, 20 nt, Homo sapiens
cucccaaagugcugagauua

SEQ ID NO: 1019888 - RNA, 15 nt, Homo sapiens
cucccagcccuaugg

SEQ ID NO: 1019889 - RNA, 20 nt, Homo sapiens
cuccccacuuguccgcuggg

SEQ ID NO: 1019890 - RNA, 18 nt, Homo sapiens
cuccccagcaagugagag

SEQ ID NO: 1019891 - RNA, 21 nt, Homo sapiens
cuccccagccuuugaucaggu

SEQ ID NO: 1019892 - RNA, 12 nt, Homo sapiens
cuccccauuugc

SEQ ID NO: 1019893 - RNA, 21 nt, Homo sapiens
cuccccggaguucaguuuuac

SEQ ID NO: 1019894 - RNA, 14 nt, Homo sapiens
cuccccuccaaaga

SEQ ID NO: 1019895 - RNA, 16 nt, Homo sapiens
cuccccugaggcucag

SEQ ID NO: 1019896 - RNA, 16 nt, Homo sapiens
cuccccuuucacaggu

SEQ ID NO: 1019897 - RNA, 13 nt, Homo sapiens
cuccccuuugccu

SEQ ID NO: 1019898 - RNA, 17 nt, Homo sapiens
cucccuaccguccuccu

SEQ ID NO: 1019899 - RNA, 23 nt, Homo sapiens
cucccuauuuuuuuucuguuaua

SEQ ID NO: 1019900 - RNA, 19 nt, Homo sapiens
cucccucagccccuucuca

SEQ ID NO: 1019901 - RNA, 19 nt, Homo sapiens
cucccugaaguaagcaaag

SEQ ID NO: 1019902 - RNA, 20 nt, Homo sapiens
cucccugcuucaauacccaa

SEQ ID NO: 1019903 - RNA, 15 nt, Homo sapiens
cucccuguaacucca

SEQ ID NO: 1019904 - RNA, 22 nt, Homo sapiens
cucccuguucuuggguaaggaa

SEQ ID NO: 1019905 - RNA, 17 nt, Homo sapiens
cucccuuaaucugccag

SEQ ID NO: 1019906 - RNA, 19 nt, Homo sapiens
cuccgcuuucuacccagcg

SEQ ID NO: 1019907 - RNA, 12 nt, Homo sapiens
cuccggggagcg

SEQ ID NO: 1019908 - RNA, 21 nt, Homo sapiens
cuccggguuugagauggacac

SEQ ID NO: 1019909 - RNA, 20 nt, Homo sapiens
cuccgucuaagucaugagcu

SEQ ID NO: 1019910 - RNA, 14 nt, Homo sapiens
cuccuaacccuuau

SEQ ID NO: 1019911 - RNA, 18 nt, Homo sapiens
cuccuauucaguucccag

SEQ ID NO: 1019912 - RNA, 16 nt, Homo sapiens
cuccucuccccagcaa

SEQ ID NO: 1019913 - RNA, 22 nt, Homo sapiens
cuccucuuucaaccucagugau

SEQ ID NO: 1019914 - RNA, 12 nt, Homo sapiens
cuccugcaaaau

SEQ ID NO: 1019915 - RNA, 19 nt, Homo sapiens
cuccuggacugccuugaau

SEQ ID NO: 1019916 - RNA, 20 nt, Homo sapiens
cuccuggccucaagugauuc

SEQ ID NO: 1019917 - RNA, 14 nt, Homo sapiens
cuccuggugcugcc

SEQ ID NO: 1019918 - RNA, 14 nt, Homo sapiens
cuccugugcaacuu

SEQ ID NO: 1019919 - RNA, 21 nt, Homo sapiens
cuccuguggucucugaccagg

SEQ ID NO: 1019920 - RNA, 19 nt, Homo sapiens
cuccuuccaacaggagcug

SEQ ID NO: 1019921 - RNA, 17 nt, Homo sapiens
cuccuugacuccaagaa

SEQ ID NO: 1019922 - RNA, 17 nt, Homo sapiens
cuccuugauugggacug

SEQ ID NO: 1019923 - RNA, 17 nt, Homo sapiens
cuccuugcuacccagaa

SEQ ID NO: 1019924 - RNA, 17 nt, Homo sapiens
cuccuuguccacccacc

SEQ ID NO: 1019925 - RNA, 19 nt, Homo sapiens
cuccuuucuuucuaacucc

SEQ ID NO: 1019926 - RNA, 14 nt, Homo sapiens
cuccuuugcaggcu

SEQ ID NO: 1019927 - RNA, 22 nt, Homo sapiens
cuccuuuggaaugcuguauuaa

SEQ ID NO: 1019928 - RNA, 17 nt, Homo sapiens
cuccuuuggccauucca

SEQ ID NO: 1019929 - RNA, 19 nt, Homo sapiens
cuccuuuugcuugaaacca

SEQ ID NO: 1019930 - RNA, 13 nt, Homo sapiens
cucgaacuccuga

SEQ ID NO: 1019931 - RNA, 16 nt, Homo sapiens
cucgagcaguccugcc

SEQ ID NO: 1019932 - RNA, 22 nt, Homo sapiens
cucgauuauucccuguacaaua

SEQ ID NO: 1019933 - RNA, 14 nt, Homo sapiens
cucgcccaccagug

SEQ ID NO: 1019934 - RNA, 20 nt, Homo sapiens
cucgggcgagucacugccuc

SEQ ID NO: 1019935 - RNA, 19 nt, Homo sapiens
cucgugguaggacuguaga

SEQ ID NO: 1019936 - RNA, 19 nt, Homo sapiens
cucguugccugccacugag

SEQ ID NO: 1019937 - RNA, 22 nt, Homo sapiens
cucuaagccacucuuccaaagg

SEQ ID NO: 1019938 - RNA, 22 nt, Homo sapiens
cucuacccuauacaacuggaca

SEQ ID NO: 1019939 - RNA, 20 nt, Homo sapiens
cucuacccuggcacuauaau

SEQ ID NO: 1019940 - RNA, 17 nt, Homo sapiens
cugauaauaauugauca

SEQ ID NO: 1019941 - RNA, 16 nt, Homo sapiens
cugauaggaaugugaa

SEQ ID NO: 1019942 - RNA, 21 nt, Homo sapiens
cugauauugccgcacuagggg

SEQ ID NO: 1019943 - RNA, 18 nt, Homo sapiens
cugauccagagcacagau

SEQ ID NO: 1019944 - RNA, 16 nt, Homo sapiens
cugaucucaguuuccu

SEQ ID NO: 1019945 - RNA, 11 nt, Homo sapiens
cugaucugcag

SEQ ID NO: 1019946 - RNA, 20 nt, Homo sapiens
cugaucugcaguuuuugccu

SEQ ID NO: 1019947 - RNA, 13 nt, Homo sapiens
cugaugcaagcaa

SEQ ID NO: 1019948 - RNA, 14 nt, Homo sapiens
cugauggaccagga

SEQ ID NO: 1019949 - RNA, 17 nt, Homo sapiens
cugauguucaguguaau

SEQ ID NO: 1019950 - RNA, 16 nt, Homo sapiens
cugauguuccacucca

SEQ ID NO: 1019951 - RNA, 17 nt, Homo sapiens
cugauuaaagguggugc

SEQ ID NO: 1019952 - RNA, 19 nt, Homo sapiens
cugauuagaaaugaccaau

SEQ ID NO: 1019953 - RNA, 22 nt, Homo sapiens
cugauuaggacuuuuauuguga

SEQ ID NO: 1019954 - RNA, 15 nt, Homo sapiens
cugauuccacuuuua

SEQ ID NO: 1019955 - RNA, 20 nt, Homo sapiens
cugauuuaaaagggcucuuu

SEQ ID NO: 1019956 - RNA, 15 nt, Homo sapiens
cugauuuucgcugau

SEQ ID NO: 1019957 - RNA, 19 nt, Homo sapiens
cugauuuuuagcuuuacaa

SEQ ID NO: 1019958 - RNA, 13 nt, Homo sapiens
cugcaaagccaua

SEQ ID NO: 1019959 - RNA, 22 nt, Homo sapiens
cugcaaaggcaccugaaugugu

SEQ ID NO: 1019960 - RNA, 18 nt, Homo sapiens
cugcaaaucagccaugug

SEQ ID NO: 1019961 - RNA, 19 nt, Homo sapiens
cugcaacaggcuugugcaa

SEQ ID NO: 1019962 - RNA, 22 nt, Homo sapiens
cugcaaccuucgccucccagga

SEQ ID NO: 1019963 - RNA, 16 nt, Homo sapiens
cugcaagcacaucugc

SEQ ID NO: 1019964 - RNA, 14 nt, Homo sapiens
cugcaagcacugca

SEQ ID NO: 1019965 - RNA, 23 nt, Homo sapiens
cugcaaucuucucagaaggcaaa

SEQ ID NO: 1019966 - RNA, 18 nt, Homo sapiens
cugcaaugggcacuggga

SEQ ID NO: 1019967 - RNA, 20 nt, Homo sapiens
cugcaauuuuaauugauuau

SEQ ID NO: 1019968 - RNA, 14 nt, Homo sapiens
cugcacaguuuucu

SEQ ID NO: 1019969 - RNA, 18 nt, Homo sapiens
cugcacaugucuuguaca

SEQ ID NO: 1019970 - RNA, 17 nt, Homo sapiens
cugcaccgagagagaug

SEQ ID NO: 1019971 - RNA, 24 nt, Homo sapiens
cugcaccgagagagauggaauaaa

SEQ ID NO: 1019972 - RNA, 11 nt, Homo sapiens
cugcacucuaa

SEQ ID NO: 1019973 - RNA, 20 nt, Homo sapiens
cugcacuggaguccagucuc

SEQ ID NO: 1019974 - RNA, 15 nt, Homo sapiens
cugcacuuacaggcc

SEQ ID NO: 1019975 - RNA, 16 nt, Homo sapiens
cugcagaauccagcua

SEQ ID NO: 1019976 - RNA, 17 nt, Homo sapiens
cugcagagggacagaug

SEQ ID NO: 1019977 - RNA, 23 nt, Homo sapiens
cugcagaggggaaaccaguguag

SEQ ID NO: 1019978 - RNA, 19 nt, Homo sapiens
cugcagcagaggcacuggg

SEQ ID NO: 1019979 - RNA, 15 nt, Homo sapiens
cugcagcucagggac

SEQ ID NO: 1019980 - RNA, 23 nt, Homo sapiens
cugcagggcccucccuuuuccca

SEQ ID NO: 1019981 - RNA, 15 nt, Homo sapiens
cugcaggucaacagc

SEQ ID NO: 1019982 - RNA, 21 nt, Homo sapiens
cugcaguagucucugugcuuu

SEQ ID NO: 1019983 - RNA, 23 nt, Homo sapiens
cugcagucccauccucuugucag

SEQ ID NO: 1019984 - RNA, 21 nt, Homo sapiens
cugcagugacgugcaccugua

SEQ ID NO: 1019985 - RNA, 14 nt, Homo sapiens
cugcauaaucauau

SEQ ID NO: 1019986 - RNA, 15 nt, Homo sapiens
cugcauaguauucca

SEQ ID NO: 1019987 - RNA, 21 nt, Homo sapiens
cugcauaguauuccauugugu

SEQ ID NO: 1019988 - RNA, 21 nt, Homo sapiens
cugcauccccuuggcugugag

SEQ ID NO: 1019989 - RNA, 23 nt, Homo sapiens
cugcaucgagucaaaacucaaau

SEQ ID NO: 1019990 - RNA, 20 nt, Homo sapiens
cugcaucuucccacaguggc

SEQ ID NO: 1019991 - RNA, 20 nt, Homo sapiens
cugcauguaccauuugcaug

SEQ ID NO: 1019992 - RNA, 12 nt, Homo sapiens
cugcauguuaca

SEQ ID NO: 1019993 - RNA, 22 nt, Homo sapiens
cugcauuuauagcauacgguau

SEQ ID NO: 1019994 - RNA, 15 nt, Homo sapiens
cugcauuuugcuauu

SEQ ID NO: 1019995 - RNA, 20 nt, Homo sapiens
cugccaacacgcccggcuaa

SEQ ID NO: 1019996 - RNA, 22 nt, Homo sapiens
cugccaacacgcccggcuaauu

SEQ ID NO: 1019997 - RNA, 16 nt, Homo sapiens
cugccacccuggggag

SEQ ID NO: 1019998 - RNA, 16 nt, Homo sapiens
cugccaccucccugac

SEQ ID NO: 1019999 - RNA, 16 nt, Homo sapiens
cugccagaugcugaug

SEQ ID NO: 1020000 - RNA, 13 nt, Homo sapiens
cugccagggagcu

SEQ ID NO: 1020001 - RNA, 14 nt, Homo sapiens
cugcccaauaugca

SEQ ID NO: 1020002 - RNA, 20 nt, Homo sapiens
cugcccaggaaggacugugc

SEQ ID NO: 1020003 - RNA, 15 nt, Homo sapiens
cugcccagugcacac

SEQ ID NO: 1020004 - RNA, 16 nt, Homo sapiens
cugccccagccuccuc

SEQ ID NO: 1020005 - RNA, 16 nt, Homo sapiens
cugcccccaauccaug

SEQ ID NO: 1020006 - RNA, 21 nt, Homo sapiens
cugcccuccccagagcacugg

SEQ ID NO: 1020007 - RNA, 16 nt, Homo sapiens
cugcccuugucacugg

SEQ ID NO: 1020008 - RNA, 21 nt, Homo sapiens
cugccggcucuuuccuugcuc

SEQ ID NO: 1020009 - RNA, 22 nt, Homo sapiens
cugccuaagugcagccccgugg

SEQ ID NO: 1020010 - RNA, 18 nt, Homo sapiens
cugccuccccaacccugc

SEQ ID NO: 1020011 - RNA, 15 nt, Homo sapiens
cugccucugacacac

SEQ ID NO: 1020012 - RNA, 15 nt, Homo sapiens
cugccugaagucaca

SEQ ID NO: 1020013 - RNA, 21 nt, Homo sapiens
cugccuucaccuccucuuuca

SEQ ID NO: 1020014 - RNA, 18 nt, Homo sapiens
cugccuugauuagacucc

SEQ ID NO: 1020015 - RNA, 19 nt, Homo sapiens
cugccuugguauagcauau

SEQ ID NO: 1020016 - RNA, 14 nt, Homo sapiens
cugccuuguguaca

SEQ ID NO: 1020017 - RNA, 17 nt, Homo sapiens
cugccuuuucaucuaau

SEQ ID NO: 1020018 - RNA, 19 nt, Homo sapiens
cugcgcccaguccuuccac

SEQ ID NO: 1020019 - RNA, 16 nt, Homo sapiens
cugcgccugacauuca

SEQ ID NO: 1020020 - RNA, 14 nt, Homo sapiens
cugcguggggacag

SEQ ID NO: 1020021 - RNA, 16 nt, Homo sapiens
cugcuaccucacuggg

SEQ ID NO: 1020022 - RNA, 15 nt, Homo sapiens
cugcuacuuaauucc

SEQ ID NO: 1020023 - RNA, 16 nt, Homo sapiens
cugcuauaacuaugac

SEQ ID NO: 1020024 - RNA, 12 nt, Homo sapiens
cugcuauuuuag

SEQ ID NO: 1020025 - RNA, 19 nt, Homo sapiens
cugcucauccccaccuguc

SEQ ID NO: 1020026 - RNA, 12 nt, Homo sapiens
cugcuccagaag

SEQ ID NO: 1020027 - RNA, 19 nt, Homo sapiens
cugcuccuggagccuuuga

SEQ ID NO: 1020028 - RNA, 18 nt, Homo sapiens
cugcucuggaaaauguga

SEQ ID NO: 1020029 - RNA, 22 nt, Homo sapiens
cugcugaaaacuagcucgugau

SEQ ID NO: 1020030 - RNA, 18 nt, Homo sapiens
cugcugacccagccuguu

SEQ ID NO: 1020031 - RNA, 21 nt, Homo sapiens
cugcuggagugaaggggccaa

SEQ ID NO: 1020032 - RNA, 14 nt, Homo sapiens
cugcuguaucuuua

SEQ ID NO: 1020033 - RNA, 23 nt, Homo sapiens
cugcugugcacauuuaugaauca

SEQ ID NO: 1020034 - RNA, 21 nt, Homo sapiens
cugcuguggcgugagggugag

SEQ ID NO: 1020035 - RNA, 21 nt, Homo sapiens
cugcuuacaauucccugcugu

SEQ ID NO: 1020036 - RNA, 18 nt, Homo sapiens
cugcuuagacauaacaaa

SEQ ID NO: 1020037 - RNA, 20 nt, Homo sapiens
cugcuuccaauuuucuggaa

SEQ ID NO: 1020038 - RNA, 22 nt, Homo sapiens
cugcuucuguguguggugagca

SEQ ID NO: 1020039 - RNA, 17 nt, Homo sapiens
cugcuucuuuucacuuc

SEQ ID NO: 1020040 - RNA, 15 nt, Homo sapiens
cugcuugcacuuugu

SEQ ID NO: 1020041 - RNA, 15 nt, Homo sapiens
cugcuugcugcucau

SEQ ID NO: 1020042 - RNA, 18 nt, Homo sapiens
cugcuuucccuuuuccau

SEQ ID NO: 1020043 - RNA, 14 nt, Homo sapiens
cugcuuugcaaauu

SEQ ID NO: 1020044 - RNA, 17 nt, Homo sapiens
cugcuuuggaaaucaca

SEQ ID NO: 1020045 - RNA, 16 nt, Homo sapiens
cugcuuugucaaaagg

SEQ ID NO: 1020046 - RNA, 19 nt, Homo sapiens
cugcuuuugaaaucuguau

SEQ ID NO: 1020047 - RNA, 16 nt, Homo sapiens
cuggaaaacccaaagu

SEQ ID NO: 1020048 - RNA, 22 nt, Homo sapiens
cuggaaaagggucuugggaaau

SEQ ID NO: 1020049 - RNA, 23 nt, Homo sapiens
cuggaaaggcucagucucaggag

SEQ ID NO: 1020050 - RNA, 14 nt, Homo sapiens
cuggaacaucauca

SEQ ID NO: 1020051 - RNA, 22 nt, Homo sapiens
cuggaacucagugugacuccuc

SEQ ID NO: 1020052 - RNA, 14 nt, Homo sapiens
cuggaauacaugaa

SEQ ID NO: 1020053 - RNA, 14 nt, Homo sapiens
cuggaccagccugu

SEQ ID NO: 1020054 - RNA, 18 nt, Homo sapiens
cuggaccccaucugugaa

SEQ ID NO: 1020055 - RNA, 18 nt, Homo sapiens
cuggacggggacugggga

SEQ ID NO: 1020056 - RNA, 18 nt, Homo sapiens
cuggagaaaaaacacacu

SEQ ID NO: 1020057 - RNA, 15 nt, Homo sapiens
cuggagaaccucauc

SEQ ID NO: 1020058 - RNA, 21 nt, Homo sapiens
cuggagccaucucuuccucau

SEQ ID NO: 1020059 - RNA, 14 nt, Homo sapiens
cuggagccuuugaa

SEQ ID NO: 1020060 - RNA, 20 nt, Homo sapiens
cuggaggccggaaucucagc

SEQ ID NO: 1020061 - RNA, 12 nt, Homo sapiens
cuggagggcuag

SEQ ID NO: 1020062 - RNA, 20 nt, Homo sapiens
cuggagggcuagaaucugga

SEQ ID NO: 1020063 - RNA, 17 nt, Homo sapiens
cuggaguccugcucugu

SEQ ID NO: 1020064 - RNA, 12 nt, Homo sapiens
cuggagugcagu

SEQ ID NO: 1020065 - RNA, 13 nt, Homo sapiens
cuggagugcaguu

SEQ ID NO: 1020066 - RNA, 12 nt, Homo sapiens
cuggaguggugu

SEQ ID NO: 1020067 - RNA, 21 nt, Homo sapiens
cuggauaacuuagguggcaag

SEQ ID NO: 1020068 - RNA, 13 nt, Homo sapiens
cuggauccaucag

SEQ ID NO: 1020069 - RNA, 21 nt, Homo sapiens
cuggaucuaccagcauaaaua

SEQ ID NO: 1020070 - RNA, 15 nt, Homo sapiens
cuggaugcagccuca

SEQ ID NO: 1020071 - RNA, 13 nt, Homo sapiens
cuggaugucucca

SEQ ID NO: 1020072 - RNA, 15 nt, Homo sapiens
cuggauucgugacaa

SEQ ID NO: 1020073 - RNA, 22 nt, Homo sapiens
cuggauuuccuaggcugacuaa

SEQ ID NO: 1020074 - RNA, 15 nt, Homo sapiens
cuggcaagaaugugu

SEQ ID NO: 1020075 - RNA, 20 nt, Homo sapiens
cuggcacugcuuccagugag

SEQ ID NO: 1020076 - RNA, 20 nt, Homo sapiens
cuggcagcaucuucacuucu

SEQ ID NO: 1020077 - RNA, 12 nt, Homo sapiens
cuggccaucucc

SEQ ID NO: 1020078 - RNA, 14 nt, Homo sapiens
cuggcccugaggug

SEQ ID NO: 1020079 - RNA, 22 nt, Homo sapiens
cuggccucccacccgaugcugc

SEQ ID NO: 1020080 - RNA, 19 nt, Homo sapiens
cuggccuccuaugccucau

SEQ ID NO: 1020081 - RNA, 23 nt, Homo sapiens
cuggccuguaaucccagcuacuu

SEQ ID NO: 1020082 - RNA, 13 nt, Homo sapiens
cuggcgugcagug

SEQ ID NO: 1020083 - RNA, 16 nt, Homo sapiens
cuggcuaugcauuuga

SEQ ID NO: 1020084 - RNA, 17 nt, Homo sapiens
cuucugaaaaaguaucc

SEQ ID NO: 1020085 - RNA, 17 nt, Homo sapiens
cuucugacuacugggca

SEQ ID NO: 1020086 - RNA, 17 nt, Homo sapiens
cuucugaggacauucca

SEQ ID NO: 1020087 - RNA, 19 nt, Homo sapiens
cuucugaggcgcugcuuug

SEQ ID NO: 1020088 - RNA, 16 nt, Homo sapiens
cuucugcacccuccac

SEQ ID NO: 1020089 - RNA, 10 nt, Homo sapiens
cuucugccau

SEQ ID NO: 1020090 - RNA, 15 nt, Homo sapiens
cuucugccuguuaua

SEQ ID NO: 1020091 - RNA, 18 nt, Homo sapiens
cuucugcuaugugacuug

SEQ ID NO: 1020092 - RNA, 16 nt, Homo sapiens
cuucugggaacuuccu

SEQ ID NO: 1020093 - RNA, 15 nt, Homo sapiens
cuucugggaccauaa

SEQ ID NO: 1020094 - RNA, 12 nt, Homo sapiens
cuucuguauuca

SEQ ID NO: 1020095 - RNA, 15 nt, Homo sapiens
cuucuguauucacuu

SEQ ID NO: 1020096 - RNA, 16 nt, Homo sapiens
cuucuuaaucuuuuca

SEQ ID NO: 1020097 - RNA, 16 nt, Homo sapiens
cuucuuacaaugcauu

SEQ ID NO: 1020098 - RNA, 16 nt, Homo sapiens
cuucuucaccauuugg

SEQ ID NO: 1020099 - RNA, 19 nt, Homo sapiens
cuucuucaucuucaccaga

SEQ ID NO: 1020100 - RNA, 13 nt, Homo sapiens
cuucuucauugca

SEQ ID NO: 1020101 - RNA, 15 nt, Homo sapiens
cuucuuccaagaaau

SEQ ID NO: 1020102 - RNA, 21 nt, Homo sapiens
cuucuugaacacucaugcuga

SEQ ID NO: 1020103 - RNA, 13 nt, Homo sapiens
cuucuuguucccc

SEQ ID NO: 1020104 - RNA, 19 nt, Homo sapiens
cuucuuuaaaaaaacacau

SEQ ID NO: 1020105 - RNA, 17 nt, Homo sapiens
cuucuuuauacuguaau

SEQ ID NO: 1020106 - RNA, 22 nt, Homo sapiens
cuugaaacauagagaucuaugu

SEQ ID NO: 1020107 - RNA, 14 nt, Homo sapiens
cuugaaaccaaaga

SEQ ID NO: 1020108 - RNA, 23 nt, Homo sapiens
cuugaaauaccagugaaccaaag

SEQ ID NO: 1020109 - RNA, 15 nt, Homo sapiens
cuugaaaucaagggc

SEQ ID NO: 1020110 - RNA, 14 nt, Homo sapiens
cuugaaaugcauua

SEQ ID NO: 1020111 - RNA, 13 nt, Homo sapiens
cuugaacacuggg

SEQ ID NO: 1020112 - RNA, 14 nt, Homo sapiens
cuugaacacugggg

SEQ ID NO: 1020113 - RNA, 22 nt, Homo sapiens
cuugaagaaccucucacuucac

SEQ ID NO: 1020114 - RNA, 20 nt, Homo sapiens
cuugaagauaucuugaaaug

SEQ ID NO: 1020115 - RNA, 18 nt, Homo sapiens
cuugaauaaauuugccca

SEQ ID NO: 1020116 - RNA, 19 nt, Homo sapiens
cuugaauaaauuugcccaa

SEQ ID NO: 1020117 - RNA, 21 nt, Homo sapiens
cuugaauaaauuugcccaaaa

SEQ ID NO: 1020118 - RNA, 20 nt, Homo sapiens
cuugaaucucugaauuugag

SEQ ID NO: 1020119 - RNA, 15 nt, Homo sapiens
cuugaaugcagggac

SEQ ID NO: 1020120 - RNA, 23 nt, Homo sapiens
cuugaauggcaugcuaguagcag

SEQ ID NO: 1020121 - RNA, 15 nt, Homo sapiens
cuugaaugugucacu

SEQ ID NO: 1020122 - RNA, 13 nt, Homo sapiens
cuugaauguucuc

SEQ ID NO: 1020123 - RNA, 14 nt, Homo sapiens
cuugaauguucucu

SEQ ID NO: 1020124 - RNA, 18 nt, Homo sapiens
cuugacccccuugagggu

SEQ ID NO: 1020125 - RNA, 19 nt, Homo sapiens
cuugaccucaggugaucca

SEQ ID NO: 1020126 - RNA, 20 nt, Homo sapiens
cuugaccucaggugauccac

SEQ ID NO: 1020127 - RNA, 21 nt, Homo sapiens
cuugagaaaccuuauuguacc

SEQ ID NO: 1020128 - RNA, 15 nt, Homo sapiens
cuugagccaguaauu

SEQ ID NO: 1020129 - RNA, 18 nt, Homo sapiens
cuugaggaaaacaagcau

SEQ ID NO: 1020130 - RNA, 14 nt, Homo sapiens
cuugaucaauuccc

SEQ ID NO: 1020131 - RNA, 21 nt, Homo sapiens
cuugauccacuucucucagga

SEQ ID NO: 1020132 - RNA, 13 nt, Homo sapiens
cuugaucuguaua

SEQ ID NO: 1020133 - RNA, 12 nt, Homo sapiens
cuugauucacaa

SEQ ID NO: 1020134 - RNA, 19 nt, Homo sapiens
cuugcaacacacagacaca

SEQ ID NO: 1020135 - RNA, 20 nt, Homo sapiens
cuugcaagauuccaaguucu

SEQ ID NO: 1020136 - RNA, 13 nt, Homo sapiens
cuugcacaaacca

SEQ ID NO: 1020137 - RNA, 21 nt, Homo sapiens
cuugcacaggucccacugccc

SEQ ID NO: 1020138 - RNA, 18 nt, Homo sapiens
cuugcagcugauguugga

SEQ ID NO: 1020139 - RNA, 18 nt, Homo sapiens
cuugcaguuaaggguuag

SEQ ID NO: 1020140 - RNA, 18 nt, Homo sapiens
cuugcauacagagacaga

SEQ ID NO: 1020141 - RNA, 22 nt, Homo sapiens
cuugcaucguggagacagggca

SEQ ID NO: 1020142 - RNA, 19 nt, Homo sapiens
cuugcauucccuuaugaug

SEQ ID NO: 1020143 - RNA, 18 nt, Homo sapiens
cuugcauugccugccugg

SEQ ID NO: 1020144 - RNA, 14 nt, Homo sapiens
cuugccugcaggca

SEQ ID NO: 1020145 - RNA, 22 nt, Homo sapiens
cuugccugcaugaaacauguuc

SEQ ID NO: 1020146 - RNA, 11 nt, Homo sapiens
cuugcucugca

SEQ ID NO: 1020147 - RNA, 19 nt, Homo sapiens
cuugcugccacauucuaaa

SEQ ID NO: 1020148 - RNA, 20 nt, Homo sapiens
cuugcuggaaaacccaaagu

SEQ ID NO: 1020149 - RNA, 16 nt, Homo sapiens
cuugcuggacggggac

SEQ ID NO: 1020150 - RNA, 12 nt, Homo sapiens
cuugcugugagc

SEQ ID NO: 1020151 - RNA, 23 nt, Homo sapiens
cuuggaaagcaucaccucaggcc

SEQ ID NO: 1020152 - RNA, 14 nt, Homo sapiens
cuuggaaaggacca

SEQ ID NO: 1020153 - RNA, 19 nt, Homo sapiens
cuuggaaaggcucccuguc

SEQ ID NO: 1020154 - RNA, 19 nt, Homo sapiens
cuuggacuauuauaauuua

SEQ ID NO: 1020155 - RNA, 23 nt, Homo sapiens
cuuggacugaagggguucucaca

SEQ ID NO: 1020156 - RNA, 21 nt, Homo sapiens
cuuggaggccagccagugacc

SEQ ID NO: 1020157 - RNA, 22 nt, Homo sapiens
cuuggaggcugucuucucaggc

SEQ ID NO: 1020158 - RNA, 12 nt, Homo sapiens
cuuggccagaag

SEQ ID NO: 1020159 - RNA, 23 nt, Homo sapiens
cuuggcucccucugcugaucuca

SEQ ID NO: 1020160 - RNA, 17 nt, Homo sapiens
cuuggcugcuguaucuu

SEQ ID NO: 1020161 - RNA, 10 nt, Homo sapiens
cuuggcugug

SEQ ID NO: 1020162 - RNA, 15 nt, Homo sapiens
cuuggcugugcccuc

SEQ ID NO: 1020163 - RNA, 16 nt, Homo sapiens
cuugggaugaugccuc

SEQ ID NO: 1020164 - RNA, 21 nt, Homo sapiens
cuugggaugaugccucaugau

SEQ ID NO: 1020165 - RNA, 21 nt, Homo sapiens
cuugggcacuuuuuaauucac

SEQ ID NO: 1020166 - RNA, 16 nt, Homo sapiens
cuugguaaucaugaaa

SEQ ID NO: 1020167 - RNA, 15 nt, Homo sapiens
cuugguauagcauau

SEQ ID NO: 1020168 - RNA, 19 nt, Homo sapiens
cuugguuuccaaaggcauu

SEQ ID NO: 1020169 - RNA, 20 nt, Homo sapiens
cuugguuugaguuucucuca

SEQ ID NO: 1020170 - RNA, 18 nt, Homo sapiens
cuuguaaaauuucacuua

SEQ ID NO: 1020171 - RNA, 16 nt, Homo sapiens
cuuguaaagacuguag

SEQ ID NO: 1020172 - RNA, 17 nt, Homo sapiens
cuuguaaaugugguaaa

SEQ ID NO: 1020173 - RNA, 15 nt, Homo sapiens
cuuguaacaucaggg

SEQ ID NO: 1020174 - RNA, 21 nt, Homo sapiens
cuuguaaugguucuuuacaca

SEQ ID NO: 1020175 - RNA, 18 nt, Homo sapiens
cuuguaauucuaaaugaa

SEQ ID NO: 1020176 - RNA, 16 nt, Homo sapiens
cuuguaucaacacugu

SEQ ID NO: 1020177 - RNA, 15 nt, Homo sapiens
cuuguccaugugguu

SEQ ID NO: 1020178 - RNA, 21 nt, Homo sapiens
cuugugaaccccaaagugucc

SEQ ID NO: 1020179 - RNA, 17 nt, Homo sapiens
cuugugaaguggaaaug

SEQ ID NO: 1020180 - RNA, 16 nt, Homo sapiens
cuugugaccauuguaa

SEQ ID NO: 1020181 - RNA, 18 nt, Homo sapiens
cuugugacccagcacugc

SEQ ID NO: 1020182 - RNA, 17 nt, Homo sapiens
cuugugagggacugaga

SEQ ID NO: 1020183 - RNA, 20 nt, Homo sapiens
cuugugccaacacucaagaa

SEQ ID NO: 1020184 - RNA, 16 nt, Homo sapiens
cuugugccauagucac

SEQ ID NO: 1020185 - RNA, 19 nt, Homo sapiens
cuuguggggguccacggga

SEQ ID NO: 1020186 - RNA, 21 nt, Homo sapiens
cuugugugugggcugugagug

SEQ ID NO: 1020187 - RNA, 23 nt, Homo sapiens
cuuguguguguguguugauccca

SEQ ID NO: 1020188 - RNA, 14 nt, Homo sapiens
cuuguguuuuuaac

SEQ ID NO: 1020189 - RNA, 14 nt, Homo sapiens
cuuguucacacucu

SEQ ID NO: 1020190 - RNA, 24 nt, Homo sapiens
cuuguuccccaucaucuguggaac

SEQ ID NO: 1020191 - RNA, 13 nt, Homo sapiens
cuuguucuacuga

SEQ ID NO: 1020192 - RNA, 15 nt, Homo sapiens
cuuguucuacugaga

SEQ ID NO: 1020193 - RNA, 16 nt, Homo sapiens
cuuguucuacugagaa

SEQ ID NO: 1020194 - RNA, 16 nt, Homo sapiens
cuuuaaaaaaacacau

SEQ ID NO: 1020195 - RNA, 17 nt, Homo sapiens
cuuuaaaaaaacacaua

SEQ ID NO: 1020196 - RNA, 19 nt, Homo sapiens
cuuuaaaaaaacacauaau

SEQ ID NO: 1020197 - RNA, 15 nt, Homo sapiens
cuuuaaaacuuaucc

SEQ ID NO: 1020198 - RNA, 16 nt, Homo sapiens
cuuuaaacaaauucau

SEQ ID NO: 1020199 - RNA, 15 nt, Homo sapiens
cuuuaaacucaggga

SEQ ID NO: 1020200 - RNA, 14 nt, Homo sapiens
cuuuaaaucuguga

SEQ ID NO: 1020201 - RNA, 21 nt, Homo sapiens
cuuuaagugcacaacauuaca

SEQ ID NO: 1020202 - RNA, 19 nt, Homo sapiens
cuuuaauucucaugugauc

SEQ ID NO: 1020203 - RNA, 20 nt, Homo sapiens
cuuuaauucucaugugaucc

SEQ ID NO: 1020204 - RNA, 20 nt, Homo sapiens
cuuuacaaauagaauuugag

SEQ ID NO: 1020205 - RNA, 15 nt, Homo sapiens
cuuuacaugacacag

SEQ ID NO: 1020206 - RNA, 18 nt, Homo sapiens
cuuuaccuccuuuucucu

SEQ ID NO: 1020207 - RNA, 23 nt, Homo sapiens
cuuuaccuccuuuucucuuucac

SEQ ID NO: 1020208 - RNA, 15 nt, Homo sapiens
cuuuacguaucugcu

SEQ ID NO: 1020209 - RNA, 23 nt, Homo sapiens
cuuuagaguagcaugagagaauu

SEQ ID NO: 1020210 - RNA, 18 nt, Homo sapiens
cuuuaggcagcagcuuuu

SEQ ID NO: 1020211 - RNA, 19 nt, Homo sapiens
cuuuauaaucuacuccuug

SEQ ID NO: 1020212 - RNA, 19 nt, Homo sapiens
cuuuauacguguagcuaua

SEQ ID NO: 1020213 - RNA, 22 nt, Homo sapiens
cuuuauauggccucaagaucaa

SEQ ID NO: 1020214 - RNA, 12 nt, Homo sapiens
cuuuaucaaaga

SEQ ID NO: 1020215 - RNA, 22 nt, Homo sapiens
cuuucaagaagugccaguugau

SEQ ID NO: 1020216 - RNA, 14 nt, Homo sapiens
cuuucacacuucca

SEQ ID NO: 1020217 - RNA, 19 nt, Homo sapiens
cuuucagauaacuguuauu

SEQ ID NO: 1020218 - RNA, 22 nt, Homo sapiens
cuuucaggaauuuuguaaucuc

SEQ ID NO: 1020219 - RNA, 15 nt, Homo sapiens
cuuucaggaccuuuu

SEQ ID NO: 1020220 - RNA, 24 nt, Homo sapiens
cuuucaggccacauggcuaaagaa

SEQ ID NO: 1020221 - RNA, 13 nt, Homo sapiens
cuuucaguauuag

SEQ ID NO: 1020222 - RNA, 21 nt, Homo sapiens
cuuucauuauuaguacugcuc

SEQ ID NO: 1020223 - RNA, 17 nt, Homo sapiens
cuuucauuuacuguggc

SEQ ID NO: 1020224 - RNA, 16 nt, Homo sapiens
cuuucccaucuuccaa

SEQ ID NO: 1020225 - RNA, 14 nt, Homo sapiens
cuuuccccaaagac

SEQ ID NO: 1020226 - RNA, 18 nt, Homo sapiens
cuuucccuucuuggugcu

SEQ ID NO: 1020227 - RNA, 16 nt, Homo sapiens
cuuuccucagaucauc

SEQ ID NO: 1020228 - RNA, 14 nt, Homo sapiens
uaacagugcauauu

SEQ ID NO: 1020229 - RNA, 14 nt, Homo sapiens
uaacaguucacuuu

SEQ ID NO: 1020230 - RNA, 18 nt, Homo sapiens
uaacaguugugaugacua

SEQ ID NO: 1020231 - RNA, 20 nt, Homo sapiens
uaacauguaauuaaguacua

SEQ ID NO: 1020232 - RNA, 18 nt, Homo sapiens
uaaccaaaaaaguuacaa

SEQ ID NO: 1020233 - RNA, 22 nt, Homo sapiens
uaacccacaguucuccauuuca

SEQ ID NO: 1020234 - RNA, 23 nt, Homo sapiens
uaacccucagaaacacuggggcu

SEQ ID NO: 1020235 - RNA, 20 nt, Homo sapiens
uaaccguuuccuuucauuua

SEQ ID NO: 1020236 - RNA, 23 nt, Homo sapiens
uaaccguuuccuuucauuuacug

SEQ ID NO: 1020237 - RNA, 17 nt, Homo sapiens
uaaccucaaagugacua

SEQ ID NO: 1020238 - RNA, 22 nt, Homo sapiens
uaaccucugagucaccaucuua

SEQ ID NO: 1020239 - RNA, 20 nt, Homo sapiens
uaaccugcuagacacauuuu

SEQ ID NO: 1020240 - RNA, 14 nt, Homo sapiens
uaacgacuucaggg

SEQ ID NO: 1020241 - RNA, 13 nt, Homo sapiens
uaacgcagcacuu

SEQ ID NO: 1020242 - RNA, 20 nt, Homo sapiens
uaacguuagaccacaaauag

SEQ ID NO: 1020243 - RNA, 12 nt, Homo sapiens
uaacuacugugu

SEQ ID NO: 1020244 - RNA, 18 nt, Homo sapiens
uaacuagaaaucugccaa

SEQ ID NO: 1020245 - RNA, 12 nt, Homo sapiens
uaacuagaauuu

SEQ ID NO: 1020246 - RNA, 22 nt, Homo sapiens
uaacuaggcucagagaugugca

SEQ ID NO: 1020247 - RNA, 14 nt, Homo sapiens
uaacuauguugaua

SEQ ID NO: 1020248 - RNA, 22 nt, Homo sapiens
uaacucagucuuuaaucugaga

SEQ ID NO: 1020249 - RNA, 19 nt, Homo sapiens
uaacucuccuccauguugc

SEQ ID NO: 1020250 - RNA, 17 nt, Homo sapiens
uaacucugcacuacucc

SEQ ID NO: 1020251 - RNA, 20 nt, Homo sapiens
uaacuggagccccaucagcu

SEQ ID NO: 1020252 - RNA, 19 nt, Homo sapiens
uaacuucaauguaguuuuc

SEQ ID NO: 1020253 - RNA, 22 nt, Homo sapiens
uaacuucaauguaguuuuccau

SEQ ID NO: 1020254 - RNA, 19 nt, Homo sapiens
uaagaaaaaggaugcacag

SEQ ID NO: 1020255 - RNA, 18 nt, Homo sapiens
uaagaaaacaucacugaa

SEQ ID NO: 1020256 - RNA, 14 nt, Homo sapiens
uaagaaaacuaaga

SEQ ID NO: 1020257 - RNA, 14 nt, Homo sapiens
uaagaaagugcgag

SEQ ID NO: 1020258 - RNA, 14 nt, Homo sapiens
uaagaaccugaaua

SEQ ID NO: 1020259 - RNA, 22 nt, Homo sapiens
uaagaagaaauacccacuaaca

SEQ ID NO: 1020260 - RNA, 18 nt, Homo sapiens
uaagaagagacugggaag

SEQ ID NO: 1020261 - RNA, 18 nt, Homo sapiens
uaagaagcuuucaguauu

SEQ ID NO: 1020262 - RNA, 13 nt, Homo sapiens
uaagaaugaaaua

SEQ ID NO: 1020263 - RNA, 17 nt, Homo sapiens
uaagacauaaauuacuu

SEQ ID NO: 1020264 - RNA, 17 nt, Homo sapiens
uaagaccauaacagcca

SEQ ID NO: 1020265 - RNA, 15 nt, Homo sapiens
uaagagaacaaugug

SEQ ID NO: 1020266 - RNA, 18 nt, Homo sapiens
uaagagaaucaacauuuc

SEQ ID NO: 1020267 - RNA, 22 nt, Homo sapiens
uaagagggcacacacuguguac

SEQ ID NO: 1020268 - RNA, 19 nt, Homo sapiens
uaagagugccguaacaacu

SEQ ID NO: 1020269 - RNA, 23 nt, Homo sapiens
uaagaguugagauuuugcaaucu

SEQ ID NO: 1020270 - RNA, 15 nt, Homo sapiens
uaagauuagaaugaa

SEQ ID NO: 1020271 - RNA, 18 nt, Homo sapiens
uaagauuuccaagugcca

SEQ ID NO: 1020272 - RNA, 16 nt, Homo sapiens
uaagcaaagacuauga

SEQ ID NO: 1020273 - RNA, 13 nt, Homo sapiens
uaagcaacaucua

SEQ ID NO: 1020274 - RNA, 20 nt, Homo sapiens
uaagcaccaggacgcccucg

SEQ ID NO: 1020275 - RNA, 20 nt, Homo sapiens
uaagccacucuuccaaaggc

SEQ ID NO: 1020276 - RNA, 17 nt, Homo sapiens
uaagccuuuugcucaca

SEQ ID NO: 1020277 - RNA, 16 nt, Homo sapiens
uaagcuaggaaugaaa

SEQ ID NO: 1020278 - RNA, 18 nt, Homo sapiens
uaagcugggauaaucaca

SEQ ID NO: 1020279 - RNA, 14 nt, Homo sapiens
uaaggaaagcaaua

SEQ ID NO: 1020280 - RNA, 13 nt, Homo sapiens
uaagggaccucaa

SEQ ID NO: 1020281 - RNA, 18 nt, Homo sapiens
uaagggagaaaauaaucc

SEQ ID NO: 1020282 - RNA, 17 nt, Homo sapiens
uaagguaauucauggca

SEQ ID NO: 1020283 - RNA, 16 nt, Homo sapiens
uaagguaccuuucaca

SEQ ID NO: 1020284 - RNA, 19 nt, Homo sapiens
uaaggugcaauaagaauuu

SEQ ID NO: 1020285 - RNA, 19 nt, Homo sapiens
uaaggugcaguucccccaa

SEQ ID NO: 1020286 - RNA, 20 nt, Homo sapiens
uaagguggguggaucaccug

SEQ ID NO: 1020287 - RNA, 13 nt, Homo sapiens
uaaguaaaaccac

SEQ ID NO: 1020288 - RNA, 18 nt, Homo sapiens
uaaguaaguuugauuuca

SEQ ID NO: 1020289 - RNA, 15 nt, Homo sapiens
uaaguaaugaugucg

SEQ ID NO: 1020290 - RNA, 19 nt, Homo sapiens
uaagucuguuuuaugacuu

SEQ ID NO: 1020291 - RNA, 20 nt, Homo sapiens
uaagugggguugcaaccacu

SEQ ID NO: 1020292 - RNA, 15 nt, Homo sapiens
uaaguuacuucacuu

SEQ ID NO: 1020293 - RNA, 19 nt, Homo sapiens
uaaguuagggaauggcaca

SEQ ID NO: 1020294 - RNA, 17 nt, Homo sapiens
uaaguuucaggugacau

SEQ ID NO: 1020295 - RNA, 15 nt, Homo sapiens
uaaguuugauuucau

SEQ ID NO: 1020296 - RNA, 21 nt, Homo sapiens
uaauaaaagaguuaacauccc

SEQ ID NO: 1020297 - RNA, 16 nt, Homo sapiens
uaauaaaaguacaugu

SEQ ID NO: 1020298 - RNA, 13 nt, Homo sapiens
uaauaaacauccu

SEQ ID NO: 1020299 - RNA, 17 nt, Homo sapiens
uaauaaacauccuucaa

SEQ ID NO: 1020300 - RNA, 13 nt, Homo sapiens
uaauaaagacagg

SEQ ID NO: 1020301 - RNA, 19 nt, Homo sapiens
uaauaaaucuguugccaag

SEQ ID NO: 1020302 - RNA, 21 nt, Homo sapiens
uaauaaauuauuuauuauuaa

SEQ ID NO: 1020303 - RNA, 20 nt, Homo sapiens
uaauaacaacagaucugcag

SEQ ID NO: 1020304 - RNA, 17 nt, Homo sapiens
uaauaacagugcauauu

SEQ ID NO: 1020305 - RNA, 17 nt, Homo sapiens
uaauaagaaaauucuaa

SEQ ID NO: 1020306 - RNA, 14 nt, Homo sapiens
uaauaaguacugug

SEQ ID NO: 1020307 - RNA, 16 nt, Homo sapiens
uaauacagccaaagau

SEQ ID NO: 1020308 - RNA, 15 nt, Homo sapiens
uaauaccuguccaca

SEQ ID NO: 1020309 - RNA, 16 nt, Homo sapiens
uaauagaaacauugaa

SEQ ID NO: 1020310 - RNA, 22 nt, Homo sapiens
uaauagccuaauacaacaugua

SEQ ID NO: 1020311 - RNA, 13 nt, Homo sapiens
uaauaguguuaau

SEQ ID NO: 1020312 - RNA, 22 nt, Homo sapiens
uaauauauguauaugcaauaua

SEQ ID NO: 1020313 - RNA, 18 nt, Homo sapiens
uaauaucaucaguauuga

SEQ ID NO: 1020314 - RNA, 19 nt, Homo sapiens
uaauauggggaugcagcau

SEQ ID NO: 1020315 - RNA, 15 nt, Homo sapiens
uaauaugguguacau

SEQ ID NO: 1020316 - RNA, 15 nt, Homo sapiens
uaauauuuugcacag

SEQ ID NO: 1020317 - RNA, 22 nt, Homo sapiens
uaaucagggaggucauuuuggu

SEQ ID NO: 1020318 - RNA, 18 nt, Homo sapiens
uaaucaguuuuauccaca

SEQ ID NO: 1020319 - RNA, 22 nt, Homo sapiens
uaaucaguuuuauccacagaaa

SEQ ID NO: 1020320 - RNA, 22 nt, Homo sapiens
uaaucccaagaucugugcagcc

SEQ ID NO: 1020321 - RNA, 18 nt, Homo sapiens
uaauccccacccugggcu

SEQ ID NO: 1020322 - RNA, 19 nt, Homo sapiens
uaauccucuuuuucuaguc

SEQ ID NO: 1020323 - RNA, 18 nt, Homo sapiens
uaaucuauguauauacau

SEQ ID NO: 1020324 - RNA, 16 nt, Homo sapiens
uaaucugagaggccac

SEQ ID NO: 1020325 - RNA, 14 nt, Homo sapiens
uaaucuucauuucu

SEQ ID NO: 1020326 - RNA, 18 nt, Homo sapiens
uaaucuucugccuucuca

SEQ ID NO: 1020327 - RNA, 21 nt, Homo sapiens
uaaucuucugccuucucauga

SEQ ID NO: 1020328 - RNA, 15 nt, Homo sapiens
uaaugaaaaugucag

SEQ ID NO: 1020329 - RNA, 19 nt, Homo sapiens
uaaugaaggaguucacugu

SEQ ID NO: 1020330 - RNA, 20 nt, Homo sapiens
uaaugaaggggaagagauua

SEQ ID NO: 1020331 - RNA, 14 nt, Homo sapiens
uaaugagauauuaa

SEQ ID NO: 1020332 - RNA, 14 nt, Homo sapiens
uaauguaagcucua

SEQ ID NO: 1020333 - RNA, 17 nt, Homo sapiens
uaauguaauaauagaaa

SEQ ID NO: 1020334 - RNA, 13 nt, Homo sapiens
uaauguuacauua

SEQ ID NO: 1020335 - RNA, 20 nt, Homo sapiens
uaauguuguaauucaugcca

SEQ ID NO: 1020336 - RNA, 19 nt, Homo sapiens
uaauguuuuauacuguuua

SEQ ID NO: 1020337 - RNA, 16 nt, Homo sapiens
uaauuacauauuugca

SEQ ID NO: 1020338 - RNA, 14 nt, Homo sapiens
uaauucaaaagcac

SEQ ID NO: 1020339 - RNA, 14 nt, Homo sapiens
uaauucaccaaagu

SEQ ID NO: 1020340 - RNA, 15 nt, Homo sapiens
uaauucagcucuuga

SEQ ID NO: 1020341 - RNA, 23 nt, Homo sapiens
uaauuccacacccucacugcugu

SEQ ID NO: 1020342 - RNA, 22 nt, Homo sapiens
uaauuccagugguccauggaau

SEQ ID NO: 1020343 - RNA, 14 nt, Homo sapiens
uaauucucuuucaa

SEQ ID NO: 1020344 - RNA, 16 nt, Homo sapiens
uaauucugcugucuca

SEQ ID NO: 1020345 - RNA, 14 nt, Homo sapiens
uaauucuguacaua

SEQ ID NO: 1020346 - RNA, 18 nt, Homo sapiens
uaauuggaagaaauuccu

SEQ ID NO: 1020347 - RNA, 21 nt, Homo sapiens
uaauugugaauuagacuugua

SEQ ID NO: 1020348 - RNA, 16 nt, Homo sapiens
uaauugugugucacaa

SEQ ID NO: 1020349 - RNA, 19 nt, Homo sapiens
uaauuuaaaaaauaacuac

SEQ ID NO: 1020350 - RNA, 17 nt, Homo sapiens
uaauuuaaacaccuccu

SEQ ID NO: 1020351 - RNA, 16 nt, Homo sapiens
uaauuuacagcuuuca

SEQ ID NO: 1020352 - RNA, 18 nt, Homo sapiens
uaauuugaaaacauaauc

SEQ ID NO: 1020353 - RNA, 20 nt, Homo sapiens
uaauuugagagaaauaugaa

SEQ ID NO: 1020354 - RNA, 19 nt, Homo sapiens
uaauuuucuagauuuucua

SEQ ID NO: 1020355 - RNA, 19 nt, Homo sapiens
uaauuuuguacaauaaccu

SEQ ID NO: 1020356 - RNA, 20 nt, Homo sapiens
uaauuuuuuugagacagagu

SEQ ID NO: 1020357 - RNA, 23 nt, Homo sapiens
uaauuuuuuugugggaaauccac

SEQ ID NO: 1020358 - RNA, 15 nt, Homo sapiens
uacaaaaacacagca

SEQ ID NO: 1020359 - RNA, 19 nt, Homo sapiens
uacaaaaacauggccuuug

SEQ ID NO: 1020360 - RNA, 21 nt, Homo sapiens
uacaaaaauaccuacugcuga

SEQ ID NO: 1020361 - RNA, 15 nt, Homo sapiens
uacaaaauccagcua

SEQ ID NO: 1020362 - RNA, 20 nt, Homo sapiens
uacaaaauccagcuaugaau

SEQ ID NO: 1020363 - RNA, 12 nt, Homo sapiens
uacaaacaugug

SEQ ID NO: 1020364 - RNA, 21 nt, Homo sapiens
uacaaauaaagucccagguua

SEQ ID NO: 1020365 - RNA, 22 nt, Homo sapiens
uacaaaugccaaaauucauuca

SEQ ID NO: 1020366 - RNA, 12 nt, Homo sapiens
uacaacauguag

SEQ ID NO: 1020367 - RNA, 23 nt, Homo sapiens
uacaagacaggacccugggacca

SEQ ID NO: 1020368 - RNA, 20 nt, Homo sapiens
uacaagccacgaaugaauga

SEQ ID NO: 1020369 - RNA, 23 nt, Homo sapiens
uacaauaacauaauuuguacaua

SEQ ID NO: 1020370 - RNA, 15 nt, Homo sapiens
uacaauaaguuaacu

SEQ ID NO: 1020371 - RNA, 20 nt, Homo sapiens
uacaaucagccacauucuag

SEQ ID NO: 1020372 - RNA, 15 nt, Homo sapiens
uauaaugaagcuuua

SEQ ID NO: 1020373 - RNA, 17 nt, Homo sapiens
uauaauguaagcucuac

SEQ ID NO: 1020374 - RNA, 23 nt, Homo sapiens
uauaauuguaucguauagcugua

SEQ ID NO: 1020375 - RNA, 17 nt, Homo sapiens
uauacauaaacaagacc

SEQ ID NO: 1020376 - RNA, 13 nt, Homo sapiens
uauaccaaaaggg

SEQ ID NO: 1020377 - RNA, 18 nt, Homo sapiens
uauaccaauauuuacuca

SEQ ID NO: 1020378 - RNA, 17 nt, Homo sapiens
uauaccauggugaauua

SEQ ID NO: 1020379 - RNA, 15 nt, Homo sapiens
uauacgcaucuauaa

SEQ ID NO: 1020380 - RNA, 13 nt, Homo sapiens
uauacuauauuac

SEQ ID NO: 1020381 - RNA, 11 nt, Homo sapiens
uauacuguaaa

SEQ ID NO: 1020382 - RNA, 15 nt, Homo sapiens
uauacuguacuuaau

SEQ ID NO: 1020383 - RNA, 11 nt, Homo sapiens
uauacuuucag

SEQ ID NO: 1020384 - RNA, 21 nt, Homo sapiens
uauagaaggguaccuugaaca

SEQ ID NO: 1020385 - RNA, 15 nt, Homo sapiens
uauagacaaauaaua

SEQ ID NO: 1020386 - RNA, 14 nt, Homo sapiens
uauagacucuagga

SEQ ID NO: 1020387 - RNA, 16 nt, Homo sapiens
uauagauauguagaua

SEQ ID NO: 1020388 - RNA, 18 nt, Homo sapiens
uauaggucauacaaucca

SEQ ID NO: 1020389 - RNA, 13 nt, Homo sapiens
uauauaaaaaugg

SEQ ID NO: 1020390 - RNA, 21 nt, Homo sapiens
uauauaaaugugauugcagcu

SEQ ID NO: 1020391 - RNA, 20 nt, Homo sapiens
uauauaauaaagcuacugau

SEQ ID NO: 1020392 - RNA, 16 nt, Homo sapiens
uauauaauucuguaca

SEQ ID NO: 1020393 - RNA, 20 nt, Homo sapiens
uauauacaguaacuuuaugu

SEQ ID NO: 1020394 - RNA, 18 nt, Homo sapiens
uauauacccacacacaua

SEQ ID NO: 1020395 - RNA, 22 nt, Homo sapiens
uauauaugcuuggcuaacuaua

SEQ ID NO: 1020396 - RNA, 20 nt, Homo sapiens
uauauauugguaacauccuu

SEQ ID NO: 1020397 - RNA, 17 nt, Homo sapiens
uauauauuuuguguaua

SEQ ID NO: 1020398 - RNA, 13 nt, Homo sapiens
uauaucaguccuc

SEQ ID NO: 1020399 - RNA, 12 nt, Homo sapiens
uauauccaugua

SEQ ID NO: 1020400 - RNA, 12 nt, Homo sapiens
uauaucucucau

SEQ ID NO: 1020401 - RNA, 16 nt, Homo sapiens
uauaucugcuguccag

SEQ ID NO: 1020402 - RNA, 17 nt, Homo sapiens
uauaucuuuuuccauca

SEQ ID NO: 1020403 - RNA, 13 nt, Homo sapiens
uauauggccucaa

SEQ ID NO: 1020404 - RNA, 15 nt, Homo sapiens
uauauggccucaaga

SEQ ID NO: 1020405 - RNA, 17 nt, Homo sapiens
uauaugucaucucagug

SEQ ID NO: 1020406 - RNA, 17 nt, Homo sapiens
uauaugugaacauuuau

SEQ ID NO: 1020407 - RNA, 18 nt, Homo sapiens
uauauuauuacuaauugu

SEQ ID NO: 1020408 - RNA, 13 nt, Homo sapiens
uauauucauuuca

SEQ ID NO: 1020409 - RNA, 15 nt, Homo sapiens
uauauucucagugua

SEQ ID NO: 1020410 - RNA, 13 nt, Homo sapiens
uauauuguuucau

SEQ ID NO: 1020411 - RNA, 15 nt, Homo sapiens
uauauuucaagaaua

SEQ ID NO: 1020412 - RNA, 20 nt, Homo sapiens
uauauuuuaucugugauuag

SEQ ID NO: 1020413 - RNA, 20 nt, Homo sapiens
uauauuuugugcuaucagac

SEQ ID NO: 1020414 - RNA, 17 nt, Homo sapiens
uaucaaaaagacugugg

SEQ ID NO: 1020415 - RNA, 15 nt, Homo sapiens
uaucaauuuccucau

SEQ ID NO: 1020416 - RNA, 14 nt, Homo sapiens
uaucacaucacuua

SEQ ID NO: 1020417 - RNA, 13 nt, Homo sapiens
uaucacgcagauc

SEQ ID NO: 1020418 - RNA, 19 nt, Homo sapiens
uaucagccugugccacgau

SEQ ID NO: 1020419 - RNA, 19 nt, Homo sapiens
uaucaguaguaucaaugau

SEQ ID NO: 1020420 - RNA, 14 nt, Homo sapiens
uaucagucucugag

SEQ ID NO: 1020421 - RNA, 14 nt, Homo sapiens
uaucaguugcaaua

SEQ ID NO: 1020422 - RNA, 17 nt, Homo sapiens
uaucaguugcaauaaua

SEQ ID NO: 1020423 - RNA, 21 nt, Homo sapiens
uauccaacaugugcucaggga

SEQ ID NO: 1020424 - RNA, 19 nt, Homo sapiens
uauccaagaaucagugaag

SEQ ID NO: 1020425 - RNA, 19 nt, Homo sapiens
uauccaauaggcauuugau

SEQ ID NO: 1020426 - RNA, 14 nt, Homo sapiens
uauccaccaccucc

SEQ ID NO: 1020427 - RNA, 16 nt, Homo sapiens
uaucccuuacuccaga

SEQ ID NO: 1020428 - RNA, 18 nt, Homo sapiens
uauccuccaugaauauca

SEQ ID NO: 1020429 - RNA, 21 nt, Homo sapiens
uaucgaaauaacaauguuaag

SEQ ID NO: 1020430 - RNA, 22 nt, Homo sapiens
uaucggagacagugaucuccau

SEQ ID NO: 1020431 - RNA, 15 nt, Homo sapiens
uaucgggaacagugu

SEQ ID NO: 1020432 - RNA, 17 nt, Homo sapiens
uaucgggaacaguguuu

SEQ ID NO: 1020433 - RNA, 15 nt, Homo sapiens
uaucuaaaaucugcu

SEQ ID NO: 1020434 - RNA, 23 nt, Homo sapiens
uaucuaauauguaacaagccacc

SEQ ID NO: 1020435 - RNA, 18 nt, Homo sapiens
uaucuagacccaucuucu

SEQ ID NO: 1020436 - RNA, 17 nt, Homo sapiens
uaucuagcaaucacaac

SEQ ID NO: 1020437 - RNA, 21 nt, Homo sapiens
uaucuauggcacccaugcacc

SEQ ID NO: 1020438 - RNA, 20 nt, Homo sapiens
uaucucucagugaacuguga

SEQ ID NO: 1020439 - RNA, 21 nt, Homo sapiens
uaucucugaagcauguuucau

SEQ ID NO: 1020440 - RNA, 23 nt, Homo sapiens
uaucugagggaggaggccaccuc

SEQ ID NO: 1020441 - RNA, 13 nt, Homo sapiens
uaucuguucuguu

SEQ ID NO: 1020442 - RNA, 22 nt, Homo sapiens
uaucuuagugguuccccaccga

SEQ ID NO: 1020443 - RNA, 20 nt, Homo sapiens
uaugaaaacagcuaucucac

SEQ ID NO: 1020444 - RNA, 18 nt, Homo sapiens
uaugaaaagaggggacca

SEQ ID NO: 1020445 - RNA, 15 nt, Homo sapiens
uaugaaaaugucauu

SEQ ID NO: 1020446 - RNA, 15 nt, Homo sapiens
uaugaaguauauaau

SEQ ID NO: 1020447 - RNA, 12 nt, Homo sapiens
uaugaaugcagu

SEQ ID NO: 1020448 - RNA, 16 nt, Homo sapiens
uaugacaucacuugua

SEQ ID NO: 1020449 - RNA, 17 nt, Homo sapiens
uaugagaaaguucucau

SEQ ID NO: 1020450 - RNA, 15 nt, Homo sapiens
uaugagaugccugaa

SEQ ID NO: 1020451 - RNA, 17 nt, Homo sapiens
uaugagaugccugaagc

SEQ ID NO: 1020452 - RNA, 22 nt, Homo sapiens
uaugagcuggggaugucucuca

SEQ ID NO: 1020453 - RNA, 18 nt, Homo sapiens
uaugagggaaaaugagua

SEQ ID NO: 1020454 - RNA, 22 nt, Homo sapiens
uaugagggccacgggucugugu

SEQ ID NO: 1020455 - RNA, 24 nt, Homo sapiens
uaugaggggguuuggcaccaagcu

SEQ ID NO: 1020456 - RNA, 17 nt, Homo sapiens
uaugaguuucuuuuugc

SEQ ID NO: 1020457 - RNA, 18 nt, Homo sapiens
uaugauauugcauaugca

SEQ ID NO: 1020458 - RNA, 17 nt, Homo sapiens
uaugaucacggcucacu

SEQ ID NO: 1020459 - RNA, 13 nt, Homo sapiens
uaugaucucaggu

SEQ ID NO: 1020460 - RNA, 12 nt, Homo sapiens
uaugaucuuggc

SEQ ID NO: 1020461 - RNA, 13 nt, Homo sapiens
uaugaucuuggcu

SEQ ID NO: 1020462 - RNA, 18 nt, Homo sapiens
uaugauucagauuguuau

SEQ ID NO: 1020463 - RNA, 14 nt, Homo sapiens
uaugauugugcaca

SEQ ID NO: 1020464 - RNA, 19 nt, Homo sapiens
uaugauugugcacauacuu

SEQ ID NO: 1020465 - RNA, 19 nt, Homo sapiens
uaugauuuaaaacauguaa

SEQ ID NO: 1020466 - RNA, 23 nt, Homo sapiens
uaugcaaccuuuggaugcacuuu

SEQ ID NO: 1020467 - RNA, 13 nt, Homo sapiens
uaugcaaucugag

SEQ ID NO: 1020468 - RNA, 12 nt, Homo sapiens
uaugcagugaua

SEQ ID NO: 1020469 - RNA, 18 nt, Homo sapiens
uaugcauuugcauuugcu

SEQ ID NO: 1020470 - RNA, 17 nt, Homo sapiens
uaugccaauaaaguuug

SEQ ID NO: 1020471 - RNA, 15 nt, Homo sapiens
uaugccucuguauuu

SEQ ID NO: 1020472 - RNA, 14 nt, Homo sapiens
uaugccuucacuuu

SEQ ID NO: 1020473 - RNA, 20 nt, Homo sapiens
uaugccuuuaaaucugugau

SEQ ID NO: 1020474 - RNA, 18 nt, Homo sapiens
uaugcucagggucaauuu

SEQ ID NO: 1020475 - RNA, 23 nt, Homo sapiens
uauggcaccccaaccccagugau

SEQ ID NO: 1020476 - RNA, 17 nt, Homo sapiens
uauggcuuuugugcauu

SEQ ID NO: 1020477 - RNA, 18 nt, Homo sapiens
uauggcuuuugugcauua

SEQ ID NO: 1020478 - RNA, 15 nt, Homo sapiens
uaugggggcacugag

SEQ ID NO: 1020479 - RNA, 13 nt, Homo sapiens
uauggggggccaa

SEQ ID NO: 1020480 - RNA, 16 nt, Homo sapiens
uauggguugcauuugg

SEQ ID NO: 1020481 - RNA, 20 nt, Homo sapiens
uauggguuggacaaccucau

SEQ ID NO: 1020482 - RNA, 16 nt, Homo sapiens
uauggugagaugcagc

SEQ ID NO: 1020483 - RNA, 15 nt, Homo sapiens
uaugguugacacuag

SEQ ID NO: 1020484 - RNA, 13 nt, Homo sapiens
uauguaacaugua

SEQ ID NO: 1020485 - RNA, 22 nt, Homo sapiens
uauguaaucucaccucaccugg

SEQ ID NO: 1020486 - RNA, 15 nt, Homo sapiens
uauguacaaguguug

SEQ ID NO: 1020487 - RNA, 16 nt, Homo sapiens
uauguagaugugcauu

SEQ ID NO: 1020488 - RNA, 16 nt, Homo sapiens
uauguauuugcaguuc

SEQ ID NO: 1020489 - RNA, 21 nt, Homo sapiens
uaugucaggcaaagugcugcu

SEQ ID NO: 1020490 - RNA, 14 nt, Homo sapiens
uaugucuuggacac

SEQ ID NO: 1020491 - RNA, 18 nt, Homo sapiens
uaugucuuggacacugua

SEQ ID NO: 1020492 - RNA, 11 nt, Homo sapiens
uaugugacuug

SEQ ID NO: 1020493 - RNA, 14 nt, Homo sapiens
uaugugacuugcau

SEQ ID NO: 1020494 - RNA, 23 nt, Homo sapiens
uaugugagagaaagugugagcaa

SEQ ID NO: 1020495 - RNA, 9 nt, Homo sapiens
uaugugcaa

SEQ ID NO: 1020496 - RNA, 20 nt, Homo sapiens
uaugugcacugucacuuugc

SEQ ID NO: 1020497 - RNA, 15 nt, Homo sapiens
uaugugcgugugugc

SEQ ID NO: 1020498 - RNA, 22 nt, Homo sapiens
uauguggaagugugggucugug

SEQ ID NO: 1020499 - RNA, 16 nt, Homo sapiens
uaugugggugggacca

SEQ ID NO: 1020500 - RNA, 13 nt, Homo sapiens
uauguguaaguau

SEQ ID NO: 1020501 - RNA, 15 nt, Homo sapiens
uauguuauuugcucu

SEQ ID NO: 1020502 - RNA, 22 nt, Homo sapiens
uauguucaacuggagacacuau

SEQ ID NO: 1020503 - RNA, 15 nt, Homo sapiens
uauguuuacauauca

SEQ ID NO: 1020504 - RNA, 18 nt, Homo sapiens
uauuaaaauaagcacugu

SEQ ID NO: 1020505 - RNA, 15 nt, Homo sapiens
uauuacgugcaauac

SEQ ID NO: 1020506 - RNA, 16 nt, Homo sapiens
uauuacgugcaauacu

SEQ ID NO: 1020507 - RNA, 15 nt, Homo sapiens
uauuacuaaggagua

SEQ ID NO: 1020508 - RNA, 21 nt, Homo sapiens
uauuagagcugccugugccuu

SEQ ID NO: 1020509 - RNA, 16 nt, Homo sapiens
uauuagcuuauauauu

SEQ ID NO: 1020510 - RNA, 15 nt, Homo sapiens
uauuaggccauauau

SEQ ID NO: 1020511 - RNA, 16 nt, Homo sapiens
uauuauaaaaguacua

SEQ ID NO: 1020512 - RNA, 21 nt, Homo sapiens
uauuauauauauauaucuaua

SEQ ID NO: 1020513 - RNA, 13 nt, Homo sapiens
uauuauuguggaa

SEQ ID NO: 1020514 - RNA, 15 nt, Homo sapiens
uauuauuucaaugug

SEQ ID NO: 1020515 - RNA, 18 nt, Homo sapiens
uauucaguaauaacucua

SEQ ID NO: 1020516 - RNA, 14 nt, Homo sapiens
uauucauccuaaaa

SEQ ID NO: 1020517 - RNA, 22 nt, Homo sapiens
uauuccauggcuaacuggcgag

SEQ ID NO: 1020518 - RNA, 14 nt, Homo sapiens
uugcuuugcacuuu

SEQ ID NO: 1020519 - RNA, 17 nt, Homo sapiens
uuggaaagcaucaccuc

SEQ ID NO: 1020520 - RNA, 23 nt, Homo sapiens
uuggaaagcaucaccucaggcca

SEQ ID NO: 1020521 - RNA, 19 nt, Homo sapiens
uuggaaggccucccugggc

SEQ ID NO: 1020522 - RNA, 17 nt, Homo sapiens
uuggaaugggcagcuca

SEQ ID NO: 1020523 - RNA, 13 nt, Homo sapiens
uuggaauuuguaa

SEQ ID NO: 1020524 - RNA, 23 nt, Homo sapiens
uuggacaaucaugaaauaugcau

SEQ ID NO: 1020525 - RNA, 17 nt, Homo sapiens
uuggacagaagcagcuc

SEQ ID NO: 1020526 - RNA, 12 nt, Homo sapiens
uuggacuggaaa

SEQ ID NO: 1020527 - RNA, 23 nt, Homo sapiens
uuggagaaacccuugaaaagaca

SEQ ID NO: 1020528 - RNA, 18 nt, Homo sapiens
uuggagugcgggugggcu

SEQ ID NO: 1020529 - RNA, 19 nt, Homo sapiens
uuggaucuucaauggcuuu

SEQ ID NO: 1020530 - RNA, 19 nt, Homo sapiens
uuggauggagacuccauga

SEQ ID NO: 1020531 - RNA, 21 nt, Homo sapiens
uuggauuaugaagugacucuc

SEQ ID NO: 1020532 - RNA, 19 nt, Homo sapiens
uuggauuuauaaaugcuau

SEQ ID NO: 1020533 - RNA, 18 nt, Homo sapiens
uuggauuuauucugccaa

SEQ ID NO: 1020534 - RNA, 13 nt, Homo sapiens
uuggcaaugccau

SEQ ID NO: 1020535 - RNA, 13 nt, Homo sapiens
uuggcacacagca

SEQ ID NO: 1020536 - RNA, 23 nt, Homo sapiens
uuggcacagccauacggcacuga

SEQ ID NO: 1020537 - RNA, 15 nt, Homo sapiens
uuggcaugccuucca

SEQ ID NO: 1020538 - RNA, 22 nt, Homo sapiens
uuggccucagaauucacaaaau

SEQ ID NO: 1020539 - RNA, 22 nt, Homo sapiens
uuggcuguagaaggagacagag

SEQ ID NO: 1020540 - RNA, 13 nt, Homo sapiens
uuggcuucagggg

SEQ ID NO: 1020541 - RNA, 19 nt, Homo sapiens
uuggcuucucauacgucca

SEQ ID NO: 1020542 - RNA, 19 nt, Homo sapiens
uuggcuuguguguuucacu

SEQ ID NO: 1020543 - RNA, 18 nt, Homo sapiens
uuggcuuguuuggagcau

SEQ ID NO: 1020544 - RNA, 17 nt, Homo sapiens
uugggaaauaugucaaa

SEQ ID NO: 1020545 - RNA, 16 nt, Homo sapiens
uugggaggcugaggca

SEQ ID NO: 1020546 - RNA, 22 nt, Homo sapiens
uugggaggcugaggcaagagaa

SEQ ID NO: 1020547 - RNA, 20 nt, Homo sapiens
uugggauugagucugugcca

SEQ ID NO: 1020548 - RNA, 15 nt, Homo sapiens
uugggcccuuugagu

SEQ ID NO: 1020549 - RNA, 20 nt, Homo sapiens
uugggggauggcuaaaacca

SEQ ID NO: 1020550 - RNA, 15 nt, Homo sapiens
uugguaaauggcaaa

SEQ ID NO: 1020551 - RNA, 19 nt, Homo sapiens
uuggucacccuaaggaaag

SEQ ID NO: 1020552 - RNA, 16 nt, Homo sapiens
uuggucccccuuccau

SEQ ID NO: 1020553 - RNA, 14 nt, Homo sapiens
uugguccucuugcc

SEQ ID NO: 1020554 - RNA, 19 nt, Homo sapiens
uugguuuccuucacagaaa

SEQ ID NO: 1020555 - RNA, 19 nt, Homo sapiens
uugguuugcagaugacaaa

SEQ ID NO: 1020556 - RNA, 16 nt, Homo sapiens
uuguaagaguguagaa

SEQ ID NO: 1020557 - RNA, 23 nt, Homo sapiens
uuguaaguggucgcuuacuuuga

SEQ ID NO: 1020558 - RNA, 17 nt, Homo sapiens
uuguaaguuuaugcaua

SEQ ID NO: 1020559 - RNA, 20 nt, Homo sapiens
uuguaaugauauagccagaa

SEQ ID NO: 1020560 - RNA, 13 nt, Homo sapiens
uuguaauugcuua

SEQ ID NO: 1020561 - RNA, 18 nt, Homo sapiens
uuguacaccaauauucau

SEQ ID NO: 1020562 - RNA, 20 nt, Homo sapiens
uuguacagacguaugcuuau

SEQ ID NO: 1020563 - RNA, 19 nt, Homo sapiens
uuguacauauuuguggaau

SEQ ID NO: 1020564 - RNA, 22 nt, Homo sapiens
uuguagagauggggucucacag

SEQ ID NO: 1020565 - RNA, 16 nt, Homo sapiens
uuguauagacaucugc

SEQ ID NO: 1020566 - RNA, 15 nt, Homo sapiens
uuguaucaacacugu

SEQ ID NO: 1020567 - RNA, 20 nt, Homo sapiens
uuguauuuaccuucuaccuc

SEQ ID NO: 1020568 - RNA, 19 nt, Homo sapiens
uuguauuuuauuguuucuu

SEQ ID NO: 1020569 - RNA, 13 nt, Homo sapiens
uugucaaacugua

SEQ ID NO: 1020570 - RNA, 13 nt, Homo sapiens
uugucaacaaagu

SEQ ID NO: 1020571 - RNA, 18 nt, Homo sapiens
uugucccugugccuaaca

SEQ ID NO: 1020572 - RNA, 22 nt, Homo sapiens
uuguccguguucauacauuuga

SEQ ID NO: 1020573 - RNA, 14 nt, Homo sapiens
uugucuuguucacc

SEQ ID NO: 1020574 - RNA, 15 nt, Homo sapiens
uugugagccaccacg

SEQ ID NO: 1020575 - RNA, 18 nt, Homo sapiens
uugugccuggcucagagc

SEQ ID NO: 1020576 - RNA, 16 nt, Homo sapiens
uuguggaugucuuccu

SEQ ID NO: 1020577 - RNA, 19 nt, Homo sapiens
uugugguagugaugguugu

SEQ ID NO: 1020578 - RNA, 14 nt, Homo sapiens
uugugguuaaucug

SEQ ID NO: 1020579 - RNA, 17 nt, Homo sapiens
uuguguagaaagccaaa

SEQ ID NO: 1020580 - RNA, 16 nt, Homo sapiens
uuguguccacugugac

SEQ ID NO: 1020581 - RNA, 19 nt, Homo sapiens
uuguuaagugcagucugau

SEQ ID NO: 1020582 - RNA, 15 nt, Homo sapiens
uuguucagaugcuuc

SEQ ID NO: 1020583 - RNA, 16 nt, Homo sapiens
uuguuccccacugaca

SEQ ID NO: 1020584 - RNA, 14 nt, Homo sapiens
uuguucuacugaga

SEQ ID NO: 1020585 - RNA, 15 nt, Homo sapiens
uuguucugucuuuag

SEQ ID NO: 1020586 - RNA, 17 nt, Homo sapiens
uuguucuuaauugcacu

SEQ ID NO: 1020587 - RNA, 20 nt, Homo sapiens
uuguuggaucuucaauggcu

SEQ ID NO: 1020588 - RNA, 17 nt, Homo sapiens
uuguuggccaaagccaa

SEQ ID NO: 1020589 - RNA, 19 nt, Homo sapiens
uuguuuaaaucaagagcuu

SEQ ID NO: 1020590 - RNA, 12 nt, Homo sapiens
uuguuuacuuaa

SEQ ID NO: 1020591 - RNA, 19 nt, Homo sapiens
uuguuucaaccaagucaug

SEQ ID NO: 1020592 - RNA, 16 nt, Homo sapiens
uuguuugauuucugac

SEQ ID NO: 1020593 - RNA, 23 nt, Homo sapiens
uuguuugucaauauaagcucaau

SEQ ID NO: 1020594 - RNA, 19 nt, Homo sapiens
uuguuuugacggaugauug

SEQ ID NO: 1020595 - RNA, 23 nt, Homo sapiens
uuuaaaaaaaaaaaaaaagccaa

SEQ ID NO: 1020596 - RNA, 15 nt, Homo sapiens
uuuaaaagcaucuca

SEQ ID NO: 1020597 - RNA, 21 nt, Homo sapiens
uuuaaaagccaucaaacacaa

SEQ ID NO: 1020598 - RNA, 12 nt, Homo sapiens
uuuaaacaguga

SEQ ID NO: 1020599 - RNA, 22 nt, Homo sapiens
uuuaaacucagggacagagcca

SEQ ID NO: 1020600 - RNA, 20 nt, Homo sapiens
uuuaaaguauguuauugcau

SEQ ID NO: 1020601 - RNA, 14 nt, Homo sapiens
uuuaaagugauuaa

SEQ ID NO: 1020602 - RNA, 18 nt, Homo sapiens
uuuaaauaaaguaucaug

SEQ ID NO: 1020603 - RNA, 23 nt, Homo sapiens
uuuaaauaagauuuaauucacau

SEQ ID NO: 1020604 - RNA, 21 nt, Homo sapiens
uuuaaauggcuuuaugcuagu

SEQ ID NO: 1020605 - RNA, 13 nt, Homo sapiens
uuuaacaauaacu

SEQ ID NO: 1020606 - RNA, 20 nt, Homo sapiens
uuuaacucagaucacuacug

SEQ ID NO: 1020607 - RNA, 22 nt, Homo sapiens
uuuaagaagaaauacccacuaa

SEQ ID NO: 1020608 - RNA, 11 nt, Homo sapiens
uuuaagacugu

SEQ ID NO: 1020609 - RNA, 17 nt, Homo sapiens
uuuaagauuuuucucaa

SEQ ID NO: 1020610 - RNA, 22 nt, Homo sapiens
uuuaagcagcucuugcuaauca

SEQ ID NO: 1020611 - RNA, 14 nt, Homo sapiens
uuuaagcuaccaau

SEQ ID NO: 1020612 - RNA, 12 nt, Homo sapiens
uuuaaggcuaaa

SEQ ID NO: 1020613 - RNA, 23 nt, Homo sapiens
uuuaaggugacccaaugauucag

SEQ ID NO: 1020614 - RNA, 22 nt, Homo sapiens
uuuaauacaggguagauaaccu

SEQ ID NO: 1020615 - RNA, 16 nt, Homo sapiens
uuuaauagaauauaau

SEQ ID NO: 1020616 - RNA, 16 nt, Homo sapiens
uuuaaucaccaaggcu

SEQ ID NO: 1020617 - RNA, 19 nt, Homo sapiens
uuuaaucauuuugccucuu

SEQ ID NO: 1020618 - RNA, 20 nt, Homo sapiens
uuuaaucuguauuuccccaa

SEQ ID NO: 1020619 - RNA, 17 nt, Homo sapiens
uuuaaugggcacagggu

SEQ ID NO: 1020620 - RNA, 13 nt, Homo sapiens
uuuaauuaucuaa

SEQ ID NO: 1020621 - RNA, 16 nt, Homo sapiens
uuuaauugauuauucu

SEQ ID NO: 1020622 - RNA, 14 nt, Homo sapiens
uuuaauugugaauu

SEQ ID NO: 1020623 - RNA, 13 nt, Homo sapiens
uuuacaaaggggg

SEQ ID NO: 1020624 - RNA, 17 nt, Homo sapiens
uuuacaaaguauuugcu

SEQ ID NO: 1020625 - RNA, 17 nt, Homo sapiens
uuuacaaguguauauca

SEQ ID NO: 1020626 - RNA, 15 nt, Homo sapiens
uuuacagcugagcac

SEQ ID NO: 1020627 - RNA, 18 nt, Homo sapiens
uuuacagugcuauuuacu

SEQ ID NO: 1020628 - RNA, 20 nt, Homo sapiens
uuuacauaucaccucauggc

SEQ ID NO: 1020629 - RNA, 11 nt, Homo sapiens
uuuacauucau

SEQ ID NO: 1020630 - RNA, 15 nt, Homo sapiens
uuuacauucaucuca

SEQ ID NO: 1020631 - RNA, 14 nt, Homo sapiens
uuuacauucugcaa

SEQ ID NO: 1020632 - RNA, 14 nt, Homo sapiens
uuuaccacagcagc

SEQ ID NO: 1020633 - RNA, 14 nt, Homo sapiens
uuuaccaucugcau

SEQ ID NO: 1020634 - RNA, 21 nt, Homo sapiens
uuuacgcuuaguuaucagcuu

SEQ ID NO: 1020635 - RNA, 22 nt, Homo sapiens
uuuacggacacccccucgcuug

SEQ ID NO: 1020636 - RNA, 21 nt, Homo sapiens
uuuacuaagaugacauugcua

SEQ ID NO: 1020637 - RNA, 20 nt, Homo sapiens
uuuacuaauccaacccauga

SEQ ID NO: 1020638 - RNA, 13 nt, Homo sapiens
uuuacuuccucag

SEQ ID NO: 1020639 - RNA, 20 nt, Homo sapiens
uuuagaaccaccaacaagca

SEQ ID NO: 1020640 - RNA, 17 nt, Homo sapiens
uuuagaacuguauguca

SEQ ID NO: 1020641 - RNA, 20 nt, Homo sapiens
uuuagaacuuuggcugccuu

SEQ ID NO: 1020642 - RNA, 22 nt, Homo sapiens
uuuagauggcuguaaaucuauu

SEQ ID NO: 1020643 - RNA, 19 nt, Homo sapiens
uuuagauuaaacaaacaaa

SEQ ID NO: 1020644 - RNA, 20 nt, Homo sapiens
uuuagcaauuuauacaauau

SEQ ID NO: 1020645 - RNA, 22 nt, Homo sapiens
uuuagcuaccucacuaugcugc

SEQ ID NO: 1020646 - RNA, 23 nt, Homo sapiens
uuuagcuaccucacuaugcugcu

SEQ ID NO: 1020647 - RNA, 13 nt, Homo sapiens
uuuaggcucagaa

SEQ ID NO: 1020648 - RNA, 13 nt, Homo sapiens
uuuagggcagcuu

SEQ ID NO: 1020649 - RNA, 21 nt, Homo sapiens
uuuaguagagaugggguuuca

SEQ ID NO: 1020650 - RNA, 12 nt, Homo sapiens
uuuaguggcuca

SEQ ID NO: 1020651 - RNA, 16 nt, Homo sapiens
uuuauaaaacuuugaa

SEQ ID NO: 1020652 - RNA, 23 nt, Homo sapiens
uuuauaaaagaauaaaauugcac

SEQ ID NO: 1020653 - RNA, 16 nt, Homo sapiens
uuuauaaauggacaaa

SEQ ID NO: 1020654 - RNA, 16 nt, Homo sapiens
uuuauaagcuacaugu

SEQ ID NO: 1020655 - RNA, 21 nt, Homo sapiens
uuuauagaccagaaccagagc

SEQ ID NO: 1020656 - RNA, 18 nt, Homo sapiens
uuuauauuuuuauagaca

SEQ ID NO: 1020657 - RNA, 19 nt, Homo sapiens
uuuaucugugaauucagau

SEQ ID NO: 1020658 - RNA, 12 nt, Homo sapiens
uuuaucugugau

SEQ ID NO: 1020659 - RNA, 13 nt, Homo sapiens
uuuaucugugcaa

SEQ ID NO: 1020660 - RNA, 16 nt, Homo sapiens
uuuaucuuuauaugaa

SEQ ID NO: 1020661 - RNA, 20 nt, Homo sapiens
uuuaucuuucgcacagcagu

SEQ ID NO: 1020662 - RNA, 19 nt, Homo sapiens
aauaugagauaaugcaguc

SEQ ID NO: 1020663 - RNA, 17 nt, Homo sapiens
aauaugcaguucugcag

SEQ ID NO: 1020664 - RNA, 18 nt, Homo sapiens
aauaugcugcucaucccc

SEQ ID NO: 1020665 - RNA, 20 nt, Homo sapiens
aauaugcugcucauccccac

SEQ ID NO: 1020666 - RNA, 19 nt, Homo sapiens
aauauggaaugggcucagu

SEQ ID NO: 1020667 - RNA, 21 nt, Homo sapiens
aauaugggguugguguucuca

SEQ ID NO: 1020668 - RNA, 21 nt, Homo sapiens
aauaugguaaugcacaauucc

SEQ ID NO: 1020669 - RNA, 14 nt, Homo sapiens
cccccauuggacac

SEQ ID NO: 1020670 - RNA, 13 nt, Homo sapiens
cccccgccaaaag

SEQ ID NO: 1020671 - RNA, 23 nt, Homo sapiens
cccccucaaaccuccucuucuga

SEQ ID NO: 1020672 - RNA, 17 nt, Homo sapiens
cccccugaacacuguga

SEQ ID NO: 1020673 - RNA, 14 nt, Homo sapiens
cccccuggagagaa

SEQ ID NO: 1020674 - RNA, 14 nt, Homo sapiens
cccccugggcugag

SEQ ID NO: 1020675 - RNA, 15 nt, Homo sapiens
cccccuuccauggac

SEQ ID NO: 1020676 - RNA, 16 nt, Homo sapiens
ccccggccucagcacc

SEQ ID NO: 1020677 - RNA, 16 nt, Homo sapiens
ccccuaaaccaaaaac

SEQ ID NO: 1020678 - RNA, 14 nt, Homo sapiens
ccccuaagagccau

SEQ ID NO: 1020679 - RNA, 16 nt, Homo sapiens
ccccucaaagucugca

SEQ ID NO: 1020680 - RNA, 15 nt, Homo sapiens
ccccucagagugcaa

SEQ ID NO: 1020681 - RNA, 13 nt, Homo sapiens
ccccucaucucau

SEQ ID NO: 1020682 - RNA, 16 nt, Homo sapiens
ccccuccuugggcacu

SEQ ID NO: 1020683 - RNA, 15 nt, Homo sapiens
ccccucggagaagag

SEQ ID NO: 1020684 - RNA, 17 nt, Homo sapiens
ccccucugucuugugaa

SEQ ID NO: 1020685 - RNA, 17 nt, Homo sapiens
ccccugcccugggaugu

SEQ ID NO: 1020686 - RNA, 14 nt, Homo sapiens
ccccuggcucugac

SEQ ID NO: 1020687 - RNA, 22 nt, Homo sapiens
ccccuguagagugggagcugag

SEQ ID NO: 1020688 - RNA, 17 nt, Homo sapiens
ccccugucucaggguga

SEQ ID NO: 1020689 - RNA, 22 nt, Homo sapiens
ccccuuauccaggacucuguca

SEQ ID NO: 1020690 - RNA, 13 nt, Homo sapiens
ccccuucagcuuu

SEQ ID NO: 1020691 - RNA, 14 nt, Homo sapiens
ccccuuguccuuuc

SEQ ID NO: 1020692 - RNA, 19 nt, Homo sapiens
ccccuuuacucauagcacu

SEQ ID NO: 1020693 - RNA, 12 nt, Homo sapiens
ccccuuugcccu

SEQ ID NO: 1020694 - RNA, 16 nt, Homo sapiens
cccgacuccucaaaag

SEQ ID NO: 1020695 - RNA, 16 nt, Homo sapiens
cccgagccuggcucca

SEQ ID NO: 1020696 - RNA, 19 nt, Homo sapiens
cccgagcugggggccauga

SEQ ID NO: 1020697 - RNA, 22 nt, Homo sapiens
cccgcaggcagccccacacccg

SEQ ID NO: 1020698 - RNA, 15 nt, Homo sapiens
cccgccugccagucc

SEQ ID NO: 1020699 - RNA, 17 nt, Homo sapiens
cccggagcuaacacugg

SEQ ID NO: 1020700 - RNA, 15 nt, Homo sapiens
cccuaaaccaaaaac

SEQ ID NO: 1020701 - RNA, 18 nt, Homo sapiens
cccuaagcagaccacuga

SEQ ID NO: 1020702 - RNA, 18 nt, Homo sapiens
cccuaccagcgcccgcug

SEQ ID NO: 1020703 - RNA, 17 nt, Homo sapiens
cccuagcuuagagccuc

SEQ ID NO: 1020704 - RNA, 19 nt, Homo sapiens
cccuauugguaaagaaugg

SEQ ID NO: 1020705 - RNA, 15 nt, Homo sapiens
cccuauuuuugcaau

SEQ ID NO: 1020706 - RNA, 17 nt, Homo sapiens
cccucaaaacuuggaau

SEQ ID NO: 1020707 - RNA, 17 nt, Homo sapiens
cccucaaagugagggga

SEQ ID NO: 1020708 - RNA, 13 nt, Homo sapiens
cccucaccuguca

SEQ ID NO: 1020709 - RNA, 15 nt, Homo sapiens
cccucagagugcaag

SEQ ID NO: 1020710 - RNA, 13 nt, Homo sapiens
cccucagauuccg

SEQ ID NO: 1020711 - RNA, 20 nt, Homo sapiens
cccucaggagccucugcucc

SEQ ID NO: 1020712 - RNA, 11 nt, Homo sapiens
cccucagggau

SEQ ID NO: 1020713 - RNA, 17 nt, Homo sapiens
cccucagggaucuugca

SEQ ID NO: 1020714 - RNA, 15 nt, Homo sapiens
cccucaguuucccua

SEQ ID NO: 1020715 - RNA, 15 nt, Homo sapiens
cccuccaaaagcacu

SEQ ID NO: 1020716 - RNA, 14 nt, Homo sapiens
cccuccacugucac

SEQ ID NO: 1020717 - RNA, 13 nt, Homo sapiens
cccucccauggca

SEQ ID NO: 1020718 - RNA, 15 nt, Homo sapiens
cccuccccugccauu

SEQ ID NO: 1020719 - RNA, 15 nt, Homo sapiens
cccuccguggcauca

SEQ ID NO: 1020720 - RNA, 21 nt, Homo sapiens
cccucguggccagcccggcug

SEQ ID NO: 1020721 - RNA, 15 nt, Homo sapiens
cccucuaagggaccu

SEQ ID NO: 1020722 - RNA, 14 nt, Homo sapiens
cccugacaugcaca

SEQ ID NO: 1020723 - RNA, 23 nt, Homo sapiens
cccugacccagagccuaggggau

SEQ ID NO: 1020724 - RNA, 22 nt, Homo sapiens
cccugacucucugugaccugcc

SEQ ID NO: 1020725 - RNA, 17 nt, Homo sapiens
cccugauacaggcaugg

SEQ ID NO: 1020726 - RNA, 19 nt, Homo sapiens
cccugcaauaaacugcuuu

SEQ ID NO: 1020727 - RNA, 20 nt, Homo sapiens
cccugcccuccccucucugc

SEQ ID NO: 1020728 - RNA, 19 nt, Homo sapiens
cccugcuccucccuggcug

SEQ ID NO: 1020729 - RNA, 19 nt, Homo sapiens
cccugcuugcacuuuguaa

SEQ ID NO: 1020730 - RNA, 16 nt, Homo sapiens
cccugggauguccaca

SEQ ID NO: 1020731 - RNA, 23 nt, Homo sapiens
cccugggcaucagaccuuaacca

SEQ ID NO: 1020732 - RNA, 14 nt, Homo sapiens
cccuggggacagca

SEQ ID NO: 1020733 - RNA, 22 nt, Homo sapiens
cccugguggagaaagcacugac

SEQ ID NO: 1020734 - RNA, 16 nt, Homo sapiens
cccugguggcagcuca

SEQ ID NO: 1020735 - RNA, 14 nt, Homo sapiens
cccuggugguggau

SEQ ID NO: 1020736 - RNA, 16 nt, Homo sapiens
cccugguucugaugau

SEQ ID NO: 1020737 - RNA, 19 nt, Homo sapiens
cccuguagugaccuguaaa

SEQ ID NO: 1020738 - RNA, 22 nt, Homo sapiens
cccuguccaaacugccuaagcc

SEQ ID NO: 1020739 - RNA, 19 nt, Homo sapiens
cccugugcuccgugccucc

SEQ ID NO: 1020740 - RNA, 11 nt, Homo sapiens
cccugugcuga

SEQ ID NO: 1020741 - RNA, 18 nt, Homo sapiens
cccugugguccugaauuc

SEQ ID NO: 1020742 - RNA, 20 nt, Homo sapiens
cccuguucuuggaucugcca

SEQ ID NO: 1020743 - RNA, 19 nt, Homo sapiens
cccuguuucucuugaagaa

SEQ ID NO: 1020744 - RNA, 17 nt, Homo sapiens
cccuuagccucccugaa

SEQ ID NO: 1020745 - RNA, 12 nt, Homo sapiens
cccuucacccca

SEQ ID NO: 1020746 - RNA, 15 nt, Homo sapiens
cccuucacugccuuu

SEQ ID NO: 1020747 - RNA, 21 nt, Homo sapiens
cccuuccaugucgccucugca

SEQ ID NO: 1020748 - RNA, 11 nt, Homo sapiens
cccuuccccag

SEQ ID NO: 1020749 - RNA, 19 nt, Homo sapiens
cccuucuaaccugaacuga

SEQ ID NO: 1020750 - RNA, 22 nt, Homo sapiens
cccuucuugguuuccaaaggca

SEQ ID NO: 1020751 - RNA, 13 nt, Homo sapiens
cccuugaaccagc

SEQ ID NO: 1020752 - RNA, 19 nt, Homo sapiens
cccuuuccuacucucagga

SEQ ID NO: 1020753 - RNA, 19 nt, Homo sapiens
cccuuugaugauuaauuca

SEQ ID NO: 1020754 - RNA, 22 nt, Homo sapiens
cccuuugggcccagggacacca

SEQ ID NO: 1020755 - RNA, 23 nt, Homo sapiens
gugauucccuccugcuacucugu

SEQ ID NO: 1020756 - RNA, 22 nt, Homo sapiens
gugauugggaauaaauaugccu

SEQ ID NO: 1020757 - RNA, 13 nt, Homo sapiens
gugauugugccag

SEQ ID NO: 1020758 - RNA, 16 nt, Homo sapiens
gugauuuaauaguguu

SEQ ID NO: 1020759 - RNA, 18 nt, Homo sapiens
gugcaaagauuugcuuua

SEQ ID NO: 1020760 - RNA, 13 nt, Homo sapiens
gugcaaguguaug

SEQ ID NO: 1020761 - RNA, 15 nt, Homo sapiens
gugcaaguguguaug

SEQ ID NO: 1020762 - RNA, 13 nt, Homo sapiens
gugcaauauguga

SEQ ID NO: 1020763 - RNA, 16 nt, Homo sapiens
gugcacaucugugucu

SEQ ID NO: 1020764 - RNA, 20 nt, Homo sapiens
gugcacccaugggcucugac

SEQ ID NO: 1020765 - RNA, 15 nt, Homo sapiens
gugcagucugaucca

SEQ ID NO: 1020766 - RNA, 20 nt, Homo sapiens
gugcaguggcacgaucucga

SEQ ID NO: 1020767 - RNA, 20 nt, Homo sapiens
gugcauccgggggcagcucu

SEQ ID NO: 1020768 - RNA, 17 nt, Homo sapiens
gugcaugcagcaucuaa

SEQ ID NO: 1020769 - RNA, 17 nt, Homo sapiens
gugccaauauuucugau

SEQ ID NO: 1020770 - RNA, 20 nt, Homo sapiens
gugccagcaaugacaucuca

SEQ ID NO: 1020771 - RNA, 21 nt, Homo sapiens
gugccagcaaugacaucucag

SEQ ID NO: 1020772 - RNA, 21 nt, Homo sapiens
gugccauuuuaagaguuacuu

SEQ ID NO: 1020773 - RNA, 19 nt, Homo sapiens
gugcccugcaucccucucc

SEQ ID NO: 1020774 - RNA, 15 nt, Homo sapiens
gugcccugguggaga

SEQ ID NO: 1020775 - RNA, 20 nt, Homo sapiens
gugcccuuggaggccagcca

SEQ ID NO: 1020776 - RNA, 18 nt, Homo sapiens
gugccuccaccaccacug

SEQ ID NO: 1020777 - RNA, 22 nt, Homo sapiens
gugccuccaggugugcacgugg

SEQ ID NO: 1020778 - RNA, 21 nt, Homo sapiens
gugccugaaauuucaccauug

SEQ ID NO: 1020779 - RNA, 17 nt, Homo sapiens
gugcgccgagucugucu

SEQ ID NO: 1020780 - RNA, 18 nt, Homo sapiens
gugcgugcaugugcacuu

SEQ ID NO: 1020781 - RNA, 17 nt, Homo sapiens
gugcuaucgcaccacug

SEQ ID NO: 1020782 - RNA, 17 nt, Homo sapiens
gugcucaauacacagaa

SEQ ID NO: 1020783 - RNA, 15 nt, Homo sapiens
gugcuggagccacua

SEQ ID NO: 1020784 - RNA, 18 nt, Homo sapiens
gugcuguuuuuguucuac

SEQ ID NO: 1020785 - RNA, 20 nt, Homo sapiens
gugcuucgagugacugaccc

SEQ ID NO: 1020786 - RNA, 22 nt, Homo sapiens
gugcuucuuaaaauagccauaa

SEQ ID NO: 1020787 - RNA, 21 nt, Homo sapiens
gugcuuuccguggcacugcau

SEQ ID NO: 1020788 - RNA, 19 nt, Homo sapiens
guggaaagucacaggucac

SEQ ID NO: 1020789 - RNA, 23 nt, Homo sapiens
guggaauauaaggaaagcaauaa

SEQ ID NO: 1020790 - RNA, 15 nt, Homo sapiens
guggacaccauugga

SEQ ID NO: 1020791 - RNA, 18 nt, Homo sapiens
guggagaaagcacugacc

SEQ ID NO: 1020792 - RNA, 20 nt, Homo sapiens
guggaggcggaauugcucuc

SEQ ID NO: 1020793 - RNA, 15 nt, Homo sapiens
guggaugaugcugcc

SEQ ID NO: 1020794 - RNA, 15 nt, Homo sapiens
guggaugauguuucg

SEQ ID NO: 1020795 - RNA, 19 nt, Homo sapiens
guggcccagggaagccaaa

SEQ ID NO: 1020796 - RNA, 18 nt, Homo sapiens
guggccccaaauuugcua

SEQ ID NO: 1020797 - RNA, 19 nt, Homo sapiens
guggccucugggaggccag

SEQ ID NO: 1020798 - RNA, 14 nt, Homo sapiens
guggcuccuaucug

SEQ ID NO: 1020799 - RNA, 17 nt, Homo sapiens
guggcuccuaucugugu

SEQ ID NO: 1020800 - RNA, 22 nt, Homo sapiens
guggcuucacagacccacaaga

SEQ ID NO: 1020801 - RNA, 22 nt, Homo sapiens
guggcuucuuaaucuuuucaca

SEQ ID NO: 1020802 - RNA, 19 nt, Homo sapiens
guggcuuguaucaacacug

SEQ ID NO: 1020803 - RNA, 20 nt, Homo sapiens
gugggccucaaggacuugaa

SEQ ID NO: 1020804 - RNA, 11 nt, Homo sapiens
gugggggucca

SEQ ID NO: 1020805 - RNA, 22 nt, Homo sapiens
guggguccaggggccccuccag

SEQ ID NO: 1020806 - RNA, 13 nt, Homo sapiens
guggucacuggaa

SEQ ID NO: 1020807 - RNA, 21 nt, Homo sapiens
guggugagccgagauugcacc

SEQ ID NO: 1020808 - RNA, 23 nt, Homo sapiens
gugguggcauacgccuguagucc

SEQ ID NO: 1020809 - RNA, 15 nt, Homo sapiens
gugguuguuuuguca

SEQ ID NO: 1020810 - RNA, 16 nt, Homo sapiens
guguacacgugacaga

SEQ ID NO: 1020811 - RNA, 19 nt, Homo sapiens
guguagaggguguuugcag

SEQ ID NO: 1020812 - RNA, 15 nt, Homo sapiens
guguagcuuugcucu

SEQ ID NO: 1020813 - RNA, 23 nt, Homo sapiens
guguauuuaaccuugaaggguuc

SEQ ID NO: 1020814 - RNA, 15 nt, Homo sapiens
gugucaccugugcuu

SEQ ID NO: 1020815 - RNA, 22 nt, Homo sapiens
gugucacuacucacagucucuu

SEQ ID NO: 1020816 - RNA, 19 nt, Homo sapiens
guguccaugugugugcaag

SEQ ID NO: 1020817 - RNA, 14 nt, Homo sapiens
guguccugcuacaa

SEQ ID NO: 1020818 - RNA, 21 nt, Homo sapiens
gugucucugcaucacccacag

SEQ ID NO: 1020819 - RNA, 23 nt, Homo sapiens
gugucugcacccaggggugggga

SEQ ID NO: 1020820 - RNA, 18 nt, Homo sapiens
gugucuuucacagcuccu

SEQ ID NO: 1020821 - RNA, 16 nt, Homo sapiens
gugugcaaguguguau

SEQ ID NO: 1020822 - RNA, 17 nt, Homo sapiens
gugugcaagugugugca

SEQ ID NO: 1020823 - RNA, 16 nt, Homo sapiens
gugugcauguguguaa

SEQ ID NO: 1020824 - RNA, 21 nt, Homo sapiens
gugugcaugugugugcucagg

SEQ ID NO: 1020825 - RNA, 23 nt, Homo sapiens
gugugcuuauuuuaaauguuacu

SEQ ID NO: 1020826 - RNA, 12 nt, Homo sapiens
gugugucacaag

SEQ ID NO: 1020827 - RNA, 22 nt, Homo sapiens
gugugugcacguacacacacau

SEQ ID NO: 1020828 - RNA, 14 nt, Homo sapiens
gugugugugcaagu

SEQ ID NO: 1020829 - RNA, 20 nt, Homo sapiens
guguuaugcggucuagggaa

SEQ ID NO: 1020830 - RNA, 16 nt, Homo sapiens
guguucagccaaguga

SEQ ID NO: 1020831 - RNA, 23 nt, Homo sapiens
guguuccccaaaggacuugacuu

SEQ ID NO: 1020832 - RNA, 23 nt, Homo sapiens
guguucuucauuaccucagugag

SEQ ID NO: 1020833 - RNA, 12 nt, Homo sapiens
guguugauccca

SEQ ID NO: 1020834 - RNA, 13 nt, Homo sapiens
guguuuaccuaaa

SEQ ID NO: 1020835 - RNA, 13 nt, Homo sapiens
guguuuccuucag

SEQ ID NO: 1020836 - RNA, 19 nt, Homo sapiens
guguuucuauugacuucaa

SEQ ID NO: 1020837 - RNA, 15 nt, Homo sapiens
guguuugacgggaaa

SEQ ID NO: 1020838 - RNA, 20 nt, Homo sapiens
guguuugguucuggggcccc

SEQ ID NO: 1020839 - RNA, 22 nt, Homo sapiens
guguuuuuaauaaagacagggu

SEQ ID NO: 1020840 - RNA, 22 nt, Homo sapiens
guuaaaaauaaaaaacauauac

SEQ ID NO: 1020841 - RNA, 16 nt, Homo sapiens
guucuuagugucacuu

SEQ ID NO: 1020842 - RNA, 18 nt, Homo sapiens
guucuuuaagaauuacag

SEQ ID NO: 1020843 - RNA, 14 nt, Homo sapiens
guugagccuaauau

SEQ ID NO: 1020844 - RNA, 21 nt, Homo sapiens
guugagcuguugccucagucc

SEQ ID NO: 1020845 - RNA, 23 nt, Homo sapiens
guugauuucagcaccuacagugu

SEQ ID NO: 1020846 - RNA, 18 nt, Homo sapiens
guugcucaaaucuauuca

SEQ ID NO: 1020847 - RNA, 22 nt, Homo sapiens
guugcucaaaucuauucagaca

SEQ ID NO: 1020848 - RNA, 16 nt, Homo sapiens
guugcuggacugucau

SEQ ID NO: 1020849 - RNA, 18 nt, Homo sapiens
guuggaaaaugugcaaua

SEQ ID NO: 1020850 - RNA, 18 nt, Homo sapiens
guuggacccgcucuggac

SEQ ID NO: 1020851 - RNA, 14 nt, Homo sapiens
guuggcacaugccu

SEQ ID NO: 1020852 - RNA, 19 nt, Homo sapiens
guuguaacuaggcucagag

SEQ ID NO: 1020853 - RNA, 19 nt, Homo sapiens
guuguggagagugcaacag

SEQ ID NO: 1020854 - RNA, 20 nt, Homo sapiens
guuguuaaugaaaaugucag

SEQ ID NO: 1020855 - RNA, 18 nt, Homo sapiens
guuguuauuaacagcuga

SEQ ID NO: 1020856 - RNA, 20 nt, Homo sapiens
guuguuccaccuucccucau

SEQ ID NO: 1020857 - RNA, 22 nt, Homo sapiens
guuguugauguuuuaacucuau

SEQ ID NO: 1020858 - RNA, 13 nt, Homo sapiens
guuguuuacuuaa

SEQ ID NO: 1020859 - RNA, 13 nt, Homo sapiens
guuuaacucagau

SEQ ID NO: 1020860 - RNA, 21 nt, Homo sapiens
guuuacuucucaccauuugag

SEQ ID NO: 1020861 - RNA, 23 nt, Homo sapiens
guuuagccaaaggauaagugucc

SEQ ID NO: 1020862 - RNA, 17 nt, Homo sapiens
guuuaguugcagacuca

SEQ ID NO: 1020863 - RNA, 14 nt, Homo sapiens
guuuaugagccaga

SEQ ID NO: 1020864 - RNA, 20 nt, Homo sapiens
guuuaugcauagauaaucuc

SEQ ID NO: 1020865 - RNA, 20 nt, Homo sapiens
guuuaugucaucauacauga

SEQ ID NO: 1020866 - RNA, 19 nt, Homo sapiens
guuuauuuuuauacuuuca

SEQ ID NO: 1020867 - RNA, 20 nt, Homo sapiens
guuuauuuuuauacuuucag

SEQ ID NO: 1020868 - RNA, 17 nt, Homo sapiens
guuucaaaaaaucugac

SEQ ID NO: 1020869 - RNA, 19 nt, Homo sapiens
guuucaaaauaaaaaccaa

SEQ ID NO: 1020870 - RNA, 15 nt, Homo sapiens
guuucaaacuccuga

SEQ ID NO: 1020871 - RNA, 17 nt, Homo sapiens
guuucacacuagucaca

SEQ ID NO: 1020872 - RNA, 15 nt, Homo sapiens
guuucaucccaugua

SEQ ID NO: 1020873 - RNA, 16 nt, Homo sapiens
guuuccaaaaccagaa

SEQ ID NO: 1020874 - RNA, 17 nt, Homo sapiens
guuucccauaauuuucu

SEQ ID NO: 1020875 - RNA, 17 nt, Homo sapiens
guuucccguauugacag

SEQ ID NO: 1020876 - RNA, 18 nt, Homo sapiens
guuuccuuucauuuacug

SEQ ID NO: 1020877 - RNA, 21 nt, Homo sapiens
guuucgugaaguauacuguau

SEQ ID NO: 1020878 - RNA, 15 nt, Homo sapiens
guuucuaacuuggag

SEQ ID NO: 1020879 - RNA, 20 nt, Homo sapiens
guuucugaucugaugcaagc

SEQ ID NO: 1020880 - RNA, 23 nt, Homo sapiens
guuucuuuagcaguuuugugaua

SEQ ID NO: 1020881 - RNA, 12 nt, Homo sapiens
guuucuuucuag

SEQ ID NO: 1020882 - RNA, 22 nt, Homo sapiens
guuugaagaugccgcauuugga

SEQ ID NO: 1020883 - RNA, 18 nt, Homo sapiens
guuugaccucauuuguaa

SEQ ID NO: 1020884 - RNA, 21 nt, Homo sapiens
guuugaggauaggaguucacu

SEQ ID NO: 1020885 - RNA, 16 nt, Homo sapiens
guuugcaauuuuucca

SEQ ID NO: 1020886 - RNA, 17 nt, Homo sapiens
guuugcuuauuguucca

SEQ ID NO: 1020887 - RNA, 15 nt, Homo sapiens
guuugguguguuccc

SEQ ID NO: 1020888 - RNA, 13 nt, Homo sapiens
guuugucuucucc

SEQ ID NO: 1020889 - RNA, 20 nt, Homo sapiens
guuuguggccucagaauuga

SEQ ID NO: 1020890 - RNA, 12 nt, Homo sapiens
guuuguguuacc

SEQ ID NO: 1020891 - RNA, 20 nt, Homo sapiens
guuuuaaagcuugcucacau

SEQ ID NO: 1020892 - RNA, 12 nt, Homo sapiens
guuuuaacugua

SEQ ID NO: 1020893 - RNA, 22 nt, Homo sapiens
guuuuaagaggcagggucucac

SEQ ID NO: 1020894 - RNA, 18 nt, Homo sapiens
guuuuacgucugggagaa

SEQ ID NO: 1020895 - RNA, 13 nt, Homo sapiens
guuuuacuuuuaa

SEQ ID NO: 1020896 - RNA, 21 nt, Homo sapiens
guuuuagcggucaauuugccu

SEQ ID NO: 1020897 - RNA, 11 nt, Homo sapiens
guuuucagugu

SEQ ID NO: 1020898 - RNA, 17 nt, Homo sapiens
guuuucaucaagacugg

SEQ ID NO: 1020899 - RNA, 14 nt, Homo sapiens
guuuucauuaucuc

SEQ ID NO: 1020900 - RNA, 19 nt, Homo sapiens
guuuuccuaaaugcaguga

SEQ ID NO: 1020901 - RNA, 13 nt, Homo sapiens
guuuugacaucaa

SEQ ID NO: 1020902 - RNA, 20 nt, Homo sapiens
guuuugauaaaguaguaaaa

SEQ ID NO: 1020903 - RNA, 17 nt, Homo sapiens
guuuuggaagcucugaa

SEQ ID NO: 1020904 - RNA, 23 nt, Homo sapiens
guuuuggaagcucugaagucaca

SEQ ID NO: 1020905 - RNA, 16 nt, Homo sapiens
guuuugucaaacugua

SEQ ID NO: 1020906 - RNA, 22 nt, Homo sapiens
guuuuuaaauagaguuugcuau

SEQ ID NO: 1020907 - RNA, 22 nt, Homo sapiens
guuuuuauggcuuuugugcauu

SEQ ID NO: 1020908 - RNA, 23 nt, Homo sapiens
uaaaaaaaaaaaaaaaagugaug

SEQ ID NO: 1020909 - RNA, 18 nt, Homo sapiens
uaaaaaaaaaauuacuuc

SEQ ID NO: 1020910 - RNA, 13 nt, Homo sapiens
uaaaaaauggaac

SEQ ID NO: 1020911 - RNA, 20 nt, Homo sapiens
uaaaaacaccaaaaagggau

SEQ ID NO: 1020912 - RNA, 19 nt, Homo sapiens
uaaaaaccaagaagauguc

SEQ ID NO: 1020913 - RNA, 15 nt, Homo sapiens
uaaaaagucuucacu

SEQ ID NO: 1020914 - RNA, 18 nt, Homo sapiens
uaaaaagugacacagcag

SEQ ID NO: 1020915 - RNA, 19 nt, Homo sapiens
uaaaaagugacacagcagc

SEQ ID NO: 1020916 - RNA, 16 nt, Homo sapiens
uaaaaauaugcuucua

SEQ ID NO: 1020917 - RNA, 18 nt, Homo sapiens
uaaaaaucauaguacucu

SEQ ID NO: 1020918 - RNA, 15 nt, Homo sapiens
uaaaaaugaauccua

SEQ ID NO: 1020919 - RNA, 13 nt, Homo sapiens
uaaaaaugcaaau

SEQ ID NO: 1020920 - RNA, 15 nt, Homo sapiens
uaaaaaugcaacuuc

SEQ ID NO: 1020921 - RNA, 14 nt, Homo sapiens
uaaaaauggcucag

SEQ ID NO: 1020922 - RNA, 14 nt, Homo sapiens
uaacugagauuaca

SEQ ID NO: 1020923 - RNA, 13 nt, Homo sapiens
uaacugauagaac

SEQ ID NO: 1020924 - RNA, 12 nt, Homo sapiens
uaacugcaauuu

SEQ ID NO: 1020925 - RNA, 16 nt, Homo sapiens
uaacuggcuuacuucc

SEQ ID NO: 1020926 - RNA, 18 nt, Homo sapiens
uaacuggcuuacuuccua

SEQ ID NO: 1020927 - RNA, 15 nt, Homo sapiens
uaacuggggauauaa

SEQ ID NO: 1020928 - RNA, 23 nt, Homo sapiens
uaacuggggauauaauacuauau

SEQ ID NO: 1020929 - RNA, 12 nt, Homo sapiens
uaacuguucuca

SEQ ID NO: 1020930 - RNA, 23 nt, Homo sapiens
uaacuguucucauuuuauugcua

SEQ ID NO: 1020931 - RNA, 16 nt, Homo sapiens
uaacuuagguggcaag

SEQ ID NO: 1020932 - RNA, 17 nt, Homo sapiens
uaacuuauaucaucagc

SEQ ID NO: 1020933 - RNA, 17 nt, Homo sapiens
uaacuuguuuccaaugu

SEQ ID NO: 1020934 - RNA, 15 nt, Homo sapiens
uaacuuuauguguaa

SEQ ID NO: 1020935 - RNA, 19 nt, Homo sapiens
uaacuuuuuaaaacacaac

SEQ ID NO: 1020936 - RNA, 13 nt, Homo sapiens
uaagaaaauucua

SEQ ID NO: 1020937 - RNA, 15 nt, Homo sapiens
uaagaaacacacuga

SEQ ID NO: 1020938 - RNA, 22 nt, Homo sapiens
uaagaaccacucauaauucuuc

SEQ ID NO: 1020939 - RNA, 13 nt, Homo sapiens
uaagaagggaaaa

SEQ ID NO: 1020940 - RNA, 15 nt, Homo sapiens
uaagaauaguucccu

SEQ ID NO: 1020941 - RNA, 14 nt, Homo sapiens
uaagacucauuccc

SEQ ID NO: 1020942 - RNA, 12 nt, Homo sapiens
uaagacuguaau

SEQ ID NO: 1020943 - RNA, 13 nt, Homo sapiens
uaagagagucaua

SEQ ID NO: 1020944 - RNA, 15 nt, Homo sapiens
uaagagagucauaaa

SEQ ID NO: 1020945 - RNA, 16 nt, Homo sapiens
uaagagggcacacacu

SEQ ID NO: 1020946 - RNA, 19 nt, Homo sapiens
uaagagggcacacacugug

SEQ ID NO: 1020947 - RNA, 22 nt, Homo sapiens
uaagauacuggacuccucuucc

SEQ ID NO: 1020948 - RNA, 21 nt, Homo sapiens
uaagcacgggccauaugaaua

SEQ ID NO: 1020949 - RNA, 19 nt, Homo sapiens
uaagcagaagcacauauga

SEQ ID NO: 1020950 - RNA, 16 nt, Homo sapiens
uaagcagaccacugau

SEQ ID NO: 1020951 - RNA, 22 nt, Homo sapiens
uaagcaucaaauauuugugcaa

SEQ ID NO: 1020952 - RNA, 14 nt, Homo sapiens
uaagcccucaggag

SEQ ID NO: 1020953 - RNA, 15 nt, Homo sapiens
uaagccuuuccauaa

SEQ ID NO: 1020954 - RNA, 16 nt, Homo sapiens
uaagcuaucuucaaau

SEQ ID NO: 1020955 - RNA, 20 nt, Homo sapiens
uaagcugggauaaucacauu

SEQ ID NO: 1020956 - RNA, 14 nt, Homo sapiens
uaaggaaacugggu

SEQ ID NO: 1020957 - RNA, 15 nt, Homo sapiens
uaaggaauaccuguc

SEQ ID NO: 1020958 - RNA, 15 nt, Homo sapiens
uaaggacauuuccca

SEQ ID NO: 1020959 - RNA, 19 nt, Homo sapiens
uaaggaguaaucuguguac

SEQ ID NO: 1020960 - RNA, 20 nt, Homo sapiens
uaaggaguaaucuguguaca

SEQ ID NO: 1020961 - RNA, 19 nt, Homo sapiens
uaaggcugaggaaaggcca

SEQ ID NO: 1020962 - RNA, 16 nt, Homo sapiens
uaagggaaacugccag

SEQ ID NO: 1020963 - RNA, 20 nt, Homo sapiens
uaagggaaggaacucuggcu

SEQ ID NO: 1020964 - RNA, 21 nt, Homo sapiens
uaagggcuggucucugcugaa

SEQ ID NO: 1020965 - RNA, 20 nt, Homo sapiens
uaaggguuaguuuacaauca

SEQ ID NO: 1020966 - RNA, 13 nt, Homo sapiens
uaagguacuagca

SEQ ID NO: 1020967 - RNA, 21 nt, Homo sapiens
uaagguauauaaauuuuccca

SEQ ID NO: 1020968 - RNA, 15 nt, Homo sapiens
uaagguccccacugc

SEQ ID NO: 1020969 - RNA, 13 nt, Homo sapiens
uaaggugagggaa

SEQ ID NO: 1020970 - RNA, 13 nt, Homo sapiens
uaaguaauuucag

SEQ ID NO: 1020971 - RNA, 17 nt, Homo sapiens
uaaguaccacucaggcc

SEQ ID NO: 1020972 - RNA, 22 nt, Homo sapiens
uaaguacuauguaucaaugagu

SEQ ID NO: 1020973 - RNA, 22 nt, Homo sapiens
uaaguagggacuucugucuuca

SEQ ID NO: 1020974 - RNA, 17 nt, Homo sapiens
uaagucaaccugccuga

SEQ ID NO: 1020975 - RNA, 22 nt, Homo sapiens
uaagucaaccugccugacauuu

SEQ ID NO: 1020976 - RNA, 17 nt, Homo sapiens
uaagucuuaaucauuug

SEQ ID NO: 1020977 - RNA, 19 nt, Homo sapiens
uaagugaaauaagccagac

SEQ ID NO: 1020978 - RNA, 18 nt, Homo sapiens
uaagugcagucugaucca

SEQ ID NO: 1020979 - RNA, 20 nt, Homo sapiens
uaaguugcaccaacuuugaa

SEQ ID NO: 1020980 - RNA, 15 nt, Homo sapiens
uaauaaagacagggu

SEQ ID NO: 1020981 - RNA, 21 nt, Homo sapiens
uaauaagcaaagggagcacug

SEQ ID NO: 1020982 - RNA, 21 nt, Homo sapiens
uaauaauagaaaaauacucau

SEQ ID NO: 1020983 - RNA, 19 nt, Homo sapiens
uaauaauguguacauuagu

SEQ ID NO: 1020984 - RNA, 13 nt, Homo sapiens
uaauaauugauca

SEQ ID NO: 1020985 - RNA, 18 nt, Homo sapiens
uaauacagacuaugucac

SEQ ID NO: 1020986 - RNA, 23 nt, Homo sapiens
uaauacagccaaagauaaucucu

SEQ ID NO: 1020987 - RNA, 21 nt, Homo sapiens
uaauacuauauuuauacugua

SEQ ID NO: 1020988 - RNA, 14 nt, Homo sapiens
uaauacugaaggac

SEQ ID NO: 1020989 - RNA, 20 nt, Homo sapiens
uaauacugaaggacacagca

SEQ ID NO: 1020990 - RNA, 15 nt, Homo sapiens
uaauagaauucuguu

SEQ ID NO: 1020991 - RNA, 19 nt, Homo sapiens
uaauagcuuuuauuguaua

SEQ ID NO: 1020992 - RNA, 20 nt, Homo sapiens
uaauagggagaaaccaagag

SEQ ID NO: 1020993 - RNA, 17 nt, Homo sapiens
uaauauaaaguguaaua

SEQ ID NO: 1020994 - RNA, 14 nt, Homo sapiens
uaauaucaucagua

SEQ ID NO: 1020995 - RNA, 12 nt, Homo sapiens
uaauauugcaag

SEQ ID NO: 1020996 - RNA, 12 nt, Homo sapiens
ucagcugccuca

SEQ ID NO: 1020997 - RNA, 21 nt, Homo sapiens
ucagcuuauaaaaucaaacag

SEQ ID NO: 1020998 - RNA, 19 nt, Homo sapiens
ucagcuuguaaauagcuca

SEQ ID NO: 1020999 - RNA, 20 nt, Homo sapiens
ucagcuuuaguagauauuac

SEQ ID NO: 1021000 - RNA, 22 nt, Homo sapiens
ucaggaaaucaaauaugcaaag

SEQ ID NO: 1021001 - RNA, 21 nt, Homo sapiens
ucaggaaggaugagcauuuag

SEQ ID NO: 1021002 - RNA, 20 nt, Homo sapiens
ucaggaauuuuguaaucuca

SEQ ID NO: 1021003 - RNA, 23 nt, Homo sapiens
ucaggaauuuuguaaucucauaa

SEQ ID NO: 1021004 - RNA, 20 nt, Homo sapiens
ucaggacagguggugcaaau

SEQ ID NO: 1021005 - RNA, 16 nt, Homo sapiens
ucaggagaaaaagccu

SEQ ID NO: 1021006 - RNA, 21 nt, Homo sapiens
ucaggagcagccucagaacaa

SEQ ID NO: 1021007 - RNA, 18 nt, Homo sapiens
ucaggaguuugagaccag

SEQ ID NO: 1021008 - RNA, 23 nt, Homo sapiens
ucaggauuaaugguccugugaug

SEQ ID NO: 1021009 - RNA, 17 nt, Homo sapiens
ucaggccaacaagccaa

SEQ ID NO: 1021010 - RNA, 14 nt, Homo sapiens
ucaggccaucauca

SEQ ID NO: 1021011 - RNA, 23 nt, Homo sapiens
ucaggcgauccaccugucucagc

SEQ ID NO: 1021012 - RNA, 16 nt, Homo sapiens
ucaggcucugccucac

SEQ ID NO: 1021013 - RNA, 15 nt, Homo sapiens
ucagggccaugccug

SEQ ID NO: 1021014 - RNA, 22 nt, Homo sapiens
ucaggggcggggagggugacag

SEQ ID NO: 1021015 - RNA, 20 nt, Homo sapiens
ucagggggauaacuaccaga

SEQ ID NO: 1021016 - RNA, 12 nt, Homo sapiens
ucaggucacaag

SEQ ID NO: 1021017 - RNA, 14 nt, Homo sapiens
ucaggugcuacaca

SEQ ID NO: 1021018 - RNA, 20 nt, Homo sapiens
ucagguggccagccuggauc

SEQ ID NO: 1021019 - RNA, 16 nt, Homo sapiens
ucagguggggcagcuu

SEQ ID NO: 1021020 - RNA, 22 nt, Homo sapiens
ucaggugucccugcacuugcag

SEQ ID NO: 1021021 - RNA, 23 nt, Homo sapiens
ucagguuugggguucguggaaag

SEQ ID NO: 1021022 - RNA, 17 nt, Homo sapiens
ucaguaaguaucuggag

SEQ ID NO: 1021023 - RNA, 18 nt, Homo sapiens
ucaguaguaucaaugauu

SEQ ID NO: 1021024 - RNA, 17 nt, Homo sapiens
ucaguaguuuuacugau

SEQ ID NO: 1021025 - RNA, 11 nt, Homo sapiens
ucaguaugugg

SEQ ID NO: 1021026 - RNA, 12 nt, Homo sapiens
ucaguaugugga

SEQ ID NO: 1021027 - RNA, 15 nt, Homo sapiens
ucaguccacugcuga

SEQ ID NO: 1021028 - RNA, 23 nt, Homo sapiens
ucagucccuauguauuugcaguu

SEQ ID NO: 1021029 - RNA, 22 nt, Homo sapiens
ucagucugaugagaacucugag

SEQ ID NO: 1021030 - RNA, 15 nt, Homo sapiens
ucagugaaagccaga

SEQ ID NO: 1021031 - RNA, 20 nt, Homo sapiens
ucagugaagaugccagugaa

SEQ ID NO: 1021032 - RNA, 12 nt, Homo sapiens
ucagugaaggac

SEQ ID NO: 1021033 - RNA, 14 nt, Homo sapiens
ucagugcaggagag

SEQ ID NO: 1021034 - RNA, 23 nt, Homo sapiens
ucaguuauuuuuugaauaauaac

SEQ ID NO: 1021035 - RNA, 16 nt, Homo sapiens
ucaguuuaaacaaagg

SEQ ID NO: 1021036 - RNA, 21 nt, Homo sapiens
ucauaagaaugaauaauaauu

SEQ ID NO: 1021037 - RNA, 23 nt, Homo sapiens
ucauaagccuaccaauguagaca

SEQ ID NO: 1021038 - RNA, 21 nt, Homo sapiens
ucauaaugugcaaagucauca

SEQ ID NO: 1021039 - RNA, 18 nt, Homo sapiens
ucauacaaggcccaggag

SEQ ID NO: 1021040 - RNA, 13 nt, Homo sapiens
ucauagcauuaac

SEQ ID NO: 1021041 - RNA, 23 nt, Homo sapiens
ucauagcuaagaaauaaaacugu

SEQ ID NO: 1021042 - RNA, 11 nt, Homo sapiens
ucauagcucau

SEQ ID NO: 1021043 - RNA, 15 nt, Homo sapiens
ucauagcugagauuc

SEQ ID NO: 1021044 - RNA, 20 nt, Homo sapiens
ucauaggaaaaguacauuua

SEQ ID NO: 1021045 - RNA, 14 nt, Homo sapiens
ucauauaccagcaa

SEQ ID NO: 1021046 - RNA, 16 nt, Homo sapiens
ucauauaccagcaaua

SEQ ID NO: 1021047 - RNA, 16 nt, Homo sapiens
ucauaugauugugcac

SEQ ID NO: 1021048 - RNA, 21 nt, Homo sapiens
ucauaugauugugcacauacu

SEQ ID NO: 1021049 - RNA, 22 nt, Homo sapiens
ucauaugauugugcacauacuu

SEQ ID NO: 1021050 - RNA, 22 nt, Homo sapiens
ucauauuggacugauaaucucu

SEQ ID NO: 1021051 - RNA, 23 nt, Homo sapiens
ucauauugguauucacuaaucug

SEQ ID NO: 1021052 - RNA, 19 nt, Homo sapiens
ucaucaaauggaagacaca

SEQ ID NO: 1021053 - RNA, 18 nt, Homo sapiens
ucaucaaggcacugccug

SEQ ID NO: 1021054 - RNA, 19 nt, Homo sapiens
ucaucacuggaugaagauu

SEQ ID NO: 1021055 - RNA, 22 nt, Homo sapiens
ucaucagaagauaacuugagca

SEQ ID NO: 1021056 - RNA, 15 nt, Homo sapiens
ucaucagcauaccuu

SEQ ID NO: 1021057 - RNA, 21 nt, Homo sapiens
ucaucaguggagccauguuaa

SEQ ID NO: 1021058 - RNA, 23 nt, Homo sapiens
ucaucaguguccucuugcucaaa

SEQ ID NO: 1021059 - RNA, 14 nt, Homo sapiens
ugcuugaaugaagu

SEQ ID NO: 1021060 - RNA, 17 nt, Homo sapiens
ugcuugcacaaaccaau

SEQ ID NO: 1021061 - RNA, 14 nt, Homo sapiens
ugcuugcugcucau

SEQ ID NO: 1021062 - RNA, 22 nt, Homo sapiens
ugcuuggguggagaagccauug

SEQ ID NO: 1021063 - RNA, 16 nt, Homo sapiens
ugcuugguugucucca

SEQ ID NO: 1021064 - RNA, 16 nt, Homo sapiens
ugcuuguacauaaugc

SEQ ID NO: 1021065 - RNA, 19 nt, Homo sapiens
ugcuugugccacacccucc

SEQ ID NO: 1021066 - RNA, 17 nt, Homo sapiens
ugcuuuaaaaaaauaca

SEQ ID NO: 1021067 - RNA, 18 nt, Homo sapiens
ugcuuuagcacaggacaa

SEQ ID NO: 1021068 - RNA, 16 nt, Homo sapiens
ugcuuucuauuuugag

SEQ ID NO: 1021069 - RNA, 16 nt, Homo sapiens
ugcuuuggaaaucaca

SEQ ID NO: 1021070 - RNA, 13 nt, Homo sapiens
ugcuuugugauuu

SEQ ID NO: 1021071 - RNA, 14 nt, Homo sapiens
ugcuuuuaaaugca

SEQ ID NO: 1021072 - RNA, 17 nt, Homo sapiens
ugcuuuucacugcugca

SEQ ID NO: 1021073 - RNA, 21 nt, Homo sapiens
ugcuuuuuaaagaaugcucuu

SEQ ID NO: 1021074 - RNA, 22 nt, Homo sapiens
uggaaaagcaaaacuguagggg

SEQ ID NO: 1021075 - RNA, 19 nt, Homo sapiens
uggaaaaggaagacuagag

SEQ ID NO: 1021076 - RNA, 14 nt, Homo sapiens
uggaaaauaaauca

SEQ ID NO: 1021077 - RNA, 14 nt, Homo sapiens
uggaaaaugugacc

SEQ ID NO: 1021078 - RNA, 14 nt, Homo sapiens
uggaaacaggacca

SEQ ID NO: 1021079 - RNA, 14 nt, Homo sapiens
uggaaacugaaugc

SEQ ID NO: 1021080 - RNA, 17 nt, Homo sapiens
uggaaagaaaaagcaau

SEQ ID NO: 1021081 - RNA, 21 nt, Homo sapiens
uggaaagacagcuucucaucc

SEQ ID NO: 1021082 - RNA, 17 nt, Homo sapiens
uggaaagacauagccaa

SEQ ID NO: 1021083 - RNA, 19 nt, Homo sapiens
uggaaagcaucaccucagg

SEQ ID NO: 1021084 - RNA, 14 nt, Homo sapiens
uggaaagcugcuuc

SEQ ID NO: 1021085 - RNA, 15 nt, Homo sapiens
uggaaauucccuuca

SEQ ID NO: 1021086 - RNA, 20 nt, Homo sapiens
uggaaauucccuucaucugg

SEQ ID NO: 1021087 - RNA, 15 nt, Homo sapiens
uggaacaccuccuca

SEQ ID NO: 1021088 - RNA, 16 nt, Homo sapiens
uggaacagucuuccca

SEQ ID NO: 1021089 - RNA, 15 nt, Homo sapiens
uggaacuucuaauau

SEQ ID NO: 1021090 - RNA, 21 nt, Homo sapiens
uggaagagccugcaggugcug

SEQ ID NO: 1021091 - RNA, 13 nt, Homo sapiens
uggaagcaacagg

SEQ ID NO: 1021092 - RNA, 14 nt, Homo sapiens
uggaagcacagcuu

SEQ ID NO: 1021093 - RNA, 16 nt, Homo sapiens
uggaaggcuuccacua

SEQ ID NO: 1021094 - RNA, 13 nt, Homo sapiens
uggaaggugcugu

SEQ ID NO: 1021095 - RNA, 23 nt, Homo sapiens
uggaagguggggacagggaugag

SEQ ID NO: 1021096 - RNA, 19 nt, Homo sapiens
uggaagugaggcauugcac

SEQ ID NO: 1021097 - RNA, 19 nt, Homo sapiens
uggaaguugcauggcauca

SEQ ID NO: 1021098 - RNA, 23 nt, Homo sapiens
uggaaguugcauggcaucaccuc

SEQ ID NO: 1021099 - RNA, 17 nt, Homo sapiens
uggaauaaagcccuuga

SEQ ID NO: 1021100 - RNA, 19 nt, Homo sapiens
uggaauaaagcccuugaac

SEQ ID NO: 1021101 - RNA, 21 nt, Homo sapiens
uggaauauaaggaaagcaaua

SEQ ID NO: 1021102 - RNA, 21 nt, Homo sapiens
uggaauauuguccauugucca

SEQ ID NO: 1021103 - RNA, 12 nt, Homo sapiens
uggaaucuggag

SEQ ID NO: 1021104 - RNA, 20 nt, Homo sapiens
uggaaugggcagcucaucuc

SEQ ID NO: 1021105 - RNA, 16 nt, Homo sapiens
uggaauguacucuguu

SEQ ID NO: 1021106 - RNA, 19 nt, Homo sapiens
uggaauuaugucugcugaa

SEQ ID NO: 1021107 - RNA, 19 nt, Homo sapiens
uggacaaaccgagugcaau

SEQ ID NO: 1021108 - RNA, 13 nt, Homo sapiens
uggacacacuggu

SEQ ID NO: 1021109 - RNA, 12 nt, Homo sapiens
uggacacagccc

SEQ ID NO: 1021110 - RNA, 12 nt, Homo sapiens
uggacacagcuc

SEQ ID NO: 1021111 - RNA, 10 nt, Homo sapiens
uggacacugu

SEQ ID NO: 1021112 - RNA, 15 nt, Homo sapiens
uggacagaagcagcu

SEQ ID NO: 1021113 - RNA, 22 nt, Homo sapiens
uggacaggaggcccccaucuau

SEQ ID NO: 1021114 - RNA, 14 nt, Homo sapiens
uggacauuugccuu

SEQ ID NO: 1021115 - RNA, 15 nt, Homo sapiens
uggaccaacccuguu

SEQ ID NO: 1021116 - RNA, 21 nt, Homo sapiens
uggaccaauagggcugagcuc

SEQ ID NO: 1021117 - RNA, 17 nt, Homo sapiens
uggaccugcaccaaagc

SEQ ID NO: 1021118 - RNA, 21 nt, Homo sapiens
uggacuauggcucuacuuuca

SEQ ID NO: 1021119 - RNA, 20 nt, Homo sapiens
uggacucaagcaagauuuca

SEQ ID NO: 1021120 - RNA, 17 nt, Homo sapiens
uggacucugcacauguc

SEQ ID NO: 1021121 - RNA, 16 nt, Homo sapiens
uggacuguaacugacu

SEQ ID NO: 1021122 - RNA, 23 nt, Homo sapiens
uggacugugggacccuccuggug

SEQ ID NO: 1021123 - RNA, 19 nt, Homo sapiens
uggagaaaaaacacacucc

SEQ ID NO: 1021124 - RNA, 17 nt, Homo sapiens
uggagaaacuguagucu

SEQ ID NO: 1021125 - RNA, 19 nt, Homo sapiens
uggagaaauaaaaauaccu

SEQ ID NO: 1021126 - RNA, 21 nt, Homo sapiens
uggagaagucuuagacuugaa

SEQ ID NO: 1021127 - RNA, 13 nt, Homo sapiens
uggagacagggca

SEQ ID NO: 1021128 - RNA, 21 nt, Homo sapiens
uggagacuccuaggcaggaca

SEQ ID NO: 1021129 - RNA, 12 nt, Homo sapiens
uggagagccacc

SEQ ID NO: 1021130 - RNA, 21 nt, Homo sapiens
uggagagccccucacacagcc

SEQ ID NO: 1021131 - RNA, 16 nt, Homo sapiens
uggagcauaguggcaa

SEQ ID NO: 1021132 - RNA, 20 nt, Homo sapiens
uggagcauuggcugagagac

SEQ ID NO: 1021133 - RNA, 23 nt, Homo sapiens
uggagccccagugccaagcacag

SEQ ID NO: 1021134 - RNA, 18 nt, Homo sapiens
uggagccccaucagcucc

SEQ ID NO: 1021135 - RNA, 15 nt, Homo sapiens
uggagcccuguaauu

SEQ ID NO: 1021136 - RNA, 24 nt, Homo sapiens
uggagcugagcagguguucuucau

SEQ ID NO: 1021137 - RNA, 16 nt, Homo sapiens
uggaggcaccauuugu

SEQ ID NO: 1021138 - RNA, 19 nt, Homo sapiens
uggaggcacccaugccauc

SEQ ID NO: 1021139 - RNA, 23 nt, Homo sapiens
uggaggcggaauugcucucccag

SEQ ID NO: 1021140 - RNA, 18 nt, Homo sapiens
uggaggcugucuucucag

SEQ ID NO: 1021141 - RNA, 21 nt, Homo sapiens
uggagggaccuugucucccag

SEQ ID NO: 1021142 - RNA, 23 nt, Homo sapiens
uggagggagaagcugucagggac

SEQ ID NO: 1021143 - RNA, 18 nt, Homo sapiens
uggagggcaugaagacag

SEQ ID NO: 1021144 - RNA, 19 nt, Homo sapiens
uggaggggggaggugggau

SEQ ID NO: 1021145 - RNA, 19 nt, Homo sapiens
uggagggguuuaugcucaa

SEQ ID NO: 1021146 - RNA, 20 nt, Homo sapiens
uggagguugcagugagccaa

SEQ ID NO: 1021147 - RNA, 15 nt, Homo sapiens
uggaguccagucucu

SEQ ID NO: 1021148 - RNA, 18 nt, Homo sapiens
uggagugaccauagcucc

SEQ ID NO: 1021149 - RNA, 22 nt, Homo sapiens
uggaucuaccagcauaaauauc

SEQ ID NO: 1021150 - RNA, 14 nt, Homo sapiens
uggaugcagaucca

SEQ ID NO: 1021151 - RNA, 18 nt, Homo sapiens
uggaugcauuucucuggg

SEQ ID NO: 1021152 - RNA, 22 nt, Homo sapiens
uggaugccaaccggucacccag

SEQ ID NO: 1021153 - RNA, 18 nt, Homo sapiens
uggaugccugauugccaa

SEQ ID NO: 1021154 - RNA, 14 nt, Homo sapiens
uggauguagucagu

SEQ ID NO: 1021155 - RNA, 23 nt, Homo sapiens
uggaugucuccaucucugucuca

SEQ ID NO: 1021156 - RNA, 13 nt, Homo sapiens
uggaugucuuccu

SEQ ID NO: 1021157 - RNA, 15 nt, Homo sapiens
uggaugugggguccc

SEQ ID NO: 1021158 - RNA, 14 nt, Homo sapiens
uggauuaaccugcc

SEQ ID NO: 1021159 - RNA, 14 nt, Homo sapiens
uggauuauucauuu

SEQ ID NO: 1021160 - RNA, 18 nt, Homo sapiens
uggauugauaauugcauu

SEQ ID NO: 1021161 - RNA, 16 nt, Homo sapiens
uggauuuauucugcca

SEQ ID NO: 1021162 - RNA, 15 nt, Homo sapiens
uggcaaaaacaaagg

SEQ ID NO: 1021163 - RNA, 23 nt, Homo sapiens
uggcaaagccuucauugccuuaa

SEQ ID NO: 1021164 - RNA, 18 nt, Homo sapiens
uggcaacaucuugcaaaa

SEQ ID NO: 1021165 - RNA, 23 nt, Homo sapiens
uggcaauaggugugaacagggaa

SEQ ID NO: 1021166 - RNA, 15 nt, Homo sapiens
uggcacacucuccaa

SEQ ID NO: 1021167 - RNA, 15 nt, Homo sapiens
uggcaccacugcacu

SEQ ID NO: 1021168 - RNA, 16 nt, Homo sapiens
uggcacccaugcaccu

SEQ ID NO: 1021169 - RNA, 16 nt, Homo sapiens
uggcaccuucagacuu

SEQ ID NO: 1021170 - RNA, 13 nt, Homo sapiens
uggcacuauuuga

SEQ ID NO: 1021171 - RNA, 16 nt, Homo sapiens
uggcacugacugggca

SEQ ID NO: 1021172 - RNA, 13 nt, Homo sapiens
uggcacugcauac

SEQ ID NO: 1021173 - RNA, 12 nt, Homo sapiens
uggcacugcugu

SEQ ID NO: 1021174 - RNA, 16 nt, Homo sapiens
uggcacugcugugcug

SEQ ID NO: 1021175 - RNA, 11 nt, Homo sapiens
uggcacuuuga

SEQ ID NO: 1021176 - RNA, 19 nt, Homo sapiens
uggcacuuugaaggggccu

SEQ ID NO: 1021177 - RNA, 14 nt, Homo sapiens
uggcagaaagcaaa

SEQ ID NO: 1021178 - RNA, 16 nt, Homo sapiens
uggcagcauacacaga

SEQ ID NO: 1021179 - RNA, 20 nt, Homo sapiens
uggcagcauacacagaugaa

SEQ ID NO: 1021180 - RNA, 15 nt, Homo sapiens
uggcagucacaucuc

SEQ ID NO: 1021181 - RNA, 21 nt, Homo sapiens
uggcaguggaacuaagaaagc

SEQ ID NO: 1021182 - RNA, 13 nt, Homo sapiens
uggccaaagccaa

SEQ ID NO: 1021183 - RNA, 20 nt, Homo sapiens
uggccaagcaauuccucuga

SEQ ID NO: 1021184 - RNA, 22 nt, Homo sapiens
uggccacgugggcaaacaggca

SEQ ID NO: 1021185 - RNA, 19 nt, Homo sapiens
uggccagaagggggccaug

SEQ ID NO: 1021186 - RNA, 22 nt, Homo sapiens
uggccagaagggggccaugagg

SEQ ID NO: 1021187 - RNA, 23 nt, Homo sapiens
uggccagagagccuggugcugcu

SEQ ID NO: 1021188 - RNA, 19 nt, Homo sapiens
uggccagcccggcugguuu

SEQ ID NO: 1021189 - RNA, 18 nt, Homo sapiens
uggccaggcuggucucaa

SEQ ID NO: 1021190 - RNA, 17 nt, Homo sapiens
uggccagugugauccca

SEQ ID NO: 1021191 - RNA, 18 nt, Homo sapiens
uggccagugugaucccaa

SEQ ID NO: 1021192 - RNA, 15 nt, Homo sapiens
uggcccaacacaauu

SEQ ID NO: 1021193 - RNA, 13 nt, Homo sapiens
uggcccacugcau

SEQ ID NO: 1021194 - RNA, 13 nt, Homo sapiens
uggcccagccaaa

SEQ ID NO: 1021195 - RNA, 20 nt, Homo sapiens
uggcccagcuccccaagaaa

SEQ ID NO: 1021196 - RNA, 17 nt, Homo sapiens
uggcccagggaagccaa

SEQ ID NO: 1021197 - RNA, 16 nt, Homo sapiens
uggccuaugcacauau

SEQ ID NO: 1021198 - RNA, 15 nt, Homo sapiens
uggccucaagugauu

SEQ ID NO: 1021199 - RNA, 15 nt, Homo sapiens
uggccucccacagac

SEQ ID NO: 1021200 - RNA, 15 nt, Homo sapiens
uggccuccugugcau

SEQ ID NO: 1021201 - RNA, 16 nt, Homo sapiens
uggccugugucccaug

SEQ ID NO: 1021202 - RNA, 18 nt, Homo sapiens
uggccuugaaaccaccuu

SEQ ID NO: 1021203 - RNA, 22 nt, Homo sapiens
uggcguagaaguuuuuguacug

SEQ ID NO: 1021204 - RNA, 19 nt, Homo sapiens
uggcuaaaaccaucauagu

SEQ ID NO: 1021205 - RNA, 14 nt, Homo sapiens
uggcuaauucccag

SEQ ID NO: 1021206 - RNA, 12 nt, Homo sapiens
uggcuaauugca

SEQ ID NO: 1021207 - RNA, 18 nt, Homo sapiens
uggcucaaacaacauucc

SEQ ID NO: 1021208 - RNA, 19 nt, Homo sapiens
uggcucacuauggugccaa

SEQ ID NO: 1021209 - RNA, 16 nt, Homo sapiens
uggcucagaugccacu

SEQ ID NO: 1021210 - RNA, 22 nt, Homo sapiens
uggcucagggagguuaagugac

SEQ ID NO: 1021211 - RNA, 13 nt, Homo sapiens
uggcucaucucuu

SEQ ID NO: 1021212 - RNA, 17 nt, Homo sapiens
uggcucaugucuauaau

SEQ ID NO: 1021213 - RNA, 12 nt, Homo sapiens
uggcuccaaacc

SEQ ID NO: 1021214 - RNA, 15 nt, Homo sapiens
uggcuccaacacugc

SEQ ID NO: 1021215 - RNA, 20 nt, Homo sapiens
uggcuccaacacugcugcuc

SEQ ID NO: 1021216 - RNA, 15 nt, Homo sapiens
uggcuccaccacuga

SEQ ID NO: 1021217 - RNA, 21 nt, Homo sapiens
uggcucccucuuggucuuccc

SEQ ID NO: 1021218 - RNA, 13 nt, Homo sapiens
uggcucucauggg

SEQ ID NO: 1021219 - RNA, 15 nt, Homo sapiens
uggcucucuccagga

SEQ ID NO: 1021220 - RNA, 14 nt, Homo sapiens
uggcucugaccgaa

SEQ ID NO: 1021221 - RNA, 17 nt, Homo sapiens
uggcugaccccaaagag

SEQ ID NO: 1021222 - RNA, 12 nt, Homo sapiens
uggcugccuugu

SEQ ID NO: 1021223 - RNA, 15 nt, Homo sapiens
uggcuggaucuguga

SEQ ID NO: 1021224 - RNA, 22 nt, Homo sapiens
uggcuggccacugcacagagcu

SEQ ID NO: 1021225 - RNA, 20 nt, Homo sapiens
uggcuguagaaggagacaga

SEQ ID NO: 1021226 - RNA, 19 nt, Homo sapiens
uggcugucucaaaccaagc

SEQ ID NO: 1021227 - RNA, 23 nt, Homo sapiens
uggcuucacagaugugugauuca

SEQ ID NO: 1021228 - RNA, 13 nt, Homo sapiens
uggcuucagggga

SEQ ID NO: 1021229 - RNA, 16 nt, Homo sapiens
uggcuugccacagcuc

SEQ ID NO: 1021230 - RNA, 16 nt, Homo sapiens
uggcuuuugugcauua

SEQ ID NO: 1021231 - RNA, 15 nt, Homo sapiens
uggcuuuuucuccuu

SEQ ID NO: 1021232 - RNA, 21 nt, Homo sapiens
uggcuuuuuuccuccugugua

SEQ ID NO: 1021233 - RNA, 22 nt, Homo sapiens
ugggaaaaauucagagaguuag

SEQ ID NO: 1021234 - RNA, 16 nt, Homo sapiens
ugggaaagauuacuuu

SEQ ID NO: 1021235 - RNA, 14 nt, Homo sapiens
ugggaaagcauugu

SEQ ID NO: 1021236 - RNA, 19 nt, Homo sapiens
ugggaacaugcgugugacc

SEQ ID NO: 1021237 - RNA, 18 nt, Homo sapiens
ugggaagaccagcuuugc

SEQ ID NO: 1021238 - RNA, 21 nt, Homo sapiens
ugggaagauaggcucugcaca

SEQ ID NO: 1021239 - RNA, 17 nt, Homo sapiens
ugggaagcaggagccca

SEQ ID NO: 1021240 - RNA, 15 nt, Homo sapiens
ugggaaggugaccac

SEQ ID NO: 1021241 - RNA, 21 nt, Homo sapiens
ugggacaaaacagaaguccau

SEQ ID NO: 1021242 - RNA, 12 nt, Homo sapiens
ugggaccacaga

SEQ ID NO: 1021243 - RNA, 21 nt, Homo sapiens
ugggaccacgugagaucauuc

SEQ ID NO: 1021244 - RNA, 14 nt, Homo sapiens
ugggacugcuaaau

SEQ ID NO: 1021245 - RNA, 12 nt, Homo sapiens
ugggacuggggc

SEQ ID NO: 1021246 - RNA, 12 nt, Homo sapiens
ugggacuuuuaa

SEQ ID NO: 1021247 - RNA, 17 nt, Homo sapiens
ugggagaaugucaguau

SEQ ID NO: 1021248 - RNA, 14 nt, Homo sapiens
ugggagacacugau

SEQ ID NO: 1021249 - RNA, 14 nt, Homo sapiens
ugggagacuuugaa

SEQ ID NO: 1021250 - RNA, 22 nt, Homo sapiens
ugggagcucuguuuucaugcua

SEQ ID NO: 1021251 - RNA, 21 nt, Homo sapiens
ugggagguggagguugcagug

SEQ ID NO: 1021252 - RNA, 18 nt, Homo sapiens
ugggagguugugggcauu

SEQ ID NO: 1021253 - RNA, 14 nt, Homo sapiens
ugggagugagggau

SEQ ID NO: 1021254 - RNA, 14 nt, Homo sapiens
ugggaugaugccuc

SEQ ID NO: 1021255 - RNA, 14 nt, Homo sapiens
ugggauuacaggga

SEQ ID NO: 1021256 - RNA, 16 nt, Homo sapiens
ugggcaaacaggcagu

SEQ ID NO: 1021257 - RNA, 21 nt, Homo sapiens
ugggcaccuggggagugggac

SEQ ID NO: 1021258 - RNA, 13 nt, Homo sapiens
ugggcacugggau

SEQ ID NO: 1021259 - RNA, 15 nt, Homo sapiens
ugggcagaaggccaa

SEQ ID NO: 1021260 - RNA, 13 nt, Homo sapiens
ugggcagagccca

SEQ ID NO: 1021261 - RNA, 14 nt, Homo sapiens
ugggcagagcccaa

SEQ ID NO: 1021262 - RNA, 16 nt, Homo sapiens
ugggcaggaagugaag

SEQ ID NO: 1021263 - RNA, 12 nt, Homo sapiens
ugggcaguuaca

SEQ ID NO: 1021264 - RNA, 14 nt, Homo sapiens
ugggcccagaucug

SEQ ID NO: 1021265 - RNA, 19 nt, Homo sapiens
ugggcccccaaauggaaau

SEQ ID NO: 1021266 - RNA, 15 nt, Homo sapiens
ugggcggcacagccu

SEQ ID NO: 1021267 - RNA, 19 nt, Homo sapiens
ugggcuaaugaagaucaua

SEQ ID NO: 1021268 - RNA, 16 nt, Homo sapiens
ugggcugagacuggau

SEQ ID NO: 1021269 - RNA, 19 nt, Homo sapiens
ugggcuggugucaccugaa

SEQ ID NO: 1021270 - RNA, 13 nt, Homo sapiens
ugggcuucaucca

SEQ ID NO: 1021271 - RNA, 14 nt, Homo sapiens
uggggaagacugug

SEQ ID NO: 1021272 - RNA, 16 nt, Homo sapiens
uggggaagcugugaaa

SEQ ID NO: 1021273 - RNA, 16 nt, Homo sapiens
uggggaagcuucuuaa

SEQ ID NO: 1021274 - RNA, 16 nt, Homo sapiens
uggggagaaaagacau

SEQ ID NO: 1021275 - RNA, 18 nt, Homo sapiens
uggggagaaaagacauga

SEQ ID NO: 1021276 - RNA, 15 nt, Homo sapiens
uggggagauggaguu

SEQ ID NO: 1021277 - RNA, 18 nt, Homo sapiens
uggggagccugagccaca

SEQ ID NO: 1021278 - RNA, 19 nt, Homo sapiens
uggggagggagagccauca

SEQ ID NO: 1021279 - RNA, 19 nt, Homo sapiens
uggggaguaggacauacca

SEQ ID NO: 1021280 - RNA, 17 nt, Homo sapiens
uggggaucucaggggcu

SEQ ID NO: 1021281 - RNA, 20 nt, Homo sapiens
uggggcagcuugaggguugg

SEQ ID NO: 1021282 - RNA, 20 nt, Homo sapiens
uggggcaggcagugaugcug

SEQ ID NO: 1021283 - RNA, 18 nt, Homo sapiens
uggggcuccuuucuccag

SEQ ID NO: 1021284 - RNA, 12 nt, Homo sapiens
uggggcucucuc

SEQ ID NO: 1021285 - RNA, 15 nt, Homo sapiens
uggggcugauuguau

SEQ ID NO: 1021286 - RNA, 14 nt, Homo sapiens
ugggggacacccgg

SEQ ID NO: 1021287 - RNA, 17 nt, Homo sapiens
ugggggccaugagcucc

SEQ ID NO: 1021288 - RNA, 16 nt, Homo sapiens
ugggggcugugauauu

SEQ ID NO: 1021289 - RNA, 16 nt, Homo sapiens
ugggggcuugcaagua

SEQ ID NO: 1021290 - RNA, 14 nt, Homo sapiens
ugggggugcagaug

SEQ ID NO: 1021291 - RNA, 14 nt, Homo sapiens
ugggguccagggag

SEQ ID NO: 1021292 - RNA, 21 nt, Homo sapiens
uggggucuuuuuaugcauuug

SEQ ID NO: 1021293 - RNA, 15 nt, Homo sapiens
uggggugaagauuca

SEQ ID NO: 1021294 - RNA, 15 nt, Homo sapiens
uggggugggccucug

SEQ ID NO: 1021295 - RNA, 19 nt, Homo sapiens
uggguacuauucugauuac

SEQ ID NO: 1021296 - RNA, 14 nt, Homo sapiens
ugggucaguuguau

SEQ ID NO: 1021297 - RNA, 18 nt, Homo sapiens
uggguccugggucuuuca

SEQ ID NO: 1021298 - RNA, 20 nt, Homo sapiens
ugggucucauuuagaacuug

SEQ ID NO: 1021299 - RNA, 13 nt, Homo sapiens
ugggucuuucaug

SEQ ID NO: 1021300 - RNA, 20 nt, Homo sapiens
ugggugaauaauacaguauc

SEQ ID NO: 1021301 - RNA, 17 nt, Homo sapiens
uggguucugcacagcug

SEQ ID NO: 1021302 - RNA, 23 nt, Homo sapiens
uggguugcaggaccucaggugag

SEQ ID NO: 1021303 - RNA, 17 nt, Homo sapiens
uggguuggacaaccuca

SEQ ID NO: 1021304 - RNA, 15 nt, Homo sapiens
ugguaaauuaguauu

SEQ ID NO: 1021305 - RNA, 23 nt, Homo sapiens
ugguaacacaaauuuucaccugc

SEQ ID NO: 1021306 - RNA, 14 nt, Homo sapiens
ugguacagcacugu

SEQ ID NO: 1021307 - RNA, 14 nt, Homo sapiens
ugguagcucaggug

SEQ ID NO: 1021308 - RNA, 16 nt, Homo sapiens
ugguagguuaacauua

SEQ ID NO: 1021309 - RNA, 21 nt, Homo sapiens
ugguauguguguguaugcuac

SEQ ID NO: 1021310 - RNA, 21 nt, Homo sapiens
uggucaagauuuugaaugcuu

SEQ ID NO: 1021311 - RNA, 18 nt, Homo sapiens
uggucacagccuccucug

SEQ ID NO: 1021312 - RNA, 23 nt, Homo sapiens
uggucacccuaaggaaaggaauu

SEQ ID NO: 1021313 - RNA, 23 nt, Homo sapiens
uggucauagcccagaucagcucc

SEQ ID NO: 1021314 - RNA, 14 nt, Homo sapiens
uggucccaucugca

SEQ ID NO: 1021315 - RNA, 15 nt, Homo sapiens
uggucccccuuccau

SEQ ID NO: 1021316 - RNA, 20 nt, Homo sapiens
ugguccuuagccccaucugc

SEQ ID NO: 1021317 - RNA, 17 nt, Homo sapiens
uggucuugaucuccuga

SEQ ID NO: 1021318 - RNA, 17 nt, Homo sapiens
uggugaaaugcagaguc

SEQ ID NO: 1021319 - RNA, 13 nt, Homo sapiens
uggugcacugagc

SEQ ID NO: 1021320 - RNA, 22 nt, Homo sapiens
ugguggagccaguaaacagagg

SEQ ID NO: 1021321 - RNA, 19 nt, Homo sapiens
ugguggcccacgccuguaa

SEQ ID NO: 1021322 - RNA, 19 nt, Homo sapiens
ugguggucucugcuugcau

SEQ ID NO: 1021323 - RNA, 21 nt, Homo sapiens
uggugucaguaguuuuacuga

SEQ ID NO: 1021324 - RNA, 19 nt, Homo sapiens
ugguguucaaaaaaacacu

SEQ ID NO: 1021325 - RNA, 15 nt, Homo sapiens
ugguguucucaucua

SEQ ID NO: 1021326 - RNA, 17 nt, Homo sapiens
ugguguuuucuuaugca

SEQ ID NO: 1021327 - RNA, 19 nt, Homo sapiens
ugguuccaugccugagggu

SEQ ID NO: 1021328 - RNA, 20 nt, Homo sapiens
ugguuccauuguuuggagac

SEQ ID NO: 1021329 - RNA, 17 nt, Homo sapiens
ugguucuuaguucucac

SEQ ID NO: 1021330 - RNA, 15 nt, Homo sapiens
ugguugagguuucaa

SEQ ID NO: 1021331 - RNA, 13 nt, Homo sapiens
ugguuuaugucau

SEQ ID NO: 1021332 - RNA, 15 nt, Homo sapiens
ugguuuaugucauca

SEQ ID NO: 1021333 - RNA, 21 nt, Homo sapiens
ugguuucauuucuacugugac

SEQ ID NO: 1021334 - RNA, 17 nt, Homo sapiens
ugguuuuguaacuuguu

SEQ ID NO: 1021335 - RNA, 18 nt, Homo sapiens
uguaaaacuauauucuca

SEQ ID NO: 1021336 - RNA, 21 nt, Homo sapiens
uguaaaauauuuaugagaaag

SEQ ID NO: 1021337 - RNA, 22 nt, Homo sapiens
uguaaaauguuuuagcaauuua

SEQ ID NO: 1021338 - RNA, 16 nt, Homo sapiens
uguaaacccucaaggg

SEQ ID NO: 1021339 - RNA, 20 nt, Homo sapiens
uguaaacuuuuugugcugaa

SEQ ID NO: 1021340 - RNA, 16 nt, Homo sapiens
uguaaauguauauacc

SEQ ID NO: 1021341 - RNA, 23 nt, Homo sapiens
uguaacagcggcaggguguccca

SEQ ID NO: 1021342 - RNA, 12 nt, Homo sapiens
ugugccuauagu

SEQ ID NO: 1021343 - RNA, 23 nt, Homo sapiens
ugugccugucuguuacacuggag

SEQ ID NO: 1021344 - RNA, 18 nt, Homo sapiens
ugugccuuggugugcugu

SEQ ID NO: 1021345 - RNA, 15 nt, Homo sapiens
ugugcgccuacagga

SEQ ID NO: 1021346 - RNA, 15 nt, Homo sapiens
cccauuucuauuuau

SEQ ID NO: 1021347 - RNA, 16 nt, Homo sapiens
ccccaaccugcugaag

SEQ ID NO: 1021348 - RNA, 14 nt, Homo sapiens
ccccaauccaugaa

SEQ ID NO: 1021349 - RNA, 23 nt, Homo sapiens
ccccacacuggagccaucucuuc

SEQ ID NO: 1021350 - RNA, 18 nt, Homo sapiens
ccccacagacaacaguug

SEQ ID NO: 1021351 - RNA, 21 nt, Homo sapiens
ccccaccacggccacuggcca

SEQ ID NO: 1021352 - RNA, 10 nt, Homo sapiens
ccccagagac

SEQ ID NO: 1021353 - RNA, 16 nt, Homo sapiens
ccccagcccacaggug

SEQ ID NO: 1021354 - RNA, 12 nt, Homo sapiens
ccccagcucacc

SEQ ID NO: 1021355 - RNA, 16 nt, Homo sapiens
ccccaggccccaggaa

SEQ ID NO: 1021356 - RNA, 17 nt, Homo sapiens
ccccaggggucccagcc

SEQ ID NO: 1021357 - RNA, 21 nt, Homo sapiens
ccccaggugcagugugacauu

SEQ ID NO: 1021358 - RNA, 18 nt, Homo sapiens
ccccaugccuguccagcc

SEQ ID NO: 1021359 - RNA, 18 nt, Homo sapiens
cccccacgugacagugcc

SEQ ID NO: 1021360 - RNA, 12 nt, Homo sapiens
cccccugugcag

SEQ ID NO: 1021361 - RNA, 12 nt, Homo sapiens
cccccuugaggg

SEQ ID NO: 1021362 - RNA, 14 nt, Homo sapiens
ccccggaguucagu

SEQ ID NO: 1021363 - RNA, 12 nt, Homo sapiens
ccccgggcgggu

SEQ ID NO: 1021364 - RNA, 22 nt, Homo sapiens
ccccugcuggcucuucugccca

SEQ ID NO: 1021365 - RNA, 17 nt, Homo sapiens
ccccuggucucuggucc

SEQ ID NO: 1021366 - RNA, 23 nt, Homo sapiens
ccccuuauccaggacucugucaa

SEQ ID NO: 1021367 - RNA, 18 nt, Homo sapiens
ccccuugccagacaugug

SEQ ID NO: 1021368 - RNA, 20 nt, Homo sapiens
uuccuggcuccaacacugcu

SEQ ID NO: 1021369 - RNA, 16 nt, Homo sapiens
uuccuggucuguagaa

SEQ ID NO: 1021370 - RNA, 22 nt, Homo sapiens
uuccuguggggggaaguccaug

SEQ ID NO: 1021371 - RNA, 23 nt, Homo sapiens
uuccuguugauguucagaaugga

SEQ ID NO: 1021372 - RNA, 15 nt, Homo sapiens
uuccuuaaacugugu

SEQ ID NO: 1021373 - RNA, 22 nt, Homo sapiens
uuccuuagcuuagaccucagcc

SEQ ID NO: 1021374 - RNA, 16 nt, Homo sapiens
uuccuuaggucugccc

SEQ ID NO: 1021375 - RNA, 19 nt, Homo sapiens
uuccuucagacagauucca

SEQ ID NO: 1021376 - RNA, 20 nt, Homo sapiens
uuccuucagugcaucuggga

SEQ ID NO: 1021377 - RNA, 21 nt, Homo sapiens
uuccuucaugaucaucacaau

SEQ ID NO: 1021378 - RNA, 19 nt, Homo sapiens
uuccuucucaucugugauu

SEQ ID NO: 1021379 - RNA, 17 nt, Homo sapiens
uuccuugaucuguauau

SEQ ID NO: 1021380 - RNA, 12 nt, Homo sapiens
uuccuugcucuc

SEQ ID NO: 1021381 - RNA, 15 nt, Homo sapiens
uuccuugcucugcac

SEQ ID NO: 1021382 - RNA, 20 nt, Homo sapiens
uuccuuggggcaggcaguga

SEQ ID NO: 1021383 - RNA, 17 nt, Homo sapiens
uuccuuucacuggccac

SEQ ID NO: 1021384 - RNA, 17 nt, Homo sapiens
uuccuuucauuuacugu

SEQ ID NO: 1021385 - RNA, 19 nt, Homo sapiens
uuccuuucauuuacugugg

SEQ ID NO: 1021386 - RNA, 20 nt, Homo sapiens
uuccuuuuaaaacacuucca

SEQ ID NO: 1021387 - RNA, 21 nt, Homo sapiens
uuccuuuuaaaacacuuccau

SEQ ID NO: 1021388 - RNA, 16 nt, Homo sapiens
uucgaaacuccauuga

SEQ ID NO: 1021389 - RNA, 22 nt, Homo sapiens
uucgaaacuccauugagucauu

SEQ ID NO: 1021390 - RNA, 13 nt, Homo sapiens
uucgagaagcaau

SEQ ID NO: 1021391 - RNA, 20 nt, Homo sapiens
uucgagaagcugcucuggaa

SEQ ID NO: 1021392 - RNA, 21 nt, Homo sapiens
uucgcaccuaccaucagggac

SEQ ID NO: 1021393 - RNA, 16 nt, Homo sapiens
uucggacaacucaguc

SEQ ID NO: 1021394 - RNA, 18 nt, Homo sapiens
uucgguugacccagguca

SEQ ID NO: 1021395 - RNA, 17 nt, Homo sapiens
uucguauucccauuaga

SEQ ID NO: 1021396 - RNA, 15 nt, Homo sapiens
uucuaaaaguugcau

SEQ ID NO: 1021397 - RNA, 20 nt, Homo sapiens
uucuaaaaguugcauguuau

SEQ ID NO: 1021398 - RNA, 23 nt, Homo sapiens
uucuaaaugaauguuuacacucu

SEQ ID NO: 1021399 - RNA, 21 nt, Homo sapiens
uucuaacuagaaaucugccaa

SEQ ID NO: 1021400 - RNA, 18 nt, Homo sapiens
uucuaaggaauaugagcu

SEQ ID NO: 1021401 - RNA, 12 nt, Homo sapiens
uucuaaguauuu

SEQ ID NO: 1021402 - RNA, 15 nt, Homo sapiens
uucuaaugugcauua

SEQ ID NO: 1021403 - RNA, 16 nt, Homo sapiens
uucuaaugugcauuaa

SEQ ID NO: 1021404 - RNA, 19 nt, Homo sapiens
uucuaauuucaaaaauaua

SEQ ID NO: 1021405 - RNA, 23 nt, Homo sapiens
uucuacacagagcaggacugcac

SEQ ID NO: 1021406 - RNA, 13 nt, Homo sapiens
uucuacaguauua

SEQ ID NO: 1021407 - RNA, 15 nt, Homo sapiens
uucuacugugacuga

SEQ ID NO: 1021408 - RNA, 16 nt, Homo sapiens
uucuaggaagcuccag

SEQ ID NO: 1021409 - RNA, 15 nt, Homo sapiens
uucuaggcaucccag

SEQ ID NO: 1021410 - RNA, 17 nt, Homo sapiens
uucuaggccaagcauuu

SEQ ID NO: 1021411 - RNA, 16 nt, Homo sapiens
uucuaguugcuuguaa

SEQ ID NO: 1021412 - RNA, 16 nt, Homo sapiens
uucuaguuugcauucc

SEQ ID NO: 1021413 - RNA, 21 nt, Homo sapiens
uucuauaugaauuuaaauaua

SEQ ID NO: 1021414 - RNA, 15 nt, Homo sapiens
uucuauucuaaguaa

SEQ ID NO: 1021415 - RNA, 16 nt, Homo sapiens
uucuauuuccuggaau

SEQ ID NO: 1021416 - RNA, 16 nt, Homo sapiens
uucucaccauuugagu

SEQ ID NO: 1021417 - RNA, 18 nt, Homo sapiens
uucucagagugguucuga

SEQ ID NO: 1021418 - RNA, 23 nt, Homo sapiens
uucucagcucccauuucuacucu

SEQ ID NO: 1021419 - RNA, 20 nt, Homo sapiens
uucucauccugcaggcagcu

SEQ ID NO: 1021420 - RNA, 15 nt, Homo sapiens
uucucauuugucaca

SEQ ID NO: 1021421 - RNA, 18 nt, Homo sapiens
uucucauuuuauugcuag

SEQ ID NO: 1021422 - RNA, 17 nt, Homo sapiens
uucuccaccugccaggg

SEQ ID NO: 1021423 - RNA, 13 nt, Homo sapiens
uucuccagacagg

SEQ ID NO: 1021424 - RNA, 17 nt, Homo sapiens
uucuccagacaggguuc

SEQ ID NO: 1021425 - RNA, 23 nt, Homo sapiens
uucuccagacccaccacaccgca

SEQ ID NO: 1021426 - RNA, 16 nt, Homo sapiens
uucuccaggaugucaa

SEQ ID NO: 1021427 - RNA, 15 nt, Homo sapiens
uucucccucauuuca

SEQ ID NO: 1021428 - RNA, 13 nt, Homo sapiens
uucuccuccaugg

SEQ ID NO: 1021429 - RNA, 17 nt, Homo sapiens
uucuccuccugucuuua

SEQ ID NO: 1021430 - RNA, 13 nt, Homo sapiens
uucuccugccuca

SEQ ID NO: 1021431 - RNA, 15 nt, Homo sapiens
uucucuauugcugcu

SEQ ID NO: 1021432 - RNA, 17 nt, Homo sapiens
uucucucuuaguaacau

SEQ ID NO: 1021433 - RNA, 18 nt, Homo sapiens
uucucucuuauuccacuu

SEQ ID NO: 1021434 - RNA, 15 nt, Homo sapiens
uucucucuucuccac

SEQ ID NO: 1021435 - RNA, 22 nt, Homo sapiens
uucucugccuugguauagcaua

SEQ ID NO: 1021436 - RNA, 21 nt, Homo sapiens
uucucuguguuuguuccuaca

SEQ ID NO: 1021437 - RNA, 16 nt, Homo sapiens
uucucuuucucuccuu

SEQ ID NO: 1021438 - RNA, 15 nt, Homo sapiens
uucugaaaaaguauc

SEQ ID NO: 1021439 - RNA, 17 nt, Homo sapiens
uucugaaauaacauggc

SEQ ID NO: 1021440 - RNA, 19 nt, Homo sapiens
uucugaauacaaagugaug

SEQ ID NO: 1021441 - RNA, 23 nt, Homo sapiens
uucugacccaugcugcccuguga

SEQ ID NO: 1021442 - RNA, 16 nt, Homo sapiens
uucugagguaaccuca

SEQ ID NO: 1021443 - RNA, 17 nt, Homo sapiens
uucugcaagcuuuucaa

SEQ ID NO: 1021444 - RNA, 23 nt, Homo sapiens
uucugccaggcccccaagccugc

SEQ ID NO: 1021445 - RNA, 20 nt, Homo sapiens
uucugcccugcuuuugcuag

SEQ ID NO: 1021446 - RNA, 19 nt, Homo sapiens
uucugcuaccucacugggg

SEQ ID NO: 1021447 - RNA, 19 nt, Homo sapiens
uucugcuccucuccaggca

SEQ ID NO: 1021448 - RNA, 15 nt, Homo sapiens
uucugcuuuccacac

SEQ ID NO: 1021449 - RNA, 16 nt, Homo sapiens
uucuggaaaagcaaaa

SEQ ID NO: 1021450 - RNA, 16 nt, Homo sapiens
uucugggaacuuccuc

SEQ ID NO: 1021451 - RNA, 13 nt, Homo sapiens
uucugggacacag

SEQ ID NO: 1021452 - RNA, 16 nt, Homo sapiens
uucugggacacaguuc

SEQ ID NO: 1021453 - RNA, 15 nt, Homo sapiens
uucugguuacugugg

SEQ ID NO: 1021454 - RNA, 18 nt, Homo sapiens
uuauagccgaaaugaucu

SEQ ID NO: 1021455 - RNA, 22 nt, Homo sapiens
uuauaguuucagauauauauca

SEQ ID NO: 1021456 - RNA, 15 nt, Homo sapiens
uuauaucagccugag

SEQ ID NO: 1021457 - RNA, 13 nt, Homo sapiens
uuauaucaucagc

SEQ ID NO: 1021458 - RNA, 20 nt, Homo sapiens
uuauaucaucagcauaccuu

SEQ ID NO: 1021459 - RNA, 21 nt, Homo sapiens
uuauauuaaaauaagcacugu

SEQ ID NO: 1021460 - RNA, 14 nt, Homo sapiens
uuauauuauuacua

SEQ ID NO: 1021461 - RNA, 22 nt, Homo sapiens
uuaucaccgugggcucccugac

SEQ ID NO: 1021462 - RNA, 19 nt, Homo sapiens
uuaucacgcagaucacuaa

SEQ ID NO: 1021463 - RNA, 14 nt, Homo sapiens
uuaucagucauaac

SEQ ID NO: 1021464 - RNA, 21 nt, Homo sapiens
uuaucaugcauguccuguaaa

SEQ ID NO: 1021465 - RNA, 17 nt, Homo sapiens
uuaucaugcauguuaug

SEQ ID NO: 1021466 - RNA, 18 nt, Homo sapiens
uuaucgggagcagugucu

SEQ ID NO: 1021467 - RNA, 13 nt, Homo sapiens
uuaucuauggcac

SEQ ID NO: 1021468 - RNA, 16 nt, Homo sapiens
uuaucucaaaacugca

SEQ ID NO: 1021469 - RNA, 12 nt, Homo sapiens
uuaucugugcaa

SEQ ID NO: 1021470 - RNA, 20 nt, Homo sapiens
uuaucugugcgugaaacaca

SEQ ID NO: 1021471 - RNA, 15 nt, Homo sapiens
uuaucuugacauuca

SEQ ID NO: 1021472 - RNA, 21 nt, Homo sapiens
uuaugaaaaauaagucacuua

SEQ ID NO: 1021473 - RNA, 18 nt, Homo sapiens
uuaugaaacauuacaguu

SEQ ID NO: 1021474 - RNA, 22 nt, Homo sapiens
uuaugaagcaagccccacuuau

SEQ ID NO: 1021475 - RNA, 23 nt, Homo sapiens
uuaugagaggcaaugauuguuaa

SEQ ID NO: 1021476 - RNA, 13 nt, Homo sapiens
uuaugaucuuggc

SEQ ID NO: 1021477 - RNA, 21 nt, Homo sapiens
uuaugccuucacuuuacaaau

SEQ ID NO: 1021478 - RNA, 13 nt, Homo sapiens
uuaugcugugaca

SEQ ID NO: 1021479 - RNA, 13 nt, Homo sapiens
uuauguacucuac

SEQ ID NO: 1021480 - RNA, 15 nt, Homo sapiens
uuaugucaucauaca

SEQ ID NO: 1021481 - RNA, 21 nt, Homo sapiens
uuaugucuauuuaagccucau

SEQ ID NO: 1021482 - RNA, 19 nt, Homo sapiens
uuaugucucuucugagcua

SEQ ID NO: 1021483 - RNA, 11 nt, Homo sapiens
uuaugugcaau

SEQ ID NO: 1021484 - RNA, 23 nt, Homo sapiens
uuauguuaaaucaauaaagacca

SEQ ID NO: 1021485 - RNA, 14 nt, Homo sapiens
uuauuaaugacaaa

SEQ ID NO: 1021486 - RNA, 18 nt, Homo sapiens
uuauuaccccacacaucc

SEQ ID NO: 1021487 - RNA, 21 nt, Homo sapiens
uuauuaccucugauaccucaa

SEQ ID NO: 1021488 - RNA, 15 nt, Homo sapiens
uuauucccuuucaca

SEQ ID NO: 1021489 - RNA, 17 nt, Homo sapiens
uuauuccuccugcucau

SEQ ID NO: 1021490 - RNA, 12 nt, Homo sapiens
uuauucucaaga

SEQ ID NO: 1021491 - RNA, 14 nt, Homo sapiens
uuauucucaagaag

SEQ ID NO: 1021492 - RNA, 22 nt, Homo sapiens
uuauugcuugauacuuuugaca

SEQ ID NO: 1021493 - RNA, 19 nt, Homo sapiens
uuauuggcugagauaugaa

SEQ ID NO: 1021494 - RNA, 14 nt, Homo sapiens
uuauuguaccucuc

SEQ ID NO: 1021495 - RNA, 17 nt, Homo sapiens
uuauuguauuuauucca

SEQ ID NO: 1021496 - RNA, 15 nt, Homo sapiens
uuauuuaacuauuca

SEQ ID NO: 1021497 - RNA, 16 nt, Homo sapiens
uuauuucaucauauua

SEQ ID NO: 1021498 - RNA, 15 nt, Homo sapiens
uuauuugaaggccag

SEQ ID NO: 1021499 - RNA, 16 nt, Homo sapiens
uuauuuugaaaauaau

SEQ ID NO: 1021500 - RNA, 16 nt, Homo sapiens
uuauuuuuacaguucu

SEQ ID NO: 1021501 - RNA, 17 nt, Homo sapiens
uuauuuuuguucauaua

SEQ ID NO: 1021502 - RNA, 14 nt, Homo sapiens
uucaaaaccuugca

SEQ ID NO: 1021503 - RNA, 16 nt, Homo sapiens
uucaaaauuggacuua

SEQ ID NO: 1021504 - RNA, 16 nt, Homo sapiens
cauuccuccaccugcc

SEQ ID NO: 1021505 - RNA, 20 nt, Homo sapiens
cauuccugauaugauuuaaa

SEQ ID NO: 1021506 - RNA, 23 nt, Homo sapiens
cauuccuguagucaaaaucuggu

SEQ ID NO: 1021507 - RNA, 13 nt, Homo sapiens
cauucuagguagg

SEQ ID NO: 1021508 - RNA, 18 nt, Homo sapiens
cauucuauuguggcaagg

SEQ ID NO: 1021509 - RNA, 17 nt, Homo sapiens
cauucuccuuguguuac

SEQ ID NO: 1021510 - RNA, 13 nt, Homo sapiens
cauucucugaguc

SEQ ID NO: 1021511 - RNA, 14 nt, Homo sapiens
cauucugaccauuu

SEQ ID NO: 1021512 - RNA, 22 nt, Homo sapiens
aaauuugugguccacugagcua

SEQ ID NO: 1021513 - RNA, 14 nt, Homo sapiens
aaauuuuaaccuau

SEQ ID NO: 1021514 - RNA, 13 nt, Homo sapiens
aaauuuugugaua

SEQ ID NO: 1021515 - RNA, 18 nt, Homo sapiens
aacaaaauguaaagccag

SEQ ID NO: 1021516 - RNA, 17 nt, Homo sapiens
aacaaagaacugaagcu

SEQ ID NO: 1021517 - RNA, 13 nt, Homo sapiens
aacaaaguccaca

SEQ ID NO: 1021518 - RNA, 12 nt, Homo sapiens
aacaaauaugca

SEQ ID NO: 1021519 - RNA, 19 nt, Homo sapiens
aacaaaugccacacaucac

SEQ ID NO: 1021520 - RNA, 15 nt, Homo sapiens
aacaaauugaugcaa

SEQ ID NO: 1021521 - RNA, 20 nt, Homo sapiens
aacaacaaagccaacaguca

SEQ ID NO: 1021522 - RNA, 19 nt, Homo sapiens
aacaacaauaacacugucu

SEQ ID NO: 1021523 - RNA, 21 nt, Homo sapiens
aacaaccagcaucccuugacc

SEQ ID NO: 1021524 - RNA, 20 nt, Homo sapiens
aacaaccugccaccaaaaga

SEQ ID NO: 1021525 - RNA, 17 nt, Homo sapiens
aacaacuguggucaauc

SEQ ID NO: 1021526 - RNA, 19 nt, Homo sapiens
aacaacuguggucaauccg

SEQ ID NO: 1021527 - RNA, 19 nt, Homo sapiens
aacaagaguugucuugucc

SEQ ID NO: 1021528 - RNA, 14 nt, Homo sapiens
aacaagaugcugga

SEQ ID NO: 1021529 - RNA, 20 nt, Homo sapiens
aacaagguucccucugagaa

SEQ ID NO: 1021530 - RNA, 13 nt, Homo sapiens
aacaagucccugu

SEQ ID NO: 1021531 - RNA, 18 nt, Homo sapiens
aacaaguuuuucugucaa

SEQ ID NO: 1021532 - RNA, 15 nt, Homo sapiens
aacaaugacauuuau

SEQ ID NO: 1021533 - RNA, 13 nt, Homo sapiens
aacacaaagugaa

SEQ ID NO: 1021534 - RNA, 14 nt, Homo sapiens
aacacaauaugaau

SEQ ID NO: 1021535 - RNA, 15 nt, Homo sapiens
aacacaaugccucau

SEQ ID NO: 1021536 - RNA, 23 nt, Homo sapiens
aacacaaugccucaucuucccug

SEQ ID NO: 1021537 - RNA, 19 nt, Homo sapiens
aacacaauucuucuuccaa

SEQ ID NO: 1021538 - RNA, 13 nt, Homo sapiens
aacacacacuguu

SEQ ID NO: 1021539 - RNA, 19 nt, Homo sapiens
aacacacacuguucugaaa

SEQ ID NO: 1021540 - RNA, 23 nt, Homo sapiens
aacacaguguuuuuguaaagugu

SEQ ID NO: 1021541 - RNA, 11 nt, Homo sapiens
aacacauuaag

SEQ ID NO: 1021542 - RNA, 17 nt, Homo sapiens
aacaccaaaaagggauc

SEQ ID NO: 1021543 - RNA, 23 nt, Homo sapiens
aacaccagacagacaacacuggg

SEQ ID NO: 1021544 - RNA, 20 nt, Homo sapiens
aacaccaggagagcuucucc

SEQ ID NO: 1021545 - RNA, 20 nt, Homo sapiens
aacacccaugaaucaaagac

SEQ ID NO: 1021546 - RNA, 19 nt, Homo sapiens
aacacccgacuccucaaaa

SEQ ID NO: 1021547 - RNA, 13 nt, Homo sapiens
aacaccuccucaa

SEQ ID NO: 1021548 - RNA, 13 nt, Homo sapiens
aacaccucugcac

SEQ ID NO: 1021549 - RNA, 12 nt, Homo sapiens
aacaccugaugu

SEQ ID NO: 1021550 - RNA, 18 nt, Homo sapiens
aacacuagagucugucau

SEQ ID NO: 1021551 - RNA, 15 nt, Homo sapiens
aacacugaagcucuu

SEQ ID NO: 1021552 - RNA, 21 nt, Homo sapiens
aacacugcugcuccagugcag

SEQ ID NO: 1021553 - RNA, 18 nt, Homo sapiens
aacacuggugugaccuga

SEQ ID NO: 1021554 - RNA, 11 nt, Homo sapiens
aacacugugaa

SEQ ID NO: 1021555 - RNA, 17 nt, Homo sapiens
aacagaaagcauccuaa

SEQ ID NO: 1021556 - RNA, 18 nt, Homo sapiens
aacagaacaucauuagaa

SEQ ID NO: 1021557 - RNA, 16 nt, Homo sapiens
aacagaagcuuccauu

SEQ ID NO: 1021558 - RNA, 21 nt, Homo sapiens
aacagaagggcuaacucaguu

SEQ ID NO: 1021559 - RNA, 18 nt, Homo sapiens
aacagaaguccauggagu

SEQ ID NO: 1021560 - RNA, 13 nt, Homo sapiens
aacagacaacaga

SEQ ID NO: 1021561 - RNA, 21 nt, Homo sapiens
aacagauggauagucugucca

SEQ ID NO: 1021562 - RNA, 21 nt, Homo sapiens
aacagcaaaacuccaucucaa

SEQ ID NO: 1021563 - RNA, 15 nt, Homo sapiens
aacagcacccucucc

SEQ ID NO: 1021564 - RNA, 19 nt, Homo sapiens
aacagcagauuucagauca

SEQ ID NO: 1021565 - RNA, 23 nt, Homo sapiens
aacagccaaaacuccacagucaa

SEQ ID NO: 1021566 - RNA, 17 nt, Homo sapiens
aacagccaacagguggc

SEQ ID NO: 1021567 - RNA, 15 nt, Homo sapiens
aacagccccaaaguc

SEQ ID NO: 1021568 - RNA, 20 nt, Homo sapiens
aacagcgcuggguccacccc

SEQ ID NO: 1021569 - RNA, 13 nt, Homo sapiens
aacagcucaguuc

SEQ ID NO: 1021570 - RNA, 23 nt, Homo sapiens
aacagcugaggucucuugaggga

SEQ ID NO: 1021571 - RNA, 16 nt, Homo sapiens
aacaggaggacaauuc

SEQ ID NO: 1021572 - RNA, 18 nt, Homo sapiens
aacaggcucaauauuccu

SEQ ID NO: 1021573 - RNA, 19 nt, Homo sapiens
aacaggcucagaucucaug

SEQ ID NO: 1021574 - RNA, 17 nt, Homo sapiens
aacagugaggugcccag

SEQ ID NO: 1021575 - RNA, 15 nt, Homo sapiens
aacagugcauauucc

SEQ ID NO: 1021576 - RNA, 21 nt, Homo sapiens
aacagugcuaaaaaugggacu

SEQ ID NO: 1021577 - RNA, 18 nt, Homo sapiens
aacagugucauauacaau

SEQ ID NO: 1021578 - RNA, 20 nt, Homo sapiens
aacaguuccuucagcuucca

SEQ ID NO: 1021579 - RNA, 16 nt, Homo sapiens
aacaguuuuccaugaa

SEQ ID NO: 1021580 - RNA, 19 nt, Homo sapiens
aacauaaagagaacucugg

SEQ ID NO: 1021581 - RNA, 12 nt, Homo sapiens
aacauaaagccu

SEQ ID NO: 1021582 - RNA, 13 nt, Homo sapiens
aacauaaagccuu

SEQ ID NO: 1021583 - RNA, 17 nt, Homo sapiens
aacauaagguacuagca

SEQ ID NO: 1021584 - RNA, 19 nt, Homo sapiens
aacauaagguacuagcagu

SEQ ID NO: 1021585 - RNA, 20 nt, Homo sapiens
aacauacuggccuggacugu

SEQ ID NO: 1021586 - RNA, 20 nt, Homo sapiens
aacauauaaagcacuauaca

SEQ ID NO: 1021587 - RNA, 20 nt, Homo sapiens
aacaucacaccauugcacuc

SEQ ID NO: 1021588 - RNA, 20 nt, Homo sapiens
aacaucacugaaaugcuagc

SEQ ID NO: 1021589 - RNA, 16 nt, Homo sapiens
aacaugcuugcauuau

SEQ ID NO: 1021590 - RNA, 22 nt, Homo sapiens
aacauggagaaaccccgucucu

SEQ ID NO: 1021591 - RNA, 23 nt, Homo sapiens
aacauggccuuggagggcaugaa

SEQ ID NO: 1021592 - RNA, 24 nt, Homo sapiens
aacauggugaaaccucaucucuac

SEQ ID NO: 1021593 - RNA, 23 nt, Homo sapiens
aacauguaauaaaaaguauaugu

SEQ ID NO: 1021594 - RNA, 16 nt, Homo sapiens
aacaugugcucaggga

SEQ ID NO: 1021595 - RNA, 18 nt, Homo sapiens
aacauucauagcuggucu

SEQ ID NO: 1021596 - RNA, 10 nt, Homo sapiens
aacauuccau

SEQ ID NO: 1021597 - RNA, 17 nt, Homo sapiens
aacauuccuuagucuca

SEQ ID NO: 1021598 - RNA, 18 nt, Homo sapiens
aacauuccuuagucucaa

SEQ ID NO: 1021599 - RNA, 11 nt, Homo sapiens
aacauucugua

SEQ ID NO: 1021600 - RNA, 20 nt, Homo sapiens
aaccaaauggagugacuuag

SEQ ID NO: 1021601 - RNA, 23 nt, Homo sapiens
aaccaaauuuguauuuaagguau

SEQ ID NO: 1021602 - RNA, 22 nt, Homo sapiens
aaccaacugcugcugugcacau

SEQ ID NO: 1021603 - RNA, 18 nt, Homo sapiens
aaccacaggcagcauuua

SEQ ID NO: 1021604 - RNA, 13 nt, Homo sapiens
aaccaccuuucag

SEQ ID NO: 1021605 - RNA, 17 nt, Homo sapiens
aaccagagccugagugu

SEQ ID NO: 1021606 - RNA, 17 nt, Homo sapiens
aaccaggauauugacau

SEQ ID NO: 1021607 - RNA, 16 nt, Homo sapiens
aaccagggccugagcc

SEQ ID NO: 1021608 - RNA, 16 nt, Homo sapiens
aaccaguuaugugaau

SEQ ID NO: 1021609 - RNA, 15 nt, Homo sapiens
aaccauaaacuucau

SEQ ID NO: 1021610 - RNA, 13 nt, Homo sapiens
aaccaucacauga

SEQ ID NO: 1021611 - RNA, 11 nt, Homo sapiens
aacccaaagug

SEQ ID NO: 1021612 - RNA, 22 nt, Homo sapiens
aacccaaauguucaucaaugaa

SEQ ID NO: 1021613 - RNA, 18 nt, Homo sapiens
aacccaaggacugaggga

SEQ ID NO: 1021614 - RNA, 15 nt, Homo sapiens
aacccacaguucucc

SEQ ID NO: 1021615 - RNA, 20 nt, Homo sapiens
aacccaggagguggagguug

SEQ ID NO: 1021616 - RNA, 12 nt, Homo sapiens
aaccccaucucu

SEQ ID NO: 1021617 - RNA, 19 nt, Homo sapiens
aaccccaucucuacugaaa

SEQ ID NO: 1021618 - RNA, 21 nt, Homo sapiens
aacccugacuccucuuugugc

SEQ ID NO: 1021619 - RNA, 17 nt, Homo sapiens
aacccuggagaguucaa

SEQ ID NO: 1021620 - RNA, 15 nt, Homo sapiens
aacccuuaucuguaa

SEQ ID NO: 1021621 - RNA, 14 nt, Homo sapiens
aacccuugcuugca

SEQ ID NO: 1021622 - RNA, 14 nt, Homo sapiens
aaccgagcaauuuu

SEQ ID NO: 1021623 - RNA, 19 nt, Homo sapiens
aaccgcaggaagcugcucc

SEQ ID NO: 1021624 - RNA, 21 nt, Homo sapiens
aaccuaacuggcuuacuuccu

SEQ ID NO: 1021625 - RNA, 22 nt, Homo sapiens
aaccuagccuuagaagucacac

SEQ ID NO: 1021626 - RNA, 13 nt, Homo sapiens
aaccucaaaguga

SEQ ID NO: 1021627 - RNA, 17 nt, Homo sapiens
aaccucacgcaccuccc

SEQ ID NO: 1021628 - RNA, 15 nt, Homo sapiens
aaccucauuccccaa

SEQ ID NO: 1021629 - RNA, 14 nt, Homo sapiens
aaccucauugacaa

SEQ ID NO: 1021630 - RNA, 20 nt, Homo sapiens
aaccuccgccucccggguuc

SEQ ID NO: 1021631 - RNA, 16 nt, Homo sapiens
aaccucuaacccaggu

SEQ ID NO: 1021632 - RNA, 16 nt, Homo sapiens
aaccugaugcugacua

SEQ ID NO: 1021633 - RNA, 14 nt, Homo sapiens
aaccugcugaaggg

SEQ ID NO: 1021634 - RNA, 13 nt, Homo sapiens
aaccugcuuuacu

SEQ ID NO: 1021635 - RNA, 18 nt, Homo sapiens
aaccuggaguauaauauu

SEQ ID NO: 1021636 - RNA, 21 nt, Homo sapiens
aaccuggcagguuagaaccua

SEQ ID NO: 1021637 - RNA, 20 nt, Homo sapiens
aaccuggguaacuagggaag

SEQ ID NO: 1021638 - RNA, 19 nt, Homo sapiens
aaccuguccuugcacacuc

SEQ ID NO: 1021639 - RNA, 17 nt, Homo sapiens
aaccugugaugagggga

SEQ ID NO: 1021640 - RNA, 13 nt, Homo sapiens
aaccuuccaucuc

SEQ ID NO: 1021641 - RNA, 23 nt, Homo sapiens
aaccuugcacaggucccacugcc

SEQ ID NO: 1021642 - RNA, 15 nt, Homo sapiens
aaccuugguguaguu

SEQ ID NO: 1021643 - RNA, 24 nt, Homo sapiens
aaccuugugccuggcucagagcca

SEQ ID NO: 1021644 - RNA, 11 nt, Homo sapiens
aaccuuucaaa

SEQ ID NO: 1021645 - RNA, 15 nt, Homo sapiens
aacgacaaagccaaa

SEQ ID NO: 1021646 - RNA, 20 nt, Homo sapiens
aacgcuuaaaggugucuucc

SEQ ID NO: 1021647 - RNA, 16 nt, Homo sapiens
aacggaacaguaucca

SEQ ID NO: 1021648 - RNA, 18 nt, Homo sapiens
aacggugagcauuguggc

SEQ ID NO: 1021649 - RNA, 13 nt, Homo sapiens
aacuaacucuccu

SEQ ID NO: 1021650 - RNA, 23 nt, Homo sapiens
aacuaauuuccucugacauguaa

SEQ ID NO: 1021651 - RNA, 15 nt, Homo sapiens
aacuacaagccacga

SEQ ID NO: 1021652 - RNA, 16 nt, Homo sapiens
aacuacauguaaucca

SEQ ID NO: 1021653 - RNA, 13 nt, Homo sapiens
aacuacugugauc

SEQ ID NO: 1021654 - RNA, 16 nt, Homo sapiens
aacuagaaaucugcca

SEQ ID NO: 1021655 - RNA, 14 nt, Homo sapiens
aacuagaaccugga

SEQ ID NO: 1021656 - RNA, 14 nt, Homo sapiens
aacuagcaccaggg

SEQ ID NO: 1021657 - RNA, 15 nt, Homo sapiens
aacuaggcucagaga

SEQ ID NO: 1021658 - RNA, 21 nt, Homo sapiens
aacuaggcucagagaugugca

SEQ ID NO: 1021659 - RNA, 23 nt, Homo sapiens
aacuaggcucagagaugugcacc

SEQ ID NO: 1021660 - RNA, 18 nt, Homo sapiens
aacuauaagcccacuguu

SEQ ID NO: 1021661 - RNA, 14 nt, Homo sapiens
aacuaucuuuuugc

SEQ ID NO: 1021662 - RNA, 16 nt, Homo sapiens
aacuauguaacaugua

SEQ ID NO: 1021663 - RNA, 16 nt, Homo sapiens
aacuauguacuuuaaa

SEQ ID NO: 1021664 - RNA, 13 nt, Homo sapiens
aacucaaugagcu

SEQ ID NO: 1021665 - RNA, 15 nt, Homo sapiens
aacucacugcucaag

SEQ ID NO: 1021666 - RNA, 17 nt, Homo sapiens
aacucagaucacuacug

SEQ ID NO: 1021667 - RNA, 18 nt, Homo sapiens
aacucagaucacuacugc

SEQ ID NO: 1021668 - RNA, 19 nt, Homo sapiens
aacucagugugacuccuca

SEQ ID NO: 1021669 - RNA, 16 nt, Homo sapiens
aacucauacugugcug

SEQ ID NO: 1021670 - RNA, 20 nt, Homo sapiens
aacucuacccuggcacuaua

SEQ ID NO: 1021671 - RNA, 24 nt, Homo sapiens
aacucuaucugucauacauccuag

SEQ ID NO: 1021672 - RNA, 19 nt, Homo sapiens
aacucuccuacacuuccau

SEQ ID NO: 1021673 - RNA, 22 nt, Homo sapiens
aacucugaaagagaaaucaaug

SEQ ID NO: 1021674 - RNA, 18 nt, Homo sapiens
aacucugagaucuaagga

SEQ ID NO: 1021675 - RNA, 18 nt, Homo sapiens
aacucugcccaggugugc

SEQ ID NO: 1021676 - RNA, 14 nt, Homo sapiens
aacucuuaaaaccc

SEQ ID NO: 1021677 - RNA, 16 nt, Homo sapiens
aacucuugaccucagg

SEQ ID NO: 1021678 - RNA, 15 nt, Homo sapiens
aacucuugagaucuu

SEQ ID NO: 1021679 - RNA, 15 nt, Homo sapiens
aacugaauaaauacc

SEQ ID NO: 1021680 - RNA, 17 nt, Homo sapiens
aacugaaugagaaccaa

SEQ ID NO: 1021681 - RNA, 22 nt, Homo sapiens
aacugacuagugagauggccug

SEQ ID NO: 1021682 - RNA, 18 nt, Homo sapiens
aacugagauuacaggcac

SEQ ID NO: 1021683 - RNA, 14 nt, Homo sapiens
aacugauuuaucua

SEQ ID NO: 1021684 - RNA, 16 nt, Homo sapiens
aacugcagcaguggcu

SEQ ID NO: 1021685 - RNA, 20 nt, Homo sapiens
aacugccuuuggcagaguuc

SEQ ID NO: 1021686 - RNA, 18 nt, Homo sapiens
aacugcuugaacccagga

SEQ ID NO: 1021687 - RNA, 14 nt, Homo sapiens
aacuggacucagga

SEQ ID NO: 1021688 - RNA, 18 nt, Homo sapiens
aacuggguuccugcaaug

SEQ ID NO: 1021689 - RNA, 19 nt, Homo sapiens
aacugguauauacauauau

SEQ ID NO: 1021690 - RNA, 14 nt, Homo sapiens
aacuguacauguga

SEQ ID NO: 1021691 - RNA, 16 nt, Homo sapiens
aacuguauauauuccc

SEQ ID NO: 1021692 - RNA, 14 nt, Homo sapiens
aacuguaugaaugu

SEQ ID NO: 1021693 - RNA, 16 nt, Homo sapiens
aacugugcuccucacu

SEQ ID NO: 1021694 - RNA, 19 nt, Homo sapiens
aacugugcuccucacuucc

SEQ ID NO: 1021695 - RNA, 17 nt, Homo sapiens
aacuguguggacuguga

SEQ ID NO: 1021696 - RNA, 17 nt, Homo sapiens
aacuuaaaaaaaugaca

SEQ ID NO: 1021697 - RNA, 18 nt, Homo sapiens
aacuuaaaugaaaugcau

SEQ ID NO: 1021698 - RNA, 13 nt, Homo sapiens
aacuuaacauuca

SEQ ID NO: 1021699 - RNA, 16 nt, Homo sapiens
aacuuacuuaguguua

SEQ ID NO: 1021700 - RNA, 13 nt, Homo sapiens
aacuuaggaagga

SEQ ID NO: 1021701 - RNA, 14 nt, Homo sapiens
aacuucagacugaa

SEQ ID NO: 1021702 - RNA, 13 nt, Homo sapiens
aacuucauuugau

SEQ ID NO: 1021703 - RNA, 15 nt, Homo sapiens
aacuuccaauuuaca

SEQ ID NO: 1021704 - RNA, 12 nt, Homo sapiens
aacuucugccuc

SEQ ID NO: 1021705 - RNA, 19 nt, Homo sapiens
aacuugacaguaaaucaca

SEQ ID NO: 1021706 - RNA, 16 nt, Homo sapiens
aacuugagggcccaga

SEQ ID NO: 1021707 - RNA, 22 nt, Homo sapiens
aacuuggaaauagugauuucca

SEQ ID NO: 1021708 - RNA, 19 nt, Homo sapiens
aacuuggauguaccugccc

SEQ ID NO: 1021709 - RNA, 21 nt, Homo sapiens
aacuuguagcauuaaacaauc

SEQ ID NO: 1021710 - RNA, 17 nt, Homo sapiens
aacuuguuacuaaagaa

SEQ ID NO: 1021711 - RNA, 15 nt, Homo sapiens
aacuuuauucaagua

SEQ ID NO: 1021712 - RNA, 16 nt, Homo sapiens
aacuuuccaagcucca

SEQ ID NO: 1021713 - RNA, 19 nt, Homo sapiens
aacuuugauaggaugugga

SEQ ID NO: 1021714 - RNA, 19 nt, Homo sapiens
aacuuuguggaugucuucc

SEQ ID NO: 1021715 - RNA, 19 nt, Homo sapiens
aagaaaaaaaaagucuuug

SEQ ID NO: 1021716 - RNA, 16 nt, Homo sapiens
aagaaaaaauaucuug

SEQ ID NO: 1021717 - RNA, 23 nt, Homo sapiens
aagaaaaagaccuaugagcacau

SEQ ID NO: 1021718 - RNA, 22 nt, Homo sapiens
aagaaaaagucauccaaucuaa

SEQ ID NO: 1021719 - RNA, 16 nt, Homo sapiens
aagaaaacaucacuga

SEQ ID NO: 1021720 - RNA, 14 nt, Homo sapiens
aagaaaaugauugc

SEQ ID NO: 1021721 - RNA, 16 nt, Homo sapiens
aagaaaauggauuuaa

SEQ ID NO: 1021722 - RNA, 15 nt, Homo sapiens
aagaaagacuuauca

SEQ ID NO: 1021723 - RNA, 23 nt, Homo sapiens
aagaaagagcaacaauccaucuc

SEQ ID NO: 1021724 - RNA, 13 nt, Homo sapiens
aagaaaugcugcc

SEQ ID NO: 1021725 - RNA, 23 nt, Homo sapiens
aagaaauguaagggaaacugcca

SEQ ID NO: 1021726 - RNA, 14 nt, Homo sapiens
aagaaauucugcaa

SEQ ID NO: 1021727 - RNA, 20 nt, Homo sapiens
aagaacccucaggucacaag

SEQ ID NO: 1021728 - RNA, 20 nt, Homo sapiens
aagaacuuggaggcaccauu

SEQ ID NO: 1021729 - RNA, 19 nt, Homo sapiens
aagaacuuggcacacucuc

SEQ ID NO: 1021730 - RNA, 16 nt, Homo sapiens
aagaagaaaccuucau

SEQ ID NO: 1021731 - RNA, 18 nt, Homo sapiens
aagaagagacucuuugca

SEQ ID NO: 1021732 - RNA, 15 nt, Homo sapiens
aagaagagacuggga

SEQ ID NO: 1021733 - RNA, 15 nt, Homo sapiens
aagaagccacagacc

SEQ ID NO: 1021734 - RNA, 17 nt, Homo sapiens
aagaaucagucuaucca

SEQ ID NO: 1021735 - RNA, 13 nt, Homo sapiens
aagaaucuguuuc

SEQ ID NO: 1021736 - RNA, 20 nt, Homo sapiens
aagaauggggaucacagaga

SEQ ID NO: 1021737 - RNA, 14 nt, Homo sapiens
aagacaaauucugu

SEQ ID NO: 1021738 - RNA, 13 nt, Homo sapiens
aagacaauggcuu

SEQ ID NO: 1021739 - RNA, 13 nt, Homo sapiens
aagacaauucuuu

SEQ ID NO: 1021740 - RNA, 20 nt, Homo sapiens
aagacacugaaauauacaca

SEQ ID NO: 1021741 - RNA, 19 nt, Homo sapiens
aagacacuuuuuggacuca

SEQ ID NO: 1021742 - RNA, 15 nt, Homo sapiens
aagacagcuucucau

SEQ ID NO: 1021743 - RNA, 20 nt, Homo sapiens
aagacauacuccuuccauca

SEQ ID NO: 1021744 - RNA, 19 nt, Homo sapiens
aagacauaguugugcaugc

SEQ ID NO: 1021745 - RNA, 18 nt, Homo sapiens
aagacauggaauuaccuu

SEQ ID NO: 1021746 - RNA, 21 nt, Homo sapiens
aagacauuaccaugaguaaua

SEQ ID NO: 1021747 - RNA, 14 nt, Homo sapiens
aagaccaauauuca

SEQ ID NO: 1021748 - RNA, 22 nt, Homo sapiens
aagaccaauauucaaaugcgua

SEQ ID NO: 1021749 - RNA, 16 nt, Homo sapiens
aagaccaccaccucag

SEQ ID NO: 1021750 - RNA, 15 nt, Homo sapiens
aagaccagcuuugca

SEQ ID NO: 1021751 - RNA, 20 nt, Homo sapiens
aagacccuuguggucccacc

SEQ ID NO: 1021752 - RNA, 14 nt, Homo sapiens
aagacgugauucaa

SEQ ID NO: 1021753 - RNA, 11 nt, Homo sapiens
aagacugacca

SEQ ID NO: 1021754 - RNA, 17 nt, Homo sapiens
aagacuguaaugaaucu

SEQ ID NO: 1021755 - RNA, 19 nt, Homo sapiens
aagacuguggccugcccag

SEQ ID NO: 1021756 - RNA, 14 nt, Homo sapiens
aagacuuaacuggu

SEQ ID NO: 1021757 - RNA, 18 nt, Homo sapiens
aagagaccaagacucuga

SEQ ID NO: 1021758 - RNA, 14 nt, Homo sapiens
aagagacugggaag

SEQ ID NO: 1021759 - RNA, 21 nt, Homo sapiens
aagagagaaagaaguaggcau

SEQ ID NO: 1021760 - RNA, 17 nt, Homo sapiens
aagagcacacuuggccc

SEQ ID NO: 1021761 - RNA, 19 nt, Homo sapiens
aagagccauauaaguuuga

SEQ ID NO: 1021762 - RNA, 19 nt, Homo sapiens
aagagcuggcaaagguggc

SEQ ID NO: 1021763 - RNA, 14 nt, Homo sapiens
aagaggcagggucu

SEQ ID NO: 1021764 - RNA, 18 nt, Homo sapiens
aagagggccugugggagc

SEQ ID NO: 1021765 - RNA, 21 nt, Homo sapiens
aagaggggacaggucccucac

SEQ ID NO: 1021766 - RNA, 16 nt, Homo sapiens
aagagggucugaggaa

SEQ ID NO: 1021767 - RNA, 18 nt, Homo sapiens
aagagucauauugcccag

SEQ ID NO: 1021768 - RNA, 14 nt, Homo sapiens
aagaguggaaccaa

SEQ ID NO: 1021769 - RNA, 21 nt, Homo sapiens
aagaguugagauuuugcaauc

SEQ ID NO: 1021770 - RNA, 14 nt, Homo sapiens
aagauaaaugugcu

SEQ ID NO: 1021771 - RNA, 19 nt, Homo sapiens
aagauaaaugugcugaaug

SEQ ID NO: 1021772 - RNA, 19 nt, Homo sapiens
aagauaacaagaucuuuca

SEQ ID NO: 1021773 - RNA, 22 nt, Homo sapiens
aagauaaucucucagcuuuuaa

SEQ ID NO: 1021774 - RNA, 20 nt, Homo sapiens
aagauacaggacauucucau

SEQ ID NO: 1021775 - RNA, 15 nt, Homo sapiens
aagauagcagggcau

SEQ ID NO: 1021776 - RNA, 22 nt, Homo sapiens
agaaggcaugaaauugucuagc

SEQ ID NO: 1021777 - RNA, 10 nt, Homo sapiens
agaagggaug

SEQ ID NO: 1021778 - RNA, 13 nt, Homo sapiens
agaagggggccau

SEQ ID NO: 1021779 - RNA, 17 nt, Homo sapiens
agaagggggccaugagg

SEQ ID NO: 1021780 - RNA, 22 nt, Homo sapiens
agaaggguaccuugaacacugg

SEQ ID NO: 1021781 - RNA, 19 nt, Homo sapiens
agaaggucauaagggagca

SEQ ID NO: 1021782 - RNA, 20 nt, Homo sapiens
agaagguggguuuucaucaa

SEQ ID NO: 1021783 - RNA, 17 nt, Homo sapiens
agaagguuuacucugug

SEQ ID NO: 1021784 - RNA, 22 nt, Homo sapiens
agaaguccauggaguuaucuaa

SEQ ID NO: 1021785 - RNA, 21 nt, Homo sapiens
agaaguccccuuccaucccag

SEQ ID NO: 1021786 - RNA, 12 nt, Homo sapiens
agaagugccagu

SEQ ID NO: 1021787 - RNA, 13 nt, Homo sapiens
agaagugugauug

SEQ ID NO: 1021788 - RNA, 13 nt, Homo sapiens
agaaguuccucaa

SEQ ID NO: 1021789 - RNA, 22 nt, Homo sapiens
agaaguucuggcugaacacugg

SEQ ID NO: 1021790 - RNA, 17 nt, Homo sapiens
agaaguugagagagcaa

SEQ ID NO: 1021791 - RNA, 16 nt, Homo sapiens
agaauauaauacugua

SEQ ID NO: 1021792 - RNA, 17 nt, Homo sapiens
agaauauaauacuguau

SEQ ID NO: 1021793 - RNA, 19 nt, Homo sapiens
agaauauacaaauagcaaa

SEQ ID NO: 1021794 - RNA, 20 nt, Homo sapiens
agaauauacuaaauuaacuu

SEQ ID NO: 1021795 - RNA, 14 nt, Homo sapiens
agaaucacuugaac

SEQ ID NO: 1021796 - RNA, 16 nt, Homo sapiens
agaaucacuugaaccc

SEQ ID NO: 1021797 - RNA, 17 nt, Homo sapiens
agaaucagaucauuuca

SEQ ID NO: 1021798 - RNA, 21 nt, Homo sapiens
agaauccagcuacgaauauag

SEQ ID NO: 1021799 - RNA, 22 nt, Homo sapiens
agaauccaguuugcaauuacuu

SEQ ID NO: 1021800 - RNA, 15 nt, Homo sapiens
agaaucuaaagccag

SEQ ID NO: 1021801 - RNA, 19 nt, Homo sapiens
agaaugaaagcuccucgag

SEQ ID NO: 1021802 - RNA, 18 nt, Homo sapiens
agaaugaauaauaauuau

SEQ ID NO: 1021803 - RNA, 11 nt, Homo sapiens
agaaugcucuu

SEQ ID NO: 1021804 - RNA, 17 nt, Homo sapiens
agaauggaaaacagacu

SEQ ID NO: 1021805 - RNA, 17 nt, Homo sapiens
agaauggggaucacaga

SEQ ID NO: 1021806 - RNA, 20 nt, Homo sapiens
agaauguucuccuaaaagac

SEQ ID NO: 1021807 - RNA, 15 nt, Homo sapiens
agaauucuuacaugu

SEQ ID NO: 1021808 - RNA, 16 nt, Homo sapiens
agaauugguugccaua

SEQ ID NO: 1021809 - RNA, 13 nt, Homo sapiens
agaauuguaucau

SEQ ID NO: 1021810 - RNA, 22 nt, Homo sapiens
agaauuuaaaacgcaugugcag

SEQ ID NO: 1021811 - RNA, 23 nt, Homo sapiens
agaauuugguaaauuaguauuua

SEQ ID NO: 1021812 - RNA, 13 nt, Homo sapiens
agacaacauuucu

SEQ ID NO: 1021813 - RNA, 15 nt, Homo sapiens
agacaacauuucuca

SEQ ID NO: 1021814 - RNA, 21 nt, Homo sapiens
agacaagcuuguccauguaau

SEQ ID NO: 1021815 - RNA, 12 nt, Homo sapiens
agacaaugacuu

SEQ ID NO: 1021816 - RNA, 21 nt, Homo sapiens
agacaauggcuuacuccagga

SEQ ID NO: 1021817 - RNA, 18 nt, Homo sapiens
agacaauucuuuauacaa

SEQ ID NO: 1021818 - RNA, 17 nt, Homo sapiens
agacacaucuccuccau

SEQ ID NO: 1021819 - RNA, 18 nt, Homo sapiens
agacaccuugacagggca

SEQ ID NO: 1021820 - RNA, 15 nt, Homo sapiens
agacacgcucuucua

SEQ ID NO: 1021821 - RNA, 14 nt, Homo sapiens
agacagaaagcaga

SEQ ID NO: 1021822 - RNA, 14 nt, Homo sapiens
agacagaagccuca

SEQ ID NO: 1021823 - RNA, 19 nt, Homo sapiens
agacagacaacacugggaa

SEQ ID NO: 1021824 - RNA, 16 nt, Homo sapiens
agacagagcucacaau

SEQ ID NO: 1021825 - RNA, 14 nt, Homo sapiens
agacagagucucac

SEQ ID NO: 1021826 - RNA, 16 nt, Homo sapiens
agacaggacccuggga

SEQ ID NO: 1021827 - RNA, 20 nt, Homo sapiens
agacaggaugguuacucuug

SEQ ID NO: 1021828 - RNA, 19 nt, Homo sapiens
agacaggguuucaccaugu

SEQ ID NO: 1021829 - RNA, 23 nt, Homo sapiens
agacaguaugagucaaugugcag

SEQ ID NO: 1021830 - RNA, 15 nt, Homo sapiens
agacagugggaaaua

SEQ ID NO: 1021831 - RNA, 14 nt, Homo sapiens
agacaguucaagaa

SEQ ID NO: 1021832 - RNA, 23 nt, Homo sapiens
agacauagaauuaacacaugauc

SEQ ID NO: 1021833 - RNA, 12 nt, Homo sapiens
agacaucugccc

SEQ ID NO: 1021834 - RNA, 13 nt, Homo sapiens
agacaugaauaug

SEQ ID NO: 1021835 - RNA, 18 nt, Homo sapiens
agacaugagcauggcuga

SEQ ID NO: 1021836 - RNA, 20 nt, Homo sapiens
agacaugcacuaugaggaau

SEQ ID NO: 1021837 - RNA, 16 nt, Homo sapiens
agacauguaucacugu

SEQ ID NO: 1021838 - RNA, 15 nt, Homo sapiens
agacaugugcacuug

SEQ ID NO: 1021839 - RNA, 22 nt, Homo sapiens
agaccaaggcgggagcaucucu

SEQ ID NO: 1021840 - RNA, 15 nt, Homo sapiens
agaccacuguuauca

SEQ ID NO: 1021841 - RNA, 23 nt, Homo sapiens
agaccagacuguggagaaauaaa

SEQ ID NO: 1021842 - RNA, 17 nt, Homo sapiens
agaccagcuuugcagug

SEQ ID NO: 1021843 - RNA, 23 nt, Homo sapiens
agaccaguccuguuugcagggaa

SEQ ID NO: 1021844 - RNA, 15 nt, Homo sapiens
agaccauaauguuac

SEQ ID NO: 1021845 - RNA, 16 nt, Homo sapiens
agaccauaauguuaca

SEQ ID NO: 1021846 - RNA, 21 nt, Homo sapiens
agaccauucaggacacaggga

SEQ ID NO: 1021847 - RNA, 12 nt, Homo sapiens
agaccuaccuca

SEQ ID NO: 1021848 - RNA, 16 nt, Homo sapiens
agaccuaggauuucau

SEQ ID NO: 1021849 - RNA, 16 nt, Homo sapiens
agaccugacaagcacu

SEQ ID NO: 1021850 - RNA, 21 nt, Homo sapiens
agaccugcugagggaccagcc

SEQ ID NO: 1021851 - RNA, 19 nt, Homo sapiens
agaccuuccauaaugcuac

SEQ ID NO: 1021852 - RNA, 24 nt, Homo sapiens
agacuaagcccugucgagacacuu

SEQ ID NO: 1021853 - RNA, 15 nt, Homo sapiens
agacuagauugccuu

SEQ ID NO: 1021854 - RNA, 23 nt, Homo sapiens
agacuauuaauaaauaagacugu

SEQ ID NO: 1021855 - RNA, 15 nt, Homo sapiens
agacuauugagauau

SEQ ID NO: 1021856 - RNA, 16 nt, Homo sapiens
agacucaaaugcucag

SEQ ID NO: 1021857 - RNA, 17 nt, Homo sapiens
agacucacauccugacc

SEQ ID NO: 1021858 - RNA, 20 nt, Homo sapiens
agacucagggccccagcacu

SEQ ID NO: 1021859 - RNA, 21 nt, Homo sapiens
agacucagggccccagcacua

SEQ ID NO: 1021860 - RNA, 13 nt, Homo sapiens
agacuccaaagaa

SEQ ID NO: 1021861 - RNA, 13 nt, Homo sapiens
agacuccaugaga

SEQ ID NO: 1021862 - RNA, 15 nt, Homo sapiens
agacucugucucagu

SEQ ID NO: 1021863 - RNA, 13 nt, Homo sapiens
agacugagcucaa

SEQ ID NO: 1021864 - RNA, 21 nt, Homo sapiens
agacugcccagcuaaagcaau

SEQ ID NO: 1021865 - RNA, 12 nt, Homo sapiens
agacugcuuccc

SEQ ID NO: 1021866 - RNA, 15 nt, Homo sapiens
agacuggaagcacag

SEQ ID NO: 1021867 - RNA, 18 nt, Homo sapiens
agacuggagcaucugacu

SEQ ID NO: 1021868 - RNA, 18 nt, Homo sapiens
agacuggauucgugacaa

SEQ ID NO: 1021869 - RNA, 21 nt, Homo sapiens
agacuguaggaagaguagcau

SEQ ID NO: 1021870 - RNA, 14 nt, Homo sapiens
agacuguugcucaa

SEQ ID NO: 1021871 - RNA, 23 nt, Homo sapiens
agacuugaaauacuacuuaccau

SEQ ID NO: 1021872 - RNA, 15 nt, Homo sapiens
agagaaaagucuacc

SEQ ID NO: 1021873 - RNA, 13 nt, Homo sapiens
agagaaaguguga

SEQ ID NO: 1021874 - RNA, 16 nt, Homo sapiens
agagaaauacuuucag

SEQ ID NO: 1021875 - RNA, 22 nt, Homo sapiens
agagaacaaugugcuaugugaa

SEQ ID NO: 1021876 - RNA, 23 nt, Homo sapiens
agagaacuggaaagacauagcca

SEQ ID NO: 1021877 - RNA, 21 nt, Homo sapiens
agaggcaaaggcucucacucc

SEQ ID NO: 1021878 - RNA, 13 nt, Homo sapiens
agaggcacugggg

SEQ ID NO: 1021879 - RNA, 19 nt, Homo sapiens
agaggcagggucucacucu

SEQ ID NO: 1021880 - RNA, 14 nt, Homo sapiens
agaggccauggcag

SEQ ID NO: 1021881 - RNA, 14 nt, Homo sapiens
agaggccuuguccc

SEQ ID NO: 1021882 - RNA, 16 nt, Homo sapiens
agaggcucagcacuuu

SEQ ID NO: 1021883 - RNA, 18 nt, Homo sapiens
agagggcacacacugugu

SEQ ID NO: 1021884 - RNA, 14 nt, Homo sapiens
agagggcaggcaug

SEQ ID NO: 1021885 - RNA, 20 nt, Homo sapiens
agaggggaaaccaguguagc

SEQ ID NO: 1021886 - RNA, 14 nt, Homo sapiens
agaggguguuugca

SEQ ID NO: 1021887 - RNA, 21 nt, Homo sapiens
agagguaaaagugugagcagu

SEQ ID NO: 1021888 - RNA, 22 nt, Homo sapiens
agagguagguaggaucauccca

SEQ ID NO: 1021889 - RNA, 20 nt, Homo sapiens
agaggucaaggcugcaguga

SEQ ID NO: 1021890 - RNA, 20 nt, Homo sapiens
agaggugaaagcuauaucaa

SEQ ID NO: 1021891 - RNA, 18 nt, Homo sapiens
agagguuaaggugcaaua

SEQ ID NO: 1021892 - RNA, 13 nt, Homo sapiens
agagguuucagug

SEQ ID NO: 1021893 - RNA, 16 nt, Homo sapiens
agaguaaaaacugaau

SEQ ID NO: 1021894 - RNA, 14 nt, Homo sapiens
agaguaucacuccc

SEQ ID NO: 1021895 - RNA, 20 nt, Homo sapiens
agaguauuggucuccucuca

SEQ ID NO: 1021896 - RNA, 18 nt, Homo sapiens
agagucacuugaugugcc

SEQ ID NO: 1021897 - RNA, 14 nt, Homo sapiens
agaguccucuggau

SEQ ID NO: 1021898 - RNA, 20 nt, Homo sapiens
agagugagagacaucaucaa

SEQ ID NO: 1021899 - RNA, 19 nt, Homo sapiens
agagugcauuacuuugaau

SEQ ID NO: 1021900 - RNA, 19 nt, Homo sapiens
agagugcuuggcugcugua

SEQ ID NO: 1021901 - RNA, 23 nt, Homo sapiens
agaguggaaugcuuccuagaagu

SEQ ID NO: 1021902 - RNA, 23 nt, Homo sapiens
agagugucuucacggcaggacaa

SEQ ID NO: 1021903 - RNA, 17 nt, Homo sapiens
agaguucuccagacagg

SEQ ID NO: 1021904 - RNA, 19 nt, Homo sapiens
agaguucuccagacagggu

SEQ ID NO: 1021905 - RNA, 17 nt, Homo sapiens
agauaaaagauguacuu

SEQ ID NO: 1021906 - RNA, 19 nt, Homo sapiens
agauaaauaaauauaugau

SEQ ID NO: 1021907 - RNA, 23 nt, Homo sapiens
agauaacaagaucuuucaggaaa

SEQ ID NO: 1021908 - RNA, 20 nt, Homo sapiens
agauaacaaucuguauauaa

SEQ ID NO: 1021909 - RNA, 21 nt, Homo sapiens
agauaacuugagcaccgucau

SEQ ID NO: 1021910 - RNA, 14 nt, Homo sapiens
agauaauaugagaa

SEQ ID NO: 1021911 - RNA, 19 nt, Homo sapiens
agauaaucucuccauuccc

SEQ ID NO: 1021912 - RNA, 17 nt, Homo sapiens
agauaauuauaauauac

SEQ ID NO: 1021913 - RNA, 12 nt, Homo sapiens
agauacaaacug

SEQ ID NO: 1021914 - RNA, 15 nt, Homo sapiens
agauacagccugcaa

SEQ ID NO: 1021915 - RNA, 16 nt, Homo sapiens
agauagaagaacugca

SEQ ID NO: 1021916 - RNA, 15 nt, Homo sapiens
agauagguaaauacc

SEQ ID NO: 1021917 - RNA, 20 nt, Homo sapiens
agauaguacauaaagguggu

SEQ ID NO: 1021918 - RNA, 23 nt, Homo sapiens
agauaguggggagacuucuuggc

SEQ ID NO: 1021919 - RNA, 23 nt, Homo sapiens
agauaguuguguuuuuauuguua

SEQ ID NO: 1021920 - RNA, 13 nt, Homo sapiens
agauauaugcucu

SEQ ID NO: 1021921 - RNA, 17 nt, Homo sapiens
agauauuauucauucau

SEQ ID NO: 1021922 - RNA, 19 nt, Homo sapiens
agauauugugaaguacaua

SEQ ID NO: 1021923 - RNA, 12 nt, Homo sapiens
agauauuucaca

SEQ ID NO: 1021924 - RNA, 22 nt, Homo sapiens
agaucaaugaaaugaugucaua

SEQ ID NO: 1021925 - RNA, 15 nt, Homo sapiens
agaucacgccacugc

SEQ ID NO: 1021926 - RNA, 20 nt, Homo sapiens
agaucacuuucucaguuuuc

SEQ ID NO: 1021927 - RNA, 20 nt, Homo sapiens
agaucauccagaaguuccuc

SEQ ID NO: 1021928 - RNA, 15 nt, Homo sapiens
agaucauccuuucca

SEQ ID NO: 1021929 - RNA, 14 nt, Homo sapiens
agaucauucacuca

SEQ ID NO: 1021930 - RNA, 17 nt, Homo sapiens
agauccccccuuuccuu

SEQ ID NO: 1021931 - RNA, 22 nt, Homo sapiens
agauccuaccccaauuccuugu

SEQ ID NO: 1021932 - RNA, 20 nt, Homo sapiens
agaucgcgccacugcacucc

SEQ ID NO: 1021933 - RNA, 19 nt, Homo sapiens
agaucguucucugccucac

SEQ ID NO: 1021934 - RNA, 20 nt, Homo sapiens
agaucuaagccuuuccauaa

SEQ ID NO: 1021935 - RNA, 21 nt, Homo sapiens
agaucuaaggaugucacaggg

SEQ ID NO: 1021936 - RNA, 12 nt, Homo sapiens
agaucuaccccu

SEQ ID NO: 1021937 - RNA, 16 nt, Homo sapiens
agaucucuaacuucac

SEQ ID NO: 1021938 - RNA, 19 nt, Homo sapiens
agaucugcagucacuucgu

SEQ ID NO: 1021939 - RNA, 10 nt, Homo sapiens
agaucuugau

SEQ ID NO: 1021940 - RNA, 17 nt, Homo sapiens
agaucuuucaggaaaga

SEQ ID NO: 1021941 - RNA, 16 nt, Homo sapiens
agaugaagacaacagc

SEQ ID NO: 1021942 - RNA, 16 nt, Homo sapiens
agaugacauggugaaa

SEQ ID NO: 1021943 - RNA, 18 nt, Homo sapiens
agaugacauggugaaaau

SEQ ID NO: 1021944 - RNA, 22 nt, Homo sapiens
agaugacauugcuaagaugcuc

SEQ ID NO: 1021945 - RNA, 16 nt, Homo sapiens
agaugagaguacaccc

SEQ ID NO: 1021946 - RNA, 14 nt, Homo sapiens
agaugaugaugauc

SEQ ID NO: 1021947 - RNA, 19 nt, Homo sapiens
agaugcaaggaccaggacu

SEQ ID NO: 1021948 - RNA, 16 nt, Homo sapiens
agaugcagccccaucu

SEQ ID NO: 1021949 - RNA, 22 nt, Homo sapiens
agaugcauguucaaaccaauca

SEQ ID NO: 1021950 - RNA, 20 nt, Homo sapiens
agaugccuucuccagacaaa

SEQ ID NO: 1021951 - RNA, 14 nt, Homo sapiens
agaugcugauguuc

SEQ ID NO: 1021952 - RNA, 20 nt, Homo sapiens
agaugcugcaaauaaauuca

SEQ ID NO: 1021953 - RNA, 17 nt, Homo sapiens
agauggaauaaagcccu

SEQ ID NO: 1021954 - RNA, 21 nt, Homo sapiens
agauggaguucuugugccaua

SEQ ID NO: 1021955 - RNA, 14 nt, Homo sapiens
agauggcacuuuga

SEQ ID NO: 1021956 - RNA, 22 nt, Homo sapiens
agauggcugugccucugccugu

SEQ ID NO: 1021957 - RNA, 20 nt, Homo sapiens
agaugggagcccaguuucac

SEQ ID NO: 1021958 - RNA, 22 nt, Homo sapiens
agaugggcaaauuaaggcauaa

SEQ ID NO: 1021959 - RNA, 21 nt, Homo sapiens
agaugguaccgugcaucgcac

SEQ ID NO: 1021960 - RNA, 19 nt, Homo sapiens
agauguccuugaugcucau

SEQ ID NO: 1021961 - RNA, 23 nt, Homo sapiens
agaugucgcccuacucaccugag

SEQ ID NO: 1021962 - RNA, 18 nt, Homo sapiens
agaugucuagguacuuca

SEQ ID NO: 1021963 - RNA, 17 nt, Homo sapiens
agaugugggcagugaug

SEQ ID NO: 1021964 - RNA, 22 nt, Homo sapiens
agauguuuuacgucugggagaa

SEQ ID NO: 1021965 - RNA, 19 nt, Homo sapiens
agauguuuuggggacucau

SEQ ID NO: 1021966 - RNA, 15 nt, Homo sapiens
agauuagcucuggac

SEQ ID NO: 1021967 - RNA, 20 nt, Homo sapiens
agauuagcucuggaccagcc

SEQ ID NO: 1021968 - RNA, 13 nt, Homo sapiens
agauuaugaucuc

SEQ ID NO: 1021969 - RNA, 21 nt, Homo sapiens
agauuccaggcgaugugcaag

SEQ ID NO: 1021970 - RNA, 14 nt, Homo sapiens
agcagcagugaaaa

SEQ ID NO: 1021971 - RNA, 18 nt, Homo sapiens
agcagcccuaaggaucuc

SEQ ID NO: 1021972 - RNA, 21 nt, Homo sapiens
agcagcuucugggaccauaag

SEQ ID NO: 1021973 - RNA, 21 nt, Homo sapiens
agcagcuuuaaacaaauucau

SEQ ID NO: 1021974 - RNA, 19 nt, Homo sapiens
agcagcuuuaaacucaggg

SEQ ID NO: 1021975 - RNA, 15 nt, Homo sapiens
agcaggaaaccugug

SEQ ID NO: 1021976 - RNA, 18 nt, Homo sapiens
agcaggaaccccaggaga

SEQ ID NO: 1021977 - RNA, 15 nt, Homo sapiens
agcaggaagcucaga

SEQ ID NO: 1021978 - RNA, 21 nt, Homo sapiens
agcaggacucugcccagacca

SEQ ID NO: 1021979 - RNA, 16 nt, Homo sapiens
agcaggagaaucacuu

SEQ ID NO: 1021980 - RNA, 23 nt, Homo sapiens
agcaggcgccucgggucccagau

SEQ ID NO: 1021981 - RNA, 19 nt, Homo sapiens
agcaggcguucagcucacu

SEQ ID NO: 1021982 - RNA, 14 nt, Homo sapiens
agcagggaugaagg

SEQ ID NO: 1021983 - RNA, 17 nt, Homo sapiens
agcaggggcuuguugca

SEQ ID NO: 1021984 - RNA, 15 nt, Homo sapiens
agcaggugcugagca

SEQ ID NO: 1021985 - RNA, 16 nt, Homo sapiens
agcagugccuuccaua

SEQ ID NO: 1021986 - RNA, 21 nt, Homo sapiens
agcaguugaaacaagaagcca

SEQ ID NO: 1021987 - RNA, 15 nt, Homo sapiens
agcauaacaaaaaga

SEQ ID NO: 1021988 - RNA, 18 nt, Homo sapiens
agcauaaguuucugggac

SEQ ID NO: 1021989 - RNA, 12 nt, Homo sapiens
agcauaauguga

SEQ ID NO: 1021990 - RNA, 13 nt, Homo sapiens
agcauaaugugag

SEQ ID NO: 1021991 - RNA, 21 nt, Homo sapiens
agcauacgguaugauauugca

SEQ ID NO: 1021992 - RNA, 20 nt, Homo sapiens
agcauaggaaaccacacaga

SEQ ID NO: 1021993 - RNA, 22 nt, Homo sapiens
agcauaugaguuucauagcuaa

SEQ ID NO: 1021994 - RNA, 17 nt, Homo sapiens
agcauauuguuauuaua

SEQ ID NO: 1021995 - RNA, 14 nt, Homo sapiens
agcaucaccucagg

SEQ ID NO: 1021996 - RNA, 13 nt, Homo sapiens
agcauccaugugu

SEQ ID NO: 1021997 - RNA, 21 nt, Homo sapiens
agcauccuggccaacauggug

SEQ ID NO: 1021998 - RNA, 17 nt, Homo sapiens
agcaucucccaguucau

SEQ ID NO: 1021999 - RNA, 14 nt, Homo sapiens
agcaucucugagca

SEQ ID NO: 1022000 - RNA, 19 nt, Homo sapiens
agcaucuguccucaucagu

SEQ ID NO: 1022001 - RNA, 14 nt, Homo sapiens
agcaugacgugugg

SEQ ID NO: 1022002 - RNA, 15 nt, Homo sapiens
agcaugaugagaguu

SEQ ID NO: 1022003 - RNA, 20 nt, Homo sapiens
agcaugcauccuuugcacug

SEQ ID NO: 1022004 - RNA, 12 nt, Homo sapiens
agcauguuucau

SEQ ID NO: 1022005 - RNA, 14 nt, Homo sapiens
agcauugcuuucug

SEQ ID NO: 1022006 - RNA, 18 nt, Homo sapiens
agcauuuaauguagccau

SEQ ID NO: 1022007 - RNA, 16 nt, Homo sapiens
agcauuucuagcagug

SEQ ID NO: 1022008 - RNA, 14 nt, Homo sapiens
agccaaacucugcc

SEQ ID NO: 1022009 - RNA, 19 nt, Homo sapiens
agccaaagauaaucucuca

SEQ ID NO: 1022010 - RNA, 23 nt, Homo sapiens
agccaaaggauaaguguccccua

SEQ ID NO: 1022011 - RNA, 16 nt, Homo sapiens
agccaaauaaaaucua

SEQ ID NO: 1022012 - RNA, 18 nt, Homo sapiens
agccaacagaugugucag

SEQ ID NO: 1022013 - RNA, 13 nt, Homo sapiens
agccaacugcugc

SEQ ID NO: 1022014 - RNA, 16 nt, Homo sapiens
agccaacuuggcuuuc

SEQ ID NO: 1022015 - RNA, 15 nt, Homo sapiens
agccaagaucccauc

SEQ ID NO: 1022016 - RNA, 13 nt, Homo sapiens
agccaaugcuguc

SEQ ID NO: 1022017 - RNA, 16 nt, Homo sapiens
agccacaaccaaaaaa

SEQ ID NO: 1022018 - RNA, 13 nt, Homo sapiens
agccacacugugg

SEQ ID NO: 1022019 - RNA, 15 nt, Homo sapiens
agccacacuguggga

SEQ ID NO: 1022020 - RNA, 15 nt, Homo sapiens
agccaccaagaggga

SEQ ID NO: 1022021 - RNA, 16 nt, Homo sapiens
agccacgaaugaauga

SEQ ID NO: 1022022 - RNA, 13 nt, Homo sapiens
agccacucuucca

SEQ ID NO: 1022023 - RNA, 15 nt, Homo sapiens
agccacugugcugaa

SEQ ID NO: 1022024 - RNA, 14 nt, Homo sapiens
agccagacuggcac

SEQ ID NO: 1022025 - RNA, 19 nt, Homo sapiens
agccagcagccagcucuca

SEQ ID NO: 1022026 - RNA, 16 nt, Homo sapiens
agccagcucugcauua

SEQ ID NO: 1022027 - RNA, 18 nt, Homo sapiens
agccagggcugucuucgu

SEQ ID NO: 1022028 - RNA, 21 nt, Homo sapiens
agccaggguggucuugaucuc

SEQ ID NO: 1022029 - RNA, 15 nt, Homo sapiens
agccagguaauguga

SEQ ID NO: 1022030 - RNA, 16 nt, Homo sapiens
agccagguaaugugaa

SEQ ID NO: 1022031 - RNA, 22 nt, Homo sapiens
agccagucuuuacagcugagca

SEQ ID NO: 1022032 - RNA, 23 nt, Homo sapiens
agccauaguggagagaacugaau

SEQ ID NO: 1022033 - RNA, 15 nt, Homo sapiens
agccaucuugaucug

SEQ ID NO: 1022034 - RNA, 21 nt, Homo sapiens
agccaugggaccaaaccuagc

SEQ ID NO: 1022035 - RNA, 19 nt, Homo sapiens
agccaugggagacacugau

SEQ ID NO: 1022036 - RNA, 15 nt, Homo sapiens
agccauuuugugaau

SEQ ID NO: 1022037 - RNA, 18 nt, Homo sapiens
agcccaagggcuccagac

SEQ ID NO: 1022038 - RNA, 14 nt, Homo sapiens
agcccagccauuac

SEQ ID NO: 1022039 - RNA, 18 nt, Homo sapiens
agcccauccagucuccca

SEQ ID NO: 1022040 - RNA, 16 nt, Homo sapiens
agcccauucauuccau

SEQ ID NO: 1022041 - RNA, 20 nt, Homo sapiens
agcccauuucuccauacgca

SEQ ID NO: 1022042 - RNA, 14 nt, Homo sapiens
agccccaauucgau

SEQ ID NO: 1022043 - RNA, 12 nt, Homo sapiens
agccccacagac

SEQ ID NO: 1022044 - RNA, 14 nt, Homo sapiens
agccccacuugaag

SEQ ID NO: 1022045 - RNA, 19 nt, Homo sapiens
agccccaggccucuguguc

SEQ ID NO: 1022046 - RNA, 14 nt, Homo sapiens
agccccauccucug

SEQ ID NO: 1022047 - RNA, 20 nt, Homo sapiens
agcccccaaguugauauuuc

SEQ ID NO: 1022048 - RNA, 21 nt, Homo sapiens
agcccccauuguggucacagg

SEQ ID NO: 1022049 - RNA, 13 nt, Homo sapiens
agcccccucggug

SEQ ID NO: 1022050 - RNA, 15 nt, Homo sapiens
agccccucacacagc

SEQ ID NO: 1022051 - RNA, 14 nt, Homo sapiens
agccccuccaaagg

SEQ ID NO: 1022052 - RNA, 23 nt, Homo sapiens
agccccuggccugugccuuccaa

SEQ ID NO: 1022053 - RNA, 16 nt, Homo sapiens
agcccgcugaguggac

SEQ ID NO: 1022054 - RNA, 19 nt, Homo sapiens
agcccggaugcuucuccau

SEQ ID NO: 1022055 - RNA, 19 nt, Homo sapiens
agcccuaaaucuagacuca

SEQ ID NO: 1022056 - RNA, 13 nt, Homo sapiens
agcccugcagcua

SEQ ID NO: 1022057 - RNA, 19 nt, Homo sapiens
agcccugcagucacagcua

SEQ ID NO: 1022058 - RNA, 12 nt, Homo sapiens
auuuucaguaua

SEQ ID NO: 1022059 - RNA, 18 nt, Homo sapiens
auuuuccccuagcuuucc

SEQ ID NO: 1022060 - RNA, 17 nt, Homo sapiens
auuuuccuccaggcaaa

SEQ ID NO: 1022061 - RNA, 21 nt, Homo sapiens
auuuuccuggugccaauuuca

SEQ ID NO: 1022062 - RNA, 19 nt, Homo sapiens
auuuucuacacauacaugu

SEQ ID NO: 1022063 - RNA, 15 nt, Homo sapiens
auuuucuagacuuuc

SEQ ID NO: 1022064 - RNA, 19 nt, Homo sapiens
auuuucuugaauggcaugc

SEQ ID NO: 1022065 - RNA, 18 nt, Homo sapiens
auuuugaaaucaugaaga

SEQ ID NO: 1022066 - RNA, 20 nt, Homo sapiens
auuuugccauaaagucaaau

SEQ ID NO: 1022067 - RNA, 21 nt, Homo sapiens
auuuugcggcauuaaagccau

SEQ ID NO: 1022068 - RNA, 15 nt, Homo sapiens
auuuuggccaaagug

SEQ ID NO: 1022069 - RNA, 17 nt, Homo sapiens
auuuugguguccuauua

SEQ ID NO: 1022070 - RNA, 14 nt, Homo sapiens
auuuuguaaucuca

SEQ ID NO: 1022071 - RNA, 19 nt, Homo sapiens
auuuuuacaguucucccaa

SEQ ID NO: 1022072 - RNA, 15 nt, Homo sapiens
auuuuuaugugcaau

SEQ ID NO: 1022073 - RNA, 22 nt, Homo sapiens
auuuuucacugccccagacaca

SEQ ID NO: 1022074 - RNA, 13 nt, Homo sapiens
auuuuuccauuuu

SEQ ID NO: 1022075 - RNA, 14 nt, Homo sapiens
auuuuugaaaccaa

SEQ ID NO: 1022076 - RNA, 19 nt, Homo sapiens
auuuuugaauacaggcaua

SEQ ID NO: 1022077 - RNA, 12 nt, Homo sapiens
auuuuugcaaug

SEQ ID NO: 1022078 - RNA, 19 nt, Homo sapiens
auuuuuguguggauaugaa

SEQ ID NO: 1022079 - RNA, 20 nt, Homo sapiens
auuuuuuaagguaacaaaua

SEQ ID NO: 1022080 - RNA, 21 nt, Homo sapiens
auuuuuuacagcugccugcag

SEQ ID NO: 1022081 - RNA, 20 nt, Homo sapiens
auuuuuuaguauaaguacau

SEQ ID NO: 1022082 - RNA, 23 nt, Homo sapiens
auuuuuucucuguaaacuuccaa

SEQ ID NO: 1022083 - RNA, 19 nt, Homo sapiens
caaaaaaaaaaaaaugcac

SEQ ID NO: 1022084 - RNA, 21 nt, Homo sapiens
caaaaaaaccucuaugcaauc

SEQ ID NO: 1022085 - RNA, 24 nt, Homo sapiens
caaaaaaauacugccagaugcuga

SEQ ID NO: 1022086 - RNA, 14 nt, Homo sapiens
caaaaaaucugacc

SEQ ID NO: 1022087 - RNA, 17 nt, Homo sapiens
caaaaaaucugaccaaa

SEQ ID NO: 1022088 - RNA, 18 nt, Homo sapiens
caaaaacaaaaaacugca

SEQ ID NO: 1022089 - RNA, 10 nt, Homo sapiens
caaaaacacc

SEQ ID NO: 1022090 - RNA, 22 nt, Homo sapiens
caaaaacauucuuacauuuuac

SEQ ID NO: 1022091 - RNA, 13 nt, Homo sapiens
caaaaaccucacc

SEQ ID NO: 1022092 - RNA, 14 nt, Homo sapiens
caaaaacuacacau

SEQ ID NO: 1022093 - RNA, 18 nt, Homo sapiens
caaaaagccuuuuccaga

SEQ ID NO: 1022094 - RNA, 21 nt, Homo sapiens
caaaaagccuuuuccagaaga

SEQ ID NO: 1022095 - RNA, 18 nt, Homo sapiens
caaaaauacucacauggc

SEQ ID NO: 1022096 - RNA, 12 nt, Homo sapiens
caaaaaugaacu

SEQ ID NO: 1022097 - RNA, 14 nt, Homo sapiens
caaaaaugaacuga

SEQ ID NO: 1022098 - RNA, 17 nt, Homo sapiens
caaaaauugucccuuaa

SEQ ID NO: 1022099 - RNA, 11 nt, Homo sapiens
caaaaccaaau

SEQ ID NO: 1022100 - RNA, 13 nt, Homo sapiens
caaaaccaaauau

SEQ ID NO: 1022101 - RNA, 22 nt, Homo sapiens
caaaaccaaauauuccagagac

SEQ ID NO: 1022102 - RNA, 18 nt, Homo sapiens
caaaaccccacuacacag

SEQ ID NO: 1022103 - RNA, 18 nt, Homo sapiens
caaaaccugauguuaaaa

SEQ ID NO: 1022104 - RNA, 22 nt, Homo sapiens
caaaacucuccuacacuuccau

SEQ ID NO: 1022105 - RNA, 17 nt, Homo sapiens
caaaacuucagacauag

SEQ ID NO: 1022106 - RNA, 22 nt, Homo sapiens
caaaagaucaaauguauucaga

SEQ ID NO: 1022107 - RNA, 13 nt, Homo sapiens
caaaagcccaaug

SEQ ID NO: 1022108 - RNA, 19 nt, Homo sapiens
caaaagcccauucauucca

SEQ ID NO: 1022109 - RNA, 21 nt, Homo sapiens
caaaagcccauucauuccauu

SEQ ID NO: 1022110 - RNA, 22 nt, Homo sapiens
caaaagcccauucauuccauuc

SEQ ID NO: 1022111 - RNA, 20 nt, Homo sapiens
caaaauaaaaaccaagaaga

SEQ ID NO: 1022112 - RNA, 20 nt, Homo sapiens
caaaauaaaaagugacacag

SEQ ID NO: 1022113 - RNA, 15 nt, Homo sapiens
caaaauauacauuca

SEQ ID NO: 1022114 - RNA, 23 nt, Homo sapiens
caaaauauauuuuaucugugauu

SEQ ID NO: 1022115 - RNA, 17 nt, Homo sapiens
caaaauuagugcuuuuu

SEQ ID NO: 1022116 - RNA, 20 nt, Homo sapiens
caaacaaagccagaagcuga

SEQ ID NO: 1022117 - RNA, 20 nt, Homo sapiens
caaacaauaguaauucucag

SEQ ID NO: 1022118 - RNA, 13 nt, Homo sapiens
caaacaccuucca

SEQ ID NO: 1022119 - RNA, 19 nt, Homo sapiens
caaaccaaccgcacaugca

SEQ ID NO: 1022120 - RNA, 17 nt, Homo sapiens
caaaccucugugagcau

SEQ ID NO: 1022121 - RNA, 19 nt, Homo sapiens
caaacgggcugcccugcca

SEQ ID NO: 1022122 - RNA, 16 nt, Homo sapiens
caaacuacauguaauc

SEQ ID NO: 1022123 - RNA, 21 nt, Homo sapiens
caaacuacuggcaauuuguaa

SEQ ID NO: 1022124 - RNA, 17 nt, Homo sapiens
caaacucacugcucaag

SEQ ID NO: 1022125 - RNA, 17 nt, Homo sapiens
caaacuccugaccucaa

SEQ ID NO: 1022126 - RNA, 15 nt, Homo sapiens
caaacucucccuuca

SEQ ID NO: 1022127 - RNA, 13 nt, Homo sapiens
caaacugagaucc

SEQ ID NO: 1022128 - RNA, 21 nt, Homo sapiens
caaacugcauauguacuucaa

SEQ ID NO: 1022129 - RNA, 12 nt, Homo sapiens
caaacugccuaa

SEQ ID NO: 1022130 - RNA, 20 nt, Homo sapiens
caaacugccuauauugauaa

SEQ ID NO: 1022131 - RNA, 11 nt, Homo sapiens
caaacugccuu

SEQ ID NO: 1022132 - RNA, 21 nt, Homo sapiens
caaacuggugugugccucauu

SEQ ID NO: 1022133 - RNA, 16 nt, Homo sapiens
caaacuucagacugaa

SEQ ID NO: 1022134 - RNA, 19 nt, Homo sapiens
caaacuugggcccuucccu

SEQ ID NO: 1022135 - RNA, 16 nt, Homo sapiens
caaagacaaaggugag

SEQ ID NO: 1022136 - RNA, 11 nt, Homo sapiens
caaagacagaa

SEQ ID NO: 1022137 - RNA, 12 nt, Homo sapiens
caaagacaugga

SEQ ID NO: 1022138 - RNA, 15 nt, Homo sapiens
caaagacuuaacugg

SEQ ID NO: 1022139 - RNA, 16 nt, Homo sapiens
caaagauaacaugcuu

SEQ ID NO: 1022140 - RNA, 23 nt, Homo sapiens
caaagaucaaaauaaaaagugac

SEQ ID NO: 1022141 - RNA, 17 nt, Homo sapiens
caaagauuugcuuuaau

SEQ ID NO: 1022142 - RNA, 19 nt, Homo sapiens
caaagcaguagucaaggag

SEQ ID NO: 1022143 - RNA, 20 nt, Homo sapiens
caaagcauaggaaggcucua

SEQ ID NO: 1022144 - RNA, 14 nt, Homo sapiens
caaagccacacucu

SEQ ID NO: 1022145 - RNA, 18 nt, Homo sapiens
caaagccuucauugccuu

SEQ ID NO: 1022146 - RNA, 18 nt, Homo sapiens
caaagccuugugucuaca

SEQ ID NO: 1022147 - RNA, 15 nt, Homo sapiens
caaagcuacuugaag

SEQ ID NO: 1022148 - RNA, 17 nt, Homo sapiens
caaagcuacuugaagga

SEQ ID NO: 1022149 - RNA, 17 nt, Homo sapiens
caaagcuuucauguaaa

SEQ ID NO: 1022150 - RNA, 20 nt, Homo sapiens
caaaggacagaguaugaaca

SEQ ID NO: 1022151 - RNA, 18 nt, Homo sapiens
caaaggacuccacccauc

SEQ ID NO: 1022152 - RNA, 17 nt, Homo sapiens
caaaggcucucacucca

SEQ ID NO: 1022153 - RNA, 18 nt, Homo sapiens
caaaggcucucacuccag

SEQ ID NO: 1022154 - RNA, 13 nt, Homo sapiens
caaaggcugagaa

SEQ ID NO: 1022155 - RNA, 16 nt, Homo sapiens
caaagggaacagugag

SEQ ID NO: 1022156 - RNA, 22 nt, Homo sapiens
caaagggggaggcuaaagccca

SEQ ID NO: 1022157 - RNA, 14 nt, Homo sapiens
caaaggugcuaaau

SEQ ID NO: 1022158 - RNA, 15 nt, Homo sapiens
caaagucaucaaaga

SEQ ID NO: 1022159 - RNA, 18 nt, Homo sapiens
caaagucugugugaugaa

SEQ ID NO: 1022160 - RNA, 18 nt, Homo sapiens
caaagugagacaguccag

SEQ ID NO: 1022161 - RNA, 15 nt, Homo sapiens
caaagugcugagauu

SEQ ID NO: 1022162 - RNA, 18 nt, Homo sapiens
caaagugcugagauuaca

SEQ ID NO: 1022163 - RNA, 22 nt, Homo sapiens
caaaguuaaaagcaaacacuua

SEQ ID NO: 1022164 - RNA, 13 nt, Homo sapiens
caaauaaaaucua

SEQ ID NO: 1022165 - RNA, 16 nt, Homo sapiens
caaauaaacaugucug

SEQ ID NO: 1022166 - RNA, 13 nt, Homo sapiens
caaauaaacucca

SEQ ID NO: 1022167 - RNA, 21 nt, Homo sapiens
caaauaaagaccugagaaccu

SEQ ID NO: 1022168 - RNA, 14 nt, Homo sapiens
caaauaauuuguau

SEQ ID NO: 1022169 - RNA, 14 nt, Homo sapiens
caaauacaauagag

SEQ ID NO: 1022170 - RNA, 17 nt, Homo sapiens
caaauacucauguguau

SEQ ID NO: 1022171 - RNA, 18 nt, Homo sapiens
caaauagaauuugagcau

SEQ ID NO: 1022172 - RNA, 21 nt, Homo sapiens
caaauaugcaaagcacugacu

SEQ ID NO: 1022173 - RNA, 16 nt, Homo sapiens
caaauauuccagagac

SEQ ID NO: 1022174 - RNA, 12 nt, Homo sapiens
caaauauuuccc

SEQ ID NO: 1022175 - RNA, 22 nt, Homo sapiens
caaaucagccaugugcugcgug

SEQ ID NO: 1022176 - RNA, 21 nt, Homo sapiens
caaaucagcugcuacuacucc

SEQ ID NO: 1022177 - RNA, 14 nt, Homo sapiens
caaauccucuccag

SEQ ID NO: 1022178 - RNA, 13 nt, Homo sapiens
caaaucucuauua

SEQ ID NO: 1022179 - RNA, 16 nt, Homo sapiens
caaaucuuaacuugaa

SEQ ID NO: 1022180 - RNA, 22 nt, Homo sapiens
caaaucuucuugauccacuucu

SEQ ID NO: 1022181 - RNA, 14 nt, Homo sapiens
caaaugacaaaaag

SEQ ID NO: 1022182 - RNA, 20 nt, Homo sapiens
caaaugcacaucucauggca

SEQ ID NO: 1022183 - RNA, 14 nt, Homo sapiens
caaaugcccagcuu

SEQ ID NO: 1022184 - RNA, 23 nt, Homo sapiens
caaaugcccuuacacuuacuguu

SEQ ID NO: 1022185 - RNA, 13 nt, Homo sapiens
caaauggacauaa

SEQ ID NO: 1022186 - RNA, 23 nt, Homo sapiens
caaaugucuaagguccccacugc

SEQ ID NO: 1022187 - RNA, 16 nt, Homo sapiens
caaauguuaugcauaa

SEQ ID NO: 1022188 - RNA, 17 nt, Homo sapiens
caaauguucaucaauga

SEQ ID NO: 1022189 - RNA, 19 nt, Homo sapiens
caaauguuuugacaugaaa

SEQ ID NO: 1022190 - RNA, 22 nt, Homo sapiens
caaauucauuuuuuucacugga

SEQ ID NO: 1022191 - RNA, 17 nt, Homo sapiens
caaauuuucacauaaaa

SEQ ID NO: 1022192 - RNA, 17 nt, Homo sapiens
caacaacaacaaaaagc

SEQ ID NO: 1022193 - RNA, 21 nt, Homo sapiens
caacaagauccuuaaugcaga

SEQ ID NO: 1022194 - RNA, 17 nt, Homo sapiens
caacaagcaagcuccca

SEQ ID NO: 1022195 - RNA, 15 nt, Homo sapiens
caacaagucuugaaa

SEQ ID NO: 1022196 - RNA, 13 nt, Homo sapiens
caacaauacaugc

SEQ ID NO: 1022197 - RNA, 17 nt, Homo sapiens
caacaauacaugcugcu

SEQ ID NO: 1022198 - RNA, 21 nt, Homo sapiens
caacaauccaucucucaagua

SEQ ID NO: 1022199 - RNA, 23 nt, Homo sapiens
caacacaagcuggaagcacaugu

SEQ ID NO: 1022200 - RNA, 13 nt, Homo sapiens
caacacacacugu

SEQ ID NO: 1022201 - RNA, 20 nt, Homo sapiens
caacacaugucuagcuuuca

SEQ ID NO: 1022202 - RNA, 22 nt, Homo sapiens
caacacugcugcuccagugcag

SEQ ID NO: 1022203 - RNA, 17 nt, Homo sapiens
caacacuguacacauaa

SEQ ID NO: 1022204 - RNA, 22 nt, Homo sapiens
caacacugugcccugguggaga

SEQ ID NO: 1022205 - RNA, 19 nt, Homo sapiens
caacacuguuacuuucgua

SEQ ID NO: 1022206 - RNA, 13 nt, Homo sapiens
caaccaaauggag

SEQ ID NO: 1022207 - RNA, 21 nt, Homo sapiens
caaccacuguaaaaugaaauu

SEQ ID NO: 1022208 - RNA, 14 nt, Homo sapiens
caaccccaccacuu

SEQ ID NO: 1022209 - RNA, 20 nt, Homo sapiens
caacccucucaggugaccaa

SEQ ID NO: 1022210 - RNA, 19 nt, Homo sapiens
caaccgaguggcugucauc

SEQ ID NO: 1022211 - RNA, 18 nt, Homo sapiens
caaccggucacccaggag

SEQ ID NO: 1022212 - RNA, 20 nt, Homo sapiens
caaccuaagggcccaaaggc

SEQ ID NO: 1022213 - RNA, 15 nt, Homo sapiens
caaccuccacauguu

SEQ ID NO: 1022214 - RNA, 19 nt, Homo sapiens
caaccugccaccaaaagaa

SEQ ID NO: 1022215 - RNA, 18 nt, Homo sapiens
caaccugccugacauuug

SEQ ID NO: 1022216 - RNA, 18 nt, Homo sapiens
caaccuggguccaaauaa

SEQ ID NO: 1022217 - RNA, 14 nt, Homo sapiens
caaccuucgccucc

SEQ ID NO: 1022218 - RNA, 15 nt, Homo sapiens
caacgcuuaaaggug

SEQ ID NO: 1022219 - RNA, 21 nt, Homo sapiens
caacgcuuaaaggugucuucc

SEQ ID NO: 1022220 - RNA, 22 nt, Homo sapiens
caacguagcuucuaccaugaac

SEQ ID NO: 1022221 - RNA, 16 nt, Homo sapiens
caacguggcccagaga

SEQ ID NO: 1022222 - RNA, 14 nt, Homo sapiens
caacuaaugccuua

SEQ ID NO: 1022223 - RNA, 13 nt, Homo sapiens
caacuagacauuc

SEQ ID NO: 1022224 - RNA, 18 nt, Homo sapiens
caacuagacauucugucg

SEQ ID NO: 1022225 - RNA, 21 nt, Homo sapiens
caacuagggagugagugcaaa

SEQ ID NO: 1022226 - RNA, 18 nt, Homo sapiens
caacucugagaucuaagg

SEQ ID NO: 1022227 - RNA, 19 nt, Homo sapiens
caacugaauaaauaccucu

SEQ ID NO: 1022228 - RNA, 10 nt, Homo sapiens
caacugacca

SEQ ID NO: 1022229 - RNA, 23 nt, Homo sapiens
caacugcugcugugcacauuuau

SEQ ID NO: 1022230 - RNA, 14 nt, Homo sapiens
caacuucagcagua

SEQ ID NO: 1022231 - RNA, 12 nt, Homo sapiens
caacuuucugua

SEQ ID NO: 1022232 - RNA, 14 nt, Homo sapiens
caacuuuugugcuc

SEQ ID NO: 1022233 - RNA, 20 nt, Homo sapiens
caacuuuuuaccuaguacaa

SEQ ID NO: 1022234 - RNA, 22 nt, Homo sapiens
caagaaucagucuauccacaga

SEQ ID NO: 1022235 - RNA, 20 nt, Homo sapiens
caagacauuaaaucuaugaa

SEQ ID NO: 1022236 - RNA, 16 nt, Homo sapiens
caagaccacguuucua

SEQ ID NO: 1022237 - RNA, 19 nt, Homo sapiens
caagacucugucucaaaaa

SEQ ID NO: 1022238 - RNA, 16 nt, Homo sapiens
caagagcacacuuggc

SEQ ID NO: 1022239 - RNA, 15 nt, Homo sapiens
caagagcuuacauaa

SEQ ID NO: 1022240 - RNA, 17 nt, Homo sapiens
caagauacagccugcaa

SEQ ID NO: 1022241 - RNA, 18 nt, Homo sapiens
caagaucacgccauugca

SEQ ID NO: 1022242 - RNA, 20 nt, Homo sapiens
caagaucacgccauugcacu

SEQ ID NO: 1022243 - RNA, 15 nt, Homo sapiens
caagaucauagcuca

SEQ ID NO: 1022244 - RNA, 17 nt, Homo sapiens
caagauccuuaaugcag

SEQ ID NO: 1022245 - RNA, 18 nt, Homo sapiens
caagauccuuaaugcaga

SEQ ID NO: 1022246 - RNA, 17 nt, Homo sapiens
caagaugcgcacugcau

SEQ ID NO: 1022247 - RNA, 19 nt, Homo sapiens
caagaugcgcacugcauuc

SEQ ID NO: 1022248 - RNA, 18 nt, Homo sapiens
caagaugugggcagugau

SEQ ID NO: 1022249 - RNA, 19 nt, Homo sapiens
caagcaagcucccaaggga

SEQ ID NO: 1022250 - RNA, 14 nt, Homo sapiens
caagcaaggccaaa

SEQ ID NO: 1022251 - RNA, 17 nt, Homo sapiens
caagcaauuauugugcc

SEQ ID NO: 1022252 - RNA, 21 nt, Homo sapiens
caagcaauucuccugccucag

SEQ ID NO: 1022253 - RNA, 15 nt, Homo sapiens
caagcaggaagcuca

SEQ ID NO: 1022254 - RNA, 20 nt, Homo sapiens
caagcauuucuagcagugau

SEQ ID NO: 1022255 - RNA, 18 nt, Homo sapiens
caagccacagaagccagg

SEQ ID NO: 1022256 - RNA, 18 nt, Homo sapiens
caagccacgaaugaauga

SEQ ID NO: 1022257 - RNA, 16 nt, Homo sapiens
caagccccacuuauuc

SEQ ID NO: 1022258 - RNA, 14 nt, Homo sapiens
caagccccugccca

SEQ ID NO: 1022259 - RNA, 16 nt, Homo sapiens
caagccccugcuccag

SEQ ID NO: 1022260 - RNA, 17 nt, Homo sapiens
caagcccugcagucaca

SEQ ID NO: 1022261 - RNA, 15 nt, Homo sapiens
caagccuacaugaca

SEQ ID NO: 1022262 - RNA, 18 nt, Homo sapiens
caagccuacaugacacag

SEQ ID NO: 1022263 - RNA, 20 nt, Homo sapiens
caagccuagcccuucucuca

SEQ ID NO: 1022264 - RNA, 23 nt, Homo sapiens
caagcucaaagcguggacaggug

SEQ ID NO: 1022265 - RNA, 15 nt, Homo sapiens
caagcucccaaggga

SEQ ID NO: 1022266 - RNA, 22 nt, Homo sapiens
caagcucuguccaaucagguag

SEQ ID NO: 1022267 - RNA, 21 nt, Homo sapiens
caagcugugacuucuccaggu

SEQ ID NO: 1022268 - RNA, 19 nt, Homo sapiens
caagcuuuucaaaauugga

SEQ ID NO: 1022269 - RNA, 16 nt, Homo sapiens
caaggaaaccacagcu

SEQ ID NO: 1022270 - RNA, 23 nt, Homo sapiens
caaggaagccucggcagaugugg

SEQ ID NO: 1022271 - RNA, 21 nt, Homo sapiens
caaggauggaugcagauccag

SEQ ID NO: 1022272 - RNA, 22 nt, Homo sapiens
caaggcccauaucugugaaaug

SEQ ID NO: 1022273 - RNA, 17 nt, Homo sapiens
caaggcugaccaagaga

SEQ ID NO: 1022274 - RNA, 14 nt, Homo sapiens
caaggcugcaguga

SEQ ID NO: 1022275 - RNA, 17 nt, Homo sapiens
caaggcuggagugcagu

SEQ ID NO: 1022276 - RNA, 19 nt, Homo sapiens
caaggcuggagugcagugg

SEQ ID NO: 1022277 - RNA, 19 nt, Homo sapiens
caaggcuggcagugacaga

SEQ ID NO: 1022278 - RNA, 16 nt, Homo sapiens
caaggcugugcucccu

SEQ ID NO: 1022279 - RNA, 14 nt, Homo sapiens
caagggaugucuca

SEQ ID NO: 1022280 - RNA, 21 nt, Homo sapiens
caagggcuuuguuuugcacac

SEQ ID NO: 1022281 - RNA, 19 nt, Homo sapiens
caagggggacugucuuuca

SEQ ID NO: 1022282 - RNA, 20 nt, Homo sapiens
caagggggacugucuuucag

SEQ ID NO: 1022283 - RNA, 13 nt, Homo sapiens
caagguccaagau

SEQ ID NO: 1022284 - RNA, 19 nt, Homo sapiens
caaggugggccuugcuacc

SEQ ID NO: 1022285 - RNA, 17 nt, Homo sapiens
caaguaagaagacauga

SEQ ID NO: 1022286 - RNA, 17 nt, Homo sapiens
caaguacuguaacugug

SEQ ID NO: 1022287 - RNA, 18 nt, Homo sapiens
caaguagggggucuaaaa

SEQ ID NO: 1022288 - RNA, 19 nt, Homo sapiens
caaguauuaacagcacaag

SEQ ID NO: 1022289 - RNA, 12 nt, Homo sapiens
caagucaggaca

SEQ ID NO: 1022290 - RNA, 22 nt, Homo sapiens
caaguccagauuuacacuggga

SEQ ID NO: 1022291 - RNA, 19 nt, Homo sapiens
caagucuucccugaucaag

SEQ ID NO: 1022292 - RNA, 19 nt, Homo sapiens
caagucuugaaacaagcaa

SEQ ID NO: 1022293 - RNA, 22 nt, Homo sapiens
caagugaagaaaagugaaugcu

SEQ ID NO: 1022294 - RNA, 15 nt, Homo sapiens
caagugccuuagcaa

SEQ ID NO: 1022295 - RNA, 16 nt, Homo sapiens
caagugggaucuguca

SEQ ID NO: 1022296 - RNA, 22 nt, Homo sapiens
caaguguaaaauauuuugaauc

SEQ ID NO: 1022297 - RNA, 18 nt, Homo sapiens
caaguguagguaucauuu

SEQ ID NO: 1022298 - RNA, 20 nt, Homo sapiens
caaguguaugcacgugugca

SEQ ID NO: 1022299 - RNA, 22 nt, Homo sapiens
caaguguaugcacgugugcaca

SEQ ID NO: 1022300 - RNA, 13 nt, Homo sapiens
caagugucugugu

SEQ ID NO: 1022301 - RNA, 16 nt, Homo sapiens
caagugugugcacaug

SEQ ID NO: 1022302 - RNA, 13 nt, Homo sapiens
caagugugugcau

SEQ ID NO: 1022303 - RNA, 22 nt, Homo sapiens
caagugugugcaugugugcgag

SEQ ID NO: 1022304 - RNA, 21 nt, Homo sapiens
caaguuagaaaacauaaucuu

SEQ ID NO: 1022305 - RNA, 15 nt, Homo sapiens
caaguucucaccucu

SEQ ID NO: 1022306 - RNA, 14 nt, Homo sapiens
caaguugauauuuc

SEQ ID NO: 1022307 - RNA, 20 nt, Homo sapiens
caaguuggcuucuaaucaaa

SEQ ID NO: 1022308 - RNA, 16 nt, Homo sapiens
caaguuguguuugaua

SEQ ID NO: 1022309 - RNA, 12 nt, Homo sapiens
caaguuugucac

SEQ ID NO: 1022310 - RNA, 19 nt, Homo sapiens
caauaaagaccacuuuaca

SEQ ID NO: 1022311 - RNA, 17 nt, Homo sapiens
caauaaauaaucuguac

SEQ ID NO: 1022312 - RNA, 21 nt, Homo sapiens
caauaaauauuuuugcuguag

SEQ ID NO: 1022313 - RNA, 15 nt, Homo sapiens
caauaaauuuugcca

SEQ ID NO: 1022314 - RNA, 18 nt, Homo sapiens
caauaacuacuguguucc

SEQ ID NO: 1022315 - RNA, 23 nt, Homo sapiens
caauacaaaaauaccuacugcug

SEQ ID NO: 1022316 - RNA, 12 nt, Homo sapiens
caauacccaaau

SEQ ID NO: 1022317 - RNA, 14 nt, Homo sapiens
caauagauauuuac

SEQ ID NO: 1022318 - RNA, 15 nt, Homo sapiens
caauaggcauuugau

SEQ ID NO: 1022319 - RNA, 18 nt, Homo sapiens
caauaugaugacucccuu

SEQ ID NO: 1022320 - RNA, 16 nt, Homo sapiens
caauauuaaauacaga

SEQ ID NO: 1022321 - RNA, 21 nt, Homo sapiens
caauauuaaauacagacacua

SEQ ID NO: 1022322 - RNA, 18 nt, Homo sapiens
caauauuuccucauguga

SEQ ID NO: 1022323 - RNA, 15 nt, Homo sapiens
caaucaaagcacuug

SEQ ID NO: 1022324 - RNA, 19 nt, Homo sapiens
caaucaaaugguguuuucu

SEQ ID NO: 1022325 - RNA, 12 nt, Homo sapiens
caaucacacuga

SEQ ID NO: 1022326 - RNA, 15 nt, Homo sapiens
caaucagagagcuca

SEQ ID NO: 1022327 - RNA, 16 nt, Homo sapiens
caaucagaucaacucu

SEQ ID NO: 1022328 - RNA, 21 nt, Homo sapiens
caaucaggguuuuuagauuaa

SEQ ID NO: 1022329 - RNA, 13 nt, Homo sapiens
caaucauagccaa

SEQ ID NO: 1022330 - RNA, 19 nt, Homo sapiens
caaucaucaucauucucau

SEQ ID NO: 1022331 - RNA, 16 nt, Homo sapiens
caauccagcuauguua

SEQ ID NO: 1022332 - RNA, 13 nt, Homo sapiens
caauccuauguuu

SEQ ID NO: 1022333 - RNA, 18 nt, Homo sapiens
caaucucugauucuguca

SEQ ID NO: 1022334 - RNA, 21 nt, Homo sapiens
caaucuguguucgauggcuca

SEQ ID NO: 1022335 - RNA, 14 nt, Homo sapiens
caaugaaaugcucu

SEQ ID NO: 1022336 - RNA, 14 nt, Homo sapiens
caaugaacacuuaa

SEQ ID NO: 1022337 - RNA, 17 nt, Homo sapiens
caaugaacccccaugau

SEQ ID NO: 1022338 - RNA, 16 nt, Homo sapiens
caaugaagucucugaa

SEQ ID NO: 1022339 - RNA, 21 nt, Homo sapiens
caaugacauuuauaucacaug

SEQ ID NO: 1022340 - RNA, 16 nt, Homo sapiens
caaugacuuacuguac

SEQ ID NO: 1022341 - RNA, 13 nt, Homo sapiens
caaugaucuaggu

SEQ ID NO: 1022342 - RNA, 21 nt, Homo sapiens
caaugaucuagguuuaacuca

SEQ ID NO: 1022343 - RNA, 15 nt, Homo sapiens
caaugcaaaguacau

SEQ ID NO: 1022344 - RNA, 17 nt, Homo sapiens
caaugcaaaguacaugu

SEQ ID NO: 1022345 - RNA, 15 nt, Homo sapiens
caaugcacacaaaac

SEQ ID NO: 1022346 - RNA, 23 nt, Homo sapiens
caaugccccuggaucuaccagca

SEQ ID NO: 1022347 - RNA, 21 nt, Homo sapiens
caaugcugcaggucaacagcu

SEQ ID NO: 1022348 - RNA, 17 nt, Homo sapiens
caaugcuggacacuaca

SEQ ID NO: 1022349 - RNA, 18 nt, Homo sapiens
caaugcuggcuuucuccc

SEQ ID NO: 1022350 - RNA, 19 nt, Homo sapiens
caauggccuuuaucaucua

SEQ ID NO: 1022351 - RNA, 20 nt, Homo sapiens
caauggcugcugaagcugcc

SEQ ID NO: 1022352 - RNA, 17 nt, Homo sapiens
caaugguuaacaucuuc

SEQ ID NO: 1022353 - RNA, 14 nt, Homo sapiens
caauguuagccaca

SEQ ID NO: 1022354 - RNA, 21 nt, Homo sapiens
caauuagcaauugacugucac

SEQ ID NO: 1022355 - RNA, 22 nt, Homo sapiens
caauuauagaguaucacuccca

SEQ ID NO: 1022356 - RNA, 23 nt, Homo sapiens
caauuauaucaguccucuuucaa

SEQ ID NO: 1022357 - RNA, 17 nt, Homo sapiens
caauuccaaagccagac

SEQ ID NO: 1022358 - RNA, 14 nt, Homo sapiens
caauuccgcauuua

SEQ ID NO: 1022359 - RNA, 13 nt, Homo sapiens
caauuccucuggg

SEQ ID NO: 1022360 - RNA, 14 nt, Homo sapiens
caauuccugugauu

SEQ ID NO: 1022361 - RNA, 20 nt, Homo sapiens
caauucucaaaagaaaaggc

SEQ ID NO: 1022362 - RNA, 16 nt, Homo sapiens
caauucuccugccuca

SEQ ID NO: 1022363 - RNA, 17 nt, Homo sapiens
caauucuccugccucag

SEQ ID NO: 1022364 - RNA, 20 nt, Homo sapiens
caauucuguuuuagguuaaa

SEQ ID NO: 1022365 - RNA, 13 nt, Homo sapiens
caauucuucuucc

SEQ ID NO: 1022366 - RNA, 14 nt, Homo sapiens
caauucuuuauaca

SEQ ID NO: 1022367 - RNA, 22 nt, Homo sapiens
caauuguugacaguucugaaga

SEQ ID NO: 1022368 - RNA, 18 nt, Homo sapiens
caauuugccauuguuucu

SEQ ID NO: 1022369 - RNA, 18 nt, Homo sapiens
cacaaaaagaugcaucua

SEQ ID NO: 1022370 - RNA, 21 nt, Homo sapiens
cacaaaaguccacugaugcaa

SEQ ID NO: 1022371 - RNA, 14 nt, Homo sapiens
cacaaaauugggaa

SEQ ID NO: 1022372 - RNA, 18 nt, Homo sapiens
cacaaagcccuuccaugu

SEQ ID NO: 1022373 - RNA, 14 nt, Homo sapiens
cacaaaucuuaacu

SEQ ID NO: 1022374 - RNA, 18 nt, Homo sapiens
cacaaauuuguaaacuuu

SEQ ID NO: 1022375 - RNA, 13 nt, Homo sapiens
cacaacugcaguc

SEQ ID NO: 1022376 - RNA, 22 nt, Homo sapiens
cacaagaagaccagacugugga

SEQ ID NO: 1022377 - RNA, 13 nt, Homo sapiens
cacaagaccaucu

SEQ ID NO: 1022378 - RNA, 22 nt, Homo sapiens
cacaagauggaaaucacauuua

SEQ ID NO: 1022379 - RNA, 15 nt, Homo sapiens
cacaagccacagaag

SEQ ID NO: 1022380 - RNA, 18 nt, Homo sapiens
cacaagcuggaagcacau

SEQ ID NO: 1022381 - RNA, 20 nt, Homo sapiens
cacaagcuuuuuuacacaaa

SEQ ID NO: 1022382 - RNA, 23 nt, Homo sapiens
cacaaggggaaggguacugaaaa

SEQ ID NO: 1022383 - RNA, 20 nt, Homo sapiens
cacaauaaaggcugagcucu

SEQ ID NO: 1022384 - RNA, 12 nt, Homo sapiens
cacaauacuguu

SEQ ID NO: 1022385 - RNA, 14 nt, Homo sapiens
cacacagacagggu

SEQ ID NO: 1022386 - RNA, 16 nt, Homo sapiens
cacacagacaggguuu

SEQ ID NO: 1022387 - RNA, 20 nt, Homo sapiens
cacacagcaagucaggguug

SEQ ID NO: 1022388 - RNA, 22 nt, Homo sapiens
cacacauccccuuuguguagaa

SEQ ID NO: 1022389 - RNA, 14 nt, Homo sapiens
cacacaucucauuu

SEQ ID NO: 1022390 - RNA, 12 nt, Homo sapiens
cacaccaucucc

SEQ ID NO: 1022391 - RNA, 15 nt, Homo sapiens
cacaccaucuuucca

SEQ ID NO: 1022392 - RNA, 14 nt, Homo sapiens
cacaccauucaggu

SEQ ID NO: 1022393 - RNA, 14 nt, Homo sapiens
cacaccauugcacu

SEQ ID NO: 1022394 - RNA, 20 nt, Homo sapiens
cacacccuggaggauuucau

SEQ ID NO: 1022395 - RNA, 19 nt, Homo sapiens
cacaccuagcgucaguauu

SEQ ID NO: 1022396 - RNA, 14 nt, Homo sapiens
cacacgcgugcaca

SEQ ID NO: 1022397 - RNA, 21 nt, Homo sapiens
cacacgucuggcuucacagau

SEQ ID NO: 1022398 - RNA, 15 nt, Homo sapiens
cacacucacagaugu

SEQ ID NO: 1022399 - RNA, 16 nt, Homo sapiens
cacacuccauggaguc

SEQ ID NO: 1022400 - RNA, 22 nt, Homo sapiens
cacacuccccugcacuggaguc

SEQ ID NO: 1022401 - RNA, 19 nt, Homo sapiens
cacacucuccaaacaguca

SEQ ID NO: 1022402 - RNA, 18 nt, Homo sapiens
cacacugaggaacucaca

SEQ ID NO: 1022403 - RNA, 15 nt, Homo sapiens
cacacuggugacugc

SEQ ID NO: 1022404 - RNA, 15 nt, Homo sapiens
cacacuguacucugc

SEQ ID NO: 1022405 - RNA, 20 nt, Homo sapiens
cacacuuggaugcaggguuu

SEQ ID NO: 1022406 - RNA, 22 nt, Homo sapiens
cacagacacacacacgcacgca

SEQ ID NO: 1022407 - RNA, 13 nt, Homo sapiens
cacagagacauuc

SEQ ID NO: 1022408 - RNA, 20 nt, Homo sapiens
cacagagagucccacugccu

SEQ ID NO: 1022409 - RNA, 14 nt, Homo sapiens
cacagagugcauug

SEQ ID NO: 1022410 - RNA, 23 nt, Homo sapiens
cacagagugcauugugaggguua

SEQ ID NO: 1022411 - RNA, 15 nt, Homo sapiens
cacagaucacagcuu

SEQ ID NO: 1022412 - RNA, 20 nt, Homo sapiens
cacagaucugcuugaucaau

SEQ ID NO: 1022413 - RNA, 15 nt, Homo sapiens
cacagcagcugaaca

SEQ ID NO: 1022414 - RNA, 20 nt, Homo sapiens
cacagcagcugaacagccaa

SEQ ID NO: 1022415 - RNA, 18 nt, Homo sapiens
cacagcauguguauuucc

SEQ ID NO: 1022416 - RNA, 20 nt, Homo sapiens
cacagccacacacacagaaa

SEQ ID NO: 1022417 - RNA, 23 nt, Homo sapiens
cacagccgcagccucccucugac

SEQ ID NO: 1022418 - RNA, 20 nt, Homo sapiens
cacagccuccucugucugcc

SEQ ID NO: 1022419 - RNA, 14 nt, Homo sapiens
cacagcguccuguc

SEQ ID NO: 1022420 - RNA, 15 nt, Homo sapiens
cacagcuacacagau

SEQ ID NO: 1022421 - RNA, 20 nt, Homo sapiens
cacagcuucauuuccugugu

SEQ ID NO: 1022422 - RNA, 19 nt, Homo sapiens
cacaggaagccugcagucc

SEQ ID NO: 1022423 - RNA, 18 nt, Homo sapiens
cacaggauccuauucuca

SEQ ID NO: 1022424 - RNA, 22 nt, Homo sapiens
cacaggaugaaggcaaugccau

SEQ ID NO: 1022425 - RNA, 22 nt, Homo sapiens
cacaggcagcauuuagcacaua

SEQ ID NO: 1022426 - RNA, 22 nt, Homo sapiens
cacaggcagcuggaugagacuu

SEQ ID NO: 1022427 - RNA, 17 nt, Homo sapiens
cacagggccaacuugag

SEQ ID NO: 1022428 - RNA, 14 nt, Homo sapiens
cacagggucugcac

SEQ ID NO: 1022429 - RNA, 16 nt, Homo sapiens
cacagggucugcacuc

SEQ ID NO: 1022430 - RNA, 16 nt, Homo sapiens
cacagguucaugccac

SEQ ID NO: 1022431 - RNA, 15 nt, Homo sapiens
cacaguggcuucaca

SEQ ID NO: 1022432 - RNA, 12 nt, Homo sapiens
cacagugugaau

SEQ ID NO: 1022433 - RNA, 16 nt, Homo sapiens
cacaguuggauuuauu

SEQ ID NO: 1022434 - RNA, 22 nt, Homo sapiens
cacauaguagguacccaauuca

SEQ ID NO: 1022435 - RNA, 13 nt, Homo sapiens
cacauaugcaccu

SEQ ID NO: 1022436 - RNA, 22 nt, Homo sapiens
cacaucaagcgaugaaacugga

SEQ ID NO: 1022437 - RNA, 22 nt, Homo sapiens
cacauccaaccccccaccugcc

SEQ ID NO: 1022438 - RNA, 20 nt, Homo sapiens
cacauccucugucuauuuga

SEQ ID NO: 1022439 - RNA, 22 nt, Homo sapiens
cacaucuccuguggucucugac

SEQ ID NO: 1022440 - RNA, 13 nt, Homo sapiens
cacaucugcauuu

SEQ ID NO: 1022441 - RNA, 19 nt, Homo sapiens
cacaugaccacauagcaug

SEQ ID NO: 1022442 - RNA, 21 nt, Homo sapiens
cacaugauaccucugaucaag

SEQ ID NO: 1022443 - RNA, 17 nt, Homo sapiens
cacaugcaaggucauuu

SEQ ID NO: 1022444 - RNA, 23 nt, Homo sapiens
cacaugcacacacacacaucuca

SEQ ID NO: 1022445 - RNA, 15 nt, Homo sapiens
cacaugcuacaagac

SEQ ID NO: 1022446 - RNA, 17 nt, Homo sapiens
cacaugcucaaugacuc

SEQ ID NO: 1022447 - RNA, 15 nt, Homo sapiens
cacauggccuaugca

SEQ ID NO: 1022448 - RNA, 15 nt, Homo sapiens
cacaugugacacaua

SEQ ID NO: 1022449 - RNA, 19 nt, Homo sapiens
cacaugugacacauaugca

SEQ ID NO: 1022450 - RNA, 20 nt, Homo sapiens
cacaugugacacauaugcac

SEQ ID NO: 1022451 - RNA, 16 nt, Homo sapiens
cacaugugcacaugca

SEQ ID NO: 1022452 - RNA, 19 nt, Homo sapiens
cacauguucaacuauuaau

SEQ ID NO: 1022453 - RNA, 20 nt, Homo sapiens
cacauuaucgggagcagugu

SEQ ID NO: 1022454 - RNA, 21 nt, Homo sapiens
cacauuccaagccucaugucc

SEQ ID NO: 1022455 - RNA, 17 nt, Homo sapiens
cacauucccaucuguca

SEQ ID NO: 1022456 - RNA, 19 nt, Homo sapiens
cacauucuaaaggcuugau

SEQ ID NO: 1022457 - RNA, 24 nt, Homo sapiens
cacauucuuauuaggauuccaccu

SEQ ID NO: 1022458 - RNA, 17 nt, Homo sapiens
cacauuuuucagauaua

SEQ ID NO: 1022459 - RNA, 13 nt, Homo sapiens
caccaaagccacc

SEQ ID NO: 1022460 - RNA, 23 nt, Homo sapiens
caccaaaucagcugcuacuacuc

SEQ ID NO: 1022461 - RNA, 21 nt, Homo sapiens
caccaagcucuguccaaucag

SEQ ID NO: 1022462 - RNA, 14 nt, Homo sapiens
caccacagacacac

SEQ ID NO: 1022463 - RNA, 17 nt, Homo sapiens
caccacaucucuaucug

SEQ ID NO: 1022464 - RNA, 18 nt, Homo sapiens
caccacggccucacccag

SEQ ID NO: 1022465 - RNA, 20 nt, Homo sapiens
caccacgguggucacuggaa

SEQ ID NO: 1022466 - RNA, 20 nt, Homo sapiens
caccagagauaauaugagaa

SEQ ID NO: 1022467 - RNA, 23 nt, Homo sapiens
caccagaggcugcagaaggccaa

SEQ ID NO: 1022468 - RNA, 21 nt, Homo sapiens
caccagaggucagguguucaa

SEQ ID NO: 1022469 - RNA, 16 nt, Homo sapiens
caccauaaaaaggaau

SEQ ID NO: 1022470 - RNA, 20 nt, Homo sapiens
caccauacacacuguuguca

SEQ ID NO: 1022471 - RNA, 22 nt, Homo sapiens
caccauauuaccacagacauac

SEQ ID NO: 1022472 - RNA, 18 nt, Homo sapiens
caccaucaccagacaggu

SEQ ID NO: 1022473 - RNA, 18 nt, Homo sapiens
caccaucagucaaugaau

SEQ ID NO: 1022474 - RNA, 23 nt, Homo sapiens
caccaucagucaaugaauaacag

SEQ ID NO: 1022475 - RNA, 18 nt, Homo sapiens
caccaucucuuuaccucc

SEQ ID NO: 1022476 - RNA, 20 nt, Homo sapiens
caccauguacauagcuugau

SEQ ID NO: 1022477 - RNA, 19 nt, Homo sapiens
caccauguuggccaggcug

SEQ ID NO: 1022478 - RNA, 16 nt, Homo sapiens
caccauuuguauccac

SEQ ID NO: 1022479 - RNA, 14 nt, Homo sapiens
cacccacccaggag

SEQ ID NO: 1022480 - RNA, 17 nt, Homo sapiens
cacccaccuaugugcca

SEQ ID NO: 1022481 - RNA, 18 nt, Homo sapiens
cacccaccuaugugccaa

SEQ ID NO: 1022482 - RNA, 15 nt, Homo sapiens
cacccagccuggauc

SEQ ID NO: 1022483 - RNA, 20 nt, Homo sapiens
cacccaggcuggagugcaau

SEQ ID NO: 1022484 - RNA, 20 nt, Homo sapiens
cacccaggcuggagugcagu

SEQ ID NO: 1022485 - RNA, 17 nt, Homo sapiens
cacccagugaaagccca

SEQ ID NO: 1022486 - RNA, 20 nt, Homo sapiens
cacccaucuguuuuuuguaa

SEQ ID NO: 1022487 - RNA, 14 nt, Homo sapiens
cacccaugugccaa

SEQ ID NO: 1022488 - RNA, 14 nt, Homo sapiens
cacccccagcucaa

SEQ ID NO: 1022489 - RNA, 21 nt, Homo sapiens
aagagaaucaacauuucucaa

SEQ ID NO: 1022490 - RNA, 14 nt, Homo sapiens
aagagaaugucuga

SEQ ID NO: 1022491 - RNA, 23 nt, Homo sapiens
aagagaccuaccucagguugcug

SEQ ID NO: 1022492 - RNA, 19 nt, Homo sapiens
aagagacuggagcaucuga

SEQ ID NO: 1022493 - RNA, 21 nt, Homo sapiens
aagagagaacaacuacuguga

SEQ ID NO: 1022494 - RNA, 23 nt, Homo sapiens
aagagagucgcaucucagugcag

SEQ ID NO: 1022495 - RNA, 13 nt, Homo sapiens
aagagcaacaauc

SEQ ID NO: 1022496 - RNA, 20 nt, Homo sapiens
aagagccauauaaguuugaa

SEQ ID NO: 1022497 - RNA, 22 nt, Homo sapiens
aagagcuggcaaagguggcucu

SEQ ID NO: 1022498 - RNA, 16 nt, Homo sapiens
aagaggcagcuugaaa

SEQ ID NO: 1022499 - RNA, 20 nt, Homo sapiens
aagagggagggagggcucca

SEQ ID NO: 1022500 - RNA, 18 nt, Homo sapiens
aagagggcacacacugug

SEQ ID NO: 1022501 - RNA, 23 nt, Homo sapiens
aagaggguccuuuaguaccugaa

SEQ ID NO: 1022502 - RNA, 20 nt, Homo sapiens
aagagggugauugcuggggc

SEQ ID NO: 1022503 - RNA, 13 nt, Homo sapiens
aagaggugggagc

SEQ ID NO: 1022504 - RNA, 18 nt, Homo sapiens
aagaguaggaagacuuug

SEQ ID NO: 1022505 - RNA, 19 nt, Homo sapiens
aagaguaggaagacuuugg

SEQ ID NO: 1022506 - RNA, 18 nt, Homo sapiens
aagaguccucugaaugaa

SEQ ID NO: 1022507 - RNA, 19 nt, Homo sapiens
aagagugccguaacaacug

SEQ ID NO: 1022508 - RNA, 14 nt, Homo sapiens
aagaguuacuuaau

SEQ ID NO: 1022509 - RNA, 21 nt, Homo sapiens
aagaguucuuaaggauuguga

SEQ ID NO: 1022510 - RNA, 15 nt, Homo sapiens
aagauaacugagaau

SEQ ID NO: 1022511 - RNA, 17 nt, Homo sapiens
aagauagcuucacccca

SEQ ID NO: 1022512 - RNA, 20 nt, Homo sapiens
aagauauaugacugcuucau

SEQ ID NO: 1022513 - RNA, 13 nt, Homo sapiens
aagauauggacac

SEQ ID NO: 1022514 - RNA, 23 nt, Homo sapiens
aagaucaaaagcuuauucaucug

SEQ ID NO: 1022515 - RNA, 20 nt, Homo sapiens
aagaucacgccauugcacuc

SEQ ID NO: 1022516 - RNA, 23 nt, Homo sapiens
aagaucacgccauugcacuccag

SEQ ID NO: 1022517 - RNA, 18 nt, Homo sapiens
aagaucccaucucuccau

SEQ ID NO: 1022518 - RNA, 20 nt, Homo sapiens
aagaucgcgccacugcacuc

SEQ ID NO: 1022519 - RNA, 24 nt, Homo sapiens
aagaucuuucaggacucuaccuca

SEQ ID NO: 1022520 - RNA, 17 nt, Homo sapiens
aagaugaagacaacagc

SEQ ID NO: 1022521 - RNA, 23 nt, Homo sapiens
aagaugaccuuugucucaccuca

SEQ ID NO: 1022522 - RNA, 18 nt, Homo sapiens
aagaugagggcgcaagaa

SEQ ID NO: 1022523 - RNA, 14 nt, Homo sapiens
aagaugaucaucuc

SEQ ID NO: 1022524 - RNA, 17 nt, Homo sapiens
aagaugaugaugaucuu

SEQ ID NO: 1022525 - RNA, 16 nt, Homo sapiens
aagaugaugcuauuaa

SEQ ID NO: 1022526 - RNA, 20 nt, Homo sapiens
aagauggcacuuauaaccaa

SEQ ID NO: 1022527 - RNA, 19 nt, Homo sapiens
aagauggcauccugugaag

SEQ ID NO: 1022528 - RNA, 18 nt, Homo sapiens
aagauggcuuuuucuccu

SEQ ID NO: 1022529 - RNA, 22 nt, Homo sapiens
aagauguagaggagaaacugga

SEQ ID NO: 1022530 - RNA, 12 nt, Homo sapiens
aagauuacuuuu

SEQ ID NO: 1022531 - RNA, 15 nt, Homo sapiens
aagauuaugaucuca

SEQ ID NO: 1022532 - RNA, 16 nt, Homo sapiens
aagauuuuaugcugcu

SEQ ID NO: 1022533 - RNA, 16 nt, Homo sapiens
aagcaaaaugugauau

SEQ ID NO: 1022534 - RNA, 19 nt, Homo sapiens
aagcaaaauuauguuugcc

SEQ ID NO: 1022535 - RNA, 19 nt, Homo sapiens
aagcaacuguuaugaaaua

SEQ ID NO: 1022536 - RNA, 13 nt, Homo sapiens
aagcaaggccaaa

SEQ ID NO: 1022537 - RNA, 18 nt, Homo sapiens
aagcaaggcuuuaaauga

SEQ ID NO: 1022538 - RNA, 20 nt, Homo sapiens
aagcacaggugggcuuccca

SEQ ID NO: 1022539 - RNA, 11 nt, Homo sapiens
aagcacugugc

SEQ ID NO: 1022540 - RNA, 13 nt, Homo sapiens
aagcacuguucca

SEQ ID NO: 1022541 - RNA, 15 nt, Homo sapiens
aagcagaacagugau

SEQ ID NO: 1022542 - RNA, 17 nt, Homo sapiens
aagcagaacagugauua

SEQ ID NO: 1022543 - RNA, 20 nt, Homo sapiens
aagcagaacagugauuacca

SEQ ID NO: 1022544 - RNA, 21 nt, Homo sapiens
aagcagaagcauuaacuucuc

SEQ ID NO: 1022545 - RNA, 18 nt, Homo sapiens
aagcagaugcaaagaggc

SEQ ID NO: 1022546 - RNA, 16 nt, Homo sapiens
aagcagcaacagcaaa

SEQ ID NO: 1022547 - RNA, 13 nt, Homo sapiens
aagcagcagggga

SEQ ID NO: 1022548 - RNA, 16 nt, Homo sapiens
aagcagccaagcuccu

SEQ ID NO: 1022549 - RNA, 18 nt, Homo sapiens
aagcagguggcaucucua

SEQ ID NO: 1022550 - RNA, 19 nt, Homo sapiens
aagcaguaagcuaucuuca

SEQ ID NO: 1022551 - RNA, 18 nt, Homo sapiens
aagcagugccuuccauaa

SEQ ID NO: 1022552 - RNA, 15 nt, Homo sapiens
aagcaguuaguuccu

SEQ ID NO: 1022553 - RNA, 18 nt, Homo sapiens
aagcauaggaaggcucua

SEQ ID NO: 1022554 - RNA, 15 nt, Homo sapiens
aagcaucaccucagg

SEQ ID NO: 1022555 - RNA, 24 nt, Homo sapiens
aagcaucucagccuaccaugagaa

SEQ ID NO: 1022556 - RNA, 19 nt, Homo sapiens
aagcaucugagcuaacuua

SEQ ID NO: 1022557 - RNA, 14 nt, Homo sapiens
aagcaucuuccuua

SEQ ID NO: 1022558 - RNA, 19 nt, Homo sapiens
aagcauuaccacucaggca

SEQ ID NO: 1022559 - RNA, 13 nt, Homo sapiens
aagcauucuucaa

SEQ ID NO: 1022560 - RNA, 18 nt, Homo sapiens
aagcauugagcaaagggg

SEQ ID NO: 1022561 - RNA, 16 nt, Homo sapiens
aagccaaacucugcca

SEQ ID NO: 1022562 - RNA, 16 nt, Homo sapiens
aagccaaagccaauaa

SEQ ID NO: 1022563 - RNA, 17 nt, Homo sapiens
aagccacagaagccagg

SEQ ID NO: 1022564 - RNA, 20 nt, Homo sapiens
aagccacagcuggugguauc

SEQ ID NO: 1022565 - RNA, 15 nt, Homo sapiens
aagccagaccagaag

SEQ ID NO: 1022566 - RNA, 22 nt, Homo sapiens
aagccagugcggcagguucaca

SEQ ID NO: 1022567 - RNA, 22 nt, Homo sapiens
aagccauaguggagagaacuga

SEQ ID NO: 1022568 - RNA, 14 nt, Homo sapiens
aagcccauucauuc

SEQ ID NO: 1022569 - RNA, 17 nt, Homo sapiens
aagcccauucauuccau

SEQ ID NO: 1022570 - RNA, 14 nt, Homo sapiens
aagcccuaagugac

SEQ ID NO: 1022571 - RNA, 19 nt, Homo sapiens
aagcccuccaaaagcacuu

SEQ ID NO: 1022572 - RNA, 14 nt, Homo sapiens
aagcccucuuccau

SEQ ID NO: 1022573 - RNA, 12 nt, Homo sapiens
aagcccuugaac

SEQ ID NO: 1022574 - RNA, 18 nt, Homo sapiens
aagccuagcccuucucuc

SEQ ID NO: 1022575 - RNA, 18 nt, Homo sapiens
aagccuauguaugccaug

SEQ ID NO: 1022576 - RNA, 12 nt, Homo sapiens
aagccuccucau

SEQ ID NO: 1022577 - RNA, 20 nt, Homo sapiens
aagccucuggucacauggcu

SEQ ID NO: 1022578 - RNA, 13 nt, Homo sapiens
aagccugaggcug

SEQ ID NO: 1022579 - RNA, 20 nt, Homo sapiens
aagcgauucuucugccucag

SEQ ID NO: 1022580 - RNA, 18 nt, Homo sapiens
aagcggagguugcaggga

SEQ ID NO: 1022581 - RNA, 21 nt, Homo sapiens
aagcguaauuuugccaaauaa

SEQ ID NO: 1022582 - RNA, 12 nt, Homo sapiens
aagcgugaaggc

SEQ ID NO: 1022583 - RNA, 18 nt, Homo sapiens
aagcuaaaaugauuuuau

SEQ ID NO: 1022584 - RNA, 22 nt, Homo sapiens
aagcuaaauccuuuacuguuag

SEQ ID NO: 1022585 - RNA, 15 nt, Homo sapiens
aagcuagaaccugga

SEQ ID NO: 1022586 - RNA, 21 nt, Homo sapiens
aagcuaggguggcccuugcag

SEQ ID NO: 1022587 - RNA, 17 nt, Homo sapiens
aagcuaguggcuucaaa

SEQ ID NO: 1022588 - RNA, 13 nt, Homo sapiens
aagcucaucucag

SEQ ID NO: 1022589 - RNA, 22 nt, Homo sapiens
aagcucaucucagcuccugaaa

SEQ ID NO: 1022590 - RNA, 14 nt, Homo sapiens
aagcuccacuguca

SEQ ID NO: 1022591 - RNA, 17 nt, Homo sapiens
aagcucccaagggaugg

SEQ ID NO: 1022592 - RNA, 19 nt, Homo sapiens
aagcuccugccucuuugug

SEQ ID NO: 1022593 - RNA, 17 nt, Homo sapiens
aagcucuauuaagauuu

SEQ ID NO: 1022594 - RNA, 16 nt, Homo sapiens
aagcucugaagucaca

SEQ ID NO: 1022595 - RNA, 13 nt, Homo sapiens
aagcucuguccaa

SEQ ID NO: 1022596 - RNA, 21 nt, Homo sapiens
aagcucuucacugaaacuggu

SEQ ID NO: 1022597 - RNA, 14 nt, Homo sapiens
aagcugaagugcau

SEQ ID NO: 1022598 - RNA, 12 nt, Homo sapiens
aagcugcucagg

SEQ ID NO: 1022599 - RNA, 14 nt, Homo sapiens
aagcugcucuggaa

SEQ ID NO: 1022600 - RNA, 21 nt, Homo sapiens
aagcugcuuaacccauggauc

SEQ ID NO: 1022601 - RNA, 14 nt, Homo sapiens
aagcugcuuuagaa

SEQ ID NO: 1022602 - RNA, 23 nt, Homo sapiens
aagcuggaggacuagaaccugga

SEQ ID NO: 1022603 - RNA, 16 nt, Homo sapiens
aagcuggcuuuuccca

SEQ ID NO: 1022604 - RNA, 14 nt, Homo sapiens
aagcugggagcaca

SEQ ID NO: 1022605 - RNA, 19 nt, Homo sapiens
aagcugggauaaucacauu

SEQ ID NO: 1022606 - RNA, 21 nt, Homo sapiens
aagcugggauaaucacauuau

SEQ ID NO: 1022607 - RNA, 23 nt, Homo sapiens
aagcuggugucugauuuuggcca

SEQ ID NO: 1022608 - RNA, 21 nt, Homo sapiens
aagcugucccucacuguugaa

SEQ ID NO: 1022609 - RNA, 15 nt, Homo sapiens
aagcugugacuucuc

SEQ ID NO: 1022610 - RNA, 19 nt, Homo sapiens
aagcuuccaguccaaucuc

SEQ ID NO: 1022611 - RNA, 17 nt, Homo sapiens
aagcuuccgccgucuca

SEQ ID NO: 1022612 - RNA, 16 nt, Homo sapiens
aagcuuuuaaugcucc

SEQ ID NO: 1022613 - RNA, 21 nt, Homo sapiens
aagcuuuuuauuccuccugcu

SEQ ID NO: 1022614 - RNA, 17 nt, Homo sapiens
aaggaagacaaugugaa

SEQ ID NO: 1022615 - RNA, 12 nt, Homo sapiens
aaggaagcucca

SEQ ID NO: 1022616 - RNA, 18 nt, Homo sapiens
aaggaagcuccacuguca

SEQ ID NO: 1022617 - RNA, 19 nt, Homo sapiens
aaggaagcuccacugucac

SEQ ID NO: 1022618 - RNA, 18 nt, Homo sapiens
aaggaagucagacuuuuu

SEQ ID NO: 1022619 - RNA, 13 nt, Homo sapiens
aaggaccagguua

SEQ ID NO: 1022620 - RNA, 16 nt, Homo sapiens
aaggagaacuauccaa

SEQ ID NO: 1022621 - RNA, 19 nt, Homo sapiens
aaggagaacuauccaaaac

SEQ ID NO: 1022622 - RNA, 20 nt, Homo sapiens
ggagguggagguugcaguga

SEQ ID NO: 1022623 - RNA, 13 nt, Homo sapiens
ggaguaaucugug

SEQ ID NO: 1022624 - RNA, 14 nt, Homo sapiens
ggaguacaggugaa

SEQ ID NO: 1022625 - RNA, 14 nt, Homo sapiens
ggagucaugccaag

SEQ ID NO: 1022626 - RNA, 14 nt, Homo sapiens
ggaguccacuccca

SEQ ID NO: 1022627 - RNA, 21 nt, Homo sapiens
ggagugaaaccuuuagggcag

SEQ ID NO: 1022628 - RNA, 12 nt, Homo sapiens
ggagugcaguuu

SEQ ID NO: 1022629 - RNA, 21 nt, Homo sapiens
ggagugcccccaacagcaccc

SEQ ID NO: 1022630 - RNA, 16 nt, Homo sapiens
ggaguggaugcgauaa

SEQ ID NO: 1022631 - RNA, 15 nt, Homo sapiens
ggaguuagaggccag

SEQ ID NO: 1022632 - RNA, 20 nt, Homo sapiens
ggaguucacuucaucuucuc

SEQ ID NO: 1022633 - RNA, 14 nt, Homo sapiens
uacuaucaugucaa

SEQ ID NO: 1022634 - RNA, 15 nt, Homo sapiens
uacuaucaugucaaa

SEQ ID NO: 1022635 - RNA, 18 nt, Homo sapiens
uacuaugcucuagagaaa

SEQ ID NO: 1022636 - RNA, 21 nt, Homo sapiens
uacuauuuuuacuaaucuuuc

SEQ ID NO: 1022637 - RNA, 16 nt, Homo sapiens
uacucaaaaauuugcu

SEQ ID NO: 1022638 - RNA, 21 nt, Homo sapiens
uacucaauguuacuaucugcu

SEQ ID NO: 1022639 - RNA, 14 nt, Homo sapiens
uacucauagcacuu

SEQ ID NO: 1022640 - RNA, 23 nt, Homo sapiens
uacucccaucugugaaaggaaag

SEQ ID NO: 1022641 - RNA, 20 nt, Homo sapiens
uacucuaucagagaaaaaca

SEQ ID NO: 1022642 - RNA, 15 nt, Homo sapiens
uacucucaugcugca

SEQ ID NO: 1022643 - RNA, 13 nt, Homo sapiens
uacugaaucuuca

SEQ ID NO: 1022644 - RNA, 13 nt, Homo sapiens
uacugaaugcacc

SEQ ID NO: 1022645 - RNA, 22 nt, Homo sapiens
uacugaggugcuauguucuuag

SEQ ID NO: 1022646 - RNA, 18 nt, Homo sapiens
uacugaguuacauuguca

SEQ ID NO: 1022647 - RNA, 19 nt, Homo sapiens
uacugauaaccacuccuaa

SEQ ID NO: 1022648 - RNA, 14 nt, Homo sapiens
uacugauucacugc

SEQ ID NO: 1022649 - RNA, 23 nt, Homo sapiens
uacugcagcuuuguuuguuguca

SEQ ID NO: 1022650 - RNA, 19 nt, Homo sapiens
uacugcuucuuuucacuuc

SEQ ID NO: 1022651 - RNA, 18 nt, Homo sapiens
uacuguagacucuggaag

SEQ ID NO: 1022652 - RNA, 16 nt, Homo sapiens
uacuguauauacuuug

SEQ ID NO: 1022653 - RNA, 15 nt, Homo sapiens
uacuguauauauaau

SEQ ID NO: 1022654 - RNA, 23 nt, Homo sapiens
uacuguggcuucuuaaucuuuuc

SEQ ID NO: 1022655 - RNA, 13 nt, Homo sapiens
uacuguguuucag

SEQ ID NO: 1022656 - RNA, 19 nt, Homo sapiens
uacuuacccucaccuguca

SEQ ID NO: 1022657 - RNA, 13 nt, Homo sapiens
uacuuagcagcua

SEQ ID NO: 1022658 - RNA, 17 nt, Homo sapiens
uacuuagcagcuaucuc

SEQ ID NO: 1022659 - RNA, 20 nt, Homo sapiens
uacuuauauguaaaguauua

SEQ ID NO: 1022660 - RNA, 18 nt, Homo sapiens
uacuucuuauacauuuga

SEQ ID NO: 1022661 - RNA, 14 nt, Homo sapiens
uacuugaaauacca

SEQ ID NO: 1022662 - RNA, 13 nt, Homo sapiens
uacuugagacugu

SEQ ID NO: 1022663 - RNA, 14 nt, Homo sapiens
uacuuguggacaca

SEQ ID NO: 1022664 - RNA, 18 nt, Homo sapiens
uacuuguuuucacuuuau

SEQ ID NO: 1022665 - RNA, 13 nt, Homo sapiens
uacuuuaaaggaa

SEQ ID NO: 1022666 - RNA, 15 nt, Homo sapiens
uacuuuaccuccuau

SEQ ID NO: 1022667 - RNA, 14 nt, Homo sapiens
uacuuucacacuaa

SEQ ID NO: 1022668 - RNA, 20 nt, Homo sapiens
uacuuucucuagggagaaaa

SEQ ID NO: 1022669 - RNA, 21 nt, Homo sapiens
uacuuugaagucauaccaaug

SEQ ID NO: 1022670 - RNA, 18 nt, Homo sapiens
uacuuuuaaacuguguac

SEQ ID NO: 1022671 - RNA, 21 nt, Homo sapiens
uacuuuugcccuuugauuaaa

SEQ ID NO: 1022672 - RNA, 22 nt, Homo sapiens
uacuuuuuccuggcucaucucu

SEQ ID NO: 1022673 - RNA, 20 nt, Homo sapiens
uagaaaagcaaagggugcua

SEQ ID NO: 1022674 - RNA, 19 nt, Homo sapiens
uagaaacauugaagaugaa

SEQ ID NO: 1022675 - RNA, 17 nt, Homo sapiens
uagaaaggggcccaguc

SEQ ID NO: 1022676 - RNA, 18 nt, Homo sapiens
uagaaaugaccaauauua

SEQ ID NO: 1022677 - RNA, 13 nt, Homo sapiens
uagaaccaggcaa

SEQ ID NO: 1022678 - RNA, 12 nt, Homo sapiens
uagaacuugcag

SEQ ID NO: 1022679 - RNA, 19 nt, Homo sapiens
uagaacuugcagcugaugu

SEQ ID NO: 1022680 - RNA, 19 nt, Homo sapiens
uagaagauauuagucuugg

SEQ ID NO: 1022681 - RNA, 21 nt, Homo sapiens
uagaagccacuauuacuggga

SEQ ID NO: 1022682 - RNA, 20 nt, Homo sapiens
uagaaggguaccuugaacac

SEQ ID NO: 1022683 - RNA, 22 nt, Homo sapiens
uagaagguucucuccuccccaa

SEQ ID NO: 1022684 - RNA, 20 nt, Homo sapiens
uagaauaauacuagucuuau

SEQ ID NO: 1022685 - RNA, 20 nt, Homo sapiens
uagaauauccuacuucucca

SEQ ID NO: 1022686 - RNA, 21 nt, Homo sapiens
uagaauauccuacuucuccag

SEQ ID NO: 1022687 - RNA, 18 nt, Homo sapiens
uagaauccaguuugcaau

SEQ ID NO: 1022688 - RNA, 12 nt, Homo sapiens
uagaaucuggag

SEQ ID NO: 1022689 - RNA, 16 nt, Homo sapiens
uagaauuaacacauga

SEQ ID NO: 1022690 - RNA, 12 nt, Homo sapiens
uagaauucugaa

SEQ ID NO: 1022691 - RNA, 13 nt, Homo sapiens
uagaauuuauuca

SEQ ID NO: 1022692 - RNA, 20 nt, Homo sapiens
uagaauuugagcaucaguga

SEQ ID NO: 1022693 - RNA, 18 nt, Homo sapiens
agaacuuuggcugccuuu

SEQ ID NO: 1022694 - RNA, 18 nt, Homo sapiens
agaagacaacauuucuca

SEQ ID NO: 1022695 - RNA, 19 nt, Homo sapiens
agaagacaacauuucucaa

SEQ ID NO: 1022696 - RNA, 13 nt, Homo sapiens
agaagacacugca

SEQ ID NO: 1022697 - RNA, 20 nt, Homo sapiens
agaagacaucguaugcuugg

SEQ ID NO: 1022698 - RNA, 18 nt, Homo sapiens
agaagacucuaccagacu

SEQ ID NO: 1022699 - RNA, 14 nt, Homo sapiens
agaagagcuguuca

SEQ ID NO: 1022700 - RNA, 19 nt, Homo sapiens
agaagaggcuggugcugug

SEQ ID NO: 1022701 - RNA, 22 nt, Homo sapiens
agaagauggcacuuauaaccaa

SEQ ID NO: 1022702 - RNA, 18 nt, Homo sapiens
agaagauggcccagcucc

SEQ ID NO: 1022703 - RNA, 19 nt, Homo sapiens
agaagauuuuaugcugcug

SEQ ID NO: 1022704 - RNA, 16 nt, Homo sapiens
agaagcaagugguggg

SEQ ID NO: 1022705 - RNA, 23 nt, Homo sapiens
agaagcuaaauccuuuacuguua

SEQ ID NO: 1022706 - RNA, 16 nt, Homo sapiens
agaagcugucagggac

SEQ ID NO: 1022707 - RNA, 21 nt, Homo sapiens
agaagcugucagggacccagg

SEQ ID NO: 1022708 - RNA, 17 nt, Homo sapiens
agaaggauguacauuuc

SEQ ID NO: 1022709 - RNA, 13 nt, Homo sapiens
agaaggcaaaaag

SEQ ID NO: 1022710 - RNA, 15 nt, Homo sapiens
agaaggcuaugggga

SEQ ID NO: 1022711 - RNA, 20 nt, Homo sapiens
agaagggagggagagaauuu

SEQ ID NO: 1022712 - RNA, 18 nt, Homo sapiens
agaagggcaaauauuuau

SEQ ID NO: 1022713 - RNA, 15 nt, Homo sapiens
agaagggcuaacuca

SEQ ID NO: 1022714 - RNA, 22 nt, Homo sapiens
agaaggguuuuccacccuggaa

SEQ ID NO: 1022715 - RNA, 14 nt, Homo sapiens
agaagguccuuaau

SEQ ID NO: 1022716 - RNA, 15 nt, Homo sapiens
agaagguuaccaaga

SEQ ID NO: 1022717 - RNA, 14 nt, Homo sapiens
agaagguugcucua

SEQ ID NO: 1022718 - RNA, 22 nt, Homo sapiens
agaagucaugaagcccaaguga

SEQ ID NO: 1022719 - RNA, 23 nt, Homo sapiens
agaaguuuaaggaauaugggaga

SEQ ID NO: 1022720 - RNA, 17 nt, Homo sapiens
agaaguuuuguacagag

SEQ ID NO: 1022721 - RNA, 17 nt, Homo sapiens
agaauauaaaaaacuuu

SEQ ID NO: 1022722 - RNA, 14 nt, Homo sapiens
agaauaucugggau

SEQ ID NO: 1022723 - RNA, 17 nt, Homo sapiens
agaaucacuugcacucc

SEQ ID NO: 1022724 - RNA, 16 nt, Homo sapiens
agaaucagucuaucca

SEQ ID NO: 1022725 - RNA, 20 nt, Homo sapiens
agaaucagucuauccacaga

SEQ ID NO: 1022726 - RNA, 14 nt, Homo sapiens
agaaucgcuuaaac

SEQ ID NO: 1022727 - RNA, 17 nt, Homo sapiens
agaaucugcagcuaacu

SEQ ID NO: 1022728 - RNA, 21 nt, Homo sapiens
agaaucugcagcuaacuuauu

SEQ ID NO: 1022729 - RNA, 20 nt, Homo sapiens
agaaugaacaaauugaacuc

SEQ ID NO: 1022730 - RNA, 11 nt, Homo sapiens
agaauggagcu

SEQ ID NO: 1022731 - RNA, 12 nt, Homo sapiens
agaauggagcug

SEQ ID NO: 1022732 - RNA, 23 nt, Homo sapiens
agaauguauuguaccuuuuaaca

SEQ ID NO: 1022733 - RNA, 22 nt, Homo sapiens
agaaugucaaugaguaauucau

SEQ ID NO: 1022734 - RNA, 23 nt, Homo sapiens
agaauguucuuauguugcccagu

SEQ ID NO: 1022735 - RNA, 19 nt, Homo sapiens
agaauuaguggcacuugcu

SEQ ID NO: 1022736 - RNA, 23 nt, Homo sapiens
agaauucugcuaccucacugggg

SEQ ID NO: 1022737 - RNA, 16 nt, Homo sapiens
agacaacagaagucau

SEQ ID NO: 1022738 - RNA, 18 nt, Homo sapiens
agacaacagcauaacuaa

SEQ ID NO: 1022739 - RNA, 16 nt, Homo sapiens
agacaacaguugcaca

SEQ ID NO: 1022740 - RNA, 19 nt, Homo sapiens
agacaagaacuuggaggca

SEQ ID NO: 1022741 - RNA, 19 nt, Homo sapiens
agacaagagggacaagugg

SEQ ID NO: 1022742 - RNA, 19 nt, Homo sapiens
agacaaggccgucaggacc

SEQ ID NO: 1022743 - RNA, 18 nt, Homo sapiens
agacaaggucuugcuaug

SEQ ID NO: 1022744 - RNA, 19 nt, Homo sapiens
agacaaugacuuacuguac

SEQ ID NO: 1022745 - RNA, 19 nt, Homo sapiens
agacacaacaacuccuagg

SEQ ID NO: 1022746 - RNA, 17 nt, Homo sapiens
agacaccuugacagggc

SEQ ID NO: 1022747 - RNA, 18 nt, Homo sapiens
agacacguguuguuccac

SEQ ID NO: 1022748 - RNA, 17 nt, Homo sapiens
agacagaaccuuguuau

SEQ ID NO: 1022749 - RNA, 17 nt, Homo sapiens
agacagagaccuccugc

SEQ ID NO: 1022750 - RNA, 15 nt, Homo sapiens
agacagagucucacu

SEQ ID NO: 1022751 - RNA, 16 nt, Homo sapiens
agacagauacuccucc

SEQ ID NO: 1022752 - RNA, 14 nt, Homo sapiens
agacagcugucuug

SEQ ID NO: 1022753 - RNA, 15 nt, Homo sapiens
agacaguucaagaaa

SEQ ID NO: 1022754 - RNA, 11 nt, Homo sapiens
agacauacucc

SEQ ID NO: 1022755 - RNA, 19 nt, Homo sapiens
agacauacuccuuccauca

SEQ ID NO: 1022756 - RNA, 15 nt, Homo sapiens
agacaucaacagaua

SEQ ID NO: 1022757 - RNA, 22 nt, Homo sapiens
agacauccauaaagaagcaaua

SEQ ID NO: 1022758 - RNA, 14 nt, Homo sapiens
agacauccauguuu

SEQ ID NO: 1022759 - RNA, 23 nt, Homo sapiens
agacaugcugacuuucauuucuu

SEQ ID NO: 1022760 - RNA, 23 nt, Homo sapiens
agacaugugcacaugaauccaua

SEQ ID NO: 1022761 - RNA, 16 nt, Homo sapiens
agacaugugcacuuga

SEQ ID NO: 1022762 - RNA, 19 nt, Homo sapiens
agacauuugcuaugagcug

SEQ ID NO: 1022763 - RNA, 23 nt, Homo sapiens
agaccagcccaccccugugccca

SEQ ID NO: 1022764 - RNA, 15 nt, Homo sapiens
agaccaggagggcac

SEQ ID NO: 1022765 - RNA, 21 nt, Homo sapiens
agaccaggagggcacuggagc

SEQ ID NO: 1022766 - RNA, 13 nt, Homo sapiens
agaccaguccaug

SEQ ID NO: 1022767 - RNA, 15 nt, Homo sapiens
agaccauagugacca

SEQ ID NO: 1022768 - RNA, 14 nt, Homo sapiens
agacccgcccuccc

SEQ ID NO: 1022769 - RNA, 20 nt, Homo sapiens
agaccuaccucagguugcug

SEQ ID NO: 1022770 - RNA, 15 nt, Homo sapiens
agaccugagaaccuu

SEQ ID NO: 1022771 - RNA, 22 nt, Homo sapiens
agaccuggguugagccucagaa

SEQ ID NO: 1022772 - RNA, 19 nt, Homo sapiens
agaccuguaaucauauaau

SEQ ID NO: 1022773 - RNA, 20 nt, Homo sapiens
agacgcagacaugugcacuu

SEQ ID NO: 1022774 - RNA, 15 nt, Homo sapiens
agacgcuucauccca

SEQ ID NO: 1022775 - RNA, 11 nt, Homo sapiens
agacgggaccg

SEQ ID NO: 1022776 - RNA, 23 nt, Homo sapiens
agacgggcaaaauaaagugacag

SEQ ID NO: 1022777 - RNA, 16 nt, Homo sapiens
uaggguggcccuugca

SEQ ID NO: 1022778 - RNA, 12 nt, Homo sapiens
uagguagcuuua

SEQ ID NO: 1022779 - RNA, 20 nt, Homo sapiens
uagguaggggcccacuucac

SEQ ID NO: 1022780 - RNA, 16 nt, Homo sapiens
uagguggcaagcugug

SEQ ID NO: 1022781 - RNA, 16 nt, Homo sapiens
uaggugugacuugaac

SEQ ID NO: 1022782 - RNA, 14 nt, Homo sapiens
uagguuggacugga

SEQ ID NO: 1022783 - RNA, 19 nt, Homo sapiens
uagguuuaacucagaucac

SEQ ID NO: 1022784 - RNA, 19 nt, Homo sapiens
uaguaaagugauaauuucu

SEQ ID NO: 1022785 - RNA, 21 nt, Homo sapiens
uaguaagaaaacaucacugaa

SEQ ID NO: 1022786 - RNA, 15 nt, Homo sapiens
uaguaaucacaguug

SEQ ID NO: 1022787 - RNA, 21 nt, Homo sapiens
uaguaauguuuuauacuguuu

SEQ ID NO: 1022788 - RNA, 13 nt, Homo sapiens
uaguauuuaugaa

SEQ ID NO: 1022789 - RNA, 16 nt, Homo sapiens
uagucaaggaggaaag

SEQ ID NO: 1022790 - RNA, 20 nt, Homo sapiens
uagucaaggaggaaagggau

SEQ ID NO: 1022791 - RNA, 22 nt, Homo sapiens
uagucacauggccuaugcacau

SEQ ID NO: 1022792 - RNA, 23 nt, Homo sapiens
uagucacauggccuaugcacaua

SEQ ID NO: 1022793 - RNA, 16 nt, Homo sapiens
uagucaugcuaauuau

SEQ ID NO: 1022794 - RNA, 22 nt, Homo sapiens
uagugaaucacguaaagcuaga

SEQ ID NO: 1022795 - RNA, 19 nt, Homo sapiens
uagugauuuccacagugac

SEQ ID NO: 1022796 - RNA, 16 nt, Homo sapiens
uagugcagaaucucau

SEQ ID NO: 1022797 - RNA, 18 nt, Homo sapiens
uagugccugaaauuucac

SEQ ID NO: 1022798 - RNA, 16 nt, Homo sapiens
uaguggggucagggcu

SEQ ID NO: 1022799 - RNA, 14 nt, Homo sapiens
uaguggugacugug

SEQ ID NO: 1022800 - RNA, 18 nt, Homo sapiens
uaguguuaauaucuugaa

SEQ ID NO: 1022801 - RNA, 19 nt, Homo sapiens
uaguguuggaaaaugugca

SEQ ID NO: 1022802 - RNA, 23 nt, Homo sapiens
uaguguuggaaaaugugcaauau

SEQ ID NO: 1022803 - RNA, 15 nt, Homo sapiens
uaguuacagcuguga

SEQ ID NO: 1022804 - RNA, 18 nt, Homo sapiens
uaguuacucauucaggga

SEQ ID NO: 1022805 - RNA, 18 nt, Homo sapiens
uaguucuaggguuucccu

SEQ ID NO: 1022806 - RNA, 13 nt, Homo sapiens
uaguucuuuggaa

SEQ ID NO: 1022807 - RNA, 21 nt, Homo sapiens
uaguugaucuacaaaggccau

SEQ ID NO: 1022808 - RNA, 19 nt, Homo sapiens
uaguugcguggacucugca

SEQ ID NO: 1022809 - RNA, 19 nt, Homo sapiens
uaguuguaccgcaauguga

SEQ ID NO: 1022810 - RNA, 22 nt, Homo sapiens
uaguuugauacucccagucuug

SEQ ID NO: 1022811 - RNA, 19 nt, Homo sapiens
uaguuugcaguuacacuaa

SEQ ID NO: 1022812 - RNA, 16 nt, Homo sapiens
uaguuuuaguugcaga

SEQ ID NO: 1022813 - RNA, 21 nt, Homo sapiens
uauaaaagaauaaaauugcac

SEQ ID NO: 1022814 - RNA, 17 nt, Homo sapiens
uauaaaauuaacauaaa

SEQ ID NO: 1022815 - RNA, 16 nt, Homo sapiens
uauaaagaagaacuug

SEQ ID NO: 1022816 - RNA, 21 nt, Homo sapiens
uauaaagaagaacuugcaugg

SEQ ID NO: 1022817 - RNA, 19 nt, Homo sapiens
uauaaaggccagcgccaga

SEQ ID NO: 1022818 - RNA, 20 nt, Homo sapiens
uauaaauaacuaaugucucu

SEQ ID NO: 1022819 - RNA, 14 nt, Homo sapiens
uauaaaugcuauuu

SEQ ID NO: 1022820 - RNA, 23 nt, Homo sapiens
uauaaauuuauuuacugcuaguc

SEQ ID NO: 1022821 - RNA, 21 nt, Homo sapiens
uauaacaaacuacauguaauc

SEQ ID NO: 1022822 - RNA, 16 nt, Homo sapiens
uauaacuauguugaua

SEQ ID NO: 1022823 - RNA, 18 nt, Homo sapiens
uauaacucugcacuacuc

SEQ ID NO: 1022824 - RNA, 22 nt, Homo sapiens
uauaagcccacuguuaauauuc

SEQ ID NO: 1022825 - RNA, 22 nt, Homo sapiens
uauaaucuuccauacuucuuca

SEQ ID NO: 1022826 - RNA, 22 nt, Homo sapiens
uauaauucuguacauagccuau

SEQ ID NO: 1022827 - RNA, 16 nt, Homo sapiens
uauaauugaguuuuca

SEQ ID NO: 1022828 - RNA, 15 nt, Homo sapiens
uauaauuucuguuca

SEQ ID NO: 1022829 - RNA, 20 nt, Homo sapiens
uauacagauucgaaacucca

SEQ ID NO: 1022830 - RNA, 12 nt, Homo sapiens
uauacaugacuu

SEQ ID NO: 1022831 - RNA, 12 nt, Homo sapiens
uauacauuugau

SEQ ID NO: 1022832 - RNA, 18 nt, Homo sapiens
uauacauuugauguauug

SEQ ID NO: 1022833 - RNA, 14 nt, Homo sapiens
uauacguguagcua

SEQ ID NO: 1022834 - RNA, 15 nt, Homo sapiens
uauacucuucaagga

SEQ ID NO: 1022835 - RNA, 14 nt, Homo sapiens
uauacuguuuacug

SEQ ID NO: 1022836 - RNA, 21 nt, Homo sapiens
uauacuugggaauauaaagga

SEQ ID NO: 1022837 - RNA, 17 nt, Homo sapiens
uauagaauggaacucaa

SEQ ID NO: 1022838 - RNA, 16 nt, Homo sapiens
uauagaguagaagauu

SEQ ID NO: 1022839 - RNA, 17 nt, Homo sapiens
uauagcagauuguguaa

SEQ ID NO: 1022840 - RNA, 22 nt, Homo sapiens
uauaggaucauuuguuggaaug

SEQ ID NO: 1022841 - RNA, 15 nt, Homo sapiens
uauaggucacuccug

SEQ ID NO: 1022842 - RNA, 21 nt, Homo sapiens
uauaggugcuacaaaaacaca

SEQ ID NO: 1022843 - RNA, 13 nt, Homo sapiens
uauagguuuccaa

SEQ ID NO: 1022844 - RNA, 23 nt, Homo sapiens
agaggagguuuggggucugccac

SEQ ID NO: 1022845 - RNA, 15 nt, Homo sapiens
agaggaguucaauga

SEQ ID NO: 1022846 - RNA, 17 nt, Homo sapiens
agaggaucggaggcuug

SEQ ID NO: 1022847 - RNA, 21 nt, Homo sapiens
agaggaugaauguaugugcac

SEQ ID NO: 1022848 - RNA, 23 nt, Homo sapiens
agaggaugaauguaugugcacug

SEQ ID NO: 1022849 - RNA, 14 nt, Homo sapiens
agaggcaaaggcuc

SEQ ID NO: 1022850 - RNA, 16 nt, Homo sapiens
agaggcaacugcccag

SEQ ID NO: 1022851 - RNA, 22 nt, Homo sapiens
agaggcuauuauuuucacugua

SEQ ID NO: 1022852 - RNA, 18 nt, Homo sapiens
agagggacagaugaccaa

SEQ ID NO: 1022853 - RNA, 16 nt, Homo sapiens
agagggcugcugacca

SEQ ID NO: 1022854 - RNA, 17 nt, Homo sapiens
agagggcuuucucagga

SEQ ID NO: 1022855 - RNA, 19 nt, Homo sapiens
agaggggguagcuagccug

SEQ ID NO: 1022856 - RNA, 17 nt, Homo sapiens
agagggggucucagaaa

SEQ ID NO: 1022857 - RNA, 23 nt, Homo sapiens
agagggguggaguuuuaacugua

SEQ ID NO: 1022858 - RNA, 19 nt, Homo sapiens
agaggugccagcaacugaa

SEQ ID NO: 1022859 - RNA, 21 nt, Homo sapiens
agagguuucuggcagccagua

SEQ ID NO: 1022860 - RNA, 19 nt, Homo sapiens
agaguaaauagcauucucu

SEQ ID NO: 1022861 - RNA, 19 nt, Homo sapiens
agaguacaccccaacagca

SEQ ID NO: 1022862 - RNA, 20 nt, Homo sapiens
agaguacaccccaacagcac

SEQ ID NO: 1022863 - RNA, 17 nt, Homo sapiens
agaguaggaagacuuug

SEQ ID NO: 1022864 - RNA, 15 nt, Homo sapiens
agaguauggagcuca

SEQ ID NO: 1022865 - RNA, 21 nt, Homo sapiens
agagucauauugcccaguggu

SEQ ID NO: 1022866 - RNA, 14 nt, Homo sapiens
agaguccucugaau

SEQ ID NO: 1022867 - RNA, 18 nt, Homo sapiens
agaguccucuggauggca

SEQ ID NO: 1022868 - RNA, 18 nt, Homo sapiens
agagugcccagaacugga

SEQ ID NO: 1022869 - RNA, 22 nt, Homo sapiens
agaguggaaccaacacuaacau

SEQ ID NO: 1022870 - RNA, 21 nt, Homo sapiens
agaguggccuggccaggagcu

SEQ ID NO: 1022871 - RNA, 19 nt, Homo sapiens
agaguggggaugacaugca

SEQ ID NO: 1022872 - RNA, 19 nt, Homo sapiens
agaguggucuuucuggaga

SEQ ID NO: 1022873 - RNA, 19 nt, Homo sapiens
agaguguuaucagucauaa

SEQ ID NO: 1022874 - RNA, 19 nt, Homo sapiens
agaguuaagugaaugucua

SEQ ID NO: 1022875 - RNA, 17 nt, Homo sapiens
agaguucaauggcugcu

SEQ ID NO: 1022876 - RNA, 15 nt, Homo sapiens
agauaaaauguguaa

SEQ ID NO: 1022877 - RNA, 17 nt, Homo sapiens
agauaaacaacaaauaa

SEQ ID NO: 1022878 - RNA, 23 nt, Homo sapiens
agauaacuguuauuuauaaucac

SEQ ID NO: 1022879 - RNA, 13 nt, Homo sapiens
agauaagcaagag

SEQ ID NO: 1022880 - RNA, 15 nt, Homo sapiens
agauaauacaccacu

SEQ ID NO: 1022881 - RNA, 13 nt, Homo sapiens
agauacaaacugc

SEQ ID NO: 1022882 - RNA, 18 nt, Homo sapiens
agauacagggaugaggca

SEQ ID NO: 1022883 - RNA, 21 nt, Homo sapiens
agauacaugguugugaccuga

SEQ ID NO: 1022884 - RNA, 13 nt, Homo sapiens
agauacugaggaa

SEQ ID NO: 1022885 - RNA, 23 nt, Homo sapiens
agauacugaggaaugucuuucag

SEQ ID NO: 1022886 - RNA, 18 nt, Homo sapiens
agauacuuuuguaaauaa

SEQ ID NO: 1022887 - RNA, 14 nt, Homo sapiens
agauagaaccugga

SEQ ID NO: 1022888 - RNA, 20 nt, Homo sapiens
agauagaaccuggagccacu

SEQ ID NO: 1022889 - RNA, 17 nt, Homo sapiens
agauauacugggagaaa

SEQ ID NO: 1022890 - RNA, 23 nt, Homo sapiens
agauauaucccggaugaggcuga

SEQ ID NO: 1022891 - RNA, 11 nt, Homo sapiens
agauaugauau

SEQ ID NO: 1022892 - RNA, 15 nt, Homo sapiens
agauaugaugucccu

SEQ ID NO: 1022893 - RNA, 18 nt, Homo sapiens
agauauggacacacggga

SEQ ID NO: 1022894 - RNA, 14 nt, Homo sapiens
agauauuucacauu

SEQ ID NO: 1022895 - RNA, 21 nt, Homo sapiens
agauauuuuucaugauuuuga

SEQ ID NO: 1022896 - RNA, 19 nt, Homo sapiens
agaucaaugaaaugauguc

SEQ ID NO: 1022897 - RNA, 18 nt, Homo sapiens
agaucaauggcgcagugc

SEQ ID NO: 1022898 - RNA, 17 nt, Homo sapiens
agaucauuuucuuaucu

SEQ ID NO: 1022899 - RNA, 14 nt, Homo sapiens
agaucccagcucac

SEQ ID NO: 1022900 - RNA, 18 nt, Homo sapiens
agaucccagcucacguca

SEQ ID NO: 1022901 - RNA, 14 nt, Homo sapiens
agaucccaucucuc

SEQ ID NO: 1022902 - RNA, 17 nt, Homo sapiens
agauccgagucuaccca

SEQ ID NO: 1022903 - RNA, 13 nt, Homo sapiens
agauccuacccca

SEQ ID NO: 1022904 - RNA, 16 nt, Homo sapiens
agaucgcaguuugccu

SEQ ID NO: 1022905 - RNA, 18 nt, Homo sapiens
agaucgcgccacugcacu

SEQ ID NO: 1022906 - RNA, 17 nt, Homo sapiens
agaucuauguacuguaa

SEQ ID NO: 1022907 - RNA, 18 nt, Homo sapiens
agaucuggucccuugcag

SEQ ID NO: 1022908 - RNA, 19 nt, Homo sapiens
agaucuugguccuguguuu

SEQ ID NO: 1022909 - RNA, 18 nt, Homo sapiens
agaugaagacaacagcau

SEQ ID NO: 1022910 - RNA, 15 nt, Homo sapiens
agaugacauggugaa

SEQ ID NO: 1022911 - RNA, 15 nt, Homo sapiens
agaugagaguacacc

SEQ ID NO: 1022912 - RNA, 17 nt, Homo sapiens
agaugcaggugagccca

SEQ ID NO: 1022913 - RNA, 10 nt, Homo sapiens
agaugcauua

SEQ ID NO: 1022914 - RNA, 20 nt, Homo sapiens
agaugcauuaucuaugauau

SEQ ID NO: 1022915 - RNA, 20 nt, Homo sapiens
agaugcuaccuugugaccca

SEQ ID NO: 1022916 - RNA, 21 nt, Homo sapiens
agaugcucuaucuugcucugu

SEQ ID NO: 1022917 - RNA, 13 nt, Homo sapiens
agaugcugauguu

SEQ ID NO: 1022918 - RNA, 21 nt, Homo sapiens
agaugcuuuccugcacauuaa

SEQ ID NO: 1022919 - RNA, 21 nt, Homo sapiens
agauggagucuggcucugucu

SEQ ID NO: 1022920 - RNA, 14 nt, Homo sapiens
agauggaguucuug

SEQ ID NO: 1022921 - RNA, 17 nt, Homo sapiens
uauggcucuacuuucag

SEQ ID NO: 1022922 - RNA, 21 nt, Homo sapiens
uauguaaauagaaacguguau

SEQ ID NO: 1022923 - RNA, 18 nt, Homo sapiens
uauguaacaaaccugcac

SEQ ID NO: 1022924 - RNA, 14 nt, Homo sapiens
uauguaaucucacc

SEQ ID NO: 1022925 - RNA, 19 nt, Homo sapiens
uaugucacccaaugcauau

SEQ ID NO: 1022926 - RNA, 20 nt, Homo sapiens
uaugucaggcaaagugcugc

SEQ ID NO: 1022927 - RNA, 20 nt, Homo sapiens
uaugucaucucagugcugua

SEQ ID NO: 1022928 - RNA, 15 nt, Homo sapiens
uaugucuucaugcaa

SEQ ID NO: 1022929 - RNA, 19 nt, Homo sapiens
uaugucuuggacacuguac

SEQ ID NO: 1022930 - RNA, 14 nt, Homo sapiens
uaugugauguggca

SEQ ID NO: 1022931 - RNA, 16 nt, Homo sapiens
uaugugggggucugug

SEQ ID NO: 1022932 - RNA, 13 nt, Homo sapiens
uauguuauugcau

SEQ ID NO: 1022933 - RNA, 15 nt, Homo sapiens
uauguucuaagaagu

SEQ ID NO: 1022934 - RNA, 17 nt, Homo sapiens
uauguuuacuucucacc

SEQ ID NO: 1022935 - RNA, 22 nt, Homo sapiens
uauuaaaauaagcacugugcua

SEQ ID NO: 1022936 - RNA, 20 nt, Homo sapiens
uauuaacagcugauacaggu

SEQ ID NO: 1022937 - RNA, 15 nt, Homo sapiens
uauuaagauuuccaa

SEQ ID NO: 1022938 - RNA, 15 nt, Homo sapiens
uauuaagccacuuaa

SEQ ID NO: 1022939 - RNA, 20 nt, Homo sapiens
uauuaaggaagacaauguga

SEQ ID NO: 1022940 - RNA, 16 nt, Homo sapiens
uauuaagugugcuuau

SEQ ID NO: 1022941 - RNA, 20 nt, Homo sapiens
uauuaauuguuuugcacuuu

SEQ ID NO: 1022942 - RNA, 20 nt, Homo sapiens
uauuacaguuuaucuauggc

SEQ ID NO: 1022943 - RNA, 14 nt, Homo sapiens
uauuacgugcaaua

SEQ ID NO: 1022944 - RNA, 20 nt, Homo sapiens
uauuacugggacugugcuca

SEQ ID NO: 1022945 - RNA, 15 nt, Homo sapiens
uauuagaacaggcaa

SEQ ID NO: 1022946 - RNA, 18 nt, Homo sapiens
uauuagagcugccugugc

SEQ ID NO: 1022947 - RNA, 17 nt, Homo sapiens
uauuagauaaauuucaa

SEQ ID NO: 1022948 - RNA, 13 nt, Homo sapiens
uauuagcuuauau

SEQ ID NO: 1022949 - RNA, 15 nt, Homo sapiens
uauuauacuaagaaa

SEQ ID NO: 1022950 - RNA, 19 nt, Homo sapiens
uauucaauggaaagcugcu

SEQ ID NO: 1022951 - RNA, 20 nt, Homo sapiens
uauucaauggaaagcugcuu

SEQ ID NO: 1022952 - RNA, 21 nt, Homo sapiens
uauucacaaccacucauucaa

SEQ ID NO: 1022953 - RNA, 14 nt, Homo sapiens
uauucagacaagca

SEQ ID NO: 1022954 - RNA, 23 nt, Homo sapiens
uauucagauauaaaacaguuuug

SEQ ID NO: 1022955 - RNA, 12 nt, Homo sapiens
uauucagcuuua

SEQ ID NO: 1022956 - RNA, 23 nt, Homo sapiens
uauucauucauuuacucauucau

SEQ ID NO: 1022957 - RNA, 22 nt, Homo sapiens
uauuccauauucauguaaacaa

SEQ ID NO: 1022958 - RNA, 15 nt, Homo sapiens
uauucccaugcauuu

SEQ ID NO: 1022959 - RNA, 19 nt, Homo sapiens
uauucuuaaauucauuuua

SEQ ID NO: 1022960 - RNA, 12 nt, Homo sapiens
uauucuugucaa

SEQ ID NO: 1022961 - RNA, 21 nt, Homo sapiens
uauucuuuaaauuucaucuca

SEQ ID NO: 1022962 - RNA, 22 nt, Homo sapiens
uauugaaaaaucaccacaccaa

SEQ ID NO: 1022963 - RNA, 15 nt, Homo sapiens
uauugacuucaauga

SEQ ID NO: 1022964 - RNA, 19 nt, Homo sapiens
uauugaugauguugaacaa

SEQ ID NO: 1022965 - RNA, 14 nt, Homo sapiens
uauugcgauggcgu

SEQ ID NO: 1022966 - RNA, 21 nt, Homo sapiens
uauugcugcuggggcucccca

SEQ ID NO: 1022967 - RNA, 16 nt, Homo sapiens
uauugcuugaguuaua

SEQ ID NO: 1022968 - RNA, 17 nt, Homo sapiens
uauugcuugaguuauau

SEQ ID NO: 1022969 - RNA, 14 nt, Homo sapiens
uauugguguuuacc

SEQ ID NO: 1022970 - RNA, 17 nt, Homo sapiens
uauugguguuuacccag

SEQ ID NO: 1022971 - RNA, 19 nt, Homo sapiens
uauuguccugcuccccugu

SEQ ID NO: 1022972 - RNA, 17 nt, Homo sapiens
uauugugaaguacauau

SEQ ID NO: 1022973 - RNA, 18 nt, Homo sapiens
uauuuaaagacaaagaca

SEQ ID NO: 1022974 - RNA, 21 nt, Homo sapiens
uauuuaaauaaaaucauauug

SEQ ID NO: 1022975 - RNA, 18 nt, Homo sapiens
uauuuacauacaggccau

SEQ ID NO: 1022976 - RNA, 16 nt, Homo sapiens
uauuuaccagaccaca

SEQ ID NO: 1022977 - RNA, 12 nt, Homo sapiens
uauuuaccugaa

SEQ ID NO: 1022978 - RNA, 15 nt, Homo sapiens
uauuuagugaacuac

SEQ ID NO: 1022979 - RNA, 13 nt, Homo sapiens
uauuuauaacuca

SEQ ID NO: 1022980 - RNA, 13 nt, Homo sapiens
uauuuauacugua

SEQ ID NO: 1022981 - RNA, 14 nt, Homo sapiens
uauuuauacuguau

SEQ ID NO: 1022982 - RNA, 12 nt, Homo sapiens
uauuuauagucg

SEQ ID NO: 1022983 - RNA, 21 nt, Homo sapiens
uauuuauauauuuauaacuca

SEQ ID NO: 1022984 - RNA, 17 nt, Homo sapiens
uauuuaucaaguguauu

SEQ ID NO: 1022985 - RNA, 13 nt, Homo sapiens
uauuuauuuacug

SEQ ID NO: 1022986 - RNA, 12 nt, Homo sapiens
uauuucucugau

SEQ ID NO: 1022987 - RNA, 16 nt, Homo sapiens
uauuucuguaccaaag

SEQ ID NO: 1022988 - RNA, 20 nt, Homo sapiens
uauuucuuacaggcacaaaa

SEQ ID NO: 1022989 - RNA, 16 nt, Homo sapiens
uauuugaaaacauaua

SEQ ID NO: 1022990 - RNA, 17 nt, Homo sapiens
uauuugcaagacauaga

SEQ ID NO: 1022991 - RNA, 13 nt, Homo sapiens
uauuugcuaugaa

SEQ ID NO: 1022992 - RNA, 16 nt, Homo sapiens
uauuugcuuuuugcua

SEQ ID NO: 1022993 - RNA, 24 nt, Homo sapiens
uauuugcuuuuugcuaacaaugcu

SEQ ID NO: 1022994 - RNA, 13 nt, Homo sapiens
uauuugguacugu

SEQ ID NO: 1022995 - RNA, 15 nt, Homo sapiens
uauuuguacaaaaaa

SEQ ID NO: 1022996 - RNA, 24 nt, Homo sapiens
uauuuuaggucuuaauacacacag

SEQ ID NO: 1022997 - RNA, 22 nt, Homo sapiens
agcagagcaccuuagacagucc

SEQ ID NO: 1022998 - RNA, 16 nt, Homo sapiens
agcagagcuuccucag

SEQ ID NO: 1022999 - RNA, 14 nt, Homo sapiens
agcagauacuuugu

SEQ ID NO: 1023000 - RNA, 21 nt, Homo sapiens
agcagauauauuaagugacug

SEQ ID NO: 1023001 - RNA, 13 nt, Homo sapiens
agcagauuuaaca

SEQ ID NO: 1023002 - RNA, 21 nt, Homo sapiens
agcagcccuaaggaucucuca

SEQ ID NO: 1023003 - RNA, 21 nt, Homo sapiens
agcagcgccccucccaagagg

SEQ ID NO: 1023004 - RNA, 19 nt, Homo sapiens
agcagcuaucucucaguga

SEQ ID NO: 1023005 - RNA, 15 nt, Homo sapiens
agcagcuucugggac

SEQ ID NO: 1023006 - RNA, 14 nt, Homo sapiens
agcagcuuuaaaca

SEQ ID NO: 1023007 - RNA, 15 nt, Homo sapiens
agcaggacugcacag

SEQ ID NO: 1023008 - RNA, 15 nt, Homo sapiens
agcaggcuacacuga

SEQ ID NO: 1023009 - RNA, 20 nt, Homo sapiens
agcaggcuggcagcucucca

SEQ ID NO: 1023010 - RNA, 24 nt, Homo sapiens
agcaggcuuucaagaagugccagu

SEQ ID NO: 1023011 - RNA, 19 nt, Homo sapiens
agcagguggcaucucuaau

SEQ ID NO: 1023012 - RNA, 13 nt, Homo sapiens
agcaguaagcuau

SEQ ID NO: 1023013 - RNA, 19 nt, Homo sapiens
agcaguaagcuaucuucaa

SEQ ID NO: 1023014 - RNA, 16 nt, Homo sapiens
agcaguagacaagcaa

SEQ ID NO: 1023015 - RNA, 20 nt, Homo sapiens
agcagugaaugauucagugu

SEQ ID NO: 1023016 - RNA, 13 nt, Homo sapiens
agcagugaugaaa

SEQ ID NO: 1023017 - RNA, 17 nt, Homo sapiens
agcagugccagcuuucu

SEQ ID NO: 1023018 - RNA, 14 nt, Homo sapiens
agcagugcuucuca

SEQ ID NO: 1023019 - RNA, 15 nt, Homo sapiens
agcagugcuucucaa

SEQ ID NO: 1023020 - RNA, 15 nt, Homo sapiens
agcagugucuuccau

SEQ ID NO: 1023021 - RNA, 22 nt, Homo sapiens
agcagugucuuccauaauguau

SEQ ID NO: 1023022 - RNA, 13 nt, Homo sapiens
agcauaacuuauu

SEQ ID NO: 1023023 - RNA, 13 nt, Homo sapiens
agcauacaacuuu

SEQ ID NO: 1023024 - RNA, 18 nt, Homo sapiens
agcauaccaacacgagca

SEQ ID NO: 1023025 - RNA, 16 nt, Homo sapiens
agcauacguacacauu

SEQ ID NO: 1023026 - RNA, 18 nt, Homo sapiens
agcauaggaaggcucuau

SEQ ID NO: 1023027 - RNA, 22 nt, Homo sapiens
agcauauguuuuuguaaguuua

SEQ ID NO: 1023028 - RNA, 15 nt, Homo sapiens
agcaucacaguuuug

SEQ ID NO: 1023029 - RNA, 11 nt, Homo sapiens
agcauccaugu

SEQ ID NO: 1023030 - RNA, 19 nt, Homo sapiens
agcaucccuugaccaggcc

SEQ ID NO: 1023031 - RNA, 20 nt, Homo sapiens
agcauccucucucacaugga

SEQ ID NO: 1023032 - RNA, 14 nt, Homo sapiens
agcauccucuuuaa

SEQ ID NO: 1023033 - RNA, 13 nt, Homo sapiens
agcaucugacuca

SEQ ID NO: 1023034 - RNA, 14 nt, Homo sapiens
agcaucugacucac

SEQ ID NO: 1023035 - RNA, 22 nt, Homo sapiens
agcaucuucacuucuaaaugca

SEQ ID NO: 1023036 - RNA, 20 nt, Homo sapiens
agcaugaccugugaccagca

SEQ ID NO: 1023037 - RNA, 18 nt, Homo sapiens
agcaugcauucauaacag

SEQ ID NO: 1023038 - RNA, 16 nt, Homo sapiens
agcauggagcauggga

SEQ ID NO: 1023039 - RNA, 15 nt, Homo sapiens
agcauuacagugggu

SEQ ID NO: 1023040 - RNA, 22 nt, Homo sapiens
agcauuacgugagccagguaau

SEQ ID NO: 1023041 - RNA, 21 nt, Homo sapiens
agcauuaguuguuauuauuaa

SEQ ID NO: 1023042 - RNA, 16 nt, Homo sapiens
agcauuccuauugaca

SEQ ID NO: 1023043 - RNA, 17 nt, Homo sapiens
agcauugagcaaagggg

SEQ ID NO: 1023044 - RNA, 17 nt, Homo sapiens
agcauuguaaaugugcu

SEQ ID NO: 1023045 - RNA, 18 nt, Homo sapiens
agcauuguaaaugugcuu

SEQ ID NO: 1023046 - RNA, 23 nt, Homo sapiens
agcauuuccaacaccacagacac

SEQ ID NO: 1023047 - RNA, 20 nt, Homo sapiens
agcauuuugcuaaaugugaa

SEQ ID NO: 1023048 - RNA, 14 nt, Homo sapiens
agccaaacccauga

SEQ ID NO: 1023049 - RNA, 19 nt, Homo sapiens
agccaaacccuugucagug

SEQ ID NO: 1023050 - RNA, 21 nt, Homo sapiens
agccaaacucugccagccaca

SEQ ID NO: 1023051 - RNA, 18 nt, Homo sapiens
agccaaagauaaucucuc

SEQ ID NO: 1023052 - RNA, 20 nt, Homo sapiens
agccaacacccugucuaaaa

SEQ ID NO: 1023053 - RNA, 22 nt, Homo sapiens
agccaacaucacaccauugcac

SEQ ID NO: 1023054 - RNA, 17 nt, Homo sapiens
agccaagaucacgccau

SEQ ID NO: 1023055 - RNA, 19 nt, Homo sapiens
agccaagauugcgccauug

SEQ ID NO: 1023056 - RNA, 15 nt, Homo sapiens
agccaagccagucaa

SEQ ID NO: 1023057 - RNA, 18 nt, Homo sapiens
agccaauaacacacagcu

SEQ ID NO: 1023058 - RNA, 15 nt, Homo sapiens
agccacaggcauuuc

SEQ ID NO: 1023059 - RNA, 16 nt, Homo sapiens
agccacgugcucucug

SEQ ID NO: 1023060 - RNA, 18 nt, Homo sapiens
agccacgugcucucugga

SEQ ID NO: 1023061 - RNA, 13 nt, Homo sapiens
agccagauucaaa

SEQ ID NO: 1023062 - RNA, 15 nt, Homo sapiens
agccagcagccagcu

SEQ ID NO: 1023063 - RNA, 15 nt, Homo sapiens
agccagcucauuuca

SEQ ID NO: 1023064 - RNA, 13 nt, Homo sapiens
agccaggagcaaa

SEQ ID NO: 1023065 - RNA, 22 nt, Homo sapiens
agccaggauugaccuuugcacg

SEQ ID NO: 1023066 - RNA, 12 nt, Homo sapiens
auucauuccauu

SEQ ID NO: 1023067 - RNA, 16 nt, Homo sapiens
auuccaccuucccaug

SEQ ID NO: 1023068 - RNA, 14 nt, Homo sapiens
auuccaguggaaca

SEQ ID NO: 1023069 - RNA, 16 nt, Homo sapiens
auuccauccucaacac

SEQ ID NO: 1023070 - RNA, 19 nt, Homo sapiens
auucccuaucuuuuaguuu

SEQ ID NO: 1023071 - RNA, 23 nt, Homo sapiens
auucccuucaucuggaaccauca

SEQ ID NO: 1023072 - RNA, 14 nt, Homo sapiens
auuccgcaccaaua

SEQ ID NO: 1023073 - RNA, 13 nt, Homo sapiens
auuccgucuuaaa

SEQ ID NO: 1023074 - RNA, 19 nt, Homo sapiens
ugagucccagagccaauca

SEQ ID NO: 1023075 - RNA, 14 nt, Homo sapiens
ugagucgaggacag

SEQ ID NO: 1023076 - RNA, 18 nt, Homo sapiens
ugaguggaucuccaagga

SEQ ID NO: 1023077 - RNA, 19 nt, Homo sapiens
ugaguggcuuuaaugaaua

SEQ ID NO: 1023078 - RNA, 19 nt, Homo sapiens
ugaguguguccaagugugu

SEQ ID NO: 1023079 - RNA, 14 nt, Homo sapiens
ugaguuuauacuca

SEQ ID NO: 1023080 - RNA, 20 nt, Homo sapiens
ugaguuuuugauagcuuuau

SEQ ID NO: 1023081 - RNA, 14 nt, Homo sapiens
ugauaaacuuugcu

SEQ ID NO: 1023082 - RNA, 16 nt, Homo sapiens
ugauaauaauugauca

SEQ ID NO: 1023083 - RNA, 14 nt, Homo sapiens
ugauacacuaugaa

SEQ ID NO: 1023084 - RNA, 15 nt, Homo sapiens
ugauacauaugugaa

SEQ ID NO: 1023085 - RNA, 22 nt, Homo sapiens
ugauacccaaguuauugggaug

SEQ ID NO: 1023086 - RNA, 12 nt, Homo sapiens
ugauacuuuuaa

SEQ ID NO: 1023087 - RNA, 18 nt, Homo sapiens
ugauaucccccagccuca

SEQ ID NO: 1023088 - RNA, 18 nt, Homo sapiens
ugauauguaaacauaauu

SEQ ID NO: 1023089 - RNA, 14 nt, Homo sapiens
ugauaugucagggc

SEQ ID NO: 1023090 - RNA, 21 nt, Homo sapiens
ugauauuucuauuuccuggaa

SEQ ID NO: 1023091 - RNA, 18 nt, Homo sapiens
ugaucaaaggcacacagc

SEQ ID NO: 1023092 - RNA, 18 nt, Homo sapiens
ugaucacggcucacugca

SEQ ID NO: 1023093 - RNA, 14 nt, Homo sapiens
ugaucagaccuugg

SEQ ID NO: 1023094 - RNA, 15 nt, Homo sapiens
ugaucaggcacagug

SEQ ID NO: 1023095 - RNA, 21 nt, Homo sapiens
ugaucaggcuauguauggaau

SEQ ID NO: 1023096 - RNA, 23 nt, Homo sapiens
ugaucauuuuccccccacucucc

SEQ ID NO: 1023097 - RNA, 16 nt, Homo sapiens
ugauccacuucucuca

SEQ ID NO: 1023098 - RNA, 19 nt, Homo sapiens
ugauccuaggcauuugcug

SEQ ID NO: 1023099 - RNA, 17 nt, Homo sapiens
ugaucuaucaauaguca

SEQ ID NO: 1023100 - RNA, 23 nt, Homo sapiens
ugaucucuucuuuuggcuuccau

SEQ ID NO: 1023101 - RNA, 18 nt, Homo sapiens
ugaugaggccucuuggac

SEQ ID NO: 1023102 - RNA, 23 nt, Homo sapiens
ugaugcucccuccccugcccugg

SEQ ID NO: 1023103 - RNA, 14 nt, Homo sapiens
ugaugcugugcuau

SEQ ID NO: 1023104 - RNA, 13 nt, Homo sapiens
ugauggaaauauu

SEQ ID NO: 1023105 - RNA, 11 nt, Homo sapiens
ugauggugcug

SEQ ID NO: 1023106 - RNA, 13 nt, Homo sapiens
ugauguccagaag

SEQ ID NO: 1023107 - RNA, 22 nt, Homo sapiens
ugaugucccuauggaagcauau

SEQ ID NO: 1023108 - RNA, 17 nt, Homo sapiens
ugauguuggcugggaac

SEQ ID NO: 1023109 - RNA, 17 nt, Homo sapiens
ugauguuucacauaaaa

SEQ ID NO: 1023110 - RNA, 20 nt, Homo sapiens
ugauuaaagguggugccaau

SEQ ID NO: 1023111 - RNA, 15 nt, Homo sapiens
ugauuaaauucuugc

SEQ ID NO: 1023112 - RNA, 21 nt, Homo sapiens
ugauuagaaggcaaguuucua

SEQ ID NO: 1023113 - RNA, 15 nt, Homo sapiens
ugauuagccauuuga

SEQ ID NO: 1023114 - RNA, 15 nt, Homo sapiens
ugauuauuaaagucc

SEQ ID NO: 1023115 - RNA, 21 nt, Homo sapiens
ugauucacaaugaaaugcucu

SEQ ID NO: 1023116 - RNA, 22 nt, Homo sapiens
ugauucaggggucugaugacac

SEQ ID NO: 1023117 - RNA, 19 nt, Homo sapiens
ugauucauacauuaucuca

SEQ ID NO: 1023118 - RNA, 20 nt, Homo sapiens
ugauucgcccaaagccagac

SEQ ID NO: 1023119 - RNA, 22 nt, Homo sapiens
ugauucuccugccucagccucc

SEQ ID NO: 1023120 - RNA, 14 nt, Homo sapiens
ugauucugaaucaa

SEQ ID NO: 1023121 - RNA, 15 nt, Homo sapiens
ugauuguauuuaccu

SEQ ID NO: 1023122 - RNA, 19 nt, Homo sapiens
ugauuguguuuauugauga

SEQ ID NO: 1023123 - RNA, 13 nt, Homo sapiens
ugauuucaggaua

SEQ ID NO: 1023124 - RNA, 16 nt, Homo sapiens
ugauuuuaacucuguc

SEQ ID NO: 1023125 - RNA, 16 nt, Homo sapiens
ugauuuuaucugugaa

SEQ ID NO: 1023126 - RNA, 22 nt, Homo sapiens
ugcaaaaggacucucaggacca

SEQ ID NO: 1023127 - RNA, 19 nt, Homo sapiens
ugcaaacucacugcucaag

SEQ ID NO: 1023128 - RNA, 13 nt, Homo sapiens
ugcaaagcacuga

SEQ ID NO: 1023129 - RNA, 16 nt, Homo sapiens
ugcaaaucagccaugu

SEQ ID NO: 1023130 - RNA, 19 nt, Homo sapiens
ugcaaauccacuagcaccg

SEQ ID NO: 1023131 - RNA, 13 nt, Homo sapiens
ugcaacaacaugu

SEQ ID NO: 1023132 - RNA, 20 nt, Homo sapiens
ugcaacagccacuacauuac

SEQ ID NO: 1023133 - RNA, 18 nt, Homo sapiens
ugcaacauguguacuuaa

SEQ ID NO: 1023134 - RNA, 17 nt, Homo sapiens
ugcaaccuuugccuccc

SEQ ID NO: 1023135 - RNA, 21 nt, Homo sapiens
ugcaacuuaaaugaaaugcau

SEQ ID NO: 1023136 - RNA, 21 nt, Homo sapiens
ugcaacuuagcucacaccuga

SEQ ID NO: 1023137 - RNA, 12 nt, Homo sapiens
ugcaagacauag

SEQ ID NO: 1023138 - RNA, 19 nt, Homo sapiens
ugcaagcaagaaacacugg

SEQ ID NO: 1023139 - RNA, 19 nt, Homo sapiens
ugcaagcacaucugcauuu

SEQ ID NO: 1023140 - RNA, 13 nt, Homo sapiens
ugcaaggucauuu

SEQ ID NO: 1023141 - RNA, 16 nt, Homo sapiens
ugcaaguaaacaccug

SEQ ID NO: 1023142 - RNA, 15 nt, Homo sapiens
ugcaagucauggcug

SEQ ID NO: 1023143 - RNA, 14 nt, Homo sapiens
ugcaagugugugca

SEQ ID NO: 1023144 - RNA, 16 nt, Homo sapiens
ugcaauaauacuucuc

SEQ ID NO: 1023145 - RNA, 20 nt, Homo sapiens
ugcaauauuuccucauguga

SEQ ID NO: 1023146 - RNA, 16 nt, Homo sapiens
ugcaauccucccuacc

SEQ ID NO: 1023147 - RNA, 21 nt, Homo sapiens
ugcaauccucccuaccguccu

SEQ ID NO: 1023148 - RNA, 21 nt, Homo sapiens
ugcaaucuucucagaaggcaa

SEQ ID NO: 1023149 - RNA, 16 nt, Homo sapiens
ugcaaugacacagucu

SEQ ID NO: 1023150 - RNA, 18 nt, Homo sapiens
ugcaaugacacagucuug

SEQ ID NO: 1023151 - RNA, 13 nt, Homo sapiens
ugcaauggcucaa

SEQ ID NO: 1023152 - RNA, 13 nt, Homo sapiens
ugcaaugugcuac

SEQ ID NO: 1023153 - RNA, 16 nt, Homo sapiens
ugcaauuaaagugaua

SEQ ID NO: 1023154 - RNA, 14 nt, Homo sapiens
ugcaauugaccucu

SEQ ID NO: 1023155 - RNA, 14 nt, Homo sapiens
ugcaauuugcacaa

SEQ ID NO: 1023156 - RNA, 15 nt, Homo sapiens
ugcacaaaccaauua

SEQ ID NO: 1023157 - RNA, 20 nt, Homo sapiens
ugcacacacacacaucucau

SEQ ID NO: 1023158 - RNA, 23 nt, Homo sapiens
ugcacacauuuuuuaaaugcacc

SEQ ID NO: 1023159 - RNA, 19 nt, Homo sapiens
ugcacaggucccacugccc

SEQ ID NO: 1023160 - RNA, 16 nt, Homo sapiens
ugcacaguagagcaaa

SEQ ID NO: 1023161 - RNA, 19 nt, Homo sapiens
ugcacauacuugagacugu

SEQ ID NO: 1023162 - RNA, 15 nt, Homo sapiens
ugcacaucacaacau

SEQ ID NO: 1023163 - RNA, 18 nt, Homo sapiens
ugcaccccaccagcaaua

SEQ ID NO: 1023164 - RNA, 18 nt, Homo sapiens
ugcaccuguacucaggag

SEQ ID NO: 1023165 - RNA, 14 nt, Homo sapiens
ugcacgaucucagu

SEQ ID NO: 1023166 - RNA, 15 nt, Homo sapiens
ugcacgcccaugugu

SEQ ID NO: 1023167 - RNA, 19 nt, Homo sapiens
ugcacuacagcccuggccu

SEQ ID NO: 1023168 - RNA, 16 nt, Homo sapiens
ugcacuccagccuggg

SEQ ID NO: 1023169 - RNA, 19 nt, Homo sapiens
ugcacucuaacccuaggca

SEQ ID NO: 1023170 - RNA, 17 nt, Homo sapiens
ugcacugagagugaagu

SEQ ID NO: 1023171 - RNA, 16 nt, Homo sapiens
ugcacugucacuuugc

SEQ ID NO: 1023172 - RNA, 23 nt, Homo sapiens
ugcacuugcacgcccauguguga

SEQ ID NO: 1023173 - RNA, 14 nt, Homo sapiens
ugcagaagacagua

SEQ ID NO: 1023174 - RNA, 12 nt, Homo sapiens
ugcagacaugag

SEQ ID NO: 1023175 - RNA, 12 nt, Homo sapiens
ugcagagcaaug

SEQ ID NO: 1023176 - RNA, 20 nt, Homo sapiens
ugcagagccacccuguguug

SEQ ID NO: 1023177 - RNA, 19 nt, Homo sapiens
ugcagagguaaaaguguga

SEQ ID NO: 1023178 - RNA, 22 nt, Homo sapiens
ugcagauaaacaguagugauag

SEQ ID NO: 1023179 - RNA, 14 nt, Homo sapiens
ugcagcagaggcac

SEQ ID NO: 1023180 - RNA, 23 nt, Homo sapiens
ugcagccucacaguccuuaccag

SEQ ID NO: 1023181 - RNA, 16 nt, Homo sapiens
ugcagcuaacuuauca

SEQ ID NO: 1023182 - RNA, 13 nt, Homo sapiens
ugcaggcacagua

SEQ ID NO: 1023183 - RNA, 22 nt, Homo sapiens
ugcaggcacucaaugcagccag

SEQ ID NO: 1023184 - RNA, 19 nt, Homo sapiens
ugcaggcaugcaugugcuu

SEQ ID NO: 1023185 - RNA, 20 nt, Homo sapiens
ugcaggccaggccagcugcc

SEQ ID NO: 1023186 - RNA, 14 nt, Homo sapiens
ugcagggacugcca

SEQ ID NO: 1023187 - RNA, 13 nt, Homo sapiens
ugcagggccagac

SEQ ID NO: 1023188 - RNA, 21 nt, Homo sapiens
ugcagggggugugucugcuca

SEQ ID NO: 1023189 - RNA, 12 nt, Homo sapiens
ugcaggucucaa

SEQ ID NO: 1023190 - RNA, 18 nt, Homo sapiens
ugcagguuuguuacauag

SEQ ID NO: 1023191 - RNA, 18 nt, Homo sapiens
ugcagucaucuugaccaa

SEQ ID NO: 1023192 - RNA, 13 nt, Homo sapiens
ugcagucugggug

SEQ ID NO: 1023193 - RNA, 17 nt, Homo sapiens
ugcagugccccuagcuu

SEQ ID NO: 1023194 - RNA, 18 nt, Homo sapiens
ugcaguggcgugaucucg

SEQ ID NO: 1023195 - RNA, 23 nt, Homo sapiens
ugcagugguaugaucacggcuca

SEQ ID NO: 1023196 - RNA, 15 nt, Homo sapiens
ugcaguuuccaaucc

SEQ ID NO: 1023197 - RNA, 20 nt, Homo sapiens
ugcauaagugcaugacauau

SEQ ID NO: 1023198 - RNA, 14 nt, Homo sapiens
ugcauaauaagcua

SEQ ID NO: 1023199 - RNA, 22 nt, Homo sapiens
ugcauacacacacacacacagc

SEQ ID NO: 1023200 - RNA, 14 nt, Homo sapiens
ugcauacaguaauu

SEQ ID NO: 1023201 - RNA, 19 nt, Homo sapiens
ugcauagagccacguaugu

SEQ ID NO: 1023202 - RNA, 14 nt, Homo sapiens
ugcauaggaaguau

SEQ ID NO: 1023203 - RNA, 20 nt, Homo sapiens
ugcauauccaacaugugcuc

SEQ ID NO: 1023204 - RNA, 21 nt, Homo sapiens
ugcauauccaacaugugcuca

SEQ ID NO: 1023205 - RNA, 16 nt, Homo sapiens
ugcauauuuuauuaua

SEQ ID NO: 1023206 - RNA, 19 nt, Homo sapiens
ugcauccagccuccugcua

SEQ ID NO: 1023207 - RNA, 17 nt, Homo sapiens
ugcauccccaacuuagc

SEQ ID NO: 1023208 - RNA, 19 nt, Homo sapiens
ugcaucguuucaucuucca

SEQ ID NO: 1023209 - RNA, 13 nt, Homo sapiens
ugcaugaaacaug

SEQ ID NO: 1023210 - RNA, 21 nt, Homo sapiens
ugcaugcgagugcucauuuca

SEQ ID NO: 1023211 - RNA, 12 nt, Homo sapiens
ugcuucagccug

SEQ ID NO: 1023212 - RNA, 16 nt, Homo sapiens
ugcuucuucucaggca

SEQ ID NO: 1023213 - RNA, 14 nt, Homo sapiens
ugcuugaaccuggg

SEQ ID NO: 1023214 - RNA, 21 nt, Homo sapiens
ugcuugagcccaggaauuuga

SEQ ID NO: 1023215 - RNA, 22 nt, Homo sapiens
ugcuugccucaguaaaaugaac

SEQ ID NO: 1023216 - RNA, 21 nt, Homo sapiens
ugcuuggguggagaagccauu

SEQ ID NO: 1023217 - RNA, 20 nt, Homo sapiens
ugcuuguaaaauuucacuua

SEQ ID NO: 1023218 - RNA, 20 nt, Homo sapiens
ugcuuuacuuugcccaggga

SEQ ID NO: 1023219 - RNA, 16 nt, Homo sapiens
ugcuuuucacugcugc

SEQ ID NO: 1023220 - RNA, 21 nt, Homo sapiens
ugcuuuucugcggcuguguag

SEQ ID NO: 1023221 - RNA, 17 nt, Homo sapiens
ugcuuuugaaaucugua

SEQ ID NO: 1023222 - RNA, 18 nt, Homo sapiens
ugcuuuugaaaucuguau

SEQ ID NO: 1023223 - RNA, 16 nt, Homo sapiens
uggaaaaaaaggaaga

SEQ ID NO: 1023224 - RNA, 16 nt, Homo sapiens
uggaaaaaacaaaaac

SEQ ID NO: 1023225 - RNA, 20 nt, Homo sapiens
uggaaaaaaugauguucauu

SEQ ID NO: 1023226 - RNA, 18 nt, Homo sapiens
uggaaaagggucuuggga

SEQ ID NO: 1023227 - RNA, 14 nt, Homo sapiens
uggaaaauauguaa

SEQ ID NO: 1023228 - RNA, 12 nt, Homo sapiens
uggaaaaugcau

SEQ ID NO: 1023229 - RNA, 16 nt, Homo sapiens
uggaaaaugugcaaua

SEQ ID NO: 1023230 - RNA, 22 nt, Homo sapiens
uggaaaggcucagucucaggag

SEQ ID NO: 1023231 - RNA, 15 nt, Homo sapiens
auuuuaucugugaau

SEQ ID NO: 1023232 - RNA, 16 nt, Homo sapiens
auuuuaugaucuuggc

SEQ ID NO: 1023233 - RNA, 13 nt, Homo sapiens
auuuuauuauaau

SEQ ID NO: 1023234 - RNA, 15 nt, Homo sapiens
auuuuauuaugcaug

SEQ ID NO: 1023235 - RNA, 19 nt, Homo sapiens
auuuuauucccaagcucua

SEQ ID NO: 1023236 - RNA, 18 nt, Homo sapiens
auuuuauuuuucucauga

SEQ ID NO: 1023237 - RNA, 19 nt, Homo sapiens
auuuucaagaaacugagga

SEQ ID NO: 1023238 - RNA, 13 nt, Homo sapiens
auuuucacuuuug

SEQ ID NO: 1023239 - RNA, 20 nt, Homo sapiens
auuuucacuuuuggcuugua

SEQ ID NO: 1023240 - RNA, 18 nt, Homo sapiens
auuuuccaagugugcaua

SEQ ID NO: 1023241 - RNA, 15 nt, Homo sapiens
auuuuccccaaccuc

SEQ ID NO: 1023242 - RNA, 22 nt, Homo sapiens
auuuuccccccacucuccccac

SEQ ID NO: 1023243 - RNA, 12 nt, Homo sapiens
auuuucuuccaa

SEQ ID NO: 1023244 - RNA, 21 nt, Homo sapiens
auuuucuuucucuacuuugag

SEQ ID NO: 1023245 - RNA, 17 nt, Homo sapiens
auuuucuuuuuauacua

SEQ ID NO: 1023246 - RNA, 23 nt, Homo sapiens
auuuugaaaaaaaauuucaaaaa

SEQ ID NO: 1023247 - RNA, 15 nt, Homo sapiens
auuuugcagcaguga

SEQ ID NO: 1023248 - RNA, 15 nt, Homo sapiens
auuuugcaggauuug

SEQ ID NO: 1023249 - RNA, 21 nt, Homo sapiens
auuuuggggugaagauucagu

SEQ ID NO: 1023250 - RNA, 19 nt, Homo sapiens
auuuugggguuguguuguc

SEQ ID NO: 1023251 - RNA, 21 nt, Homo sapiens
auuuugggguuguguugucac

SEQ ID NO: 1023252 - RNA, 13 nt, Homo sapiens
auuuugguacuuu

SEQ ID NO: 1023253 - RNA, 23 nt, Homo sapiens
auuuugguggguuuugaacauaa

SEQ ID NO: 1023254 - RNA, 21 nt, Homo sapiens
auuuuguguguaccugugacu

SEQ ID NO: 1023255 - RNA, 21 nt, Homo sapiens
auuuuguuuuugucuuaaaaa

SEQ ID NO: 1023256 - RNA, 15 nt, Homo sapiens
auuuuuaaggacuuu

SEQ ID NO: 1023257 - RNA, 19 nt, Homo sapiens
auuuuuaguuuaaaaaccu

SEQ ID NO: 1023258 - RNA, 16 nt, Homo sapiens
auuuuuauacuuucag

SEQ ID NO: 1023259 - RNA, 16 nt, Homo sapiens
auuuuuaugugcaaua

SEQ ID NO: 1023260 - RNA, 18 nt, Homo sapiens
auuuuucagauauaaaag

SEQ ID NO: 1023261 - RNA, 13 nt, Homo sapiens
auuuuuccauuua

SEQ ID NO: 1023262 - RNA, 19 nt, Homo sapiens
auuuuugugaaaaugucaa

SEQ ID NO: 1023263 - RNA, 14 nt, Homo sapiens
auuuuugugcacau

SEQ ID NO: 1023264 - RNA, 21 nt, Homo sapiens
auuuuuuaugaaacauuacag

SEQ ID NO: 1023265 - RNA, 18 nt, Homo sapiens
auuuuuuccagucuuccu

SEQ ID NO: 1023266 - RNA, 18 nt, Homo sapiens
auuuuuuugagacagagu

SEQ ID NO: 1023267 - RNA, 22 nt, Homo sapiens
auuuuuuugugggaaauccaca

SEQ ID NO: 1023268 - RNA, 20 nt, Homo sapiens
auuuuuuuuaacauuccaau

SEQ ID NO: 1023269 - RNA, 14 nt, Homo sapiens
caaaaaaagacagg

SEQ ID NO: 1023270 - RNA, 17 nt, Homo sapiens
caaaaaaguuacaacuu

SEQ ID NO: 1023271 - RNA, 18 nt, Homo sapiens
caaaaaaguuguuaacua

SEQ ID NO: 1023272 - RNA, 13 nt, Homo sapiens
caaaaaauuugag

SEQ ID NO: 1023273 - RNA, 15 nt, Homo sapiens
caaaaacauggccuu

SEQ ID NO: 1023274 - RNA, 15 nt, Homo sapiens
caaaaacuacacaua

SEQ ID NO: 1023275 - RNA, 12 nt, Homo sapiens
caaaaacuuugg

SEQ ID NO: 1023276 - RNA, 15 nt, Homo sapiens
caaaaagcuucccca

SEQ ID NO: 1023277 - RNA, 22 nt, Homo sapiens
caaaaagggauccguacauuca

SEQ ID NO: 1023278 - RNA, 21 nt, Homo sapiens
caaaaaugaaagcaugucuca

SEQ ID NO: 1023279 - RNA, 23 nt, Homo sapiens
caaaaaugaaagcaugucucaau

SEQ ID NO: 1023280 - RNA, 18 nt, Homo sapiens
caaaacagagaugugaua

SEQ ID NO: 1023281 - RNA, 17 nt, Homo sapiens
caaaacauuuuacuuua

SEQ ID NO: 1023282 - RNA, 17 nt, Homo sapiens
caaaaccugauguuaaa

SEQ ID NO: 1023283 - RNA, 16 nt, Homo sapiens
caaaacucaguaucau

SEQ ID NO: 1023284 - RNA, 16 nt, Homo sapiens
caaaacugacaguaaa

SEQ ID NO: 1023285 - RNA, 17 nt, Homo sapiens
caaaacugacaguaaau

SEQ ID NO: 1023286 - RNA, 20 nt, Homo sapiens
caaaacuuggaauucucuca

SEQ ID NO: 1023287 - RNA, 14 nt, Homo sapiens
caaaacuuuggcac

SEQ ID NO: 1023288 - RNA, 13 nt, Homo sapiens
caaaagaagacaa

SEQ ID NO: 1023289 - RNA, 20 nt, Homo sapiens
caaaagaagacaacauuucu

SEQ ID NO: 1023290 - RNA, 22 nt, Homo sapiens
caaaagaagacaacauuucuca

SEQ ID NO: 1023291 - RNA, 15 nt, Homo sapiens
caaaagcccauucau

SEQ ID NO: 1023292 - RNA, 20 nt, Homo sapiens
caaaagcccauucauuccau

SEQ ID NO: 1023293 - RNA, 20 nt, Homo sapiens
caaaagcuuauucaucuguu

SEQ ID NO: 1023294 - RNA, 14 nt, Homo sapiens
caaaaggaccccaa

SEQ ID NO: 1023295 - RNA, 15 nt, Homo sapiens
caaaaggacucucag

SEQ ID NO: 1023296 - RNA, 23 nt, Homo sapiens
caaaaguucuuugggacaaaaca

SEQ ID NO: 1023297 - RNA, 16 nt, Homo sapiens
caaaauaaacuccccu

SEQ ID NO: 1023298 - RNA, 17 nt, Homo sapiens
caaaauaaagugacaga

SEQ ID NO: 1023299 - RNA, 16 nt, Homo sapiens
caaaaucacacagcca

SEQ ID NO: 1023300 - RNA, 17 nt, Homo sapiens
caaaaugaauucuggga

SEQ ID NO: 1023301 - RNA, 18 nt, Homo sapiens
caaaaugaugucauguca

SEQ ID NO: 1023302 - RNA, 16 nt, Homo sapiens
caaaauuacacaguua

SEQ ID NO: 1023303 - RNA, 13 nt, Homo sapiens
caaaauucauuca

SEQ ID NO: 1023304 - RNA, 17 nt, Homo sapiens
caaaauuuaugcaaauc

SEQ ID NO: 1023305 - RNA, 15 nt, Homo sapiens
caaaauuuccaguac

SEQ ID NO: 1023306 - RNA, 20 nt, Homo sapiens
caaaauuugaugccaggaca

SEQ ID NO: 1023307 - RNA, 21 nt, Homo sapiens
caaacacauuaagccuuccac

SEQ ID NO: 1023308 - RNA, 16 nt, Homo sapiens
caaacacuuacagaau

SEQ ID NO: 1023309 - RNA, 17 nt, Homo sapiens
caaacagaacuauggaa

SEQ ID NO: 1023310 - RNA, 17 nt, Homo sapiens
caaacagccacacugug

SEQ ID NO: 1023311 - RNA, 11 nt, Homo sapiens
caaacagugac

SEQ ID NO: 1023312 - RNA, 14 nt, Homo sapiens
caaacauaaagaga

SEQ ID NO: 1023313 - RNA, 16 nt, Homo sapiens
caaaccccgaccaccu

SEQ ID NO: 1023314 - RNA, 15 nt, Homo sapiens
caaaccgagugcaau

SEQ ID NO: 1023315 - RNA, 16 nt, Homo sapiens
caaaccgagugcaaug

SEQ ID NO: 1023316 - RNA, 17 nt, Homo sapiens
caaaccgagugcaauga

SEQ ID NO: 1023317 - RNA, 14 nt, Homo sapiens
caaaccuccacugc

SEQ ID NO: 1023318 - RNA, 17 nt, Homo sapiens
caaaccucuaacccagg

SEQ ID NO: 1023319 - RNA, 19 nt, Homo sapiens
caaaccuguguaggcauuu

SEQ ID NO: 1023320 - RNA, 15 nt, Homo sapiens
caaacuacauguaau

SEQ ID NO: 1023321 - RNA, 23 nt, Homo sapiens
caaacuaccuuccaguuccucau

SEQ ID NO: 1023322 - RNA, 21 nt, Homo sapiens
caaacucacugcucaagaaga

SEQ ID NO: 1023323 - RNA, 13 nt, Homo sapiens
caaacuccugacc

SEQ ID NO: 1023324 - RNA, 22 nt, Homo sapiens
caaacucuuaguuacucauuca

SEQ ID NO: 1023325 - RNA, 15 nt, Homo sapiens
caaacugaggaauuu

SEQ ID NO: 1023326 - RNA, 14 nt, Homo sapiens
caaacuucaagggu

SEQ ID NO: 1023327 - RNA, 14 nt, Homo sapiens
caaacuucccugac

SEQ ID NO: 1023328 - RNA, 21 nt, Homo sapiens
caaacuucccugacucuucaa

SEQ ID NO: 1023329 - RNA, 14 nt, Homo sapiens
caaacuugcuuuau

SEQ ID NO: 1023330 - RNA, 22 nt, Homo sapiens
caaagaacuuggaaauagugau

SEQ ID NO: 1023331 - RNA, 18 nt, Homo sapiens
caaagaagguuaccaaga

SEQ ID NO: 1023332 - RNA, 20 nt, Homo sapiens
caaagaauuuuuuuuaacau

SEQ ID NO: 1023333 - RNA, 23 nt, Homo sapiens
caaagacugaguacguugugcau

SEQ ID NO: 1023334 - RNA, 13 nt, Homo sapiens
caaagacuuuccu

SEQ ID NO: 1023335 - RNA, 14 nt, Homo sapiens
caaagagauuauuu

SEQ ID NO: 1023336 - RNA, 12 nt, Homo sapiens
caaagauuugcu

SEQ ID NO: 1023337 - RNA, 23 nt, Homo sapiens
caaagcaaggaaacuauguaaca

SEQ ID NO: 1023338 - RNA, 21 nt, Homo sapiens
caaagccaauaacacacagcu

SEQ ID NO: 1023339 - RNA, 23 nt, Homo sapiens
caaagccacacucugggcuccag

SEQ ID NO: 1023340 - RNA, 23 nt, Homo sapiens
caaagccuuaucaagugucuucc

SEQ ID NO: 1023341 - RNA, 21 nt, Homo sapiens
caaagcuguuggccucugcaa

SEQ ID NO: 1023342 - RNA, 22 nt, Homo sapiens
caaagcuuucauguaaacugug

SEQ ID NO: 1023343 - RNA, 18 nt, Homo sapiens
caaaggagggucaggaag

SEQ ID NO: 1023344 - RNA, 15 nt, Homo sapiens
caaaggcacugaggc

SEQ ID NO: 1023345 - RNA, 21 nt, Homo sapiens
caaaggcugagaacacuguga

SEQ ID NO: 1023346 - RNA, 20 nt, Homo sapiens
caaagggagcagaacugaac

SEQ ID NO: 1023347 - RNA, 14 nt, Homo sapiens
caaaguauuugcug

SEQ ID NO: 1023348 - RNA, 16 nt, Homo sapiens
caaagugacuauucag

SEQ ID NO: 1023349 - RNA, 17 nt, Homo sapiens
caaagugagacuccguc

SEQ ID NO: 1023350 - RNA, 19 nt, Homo sapiens
caaagugcugagauuacag

SEQ ID NO: 1023351 - RNA, 20 nt, Homo sapiens
caaagugcuuccaaggcaga

SEQ ID NO: 1023352 - RNA, 11 nt, Homo sapiens
caaagugugac

SEQ ID NO: 1023353 - RNA, 11 nt, Homo sapiens
caaaguuggcg

SEQ ID NO: 1023354 - RNA, 15 nt, Homo sapiens
caaauaaagaccuga

SEQ ID NO: 1023355 - RNA, 16 nt, Homo sapiens
caaauaaauucauaca

SEQ ID NO: 1023356 - RNA, 17 nt, Homo sapiens
caagucacucaucucag

SEQ ID NO: 1023357 - RNA, 21 nt, Homo sapiens
caagucaggcccuuauuuuca

SEQ ID NO: 1023358 - RNA, 18 nt, Homo sapiens
caagucaugugcauuucc

SEQ ID NO: 1023359 - RNA, 16 nt, Homo sapiens
caaguccagauuuaca

SEQ ID NO: 1023360 - RNA, 17 nt, Homo sapiens
caaguccuuaccucuuc

SEQ ID NO: 1023361 - RNA, 18 nt, Homo sapiens
caagucuucucaagaucc

SEQ ID NO: 1023362 - RNA, 20 nt, Homo sapiens
caagucuuuacagaaucaaa

SEQ ID NO: 1023363 - RNA, 17 nt, Homo sapiens
caagugaaaaacaucca

SEQ ID NO: 1023364 - RNA, 18 nt, Homo sapiens
caagugaaaaacauccag

SEQ ID NO: 1023365 - RNA, 18 nt, Homo sapiens
caagugggaucugucaca

SEQ ID NO: 1023366 - RNA, 18 nt, Homo sapiens
caaguggugccuaaaguu

SEQ ID NO: 1023367 - RNA, 21 nt, Homo sapiens
caaguggugccuaaaguuuaa

SEQ ID NO: 1023368 - RNA, 20 nt, Homo sapiens
caaguguaaccuugcaucuc

SEQ ID NO: 1023369 - RNA, 16 nt, Homo sapiens
caagugucugugugca

SEQ ID NO: 1023370 - RNA, 13 nt, Homo sapiens
caagugucuucca

SEQ ID NO: 1023371 - RNA, 12 nt, Homo sapiens
caagugugaaca

SEQ ID NO: 1023372 - RNA, 22 nt, Homo sapiens
caagugugcauauuguacacuu

SEQ ID NO: 1023373 - RNA, 14 nt, Homo sapiens
caagugugugcaca

SEQ ID NO: 1023374 - RNA, 16 nt, Homo sapiens
caagugugugcaugug

SEQ ID NO: 1023375 - RNA, 23 nt, Homo sapiens
caaguuaaagugaauaaccacuu

SEQ ID NO: 1023376 - RNA, 16 nt, Homo sapiens
caaguuguggugcuga

SEQ ID NO: 1023377 - RNA, 17 nt, Homo sapiens
caaguuguguuugauau

SEQ ID NO: 1023378 - RNA, 16 nt, Homo sapiens
caaguuucaucaguca

SEQ ID NO: 1023379 - RNA, 18 nt, Homo sapiens
caaguuucuagcuagaaa

SEQ ID NO: 1023380 - RNA, 21 nt, Homo sapiens
caaguuuuucagaaagcauua

SEQ ID NO: 1023381 - RNA, 18 nt, Homo sapiens
caauaaacugcuuugcaa

SEQ ID NO: 1023382 - RNA, 18 nt, Homo sapiens
caauaaagaccacuuuac

SEQ ID NO: 1023383 - RNA, 19 nt, Homo sapiens
caauaaagcagcguuucua

SEQ ID NO: 1023384 - RNA, 15 nt, Homo sapiens
caauaaagccuucaa

SEQ ID NO: 1023385 - RNA, 16 nt, Homo sapiens
caauaaaguaucuaca

SEQ ID NO: 1023386 - RNA, 16 nt, Homo sapiens
caauaaaguuugccca

SEQ ID NO: 1023387 - RNA, 13 nt, Homo sapiens
caauaagcaucaa

SEQ ID NO: 1023388 - RNA, 18 nt, Homo sapiens
uggcuuuagcuaccucac

SEQ ID NO: 1023389 - RNA, 14 nt, Homo sapiens
uggcuuuugugcau

SEQ ID NO: 1023390 - RNA, 23 nt, Homo sapiens
uggcuuuuuuccuccuguguaca

SEQ ID NO: 1023391 - RNA, 21 nt, Homo sapiens
ugggaaauauuuagcaaauaa

SEQ ID NO: 1023392 - RNA, 18 nt, Homo sapiens
ugggaacuagacucccaa

SEQ ID NO: 1023393 - RNA, 17 nt, Homo sapiens
ugggaacuccuaaauca

SEQ ID NO: 1023394 - RNA, 15 nt, Homo sapiens
ugggaacugcaauaa

SEQ ID NO: 1023395 - RNA, 16 nt, Homo sapiens
ugggaauugugugaug

SEQ ID NO: 1023396 - RNA, 17 nt, Homo sapiens
ugggaauuuucuuccaa

SEQ ID NO: 1023397 - RNA, 15 nt, Homo sapiens
ugggacacccuguga

SEQ ID NO: 1023398 - RNA, 16 nt, Homo sapiens
ugggacacccugugau

SEQ ID NO: 1023399 - RNA, 18 nt, Homo sapiens
ugggacaugggaaagggg

SEQ ID NO: 1023400 - RNA, 22 nt, Homo sapiens
ugggaccaacuuccuguugaug

SEQ ID NO: 1023401 - RNA, 20 nt, Homo sapiens
ugggaccacacagacagggu

SEQ ID NO: 1023402 - RNA, 13 nt, Homo sapiens
ugggaccacagac

SEQ ID NO: 1023403 - RNA, 23 nt, Homo sapiens
ugggaccucaguuuuaucauuuu

SEQ ID NO: 1023404 - RNA, 22 nt, Homo sapiens
ugggacuacaggugugagucac

SEQ ID NO: 1023405 - RNA, 13 nt, Homo sapiens
ugggacugagaug

SEQ ID NO: 1023406 - RNA, 14 nt, Homo sapiens
ugggacuuauguau

SEQ ID NO: 1023407 - RNA, 21 nt, Homo sapiens
ugggagaaauugacagaucaa

SEQ ID NO: 1023408 - RNA, 17 nt, Homo sapiens
ugggagacacugaugua

SEQ ID NO: 1023409 - RNA, 14 nt, Homo sapiens
ugggagcacaggca

SEQ ID NO: 1023410 - RNA, 18 nt, Homo sapiens
ugggagccagggcugucu

SEQ ID NO: 1023411 - RNA, 19 nt, Homo sapiens
ugggagcccaguuucacug

SEQ ID NO: 1023412 - RNA, 14 nt, Homo sapiens
ugggauaaucacau

SEQ ID NO: 1023413 - RNA, 19 nt, Homo sapiens
ugggauagcacguggagcu

SEQ ID NO: 1023414 - RNA, 20 nt, Homo sapiens
ugggaucugucacaccagcc

SEQ ID NO: 1023415 - RNA, 18 nt, Homo sapiens
ugggaugaugccucauga

SEQ ID NO: 1023416 - RNA, 23 nt, Homo sapiens
ugggaugggccugcuuccugucu

SEQ ID NO: 1023417 - RNA, 12 nt, Homo sapiens
ugggauucccac

SEQ ID NO: 1023418 - RNA, 14 nt, Homo sapiens
ugggauuccugacc

SEQ ID NO: 1023419 - RNA, 13 nt, Homo sapiens
ugggcaaaacuga

SEQ ID NO: 1023420 - RNA, 14 nt, Homo sapiens
ugggcaaugugaua

SEQ ID NO: 1023421 - RNA, 16 nt, Homo sapiens
ugggcaggaccucaga

SEQ ID NO: 1023422 - RNA, 18 nt, Homo sapiens
ugggcaggguacagacac

SEQ ID NO: 1023423 - RNA, 18 nt, Homo sapiens
ugggccaagucaaagaca

SEQ ID NO: 1023424 - RNA, 14 nt, Homo sapiens
ugggccacagccau

SEQ ID NO: 1023425 - RNA, 18 nt, Homo sapiens
ugggcccaaugcacuuug

SEQ ID NO: 1023426 - RNA, 16 nt, Homo sapiens
ugggcccuuugagugc

SEQ ID NO: 1023427 - RNA, 13 nt, Homo sapiens
ugggccuccucac

SEQ ID NO: 1023428 - RNA, 20 nt, Homo sapiens
ugggccuccucacaacaugg

SEQ ID NO: 1023429 - RNA, 15 nt, Homo sapiens
ugggcgacagagcca

SEQ ID NO: 1023430 - RNA, 13 nt, Homo sapiens
ugggcuacaagga

SEQ ID NO: 1023431 - RNA, 15 nt, Homo sapiens
uggggaagcugugaa

SEQ ID NO: 1023432 - RNA, 20 nt, Homo sapiens
uggggaaguguuccagauag

SEQ ID NO: 1023433 - RNA, 22 nt, Homo sapiens
uggggacagagcagaacuuuca

SEQ ID NO: 1023434 - RNA, 12 nt, Homo sapiens
uggggacagggc

SEQ ID NO: 1023435 - RNA, 16 nt, Homo sapiens
uggggagaaaguacuu

SEQ ID NO: 1023436 - RNA, 15 nt, Homo sapiens
uggggagucagggac

SEQ ID NO: 1023437 - RNA, 16 nt, Homo sapiens
uggggaugucucucau

SEQ ID NO: 1023438 - RNA, 17 nt, Homo sapiens
uggggccgaaagaacag

SEQ ID NO: 1023439 - RNA, 15 nt, Homo sapiens
ugggggaaagcacag

SEQ ID NO: 1023440 - RNA, 21 nt, Homo sapiens
ugggguacccacugcucuggu

SEQ ID NO: 1023441 - RNA, 21 nt, Homo sapiens
ugggguauuuaccacagcagc

SEQ ID NO: 1023442 - RNA, 22 nt, Homo sapiens
ugggguugaaaauucaaaaagu

SEQ ID NO: 1023443 - RNA, 15 nt, Homo sapiens
uggguaucagcaucu

SEQ ID NO: 1023444 - RNA, 14 nt, Homo sapiens
uggguccaggggau

SEQ ID NO: 1023445 - RNA, 14 nt, Homo sapiens
ugggucuaugccuu

SEQ ID NO: 1023446 - RNA, 23 nt, Homo sapiens
ugggucucauuuagaacuugcag

SEQ ID NO: 1023447 - RNA, 17 nt, Homo sapiens
ugggucuuucauggggu

SEQ ID NO: 1023448 - RNA, 17 nt, Homo sapiens
uggguggagaagccauu

SEQ ID NO: 1023449 - RNA, 15 nt, Homo sapiens
ugggugucucugcau

SEQ ID NO: 1023450 - RNA, 19 nt, Homo sapiens
uggguuggaaaacaguauu

SEQ ID NO: 1023451 - RNA, 21 nt, Homo sapiens
uggguuuucuccauucaggau

SEQ ID NO: 1023452 - RNA, 20 nt, Homo sapiens
uggguuuugggucuuugaac

SEQ ID NO: 1023453 - RNA, 18 nt, Homo sapiens
ugguaaaaccccaucucu

SEQ ID NO: 1023454 - RNA, 14 nt, Homo sapiens
ugguaaaauacuuc

SEQ ID NO: 1023455 - RNA, 19 nt, Homo sapiens
ugguaauaaguacugugua

SEQ ID NO: 1023456 - RNA, 17 nt, Homo sapiens
ugguauaucuuuuucca

SEQ ID NO: 1023457 - RNA, 22 nt, Homo sapiens
uggucaaacaaacucucugaac

SEQ ID NO: 1023458 - RNA, 15 nt, Homo sapiens
uggucaacacuuaag

SEQ ID NO: 1023459 - RNA, 13 nt, Homo sapiens
uggucaagcacuc

SEQ ID NO: 1023460 - RNA, 14 nt, Homo sapiens
uggucaagcacucg

SEQ ID NO: 1023461 - RNA, 20 nt, Homo sapiens
uggucaauccgaaguaugag

SEQ ID NO: 1023462 - RNA, 14 nt, Homo sapiens
uggucacauacaau

SEQ ID NO: 1023463 - RNA, 22 nt, Homo sapiens
uggucaccaaaucagcugcuac

SEQ ID NO: 1023464 - RNA, 12 nt, Homo sapiens
uggucacuggaa

SEQ ID NO: 1023465 - RNA, 22 nt, Homo sapiens
uggucacuggaacucaguguga

SEQ ID NO: 1023466 - RNA, 14 nt, Homo sapiens
uggucagauuugaa

SEQ ID NO: 1023467 - RNA, 16 nt, Homo sapiens
uggucagcguugcaug

SEQ ID NO: 1023468 - RNA, 21 nt, Homo sapiens
uggucccaacaggaggacaau

SEQ ID NO: 1023469 - RNA, 12 nt, Homo sapiens
ugguccuguaaa

SEQ ID NO: 1023470 - RNA, 12 nt, Homo sapiens
uggucucagugu

SEQ ID NO: 1023471 - RNA, 13 nt, Homo sapiens
uggucugacccac

SEQ ID NO: 1023472 - RNA, 22 nt, Homo sapiens
uggucuuuguaagaguguagaa

SEQ ID NO: 1023473 - RNA, 19 nt, Homo sapiens
uggugaaaccucaucucua

SEQ ID NO: 1023474 - RNA, 19 nt, Homo sapiens
uggugagaugcagcuggaa

SEQ ID NO: 1023475 - RNA, 17 nt, Homo sapiens
uggugagcgaggacauu

SEQ ID NO: 1023476 - RNA, 21 nt, Homo sapiens
uggugagcuuaacccuggaaa

SEQ ID NO: 1023477 - RNA, 14 nt, Homo sapiens
uggugauauccucu

SEQ ID NO: 1023478 - RNA, 14 nt, Homo sapiens
ugguggucagggag

SEQ ID NO: 1023479 - RNA, 11 nt, Homo sapiens
uggugugauuu

SEQ ID NO: 1023480 - RNA, 15 nt, Homo sapiens
uggugugugccucau

SEQ ID NO: 1023481 - RNA, 22 nt, Homo sapiens
ugguguuaccuuagcuaacuaa

SEQ ID NO: 1023482 - RNA, 17 nt, Homo sapiens
ugguuaagacuacugaa

SEQ ID NO: 1023483 - RNA, 19 nt, Homo sapiens
ugguuacaaucauugcuga

SEQ ID NO: 1023484 - RNA, 15 nt, Homo sapiens
ugguuauaauguguu

SEQ ID NO: 1023485 - RNA, 20 nt, Homo sapiens
ugguuaucuaauauguaaca

SEQ ID NO: 1023486 - RNA, 20 nt, Homo sapiens
ugguuauuucucaacaaagc

SEQ ID NO: 1023487 - RNA, 14 nt, Homo sapiens
ugguucaggguugg

SEQ ID NO: 1023488 - RNA, 14 nt, Homo sapiens
ugguucugugccaa

SEQ ID NO: 1023489 - RNA, 20 nt, Homo sapiens
ugguugaguguugcucucua

SEQ ID NO: 1023490 - RNA, 19 nt, Homo sapiens
ugguuucaauaaaccuaau

SEQ ID NO: 1023491 - RNA, 22 nt, Homo sapiens
uguaaaaaaaaaugccuuugag

SEQ ID NO: 1023492 - RNA, 23 nt, Homo sapiens
uguaaaaauuuuguuauuuuugc

SEQ ID NO: 1023493 - RNA, 23 nt, Homo sapiens
uguaaaaugucuguuaacuuaau

SEQ ID NO: 1023494 - RNA, 17 nt, Homo sapiens
uguaaaauuucacuuaa

SEQ ID NO: 1023495 - RNA, 12 nt, Homo sapiens
uguaaaccaaag

SEQ ID NO: 1023496 - RNA, 15 nt, Homo sapiens
uguaaacugugcacc

SEQ ID NO: 1023497 - RNA, 15 nt, Homo sapiens
uguaaagcaggugcc

SEQ ID NO: 1023498 - RNA, 21 nt, Homo sapiens
uguaaagcaggugcccaggaa

SEQ ID NO: 1023499 - RNA, 20 nt, Homo sapiens
uguaaauacuguuuuuaaca

SEQ ID NO: 1023500 - RNA, 14 nt, Homo sapiens
uguaaaugcauuag

SEQ ID NO: 1023501 - RNA, 13 nt, Homo sapiens
uguaaaugugcuu

SEQ ID NO: 1023502 - RNA, 16 nt, Homo sapiens
uguaaauuuaugugau

SEQ ID NO: 1023503 - RNA, 23 nt, Homo sapiens
uguaacacagcugagagacuuuu

SEQ ID NO: 1023504 - RNA, 19 nt, Homo sapiens
uguaacaugcaauuuugca

SEQ ID NO: 1023505 - RNA, 12 nt, Homo sapiens
uguaacugcuga

SEQ ID NO: 1023506 - RNA, 17 nt, Homo sapiens
uguaagcauaacuuauu

SEQ ID NO: 1023507 - RNA, 14 nt, Homo sapiens
uguaaggugcuaca

SEQ ID NO: 1023508 - RNA, 22 nt, Homo sapiens
uguaaguuuaccuauguaacaa

SEQ ID NO: 1023509 - RNA, 22 nt, Homo sapiens
uguaaguuuaugcauacaguaa

SEQ ID NO: 1023510 - RNA, 15 nt, Homo sapiens
uguaauagcauacau

SEQ ID NO: 1023511 - RNA, 19 nt, Homo sapiens
uguaaucacagcuacuugg

SEQ ID NO: 1023512 - RNA, 19 nt, Homo sapiens
uguaaucccagcuacuugg

SEQ ID NO: 1023513 - RNA, 17 nt, Homo sapiens
uguaaucucacuacaca

SEQ ID NO: 1023514 - RNA, 18 nt, Homo sapiens
uguaaucucauaacuuuc

SEQ ID NO: 1023515 - RNA, 12 nt, Homo sapiens
uguaaugaucau

SEQ ID NO: 1023516 - RNA, 15 nt, Homo sapiens
uguaauggaucuuaa

SEQ ID NO: 1023517 - RNA, 18 nt, Homo sapiens
uguaauuuaaaauuguga

SEQ ID NO: 1023518 - RNA, 15 nt, Homo sapiens
uguacaaagaccaca

SEQ ID NO: 1023519 - RNA, 13 nt, Homo sapiens
uguacaccaaggu

SEQ ID NO: 1023520 - RNA, 15 nt, Homo sapiens
uguacagacguaugc

SEQ ID NO: 1023521 - RNA, 16 nt, Homo sapiens
uguacagucuuguauu

SEQ ID NO: 1023522 - RNA, 20 nt, Homo sapiens
uguacaguuugcuguacuag

SEQ ID NO: 1023523 - RNA, 20 nt, Homo sapiens
uguacauguguagccugugc

SEQ ID NO: 1023524 - RNA, 16 nt, Homo sapiens
uguaccauuugcaugg

SEQ ID NO: 1023525 - RNA, 14 nt, Homo sapiens
uguacccuuccuac

SEQ ID NO: 1023526 - RNA, 15 nt, Homo sapiens
uguaccugugcacgu

SEQ ID NO: 1023527 - RNA, 23 nt, Homo sapiens
uguacuguucugugucuuucaca

SEQ ID NO: 1023528 - RNA, 22 nt, Homo sapiens
uguacuuauauccacacugcac

SEQ ID NO: 1023529 - RNA, 18 nt, Homo sapiens
uguacuugccuuauuaga

SEQ ID NO: 1023530 - RNA, 20 nt, Homo sapiens
uguagaaugauuucaugcua

SEQ ID NO: 1023531 - RNA, 15 nt, Homo sapiens
uguagacucuggaag

SEQ ID NO: 1023532 - RNA, 10 nt, Homo sapiens
uguagagugg

SEQ ID NO: 1023533 - RNA, 18 nt, Homo sapiens
uguagaugacauggugaa

SEQ ID NO: 1023534 - RNA, 22 nt, Homo sapiens
uguagcaucuucuggagucucc

SEQ ID NO: 1023535 - RNA, 22 nt, Homo sapiens
uguagccucgccgucugugaau

SEQ ID NO: 1023536 - RNA, 19 nt, Homo sapiens
uguaggcagucauggcacc

SEQ ID NO: 1023537 - RNA, 14 nt, Homo sapiens
caauaauuucaggu

SEQ ID NO: 1023538 - RNA, 19 nt, Homo sapiens
caauacagaacccauucca

SEQ ID NO: 1023539 - RNA, 22 nt, Homo sapiens
caauacaucucacuuguuucua

SEQ ID NO: 1023540 - RNA, 16 nt, Homo sapiens
caauacaugcugcuaa

SEQ ID NO: 1023541 - RNA, 15 nt, Homo sapiens
caauacucaaaagag

SEQ ID NO: 1023542 - RNA, 14 nt, Homo sapiens
caauaguaaaagau

SEQ ID NO: 1023543 - RNA, 14 nt, Homo sapiens
caauaguuugcaua

SEQ ID NO: 1023544 - RNA, 14 nt, Homo sapiens
caauaugcaaugug

SEQ ID NO: 1023545 - RNA, 17 nt, Homo sapiens
caauaugcaaugugaag

SEQ ID NO: 1023546 - RNA, 20 nt, Homo sapiens
caauauuuccucaugugauc

SEQ ID NO: 1023547 - RNA, 16 nt, Homo sapiens
caauauuucugauaua

SEQ ID NO: 1023548 - RNA, 12 nt, Homo sapiens
caauccaagagu

SEQ ID NO: 1023549 - RNA, 19 nt, Homo sapiens
caauccaagagucugauga

SEQ ID NO: 1023550 - RNA, 18 nt, Homo sapiens
caauccagcuauguuaua

SEQ ID NO: 1023551 - RNA, 18 nt, Homo sapiens
caaucuccccuugcacua

SEQ ID NO: 1023552 - RNA, 15 nt, Homo sapiens
caaucucggcucauu

SEQ ID NO: 1023553 - RNA, 22 nt, Homo sapiens
caaugaaaaaaaguacauguau

SEQ ID NO: 1023554 - RNA, 11 nt, Homo sapiens
caaugaacuuu

SEQ ID NO: 1023555 - RNA, 15 nt, Homo sapiens
caaugacaucucagg

SEQ ID NO: 1023556 - RNA, 17 nt, Homo sapiens
caaugacaucucagggg

SEQ ID NO: 1023557 - RNA, 21 nt, Homo sapiens
caaugacaucucaggggccag

SEQ ID NO: 1023558 - RNA, 22 nt, Homo sapiens
caaugacaucucaggggccaga

SEQ ID NO: 1023559 - RNA, 13 nt, Homo sapiens
caaugacauuuau

SEQ ID NO: 1023560 - RNA, 16 nt, Homo sapiens
caaugacgugugccua

SEQ ID NO: 1023561 - RNA, 15 nt, Homo sapiens
caaugagcucuucca

SEQ ID NO: 1023562 - RNA, 15 nt, Homo sapiens
caaugccaaucuuca

SEQ ID NO: 1023563 - RNA, 23 nt, Homo sapiens
caaugcuauaacuauguugauaa

SEQ ID NO: 1023564 - RNA, 18 nt, Homo sapiens
caauggcaacaauuugag

SEQ ID NO: 1023565 - RNA, 19 nt, Homo sapiens
caauggcugcugaagcugc

SEQ ID NO: 1023566 - RNA, 16 nt, Homo sapiens
caauggcuuacuccag

SEQ ID NO: 1023567 - RNA, 22 nt, Homo sapiens
caaugguuugcaaggaagccac

SEQ ID NO: 1023568 - RNA, 22 nt, Homo sapiens
caauguaaauauuacacaucaa

SEQ ID NO: 1023569 - RNA, 22 nt, Homo sapiens
caauguagucucauaaccagga

SEQ ID NO: 1023570 - RNA, 19 nt, Homo sapiens
caauguauugagcauguga

SEQ ID NO: 1023571 - RNA, 13 nt, Homo sapiens
caaugucacuuaa

SEQ ID NO: 1023572 - RNA, 15 nt, Homo sapiens
caauguuacuaucug

SEQ ID NO: 1023573 - RNA, 22 nt, Homo sapiens
caauguugcuuaggaugugugc

SEQ ID NO: 1023574 - RNA, 17 nt, Homo sapiens
caauucacuagaccaga

SEQ ID NO: 1023575 - RNA, 14 nt, Homo sapiens
caauuccaguggaa

SEQ ID NO: 1023576 - RNA, 16 nt, Homo sapiens
caauuccucugaacaa

SEQ ID NO: 1023577 - RNA, 17 nt, Homo sapiens
caauuccucugaacaaa

SEQ ID NO: 1023578 - RNA, 18 nt, Homo sapiens
caauuccugugauuuaug

SEQ ID NO: 1023579 - RNA, 21 nt, Homo sapiens
caauucuauuacgugcaauac

SEQ ID NO: 1023580 - RNA, 11 nt, Homo sapiens
caauuuaguuc

SEQ ID NO: 1023581 - RNA, 13 nt, Homo sapiens
caauuugccuuuu

SEQ ID NO: 1023582 - RNA, 12 nt, Homo sapiens
caauuuuuccau

SEQ ID NO: 1023583 - RNA, 16 nt, Homo sapiens
cacaaaacaaaugcca

SEQ ID NO: 1023584 - RNA, 13 nt, Homo sapiens
cacaaaaucacac

SEQ ID NO: 1023585 - RNA, 18 nt, Homo sapiens
cacaaauuagcuaggcau

SEQ ID NO: 1023586 - RNA, 15 nt, Homo sapiens
cacaacacacacacu

SEQ ID NO: 1023587 - RNA, 12 nt, Homo sapiens
cacaaccaaaaa

SEQ ID NO: 1023588 - RNA, 14 nt, Homo sapiens
cacaacccaagaau

SEQ ID NO: 1023589 - RNA, 16 nt, Homo sapiens
cacaacccuguuuuau

SEQ ID NO: 1023590 - RNA, 13 nt, Homo sapiens
cacaagaagacca

SEQ ID NO: 1023591 - RNA, 17 nt, Homo sapiens
cacaagaccaucuacau

SEQ ID NO: 1023592 - RNA, 20 nt, Homo sapiens
cacaaggcugaccaagagag

SEQ ID NO: 1023593 - RNA, 12 nt, Homo sapiens
cacaaucugaca

SEQ ID NO: 1023594 - RNA, 14 nt, Homo sapiens
cacaaugccucauc

SEQ ID NO: 1023595 - RNA, 22 nt, Homo sapiens
cacacaagcuuuuuuacacaaa

SEQ ID NO: 1023596 - RNA, 15 nt, Homo sapiens
cacacaaggugcaaa

SEQ ID NO: 1023597 - RNA, 15 nt, Homo sapiens
cacacaccuguaguc

SEQ ID NO: 1023598 - RNA, 12 nt, Homo sapiens
cacacacugugu

SEQ ID NO: 1023599 - RNA, 20 nt, Homo sapiens
cacacagaaaauauacugua

SEQ ID NO: 1023600 - RNA, 15 nt, Homo sapiens
cacacagacaggguu

SEQ ID NO: 1023601 - RNA, 23 nt, Homo sapiens
cacacauacacacacacaagcuu

SEQ ID NO: 1023602 - RNA, 17 nt, Homo sapiens
cacaccccagacgaugu

SEQ ID NO: 1023603 - RNA, 20 nt, Homo sapiens
cacaccugaacacaucguga

SEQ ID NO: 1023604 - RNA, 19 nt, Homo sapiens
cacaccuggaaagcauaua

SEQ ID NO: 1023605 - RNA, 15 nt, Homo sapiens
cacacgcaggaacuc

SEQ ID NO: 1023606 - RNA, 19 nt, Homo sapiens
cacacucacugcggagaac

SEQ ID NO: 1023607 - RNA, 20 nt, Homo sapiens
cacacuccuccaaggcacaa

SEQ ID NO: 1023608 - RNA, 22 nt, Homo sapiens
cacacucgcccgcccacugucc

SEQ ID NO: 1023609 - RNA, 21 nt, Homo sapiens
cacacuguagcauuacagugg

SEQ ID NO: 1023610 - RNA, 17 nt, Homo sapiens
cacacuugguccaucca

SEQ ID NO: 1023611 - RNA, 17 nt, Homo sapiens
cacagaaauacaugaaa

SEQ ID NO: 1023612 - RNA, 16 nt, Homo sapiens
cacagaaaugagauca

SEQ ID NO: 1023613 - RNA, 17 nt, Homo sapiens
cacagaaaugagaucag

SEQ ID NO: 1023614 - RNA, 21 nt, Homo sapiens
cacagaacuauguacuuuaaa

SEQ ID NO: 1023615 - RNA, 14 nt, Homo sapiens
cacagaagccagga

SEQ ID NO: 1023616 - RNA, 17 nt, Homo sapiens
cacagaagguccuggug

SEQ ID NO: 1023617 - RNA, 12 nt, Homo sapiens
cacagaaguagc

SEQ ID NO: 1023618 - RNA, 19 nt, Homo sapiens
cacagacaacaguugcaca

SEQ ID NO: 1023619 - RNA, 16 nt, Homo sapiens
cacagacccugcccug

SEQ ID NO: 1023620 - RNA, 21 nt, Homo sapiens
cacagagauaauucuagcuuu

SEQ ID NO: 1023621 - RNA, 22 nt, Homo sapiens
cacagagggcaggcacucccau

SEQ ID NO: 1023622 - RNA, 13 nt, Homo sapiens
cacagagugugcu

SEQ ID NO: 1023623 - RNA, 17 nt, Homo sapiens
cacagaucacagcuuca

SEQ ID NO: 1023624 - RNA, 22 nt, Homo sapiens
cacagauguuugaggcuuucag

SEQ ID NO: 1023625 - RNA, 21 nt, Homo sapiens
cacagcaagucacuggccagu

SEQ ID NO: 1023626 - RNA, 17 nt, Homo sapiens
cacagcaggacuccauc

SEQ ID NO: 1023627 - RNA, 19 nt, Homo sapiens
cacagcaguagcaguagau

SEQ ID NO: 1023628 - RNA, 22 nt, Homo sapiens
cacagcaucauuuugcauucaa

SEQ ID NO: 1023629 - RNA, 16 nt, Homo sapiens
cacagcugaacuuguu

SEQ ID NO: 1023630 - RNA, 19 nt, Homo sapiens
cacagcugauugggcaccu

SEQ ID NO: 1023631 - RNA, 23 nt, Homo sapiens
cacagcugcuuucuguugucauu

SEQ ID NO: 1023632 - RNA, 16 nt, Homo sapiens
cacaggcacugcagga

SEQ ID NO: 1023633 - RNA, 16 nt, Homo sapiens
cacagggauguacaag

SEQ ID NO: 1023634 - RNA, 12 nt, Homo sapiens
cacaggucccac

SEQ ID NO: 1023635 - RNA, 18 nt, Homo sapiens
cacaggucccacugcccu

SEQ ID NO: 1023636 - RNA, 15 nt, Homo sapiens
cacagucuuggcuca

SEQ ID NO: 1023637 - RNA, 22 nt, Homo sapiens
cacagugagucgaggacaggga

SEQ ID NO: 1023638 - RNA, 18 nt, Homo sapiens
cacaguuggcuggaugaa

SEQ ID NO: 1023639 - RNA, 15 nt, Homo sapiens
cacaguuuucuggcu

SEQ ID NO: 1023640 - RNA, 21 nt, Homo sapiens
cacaguuuugguugcuuuaau

SEQ ID NO: 1023641 - RNA, 17 nt, Homo sapiens
cacauauggacucugca

SEQ ID NO: 1023642 - RNA, 14 nt, Homo sapiens
cacaucuugcucug

SEQ ID NO: 1023643 - RNA, 19 nt, Homo sapiens
cacaugacaacuuugccag

SEQ ID NO: 1023644 - RNA, 12 nt, Homo sapiens
cacaugccaagc

SEQ ID NO: 1023645 - RNA, 16 nt, Homo sapiens
cacaugccaagcacug

SEQ ID NO: 1023646 - RNA, 11 nt, Homo sapiens
cugcuuuccac

SEQ ID NO: 1023647 - RNA, 19 nt, Homo sapiens
cugcuuuccccugugggga

SEQ ID NO: 1023648 - RNA, 14 nt, Homo sapiens
cuggaaaaugugac

SEQ ID NO: 1023649 - RNA, 15 nt, Homo sapiens
cuggaaaaugugacc

SEQ ID NO: 1023650 - RNA, 16 nt, Homo sapiens
cuggaaagacauagcc

SEQ ID NO: 1023651 - RNA, 20 nt, Homo sapiens
cuggaacagauucacacugu

SEQ ID NO: 1023652 - RNA, 15 nt, Homo sapiens
cuggaacaucaucaa

SEQ ID NO: 1023653 - RNA, 16 nt, Homo sapiens
cuggaaggcuuccacu

SEQ ID NO: 1023654 - RNA, 16 nt, Homo sapiens
cuggaaggugcuguua

SEQ ID NO: 1023655 - RNA, 13 nt, Homo sapiens
cuggacaagccaa

SEQ ID NO: 1023656 - RNA, 18 nt, Homo sapiens
cuggacacagccccaugu

SEQ ID NO: 1023657 - RNA, 20 nt, Homo sapiens
cuggacauuuuuucagucau

SEQ ID NO: 1023658 - RNA, 20 nt, Homo sapiens
cuggaccugccuccugccug

SEQ ID NO: 1023659 - RNA, 12 nt, Homo sapiens
cuggacucagga

SEQ ID NO: 1023660 - RNA, 13 nt, Homo sapiens
cuggacucaggau

SEQ ID NO: 1023661 - RNA, 19 nt, Homo sapiens
cuggacucaggaugcccag

SEQ ID NO: 1023662 - RNA, 13 nt, Homo sapiens
cuggacucucagu

SEQ ID NO: 1023663 - RNA, 22 nt, Homo sapiens
cuggagaagucuuagacuugaa

SEQ ID NO: 1023664 - RNA, 14 nt, Homo sapiens
cuggagaguucaau

SEQ ID NO: 1023665 - RNA, 16 nt, Homo sapiens
cuggagcaauguugcu

SEQ ID NO: 1023666 - RNA, 18 nt, Homo sapiens
cuggagcaucugacucac

SEQ ID NO: 1023667 - RNA, 16 nt, Homo sapiens
cuggagccaaguccag

SEQ ID NO: 1023668 - RNA, 13 nt, Homo sapiens
cuggagcucugcc

SEQ ID NO: 1023669 - RNA, 18 nt, Homo sapiens
cuggaggccggaaucuca

SEQ ID NO: 1023670 - RNA, 19 nt, Homo sapiens
cuggagggaagcacugccu

SEQ ID NO: 1023671 - RNA, 20 nt, Homo sapiens
cuggagggcuggaaucugga

SEQ ID NO: 1023672 - RNA, 16 nt, Homo sapiens
cuggaguccuugaccg

SEQ ID NO: 1023673 - RNA, 21 nt, Homo sapiens
cuggagucgggacuaacccag

SEQ ID NO: 1023674 - RNA, 16 nt, Homo sapiens
cuggagugagcucugu

SEQ ID NO: 1023675 - RNA, 20 nt, Homo sapiens
cuggagugcaauggcgugau

SEQ ID NO: 1023676 - RNA, 13 nt, Homo sapiens
cuggagugcagug

SEQ ID NO: 1023677 - RNA, 20 nt, Homo sapiens
cuggagugcaguggcacgau

SEQ ID NO: 1023678 - RNA, 20 nt, Homo sapiens
cuggagugcaguggcgugau

SEQ ID NO: 1023679 - RNA, 16 nt, Homo sapiens
cuggaucacagcugcu

SEQ ID NO: 1023680 - RNA, 19 nt, Homo sapiens
cuggaugagacuuccaaac

SEQ ID NO: 1023681 - RNA, 13 nt, Homo sapiens
cuggauggcacca

SEQ ID NO: 1023682 - RNA, 17 nt, Homo sapiens
cuggauggcaccagagg

SEQ ID NO: 1023683 - RNA, 20 nt, Homo sapiens
cuggaugggcugcagcagag

SEQ ID NO: 1023684 - RNA, 20 nt, Homo sapiens
cuggauuacaggcaugugcc

SEQ ID NO: 1023685 - RNA, 14 nt, Homo sapiens
cuggcaacaucuuu

SEQ ID NO: 1023686 - RNA, 15 nt, Homo sapiens
cuggcacaguuuucu

SEQ ID NO: 1023687 - RNA, 17 nt, Homo sapiens
cuggcacuauaauguaa

SEQ ID NO: 1023688 - RNA, 22 nt, Homo sapiens
cuggcacugaauuaaucaucua

SEQ ID NO: 1023689 - RNA, 12 nt, Homo sapiens
cuggcacugacu

SEQ ID NO: 1023690 - RNA, 22 nt, Homo sapiens
cuggcagaaagcaaaugugacc

SEQ ID NO: 1023691 - RNA, 19 nt, Homo sapiens
cuggcagggacgaggacaa

SEQ ID NO: 1023692 - RNA, 19 nt, Homo sapiens
cuggcaguggaacuaagaa

SEQ ID NO: 1023693 - RNA, 22 nt, Homo sapiens
cuggcauuccuucugaccacag

SEQ ID NO: 1023694 - RNA, 19 nt, Homo sapiens
cuggccacaguuguuugau

SEQ ID NO: 1023695 - RNA, 19 nt, Homo sapiens
cuggccagaugcaccagcc

SEQ ID NO: 1023696 - RNA, 23 nt, Homo sapiens
cuggccagggccuggaagacaga

SEQ ID NO: 1023697 - RNA, 21 nt, Homo sapiens
cuggcccacagcaggugcuga

SEQ ID NO: 1023698 - RNA, 12 nt, Homo sapiens
cuggcccugugc

SEQ ID NO: 1023699 - RNA, 23 nt, Homo sapiens
cuggcgacagagggagacuccau

SEQ ID NO: 1023700 - RNA, 19 nt, Homo sapiens
cuggcugaacccugugcug

SEQ ID NO: 1023701 - RNA, 20 nt, Homo sapiens
cuggcuucacagauguguga

SEQ ID NO: 1023702 - RNA, 23 nt, Homo sapiens
cuggcuuccagguaucuccagga

SEQ ID NO: 1023703 - RNA, 22 nt, Homo sapiens
cugggaagacgccugagcucac

SEQ ID NO: 1023704 - RNA, 20 nt, Homo sapiens
cugggaccucccacugcccc

SEQ ID NO: 1023705 - RNA, 19 nt, Homo sapiens
cugggacugugcucagaga

SEQ ID NO: 1023706 - RNA, 21 nt, Homo sapiens
cugggagacuuugaagaccag

SEQ ID NO: 1023707 - RNA, 15 nt, Homo sapiens
cugggagcacuuugu

SEQ ID NO: 1023708 - RNA, 17 nt, Homo sapiens
cugggagcccucaggca

SEQ ID NO: 1023709 - RNA, 20 nt, Homo sapiens
cugggauccgggaucaaagu

SEQ ID NO: 1023710 - RNA, 14 nt, Homo sapiens
cugggaugucuccg

SEQ ID NO: 1023711 - RNA, 22 nt, Homo sapiens
cugggauuacaggcaugagcca

SEQ ID NO: 1023712 - RNA, 20 nt, Homo sapiens
cugggauuacaggugugaac

SEQ ID NO: 1023713 - RNA, 19 nt, Homo sapiens
cugggcaacacagcgagac

SEQ ID NO: 1023714 - RNA, 23 nt, Homo sapiens
cugggcaaggaggccacgugaug

SEQ ID NO: 1023715 - RNA, 16 nt, Homo sapiens
cugggcagaaggccaa

SEQ ID NO: 1023716 - RNA, 23 nt, Homo sapiens
cugggcagaccccucuaccuccu

SEQ ID NO: 1023717 - RNA, 14 nt, Homo sapiens
cugggcagcauagc

SEQ ID NO: 1023718 - RNA, 21 nt, Homo sapiens
cugggccccucaucugcucag

SEQ ID NO: 1023719 - RNA, 17 nt, Homo sapiens
cuggggaacuagaggga

SEQ ID NO: 1023720 - RNA, 19 nt, Homo sapiens
cuggggaugucucucauga

SEQ ID NO: 1023721 - RNA, 14 nt, Homo sapiens
cuggggcaauggga

SEQ ID NO: 1023722 - RNA, 18 nt, Homo sapiens
cuggggcaggucacuuua

SEQ ID NO: 1023723 - RNA, 22 nt, Homo sapiens
cugggggaggggacauugaaca

SEQ ID NO: 1023724 - RNA, 15 nt, Homo sapiens
cugggggaguggaau

SEQ ID NO: 1023725 - RNA, 14 nt, Homo sapiens
cugggggccaugag

SEQ ID NO: 1023726 - RNA, 16 nt, Homo sapiens
cugggggccucagugc

SEQ ID NO: 1023727 - RNA, 16 nt, Homo sapiens
cugggguccauucucu

SEQ ID NO: 1023728 - RNA, 21 nt, Homo sapiens
cugggucucgcuuuguugccc

SEQ ID NO: 1023729 - RNA, 18 nt, Homo sapiens
cuggguggcacugccaug

SEQ ID NO: 1023730 - RNA, 20 nt, Homo sapiens
cuggguucccuuuccuucca

SEQ ID NO: 1023731 - RNA, 16 nt, Homo sapiens
cuggguuccugcaaug

SEQ ID NO: 1023732 - RNA, 16 nt, Homo sapiens
cuggguuggugcacag

SEQ ID NO: 1023733 - RNA, 22 nt, Homo sapiens
cuggguuuuguauucucugagc

SEQ ID NO: 1023734 - RNA, 16 nt, Homo sapiens
cugguagaaaggcagu

SEQ ID NO: 1023735 - RNA, 15 nt, Homo sapiens
cugguauguguggau

SEQ ID NO: 1023736 - RNA, 16 nt, Homo sapiens
cuggucuuggugaaca

SEQ ID NO: 1023737 - RNA, 17 nt, Homo sapiens
cuggugaugcccaaaga

SEQ ID NO: 1023738 - RNA, 18 nt, Homo sapiens
cuuagcagcuaucucuca

SEQ ID NO: 1023739 - RNA, 19 nt, Homo sapiens
cuuagcagcuaucucucag

SEQ ID NO: 1023740 - RNA, 22 nt, Homo sapiens
cuuagcagcuaucucucaguga

SEQ ID NO: 1023741 - RNA, 21 nt, Homo sapiens
cuuagcuucuauuauagccac

SEQ ID NO: 1023742 - RNA, 23 nt, Homo sapiens
cuuaguccaauuccuugcacaua

SEQ ID NO: 1023743 - RNA, 17 nt, Homo sapiens
cuuagucccucaugcaa

SEQ ID NO: 1023744 - RNA, 21 nt, Homo sapiens
cuuagucuguggagaacagaa

SEQ ID NO: 1023745 - RNA, 18 nt, Homo sapiens
cuuagugaaauuacuucu

SEQ ID NO: 1023746 - RNA, 13 nt, Homo sapiens
cuuaguggcuuuu

SEQ ID NO: 1023747 - RNA, 15 nt, Homo sapiens
cuuagugucacuuac

SEQ ID NO: 1023748 - RNA, 22 nt, Homo sapiens
cuuaguguuuggguauauucau

SEQ ID NO: 1023749 - RNA, 21 nt, Homo sapiens
cuuaguuacucauucagggau

SEQ ID NO: 1023750 - RNA, 16 nt, Homo sapiens
cuuauaggaauugacc

SEQ ID NO: 1023751 - RNA, 20 nt, Homo sapiens
cuuauauuuaaaacuugccu

SEQ ID NO: 1023752 - RNA, 19 nt, Homo sapiens
cuuaucaacauuuguucca

SEQ ID NO: 1023753 - RNA, 20 nt, Homo sapiens
cuuaucaagcagccaaggga

SEQ ID NO: 1023754 - RNA, 15 nt, Homo sapiens
cuuauguauuuauga

SEQ ID NO: 1023755 - RNA, 16 nt, Homo sapiens
cuuauugacucauaca

SEQ ID NO: 1023756 - RNA, 16 nt, Homo sapiens
cuuauuuaacuuaaca

SEQ ID NO: 1023757 - RNA, 17 nt, Homo sapiens
cuuauuuuugacagugu

SEQ ID NO: 1023758 - RNA, 21 nt, Homo sapiens
cuucaaaacggggcagccaaa

SEQ ID NO: 1023759 - RNA, 21 nt, Homo sapiens
cuucaaauaaacaugucugcc

SEQ ID NO: 1023760 - RNA, 16 nt, Homo sapiens
cuucaagaacucuggg

SEQ ID NO: 1023761 - RNA, 22 nt, Homo sapiens
cuucaaggcccauaucugugaa

SEQ ID NO: 1023762 - RNA, 15 nt, Homo sapiens
cuucaauacccaaau

SEQ ID NO: 1023763 - RNA, 21 nt, Homo sapiens
cuucaaucucuugcacucaaa

SEQ ID NO: 1023764 - RNA, 23 nt, Homo sapiens
cuucacagaugugugauucacag

SEQ ID NO: 1023765 - RNA, 14 nt, Homo sapiens
cuucaccucacuga

SEQ ID NO: 1023766 - RNA, 14 nt, Homo sapiens
cuucaccucugaaa

SEQ ID NO: 1023767 - RNA, 14 nt, Homo sapiens
cuucaccuuaggaa

SEQ ID NO: 1023768 - RNA, 21 nt, Homo sapiens
cuucacgccuccccuuuguga

SEQ ID NO: 1023769 - RNA, 16 nt, Homo sapiens
cuucacuguauaaaua

SEQ ID NO: 1023770 - RNA, 21 nt, Homo sapiens
cuucacuucaguugcuuugca

SEQ ID NO: 1023771 - RNA, 18 nt, Homo sapiens
cuucagauacaaacugca

SEQ ID NO: 1023772 - RNA, 20 nt, Homo sapiens
cuucagaucucuaacuucac

SEQ ID NO: 1023773 - RNA, 16 nt, Homo sapiens
cuucagauuuguguua

SEQ ID NO: 1023774 - RNA, 22 nt, Homo sapiens
cuucagccuagccgaccucagc

SEQ ID NO: 1023775 - RNA, 23 nt, Homo sapiens
cuucagcucacacaugagaucua

SEQ ID NO: 1023776 - RNA, 14 nt, Homo sapiens
cuucaguuaugauu

SEQ ID NO: 1023777 - RNA, 18 nt, Homo sapiens
cuucaguuuuacucugcu

SEQ ID NO: 1023778 - RNA, 19 nt, Homo sapiens
cuucauauaccagcaauau

SEQ ID NO: 1023779 - RNA, 15 nt, Homo sapiens
cuucaugcaaugaca

SEQ ID NO: 1023780 - RNA, 15 nt, Homo sapiens
cuucauggacuucca

SEQ ID NO: 1023781 - RNA, 14 nt, Homo sapiens
cuucauuaccucag

SEQ ID NO: 1023782 - RNA, 15 nt, Homo sapiens
cuucauuguucuucu

SEQ ID NO: 1023783 - RNA, 18 nt, Homo sapiens
cuuccaacguggcccaga

SEQ ID NO: 1023784 - RNA, 11 nt, Homo sapiens
cuuccaaggau

SEQ ID NO: 1023785 - RNA, 21 nt, Homo sapiens
cuuccaauuuacauacucugc

SEQ ID NO: 1023786 - RNA, 19 nt, Homo sapiens
cuuccacaauucacuagac

SEQ ID NO: 1023787 - RNA, 21 nt, Homo sapiens
cuuccacgcugucuccagacc

SEQ ID NO: 1023788 - RNA, 19 nt, Homo sapiens
cuuccagguaucuccagga

SEQ ID NO: 1023789 - RNA, 20 nt, Homo sapiens
cuuccauaaugcuacugucu

SEQ ID NO: 1023790 - RNA, 21 nt, Homo sapiens
cuuccauaauuaugacaguua

SEQ ID NO: 1023791 - RNA, 22 nt, Homo sapiens
cuuccauaauuaugacaguuau

SEQ ID NO: 1023792 - RNA, 13 nt, Homo sapiens
cuucccacagugg

SEQ ID NO: 1023793 - RNA, 19 nt, Homo sapiens
cuucccacucaccccggca

SEQ ID NO: 1023794 - RNA, 23 nt, Homo sapiens
cuucccauuguggcuccuaucug

SEQ ID NO: 1023795 - RNA, 20 nt, Homo sapiens
cuucccggcgucccuaccuc

SEQ ID NO: 1023796 - RNA, 22 nt, Homo sapiens
cuucccggcgucccuaccuccu

SEQ ID NO: 1023797 - RNA, 14 nt, Homo sapiens
auuacuucugcuac

SEQ ID NO: 1023798 - RNA, 20 nt, Homo sapiens
auuacuuuuucauucuuuua

SEQ ID NO: 1023799 - RNA, 16 nt, Homo sapiens
auuagaauauccauga

SEQ ID NO: 1023800 - RNA, 17 nt, Homo sapiens
auuagaauuucauauga

SEQ ID NO: 1023801 - RNA, 13 nt, Homo sapiens
auuagaccaagcu

SEQ ID NO: 1023802 - RNA, 18 nt, Homo sapiens
auuagaggucuccaaaau

SEQ ID NO: 1023803 - RNA, 13 nt, Homo sapiens
auuagaugaacuc

SEQ ID NO: 1023804 - RNA, 22 nt, Homo sapiens
auuagcaaguuacagugaugcu

SEQ ID NO: 1023805 - RNA, 19 nt, Homo sapiens
auuagcaauugacugucac

SEQ ID NO: 1023806 - RNA, 18 nt, Homo sapiens
auuagcauuuugcuaaau

SEQ ID NO: 1023807 - RNA, 23 nt, Homo sapiens
auuagccaagugugguagagugu

SEQ ID NO: 1023808 - RNA, 16 nt, Homo sapiens
auuagccauuugacua

SEQ ID NO: 1023809 - RNA, 15 nt, Homo sapiens
auuagcucuggacca

SEQ ID NO: 1023810 - RNA, 16 nt, Homo sapiens
auuagcucuggaccag

SEQ ID NO: 1023811 - RNA, 15 nt, Homo sapiens
auuaggaaguguaac

SEQ ID NO: 1023812 - RNA, 16 nt, Homo sapiens
auuauaacauccacaa

SEQ ID NO: 1023813 - RNA, 17 nt, Homo sapiens
auuauaauauacuauau

SEQ ID NO: 1023814 - RNA, 17 nt, Homo sapiens
auuauaugcacuagcaa

SEQ ID NO: 1023815 - RNA, 16 nt, Homo sapiens
auuaucacgcagauca

SEQ ID NO: 1023816 - RNA, 16 nt, Homo sapiens
auuaucuaaaguauga

SEQ ID NO: 1023817 - RNA, 20 nt, Homo sapiens
auuaucuaaaguaugaagca

SEQ ID NO: 1023818 - RNA, 18 nt, Homo sapiens
auuaucucacuugugcca

SEQ ID NO: 1023819 - RNA, 12 nt, Homo sapiens
auuauguacaaa

SEQ ID NO: 1023820 - RNA, 15 nt, Homo sapiens
auuauuaacacugaa

SEQ ID NO: 1023821 - RNA, 13 nt, Homo sapiens
auuauuagucugu

SEQ ID NO: 1023822 - RNA, 12 nt, Homo sapiens
auuauucccaug

SEQ ID NO: 1023823 - RNA, 18 nt, Homo sapiens
auuauucccuguacaaua

SEQ ID NO: 1023824 - RNA, 20 nt, Homo sapiens
auuauucuuguaguuuaccu

SEQ ID NO: 1023825 - RNA, 17 nt, Homo sapiens
auuauuggacagucuca

SEQ ID NO: 1023826 - RNA, 15 nt, Homo sapiens
auuauuucaauguga

SEQ ID NO: 1023827 - RNA, 14 nt, Homo sapiens
auucaaaagaucaa

SEQ ID NO: 1023828 - RNA, 15 nt, Homo sapiens
auucaaaauugacau

SEQ ID NO: 1023829 - RNA, 11 nt, Homo sapiens
auucaaaguga

SEQ ID NO: 1023830 - RNA, 16 nt, Homo sapiens
auucaacucagacuag

SEQ ID NO: 1023831 - RNA, 19 nt, Homo sapiens
auucaagucaccuccuuaa

SEQ ID NO: 1023832 - RNA, 18 nt, Homo sapiens
auucacaaaauuuccaca

SEQ ID NO: 1023833 - RNA, 21 nt, Homo sapiens
auucacaauagaaacucacca

SEQ ID NO: 1023834 - RNA, 13 nt, Homo sapiens
auucacagcaagu

SEQ ID NO: 1023835 - RNA, 18 nt, Homo sapiens
auucacagcaagucacug

SEQ ID NO: 1023836 - RNA, 22 nt, Homo sapiens
auucaccuuccagugucucgga

SEQ ID NO: 1023837 - RNA, 15 nt, Homo sapiens
auucacuagaccaga

SEQ ID NO: 1023838 - RNA, 23 nt, Homo sapiens
auucacuuauggcagaggaauau

SEQ ID NO: 1023839 - RNA, 22 nt, Homo sapiens
auucagacuguuuuucagggag

SEQ ID NO: 1023840 - RNA, 13 nt, Homo sapiens
auucaggacacag

SEQ ID NO: 1023841 - RNA, 16 nt, Homo sapiens
auucaggauuacaugc

SEQ ID NO: 1023842 - RNA, 16 nt, Homo sapiens
auucagguauguugcc

SEQ ID NO: 1023843 - RNA, 17 nt, Homo sapiens
auucauaacagaacaag

SEQ ID NO: 1023844 - RNA, 19 nt, Homo sapiens
auucaucucucuuuaauau

SEQ ID NO: 1023845 - RNA, 12 nt, Homo sapiens
auucaucuucau

SEQ ID NO: 1023846 - RNA, 14 nt, Homo sapiens
auucauguggaaua

SEQ ID NO: 1023847 - RNA, 22 nt, Homo sapiens
auucauuauuuuuccacuuugu

SEQ ID NO: 1023848 - RNA, 23 nt, Homo sapiens
auucauuuuucuuucugauguca

SEQ ID NO: 1023849 - RNA, 22 nt, Homo sapiens
auuccaacagcucaagucuucc

SEQ ID NO: 1023850 - RNA, 13 nt, Homo sapiens
auuccaaccccaa

SEQ ID NO: 1023851 - RNA, 14 nt, Homo sapiens
auuccaaguucuca

SEQ ID NO: 1023852 - RNA, 13 nt, Homo sapiens
auuccacaggugg

SEQ ID NO: 1023853 - RNA, 17 nt, Homo sapiens
auuccaccugcaaucaa

SEQ ID NO: 1023854 - RNA, 17 nt, Homo sapiens
auuccaggcgaugugca

SEQ ID NO: 1023855 - RNA, 20 nt, Homo sapiens
auuccaggcgaugugcaagu

SEQ ID NO: 1023856 - RNA, 22 nt, Homo sapiens
auucccacaccuccacaguuca

SEQ ID NO: 1023857 - RNA, 14 nt, Homo sapiens
auucccaccaaggu

SEQ ID NO: 1023858 - RNA, 13 nt, Homo sapiens
auucccauucuac

SEQ ID NO: 1023859 - RNA, 17 nt, Homo sapiens
auucccauuuugcaaaa

SEQ ID NO: 1023860 - RNA, 14 nt, Homo sapiens
auucccuguacaau

SEQ ID NO: 1023861 - RNA, 14 nt, Homo sapiens
auuccuacaaagau

SEQ ID NO: 1023862 - RNA, 14 nt, Homo sapiens
auuccugagccagu

SEQ ID NO: 1023863 - RNA, 13 nt, Homo sapiens
auuccugauaaua

SEQ ID NO: 1023864 - RNA, 20 nt, Homo sapiens
auuccugauaauaauugauc

SEQ ID NO: 1023865 - RNA, 14 nt, Homo sapiens
auuccuugauucac

SEQ ID NO: 1023866 - RNA, 21 nt, Homo sapiens
auuccuuggcaugccuuccag

SEQ ID NO: 1023867 - RNA, 18 nt, Homo sapiens
auuccuuucucaucccac

SEQ ID NO: 1023868 - RNA, 16 nt, Homo sapiens
auucgauccccuguca

SEQ ID NO: 1023869 - RNA, 17 nt, Homo sapiens
auucgugacaacaugcg

SEQ ID NO: 1023870 - RNA, 21 nt, Homo sapiens
auucuacuuuaagcacuacau

SEQ ID NO: 1023871 - RNA, 13 nt, Homo sapiens
auucuaguacuug

SEQ ID NO: 1023872 - RNA, 16 nt, Homo sapiens
auucuaguuuugucaa

SEQ ID NO: 1023873 - RNA, 17 nt, Homo sapiens
auucucacacacauaca

SEQ ID NO: 1023874 - RNA, 12 nt, Homo sapiens
auucucaccagg

SEQ ID NO: 1023875 - RNA, 19 nt, Homo sapiens
auucucaguguagggcaga

SEQ ID NO: 1023876 - RNA, 13 nt, Homo sapiens
auucucauucuca

SEQ ID NO: 1023877 - RNA, 19 nt, Homo sapiens
auucucauuugucacacac

SEQ ID NO: 1023878 - RNA, 17 nt, Homo sapiens
auucucugucucaucca

SEQ ID NO: 1023879 - RNA, 22 nt, Homo sapiens
auucucugugguauccaagaau

SEQ ID NO: 1023880 - RNA, 11 nt, Homo sapiens
auucugaccau

SEQ ID NO: 1023881 - RNA, 22 nt, Homo sapiens
auucugaggguccacuacucaa

SEQ ID NO: 1023882 - RNA, 21 nt, Homo sapiens
auucugagguaaccucauuau

SEQ ID NO: 1023883 - RNA, 16 nt, Homo sapiens
auucugauuacacaaa

SEQ ID NO: 1023884 - RNA, 20 nt, Homo sapiens
auucuggcuagugucuauca

SEQ ID NO: 1023885 - RNA, 15 nt, Homo sapiens
auucuggcucaggga

SEQ ID NO: 1023886 - RNA, 19 nt, Homo sapiens
auucuguaugccaagugaa

SEQ ID NO: 1023887 - RNA, 23 nt, Homo sapiens
auucuucaaccucauugacaaga

SEQ ID NO: 1023888 - RNA, 20 nt, Homo sapiens
auucuucagauacaaacugc

SEQ ID NO: 1023889 - RNA, 21 nt, Homo sapiens
auucuucagauacaaacugca

SEQ ID NO: 1023890 - RNA, 21 nt, Homo sapiens
auucuucuuugguggagauaa

SEQ ID NO: 1023891 - RNA, 14 nt, Homo sapiens
auucuugaaugagg

SEQ ID NO: 1023892 - RNA, 15 nt, Homo sapiens
auucuugaguucugg

SEQ ID NO: 1023893 - RNA, 22 nt, Homo sapiens
auucuuguuggagacaugggau

SEQ ID NO: 1023894 - RNA, 18 nt, Homo sapiens
auucuuuacccccuggga

SEQ ID NO: 1023895 - RNA, 14 nt, Homo sapiens
auucuuuguuacag

SEQ ID NO: 1023896 - RNA, 17 nt, Homo sapiens
auugaaaucaagcuuau

SEQ ID NO: 1023897 - RNA, 19 nt, Homo sapiens
auugaaauguuugcauaaa

SEQ ID NO: 1023898 - RNA, 21 nt, Homo sapiens
auugaaccucuuggguucaag

SEQ ID NO: 1023899 - RNA, 15 nt, Homo sapiens
auugaagcccuccaa

SEQ ID NO: 1023900 - RNA, 23 nt, Homo sapiens
auugaaguuuugacaucaaugau

SEQ ID NO: 1023901 - RNA, 18 nt, Homo sapiens
auugacugauggugaaau

SEQ ID NO: 1023902 - RNA, 14 nt, Homo sapiens
auugagcaaagggg

SEQ ID NO: 1023903 - RNA, 19 nt, Homo sapiens
auugaggcuuuaaaacuua

SEQ ID NO: 1023904 - RNA, 18 nt, Homo sapiens
auugauagaguguuauca

SEQ ID NO: 1023905 - RNA, 17 nt, Homo sapiens
auugauggguuaauuaa

SEQ ID NO: 1023906 - RNA, 14 nt, Homo sapiens
auugauuaccaagu

SEQ ID NO: 1023907 - RNA, 19 nt, Homo sapiens
auugauuauaagcauguau

SEQ ID NO: 1023908 - RNA, 14 nt, Homo sapiens
auugauuauucuga

SEQ ID NO: 1023909 - RNA, 16 nt, Homo sapiens
auugcaccacugcacu

SEQ ID NO: 1023910 - RNA, 20 nt, Homo sapiens
auugcacguguguauugcaa

SEQ ID NO: 1023911 - RNA, 20 nt, Homo sapiens
auugccaccaggagaaccac

SEQ ID NO: 1023912 - RNA, 23 nt, Homo sapiens
auugcccccagggcacuucacag

SEQ ID NO: 1023913 - RNA, 15 nt, Homo sapiens
auugccugcagagag

SEQ ID NO: 1023914 - RNA, 23 nt, Homo sapiens
auugccuugugaauuugcugcua

SEQ ID NO: 1023915 - RNA, 17 nt, Homo sapiens
auugcuaugaaugauac

SEQ ID NO: 1023916 - RNA, 19 nt, Homo sapiens
auugcucucccagcccuug

SEQ ID NO: 1023917 - RNA, 16 nt, Homo sapiens
auuggaagcugucaua

SEQ ID NO: 1023918 - RNA, 18 nt, Homo sapiens
auuggaauuaaccuggug

SEQ ID NO: 1023919 - RNA, 17 nt, Homo sapiens
auuggaccauccuauuu

SEQ ID NO: 1023920 - RNA, 20 nt, Homo sapiens
auuggaccuguucaaaaagg

SEQ ID NO: 1023921 - RNA, 13 nt, Homo sapiens
auuggcugagaua

SEQ ID NO: 1023922 - RNA, 14 nt, Homo sapiens
acgaucucgacuca

SEQ ID NO: 1023923 - RNA, 10 nt, Homo sapiens
acgcacacac

SEQ ID NO: 1023924 - RNA, 14 nt, Homo sapiens
acgcaccacaucuc

SEQ ID NO: 1023925 - RNA, 16 nt, Homo sapiens
acgcacugguaugugu

SEQ ID NO: 1023926 - RNA, 20 nt, Homo sapiens
acgcccaugugugagugugu

SEQ ID NO: 1023927 - RNA, 15 nt, Homo sapiens
acgccgcccuaaaag

SEQ ID NO: 1023928 - RNA, 17 nt, Homo sapiens
acgccuccccuuuguga

SEQ ID NO: 1023929 - RNA, 21 nt, Homo sapiens
acgccuguaaucccagcacuu

SEQ ID NO: 1023930 - RNA, 13 nt, Homo sapiens
acgccuguagucc

SEQ ID NO: 1023931 - RNA, 19 nt, Homo sapiens
acgccuguaguccuagcca

SEQ ID NO: 1023932 - RNA, 17 nt, Homo sapiens
acgccuuguucuuggcc

SEQ ID NO: 1023933 - RNA, 18 nt, Homo sapiens
acgcuaguuaucaugcau

SEQ ID NO: 1023934 - RNA, 17 nt, Homo sapiens
acggacacucaaaagcu

SEQ ID NO: 1023935 - RNA, 22 nt, Homo sapiens
acggagccacuccucugacuca

SEQ ID NO: 1023936 - RNA, 17 nt, Homo sapiens
acggccagguacaacac

SEQ ID NO: 1023937 - RNA, 13 nt, Homo sapiens
acggcucuaggug

SEQ ID NO: 1023938 - RNA, 18 nt, Homo sapiens
acggcuuguaaaugugac

SEQ ID NO: 1023939 - RNA, 11 nt, Homo sapiens
acggugcaguc

SEQ ID NO: 1023940 - RNA, 14 nt, Homo sapiens
acgucaagucuccu

SEQ ID NO: 1023941 - RNA, 10 nt, Homo sapiens
acgugcaaua

SEQ ID NO: 1023942 - RNA, 20 nt, Homo sapiens
acguggugcauuuugcuugu

SEQ ID NO: 1023943 - RNA, 11 nt, Homo sapiens
acguguugccu

SEQ ID NO: 1023944 - RNA, 22 nt, Homo sapiens
acguugaggacuuuucgaccaa

SEQ ID NO: 1023945 - RNA, 23 nt, Homo sapiens
acuaaaaauacaauuagccaggu

SEQ ID NO: 1023946 - RNA, 16 nt, Homo sapiens
acuaaaaggugaccaa

SEQ ID NO: 1023947 - RNA, 17 nt, Homo sapiens
acuaaaguauaucuuua

SEQ ID NO: 1023948 - RNA, 15 nt, Homo sapiens
acuaacagauaagca

SEQ ID NO: 1023949 - RNA, 20 nt, Homo sapiens
acuaagaugacauugcuaag

SEQ ID NO: 1023950 - RNA, 20 nt, Homo sapiens
acuaagaugaucaucuccag

SEQ ID NO: 1023951 - RNA, 18 nt, Homo sapiens
acuaagauugugcucaau

SEQ ID NO: 1023952 - RNA, 15 nt, Homo sapiens
acuaagcuuugccag

SEQ ID NO: 1023953 - RNA, 16 nt, Homo sapiens
acuaaggaaucuuucu

SEQ ID NO: 1023954 - RNA, 22 nt, Homo sapiens
acuaaggaguaaucuguguaca

SEQ ID NO: 1023955 - RNA, 17 nt, Homo sapiens
acuaaggugugcucuga

SEQ ID NO: 1023956 - RNA, 22 nt, Homo sapiens
acuacacauucaauaagcauca

SEQ ID NO: 1023957 - RNA, 23 nt, Homo sapiens
acuacacauucaauaagcaucaa

SEQ ID NO: 1023958 - RNA, 13 nt, Homo sapiens
acuacacuccagc

SEQ ID NO: 1023959 - RNA, 17 nt, Homo sapiens
acuacaggcacacgcca

SEQ ID NO: 1023960 - RNA, 16 nt, Homo sapiens
acuacaggcucaugcc

SEQ ID NO: 1023961 - RNA, 20 nt, Homo sapiens
acuaccuaacauuauuuauu

SEQ ID NO: 1023962 - RNA, 15 nt, Homo sapiens
acuacgcuugcucau

SEQ ID NO: 1023963 - RNA, 20 nt, Homo sapiens
acuacucagccuucaaugua

SEQ ID NO: 1023964 - RNA, 21 nt, Homo sapiens
acuacuccucugcagugccuu

SEQ ID NO: 1023965 - RNA, 22 nt, Homo sapiens
acuacuccucugcagugccuug

SEQ ID NO: 1023966 - RNA, 16 nt, Homo sapiens
acuacucuacuuccuc

SEQ ID NO: 1023967 - RNA, 15 nt, Homo sapiens
acuacuggcaauuug

SEQ ID NO: 1023968 - RNA, 14 nt, Homo sapiens
acuagaacucucca

SEQ ID NO: 1023969 - RNA, 18 nt, Homo sapiens
acuagagggauacacuga

SEQ ID NO: 1023970 - RNA, 24 nt, Homo sapiens
acuagcauaugaguuucauagcua

SEQ ID NO: 1023971 - RNA, 21 nt, Homo sapiens
acuagcccaaugaaaugaauu

SEQ ID NO: 1023972 - RNA, 19 nt, Homo sapiens
acuaguaguuccugcuaca

SEQ ID NO: 1023973 - RNA, 22 nt, Homo sapiens
acuauaaauaauauucuauuca

SEQ ID NO: 1023974 - RNA, 17 nt, Homo sapiens
acuauauuuauacugua

SEQ ID NO: 1023975 - RNA, 15 nt, Homo sapiens
acuauccuaccccac

SEQ ID NO: 1023976 - RNA, 19 nt, Homo sapiens
acuauggcucuacuuucag

SEQ ID NO: 1023977 - RNA, 15 nt, Homo sapiens
acuauggugccaaug

SEQ ID NO: 1023978 - RNA, 15 nt, Homo sapiens
acuauguaacaugua

SEQ ID NO: 1023979 - RNA, 15 nt, Homo sapiens
acuauguugcccagg

SEQ ID NO: 1023980 - RNA, 15 nt, Homo sapiens
acuauuaccaugaga

SEQ ID NO: 1023981 - RNA, 14 nt, Homo sapiens
acuauucauaagau

SEQ ID NO: 1023982 - RNA, 13 nt, Homo sapiens
acuauucugauua

SEQ ID NO: 1023983 - RNA, 21 nt, Homo sapiens
acuauugaaguugcagauuca

SEQ ID NO: 1023984 - RNA, 13 nt, Homo sapiens
acuauugagauau

SEQ ID NO: 1023985 - RNA, 13 nt, Homo sapiens
acucaaacugccu

SEQ ID NO: 1023986 - RNA, 20 nt, Homo sapiens
acucaaguccuuaccucuuc

SEQ ID NO: 1023987 - RNA, 20 nt, Homo sapiens
acucacaagaagaccagacu

SEQ ID NO: 1023988 - RNA, 16 nt, Homo sapiens
acucacaauuccaaac

SEQ ID NO: 1023989 - RNA, 15 nt, Homo sapiens
acucacagucucuuu

SEQ ID NO: 1023990 - RNA, 21 nt, Homo sapiens
acucacgaauauuaugcccag

SEQ ID NO: 1023991 - RNA, 21 nt, Homo sapiens
acucacugacucuucuaugca

SEQ ID NO: 1023992 - RNA, 21 nt, Homo sapiens
acucacugcaaccuucgccuc

SEQ ID NO: 1023993 - RNA, 17 nt, Homo sapiens
acucagaagacacugau

SEQ ID NO: 1023994 - RNA, 18 nt, Homo sapiens
acucagauggaaccgcag

SEQ ID NO: 1023995 - RNA, 15 nt, Homo sapiens
acucagcucuuggcu

SEQ ID NO: 1023996 - RNA, 13 nt, Homo sapiens
acucaggacaucc

SEQ ID NO: 1023997 - RNA, 12 nt, Homo sapiens
acucaggaucca

SEQ ID NO: 1023998 - RNA, 18 nt, Homo sapiens
acucagggacagagccau

SEQ ID NO: 1023999 - RNA, 19 nt, Homo sapiens
acucagggccccagcacua

SEQ ID NO: 1024000 - RNA, 13 nt, Homo sapiens
acucagggcuccu

SEQ ID NO: 1024001 - RNA, 18 nt, Homo sapiens
aaaacggcccucuugaag

SEQ ID NO: 1024002 - RNA, 14 nt, Homo sapiens
aaaacguauugcau

SEQ ID NO: 1024003 - RNA, 14 nt, Homo sapiens
aaaacgucuugcuu

SEQ ID NO: 1024004 - RNA, 20 nt, Homo sapiens
aaaacuaauuuccucugaca

SEQ ID NO: 1024005 - RNA, 20 nt, Homo sapiens
aaaacucauuacuuuuccau

SEQ ID NO: 1024006 - RNA, 13 nt, Homo sapiens
aaaacucauuucc

SEQ ID NO: 1024007 - RNA, 20 nt, Homo sapiens
aaaacucauuuccuauguaa

SEQ ID NO: 1024008 - RNA, 14 nt, Homo sapiens
aaaacuccaucuca

SEQ ID NO: 1024009 - RNA, 17 nt, Homo sapiens
aaaacuccccuuccuca

SEQ ID NO: 1024010 - RNA, 14 nt, Homo sapiens
aaaacuucuuuaaa

SEQ ID NO: 1024011 - RNA, 14 nt, Homo sapiens
aaaacuugcugccu

SEQ ID NO: 1024012 - RNA, 23 nt, Homo sapiens
aaaacuuggaauucucucaccuc

SEQ ID NO: 1024013 - RNA, 19 nt, Homo sapiens
aaaacuuguuacuaaagaa

SEQ ID NO: 1024014 - RNA, 19 nt, Homo sapiens
aaaacuuuaugcuaaguga

SEQ ID NO: 1024015 - RNA, 11 nt, Homo sapiens
aaaagacauaa

SEQ ID NO: 1024016 - RNA, 15 nt, Homo sapiens
aaaagaccaguccau

SEQ ID NO: 1024017 - RNA, 13 nt, Homo sapiens
aaaagacugacca

SEQ ID NO: 1024018 - RNA, 15 nt, Homo sapiens
aaaagagagaucuug

SEQ ID NO: 1024019 - RNA, 17 nt, Homo sapiens
aaaagagagaucuugau

SEQ ID NO: 1024020 - RNA, 16 nt, Homo sapiens
aaaagauaacaagauc

SEQ ID NO: 1024021 - RNA, 12 nt, Homo sapiens
aaaagaucuucu

SEQ ID NO: 1024022 - RNA, 17 nt, Homo sapiens
aaaagaucuucuuccaa

SEQ ID NO: 1024023 - RNA, 21 nt, Homo sapiens
aaaagaugcaucuaccgcucu

SEQ ID NO: 1024024 - RNA, 23 nt, Homo sapiens
aaaagaugcuucucacugccaug

SEQ ID NO: 1024025 - RNA, 18 nt, Homo sapiens
aaaagcacacucaucccc

SEQ ID NO: 1024026 - RNA, 14 nt, Homo sapiens
aaaagcagcuacca

SEQ ID NO: 1024027 - RNA, 18 nt, Homo sapiens
aaaagcaguaacugacaa

SEQ ID NO: 1024028 - RNA, 22 nt, Homo sapiens
aaaagcuauuagccaggaucau

SEQ ID NO: 1024029 - RNA, 20 nt, Homo sapiens
aaaagcugaauccagaucau

SEQ ID NO: 1024030 - RNA, 15 nt, Homo sapiens
aaaaggauaugcagu

SEQ ID NO: 1024031 - RNA, 23 nt, Homo sapiens
aaaaggcaccuauaaaacagguc

SEQ ID NO: 1024032 - RNA, 15 nt, Homo sapiens
aaaaggcauauugcu

SEQ ID NO: 1024033 - RNA, 20 nt, Homo sapiens
aaaagggagauucagacugu

SEQ ID NO: 1024034 - RNA, 15 nt, Homo sapiens
aaaagguuauauacc

SEQ ID NO: 1024035 - RNA, 15 nt, Homo sapiens
aaaaguaagcccuug

SEQ ID NO: 1024036 - RNA, 18 nt, Homo sapiens
aaaaguaaguaccacuca

SEQ ID NO: 1024037 - RNA, 18 nt, Homo sapiens
aaaagucuacgcucuccu

SEQ ID NO: 1024038 - RNA, 12 nt, Homo sapiens
aaaagugggcca

SEQ ID NO: 1024039 - RNA, 16 nt, Homo sapiens
aaaagugugagcagug

SEQ ID NO: 1024040 - RNA, 13 nt, Homo sapiens
aaaaguugugauu

SEQ ID NO: 1024041 - RNA, 12 nt, Homo sapiens
aaaauaacuuau

SEQ ID NO: 1024042 - RNA, 15 nt, Homo sapiens
aaaauaagcacugug

SEQ ID NO: 1024043 - RNA, 13 nt, Homo sapiens
aaaauacaguucu

SEQ ID NO: 1024044 - RNA, 18 nt, Homo sapiens
aaaauacaugacauuuau

SEQ ID NO: 1024045 - RNA, 21 nt, Homo sapiens
aaaauaccaaggaacaggaaa

SEQ ID NO: 1024046 - RNA, 10 nt, Homo sapiens
aaaauacuug

SEQ ID NO: 1024047 - RNA, 13 nt, Homo sapiens
aaaauagcaacac

SEQ ID NO: 1024048 - RNA, 11 nt, Homo sapiens
aaaauagccac

SEQ ID NO: 1024049 - RNA, 22 nt, Homo sapiens
aaaauagggaaguaacaguaac

SEQ ID NO: 1024050 - RNA, 13 nt, Homo sapiens
aaaauaguaaugu

SEQ ID NO: 1024051 - RNA, 21 nt, Homo sapiens
aaaauauauuucagauaucag

SEQ ID NO: 1024052 - RNA, 11 nt, Homo sapiens
aaaauaugcau

SEQ ID NO: 1024053 - RNA, 20 nt, Homo sapiens
aaaaucaaacaauucaggga

SEQ ID NO: 1024054 - RNA, 12 nt, Homo sapiens
aaaaucaaacag

SEQ ID NO: 1024055 - RNA, 22 nt, Homo sapiens
aaaaucacacagccaagccagu

SEQ ID NO: 1024056 - RNA, 19 nt, Homo sapiens
aaaaucagccugcuccagc

SEQ ID NO: 1024057 - RNA, 12 nt, Homo sapiens
aaaaucugucca

SEQ ID NO: 1024058 - RNA, 12 nt, Homo sapiens
aaaaucuuggau

SEQ ID NO: 1024059 - RNA, 22 nt, Homo sapiens
aaaaugaaaauuaggauuucau

SEQ ID NO: 1024060 - RNA, 19 nt, Homo sapiens
aaaaugaaagcaugucuca

SEQ ID NO: 1024061 - RNA, 23 nt, Homo sapiens
aaaaugaaauacuaaaucuuucu

SEQ ID NO: 1024062 - RNA, 24 nt, Homo sapiens
aaaaugaacugaaguuucacauga

SEQ ID NO: 1024063 - RNA, 17 nt, Homo sapiens
aaaaugaaucuucacaa

SEQ ID NO: 1024064 - RNA, 12 nt, Homo sapiens
aaaaugagacaa

SEQ ID NO: 1024065 - RNA, 14 nt, Homo sapiens
aaaaugagcaaaag

SEQ ID NO: 1024066 - RNA, 22 nt, Homo sapiens
aaaaugagguucaacuguugau

SEQ ID NO: 1024067 - RNA, 18 nt, Homo sapiens
aaaaugcaacaacaugua

SEQ ID NO: 1024068 - RNA, 19 nt, Homo sapiens
aaaauggcucagaugccac

SEQ ID NO: 1024069 - RNA, 16 nt, Homo sapiens
aaaaugggacuucuuu

SEQ ID NO: 1024070 - RNA, 17 nt, Homo sapiens
aaaaugucauuguucuc

SEQ ID NO: 1024071 - RNA, 13 nt, Homo sapiens
aaaauguccauga

SEQ ID NO: 1024072 - RNA, 22 nt, Homo sapiens
aaaauguccucccuuguggcuu

SEQ ID NO: 1024073 - RNA, 12 nt, Homo sapiens
aaaaugugcaau

SEQ ID NO: 1024074 - RNA, 15 nt, Homo sapiens
aaaaugugcaauaug

SEQ ID NO: 1024075 - RNA, 19 nt, Homo sapiens
aaaaugugcuauacugcau

SEQ ID NO: 1024076 - RNA, 13 nt, Homo sapiens
aaaauguugaaua

SEQ ID NO: 1024077 - RNA, 13 nt, Homo sapiens
aaaauuaaauugc

SEQ ID NO: 1024078 - RNA, 11 nt, Homo sapiens
aaaauuacuuc

SEQ ID NO: 1024079 - RNA, 18 nt, Homo sapiens
aaaauuauuugcauaaca

SEQ ID NO: 1024080 - RNA, 17 nt, Homo sapiens
aaaauucagagaguuag

SEQ ID NO: 1024081 - RNA, 15 nt, Homo sapiens
aaaauucuuggaaua

SEQ ID NO: 1024082 - RNA, 15 nt, Homo sapiens
aaaauugcacuuuua

SEQ ID NO: 1024083 - RNA, 22 nt, Homo sapiens
aaaauuggucacccuaaggaaa

SEQ ID NO: 1024084 - RNA, 18 nt, Homo sapiens
aaaauuugaaauuuagcu

SEQ ID NO: 1024085 - RNA, 18 nt, Homo sapiens
aaaauuuguuuugacgga

SEQ ID NO: 1024086 - RNA, 17 nt, Homo sapiens
aaacaaauguauuucaa

SEQ ID NO: 1024087 - RNA, 16 nt, Homo sapiens
aaacaacagcuuuaaa

SEQ ID NO: 1024088 - RNA, 13 nt, Homo sapiens
aaacaaccugcca

SEQ ID NO: 1024089 - RNA, 22 nt, Homo sapiens
aaacaaccugccaccaaaagaa

SEQ ID NO: 1024090 - RNA, 12 nt, Homo sapiens
aaacaagccaug

SEQ ID NO: 1024091 - RNA, 22 nt, Homo sapiens
aaacacauacaggaagguagaa

SEQ ID NO: 1024092 - RNA, 17 nt, Homo sapiens
aaacaccaaaaagggau

SEQ ID NO: 1024093 - RNA, 22 nt, Homo sapiens
aaacaccuagcuuuauucuuca

SEQ ID NO: 1024094 - RNA, 20 nt, Homo sapiens
aaacaccuggaggugaaggc

SEQ ID NO: 1024095 - RNA, 22 nt, Homo sapiens
aaacacuauauggcagugucuu

SEQ ID NO: 1024096 - RNA, 12 nt, Homo sapiens
aaacacugccau

SEQ ID NO: 1024097 - RNA, 14 nt, Homo sapiens
aaacacuuacagaa

SEQ ID NO: 1024098 - RNA, 20 nt, Homo sapiens
aaacagaaagcauccuaaau

SEQ ID NO: 1024099 - RNA, 14 nt, Homo sapiens
aaacagaucuccug

SEQ ID NO: 1024100 - RNA, 20 nt, Homo sapiens
aaacagcagauuucagauca

SEQ ID NO: 1024101 - RNA, 21 nt, Homo sapiens
aaacagccccucuggacacag

SEQ ID NO: 1024102 - RNA, 17 nt, Homo sapiens
aaacagcugcccugugu

SEQ ID NO: 1024103 - RNA, 16 nt, Homo sapiens
aaacaggaccacaaaa

SEQ ID NO: 1024104 - RNA, 19 nt, Homo sapiens
aaagugcuuccaaggcaga

SEQ ID NO: 1024105 - RNA, 16 nt, Homo sapiens
aaaguggugcucaguu

SEQ ID NO: 1024106 - RNA, 11 nt, Homo sapiens
aaaguguaaag

SEQ ID NO: 1024107 - RNA, 14 nt, Homo sapiens
aaagugucccccuu

SEQ ID NO: 1024108 - RNA, 14 nt, Homo sapiens
aaagugugagcaaa

SEQ ID NO: 1024109 - RNA, 16 nt, Homo sapiens
aaaguucucaaugcaa

SEQ ID NO: 1024110 - RNA, 17 nt, Homo sapiens
aaaguucugcagauaaa

SEQ ID NO: 1024111 - RNA, 22 nt, Homo sapiens
aaaguugcauguuaugugaguc

SEQ ID NO: 1024112 - RNA, 14 nt, Homo sapiens
aaaguuucagagaa

SEQ ID NO: 1024113 - RNA, 19 nt, Homo sapiens
aaauaaaaaacauauacaa

SEQ ID NO: 1024114 - RNA, 17 nt, Homo sapiens
aaauaaaaugcagacag

SEQ ID NO: 1024115 - RNA, 22 nt, Homo sapiens
aaauaaaguauauauagaaucu

SEQ ID NO: 1024116 - RNA, 18 nt, Homo sapiens
aaauaaagucccagguua

SEQ ID NO: 1024117 - RNA, 16 nt, Homo sapiens
aaauaacgccccagau

SEQ ID NO: 1024118 - RNA, 15 nt, Homo sapiens
aaauaacuaaugucu

SEQ ID NO: 1024119 - RNA, 20 nt, Homo sapiens
aaauaagagaaaaaauuaaa

SEQ ID NO: 1024120 - RNA, 20 nt, Homo sapiens
aaauaagauuuaauucacau

SEQ ID NO: 1024121 - RNA, 16 nt, Homo sapiens
aaauaauaaaucuggu

SEQ ID NO: 1024122 - RNA, 12 nt, Homo sapiens
aaauaauaugca

SEQ ID NO: 1024123 - RNA, 16 nt, Homo sapiens
aaauaaugcacuuccu

SEQ ID NO: 1024124 - RNA, 16 nt, Homo sapiens
aaauaauugauuucaa

SEQ ID NO: 1024125 - RNA, 15 nt, Homo sapiens
aaauacagucuucca

SEQ ID NO: 1024126 - RNA, 22 nt, Homo sapiens
aaauacaguuugucacaugaaa

SEQ ID NO: 1024127 - RNA, 15 nt, Homo sapiens
aaauaccagccagua

SEQ ID NO: 1024128 - RNA, 19 nt, Homo sapiens
aaauacccacuaacaaaga

SEQ ID NO: 1024129 - RNA, 20 nt, Homo sapiens
aaauaccucuuagcugagug

SEQ ID NO: 1024130 - RNA, 15 nt, Homo sapiens
aaauacuucuugaag

SEQ ID NO: 1024131 - RNA, 19 nt, Homo sapiens
aaauacuucuugaagccga

SEQ ID NO: 1024132 - RNA, 9 nt, Homo sapiens
aaauacuug

SEQ ID NO: 1024133 - RNA, 16 nt, Homo sapiens
aaauagaauuugagca

SEQ ID NO: 1024134 - RNA, 15 nt, Homo sapiens
aaauagagaauccca

SEQ ID NO: 1024135 - RNA, 14 nt, Homo sapiens
aaauagcauucucu

SEQ ID NO: 1024136 - RNA, 16 nt, Homo sapiens
aaauagccaacaccca

SEQ ID NO: 1024137 - RNA, 15 nt, Homo sapiens
aaauagcugccuuuu

SEQ ID NO: 1024138 - RNA, 14 nt, Homo sapiens
aaauauauaugugu

SEQ ID NO: 1024139 - RNA, 17 nt, Homo sapiens
aaauaucacaucacuua

SEQ ID NO: 1024140 - RNA, 13 nt, Homo sapiens
aaauaugcaguga

SEQ ID NO: 1024141 - RNA, 19 nt, Homo sapiens
aaauauuagaagccugcag

SEQ ID NO: 1024142 - RNA, 17 nt, Homo sapiens
aaauauugcuucaauaa

SEQ ID NO: 1024143 - RNA, 18 nt, Homo sapiens
aaauauuugcuaugaagc

SEQ ID NO: 1024144 - RNA, 20 nt, Homo sapiens
aaauauuuuuaugugcaaua

SEQ ID NO: 1024145 - RNA, 18 nt, Homo sapiens
aaauauuuuugcuguaga

SEQ ID NO: 1024146 - RNA, 16 nt, Homo sapiens
aaaucaaauauauguc

SEQ ID NO: 1024147 - RNA, 20 nt, Homo sapiens
aaaucagcugcuacuacucc

SEQ ID NO: 1024148 - RNA, 23 nt, Homo sapiens
aaaucaggacagguggugcaaau

SEQ ID NO: 1024149 - RNA, 15 nt, Homo sapiens
aaaucauaguuuaaa

SEQ ID NO: 1024150 - RNA, 19 nt, Homo sapiens
aaaucauuaauacucuucu

SEQ ID NO: 1024151 - RNA, 20 nt, Homo sapiens
aaauccaucuaaauaccugc

SEQ ID NO: 1024152 - RNA, 13 nt, Homo sapiens
aaauccuauguga

SEQ ID NO: 1024153 - RNA, 18 nt, Homo sapiens
aaaucuacacuccaguga

SEQ ID NO: 1024154 - RNA, 17 nt, Homo sapiens
aaaucuagaagacuguc

SEQ ID NO: 1024155 - RNA, 14 nt, Homo sapiens
aacagacuucucaa

SEQ ID NO: 1024156 - RNA, 15 nt, Homo sapiens
aacagauaagcaaga

SEQ ID NO: 1024157 - RNA, 14 nt, Homo sapiens
aacagauauuguca

SEQ ID NO: 1024158 - RNA, 17 nt, Homo sapiens
aacagcacccucuccag

SEQ ID NO: 1024159 - RNA, 12 nt, Homo sapiens
aacagcacuggc

SEQ ID NO: 1024160 - RNA, 13 nt, Homo sapiens
aacagcauaacua

SEQ ID NO: 1024161 - RNA, 14 nt, Homo sapiens
aacagcucucaccu

SEQ ID NO: 1024162 - RNA, 16 nt, Homo sapiens
aacaggaaaccacuua

SEQ ID NO: 1024163 - RNA, 23 nt, Homo sapiens
aacaggagaauuuuacuguguuu

SEQ ID NO: 1024164 - RNA, 15 nt, Homo sapiens
aacaguccauugaaa

SEQ ID NO: 1024165 - RNA, 23 nt, Homo sapiens
aacagugucauauacaauuguca

SEQ ID NO: 1024166 - RNA, 20 nt, Homo sapiens
aacaguucauguuugcuuca

SEQ ID NO: 1024167 - RNA, 21 nt, Homo sapiens
aacauaaauuucuuuaaucau

SEQ ID NO: 1024168 - RNA, 16 nt, Homo sapiens
aacauagagaucuaug

SEQ ID NO: 1024169 - RNA, 19 nt, Homo sapiens
aacaucaguuacucugaag

SEQ ID NO: 1024170 - RNA, 15 nt, Homo sapiens
aacaugaaaacaauu

SEQ ID NO: 1024171 - RNA, 19 nt, Homo sapiens
aacaugauuguuuacagcu

SEQ ID NO: 1024172 - RNA, 23 nt, Homo sapiens
aacaugcacaaaaagaugcaucu

SEQ ID NO: 1024173 - RNA, 17 nt, Homo sapiens
aacaugcuugcauuaua

SEQ ID NO: 1024174 - RNA, 19 nt, Homo sapiens
aacauggccuuugcuugaa

SEQ ID NO: 1024175 - RNA, 23 nt, Homo sapiens
aacauggcugaacgcguguguac

SEQ ID NO: 1024176 - RNA, 22 nt, Homo sapiens
aacauggugaaaccucaucucu

SEQ ID NO: 1024177 - RNA, 19 nt, Homo sapiens
aacauguaagcauaacuua

SEQ ID NO: 1024178 - RNA, 22 nt, Homo sapiens
aacauguuccuuauauuuacuc

SEQ ID NO: 1024179 - RNA, 17 nt, Homo sapiens
aacauuccaaugcauug

SEQ ID NO: 1024180 - RNA, 18 nt, Homo sapiens
aacauugauuauaagcau

SEQ ID NO: 1024181 - RNA, 13 nt, Homo sapiens
aacauuuacaugu

SEQ ID NO: 1024182 - RNA, 15 nt, Homo sapiens
aacauuuacauguau

SEQ ID NO: 1024183 - RNA, 16 nt, Homo sapiens
aacauuuaucaaucag

SEQ ID NO: 1024184 - RNA, 16 nt, Homo sapiens
aaccaaagagacugga

SEQ ID NO: 1024185 - RNA, 19 nt, Homo sapiens
aaccaaauauuccagagac

SEQ ID NO: 1024186 - RNA, 14 nt, Homo sapiens
aaccaacacuaaca

SEQ ID NO: 1024187 - RNA, 23 nt, Homo sapiens
aaccaaccuaagggcccaaaggc

SEQ ID NO: 1024188 - RNA, 15 nt, Homo sapiens
aaccaagcaaaggaa

SEQ ID NO: 1024189 - RNA, 19 nt, Homo sapiens
aaccaaguggcucccacac

SEQ ID NO: 1024190 - RNA, 19 nt, Homo sapiens
aaccacucauaauucuuca

SEQ ID NO: 1024191 - RNA, 21 nt, Homo sapiens
aaccacuuaaaaaauguccau

SEQ ID NO: 1024192 - RNA, 22 nt, Homo sapiens
aaccacuucagcugacuuuucu

SEQ ID NO: 1024193 - RNA, 16 nt, Homo sapiens
aaccagaaauccaguu

SEQ ID NO: 1024194 - RNA, 17 nt, Homo sapiens
aaccagagccauggacu

SEQ ID NO: 1024195 - RNA, 23 nt, Homo sapiens
aaccagauguuagaucaggggag

SEQ ID NO: 1024196 - RNA, 15 nt, Homo sapiens
aaccaggaaauggaa

SEQ ID NO: 1024197 - RNA, 16 nt, Homo sapiens
aaccaggaaccuccuc

SEQ ID NO: 1024198 - RNA, 16 nt, Homo sapiens
aaccagguuuagacag

SEQ ID NO: 1024199 - RNA, 20 nt, Homo sapiens
aaccauccauaguaguauga

SEQ ID NO: 1024200 - RNA, 15 nt, Homo sapiens
aaccaugcccaagaa

SEQ ID NO: 1024201 - RNA, 12 nt, Homo sapiens
aaccauuugcac

SEQ ID NO: 1024202 - RNA, 19 nt, Homo sapiens
aacccaaagugugacucau

SEQ ID NO: 1024203 - RNA, 23 nt, Homo sapiens
aacccaaagugugacucauuaaa

SEQ ID NO: 1024204 - RNA, 15 nt, Homo sapiens
aacccaaauguucau

SEQ ID NO: 1024205 - RNA, 15 nt, Homo sapiens
aacccacagccaaac

SEQ ID NO: 1024206 - RNA, 14 nt, Homo sapiens
aaccccaucucuac

SEQ ID NO: 1024207 - RNA, 19 nt, Homo sapiens
aacccuaaauuaauaaaag

SEQ ID NO: 1024208 - RNA, 11 nt, Homo sapiens
aaccacugcac

SEQ ID NO: 1024209 - RNA, 14 nt, Homo sapiens
aaccacuucagcug

SEQ ID NO: 1024210 - RNA, 19 nt, Homo sapiens
aaccagguuuagacaguau

SEQ ID NO: 1024211 - RNA, 13 nt, Homo sapiens
aaccauaaacuuc

SEQ ID NO: 1024212 - RNA, 16 nt, Homo sapiens
aaccaucaucuugcca

SEQ ID NO: 1024213 - RNA, 13 nt, Homo sapiens
aaccaucccugau

SEQ ID NO: 1024214 - RNA, 15 nt, Homo sapiens
aaccaucccugaugu

SEQ ID NO: 1024215 - RNA, 22 nt, Homo sapiens
aaccaugagaccacuguuauca

SEQ ID NO: 1024216 - RNA, 16 nt, Homo sapiens
aaccauuuuuuccuac

SEQ ID NO: 1024217 - RNA, 21 nt, Homo sapiens
aacccacaguucuccauuuca

SEQ ID NO: 1024218 - RNA, 20 nt, Homo sapiens
aacccaggaggcagcuguug

SEQ ID NO: 1024219 - RNA, 23 nt, Homo sapiens
aacccaggucuugacaccagcug

SEQ ID NO: 1024220 - RNA, 16 nt, Homo sapiens
aaccccaaacuguuga

SEQ ID NO: 1024221 - RNA, 16 nt, Homo sapiens
aaccccaucucuacaa

SEQ ID NO: 1024222 - RNA, 21 nt, Homo sapiens
aacccuaggcaucacaugcuc

SEQ ID NO: 1024223 - RNA, 23 nt, Homo sapiens
aacccuaggcaucacaugcucaa

SEQ ID NO: 1024224 - RNA, 18 nt, Homo sapiens
aacccucagaaacacugg

SEQ ID NO: 1024225 - RNA, 19 nt, Homo sapiens
aacccucuaagggaccuca

SEQ ID NO: 1024226 - RNA, 23 nt, Homo sapiens
aacccugacuccucuuugugcag

SEQ ID NO: 1024227 - RNA, 12 nt, Homo sapiens
aacccugcaaua

SEQ ID NO: 1024228 - RNA, 17 nt, Homo sapiens
aacccugccccugcccc

SEQ ID NO: 1024229 - RNA, 22 nt, Homo sapiens
aacccugcuugcacuuuguaac

SEQ ID NO: 1024230 - RNA, 18 nt, Homo sapiens
aacccuggagaguucaau

SEQ ID NO: 1024231 - RNA, 12 nt, Homo sapiens
aacccugucuga

SEQ ID NO: 1024232 - RNA, 21 nt, Homo sapiens
aaccgguggauccucaaacaa

SEQ ID NO: 1024233 - RNA, 21 nt, Homo sapiens
aaccucaacugccuacuccaa

SEQ ID NO: 1024234 - RNA, 15 nt, Homo sapiens
aaccucaaguuauuc

SEQ ID NO: 1024235 - RNA, 12 nt, Homo sapiens
aaccucaucucu

SEQ ID NO: 1024236 - RNA, 15 nt, Homo sapiens
aaccucauuaucagu

SEQ ID NO: 1024237 - RNA, 21 nt, Homo sapiens
aaccucauuccccaaccacuu

SEQ ID NO: 1024238 - RNA, 15 nt, Homo sapiens
aaccuccacugcugc

SEQ ID NO: 1024239 - RNA, 18 nt, Homo sapiens
aaccuccccaacagcacu

SEQ ID NO: 1024240 - RNA, 20 nt, Homo sapiens
aaccuccccaacagcacuua

SEQ ID NO: 1024241 - RNA, 21 nt, Homo sapiens
aaccuccuuucucuucucugu

SEQ ID NO: 1024242 - RNA, 18 nt, Homo sapiens
aaccucuaugcaaucuga

SEQ ID NO: 1024243 - RNA, 14 nt, Homo sapiens
aaccugaugcaguc

SEQ ID NO: 1024244 - RNA, 15 nt, Homo sapiens
aaccugccaccaaaa

SEQ ID NO: 1024245 - RNA, 23 nt, Homo sapiens
aaccuggagggcuagaaccugga

SEQ ID NO: 1024246 - RNA, 20 nt, Homo sapiens
aaccugggagguggagguug

SEQ ID NO: 1024247 - RNA, 16 nt, Homo sapiens
aaccuggggcuaauca

SEQ ID NO: 1024248 - RNA, 16 nt, Homo sapiens
aaccuguccuugcaca

SEQ ID NO: 1024249 - RNA, 12 nt, Homo sapiens
aaccugugauga

SEQ ID NO: 1024250 - RNA, 18 nt, Homo sapiens
aaccuuauuguaccucuc

SEQ ID NO: 1024251 - RNA, 20 nt, Homo sapiens
aaccuucuggccucccacag

SEQ ID NO: 1024252 - RNA, 21 nt, Homo sapiens
aaccuugguguaguugaacug

SEQ ID NO: 1024253 - RNA, 18 nt, Homo sapiens
aaccuugucucuaugcca

SEQ ID NO: 1024254 - RNA, 20 nt, Homo sapiens
aaccuugugccuggcucaga

SEQ ID NO: 1024255 - RNA, 23 nt, Homo sapiens
aaccuugugccuggcucagagcc

SEQ ID NO: 1024256 - RNA, 23 nt, Homo sapiens
aaccuuugagacuauugagauau

SEQ ID NO: 1024257 - RNA, 23 nt, Homo sapiens
aaccuuuuuuaagauuuuucuca

SEQ ID NO: 1024258 - RNA, 23 nt, Homo sapiens
aacgacaaagccaaacucugcca

SEQ ID NO: 1024259 - RNA, 15 nt, Homo sapiens
aacgauuuaauucuc

SEQ ID NO: 1024260 - RNA, 22 nt, Homo sapiens
aacgcaaagggcugaaagccau

SEQ ID NO: 1024261 - RNA, 17 nt, Homo sapiens
aacgcacacaguaucua

SEQ ID NO: 1024262 - RNA, 19 nt, Homo sapiens
aacggagagcgccugcccc

SEQ ID NO: 1024263 - RNA, 18 nt, Homo sapiens
aacggcuccaggauuuua

SEQ ID NO: 1024264 - RNA, 14 nt, Homo sapiens
aacguaugcaugug

SEQ ID NO: 1024265 - RNA, 22 nt, Homo sapiens
aacguuuacuuaucuuaugcca

SEQ ID NO: 1024266 - RNA, 14 nt, Homo sapiens
aacuaaaaagccau

SEQ ID NO: 1024267 - RNA, 17 nt, Homo sapiens
aacuaacguacauucaa

SEQ ID NO: 1024268 - RNA, 23 nt, Homo sapiens
aacuaacucuccuccauguugcc

SEQ ID NO: 1024269 - RNA, 22 nt, Homo sapiens
aacuaauaaaagcauaaaugca

SEQ ID NO: 1024270 - RNA, 18 nt, Homo sapiens
aacuaaugucucuacaau

SEQ ID NO: 1024271 - RNA, 14 nt, Homo sapiens
aacuacaauguagu

SEQ ID NO: 1024272 - RNA, 12 nt, Homo sapiens
aacuacauguaa

SEQ ID NO: 1024273 - RNA, 11 nt, Homo sapiens
aacuaccuccu

SEQ ID NO: 1024274 - RNA, 14 nt, Homo sapiens
aacuauaugccaua

SEQ ID NO: 1024275 - RNA, 13 nt, Homo sapiens
aacuauccaaaac

SEQ ID NO: 1024276 - RNA, 22 nt, Homo sapiens
aacuaucuuuuuuuuauuccac

SEQ ID NO: 1024277 - RNA, 17 nt, Homo sapiens
aacuauuacaccaaaua

SEQ ID NO: 1024278 - RNA, 20 nt, Homo sapiens
aacucaauauuuuccaugaa

SEQ ID NO: 1024279 - RNA, 14 nt, Homo sapiens
aacucacaauucca

SEQ ID NO: 1024280 - RNA, 12 nt, Homo sapiens
aacucagggaca

SEQ ID NO: 1024281 - RNA, 19 nt, Homo sapiens
aacucagggacagagccau

SEQ ID NO: 1024282 - RNA, 20 nt, Homo sapiens
aacucagggacagagccaug

SEQ ID NO: 1024283 - RNA, 14 nt, Homo sapiens
aacucagugugacu

SEQ ID NO: 1024284 - RNA, 21 nt, Homo sapiens
aacucauggaccacaguaaca

SEQ ID NO: 1024285 - RNA, 17 nt, Homo sapiens
aacucauuccugccugu

SEQ ID NO: 1024286 - RNA, 20 nt, Homo sapiens
aacucauuccugccugucuc

SEQ ID NO: 1024287 - RNA, 15 nt, Homo sapiens
aacucauuugcucua

SEQ ID NO: 1024288 - RNA, 12 nt, Homo sapiens
aacuccagugaa

SEQ ID NO: 1024289 - RNA, 17 nt, Homo sapiens
aacuccuagcugacuca

SEQ ID NO: 1024290 - RNA, 21 nt, Homo sapiens
aacucugagaucuaaggaugu

SEQ ID NO: 1024291 - RNA, 23 nt, Homo sapiens
aacucugagcagugcuugaauga

SEQ ID NO: 1024292 - RNA, 23 nt, Homo sapiens
aacucugcuugauuuuugccucu

SEQ ID NO: 1024293 - RNA, 17 nt, Homo sapiens
aacugaaaacaagccau

SEQ ID NO: 1024294 - RNA, 18 nt, Homo sapiens
aacugaaaacaagccaug

SEQ ID NO: 1024295 - RNA, 22 nt, Homo sapiens
aacugacaggcagccuggacau

SEQ ID NO: 1024296 - RNA, 19 nt, Homo sapiens
aacugacaguaaaucucac

SEQ ID NO: 1024297 - RNA, 21 nt, Homo sapiens
aacugagauuacaggcaccca

SEQ ID NO: 1024298 - RNA, 18 nt, Homo sapiens
aacugauuuuuagcuuua

SEQ ID NO: 1024299 - RNA, 21 nt, Homo sapiens
aacugauuuuuagcuuuacaa

SEQ ID NO: 1024300 - RNA, 17 nt, Homo sapiens
aacugcauuccuucccc

SEQ ID NO: 1024301 - RNA, 14 nt, Homo sapiens
aacugcauugagaa

SEQ ID NO: 1024302 - RNA, 17 nt, Homo sapiens
aacugcugcugugcaca

SEQ ID NO: 1024303 - RNA, 22 nt, Homo sapiens
aacugcugcuuuuugagguggc

SEQ ID NO: 1024304 - RNA, 19 nt, Homo sapiens
aacuggaggaguuccuuga

SEQ ID NO: 1024305 - RNA, 20 nt, Homo sapiens
aacuggaggaguuccuugau

SEQ ID NO: 1024306 - RNA, 14 nt, Homo sapiens
aacuggcaguuuuc

SEQ ID NO: 1024307 - RNA, 19 nt, Homo sapiens
aacuggguacuuguggaca

SEQ ID NO: 1024308 - RNA, 16 nt, Homo sapiens
aacuguagucucagga

SEQ ID NO: 1024309 - RNA, 15 nt, Homo sapiens
aacuguggucaaucc

SEQ ID NO: 1024310 - RNA, 18 nt, Homo sapiens
aacuguucccaccugcug

SEQ ID NO: 1024311 - RNA, 20 nt, Homo sapiens
aacuguugauugcaggaaua

SEQ ID NO: 1024312 - RNA, 21 nt, Homo sapiens
aacuguuggcaaggugacauu

SEQ ID NO: 1024313 - RNA, 16 nt, Homo sapiens
aacuuaauaguauuua

SEQ ID NO: 1024314 - RNA, 14 nt, Homo sapiens
aacuuagagaggua

SEQ ID NO: 1024315 - RNA, 19 nt, Homo sapiens
aacuuaggaaggauccucu

SEQ ID NO: 1024316 - RNA, 21 nt, Homo sapiens
aacuucaauauccacuucuuu

SEQ ID NO: 1024317 - RNA, 21 nt, Homo sapiens
aacuucaauguaguuuuccau

SEQ ID NO: 1024318 - RNA, 13 nt, Homo sapiens
aacuucagggauc

SEQ ID NO: 1024319 - RNA, 23 nt, Homo sapiens
aacuuccacauuauacauuugau

SEQ ID NO: 1024320 - RNA, 24 nt, Homo sapiens
aacuucuacuucugcccuugccaa

SEQ ID NO: 1024321 - RNA, 22 nt, Homo sapiens
aacuucuuuaaaaaaacacaua

SEQ ID NO: 1024322 - RNA, 14 nt, Homo sapiens
aacuugacccccuu

SEQ ID NO: 1024323 - RNA, 23 nt, Homo sapiens
aacuugcacaaaaucacacagcc

SEQ ID NO: 1024324 - RNA, 13 nt, Homo sapiens
aacuugcaccucu

SEQ ID NO: 1024325 - RNA, 20 nt, Homo sapiens
aacuugcacgacgccugcca

SEQ ID NO: 1024326 - RNA, 12 nt, Homo sapiens
aacuuguaaaua

SEQ ID NO: 1024327 - RNA, 20 nt, Homo sapiens
aacuuuaauugacaguuuca

SEQ ID NO: 1024328 - RNA, 13 nt, Homo sapiens
aacuuuggcuuau

SEQ ID NO: 1024329 - RNA, 20 nt, Homo sapiens
aacuuuguuuagcccaaaac

SEQ ID NO: 1024330 - RNA, 16 nt, Homo sapiens
aacuuuuauuacuggg

SEQ ID NO: 1024331 - RNA, 15 nt, Homo sapiens
aagaaaaaauaucuu

SEQ ID NO: 1024332 - RNA, 22 nt, Homo sapiens
aagaaaaguagguuuacauuca

SEQ ID NO: 1024333 - RNA, 13 nt, Homo sapiens
aagaaaaucacuu

SEQ ID NO: 1024334 - RNA, 14 nt, Homo sapiens
aagaaaaugagaca

SEQ ID NO: 1024335 - RNA, 15 nt, Homo sapiens
aagaaaaugaugcug

SEQ ID NO: 1024336 - RNA, 14 nt, Homo sapiens
aagaaagacuaucu

SEQ ID NO: 1024337 - RNA, 22 nt, Homo sapiens
aagaaagcaaugccaaucuuca

SEQ ID NO: 1024338 - RNA, 18 nt, Homo sapiens
aagaaaggccagcaaauu

SEQ ID NO: 1024339 - RNA, 20 nt, Homo sapiens
aagaaagugcgaguccucca

SEQ ID NO: 1024340 - RNA, 12 nt, Homo sapiens
aagaaauuccug

SEQ ID NO: 1024341 - RNA, 22 nt, Homo sapiens
aagaaauuccuguagcaucuuc

SEQ ID NO: 1024342 - RNA, 20 nt, Homo sapiens
aagaacaguaacugccauca

SEQ ID NO: 1024343 - RNA, 21 nt, Homo sapiens
aagaaccacucauaauucuuc

SEQ ID NO: 1024344 - RNA, 13 nt, Homo sapiens
aagaaccucucac

SEQ ID NO: 1024345 - RNA, 12 nt, Homo sapiens
aagaagacauga

SEQ ID NO: 1024346 - RNA, 14 nt, Homo sapiens
aagaagacauguuu

SEQ ID NO: 1024347 - RNA, 19 nt, Homo sapiens
aagaagcauacaacuuugg

SEQ ID NO: 1024348 - RNA, 14 nt, Homo sapiens
aagaagccuuuccu

SEQ ID NO: 1024349 - RNA, 21 nt, Homo sapiens
aagaaggaauucuaggcaucc

SEQ ID NO: 1024350 - RNA, 15 nt, Homo sapiens
aagaagguuuguguu

SEQ ID NO: 1024351 - RNA, 17 nt, Homo sapiens
aagaauaaaauugcacu

SEQ ID NO: 1024352 - RNA, 16 nt, Homo sapiens
aaucuucuuaugcaau

SEQ ID NO: 1024353 - RNA, 18 nt, Homo sapiens
aaucuucuugauccacuu

SEQ ID NO: 1024354 - RNA, 16 nt, Homo sapiens
aaucuugauaccaccu

SEQ ID NO: 1024355 - RNA, 13 nt, Homo sapiens
aaucuugcaacug

SEQ ID NO: 1024356 - RNA, 19 nt, Homo sapiens
aaucuuucuuuaccugaga

SEQ ID NO: 1024357 - RNA, 19 nt, Homo sapiens
aaucuuuuaaaaauucaaa

SEQ ID NO: 1024358 - RNA, 20 nt, Homo sapiens
aaugaaaagcugaauccaga

SEQ ID NO: 1024359 - RNA, 17 nt, Homo sapiens
aaugaaacugcugugaa

SEQ ID NO: 1024360 - RNA, 16 nt, Homo sapiens
aaugaaccccacuggg

SEQ ID NO: 1024361 - RNA, 13 nt, Homo sapiens
aaugaaccuucug

SEQ ID NO: 1024362 - RNA, 15 nt, Homo sapiens
aaugaagaugaugcu

SEQ ID NO: 1024363 - RNA, 21 nt, Homo sapiens
aaugaagguuaggauuuaaca

SEQ ID NO: 1024364 - RNA, 23 nt, Homo sapiens
aaugaaugaccuuguugcaugau

SEQ ID NO: 1024365 - RNA, 14 nt, Homo sapiens
aaugaauguuuaca

SEQ ID NO: 1024366 - RNA, 22 nt, Homo sapiens
aaugaauuuuguuuggacuucu

SEQ ID NO: 1024367 - RNA, 22 nt, Homo sapiens
aaugacaaagaguagacauuuc

SEQ ID NO: 1024368 - RNA, 15 nt, Homo sapiens
aaugacacagucuug

SEQ ID NO: 1024369 - RNA, 20 nt, Homo sapiens
aaugacacagucuuggcuca

SEQ ID NO: 1024370 - RNA, 14 nt, Homo sapiens
aaugacaucucagg

SEQ ID NO: 1024371 - RNA, 15 nt, Homo sapiens
aaugacaucucaggg

SEQ ID NO: 1024372 - RNA, 20 nt, Homo sapiens
aaugacaucucaggggccag

SEQ ID NO: 1024373 - RNA, 14 nt, Homo sapiens
aaugaccucaagau

SEQ ID NO: 1024374 - RNA, 15 nt, Homo sapiens
aaugacggcaaacuc

SEQ ID NO: 1024375 - RNA, 21 nt, Homo sapiens
aaugagacauaggccaugaaa

SEQ ID NO: 1024376 - RNA, 23 nt, Homo sapiens
aaugagcaaaaccaaauauucca

SEQ ID NO: 1024377 - RNA, 15 nt, Homo sapiens
aaugaggacauguuu

SEQ ID NO: 1024378 - RNA, 19 nt, Homo sapiens
aaugaguuagaacuauuaa

SEQ ID NO: 1024379 - RNA, 15 nt, Homo sapiens
aaugauacaguugca

SEQ ID NO: 1024380 - RNA, 19 nt, Homo sapiens
aaugaugauccuaggcauu

SEQ ID NO: 1024381 - RNA, 20 nt, Homo sapiens
aaugauggcaaaaacaaagg

SEQ ID NO: 1024382 - RNA, 20 nt, Homo sapiens
aaugaugucaugucagcucc

SEQ ID NO: 1024383 - RNA, 19 nt, Homo sapiens
aaugaugucguuugaauca

SEQ ID NO: 1024384 - RNA, 19 nt, Homo sapiens
aaugauuuagguacgucaa

SEQ ID NO: 1024385 - RNA, 23 nt, Homo sapiens
aaugauuucaugcuaucucugug

SEQ ID NO: 1024386 - RNA, 16 nt, Homo sapiens
aaugcaacaacaugua

SEQ ID NO: 1024387 - RNA, 11 nt, Homo sapiens
aaugcaacuuc

SEQ ID NO: 1024388 - RNA, 14 nt, Homo sapiens
aaugcacacaaaac

SEQ ID NO: 1024389 - RNA, 23 nt, Homo sapiens
aaugcauauccaacaugugcuca

SEQ ID NO: 1024390 - RNA, 22 nt, Homo sapiens
aaugcaucauucuuguuaauua

SEQ ID NO: 1024391 - RNA, 14 nt, Homo sapiens
aaugcauugcuaaa

SEQ ID NO: 1024392 - RNA, 21 nt, Homo sapiens
aaugcauuguaucgauguuau

SEQ ID NO: 1024393 - RNA, 17 nt, Homo sapiens
aaugccacaaaacugac

SEQ ID NO: 1024394 - RNA, 19 nt, Homo sapiens
aaugccacacggcucucac

SEQ ID NO: 1024395 - RNA, 13 nt, Homo sapiens
aaugccauccuca

SEQ ID NO: 1024396 - RNA, 14 nt, Homo sapiens
aaugcccagugacc

SEQ ID NO: 1024397 - RNA, 23 nt, Homo sapiens
aaugcccagugaccagucacuga

SEQ ID NO: 1024398 - RNA, 21 nt, Homo sapiens
aaugcccucaggggacuugaa

SEQ ID NO: 1024399 - RNA, 20 nt, Homo sapiens
aaugcccuuacacuuacugu

SEQ ID NO: 1024400 - RNA, 16 nt, Homo sapiens
aaugccggugagaaua

SEQ ID NO: 1024401 - RNA, 16 nt, Homo sapiens
aaugccucaaugugac

SEQ ID NO: 1024402 - RNA, 13 nt, Homo sapiens
aaugcggcccaac

SEQ ID NO: 1024403 - RNA, 20 nt, Homo sapiens
aaugcucuuuacuucaugga

SEQ ID NO: 1024404 - RNA, 16 nt, Homo sapiens
aaugcugauguccuca

SEQ ID NO: 1024405 - RNA, 17 nt, Homo sapiens
aaugcuucuucucaggc

SEQ ID NO: 1024406 - RNA, 20 nt, Homo sapiens
aaugcuuggcuucucauacg

SEQ ID NO: 1024407 - RNA, 20 nt, Homo sapiens
aauggacauaagacagacag

SEQ ID NO: 1024408 - RNA, 19 nt, Homo sapiens
aauggaucuuaaagcauuc

SEQ ID NO: 1024409 - RNA, 17 nt, Homo sapiens
aauggcaacaucuugca

SEQ ID NO: 1024410 - RNA, 19 nt, Homo sapiens
aauggccuuuaucaucuag

SEQ ID NO: 1024411 - RNA, 17 nt, Homo sapiens
aauggcgcagugccucu

SEQ ID NO: 1024412 - RNA, 15 nt, Homo sapiens
aauggcgugaucucg

SEQ ID NO: 1024413 - RNA, 21 nt, Homo sapiens
aauggcuaagcaaaaugugau

SEQ ID NO: 1024414 - RNA, 23 nt, Homo sapiens
aauggcucacuauggugccaaug

SEQ ID NO: 1024415 - RNA, 24 nt, Homo sapiens
aaugggaauauuuuauacugacag

SEQ ID NO: 1024416 - RNA, 14 nt, Homo sapiens
aaugggcaaaacug

SEQ ID NO: 1024417 - RNA, 14 nt, Homo sapiens
aaugggcacuggga

SEQ ID NO: 1024418 - RNA, 17 nt, Homo sapiens
aauggggaucacagaga

SEQ ID NO: 1024419 - RNA, 17 nt, Homo sapiens
aauggggugcaugaagg

SEQ ID NO: 1024420 - RNA, 23 nt, Homo sapiens
aauggguuugcuagaaugugaua

SEQ ID NO: 1024421 - RNA, 17 nt, Homo sapiens
aauggucgcccaggaga

SEQ ID NO: 1024422 - RNA, 14 nt, Homo sapiens
aaugguuugaauau

SEQ ID NO: 1024423 - RNA, 14 nt, Homo sapiens
aauguaaagccagc

SEQ ID NO: 1024424 - RNA, 14 nt, Homo sapiens
aauguaacugcuga

SEQ ID NO: 1024425 - RNA, 22 nt, Homo sapiens
aauguaagggaaacugccagca

SEQ ID NO: 1024426 - RNA, 19 nt, Homo sapiens
aauguaguaaguaaauuaa

SEQ ID NO: 1024427 - RNA, 16 nt, Homo sapiens
aauguaucauagaaau

SEQ ID NO: 1024428 - RNA, 15 nt, Homo sapiens
aauguaugauuacau

SEQ ID NO: 1024429 - RNA, 21 nt, Homo sapiens
aauguauuuaaccagucuucu

SEQ ID NO: 1024430 - RNA, 17 nt, Homo sapiens
aaugucaggaacagaag

SEQ ID NO: 1024431 - RNA, 14 nt, Homo sapiens
aaugucuuaaucau

SEQ ID NO: 1024432 - RNA, 19 nt, Homo sapiens
aaugucuugaugcaugcac

SEQ ID NO: 1024433 - RNA, 20 nt, Homo sapiens
aaugucuuuugaauauuccc

SEQ ID NO: 1024434 - RNA, 22 nt, Homo sapiens
aaugugaaaaugguccaggaga

SEQ ID NO: 1024435 - RNA, 16 nt, Homo sapiens
aaugugaccaggggug

SEQ ID NO: 1024436 - RNA, 15 nt, Homo sapiens
aaugugauugcagcu

SEQ ID NO: 1024437 - RNA, 17 nt, Homo sapiens
aauguggauucuuccca

SEQ ID NO: 1024438 - RNA, 23 nt, Homo sapiens
aauguuaaguugauggugaugaa

SEQ ID NO: 1024439 - RNA, 18 nt, Homo sapiens
aauguuacugaucaugca

SEQ ID NO: 1024440 - RNA, 21 nt, Homo sapiens
aauguucauuguaauguuacu

SEQ ID NO: 1024441 - RNA, 13 nt, Homo sapiens
aauguucugacau

SEQ ID NO: 1024442 - RNA, 14 nt, Homo sapiens
aauguugggagaaa

SEQ ID NO: 1024443 - RNA, 15 nt, Homo sapiens
aauguuguaauucau

SEQ ID NO: 1024444 - RNA, 14 nt, Homo sapiens
aauuaaaagcccua

SEQ ID NO: 1024445 - RNA, 19 nt, Homo sapiens
aauuaaaauccucaaucca

SEQ ID NO: 1024446 - RNA, 23 nt, Homo sapiens
aauuaaaggagaagauuccugaa

SEQ ID NO: 1024447 - RNA, 18 nt, Homo sapiens
aauuaauggaauauguaa

SEQ ID NO: 1024448 - RNA, 21 nt, Homo sapiens
aauuacaguugaaagcuguau

SEQ ID NO: 1024449 - RNA, 18 nt, Homo sapiens
aauuagaauauccaugac

SEQ ID NO: 1024450 - RNA, 13 nt, Homo sapiens
aauuagaugaacu

SEQ ID NO: 1024451 - RNA, 21 nt, Homo sapiens
aauuagcugugugaaauacca

SEQ ID NO: 1024452 - RNA, 14 nt, Homo sapiens
aauuagggcccaau

SEQ ID NO: 1024453 - RNA, 18 nt, Homo sapiens
aauuagguuuuguacaau

SEQ ID NO: 1024454 - RNA, 15 nt, Homo sapiens
aauuaguaacaugug

SEQ ID NO: 1024455 - RNA, 12 nt, Homo sapiens
aauuaguggcac

SEQ ID NO: 1024456 - RNA, 20 nt, Homo sapiens
aauuauagaguaucacuccc

SEQ ID NO: 1024457 - RNA, 22 nt, Homo sapiens
aauuauuugcauaacaauuccu

SEQ ID NO: 1024458 - RNA, 16 nt, Homo sapiens
aauuauuuugguacuu

SEQ ID NO: 1024459 - RNA, 17 nt, Homo sapiens
aauuauuuuuguucaua

SEQ ID NO: 1024460 - RNA, 13 nt, Homo sapiens
aauucagcacuga

SEQ ID NO: 1024461 - RNA, 14 nt, Homo sapiens
aauuccaaagccag

SEQ ID NO: 1024462 - RNA, 21 nt, Homo sapiens
aauuccagugguccauggaau

SEQ ID NO: 1024463 - RNA, 18 nt, Homo sapiens
aauucccuggccuuucau

SEQ ID NO: 1024464 - RNA, 21 nt, Homo sapiens
aauuccuagaaguugagagag

SEQ ID NO: 1024465 - RNA, 22 nt, Homo sapiens
aauuccuguauucuacagcaga

SEQ ID NO: 1024466 - RNA, 22 nt, Homo sapiens
aauucgcugcaaccuguugaua

SEQ ID NO: 1024467 - RNA, 20 nt, Homo sapiens
aauucguucaccuacauuug

SEQ ID NO: 1024468 - RNA, 21 nt, Homo sapiens
aauucuauaggaacauaugaa

SEQ ID NO: 1024469 - RNA, 20 nt, Homo sapiens
aauucucauuugucacacac

SEQ ID NO: 1024470 - RNA, 14 nt, Homo sapiens
aauucucuuucaaa

SEQ ID NO: 1024471 - RNA, 15 nt, Homo sapiens
aauucugcaagcuuu

SEQ ID NO: 1024472 - RNA, 16 nt, Homo sapiens
aauucugggaauccac

SEQ ID NO: 1024473 - RNA, 20 nt, Homo sapiens
aauucugucauuucaaagac

SEQ ID NO: 1024474 - RNA, 13 nt, Homo sapiens
aauugacagauca

SEQ ID NO: 1024475 - RNA, 21 nt, Homo sapiens
aauugacagaucaagcuguga

SEQ ID NO: 1024476 - RNA, 13 nt, Homo sapiens
aauugacaggauu

SEQ ID NO: 1024477 - RNA, 14 nt, Homo sapiens
aauugauguugcug

SEQ ID NO: 1024478 - RNA, 14 nt, Homo sapiens
aauugccuaaagag

SEQ ID NO: 1024479 - RNA, 12 nt, Homo sapiens
aauugcugaaag

SEQ ID NO: 1024480 - RNA, 16 nt, Homo sapiens
aauugcuucaagcauu

SEQ ID NO: 1024481 - RNA, 13 nt, Homo sapiens
aauuguccguguu

SEQ ID NO: 1024482 - RNA, 20 nt, Homo sapiens
aauugucuuuguucugugau

SEQ ID NO: 1024483 - RNA, 18 nt, Homo sapiens
aauugugugucacaagaa

SEQ ID NO: 1024484 - RNA, 11 nt, Homo sapiens
aauuguugcua

SEQ ID NO: 1024485 - RNA, 15 nt, Homo sapiens
aauuguuuugcacuu

SEQ ID NO: 1024486 - RNA, 18 nt, Homo sapiens
aauuuaauuuugcaggau

SEQ ID NO: 1024487 - RNA, 14 nt, Homo sapiens
aauuuaggaccaau

SEQ ID NO: 1024488 - RNA, 18 nt, Homo sapiens
aauuuauucaauuccucu

SEQ ID NO: 1024489 - RNA, 22 nt, Homo sapiens
aauuuauuuauuaagauggauu

SEQ ID NO: 1024490 - RNA, 12 nt, Homo sapiens
aauuucacuuaa

SEQ ID NO: 1024491 - RNA, 20 nt, Homo sapiens
aauuucacuuaauaaugugu

SEQ ID NO: 1024492 - RNA, 16 nt, Homo sapiens
aauuucauaccuauca

SEQ ID NO: 1024493 - RNA, 19 nt, Homo sapiens
aauuucauaccuaucaucu

SEQ ID NO: 1024494 - RNA, 15 nt, Homo sapiens
aauuuccucugacau

SEQ ID NO: 1024495 - RNA, 15 nt, Homo sapiens
aauuucucccaguca

SEQ ID NO: 1024496 - RNA, 20 nt, Homo sapiens
acagacaccaaguuccguca

SEQ ID NO: 1024497 - RNA, 20 nt, Homo sapiens
acagacacucccacuuggca

SEQ ID NO: 1024498 - RNA, 20 nt, Homo sapiens
acagacacuggcauggauau

SEQ ID NO: 1024499 - RNA, 20 nt, Homo sapiens
acagacauccuagcauuugu

SEQ ID NO: 1024500 - RNA, 20 nt, Homo sapiens
acagaccuaggauuucauga

SEQ ID NO: 1024501 - RNA, 24 nt, Homo sapiens
acagacuaugucacccaaugcaua

SEQ ID NO: 1024502 - RNA, 14 nt, Homo sapiens
acagacucacaucc

SEQ ID NO: 1024503 - RNA, 17 nt, Homo sapiens
acagacuucuccagacc

SEQ ID NO: 1024504 - RNA, 15 nt, Homo sapiens
acagagcagaacuuu

SEQ ID NO: 1024505 - RNA, 17 nt, Homo sapiens
acagagcagaacuuuca

SEQ ID NO: 1024506 - RNA, 21 nt, Homo sapiens
acagagcgagacuccgucuca

SEQ ID NO: 1024507 - RNA, 18 nt, Homo sapiens
acagaggaagagcaggca

SEQ ID NO: 1024508 - RNA, 15 nt, Homo sapiens
acagaggaucugcuu

SEQ ID NO: 1024509 - RNA, 22 nt, Homo sapiens
acagagggcaggaacuugcaca

SEQ ID NO: 1024510 - RNA, 23 nt, Homo sapiens
acagagggcaggaacuugcacaa

SEQ ID NO: 1024511 - RNA, 15 nt, Homo sapiens
acagagucucacucu

SEQ ID NO: 1024512 - RNA, 19 nt, Homo sapiens
acagagugaacacucuacu

SEQ ID NO: 1024513 - RNA, 14 nt, Homo sapiens
acagaguuguuaca

SEQ ID NO: 1024514 - RNA, 13 nt, Homo sapiens
acagauagucaaa

SEQ ID NO: 1024515 - RNA, 19 nt, Homo sapiens
acagaugcaaugugcuacu

SEQ ID NO: 1024516 - RNA, 23 nt, Homo sapiens
acagaugcuuuucugucucugcc

SEQ ID NO: 1024517 - RNA, 16 nt, Homo sapiens
acagauggauuugccu

SEQ ID NO: 1024518 - RNA, 16 nt, Homo sapiens
acagaugugucagcca

SEQ ID NO: 1024519 - RNA, 15 nt, Homo sapiens
acagauucacacugu

SEQ ID NO: 1024520 - RNA, 16 nt, Homo sapiens
acagcaagucaggguu

SEQ ID NO: 1024521 - RNA, 18 nt, Homo sapiens
acagcacccucuccagau

SEQ ID NO: 1024522 - RNA, 13 nt, Homo sapiens
acagcacuaugua

SEQ ID NO: 1024523 - RNA, 18 nt, Homo sapiens
acagcagauacuuuguca

SEQ ID NO: 1024524 - RNA, 13 nt, Homo sapiens
acagcagauuuca

SEQ ID NO: 1024525 - RNA, 23 nt, Homo sapiens
acagcagcuucaccagagcauuu

SEQ ID NO: 1024526 - RNA, 23 nt, Homo sapiens
acagcaggcgccucgggucccag

SEQ ID NO: 1024527 - RNA, 13 nt, Homo sapiens
acagcauguguau

SEQ ID NO: 1024528 - RNA, 14 nt, Homo sapiens
acagcauguguauu

SEQ ID NO: 1024529 - RNA, 18 nt, Homo sapiens
acagccccucuggacaca

SEQ ID NO: 1024530 - RNA, 19 nt, Homo sapiens
acagccccucuggacacag

SEQ ID NO: 1024531 - RNA, 21 nt, Homo sapiens
acagccuccucugucugcccu

SEQ ID NO: 1024532 - RNA, 18 nt, Homo sapiens
acagccucugaaaaccaa

SEQ ID NO: 1024533 - RNA, 18 nt, Homo sapiens
acagcgagaggcagagaa

SEQ ID NO: 1024534 - RNA, 19 nt, Homo sapiens
acagcuaacacacagcucc

SEQ ID NO: 1024535 - RNA, 20 nt, Homo sapiens
acagcuacuugggaggcuga

SEQ ID NO: 1024536 - RNA, 21 nt, Homo sapiens
acagcucaagucuucccugau

SEQ ID NO: 1024537 - RNA, 15 nt, Homo sapiens
acagcuccacucuga

SEQ ID NO: 1024538 - RNA, 19 nt, Homo sapiens
acagcucuacguggcaaau

SEQ ID NO: 1024539 - RNA, 20 nt, Homo sapiens
acagcucuagacacugccac

SEQ ID NO: 1024540 - RNA, 18 nt, Homo sapiens
acagcucuucuccaggcu

SEQ ID NO: 1024541 - RNA, 17 nt, Homo sapiens
acagcucuugaggaugu

SEQ ID NO: 1024542 - RNA, 16 nt, Homo sapiens
acagcugagcacauuc

SEQ ID NO: 1024543 - RNA, 21 nt, Homo sapiens
acagcugccugugugggacug

SEQ ID NO: 1024544 - RNA, 20 nt, Homo sapiens
acagcugcuggagacuccua

SEQ ID NO: 1024545 - RNA, 22 nt, Homo sapiens
acagcugcuggagacuccuagg

SEQ ID NO: 1024546 - RNA, 20 nt, Homo sapiens
acagcuucucaauuucuaca

SEQ ID NO: 1024547 - RNA, 21 nt, Homo sapiens
acagcuugaguggguucucug

SEQ ID NO: 1024548 - RNA, 18 nt, Homo sapiens
acagcuuugugacuguau

SEQ ID NO: 1024549 - RNA, 21 nt, Homo sapiens
acaggaauacuuaacucaaua

SEQ ID NO: 1024550 - RNA, 20 nt, Homo sapiens
acaggaauggaacacacuug

SEQ ID NO: 1024551 - RNA, 16 nt, Homo sapiens
acaggacaacuuuaca

SEQ ID NO: 1024552 - RNA, 15 nt, Homo sapiens
acaggacauucucau

SEQ ID NO: 1024553 - RNA, 15 nt, Homo sapiens
acaggagaccuggca

SEQ ID NO: 1024554 - RNA, 18 nt, Homo sapiens
acaggaggaaucauguca

SEQ ID NO: 1024555 - RNA, 19 nt, Homo sapiens
acaggauccuauucucacc

SEQ ID NO: 1024556 - RNA, 19 nt, Homo sapiens
acaggauuauuggaaauuu

SEQ ID NO: 1024557 - RNA, 21 nt, Homo sapiens
acaggcaacugaggcagacag

SEQ ID NO: 1024558 - RNA, 23 nt, Homo sapiens
acaggcaaugcuggcuguuggcu

SEQ ID NO: 1024559 - RNA, 19 nt, Homo sapiens
acaggcacauaccacugca

SEQ ID NO: 1024560 - RNA, 17 nt, Homo sapiens
acaggcaccugccaaca

SEQ ID NO: 1024561 - RNA, 15 nt, Homo sapiens
acaggcagcauuuag

SEQ ID NO: 1024562 - RNA, 20 nt, Homo sapiens
acaggcauuuccugcuuauu

SEQ ID NO: 1024563 - RNA, 16 nt, Homo sapiens
acaggccagcaggggc

SEQ ID NO: 1024564 - RNA, 15 nt, Homo sapiens
acaggccauacuuua

SEQ ID NO: 1024565 - RNA, 21 nt, Homo sapiens
acaggcccccuugaguggggu

SEQ ID NO: 1024566 - RNA, 18 nt, Homo sapiens
acaggccucccaaguuuu

SEQ ID NO: 1024567 - RNA, 14 nt, Homo sapiens
acaggcucugacca

SEQ ID NO: 1024568 - RNA, 20 nt, Homo sapiens
acagggaacaagcauucucc

SEQ ID NO: 1024569 - RNA, 15 nt, Homo sapiens
acagggaggugaccc

SEQ ID NO: 1024570 - RNA, 19 nt, Homo sapiens
acagggcaugcauuuugca

SEQ ID NO: 1024571 - RNA, 23 nt, Homo sapiens
acagggucucuagugcugugaaa

SEQ ID NO: 1024572 - RNA, 18 nt, Homo sapiens
acagggucugcacucuaa

SEQ ID NO: 1024573 - RNA, 15 nt, Homo sapiens
acagguggugcaaau

SEQ ID NO: 1024574 - RNA, 12 nt, Homo sapiens
acaguaaaucac

SEQ ID NO: 1024575 - RNA, 14 nt, Homo sapiens
acaguaaaucucac

SEQ ID NO: 1024576 - RNA, 19 nt, Homo sapiens
acaguacaggcagcacaga

SEQ ID NO: 1024577 - RNA, 22 nt, Homo sapiens
acaguagagcaaaucuaugaga

SEQ ID NO: 1024578 - RNA, 22 nt, Homo sapiens
acaguauggcagcuuuccucaa

SEQ ID NO: 1024579 - RNA, 15 nt, Homo sapiens
acagucacauuccaa

SEQ ID NO: 1024580 - RNA, 21 nt, Homo sapiens
acagucaccauacacacuguu

SEQ ID NO: 1024581 - RNA, 19 nt, Homo sapiens
acagucaccccaggacuca

SEQ ID NO: 1024582 - RNA, 20 nt, Homo sapiens
acagucaccgacaacaugcu

SEQ ID NO: 1024583 - RNA, 19 nt, Homo sapiens
acaguccuucaaacuucca

SEQ ID NO: 1024584 - RNA, 20 nt, Homo sapiens
acagucuugcagcaggaucu

SEQ ID NO: 1024585 - RNA, 11 nt, Homo sapiens
acagugacauu

SEQ ID NO: 1024586 - RNA, 22 nt, Homo sapiens
acagugacauuuauuuuucuca

SEQ ID NO: 1024587 - RNA, 14 nt, Homo sapiens
acagugaggcugca

SEQ ID NO: 1024588 - RNA, 22 nt, Homo sapiens
acagugaucuccauauguuaca

SEQ ID NO: 1024589 - RNA, 21 nt, Homo sapiens
acagugaugcugugcuaugaa

SEQ ID NO: 1024590 - RNA, 16 nt, Homo sapiens
acaguggagagagaaa

SEQ ID NO: 1024591 - RNA, 22 nt, Homo sapiens
acaguggagagagaaaggcuuc

SEQ ID NO: 1024592 - RNA, 15 nt, Homo sapiens
acagugggagccagg

SEQ ID NO: 1024593 - RNA, 22 nt, Homo sapiens
acaguguauguacuaagcagua

SEQ ID NO: 1024594 - RNA, 16 nt, Homo sapiens
acaguuaacuuucaga

SEQ ID NO: 1024595 - RNA, 18 nt, Homo sapiens
acaguuagguagcuuuag

SEQ ID NO: 1024596 - RNA, 20 nt, Homo sapiens
acaguuccuucagcuuccau

SEQ ID NO: 1024597 - RNA, 21 nt, Homo sapiens
acaguuggauuuauucugcca

SEQ ID NO: 1024598 - RNA, 23 nt, Homo sapiens
acaguuggauuuauucugccaaa

SEQ ID NO: 1024599 - RNA, 22 nt, Homo sapiens
acaguuuauuuuuauacuuuca

SEQ ID NO: 1024600 - RNA, 22 nt, Homo sapiens
acaguuuucugcuuuaauuuca

SEQ ID NO: 1024601 - RNA, 19 nt, Homo sapiens
acaguuuugguugcuuuaa

SEQ ID NO: 1024602 - RNA, 13 nt, Homo sapiens
acauaaacccagu

SEQ ID NO: 1024603 - RNA, 23 nt, Homo sapiens
acauaaauuacuuuuucauucuu

SEQ ID NO: 1024604 - RNA, 22 nt, Homo sapiens
acauaacacuauaaagguugac

SEQ ID NO: 1024605 - RNA, 15 nt, Homo sapiens
acauaagacagacag

SEQ ID NO: 1024606 - RNA, 19 nt, Homo sapiens
acauaagcaaagacuauga

SEQ ID NO: 1024607 - RNA, 12 nt, Homo sapiens
acauacaauuau

SEQ ID NO: 1024608 - RNA, 20 nt, Homo sapiens
acauacaauuccaaacacau

SEQ ID NO: 1024609 - RNA, 18 nt, Homo sapiens
acauacccucccuuugaa

SEQ ID NO: 1024610 - RNA, 22 nt, Homo sapiens
acauaccuggcccugugccuug

SEQ ID NO: 1024611 - RNA, 23 nt, Homo sapiens
acauaccuggcccugugccuugg

SEQ ID NO: 1024612 - RNA, 15 nt, Homo sapiens
acauacguacuuuuc

SEQ ID NO: 1024613 - RNA, 16 nt, Homo sapiens
acauacuccuuccauc

SEQ ID NO: 1024614 - RNA, 21 nt, Homo sapiens
acauacucugcuuagaauuug

SEQ ID NO: 1024615 - RNA, 14 nt, Homo sapiens
acauacuuucaucc

SEQ ID NO: 1024616 - RNA, 22 nt, Homo sapiens
acauacuuucauccugacucug

SEQ ID NO: 1024617 - RNA, 19 nt, Homo sapiens
acauagacaaaaaauuuga

SEQ ID NO: 1024618 - RNA, 15 nt, Homo sapiens
acauagcgaauacaa

SEQ ID NO: 1024619 - RNA, 18 nt, Homo sapiens
acauaugucauauauuac

SEQ ID NO: 1024620 - RNA, 18 nt, Homo sapiens
acaucaagcgaugaaacu

SEQ ID NO: 1024621 - RNA, 22 nt, Homo sapiens
acaucaagcgaugaaacuggaa

SEQ ID NO: 1024622 - RNA, 12 nt, Homo sapiens
acaucaauguuc

SEQ ID NO: 1024623 - RNA, 13 nt, Homo sapiens
acaucaauguuca

SEQ ID NO: 1024624 - RNA, 17 nt, Homo sapiens
acaucacugaaaugcua

SEQ ID NO: 1024625 - RNA, 20 nt, Homo sapiens
acaucagcagagaacuggaa

SEQ ID NO: 1024626 - RNA, 23 nt, Homo sapiens
acaucaguuuaaacaaagggaag

SEQ ID NO: 1024627 - RNA, 21 nt, Homo sapiens
acauccguugugcuugccugc

SEQ ID NO: 1024628 - RNA, 15 nt, Homo sapiens
acauccuagcauuug

SEQ ID NO: 1024629 - RNA, 22 nt, Homo sapiens
acauccucugucuauuugagac

SEQ ID NO: 1024630 - RNA, 17 nt, Homo sapiens
acaucgugaaacccugu

SEQ ID NO: 1024631 - RNA, 18 nt, Homo sapiens
acaucuaguaggugcuug

SEQ ID NO: 1024632 - RNA, 12 nt, Homo sapiens
acaucucagggg

SEQ ID NO: 1024633 - RNA, 17 nt, Homo sapiens
acaucucaggggccaga

SEQ ID NO: 1024634 - RNA, 21 nt, Homo sapiens
acaucuccuccauacucagga

SEQ ID NO: 1024635 - RNA, 22 nt, Homo sapiens
acaucuggccuugaaaccaccu

SEQ ID NO: 1024636 - RNA, 15 nt, Homo sapiens
acaucugugucuugu

SEQ ID NO: 1024637 - RNA, 19 nt, Homo sapiens
acaucuugcucugcugaca

SEQ ID NO: 1024638 - RNA, 15 nt, Homo sapiens
acugauagaugucua

SEQ ID NO: 1024639 - RNA, 21 nt, Homo sapiens
acugauagaugucuauucuug

SEQ ID NO: 1024640 - RNA, 14 nt, Homo sapiens
acugauuuaucuau

SEQ ID NO: 1024641 - RNA, 15 nt, Homo sapiens
acugcaagcacugca

SEQ ID NO: 1024642 - RNA, 16 nt, Homo sapiens
acugcacaguagagca

SEQ ID NO: 1024643 - RNA, 20 nt, Homo sapiens
acugcacuccagccugggca

SEQ ID NO: 1024644 - RNA, 20 nt, Homo sapiens
acugcacucuagccugggug

SEQ ID NO: 1024645 - RNA, 18 nt, Homo sapiens
acugcagagggacagaug

SEQ ID NO: 1024646 - RNA, 17 nt, Homo sapiens
acugcagcaguggcuua

SEQ ID NO: 1024647 - RNA, 15 nt, Homo sapiens
acugcagcuuuacau

SEQ ID NO: 1024648 - RNA, 20 nt, Homo sapiens
acugcagggacugccagucc

SEQ ID NO: 1024649 - RNA, 14 nt, Homo sapiens
acugcauaaauaac

SEQ ID NO: 1024650 - RNA, 21 nt, Homo sapiens
acugcauaugaaaggacacua

SEQ ID NO: 1024651 - RNA, 19 nt, Homo sapiens
acugcauuuuuaaauacaa

SEQ ID NO: 1024652 - RNA, 12 nt, Homo sapiens
acugccaaagaa

SEQ ID NO: 1024653 - RNA, 17 nt, Homo sapiens
acugcccccuccacugg

SEQ ID NO: 1024654 - RNA, 23 nt, Homo sapiens
acugcugccucuugaaugcaggg

SEQ ID NO: 1024655 - RNA, 19 nt, Homo sapiens
acugcugcuagagccagca

SEQ ID NO: 1024656 - RNA, 19 nt, Homo sapiens
acugcugcuccagugcagg

SEQ ID NO: 1024657 - RNA, 13 nt, Homo sapiens
acugcuguagaca

SEQ ID NO: 1024658 - RNA, 20 nt, Homo sapiens
acugcuguagacauuugcua

SEQ ID NO: 1024659 - RNA, 15 nt, Homo sapiens
acugcugugaaugug

SEQ ID NO: 1024660 - RNA, 19 nt, Homo sapiens
acugcugugcugugcccaa

SEQ ID NO: 1024661 - RNA, 19 nt, Homo sapiens
acugcuguguuugagcucu

SEQ ID NO: 1024662 - RNA, 20 nt, Homo sapiens
acugcuguucauguuacuca

SEQ ID NO: 1024663 - RNA, 17 nt, Homo sapiens
acuggaaagacauagcc

SEQ ID NO: 1024664 - RNA, 14 nt, Homo sapiens
acuggaaccaggga

SEQ ID NO: 1024665 - RNA, 15 nt, Homo sapiens
acuggaagcacagcu

SEQ ID NO: 1024666 - RNA, 13 nt, Homo sapiens
acuggacucagga

SEQ ID NO: 1024667 - RNA, 16 nt, Homo sapiens
acuggagccaucucuu

SEQ ID NO: 1024668 - RNA, 19 nt, Homo sapiens
acuggagccccaucagcuc

SEQ ID NO: 1024669 - RNA, 12 nt, Homo sapiens
acuggaguggag

SEQ ID NO: 1024670 - RNA, 17 nt, Homo sapiens
acuggaguggagcauug

SEQ ID NO: 1024671 - RNA, 22 nt, Homo sapiens
acuggcacaguuuucugagaaa

SEQ ID NO: 1024672 - RNA, 12 nt, Homo sapiens
acuggcacuauu

SEQ ID NO: 1024673 - RNA, 19 nt, Homo sapiens
acugggcaaugauggcaau

SEQ ID NO: 1024674 - RNA, 19 nt, Homo sapiens
acugguagaaaggcaguuc

SEQ ID NO: 1024675 - RNA, 22 nt, Homo sapiens
acugguagaacguaaccacgga

SEQ ID NO: 1024676 - RNA, 23 nt, Homo sapiens
acugguauguguggaugaugcug

SEQ ID NO: 1024677 - RNA, 16 nt, Homo sapiens
acuguaauuugugaua

SEQ ID NO: 1024678 - RNA, 15 nt, Homo sapiens
acuguacuacaucua

SEQ ID NO: 1024679 - RNA, 22 nt, Homo sapiens
acuguauguuuacuucucacca

SEQ ID NO: 1024680 - RNA, 12 nt, Homo sapiens
acugucacuguu

SEQ ID NO: 1024681 - RNA, 18 nt, Homo sapiens
acugucacuguuucucug

SEQ ID NO: 1024682 - RNA, 13 nt, Homo sapiens
acugugaaacugg

SEQ ID NO: 1024683 - RNA, 22 nt, Homo sapiens
acugugaagagaaccauaucaa

SEQ ID NO: 1024684 - RNA, 18 nt, Homo sapiens
acugugccaugugccagg

SEQ ID NO: 1024685 - RNA, 14 nt, Homo sapiens
acugugcuccucac

SEQ ID NO: 1024686 - RNA, 22 nt, Homo sapiens
acuguggcugcuagcacuugga

SEQ ID NO: 1024687 - RNA, 17 nt, Homo sapiens
acugugggaaggccagc

SEQ ID NO: 1024688 - RNA, 12 nt, Homo sapiens
acugugggcucc

SEQ ID NO: 1024689 - RNA, 19 nt, Homo sapiens
acuguuaaauugcugugua

SEQ ID NO: 1024690 - RNA, 18 nt, Homo sapiens
acuguucuauucaucuca

SEQ ID NO: 1024691 - RNA, 16 nt, Homo sapiens
acuguugucaaaaagu

SEQ ID NO: 1024692 - RNA, 17 nt, Homo sapiens
acuuaaaaaaaugacag

SEQ ID NO: 1024693 - RNA, 18 nt, Homo sapiens
acuuaaaaucuaauucaa

SEQ ID NO: 1024694 - RNA, 13 nt, Homo sapiens
acuuaacaagcuc

SEQ ID NO: 1024695 - RNA, 16 nt, Homo sapiens
acuuaacacccaguga

SEQ ID NO: 1024696 - RNA, 22 nt, Homo sapiens
acuuaagcugggauaaucacau

SEQ ID NO: 1024697 - RNA, 17 nt, Homo sapiens
acuuaauaauguguaca

SEQ ID NO: 1024698 - RNA, 19 nt, Homo sapiens
acuuaauagaaacauugaa

SEQ ID NO: 1024699 - RNA, 11 nt, Homo sapiens
acuuacccuca

SEQ ID NO: 1024700 - RNA, 13 nt, Homo sapiens
acuuacccucacc

SEQ ID NO: 1024701 - RNA, 21 nt, Homo sapiens
acuuagaauuaguggcacuug

SEQ ID NO: 1024702 - RNA, 14 nt, Homo sapiens
acuuaggaaggauc

SEQ ID NO: 1024703 - RNA, 16 nt, Homo sapiens
acuuaguguacaugaa

SEQ ID NO: 1024704 - RNA, 15 nt, Homo sapiens
acuuauaucaucagc

SEQ ID NO: 1024705 - RNA, 16 nt, Homo sapiens
acuuauaucaucagca

SEQ ID NO: 1024706 - RNA, 18 nt, Homo sapiens
acuuaucaucacacaacu

SEQ ID NO: 1024707 - RNA, 18 nt, Homo sapiens
acuuaugaaccuuuacau

SEQ ID NO: 1024708 - RNA, 16 nt, Homo sapiens
acuuauggacuccugu

SEQ ID NO: 1024709 - RNA, 14 nt, Homo sapiens
acuuauuuauauaa

SEQ ID NO: 1024710 - RNA, 16 nt, Homo sapiens
acuucaacauuuacau

SEQ ID NO: 1024711 - RNA, 19 nt, Homo sapiens
acuucaagagccucuggca

SEQ ID NO: 1024712 - RNA, 19 nt, Homo sapiens
acuucaaguuaaagugaau

SEQ ID NO: 1024713 - RNA, 18 nt, Homo sapiens
acuucacuuuaauucuca

SEQ ID NO: 1024714 - RNA, 12 nt, Homo sapiens
acuucagggauc

SEQ ID NO: 1024715 - RNA, 17 nt, Homo sapiens
acuucaggggcacuuca

SEQ ID NO: 1024716 - RNA, 17 nt, Homo sapiens
acuucaguugcuuugca

SEQ ID NO: 1024717 - RNA, 14 nt, Homo sapiens
acuucaucuucuca

SEQ ID NO: 1024718 - RNA, 19 nt, Homo sapiens
acuucauuugaugcuaaau

SEQ ID NO: 1024719 - RNA, 11 nt, Homo sapiens
acuucccugaa

SEQ ID NO: 1024720 - RNA, 18 nt, Homo sapiens
acuuccuauaugcacuua

SEQ ID NO: 1024721 - RNA, 16 nt, Homo sapiens
acuuccuugcucuccc

SEQ ID NO: 1024722 - RNA, 19 nt, Homo sapiens
acuuccuuggaaacagagc

SEQ ID NO: 1024723 - RNA, 21 nt, Homo sapiens
acuuccuuggacucauuuuaa

SEQ ID NO: 1024724 - RNA, 18 nt, Homo sapiens
acuucgacucaggaucca

SEQ ID NO: 1024725 - RNA, 15 nt, Homo sapiens
acuucuaaaugaagu

SEQ ID NO: 1024726 - RNA, 15 nt, Homo sapiens
acuucuaaaugcaua

SEQ ID NO: 1024727 - RNA, 23 nt, Homo sapiens
acuucuaacuagaaaucugccaa

SEQ ID NO: 1024728 - RNA, 22 nt, Homo sapiens
acuucuaaguaaaaccacagca

SEQ ID NO: 1024729 - RNA, 11 nt, Homo sapiens
acuucucacca

SEQ ID NO: 1024730 - RNA, 16 nt, Homo sapiens
acuucucucaggaucc

SEQ ID NO: 1024731 - RNA, 16 nt, Homo sapiens
acuucucugaagggag

SEQ ID NO: 1024732 - RNA, 21 nt, Homo sapiens
acuucugucuucacaacagau

SEQ ID NO: 1024733 - RNA, 23 nt, Homo sapiens
acuucuuaaaaguugugauucca

SEQ ID NO: 1024734 - RNA, 23 nt, Homo sapiens
acuucuuuaaaaaaacacauaau

SEQ ID NO: 1024735 - RNA, 13 nt, Homo sapiens
acuugaaauacca

SEQ ID NO: 1024736 - RNA, 14 nt, Homo sapiens
acuugaacccagga

SEQ ID NO: 1024737 - RNA, 20 nt, Homo sapiens
acuugagacagcacuaugua

SEQ ID NO: 1024738 - RNA, 18 nt, Homo sapiens
acuugcaccucugaccua

SEQ ID NO: 1024739 - RNA, 18 nt, Homo sapiens
acuugcacgcccaugugu

SEQ ID NO: 1024740 - RNA, 17 nt, Homo sapiens
acuugcauacagagaca

SEQ ID NO: 1024741 - RNA, 21 nt, Homo sapiens
acuugcauccaacuccaggau

SEQ ID NO: 1024742 - RNA, 15 nt, Homo sapiens
acuugcaucguggag

SEQ ID NO: 1024743 - RNA, 23 nt, Homo sapiens
acuugcaucguggagacagggca

SEQ ID NO: 1024744 - RNA, 22 nt, Homo sapiens
acuugcugugugaccucaggcc

SEQ ID NO: 1024745 - RNA, 16 nt, Homo sapiens
acuugcuuuaugccuu

SEQ ID NO: 1024746 - RNA, 14 nt, Homo sapiens
acuuggaacacaau

SEQ ID NO: 1024747 - RNA, 21 nt, Homo sapiens
acuuggaauuuguaaccucag

SEQ ID NO: 1024748 - RNA, 17 nt, Homo sapiens
acuuggcuacacaggga

SEQ ID NO: 1024749 - RNA, 20 nt, Homo sapiens
acuuggcuacacagggaugu

SEQ ID NO: 1024750 - RNA, 13 nt, Homo sapiens
acuugggaacuag

SEQ ID NO: 1024751 - RNA, 22 nt, Homo sapiens
acuugggggaggaggaacaaau

SEQ ID NO: 1024752 - RNA, 15 nt, Homo sapiens
acuuggggucagaga

SEQ ID NO: 1024753 - RNA, 16 nt, Homo sapiens
acuuggucaccagcuc

SEQ ID NO: 1024754 - RNA, 23 nt, Homo sapiens
acuuguaagaaaaugagacaaaa

SEQ ID NO: 1024755 - RNA, 20 nt, Homo sapiens
acuuguagcauuaaacaauc

SEQ ID NO: 1024756 - RNA, 19 nt, Homo sapiens
acuuguauuauuaaugcca

SEQ ID NO: 1024757 - RNA, 21 nt, Homo sapiens
acuugucccuuuuuuguccca

SEQ ID NO: 1024758 - RNA, 18 nt, Homo sapiens
acuuguccuuuuguacca

SEQ ID NO: 1024759 - RNA, 19 nt, Homo sapiens
acuugucuucccuucugau

SEQ ID NO: 1024760 - RNA, 18 nt, Homo sapiens
acuugugccaacacucaa

SEQ ID NO: 1024761 - RNA, 22 nt, Homo sapiens
acuugugcugaucgugcuaaau

SEQ ID NO: 1024762 - RNA, 18 nt, Homo sapiens
acuuguggacacagcucu

SEQ ID NO: 1024763 - RNA, 20 nt, Homo sapiens
acuuguuuggccuauuccau

SEQ ID NO: 1024764 - RNA, 21 nt, Homo sapiens
acuuuacacgcucauggacug

SEQ ID NO: 1024765 - RNA, 18 nt, Homo sapiens
acuuuacaugacacagcu

SEQ ID NO: 1024766 - RNA, 14 nt, Homo sapiens
acuuuagaugcuga

SEQ ID NO: 1024767 - RNA, 13 nt, Homo sapiens
acuuuagcugcau

SEQ ID NO: 1024768 - RNA, 17 nt, Homo sapiens
acuuuauuuauacacug

SEQ ID NO: 1024769 - RNA, 20 nt, Homo sapiens
acuuuauuuauacacugucu

SEQ ID NO: 1024770 - RNA, 18 nt, Homo sapiens
acuuucagguacuaaaua

SEQ ID NO: 1024771 - RNA, 20 nt, Homo sapiens
acuuucagguacuaaauacc

SEQ ID NO: 1024772 - RNA, 19 nt, Homo sapiens
acuuucauuaaagcauuua

SEQ ID NO: 1024773 - RNA, 15 nt, Homo sapiens
acuuucuaaauuuca

SEQ ID NO: 1024774 - RNA, 19 nt, Homo sapiens
acuuucucuucauacuuuu

SEQ ID NO: 1024775 - RNA, 18 nt, Homo sapiens
acuuucuuaucacuuaua

SEQ ID NO: 1024776 - RNA, 13 nt, Homo sapiens
acuuugaagacca

SEQ ID NO: 1024777 - RNA, 13 nt, Homo sapiens
acuuugaccucug

SEQ ID NO: 1024778 - RNA, 23 nt, Homo sapiens
acuuuuaaguugcugaugaacuc

SEQ ID NO: 1024779 - RNA, 18 nt, Homo sapiens
acuuuugaagcaauauca

SEQ ID NO: 1024780 - RNA, 15 nt, Homo sapiens
acuuuuggcuuguaa

SEQ ID NO: 1024781 - RNA, 22 nt, Homo sapiens
acuuuuguguaucguaaccagc

SEQ ID NO: 1024782 - RNA, 15 nt, Homo sapiens
agaucauauuucaca

SEQ ID NO: 1024783 - RNA, 16 nt, Homo sapiens
agaucauccuuuccag

SEQ ID NO: 1024784 - RNA, 19 nt, Homo sapiens
agaucauccuuuccagcau

SEQ ID NO: 1024785 - RNA, 21 nt, Homo sapiens
agaucccagcucacgucacac

SEQ ID NO: 1024786 - RNA, 18 nt, Homo sapiens
agaucccccagacuuuac

SEQ ID NO: 1024787 - RNA, 15 nt, Homo sapiens
agauccugguuggug

SEQ ID NO: 1024788 - RNA, 13 nt, Homo sapiens
agaucgcaucauu

SEQ ID NO: 1024789 - RNA, 15 nt, Homo sapiens
agaucguuguuuaca

SEQ ID NO: 1024790 - RNA, 17 nt, Homo sapiens
agaucuaaggaugucac

SEQ ID NO: 1024791 - RNA, 18 nt, Homo sapiens
agaucuaaggaugucaca

SEQ ID NO: 1024792 - RNA, 16 nt, Homo sapiens
agaucuauguacugua

SEQ ID NO: 1024793 - RNA, 21 nt, Homo sapiens
agaucugcuugaucaauuccc

SEQ ID NO: 1024794 - RNA, 13 nt, Homo sapiens
agaucuuccccaa

SEQ ID NO: 1024795 - RNA, 20 nt, Homo sapiens
agaucuuucaggaaagacgg

SEQ ID NO: 1024796 - RNA, 23 nt, Homo sapiens
agaucuuucaggacucuaccuca

SEQ ID NO: 1024797 - RNA, 20 nt, Homo sapiens
agaugaagcaaacacauuaa

SEQ ID NO: 1024798 - RNA, 14 nt, Homo sapiens
agaugaaugggagu

SEQ ID NO: 1024799 - RNA, 15 nt, Homo sapiens
agaugaucauuugcc

SEQ ID NO: 1024800 - RNA, 19 nt, Homo sapiens
agaugauucagaaggggag

SEQ ID NO: 1024801 - RNA, 13 nt, Homo sapiens
agaugcaggugag

SEQ ID NO: 1024802 - RNA, 19 nt, Homo sapiens
agaugcauuaucuaugaua

SEQ ID NO: 1024803 - RNA, 15 nt, Homo sapiens
agaugcgcacugcau

SEQ ID NO: 1024804 - RNA, 17 nt, Homo sapiens
agaugcugauguucagu

SEQ ID NO: 1024805 - RNA, 16 nt, Homo sapiens
agaugcuggguuggug

SEQ ID NO: 1024806 - RNA, 19 nt, Homo sapiens
agaugcuuuaagugcacaa

SEQ ID NO: 1024807 - RNA, 16 nt, Homo sapiens
agauggacuccagccu

SEQ ID NO: 1024808 - RNA, 16 nt, Homo sapiens
agauggauagucuguc

SEQ ID NO: 1024809 - RNA, 18 nt, Homo sapiens
agauggauagucugucca

SEQ ID NO: 1024810 - RNA, 19 nt, Homo sapiens
agauggauagucuguccaa

SEQ ID NO: 1024811 - RNA, 21 nt, Homo sapiens
agauggcaggaugggcacugc

SEQ ID NO: 1024812 - RNA, 16 nt, Homo sapiens
agauggcugugccucu

SEQ ID NO: 1024813 - RNA, 16 nt, Homo sapiens
agaugggggacugaga

SEQ ID NO: 1024814 - RNA, 21 nt, Homo sapiens
agauggggucucacaguguug

SEQ ID NO: 1024815 - RNA, 13 nt, Homo sapiens
agauguagaggag

SEQ ID NO: 1024816 - RNA, 18 nt, Homo sapiens
agauguauaaaucuuucu

SEQ ID NO: 1024817 - RNA, 17 nt, Homo sapiens
agauguauauauuuccu

SEQ ID NO: 1024818 - RNA, 19 nt, Homo sapiens
agaugugggcagugauguc

SEQ ID NO: 1024819 - RNA, 14 nt, Homo sapiens
agauuagucucuuc

SEQ ID NO: 1024820 - RNA, 22 nt, Homo sapiens
agauucccaucauacacuuccu

SEQ ID NO: 1024821 - RNA, 16 nt, Homo sapiens
agauuccccauugccu

SEQ ID NO: 1024822 - RNA, 13 nt, Homo sapiens
agauucuguggaa

SEQ ID NO: 1024823 - RNA, 24 nt, Homo sapiens
agauugcaccacugcacuccaguc

SEQ ID NO: 1024824 - RNA, 19 nt, Homo sapiens
agauugcaccauugcgcuc

SEQ ID NO: 1024825 - RNA, 19 nt, Homo sapiens
agauugcgccauugcacuc

SEQ ID NO: 1024826 - RNA, 17 nt, Homo sapiens
agauugugaauauuucc

SEQ ID NO: 1024827 - RNA, 18 nt, Homo sapiens
agauuuugcaaucugugu

SEQ ID NO: 1024828 - RNA, 22 nt, Homo sapiens
agcaaaaccaaauauuccagag

SEQ ID NO: 1024829 - RNA, 13 nt, Homo sapiens
agcaaaaugugau

SEQ ID NO: 1024830 - RNA, 13 nt, Homo sapiens
agcaaacuuggaa

SEQ ID NO: 1024831 - RNA, 15 nt, Homo sapiens
agcaaagcaaugcac

SEQ ID NO: 1024832 - RNA, 17 nt, Homo sapiens
agcaaagcuccugccuc

SEQ ID NO: 1024833 - RNA, 14 nt, Homo sapiens
agcaaauacauauu

SEQ ID NO: 1024834 - RNA, 15 nt, Homo sapiens
agcaaaucacgacca

SEQ ID NO: 1024835 - RNA, 22 nt, Homo sapiens
agcaaaucuacuucaacacuuc

SEQ ID NO: 1024836 - RNA, 13 nt, Homo sapiens
agcaaaugugacc

SEQ ID NO: 1024837 - RNA, 17 nt, Homo sapiens
agcaacccuaacaguaa

SEQ ID NO: 1024838 - RNA, 18 nt, Homo sapiens
agcaacccuaacaguaag

SEQ ID NO: 1024839 - RNA, 19 nt, Homo sapiens
agcaacucugagaucuaag

SEQ ID NO: 1024840 - RNA, 13 nt, Homo sapiens
agcaacugcagaa

SEQ ID NO: 1024841 - RNA, 12 nt, Homo sapiens
agcaacugcugu

SEQ ID NO: 1024842 - RNA, 18 nt, Homo sapiens
agcaacuguuaugaaaua

SEQ ID NO: 1024843 - RNA, 18 nt, Homo sapiens
agcaagacucugucucaa

SEQ ID NO: 1024844 - RNA, 18 nt, Homo sapiens
agcaagcucuucacugaa

SEQ ID NO: 1024845 - RNA, 24 nt, Homo sapiens
agcaagucucuuuauauggccuca

SEQ ID NO: 1024846 - RNA, 18 nt, Homo sapiens
agcaaguuacagugaugc

SEQ ID NO: 1024847 - RNA, 16 nt, Homo sapiens
agcaauacuaagggaa

SEQ ID NO: 1024848 - RNA, 14 nt, Homo sapiens
agcaaugacaucuc

SEQ ID NO: 1024849 - RNA, 20 nt, Homo sapiens
agcaauuauuuuaagcacuu

SEQ ID NO: 1024850 - RNA, 11 nt, Homo sapiens
agcacacugua

SEQ ID NO: 1024851 - RNA, 13 nt, Homo sapiens
agcacaguuugaa

SEQ ID NO: 1024852 - RNA, 19 nt, Homo sapiens
agcaccagggacuaugaau

SEQ ID NO: 1024853 - RNA, 14 nt, Homo sapiens
agcaccagggcuca

SEQ ID NO: 1024854 - RNA, 15 nt, Homo sapiens
agcacggacucuuac

SEQ ID NO: 1024855 - RNA, 15 nt, Homo sapiens
agcacgugucucaga

SEQ ID NO: 1024856 - RNA, 19 nt, Homo sapiens
agcacuaaggugugcucug

SEQ ID NO: 1024857 - RNA, 23 nt, Homo sapiens
agcacuaaggugugcucugauca

SEQ ID NO: 1024858 - RNA, 18 nt, Homo sapiens
agcacuacauaaacugac

SEQ ID NO: 1024859 - RNA, 12 nt, Homo sapiens
agcacuccucau

SEQ ID NO: 1024860 - RNA, 18 nt, Homo sapiens
agcacuccucaucaucac

SEQ ID NO: 1024861 - RNA, 20 nt, Homo sapiens
agcacugugcuaauaacagu

SEQ ID NO: 1024862 - RNA, 12 nt, Homo sapiens
agcacuguucca

SEQ ID NO: 1024863 - RNA, 15 nt, Homo sapiens
agcagaacagugauu

SEQ ID NO: 1024864 - RNA, 17 nt, Homo sapiens
agcagagacaugacuca

SEQ ID NO: 1024865 - RNA, 17 nt, Homo sapiens
agcagagacuugggaca

SEQ ID NO: 1024866 - RNA, 15 nt, Homo sapiens
agcagaggcacuggg

SEQ ID NO: 1024867 - RNA, 13 nt, Homo sapiens
agcagaugaugcc

SEQ ID NO: 1024868 - RNA, 19 nt, Homo sapiens
agcagaugcaaagaggcaa

SEQ ID NO: 1024869 - RNA, 16 nt, Homo sapiens
agcagauuguguaaca

SEQ ID NO: 1024870 - RNA, 15 nt, Homo sapiens
agcagccaagggaug

SEQ ID NO: 1024871 - RNA, 16 nt, Homo sapiens
agcagcuaucucucag

SEQ ID NO: 1024872 - RNA, 23 nt, Homo sapiens
agcagcuaucucucagugaacug

SEQ ID NO: 1024873 - RNA, 15 nt, Homo sapiens
agcagcucugugacu

SEQ ID NO: 1024874 - RNA, 22 nt, Homo sapiens
agcagcucuugcuaaucagugu

SEQ ID NO: 1024875 - RNA, 18 nt, Homo sapiens
agcaggacuccaucucuu

SEQ ID NO: 1024876 - RNA, 19 nt, Homo sapiens
agcaggagaggagagccag

SEQ ID NO: 1024877 - RNA, 21 nt, Homo sapiens
agcaggcggugggcacccacc

SEQ ID NO: 1024878 - RNA, 13 nt, Homo sapiens
agcaggguggccu

SEQ ID NO: 1024879 - RNA, 16 nt, Homo sapiens
agcagguggcaucucu

SEQ ID NO: 1024880 - RNA, 19 nt, Homo sapiens
agcaggugguccugagacc

SEQ ID NO: 1024881 - RNA, 16 nt, Homo sapiens
agcagugaugaaaaug

SEQ ID NO: 1024882 - RNA, 15 nt, Homo sapiens
agcagugcaggcaca

SEQ ID NO: 1024883 - RNA, 17 nt, Homo sapiens
agcagugccuuccauaa

SEQ ID NO: 1024884 - RNA, 21 nt, Homo sapiens
agcaguggacucaaaacccau

SEQ ID NO: 1024885 - RNA, 16 nt, Homo sapiens
agcaguggcuccauug

SEQ ID NO: 1024886 - RNA, 16 nt, Homo sapiens
agcagugucuuccaua

SEQ ID NO: 1024887 - RNA, 17 nt, Homo sapiens
agcagugucuuccauaa

SEQ ID NO: 1024888 - RNA, 22 nt, Homo sapiens
agcaguuacaaaaaccuucccc

SEQ ID NO: 1024889 - RNA, 20 nt, Homo sapiens
agcaguuaguuccuucauga

SEQ ID NO: 1024890 - RNA, 14 nt, Homo sapiens
agcaguugugucag

SEQ ID NO: 1024891 - RNA, 22 nt, Homo sapiens
agcauaacaagguccaagauac

SEQ ID NO: 1024892 - RNA, 16 nt, Homo sapiens
agcauaacuguucuca

SEQ ID NO: 1024893 - RNA, 18 nt, Homo sapiens
agcauacgguaugauauu

SEQ ID NO: 1024894 - RNA, 21 nt, Homo sapiens
agcauacguacacauuuuauu

SEQ ID NO: 1024895 - RNA, 21 nt, Homo sapiens
agcaucacuugggauuaauau

SEQ ID NO: 1024896 - RNA, 17 nt, Homo sapiens
agcaucagcucagggcu

SEQ ID NO: 1024897 - RNA, 20 nt, Homo sapiens
agcaucucugagcacccaag

SEQ ID NO: 1024898 - RNA, 22 nt, Homo sapiens
agcaucugagcuaacuuauauu

SEQ ID NO: 1024899 - RNA, 20 nt, Homo sapiens
agcaugaaccuuguuuaaau

SEQ ID NO: 1024900 - RNA, 21 nt, Homo sapiens
agcaugugaugggcuguuuaa

SEQ ID NO: 1024901 - RNA, 14 nt, Homo sapiens
agcauuacaguggg

SEQ ID NO: 1024902 - RNA, 18 nt, Homo sapiens
agcauuaugauguggguc

SEQ ID NO: 1024903 - RNA, 16 nt, Homo sapiens
agcauucaauuuauuc

SEQ ID NO: 1024904 - RNA, 17 nt, Homo sapiens
agcauuuaaccaaccua

SEQ ID NO: 1024905 - RNA, 20 nt, Homo sapiens
agcauuuccaacaccacaga

SEQ ID NO: 1024906 - RNA, 22 nt, Homo sapiens
agcauuuccaacaccacagaca

SEQ ID NO: 1024907 - RNA, 17 nt, Homo sapiens
agcauuuccacaccaag

SEQ ID NO: 1024908 - RNA, 22 nt, Homo sapiens
agcauuucuagcagugaugaaa

SEQ ID NO: 1024909 - RNA, 16 nt, Homo sapiens
agccaaacucugccag

SEQ ID NO: 1024910 - RNA, 12 nt, Homo sapiens
agccaaagccaa

SEQ ID NO: 1024911 - RNA, 16 nt, Homo sapiens
agccaaccccugugga

SEQ ID NO: 1024912 - RNA, 20 nt, Homo sapiens
agccaagaucgcgccacugc

SEQ ID NO: 1024913 - RNA, 17 nt, Homo sapiens
agccaagucagcuuugc

SEQ ID NO: 1024914 - RNA, 23 nt, Homo sapiens
agccaagucagcuuugccuucca

SEQ ID NO: 1024915 - RNA, 15 nt, Homo sapiens
agccaaguuaagaau

SEQ ID NO: 1024916 - RNA, 15 nt, Homo sapiens
agccacaacugcagu

SEQ ID NO: 1024917 - RNA, 12 nt, Homo sapiens
agccacacucug

SEQ ID NO: 1024918 - RNA, 21 nt, Homo sapiens
agccaccacauuuagaacuuu

SEQ ID NO: 1024919 - RNA, 23 nt, Homo sapiens
agccaccgcgcccagccucaucu

SEQ ID NO: 1024920 - RNA, 14 nt, Homo sapiens
agccacuaagcaga

SEQ ID NO: 1024921 - RNA, 21 nt, Homo sapiens
agccacuacauuacuucaaac

SEQ ID NO: 1024922 - RNA, 16 nt, Homo sapiens
agccacuucacuuuuu

SEQ ID NO: 1024923 - RNA, 17 nt, Homo sapiens
agccagaggucuggccc

SEQ ID NO: 1024924 - RNA, 16 nt, Homo sapiens
agccaggaacugugug

SEQ ID NO: 1024925 - RNA, 22 nt, Homo sapiens
agccaggguggucuugaucucc

SEQ ID NO: 1024926 - RNA, 19 nt, Homo sapiens
agccagugacuccaggaga

SEQ ID NO: 1024927 - RNA, 12 nt, Homo sapiens
auuucagauauc

SEQ ID NO: 1024928 - RNA, 20 nt, Homo sapiens
auuucagaucauauuucaca

SEQ ID NO: 1024929 - RNA, 15 nt, Homo sapiens
auuucagcugaucag

SEQ ID NO: 1024930 - RNA, 16 nt, Homo sapiens
auuucaguagugguga

SEQ ID NO: 1024931 - RNA, 20 nt, Homo sapiens
auuucauaccuaucaucuua

SEQ ID NO: 1024932 - RNA, 21 nt, Homo sapiens
auuucauaccuaucaucuuaa

SEQ ID NO: 1024933 - RNA, 13 nt, Homo sapiens
auuucauaugaca

SEQ ID NO: 1024934 - RNA, 20 nt, Homo sapiens
auuucaugugucaacuucaa

SEQ ID NO: 1024935 - RNA, 17 nt, Homo sapiens
auuucauuguaugaugu

SEQ ID NO: 1024936 - RNA, 18 nt, Homo sapiens
auuuccaaaccuccacug

SEQ ID NO: 1024937 - RNA, 19 nt, Homo sapiens
auuuccaaaccuccacugc

SEQ ID NO: 1024938 - RNA, 21 nt, Homo sapiens
auuuccaaaccuccacugcug

SEQ ID NO: 1024939 - RNA, 17 nt, Homo sapiens
auuuccaaaugaaugac

SEQ ID NO: 1024940 - RNA, 17 nt, Homo sapiens
auuuccaaauucacaag

SEQ ID NO: 1024941 - RNA, 14 nt, Homo sapiens
auuuccacaccaag

SEQ ID NO: 1024942 - RNA, 16 nt, Homo sapiens
auuucccugugcugac

SEQ ID NO: 1024943 - RNA, 20 nt, Homo sapiens
auuuccuaaugucagaguag

SEQ ID NO: 1024944 - RNA, 21 nt, Homo sapiens
auuuccucaugugaucacaau

SEQ ID NO: 1024945 - RNA, 23 nt, Homo sapiens
auuuccugugucuuuuuucacua

SEQ ID NO: 1024946 - RNA, 17 nt, Homo sapiens
auuuccuuuuccuucaa

SEQ ID NO: 1024947 - RNA, 14 nt, Homo sapiens
auuucuacacugag

SEQ ID NO: 1024948 - RNA, 23 nt, Homo sapiens
auuucuacucuuaaguuucucag

SEQ ID NO: 1024949 - RNA, 14 nt, Homo sapiens
auuucucacugaga

SEQ ID NO: 1024950 - RNA, 16 nt, Homo sapiens
auuucucugauuugca

SEQ ID NO: 1024951 - RNA, 23 nt, Homo sapiens
auuucugaccuuguaccucucuu

SEQ ID NO: 1024952 - RNA, 19 nt, Homo sapiens
auuucuggaaaacugccuu

SEQ ID NO: 1024953 - RNA, 18 nt, Homo sapiens
auuucuguucacuuugua

SEQ ID NO: 1024954 - RNA, 16 nt, Homo sapiens
auuucuuauagucaau

SEQ ID NO: 1024955 - RNA, 23 nt, Homo sapiens
auuucuuugccuguucaguuaca

SEQ ID NO: 1024956 - RNA, 13 nt, Homo sapiens
auuugaaaacaua

SEQ ID NO: 1024957 - RNA, 18 nt, Homo sapiens
auuugaauuucaguaaac

SEQ ID NO: 1024958 - RNA, 14 nt, Homo sapiens
auuugacuaauaau

SEQ ID NO: 1024959 - RNA, 17 nt, Homo sapiens
auuugagaaaugcauau

SEQ ID NO: 1024960 - RNA, 18 nt, Homo sapiens
auuugagauguauuucaa

SEQ ID NO: 1024961 - RNA, 19 nt, Homo sapiens
auuugagguuaagacaaac

SEQ ID NO: 1024962 - RNA, 23 nt, Homo sapiens
auuugauaguugguguucaaaaa

SEQ ID NO: 1024963 - RNA, 15 nt, Homo sapiens
auuugauuuugccca

SEQ ID NO: 1024964 - RNA, 15 nt, Homo sapiens
auuugcaagacauag

SEQ ID NO: 1024965 - RNA, 15 nt, Homo sapiens
auuugcauauguaug

SEQ ID NO: 1024966 - RNA, 19 nt, Homo sapiens
auuugcccuuaaggacaaa

SEQ ID NO: 1024967 - RNA, 12 nt, Homo sapiens
auuugccuguuu

SEQ ID NO: 1024968 - RNA, 13 nt, Homo sapiens
auuugcuaugagc

SEQ ID NO: 1024969 - RNA, 19 nt, Homo sapiens
auuugcugagcauguacug

SEQ ID NO: 1024970 - RNA, 16 nt, Homo sapiens
auuuggcaaugccauc

SEQ ID NO: 1024971 - RNA, 12 nt, Homo sapiens
auuugguguaca

SEQ ID NO: 1024972 - RNA, 13 nt, Homo sapiens
auuugucaacaaa

SEQ ID NO: 1024973 - RNA, 22 nt, Homo sapiens
auuugugacuaauuguauaaca

SEQ ID NO: 1024974 - RNA, 20 nt, Homo sapiens
auuugugguccacugagcua

SEQ ID NO: 1024975 - RNA, 20 nt, Homo sapiens
auuuguuaaugguuugaaua

SEQ ID NO: 1024976 - RNA, 17 nt, Homo sapiens
auuuuaaaaagucuuca

SEQ ID NO: 1024977 - RNA, 18 nt, Homo sapiens
auuuuaaguaauuucaga

SEQ ID NO: 1024978 - RNA, 18 nt, Homo sapiens
auuuuacauguggcccaa

SEQ ID NO: 1024979 - RNA, 21 nt, Homo sapiens
auuuuaguaagagauuccuga

SEQ ID NO: 1024980 - RNA, 18 nt, Homo sapiens
auuuuauaacagaauuaa

SEQ ID NO: 1024981 - RNA, 15 nt, Homo sapiens
auuuuauacauuaac

SEQ ID NO: 1024982 - RNA, 14 nt, Homo sapiens
auuuuauacugaca

SEQ ID NO: 1024983 - RNA, 22 nt, Homo sapiens
auuuuauaugcuuacugauaua

SEQ ID NO: 1024984 - RNA, 14 nt, Homo sapiens
auuuuaugcugcug

SEQ ID NO: 1024985 - RNA, 21 nt, Homo sapiens
auuuuaugcugcuguuuacaa

SEQ ID NO: 1024986 - RNA, 12 nt, Homo sapiens
auuuuauggcaa

SEQ ID NO: 1024987 - RNA, 19 nt, Homo sapiens
auuuuauggcucacuauga

SEQ ID NO: 1024988 - RNA, 12 nt, Homo sapiens
auuuuauuaaau

SEQ ID NO: 1024989 - RNA, 18 nt, Homo sapiens
auuuuauugcuagccauc

SEQ ID NO: 1024990 - RNA, 18 nt, Homo sapiens
auuuuauuuaauccccac

SEQ ID NO: 1024991 - RNA, 14 nt, Homo sapiens
auuuucaaguaauu

SEQ ID NO: 1024992 - RNA, 17 nt, Homo sapiens
auuuucacacaauacaa

SEQ ID NO: 1024993 - RNA, 21 nt, Homo sapiens
auuuucaucaggggccugcag

SEQ ID NO: 1024994 - RNA, 16 nt, Homo sapiens
auuuucauguauaugu

SEQ ID NO: 1024995 - RNA, 20 nt, Homo sapiens
auuuucauugaaaugcacag

SEQ ID NO: 1024996 - RNA, 20 nt, Homo sapiens
auuuucccccuuuucugcau

SEQ ID NO: 1024997 - RNA, 16 nt, Homo sapiens
auuuuccuccaggcaa

SEQ ID NO: 1024998 - RNA, 17 nt, Homo sapiens
auuuucuaaugugccua

SEQ ID NO: 1024999 - RNA, 21 nt, Homo sapiens
auuuucuagauuuucuacuuu

SEQ ID NO: 1025000 - RNA, 21 nt, Homo sapiens
auuuucuauuauuaacacuga

SEQ ID NO: 1025001 - RNA, 19 nt, Homo sapiens
auuuucuggaauacaugaa

SEQ ID NO: 1025002 - RNA, 17 nt, Homo sapiens
auuuucuuuacagguau

SEQ ID NO: 1025003 - RNA, 18 nt, Homo sapiens
auuuugaaaccaugaaga

SEQ ID NO: 1025004 - RNA, 15 nt, Homo sapiens
auuuugauccaagcu

SEQ ID NO: 1025005 - RNA, 16 nt, Homo sapiens
auuuugcaaucugugu

SEQ ID NO: 1025006 - RNA, 19 nt, Homo sapiens
auuuugcuaaaugugaaug

SEQ ID NO: 1025007 - RNA, 18 nt, Homo sapiens
auuuugggguaagacuuu

SEQ ID NO: 1025008 - RNA, 22 nt, Homo sapiens
auuuugguguccuauuaaagga

SEQ ID NO: 1025009 - RNA, 19 nt, Homo sapiens
auuuuguaacgaagacaca

SEQ ID NO: 1025010 - RNA, 15 nt, Homo sapiens
auuuuguaaucucau

SEQ ID NO: 1025011 - RNA, 22 nt, Homo sapiens
auuuuguauaauuguaucguau

SEQ ID NO: 1025012 - RNA, 20 nt, Homo sapiens
auuuuguguucaguacaauu

SEQ ID NO: 1025013 - RNA, 17 nt, Homo sapiens
auuuuuauagacaaaua

SEQ ID NO: 1025014 - RNA, 17 nt, Homo sapiens
auuuuuauuugagacag

SEQ ID NO: 1025015 - RNA, 17 nt, Homo sapiens
auuuuucacugccccag

SEQ ID NO: 1025016 - RNA, 13 nt, Homo sapiens
auuuuugaauaca

SEQ ID NO: 1025017 - RNA, 22 nt, Homo sapiens
auuuuugcuuguuucugauuaa

SEQ ID NO: 1025018 - RNA, 19 nt, Homo sapiens
auuuuuguagagccagggu

SEQ ID NO: 1025019 - RNA, 13 nt, Homo sapiens
auuuuugugcaca

SEQ ID NO: 1025020 - RNA, 20 nt, Homo sapiens
auuuuuguuucuuccaaagc

SEQ ID NO: 1025021 - RNA, 22 nt, Homo sapiens
auuuuuguuuucauuaucucaa

SEQ ID NO: 1025022 - RNA, 12 nt, Homo sapiens
auuuuuuccaca

SEQ ID NO: 1025023 - RNA, 15 nt, Homo sapiens
auuuuuuugagacag

SEQ ID NO: 1025024 - RNA, 19 nt, Homo sapiens
auuuuuuuucagcagacua

SEQ ID NO: 1025025 - RNA, 17 nt, Homo sapiens
auuuuuuuucuguuaua

SEQ ID NO: 1025026 - RNA, 20 nt, Homo sapiens
caaaaaaaaccuucagugaa

SEQ ID NO: 1025027 - RNA, 19 nt, Homo sapiens
caaaaaaaccucuaugcaa

SEQ ID NO: 1025028 - RNA, 16 nt, Homo sapiens
caaaaaaagaaaaaga

SEQ ID NO: 1025029 - RNA, 22 nt, Homo sapiens
caaaaaaauacugccagaugcu

SEQ ID NO: 1025030 - RNA, 11 nt, Homo sapiens
caaaaaaucug

SEQ ID NO: 1025031 - RNA, 15 nt, Homo sapiens
caaaaaccuucccca

SEQ ID NO: 1025032 - RNA, 13 nt, Homo sapiens
caaaaacuuugga

SEQ ID NO: 1025033 - RNA, 15 nt, Homo sapiens
caaaaagaugaccuu

SEQ ID NO: 1025034 - RNA, 22 nt, Homo sapiens
caaaaagaugaccuuugucuca

SEQ ID NO: 1025035 - RNA, 22 nt, Homo sapiens
caaaaaugaacugaaguuucac

SEQ ID NO: 1025036 - RNA, 13 nt, Homo sapiens
caaaaauguaaug

SEQ ID NO: 1025037 - RNA, 18 nt, Homo sapiens
caaaaauguaaugaucau

SEQ ID NO: 1025038 - RNA, 19 nt, Homo sapiens
caaaaauguaaugaucaua

SEQ ID NO: 1025039 - RNA, 21 nt, Homo sapiens
caaaacaaguuuuucugucaa

SEQ ID NO: 1025040 - RNA, 16 nt, Homo sapiens
caaaacagagauguga

SEQ ID NO: 1025041 - RNA, 13 nt, Homo sapiens
caaaacagcguuu

SEQ ID NO: 1025042 - RNA, 19 nt, Homo sapiens
caaaaccaaauauuccaga

SEQ ID NO: 1025043 - RNA, 18 nt, Homo sapiens
caaaaccacuagaacucu

SEQ ID NO: 1025044 - RNA, 23 nt, Homo sapiens
caaaaccggguugccagcuccca

SEQ ID NO: 1025045 - RNA, 14 nt, Homo sapiens
caaaaccuugcaca

SEQ ID NO: 1025046 - RNA, 20 nt, Homo sapiens
caaaacugauacccuuugaa

SEQ ID NO: 1025047 - RNA, 17 nt, Homo sapiens
caaaagaagaaaccuuc

SEQ ID NO: 1025048 - RNA, 18 nt, Homo sapiens
caaaagcccauucauucc

SEQ ID NO: 1025049 - RNA, 15 nt, Homo sapiens
caaaagcucagccag

SEQ ID NO: 1025050 - RNA, 16 nt, Homo sapiens
caaaagcucauccauu

SEQ ID NO: 1025051 - RNA, 22 nt, Homo sapiens
caaaaguuucuuacucaaggaa

SEQ ID NO: 1025052 - RNA, 19 nt, Homo sapiens
caaaauaccaugccauuua

SEQ ID NO: 1025053 - RNA, 22 nt, Homo sapiens
caaaauauauuuuaucugugau

SEQ ID NO: 1025054 - RNA, 14 nt, Homo sapiens
caaaaucacacagc

SEQ ID NO: 1025055 - RNA, 15 nt, Homo sapiens
caaaaucacacagcc

SEQ ID NO: 1025056 - RNA, 22 nt, Homo sapiens
caaaaugaaggcgggccugcaa

SEQ ID NO: 1025057 - RNA, 18 nt, Homo sapiens
caaaaugaauucugggaa

SEQ ID NO: 1025058 - RNA, 17 nt, Homo sapiens
caaaauuacacaguuaa

SEQ ID NO: 1025059 - RNA, 20 nt, Homo sapiens
caaaauuggaagcugucaua

SEQ ID NO: 1025060 - RNA, 14 nt, Homo sapiens
caaacaaauaugca

SEQ ID NO: 1025061 - RNA, 14 nt, Homo sapiens
caaacaccuggacu

SEQ ID NO: 1025062 - RNA, 15 nt, Homo sapiens
caaacacugcaggca

SEQ ID NO: 1025063 - RNA, 20 nt, Homo sapiens
caaacacugcaggcaucaca

SEQ ID NO: 1025064 - RNA, 17 nt, Homo sapiens
caaacagaacugcaguc

SEQ ID NO: 1025065 - RNA, 16 nt, Homo sapiens
caaacagccacacugu

SEQ ID NO: 1025066 - RNA, 16 nt, Homo sapiens
caaacagccccaaagu

SEQ ID NO: 1025067 - RNA, 23 nt, Homo sapiens
caaacagccccucuggacacagc

SEQ ID NO: 1025068 - RNA, 13 nt, Homo sapiens
caaacaggcaguu

SEQ ID NO: 1025069 - RNA, 22 nt, Homo sapiens
caaacaggcaguuggccagaga

SEQ ID NO: 1025070 - RNA, 16 nt, Homo sapiens
caaacagucucaggaa

SEQ ID NO: 1025071 - RNA, 15 nt, Homo sapiens
cacuauggugccaau

SEQ ID NO: 1025072 - RNA, 21 nt, Homo sapiens
cacuauguuuauuuacuaauu

SEQ ID NO: 1025073 - RNA, 19 nt, Homo sapiens
cacuauuuaucugugcaaa

SEQ ID NO: 1025074 - RNA, 17 nt, Homo sapiens
cacucacagauguuuga

SEQ ID NO: 1025075 - RNA, 21 nt, Homo sapiens
cacucacauuuauucugcuca

SEQ ID NO: 1025076 - RNA, 21 nt, Homo sapiens
cacucacgaauauuaugccca

SEQ ID NO: 1025077 - RNA, 12 nt, Homo sapiens
cacucaugcuga

SEQ ID NO: 1025078 - RNA, 14 nt, Homo sapiens
cacucaugcugaaa

SEQ ID NO: 1025079 - RNA, 14 nt, Homo sapiens
cacuccacuggccu

SEQ ID NO: 1025080 - RNA, 21 nt, Homo sapiens
cacuccacuuuguauagacau

SEQ ID NO: 1025081 - RNA, 23 nt, Homo sapiens
cacuccagccugagcgacaguga

SEQ ID NO: 1025082 - RNA, 14 nt, Homo sapiens
cacuccagugccag

SEQ ID NO: 1025083 - RNA, 16 nt, Homo sapiens
cacucggcauuucaaa

SEQ ID NO: 1025084 - RNA, 17 nt, Homo sapiens
cacucugaauccucaug

SEQ ID NO: 1025085 - RNA, 22 nt, Homo sapiens
cacucuuauugcccacgcugga

SEQ ID NO: 1025086 - RNA, 14 nt, Homo sapiens
cacugaaaccaggu

SEQ ID NO: 1025087 - RNA, 21 nt, Homo sapiens
cacugaaacugguugaagggu

SEQ ID NO: 1025088 - RNA, 13 nt, Homo sapiens
cacugaaaugcua

SEQ ID NO: 1025089 - RNA, 23 nt, Homo sapiens
cacugaaugccucaaugugacca

SEQ ID NO: 1025090 - RNA, 13 nt, Homo sapiens
cacugagagugaa

SEQ ID NO: 1025091 - RNA, 10 nt, Homo sapiens
cacugagaua

SEQ ID NO: 1025092 - RNA, 19 nt, Homo sapiens
cacugagcaaagcauugag

SEQ ID NO: 1025093 - RNA, 22 nt, Homo sapiens
cacugauguaaguguuguggaa

SEQ ID NO: 1025094 - RNA, 13 nt, Homo sapiens
cacugauguauga

SEQ ID NO: 1025095 - RNA, 13 nt, Homo sapiens
cacugcaagcacu

SEQ ID NO: 1025096 - RNA, 19 nt, Homo sapiens
cacugcacuauagccuagg

SEQ ID NO: 1025097 - RNA, 19 nt, Homo sapiens
cacugcaggggccgagcca

SEQ ID NO: 1025098 - RNA, 21 nt, Homo sapiens
cacugcccaaagugcuuccaa

SEQ ID NO: 1025099 - RNA, 18 nt, Homo sapiens
cacugcccccuccacugg

SEQ ID NO: 1025100 - RNA, 14 nt, Homo sapiens
cacugcucaagaag

SEQ ID NO: 1025101 - RNA, 21 nt, Homo sapiens
cacugcucauuuggaucccag

SEQ ID NO: 1025102 - RNA, 24 nt, Homo sapiens
cacugcuuaacuucacauauugau

SEQ ID NO: 1025103 - RNA, 17 nt, Homo sapiens
cacuggaaaaguguaau

SEQ ID NO: 1025104 - RNA, 18 nt, Homo sapiens
cacuggcagcaucuucac

SEQ ID NO: 1025105 - RNA, 17 nt, Homo sapiens
cacuggccaccaggcug

SEQ ID NO: 1025106 - RNA, 22 nt, Homo sapiens
cacuggccccucaaaucgucca

SEQ ID NO: 1025107 - RNA, 14 nt, Homo sapiens
cacuggcucuccaa

SEQ ID NO: 1025108 - RNA, 22 nt, Homo sapiens
cacugggaugagccgcugugag

SEQ ID NO: 1025109 - RNA, 14 nt, Homo sapiens
cacugggcuucuag

SEQ ID NO: 1025110 - RNA, 17 nt, Homo sapiens
cacuggggcuggcacaa

SEQ ID NO: 1025111 - RNA, 20 nt, Homo sapiens
cacugggugcccaagcucag

SEQ ID NO: 1025112 - RNA, 16 nt, Homo sapiens
cacugguaaucccaag

SEQ ID NO: 1025113 - RNA, 11 nt, Homo sapiens
cacuguacaag

SEQ ID NO: 1025114 - RNA, 18 nt, Homo sapiens
cacuguaccgacuuugau

SEQ ID NO: 1025115 - RNA, 15 nt, Homo sapiens
cacuguauguuuacu

SEQ ID NO: 1025116 - RNA, 12 nt, Homo sapiens
cacuguccagua

SEQ ID NO: 1025117 - RNA, 16 nt, Homo sapiens
cacuguccaguauucu

SEQ ID NO: 1025118 - RNA, 23 nt, Homo sapiens
cacuguccugggcgcccuggaag

SEQ ID NO: 1025119 - RNA, 19 nt, Homo sapiens
cacugucuccuuucucuua

SEQ ID NO: 1025120 - RNA, 22 nt, Homo sapiens
cacugugcuaauaacagugcau

SEQ ID NO: 1025121 - RNA, 21 nt, Homo sapiens
cacugugguggugugcugcuu

SEQ ID NO: 1025122 - RNA, 23 nt, Homo sapiens
cacuguuacuuucguacauuggc

SEQ ID NO: 1025123 - RNA, 22 nt, Homo sapiens
cacuguugucaaaaaguuccau

SEQ ID NO: 1025124 - RNA, 13 nt, Homo sapiens
cacuguuugccca

SEQ ID NO: 1025125 - RNA, 20 nt, Homo sapiens
cacuuaaaaaauguccauga

SEQ ID NO: 1025126 - RNA, 17 nt, Homo sapiens
cacuuaagacuguguau

SEQ ID NO: 1025127 - RNA, 22 nt, Homo sapiens
cacuuaaugaaugaaugaauuc

SEQ ID NO: 1025128 - RNA, 17 nt, Homo sapiens
cacuuacuguuguccua

SEQ ID NO: 1025129 - RNA, 20 nt, Homo sapiens
cacuuauacccaugaacuua

SEQ ID NO: 1025130 - RNA, 17 nt, Homo sapiens
cacuuauccuguucucu

SEQ ID NO: 1025131 - RNA, 18 nt, Homo sapiens
cacuuauccuguucucug

SEQ ID NO: 1025132 - RNA, 23 nt, Homo sapiens
cacuuaugagaugccugaagcca

SEQ ID NO: 1025133 - RNA, 12 nt, Homo sapiens
cacuuccagucc

SEQ ID NO: 1025134 - RNA, 16 nt, Homo sapiens
cacuucccuacaugga

SEQ ID NO: 1025135 - RNA, 18 nt, Homo sapiens
cacuuccuauaugcacuu

SEQ ID NO: 1025136 - RNA, 17 nt, Homo sapiens
cacuuccuguccagaga

SEQ ID NO: 1025137 - RNA, 17 nt, Homo sapiens
cacuuccuuaccuagug

SEQ ID NO: 1025138 - RNA, 16 nt, Homo sapiens
cacuucuaaaugcaua

SEQ ID NO: 1025139 - RNA, 12 nt, Homo sapiens
cacuugaacccg

SEQ ID NO: 1025140 - RNA, 20 nt, Homo sapiens
cacuugccuucuucacccag

SEQ ID NO: 1025141 - RNA, 16 nt, Homo sapiens
cacuuggaugcagggu

SEQ ID NO: 1025142 - RNA, 15 nt, Homo sapiens
cacuuggcaucagcu

SEQ ID NO: 1025143 - RNA, 22 nt, Homo sapiens
cacuuggugauauguccuauau

SEQ ID NO: 1025144 - RNA, 20 nt, Homo sapiens
cacuugugugugggcuguga

SEQ ID NO: 1025145 - RNA, 21 nt, Homo sapiens
cacuuuaauuaccaaccuguu

SEQ ID NO: 1025146 - RNA, 20 nt, Homo sapiens
cacuuuaauucucaugugau

SEQ ID NO: 1025147 - RNA, 18 nt, Homo sapiens
cacuuuaccucuguggac

SEQ ID NO: 1025148 - RNA, 22 nt, Homo sapiens
cacuuuggacauggcucacaaa

SEQ ID NO: 1025149 - RNA, 16 nt, Homo sapiens
cacuuuuaauaaacuu

SEQ ID NO: 1025150 - RNA, 20 nt, Homo sapiens
cacuuuugaagcaauaucag

SEQ ID NO: 1025151 - RNA, 14 nt, Homo sapiens
cagaaaaaugucau

SEQ ID NO: 1025152 - RNA, 13 nt, Homo sapiens
cagaaacagugag

SEQ ID NO: 1025153 - RNA, 14 nt, Homo sapiens
cagaaacagugagu

SEQ ID NO: 1025154 - RNA, 18 nt, Homo sapiens
cagaaacagugaguuaaa

SEQ ID NO: 1025155 - RNA, 13 nt, Homo sapiens
cagaaaccaaaac

SEQ ID NO: 1025156 - RNA, 19 nt, Homo sapiens
cagaaaggagaacuaucca

SEQ ID NO: 1025157 - RNA, 19 nt, Homo sapiens
cagaaauacauauuuccaa

SEQ ID NO: 1025158 - RNA, 14 nt, Homo sapiens
cagaaauccaucua

SEQ ID NO: 1025159 - RNA, 12 nt, Homo sapiens
cagaacacacuc

SEQ ID NO: 1025160 - RNA, 19 nt, Homo sapiens
cagaacacacuccaucagc

SEQ ID NO: 1025161 - RNA, 16 nt, Homo sapiens
cagaacacugucuuga

SEQ ID NO: 1025162 - RNA, 22 nt, Homo sapiens
cagaacacugucuugaagacaa

SEQ ID NO: 1025163 - RNA, 12 nt, Homo sapiens
cagaacagugau

SEQ ID NO: 1025164 - RNA, 16 nt, Homo sapiens
cagaacccagauuucc

SEQ ID NO: 1025165 - RNA, 23 nt, Homo sapiens
cagaacugcuugaacccaggagg

SEQ ID NO: 1025166 - RNA, 20 nt, Homo sapiens
cagaacuuaaggauggagcc

SEQ ID NO: 1025167 - RNA, 15 nt, Homo sapiens
cagaagaaugggaau

SEQ ID NO: 1025168 - RNA, 15 nt, Homo sapiens
cagaagcacauauga

SEQ ID NO: 1025169 - RNA, 21 nt, Homo sapiens
cagaagcacauaugaacugga

SEQ ID NO: 1025170 - RNA, 16 nt, Homo sapiens
cagaaggcaaaaagac

SEQ ID NO: 1025171 - RNA, 16 nt, Homo sapiens
cagaaggcaaacccau

SEQ ID NO: 1025172 - RNA, 15 nt, Homo sapiens
cagaaggccaagagg

SEQ ID NO: 1025173 - RNA, 15 nt, Homo sapiens
cagaagguugcucua

SEQ ID NO: 1025174 - RNA, 16 nt, Homo sapiens
cagaaguuugagauca

SEQ ID NO: 1025175 - RNA, 18 nt, Homo sapiens
cagaauauacccauccau

SEQ ID NO: 1025176 - RNA, 12 nt, Homo sapiens
cagaauccagcu

SEQ ID NO: 1025177 - RNA, 23 nt, Homo sapiens
cagaaucucauagguugccaaua

SEQ ID NO: 1025178 - RNA, 19 nt, Homo sapiens
cagaaucuguuaccagagg

SEQ ID NO: 1025179 - RNA, 12 nt, Homo sapiens
cagaauggagcu

SEQ ID NO: 1025180 - RNA, 22 nt, Homo sapiens
cagaauguuuuuaaaauaugag

SEQ ID NO: 1025181 - RNA, 19 nt, Homo sapiens
cagaauuaacuccauucca

SEQ ID NO: 1025182 - RNA, 12 nt, Homo sapiens
cagaauuaugaa

SEQ ID NO: 1025183 - RNA, 21 nt, Homo sapiens
cagacaaaguaauuccucuca

SEQ ID NO: 1025184 - RNA, 12 nt, Homo sapiens
cagacaacagaa

SEQ ID NO: 1025185 - RNA, 22 nt, Homo sapiens
cagacacacacacgcacgcaca

SEQ ID NO: 1025186 - RNA, 18 nt, Homo sapiens
cagacacaggcccggcuc

SEQ ID NO: 1025187 - RNA, 20 nt, Homo sapiens
cagacacuggcauggauaua

SEQ ID NO: 1025188 - RNA, 16 nt, Homo sapiens
cagacaggaccaggga

SEQ ID NO: 1025189 - RNA, 22 nt, Homo sapiens
cagacaggaggaaucaugucag

SEQ ID NO: 1025190 - RNA, 12 nt, Homo sapiens
cagacaggguuu

SEQ ID NO: 1025191 - RNA, 19 nt, Homo sapiens
cagacauccuagcauuugu

SEQ ID NO: 1025192 - RNA, 22 nt, Homo sapiens
cagaccaguuucagagaaauac

SEQ ID NO: 1025193 - RNA, 17 nt, Homo sapiens
cagacccugcccugugg

SEQ ID NO: 1025194 - RNA, 22 nt, Homo sapiens
cagacgcguuggcacaguucau

SEQ ID NO: 1025195 - RNA, 21 nt, Homo sapiens
cagacuacuucuuccccagau

SEQ ID NO: 1025196 - RNA, 23 nt, Homo sapiens
cagacuaugucacccaaugcaua

SEQ ID NO: 1025197 - RNA, 16 nt, Homo sapiens
cagacucaaaugcuca

SEQ ID NO: 1025198 - RNA, 16 nt, Homo sapiens
cagacuccugugcaac

SEQ ID NO: 1025199 - RNA, 14 nt, Homo sapiens
cagacucucuguga

SEQ ID NO: 1025200 - RNA, 20 nt, Homo sapiens
cagacugaacuuaccgugag

SEQ ID NO: 1025201 - RNA, 16 nt, Homo sapiens
cagacugacaaaugug

SEQ ID NO: 1025202 - RNA, 15 nt, Homo sapiens
cagacugcugcuaga

SEQ ID NO: 1025203 - RNA, 11 nt, Homo sapiens
cagacugucuc

SEQ ID NO: 1025204 - RNA, 15 nt, Homo sapiens
cagacuguguauuca

SEQ ID NO: 1025205 - RNA, 14 nt, Homo sapiens
cagacuucuccaga

SEQ ID NO: 1025206 - RNA, 22 nt, Homo sapiens
cagacuugucccuccuuuucca

SEQ ID NO: 1025207 - RNA, 20 nt, Homo sapiens
cagacuuuggaaaaugcauu

SEQ ID NO: 1025208 - RNA, 17 nt, Homo sapiens
cagagaaauacuuucag

SEQ ID NO: 1025209 - RNA, 15 nt, Homo sapiens
cagagaaccaaaggg

SEQ ID NO: 1025210 - RNA, 20 nt, Homo sapiens
cagagaacuggaaagacaua

SEQ ID NO: 1025211 - RNA, 21 nt, Homo sapiens
cagagaagggcuuggacucaa

SEQ ID NO: 1025212 - RNA, 22 nt, Homo sapiens
cagagacacuaacgacuucagg

SEQ ID NO: 1025213 - RNA, 14 nt, Homo sapiens
cagagacagcuuga

SEQ ID NO: 1025214 - RNA, 19 nt, Homo sapiens
cagagacaggcccaagaga

SEQ ID NO: 1025215 - RNA, 17 nt, Homo sapiens
cauccuucaagaacucu

SEQ ID NO: 1025216 - RNA, 17 nt, Homo sapiens
caucgccgggacuccag

SEQ ID NO: 1025217 - RNA, 14 nt, Homo sapiens
caucuacauacaca

SEQ ID NO: 1025218 - RNA, 21 nt, Homo sapiens
caucuauugccugagagcaca

SEQ ID NO: 1025219 - RNA, 13 nt, Homo sapiens
caucucagugcag

SEQ ID NO: 1025220 - RNA, 14 nt, Homo sapiens
caucucucuuuaau

SEQ ID NO: 1025221 - RNA, 14 nt, Homo sapiens
caucucuuguauau

SEQ ID NO: 1025222 - RNA, 14 nt, Homo sapiens
caucugacucacaa

SEQ ID NO: 1025223 - RNA, 18 nt, Homo sapiens
caucugacucacaagaag

SEQ ID NO: 1025224 - RNA, 21 nt, Homo sapiens
caucugcucagcagcuauuug

SEQ ID NO: 1025225 - RNA, 13 nt, Homo sapiens
caucugcuuacaa

SEQ ID NO: 1025226 - RNA, 21 nt, Homo sapiens
caucugcuuuacucuggacca

SEQ ID NO: 1025227 - RNA, 13 nt, Homo sapiens
caucugggaaaga

SEQ ID NO: 1025228 - RNA, 17 nt, Homo sapiens
caucugggaaagacauc

SEQ ID NO: 1025229 - RNA, 12 nt, Homo sapiens
caucuguacuca

SEQ ID NO: 1025230 - RNA, 18 nt, Homo sapiens
caucugugaauaagccau

SEQ ID NO: 1025231 - RNA, 18 nt, Homo sapiens
caucuuccagaaguguga

SEQ ID NO: 1025232 - RNA, 14 nt, Homo sapiens
caucuucuggaguc

SEQ ID NO: 1025233 - RNA, 15 nt, Homo sapiens
caucuugaucugugu

SEQ ID NO: 1025234 - RNA, 23 nt, Homo sapiens
caucuugcucugcugacagacac

SEQ ID NO: 1025235 - RNA, 14 nt, Homo sapiens
caucuuggucacau

SEQ ID NO: 1025236 - RNA, 20 nt, Homo sapiens
caucuuuaucuguucuugcu

SEQ ID NO: 1025237 - RNA, 12 nt, Homo sapiens
caucuuucacau

SEQ ID NO: 1025238 - RNA, 16 nt, Homo sapiens
caucuuuccuguucca

SEQ ID NO: 1025239 - RNA, 14 nt, Homo sapiens
caugaaauaugcau

SEQ ID NO: 1025240 - RNA, 13 nt, Homo sapiens
caugaacauguac

SEQ ID NO: 1025241 - RNA, 16 nt, Homo sapiens
caugaagauucuuucc

SEQ ID NO: 1025242 - RNA, 16 nt, Homo sapiens
caugaauaucaguuau

SEQ ID NO: 1025243 - RNA, 13 nt, Homo sapiens
caugaauaugauu

SEQ ID NO: 1025244 - RNA, 22 nt, Homo sapiens
caugaaucccacccacauguga

SEQ ID NO: 1025245 - RNA, 17 nt, Homo sapiens
caugaauguaucaggaa

SEQ ID NO: 1025246 - RNA, 15 nt, Homo sapiens
caugacacagcuuua

SEQ ID NO: 1025247 - RNA, 18 nt, Homo sapiens
caugacccaccccugugc

SEQ ID NO: 1025248 - RNA, 20 nt, Homo sapiens
caugacccaccccugugcuc

SEQ ID NO: 1025249 - RNA, 18 nt, Homo sapiens
caugaccugugaccagca

SEQ ID NO: 1025250 - RNA, 20 nt, Homo sapiens
caugacucagcauaccugcu

SEQ ID NO: 1025251 - RNA, 14 nt, Homo sapiens
caugagaauaagag

SEQ ID NO: 1025252 - RNA, 19 nt, Homo sapiens
caugagauucauucaguua

SEQ ID NO: 1025253 - RNA, 17 nt, Homo sapiens
caugaguuggcugggaa

SEQ ID NO: 1025254 - RNA, 14 nt, Homo sapiens
caugauaggauuug

SEQ ID NO: 1025255 - RNA, 17 nt, Homo sapiens
caugaucaucacaauca

SEQ ID NO: 1025256 - RNA, 18 nt, Homo sapiens
caugauggugcugaccuc

SEQ ID NO: 1025257 - RNA, 17 nt, Homo sapiens
caugauguuuuccauga

SEQ ID NO: 1025258 - RNA, 15 nt, Homo sapiens
caugauuguuuacag

SEQ ID NO: 1025259 - RNA, 13 nt, Homo sapiens
caugcaaugacau

SEQ ID NO: 1025260 - RNA, 15 nt, Homo sapiens
caugcacaaaaagau

SEQ ID NO: 1025261 - RNA, 22 nt, Homo sapiens
caugcacaaaaagaugcaucua

SEQ ID NO: 1025262 - RNA, 18 nt, Homo sapiens
caugccaagcacugugcu

SEQ ID NO: 1025263 - RNA, 18 nt, Homo sapiens
caugcccccaguuacugu

SEQ ID NO: 1025264 - RNA, 19 nt, Homo sapiens
caugcccccaguuacugua

SEQ ID NO: 1025265 - RNA, 15 nt, Homo sapiens
caugccucagugaag

SEQ ID NO: 1025266 - RNA, 22 nt, Homo sapiens
caugccugccccccucaucuca

SEQ ID NO: 1025267 - RNA, 16 nt, Homo sapiens
caugccuggucuuucc

SEQ ID NO: 1025268 - RNA, 14 nt, Homo sapiens
caugcuacugccaa

SEQ ID NO: 1025269 - RNA, 20 nt, Homo sapiens
caugcugaagccaaagccaa

SEQ ID NO: 1025270 - RNA, 18 nt, Homo sapiens
caugcugggaaugagaca

SEQ ID NO: 1025271 - RNA, 15 nt, Homo sapiens
caugcugugugcugg

SEQ ID NO: 1025272 - RNA, 12 nt, Homo sapiens
caugcuguucca

SEQ ID NO: 1025273 - RNA, 22 nt, Homo sapiens
caugcuugcauuauauuuguaa

SEQ ID NO: 1025274 - RNA, 23 nt, Homo sapiens
cauggaaauucccuucaucugga

SEQ ID NO: 1025275 - RNA, 23 nt, Homo sapiens
cauggaacucauuccugccuguc

SEQ ID NO: 1025276 - RNA, 17 nt, Homo sapiens
cauggacacuccagugc

SEQ ID NO: 1025277 - RNA, 16 nt, Homo sapiens
cauggagcaugggacu

SEQ ID NO: 1025278 - RNA, 16 nt, Homo sapiens
cauggaggcaugccaa

SEQ ID NO: 1025279 - RNA, 16 nt, Homo sapiens
cauggcaccaaagcca

SEQ ID NO: 1025280 - RNA, 21 nt, Homo sapiens
cauggcagaaggcaaacccau

SEQ ID NO: 1025281 - RNA, 14 nt, Homo sapiens
cauggccuaugcac

SEQ ID NO: 1025282 - RNA, 15 nt, Homo sapiens
cauggccuaugcaca

SEQ ID NO: 1025283 - RNA, 19 nt, Homo sapiens
cauggccuaugcacauaug

SEQ ID NO: 1025284 - RNA, 21 nt, Homo sapiens
cauggcucacaaacaguuguu

SEQ ID NO: 1025285 - RNA, 22 nt, Homo sapiens
cauggcuuaaugcuucuuucau

SEQ ID NO: 1025286 - RNA, 16 nt, Homo sapiens
cauggggcugauugua

SEQ ID NO: 1025287 - RNA, 14 nt, Homo sapiens
cauggggugaugcu

SEQ ID NO: 1025288 - RNA, 16 nt, Homo sapiens
cauggugaaaauguac

SEQ ID NO: 1025289 - RNA, 19 nt, Homo sapiens
cauggugaaacccugucuc

SEQ ID NO: 1025290 - RNA, 13 nt, Homo sapiens
cauggugcacuga

SEQ ID NO: 1025291 - RNA, 17 nt, Homo sapiens
cauguaaacugugcacc

SEQ ID NO: 1025292 - RNA, 22 nt, Homo sapiens
cauguaauauaaagauguuaaa

SEQ ID NO: 1025293 - RNA, 16 nt, Homo sapiens
cauguacauacccugg

SEQ ID NO: 1025294 - RNA, 16 nt, Homo sapiens
cauguacauagcuuga

SEQ ID NO: 1025295 - RNA, 17 nt, Homo sapiens
cauguaugucuuggaca

SEQ ID NO: 1025296 - RNA, 15 nt, Homo sapiens
caugucagacuguac

SEQ ID NO: 1025297 - RNA, 14 nt, Homo sapiens
cauguccaagaagc

SEQ ID NO: 1025298 - RNA, 15 nt, Homo sapiens
caugucucaauagua

SEQ ID NO: 1025299 - RNA, 17 nt, Homo sapiens
caugucucaauaguaaa

SEQ ID NO: 1025300 - RNA, 19 nt, Homo sapiens
caugucuuuucuugcauga

SEQ ID NO: 1025301 - RNA, 14 nt, Homo sapiens
caugugacucugaa

SEQ ID NO: 1025302 - RNA, 18 nt, Homo sapiens
caugugacucugaagcug

SEQ ID NO: 1025303 - RNA, 14 nt, Homo sapiens
caugugcacaugca

SEQ ID NO: 1025304 - RNA, 18 nt, Homo sapiens
caugugccgaaugugcag

SEQ ID NO: 1025305 - RNA, 16 nt, Homo sapiens
caugugcgcacacaca

SEQ ID NO: 1025306 - RNA, 19 nt, Homo sapiens
cauguggugggacagggac

SEQ ID NO: 1025307 - RNA, 18 nt, Homo sapiens
cauguguagccugugcau

SEQ ID NO: 1025308 - RNA, 18 nt, Homo sapiens
caugugugagugugugca

SEQ ID NO: 1025309 - RNA, 20 nt, Homo sapiens
caugugugagugugugcaag

SEQ ID NO: 1025310 - RNA, 20 nt, Homo sapiens
caugugugcgagugugugca

SEQ ID NO: 1025311 - RNA, 22 nt, Homo sapiens
caugugugcgagugugugcaug

SEQ ID NO: 1025312 - RNA, 23 nt, Homo sapiens
caugugugcgagugugugcaugu

SEQ ID NO: 1025313 - RNA, 17 nt, Homo sapiens
cauguuacugaccagca

SEQ ID NO: 1025314 - RNA, 18 nt, Homo sapiens
cauguuacugaccagcaa

SEQ ID NO: 1025315 - RNA, 19 nt, Homo sapiens
cauguuauauuauuacuaa

SEQ ID NO: 1025316 - RNA, 23 nt, Homo sapiens
cauguuaugcuuuacugcgaaua

SEQ ID NO: 1025317 - RNA, 22 nt, Homo sapiens
cauguuauuaaacguaugcaug

SEQ ID NO: 1025318 - RNA, 16 nt, Homo sapiens
cauguuccucaaaagc

SEQ ID NO: 1025319 - RNA, 16 nt, Homo sapiens
cauguuccuucaagau

SEQ ID NO: 1025320 - RNA, 20 nt, Homo sapiens
cauguuuuaacaaaaaccaa

SEQ ID NO: 1025321 - RNA, 12 nt, Homo sapiens
cauguuuuuacc

SEQ ID NO: 1025322 - RNA, 18 nt, Homo sapiens
cauuaaaacaaauccaua

SEQ ID NO: 1025323 - RNA, 18 nt, Homo sapiens
cauuaagcccucuuccau

SEQ ID NO: 1025324 - RNA, 18 nt, Homo sapiens
cauuaaugacacuugucc

SEQ ID NO: 1025325 - RNA, 20 nt, Homo sapiens
cauuaccagacgguucacca

SEQ ID NO: 1025326 - RNA, 16 nt, Homo sapiens
cauuaccuugugcuaa

SEQ ID NO: 1025327 - RNA, 17 nt, Homo sapiens
cauuagaauaggaauug

SEQ ID NO: 1025328 - RNA, 17 nt, Homo sapiens
cauuauaaacgugauga

SEQ ID NO: 1025329 - RNA, 21 nt, Homo sapiens
cauuauguaaaauguuuuagc

SEQ ID NO: 1025330 - RNA, 19 nt, Homo sapiens
cauuauuuuauuauaacau

SEQ ID NO: 1025331 - RNA, 17 nt, Homo sapiens
cauuauuuugaauguga

SEQ ID NO: 1025332 - RNA, 22 nt, Homo sapiens
cauucaacccuggagaguucaa

SEQ ID NO: 1025333 - RNA, 14 nt, Homo sapiens
cauucaacugaaaa

SEQ ID NO: 1025334 - RNA, 21 nt, Homo sapiens
cauucaagucuaugaugcugu

SEQ ID NO: 1025335 - RNA, 18 nt, Homo sapiens
cauucaauguuuaugcaa

SEQ ID NO: 1025336 - RNA, 15 nt, Homo sapiens
cauucaggucuuucu

SEQ ID NO: 1025337 - RNA, 19 nt, Homo sapiens
cauucauaacagaacaaga

SEQ ID NO: 1025338 - RNA, 20 nt, Homo sapiens
cauucaucuuguguuuuaua

SEQ ID NO: 1025339 - RNA, 12 nt, Homo sapiens
cauucauuccau

SEQ ID NO: 1025340 - RNA, 18 nt, Homo sapiens
cauucauuccauucugga

SEQ ID NO: 1025341 - RNA, 19 nt, Homo sapiens
cauucauuuauucauucau

SEQ ID NO: 1025342 - RNA, 15 nt, Homo sapiens
cauucccagugguca

SEQ ID NO: 1025343 - RNA, 20 nt, Homo sapiens
cauuccugaaagaaacaguu

SEQ ID NO: 1025344 - RNA, 17 nt, Homo sapiens
cauuccuguagucaaaa

SEQ ID NO: 1025345 - RNA, 14 nt, Homo sapiens
cauuccuguauuca

SEQ ID NO: 1025346 - RNA, 15 nt, Homo sapiens
cauucuaucuauucc

SEQ ID NO: 1025347 - RNA, 14 nt, Homo sapiens
cauucucaagcccu

SEQ ID NO: 1025348 - RNA, 15 nt, Homo sapiens
cauucuccugccuca

SEQ ID NO: 1025349 - RNA, 12 nt, Homo sapiens
cauucucugucu

SEQ ID NO: 1025350 - RNA, 16 nt, Homo sapiens
cauucugaccauuuca

SEQ ID NO: 1025351 - RNA, 13 nt, Homo sapiens
cauucuugcuaau

SEQ ID NO: 1025352 - RNA, 19 nt, Homo sapiens
cauucuugcuaauucucag

SEQ ID NO: 1025353 - RNA, 18 nt, Homo sapiens
cauugaaguaaugaauuu

SEQ ID NO: 1025354 - RNA, 15 nt, Homo sapiens
cauugaauuugccuu

SEQ ID NO: 1025355 - RNA, 16 nt, Homo sapiens
cauugauggggaagga

SEQ ID NO: 1025356 - RNA, 19 nt, Homo sapiens
cauuggacacguggugcau

SEQ ID NO: 1025357 - RNA, 23 nt, Homo sapiens
cauuggcuauuuaaaacuuguaa

SEQ ID NO: 1025358 - RNA, 17 nt, Homo sapiens
cauugguaagaaugagc

SEQ ID NO: 1025359 - RNA, 12 nt, Homo sapiens
cauugguguuga

SEQ ID NO: 1025360 - RNA, 21 nt, Homo sapiens
ccaccuacuuuucuuuccuca

SEQ ID NO: 1025361 - RNA, 24 nt, Homo sapiens
ccaccuagagguagguaggaucau

SEQ ID NO: 1025362 - RNA, 16 nt, Homo sapiens
ccaccucuccuuuggc

SEQ ID NO: 1025363 - RNA, 19 nt, Homo sapiens
ccaccugcuggagugaagg

SEQ ID NO: 1025364 - RNA, 17 nt, Homo sapiens
ccaccugggcauaucca

SEQ ID NO: 1025365 - RNA, 22 nt, Homo sapiens
ccacgagcuguuuacuagggau

SEQ ID NO: 1025366 - RNA, 23 nt, Homo sapiens
ccacggccacuggccaucuccac

SEQ ID NO: 1025367 - RNA, 19 nt, Homo sapiens
ccacgugggcaaacaggca

SEQ ID NO: 1025368 - RNA, 21 nt, Homo sapiens
ccacgugggcaaacaggcagu

SEQ ID NO: 1025369 - RNA, 12 nt, Homo sapiens
ccacuacugcua

SEQ ID NO: 1025370 - RNA, 18 nt, Homo sapiens
ccacuagacaaguccagc

SEQ ID NO: 1025371 - RNA, 16 nt, Homo sapiens
ccacuaggacucugag

SEQ ID NO: 1025372 - RNA, 13 nt, Homo sapiens
ccacuauggucau

SEQ ID NO: 1025373 - RNA, 23 nt, Homo sapiens
ccacucaccgaagccacuuucua

SEQ ID NO: 1025374 - RNA, 21 nt, Homo sapiens
ccacucaggcauuugacugaa

SEQ ID NO: 1025375 - RNA, 18 nt, Homo sapiens
ccacucccagugcuugca

SEQ ID NO: 1025376 - RNA, 13 nt, Homo sapiens
ccacuccuaauau

SEQ ID NO: 1025377 - RNA, 15 nt, Homo sapiens
ccacucugacuggca

SEQ ID NO: 1025378 - RNA, 23 nt, Homo sapiens
ccacucugccucugccugcauuc

SEQ ID NO: 1025379 - RNA, 20 nt, Homo sapiens
ccacucuguccugggaaaug

SEQ ID NO: 1025380 - RNA, 12 nt, Homo sapiens
ccacugauaucc

SEQ ID NO: 1025381 - RNA, 15 nt, Homo sapiens
ccacugccaaagaac

SEQ ID NO: 1025382 - RNA, 18 nt, Homo sapiens
ccacugccugcuggagaa

SEQ ID NO: 1025383 - RNA, 14 nt, Homo sapiens
ccacuggacuugag

SEQ ID NO: 1025384 - RNA, 17 nt, Homo sapiens
ccacuggccaucuccac

SEQ ID NO: 1025385 - RNA, 18 nt, Homo sapiens
ccacugugacuuugccca

SEQ ID NO: 1025386 - RNA, 19 nt, Homo sapiens
ccacuuaaaaaauguccau

SEQ ID NO: 1025387 - RNA, 16 nt, Homo sapiens
ccacuucuaaauagca

SEQ ID NO: 1025388 - RNA, 14 nt, Homo sapiens
ccacuugauuuugc

SEQ ID NO: 1025389 - RNA, 17 nt, Homo sapiens
ccacuuggcaucauuca

SEQ ID NO: 1025390 - RNA, 23 nt, Homo sapiens
ccacuuuguauagacaucugccc

SEQ ID NO: 1025391 - RNA, 18 nt, Homo sapiens
ccagaaauccaguuauuu

SEQ ID NO: 1025392 - RNA, 13 nt, Homo sapiens
ccagaaaugucua

SEQ ID NO: 1025393 - RNA, 18 nt, Homo sapiens
ccagaaccgcagaagccu

SEQ ID NO: 1025394 - RNA, 13 nt, Homo sapiens
ccagaaccuggag

SEQ ID NO: 1025395 - RNA, 16 nt, Homo sapiens
ccagaagaauauucag

SEQ ID NO: 1025396 - RNA, 21 nt, Homo sapiens
ccagaagaauauucaggacuu

SEQ ID NO: 1025397 - RNA, 13 nt, Homo sapiens
ccagaagauucua

SEQ ID NO: 1025398 - RNA, 15 nt, Homo sapiens
ccagaagauucuauc

SEQ ID NO: 1025399 - RNA, 22 nt, Homo sapiens
ccagaaggcagggaaaggcucu

SEQ ID NO: 1025400 - RNA, 17 nt, Homo sapiens
ccagaagggggccauga

SEQ ID NO: 1025401 - RNA, 17 nt, Homo sapiens
ccagaauaacuagcacc

SEQ ID NO: 1025402 - RNA, 21 nt, Homo sapiens
ccagacagacaacacugggaa

SEQ ID NO: 1025403 - RNA, 22 nt, Homo sapiens
ccagacagcucccucugccuga

SEQ ID NO: 1025404 - RNA, 11 nt, Homo sapiens
ccagacagggu

SEQ ID NO: 1025405 - RNA, 16 nt, Homo sapiens
ccagacugaacuuacc

SEQ ID NO: 1025406 - RNA, 16 nt, Homo sapiens
ccagacuguguauuca

SEQ ID NO: 1025407 - RNA, 10 nt, Homo sapiens
ccagacuguu

SEQ ID NO: 1025408 - RNA, 19 nt, Homo sapiens
ccagagaaccugcuuuacu

SEQ ID NO: 1025409 - RNA, 14 nt, Homo sapiens
ccagagacugggac

SEQ ID NO: 1025410 - RNA, 18 nt, Homo sapiens
ccagagagcaacucugag

SEQ ID NO: 1025411 - RNA, 20 nt, Homo sapiens
ccagagagccuggugcugcu

SEQ ID NO: 1025412 - RNA, 14 nt, Homo sapiens
ccagagcaaaauaa

SEQ ID NO: 1025413 - RNA, 12 nt, Homo sapiens
ccagagcacugg

SEQ ID NO: 1025414 - RNA, 17 nt, Homo sapiens
ccagagcagaugcagag

SEQ ID NO: 1025415 - RNA, 15 nt, Homo sapiens
ccagagcauuuccaa

SEQ ID NO: 1025416 - RNA, 18 nt, Homo sapiens
ccagagcguguagugaau

SEQ ID NO: 1025417 - RNA, 16 nt, Homo sapiens
ccagaggaacugucca

SEQ ID NO: 1025418 - RNA, 19 nt, Homo sapiens
ccagaggcuauuauuuuca

SEQ ID NO: 1025419 - RNA, 18 nt, Homo sapiens
ccagaggcucagcacuuu

SEQ ID NO: 1025420 - RNA, 23 nt, Homo sapiens
ccagaguccuuuccaaggcuucu

SEQ ID NO: 1025421 - RNA, 12 nt, Homo sapiens
ccagauaccagc

SEQ ID NO: 1025422 - RNA, 13 nt, Homo sapiens
ccagauaccagcc

SEQ ID NO: 1025423 - RNA, 22 nt, Homo sapiens
ccagauccuucaaagagucaua

SEQ ID NO: 1025424 - RNA, 17 nt, Homo sapiens
ccagaugcugauguuca

SEQ ID NO: 1025425 - RNA, 15 nt, Homo sapiens
ccagauggacuccag

SEQ ID NO: 1025426 - RNA, 23 nt, Homo sapiens
ccagaugggggaaagcacaggug

SEQ ID NO: 1025427 - RNA, 16 nt, Homo sapiens
ccagauucuaccacac

SEQ ID NO: 1025428 - RNA, 12 nt, Homo sapiens
ccagcaaagagu

SEQ ID NO: 1025429 - RNA, 20 nt, Homo sapiens
ccagcaaugauguccagaag

SEQ ID NO: 1025430 - RNA, 20 nt, Homo sapiens
ccagcacuuugggaggccaa

SEQ ID NO: 1025431 - RNA, 17 nt, Homo sapiens
ccagcagaucccagcuc

SEQ ID NO: 1025432 - RNA, 19 nt, Homo sapiens
ccagcagaucccagcucac

SEQ ID NO: 1025433 - RNA, 14 nt, Homo sapiens
ccagcagcuggaau

SEQ ID NO: 1025434 - RNA, 15 nt, Homo sapiens
ccagcaggacaguga

SEQ ID NO: 1025435 - RNA, 18 nt, Homo sapiens
ccagcagggccucaaagu

SEQ ID NO: 1025436 - RNA, 19 nt, Homo sapiens
ccagcaucccuugaccagg

SEQ ID NO: 1025437 - RNA, 16 nt, Homo sapiens
ccagcauuuaaccaac

SEQ ID NO: 1025438 - RNA, 14 nt, Homo sapiens
ccagccucaucucu

SEQ ID NO: 1025439 - RNA, 15 nt, Homo sapiens
ccagccuccugcuaa

SEQ ID NO: 1025440 - RNA, 20 nt, Homo sapiens
ccagccugggcagccaggcu

SEQ ID NO: 1025441 - RNA, 17 nt, Homo sapiens
ccagcuaacucugaccu

SEQ ID NO: 1025442 - RNA, 15 nt, Homo sapiens
ccagcuacucaggag

SEQ ID NO: 1025443 - RNA, 15 nt, Homo sapiens
ccagcuacucgggag

SEQ ID NO: 1025444 - RNA, 21 nt, Homo sapiens
ccagcuacuugggaggcugag

SEQ ID NO: 1025445 - RNA, 16 nt, Homo sapiens
ccagcuauuugggagg

SEQ ID NO: 1025446 - RNA, 19 nt, Homo sapiens
ccagcucagggcucuuucc

SEQ ID NO: 1025447 - RNA, 21 nt, Homo sapiens
ccagcucagucccaucagaga

SEQ ID NO: 1025448 - RNA, 17 nt, Homo sapiens
ccagcucccauguacca

SEQ ID NO: 1025449 - RNA, 15 nt, Homo sapiens
ccagcucugguccau

SEQ ID NO: 1025450 - RNA, 22 nt, Homo sapiens
ccagcucuucuccccaggugug

SEQ ID NO: 1025451 - RNA, 16 nt, Homo sapiens
ccaggaaccucagggc

SEQ ID NO: 1025452 - RNA, 16 nt, Homo sapiens
ccaggaaggacugugc

SEQ ID NO: 1025453 - RNA, 13 nt, Homo sapiens
ccaggaaugccuc

SEQ ID NO: 1025454 - RNA, 15 nt, Homo sapiens
ccaggacaguggaga

SEQ ID NO: 1025455 - RNA, 17 nt, Homo sapiens
ccaggagacucugggaa

SEQ ID NO: 1025456 - RNA, 21 nt, Homo sapiens
ccaggagauggaaguugcagu

SEQ ID NO: 1025457 - RNA, 22 nt, Homo sapiens
ccaggaggcagcuguugcagug

SEQ ID NO: 1025458 - RNA, 22 nt, Homo sapiens
ccaggagguggagguugcagug

SEQ ID NO: 1025459 - RNA, 22 nt, Homo sapiens
ccaggauccagaagggguuugg

SEQ ID NO: 1025460 - RNA, 16 nt, Homo sapiens
ccaggauggcacuguu

SEQ ID NO: 1025461 - RNA, 18 nt, Homo sapiens
ccaggcaccucacagaaa

SEQ ID NO: 1025462 - RNA, 16 nt, Homo sapiens
ccaggcaccugcauuu

SEQ ID NO: 1025463 - RNA, 14 nt, Homo sapiens
ccaggcagauccca

SEQ ID NO: 1025464 - RNA, 20 nt, Homo sapiens
ccaggcaggcugugcgcuga

SEQ ID NO: 1025465 - RNA, 15 nt, Homo sapiens
ccaggccaccuccag

SEQ ID NO: 1025466 - RNA, 17 nt, Homo sapiens
ccaggccaguaagggaa

SEQ ID NO: 1025467 - RNA, 15 nt, Homo sapiens
ccaggccguccuccc

SEQ ID NO: 1025468 - RNA, 16 nt, Homo sapiens
ccaggccucuuggcag

SEQ ID NO: 1025469 - RNA, 18 nt, Homo sapiens
ccaggcgaugugcaagug

SEQ ID NO: 1025470 - RNA, 21 nt, Homo sapiens
ccaggcuggacgugguggcuc

SEQ ID NO: 1025471 - RNA, 17 nt, Homo sapiens
ccaggcuggaguacagu

SEQ ID NO: 1025472 - RNA, 19 nt, Homo sapiens
ccaggcuggagugcaaugc

SEQ ID NO: 1025473 - RNA, 19 nt, Homo sapiens
ccagggagacagagcucac

SEQ ID NO: 1025474 - RNA, 14 nt, Homo sapiens
ccagggagucagag

SEQ ID NO: 1025475 - RNA, 18 nt, Homo sapiens
ccagggaugacauguccc

SEQ ID NO: 1025476 - RNA, 23 nt, Homo sapiens
ccagggcucuaaugugucucuca

SEQ ID NO: 1025477 - RNA, 16 nt, Homo sapiens
ccaggguccacaggaa

SEQ ID NO: 1025478 - RNA, 18 nt, Homo sapiens
ccaggguugaggggacca

SEQ ID NO: 1025479 - RNA, 22 nt, Homo sapiens
ccaggguugaucacacucuggg

SEQ ID NO: 1025480 - RNA, 11 nt, Homo sapiens
ccagguccuuu

SEQ ID NO: 1025481 - RNA, 12 nt, Homo sapiens
ccaggugccuug

SEQ ID NO: 1025482 - RNA, 14 nt, Homo sapiens
ccagguguucuaca

SEQ ID NO: 1025483 - RNA, 19 nt, Homo sapiens
ccagguguucuacacucau

SEQ ID NO: 1025484 - RNA, 20 nt, Homo sapiens
ccaguaaaugggggugcauu

SEQ ID NO: 1025485 - RNA, 22 nt, Homo sapiens
ccagucacugucccucaaauga

SEQ ID NO: 1025486 - RNA, 17 nt, Homo sapiens
ccagucacuuugccaga

SEQ ID NO: 1025487 - RNA, 16 nt, Homo sapiens
ccaguccuagcugcac

SEQ ID NO: 1025488 - RNA, 13 nt, Homo sapiens
ccagucucuggca

SEQ ID NO: 1025489 - RNA, 20 nt, Homo sapiens
ccagugaggcucugcccuug

SEQ ID NO: 1025490 - RNA, 15 nt, Homo sapiens
ccagugcaacagcac

SEQ ID NO: 1025491 - RNA, 17 nt, Homo sapiens
ccaguggaacagucuuc

SEQ ID NO: 1025492 - RNA, 20 nt, Homo sapiens
ccaguggaacagucuuccca

SEQ ID NO: 1025493 - RNA, 18 nt, Homo sapiens
ccaguguuauuaaugaca

SEQ ID NO: 1025494 - RNA, 16 nt, Homo sapiens
ccauaaacacccauga

SEQ ID NO: 1025495 - RNA, 13 nt, Homo sapiens
ccauaaucacuca

SEQ ID NO: 1025496 - RNA, 18 nt, Homo sapiens
ccauacuuugucugaaaa

SEQ ID NO: 1025497 - RNA, 16 nt, Homo sapiens
ccauagagacuuugug

SEQ ID NO: 1025498 - RNA, 17 nt, Homo sapiens
ccauagcuccuucucuc

SEQ ID NO: 1025499 - RNA, 22 nt, Homo sapiens
ccauaggaggccaacccaaaau

SEQ ID NO: 1025500 - RNA, 22 nt, Homo sapiens
ccauagucgugccuguuugcuu

SEQ ID NO: 1025501 - RNA, 23 nt, Homo sapiens
ccauaguggagagaacugaauaa

SEQ ID NO: 1025502 - RNA, 18 nt, Homo sapiens
ccauauacucuucaagga

SEQ ID NO: 1025503 - RNA, 14 nt, Homo sapiens
ccauaugugggugu

SEQ ID NO: 1025504 - RNA, 14 nt, Homo sapiens
ccaucaacaagucu

SEQ ID NO: 1025505 - RNA, 16 nt, Homo sapiens
ccuguugcacccagcc

SEQ ID NO: 1025506 - RNA, 18 nt, Homo sapiens
ccuguuuucgcaccuacc

SEQ ID NO: 1025507 - RNA, 19 nt, Homo sapiens
ccuguuuugagcuuaaaaa

SEQ ID NO: 1025508 - RNA, 22 nt, Homo sapiens
ccuuaaagucaguaacuuaccc

SEQ ID NO: 1025509 - RNA, 16 nt, Homo sapiens
ccuuacaaguuagaaa

SEQ ID NO: 1025510 - RNA, 14 nt, Homo sapiens
ccuuacaguaggag

SEQ ID NO: 1025511 - RNA, 23 nt, Homo sapiens
ccuuagauguucuaagucuuucc

SEQ ID NO: 1025512 - RNA, 20 nt, Homo sapiens
ccuuagcagggaaacagcua

SEQ ID NO: 1025513 - RNA, 21 nt, Homo sapiens
ccuuagcucccuguucuugga

SEQ ID NO: 1025514 - RNA, 23 nt, Homo sapiens
ccuuaguguuuggguauauucau

SEQ ID NO: 1025515 - RNA, 14 nt, Homo sapiens
ccuuauuguaccuc

SEQ ID NO: 1025516 - RNA, 16 nt, Homo sapiens
ccuuauuguaccucuc

SEQ ID NO: 1025517 - RNA, 19 nt, Homo sapiens
ccuucaaguuagcucagga

SEQ ID NO: 1025518 - RNA, 22 nt, Homo sapiens
ccuucaccccaguggccacuca

SEQ ID NO: 1025519 - RNA, 12 nt, Homo sapiens
ccuucacuuuac

SEQ ID NO: 1025520 - RNA, 14 nt, Homo sapiens
ccuucagauuugcc

SEQ ID NO: 1025521 - RNA, 14 nt, Homo sapiens
ccuucaucuggaac

SEQ ID NO: 1025522 - RNA, 17 nt, Homo sapiens
ccuucaugaucaucaca

SEQ ID NO: 1025523 - RNA, 21 nt, Homo sapiens
ccuuccauagccuaaucccug

SEQ ID NO: 1025524 - RNA, 20 nt, Homo sapiens
ccuuccccagccucuucuag

SEQ ID NO: 1025525 - RNA, 18 nt, Homo sapiens
ccuuccugccaccaguca

SEQ ID NO: 1025526 - RNA, 14 nt, Homo sapiens
ccuuccugucuucc

SEQ ID NO: 1025527 - RNA, 19 nt, Homo sapiens
ccuucucaccccuuugcug

SEQ ID NO: 1025528 - RNA, 14 nt, Homo sapiens
ccuucuccaucucu

SEQ ID NO: 1025529 - RNA, 18 nt, Homo sapiens
ccuucucccacacugcua

SEQ ID NO: 1025530 - RNA, 18 nt, Homo sapiens
ccuucucgaccacgggaa

SEQ ID NO: 1025531 - RNA, 19 nt, Homo sapiens
ccuucucucuuacauugaa

SEQ ID NO: 1025532 - RNA, 18 nt, Homo sapiens
ccuucugaggacauucca

SEQ ID NO: 1025533 - RNA, 17 nt, Homo sapiens
ccuucugaggagaggca

SEQ ID NO: 1025534 - RNA, 23 nt, Homo sapiens
ccuucugauugauggugcuauuu

SEQ ID NO: 1025535 - RNA, 20 nt, Homo sapiens
ccuucuuugauaauguuaaa

SEQ ID NO: 1025536 - RNA, 16 nt, Homo sapiens
ccuugaaccacuuccc

SEQ ID NO: 1025537 - RNA, 13 nt, Homo sapiens
ccuugaagccacu

SEQ ID NO: 1025538 - RNA, 23 nt, Homo sapiens
ccuugacauuguagagcuucugg

SEQ ID NO: 1025539 - RNA, 17 nt, Homo sapiens
ccuugaccagcagaucc

SEQ ID NO: 1025540 - RNA, 16 nt, Homo sapiens
ccuugaggaggggcag

SEQ ID NO: 1025541 - RNA, 13 nt, Homo sapiens
ccuugagucaaaa

SEQ ID NO: 1025542 - RNA, 15 nt, Homo sapiens
ccuugccugcacaaa

SEQ ID NO: 1025543 - RNA, 17 nt, Homo sapiens
ccuugcuaaaagauuau

SEQ ID NO: 1025544 - RNA, 21 nt, Homo sapiens
ccuugcuggacggggacuggg

SEQ ID NO: 1025545 - RNA, 23 nt, Homo sapiens
ccuugcuggacggggacugggga

SEQ ID NO: 1025546 - RNA, 23 nt, Homo sapiens
ccuuggagcuguaaaccagagag

SEQ ID NO: 1025547 - RNA, 20 nt, Homo sapiens
ccuuggcaugccuuccagca

SEQ ID NO: 1025548 - RNA, 19 nt, Homo sapiens
ccuugguucccccacugau

SEQ ID NO: 1025549 - RNA, 18 nt, Homo sapiens
ccuuguccccugccugug

SEQ ID NO: 1025550 - RNA, 15 nt, Homo sapiens
ccuugucgacaaaga

SEQ ID NO: 1025551 - RNA, 15 nt, Homo sapiens
ccuugugaaccccaa

SEQ ID NO: 1025552 - RNA, 19 nt, Homo sapiens
ccuugugaacccugcaaua

SEQ ID NO: 1025553 - RNA, 20 nt, Homo sapiens
ccuugugaacccugcaauaa

SEQ ID NO: 1025554 - RNA, 16 nt, Homo sapiens
ccuugugccuggcuca

SEQ ID NO: 1025555 - RNA, 23 nt, Homo sapiens
ccuuguuauuucucagacuuugg

SEQ ID NO: 1025556 - RNA, 20 nt, Homo sapiens
ccuuuaaauccuuccaugaa

SEQ ID NO: 1025557 - RNA, 17 nt, Homo sapiens
ccuuuaaaucugugaug

SEQ ID NO: 1025558 - RNA, 15 nt, Homo sapiens
ccuuuagugaucaca

SEQ ID NO: 1025559 - RNA, 16 nt, Homo sapiens
ccuuucaaauuucaca

SEQ ID NO: 1025560 - RNA, 16 nt, Homo sapiens
ccuuucaccacaugug

SEQ ID NO: 1025561 - RNA, 20 nt, Homo sapiens
ccuuucaccacaugugcaca

SEQ ID NO: 1025562 - RNA, 14 nt, Homo sapiens
ccuuucauuuacug

SEQ ID NO: 1025563 - RNA, 15 nt, Homo sapiens
ccuuucauuuacugu

SEQ ID NO: 1025564 - RNA, 17 nt, Homo sapiens
ccuuucgacuugcauuu

SEQ ID NO: 1025565 - RNA, 21 nt, Homo sapiens
ccuuucucagccacaaaauaa

SEQ ID NO: 1025566 - RNA, 21 nt, Homo sapiens
ccuuucucuccagccugacuu

SEQ ID NO: 1025567 - RNA, 22 nt, Homo sapiens
ccuuucuuucuaacuccaguga

SEQ ID NO: 1025568 - RNA, 19 nt, Homo sapiens
ccuuugaauaaaaaugcac

SEQ ID NO: 1025569 - RNA, 23 nt, Homo sapiens
ccuuugagcccacaaagccuuau

SEQ ID NO: 1025570 - RNA, 16 nt, Homo sapiens
ccuuugaucaguauaa

SEQ ID NO: 1025571 - RNA, 21 nt, Homo sapiens
ccuuugcucuugggaagacca

SEQ ID NO: 1025572 - RNA, 18 nt, Homo sapiens
ccuuuggaugcacuuuau

SEQ ID NO: 1025573 - RNA, 19 nt, Homo sapiens
ccuuuggauugacucugca

SEQ ID NO: 1025574 - RNA, 18 nt, Homo sapiens
ccuuugggaggcugaggc

SEQ ID NO: 1025575 - RNA, 24 nt, Homo sapiens
ccuuugggcccagggacaccagcc

SEQ ID NO: 1025576 - RNA, 16 nt, Homo sapiens
ccuuuggggacuuuuc

SEQ ID NO: 1025577 - RNA, 21 nt, Homo sapiens
ccuuuguauuuuuacuuuuaa

SEQ ID NO: 1025578 - RNA, 14 nt, Homo sapiens
ccuuugucccagaa

SEQ ID NO: 1025579 - RNA, 18 nt, Homo sapiens
ccuuugugguuacaguuu

SEQ ID NO: 1025580 - RNA, 23 nt, Homo sapiens
ccuuuuaacaccugauguguaca

SEQ ID NO: 1025581 - RNA, 23 nt, Homo sapiens
ccuuuuauuuuuuaagguaacaa

SEQ ID NO: 1025582 - RNA, 16 nt, Homo sapiens
ccuuuuggcacugaga

SEQ ID NO: 1025583 - RNA, 16 nt, Homo sapiens
ccuuuuuuguuauuau

SEQ ID NO: 1025584 - RNA, 15 nt, Homo sapiens
cgaaaccccaucucu

SEQ ID NO: 1025585 - RNA, 19 nt, Homo sapiens
cgaaacuccauugagucau

SEQ ID NO: 1025586 - RNA, 18 nt, Homo sapiens
cgaaauaacaauguuaag

SEQ ID NO: 1025587 - RNA, 16 nt, Homo sapiens
cgaacaauucauauau

SEQ ID NO: 1025588 - RNA, 21 nt, Homo sapiens
cgaacaauucauauauuugaa

SEQ ID NO: 1025589 - RNA, 15 nt, Homo sapiens
cgaacauucuuugcc

SEQ ID NO: 1025590 - RNA, 22 nt, Homo sapiens
cgaacucaucccuguuccucaa

SEQ ID NO: 1025591 - RNA, 14 nt, Homo sapiens
cgaaguguugcaug

SEQ ID NO: 1025592 - RNA, 17 nt, Homo sapiens
cgaauuaauuaccuggc

SEQ ID NO: 1025593 - RNA, 12 nt, Homo sapiens
cgacaguuuucc

SEQ ID NO: 1025594 - RNA, 13 nt, Homo sapiens
cgaccccaccacc

SEQ ID NO: 1025595 - RNA, 20 nt, Homo sapiens
cgaccccgucacagccucaa

SEQ ID NO: 1025596 - RNA, 15 nt, Homo sapiens
cgagacuccgucuca

SEQ ID NO: 1025597 - RNA, 19 nt, Homo sapiens
cgagacuccgucucaagga

SEQ ID NO: 1025598 - RNA, 14 nt, Homo sapiens
cgagaucaagagau

SEQ ID NO: 1025599 - RNA, 17 nt, Homo sapiens
cgagaucacgccacugc

SEQ ID NO: 1025600 - RNA, 17 nt, Homo sapiens
cgagcaggcuacuguca

SEQ ID NO: 1025601 - RNA, 14 nt, Homo sapiens
cgagccucugucac

SEQ ID NO: 1025602 - RNA, 17 nt, Homo sapiens
cgagccuggcuccaaac

SEQ ID NO: 1025603 - RNA, 22 nt, Homo sapiens
cgagcuaugaucgcgccacuac

SEQ ID NO: 1025604 - RNA, 20 nt, Homo sapiens
cgagcucccagcuccagcuu

SEQ ID NO: 1025605 - RNA, 19 nt, Homo sapiens
cgaggacagggaggugacc

SEQ ID NO: 1025606 - RNA, 17 nt, Homo sapiens
cgaggcggaucuuugga

SEQ ID NO: 1025607 - RNA, 15 nt, Homo sapiens
cgaguaacugagauu

SEQ ID NO: 1025608 - RNA, 13 nt, Homo sapiens
cgaguauguguuu

SEQ ID NO: 1025609 - RNA, 17 nt, Homo sapiens
cgaguuguggaaagccu

SEQ ID NO: 1025610 - RNA, 14 nt, Homo sapiens
cgauccccugucac

SEQ ID NO: 1025611 - RNA, 12 nt, Homo sapiens
cgaucuggguuc

SEQ ID NO: 1025612 - RNA, 13 nt, Homo sapiens
cgaugaaacugga

SEQ ID NO: 1025613 - RNA, 18 nt, Homo sapiens
cgauuaauaacaggcaaa

SEQ ID NO: 1025614 - RNA, 20 nt, Homo sapiens
cgcaaagggcugaaagccau

SEQ ID NO: 1025615 - RNA, 14 nt, Homo sapiens
cgcaacuggcucaa

SEQ ID NO: 1025616 - RNA, 16 nt, Homo sapiens
cgcaaugugacuuaau

SEQ ID NO: 1025617 - RNA, 20 nt, Homo sapiens
cgcacaaggcugaccaagag

SEQ ID NO: 1025618 - RNA, 18 nt, Homo sapiens
cgcaccuaccaucaggga

SEQ ID NO: 1025619 - RNA, 11 nt, Homo sapiens
cgcaccugccc

SEQ ID NO: 1025620 - RNA, 12 nt, Homo sapiens
cgcagaccccac

SEQ ID NO: 1025621 - RNA, 22 nt, Homo sapiens
cgcagcuguaaggcacgcugga

SEQ ID NO: 1025622 - RNA, 18 nt, Homo sapiens
cgcagcuucagcaucucc

SEQ ID NO: 1025623 - RNA, 19 nt, Homo sapiens
cgcaucaaaagacaauucu

SEQ ID NO: 1025624 - RNA, 15 nt, Homo sapiens
cgcaucucagugcag

SEQ ID NO: 1025625 - RNA, 16 nt, Homo sapiens
cgcaucucagugcagg

SEQ ID NO: 1025626 - RNA, 20 nt, Homo sapiens
cgcaugcccucaaucccagc

SEQ ID NO: 1025627 - RNA, 16 nt, Homo sapiens
cgccaaggcuggagug

SEQ ID NO: 1025628 - RNA, 20 nt, Homo sapiens
cgccaccccuccuuccuuga

SEQ ID NO: 1025629 - RNA, 19 nt, Homo sapiens
cgcccagcugcaccugcca

SEQ ID NO: 1025630 - RNA, 19 nt, Homo sapiens
cgcccucacugcaggcucc

SEQ ID NO: 1025631 - RNA, 15 nt, Homo sapiens
cgccgccggagucca

SEQ ID NO: 1025632 - RNA, 13 nt, Homo sapiens
cgccugagcucac

SEQ ID NO: 1025633 - RNA, 16 nt, Homo sapiens
cgccuggcagaacuga

SEQ ID NO: 1025634 - RNA, 22 nt, Homo sapiens
cgccuguaaucccagcacuuug

SEQ ID NO: 1025635 - RNA, 17 nt, Homo sapiens
cgccuugccuccucacc

SEQ ID NO: 1025636 - RNA, 11 nt, Homo sapiens
cgcgugcacac

SEQ ID NO: 1025637 - RNA, 18 nt, Homo sapiens
cgcuacccacuucuaaau

SEQ ID NO: 1025638 - RNA, 16 nt, Homo sapiens
cgcugaagauggcauc

SEQ ID NO: 1025639 - RNA, 15 nt, Homo sapiens
cgcuggagugcagug

SEQ ID NO: 1025640 - RNA, 21 nt, Homo sapiens
cgcuucugcuuaaucugagaa

SEQ ID NO: 1025641 - RNA, 13 nt, Homo sapiens
cgcuugcuuuagc

SEQ ID NO: 1025642 - RNA, 15 nt, Homo sapiens
cgcuuuguugcccag

SEQ ID NO: 1025643 - RNA, 18 nt, Homo sapiens
cggaagcccuugccugaa

SEQ ID NO: 1025644 - RNA, 20 nt, Homo sapiens
cggaaugaaccacaucuugc

SEQ ID NO: 1025645 - RNA, 15 nt, Homo sapiens
cggaauugcucuccc

SEQ ID NO: 1025646 - RNA, 16 nt, Homo sapiens
cggacccaucuuugcu

SEQ ID NO: 1025647 - RNA, 17 nt, Homo sapiens
cggagaacaaaugugaa

SEQ ID NO: 1025648 - RNA, 14 nt, Homo sapiens
cggagaguacagug

SEQ ID NO: 1025649 - RNA, 15 nt, Homo sapiens
gacccugggaccaca

SEQ ID NO: 1025650 - RNA, 18 nt, Homo sapiens
gaccgcccccuccucuag

SEQ ID NO: 1025651 - RNA, 23 nt, Homo sapiens
gaccgccccucaccaacccagag

SEQ ID NO: 1025652 - RNA, 13 nt, Homo sapiens
gaccuaaaauaaa

SEQ ID NO: 1025653 - RNA, 20 nt, Homo sapiens
gaccuaaaauuugcccuccc

SEQ ID NO: 1025654 - RNA, 15 nt, Homo sapiens
gaccuagagacuuca

SEQ ID NO: 1025655 - RNA, 15 nt, Homo sapiens
gaccuaggauuucau

SEQ ID NO: 1025656 - RNA, 17 nt, Homo sapiens
gaccuaugagcacauag

SEQ ID NO: 1025657 - RNA, 14 nt, Homo sapiens
gaccucagccugug

SEQ ID NO: 1025658 - RNA, 20 nt, Homo sapiens
gaccucaggugauccaccca

SEQ ID NO: 1025659 - RNA, 22 nt, Homo sapiens
gaccucaggugauccacccacc

SEQ ID NO: 1025660 - RNA, 16 nt, Homo sapiens
gaccucccacugcccc

SEQ ID NO: 1025661 - RNA, 21 nt, Homo sapiens
gaccuccccugaggcucaggg

SEQ ID NO: 1025662 - RNA, 14 nt, Homo sapiens
gaccugcaggccaa

SEQ ID NO: 1025663 - RNA, 19 nt, Homo sapiens
gaccugccaggcacacuga

SEQ ID NO: 1025664 - RNA, 12 nt, Homo sapiens
gaccuggcacug

SEQ ID NO: 1025665 - RNA, 14 nt, Homo sapiens
gaccuguugggagu

SEQ ID NO: 1025666 - RNA, 19 nt, Homo sapiens
gaccuuaucugugcgugaa

SEQ ID NO: 1025667 - RNA, 14 nt, Homo sapiens
gaccuucuccuuca

SEQ ID NO: 1025668 - RNA, 15 nt, Homo sapiens
gaccuuggcagccca

SEQ ID NO: 1025669 - RNA, 20 nt, Homo sapiens
gacgacucugaccucuuggc

SEQ ID NO: 1025670 - RNA, 22 nt, Homo sapiens
gacgccaucccagccccaauga

SEQ ID NO: 1025671 - RNA, 20 nt, Homo sapiens
gacggaggccuacucuucca

SEQ ID NO: 1025672 - RNA, 21 nt, Homo sapiens
gacgggaccgggccgcuagau

SEQ ID NO: 1025673 - RNA, 22 nt, Homo sapiens
gacgggcaaaauaaagugacag

SEQ ID NO: 1025674 - RNA, 16 nt, Homo sapiens
gacggucccacacugg

SEQ ID NO: 1025675 - RNA, 15 nt, Homo sapiens
gacguaaucuccaca

SEQ ID NO: 1025676 - RNA, 18 nt, Homo sapiens
gacgugauuuugcuguag

SEQ ID NO: 1025677 - RNA, 19 nt, Homo sapiens
gacgugauuuugcuguaga

SEQ ID NO: 1025678 - RNA, 18 nt, Homo sapiens
gacuaagccuaccugcuc

SEQ ID NO: 1025679 - RNA, 19 nt, Homo sapiens
gacuaaguguaccagagaa

SEQ ID NO: 1025680 - RNA, 13 nt, Homo sapiens
gacuaauaauacu

SEQ ID NO: 1025681 - RNA, 15 nt, Homo sapiens
gacuaggagcacugu

SEQ ID NO: 1025682 - RNA, 18 nt, Homo sapiens
gacuagugacacauugua

SEQ ID NO: 1025683 - RNA, 16 nt, Homo sapiens
gacucaaaacccaucu

SEQ ID NO: 1025684 - RNA, 13 nt, Homo sapiens
gacucaaacugcc

SEQ ID NO: 1025685 - RNA, 18 nt, Homo sapiens
gacucaaguccuuaccuc

SEQ ID NO: 1025686 - RNA, 17 nt, Homo sapiens
gacucaauaaaaucaug

SEQ ID NO: 1025687 - RNA, 17 nt, Homo sapiens
gacucaaugcacugaca

SEQ ID NO: 1025688 - RNA, 18 nt, Homo sapiens
gacucacaagaagaccag

SEQ ID NO: 1025689 - RNA, 16 nt, Homo sapiens
gacucaggacaucccc

SEQ ID NO: 1025690 - RNA, 19 nt, Homo sapiens
gacucagggccccagcacu

SEQ ID NO: 1025691 - RNA, 18 nt, Homo sapiens
gacucauacaccagguca

SEQ ID NO: 1025692 - RNA, 18 nt, Homo sapiens
gacucauggccgggcuga

SEQ ID NO: 1025693 - RNA, 17 nt, Homo sapiens
gacucauuacuacucag

SEQ ID NO: 1025694 - RNA, 21 nt, Homo sapiens
gacuccuaggcaggacaugcu

SEQ ID NO: 1025695 - RNA, 15 nt, Homo sapiens
gacuccuccuccaaa

SEQ ID NO: 1025696 - RNA, 23 nt, Homo sapiens
gacucuccagaaagcucaucuca

SEQ ID NO: 1025697 - RNA, 14 nt, Homo sapiens
gacucugcacaugu

SEQ ID NO: 1025698 - RNA, 18 nt, Homo sapiens
gacucugcacaugucuug

SEQ ID NO: 1025699 - RNA, 12 nt, Homo sapiens
gacucuugcaau

SEQ ID NO: 1025700 - RNA, 15 nt, Homo sapiens
gacucuugcucuuuc

SEQ ID NO: 1025701 - RNA, 20 nt, Homo sapiens
gacucuuguuuucaguuuca

SEQ ID NO: 1025702 - RNA, 17 nt, Homo sapiens
gacucuuuggacacuca

SEQ ID NO: 1025703 - RNA, 12 nt, Homo sapiens
gacugagcucaa

SEQ ID NO: 1025704 - RNA, 22 nt, Homo sapiens
gacugaguacguugugcauuug

SEQ ID NO: 1025705 - RNA, 17 nt, Homo sapiens
gacugccaugcuagaca

SEQ ID NO: 1025706 - RNA, 19 nt, Homo sapiens
gacugcuucaucugcugua

SEQ ID NO: 1025707 - RNA, 17 nt, Homo sapiens
gacuggauucgugacaa

SEQ ID NO: 1025708 - RNA, 19 nt, Homo sapiens
gacugucaguaggcuggaa

SEQ ID NO: 1025709 - RNA, 13 nt, Homo sapiens
gacuguugcucaa

SEQ ID NO: 1025710 - RNA, 12 nt, Homo sapiens
gacuuaucaaca

SEQ ID NO: 1025711 - RNA, 19 nt, Homo sapiens
gacuuccauuugcuuuguc

SEQ ID NO: 1025712 - RNA, 16 nt, Homo sapiens
gacuucuggcagggaa

SEQ ID NO: 1025713 - RNA, 17 nt, Homo sapiens
gacuucugucuucacaa

SEQ ID NO: 1025714 - RNA, 12 nt, Homo sapiens
gacuugaaccca

SEQ ID NO: 1025715 - RNA, 16 nt, Homo sapiens
gacuugagcuuggcag

SEQ ID NO: 1025716 - RNA, 20 nt, Homo sapiens
gacuuggucugauuucagga

SEQ ID NO: 1025717 - RNA, 20 nt, Homo sapiens
gacuuguuuuaugcucaggg

SEQ ID NO: 1025718 - RNA, 15 nt, Homo sapiens
gacuuugaagaccag

SEQ ID NO: 1025719 - RNA, 20 nt, Homo sapiens
gacuuuuuuuaaauaguaaa

SEQ ID NO: 1025720 - RNA, 16 nt, Homo sapiens
gagaaaaaaacuucuu

SEQ ID NO: 1025721 - RNA, 17 nt, Homo sapiens
gagaaaagccucuccag

SEQ ID NO: 1025722 - RNA, 21 nt, Homo sapiens
gagaaacaaauaauuuguaua

SEQ ID NO: 1025723 - RNA, 23 nt, Homo sapiens
gagaaacagagacaggcccaaga

SEQ ID NO: 1025724 - RNA, 13 nt, Homo sapiens
gagaaagcacuga

SEQ ID NO: 1025725 - RNA, 19 nt, Homo sapiens
gagaaaucuauagaacuga

SEQ ID NO: 1025726 - RNA, 18 nt, Homo sapiens
gagaaauuccuugauuca

SEQ ID NO: 1025727 - RNA, 13 nt, Homo sapiens
gagaaccucaggc

SEQ ID NO: 1025728 - RNA, 21 nt, Homo sapiens
gagaaccuugugccuggcuca

SEQ ID NO: 1025729 - RNA, 14 nt, Homo sapiens
gagaagcucaccca

SEQ ID NO: 1025730 - RNA, 14 nt, Homo sapiens
gagaaguuaagcaa

SEQ ID NO: 1025731 - RNA, 12 nt, Homo sapiens
gagaaucacuug

SEQ ID NO: 1025732 - RNA, 23 nt, Homo sapiens
gagaauguuagaggaucccucuc

SEQ ID NO: 1025733 - RNA, 16 nt, Homo sapiens
gagaauguuguauuca

SEQ ID NO: 1025734 - RNA, 19 nt, Homo sapiens
gagacaagggcaucaucua

SEQ ID NO: 1025735 - RNA, 15 nt, Homo sapiens
gagacaggcccaaga

SEQ ID NO: 1025736 - RNA, 12 nt, Homo sapiens
gagacagucacc

SEQ ID NO: 1025737 - RNA, 19 nt, Homo sapiens
gagacaugagcauggcuga

SEQ ID NO: 1025738 - RNA, 12 nt, Homo sapiens
gagacauggcuu

SEQ ID NO: 1025739 - RNA, 19 nt, Homo sapiens
gagacauggcuugccacag

SEQ ID NO: 1025740 - RNA, 22 nt, Homo sapiens
gagaccaagacucugaaaucuc

SEQ ID NO: 1025741 - RNA, 22 nt, Homo sapiens
gagaccaggcaaagcaagugau

SEQ ID NO: 1025742 - RNA, 23 nt, Homo sapiens
gagacccccacaccucaguuccc

SEQ ID NO: 1025743 - RNA, 20 nt, Homo sapiens
gagacuccgucacaacaaca

SEQ ID NO: 1025744 - RNA, 17 nt, Homo sapiens
gagacuccgucucaagg

SEQ ID NO: 1025745 - RNA, 14 nt, Homo sapiens
gagacugcgggaug

SEQ ID NO: 1025746 - RNA, 13 nt, Homo sapiens
gagagaacuggag

SEQ ID NO: 1025747 - RNA, 14 nt, Homo sapiens
gagagagugcuauu

SEQ ID NO: 1025748 - RNA, 13 nt, Homo sapiens
gagagauggaaua

SEQ ID NO: 1025749 - RNA, 20 nt, Homo sapiens
gagagauggaauaaagcccu

SEQ ID NO: 1025750 - RNA, 11 nt, Homo sapiens
gagagcucacu

SEQ ID NO: 1025751 - RNA, 17 nt, Homo sapiens
gagaggaagagcugcaa

SEQ ID NO: 1025752 - RNA, 23 nt, Homo sapiens
gagaggagaaggagggagacaug

SEQ ID NO: 1025753 - RNA, 22 nt, Homo sapiens
gagaggcaaaggcucucacucc

SEQ ID NO: 1025754 - RNA, 18 nt, Homo sapiens
gagaggccuuuuggaaug

SEQ ID NO: 1025755 - RNA, 12 nt, Homo sapiens
gagagggcugcu

SEQ ID NO: 1025756 - RNA, 18 nt, Homo sapiens
gagagggcugcugaccau

SEQ ID NO: 1025757 - RNA, 18 nt, Homo sapiens
gagaguauauuauguauu

SEQ ID NO: 1025758 - RNA, 19 nt, Homo sapiens
gagaguucaauggcugcug

SEQ ID NO: 1025759 - RNA, 14 nt, Homo sapiens
gagaguuucuguua

SEQ ID NO: 1025760 - RNA, 14 nt, Homo sapiens
gagauaaugcaguc

SEQ ID NO: 1025761 - RNA, 23 nt, Homo sapiens
gagauagaagaacugcaaaggua

SEQ ID NO: 1025762 - RNA, 17 nt, Homo sapiens
gagauagcauugugaac

SEQ ID NO: 1025763 - RNA, 13 nt, Homo sapiens
gagauauuuacau

SEQ ID NO: 1025764 - RNA, 21 nt, Homo sapiens
gagaucaugccacuacacucc

SEQ ID NO: 1025765 - RNA, 17 nt, Homo sapiens
gagaucgcgccacugca

SEQ ID NO: 1025766 - RNA, 21 nt, Homo sapiens
gagaucgcgccacugcacucc

SEQ ID NO: 1025767 - RNA, 15 nt, Homo sapiens
gagaucuaggugagg

SEQ ID NO: 1025768 - RNA, 17 nt, Homo sapiens
gagauggaauaaagccc

SEQ ID NO: 1025769 - RNA, 17 nt, Homo sapiens
gagauuaccuccugaga

SEQ ID NO: 1025770 - RNA, 20 nt, Homo sapiens
gagauuagucucuucugugu

SEQ ID NO: 1025771 - RNA, 15 nt, Homo sapiens
gagauuccugagcca

SEQ ID NO: 1025772 - RNA, 20 nt, Homo sapiens
gagauugcaccauugcgcuc

SEQ ID NO: 1025773 - RNA, 17 nt, Homo sapiens
gagauugugccacuuca

SEQ ID NO: 1025774 - RNA, 21 nt, Homo sapiens
gagauugugccccugcacucc

SEQ ID NO: 1025775 - RNA, 16 nt, Homo sapiens
gagauuugguguacaa

SEQ ID NO: 1025776 - RNA, 13 nt, Homo sapiens
gagauuuugcaau

SEQ ID NO: 1025777 - RNA, 16 nt, Homo sapiens
gagcaaagagccagca

SEQ ID NO: 1025778 - RNA, 21 nt, Homo sapiens
gagcaaaggcugagaacacug

SEQ ID NO: 1025779 - RNA, 14 nt, Homo sapiens
gagcaacagaguga

SEQ ID NO: 1025780 - RNA, 18 nt, Homo sapiens
gagcaagugagacccugu

SEQ ID NO: 1025781 - RNA, 20 nt, Homo sapiens
gagcaauucuccugccucag

SEQ ID NO: 1025782 - RNA, 16 nt, Homo sapiens
gagcacccaagccagg

SEQ ID NO: 1025783 - RNA, 21 nt, Homo sapiens
gagcacuggguugacuuucag

SEQ ID NO: 1025784 - RNA, 22 nt, Homo sapiens
gagcacuguccaguauucuacc

SEQ ID NO: 1025785 - RNA, 15 nt, Homo sapiens
gagcagaugaugcca

SEQ ID NO: 1025786 - RNA, 22 nt, Homo sapiens
gagcagccucagaacaaaguga

SEQ ID NO: 1025787 - RNA, 12 nt, Homo sapiens
gagcagccugug

SEQ ID NO: 1025788 - RNA, 20 nt, Homo sapiens
gagcauaacuguucucauuu

SEQ ID NO: 1025789 - RNA, 22 nt, Homo sapiens
gagcauaauaaauuauauuaaa

SEQ ID NO: 1025790 - RNA, 23 nt, Homo sapiens
gagcaucacaguuuugguugcuu

SEQ ID NO: 1025791 - RNA, 17 nt, Homo sapiens
gagcaugggacuguucu

SEQ ID NO: 1025792 - RNA, 18 nt, Homo sapiens
gagcauucagaaugucaa

SEQ ID NO: 1025793 - RNA, 21 nt, Homo sapiens
gagcauucagaaugucaauga

SEQ ID NO: 1025794 - RNA, 16 nt, Homo sapiens
gcauucagccaggaga

SEQ ID NO: 1025795 - RNA, 21 nt, Homo sapiens
gcauuccaccacacauggcua

SEQ ID NO: 1025796 - RNA, 21 nt, Homo sapiens
gcauucuguggccagccaaaa

SEQ ID NO: 1025797 - RNA, 16 nt, Homo sapiens
gcauugagcaaagggg

SEQ ID NO: 1025798 - RNA, 20 nt, Homo sapiens
gcauugccuuuagugaucac

SEQ ID NO: 1025799 - RNA, 17 nt, Homo sapiens
gcauuguaucgauguua

SEQ ID NO: 1025800 - RNA, 19 nt, Homo sapiens
gcauugucccugugccuaa

SEQ ID NO: 1025801 - RNA, 15 nt, Homo sapiens
gcauuuaauguagcc

SEQ ID NO: 1025802 - RNA, 19 nt, Homo sapiens
gcauuuggugguuucagaa

SEQ ID NO: 1025803 - RNA, 19 nt, Homo sapiens
gcauuugugcccacucucc

SEQ ID NO: 1025804 - RNA, 13 nt, Homo sapiens
gcauuuguuugaa

SEQ ID NO: 1025805 - RNA, 17 nt, Homo sapiens
gcauuuucaagcaguua

SEQ ID NO: 1025806 - RNA, 20 nt, Homo sapiens
gccaaauguuccauaugugg

SEQ ID NO: 1025807 - RNA, 14 nt, Homo sapiens
gccaaauuuuggcc

SEQ ID NO: 1025808 - RNA, 22 nt, Homo sapiens
gccaacauuuuaguucuuugga

SEQ ID NO: 1025809 - RNA, 13 nt, Homo sapiens
gccaagaaguuua

SEQ ID NO: 1025810 - RNA, 19 nt, Homo sapiens
gccaagcagccaagcuccu

SEQ ID NO: 1025811 - RNA, 17 nt, Homo sapiens
gccaagccagucaagga

SEQ ID NO: 1025812 - RNA, 20 nt, Homo sapiens
gccaagcucaggaccaggca

SEQ ID NO: 1025813 - RNA, 23 nt, Homo sapiens
gccaaguccagauuuacacuggg

SEQ ID NO: 1025814 - RNA, 13 nt, Homo sapiens
gccaagugaaaaa

SEQ ID NO: 1025815 - RNA, 18 nt, Homo sapiens
gccaaucuucaguauuuu

SEQ ID NO: 1025816 - RNA, 14 nt, Homo sapiens
gccaauuagcaauu

SEQ ID NO: 1025817 - RNA, 12 nt, Homo sapiens
gccaauuuacuu

SEQ ID NO: 1025818 - RNA, 19 nt, Homo sapiens
gccacacaaacguuuacuu

SEQ ID NO: 1025819 - RNA, 14 nt, Homo sapiens
gccacacacacaga

SEQ ID NO: 1025820 - RNA, 20 nt, Homo sapiens
gccacacacaguuacagagu

SEQ ID NO: 1025821 - RNA, 22 nt, Homo sapiens
gccacagaggacucacuugccc

SEQ ID NO: 1025822 - RNA, 23 nt, Homo sapiens
gccacaguuuccucaucugucca

SEQ ID NO: 1025823 - RNA, 22 nt, Homo sapiens
gccacauggggcugggcagcua

SEQ ID NO: 1025824 - RNA, 24 nt, Homo sapiens
gccaccaaaggccagggucacuga

SEQ ID NO: 1025825 - RNA, 19 nt, Homo sapiens
gccaccaacauacucccau

SEQ ID NO: 1025826 - RNA, 23 nt, Homo sapiens
gccaccagcgaaugcuaggucuc

SEQ ID NO: 1025827 - RNA, 18 nt, Homo sapiens
gccacccucccacugcca

SEQ ID NO: 1025828 - RNA, 19 nt, Homo sapiens
gccacccucccacugccaa

SEQ ID NO: 1025829 - RNA, 17 nt, Homo sapiens
gccacccuguguugaca

SEQ ID NO: 1025830 - RNA, 16 nt, Homo sapiens
gccacgaaugaaugaa

SEQ ID NO: 1025831 - RNA, 14 nt, Homo sapiens
gccacgugggcaaa

SEQ ID NO: 1025832 - RNA, 14 nt, Homo sapiens
gccacuaagccaag

SEQ ID NO: 1025833 - RNA, 13 nt, Homo sapiens
gccacugcacaga

SEQ ID NO: 1025834 - RNA, 18 nt, Homo sapiens
gccacuggccaucuccac

SEQ ID NO: 1025835 - RNA, 21 nt, Homo sapiens
gccacugggccugucacugau

SEQ ID NO: 1025836 - RNA, 15 nt, Homo sapiens
gccacuuugcaaagg

SEQ ID NO: 1025837 - RNA, 17 nt, Homo sapiens
gccagacaucaacagau

SEQ ID NO: 1025838 - RNA, 18 nt, Homo sapiens
gccagacuggcacaguuu

SEQ ID NO: 1025839 - RNA, 17 nt, Homo sapiens
gccagcaaugaugucca

SEQ ID NO: 1025840 - RNA, 14 nt, Homo sapiens
gccagcaucugccu

SEQ ID NO: 1025841 - RNA, 16 nt, Homo sapiens
gccagccaugcauugu

SEQ ID NO: 1025842 - RNA, 16 nt, Homo sapiens
gccagccuccagcacc

SEQ ID NO: 1025843 - RNA, 14 nt, Homo sapiens
gccagcuacuuccu

SEQ ID NO: 1025844 - RNA, 16 nt, Homo sapiens
gccagcucagucccau

SEQ ID NO: 1025845 - RNA, 18 nt, Homo sapiens
gccaggcaugguggccca

SEQ ID NO: 1025846 - RNA, 19 nt, Homo sapiens
gccaggcuagagugcagug

SEQ ID NO: 1025847 - RNA, 21 nt, Homo sapiens
gccaggguuucgagaagcugc

SEQ ID NO: 1025848 - RNA, 13 nt, Homo sapiens
gccagguccuugc

SEQ ID NO: 1025849 - RNA, 22 nt, Homo sapiens
gccaguaaaugggggugcauuu

SEQ ID NO: 1025850 - RNA, 11 nt, Homo sapiens
gccaguauuuu

SEQ ID NO: 1025851 - RNA, 19 nt, Homo sapiens
gccaguccugccuggccag

SEQ ID NO: 1025852 - RNA, 17 nt, Homo sapiens
gccaguuguugccaacc

SEQ ID NO: 1025853 - RNA, 22 nt, Homo sapiens
gccauaaaggggagggacucau

SEQ ID NO: 1025854 - RNA, 14 nt, Homo sapiens
gccauaacagacca

SEQ ID NO: 1025855 - RNA, 18 nt, Homo sapiens
gccauaauuacuauguca

SEQ ID NO: 1025856 - RNA, 13 nt, Homo sapiens
gccauaugaauaa

SEQ ID NO: 1025857 - RNA, 22 nt, Homo sapiens
gccauaugaaugucaguaguuu

SEQ ID NO: 1025858 - RNA, 17 nt, Homo sapiens
gccauccucacccagca

SEQ ID NO: 1025859 - RNA, 15 nt, Homo sapiens
gccaucgccaaguaa

SEQ ID NO: 1025860 - RNA, 20 nt, Homo sapiens
gccaucggugaaacuaacag

SEQ ID NO: 1025861 - RNA, 19 nt, Homo sapiens
gccaugaggccucagugga

SEQ ID NO: 1025862 - RNA, 19 nt, Homo sapiens
gccauggacucuacacugu

SEQ ID NO: 1025863 - RNA, 15 nt, Homo sapiens
gccauucacugcccc

SEQ ID NO: 1025864 - RNA, 20 nt, Homo sapiens
gccauucucaagcccugcag

SEQ ID NO: 1025865 - RNA, 22 nt, Homo sapiens
gccauucucccucuuguuuuca

SEQ ID NO: 1025866 - RNA, 14 nt, Homo sapiens
gccauugcacucca

SEQ ID NO: 1025867 - RNA, 18 nt, Homo sapiens
gccauuguuucuccuggg

SEQ ID NO: 1025868 - RNA, 16 nt, Homo sapiens
gccauuuuugugcuuu

SEQ ID NO: 1025869 - RNA, 16 nt, Homo sapiens
gcccaaauucuuucag

SEQ ID NO: 1025870 - RNA, 14 nt, Homo sapiens
gcccaaugcacuuu

SEQ ID NO: 1025871 - RNA, 15 nt, Homo sapiens
gcccaauguaaugca

SEQ ID NO: 1025872 - RNA, 13 nt, Homo sapiens
gcccacacuugag

SEQ ID NO: 1025873 - RNA, 23 nt, Homo sapiens
gcccacugaggaaugaugaagcu

SEQ ID NO: 1025874 - RNA, 21 nt, Homo sapiens
gcccagagcaggaagcauuca

SEQ ID NO: 1025875 - RNA, 21 nt, Homo sapiens
gcccagauucuaccacacagc

SEQ ID NO: 1025876 - RNA, 20 nt, Homo sapiens
gcccagccauuaccauggag

SEQ ID NO: 1025877 - RNA, 14 nt, Homo sapiens
gcccagcugcaccu

SEQ ID NO: 1025878 - RNA, 16 nt, Homo sapiens
gcccagcugcaccugc

SEQ ID NO: 1025879 - RNA, 16 nt, Homo sapiens
gcccagcuugggccca

SEQ ID NO: 1025880 - RNA, 19 nt, Homo sapiens
gcccaggcuggagugcaau

SEQ ID NO: 1025881 - RNA, 19 nt, Homo sapiens
gcccaggcuggagugcagu

SEQ ID NO: 1025882 - RNA, 20 nt, Homo sapiens
gcccaggcuggaguggagug

SEQ ID NO: 1025883 - RNA, 20 nt, Homo sapiens
gcccaggggcccacagggaa

SEQ ID NO: 1025884 - RNA, 20 nt, Homo sapiens
gcccaguuucacugccauau

SEQ ID NO: 1025885 - RNA, 18 nt, Homo sapiens
gcccauaucugugaaaug

SEQ ID NO: 1025886 - RNA, 15 nt, Homo sapiens
gcccauccaucugcu

SEQ ID NO: 1025887 - RNA, 22 nt, Homo sapiens
gcccauggcuuuagcuaccuca

SEQ ID NO: 1025888 - RNA, 15 nt, Homo sapiens
gcccaugugugagug

SEQ ID NO: 1025889 - RNA, 19 nt, Homo sapiens
gccccaccccagguccugc

SEQ ID NO: 1025890 - RNA, 16 nt, Homo sapiens
gccccagacacagugc

SEQ ID NO: 1025891 - RNA, 23 nt, Homo sapiens
gccccagcacuaaagcaguggac

SEQ ID NO: 1025892 - RNA, 21 nt, Homo sapiens
gccccaucaggacucuuguga

SEQ ID NO: 1025893 - RNA, 14 nt, Homo sapiens
gcccccagggcacu

SEQ ID NO: 1025894 - RNA, 13 nt, Homo sapiens
gcccccccagugg

SEQ ID NO: 1025895 - RNA, 20 nt, Homo sapiens
gccccccuugccagacaugu

SEQ ID NO: 1025896 - RNA, 16 nt, Homo sapiens
gcccccuuucagaugu

SEQ ID NO: 1025897 - RNA, 11 nt, Homo sapiens
gccccuacccc

SEQ ID NO: 1025898 - RNA, 19 nt, Homo sapiens
gccccucaccaacccagag

SEQ ID NO: 1025899 - RNA, 17 nt, Homo sapiens
gccccucugaccugcac

SEQ ID NO: 1025900 - RNA, 13 nt, Homo sapiens
gccccuugacucu

SEQ ID NO: 1025901 - RNA, 13 nt, Homo sapiens
gcccgcugagugg

SEQ ID NO: 1025902 - RNA, 15 nt, Homo sapiens
gcccuaaaagcacac

SEQ ID NO: 1025903 - RNA, 12 nt, Homo sapiens
gcccuaccuaaa

SEQ ID NO: 1025904 - RNA, 13 nt, Homo sapiens
gcccuacucaccu

SEQ ID NO: 1025905 - RNA, 16 nt, Homo sapiens
gcccuacuucuuugcu

SEQ ID NO: 1025906 - RNA, 20 nt, Homo sapiens
gcccucaaaaugacagccau

SEQ ID NO: 1025907 - RNA, 21 nt, Homo sapiens
gcccucagccccacuucucag

SEQ ID NO: 1025908 - RNA, 18 nt, Homo sapiens
gcccuccaaaagcacuua

SEQ ID NO: 1025909 - RNA, 14 nt, Homo sapiens
gcccuccacgccgg

SEQ ID NO: 1025910 - RNA, 20 nt, Homo sapiens
gcccuccccagagcacuggg

SEQ ID NO: 1025911 - RNA, 19 nt, Homo sapiens
gcccuccccaucccaugua

SEQ ID NO: 1025912 - RNA, 11 nt, Homo sapiens
gcccucgcugc

SEQ ID NO: 1025913 - RNA, 14 nt, Homo sapiens
gcccucgcugcuuc

SEQ ID NO: 1025914 - RNA, 22 nt, Homo sapiens
gcccucgggcgagucacugccu

SEQ ID NO: 1025915 - RNA, 22 nt, Homo sapiens
gcccucuaugguguggcaaagc

SEQ ID NO: 1025916 - RNA, 18 nt, Homo sapiens
gcccucuucauuuagcca

SEQ ID NO: 1025917 - RNA, 20 nt, Homo sapiens
gcccugaauccauaaaggca

SEQ ID NO: 1025918 - RNA, 16 nt, Homo sapiens
gcccugaguccaagag

SEQ ID NO: 1025919 - RNA, 16 nt, Homo sapiens
gcccugcaccugugca

SEQ ID NO: 1025920 - RNA, 16 nt, Homo sapiens
gcccugcuuagcucau

SEQ ID NO: 1025921 - RNA, 17 nt, Homo sapiens
gcccuggagccaacugc

SEQ ID NO: 1025922 - RNA, 16 nt, Homo sapiens
gcccugguagggcagu

SEQ ID NO: 1025923 - RNA, 16 nt, Homo sapiens
gcccuuaaggacaaaa

SEQ ID NO: 1025924 - RNA, 15 nt, Homo sapiens
gcccuucccacugga

SEQ ID NO: 1025925 - RNA, 23 nt, Homo sapiens
gcccuuuauuuauaauacauuuc

SEQ ID NO: 1025926 - RNA, 18 nt, Homo sapiens
gccgaaaaggauaugcag

SEQ ID NO: 1025927 - RNA, 19 nt, Homo sapiens
gccgaaaaggauaugcagu

SEQ ID NO: 1025928 - RNA, 14 nt, Homo sapiens
gccgagaagccagu

SEQ ID NO: 1025929 - RNA, 21 nt, Homo sapiens
gccgagaucacgccacugcac

SEQ ID NO: 1025930 - RNA, 17 nt, Homo sapiens
gccgcaaaccacacugg

SEQ ID NO: 1025931 - RNA, 19 nt, Homo sapiens
gccgcaaaccacacuggac

SEQ ID NO: 1025932 - RNA, 18 nt, Homo sapiens
gccgccggaguccacucc

SEQ ID NO: 1025933 - RNA, 14 nt, Homo sapiens
gccggaaucucagc

SEQ ID NO: 1025934 - RNA, 22 nt, Homo sapiens
gccggcaaccccaguucugcuc

SEQ ID NO: 1025935 - RNA, 12 nt, Homo sapiens
gccggcucuuuc

SEQ ID NO: 1025936 - RNA, 17 nt, Homo sapiens
gccuaaaaaugcaacuu

SEQ ID NO: 1025937 - RNA, 17 nt, Homo sapiens
gccuaauacaacaugua

SEQ ID NO: 1025938 - RNA, 19 nt, Homo sapiens
ggaugcagccucacagucc

SEQ ID NO: 1025939 - RNA, 23 nt, Homo sapiens
ggaugccaaccggucacccagga

SEQ ID NO: 1025940 - RNA, 17 nt, Homo sapiens
ggauggaugcagaucca

SEQ ID NO: 1025941 - RNA, 17 nt, Homo sapiens
ggaugguggagggccac

SEQ ID NO: 1025942 - RNA, 19 nt, Homo sapiens
ggauguccacagaugccuc

SEQ ID NO: 1025943 - RNA, 22 nt, Homo sapiens
ggaugucuccaucucugucuca

SEQ ID NO: 1025944 - RNA, 15 nt, Homo sapiens
ggauuaaaagccaug

SEQ ID NO: 1025945 - RNA, 19 nt, Homo sapiens
ggauuaaccugccagggag

SEQ ID NO: 1025946 - RNA, 20 nt, Homo sapiens
ggauuaaugguccugugaug

SEQ ID NO: 1025947 - RNA, 13 nt, Homo sapiens
ggauuacaggcau

SEQ ID NO: 1025948 - RNA, 16 nt, Homo sapiens
ggauuaccaguagaug

SEQ ID NO: 1025949 - RNA, 21 nt, Homo sapiens
ggauuaugaagugacucucac

SEQ ID NO: 1025950 - RNA, 14 nt, Homo sapiens
ggauuauucauuua

SEQ ID NO: 1025951 - RNA, 14 nt, Homo sapiens
ggauucccaggaug

SEQ ID NO: 1025952 - RNA, 16 nt, Homo sapiens
ggauugcuaugaauga

SEQ ID NO: 1025953 - RNA, 23 nt, Homo sapiens
ggauuugaagcaaagcaccagcu

SEQ ID NO: 1025954 - RNA, 23 nt, Homo sapiens
ggauuuuguauaugcauagucau

SEQ ID NO: 1025955 - RNA, 15 nt, Homo sapiens
ggcaaaaacaaaggu

SEQ ID NO: 1025956 - RNA, 20 nt, Homo sapiens
ggcaaaaccacuagaacucu

SEQ ID NO: 1025957 - RNA, 12 nt, Homo sapiens
ggcaaacaggca

SEQ ID NO: 1025958 - RNA, 18 nt, Homo sapiens
ggcaaaucagaugcagcu

SEQ ID NO: 1025959 - RNA, 22 nt, Homo sapiens
ggcaaggacggccuucaacuga

SEQ ID NO: 1025960 - RNA, 15 nt, Homo sapiens
ggcacacacugugua

SEQ ID NO: 1025961 - RNA, 15 nt, Homo sapiens
ggcacaccgggcacu

SEQ ID NO: 1025962 - RNA, 20 nt, Homo sapiens
ggcacccagccucuagggac

SEQ ID NO: 1025963 - RNA, 18 nt, Homo sapiens
ggcacccaugccaucuca

SEQ ID NO: 1025964 - RNA, 21 nt, Homo sapiens
ggcaccuccuacgucaaacau

SEQ ID NO: 1025965 - RNA, 18 nt, Homo sapiens
ggcacucagaagacacug

SEQ ID NO: 1025966 - RNA, 17 nt, Homo sapiens
ggcacucccauccaucc

SEQ ID NO: 1025967 - RNA, 15 nt, Homo sapiens
ggcacuggggcacuu

SEQ ID NO: 1025968 - RNA, 11 nt, Homo sapiens
ggcacuuugaa

SEQ ID NO: 1025969 - RNA, 15 nt, Homo sapiens
ggcagaaagcaaaug

SEQ ID NO: 1025970 - RNA, 22 nt, Homo sapiens
ggcagaagagacccaaccacuu

SEQ ID NO: 1025971 - RNA, 14 nt, Homo sapiens
ggcagaagcagcag

SEQ ID NO: 1025972 - RNA, 13 nt, Homo sapiens
ggcagaagggaac

SEQ ID NO: 1025973 - RNA, 22 nt, Homo sapiens
ggcagacacuguuugcccagug

SEQ ID NO: 1025974 - RNA, 13 nt, Homo sapiens
ggcagagcauuca

SEQ ID NO: 1025975 - RNA, 12 nt, Homo sapiens
ggcagagccaug

SEQ ID NO: 1025976 - RNA, 19 nt, Homo sapiens
ggcagaucccacuugcagc

SEQ ID NO: 1025977 - RNA, 14 nt, Homo sapiens
ggcagauugaaaag

SEQ ID NO: 1025978 - RNA, 20 nt, Homo sapiens
ggcagauugaacaagagcuu

SEQ ID NO: 1025979 - RNA, 19 nt, Homo sapiens
ggcagccacgugcucucug

SEQ ID NO: 1025980 - RNA, 19 nt, Homo sapiens
ggcagcgggggccagggaa

SEQ ID NO: 1025981 - RNA, 16 nt, Homo sapiens
ggcagcuccacagggc

SEQ ID NO: 1025982 - RNA, 13 nt, Homo sapiens
ggcagcucuccag

SEQ ID NO: 1025983 - RNA, 20 nt, Homo sapiens
ggcaggaaaauuguuugaac

SEQ ID NO: 1025984 - RNA, 17 nt, Homo sapiens
ggcaggaccuguggcca

SEQ ID NO: 1025985 - RNA, 20 nt, Homo sapiens
ggcaggagaauggcgugaac

SEQ ID NO: 1025986 - RNA, 22 nt, Homo sapiens
ggcaggaguauaugagcauccu

SEQ ID NO: 1025987 - RNA, 12 nt, Homo sapiens
ggcaggcagcug

SEQ ID NO: 1025988 - RNA, 15 nt, Homo sapiens
ggcaguaacauuggg

SEQ ID NO: 1025989 - RNA, 16 nt, Homo sapiens
ggcagugccuguaauc

SEQ ID NO: 1025990 - RNA, 11 nt, Homo sapiens
ggcaguuacau

SEQ ID NO: 1025991 - RNA, 24 nt, Homo sapiens
ggcauagaugcaggugagcccaug

SEQ ID NO: 1025992 - RNA, 18 nt, Homo sapiens
ggcaugcccccaguuacu

SEQ ID NO: 1025993 - RNA, 15 nt, Homo sapiens
ggcauggagccagug

SEQ ID NO: 1025994 - RNA, 20 nt, Homo sapiens
ggcauggcccugggguccca

SEQ ID NO: 1025995 - RNA, 22 nt, Homo sapiens
ggccaagcccagcuuaauggcu

SEQ ID NO: 1025996 - RNA, 23 nt, Homo sapiens
ggccaagguggguggaucacuug

SEQ ID NO: 1025997 - RNA, 15 nt, Homo sapiens
ggccaauaaauauga

SEQ ID NO: 1025998 - RNA, 19 nt, Homo sapiens
ggccacaugagucccagug

SEQ ID NO: 1025999 - RNA, 18 nt, Homo sapiens
ggccacuggccaucucca

SEQ ID NO: 1026000 - RNA, 19 nt, Homo sapiens
ggccagaagggggccauga

SEQ ID NO: 1026001 - RNA, 19 nt, Homo sapiens
ggccagcaagcucuucacu

SEQ ID NO: 1026002 - RNA, 20 nt, Homo sapiens
ggccaggaguuugagaccag

SEQ ID NO: 1026003 - RNA, 17 nt, Homo sapiens
ggccagggcuauagcuc

SEQ ID NO: 1026004 - RNA, 22 nt, Homo sapiens
ggccauccugucccaccaugca

SEQ ID NO: 1026005 - RNA, 20 nt, Homo sapiens
ggccaucucuggaugccuga

SEQ ID NO: 1026006 - RNA, 17 nt, Homo sapiens
ggccaugccacccuguu

SEQ ID NO: 1026007 - RNA, 23 nt, Homo sapiens
ggccauuuagccaccaucuuugc

SEQ ID NO: 1026008 - RNA, 13 nt, Homo sapiens
ggccccacugggg

SEQ ID NO: 1026009 - RNA, 12 nt, Homo sapiens
ggcccccagugg

SEQ ID NO: 1026010 - RNA, 18 nt, Homo sapiens
ggcccucccuuuucccau

SEQ ID NO: 1026011 - RNA, 23 nt, Homo sapiens
ggcccuggccuagcauacguaca

SEQ ID NO: 1026012 - RNA, 15 nt, Homo sapiens
ggcccugugccuugg

SEQ ID NO: 1026013 - RNA, 23 nt, Homo sapiens
ggcccuucccacaggacauuucu

SEQ ID NO: 1026014 - RNA, 17 nt, Homo sapiens
ggccgaaggcagugcaa

SEQ ID NO: 1026015 - RNA, 19 nt, Homo sapiens
ggccgggcgcgguggcuca

SEQ ID NO: 1026016 - RNA, 22 nt, Homo sapiens
ggccggggcccugcaccugugc

SEQ ID NO: 1026017 - RNA, 16 nt, Homo sapiens
ggccgugagggguccc

SEQ ID NO: 1026018 - RNA, 13 nt, Homo sapiens
ggccuaugcacau

SEQ ID NO: 1026019 - RNA, 22 nt, Homo sapiens
ggccucagcaccccugucucua

SEQ ID NO: 1026020 - RNA, 13 nt, Homo sapiens
ggccucagguuug

SEQ ID NO: 1026021 - RNA, 20 nt, Homo sapiens
ggccucccacccgaugcugc

SEQ ID NO: 1026022 - RNA, 20 nt, Homo sapiens
ggccuccucucucaguuuuu

SEQ ID NO: 1026023 - RNA, 17 nt, Homo sapiens
ggccuccugucccucau

SEQ ID NO: 1026024 - RNA, 19 nt, Homo sapiens
ggccuccugugcaucugua

SEQ ID NO: 1026025 - RNA, 16 nt, Homo sapiens
ggccuccugugugugc

SEQ ID NO: 1026026 - RNA, 21 nt, Homo sapiens
ggccugaagucccagcauuga

SEQ ID NO: 1026027 - RNA, 16 nt, Homo sapiens
ggccuggccaccucuc

SEQ ID NO: 1026028 - RNA, 16 nt, Homo sapiens
ggccuggccagaugca

SEQ ID NO: 1026029 - RNA, 15 nt, Homo sapiens
ggccugguccaugau

SEQ ID NO: 1026030 - RNA, 21 nt, Homo sapiens
ggccuuaucuccaagaccaga

SEQ ID NO: 1026031 - RNA, 17 nt, Homo sapiens
ggcgaaaccccaucucu

SEQ ID NO: 1026032 - RNA, 21 nt, Homo sapiens
ggcgaaucauuuguucaaagc

SEQ ID NO: 1026033 - RNA, 22 nt, Homo sapiens
ggcgaccccgucacagccucaa

SEQ ID NO: 1026034 - RNA, 16 nt, Homo sapiens
ggcgagucugcuuucu

SEQ ID NO: 1026035 - RNA, 20 nt, Homo sapiens
ggcgccgcaaaccacacugg

SEQ ID NO: 1026036 - RNA, 18 nt, Homo sapiens
ggcgcugcuuugucaaaa

SEQ ID NO: 1026037 - RNA, 16 nt, Homo sapiens
ggcggaucuuuggaca

SEQ ID NO: 1026038 - RNA, 23 nt, Homo sapiens
ggcggaucuuuggacagaagcag

SEQ ID NO: 1026039 - RNA, 12 nt, Homo sapiens
ggcuaagugauc

SEQ ID NO: 1026040 - RNA, 17 nt, Homo sapiens
ggcuagaaccuggagag

SEQ ID NO: 1026041 - RNA, 15 nt, Homo sapiens
ggcucaacuagggag

SEQ ID NO: 1026042 - RNA, 17 nt, Homo sapiens
ggcucacgccuguaauu

SEQ ID NO: 1026043 - RNA, 14 nt, Homo sapiens
ggcucagcacuuug

SEQ ID NO: 1026044 - RNA, 16 nt, Homo sapiens
ggcucagucucaggag

SEQ ID NO: 1026045 - RNA, 17 nt, Homo sapiens
ggcucauuuugcucaac

SEQ ID NO: 1026046 - RNA, 16 nt, Homo sapiens
ggcuccaacacugcug

SEQ ID NO: 1026047 - RNA, 14 nt, Homo sapiens
ggcuccacugggau

SEQ ID NO: 1026048 - RNA, 18 nt, Homo sapiens
ggcucccacuucuuggga

SEQ ID NO: 1026049 - RNA, 14 nt, Homo sapiens
ggcucccaugacca

SEQ ID NO: 1026050 - RNA, 19 nt, Homo sapiens
ggcucccggagggcccuga

SEQ ID NO: 1026051 - RNA, 18 nt, Homo sapiens
ggcuccucggacucugcu

SEQ ID NO: 1026052 - RNA, 13 nt, Homo sapiens
ggcuccugugcua

SEQ ID NO: 1026053 - RNA, 21 nt, Homo sapiens
ggcuccuuggauguagucagu

SEQ ID NO: 1026054 - RNA, 22 nt, Homo sapiens
ggcucgccaugccggggguuca

SEQ ID NO: 1026055 - RNA, 22 nt, Homo sapiens
ggcucgucggggggacagcucc

SEQ ID NO: 1026056 - RNA, 14 nt, Homo sapiens
ggcucucacuccag

SEQ ID NO: 1026057 - RNA, 20 nt, Homo sapiens
ggcucucagcucagcgccag

SEQ ID NO: 1026058 - RNA, 18 nt, Homo sapiens
ggcucuuuccuugcucaa

SEQ ID NO: 1026059 - RNA, 22 nt, Homo sapiens
ggcugacggugcagucugggug

SEQ ID NO: 1026060 - RNA, 15 nt, Homo sapiens
ggcugaggauuucaa

SEQ ID NO: 1026061 - RNA, 12 nt, Homo sapiens
ggcugcaaucac

SEQ ID NO: 1026062 - RNA, 18 nt, Homo sapiens
ggcugcacccacccagga

SEQ ID NO: 1026063 - RNA, 11 nt, Homo sapiens
ggcugcaguga

SEQ ID NO: 1026064 - RNA, 19 nt, Homo sapiens
ggcugcagugagcugagau

SEQ ID NO: 1026065 - RNA, 19 nt, Homo sapiens
ggcugccccaaccugcuga

SEQ ID NO: 1026066 - RNA, 15 nt, Homo sapiens
ggcuggagugcaaug

SEQ ID NO: 1026067 - RNA, 19 nt, Homo sapiens
ggcuggaguggaguggcgu

SEQ ID NO: 1026068 - RNA, 14 nt, Homo sapiens
ggcugggcagcuac

SEQ ID NO: 1026069 - RNA, 16 nt, Homo sapiens
ggcuggguaccaaugc

SEQ ID NO: 1026070 - RNA, 17 nt, Homo sapiens
ggcugguaacaguucau

SEQ ID NO: 1026071 - RNA, 23 nt, Homo sapiens
ggcuggugcuguggccaggguga

SEQ ID NO: 1026072 - RNA, 15 nt, Homo sapiens
ggcuguaucccauga

SEQ ID NO: 1026073 - RNA, 10 nt, Homo sapiens
ggcugugagg

SEQ ID NO: 1026074 - RNA, 20 nt, Homo sapiens
ggcugugcggaucucuggag

SEQ ID NO: 1026075 - RNA, 16 nt, Homo sapiens
ggcuguuauucuucca

SEQ ID NO: 1026076 - RNA, 16 nt, Homo sapiens
ggcuuaggacuuucca

SEQ ID NO: 1026077 - RNA, 15 nt, Homo sapiens
ggcuucacuguauaa

SEQ ID NO: 1026078 - RNA, 20 nt, Homo sapiens
ggcuucuuaaucuuuucaca

SEQ ID NO: 1026079 - RNA, 14 nt, Homo sapiens
ggcuugcaugccaa

SEQ ID NO: 1026080 - RNA, 18 nt, Homo sapiens
ggcuuguaaaugugacac

SEQ ID NO: 1026081 - RNA, 21 nt, Homo sapiens
ggcuuguguguuucacuuuua

SEQ ID NO: 1026082 - RNA, 14 nt, Homo sapiens
gugaucaaagccac

SEQ ID NO: 1026083 - RNA, 23 nt, Homo sapiens
gugaugccucccuguugaagcuc

SEQ ID NO: 1026084 - RNA, 17 nt, Homo sapiens
gugaugucaucugucac

SEQ ID NO: 1026085 - RNA, 21 nt, Homo sapiens
gugauguguccugauaagcug

SEQ ID NO: 1026086 - RNA, 19 nt, Homo sapiens
gugauuuaagacacuuuuu

SEQ ID NO: 1026087 - RNA, 17 nt, Homo sapiens
gugauuuucauugcugg

SEQ ID NO: 1026088 - RNA, 20 nt, Homo sapiens
gugcaaagauuugcuuuaau

SEQ ID NO: 1026089 - RNA, 20 nt, Homo sapiens
gugcaagugucugugugcaa

SEQ ID NO: 1026090 - RNA, 19 nt, Homo sapiens
gugcaagugugugcacaug

SEQ ID NO: 1026091 - RNA, 18 nt, Homo sapiens
gugcaccacuucaaguga

SEQ ID NO: 1026092 - RNA, 18 nt, Homo sapiens
gugcacguacacacacau

SEQ ID NO: 1026093 - RNA, 19 nt, Homo sapiens
gugcaguggcgugaucucg

SEQ ID NO: 1026094 - RNA, 17 nt, Homo sapiens
gugcaguugacagcagg

SEQ ID NO: 1026095 - RNA, 22 nt, Homo sapiens
gugcaugccuggcacaacauca

SEQ ID NO: 1026096 - RNA, 12 nt, Homo sapiens
gugcaugugcac

SEQ ID NO: 1026097 - RNA, 15 nt, Homo sapiens
gugcaugugugcgag

SEQ ID NO: 1026098 - RNA, 18 nt, Homo sapiens
gugccaauauuucugaua

SEQ ID NO: 1026099 - RNA, 23 nt, Homo sapiens
gugccacugcccgagcuggugca

SEQ ID NO: 1026100 - RNA, 15 nt, Homo sapiens
gugccagcaaugaca

SEQ ID NO: 1026101 - RNA, 17 nt, Homo sapiens
gugccagcaaugacauc

SEQ ID NO: 1026102 - RNA, 21 nt, Homo sapiens
gugccagcccugcauugcuga

SEQ ID NO: 1026103 - RNA, 19 nt, Homo sapiens
gugccccaugccuguccag

SEQ ID NO: 1026104 - RNA, 14 nt, Homo sapiens
gugcccccaucacc

SEQ ID NO: 1026105 - RNA, 14 nt, Homo sapiens
gugccccuuuccaa

SEQ ID NO: 1026106 - RNA, 14 nt, Homo sapiens
gugccuaacaccag

SEQ ID NO: 1026107 - RNA, 24 nt, Homo sapiens
gugccuccagacaugugcacauga

SEQ ID NO: 1026108 - RNA, 18 nt, Homo sapiens
gugccuggccaaagggau

SEQ ID NO: 1026109 - RNA, 17 nt, Homo sapiens
gugcgagugugugcaug

SEQ ID NO: 1026110 - RNA, 15 nt, Homo sapiens
gugcggaucucugga

SEQ ID NO: 1026111 - RNA, 17 nt, Homo sapiens
gugcgugugcgugcaug

SEQ ID NO: 1026112 - RNA, 15 nt, Homo sapiens
gugcgugugugcaag

SEQ ID NO: 1026113 - RNA, 16 nt, Homo sapiens
gugcgugugugcaagu

SEQ ID NO: 1026114 - RNA, 23 nt, Homo sapiens
gugcuaauaacagugcauauucc

SEQ ID NO: 1026115 - RNA, 13 nt, Homo sapiens
gugcuacaaaaac

SEQ ID NO: 1026116 - RNA, 23 nt, Homo sapiens
gugcuacuuugccuuuugcaaac

SEQ ID NO: 1026117 - RNA, 21 nt, Homo sapiens
gugcuaugaauuuucaaguaa

SEQ ID NO: 1026118 - RNA, 20 nt, Homo sapiens
gugcuccuccuuggugccug

SEQ ID NO: 1026119 - RNA, 17 nt, Homo sapiens
gugcucugaucauccac

SEQ ID NO: 1026120 - RNA, 16 nt, Homo sapiens
gugcugccaguccucu

SEQ ID NO: 1026121 - RNA, 15 nt, Homo sapiens
gugcuggagacacuc

SEQ ID NO: 1026122 - RNA, 18 nt, Homo sapiens
gugcugggauuacaggug

SEQ ID NO: 1026123 - RNA, 19 nt, Homo sapiens
gugcugggauuacaggugu

SEQ ID NO: 1026124 - RNA, 17 nt, Homo sapiens
gugcuguggccugggca

SEQ ID NO: 1026125 - RNA, 15 nt, Homo sapiens
gugcuucagccugag

SEQ ID NO: 1026126 - RNA, 14 nt, Homo sapiens
gugcuucuucacuu

SEQ ID NO: 1026127 - RNA, 18 nt, Homo sapiens
gugcuuguaaaaagucaa

SEQ ID NO: 1026128 - RNA, 15 nt, Homo sapiens
gugcuuuguacugcu

SEQ ID NO: 1026129 - RNA, 17 nt, Homo sapiens
gugcuuuguacugcugu

SEQ ID NO: 1026130 - RNA, 18 nt, Homo sapiens
guggaaccaacacuaaca

SEQ ID NO: 1026131 - RNA, 15 nt, Homo sapiens
guggaacucagucau

SEQ ID NO: 1026132 - RNA, 18 nt, Homo sapiens
guggaacucagucauuag

SEQ ID NO: 1026133 - RNA, 19 nt, Homo sapiens
guggaauagccucccugua

SEQ ID NO: 1026134 - RNA, 21 nt, Homo sapiens
guggaccacugcaugagcuuu

SEQ ID NO: 1026135 - RNA, 21 nt, Homo sapiens
guggagguauugccuugugaa

SEQ ID NO: 1026136 - RNA, 21 nt, Homo sapiens
guggagucccuuuugcaucau

SEQ ID NO: 1026137 - RNA, 16 nt, Homo sapiens
guggauguaaagugau

SEQ ID NO: 1026138 - RNA, 21 nt, Homo sapiens
guggauucuucccacacagaa

SEQ ID NO: 1026139 - RNA, 15 nt, Homo sapiens
guggcagggcucagg

SEQ ID NO: 1026140 - RNA, 21 nt, Homo sapiens
guggcagguggaggugucagg

SEQ ID NO: 1026141 - RNA, 13 nt, Homo sapiens
guggcauguggcc

SEQ ID NO: 1026142 - RNA, 15 nt, Homo sapiens
guggcauuuucacuu

SEQ ID NO: 1026143 - RNA, 13 nt, Homo sapiens
guggccaguauuu

SEQ ID NO: 1026144 - RNA, 18 nt, Homo sapiens
guggcccagggaagccaa

SEQ ID NO: 1026145 - RNA, 21 nt, Homo sapiens
guggccucaacccucccucag

SEQ ID NO: 1026146 - RNA, 23 nt, Homo sapiens
guggcuuagaaaguccaauucca

SEQ ID NO: 1026147 - RNA, 20 nt, Homo sapiens
guggcuuuuuuccuccugug

SEQ ID NO: 1026148 - RNA, 17 nt, Homo sapiens
gugggcaaacaggcagu

SEQ ID NO: 1026149 - RNA, 15 nt, Homo sapiens
gugggcagguggugg

SEQ ID NO: 1026150 - RNA, 17 nt, Homo sapiens
gugggcauggagccagu

SEQ ID NO: 1026151 - RNA, 15 nt, Homo sapiens
gugggccacagccau

SEQ ID NO: 1026152 - RNA, 22 nt, Homo sapiens
gugggcuaagcacgggccauau

SEQ ID NO: 1026153 - RNA, 20 nt, Homo sapiens
gugggcucccugacugggag

SEQ ID NO: 1026154 - RNA, 15 nt, Homo sapiens
gugggcuccuuacag

SEQ ID NO: 1026155 - RNA, 14 nt, Homo sapiens
guggggacagggau

SEQ ID NO: 1026156 - RNA, 15 nt, Homo sapiens
guggggcaaucuauu

SEQ ID NO: 1026157 - RNA, 19 nt, Homo sapiens
guggggcugguagcucagg

SEQ ID NO: 1026158 - RNA, 21 nt, Homo sapiens
gugggguaaccaaauguuggc

SEQ ID NO: 1026159 - RNA, 20 nt, Homo sapiens
gugggguccccaucauccca

SEQ ID NO: 1026160 - RNA, 20 nt, Homo sapiens
guggguacucaauguguacu

SEQ ID NO: 1026161 - RNA, 12 nt, Homo sapiens
guggguggugga

SEQ ID NO: 1026162 - RNA, 15 nt, Homo sapiens
guggguuuugaacau

SEQ ID NO: 1026163 - RNA, 14 nt, Homo sapiens
gugguccacugagc

SEQ ID NO: 1026164 - RNA, 14 nt, Homo sapiens
guggugugcugcuu

SEQ ID NO: 1026165 - RNA, 19 nt, Homo sapiens
gugguguuaaucauuucau

SEQ ID NO: 1026166 - RNA, 21 nt, Homo sapiens
gugguuauuuagggaacugcu

SEQ ID NO: 1026167 - RNA, 13 nt, Homo sapiens
guguaaaccaaag

SEQ ID NO: 1026168 - RNA, 14 nt, Homo sapiens
guguaacaggucuc

SEQ ID NO: 1026169 - RNA, 17 nt, Homo sapiens
guguacacgugacagag

SEQ ID NO: 1026170 - RNA, 14 nt, Homo sapiens
guguacauucuucc

SEQ ID NO: 1026171 - RNA, 18 nt, Homo sapiens
guguauaaauaguaacuu

SEQ ID NO: 1026172 - RNA, 13 nt, Homo sapiens
guguaugcacgug

SEQ ID NO: 1026173 - RNA, 21 nt, Homo sapiens
guguaugugcgugugugcaag

SEQ ID NO: 1026174 - RNA, 14 nt, Homo sapiens
guguauugcaaugg

SEQ ID NO: 1026175 - RNA, 18 nt, Homo sapiens
gugucauauacaauuguc

SEQ ID NO: 1026176 - RNA, 15 nt, Homo sapiens
gugucaugauucacc

SEQ ID NO: 1026177 - RNA, 17 nt, Homo sapiens
guguccaguugcagcug

SEQ ID NO: 1026178 - RNA, 13 nt, Homo sapiens
guguccaugugug

SEQ ID NO: 1026179 - RNA, 17 nt, Homo sapiens
guguccccuccacuguc

SEQ ID NO: 1026180 - RNA, 12 nt, Homo sapiens
guguccugacca

SEQ ID NO: 1026181 - RNA, 19 nt, Homo sapiens
gugucucaggccacaccgg

SEQ ID NO: 1026182 - RNA, 14 nt, Homo sapiens
gugucuguguauau

SEQ ID NO: 1026183 - RNA, 21 nt, Homo sapiens
gugugaacagggaacucagaa

SEQ ID NO: 1026184 - RNA, 17 nt, Homo sapiens
gugugagugugugcaag

SEQ ID NO: 1026185 - RNA, 12 nt, Homo sapiens
gugugcaagugu

SEQ ID NO: 1026186 - RNA, 20 nt, Homo sapiens
gugugcaagugugugcacau

SEQ ID NO: 1026187 - RNA, 18 nt, Homo sapiens
gugugcaagugugugcau

SEQ ID NO: 1026188 - RNA, 20 nt, Homo sapiens
gugugcaagugugugcaugu

SEQ ID NO: 1026189 - RNA, 22 nt, Homo sapiens
guguggcccagggaagccaaaa

SEQ ID NO: 1026190 - RNA, 17 nt, Homo sapiens
guguguacacgggacug

SEQ ID NO: 1026191 - RNA, 17 nt, Homo sapiens
guguguguauacaugcc

SEQ ID NO: 1026192 - RNA, 15 nt, Homo sapiens
gugugugugcaagug

SEQ ID NO: 1026193 - RNA, 15 nt, Homo sapiens
guguguguguguaua

SEQ ID NO: 1026194 - RNA, 14 nt, Homo sapiens
guguguugauccca

SEQ ID NO: 1026195 - RNA, 21 nt, Homo sapiens
guguuaucagucauaacuaaa

SEQ ID NO: 1026196 - RNA, 21 nt, Homo sapiens
guguuauuaaugacaaaggca

SEQ ID NO: 1026197 - RNA, 17 nt, Homo sapiens
guguucugauuagaaau

SEQ ID NO: 1026198 - RNA, 16 nt, Homo sapiens
guguucugucacucag

SEQ ID NO: 1026199 - RNA, 14 nt, Homo sapiens
guguugaccacaga

SEQ ID NO: 1026200 - RNA, 14 nt, Homo sapiens
guguugaucccaag

SEQ ID NO: 1026201 - RNA, 16 nt, Homo sapiens
guguuggcacaugccu

SEQ ID NO: 1026202 - RNA, 22 nt, Homo sapiens
guguuuuugcuaucacacagug

SEQ ID NO: 1026203 - RNA, 17 nt, Homo sapiens
guuaaacauugaaguaa

SEQ ID NO: 1026204 - RNA, 19 nt, Homo sapiens
guuaaauaucacaucacuu

SEQ ID NO: 1026205 - RNA, 15 nt, Homo sapiens
guuaaauucaaugua

SEQ ID NO: 1026206 - RNA, 11 nt, Homo sapiens
guuaacuuaau

SEQ ID NO: 1026207 - RNA, 19 nt, Homo sapiens
guuaagacaaacugcauau

SEQ ID NO: 1026208 - RNA, 13 nt, Homo sapiens
guuaaugccacaa

SEQ ID NO: 1026209 - RNA, 12 nt, Homo sapiens
guuacacuggag

SEQ ID NO: 1026210 - RNA, 21 nt, Homo sapiens
guuacagcgagaggcagagaa

SEQ ID NO: 1026211 - RNA, 14 nt, Homo sapiens
guuacauaagauaa

SEQ ID NO: 1026212 - RNA, 21 nt, Homo sapiens
guuacaucacaguguuugcaa

SEQ ID NO: 1026213 - RNA, 18 nt, Homo sapiens
guuaccugaucaaugaca

SEQ ID NO: 1026214 - RNA, 22 nt, Homo sapiens
guuagaagcaaugaauguauau

SEQ ID NO: 1026215 - RNA, 18 nt, Homo sapiens
guuagacuuaaacagcag

SEQ ID NO: 1026216 - RNA, 20 nt, Homo sapiens
guuagauuuuguauucaggg

SEQ ID NO: 1026217 - RNA, 17 nt, Homo sapiens
guuagggaugacuguga

SEQ ID NO: 1026218 - RNA, 19 nt, Homo sapiens
guuagggaugacugugauu

SEQ ID NO: 1026219 - RNA, 15 nt, Homo sapiens
guuagugauggagcu

SEQ ID NO: 1026220 - RNA, 22 nt, Homo sapiens
guuagugcuaguggauuuuaca

SEQ ID NO: 1026221 - RNA, 17 nt, Homo sapiens
guuaucaugcauguuau

SEQ ID NO: 1026222 - RNA, 18 nt, Homo sapiens
guuaucuaauauguaaca

SEQ ID NO: 1026223 - RNA, 19 nt, Homo sapiens
guuaucuguguagcaagcu

SEQ ID NO: 1026224 - RNA, 18 nt, Homo sapiens
guuaugccgcuagauaca

SEQ ID NO: 1026225 - RNA, 17 nt, Homo sapiens
guuaugcuuuacugcga

SEQ ID NO: 1026226 - RNA, 13 nt, Homo sapiens
guuaugugaauga

SEQ ID NO: 1026227 - RNA, 22 nt, Homo sapiens
ucuacucuuaaguuucucagcu

SEQ ID NO: 1026228 - RNA, 18 nt, Homo sapiens
ucuacuggucuuguggaa

SEQ ID NO: 1026229 - RNA, 15 nt, Homo sapiens
ucuagaacacaggca

SEQ ID NO: 1026230 - RNA, 20 nt, Homo sapiens
ucuagaaccaggcaacuugg

SEQ ID NO: 1026231 - RNA, 13 nt, Homo sapiens
ucuagaacuugac

SEQ ID NO: 1026232 - RNA, 15 nt, Homo sapiens
ucuagaagacuguca

SEQ ID NO: 1026233 - RNA, 16 nt, Homo sapiens
ucuagacaaaaaccau

SEQ ID NO: 1026234 - RNA, 16 nt, Homo sapiens
ucuagacuugugcuga

SEQ ID NO: 1026235 - RNA, 19 nt, Homo sapiens
ucuagccugggcaacaaca

SEQ ID NO: 1026236 - RNA, 18 nt, Homo sapiens
ucuaggcaucccagggga

SEQ ID NO: 1026237 - RNA, 21 nt, Homo sapiens
ucuagucuccuuugcacugag

SEQ ID NO: 1026238 - RNA, 21 nt, Homo sapiens
ucuagucucucuggggccaca

SEQ ID NO: 1026239 - RNA, 20 nt, Homo sapiens
ucuagugucuuuugccuuua

SEQ ID NO: 1026240 - RNA, 14 nt, Homo sapiens
ucuaguuaaucaua

SEQ ID NO: 1026241 - RNA, 13 nt, Homo sapiens
ucuauaaauaacc

SEQ ID NO: 1026242 - RNA, 20 nt, Homo sapiens
ucuauacaaaaugauuuuga

SEQ ID NO: 1026243 - RNA, 18 nt, Homo sapiens
ucuauauuuuuguccaaa

SEQ ID NO: 1026244 - RNA, 14 nt, Homo sapiens
ucuaucaauaguca

SEQ ID NO: 1026245 - RNA, 19 nt, Homo sapiens
ucuaucugcuuaugcaguu

SEQ ID NO: 1026246 - RNA, 17 nt, Homo sapiens
ucuaugaaauaucaugc

SEQ ID NO: 1026247 - RNA, 21 nt, Homo sapiens
ucuaugccagcucagucccau

SEQ ID NO: 1026248 - RNA, 13 nt, Homo sapiens
ucuauguacugua

SEQ ID NO: 1026249 - RNA, 18 nt, Homo sapiens
ucuauuaaaucuugcaac

SEQ ID NO: 1026250 - RNA, 12 nt, Homo sapiens
ucuauucauuau

SEQ ID NO: 1026251 - RNA, 13 nt, Homo sapiens
ucuauugcugcuc

SEQ ID NO: 1026252 - RNA, 13 nt, Homo sapiens
ucuauuugugcuu

SEQ ID NO: 1026253 - RNA, 20 nt, Homo sapiens
ucuauuuucccucgcugggg

SEQ ID NO: 1026254 - RNA, 22 nt, Homo sapiens
ucucaaaaccggguugccagcu

SEQ ID NO: 1026255 - RNA, 22 nt, Homo sapiens
ucucaaaccaagcaaaggaagg

SEQ ID NO: 1026256 - RNA, 16 nt, Homo sapiens
ucucaaacuacuggca

SEQ ID NO: 1026257 - RNA, 14 nt, Homo sapiens
ucucaaauucucaa

SEQ ID NO: 1026258 - RNA, 21 nt, Homo sapiens
ucucaaauucucaaccuacca

SEQ ID NO: 1026259 - RNA, 17 nt, Homo sapiens
ucucaaauuuguggucc

SEQ ID NO: 1026260 - RNA, 14 nt, Homo sapiens
ucucaaguuuuauu

SEQ ID NO: 1026261 - RNA, 18 nt, Homo sapiens
ucucaauaaucaaugaag

SEQ ID NO: 1026262 - RNA, 14 nt, Homo sapiens
ucucaauucuuccc

SEQ ID NO: 1026263 - RNA, 14 nt, Homo sapiens
ucucaauuugcagu

SEQ ID NO: 1026264 - RNA, 20 nt, Homo sapiens
ucucacuauguugcccaggc

SEQ ID NO: 1026265 - RNA, 16 nt, Homo sapiens
ucucacuguugcccag

SEQ ID NO: 1026266 - RNA, 18 nt, Homo sapiens
ucucacuguugcccaggc

SEQ ID NO: 1026267 - RNA, 14 nt, Homo sapiens
ucucacuugucuca

SEQ ID NO: 1026268 - RNA, 19 nt, Homo sapiens
ucucagacugcauguacca

SEQ ID NO: 1026269 - RNA, 22 nt, Homo sapiens
ucucagagugguucugagauua

SEQ ID NO: 1026270 - RNA, 15 nt, Homo sapiens
ucucagccagccucc

SEQ ID NO: 1026271 - RNA, 18 nt, Homo sapiens
ucucagcuaccuaagaaa

SEQ ID NO: 1026272 - RNA, 13 nt, Homo sapiens
ucucagcucccau

SEQ ID NO: 1026273 - RNA, 21 nt, Homo sapiens
ucucagcuggaucuccauucu

SEQ ID NO: 1026274 - RNA, 14 nt, Homo sapiens
ucucaggaccaaag

SEQ ID NO: 1026275 - RNA, 19 nt, Homo sapiens
ucucaggaccaaagcuuuc

SEQ ID NO: 1026276 - RNA, 20 nt, Homo sapiens
ucucaggaccaaagcuuuca

SEQ ID NO: 1026277 - RNA, 12 nt, Homo sapiens
ucucagugcagg

SEQ ID NO: 1026278 - RNA, 13 nt, Homo sapiens
ucucagugcugua

SEQ ID NO: 1026279 - RNA, 21 nt, Homo sapiens
ucucaguggcuucaucuguca

SEQ ID NO: 1026280 - RNA, 15 nt, Homo sapiens
ucucaugagugccaa

SEQ ID NO: 1026281 - RNA, 23 nt, Homo sapiens
ucucaugauccaacuaaugccuu

SEQ ID NO: 1026282 - RNA, 16 nt, Homo sapiens
ucucauuuagaacuug

SEQ ID NO: 1026283 - RNA, 15 nt, Homo sapiens
ucucauuugucacac

SEQ ID NO: 1026284 - RNA, 13 nt, Homo sapiens
ucuccaaacaguc

SEQ ID NO: 1026285 - RNA, 14 nt, Homo sapiens
ucuccaaacaguca

SEQ ID NO: 1026286 - RNA, 19 nt, Homo sapiens
ucuccacuucuuguucccc

SEQ ID NO: 1026287 - RNA, 14 nt, Homo sapiens
ucuccacuuuguug

SEQ ID NO: 1026288 - RNA, 23 nt, Homo sapiens
ucuccagaugagaguacacccca

SEQ ID NO: 1026289 - RNA, 17 nt, Homo sapiens
ucuccagcccugcagcu

SEQ ID NO: 1026290 - RNA, 20 nt, Homo sapiens
ucuccaggauugaagagcau

SEQ ID NO: 1026291 - RNA, 22 nt, Homo sapiens
ucuccaggggccacaagaccau

SEQ ID NO: 1026292 - RNA, 16 nt, Homo sapiens
ucucccagcucagggc

SEQ ID NO: 1026293 - RNA, 15 nt, Homo sapiens
ucuccccugauuaca

SEQ ID NO: 1026294 - RNA, 14 nt, Homo sapiens
ucuccucagaagaa

SEQ ID NO: 1026295 - RNA, 20 nt, Homo sapiens
ucuccucugcagcucaggga

SEQ ID NO: 1026296 - RNA, 16 nt, Homo sapiens
ucuccuggacugccuu

SEQ ID NO: 1026297 - RNA, 13 nt, Homo sapiens
ucuccuguggucu

SEQ ID NO: 1026298 - RNA, 18 nt, Homo sapiens
ucucgcuuuguugcccag

SEQ ID NO: 1026299 - RNA, 18 nt, Homo sapiens
ucucguaacugguuucau

SEQ ID NO: 1026300 - RNA, 16 nt, Homo sapiens
ucucuaacucagaaac

SEQ ID NO: 1026301 - RNA, 21 nt, Homo sapiens
ucucuacaauuuugaaauaaa

SEQ ID NO: 1026302 - RNA, 18 nt, Homo sapiens
ucucuacugaaaguacaa

SEQ ID NO: 1026303 - RNA, 15 nt, Homo sapiens
ucucuagccacuuug

SEQ ID NO: 1026304 - RNA, 21 nt, Homo sapiens
ucucuaucuggccuuugcaug

SEQ ID NO: 1026305 - RNA, 15 nt, Homo sapiens
ucucuauugcugcuc

SEQ ID NO: 1026306 - RNA, 13 nt, Homo sapiens
ucucucacaugga

SEQ ID NO: 1026307 - RNA, 15 nt, Homo sapiens
ucucuccagccugac

SEQ ID NO: 1026308 - RNA, 13 nt, Homo sapiens
ucucuccccucaa

SEQ ID NO: 1026309 - RNA, 13 nt, Homo sapiens
ucucucuucucca

SEQ ID NO: 1026310 - RNA, 14 nt, Homo sapiens
ucucucuucuuuuc

SEQ ID NO: 1026311 - RNA, 18 nt, Homo sapiens
ucucucuugcuuacaaau

SEQ ID NO: 1026312 - RNA, 23 nt, Homo sapiens
ucucugaagaugaucauuugccc

SEQ ID NO: 1026313 - RNA, 14 nt, Homo sapiens
ucucugagcaguga

SEQ ID NO: 1026314 - RNA, 15 nt, Homo sapiens
ucucugagcagugaa

SEQ ID NO: 1026315 - RNA, 17 nt, Homo sapiens
ucucugaggacacuaac

SEQ ID NO: 1026316 - RNA, 16 nt, Homo sapiens
ucucugcaucacccac

SEQ ID NO: 1026317 - RNA, 23 nt, Homo sapiens
ucucugccaccaucaacccccca

SEQ ID NO: 1026318 - RNA, 12 nt, Homo sapiens
ucucugcucugc

SEQ ID NO: 1026319 - RNA, 21 nt, Homo sapiens
ucucugcuuuggaaaucacac

SEQ ID NO: 1026320 - RNA, 20 nt, Homo sapiens
ucucuggaaaggggggagcu

SEQ ID NO: 1026321 - RNA, 19 nt, Homo sapiens
ucucugucucaugugugcu

SEQ ID NO: 1026322 - RNA, 23 nt, Homo sapiens
ucucuuaaaaaaaaaauuacuuc

SEQ ID NO: 1026323 - RNA, 13 nt, Homo sapiens
ucucuuacauuga

SEQ ID NO: 1026324 - RNA, 22 nt, Homo sapiens
ucucuucuuuuggcuuccauga

SEQ ID NO: 1026325 - RNA, 16 nt, Homo sapiens
ucucuuguuauugcau

SEQ ID NO: 1026326 - RNA, 12 nt, Homo sapiens
ucucuuuggucu

SEQ ID NO: 1026327 - RNA, 14 nt, Homo sapiens
ucucuuuugagcua

SEQ ID NO: 1026328 - RNA, 21 nt, Homo sapiens
ucucuuuugagcuaaucuuca

SEQ ID NO: 1026329 - RNA, 16 nt, Homo sapiens
ucugaaaugaccucaa

SEQ ID NO: 1026330 - RNA, 20 nt, Homo sapiens
ucugaaauuuuaauugaacu

SEQ ID NO: 1026331 - RNA, 19 nt, Homo sapiens
ucugaaggucccaccucca

SEQ ID NO: 1026332 - RNA, 20 nt, Homo sapiens
ucugaagucacaucacagga

SEQ ID NO: 1026333 - RNA, 16 nt, Homo sapiens
ucugaauaacauuugu

SEQ ID NO: 1026334 - RNA, 13 nt, Homo sapiens
ucugaauccucau

SEQ ID NO: 1026335 - RNA, 17 nt, Homo sapiens
ucugacauccccacuca

SEQ ID NO: 1026336 - RNA, 18 nt, Homo sapiens
ucugacauccccacucac

SEQ ID NO: 1026337 - RNA, 22 nt, Homo sapiens
ucugaccaguuuaaccugaugc

SEQ ID NO: 1026338 - RNA, 15 nt, Homo sapiens
ucugacccacugcuu

SEQ ID NO: 1026339 - RNA, 16 nt, Homo sapiens
ucugacucacaagaag

SEQ ID NO: 1026340 - RNA, 11 nt, Homo sapiens
ucugacugcug

SEQ ID NO: 1026341 - RNA, 18 nt, Homo sapiens
ucugacuggcacagucuu

SEQ ID NO: 1026342 - RNA, 17 nt, Homo sapiens
ucugagaaggugagaua

SEQ ID NO: 1026343 - RNA, 15 nt, Homo sapiens
ucugagcuauuucau

SEQ ID NO: 1026344 - RNA, 21 nt, Homo sapiens
ucugagcucuggcuuugccuu

SEQ ID NO: 1026345 - RNA, 11 nt, Homo sapiens
ucugaguauaa

SEQ ID NO: 1026346 - RNA, 16 nt, Homo sapiens
ucugaucugaugcaag

SEQ ID NO: 1026347 - RNA, 14 nt, Homo sapiens
ucugaugucuccac

SEQ ID NO: 1026348 - RNA, 18 nt, Homo sapiens
ucugauuuuccuggacag

SEQ ID NO: 1026349 - RNA, 21 nt, Homo sapiens
ucugcaaaggaaauaccaguu

SEQ ID NO: 1026350 - RNA, 21 nt, Homo sapiens
ucugcaaaggcaccugaaugu

SEQ ID NO: 1026351 - RNA, 21 nt, Homo sapiens
ucugcaaaggcgucugaaugu

SEQ ID NO: 1026352 - RNA, 20 nt, Homo sapiens
ucugcaaugggcacugggau

SEQ ID NO: 1026353 - RNA, 22 nt, Homo sapiens
ucugcacauacgcaccacaucu

SEQ ID NO: 1026354 - RNA, 24 nt, Homo sapiens
ucugcacgcuuugggguguggaug

SEQ ID NO: 1026355 - RNA, 17 nt, Homo sapiens
ucugcagacugcugcua

SEQ ID NO: 1026356 - RNA, 16 nt, Homo sapiens
ucugcagcuaacuuau

SEQ ID NO: 1026357 - RNA, 21 nt, Homo sapiens
ucugcagggggugugucugcu

SEQ ID NO: 1026358 - RNA, 14 nt, Homo sapiens
ucugcaucuugggg

SEQ ID NO: 1026359 - RNA, 21 nt, Homo sapiens
ucugcauuaucugaggucaca

SEQ ID NO: 1026360 - RNA, 13 nt, Homo sapiens
ucugcauuuugcu

SEQ ID NO: 1026361 - RNA, 18 nt, Homo sapiens
ucugcauuuugcuauugu

SEQ ID NO: 1026362 - RNA, 19 nt, Homo sapiens
ucugccaauuuuugccuuc

SEQ ID NO: 1026363 - RNA, 14 nt, Homo sapiens
ucugccaccaaagg

SEQ ID NO: 1026364 - RNA, 16 nt, Homo sapiens
ucugccagaagauccc

SEQ ID NO: 1026365 - RNA, 16 nt, Homo sapiens
ucugcccagaauucua

SEQ ID NO: 1026366 - RNA, 23 nt, Homo sapiens
ucugcccgggaaggucaccagca

SEQ ID NO: 1026367 - RNA, 18 nt, Homo sapiens
ucugcccugcccuagcuc

SEQ ID NO: 1026368 - RNA, 13 nt, Homo sapiens
ucugcccuugcca

SEQ ID NO: 1026369 - RNA, 18 nt, Homo sapiens
ucugccuuccuugcuaau

SEQ ID NO: 1026370 - RNA, 21 nt, Homo sapiens
ucugccuuuggggacuuuucu

SEQ ID NO: 1026371 - RNA, 13 nt, Homo sapiens
ucugcgugacaau

SEQ ID NO: 1026372 - RNA, 16 nt, Homo sapiens
ugcaacagcacuggcu

SEQ ID NO: 1026373 - RNA, 16 nt, Homo sapiens
ugcaacuuagcucaca

SEQ ID NO: 1026374 - RNA, 21 nt, Homo sapiens
ugcaacuucuuacuucccuaa

SEQ ID NO: 1026375 - RNA, 13 nt, Homo sapiens
ugcaacuuguaaa

SEQ ID NO: 1026376 - RNA, 22 nt, Homo sapiens
ugcaagaauugaagcaggacua

SEQ ID NO: 1026377 - RNA, 21 nt, Homo sapiens
ugcaagacauagaauaguguu

SEQ ID NO: 1026378 - RNA, 15 nt, Homo sapiens
ugcaagagugacagu

SEQ ID NO: 1026379 - RNA, 15 nt, Homo sapiens
ugcaagcacaucugc

SEQ ID NO: 1026380 - RNA, 18 nt, Homo sapiens
ugcaagcagggcucugcc

SEQ ID NO: 1026381 - RNA, 22 nt, Homo sapiens
ugcaagccccugcuccagaaga

SEQ ID NO: 1026382 - RNA, 23 nt, Homo sapiens
ugcaagcuucuuuuaguuguauc

SEQ ID NO: 1026383 - RNA, 14 nt, Homo sapiens
ugcaaggggcucaa

SEQ ID NO: 1026384 - RNA, 15 nt, Homo sapiens
ugcaagucagaggau

SEQ ID NO: 1026385 - RNA, 23 nt, Homo sapiens
ugcaagucaggacaucagucuga

SEQ ID NO: 1026386 - RNA, 16 nt, Homo sapiens
ugcaagugacaucucu

SEQ ID NO: 1026387 - RNA, 20 nt, Homo sapiens
ugcaagugucugugugcaag

SEQ ID NO: 1026388 - RNA, 19 nt, Homo sapiens
ugcaagugugugcacaugu

SEQ ID NO: 1026389 - RNA, 16 nt, Homo sapiens
ugcaagugugugcaug

SEQ ID NO: 1026390 - RNA, 17 nt, Homo sapiens
ugcaagugugugcaugu

SEQ ID NO: 1026391 - RNA, 18 nt, Homo sapiens
ugcaauaggugugcguca

SEQ ID NO: 1026392 - RNA, 20 nt, Homo sapiens
ugcaaucgguuuaaacaugg

SEQ ID NO: 1026393 - RNA, 16 nt, Homo sapiens
ugcaaucuguguucga

SEQ ID NO: 1026394 - RNA, 18 nt, Homo sapiens
ugcaaugggcacugggau

SEQ ID NO: 1026395 - RNA, 15 nt, Homo sapiens
ugcacaaagcccuuc

SEQ ID NO: 1026396 - RNA, 16 nt, Homo sapiens
ugcacaaagcccuucc

SEQ ID NO: 1026397 - RNA, 19 nt, Homo sapiens
ugcacaacauuacagggaa

SEQ ID NO: 1026398 - RNA, 13 nt, Homo sapiens
ugcacacaccaga

SEQ ID NO: 1026399 - RNA, 21 nt, Homo sapiens
ugcacacuccccugcacugga

SEQ ID NO: 1026400 - RNA, 13 nt, Homo sapiens
ugcacacugccug

SEQ ID NO: 1026401 - RNA, 22 nt, Homo sapiens
ugcacagaucugcuugaucaau

SEQ ID NO: 1026402 - RNA, 22 nt, Homo sapiens
ugcacauacgcaccacaucucu

SEQ ID NO: 1026403 - RNA, 23 nt, Homo sapiens
ugcacauaguagguacccaauuc

SEQ ID NO: 1026404 - RNA, 22 nt, Homo sapiens
ugcacauauggacucugcacau

SEQ ID NO: 1026405 - RNA, 13 nt, Homo sapiens
ugcacaugaaucc

SEQ ID NO: 1026406 - RNA, 17 nt, Homo sapiens
ugcacaugcacgugugu

SEQ ID NO: 1026407 - RNA, 24 nt, Homo sapiens
ugcacaugugugcgugugcgugca

SEQ ID NO: 1026408 - RNA, 23 nt, Homo sapiens
ugcacauuaaggagaaaucuaua

SEQ ID NO: 1026409 - RNA, 16 nt, Homo sapiens
ugcaccaagcaggaaa

SEQ ID NO: 1026410 - RNA, 17 nt, Homo sapiens
ugcaccacuucaaguga

SEQ ID NO: 1026411 - RNA, 19 nt, Homo sapiens
ugcaccccaccagcaauac

SEQ ID NO: 1026412 - RNA, 19 nt, Homo sapiens
ugcacgggagaauauacaa

SEQ ID NO: 1026413 - RNA, 12 nt, Homo sapiens
ugcacgugugca

SEQ ID NO: 1026414 - RNA, 12 nt, Homo sapiens
ugcacgugugua

SEQ ID NO: 1026415 - RNA, 18 nt, Homo sapiens
ugcacguguguauugcaa

SEQ ID NO: 1026416 - RNA, 14 nt, Homo sapiens
ugcacgugugugca

SEQ ID NO: 1026417 - RNA, 18 nt, Homo sapiens
ugcacucagcucuuggcu

SEQ ID NO: 1026418 - RNA, 14 nt, Homo sapiens
ugcacuccagccug

SEQ ID NO: 1026419 - RNA, 22 nt, Homo sapiens
ugcacucuaaaagguucaggga

SEQ ID NO: 1026420 - RNA, 22 nt, Homo sapiens
ugcacuggggagcccgucucag

SEQ ID NO: 1026421 - RNA, 21 nt, Homo sapiens
ugcacugucgauaaucagaga

SEQ ID NO: 1026422 - RNA, 18 nt, Homo sapiens
ugcacuuauacccaugaa

SEQ ID NO: 1026423 - RNA, 15 nt, Homo sapiens
ugcacuuauucucaa

SEQ ID NO: 1026424 - RNA, 17 nt, Homo sapiens
ugcacuuauucucaaga

SEQ ID NO: 1026425 - RNA, 11 nt, Homo sapiens
ugcacuuuuaa

SEQ ID NO: 1026426 - RNA, 20 nt, Homo sapiens
ugcacuuuuuuauaagagcu

SEQ ID NO: 1026427 - RNA, 16 nt, Homo sapiens
ugcagaaaauugccua

SEQ ID NO: 1026428 - RNA, 18 nt, Homo sapiens
ugcagaaaauugccuaaa

SEQ ID NO: 1026429 - RNA, 16 nt, Homo sapiens
ugcagagcugaagauu

SEQ ID NO: 1026430 - RNA, 20 nt, Homo sapiens
ugcagagggacagaugacca

SEQ ID NO: 1026431 - RNA, 21 nt, Homo sapiens
ugcagaggggcccaugaaaga

SEQ ID NO: 1026432 - RNA, 16 nt, Homo sapiens
ugcagagugcccagaa

SEQ ID NO: 1026433 - RNA, 15 nt, Homo sapiens
ugcagauaaacagua

SEQ ID NO: 1026434 - RNA, 19 nt, Homo sapiens
ugcagcagaggcacugggg

SEQ ID NO: 1026435 - RNA, 15 nt, Homo sapiens
ugcagcccaugccca

SEQ ID NO: 1026436 - RNA, 18 nt, Homo sapiens
ugcagccuccccaggugu

SEQ ID NO: 1026437 - RNA, 19 nt, Homo sapiens
ugcagcuuauauucaucca

SEQ ID NO: 1026438 - RNA, 23 nt, Homo sapiens
ugcaggaagugucuagaggaaua

SEQ ID NO: 1026439 - RNA, 17 nt, Homo sapiens
ugcaggauuucuucaca

SEQ ID NO: 1026440 - RNA, 16 nt, Homo sapiens
ugcaggcaucacagcu

SEQ ID NO: 1026441 - RNA, 17 nt, Homo sapiens
ugcaggcaucacagcua

SEQ ID NO: 1026442 - RNA, 15 nt, Homo sapiens
ugcagucacagcuac

SEQ ID NO: 1026443 - RNA, 20 nt, Homo sapiens
ugcaguccugggauguggcu

SEQ ID NO: 1026444 - RNA, 23 nt, Homo sapiens
ugcaguccugggauguggcugca

SEQ ID NO: 1026445 - RNA, 15 nt, Homo sapiens
ugcagucugggugcu

SEQ ID NO: 1026446 - RNA, 17 nt, Homo sapiens
ugcagugacagcuugag

SEQ ID NO: 1026447 - RNA, 21 nt, Homo sapiens
ugcaguucaccugcacuuaag

SEQ ID NO: 1026448 - RNA, 21 nt, Homo sapiens
ugcauaaauaugcagugauau

SEQ ID NO: 1026449 - RNA, 18 nt, Homo sapiens
ugcauaagugcaugacau

SEQ ID NO: 1026450 - RNA, 22 nt, Homo sapiens
ugcauaaucauaugguugacag

SEQ ID NO: 1026451 - RNA, 23 nt, Homo sapiens
ugcauaccacuuuuguucuuggu

SEQ ID NO: 1026452 - RNA, 21 nt, Homo sapiens
ugcauaguucccauguuaaau

SEQ ID NO: 1026453 - RNA, 20 nt, Homo sapiens
ugcauauuuuauuauaguca

SEQ ID NO: 1026454 - RNA, 16 nt, Homo sapiens
ugcaucguggagacag

SEQ ID NO: 1026455 - RNA, 20 nt, Homo sapiens
ugcaucguggagacagggca

SEQ ID NO: 1026456 - RNA, 18 nt, Homo sapiens
ugcaucuggguagcugua

SEQ ID NO: 1026457 - RNA, 18 nt, Homo sapiens
ugcaucuucccacagugg

SEQ ID NO: 1026458 - RNA, 18 nt, Homo sapiens
ugcaugaaguaauaugca

SEQ ID NO: 1026459 - RNA, 21 nt, Homo sapiens
ugcauguaccauuugcauggc

SEQ ID NO: 1026460 - RNA, 21 nt, Homo sapiens
ugcauguauuuauccaauaaa

SEQ ID NO: 1026461 - RNA, 21 nt, Homo sapiens
ugcaugucaucuucuaggcca

SEQ ID NO: 1026462 - RNA, 16 nt, Homo sapiens
ugcaugugacucugaa

SEQ ID NO: 1026463 - RNA, 15 nt, Homo sapiens
ugcauuaaacugaau

SEQ ID NO: 1026464 - RNA, 14 nt, Homo sapiens
ugcauuacuuugaa

SEQ ID NO: 1026465 - RNA, 12 nt, Homo sapiens
ugcauuaucuau

SEQ ID NO: 1026466 - RNA, 15 nt, Homo sapiens
ugcauucacccagac

SEQ ID NO: 1026467 - RNA, 18 nt, Homo sapiens
ugcauugagaacugcaua

SEQ ID NO: 1026468 - RNA, 13 nt, Homo sapiens
ugcauugagcucu

SEQ ID NO: 1026469 - RNA, 18 nt, Homo sapiens
ugcauugcuaaaauauua

SEQ ID NO: 1026470 - RNA, 21 nt, Homo sapiens
ugcauuggaagaccccaccca

SEQ ID NO: 1026471 - RNA, 21 nt, Homo sapiens
ugcauuguuaaucauccauca

SEQ ID NO: 1026472 - RNA, 20 nt, Homo sapiens
ugcauuuauggucaacacuu

SEQ ID NO: 1026473 - RNA, 22 nt, Homo sapiens
ugcauuuauggucaacacuuaa

SEQ ID NO: 1026474 - RNA, 18 nt, Homo sapiens
ugcauuugcagugcauca

SEQ ID NO: 1026475 - RNA, 21 nt, Homo sapiens
ugcauuugugcccacucucca

SEQ ID NO: 1026476 - RNA, 19 nt, Homo sapiens
ugcauuuucccagauacuu

SEQ ID NO: 1026477 - RNA, 15 nt, Homo sapiens
ugccaaacagccaca

SEQ ID NO: 1026478 - RNA, 18 nt, Homo sapiens
ugccaaagggaaauauca

SEQ ID NO: 1026479 - RNA, 15 nt, Homo sapiens
ugccaaauguuccau

SEQ ID NO: 1026480 - RNA, 21 nt, Homo sapiens
ugccaacaauccuagugcuuu

SEQ ID NO: 1026481 - RNA, 20 nt, Homo sapiens
ugccaaccucuggagcaaug

SEQ ID NO: 1026482 - RNA, 18 nt, Homo sapiens
ugccaaccuuauagggau

SEQ ID NO: 1026483 - RNA, 19 nt, Homo sapiens
ugccaagcacugugcucag

SEQ ID NO: 1026484 - RNA, 15 nt, Homo sapiens
ugccaagcuccucaa

SEQ ID NO: 1026485 - RNA, 23 nt, Homo sapiens
ugccacagccuccccugccaggg

SEQ ID NO: 1026486 - RNA, 21 nt, Homo sapiens
ugccagcauuuagacccugca

SEQ ID NO: 1026487 - RNA, 17 nt, Homo sapiens
ugccagugggaacuccu

SEQ ID NO: 1026488 - RNA, 14 nt, Homo sapiens
ugccauagcaagau

SEQ ID NO: 1026489 - RNA, 23 nt, Homo sapiens
ugccaucaagaugagagaacugg

SEQ ID NO: 1026490 - RNA, 19 nt, Homo sapiens
ugccauccucaaacacugc

SEQ ID NO: 1026491 - RNA, 20 nt, Homo sapiens
ugccauccucacccagcacc

SEQ ID NO: 1026492 - RNA, 23 nt, Homo sapiens
ugccauccucccaaggggcccaa

SEQ ID NO: 1026493 - RNA, 15 nt, Homo sapiens
ugccaugccagcuua

SEQ ID NO: 1026494 - RNA, 20 nt, Homo sapiens
ugcccaaguuguggugcuga

SEQ ID NO: 1026495 - RNA, 16 nt, Homo sapiens
ugcccacuauggucau

SEQ ID NO: 1026496 - RNA, 20 nt, Homo sapiens
ugcccacucuccauccuccc

SEQ ID NO: 1026497 - RNA, 23 nt, Homo sapiens
ugcccagaauaaguuauugcagu

SEQ ID NO: 1026498 - RNA, 21 nt, Homo sapiens
ugcccagcccggaccuuggca

SEQ ID NO: 1026499 - RNA, 19 nt, Homo sapiens
ugcccaggaaccucagggc

SEQ ID NO: 1026500 - RNA, 20 nt, Homo sapiens
ugcccaggcuggagugcaau

SEQ ID NO: 1026501 - RNA, 17 nt, Homo sapiens
ugcccaggcuggucuca

SEQ ID NO: 1026502 - RNA, 15 nt, Homo sapiens
ugcccagggcucagc

SEQ ID NO: 1026503 - RNA, 18 nt, Homo sapiens
ugcccagugaccagucac

SEQ ID NO: 1026504 - RNA, 19 nt, Homo sapiens
ugcccagugaccagucacu

SEQ ID NO: 1026505 - RNA, 16 nt, Homo sapiens
ugcccaguguguuucu

SEQ ID NO: 1026506 - RNA, 20 nt, Homo sapiens
ugccccaaacaaauaugcaa

SEQ ID NO: 1026507 - RNA, 16 nt, Homo sapiens
ugccccagggaccuuu

SEQ ID NO: 1026508 - RNA, 17 nt, Homo sapiens
ugcccccaauccaugaa

SEQ ID NO: 1026509 - RNA, 18 nt, Homo sapiens
ugcccccagggcacuuca

SEQ ID NO: 1026510 - RNA, 19 nt, Homo sapiens
ugccccccagccucuggca

SEQ ID NO: 1026511 - RNA, 16 nt, Homo sapiens
ugccccccuugccaga

SEQ ID NO: 1026512 - RNA, 17 nt, Homo sapiens
ugccccccuugccagac

SEQ ID NO: 1026513 - RNA, 20 nt, Homo sapiens
ugccccguccacggcucuag

SEQ ID NO: 1026514 - RNA, 19 nt, Homo sapiens
uguagauaaacucagaaau

SEQ ID NO: 1026515 - RNA, 17 nt, Homo sapiens
uguagauauugugaagu

SEQ ID NO: 1026516 - RNA, 17 nt, Homo sapiens
uguagauggcggugaug

SEQ ID NO: 1026517 - RNA, 17 nt, Homo sapiens
uguaggaagaguagcau

SEQ ID NO: 1026518 - RNA, 13 nt, Homo sapiens
uguaguagucuca

SEQ ID NO: 1026519 - RNA, 21 nt, Homo sapiens
uguagucccagcuacucagga

SEQ ID NO: 1026520 - RNA, 13 nt, Homo sapiens
uguagucucagga

SEQ ID NO: 1026521 - RNA, 15 nt, Homo sapiens
uguauaaacuaucag

SEQ ID NO: 1026522 - RNA, 20 nt, Homo sapiens
uguauaaagcaacuguuaug

SEQ ID NO: 1026523 - RNA, 14 nt, Homo sapiens
uguauauaguauga

SEQ ID NO: 1026524 - RNA, 15 nt, Homo sapiens
uguauauuuguacaa

SEQ ID NO: 1026525 - RNA, 16 nt, Homo sapiens
uguaucaaaugugaca

SEQ ID NO: 1026526 - RNA, 18 nt, Homo sapiens
uguaucauuaugaaguca

SEQ ID NO: 1026527 - RNA, 15 nt, Homo sapiens
uguaugaccacuggg

SEQ ID NO: 1026528 - RNA, 20 nt, Homo sapiens
uguaugauuacaucaaggcu

SEQ ID NO: 1026529 - RNA, 18 nt, Homo sapiens
uguaugcacgugugcaca

SEQ ID NO: 1026530 - RNA, 16 nt, Homo sapiens
uguaugccaagugaga

SEQ ID NO: 1026531 - RNA, 15 nt, Homo sapiens
uguauggcacuggca

SEQ ID NO: 1026532 - RNA, 17 nt, Homo sapiens
uguauguuccucuauga

SEQ ID NO: 1026533 - RNA, 12 nt, Homo sapiens
uguauucacuua

SEQ ID NO: 1026534 - RNA, 20 nt, Homo sapiens
uguauuuuuaauauaugcau

SEQ ID NO: 1026535 - RNA, 17 nt, Homo sapiens
uguauuuuuacuuuuaa

SEQ ID NO: 1026536 - RNA, 19 nt, Homo sapiens
ugucaagacaaggucuugc

SEQ ID NO: 1026537 - RNA, 20 nt, Homo sapiens
ugucacaccagccauacuua

SEQ ID NO: 1026538 - RNA, 19 nt, Homo sapiens
ugucaccguggaccuuccu

SEQ ID NO: 1026539 - RNA, 22 nt, Homo sapiens
ugucacuacgugacuguggcac

SEQ ID NO: 1026540 - RNA, 13 nt, Homo sapiens
ugucagaguagaa

SEQ ID NO: 1026541 - RNA, 17 nt, Homo sapiens
ugucagcaucagcucag

SEQ ID NO: 1026542 - RNA, 18 nt, Homo sapiens
ugucaguaguuuuacuga

SEQ ID NO: 1026543 - RNA, 14 nt, Homo sapiens
ugucagucagggac

SEQ ID NO: 1026544 - RNA, 22 nt, Homo sapiens
ugucauaagcgaucacuuccua

SEQ ID NO: 1026545 - RNA, 20 nt, Homo sapiens
ugucaucagccaccauccua

SEQ ID NO: 1026546 - RNA, 11 nt, Homo sapiens
ugucaucucag

SEQ ID NO: 1026547 - RNA, 17 nt, Homo sapiens
ugucaucugucacuaua

SEQ ID NO: 1026548 - RNA, 22 nt, Homo sapiens
ugucaucuuccuggaagcagag

SEQ ID NO: 1026549 - RNA, 23 nt, Homo sapiens
uguccaaauggacauaagacaga

SEQ ID NO: 1026550 - RNA, 17 nt, Homo sapiens
uguccaugugugugcaa

SEQ ID NO: 1026551 - RNA, 15 nt, Homo sapiens
ugucccagaaaagca

SEQ ID NO: 1026552 - RNA, 16 nt, Homo sapiens
ugucccagaaugccuc

SEQ ID NO: 1026553 - RNA, 18 nt, Homo sapiens
ugucccagaaugccuccu

SEQ ID NO: 1026554 - RNA, 15 nt, Homo sapiens
uguccccuccacugu

SEQ ID NO: 1026555 - RNA, 21 nt, Homo sapiens
uguccccuuuuauugcugcuu

SEQ ID NO: 1026556 - RNA, 15 nt, Homo sapiens
ugucccucauccaua

SEQ ID NO: 1026557 - RNA, 19 nt, Homo sapiens
uguccucaucagucuccau

SEQ ID NO: 1026558 - RNA, 21 nt, Homo sapiens
uguccuuuuggcacugagaua

SEQ ID NO: 1026559 - RNA, 22 nt, Homo sapiens
ugucgggcucauuuugcucaac

SEQ ID NO: 1026560 - RNA, 13 nt, Homo sapiens
ugucguagccaag

SEQ ID NO: 1026561 - RNA, 17 nt, Homo sapiens
ugucuaaaaucccuccu

SEQ ID NO: 1026562 - RNA, 14 nt, Homo sapiens
ugucucagccuccc

SEQ ID NO: 1026563 - RNA, 12 nt, Homo sapiens
ugucucauauga

SEQ ID NO: 1026564 - RNA, 16 nt, Homo sapiens
ugucuccacacacagc

SEQ ID NO: 1026565 - RNA, 19 nt, Homo sapiens
ugucuccaucucugucuca

SEQ ID NO: 1026566 - RNA, 21 nt, Homo sapiens
ugucucgaugcaaugaacacu

SEQ ID NO: 1026567 - RNA, 14 nt, Homo sapiens
ugucucugucaugg

SEQ ID NO: 1026568 - RNA, 16 nt, Homo sapiens
ugucucuucugagcua

SEQ ID NO: 1026569 - RNA, 22 nt, Homo sapiens
ugucugggugaccucacuuuag

SEQ ID NO: 1026570 - RNA, 13 nt, Homo sapiens
ugucugugugcaa

SEQ ID NO: 1026571 - RNA, 15 nt, Homo sapiens
ugucuguuaacuuaa

SEQ ID NO: 1026572 - RNA, 22 nt, Homo sapiens
ugucuguuuuuguaacuuaaaa

SEQ ID NO: 1026573 - RNA, 22 nt, Homo sapiens
ugucuucagcuguacauacuca

SEQ ID NO: 1026574 - RNA, 13 nt, Homo sapiens
ugucuucucaggc

SEQ ID NO: 1026575 - RNA, 19 nt, Homo sapiens
ugucuucuguauucacuua

SEQ ID NO: 1026576 - RNA, 18 nt, Homo sapiens
ugucuuggacacuguaca

SEQ ID NO: 1026577 - RNA, 22 nt, Homo sapiens
ugucuuguccccucuugaccca

SEQ ID NO: 1026578 - RNA, 14 nt, Homo sapiens
ugucuuucagccaa

SEQ ID NO: 1026579 - RNA, 21 nt, Homo sapiens
ugucuuucugagcacacuuua

SEQ ID NO: 1026580 - RNA, 18 nt, Homo sapiens
ugucuuuuuucacuacau

SEQ ID NO: 1026581 - RNA, 17 nt, Homo sapiens
ugugaaacuggcacuga

SEQ ID NO: 1026582 - RNA, 16 nt, Homo sapiens
ugugaaagaaccaaaa

SEQ ID NO: 1026583 - RNA, 18 nt, Homo sapiens
ugugaacccaaaguguga

SEQ ID NO: 1026584 - RNA, 19 nt, Homo sapiens
ugugaacuaaacuuucaca

SEQ ID NO: 1026585 - RNA, 23 nt, Homo sapiens
ugugaaugaugauccuaggcauu

SEQ ID NO: 1026586 - RNA, 17 nt, Homo sapiens
ugugaauguggauucuu

SEQ ID NO: 1026587 - RNA, 15 nt, Homo sapiens
ugugaccagggguga

SEQ ID NO: 1026588 - RNA, 21 nt, Homo sapiens
ugugaccauuagcauuuguca

SEQ ID NO: 1026589 - RNA, 16 nt, Homo sapiens
ugugaccugugucacu

SEQ ID NO: 1026590 - RNA, 12 nt, Homo sapiens
ugugagcaagaa

SEQ ID NO: 1026591 - RNA, 16 nt, Homo sapiens
ugugagccaccacguc

SEQ ID NO: 1026592 - RNA, 13 nt, Homo sapiens
ugugauaaaaccc

SEQ ID NO: 1026593 - RNA, 22 nt, Homo sapiens
ugugauauguaccuaacgaagu

SEQ ID NO: 1026594 - RNA, 19 nt, Homo sapiens
ugugauauuuuuacuugca

SEQ ID NO: 1026595 - RNA, 18 nt, Homo sapiens
ugugaucuaucaauaguc

SEQ ID NO: 1026596 - RNA, 17 nt, Homo sapiens
ugugaugggcuguuuaa

SEQ ID NO: 1026597 - RNA, 19 nt, Homo sapiens
ugugauucaaucuguaaac

SEQ ID NO: 1026598 - RNA, 20 nt, Homo sapiens
ugugauugacgggacuguug

SEQ ID NO: 1026599 - RNA, 21 nt, Homo sapiens
ugugcaagugucugugugcaa

SEQ ID NO: 1026600 - RNA, 15 nt, Homo sapiens
ugugcacaugaaucc

SEQ ID NO: 1026601 - RNA, 14 nt, Homo sapiens
ugugcacaugugug

SEQ ID NO: 1026602 - RNA, 13 nt, Homo sapiens
ugugcacauuuau

SEQ ID NO: 1026603 - RNA, 16 nt, Homo sapiens
ugugcaucuguacuca

SEQ ID NO: 1026604 - RNA, 23 nt, Homo sapiens
ugugcauuaucuagauacuguau

SEQ ID NO: 1026605 - RNA, 22 nt, Homo sapiens
ugugccacucaccgaagccacu

SEQ ID NO: 1026606 - RNA, 20 nt, Homo sapiens
ugugccggcuuucaaguuug

SEQ ID NO: 1026607 - RNA, 21 nt, Homo sapiens
ugugccuggcucagagccagu

SEQ ID NO: 1026608 - RNA, 16 nt, Homo sapiens
ugugcggaucucugga

SEQ ID NO: 1026609 - RNA, 17 nt, Homo sapiens
ugugcgugcaugugcac

SEQ ID NO: 1026610 - RNA, 15 nt, Homo sapiens
ugugcgugugugcaa

SEQ ID NO: 1026611 - RNA, 16 nt, Homo sapiens
ugugcgugugugcaag

SEQ ID NO: 1026612 - RNA, 13 nt, Homo sapiens
ugugcucagggaa

SEQ ID NO: 1026613 - RNA, 22 nt, Homo sapiens
ugugcuccuccuacccuuccag

SEQ ID NO: 1026614 - RNA, 14 nt, Homo sapiens
uguggaaaguguaa

SEQ ID NO: 1026615 - RNA, 13 nt, Homo sapiens
uguggacugugau

SEQ ID NO: 1026616 - RNA, 16 nt, Homo sapiens
uguggaugagaggaac

SEQ ID NO: 1026617 - RNA, 17 nt, Homo sapiens
uguggaugauaaaacac

SEQ ID NO: 1026618 - RNA, 21 nt, Homo sapiens
uguggauucuucccacacaga

SEQ ID NO: 1026619 - RNA, 16 nt, Homo sapiens
uguggccccaacacaa

SEQ ID NO: 1026620 - RNA, 14 nt, Homo sapiens
uguggcgcagcaua

SEQ ID NO: 1026621 - RNA, 17 nt, Homo sapiens
uguggcggcguaauccc

SEQ ID NO: 1026622 - RNA, 16 nt, Homo sapiens
uguggcucacgugugu

SEQ ID NO: 1026623 - RNA, 17 nt, Homo sapiens
uguggcucacgugugug

SEQ ID NO: 1026624 - RNA, 14 nt, Homo sapiens
uguggcuuccucag

SEQ ID NO: 1026625 - RNA, 15 nt, Homo sapiens
ugugggcuccaugua

SEQ ID NO: 1026626 - RNA, 14 nt, Homo sapiens
ugugggcugugagu

SEQ ID NO: 1026627 - RNA, 20 nt, Homo sapiens
ugugggguccccaucauccc

SEQ ID NO: 1026628 - RNA, 19 nt, Homo sapiens
ugugggugucagucaggga

SEQ ID NO: 1026629 - RNA, 20 nt, Homo sapiens
ugugguagcgccauggcugu

SEQ ID NO: 1026630 - RNA, 20 nt, Homo sapiens
uguggucaauccgaaguaug

SEQ ID NO: 1026631 - RNA, 21 nt, Homo sapiens
uguggucaauccgaaguauga

SEQ ID NO: 1026632 - RNA, 14 nt, Homo sapiens
uguggucacaggaa

SEQ ID NO: 1026633 - RNA, 21 nt, Homo sapiens
ugugguccagguccuuuccac

SEQ ID NO: 1026634 - RNA, 21 nt, Homo sapiens
ugugguccgaagucuuccaua

SEQ ID NO: 1026635 - RNA, 13 nt, Homo sapiens
uguguacaaagug

SEQ ID NO: 1026636 - RNA, 16 nt, Homo sapiens
uguguauauaguauga

SEQ ID NO: 1026637 - RNA, 21 nt, Homo sapiens
uguguauucauugaagucaga

SEQ ID NO: 1026638 - RNA, 17 nt, Homo sapiens
uguguauuuaacugccu

SEQ ID NO: 1026639 - RNA, 15 nt, Homo sapiens
ugugucagcuacugc

SEQ ID NO: 1026640 - RNA, 14 nt, Homo sapiens
ugugucccaugacc

SEQ ID NO: 1026641 - RNA, 19 nt, Homo sapiens
ugugucccccucuguccag

SEQ ID NO: 1026642 - RNA, 13 nt, Homo sapiens
ugugucccuccug

SEQ ID NO: 1026643 - RNA, 22 nt, Homo sapiens
ugugucgggcucauuuugcuca

SEQ ID NO: 1026644 - RNA, 12 nt, Homo sapiens
ugugucuguaca

SEQ ID NO: 1026645 - RNA, 12 nt, Homo sapiens
ugugugaucugu

SEQ ID NO: 1026646 - RNA, 19 nt, Homo sapiens
ugugugcacaugugugcgu

SEQ ID NO: 1026647 - RNA, 16 nt, Homo sapiens
ugugugcacguacaca

SEQ ID NO: 1026648 - RNA, 21 nt, Homo sapiens
ugugugcacguacacacacau

SEQ ID NO: 1026649 - RNA, 19 nt, Homo sapiens
uguguggcauuuucacuuu

SEQ ID NO: 1026650 - RNA, 17 nt, Homo sapiens
uguguggggugggcaca

SEQ ID NO: 1026651 - RNA, 12 nt, Homo sapiens
uguguguagcca

SEQ ID NO: 1026652 - RNA, 22 nt, Homo sapiens
uguguguauauaguaugaaugc

SEQ ID NO: 1026653 - RNA, 19 nt, Homo sapiens
uguguguauguuugcacac

SEQ ID NO: 1026654 - RNA, 14 nt, Homo sapiens
ugugugugugcaag

SEQ ID NO: 1026655 - RNA, 19 nt, Homo sapiens
uguguucucuauugcugcu

SEQ ID NO: 1026656 - RNA, 18 nt, Homo sapiens
uguguuucaaguggggcu

SEQ ID NO: 1026657 - RNA, 21 nt, Homo sapiens
uguguuuccuucagugcaucu

SEQ ID NO: 1026658 - RNA, 14 nt, Homo sapiens
uguguuuuuaauaa

SEQ ID NO: 1026659 - RNA, 16 nt, Homo sapiens
aaaacuccaucucaaa

SEQ ID NO: 1026660 - RNA, 16 nt, Homo sapiens
aaaacucgaggacugu

SEQ ID NO: 1026661 - RNA, 22 nt, Homo sapiens
aaaacucugggaaauaagagag

SEQ ID NO: 1026662 - RNA, 20 nt, Homo sapiens
aaaacugauuuuuagcuuua

SEQ ID NO: 1026663 - RNA, 19 nt, Homo sapiens
aaaacuucaguaaguacgu

SEQ ID NO: 1026664 - RNA, 13 nt, Homo sapiens
aaaacuucuuuaa

SEQ ID NO: 1026665 - RNA, 18 nt, Homo sapiens
aaaacuuuucuaauacuc

SEQ ID NO: 1026666 - RNA, 23 nt, Homo sapiens
aaaacuuuucuaauacucuaccc

SEQ ID NO: 1026667 - RNA, 18 nt, Homo sapiens
aaaagaaacacgcacuua

SEQ ID NO: 1026668 - RNA, 21 nt, Homo sapiens
aaaagaagacaacauuucuca

SEQ ID NO: 1026669 - RNA, 16 nt, Homo sapiens
aaaagaauacagaaag

SEQ ID NO: 1026670 - RNA, 13 nt, Homo sapiens
aaaagaccuauga

SEQ ID NO: 1026671 - RNA, 15 nt, Homo sapiens
aaaagacuccaaaga

SEQ ID NO: 1026672 - RNA, 18 nt, Homo sapiens
aaaagaguuaacauccca

SEQ ID NO: 1026673 - RNA, 22 nt, Homo sapiens
aaaagaugcauuaucuaugaua

SEQ ID NO: 1026674 - RNA, 13 nt, Homo sapiens
aaaagauguagau

SEQ ID NO: 1026675 - RNA, 18 nt, Homo sapiens
aaaagauuuguuuuguca

SEQ ID NO: 1026676 - RNA, 18 nt, Homo sapiens
aaaagcagcuauuugccu

SEQ ID NO: 1026677 - RNA, 13 nt, Homo sapiens
aaaagccaugagu

SEQ ID NO: 1026678 - RNA, 13 nt, Homo sapiens
aaaagcugggcag

SEQ ID NO: 1026679 - RNA, 21 nt, Homo sapiens
aaaaggaaacuguacuacauc

SEQ ID NO: 1026680 - RNA, 18 nt, Homo sapiens
aaaaggaaggcucuucuc

SEQ ID NO: 1026681 - RNA, 16 nt, Homo sapiens
aaaagggaacugaaca

SEQ ID NO: 1026682 - RNA, 22 nt, Homo sapiens
aaaagggaagucuagaguuccu

SEQ ID NO: 1026683 - RNA, 14 nt, Homo sapiens
aaaagggagauuca

SEQ ID NO: 1026684 - RNA, 18 nt, Homo sapiens
aaaagggcagggcaucuc

SEQ ID NO: 1026685 - RNA, 22 nt, Homo sapiens
aaaagguuaaacccacagccaa

SEQ ID NO: 1026686 - RNA, 22 nt, Homo sapiens
aaaaguaaguaccacucaggcc

SEQ ID NO: 1026687 - RNA, 19 nt, Homo sapiens
aaaaguagguuuacauuca

SEQ ID NO: 1026688 - RNA, 21 nt, Homo sapiens
aaaagugaucaauaaaaugug

SEQ ID NO: 1026689 - RNA, 15 nt, Homo sapiens
aaaaguuaugguacu

SEQ ID NO: 1026690 - RNA, 22 nt, Homo sapiens
aaaaguuuggccgggugcggug

SEQ ID NO: 1026691 - RNA, 18 nt, Homo sapiens
aaaauaagcacugugcua

SEQ ID NO: 1026692 - RNA, 12 nt, Homo sapiens
aaaauaauucua

SEQ ID NO: 1026693 - RNA, 15 nt, Homo sapiens
aaaauagcucuuuca

SEQ ID NO: 1026694 - RNA, 17 nt, Homo sapiens
aaaauauguucuuuaaa

SEQ ID NO: 1026695 - RNA, 13 nt, Homo sapiens
aaaauauugcuuc

SEQ ID NO: 1026696 - RNA, 19 nt, Homo sapiens
aaaauauuuuuaugugcaa

SEQ ID NO: 1026697 - RNA, 21 nt, Homo sapiens
aaaaucuauuuuguaacuuuc

SEQ ID NO: 1026698 - RNA, 19 nt, Homo sapiens
aaaaucucaauucuucccu

SEQ ID NO: 1026699 - RNA, 22 nt, Homo sapiens
aaaaucucagcaaugauuacuc

SEQ ID NO: 1026700 - RNA, 20 nt, Homo sapiens
aaaaucugaaaaugugaaua

SEQ ID NO: 1026701 - RNA, 21 nt, Homo sapiens
aaaaucuuuguuacucuguaa

SEQ ID NO: 1026702 - RNA, 14 nt, Homo sapiens
aaaaugagguacuc

SEQ ID NO: 1026703 - RNA, 15 nt, Homo sapiens
aaaaugaguuaccua

SEQ ID NO: 1026704 - RNA, 21 nt, Homo sapiens
aaaaugaugucaugucagcuc

SEQ ID NO: 1026705 - RNA, 21 nt, Homo sapiens
aaaaugauuuuaucugugaau

SEQ ID NO: 1026706 - RNA, 22 nt, Homo sapiens
aaaaugcaacauguguacuuaa

SEQ ID NO: 1026707 - RNA, 15 nt, Homo sapiens
aaaaugcacguagcu

SEQ ID NO: 1026708 - RNA, 16 nt, Homo sapiens
aaaauggccauuugcu

SEQ ID NO: 1026709 - RNA, 18 nt, Homo sapiens
aaaaugguaauuguugcu

SEQ ID NO: 1026710 - RNA, 15 nt, Homo sapiens
aaaauguaaugauca

SEQ ID NO: 1026711 - RNA, 15 nt, Homo sapiens
aaaauguaugaccac

SEQ ID NO: 1026712 - RNA, 15 nt, Homo sapiens
aaaaugucaggccuu

SEQ ID NO: 1026713 - RNA, 23 nt, Homo sapiens
aaaauguuuuuaaacagugucau

SEQ ID NO: 1026714 - RNA, 22 nt, Homo sapiens
aaaauuagaaucugaguauaaa

SEQ ID NO: 1026715 - RNA, 21 nt, Homo sapiens
aaaauuagccgggcauggugg

SEQ ID NO: 1026716 - RNA, 13 nt, Homo sapiens
aaaauugauauac

SEQ ID NO: 1026717 - RNA, 21 nt, Homo sapiens
aaaauuucacuuaauaaugug

SEQ ID NO: 1026718 - RNA, 13 nt, Homo sapiens
aaacaaacaugac

SEQ ID NO: 1026719 - RNA, 13 nt, Homo sapiens
aaacaaauaugca

SEQ ID NO: 1026720 - RNA, 19 nt, Homo sapiens
aaacaaguuuuucugucaa

SEQ ID NO: 1026721 - RNA, 19 nt, Homo sapiens
aaacaauaucagacuuuuu

SEQ ID NO: 1026722 - RNA, 19 nt, Homo sapiens
aaacaauucuuauugacuc

SEQ ID NO: 1026723 - RNA, 19 nt, Homo sapiens
aaacacaaaugcagggauu

SEQ ID NO: 1026724 - RNA, 16 nt, Homo sapiens
aaacacagacauucug

SEQ ID NO: 1026725 - RNA, 21 nt, Homo sapiens
aaacacauuaagccuuccaca

SEQ ID NO: 1026726 - RNA, 20 nt, Homo sapiens
aaacacccaugaaucaaaga

SEQ ID NO: 1026727 - RNA, 16 nt, Homo sapiens
aaacaccuucucugga

SEQ ID NO: 1026728 - RNA, 17 nt, Homo sapiens
aaacacuuacagaauua

SEQ ID NO: 1026729 - RNA, 23 nt, Homo sapiens
aaacagaacugcagucagcauga

SEQ ID NO: 1026730 - RNA, 22 nt, Homo sapiens
aaacagagacaggcccaagaga

SEQ ID NO: 1026731 - RNA, 17 nt, Homo sapiens
aaacagccccucuggac

SEQ ID NO: 1026732 - RNA, 14 nt, Homo sapiens
aaacagcugagggu

SEQ ID NO: 1026733 - RNA, 22 nt, Homo sapiens
aaacaggcaguuggccagagag

SEQ ID NO: 1026734 - RNA, 22 nt, Homo sapiens
aaacaucaguuacucugaaggg

SEQ ID NO: 1026735 - RNA, 18 nt, Homo sapiens
aaacauucugauuuggaa

SEQ ID NO: 1026736 - RNA, 15 nt, Homo sapiens
aaaccaaaaacugaa

SEQ ID NO: 1026737 - RNA, 15 nt, Homo sapiens
aaaccaucacaugac

SEQ ID NO: 1026738 - RNA, 17 nt, Homo sapiens
aaaccauuuuuuccuac

SEQ ID NO: 1026739 - RNA, 20 nt, Homo sapiens
aaacccccacccuucugccu

SEQ ID NO: 1026740 - RNA, 13 nt, Homo sapiens
aaacccucgaggc

SEQ ID NO: 1026741 - RNA, 16 nt, Homo sapiens
aaaccgagugcaauga

SEQ ID NO: 1026742 - RNA, 16 nt, Homo sapiens
aaaccgcacucaccca

SEQ ID NO: 1026743 - RNA, 14 nt, Homo sapiens
aaaccucaagccag

SEQ ID NO: 1026744 - RNA, 13 nt, Homo sapiens
aaaccucaucucu

SEQ ID NO: 1026745 - RNA, 12 nt, Homo sapiens
aaaccuccacug

SEQ ID NO: 1026746 - RNA, 16 nt, Homo sapiens
aaaccucuaacccagg

SEQ ID NO: 1026747 - RNA, 14 nt, Homo sapiens
aaaccucuaugcaa

SEQ ID NO: 1026748 - RNA, 15 nt, Homo sapiens
aaaccuggaugucac

SEQ ID NO: 1026749 - RNA, 13 nt, Homo sapiens
aaaccuucaguga

SEQ ID NO: 1026750 - RNA, 19 nt, Homo sapiens
aaaccuuucaaauuucaca

SEQ ID NO: 1026751 - RNA, 14 nt, Homo sapiens
aaacgcaugugcag

SEQ ID NO: 1026752 - RNA, 15 nt, Homo sapiens
aaacggauaccaagu

SEQ ID NO: 1026753 - RNA, 21 nt, Homo sapiens
aaacggugaggccccaguggc

SEQ ID NO: 1026754 - RNA, 21 nt, Homo sapiens
aaacuaccagcccuacaccau

SEQ ID NO: 1026755 - RNA, 17 nt, Homo sapiens
aaacuaccuuccaguuc

SEQ ID NO: 1026756 - RNA, 15 nt, Homo sapiens
aaacuauaugccaua

SEQ ID NO: 1026757 - RNA, 18 nt, Homo sapiens
aaacuauguaacauguag

SEQ ID NO: 1026758 - RNA, 20 nt, Homo sapiens
aaacucacagaacuauguac

SEQ ID NO: 1026759 - RNA, 22 nt, Homo sapiens
aaacuccugccccuguucucuu

SEQ ID NO: 1026760 - RNA, 12 nt, Homo sapiens
aaauggacaaac

SEQ ID NO: 1026761 - RNA, 16 nt, Homo sapiens
aaauggaggaauauga

SEQ ID NO: 1026762 - RNA, 12 nt, Homo sapiens
aaauggcucaga

SEQ ID NO: 1026763 - RNA, 22 nt, Homo sapiens
aaaugguccaggagaaggccaa

SEQ ID NO: 1026764 - RNA, 17 nt, Homo sapiens
aaaugucuaagguagua

SEQ ID NO: 1026765 - RNA, 19 nt, Homo sapiens
aaaugucuaagguaguaac

SEQ ID NO: 1026766 - RNA, 16 nt, Homo sapiens
aaaugucuggucuguc

SEQ ID NO: 1026767 - RNA, 18 nt, Homo sapiens
aaaugucuggucugucca

SEQ ID NO: 1026768 - RNA, 19 nt, Homo sapiens
aaaugucuggucuguccac

SEQ ID NO: 1026769 - RNA, 22 nt, Homo sapiens
aaaugugacccagauccucaca

SEQ ID NO: 1026770 - RNA, 23 nt, Homo sapiens
aaauguggagaaacuguagucuc

SEQ ID NO: 1026771 - RNA, 19 nt, Homo sapiens
aaauguuguuuuaggaaua

SEQ ID NO: 1026772 - RNA, 13 nt, Homo sapiens
aaauuaaagcuga

SEQ ID NO: 1026773 - RNA, 19 nt, Homo sapiens
aaauuaacugggcauggua

SEQ ID NO: 1026774 - RNA, 22 nt, Homo sapiens
aaauuacacaguuaaugccaca

SEQ ID NO: 1026775 - RNA, 18 nt, Homo sapiens
aaauuacuggaaggcuuc

SEQ ID NO: 1026776 - RNA, 14 nt, Homo sapiens
aaauuauaucucag

SEQ ID NO: 1026777 - RNA, 16 nt, Homo sapiens
aaauuauaucucagua

SEQ ID NO: 1026778 - RNA, 14 nt, Homo sapiens
aaauuaugccauag

SEQ ID NO: 1026779 - RNA, 23 nt, Homo sapiens
aaauuauguuugccacuuugcaa

SEQ ID NO: 1026780 - RNA, 15 nt, Homo sapiens
aaauucaagccuuag

SEQ ID NO: 1026781 - RNA, 17 nt, Homo sapiens
aaauucacaaguugugu

SEQ ID NO: 1026782 - RNA, 21 nt, Homo sapiens
aaauucauuaguuguuaguga

SEQ ID NO: 1026783 - RNA, 22 nt, Homo sapiens
aaauucauuuuuuucacuggag

SEQ ID NO: 1026784 - RNA, 23 nt, Homo sapiens
aaauuccuuagcuuagaccucag

SEQ ID NO: 1026785 - RNA, 21 nt, Homo sapiens
aaauucuacugaacacuucaa

SEQ ID NO: 1026786 - RNA, 15 nt, Homo sapiens
aaauugcuccuugac

SEQ ID NO: 1026787 - RNA, 18 nt, Homo sapiens
aaauuggaagcugucaua

SEQ ID NO: 1026788 - RNA, 20 nt, Homo sapiens
aaauuguaucaaaugugaca

SEQ ID NO: 1026789 - RNA, 22 nt, Homo sapiens
aaauuguaucaaaugugacauu

SEQ ID NO: 1026790 - RNA, 14 nt, Homo sapiens
aaauuguauuauca

SEQ ID NO: 1026791 - RNA, 16 nt, Homo sapiens
aaauuguuuuuacuga

SEQ ID NO: 1026792 - RNA, 13 nt, Homo sapiens
aaauuuaugugau

SEQ ID NO: 1026793 - RNA, 17 nt, Homo sapiens
aaauuugcuucacucaa

SEQ ID NO: 1026794 - RNA, 16 nt, Homo sapiens
aaugugaaucaugguu

SEQ ID NO: 1026795 - RNA, 20 nt, Homo sapiens
aaugugacauuauaugcacu

SEQ ID NO: 1026796 - RNA, 12 nt, Homo sapiens
aaugugauugca

SEQ ID NO: 1026797 - RNA, 16 nt, Homo sapiens
aaugugcuguguaaag

SEQ ID NO: 1026798 - RNA, 12 nt, Homo sapiens
aaugugucacua

SEQ ID NO: 1026799 - RNA, 18 nt, Homo sapiens
aauguguucugucacuca

SEQ ID NO: 1026800 - RNA, 13 nt, Homo sapiens
aauguuaaauuca

SEQ ID NO: 1026801 - RNA, 16 nt, Homo sapiens
aauguuacauuauuau

SEQ ID NO: 1026802 - RNA, 18 nt, Homo sapiens
aauguuagauaguuacua

SEQ ID NO: 1026803 - RNA, 21 nt, Homo sapiens
aauguuagauaguuacuauau

SEQ ID NO: 1026804 - RNA, 22 nt, Homo sapiens
aauguuauuuuuuaauuauuau

SEQ ID NO: 1026805 - RNA, 15 nt, Homo sapiens
aauguucacuuuuga

SEQ ID NO: 1026806 - RNA, 22 nt, Homo sapiens
aauguuuagcaaauacauauuu

SEQ ID NO: 1026807 - RNA, 14 nt, Homo sapiens
aauguuugcauaaa

SEQ ID NO: 1026808 - RNA, 22 nt, Homo sapiens
aauguuuugcccgguuuuucuc

SEQ ID NO: 1026809 - RNA, 11 nt, Homo sapiens
aauuaaaggaa

SEQ ID NO: 1026810 - RNA, 18 nt, Homo sapiens
aauuaaaguggaccaaua

SEQ ID NO: 1026811 - RNA, 13 nt, Homo sapiens
aauuaaaugcuca

SEQ ID NO: 1026812 - RNA, 12 nt, Homo sapiens
aauuaacuugag

SEQ ID NO: 1026813 - RNA, 22 nt, Homo sapiens
aauuaccagaguuguucugucu

SEQ ID NO: 1026814 - RNA, 20 nt, Homo sapiens
aauuacuauauucuuacccu

SEQ ID NO: 1026815 - RNA, 16 nt, Homo sapiens
aauuagaaaguagcca

SEQ ID NO: 1026816 - RNA, 12 nt, Homo sapiens
aauuagcaauug

SEQ ID NO: 1026817 - RNA, 23 nt, Homo sapiens
aauuagcaauugacugucacugu

SEQ ID NO: 1026818 - RNA, 11 nt, Homo sapiens
aauuagcucac

SEQ ID NO: 1026819 - RNA, 19 nt, Homo sapiens
aauuaggagaggcagagau

SEQ ID NO: 1026820 - RNA, 11 nt, Homo sapiens
aauuaugccuu

SEQ ID NO: 1026821 - RNA, 21 nt, Homo sapiens
aauuauuauuuauauauguau

SEQ ID NO: 1026822 - RNA, 19 nt, Homo sapiens
aauuauugugccucagccu

SEQ ID NO: 1026823 - RNA, 19 nt, Homo sapiens
aauuauuuuuacaguucuc

SEQ ID NO: 1026824 - RNA, 20 nt, Homo sapiens
aauucagcucuugagagcau

SEQ ID NO: 1026825 - RNA, 13 nt, Homo sapiens
aauucaugaacuu

SEQ ID NO: 1026826 - RNA, 20 nt, Homo sapiens
aauucauuuuuuucacugga

SEQ ID NO: 1026827 - RNA, 13 nt, Homo sapiens
aauuccaauauga

SEQ ID NO: 1026828 - RNA, 18 nt, Homo sapiens
aauuccaucccaucaucu

SEQ ID NO: 1026829 - RNA, 21 nt, Homo sapiens
aauucccuucaucuggaacca

SEQ ID NO: 1026830 - RNA, 16 nt, Homo sapiens
aauuccuagucacaau

SEQ ID NO: 1026831 - RNA, 13 nt, Homo sapiens
aauuccucuggga

SEQ ID NO: 1026832 - RNA, 18 nt, Homo sapiens
aauuccuguagcaucuuc

SEQ ID NO: 1026833 - RNA, 13 nt, Homo sapiens
aauuccugugauu

SEQ ID NO: 1026834 - RNA, 22 nt, Homo sapiens
aauuccuuagcuuagaccucag

SEQ ID NO: 1026835 - RNA, 14 nt, Homo sapiens
aauuccuugauuca

SEQ ID NO: 1026836 - RNA, 14 nt, Homo sapiens
aauucuacuuugag

SEQ ID NO: 1026837 - RNA, 17 nt, Homo sapiens
aauucuaggcaucccag

SEQ ID NO: 1026838 - RNA, 23 nt, Homo sapiens
aauucucaaaagaaaaggcaaaa

SEQ ID NO: 1026839 - RNA, 18 nt, Homo sapiens
aauucucauuugucacac

SEQ ID NO: 1026840 - RNA, 21 nt, Homo sapiens
aauucuccugccucagccucc

SEQ ID NO: 1026841 - RNA, 20 nt, Homo sapiens
aauucucuaguuugauuaaa

SEQ ID NO: 1026842 - RNA, 21 nt, Homo sapiens
aauucucuuauccaacaucaa

SEQ ID NO: 1026843 - RNA, 21 nt, Homo sapiens
aauucucuuuaguucugucag

SEQ ID NO: 1026844 - RNA, 22 nt, Homo sapiens
aauucugcagaguuuccaaaac

SEQ ID NO: 1026845 - RNA, 21 nt, Homo sapiens
aauucuguacauagccuauau

SEQ ID NO: 1026846 - RNA, 18 nt, Homo sapiens
aauucuuacaaacaugug

SEQ ID NO: 1026847 - RNA, 17 nt, Homo sapiens
aauucuuacauguuuuc

SEQ ID NO: 1026848 - RNA, 21 nt, Homo sapiens
aauucuuauugacucauacac

SEQ ID NO: 1026849 - RNA, 14 nt, Homo sapiens
aauucuuuccccaa

SEQ ID NO: 1026850 - RNA, 21 nt, Homo sapiens
aauucuuuucuuuuccauuua

SEQ ID NO: 1026851 - RNA, 17 nt, Homo sapiens
aauugaaaggcauucuc

SEQ ID NO: 1026852 - RNA, 13 nt, Homo sapiens
aauugacacuuaa

SEQ ID NO: 1026853 - RNA, 23 nt, Homo sapiens
aauugacagaucaagcugugaga

SEQ ID NO: 1026854 - RNA, 15 nt, Homo sapiens
aauugacaguuucaa

SEQ ID NO: 1026855 - RNA, 13 nt, Homo sapiens
aauugacugucac

SEQ ID NO: 1026856 - RNA, 23 nt, Homo sapiens
aauugauguugcuggacugucau

SEQ ID NO: 1026857 - RNA, 21 nt, Homo sapiens
aauugauuauucugauuccac

SEQ ID NO: 1026858 - RNA, 20 nt, Homo sapiens
aauugcagaguacuggcuga

SEQ ID NO: 1026859 - RNA, 18 nt, Homo sapiens
aauugcuaagaagggaaa

SEQ ID NO: 1026860 - RNA, 23 nt, Homo sapiens
aauugugaagucgucuuaacuca

SEQ ID NO: 1026861 - RNA, 14 nt, Homo sapiens
aauugugugucaca

SEQ ID NO: 1026862 - RNA, 15 nt, Homo sapiens
aauuguuuggggaug

SEQ ID NO: 1026863 - RNA, 23 nt, Homo sapiens
aauuguuuuuaaguuuucaugaa

SEQ ID NO: 1026864 - RNA, 21 nt, Homo sapiens
aauuuaaaacacagagaugcu

SEQ ID NO: 1026865 - RNA, 22 nt, Homo sapiens
aauuuaaauaagauuuaauuca

SEQ ID NO: 1026866 - RNA, 19 nt, Homo sapiens
aauuuaaucuuccauggau

SEQ ID NO: 1026867 - RNA, 15 nt, Homo sapiens
aauuuaauuuugcag

SEQ ID NO: 1026868 - RNA, 19 nt, Homo sapiens
aauuuaauuuugcaggauu

SEQ ID NO: 1026869 - RNA, 18 nt, Homo sapiens
aauuuacuugccauuacu

SEQ ID NO: 1026870 - RNA, 18 nt, Homo sapiens
aauuuaggaccaauaccu

SEQ ID NO: 1026871 - RNA, 21 nt, Homo sapiens
aauuuaggaccaauaccuccu

SEQ ID NO: 1026872 - RNA, 22 nt, Homo sapiens
aauuuaguuauugauguauaaa

SEQ ID NO: 1026873 - RNA, 18 nt, Homo sapiens
aauuuauuaaaaugauug

SEQ ID NO: 1026874 - RNA, 20 nt, Homo sapiens
aauuuauuucaaaaagggaa

SEQ ID NO: 1026875 - RNA, 20 nt, Homo sapiens
aauuucaaaaauauaacuua

SEQ ID NO: 1026876 - RNA, 18 nt, Homo sapiens
aauuucacgucgucuucu

SEQ ID NO: 1026877 - RNA, 20 nt, Homo sapiens
aauuucaguaaacaaugaau

SEQ ID NO: 1026878 - RNA, 21 nt, Homo sapiens
aauuucauaccuaucaucuua

SEQ ID NO: 1026879 - RNA, 15 nt, Homo sapiens
aauuuccaguaccuu

SEQ ID NO: 1026880 - RNA, 16 nt, Homo sapiens
aauuucuaccuagaaa

SEQ ID NO: 1026881 - RNA, 15 nt, Homo sapiens
aauuugaugccagga

SEQ ID NO: 1026882 - RNA, 13 nt, Homo sapiens
aauuugcugcuau

SEQ ID NO: 1026883 - RNA, 18 nt, Homo sapiens
aauuuggagacucugugg

SEQ ID NO: 1026884 - RNA, 14 nt, Homo sapiens
aauuuuauaaucau

SEQ ID NO: 1026885 - RNA, 15 nt, Homo sapiens
aauuuugccaaauaa

SEQ ID NO: 1026886 - RNA, 19 nt, Homo sapiens
aauuuuguuuguugaugug

SEQ ID NO: 1026887 - RNA, 21 nt, Homo sapiens
aauuuuuuaguauaaguacau

SEQ ID NO: 1026888 - RNA, 23 nt, Homo sapiens
aauuuuuuaguauaaguacauua

SEQ ID NO: 1026889 - RNA, 20 nt, Homo sapiens
acaaaaaaaccucuaugcaa

SEQ ID NO: 1026890 - RNA, 14 nt, Homo sapiens
acaaaaacauggcc

SEQ ID NO: 1026891 - RNA, 22 nt, Homo sapiens
acaaaaaucacaaggcauucaa

SEQ ID NO: 1026892 - RNA, 22 nt, Homo sapiens
acaaaacugacaguaaaucuca

SEQ ID NO: 1026893 - RNA, 21 nt, Homo sapiens
acaaaagcccaauguaaugca

SEQ ID NO: 1026894 - RNA, 21 nt, Homo sapiens
acaaaaugacauuuugccaaa

SEQ ID NO: 1026895 - RNA, 15 nt, Homo sapiens
acaaaaugauuuuga

SEQ ID NO: 1026896 - RNA, 20 nt, Homo sapiens
acaaaauuggaagcugucau

SEQ ID NO: 1026897 - RNA, 15 nt, Homo sapiens
acaaacaaacagaaa

SEQ ID NO: 1026898 - RNA, 17 nt, Homo sapiens
acaaaccucaagccagc

SEQ ID NO: 1026899 - RNA, 16 nt, Homo sapiens
acaaaccucuaaccca

SEQ ID NO: 1026900 - RNA, 21 nt, Homo sapiens
acaaacucaccaucugugcac

SEQ ID NO: 1026901 - RNA, 15 nt, Homo sapiens
acaaagaacaagcau

SEQ ID NO: 1026902 - RNA, 13 nt, Homo sapiens
acaaagaagacau

SEQ ID NO: 1026903 - RNA, 15 nt, Homo sapiens
acaaagcacaguguu

SEQ ID NO: 1026904 - RNA, 18 nt, Homo sapiens
acaaaggacagaguauga

SEQ ID NO: 1026905 - RNA, 14 nt, Homo sapiens
acaaaguauuugcu

SEQ ID NO: 1026906 - RNA, 23 nt, Homo sapiens
acaaaguuacugauucacugcau

SEQ ID NO: 1026907 - RNA, 16 nt, Homo sapiens
acaaauaaaaaauuca

SEQ ID NO: 1026908 - RNA, 12 nt, Homo sapiens
acaaauaugcaa

SEQ ID NO: 1026909 - RNA, 17 nt, Homo sapiens
acaaauccauaauuauu

SEQ ID NO: 1026910 - RNA, 21 nt, Homo sapiens
acaaaugaucgcuaucuagca

SEQ ID NO: 1026911 - RNA, 16 nt, Homo sapiens
acaaaugccacacauc

SEQ ID NO: 1026912 - RNA, 22 nt, Homo sapiens
acaaaugccacacggcucucac

SEQ ID NO: 1026913 - RNA, 15 nt, Homo sapiens
acaaaugguagcaua

SEQ ID NO: 1026914 - RNA, 13 nt, Homo sapiens
acaaauugcuuga

SEQ ID NO: 1026915 - RNA, 22 nt, Homo sapiens
acaacagcaaaacuccaucuca

SEQ ID NO: 1026916 - RNA, 21 nt, Homo sapiens
acaacagcccugucucaaaac

SEQ ID NO: 1026917 - RNA, 14 nt, Homo sapiens
acaacauuucucaa

SEQ ID NO: 1026918 - RNA, 19 nt, Homo sapiens
acaacauuucucaaaugca

SEQ ID NO: 1026919 - RNA, 19 nt, Homo sapiens
acaaccucauuuuaacuca

SEQ ID NO: 1026920 - RNA, 12 nt, Homo sapiens
acaacucagucc

SEQ ID NO: 1026921 - RNA, 17 nt, Homo sapiens
acaacucugaaagagaa

SEQ ID NO: 1026922 - RNA, 17 nt, Homo sapiens
acaacuguggucaaucc

SEQ ID NO: 1026923 - RNA, 19 nt, Homo sapiens
acaagaagaccagacugug

SEQ ID NO: 1026924 - RNA, 19 nt, Homo sapiens
acaagacccaaaaggcaga

SEQ ID NO: 1026925 - RNA, 18 nt, Homo sapiens
acaagaccccgucucaaa

SEQ ID NO: 1026926 - RNA, 18 nt, Homo sapiens
acaagaguugucuugucc

SEQ ID NO: 1026927 - RNA, 20 nt, Homo sapiens
acaagauuaccccaccuugc

SEQ ID NO: 1026928 - RNA, 12 nt, Homo sapiens
acaagauuagaa

SEQ ID NO: 1026929 - RNA, 13 nt, Homo sapiens
acaagcauucucc

SEQ ID NO: 1026930 - RNA, 20 nt, Homo sapiens
acaagccaacgacaaagcca

SEQ ID NO: 1026931 - RNA, 14 nt, Homo sapiens
acaagccauagugg

SEQ ID NO: 1026932 - RNA, 16 nt, Homo sapiens
acaaggcugaccaaga

SEQ ID NO: 1026933 - RNA, 18 nt, Homo sapiens
acaaggcuggcagugaca

SEQ ID NO: 1026934 - RNA, 13 nt, Homo sapiens
acaaggugacaaa

SEQ ID NO: 1026935 - RNA, 18 nt, Homo sapiens
acaaguauguugagaguu

SEQ ID NO: 1026936 - RNA, 22 nt, Homo sapiens
acaaguauucauuuuuucuacc

SEQ ID NO: 1026937 - RNA, 22 nt, Homo sapiens
acaagucaucauaauucagcuc

SEQ ID NO: 1026938 - RNA, 15 nt, Homo sapiens
acaagugggugaaug

SEQ ID NO: 1026939 - RNA, 14 nt, Homo sapiens
accaaugccaaaaa

SEQ ID NO: 1026940 - RNA, 21 nt, Homo sapiens
accaaugccaaaaaaagacag

SEQ ID NO: 1026941 - RNA, 13 nt, Homo sapiens
accaaugucuuga

SEQ ID NO: 1026942 - RNA, 16 nt, Homo sapiens
accacaaaacuuuucu

SEQ ID NO: 1026943 - RNA, 16 nt, Homo sapiens
accacaaaucugaaug

SEQ ID NO: 1026944 - RNA, 23 nt, Homo sapiens
accacaggcagcauuuagcacau

SEQ ID NO: 1026945 - RNA, 18 nt, Homo sapiens
accacaucuugcucugcu

SEQ ID NO: 1026946 - RNA, 17 nt, Homo sapiens
accacauuuagaacuuu

SEQ ID NO: 1026947 - RNA, 15 nt, Homo sapiens
accaccaccaucacc

SEQ ID NO: 1026948 - RNA, 16 nt, Homo sapiens
accaccccuuccuguc

SEQ ID NO: 1026949 - RNA, 16 nt, Homo sapiens
accacccuagucccuu

SEQ ID NO: 1026950 - RNA, 21 nt, Homo sapiens
accacggccucacccaggcau

SEQ ID NO: 1026951 - RNA, 15 nt, Homo sapiens
accacgguagugccu

SEQ ID NO: 1026952 - RNA, 20 nt, Homo sapiens
accacgugagaucauucacu

SEQ ID NO: 1026953 - RNA, 23 nt, Homo sapiens
accacucaggccaacaagccaac

SEQ ID NO: 1026954 - RNA, 15 nt, Homo sapiens
accguucaccaguug

SEQ ID NO: 1026955 - RNA, 22 nt, Homo sapiens
accuaaaagagauuucaagaga

SEQ ID NO: 1026956 - RNA, 23 nt, Homo sapiens
accuaaaaggaaaucucacccca

SEQ ID NO: 1026957 - RNA, 19 nt, Homo sapiens
accuaaaauaauugguucu

SEQ ID NO: 1026958 - RNA, 16 nt, Homo sapiens
accuaaaccaccagug

SEQ ID NO: 1026959 - RNA, 19 nt, Homo sapiens
accuaaacuauaugccaua

SEQ ID NO: 1026960 - RNA, 16 nt, Homo sapiens
accuaaauuugguucu

SEQ ID NO: 1026961 - RNA, 11 nt, Homo sapiens
accuaauccaa

SEQ ID NO: 1026962 - RNA, 13 nt, Homo sapiens
accuacaguguac

SEQ ID NO: 1026963 - RNA, 12 nt, Homo sapiens
accuacauuuga

SEQ ID NO: 1026964 - RNA, 23 nt, Homo sapiens
accuacauuuuaaugcaccugaa

SEQ ID NO: 1026965 - RNA, 16 nt, Homo sapiens
accuaccaucagggac

SEQ ID NO: 1026966 - RNA, 22 nt, Homo sapiens
accuacugauaaccacuccuaa

SEQ ID NO: 1026967 - RNA, 20 nt, Homo sapiens
accuagaauuggcugaacuc

SEQ ID NO: 1026968 - RNA, 20 nt, Homo sapiens
accuagcaaagcuccugccu

SEQ ID NO: 1026969 - RNA, 12 nt, Homo sapiens
accuaguacaag

SEQ ID NO: 1026970 - RNA, 18 nt, Homo sapiens
accuaguggcccuucaca

SEQ ID NO: 1026971 - RNA, 14 nt, Homo sapiens
accucaaaggugau

SEQ ID NO: 1026972 - RNA, 13 nt, Homo sapiens
accucaaccugug

SEQ ID NO: 1026973 - RNA, 22 nt, Homo sapiens
accucagggcuguguguacuaa

SEQ ID NO: 1026974 - RNA, 15 nt, Homo sapiens
accucaggugaucca

SEQ ID NO: 1026975 - RNA, 17 nt, Homo sapiens
accucagugucauuuau

SEQ ID NO: 1026976 - RNA, 22 nt, Homo sapiens
accucagugucauuuaugaaaa

SEQ ID NO: 1026977 - RNA, 22 nt, Homo sapiens
accucaguuuuaucauuuucaa

SEQ ID NO: 1026978 - RNA, 22 nt, Homo sapiens
accucauaucaguuugcuagca

SEQ ID NO: 1026979 - RNA, 17 nt, Homo sapiens
accuccaaaacuccugc

SEQ ID NO: 1026980 - RNA, 19 nt, Homo sapiens
accucccccaggugcagug

SEQ ID NO: 1026981 - RNA, 11 nt, Homo sapiens
accucccugac

SEQ ID NO: 1026982 - RNA, 21 nt, Homo sapiens
accucccugacccgucuaaua

SEQ ID NO: 1026983 - RNA, 18 nt, Homo sapiens
accuccuucucugucuca

SEQ ID NO: 1026984 - RNA, 18 nt, Homo sapiens
accuccuuuucucuuuca

SEQ ID NO: 1026985 - RNA, 19 nt, Homo sapiens
accucgagcagaugaugcc

SEQ ID NO: 1026986 - RNA, 21 nt, Homo sapiens
accucuccaaccuaacuggcu

SEQ ID NO: 1026987 - RNA, 22 nt, Homo sapiens
accucuccaaccuaacuggcuu

SEQ ID NO: 1026988 - RNA, 13 nt, Homo sapiens
accucucucacuc

SEQ ID NO: 1026989 - RNA, 13 nt, Homo sapiens
accucugcucuga

SEQ ID NO: 1026990 - RNA, 21 nt, Homo sapiens
accucugcucugaggcuucca

SEQ ID NO: 1026991 - RNA, 17 nt, Homo sapiens
accucuggacuggcuag

SEQ ID NO: 1026992 - RNA, 17 nt, Homo sapiens
accucuguuguccuccc

SEQ ID NO: 1026993 - RNA, 20 nt, Homo sapiens
accugaaaacacugugcaca

SEQ ID NO: 1026994 - RNA, 18 nt, Homo sapiens
accugaaauaaaauucau

SEQ ID NO: 1026995 - RNA, 21 nt, Homo sapiens
accugaacacaucgugaugau

SEQ ID NO: 1026996 - RNA, 16 nt, Homo sapiens
accugaacugaugggu

SEQ ID NO: 1026997 - RNA, 16 nt, Homo sapiens
accugacagcuuuauc

SEQ ID NO: 1026998 - RNA, 13 nt, Homo sapiens
accugaugcaguc

SEQ ID NO: 1026999 - RNA, 18 nt, Homo sapiens
accugcacuuaaggcacu

SEQ ID NO: 1027000 - RNA, 13 nt, Homo sapiens
accugcaggccaa

SEQ ID NO: 1027001 - RNA, 23 nt, Homo sapiens
accugcccugggccacacugacc

SEQ ID NO: 1027002 - RNA, 19 nt, Homo sapiens
accugcucuccucuugcca

SEQ ID NO: 1027003 - RNA, 23 nt, Homo sapiens
accugcucuuguucuacugagaa

SEQ ID NO: 1027004 - RNA, 20 nt, Homo sapiens
accugcuuuacuuugcccag

SEQ ID NO: 1027005 - RNA, 21 nt, Homo sapiens
accuggagagcuagaaccuag

SEQ ID NO: 1027006 - RNA, 22 nt, Homo sapiens
accuggagggcuagaaccuaga

SEQ ID NO: 1027007 - RNA, 22 nt, Homo sapiens
accuggagggcuagaaccugga

SEQ ID NO: 1027008 - RNA, 22 nt, Homo sapiens
accuggaggggcuagaaccuag

SEQ ID NO: 1027009 - RNA, 15 nt, Homo sapiens
accuguaaucccagc

SEQ ID NO: 1027010 - RNA, 14 nt, Homo sapiens
accuguacucuucc

SEQ ID NO: 1027011 - RNA, 16 nt, Homo sapiens
accugucccccugaca

SEQ ID NO: 1027012 - RNA, 16 nt, Homo sapiens
accuguccuugcacac

SEQ ID NO: 1027013 - RNA, 14 nt, Homo sapiens
accugugaccagca

SEQ ID NO: 1027014 - RNA, 21 nt, Homo sapiens
accugugcacguuggaacuuu

SEQ ID NO: 1027015 - RNA, 19 nt, Homo sapiens
accuguggccaaguucuua

SEQ ID NO: 1027016 - RNA, 15 nt, Homo sapiens
accuguucaaaaagg

SEQ ID NO: 1027017 - RNA, 22 nt, Homo sapiens
accuuacauuugaaaucuauga

SEQ ID NO: 1027018 - RNA, 23 nt, Homo sapiens
accuuacauuugaaaucuaugaa

SEQ ID NO: 1027019 - RNA, 19 nt, Homo sapiens
accuucaauaaaguaucua

SEQ ID NO: 1027020 - RNA, 15 nt, Homo sapiens
accuucaauuccugg

SEQ ID NO: 1027021 - RNA, 21 nt, Homo sapiens
accuucagauuuguguuauaa

SEQ ID NO: 1027022 - RNA, 19 nt, Homo sapiens
accuuccagcuccuguaac

SEQ ID NO: 1027023 - RNA, 12 nt, Homo sapiens
accuuccucauc

SEQ ID NO: 1027024 - RNA, 17 nt, Homo sapiens
accuucucuggagccaa

SEQ ID NO: 1027025 - RNA, 15 nt, Homo sapiens
accuugaacacuggg

SEQ ID NO: 1027026 - RNA, 19 nt, Homo sapiens
accuugaagaaccucucac

SEQ ID NO: 1027027 - RNA, 22 nt, Homo sapiens
accuugaggagucuugugugca

SEQ ID NO: 1027028 - RNA, 15 nt, Homo sapiens
accuugcuccugugu

SEQ ID NO: 1027029 - RNA, 19 nt, Homo sapiens
accuugugacccagcacug

SEQ ID NO: 1027030 - RNA, 22 nt, Homo sapiens
accuugugccuggcucagagcc

SEQ ID NO: 1027031 - RNA, 17 nt, Homo sapiens
accuugugucuguacac

SEQ ID NO: 1027032 - RNA, 23 nt, Homo sapiens
accuuguuguuguuaaauaucag

SEQ ID NO: 1027033 - RNA, 20 nt, Homo sapiens
accuuuccauuuauucuuug

SEQ ID NO: 1027034 - RNA, 16 nt, Homo sapiens
accuuucugcacauaa

SEQ ID NO: 1027035 - RNA, 22 nt, Homo sapiens
accuuuguauucucuccuguac

SEQ ID NO: 1027036 - RNA, 13 nt, Homo sapiens
accuuuguuccca

SEQ ID NO: 1027037 - RNA, 15 nt, Homo sapiens
accuuuuuauuugca

SEQ ID NO: 1027038 - RNA, 13 nt, Homo sapiens
acgaaaucuaggu

SEQ ID NO: 1027039 - RNA, 20 nt, Homo sapiens
acgaaguguugcauggaugu

SEQ ID NO: 1027040 - RNA, 22 nt, Homo sapiens
acgaauuaauuaccuggcacca

SEQ ID NO: 1027041 - RNA, 17 nt, Homo sapiens
acgacagugcauuugcc

SEQ ID NO: 1027042 - RNA, 21 nt, Homo sapiens
acgacagugcauuugccuugu

SEQ ID NO: 1027043 - RNA, 17 nt, Homo sapiens
acgacugucuccauggc

SEQ ID NO: 1027044 - RNA, 13 nt, Homo sapiens
acgacuucagggc

SEQ ID NO: 1027045 - RNA, 17 nt, Homo sapiens
acgcaacccacguguaa

SEQ ID NO: 1027046 - RNA, 15 nt, Homo sapiens
acgcaacuggcucaa

SEQ ID NO: 1027047 - RNA, 20 nt, Homo sapiens
acgcacacacacacacagga

SEQ ID NO: 1027048 - RNA, 11 nt, Homo sapiens
acgcagaucac

SEQ ID NO: 1027049 - RNA, 12 nt, Homo sapiens
acgcaugugcag

SEQ ID NO: 1027050 - RNA, 16 nt, Homo sapiens
acgcaugugcagcuau

SEQ ID NO: 1027051 - RNA, 17 nt, Homo sapiens
acgccauugcacuccag

SEQ ID NO: 1027052 - RNA, 15 nt, Homo sapiens
acgccuaugauccca

SEQ ID NO: 1027053 - RNA, 20 nt, Homo sapiens
acgccuccccuuugugacuu

SEQ ID NO: 1027054 - RNA, 14 nt, Homo sapiens
acgccugcccuccc

SEQ ID NO: 1027055 - RNA, 17 nt, Homo sapiens
acgccuguaaucccaga

SEQ ID NO: 1027056 - RNA, 18 nt, Homo sapiens
acgccuguaaucccagca

SEQ ID NO: 1027057 - RNA, 22 nt, Homo sapiens
acgcgggacgucccugcccaug

SEQ ID NO: 1027058 - RNA, 20 nt, Homo sapiens
acgcgugcacacaccagagc

SEQ ID NO: 1027059 - RNA, 20 nt, Homo sapiens
acgcuuaaaggugucuuccu

SEQ ID NO: 1027060 - RNA, 19 nt, Homo sapiens
acgcuugcuuuagcacagg

SEQ ID NO: 1027061 - RNA, 20 nt, Homo sapiens
acggagccacuccucugacu

SEQ ID NO: 1027062 - RNA, 14 nt, Homo sapiens
acggccaacaaagc

SEQ ID NO: 1027063 - RNA, 18 nt, Homo sapiens
acggccacuggccaucuc

SEQ ID NO: 1027064 - RNA, 19 nt, Homo sapiens
acggccacuggccaucucc

SEQ ID NO: 1027065 - RNA, 14 nt, Homo sapiens
acggcucacugcag

SEQ ID NO: 1027066 - RNA, 14 nt, Homo sapiens
acggcucuuagcac

SEQ ID NO: 1027067 - RNA, 18 nt, Homo sapiens
acgggcaugggcacuccc

SEQ ID NO: 1027068 - RNA, 23 nt, Homo sapiens
acgggguuucaccacauucguca

SEQ ID NO: 1027069 - RNA, 22 nt, Homo sapiens
acgguggccuaggguacaggca

SEQ ID NO: 1027070 - RNA, 23 nt, Homo sapiens
acguacaaaauccagcuaugaau

SEQ ID NO: 1027071 - RNA, 18 nt, Homo sapiens
acguacguaucagcggcc

SEQ ID NO: 1027072 - RNA, 16 nt, Homo sapiens
acguaugguggcucau

SEQ ID NO: 1027073 - RNA, 20 nt, Homo sapiens
acguauguaaauguauauac

SEQ ID NO: 1027074 - RNA, 16 nt, Homo sapiens
acgucaaacaugaagu

SEQ ID NO: 1027075 - RNA, 12 nt, Homo sapiens
acgucacacuug

SEQ ID NO: 1027076 - RNA, 22 nt, Homo sapiens
acgucugggagaaauugacaga

SEQ ID NO: 1027077 - RNA, 15 nt, Homo sapiens
acgugacuguggcac

SEQ ID NO: 1027078 - RNA, 20 nt, Homo sapiens
acgugacuguggcacacgcc

SEQ ID NO: 1027079 - RNA, 23 nt, Homo sapiens
acgugauguggagggcacauucc

SEQ ID NO: 1027080 - RNA, 18 nt, Homo sapiens
acgugauuuugcuguaga

SEQ ID NO: 1027081 - RNA, 18 nt, Homo sapiens
acguggugcauuuugcuu

SEQ ID NO: 1027082 - RNA, 14 nt, Homo sapiens
acguguagcuauau

SEQ ID NO: 1027083 - RNA, 22 nt, Homo sapiens
acguugccuaauaaacauccuu

SEQ ID NO: 1027084 - RNA, 22 nt, Homo sapiens
acguuucuaaaggcuaccuuug

SEQ ID NO: 1027085 - RNA, 13 nt, Homo sapiens
acuaaaaagccau

SEQ ID NO: 1027086 - RNA, 14 nt, Homo sapiens
acuaaaaaucauga

SEQ ID NO: 1027087 - RNA, 18 nt, Homo sapiens
acuaaagcauucaauuua

SEQ ID NO: 1027088 - RNA, 12 nt, Homo sapiens
acuaaaguauau

SEQ ID NO: 1027089 - RNA, 20 nt, Homo sapiens
acuaagcaguaagcuaucuu

SEQ ID NO: 1027090 - RNA, 21 nt, Homo sapiens
acuaaggaguaaucuguguac

SEQ ID NO: 1027091 - RNA, 20 nt, Homo sapiens
acuaagggauggggcagucu

SEQ ID NO: 1027092 - RNA, 23 nt, Homo sapiens
acuaaguucacggcaaaauguca

SEQ ID NO: 1027093 - RNA, 17 nt, Homo sapiens
acuaauggaaauauuau

SEQ ID NO: 1027094 - RNA, 13 nt, Homo sapiens
acucaaucucuga

SEQ ID NO: 1027095 - RNA, 21 nt, Homo sapiens
acucaaucucugauucuguca

SEQ ID NO: 1027096 - RNA, 17 nt, Homo sapiens
acucaauucugcaguau

SEQ ID NO: 1027097 - RNA, 20 nt, Homo sapiens
acucacauccugaccuugca

SEQ ID NO: 1027098 - RNA, 23 nt, Homo sapiens
acucaccaguguccccuccacug

SEQ ID NO: 1027099 - RNA, 20 nt, Homo sapiens
acucacuccacaacccaaga

SEQ ID NO: 1027100 - RNA, 18 nt, Homo sapiens
acucacuuucuagauuaa

SEQ ID NO: 1027101 - RNA, 16 nt, Homo sapiens
acucagaagacacuga

SEQ ID NO: 1027102 - RNA, 17 nt, Homo sapiens
acucagaucacuacugc

SEQ ID NO: 1027103 - RNA, 22 nt, Homo sapiens
acucagauggaaccgcaggaag

SEQ ID NO: 1027104 - RNA, 18 nt, Homo sapiens
acucaggaauguuugcug

SEQ ID NO: 1027105 - RNA, 22 nt, Homo sapiens
acucaggaugcccagggccacu

SEQ ID NO: 1027106 - RNA, 18 nt, Homo sapiens
acucaggccaacaagcca

SEQ ID NO: 1027107 - RNA, 14 nt, Homo sapiens
acucaggggucauu

SEQ ID NO: 1027108 - RNA, 16 nt, Homo sapiens
acucaguuuucuugca

SEQ ID NO: 1027109 - RNA, 19 nt, Homo sapiens
acucauaauagacuuccca

SEQ ID NO: 1027110 - RNA, 12 nt, Homo sapiens
acucauaauucu

SEQ ID NO: 1027111 - RNA, 17 nt, Homo sapiens
acucauagcacuucccc

SEQ ID NO: 1027112 - RNA, 19 nt, Homo sapiens
acucaucccuaaugcugca

SEQ ID NO: 1027113 - RNA, 23 nt, Homo sapiens
acucaucccuguuccucaaggcc

SEQ ID NO: 1027114 - RNA, 12 nt, Homo sapiens
acucaugaucuu

SEQ ID NO: 1027115 - RNA, 17 nt, Homo sapiens
acucaugcugaaagccc

SEQ ID NO: 1027116 - RNA, 23 nt, Homo sapiens
acucauuuuuguuuucauuaucu

SEQ ID NO: 1027117 - RNA, 16 nt, Homo sapiens
acuccaaaauguuggu

SEQ ID NO: 1027118 - RNA, 22 nt, Homo sapiens
acuccaaagaaauguaagggaa

SEQ ID NO: 1027119 - RNA, 20 nt, Homo sapiens
acuccacuggccuccuggca

SEQ ID NO: 1027120 - RNA, 16 nt, Homo sapiens
acuccagacucucugu

SEQ ID NO: 1027121 - RNA, 19 nt, Homo sapiens
acucccaagucuacagagu

SEQ ID NO: 1027122 - RNA, 13 nt, Homo sapiens
acuccccucaaaa

SEQ ID NO: 1027123 - RNA, 17 nt, Homo sapiens
acucccgccacauuuua

SEQ ID NO: 1027124 - RNA, 14 nt, Homo sapiens
acuccuagcugacu

SEQ ID NO: 1027125 - RNA, 18 nt, Homo sapiens
acuccuaugaucucaggu

SEQ ID NO: 1027126 - RNA, 22 nt, Homo sapiens
acuccucaaaagcaaaugagau

SEQ ID NO: 1027127 - RNA, 13 nt, Homo sapiens
acuccucaggguu

SEQ ID NO: 1027128 - RNA, 14 nt, Homo sapiens
acuccuccaaggca

SEQ ID NO: 1027129 - RNA, 18 nt, Homo sapiens
acuccugaccucagguga

SEQ ID NO: 1027130 - RNA, 12 nt, Homo sapiens
acuccugcaaaa

SEQ ID NO: 1027131 - RNA, 13 nt, Homo sapiens
acuccugcaaaau

SEQ ID NO: 1027132 - RNA, 22 nt, Homo sapiens
acuccugguuccuaggugagca

SEQ ID NO: 1027133 - RNA, 12 nt, Homo sapiens
acuccuguuacu

SEQ ID NO: 1027134 - RNA, 19 nt, Homo sapiens
acuccuuguaaagacugua

SEQ ID NO: 1027135 - RNA, 22 nt, Homo sapiens
acuccuuguaaagacuguagaa

SEQ ID NO: 1027136 - RNA, 23 nt, Homo sapiens
acuccuuucucuaaaacugccuu

SEQ ID NO: 1027137 - RNA, 16 nt, Homo sapiens
acucuaacccuaggca

SEQ ID NO: 1027138 - RNA, 20 nt, Homo sapiens
acucuauuaaaucuugcaac

SEQ ID NO: 1027139 - RNA, 20 nt, Homo sapiens
acucucagcagcuaugguag

SEQ ID NO: 1027140 - RNA, 13 nt, Homo sapiens
acucuccaaauag

SEQ ID NO: 1027141 - RNA, 19 nt, Homo sapiens
acucuccaaauagcauuag

SEQ ID NO: 1027142 - RNA, 21 nt, Homo sapiens
acucuccuagagacagaagca

SEQ ID NO: 1027143 - RNA, 11 nt, Homo sapiens
acucucugaac

SEQ ID NO: 1027144 - RNA, 14 nt, Homo sapiens
acucucugaagaug

SEQ ID NO: 1027145 - RNA, 15 nt, Homo sapiens
acucugaauccucau

SEQ ID NO: 1027146 - RNA, 16 nt, Homo sapiens
acucugaauccucaug

SEQ ID NO: 1027147 - RNA, 12 nt, Homo sapiens
acucugcacaug

SEQ ID NO: 1027148 - RNA, 14 nt, Homo sapiens
acucugcacauguc

SEQ ID NO: 1027149 - RNA, 19 nt, Homo sapiens
acucugccagccacaucca

SEQ ID NO: 1027150 - RNA, 22 nt, Homo sapiens
acucugcccagaccacacguag

SEQ ID NO: 1027151 - RNA, 19 nt, Homo sapiens
acucugccucugccugcau

SEQ ID NO: 1027152 - RNA, 22 nt, Homo sapiens
acucugcugcuuagacauaaca

SEQ ID NO: 1027153 - RNA, 22 nt, Homo sapiens
acucugcuugauuuuugccucu

SEQ ID NO: 1027154 - RNA, 14 nt, Homo sapiens
acucugggcuccag

SEQ ID NO: 1027155 - RNA, 19 nt, Homo sapiens
acucugggcugccauguga

SEQ ID NO: 1027156 - RNA, 23 nt, Homo sapiens
acucuggggagccugagccacaa

SEQ ID NO: 1027157 - RNA, 21 nt, Homo sapiens
acucugggguuuuuacuguua

SEQ ID NO: 1027158 - RNA, 12 nt, Homo sapiens
acucugugucag

SEQ ID NO: 1027159 - RNA, 17 nt, Homo sapiens
acucuguuauuuagacu

SEQ ID NO: 1027160 - RNA, 14 nt, Homo sapiens
acucuuaagccauc

SEQ ID NO: 1027161 - RNA, 16 nt, Homo sapiens
acucuuaagccaucuu

SEQ ID NO: 1027162 - RNA, 17 nt, Homo sapiens
acucuuugaaugacaaa

SEQ ID NO: 1027163 - RNA, 17 nt, Homo sapiens
acugaaaacaagccaug

SEQ ID NO: 1027164 - RNA, 18 nt, Homo sapiens
acugaaaacaagccauga

SEQ ID NO: 1027165 - RNA, 18 nt, Homo sapiens
acugaaaacuugccguua

SEQ ID NO: 1027166 - RNA, 14 nt, Homo sapiens
acugaaaaugugcu

SEQ ID NO: 1027167 - RNA, 14 nt, Homo sapiens
acugaaaugcuagc

SEQ ID NO: 1027168 - RNA, 14 nt, Homo sapiens
acugaacauuccag

SEQ ID NO: 1027169 - RNA, 13 nt, Homo sapiens
acugaacuuugcu

SEQ ID NO: 1027170 - RNA, 14 nt, Homo sapiens
acugaagcucuuau

SEQ ID NO: 1027171 - RNA, 18 nt, Homo sapiens
acugaaggccuggcccac

SEQ ID NO: 1027172 - RNA, 17 nt, Homo sapiens
acugaagggguucucac

SEQ ID NO: 1027173 - RNA, 14 nt, Homo sapiens
acugaaguuucaca

SEQ ID NO: 1027174 - RNA, 17 nt, Homo sapiens
acugaaguuucacauga

SEQ ID NO: 1027175 - RNA, 15 nt, Homo sapiens
acugaauaaauaccu

SEQ ID NO: 1027176 - RNA, 22 nt, Homo sapiens
acugaaucuucaagaccaaagc

SEQ ID NO: 1027177 - RNA, 19 nt, Homo sapiens
acugaaugaaacccccaca

SEQ ID NO: 1027178 - RNA, 14 nt, Homo sapiens
acugaaugagguca

SEQ ID NO: 1027179 - RNA, 17 nt, Homo sapiens
acugaauuacucuccaa

SEQ ID NO: 1027180 - RNA, 21 nt, Homo sapiens
acugaauugaggacuauggaa

SEQ ID NO: 1027181 - RNA, 13 nt, Homo sapiens
acugacacuggua

SEQ ID NO: 1027182 - RNA, 16 nt, Homo sapiens
acugacauuguuggcc

SEQ ID NO: 1027183 - RNA, 15 nt, Homo sapiens
acugaccagccucca

SEQ ID NO: 1027184 - RNA, 12 nt, Homo sapiens
acugacuacugg

SEQ ID NO: 1027185 - RNA, 13 nt, Homo sapiens
acugacuccuuag

SEQ ID NO: 1027186 - RNA, 19 nt, Homo sapiens
acugagaagugcacuuuaa

SEQ ID NO: 1027187 - RNA, 15 nt, Homo sapiens
acugagaccaaagaa

SEQ ID NO: 1027188 - RNA, 18 nt, Homo sapiens
acugagagucugcacuua

SEQ ID NO: 1027189 - RNA, 19 nt, Homo sapiens
acugagagucugcacuuaa

SEQ ID NO: 1027190 - RNA, 12 nt, Homo sapiens
acugagccagca

SEQ ID NO: 1027191 - RNA, 16 nt, Homo sapiens
acugagcuauaacuua

SEQ ID NO: 1027192 - RNA, 14 nt, Homo sapiens
acugaggaccagcc

SEQ ID NO: 1027193 - RNA, 20 nt, Homo sapiens
acugaggcagacagcagcuc

SEQ ID NO: 1027194 - RNA, 15 nt, Homo sapiens
acugaggcagggaag

SEQ ID NO: 1027195 - RNA, 23 nt, Homo sapiens
acugaggcccagggaggugaccc

SEQ ID NO: 1027196 - RNA, 18 nt, Homo sapiens
acugaguccucguagcca

SEQ ID NO: 1027197 - RNA, 17 nt, Homo sapiens
acugaguuuauacucac

SEQ ID NO: 1027198 - RNA, 12 nt, Homo sapiens
acugaucauuaa

SEQ ID NO: 1027199 - RNA, 19 nt, Homo sapiens
acugaugaaggcaugccua

SEQ ID NO: 1027200 - RNA, 15 nt, Homo sapiens
acugauucacugcau

SEQ ID NO: 1027201 - RNA, 20 nt, Homo sapiens
acugcaagcagggcucugcc

SEQ ID NO: 1027202 - RNA, 16 nt, Homo sapiens
acugcaccaagucuca

SEQ ID NO: 1027203 - RNA, 15 nt, Homo sapiens
acugcacccagcuaa

SEQ ID NO: 1027204 - RNA, 21 nt, Homo sapiens
acugcacuauagccuagguga

SEQ ID NO: 1027205 - RNA, 22 nt, Homo sapiens
acugcagcuaacuuaucaucac

SEQ ID NO: 1027206 - RNA, 23 nt, Homo sapiens
acugcagggaaaauuauuugcau

SEQ ID NO: 1027207 - RNA, 20 nt, Homo sapiens
acuguuagucauuugcugag

SEQ ID NO: 1027208 - RNA, 13 nt, Homo sapiens
acuguugcucaaa

SEQ ID NO: 1027209 - RNA, 13 nt, Homo sapiens
acuguuucuguca

SEQ ID NO: 1027210 - RNA, 23 nt, Homo sapiens
acuuaagguuaccuuuguuccca

SEQ ID NO: 1027211 - RNA, 20 nt, Homo sapiens
acuuaauaauguguacauua

SEQ ID NO: 1027212 - RNA, 21 nt, Homo sapiens
acuuaauguuugguaacuuuu

SEQ ID NO: 1027213 - RNA, 14 nt, Homo sapiens
acuuaccuaccaca

SEQ ID NO: 1027214 - RNA, 17 nt, Homo sapiens
acuuaccuagauucuac

SEQ ID NO: 1027215 - RNA, 11 nt, Homo sapiens
acuuacuguac

SEQ ID NO: 1027216 - RNA, 16 nt, Homo sapiens
acuuacuuaguguuau

SEQ ID NO: 1027217 - RNA, 22 nt, Homo sapiens
acuuagacacguguuguuccac

SEQ ID NO: 1027218 - RNA, 22 nt, Homo sapiens
acuuagucucuaaagaguuuau

SEQ ID NO: 1027219 - RNA, 18 nt, Homo sapiens
acuuauauguucuaauua

SEQ ID NO: 1027220 - RNA, 20 nt, Homo sapiens
acuuauuauuccagaucugc

SEQ ID NO: 1027221 - RNA, 21 nt, Homo sapiens
acuuauuauuccagaucugca

SEQ ID NO: 1027222 - RNA, 15 nt, Homo sapiens
acuuauucucaagaa

SEQ ID NO: 1027223 - RNA, 17 nt, Homo sapiens
acuuauuggaacucugc

SEQ ID NO: 1027224 - RNA, 19 nt, Homo sapiens
acuucaagaucugaauuug

SEQ ID NO: 1027225 - RNA, 16 nt, Homo sapiens
acuucaauaaagcuau

SEQ ID NO: 1027226 - RNA, 21 nt, Homo sapiens
acuucaauugcuuugcacuuu

SEQ ID NO: 1027227 - RNA, 19 nt, Homo sapiens
acuucacgaaguguugcau

SEQ ID NO: 1027228 - RNA, 18 nt, Homo sapiens
acuucagagcacacuuau

SEQ ID NO: 1027229 - RNA, 19 nt, Homo sapiens
acuucagcaguaccuauaa

SEQ ID NO: 1027230 - RNA, 20 nt, Homo sapiens
acuucagcucacacaugaga

SEQ ID NO: 1027231 - RNA, 15 nt, Homo sapiens
acuucaucuucucag

SEQ ID NO: 1027232 - RNA, 22 nt, Homo sapiens
acuuccacauuauacauuugau

SEQ ID NO: 1027233 - RNA, 18 nt, Homo sapiens
acuuccaccagccugcac

SEQ ID NO: 1027234 - RNA, 13 nt, Homo sapiens
acuuccagugcaa

SEQ ID NO: 1027235 - RNA, 16 nt, Homo sapiens
acuucccuacauggag

SEQ ID NO: 1027236 - RNA, 18 nt, Homo sapiens
acuuccucgcuagaguuc

SEQ ID NO: 1027237 - RNA, 21 nt, Homo sapiens
acuuccucuucuucauugcag

SEQ ID NO: 1027238 - RNA, 16 nt, Homo sapiens
acuuccuguccagaga

SEQ ID NO: 1027239 - RNA, 13 nt, Homo sapiens
acuuccuugcucu

SEQ ID NO: 1027240 - RNA, 14 nt, Homo sapiens
acuuccuugcucuc

SEQ ID NO: 1027241 - RNA, 14 nt, Homo sapiens
acuucgagcacugu

SEQ ID NO: 1027242 - RNA, 19 nt, Homo sapiens
acuucuaaguaaaaccaca

SEQ ID NO: 1027243 - RNA, 20 nt, Homo sapiens
acuucuaaguaaaaccacag

SEQ ID NO: 1027244 - RNA, 16 nt, Homo sapiens
acuucuccaggucuca

SEQ ID NO: 1027245 - RNA, 18 nt, Homo sapiens
acuucucuauuaucucaa

SEQ ID NO: 1027246 - RNA, 13 nt, Homo sapiens
acuucucucagga

SEQ ID NO: 1027247 - RNA, 15 nt, Homo sapiens
acuucuggagucuau

SEQ ID NO: 1027248 - RNA, 19 nt, Homo sapiens
acuucuuuaaaaaaacaca

SEQ ID NO: 1027249 - RNA, 18 nt, Homo sapiens
acuugaaagcauccaugu

SEQ ID NO: 1027250 - RNA, 17 nt, Homo sapiens
acuugaaauaccaguga

SEQ ID NO: 1027251 - RNA, 23 nt, Homo sapiens
acuugaaauaccagugaaccaaa

SEQ ID NO: 1027252 - RNA, 17 nt, Homo sapiens
acuugacagaacacugu

SEQ ID NO: 1027253 - RNA, 20 nt, Homo sapiens
acuugagaggaugaauguau

SEQ ID NO: 1027254 - RNA, 13 nt, Homo sapiens
acuugagcaccgu

SEQ ID NO: 1027255 - RNA, 23 nt, Homo sapiens
acuugaggcugcaaucacacuga

SEQ ID NO: 1027256 - RNA, 21 nt, Homo sapiens
acuugaugacagacacuucua

SEQ ID NO: 1027257 - RNA, 19 nt, Homo sapiens
acuugauguguuaucucuu

SEQ ID NO: 1027258 - RNA, 13 nt, Homo sapiens
acuugauuccuug

SEQ ID NO: 1027259 - RNA, 19 nt, Homo sapiens
acuugcacgcccaugugug

SEQ ID NO: 1027260 - RNA, 16 nt, Homo sapiens
acuugcauacagagac

SEQ ID NO: 1027261 - RNA, 23 nt, Homo sapiens
acuugcugcugagugcaccacuu

SEQ ID NO: 1027262 - RNA, 20 nt, Homo sapiens
acuuggagccccagugccaa

SEQ ID NO: 1027263 - RNA, 15 nt, Homo sapiens
acuuggcaucauuca

SEQ ID NO: 1027264 - RNA, 15 nt, Homo sapiens
acuugggacauugcc

SEQ ID NO: 1027265 - RNA, 14 nt, Homo sapiens
acuuggucaccagc

SEQ ID NO: 1027266 - RNA, 18 nt, Homo sapiens
acuugucuuguucaccuu

SEQ ID NO: 1027267 - RNA, 16 nt, Homo sapiens
acuuguggacacagcu

SEQ ID NO: 1027268 - RNA, 15 nt, Homo sapiens
acuuguuuuaugcuc

SEQ ID NO: 1027269 - RNA, 22 nt, Homo sapiens
acuuuaaaaaaaucauaugcua

SEQ ID NO: 1027270 - RNA, 14 nt, Homo sapiens
acuuuaauucucau

SEQ ID NO: 1027271 - RNA, 17 nt, Homo sapiens
acuuuaauucucuuacu

SEQ ID NO: 1027272 - RNA, 20 nt, Homo sapiens
acuuuagaguagcaugagag

SEQ ID NO: 1027273 - RNA, 21 nt, Homo sapiens
acuuuaucaaagagaaguuac

SEQ ID NO: 1027274 - RNA, 16 nt, Homo sapiens
acuuucacacuaagaa

SEQ ID NO: 1027275 - RNA, 22 nt, Homo sapiens
acuuuccacuccuggcugagag

SEQ ID NO: 1027276 - RNA, 22 nt, Homo sapiens
acuuuccauagggccuccuuag

SEQ ID NO: 1027277 - RNA, 15 nt, Homo sapiens
acuuuccgcuuucac

SEQ ID NO: 1027278 - RNA, 17 nt, Homo sapiens
acuuucuacaggccagc

SEQ ID NO: 1027279 - RNA, 21 nt, Homo sapiens
acuuucugaagccucacuuau

SEQ ID NO: 1027280 - RNA, 22 nt, Homo sapiens
acuuucuguugccacaacccug

SEQ ID NO: 1027281 - RNA, 18 nt, Homo sapiens
acuuugaguuagugccau

SEQ ID NO: 1027282 - RNA, 22 nt, Homo sapiens
acuuuggaauguacucuguuca

SEQ ID NO: 1027283 - RNA, 17 nt, Homo sapiens
acuuugggauucuuucc

SEQ ID NO: 1027284 - RNA, 14 nt, Homo sapiens
acuuuguacaaaga

SEQ ID NO: 1027285 - RNA, 18 nt, Homo sapiens
acuuuguauagacaucug

SEQ ID NO: 1027286 - RNA, 21 nt, Homo sapiens
acuuuguauagacaucugccc

SEQ ID NO: 1027287 - RNA, 22 nt, Homo sapiens
acuuuguauagacaucugcccu

SEQ ID NO: 1027288 - RNA, 20 nt, Homo sapiens
acuuuugugcuccccuuugc

SEQ ID NO: 1027289 - RNA, 18 nt, Homo sapiens
acuuuuuacagugcuauu

SEQ ID NO: 1027290 - RNA, 11 nt, Homo sapiens
acuuuuuccag

SEQ ID NO: 1027291 - RNA, 22 nt, Homo sapiens
acuuuuuucuuauuuaacuuaa

SEQ ID NO: 1027292 - RNA, 23 nt, Homo sapiens
acuuuuuuuuuuuuuugagacag

SEQ ID NO: 1027293 - RNA, 20 nt, Homo sapiens
agaaaaaauaacacacauau

SEQ ID NO: 1027294 - RNA, 15 nt, Homo sapiens
agaaaaacaaauuca

SEQ ID NO: 1027295 - RNA, 15 nt, Homo sapiens
agaaaacacaaccug

SEQ ID NO: 1027296 - RNA, 15 nt, Homo sapiens
agaaaacauaaucuu

SEQ ID NO: 1027297 - RNA, 22 nt, Homo sapiens
agaaaauucuaaaucaauuauu

SEQ ID NO: 1027298 - RNA, 14 nt, Homo sapiens
agaaacacccucac

SEQ ID NO: 1027299 - RNA, 13 nt, Homo sapiens
agaaacacugggg

SEQ ID NO: 1027300 - RNA, 20 nt, Homo sapiens
agaaaccaagagaaguuuug

SEQ ID NO: 1027301 - RNA, 16 nt, Homo sapiens
agaaaccagagucaaa

SEQ ID NO: 1027302 - RNA, 20 nt, Homo sapiens
agaaaccuuauuguaccucu

SEQ ID NO: 1027303 - RNA, 13 nt, Homo sapiens
agaaacucaccau

SEQ ID NO: 1027304 - RNA, 19 nt, Homo sapiens
agaaacuguagucucagga

SEQ ID NO: 1027305 - RNA, 15 nt, Homo sapiens
agaaagagucaggcc

SEQ ID NO: 1027306 - RNA, 21 nt, Homo sapiens
agaaagcaaaugugaccugug

SEQ ID NO: 1027307 - RNA, 12 nt, Homo sapiens
agaaagccaaau

SEQ ID NO: 1027308 - RNA, 17 nt, Homo sapiens
agaaagcucaucucagc

SEQ ID NO: 1027309 - RNA, 12 nt, Homo sapiens
agaaaguauuug

SEQ ID NO: 1027310 - RNA, 19 nt, Homo sapiens
agaaagugcgaguccucca

SEQ ID NO: 1027311 - RNA, 14 nt, Homo sapiens
agaaaguggugcuc

SEQ ID NO: 1027312 - RNA, 17 nt, Homo sapiens
agaaaguggugcucagu

SEQ ID NO: 1027313 - RNA, 22 nt, Homo sapiens
aggagaccuggcacuggaugca

SEQ ID NO: 1027314 - RNA, 23 nt, Homo sapiens
aggagaggaaaaguaaggugcag

SEQ ID NO: 1027315 - RNA, 22 nt, Homo sapiens
aggagcaaauguuucugcagua

SEQ ID NO: 1027316 - RNA, 18 nt, Homo sapiens
aggagcgggaccuguggc

SEQ ID NO: 1027317 - RNA, 21 nt, Homo sapiens
aggagcugcuggcuugcagug

SEQ ID NO: 1027318 - RNA, 18 nt, Homo sapiens
aggagcuuuggaccuaau

SEQ ID NO: 1027319 - RNA, 20 nt, Homo sapiens
aggaggacaauucaugaacu

SEQ ID NO: 1027320 - RNA, 14 nt, Homo sapiens
aggaggccacguga

SEQ ID NO: 1027321 - RNA, 21 nt, Homo sapiens
aggaggccuccaucucaugua

SEQ ID NO: 1027322 - RNA, 19 nt, Homo sapiens
aggaggcuuggaaagcauc

SEQ ID NO: 1027323 - RNA, 19 nt, Homo sapiens
aggagggguuaaagcugcc

SEQ ID NO: 1027324 - RNA, 20 nt, Homo sapiens
aggagguggaggcugcagug

SEQ ID NO: 1027325 - RNA, 14 nt, Homo sapiens
aggaguacagguga

SEQ ID NO: 1027326 - RNA, 15 nt, Homo sapiens
aggaguacaggugaa

SEQ ID NO: 1027327 - RNA, 14 nt, Homo sapiens
aggagucagggaga

SEQ ID NO: 1027328 - RNA, 22 nt, Homo sapiens
aggaguucacuucaucuucuca

SEQ ID NO: 1027329 - RNA, 23 nt, Homo sapiens
aggaguucacuucaucuucucag

SEQ ID NO: 1027330 - RNA, 15 nt, Homo sapiens
aggauaggaguucac

SEQ ID NO: 1027331 - RNA, 21 nt, Homo sapiens
aggauaggaguucacuucauc

SEQ ID NO: 1027332 - RNA, 15 nt, Homo sapiens
aggauauuaacaaca

SEQ ID NO: 1027333 - RNA, 23 nt, Homo sapiens
aggauauugacauugauacagug

SEQ ID NO: 1027334 - RNA, 18 nt, Homo sapiens
aggaucaagucacucauc

SEQ ID NO: 1027335 - RNA, 14 nt, Homo sapiens
aggaucuguacaau

SEQ ID NO: 1027336 - RNA, 14 nt, Homo sapiens
aggaugaauguaug

SEQ ID NO: 1027337 - RNA, 12 nt, Homo sapiens
aggaugagcugg

SEQ ID NO: 1027338 - RNA, 23 nt, Homo sapiens
aggcaacugaggcagacagcagc

SEQ ID NO: 1027339 - RNA, 12 nt, Homo sapiens
aggcaagcacuu

SEQ ID NO: 1027340 - RNA, 22 nt, Homo sapiens
aggcacacagcaagucaggguu

SEQ ID NO: 1027341 - RNA, 19 nt, Homo sapiens
aggcacccaccaccaugcc

SEQ ID NO: 1027342 - RNA, 16 nt, Homo sapiens
aggcacgaaugaucuu

SEQ ID NO: 1027343 - RNA, 17 nt, Homo sapiens
aggcacugccugaugga

SEQ ID NO: 1027344 - RNA, 22 nt, Homo sapiens
aggcacugcugcccagccucca

SEQ ID NO: 1027345 - RNA, 17 nt, Homo sapiens
aggcagaaaaaugucau

SEQ ID NO: 1027346 - RNA, 21 nt, Homo sapiens
aggcagagauagaaccuggag

SEQ ID NO: 1027347 - RNA, 14 nt, Homo sapiens
aggcagcaaacaga

SEQ ID NO: 1027348 - RNA, 12 nt, Homo sapiens
aggcagcacaga

SEQ ID NO: 1027349 - RNA, 23 nt, Homo sapiens
aggcagcuguugcagugagccaa

SEQ ID NO: 1027350 - RNA, 21 nt, Homo sapiens
aggcagcuuuuucucucccac

SEQ ID NO: 1027351 - RNA, 15 nt, Homo sapiens
aggcaggaguggcgu

SEQ ID NO: 1027352 - RNA, 14 nt, Homo sapiens
aggcagggucucac

SEQ ID NO: 1027353 - RNA, 17 nt, Homo sapiens
aggcaguuggccagaga

SEQ ID NO: 1027354 - RNA, 19 nt, Homo sapiens
aggcauaagaaaacuaaga

SEQ ID NO: 1027355 - RNA, 16 nt, Homo sapiens
aggcauccuuccucac

SEQ ID NO: 1027356 - RNA, 18 nt, Homo sapiens
aggcaugagccaccacgc

SEQ ID NO: 1027357 - RNA, 16 nt, Homo sapiens
aggcaugauguuaacc

SEQ ID NO: 1027358 - RNA, 13 nt, Homo sapiens
aggcauggcagaa

SEQ ID NO: 1027359 - RNA, 11 nt, Homo sapiens
aggcauucucu

SEQ ID NO: 1027360 - RNA, 19 nt, Homo sapiens
aggccaagggccaagagaa

SEQ ID NO: 1027361 - RNA, 20 nt, Homo sapiens
aggccacuugaugaccccca

SEQ ID NO: 1027362 - RNA, 15 nt, Homo sapiens
aggccagcaccaucu

SEQ ID NO: 1027363 - RNA, 13 nt, Homo sapiens
aggcccaagagau

SEQ ID NO: 1027364 - RNA, 19 nt, Homo sapiens
aggcccagggaggugaccc

SEQ ID NO: 1027365 - RNA, 15 nt, Homo sapiens
aggccccaguggcug

SEQ ID NO: 1027366 - RNA, 19 nt, Homo sapiens
aggcccuuauuuucaagaa

SEQ ID NO: 1027367 - RNA, 20 nt, Homo sapiens
aggccuacaugcuuugugaa

SEQ ID NO: 1027368 - RNA, 18 nt, Homo sapiens
aggccucuuggaccucug

SEQ ID NO: 1027369 - RNA, 20 nt, Homo sapiens
aggccuggccagaugcacca

SEQ ID NO: 1027370 - RNA, 21 nt, Homo sapiens
aggccuugagggcgucuucua

SEQ ID NO: 1027371 - RNA, 19 nt, Homo sapiens
aggccuugcucacagcuga

SEQ ID NO: 1027372 - RNA, 15 nt, Homo sapiens
aggcgauccaccugu

SEQ ID NO: 1027373 - RNA, 19 nt, Homo sapiens
aggcgauccaccugucuca

SEQ ID NO: 1027374 - RNA, 17 nt, Homo sapiens
aggcgaugugcaagugu

SEQ ID NO: 1027375 - RNA, 18 nt, Homo sapiens
aggcggagcuugcaguga

SEQ ID NO: 1027376 - RNA, 15 nt, Homo sapiens
aggcggaucuuugga

SEQ ID NO: 1027377 - RNA, 17 nt, Homo sapiens
aggcggcuacaugccuc

SEQ ID NO: 1027378 - RNA, 14 nt, Homo sapiens
aggcgggccugcaa

SEQ ID NO: 1027379 - RNA, 17 nt, Homo sapiens
aggcucagagaugugca

SEQ ID NO: 1027380 - RNA, 20 nt, Homo sapiens
aggcucagggaaaggccagu

SEQ ID NO: 1027381 - RNA, 21 nt, Homo sapiens
aggcuccugccaguguggaac

SEQ ID NO: 1027382 - RNA, 23 nt, Homo sapiens
aggcuccugugcuacuuugccuu

SEQ ID NO: 1027383 - RNA, 16 nt, Homo sapiens
aggcugaccaagagag

SEQ ID NO: 1027384 - RNA, 16 nt, Homo sapiens
aggcugagaacacugu

SEQ ID NO: 1027385 - RNA, 17 nt, Homo sapiens
aggcugagaacacugug

SEQ ID NO: 1027386 - RNA, 19 nt, Homo sapiens
aggcugagaacacugugaa

SEQ ID NO: 1027387 - RNA, 21 nt, Homo sapiens
aguagagcagccacaaccaaa

SEQ ID NO: 1027388 - RNA, 16 nt, Homo sapiens
aguagaggcuauggac

SEQ ID NO: 1027389 - RNA, 12 nt, Homo sapiens
aguagauaagga

SEQ ID NO: 1027390 - RNA, 21 nt, Homo sapiens
aguagauuuuaaaaguuauua

SEQ ID NO: 1027391 - RNA, 12 nt, Homo sapiens
aguagcaauuuc

SEQ ID NO: 1027392 - RNA, 16 nt, Homo sapiens
aguagcuggauuacag

SEQ ID NO: 1027393 - RNA, 13 nt, Homo sapiens
aguaggugcuuga

SEQ ID NO: 1027394 - RNA, 13 nt, Homo sapiens
aguagguuuacau

SEQ ID NO: 1027395 - RNA, 16 nt, Homo sapiens
aguaguaugaugauac

SEQ ID NO: 1027396 - RNA, 18 nt, Homo sapiens
aguauaacugaguuaaau

SEQ ID NO: 1027397 - RNA, 16 nt, Homo sapiens
aguauaauaauuacug

SEQ ID NO: 1027398 - RNA, 13 nt, Homo sapiens
aguauacaugacu

SEQ ID NO: 1027399 - RNA, 22 nt, Homo sapiens
aguauacuuuuugcauauguaa

SEQ ID NO: 1027400 - RNA, 14 nt, Homo sapiens
aguauauauagaau

SEQ ID NO: 1027401 - RNA, 18 nt, Homo sapiens
aguaucaugaagccuaaa

SEQ ID NO: 1027402 - RNA, 16 nt, Homo sapiens
aguaugaaaaugucau

SEQ ID NO: 1027403 - RNA, 18 nt, Homo sapiens
aguaugaaaaugucauug

SEQ ID NO: 1027404 - RNA, 15 nt, Homo sapiens
aguaugaaugcagug

SEQ ID NO: 1027405 - RNA, 21 nt, Homo sapiens
aguaugugaguguguccaagu

SEQ ID NO: 1027406 - RNA, 13 nt, Homo sapiens
aguaugugcauau

SEQ ID NO: 1027407 - RNA, 23 nt, Homo sapiens
aguauugaaauguuugcauaaag

SEQ ID NO: 1027408 - RNA, 18 nt, Homo sapiens
agucaagagcauccugcu

SEQ ID NO: 1027409 - RNA, 23 nt, Homo sapiens
agucaaggauggaugcagaucca

SEQ ID NO: 1027410 - RNA, 13 nt, Homo sapiens
agucacagagaua

SEQ ID NO: 1027411 - RNA, 14 nt, Homo sapiens
agucacaggucaca

SEQ ID NO: 1027412 - RNA, 14 nt, Homo sapiens
agucacaucucuuc

SEQ ID NO: 1027413 - RNA, 18 nt, Homo sapiens
agucaccauacacacugu

SEQ ID NO: 1027414 - RNA, 17 nt, Homo sapiens
agucacucccaagcccc

SEQ ID NO: 1027415 - RNA, 21 nt, Homo sapiens
agucacugucccucaaaugac

SEQ ID NO: 1027416 - RNA, 20 nt, Homo sapiens
agucacuuauaauuaugcua

SEQ ID NO: 1027417 - RNA, 16 nt, Homo sapiens
agucaguaauugccaa

SEQ ID NO: 1027418 - RNA, 22 nt, Homo sapiens
agucauauuuugauuauuguau

SEQ ID NO: 1027419 - RNA, 13 nt, Homo sapiens
agucaucaaagau

SEQ ID NO: 1027420 - RNA, 13 nt, Homo sapiens
agucauccucaga

SEQ ID NO: 1027421 - RNA, 19 nt, Homo sapiens
agucauuaugagaggcaau

SEQ ID NO: 1027422 - RNA, 21 nt, Homo sapiens
agucauuugcugagcauguac

SEQ ID NO: 1027423 - RNA, 23 nt, Homo sapiens
agucauuuuuguuucuaccuccc

SEQ ID NO: 1027424 - RNA, 12 nt, Homo sapiens
aguccacugcug

SEQ ID NO: 1027425 - RNA, 16 nt, Homo sapiens
aguccagauauuucac

SEQ ID NO: 1027426 - RNA, 17 nt, Homo sapiens
aguccagauauuucaca

SEQ ID NO: 1027427 - RNA, 14 nt, Homo sapiens
aguccagauuuaca

SEQ ID NO: 1027428 - RNA, 13 nt, Homo sapiens
aguccagcuugua

SEQ ID NO: 1027429 - RNA, 16 nt, Homo sapiens
aguccagguguucucc

SEQ ID NO: 1027430 - RNA, 18 nt, Homo sapiens
agucccaccuuggcugca

SEQ ID NO: 1027431 - RNA, 18 nt, Homo sapiens
agucccagcuacucagga

SEQ ID NO: 1027432 - RNA, 20 nt, Homo sapiens
aguccccucaccuccucuaa

SEQ ID NO: 1027433 - RNA, 21 nt, Homo sapiens
agucccuaaaaacacagacau

SEQ ID NO: 1027434 - RNA, 15 nt, Homo sapiens
agucccuuugugacu

SEQ ID NO: 1027435 - RNA, 20 nt, Homo sapiens
aguccgacaaagcuacuuga

SEQ ID NO: 1027436 - RNA, 17 nt, Homo sapiens
aguccuacaagcuaaaa

SEQ ID NO: 1027437 - RNA, 19 nt, Homo sapiens
aguccucgcggcucuccag

SEQ ID NO: 1027438 - RNA, 16 nt, Homo sapiens
aguccuucaaacuucc

SEQ ID NO: 1027439 - RNA, 21 nt, Homo sapiens
aguccuucaccucacugaaaa

SEQ ID NO: 1027440 - RNA, 19 nt, Homo sapiens
aguccuugcuuggcugcuu

SEQ ID NO: 1027441 - RNA, 23 nt, Homo sapiens
agucgaggacagggaggugaccc

SEQ ID NO: 1027442 - RNA, 13 nt, Homo sapiens
agucgaugaacua

SEQ ID NO: 1027443 - RNA, 19 nt, Homo sapiens
agucgcaucucagugcagg

SEQ ID NO: 1027444 - RNA, 20 nt, Homo sapiens
agucguggagaugucuucgu

SEQ ID NO: 1027445 - RNA, 19 nt, Homo sapiens
agucuacucuuaagccauc

SEQ ID NO: 1027446 - RNA, 20 nt, Homo sapiens
agucuaugaugcuguugccc

SEQ ID NO: 1027447 - RNA, 16 nt, Homo sapiens
agucucaggaaaucaa

SEQ ID NO: 1027448 - RNA, 12 nt, Homo sapiens
agucuccagugg

SEQ ID NO: 1027449 - RNA, 17 nt, Homo sapiens
agucuccuuugcacuga

SEQ ID NO: 1027450 - RNA, 22 nt, Homo sapiens
agucucugaagugaaacugcuu

SEQ ID NO: 1027451 - RNA, 18 nt, Homo sapiens
agucucugagggcuuccu

SEQ ID NO: 1027452 - RNA, 18 nt, Homo sapiens
agucucuuuucuuuagag

SEQ ID NO: 1027453 - RNA, 19 nt, Homo sapiens
agucugaugagaacucuga

SEQ ID NO: 1027454 - RNA, 23 nt, Homo sapiens
agucuuaaaauaacuuauaucau

SEQ ID NO: 1027455 - RNA, 14 nt, Homo sapiens
agucuucaagcaga

SEQ ID NO: 1027456 - RNA, 13 nt, Homo sapiens
agucuucccugau

SEQ ID NO: 1027457 - RNA, 19 nt, Homo sapiens
agucuuccugacacuuuaa

SEQ ID NO: 1027458 - RNA, 19 nt, Homo sapiens
agucuugcagcaggaucua

SEQ ID NO: 1027459 - RNA, 16 nt, Homo sapiens
agucuuuccuaccuug

SEQ ID NO: 1027460 - RNA, 14 nt, Homo sapiens
agugaaccaaagag

SEQ ID NO: 1027461 - RNA, 18 nt, Homo sapiens
agugaauaaccacuuaaa

SEQ ID NO: 1027462 - RNA, 13 nt, Homo sapiens
agugaauucacca

SEQ ID NO: 1027463 - RNA, 11 nt, Homo sapiens
agugacagagg

SEQ ID NO: 1027464 - RNA, 20 nt, Homo sapiens
agugacagcucugccuguua

SEQ ID NO: 1027465 - RNA, 15 nt, Homo sapiens
agugacccacccuag

SEQ ID NO: 1027466 - RNA, 13 nt, Homo sapiens
agugacugacccc

SEQ ID NO: 1027467 - RNA, 20 nt, Homo sapiens
agugacuguucaagagcaca

SEQ ID NO: 1027468 - RNA, 19 nt, Homo sapiens
gaauaaaauugcacuuuua

SEQ ID NO: 1027469 - RNA, 16 nt, Homo sapiens
gaauaaagcccuugaa

SEQ ID NO: 1027470 - RNA, 17 nt, Homo sapiens
gaauaaagcccuugaac

SEQ ID NO: 1027471 - RNA, 21 nt, Homo sapiens
gaauaaagcccuugaaccagc

SEQ ID NO: 1027472 - RNA, 11 nt, Homo sapiens
gaauaaagccu

SEQ ID NO: 1027473 - RNA, 18 nt, Homo sapiens
gaauaaauaaauguaucu

SEQ ID NO: 1027474 - RNA, 15 nt, Homo sapiens
gaauaaauaccucuu

SEQ ID NO: 1027475 - RNA, 15 nt, Homo sapiens
gaauaaccacuuaaa

SEQ ID NO: 1027476 - RNA, 20 nt, Homo sapiens
gaauaagcuuuuaaugcucc

SEQ ID NO: 1027477 - RNA, 12 nt, Homo sapiens
gaauaaggccuu

SEQ ID NO: 1027478 - RNA, 12 nt, Homo sapiens
gaauagaacucu

SEQ ID NO: 1027479 - RNA, 14 nt, Homo sapiens
gaauauaauacugu

SEQ ID NO: 1027480 - RNA, 19 nt, Homo sapiens
gaauauaauacuguauuug

SEQ ID NO: 1027481 - RNA, 13 nt, Homo sapiens
gaauauagagggu

SEQ ID NO: 1027482 - RNA, 14 nt, Homo sapiens
gaauaugaacggug

SEQ ID NO: 1027483 - RNA, 16 nt, Homo sapiens
gaauaugauuaguaaa

SEQ ID NO: 1027484 - RNA, 12 nt, Homo sapiens
gaauauucccaa

SEQ ID NO: 1027485 - RNA, 18 nt, Homo sapiens
gaauauucccaagcccau

SEQ ID NO: 1027486 - RNA, 21 nt, Homo sapiens
gaauauuuauuaccucugaua

SEQ ID NO: 1027487 - RNA, 13 nt, Homo sapiens
gaaucaaagacau

SEQ ID NO: 1027488 - RNA, 22 nt, Homo sapiens
gaaucaaagcaguuaacuuuaa

SEQ ID NO: 1027489 - RNA, 14 nt, Homo sapiens
gaaucaacauuucu

SEQ ID NO: 1027490 - RNA, 15 nt, Homo sapiens
gaaucacaguauugu

SEQ ID NO: 1027491 - RNA, 16 nt, Homo sapiens
gaaucacuugaaccca

SEQ ID NO: 1027492 - RNA, 17 nt, Homo sapiens
gaaucacuugaacccag

SEQ ID NO: 1027493 - RNA, 17 nt, Homo sapiens
gaaucacuugaaccugg

SEQ ID NO: 1027494 - RNA, 19 nt, Homo sapiens
gaaucauauaguauguaac

SEQ ID NO: 1027495 - RNA, 18 nt, Homo sapiens
gaaucauuaauacaaaga

SEQ ID NO: 1027496 - RNA, 16 nt, Homo sapiens
gaauccagacccggcu

SEQ ID NO: 1027497 - RNA, 15 nt, Homo sapiens
gaauccaguuugcaa

SEQ ID NO: 1027498 - RNA, 19 nt, Homo sapiens
gaaucccuggcaaagggag

SEQ ID NO: 1027499 - RNA, 19 nt, Homo sapiens
gaaucuacaaaaaacaaca

SEQ ID NO: 1027500 - RNA, 20 nt, Homo sapiens
gaaucucuuuuugcuuucga

SEQ ID NO: 1027501 - RNA, 19 nt, Homo sapiens
gaaucuguaaagaaauaua

SEQ ID NO: 1027502 - RNA, 18 nt, Homo sapiens
gaaucuucaagaccaaag

SEQ ID NO: 1027503 - RNA, 20 nt, Homo sapiens
gaaucuucaagaccaaagca

SEQ ID NO: 1027504 - RNA, 19 nt, Homo sapiens
gaaugaaagaguaaaggaa

SEQ ID NO: 1027505 - RNA, 18 nt, Homo sapiens
gaaugaacaaauugaacu

SEQ ID NO: 1027506 - RNA, 23 nt, Homo sapiens
gaaugaaucucaagauucaguag

SEQ ID NO: 1027507 - RNA, 15 nt, Homo sapiens
gaaugacaacagaag

SEQ ID NO: 1027508 - RNA, 23 nt, Homo sapiens
gaaugacggcaaacucagucaua

SEQ ID NO: 1027509 - RNA, 18 nt, Homo sapiens
gaaugaggcuugcugaga

SEQ ID NO: 1027510 - RNA, 14 nt, Homo sapiens
gaaugauucagugu

SEQ ID NO: 1027511 - RNA, 16 nt, Homo sapiens
gaaugcaguggggaca

SEQ ID NO: 1027512 - RNA, 12 nt, Homo sapiens
gaaugcggccca

SEQ ID NO: 1027513 - RNA, 15 nt, Homo sapiens
gaaugcugaaaccaa

SEQ ID NO: 1027514 - RNA, 17 nt, Homo sapiens
gaauggagcuggcccuc

SEQ ID NO: 1027515 - RNA, 15 nt, Homo sapiens
gaaugguccaggguu

SEQ ID NO: 1027516 - RNA, 15 nt, Homo sapiens
gaauguaacugcuga

SEQ ID NO: 1027517 - RNA, 22 nt, Homo sapiens
gaaugucuuucagccaagccaa

SEQ ID NO: 1027518 - RNA, 12 nt, Homo sapiens
gaaugugccucu

SEQ ID NO: 1027519 - RNA, 19 nt, Homo sapiens
gaauuaaccuggugcugga

SEQ ID NO: 1027520 - RNA, 20 nt, Homo sapiens
gaauuacaggcacauaccac

SEQ ID NO: 1027521 - RNA, 12 nt, Homo sapiens
gaauuagcucac

SEQ ID NO: 1027522 - RNA, 16 nt, Homo sapiens
gaauuagcucacuugg

SEQ ID NO: 1027523 - RNA, 16 nt, Homo sapiens
gaauuaggaagaccaa

SEQ ID NO: 1027524 - RNA, 17 nt, Homo sapiens
gaauuaggaagaccaag

SEQ ID NO: 1027525 - RNA, 15 nt, Homo sapiens
gaauuauaaaggcca

SEQ ID NO: 1027526 - RNA, 18 nt, Homo sapiens
gaauuauaagaggcugau

SEQ ID NO: 1027527 - RNA, 20 nt, Homo sapiens
gaauuauuuaaacaaaaacu

SEQ ID NO: 1027528 - RNA, 18 nt, Homo sapiens
gaauuucaguaaacaaug

SEQ ID NO: 1027529 - RNA, 15 nt, Homo sapiens
gaauuuccucuauug

SEQ ID NO: 1027530 - RNA, 18 nt, Homo sapiens
gaauuugaguuggaucau

SEQ ID NO: 1027531 - RNA, 18 nt, Homo sapiens
gacaaagacaaauucugu

SEQ ID NO: 1027532 - RNA, 16 nt, Homo sapiens
gacaaagaugauuuaa

SEQ ID NO: 1027533 - RNA, 16 nt, Homo sapiens
gacaaagugagacucc

SEQ ID NO: 1027534 - RNA, 18 nt, Homo sapiens
gacaaauacucaugugua

SEQ ID NO: 1027535 - RNA, 13 nt, Homo sapiens
gacaaauucuguu

SEQ ID NO: 1027536 - RNA, 13 nt, Homo sapiens
gacaacacuggga

SEQ ID NO: 1027537 - RNA, 16 nt, Homo sapiens
gacaacagcauaacua

SEQ ID NO: 1027538 - RNA, 15 nt, Homo sapiens
gacaaccucauuuua

SEQ ID NO: 1027539 - RNA, 22 nt, Homo sapiens
gacaagccaacuuguaaauaca

SEQ ID NO: 1027540 - RNA, 14 nt, Homo sapiens
gacaagcugcaaau

SEQ ID NO: 1027541 - RNA, 15 nt, Homo sapiens
gacaaggaaaggcaa

SEQ ID NO: 1027542 - RNA, 17 nt, Homo sapiens
gacaaggccccagagac

SEQ ID NO: 1027543 - RNA, 19 nt, Homo sapiens
gacaaucaugaaauaugca

SEQ ID NO: 1027544 - RNA, 20 nt, Homo sapiens
gacaauggcuuacuccagga

SEQ ID NO: 1027545 - RNA, 18 nt, Homo sapiens
cauagcccagaucagcuc

SEQ ID NO: 1027546 - RNA, 21 nt, Homo sapiens
cauagcuccuucucucuuaca

SEQ ID NO: 1027547 - RNA, 22 nt, Homo sapiens
cauagcuccuucucucuuacau

SEQ ID NO: 1027548 - RNA, 22 nt, Homo sapiens
cauagcugucuagaguagcuua

SEQ ID NO: 1027549 - RNA, 15 nt, Homo sapiens
cauaggcccagugag

SEQ ID NO: 1027550 - RNA, 21 nt, Homo sapiens
cauaggguccugaauguuuca

SEQ ID NO: 1027551 - RNA, 20 nt, Homo sapiens
cauagguauauauaugccau

SEQ ID NO: 1027552 - RNA, 23 nt, Homo sapiens
cauaguacagguaaggugaggga

SEQ ID NO: 1027553 - RNA, 16 nt, Homo sapiens
cauaguacauacaaaa

SEQ ID NO: 1027554 - RNA, 21 nt, Homo sapiens
cauaguaugguggcuggguug

SEQ ID NO: 1027555 - RNA, 17 nt, Homo sapiens
cauaguuuaaacugcau

SEQ ID NO: 1027556 - RNA, 14 nt, Homo sapiens
cauauaaguuugaa

SEQ ID NO: 1027557 - RNA, 13 nt, Homo sapiens
cauauaauguugu

SEQ ID NO: 1027558 - RNA, 16 nt, Homo sapiens
cauauacaauugucau

SEQ ID NO: 1027559 - RNA, 18 nt, Homo sapiens
cauauacucuucaaggac

SEQ ID NO: 1027560 - RNA, 13 nt, Homo sapiens
cauauauauguca

SEQ ID NO: 1027561 - RNA, 16 nt, Homo sapiens
cauauauuacuagcau

SEQ ID NO: 1027562 - RNA, 22 nt, Homo sapiens
cauauauuagcauuuaguccaa

SEQ ID NO: 1027563 - RNA, 23 nt, Homo sapiens
cauauauuugaaguggagccaua

SEQ ID NO: 1027564 - RNA, 15 nt, Homo sapiens
cauauccaccaccuc

SEQ ID NO: 1027565 - RNA, 15 nt, Homo sapiens
cauaugauugugcac

SEQ ID NO: 1027566 - RNA, 16 nt, Homo sapiens
cauaugauugugcaca

SEQ ID NO: 1027567 - RNA, 19 nt, Homo sapiens
cauauggacucugcacaug

SEQ ID NO: 1027568 - RNA, 19 nt, Homo sapiens
cauauguugcucagucucc

SEQ ID NO: 1027569 - RNA, 20 nt, Homo sapiens
cauauguuuuuguaaguuua

SEQ ID NO: 1027570 - RNA, 19 nt, Homo sapiens
cauauucaggaagcucagg

SEQ ID NO: 1027571 - RNA, 16 nt, Homo sapiens
cauauucuguuggcca

SEQ ID NO: 1027572 - RNA, 23 nt, Homo sapiens
cauauucuuauguaugugaaagu

SEQ ID NO: 1027573 - RNA, 23 nt, Homo sapiens
cauauucuuuaaauuucaucuca

SEQ ID NO: 1027574 - RNA, 18 nt, Homo sapiens
cauauugaugugugucua

SEQ ID NO: 1027575 - RNA, 15 nt, Homo sapiens
cauauuggacugaua

SEQ ID NO: 1027576 - RNA, 16 nt, Homo sapiens
cauauugugccaauau

SEQ ID NO: 1027577 - RNA, 18 nt, Homo sapiens
cauauugugccaauaugu

SEQ ID NO: 1027578 - RNA, 13 nt, Homo sapiens
cauauuuacuucu

SEQ ID NO: 1027579 - RNA, 14 nt, Homo sapiens
cauauuuguuaaau

SEQ ID NO: 1027580 - RNA, 12 nt, Homo sapiens
caucaagcacag

SEQ ID NO: 1027581 - RNA, 17 nt, Homo sapiens
caucaagcgaugaaacu

SEQ ID NO: 1027582 - RNA, 13 nt, Homo sapiens
caucacaguuuug

SEQ ID NO: 1027583 - RNA, 13 nt, Homo sapiens
caucacaugacca

SEQ ID NO: 1027584 - RNA, 15 nt, Homo sapiens
caucacaugaccaca

SEQ ID NO: 1027585 - RNA, 17 nt, Homo sapiens
caucacaugcucaauga

SEQ ID NO: 1027586 - RNA, 15 nt, Homo sapiens
caucaccacagggau

SEQ ID NO: 1027587 - RNA, 23 nt, Homo sapiens
caucacgcggccgagacauggcu

SEQ ID NO: 1027588 - RNA, 17 nt, Homo sapiens
caucacucaucugccaa

SEQ ID NO: 1027589 - RNA, 23 nt, Homo sapiens
caucacugaaaugcuagcugcaa

SEQ ID NO: 1027590 - RNA, 18 nt, Homo sapiens
caucagacuccugugcaa

SEQ ID NO: 1027591 - RNA, 19 nt, Homo sapiens
caucagcagagaacuggaa

SEQ ID NO: 1027592 - RNA, 14 nt, Homo sapiens
caucagcuccagcu

SEQ ID NO: 1027593 - RNA, 16 nt, Homo sapiens
caucaggccuguuuua

SEQ ID NO: 1027594 - RNA, 18 nt, Homo sapiens
caucaggccuguuuuaga

SEQ ID NO: 1027595 - RNA, 18 nt, Homo sapiens
caucaguauugaagcauu

SEQ ID NO: 1027596 - RNA, 16 nt, Homo sapiens
caucagucaaugaaua

SEQ ID NO: 1027597 - RNA, 18 nt, Homo sapiens
caucaguuuaaacaaagg

SEQ ID NO: 1027598 - RNA, 17 nt, Homo sapiens
caucauaauucagcucu

SEQ ID NO: 1027599 - RNA, 13 nt, Homo sapiens
caucauaguacag

SEQ ID NO: 1027600 - RNA, 20 nt, Homo sapiens
caucauccuaagcuauucag

SEQ ID NO: 1027601 - RNA, 13 nt, Homo sapiens
caucaucuauggc

SEQ ID NO: 1027602 - RNA, 13 nt, Homo sapiens
caucauuccuuga

SEQ ID NO: 1027603 - RNA, 16 nt, Homo sapiens
cauccacugugccaug

SEQ ID NO: 1027604 - RNA, 16 nt, Homo sapiens
cauccccacucacgaa

SEQ ID NO: 1027605 - RNA, 18 nt, Homo sapiens
cauccccauccuccagcu

SEQ ID NO: 1027606 - RNA, 15 nt, Homo sapiens
caucccuaaugcugc

SEQ ID NO: 1027607 - RNA, 18 nt, Homo sapiens
caucccugaugucugucu

SEQ ID NO: 1027608 - RNA, 18 nt, Homo sapiens
cauccuaaaaaguuccau

SEQ ID NO: 1027609 - RNA, 23 nt, Homo sapiens
cauccuaaaugaguaaacccagc

SEQ ID NO: 1027610 - RNA, 14 nt, Homo sapiens
cauccuaugcaaua

SEQ ID NO: 1027611 - RNA, 15 nt, Homo sapiens
cauccucaaacacug

SEQ ID NO: 1027612 - RNA, 16 nt, Homo sapiens
cauccucaaacacugc

SEQ ID NO: 1027613 - RNA, 19 nt, Homo sapiens
cauccucacaugugacaaa

SEQ ID NO: 1027614 - RNA, 13 nt, Homo sapiens
cauccuccagcuu

SEQ ID NO: 1027615 - RNA, 21 nt, Homo sapiens
cauccuucaaauaaacauguc

SEQ ID NO: 1027616 - RNA, 12 nt, Homo sapiens
cauccuugugaa

SEQ ID NO: 1027617 - RNA, 20 nt, Homo sapiens
caucgcaggaugacagcucc

SEQ ID NO: 1027618 - RNA, 17 nt, Homo sapiens
uucuaaaugaagugcaa

SEQ ID NO: 1027619 - RNA, 22 nt, Homo sapiens
uucuaacgaguggaccauuauc

SEQ ID NO: 1027620 - RNA, 16 nt, Homo sapiens
uucuaacuccagugaa

SEQ ID NO: 1027621 - RNA, 13 nt, Homo sapiens
uucuaaugugcau

SEQ ID NO: 1027622 - RNA, 14 nt, Homo sapiens
uucuaaugugccua

SEQ ID NO: 1027623 - RNA, 17 nt, Homo sapiens
uucuaauuuuuaagcaa

SEQ ID NO: 1027624 - RNA, 16 nt, Homo sapiens
uucuacacauacaugu

SEQ ID NO: 1027625 - RNA, 14 nt, Homo sapiens
uucuacaggccagc

SEQ ID NO: 1027626 - RNA, 19 nt, Homo sapiens
uucuacauacuauggaauu

SEQ ID NO: 1027627 - RNA, 22 nt, Homo sapiens
uucuaccugccacucacacagc

SEQ ID NO: 1027628 - RNA, 12 nt, Homo sapiens
uucuacuuuaag

SEQ ID NO: 1027629 - RNA, 17 nt, Homo sapiens
uucuagguaggggccca

SEQ ID NO: 1027630 - RNA, 14 nt, Homo sapiens
uucuagucacuucc

SEQ ID NO: 1027631 - RNA, 20 nt, Homo sapiens
uucuagucucucuggggcca

SEQ ID NO: 1027632 - RNA, 24 nt, Homo sapiens
uucuaguuuugucaaacuguagaa

SEQ ID NO: 1027633 - RNA, 19 nt, Homo sapiens
uucuaucugggcuguugcu

SEQ ID NO: 1027634 - RNA, 17 nt, Homo sapiens
uucuauuacgugcaaua

SEQ ID NO: 1027635 - RNA, 21 nt, Homo sapiens
uucuauugaaaaaucaccaca

SEQ ID NO: 1027636 - RNA, 15 nt, Homo sapiens
uucuauugacuucaa

SEQ ID NO: 1027637 - RNA, 15 nt, Homo sapiens
uucucaaaguuuuga

SEQ ID NO: 1027638 - RNA, 23 nt, Homo sapiens
uucucaaaugcacaucucauggc

SEQ ID NO: 1027639 - RNA, 16 nt, Homo sapiens
uucucaagugccuuaa

SEQ ID NO: 1027640 - RNA, 21 nt, Homo sapiens
uucucagaaucucaaauaacu

SEQ ID NO: 1027641 - RNA, 17 nt, Homo sapiens
uucucagccacaaaaua

SEQ ID NO: 1027642 - RNA, 19 nt, Homo sapiens
uucucagcucccauuucua

SEQ ID NO: 1027643 - RNA, 23 nt, Homo sapiens
uucucaggaagcccccaaguuga

SEQ ID NO: 1027644 - RNA, 19 nt, Homo sapiens
uucucagggcuccugccuu

SEQ ID NO: 1027645 - RNA, 20 nt, Homo sapiens
uucucaguguagggcagaga

SEQ ID NO: 1027646 - RNA, 14 nt, Homo sapiens
uucucaugugaucc

SEQ ID NO: 1027647 - RNA, 15 nt, Homo sapiens
uucuccagacagggu

SEQ ID NO: 1027648 - RNA, 20 nt, Homo sapiens
uucuccaucucucuggcccu

SEQ ID NO: 1027649 - RNA, 22 nt, Homo sapiens
uucucccaccaccucaccaguu

SEQ ID NO: 1027650 - RNA, 14 nt, Homo sapiens
uucuccugccucag

SEQ ID NO: 1027651 - RNA, 16 nt, Homo sapiens
uucucuauugcugcuc

SEQ ID NO: 1027652 - RNA, 22 nt, Homo sapiens
uucucucugacccucuccccac

SEQ ID NO: 1027653 - RNA, 16 nt, Homo sapiens
uucucucuuacauuga

SEQ ID NO: 1027654 - RNA, 14 nt, Homo sapiens
uucucugaaggaca

SEQ ID NO: 1027655 - RNA, 19 nt, Homo sapiens
uucucuggcgacaguuuuc

SEQ ID NO: 1027656 - RNA, 22 nt, Homo sapiens
uucucuucacagucacauucca

SEQ ID NO: 1027657 - RNA, 22 nt, Homo sapiens
uucucuugagaggguggaauau

SEQ ID NO: 1027658 - RNA, 13 nt, Homo sapiens
uucugacaucagc

SEQ ID NO: 1027659 - RNA, 18 nt, Homo sapiens
uucugacaucagcagaga

SEQ ID NO: 1027660 - RNA, 11 nt, Homo sapiens
uucugagauca

SEQ ID NO: 1027661 - RNA, 16 nt, Homo sapiens
uucugaucugaugcaa

SEQ ID NO: 1027662 - RNA, 22 nt, Homo sapiens
uucugcacauaaguuaugguuu

SEQ ID NO: 1027663 - RNA, 12 nt, Homo sapiens
uucugcauuuaa

SEQ ID NO: 1027664 - RNA, 19 nt, Homo sapiens
uucugcauuuaaccgucaa

SEQ ID NO: 1027665 - RNA, 15 nt, Homo sapiens
uucugcuaugugacu

SEQ ID NO: 1027666 - RNA, 16 nt, Homo sapiens
uucuggaaagugcaau

SEQ ID NO: 1027667 - RNA, 14 nt, Homo sapiens
uucuggaauguaau

SEQ ID NO: 1027668 - RNA, 14 nt, Homo sapiens
uucuggggcuucag

SEQ ID NO: 1027669 - RNA, 18 nt, Homo sapiens
uucugguuuguaaggugg

SEQ ID NO: 1027670 - RNA, 14 nt, Homo sapiens
uucuguacaugcau

SEQ ID NO: 1027671 - RNA, 23 nt, Homo sapiens
uucugucagcaguaaaacuuaua

SEQ ID NO: 1027672 - RNA, 16 nt, Homo sapiens
uucugucucauaugau

SEQ ID NO: 1027673 - RNA, 18 nt, Homo sapiens
uucugucuuuauaaucua

SEQ ID NO: 1027674 - RNA, 22 nt, Homo sapiens
uucugugggagaauucuuacau

SEQ ID NO: 1027675 - RNA, 15 nt, Homo sapiens
uucuuaaacucagaa

SEQ ID NO: 1027676 - RNA, 13 nt, Homo sapiens
uucuuaagacaug

SEQ ID NO: 1027677 - RNA, 17 nt, Homo sapiens
uucuuaaucuuuucaca

SEQ ID NO: 1027678 - RNA, 12 nt, Homo sapiens
uucuuacacuga

SEQ ID NO: 1027679 - RNA, 17 nt, Homo sapiens
uucuuacaugcauuuga

SEQ ID NO: 1027680 - RNA, 14 nt, Homo sapiens
uucuuauaauauua

SEQ ID NO: 1027681 - RNA, 13 nt, Homo sapiens
uucuucaaccuca

SEQ ID NO: 1027682 - RNA, 14 nt, Homo sapiens
uucuucauugcagu

SEQ ID NO: 1027683 - RNA, 13 nt, Homo sapiens
uucuuccuucauu

SEQ ID NO: 1027684 - RNA, 13 nt, Homo sapiens
uucuucuauucca

SEQ ID NO: 1027685 - RNA, 17 nt, Homo sapiens
uucuucucuuaauuuca

SEQ ID NO: 1027686 - RNA, 20 nt, Homo sapiens
uucuucugcuaugugacuug

SEQ ID NO: 1027687 - RNA, 21 nt, Homo sapiens
uucuucuuggucucaguguca

SEQ ID NO: 1027688 - RNA, 13 nt, Homo sapiens
uucuucuuuuugc

SEQ ID NO: 1027689 - RNA, 21 nt, Homo sapiens
uucuugaguuuagugaucuga

SEQ ID NO: 1027690 - RNA, 20 nt, Homo sapiens
uuggcaacagaagcaguuga

SEQ ID NO: 1027691 - RNA, 23 nt, Homo sapiens
uuggcaacagaagugguuuccca

SEQ ID NO: 1027692 - RNA, 16 nt, Homo sapiens
uuggcagcucuacucu

SEQ ID NO: 1027693 - RNA, 23 nt, Homo sapiens
uuggcagcucuacucuggagguu

SEQ ID NO: 1027694 - RNA, 17 nt, Homo sapiens
uuggccaacauggugaa

SEQ ID NO: 1027695 - RNA, 23 nt, Homo sapiens
uuggccagaagggggccaugagg

SEQ ID NO: 1027696 - RNA, 16 nt, Homo sapiens
uuggccaucucuggau

SEQ ID NO: 1027697 - RNA, 23 nt, Homo sapiens
uuggcccccgagcugggggccau

SEQ ID NO: 1027698 - RNA, 15 nt, Homo sapiens
uuggccuaacccuca

SEQ ID NO: 1027699 - RNA, 14 nt, Homo sapiens
uuggcucaauccuc

SEQ ID NO: 1027700 - RNA, 11 nt, Homo sapiens
uuggcugugag

SEQ ID NO: 1027701 - RNA, 16 nt, Homo sapiens
uuggcuucuaaucaaa

SEQ ID NO: 1027702 - RNA, 16 nt, Homo sapiens
uuggcuuucauguuau

SEQ ID NO: 1027703 - RNA, 13 nt, Homo sapiens
uugggaagacaug

SEQ ID NO: 1027704 - RNA, 12 nt, Homo sapiens
uugggaagacca

SEQ ID NO: 1027705 - RNA, 16 nt, Homo sapiens
uugggcugcuccucau

SEQ ID NO: 1027706 - RNA, 10 nt, Homo sapiens
uuggggacuc

SEQ ID NO: 1027707 - RNA, 17 nt, Homo sapiens
uuggguggagaagccau

SEQ ID NO: 1027708 - RNA, 14 nt, Homo sapiens
uuggguuuucucca

SEQ ID NO: 1027709 - RNA, 17 nt, Homo sapiens
uugguaaucucugugaa

SEQ ID NO: 1027710 - RNA, 14 nt, Homo sapiens
uugguacuuuuaug

SEQ ID NO: 1027711 - RNA, 16 nt, Homo sapiens
uuggucccgugcagcu

SEQ ID NO: 1027712 - RNA, 14 nt, Homo sapiens
uugguggguuuuga

SEQ ID NO: 1027713 - RNA, 18 nt, Homo sapiens
uuguaaaauggugugacc

SEQ ID NO: 1027714 - RNA, 19 nt, Homo sapiens
uuguaaaauuucacuuaau

SEQ ID NO: 1027715 - RNA, 17 nt, Homo sapiens
uuguaaauagcucaggu

SEQ ID NO: 1027716 - RNA, 15 nt, Homo sapiens
uuguaaaugugacac

SEQ ID NO: 1027717 - RNA, 17 nt, Homo sapiens
uuguaacaauagcacaa

SEQ ID NO: 1027718 - RNA, 17 nt, Homo sapiens
uuguaagaaauacugua

SEQ ID NO: 1027719 - RNA, 22 nt, Homo sapiens
uuguaagaguguagaagcauuc

SEQ ID NO: 1027720 - RNA, 18 nt, Homo sapiens
uuguaagguggucacugu

SEQ ID NO: 1027721 - RNA, 23 nt, Homo sapiens
uuguacccuuccuacagauaguc

SEQ ID NO: 1027722 - RNA, 16 nt, Homo sapiens
uuguaccgcaauguga

SEQ ID NO: 1027723 - RNA, 17 nt, Homo sapiens
uuguaccgcaaugugac

SEQ ID NO: 1027724 - RNA, 19 nt, Homo sapiens
uuguagagauggggucuca

SEQ ID NO: 1027725 - RNA, 21 nt, Homo sapiens
uuguagagccagggucucacu

SEQ ID NO: 1027726 - RNA, 23 nt, Homo sapiens
uuguaguugcaauagaacagaga

SEQ ID NO: 1027727 - RNA, 23 nt, Homo sapiens
uuguauauauauuuuguguauaa

SEQ ID NO: 1027728 - RNA, 18 nt, Homo sapiens
uuguaugauccuaaugaa

SEQ ID NO: 1027729 - RNA, 15 nt, Homo sapiens
uuguauuuauuccau

SEQ ID NO: 1027730 - RNA, 21 nt, Homo sapiens
uugucaaaaggaagucucuag

SEQ ID NO: 1027731 - RNA, 13 nt, Homo sapiens
uugucaaagaagg

SEQ ID NO: 1027732 - RNA, 13 nt, Homo sapiens
uugucaccuguga

SEQ ID NO: 1027733 - RNA, 11 nt, Homo sapiens
uugucaugaau

SEQ ID NO: 1027734 - RNA, 16 nt, Homo sapiens
uugucauguaugugaa

SEQ ID NO: 1027735 - RNA, 19 nt, Homo sapiens
uugucccaaguuccacugc

SEQ ID NO: 1027736 - RNA, 17 nt, Homo sapiens
uugucccacucaagcca

SEQ ID NO: 1027737 - RNA, 14 nt, Homo sapiens
uugucccucugcua

SEQ ID NO: 1027738 - RNA, 23 nt, Homo sapiens
uugucuacuucuggagucuauaa

SEQ ID NO: 1027739 - RNA, 20 nt, Homo sapiens
uugucuuuccuggcacuaac

SEQ ID NO: 1027740 - RNA, 17 nt, Homo sapiens
uugucuuugcuguaaac

SEQ ID NO: 1027741 - RNA, 18 nt, Homo sapiens
uugugaacaagucccugu

SEQ ID NO: 1027742 - RNA, 21 nt, Homo sapiens
uugugaacuuuuuguagggga

SEQ ID NO: 1027743 - RNA, 19 nt, Homo sapiens
uugugaauagaacucugaa

SEQ ID NO: 1027744 - RNA, 20 nt, Homo sapiens
uugugauacaaugcugugcc

SEQ ID NO: 1027745 - RNA, 14 nt, Homo sapiens
uugugauguggcaa

SEQ ID NO: 1027746 - RNA, 16 nt, Homo sapiens
uugugauguguccuga

SEQ ID NO: 1027747 - RNA, 12 nt, Homo sapiens
uugugauugccu

SEQ ID NO: 1027748 - RNA, 20 nt, Homo sapiens
uugugccuggcucagagcca

SEQ ID NO: 1027749 - RNA, 19 nt, Homo sapiens
uugugcucaauacacagaa

SEQ ID NO: 1027750 - RNA, 20 nt, Homo sapiens
uugugcucaauacacagaaa

SEQ ID NO: 1027751 - RNA, 16 nt, Homo sapiens
uugugugugugcaagu

SEQ ID NO: 1027752 - RNA, 16 nt, Homo sapiens
uuguucaguaugcaaa

SEQ ID NO: 1027753 - RNA, 23 nt, Homo sapiens
uuguucaucagacuccugugcaa

SEQ ID NO: 1027754 - RNA, 17 nt, Homo sapiens
uuguucuuggccaaaga

SEQ ID NO: 1027755 - RNA, 13 nt, Homo sapiens
uuguucuugugaa

SEQ ID NO: 1027756 - RNA, 19 nt, Homo sapiens
uuguuguuuauaaagggag

SEQ ID NO: 1027757 - RNA, 13 nt, Homo sapiens
uuguuguuugcca

SEQ ID NO: 1027758 - RNA, 15 nt, Homo sapiens
uuguuuagaaagaau

SEQ ID NO: 1027759 - RNA, 20 nt, Homo sapiens
uuguuuagauaugacauuua

SEQ ID NO: 1027760 - RNA, 14 nt, Homo sapiens
uuguuucugauuaa

SEQ ID NO: 1027761 - RNA, 22 nt, Homo sapiens
uuguuugagaaauuaaguaucu

SEQ ID NO: 1027762 - RNA, 19 nt, Homo sapiens
uuguuugcauaggugaucu

SEQ ID NO: 1027763 - RNA, 21 nt, Homo sapiens
uuguuuuaaaauuaaagcuaa

SEQ ID NO: 1027764 - RNA, 15 nt, Homo sapiens
uuguuuuagcuccuu

SEQ ID NO: 1027765 - RNA, 21 nt, Homo sapiens
uuguuuuaugcucagggucaa

SEQ ID NO: 1027766 - RNA, 15 nt, Homo sapiens
uuguuuuccugugag

SEQ ID NO: 1027767 - RNA, 18 nt, Homo sapiens
uuuaaaaaaacacauaau

SEQ ID NO: 1027768 - RNA, 13 nt, Homo sapiens
uuuaaaaaaugga

SEQ ID NO: 1027769 - RNA, 14 nt, Homo sapiens
uuuaaaacauguaa

SEQ ID NO: 1027770 - RNA, 20 nt, Homo sapiens
uuuaaaacgcaugugcagcu

SEQ ID NO: 1027771 - RNA, 14 nt, Homo sapiens
uuuaaaagauaaaa

SEQ ID NO: 1027772 - RNA, 15 nt, Homo sapiens
uuuaaacucagggac

SEQ ID NO: 1027773 - RNA, 21 nt, Homo sapiens
uuuaaaguauguuauugcaua

SEQ ID NO: 1027774 - RNA, 18 nt, Homo sapiens
uuuaaaguggguuauucu

SEQ ID NO: 1027775 - RNA, 14 nt, Homo sapiens
uuuaaauagaccuc

SEQ ID NO: 1027776 - RNA, 14 nt, Homo sapiens
cauugcacuuugau

SEQ ID NO: 1027777 - RNA, 17 nt, Homo sapiens
cauugcuugugccacac

SEQ ID NO: 1027778 - RNA, 22 nt, Homo sapiens
cauuggagagaaaaaacuuaag

SEQ ID NO: 1027779 - RNA, 23 nt, Homo sapiens
cauuggguccugggucuuucaug

SEQ ID NO: 1027780 - RNA, 19 nt, Homo sapiens
cauuggguuguagccaaag

SEQ ID NO: 1027781 - RNA, 19 nt, Homo sapiens
cauugguguugacauacau

SEQ ID NO: 1027782 - RNA, 17 nt, Homo sapiens
cauuguggcuccuaucu

SEQ ID NO: 1027783 - RNA, 22 nt, Homo sapiens
cauuguguucucuauugcugcu

SEQ ID NO: 1027784 - RNA, 19 nt, Homo sapiens
cauuguuccugcgcugcaa

SEQ ID NO: 1027785 - RNA, 20 nt, Homo sapiens
cauuguucuugugaacccaa

SEQ ID NO: 1027786 - RNA, 21 nt, Homo sapiens
cauuguucuugugaacccaaa

SEQ ID NO: 1027787 - RNA, 16 nt, Homo sapiens
cauuguuuggagacau

SEQ ID NO: 1027788 - RNA, 14 nt, Homo sapiens
cauuguuuuaagga

SEQ ID NO: 1027789 - RNA, 16 nt, Homo sapiens
cauuuaauccucucaa

SEQ ID NO: 1027790 - RNA, 23 nt, Homo sapiens
cauuuacuuaacagaacagucac

SEQ ID NO: 1027791 - RNA, 12 nt, Homo sapiens
cauuuagcacau

SEQ ID NO: 1027792 - RNA, 20 nt, Homo sapiens
cauuuauucaaaguuaaaag

SEQ ID NO: 1027793 - RNA, 16 nt, Homo sapiens
cauuuauuuuucucau

SEQ ID NO: 1027794 - RNA, 14 nt, Homo sapiens
cauuucacuuuaca

SEQ ID NO: 1027795 - RNA, 16 nt, Homo sapiens
cauuuccaaauucaca

SEQ ID NO: 1027796 - RNA, 12 nt, Homo sapiens
cauuuccaugca

SEQ ID NO: 1027797 - RNA, 16 nt, Homo sapiens
cauuucccugugcuga

SEQ ID NO: 1027798 - RNA, 19 nt, Homo sapiens
cauuucuacucucccaugg

SEQ ID NO: 1027799 - RNA, 18 nt, Homo sapiens
cauuucuacugugacuga

SEQ ID NO: 1027800 - RNA, 14 nt, Homo sapiens
cauuucuaucacau

SEQ ID NO: 1027801 - RNA, 19 nt, Homo sapiens
cauuucucaaaugcacauc

SEQ ID NO: 1027802 - RNA, 23 nt, Homo sapiens
cauuucucaaaugcacaucucau

SEQ ID NO: 1027803 - RNA, 22 nt, Homo sapiens
cauuugaguuuauaucucucau

SEQ ID NO: 1027804 - RNA, 16 nt, Homo sapiens
cauuugcaccuaccuc

SEQ ID NO: 1027805 - RNA, 14 nt, Homo sapiens
cauuugcagagucc

SEQ ID NO: 1027806 - RNA, 14 nt, Homo sapiens
cauuugcucuuuca

SEQ ID NO: 1027807 - RNA, 19 nt, Homo sapiens
cauuugcucuuucaucucu

SEQ ID NO: 1027808 - RNA, 16 nt, Homo sapiens
cauuuggcaaugccau

SEQ ID NO: 1027809 - RNA, 22 nt, Homo sapiens
cauuugucaacaaagucaccca

SEQ ID NO: 1027810 - RNA, 17 nt, Homo sapiens
cauuugugugugugcaa

SEQ ID NO: 1027811 - RNA, 18 nt, Homo sapiens
cauuugugugugugcaag

SEQ ID NO: 1027812 - RNA, 19 nt, Homo sapiens
cauuugugugugugcaagu

SEQ ID NO: 1027813 - RNA, 15 nt, Homo sapiens
cauuuuaagugcaug

SEQ ID NO: 1027814 - RNA, 17 nt, Homo sapiens
cauuuuaaugcaccuga

SEQ ID NO: 1027815 - RNA, 17 nt, Homo sapiens
cauuuuauguuaaggga

SEQ ID NO: 1027816 - RNA, 16 nt, Homo sapiens
cauuuucugcauuuaa

SEQ ID NO: 1027817 - RNA, 13 nt, Homo sapiens
cauuuugcaaaau

SEQ ID NO: 1027818 - RNA, 17 nt, Homo sapiens
cauuuuuuucacuggag

SEQ ID NO: 1027819 - RNA, 22 nt, Homo sapiens
cauuuuuuucacuggaguuaca

SEQ ID NO: 1027820 - RNA, 23 nt, Homo sapiens
cauuuuuuucacuggaguuacau

SEQ ID NO: 1027821 - RNA, 13 nt, Homo sapiens
ccaaaaacuaaau

SEQ ID NO: 1027822 - RNA, 12 nt, Homo sapiens
ccaaaagcacuu

SEQ ID NO: 1027823 - RNA, 22 nt, Homo sapiens
ccaaaagcccauucauuccauu

SEQ ID NO: 1027824 - RNA, 21 nt, Homo sapiens
ccaaaagguauuuuaaucacc

SEQ ID NO: 1027825 - RNA, 18 nt, Homo sapiens
ccaaaaucggaucugggg

SEQ ID NO: 1027826 - RNA, 20 nt, Homo sapiens
ccaaaauuaccaaaaaucuu

SEQ ID NO: 1027827 - RNA, 17 nt, Homo sapiens
ccaaacagaacuaugga

SEQ ID NO: 1027828 - RNA, 13 nt, Homo sapiens
ccaaacaugcacu

SEQ ID NO: 1027829 - RNA, 17 nt, Homo sapiens
ccaaacccuugucagug

SEQ ID NO: 1027830 - RNA, 21 nt, Homo sapiens
ccaaagaagcugcuguucuua

SEQ ID NO: 1027831 - RNA, 19 nt, Homo sapiens
ccaaagacgaccagcauuu

SEQ ID NO: 1027832 - RNA, 16 nt, Homo sapiens
ccaaagagacuggagc

SEQ ID NO: 1027833 - RNA, 19 nt, Homo sapiens
ccaaagcccaaagugguau

SEQ ID NO: 1027834 - RNA, 12 nt, Homo sapiens
uuuucauuugag

SEQ ID NO: 1027835 - RNA, 16 nt, Homo sapiens
uuuuccacugccuggg

SEQ ID NO: 1027836 - RNA, 23 nt, Homo sapiens
uuuuccauuguuugaaacaaaga

SEQ ID NO: 1027837 - RNA, 22 nt, Homo sapiens
uuuuccgggaacaaaaugaugu

SEQ ID NO: 1027838 - RNA, 15 nt, Homo sapiens
uuuuccuccaggcaa

SEQ ID NO: 1027839 - RNA, 15 nt, Homo sapiens
uuuuccuguucuuaa

SEQ ID NO: 1027840 - RNA, 13 nt, Homo sapiens
uuuucgaacauuc

SEQ ID NO: 1027841 - RNA, 16 nt, Homo sapiens
uuuucgcugaugcugu

SEQ ID NO: 1027842 - RNA, 20 nt, Homo sapiens
uuuucuaaaaaaagaaaaaa

SEQ ID NO: 1027843 - RNA, 21 nt, Homo sapiens
uuuucuaagaaagaaauugua

SEQ ID NO: 1027844 - RNA, 14 nt, Homo sapiens
uuuucucaugauga

SEQ ID NO: 1027845 - RNA, 20 nt, Homo sapiens
uuuucuccacuuuguuggaa

SEQ ID NO: 1027846 - RNA, 15 nt, Homo sapiens
uuuucucugugcuuc

SEQ ID NO: 1027847 - RNA, 14 nt, Homo sapiens
uuuucucuucaaua

SEQ ID NO: 1027848 - RNA, 17 nt, Homo sapiens
uuuucuggugaugccca

SEQ ID NO: 1027849 - RNA, 14 nt, Homo sapiens
uuuucugugccuga

SEQ ID NO: 1027850 - RNA, 22 nt, Homo sapiens
uuuucuuacuagaccuguaacu

SEQ ID NO: 1027851 - RNA, 18 nt, Homo sapiens
uuuucuuauuuaacuuaa

SEQ ID NO: 1027852 - RNA, 19 nt, Homo sapiens
uuuucuuauuuaacuuaac

SEQ ID NO: 1027853 - RNA, 15 nt, Homo sapiens
uuuugaaaccaugaa

SEQ ID NO: 1027854 - RNA, 22 nt, Homo sapiens
uuuugaauuuauauuguuucau

SEQ ID NO: 1027855 - RNA, 23 nt, Homo sapiens
uuuugcaaauaaaauacuaaaca

SEQ ID NO: 1027856 - RNA, 18 nt, Homo sapiens
uuuugcacaguuagcaaa

SEQ ID NO: 1027857 - RNA, 13 nt, Homo sapiens
uuuugcuauugua

SEQ ID NO: 1027858 - RNA, 16 nt, Homo sapiens
uuuuggaauuaugucu

SEQ ID NO: 1027859 - RNA, 22 nt, Homo sapiens
uuuugguuugcagaugacaaaa

SEQ ID NO: 1027860 - RNA, 21 nt, Homo sapiens
uuuuuaaacaaaaaaagcauu

SEQ ID NO: 1027861 - RNA, 13 nt, Homo sapiens
uuuuuaauuguga

SEQ ID NO: 1027862 - RNA, 20 nt, Homo sapiens
uuuuuacuaaucuuucugca

SEQ ID NO: 1027863 - RNA, 17 nt, Homo sapiens
uuuuuacuccaguggug

SEQ ID NO: 1027864 - RNA, 18 nt, Homo sapiens
uuuuuagcucaucggcua

SEQ ID NO: 1027865 - RNA, 23 nt, Homo sapiens
uuuuucagaaagcauuacauuuc

SEQ ID NO: 1027866 - RNA, 15 nt, Homo sapiens
uuuuuccccaaaguc

SEQ ID NO: 1027867 - RNA, 21 nt, Homo sapiens
uuuuugaaaucagcauacuca

SEQ ID NO: 1027868 - RNA, 17 nt, Homo sapiens
uuuuugagguggcacuu

SEQ ID NO: 1027869 - RNA, 12 nt, Homo sapiens
uuuuugaugcuu

SEQ ID NO: 1027870 - RNA, 16 nt, Homo sapiens
uuuuugucaagacaag

SEQ ID NO: 1027871 - RNA, 18 nt, Homo sapiens
uuuuuguucaaagccagc

SEQ ID NO: 1027872 - RNA, 13 nt, Homo sapiens
uuuuuuauuggaa

SEQ ID NO: 1027873 - RNA, 13 nt, Homo sapiens
uuuuuuucaccuc

SEQ ID NO: 1027874 - RNA, 12 nt, Homo sapiens
ccaucaccagac

SEQ ID NO: 1027875 - RNA, 23 nt, Homo sapiens
ccaucagcuuaggggcugcugac

SEQ ID NO: 1027876 - RNA, 23 nt, Homo sapiens
ccaucagugcucccucacauguc

SEQ ID NO: 1027877 - RNA, 17 nt, Homo sapiens
ccaucauacacuuccuu

SEQ ID NO: 1027878 - RNA, 12 nt, Homo sapiens
ccauccaaauaa

SEQ ID NO: 1027879 - RNA, 22 nt, Homo sapiens
ccauccagccgcugcacaucac

SEQ ID NO: 1027880 - RNA, 14 nt, Homo sapiens
ccauccucaaacac

SEQ ID NO: 1027881 - RNA, 16 nt, Homo sapiens
ccauccuugagucaaa

SEQ ID NO: 1027882 - RNA, 12 nt, Homo sapiens
ccauccuuguga

SEQ ID NO: 1027883 - RNA, 17 nt, Homo sapiens
ccaucuccuuucaggga

SEQ ID NO: 1027884 - RNA, 14 nt, Homo sapiens
ccaucuuuccaucc

SEQ ID NO: 1027885 - RNA, 21 nt, Homo sapiens
ccaugauguaaguuuaccuau

SEQ ID NO: 1027886 - RNA, 14 nt, Homo sapiens
ccaugcagacauga

SEQ ID NO: 1027887 - RNA, 16 nt, Homo sapiens
ccaugcuagacaagcu

SEQ ID NO: 1027888 - RNA, 14 nt, Homo sapiens
ccauggaaugcuug

SEQ ID NO: 1027889 - RNA, 17 nt, Homo sapiens
ccauggcuuaaugcuuc

SEQ ID NO: 1027890 - RNA, 23 nt, Homo sapiens
ccaugggguaggaggaugggcuc

SEQ ID NO: 1027891 - RNA, 13 nt, Homo sapiens
ccaugguuuuacu

SEQ ID NO: 1027892 - RNA, 17 nt, Homo sapiens
ccauguauuuaucucua

SEQ ID NO: 1027893 - RNA, 22 nt, Homo sapiens
ccaugugugagugugugcaagu

SEQ ID NO: 1027894 - RNA, 14 nt, Homo sapiens
ccaugugugugcaa

SEQ ID NO: 1027895 - RNA, 20 nt, Homo sapiens
ccaugugugugcaagugugu

SEQ ID NO: 1027896 - RNA, 21 nt, Homo sapiens
ccauuagcauuugucaacaaa

SEQ ID NO: 1027897 - RNA, 20 nt, Homo sapiens
ccauucaggucuuucuuucc

SEQ ID NO: 1027898 - RNA, 21 nt, Homo sapiens
ccauucaggucuuucuuuccg

SEQ ID NO: 1027899 - RNA, 13 nt, Homo sapiens
ccauucauuccau

SEQ ID NO: 1027900 - RNA, 12 nt, Homo sapiens
ccauuguuccug

SEQ ID NO: 1027901 - RNA, 20 nt, Homo sapiens
ccauuguuugaaacaaagaa

SEQ ID NO: 1027902 - RNA, 23 nt, Homo sapiens
ccauuuccaaaccuccacugcug

SEQ ID NO: 1027903 - RNA, 17 nt, Homo sapiens
ccauuucugagaucaaa

SEQ ID NO: 1027904 - RNA, 19 nt, Homo sapiens
ccauuugcagaguccugca

SEQ ID NO: 1027905 - RNA, 18 nt, Homo sapiens
ccauuugugugugugcaa

SEQ ID NO: 1027906 - RNA, 16 nt, Homo sapiens
ccauuuuugaaaccaa

SEQ ID NO: 1027907 - RNA, 17 nt, Homo sapiens
ccauuuuugaaaccaaa

SEQ ID NO: 1027908 - RNA, 23 nt, Homo sapiens
cccaaaacgucuuauugugguag

SEQ ID NO: 1027909 - RNA, 17 nt, Homo sapiens
cccaaaagcccauucau

SEQ ID NO: 1027910 - RNA, 21 nt, Homo sapiens
cccaaacuugcuuuaugccuu

SEQ ID NO: 1027911 - RNA, 17 nt, Homo sapiens
cccaaagugugacucau

SEQ ID NO: 1027912 - RNA, 20 nt, Homo sapiens
cccaaauuaagaaucuagga

SEQ ID NO: 1027913 - RNA, 20 nt, Homo sapiens
cccaaauuucauaccuauca

SEQ ID NO: 1027914 - RNA, 22 nt, Homo sapiens
cccaacagcacccucuccagau

SEQ ID NO: 1027915 - RNA, 21 nt, Homo sapiens
cccaacaggaggacaauucau

SEQ ID NO: 1027916 - RNA, 23 nt, Homo sapiens
cccaagagcauaacuguucucau

SEQ ID NO: 1027917 - RNA, 19 nt, Homo sapiens
cuacucucccauggcuuaa

SEQ ID NO: 1027918 - RNA, 23 nt, Homo sapiens
cuacucuguuccuucacauccug

SEQ ID NO: 1027919 - RNA, 16 nt, Homo sapiens
cuacucuuaaguuucu

SEQ ID NO: 1027920 - RNA, 15 nt, Homo sapiens
cuacugucucacuga

SEQ ID NO: 1027921 - RNA, 13 nt, Homo sapiens
cuacuguguuccu

SEQ ID NO: 1027922 - RNA, 19 nt, Homo sapiens
cuacuuccugugacuucag

SEQ ID NO: 1027923 - RNA, 23 nt, Homo sapiens
cuacuucugaaacugcagcagug

SEQ ID NO: 1027924 - RNA, 18 nt, Homo sapiens
cuacuucugcccuugcca

SEQ ID NO: 1027925 - RNA, 12 nt, Homo sapiens
cuacuugaggcu

SEQ ID NO: 1027926 - RNA, 17 nt, Homo sapiens
cuacuugaggcugcaau

SEQ ID NO: 1027927 - RNA, 19 nt, Homo sapiens
cuacuugggaggcugaggc

SEQ ID NO: 1027928 - RNA, 15 nt, Homo sapiens
cuacuuuaagcacua

SEQ ID NO: 1027929 - RNA, 15 nt, Homo sapiens
cuagaaaucugccaa

SEQ ID NO: 1027930 - RNA, 19 nt, Homo sapiens
cuagaaccuagaagggcua

SEQ ID NO: 1027931 - RNA, 19 nt, Homo sapiens
cuagaaccuggaagggcua

SEQ ID NO: 1027932 - RNA, 18 nt, Homo sapiens
cuagaaccuggagagcua

SEQ ID NO: 1027933 - RNA, 18 nt, Homo sapiens
cuagaaccuggagggcua

SEQ ID NO: 1027934 - RNA, 19 nt, Homo sapiens
cuagaaccuggagggcuag

SEQ ID NO: 1027935 - RNA, 13 nt, Homo sapiens
cuagaagacuguc

SEQ ID NO: 1027936 - RNA, 17 nt, Homo sapiens
cuagacaaaaaccauug

SEQ ID NO: 1027937 - RNA, 14 nt, Homo sapiens
cuagagaugacuga

SEQ ID NO: 1027938 - RNA, 17 nt, Homo sapiens
cuagaguccucacuccc

SEQ ID NO: 1027939 - RNA, 22 nt, Homo sapiens
cuagaguucuccagacaggguu

SEQ ID NO: 1027940 - RNA, 15 nt, Homo sapiens
cuagauccacacaca

SEQ ID NO: 1027941 - RNA, 20 nt, Homo sapiens
cuagaugugcaaaugcaagc

SEQ ID NO: 1027942 - RNA, 15 nt, Homo sapiens
cuagauuuaugaaua

SEQ ID NO: 1027943 - RNA, 16 nt, Homo sapiens
cuagauuuaugaauac

SEQ ID NO: 1027944 - RNA, 20 nt, Homo sapiens
cuagcaaauguuaugcauaa

SEQ ID NO: 1027945 - RNA, 20 nt, Homo sapiens
cuagcacuuugggaggccaa

SEQ ID NO: 1027946 - RNA, 14 nt, Homo sapiens
cuagccgaccucag

SEQ ID NO: 1027947 - RNA, 14 nt, Homo sapiens
cuagcugcaaguga

SEQ ID NO: 1027948 - RNA, 14 nt, Homo sapiens
cuagcugugggggu

SEQ ID NO: 1027949 - RNA, 17 nt, Homo sapiens
cuaggauugugccugua

SEQ ID NO: 1027950 - RNA, 16 nt, Homo sapiens
cuaggcagugacagug

SEQ ID NO: 1027951 - RNA, 15 nt, Homo sapiens
cuagggagggacaug

SEQ ID NO: 1027952 - RNA, 21 nt, Homo sapiens
cuagggcccaggaucaaguca

SEQ ID NO: 1027953 - RNA, 17 nt, Homo sapiens
cuagggcucuuguguuu

SEQ ID NO: 1027954 - RNA, 19 nt, Homo sapiens
cuaggguccaccaggaguu

SEQ ID NO: 1027955 - RNA, 15 nt, Homo sapiens
cuagguaggggccca

SEQ ID NO: 1027956 - RNA, 13 nt, Homo sapiens
cuaggugcccuug

SEQ ID NO: 1027957 - RNA, 23 nt, Homo sapiens
cuagguucuaaaaauugugauca

SEQ ID NO: 1027958 - RNA, 19 nt, Homo sapiens
cuagguuuaacucagauca

SEQ ID NO: 1027959 - RNA, 21 nt, Homo sapiens
cuagucguggagaugucuucg

SEQ ID NO: 1027960 - RNA, 13 nt, Homo sapiens
cuagucuacuuga

SEQ ID NO: 1027961 - RNA, 16 nt, Homo sapiens
cuagucuugaucuguu

SEQ ID NO: 1027962 - RNA, 16 nt, Homo sapiens
cuagugucuuuugccu

SEQ ID NO: 1027963 - RNA, 23 nt, Homo sapiens
cuaguuaaucauagguuugauau

SEQ ID NO: 1027964 - RNA, 12 nt, Homo sapiens
cuaguuacacau

SEQ ID NO: 1027965 - RNA, 15 nt, Homo sapiens
cuaguuugaccucau

SEQ ID NO: 1027966 - RNA, 21 nt, Homo sapiens
cuaguuuuugacuugcuccua

SEQ ID NO: 1027967 - RNA, 16 nt, Homo sapiens
cuauaaaaaaaugcau

SEQ ID NO: 1027968 - RNA, 22 nt, Homo sapiens
cuauaaagaagaacuugcaugg

SEQ ID NO: 1027969 - RNA, 20 nt, Homo sapiens
cuauaaagguugacaauaaa

SEQ ID NO: 1027970 - RNA, 19 nt, Homo sapiens
cuauaacuaugaccaugcu

SEQ ID NO: 1027971 - RNA, 20 nt, Homo sapiens
cuauaacuauguugauaaaa

SEQ ID NO: 1027972 - RNA, 17 nt, Homo sapiens
cuauaagcccacuguua

SEQ ID NO: 1027973 - RNA, 23 nt, Homo sapiens
cuauagccuaggugacagaguga

SEQ ID NO: 1027974 - RNA, 17 nt, Homo sapiens
cuauauacuauaugauu

SEQ ID NO: 1027975 - RNA, 12 nt, Homo sapiens
cuauaucuguau

SEQ ID NO: 1027976 - RNA, 22 nt, Homo sapiens
cuauaugccgcuacaaaaaggu

SEQ ID NO: 1027977 - RNA, 17 nt, Homo sapiens
cuauauucucaguguag

SEQ ID NO: 1027978 - RNA, 20 nt, Homo sapiens
cuauauucucaguguagggc

SEQ ID NO: 1027979 - RNA, 16 nt, Homo sapiens
cuauauuuacagugaa

SEQ ID NO: 1027980 - RNA, 20 nt, Homo sapiens
cuaucaaguauuauaccuuu

SEQ ID NO: 1027981 - RNA, 23 nt, Homo sapiens
cuaucagcauuuuacuacuuuaa

SEQ ID NO: 1027982 - RNA, 13 nt, Homo sapiens
cuauccacagaga

SEQ ID NO: 1027983 - RNA, 22 nt, Homo sapiens
cuaucccccgcagcgcucuccu

SEQ ID NO: 1027984 - RNA, 21 nt, Homo sapiens
cuauccugugcuugaugcuag

SEQ ID NO: 1027985 - RNA, 15 nt, Homo sapiens
cuaucgcaccacugu

SEQ ID NO: 1027986 - RNA, 15 nt, Homo sapiens
cuaucuuuuugcuua

SEQ ID NO: 1027987 - RNA, 13 nt, Homo sapiens
cuaugaaauauca

SEQ ID NO: 1027988 - RNA, 16 nt, Homo sapiens
cuaugagcacauagga

SEQ ID NO: 1027989 - RNA, 18 nt, Homo sapiens
cuaugaggggguuuggca

SEQ ID NO: 1027990 - RNA, 19 nt, Homo sapiens
cuaugaggggguuuggcac

SEQ ID NO: 1027991 - RNA, 14 nt, Homo sapiens
cuaugaucucaggu

SEQ ID NO: 1027992 - RNA, 13 nt, Homo sapiens
cuauguacuuuaa

SEQ ID NO: 1027993 - RNA, 20 nt, Homo sapiens
cuaugucacccaaugcauau

SEQ ID NO: 1027994 - RNA, 21 nt, Homo sapiens
cuaugugcaugcagcaucuaa

SEQ ID NO: 1027995 - RNA, 21 nt, Homo sapiens
cuaugugggugggaccacaga

SEQ ID NO: 1027996 - RNA, 12 nt, Homo sapiens
cuauguguacag

SEQ ID NO: 1027997 - RNA, 14 nt, Homo sapiens
cuauguugcccagg

SEQ ID NO: 1027998 - RNA, 14 nt, Homo sapiens
cuauguuuauuuac

SEQ ID NO: 1027999 - RNA, 19 nt, Homo sapiens
cuauuaaaucuugcaacug

SEQ ID NO: 1028000 - RNA, 13 nt, Homo sapiens
cuauuagacugua

SEQ ID NO: 1028001 - RNA, 16 nt, Homo sapiens
cuauuauuaacacuga

SEQ ID NO: 1028002 - RNA, 16 nt, Homo sapiens
cuauucagacaagcaa

SEQ ID NO: 1028003 - RNA, 15 nt, Homo sapiens
cuauucaguuuucag

SEQ ID NO: 1028004 - RNA, 22 nt, Homo sapiens
cuauuccauggcuaacuggcga

SEQ ID NO: 1028005 - RNA, 15 nt, Homo sapiens
cuauucugauuacac

SEQ ID NO: 1028006 - RNA, 16 nt, Homo sapiens
cuauucugauuacaca

SEQ ID NO: 1028007 - RNA, 19 nt, Homo sapiens
cuauugaaaaaucaccaca

SEQ ID NO: 1028008 - RNA, 16 nt, Homo sapiens
cuauugacuucaauga

SEQ ID NO: 1028009 - RNA, 17 nt, Homo sapiens
cuauugccugagagcac

SEQ ID NO: 1028010 - RNA, 17 nt, Homo sapiens
cuauugcuggcaaagac

SEQ ID NO: 1028011 - RNA, 21 nt, Homo sapiens
cuauuuagaaauggauuuauc

SEQ ID NO: 1028012 - RNA, 14 nt, Homo sapiens
cuauuuaucuguag

SEQ ID NO: 1028013 - RNA, 21 nt, Homo sapiens
cuauuuggggcuugcaugcca

SEQ ID NO: 1028014 - RNA, 23 nt, Homo sapiens
cuauuuggggcuugcaugccaaa

SEQ ID NO: 1028015 - RNA, 14 nt, Homo sapiens
cuauuuguuuucau

SEQ ID NO: 1028016 - RNA, 15 nt, Homo sapiens
cuauuuuuguagaag

SEQ ID NO: 1028017 - RNA, 24 nt, Homo sapiens
cucaaaaaaaaaaaaaugcacaua

SEQ ID NO: 1028018 - RNA, 16 nt, Homo sapiens
cucaaaacugcacugu

SEQ ID NO: 1028019 - RNA, 18 nt, Homo sapiens
cucaaaauaccaugccau

SEQ ID NO: 1028020 - RNA, 22 nt, Homo sapiens
cucaaaauaccaugccauuuaa

SEQ ID NO: 1028021 - RNA, 12 nt, Homo sapiens
cucaaagcacac

SEQ ID NO: 1028022 - RNA, 14 nt, Homo sapiens
cucaaaucuauuca

SEQ ID NO: 1028023 - RNA, 16 nt, Homo sapiens
cucaaaugacccaaag

SEQ ID NO: 1028024 - RNA, 21 nt, Homo sapiens
cucaaaugcacaucucauggc

SEQ ID NO: 1028025 - RNA, 20 nt, Homo sapiens
cucaacaaagcacaguguua

SEQ ID NO: 1028026 - RNA, 21 nt, Homo sapiens
cucaacaugagucaagagcau

SEQ ID NO: 1028027 - RNA, 16 nt, Homo sapiens
cucaaccaccuuucag

SEQ ID NO: 1028028 - RNA, 14 nt, Homo sapiens
cucaaccuauggua

SEQ ID NO: 1028029 - RNA, 13 nt, Homo sapiens
cucaacuagggag

SEQ ID NO: 1028030 - RNA, 16 nt, Homo sapiens
cucaagaugaaggcaa

SEQ ID NO: 1028031 - RNA, 21 nt, Homo sapiens
cucaagccaagcagccaagcu

SEQ ID NO: 1028032 - RNA, 23 nt, Homo sapiens
cucaagcccgcggggacauuggg

SEQ ID NO: 1028033 - RNA, 16 nt, Homo sapiens
cucaagcccugcaguc

SEQ ID NO: 1028034 - RNA, 22 nt, Homo sapiens
cucaagugauccuccugacuca

SEQ ID NO: 1028035 - RNA, 23 nt, Homo sapiens
cucaaguuuuucagaaagcauua

SEQ ID NO: 1028036 - RNA, 19 nt, Homo sapiens
cucaaguuuuuguuuugua

SEQ ID NO: 1028037 - RNA, 15 nt, Homo sapiens
cucaauauuccugaa

SEQ ID NO: 1028038 - RNA, 12 nt, Homo sapiens
cucaaucucuga

SEQ ID NO: 1028039 - RNA, 15 nt, Homo sapiens
cucaaugcacugaca

SEQ ID NO: 1028040 - RNA, 16 nt, Homo sapiens
cucacagaacuaugua

SEQ ID NO: 1028041 - RNA, 12 nt, Homo sapiens
cucacagaccug

SEQ ID NO: 1028042 - RNA, 21 nt, Homo sapiens
cucacagagugcauugugagg

SEQ ID NO: 1028043 - RNA, 22 nt, Homo sapiens
cucacagcccugcuuaccagau

SEQ ID NO: 1028044 - RNA, 15 nt, Homo sapiens
cucacauaucuguca

SEQ ID NO: 1028045 - RNA, 15 nt, Homo sapiens
cucacaugugacaaa

SEQ ID NO: 1028046 - RNA, 19 nt, Homo sapiens
cucacauuuauucugcuca

SEQ ID NO: 1028047 - RNA, 13 nt, Homo sapiens
cucaccacaugcg

SEQ ID NO: 1028048 - RNA, 14 nt, Homo sapiens
cucacuauggugcc

SEQ ID NO: 1028049 - RNA, 21 nt, Homo sapiens
gcuccaucgcugucaucucag

SEQ ID NO: 1028050 - RNA, 17 nt, Homo sapiens
gcucccacuucuuggga

SEQ ID NO: 1028051 - RNA, 16 nt, Homo sapiens
gcucccagcuccagcu

SEQ ID NO: 1028052 - RNA, 18 nt, Homo sapiens
gcucccauguaccagcag

SEQ ID NO: 1028053 - RNA, 19 nt, Homo sapiens
gcucccucugcugaucuca

SEQ ID NO: 1028054 - RNA, 18 nt, Homo sapiens
gcucccugcgccugacau

SEQ ID NO: 1028055 - RNA, 19 nt, Homo sapiens
gcucccugguucugaugau

SEQ ID NO: 1028056 - RNA, 14 nt, Homo sapiens
gcuccuaagccaug

SEQ ID NO: 1028057 - RNA, 22 nt, Homo sapiens
gcuccucggacucugcuuuaug

SEQ ID NO: 1028058 - RNA, 15 nt, Homo sapiens
gcuccugaggggcau

SEQ ID NO: 1028059 - RNA, 15 nt, Homo sapiens
gcuccuggggcaaug

SEQ ID NO: 1028060 - RNA, 21 nt, Homo sapiens
gcuccuuucuccagccagcaa

SEQ ID NO: 1028061 - RNA, 19 nt, Homo sapiens
gcucgcauuugucaaugac

SEQ ID NO: 1028062 - RNA, 21 nt, Homo sapiens
gcucuaaaaaguuuugcccuu

SEQ ID NO: 1028063 - RNA, 14 nt, Homo sapiens
gcucucaacccagg

SEQ ID NO: 1028064 - RNA, 19 nt, Homo sapiens
gcucugccacccuaccugu

SEQ ID NO: 1028065 - RNA, 18 nt, Homo sapiens
gcucuggaaaaugugacc

SEQ ID NO: 1028066 - RNA, 14 nt, Homo sapiens
gcucuggacaggca

SEQ ID NO: 1028067 - RNA, 15 nt, Homo sapiens
gcucugucucaaaag

SEQ ID NO: 1028068 - RNA, 19 nt, Homo sapiens
gcucugucuucuuugccca

SEQ ID NO: 1028069 - RNA, 18 nt, Homo sapiens
gcucugugugguccaggu

SEQ ID NO: 1028070 - RNA, 13 nt, Homo sapiens
gcucuuauuauau

SEQ ID NO: 1028071 - RNA, 13 nt, Homo sapiens
gcucuucacugaa

SEQ ID NO: 1028072 - RNA, 19 nt, Homo sapiens
gcucuucuaccauuugaau

SEQ ID NO: 1028073 - RNA, 15 nt, Homo sapiens
gcucuuuaccaagga

SEQ ID NO: 1028074 - RNA, 15 nt, Homo sapiens
gcugaaaaaacaccu

SEQ ID NO: 1028075 - RNA, 17 nt, Homo sapiens
gcugaaauaaaaauaca

SEQ ID NO: 1028076 - RNA, 12 nt, Homo sapiens
gcugaacacugg

SEQ ID NO: 1028077 - RNA, 15 nt, Homo sapiens
gcugaacucaugaga

SEQ ID NO: 1028078 - RNA, 18 nt, Homo sapiens
gcugacaucuguguuuca

SEQ ID NO: 1028079 - RNA, 14 nt, Homo sapiens
gcugacucccuagg

SEQ ID NO: 1028080 - RNA, 22 nt, Homo sapiens
gcugagagaccaggagggcacu

SEQ ID NO: 1028081 - RNA, 21 nt, Homo sapiens
gcugagagaguuaagugaaug

SEQ ID NO: 1028082 - RNA, 13 nt, Homo sapiens
gcugagauuacag

SEQ ID NO: 1028083 - RNA, 20 nt, Homo sapiens
gcugagauugcaccacugca

SEQ ID NO: 1028084 - RNA, 16 nt, Homo sapiens
gcugaggacacucagu

SEQ ID NO: 1028085 - RNA, 20 nt, Homo sapiens
gcugaggcauccuuccucac

SEQ ID NO: 1028086 - RNA, 21 nt, Homo sapiens
gcugaggggaggaucacugga

SEQ ID NO: 1028087 - RNA, 16 nt, Homo sapiens
gcugagucaaucaaua

SEQ ID NO: 1028088 - RNA, 18 nt, Homo sapiens
gcugaguugguguugaca

SEQ ID NO: 1028089 - RNA, 21 nt, Homo sapiens
gcugauggaccaggaagcccu

SEQ ID NO: 1028090 - RNA, 17 nt, Homo sapiens
gcugauugggcaccuga

SEQ ID NO: 1028091 - RNA, 15 nt, Homo sapiens
gcugauuuuaacaau

SEQ ID NO: 1028092 - RNA, 21 nt, Homo sapiens
gcugcaacggaauuaggaaga

SEQ ID NO: 1028093 - RNA, 21 nt, Homo sapiens
gcugcacucaagcuuggguga

SEQ ID NO: 1028094 - RNA, 14 nt, Homo sapiens
gcugcaugcgagug

SEQ ID NO: 1028095 - RNA, 22 nt, Homo sapiens
gcugccucuugaaugcagggac

SEQ ID NO: 1028096 - RNA, 14 nt, Homo sapiens
gcugccugccuugg

SEQ ID NO: 1028097 - RNA, 13 nt, Homo sapiens
gcugccugggauc

SEQ ID NO: 1028098 - RNA, 14 nt, Homo sapiens
gcugcgacugauga

SEQ ID NO: 1028099 - RNA, 18 nt, Homo sapiens
gcugcuacuacuccugua

SEQ ID NO: 1028100 - RNA, 16 nt, Homo sapiens
gcugcuagagccagca

SEQ ID NO: 1028101 - RNA, 17 nt, Homo sapiens
gcugcuagagccagcaa

SEQ ID NO: 1028102 - RNA, 14 nt, Homo sapiens
gcugcucugugguc

SEQ ID NO: 1028103 - RNA, 14 nt, Homo sapiens
gcugcugacccagc

SEQ ID NO: 1028104 - RNA, 14 nt, Homo sapiens
gcugcugaccucca

SEQ ID NO: 1028105 - RNA, 16 nt, Homo sapiens
gcugcugugugccuuc

SEQ ID NO: 1028106 - RNA, 20 nt, Homo sapiens
gcugcuuuugaugaaaagca

SEQ ID NO: 1028107 - RNA, 18 nt, Homo sapiens
gcuggacggggacugggg

SEQ ID NO: 1028108 - RNA, 14 nt, Homo sapiens
gcuggagacgggug

SEQ ID NO: 1028109 - RNA, 17 nt, Homo sapiens
gcuggagagaacccaga

SEQ ID NO: 1028110 - RNA, 19 nt, Homo sapiens
gcuggaggacuagaaccug

SEQ ID NO: 1028111 - RNA, 17 nt, Homo sapiens
gcuggagucgggacuaa

SEQ ID NO: 1028112 - RNA, 17 nt, Homo sapiens
gcuggauaaaaugaggu

SEQ ID NO: 1028113 - RNA, 20 nt, Homo sapiens
gcuggaugucuccaucucug

SEQ ID NO: 1028114 - RNA, 13 nt, Homo sapiens
gcuggcagugaca

SEQ ID NO: 1028115 - RNA, 19 nt, Homo sapiens
gcuggcccgucauguuccu

SEQ ID NO: 1028116 - RNA, 16 nt, Homo sapiens
gcuggcccgugacaga

SEQ ID NO: 1028117 - RNA, 18 nt, Homo sapiens
gcuggcgucugucuucaa

SEQ ID NO: 1028118 - RNA, 20 nt, Homo sapiens
gcuggcgugcaguggugcga

SEQ ID NO: 1028119 - RNA, 14 nt, Homo sapiens
gcuggcugcaguga

SEQ ID NO: 1028120 - RNA, 16 nt, Homo sapiens
gcugggacuacaggug

SEQ ID NO: 1028121 - RNA, 17 nt, Homo sapiens
gcugggagagccuucca

SEQ ID NO: 1028122 - RNA, 16 nt, Homo sapiens
gcugggauuacaggug

SEQ ID NO: 1028123 - RNA, 16 nt, Homo sapiens
gcugggcagaccccuc

SEQ ID NO: 1028124 - RNA, 18 nt, Homo sapiens
gcugggcuucaguggcag

SEQ ID NO: 1028125 - RNA, 14 nt, Homo sapiens
gcuggggaugucuc

SEQ ID NO: 1028126 - RNA, 15 nt, Homo sapiens
gcugguagcucaggu

SEQ ID NO: 1028127 - RNA, 16 nt, Homo sapiens
gcugguagcucaggug

SEQ ID NO: 1028128 - RNA, 20 nt, Homo sapiens
gcugguuuuccuaaaugcag

SEQ ID NO: 1028129 - RNA, 15 nt, Homo sapiens
gcuguaaacuuguag

SEQ ID NO: 1028130 - RNA, 17 nt, Homo sapiens
gcuguauuuaauggcau

SEQ ID NO: 1028131 - RNA, 20 nt, Homo sapiens
gcugucaguaugacauuuca

SEQ ID NO: 1028132 - RNA, 15 nt, Homo sapiens
gcuguccaguuccca

SEQ ID NO: 1028133 - RNA, 15 nt, Homo sapiens
gauuucacagugugu

SEQ ID NO: 1028134 - RNA, 15 nt, Homo sapiens
gauuucaugauuuca

SEQ ID NO: 1028135 - RNA, 13 nt, Homo sapiens
gauuugccugugc

SEQ ID NO: 1028136 - RNA, 13 nt, Homo sapiens
gauuuggggagaa

SEQ ID NO: 1028137 - RNA, 22 nt, Homo sapiens
gauuugucccuaugcauaucag

SEQ ID NO: 1028138 - RNA, 13 nt, Homo sapiens
gauuuguguuaua

SEQ ID NO: 1028139 - RNA, 19 nt, Homo sapiens
gauuuuaaaaagucuucac

SEQ ID NO: 1028140 - RNA, 20 nt, Homo sapiens
gauuuugaaauuuuuauuaa

SEQ ID NO: 1028141 - RNA, 18 nt, Homo sapiens
gauuuugaagagauuuua

SEQ ID NO: 1028142 - RNA, 12 nt, Homo sapiens
gauuuugcaauc

SEQ ID NO: 1028143 - RNA, 23 nt, Homo sapiens
gcaaaaccaaauauuccagagac

SEQ ID NO: 1028144 - RNA, 16 nt, Homo sapiens
gcaaaacuccaucuca

SEQ ID NO: 1028145 - RNA, 17 nt, Homo sapiens
gcaaaacuccaucucaa

SEQ ID NO: 1028146 - RNA, 14 nt, Homo sapiens
gcaaaacuuuggca

SEQ ID NO: 1028147 - RNA, 21 nt, Homo sapiens
gcaaaagugagggcuugucau

SEQ ID NO: 1028148 - RNA, 19 nt, Homo sapiens
gcaaaauacaugacauuua

SEQ ID NO: 1028149 - RNA, 22 nt, Homo sapiens
gcaaaauguuucaaguacugua

SEQ ID NO: 1028150 - RNA, 16 nt, Homo sapiens
gcaaagacuuuccucu

SEQ ID NO: 1028151 - RNA, 14 nt, Homo sapiens
gcaaaggcucucac

SEQ ID NO: 1028152 - RNA, 16 nt, Homo sapiens
gcaaagggaacaguga

SEQ ID NO: 1028153 - RNA, 18 nt, Homo sapiens
gcaaagggagcacugggu

SEQ ID NO: 1028154 - RNA, 20 nt, Homo sapiens
gcaaaguaucccuacuguaa

SEQ ID NO: 1028155 - RNA, 21 nt, Homo sapiens
gcaaagucaucaaagauugag

SEQ ID NO: 1028156 - RNA, 23 nt, Homo sapiens
gcaaagugcugcuggaaguagaa

SEQ ID NO: 1028157 - RNA, 19 nt, Homo sapiens
gcaaaguucccuacuuccu

SEQ ID NO: 1028158 - RNA, 18 nt, Homo sapiens
gcaaauaaagaccugaga

SEQ ID NO: 1028159 - RNA, 16 nt, Homo sapiens
gcaaaugacaaaaagc

SEQ ID NO: 1028160 - RNA, 14 nt, Homo sapiens
gcaacaaccagcau

SEQ ID NO: 1028161 - RNA, 21 nt, Homo sapiens
gcaacaagaguaaaacucugu

SEQ ID NO: 1028162 - RNA, 15 nt, Homo sapiens
gcaacagcacuggcu

SEQ ID NO: 1028163 - RNA, 19 nt, Homo sapiens
gcaacaggaggcauucugu

SEQ ID NO: 1028164 - RNA, 16 nt, Homo sapiens
gcaacucugagaucua

SEQ ID NO: 1028165 - RNA, 11 nt, Homo sapiens
gcaacugcugu

SEQ ID NO: 1028166 - RNA, 16 nt, Homo sapiens
gcaacuggcucaaaga

SEQ ID NO: 1028167 - RNA, 15 nt, Homo sapiens
gcaacuuagcucaca

SEQ ID NO: 1028168 - RNA, 14 nt, Homo sapiens
gcaagaaacacugg

SEQ ID NO: 1028169 - RNA, 17 nt, Homo sapiens
gcaagaucauagcucau

SEQ ID NO: 1028170 - RNA, 18 nt, Homo sapiens
gcaagauuuaaauccuuu

SEQ ID NO: 1028171 - RNA, 21 nt, Homo sapiens
gcaagcaagaaacacugggcu

SEQ ID NO: 1028172 - RNA, 16 nt, Homo sapiens
gcaaggaaacuaugua

SEQ ID NO: 1028173 - RNA, 21 nt, Homo sapiens
gcaaggacggccuucaacuga

SEQ ID NO: 1028174 - RNA, 21 nt, Homo sapiens
gcaaggccuuucuguguguga

SEQ ID NO: 1028175 - RNA, 21 nt, Homo sapiens
gcaagggcagaacacuaaccu

SEQ ID NO: 1028176 - RNA, 16 nt, Homo sapiens
gcaagucccugacucu

SEQ ID NO: 1028177 - RNA, 16 nt, Homo sapiens
gcaaguguaugcacgu

SEQ ID NO: 1028178 - RNA, 23 nt, Homo sapiens
gcaaguguaugcacgugugcaca

SEQ ID NO: 1028179 - RNA, 17 nt, Homo sapiens
gcaagugucugugugca

SEQ ID NO: 1028180 - RNA, 15 nt, Homo sapiens
gcaagugugugcaug

SEQ ID NO: 1028181 - RNA, 15 nt, Homo sapiens
gcaaguuaaagaaaa

SEQ ID NO: 1028182 - RNA, 14 nt, Homo sapiens
gcaauaaauauuag

SEQ ID NO: 1028183 - RNA, 19 nt, Homo sapiens
gcaauaaccucaaagugac

SEQ ID NO: 1028184 - RNA, 22 nt, Homo sapiens
gcaauacagacuacuucuuccc

SEQ ID NO: 1028185 - RNA, 18 nt, Homo sapiens
gcaauacuacaaccucac

SEQ ID NO: 1028186 - RNA, 16 nt, Homo sapiens
gcaaucacaacacugg

SEQ ID NO: 1028187 - RNA, 20 nt, Homo sapiens
gcaaucuucucagaaggcaa

SEQ ID NO: 1028188 - RNA, 21 nt, Homo sapiens
gcaaugaaugaugcuuuucug

SEQ ID NO: 1028189 - RNA, 12 nt, Homo sapiens
gcaaugugcuac

SEQ ID NO: 1028190 - RNA, 14 nt, Homo sapiens
gcaauuaaagugau

SEQ ID NO: 1028191 - RNA, 22 nt, Homo sapiens
gcaauuccgcauuuaauucaug

SEQ ID NO: 1028192 - RNA, 19 nt, Homo sapiens
gcaauuccucugaacaaaa

SEQ ID NO: 1028193 - RNA, 22 nt, Homo sapiens
gcaauucuaacuuuuuugcuau

SEQ ID NO: 1028194 - RNA, 21 nt, Homo sapiens
gcaauuuaauauuuugcacag

SEQ ID NO: 1028195 - RNA, 17 nt, Homo sapiens
gcaauuuucgaacauuc

SEQ ID NO: 1028196 - RNA, 17 nt, Homo sapiens
gcaauuuugcauuugaa

SEQ ID NO: 1028197 - RNA, 17 nt, Homo sapiens
gcacaauaguaaccugg

SEQ ID NO: 1028198 - RNA, 21 nt, Homo sapiens
gcacacuagccucuccaggaa

SEQ ID NO: 1028199 - RNA, 18 nt, Homo sapiens
gcacacuccccugcacug

SEQ ID NO: 1028200 - RNA, 15 nt, Homo sapiens
gcacacuggccucca

SEQ ID NO: 1028201 - RNA, 16 nt, Homo sapiens
gcacagaucugcuuga

SEQ ID NO: 1028202 - RNA, 13 nt, Homo sapiens
gcacagauggauu

SEQ ID NO: 1028203 - RNA, 17 nt, Homo sapiens
gcacagcacccauggga

SEQ ID NO: 1028204 - RNA, 21 nt, Homo sapiens
gcacagggcagcugggcccaa

SEQ ID NO: 1028205 - RNA, 16 nt, Homo sapiens
gcacagguccugauga

SEQ ID NO: 1028206 - RNA, 21 nt, Homo sapiens
gcacaguucaugguuuccucc

SEQ ID NO: 1028207 - RNA, 12 nt, Homo sapiens
gcacaguuugaa

SEQ ID NO: 1028208 - RNA, 21 nt, Homo sapiens
gcacauauggacucugcacau

SEQ ID NO: 1028209 - RNA, 22 nt, Homo sapiens
gcacaucugcauuuucacccca

SEQ ID NO: 1028210 - RNA, 15 nt, Homo sapiens
gcacaugucuuguac

SEQ ID NO: 1028211 - RNA, 19 nt, Homo sapiens
gcacauucuggcucaggga

SEQ ID NO: 1028212 - RNA, 14 nt, Homo sapiens
gcaccaacuuugaa

SEQ ID NO: 1028213 - RNA, 18 nt, Homo sapiens
gcaccaauaaagccuuca

SEQ ID NO: 1028214 - RNA, 14 nt, Homo sapiens
gcaccacggccuca

SEQ ID NO: 1028215 - RNA, 15 nt, Homo sapiens
gcaccacuguguauu

SEQ ID NO: 1028216 - RNA, 18 nt, Homo sapiens
gcaccagggacuaugaau

SEQ ID NO: 1028217 - RNA, 19 nt, Homo sapiens
gcacccuaguucuaccuca

SEQ ID NO: 1028218 - RNA, 19 nt, Homo sapiens
gcacccuguaucacagacu

SEQ ID NO: 1028219 - RNA, 18 nt, Homo sapiens
gcaccgagagagauggaa

SEQ ID NO: 1028220 - RNA, 22 nt, Homo sapiens
gcaccgagagagauggaauaaa

SEQ ID NO: 1028221 - RNA, 18 nt, Homo sapiens
gcaccgggccacagagaa

SEQ ID NO: 1028222 - RNA, 16 nt, Homo sapiens
gcaccuguacucagga

SEQ ID NO: 1028223 - RNA, 20 nt, Homo sapiens
gcacgaacaccaagugucug

SEQ ID NO: 1028224 - RNA, 12 nt, Homo sapiens
gcacgcacacac

SEQ ID NO: 1028225 - RNA, 22 nt, Homo sapiens
gcacggugggccuugcugggga

SEQ ID NO: 1028226 - RNA, 18 nt, Homo sapiens
gcacucacccaugugcca

SEQ ID NO: 1028227 - RNA, 13 nt, Homo sapiens
gcacucccaaguc

SEQ ID NO: 1028228 - RNA, 19 nt, Homo sapiens
gcacucuaacccuaggcau

SEQ ID NO: 1028229 - RNA, 16 nt, Homo sapiens
gcacugagagugaagu

SEQ ID NO: 1028230 - RNA, 23 nt, Homo sapiens
gcacugagcccccccaacacugu

SEQ ID NO: 1028231 - RNA, 14 nt, Homo sapiens
gcacugcaugaaua

SEQ ID NO: 1028232 - RNA, 16 nt, Homo sapiens
gcacugcccaaagugc

SEQ ID NO: 1028233 - RNA, 17 nt, Homo sapiens
gcacugcccaaagugcu

SEQ ID NO: 1028234 - RNA, 22 nt, Homo sapiens
gcacuggguugacuuucaggua

SEQ ID NO: 1028235 - RNA, 12 nt, Homo sapiens
gcacugugcuaa

SEQ ID NO: 1028236 - RNA, 13 nt, Homo sapiens
gcacugugcucag

SEQ ID NO: 1028237 - RNA, 16 nt, Homo sapiens
gcacuuauacccauga

SEQ ID NO: 1028238 - RNA, 14 nt, Homo sapiens
gcacuugucuuuga

SEQ ID NO: 1028239 - RNA, 17 nt, Homo sapiens
gcacuuugggaggccaa

SEQ ID NO: 1028240 - RNA, 12 nt, Homo sapiens
gcagaaagcaaa

SEQ ID NO: 1028241 - RNA, 21 nt, Homo sapiens
gcagaacugcuugaacccagg

SEQ ID NO: 1028242 - RNA, 17 nt, Homo sapiens
gcagaagcaacccaaau

SEQ ID NO: 1028243 - RNA, 16 nt, Homo sapiens
gcagaagcacauauga

SEQ ID NO: 1028244 - RNA, 13 nt, Homo sapiens
gcagaauaaucuu

SEQ ID NO: 1028245 - RNA, 13 nt, Homo sapiens
gcagaccacugau

SEQ ID NO: 1028246 - RNA, 17 nt, Homo sapiens
gcagaccgccccucacc

SEQ ID NO: 1028247 - RNA, 21 nt, Homo sapiens
gcagacucuacagaggccaug

SEQ ID NO: 1028248 - RNA, 14 nt, Homo sapiens
gcagagaaccaaag

SEQ ID NO: 1028249 - RNA, 14 nt, Homo sapiens
gcagagagaagccu

SEQ ID NO: 1028250 - RNA, 19 nt, Homo sapiens
gcagaguugacaugagauu

SEQ ID NO: 1028251 - RNA, 21 nt, Homo sapiens
gcagaguuuccaaaaccagaa

SEQ ID NO: 1028252 - RNA, 23 nt, Homo sapiens
gcagaguuuguguguugucuuga

SEQ ID NO: 1028253 - RNA, 18 nt, Homo sapiens
gcagauccagagguuucu

SEQ ID NO: 1028254 - RNA, 16 nt, Homo sapiens
gcagaugagguugcua

SEQ ID NO: 1028255 - RNA, 23 nt, Homo sapiens
gcagcagcgguggccucuuuuca

SEQ ID NO: 1028256 - RNA, 22 nt, Homo sapiens
gcagcagggagggcuucugcca

SEQ ID NO: 1028257 - RNA, 18 nt, Homo sapiens
gcagcauagcaagacaca

SEQ ID NO: 1028258 - RNA, 13 nt, Homo sapiens
gcagccaccagcg

SEQ ID NO: 1028259 - RNA, 13 nt, Homo sapiens
gcagcccaugccc

SEQ ID NO: 1028260 - RNA, 17 nt, Homo sapiens
gcagccccacacccgcc

SEQ ID NO: 1028261 - RNA, 20 nt, Homo sapiens
gcagcccucagcagcugcag

SEQ ID NO: 1028262 - RNA, 19 nt, Homo sapiens
gcagccuggggucugacaa

SEQ ID NO: 1028263 - RNA, 22 nt, Homo sapiens
gcagcgauuaauaacaggcaaa

SEQ ID NO: 1028264 - RNA, 14 nt, Homo sapiens
gcagcuaagccaca

SEQ ID NO: 1028265 - RNA, 13 nt, Homo sapiens
gcagcucacccag

SEQ ID NO: 1028266 - RNA, 15 nt, Homo sapiens
gcagcucacuacccu

SEQ ID NO: 1028267 - RNA, 23 nt, Homo sapiens
gcagcucuccccucagagugcaa

SEQ ID NO: 1028268 - RNA, 14 nt, Homo sapiens
gcagcucuugcccu

SEQ ID NO: 1028269 - RNA, 15 nt, Homo sapiens
gcagcuguugcagug

SEQ ID NO: 1028270 - RNA, 19 nt, Homo sapiens
gcagcuguuuuaguuaaau

SEQ ID NO: 1028271 - RNA, 17 nt, Homo sapiens
gcagcuucuauuagcca

SEQ ID NO: 1028272 - RNA, 21 nt, Homo sapiens
gcagcuuuaaacucagggaca

SEQ ID NO: 1028273 - RNA, 20 nt, Homo sapiens
gcaggcagccccacacccgc

SEQ ID NO: 1028274 - RNA, 21 nt, Homo sapiens
gcaggcagccccacacccgcc

SEQ ID NO: 1028275 - RNA, 13 nt, Homo sapiens
gcaggcaugcaug

SEQ ID NO: 1028276 - RNA, 18 nt, Homo sapiens
gcaggcccccaggugcca

SEQ ID NO: 1028277 - RNA, 15 nt, Homo sapiens
gcaggcuacugucag

SEQ ID NO: 1028278 - RNA, 15 nt, Homo sapiens
gcaggcuagaaccug

SEQ ID NO: 1028279 - RNA, 23 nt, Homo sapiens
gcaggcuggcagcucuccaguca

SEQ ID NO: 1028280 - RNA, 22 nt, Homo sapiens
gcaggcuuuguuuauagcuugc

SEQ ID NO: 1028281 - RNA, 21 nt, Homo sapiens
gcagggaagccccacuugaag

SEQ ID NO: 1028282 - RNA, 14 nt, Homo sapiens
gcagggacuugaac

SEQ ID NO: 1028283 - RNA, 16 nt, Homo sapiens
gcaggggccgagccau

SEQ ID NO: 1028284 - RNA, 23 nt, Homo sapiens
gcaggggcuuguugcaggcugug

SEQ ID NO: 1028285 - RNA, 15 nt, Homo sapiens
gcagggucuuuucau

SEQ ID NO: 1028286 - RNA, 16 nt, Homo sapiens
gcagguggcaucucua

SEQ ID NO: 1028287 - RNA, 11 nt, Homo sapiens
gcagguugcuu

SEQ ID NO: 1028288 - RNA, 17 nt, Homo sapiens
gcaguacuuuaccuccu

SEQ ID NO: 1028289 - RNA, 13 nt, Homo sapiens
gcaguagacaagc

SEQ ID NO: 1028290 - RNA, 17 nt, Homo sapiens
gcagucagcaugaaucc

SEQ ID NO: 1028291 - RNA, 19 nt, Homo sapiens
gcagucgucgcacagucuc

SEQ ID NO: 1028292 - RNA, 15 nt, Homo sapiens
gcagugacagaacua

SEQ ID NO: 1028293 - RNA, 23 nt, Homo sapiens
gcagugacgugcaccuguacuca

SEQ ID NO: 1028294 - RNA, 21 nt, Homo sapiens
gcagugagcugauaucaugcc

SEQ ID NO: 1028295 - RNA, 15 nt, Homo sapiens
gcagugaugcuggau

SEQ ID NO: 1028296 - RNA, 17 nt, Homo sapiens
gcagugcaagagacucu

SEQ ID NO: 1028297 - RNA, 16 nt, Homo sapiens
gcaguguaggcuuuac

SEQ ID NO: 1028298 - RNA, 19 nt, Homo sapiens
gcaguucccccaaccucag

SEQ ID NO: 1028299 - RNA, 22 nt, Homo sapiens
gcauaaaauguaugaccacugg

SEQ ID NO: 1028300 - RNA, 13 nt, Homo sapiens
gcauaaaugcauu

SEQ ID NO: 1028301 - RNA, 17 nt, Homo sapiens
gcauaacuaaauuauuu

SEQ ID NO: 1028302 - RNA, 18 nt, Homo sapiens
gcauaauaagcuaaagag

SEQ ID NO: 1028303 - RNA, 21 nt, Homo sapiens
gcauaauuuuuuucugcaacu

SEQ ID NO: 1028304 - RNA, 15 nt, Homo sapiens
gcauacagagacaga

SEQ ID NO: 1028305 - RNA, 14 nt, Homo sapiens
gcauaccugcuggu

SEQ ID NO: 1028306 - RNA, 19 nt, Homo sapiens
gcauagaguucagacuuuu

SEQ ID NO: 1028307 - RNA, 16 nt, Homo sapiens
gcauagcaagacacau

SEQ ID NO: 1028308 - RNA, 20 nt, Homo sapiens
gcauaggcugacuuuugcag

SEQ ID NO: 1028309 - RNA, 21 nt, Homo sapiens
gcauauccaccaccucccuca

SEQ ID NO: 1028310 - RNA, 18 nt, Homo sapiens
gcauauuguacacuuuuu

SEQ ID NO: 1028311 - RNA, 21 nt, Homo sapiens
gcaucaauuuuucuuauuuca

SEQ ID NO: 1028312 - RNA, 16 nt, Homo sapiens
gcaucacacaucacuc

SEQ ID NO: 1028313 - RNA, 14 nt, Homo sapiens
gcaucacagcuaac

SEQ ID NO: 1028314 - RNA, 14 nt, Homo sapiens
gcaucacaugcuca

SEQ ID NO: 1028315 - RNA, 23 nt, Homo sapiens
gcaucagcugcugaaacaacaaa

SEQ ID NO: 1028316 - RNA, 13 nt, Homo sapiens
gcaucaucuaugg

SEQ ID NO: 1028317 - RNA, 22 nt, Homo sapiens
gcaucauuauuugcagagacag

SEQ ID NO: 1028318 - RNA, 11 nt, Homo sapiens
gcaucauucac

SEQ ID NO: 1028319 - RNA, 17 nt, Homo sapiens
gcauccaacuccaggau

SEQ ID NO: 1028320 - RNA, 20 nt, Homo sapiens
gcauccccuuggcugugagg

SEQ ID NO: 1028321 - RNA, 18 nt, Homo sapiens
gcauccuggcacccggcc

SEQ ID NO: 1028322 - RNA, 14 nt, Homo sapiens
gcauccuggccaac

SEQ ID NO: 1028323 - RNA, 12 nt, Homo sapiens
gcauccugugaa

SEQ ID NO: 1028324 - RNA, 22 nt, Homo sapiens
gcaucguggagacagggcauuu

SEQ ID NO: 1028325 - RNA, 14 nt, Homo sapiens
gcaucuccaggaag

SEQ ID NO: 1028326 - RNA, 18 nt, Homo sapiens
gcaucuggguagcuguaa

SEQ ID NO: 1028327 - RNA, 21 nt, Homo sapiens
gcaucuuccagaagugugauu

SEQ ID NO: 1028328 - RNA, 22 nt, Homo sapiens
gcaucuucuggagucuccagug

SEQ ID NO: 1028329 - RNA, 13 nt, Homo sapiens
gcaugaaacaugu

SEQ ID NO: 1028330 - RNA, 17 nt, Homo sapiens
gcaugaagguuucugaa

SEQ ID NO: 1028331 - RNA, 20 nt, Homo sapiens
gcaugaccugugaccagcac

SEQ ID NO: 1028332 - RNA, 13 nt, Homo sapiens
cuguggcuuucag

SEQ ID NO: 1028333 - RNA, 22 nt, Homo sapiens
cuguguacagaauucugcuacc

SEQ ID NO: 1028334 - RNA, 13 nt, Homo sapiens
cuguguauuccaa

SEQ ID NO: 1028335 - RNA, 15 nt, Homo sapiens
cuguguauucuaguu

SEQ ID NO: 1028336 - RNA, 14 nt, Homo sapiens
cugugucccaugac

SEQ ID NO: 1028337 - RNA, 13 nt, Homo sapiens
cugugucugugua

SEQ ID NO: 1028338 - RNA, 21 nt, Homo sapiens
cuguguggacugugaugccac

SEQ ID NO: 1028339 - RNA, 22 nt, Homo sapiens
cuguguggacugugaugccaca

SEQ ID NO: 1028340 - RNA, 15 nt, Homo sapiens
cuguguguagggaga

SEQ ID NO: 1028341 - RNA, 22 nt, Homo sapiens
cugugugugaaaggaagcucca

SEQ ID NO: 1028342 - RNA, 15 nt, Homo sapiens
cugugugugaugugc

SEQ ID NO: 1028343 - RNA, 13 nt, Homo sapiens
cuguguuaggggu

SEQ ID NO: 1028344 - RNA, 14 nt, Homo sapiens
cuguuacccagaga

SEQ ID NO: 1028345 - RNA, 18 nt, Homo sapiens
cuguuacuugaaauacca

SEQ ID NO: 1028346 - RNA, 23 nt, Homo sapiens
cuguuacuugaaauaccagugaa

SEQ ID NO: 1028347 - RNA, 16 nt, Homo sapiens
cuguuagucauuugcu

SEQ ID NO: 1028348 - RNA, 14 nt, Homo sapiens
cuguuauuaacaaa

SEQ ID NO: 1028349 - RNA, 21 nt, Homo sapiens
cuguuccccucugcuacuagc

SEQ ID NO: 1028350 - RNA, 14 nt, Homo sapiens
cuguuccuucacau

SEQ ID NO: 1028351 - RNA, 18 nt, Homo sapiens
cuguuccuucacauccug

SEQ ID NO: 1028352 - RNA, 22 nt, Homo sapiens
cuguucuauucaucucaaggaa

SEQ ID NO: 1028353 - RNA, 14 nt, Homo sapiens
cuguucuguggaaa

SEQ ID NO: 1028354 - RNA, 22 nt, Homo sapiens
cuguucuguggaaaguguaaag

SEQ ID NO: 1028355 - RNA, 16 nt, Homo sapiens
cuguucuuggaucugc

SEQ ID NO: 1028356 - RNA, 15 nt, Homo sapiens
cuguucuuuccaaag

SEQ ID NO: 1028357 - RNA, 23 nt, Homo sapiens
cuguugagaugggggacugagag

SEQ ID NO: 1028358 - RNA, 20 nt, Homo sapiens
cuguugauuucuuuccagag

SEQ ID NO: 1028359 - RNA, 13 nt, Homo sapiens
cuguugcauugua

SEQ ID NO: 1028360 - RNA, 12 nt, Homo sapiens
cuguuggucugu

SEQ ID NO: 1028361 - RNA, 14 nt, Homo sapiens
cuguuggucugucc

SEQ ID NO: 1028362 - RNA, 20 nt, Homo sapiens
cuguuguaggguugccagau

SEQ ID NO: 1028363 - RNA, 23 nt, Homo sapiens
cuguuuacaaaagcccaauguaa

SEQ ID NO: 1028364 - RNA, 18 nt, Homo sapiens
cuguuucgguugacccag

SEQ ID NO: 1028365 - RNA, 22 nt, Homo sapiens
cuguuuuagauaucccuuacuc

SEQ ID NO: 1028366 - RNA, 15 nt, Homo sapiens
cuuaaaaaaugucca

SEQ ID NO: 1028367 - RNA, 14 nt, Homo sapiens
cuuaaaauagccau

SEQ ID NO: 1028368 - RNA, 14 nt, Homo sapiens
cuuaaaaucuaauu

SEQ ID NO: 1028369 - RNA, 17 nt, Homo sapiens
cuuaaaaucuaauucaa

SEQ ID NO: 1028370 - RNA, 13 nt, Homo sapiens
cuuaacacugagc

SEQ ID NO: 1028371 - RNA, 17 nt, Homo sapiens
cuuaacggcuccaggau

SEQ ID NO: 1028372 - RNA, 15 nt, Homo sapiens
cuuaacucaccauaa

SEQ ID NO: 1028373 - RNA, 14 nt, Homo sapiens
cuuaagaacuuuaa

SEQ ID NO: 1028374 - RNA, 22 nt, Homo sapiens
cuuaagacgugauuuugcugua

SEQ ID NO: 1028375 - RNA, 20 nt, Homo sapiens
cuuaaguuucucagcuccca

SEQ ID NO: 1028376 - RNA, 17 nt, Homo sapiens
cuuaauaauguguacau

SEQ ID NO: 1028377 - RNA, 14 nt, Homo sapiens
cuuaauaguauuua

SEQ ID NO: 1028378 - RNA, 13 nt, Homo sapiens
cuuaaucuuuuca

SEQ ID NO: 1028379 - RNA, 17 nt, Homo sapiens
cuuaaugcuucuuucau

SEQ ID NO: 1028380 - RNA, 17 nt, Homo sapiens
cuuaauuccuuucucau

SEQ ID NO: 1028381 - RNA, 17 nt, Homo sapiens
cuuaauuuucaguauaa

SEQ ID NO: 1028382 - RNA, 18 nt, Homo sapiens
cuuacaaacaugugguua

SEQ ID NO: 1028383 - RNA, 14 nt, Homo sapiens
cuuacaauucccug

SEQ ID NO: 1028384 - RNA, 21 nt, Homo sapiens
cuuacacuacauuagaacacu

SEQ ID NO: 1028385 - RNA, 12 nt, Homo sapiens
cuuacagaauua

SEQ ID NO: 1028386 - RNA, 14 nt, Homo sapiens
cuuaccgcucuguu

SEQ ID NO: 1028387 - RNA, 18 nt, Homo sapiens
cuuaccuaccacaugcca

SEQ ID NO: 1028388 - RNA, 16 nt, Homo sapiens
cuuacuguuucuguca

SEQ ID NO: 1028389 - RNA, 20 nt, Homo sapiens
cuuacuuacccucaccuguc

SEQ ID NO: 1028390 - RNA, 23 nt, Homo sapiens
cuuacuuccuagucuacuugagg

SEQ ID NO: 1028391 - RNA, 14 nt, Homo sapiens
cuuacuuugaguua

SEQ ID NO: 1028392 - RNA, 14 nt, Homo sapiens
cuuagaaaaaccac

SEQ ID NO: 1028393 - RNA, 16 nt, Homo sapiens
cuuagacuucgacuca

SEQ ID NO: 1028394 - RNA, 13 nt, Homo sapiens
cuuagcacacuca

SEQ ID NO: 1028395 - RNA, 18 nt, Homo sapiens
cuuagccuccugaccuga

SEQ ID NO: 1028396 - RNA, 17 nt, Homo sapiens
cuuagcuuagaccucag

SEQ ID NO: 1028397 - RNA, 14 nt, Homo sapiens
cuuaggcagggaag

SEQ ID NO: 1028398 - RNA, 14 nt, Homo sapiens
cuuaggcaugacug

SEQ ID NO: 1028399 - RNA, 17 nt, Homo sapiens
cuuagguuggcaaaaag

SEQ ID NO: 1028400 - RNA, 12 nt, Homo sapiens
cuuaguguuucu

SEQ ID NO: 1028401 - RNA, 18 nt, Homo sapiens
cuuaguguuucugugcau

SEQ ID NO: 1028402 - RNA, 15 nt, Homo sapiens
cuuauaaauaugaag

SEQ ID NO: 1028403 - RNA, 16 nt, Homo sapiens
cuuauagaaaguucaa

SEQ ID NO: 1028404 - RNA, 20 nt, Homo sapiens
cuuauaucaucagcauaccu

SEQ ID NO: 1028405 - RNA, 21 nt, Homo sapiens
cuuauaucaucagcauaccuu

SEQ ID NO: 1028406 - RNA, 12 nt, Homo sapiens
cuuauauuguaa

SEQ ID NO: 1028407 - RNA, 20 nt, Homo sapiens
cuuauccaggacucugucaa

SEQ ID NO: 1028408 - RNA, 15 nt, Homo sapiens
cuuauccuccaugaa

SEQ ID NO: 1028409 - RNA, 17 nt, Homo sapiens
cuuaucugugcgugaaa

SEQ ID NO: 1028410 - RNA, 13 nt, Homo sapiens
cuuaugauucaga

SEQ ID NO: 1028411 - RNA, 12 nt, Homo sapiens
cuucaaacuucc

SEQ ID NO: 1028412 - RNA, 15 nt, Homo sapiens
cuucaaauauuuccc

SEQ ID NO: 1028413 - RNA, 22 nt, Homo sapiens
cuucaacaaccggccaccagau

SEQ ID NO: 1028414 - RNA, 21 nt, Homo sapiens
cuucaacugaccagccuccau

SEQ ID NO: 1028415 - RNA, 17 nt, Homo sapiens
cuucaagaaauuacugg

SEQ ID NO: 1028416 - RNA, 13 nt, Homo sapiens
cuucaagaccaaa

SEQ ID NO: 1028417 - RNA, 18 nt, Homo sapiens
cuucaagagccucuggca

SEQ ID NO: 1028418 - RNA, 22 nt, Homo sapiens
cuucaagaucauguaccccaau

SEQ ID NO: 1028419 - RNA, 19 nt, Homo sapiens
cuucaaucucuugcacuca

SEQ ID NO: 1028420 - RNA, 18 nt, Homo sapiens
cuucaauguaguuuucca

SEQ ID NO: 1028421 - RNA, 21 nt, Homo sapiens
cuucaauguaguuuuccaucc

SEQ ID NO: 1028422 - RNA, 21 nt, Homo sapiens
cuucaccccaguggccacuca

SEQ ID NO: 1028423 - RNA, 15 nt, Homo sapiens
cuucacccugaaugg

SEQ ID NO: 1028424 - RNA, 19 nt, Homo sapiens
cuucacuguccuccaagcc

SEQ ID NO: 1028425 - RNA, 20 nt, Homo sapiens
cuucacuuauccuguucucu

SEQ ID NO: 1028426 - RNA, 13 nt, Homo sapiens
cuucacuuuacaa

SEQ ID NO: 1028427 - RNA, 17 nt, Homo sapiens
cuucagaagacacugca

SEQ ID NO: 1028428 - RNA, 23 nt, Homo sapiens
cuucagaagacacugcaaaggcg

SEQ ID NO: 1028429 - RNA, 16 nt, Homo sapiens
cuucagagcugacaca

SEQ ID NO: 1028430 - RNA, 16 nt, Homo sapiens
cuucagauuugccuua

SEQ ID NO: 1028431 - RNA, 19 nt, Homo sapiens
cuucagccaucaacaagag

SEQ ID NO: 1028432 - RNA, 21 nt, Homo sapiens
cuucagccuagccgaccucag

SEQ ID NO: 1028433 - RNA, 12 nt, Homo sapiens
cuucagcuguac

SEQ ID NO: 1028434 - RNA, 20 nt, Homo sapiens
cuucagcuguacauacucag

SEQ ID NO: 1028435 - RNA, 21 nt, Homo sapiens
cuucagggcagggcucugaua

SEQ ID NO: 1028436 - RNA, 22 nt, Homo sapiens
cuucagguucuuagugucacuu

SEQ ID NO: 1028437 - RNA, 22 nt, Homo sapiens
cuucagucuugaauuucuaaaa

SEQ ID NO: 1028438 - RNA, 22 nt, Homo sapiens
cuucauaagguaauucauggca

SEQ ID NO: 1028439 - RNA, 20 nt, Homo sapiens
cuucauaauuucuucacuca

SEQ ID NO: 1028440 - RNA, 15 nt, Homo sapiens
cuucauauaccagca

SEQ ID NO: 1028441 - RNA, 18 nt, Homo sapiens
cuucauccuagcacuaaa

SEQ ID NO: 1028442 - RNA, 21 nt, Homo sapiens
cuucaucuggcaacaucuuua

SEQ ID NO: 1028443 - RNA, 21 nt, Homo sapiens
cuucaugaucaucacaaucau

SEQ ID NO: 1028444 - RNA, 16 nt, Homo sapiens
cuucaugcauuugcac

SEQ ID NO: 1028445 - RNA, 16 nt, Homo sapiens
cuucauguaaggacag

SEQ ID NO: 1028446 - RNA, 17 nt, Homo sapiens
cuucauuaccucaguga

SEQ ID NO: 1028447 - RNA, 13 nt, Homo sapiens
cuucauugccuua

SEQ ID NO: 1028448 - RNA, 18 nt, Homo sapiens
cuucauuugaugcuaaau

SEQ ID NO: 1028449 - RNA, 24 nt, Homo sapiens
cuucauuugaugcuaaauaggaga

SEQ ID NO: 1028450 - RNA, 14 nt, Homo sapiens
cuucauuuguguca

SEQ ID NO: 1028451 - RNA, 20 nt, Homo sapiens
cuuccaaacauuaaugcaau

SEQ ID NO: 1028452 - RNA, 21 nt, Homo sapiens
cuuccacuuggcuacacaggg

SEQ ID NO: 1028453 - RNA, 20 nt, Homo sapiens
cuuccagugcaacacugaag

SEQ ID NO: 1028454 - RNA, 14 nt, Homo sapiens
cuuccaucaccucc

SEQ ID NO: 1028455 - RNA, 18 nt, Homo sapiens
cuuccauuugcaagggaa

SEQ ID NO: 1028456 - RNA, 13 nt, Homo sapiens
cuucccacucuag

SEQ ID NO: 1028457 - RNA, 17 nt, Homo sapiens
cuucccccagcaccauu

SEQ ID NO: 1028458 - RNA, 18 nt, Homo sapiens
cuucccgaguaacugaga

SEQ ID NO: 1028459 - RNA, 22 nt, Homo sapiens
cuucccgaguaacugagauuac

SEQ ID NO: 1028460 - RNA, 16 nt, Homo sapiens
cuucccucacaccgcg

SEQ ID NO: 1028461 - RNA, 15 nt, Homo sapiens
cuucccugacucuuc

SEQ ID NO: 1028462 - RNA, 13 nt, Homo sapiens
cuucccugaucaa

SEQ ID NO: 1028463 - RNA, 13 nt, Homo sapiens
cuuccgaaaacca

SEQ ID NO: 1028464 - RNA, 14 nt, Homo sapiens
cuuccgccgucuca

SEQ ID NO: 1028465 - RNA, 23 nt, Homo sapiens
cuuccggucggcuggccagcuga

SEQ ID NO: 1028466 - RNA, 14 nt, Homo sapiens
cuuccuaauuuuag

SEQ ID NO: 1028467 - RNA, 14 nt, Homo sapiens
cuuccucaccacuu

SEQ ID NO: 1028468 - RNA, 15 nt, Homo sapiens
cuuccucucugcaau

SEQ ID NO: 1028469 - RNA, 17 nt, Homo sapiens
cuuccuggcuucuuacu

SEQ ID NO: 1028470 - RNA, 24 nt, Homo sapiens
cuuuauugcaucuggguagcugua

SEQ ID NO: 1028471 - RNA, 17 nt, Homo sapiens
cuuuauuggcugagaua

SEQ ID NO: 1028472 - RNA, 12 nt, Homo sapiens
cuuuauuuuaga

SEQ ID NO: 1028473 - RNA, 15 nt, Homo sapiens
cuuucaacuugcauc

SEQ ID NO: 1028474 - RNA, 18 nt, Homo sapiens
cuuucacggggccgugac

SEQ ID NO: 1028475 - RNA, 16 nt, Homo sapiens
cuuucagccaagccaa

SEQ ID NO: 1028476 - RNA, 14 nt, Homo sapiens
cuuucaggacucua

SEQ ID NO: 1028477 - RNA, 21 nt, Homo sapiens
cuuucaguguuauuaguguau

SEQ ID NO: 1028478 - RNA, 23 nt, Homo sapiens
cuuucaucccucgggugugcuau

SEQ ID NO: 1028479 - RNA, 16 nt, Homo sapiens
cuuucauuuacugugg

SEQ ID NO: 1028480 - RNA, 13 nt, Homo sapiens
cuuuccacauuca

SEQ ID NO: 1028481 - RNA, 14 nt, Homo sapiens
cuuuccacauucag

SEQ ID NO: 1028482 - RNA, 13 nt, Homo sapiens
cuuuccaucccag

SEQ ID NO: 1028483 - RNA, 13 nt, Homo sapiens
cuuucccaaauaa

SEQ ID NO: 1028484 - RNA, 19 nt, Homo sapiens
cuuuccccaaaacucuccu

SEQ ID NO: 1028485 - RNA, 21 nt, Homo sapiens
cuuucccggacugcaagcagg

SEQ ID NO: 1028486 - RNA, 15 nt, Homo sapiens
cuuucccuccuuugg

SEQ ID NO: 1028487 - RNA, 17 nt, Homo sapiens
cucgcuuuguugcccag

SEQ ID NO: 1028488 - RNA, 19 nt, Homo sapiens
cucuaaaaugaguuaccua

SEQ ID NO: 1028489 - RNA, 20 nt, Homo sapiens
cucuaaauagccaacaccca

SEQ ID NO: 1028490 - RNA, 18 nt, Homo sapiens
cucuaauaaauuugacug

SEQ ID NO: 1028491 - RNA, 17 nt, Homo sapiens
cucuaaugugucucuca

SEQ ID NO: 1028492 - RNA, 12 nt, Homo sapiens
cucuacaaaaag

SEQ ID NO: 1028493 - RNA, 20 nt, Homo sapiens
cugacuagaagggccagucc

SEQ ID NO: 1028494 - RNA, 16 nt, Homo sapiens
cugugcuuugacucac

SEQ ID NO: 1028495 - RNA, 14 nt, Homo sapiens
cuguggaaucugga

SEQ ID NO: 1028496 - RNA, 20 nt, Homo sapiens
cuguggaugaugguugcaaa

SEQ ID NO: 1028497 - RNA, 15 nt, Homo sapiens
cuguggccaaguucu

SEQ ID NO: 1028498 - RNA, 15 nt, Homo sapiens
cuguggcucacguga

SEQ ID NO: 1028499 - RNA, 21 nt, Homo sapiens
cuguggcugcuagcacuugga

SEQ ID NO: 1028500 - RNA, 23 nt, Homo sapiens
cuguggcuucuuaaucuuuucac

SEQ ID NO: 1028501 - RNA, 14 nt, Homo sapiens
gagugugugcaagu

SEQ ID NO: 1028502 - RNA, 21 nt, Homo sapiens
gaguuaguggauuacugccau

SEQ ID NO: 1028503 - RNA, 15 nt, Homo sapiens
gaguucaaugaucua

SEQ ID NO: 1028504 - RNA, 22 nt, Homo sapiens
gaguucucagggcuccugccuu

SEQ ID NO: 1028505 - RNA, 18 nt, Homo sapiens
gaguugagauuuugcaau

SEQ ID NO: 1028506 - RNA, 18 nt, Homo sapiens
gaguuguggaaagccucu

SEQ ID NO: 1028507 - RNA, 23 nt, Homo sapiens
gauaaacugauuuaucuauuuaa

SEQ ID NO: 1028508 - RNA, 12 nt, Homo sapiens
gauaaagcaccc

SEQ ID NO: 1028509 - RNA, 14 nt, Homo sapiens
gauaaaguaguaaa

SEQ ID NO: 1028510 - RNA, 18 nt, Homo sapiens
gauaacaguuacuccagu

SEQ ID NO: 1028511 - RNA, 22 nt, Homo sapiens
gauaagaccaccaccucagagu

SEQ ID NO: 1028512 - RNA, 18 nt, Homo sapiens
gauaagcuaacaccagac

SEQ ID NO: 1028513 - RNA, 15 nt, Homo sapiens
gauaaguguccccua

SEQ ID NO: 1028514 - RNA, 13 nt, Homo sapiens
gauaauaugagaa

SEQ ID NO: 1028515 - RNA, 18 nt, Homo sapiens
gauaaucucuccauuccc

SEQ ID NO: 1028516 - RNA, 14 nt, Homo sapiens
gauacaaacugcag

SEQ ID NO: 1028517 - RNA, 22 nt, Homo sapiens
gauacaaauugcagacugugua

SEQ ID NO: 1028518 - RNA, 19 nt, Homo sapiens
gauacacuaugaagauguu

SEQ ID NO: 1028519 - RNA, 18 nt, Homo sapiens
gauacaggaaaagcugcu

SEQ ID NO: 1028520 - RNA, 19 nt, Homo sapiens
gauacaggaaaagcugcug

SEQ ID NO: 1028521 - RNA, 20 nt, Homo sapiens
gauacaugguugugaccuga

SEQ ID NO: 1028522 - RNA, 21 nt, Homo sapiens
gauacaugugccgaaugugca

SEQ ID NO: 1028523 - RNA, 20 nt, Homo sapiens
gauacccaaguuauugggau

SEQ ID NO: 1028524 - RNA, 19 nt, Homo sapiens
gauacugaguaaauccaug

SEQ ID NO: 1028525 - RNA, 15 nt, Homo sapiens
gauagauauaugcuc

SEQ ID NO: 1028526 - RNA, 15 nt, Homo sapiens
gauagcauugugaac

SEQ ID NO: 1028527 - RNA, 12 nt, Homo sapiens
gauagcuuuauu

SEQ ID NO: 1028528 - RNA, 15 nt, Homo sapiens
gauaguccaaagacu

SEQ ID NO: 1028529 - RNA, 20 nt, Homo sapiens
gauauaacacuauguuuauu

SEQ ID NO: 1028530 - RNA, 12 nt, Homo sapiens
gauauaauacua

SEQ ID NO: 1028531 - RNA, 15 nt, Homo sapiens
gauauagaacagugc

SEQ ID NO: 1028532 - RNA, 21 nt, Homo sapiens
gauauaggucagugaggccca

SEQ ID NO: 1028533 - RNA, 16 nt, Homo sapiens
gauauauacacaggau

SEQ ID NO: 1028534 - RNA, 15 nt, Homo sapiens
gauauauaccacuuu

SEQ ID NO: 1028535 - RNA, 15 nt, Homo sapiens
gauaucaugccccug

SEQ ID NO: 1028536 - RNA, 12 nt, Homo sapiens
gauaucuuggcu

SEQ ID NO: 1028537 - RNA, 19 nt, Homo sapiens
gauaugcuuaguaaugcua

SEQ ID NO: 1028538 - RNA, 16 nt, Homo sapiens
gauauggagcccugua

SEQ ID NO: 1028539 - RNA, 13 nt, Homo sapiens
gauauuaaaggag

SEQ ID NO: 1028540 - RNA, 18 nt, Homo sapiens
gauauucaaauggacaaa

SEQ ID NO: 1028541 - RNA, 23 nt, Homo sapiens
gauauuuuaccucuuauugcaaa

SEQ ID NO: 1028542 - RNA, 16 nt, Homo sapiens
gauauuuuuccauuuu

SEQ ID NO: 1028543 - RNA, 15 nt, Homo sapiens
gaucaaauacuuuaa

SEQ ID NO: 1028544 - RNA, 19 nt, Homo sapiens
gaucaacucugucuugggc

SEQ ID NO: 1028545 - RNA, 14 nt, Homo sapiens
gaucaagcugugag

SEQ ID NO: 1028546 - RNA, 14 nt, Homo sapiens
gaucacagcugcuu

SEQ ID NO: 1028547 - RNA, 22 nt, Homo sapiens
gaucacgccauugcacuccagc

SEQ ID NO: 1028548 - RNA, 16 nt, Homo sapiens
cagagacuaucugauu

SEQ ID NO: 1028549 - RNA, 22 nt, Homo sapiens
cagagagagaagugccccugcu

SEQ ID NO: 1028550 - RNA, 15 nt, Homo sapiens
cagagaggagucaga

SEQ ID NO: 1028551 - RNA, 22 nt, Homo sapiens
cagagaugugcacccaugggcu

SEQ ID NO: 1028552 - RNA, 20 nt, Homo sapiens
cagagcaagacucugucuca

SEQ ID NO: 1028553 - RNA, 16 nt, Homo sapiens
cagugaccagucacug

SEQ ID NO: 1028554 - RNA, 16 nt, Homo sapiens
cacgugagaucauuca

SEQ ID NO: 1028555 - RNA, 20 nt, Homo sapiens
cacgugggcaaacaggcagu

SEQ ID NO: 1028556 - RNA, 15 nt, Homo sapiens
cacguguuguuccac

SEQ ID NO: 1028557 - RNA, 15 nt, Homo sapiens
cacguucugcucauc

SEQ ID NO: 1028558 - RNA, 19 nt, Homo sapiens
cacuaaauugacacuuaaa

SEQ ID NO: 1028559 - RNA, 13 nt, Homo sapiens
cacuaagccaaga

SEQ ID NO: 1028560 - RNA, 22 nt, Homo sapiens
cacuaauuugauguuuacaggu

SEQ ID NO: 1028561 - RNA, 20 nt, Homo sapiens
cacuacgugacuguggcaca

SEQ ID NO: 1028562 - RNA, 13 nt, Homo sapiens
cacuacugcaguc

SEQ ID NO: 1028563 - RNA, 15 nt, Homo sapiens
caagaacugaaacca

SEQ ID NO: 1028564 - RNA, 12 nt, Homo sapiens
caagaacuugga

SEQ ID NO: 1028565 - RNA, 19 nt, Homo sapiens
caagaagaccagacugugg

SEQ ID NO: 1028566 - RNA, 17 nt, Homo sapiens
caagaagcacagguccu

SEQ ID NO: 1028567 - RNA, 13 nt, Homo sapiens
caagaagggcuag

SEQ ID NO: 1028568 - RNA, 18 nt, Homo sapiens
caagaaucagucuaucca

SEQ ID NO: 1028569 - RNA, 21 nt, Homo sapiens
caagaaucagucuauccacag

SEQ ID NO: 1028570 - RNA, 19 nt, Homo sapiens
caagaauggggaucacaga

SEQ ID NO: 1028571 - RNA, 13 nt, Homo sapiens
caagaccaaagca

SEQ ID NO: 1028572 - RNA, 20 nt, Homo sapiens
caagacgcugugcugcccug

SEQ ID NO: 1028573 - RNA, 23 nt, Homo sapiens
caagagcugcccuccuuguccac

SEQ ID NO: 1028574 - RNA, 16 nt, Homo sapiens
caagaggagacuuuaa

SEQ ID NO: 1028575 - RNA, 21 nt, Homo sapiens
caagauagagagccgacucca

SEQ ID NO: 1028576 - RNA, 16 nt, Homo sapiens
caagaucauagcucau

SEQ ID NO: 1028577 - RNA, 20 nt, Homo sapiens
caagauccgagucuacccag

SEQ ID NO: 1028578 - RNA, 21 nt, Homo sapiens
agccuuccacacucaccucua

SEQ ID NO: 1028579 - RNA, 11 nt, Homo sapiens
agccuuccagg

SEQ ID NO: 1028580 - RNA, 21 nt, Homo sapiens
agccuuggauguauaugucau

SEQ ID NO: 1028581 - RNA, 17 nt, Homo sapiens
agccuuggcucuacccu

SEQ ID NO: 1028582 - RNA, 14 nt, Homo sapiens
agccuuugccuccc

SEQ ID NO: 1028583 - RNA, 22 nt, Homo sapiens
agcgaccgcccccuccucuagc

SEQ ID NO: 1028584 - RNA, 18 nt, Homo sapiens
agcgaggaggcuccagag

SEQ ID NO: 1028585 - RNA, 17 nt, Homo sapiens
agcggaaagcagcucaa

SEQ ID NO: 1028586 - RNA, 15 nt, Homo sapiens
agcggaagaccugaa

SEQ ID NO: 1028587 - RNA, 23 nt, Homo sapiens
agcggccacacuguacucugcac

SEQ ID NO: 1028588 - RNA, 22 nt, Homo sapiens
agcggccccuugacucugggga

SEQ ID NO: 1028589 - RNA, 14 nt, Homo sapiens
agcgggaauggcag

SEQ ID NO: 1028590 - RNA, 15 nt, Homo sapiens
agcgucccagucucu

SEQ ID NO: 1028591 - RNA, 14 nt, Homo sapiens
agcgugaagggauu

SEQ ID NO: 1028592 - RNA, 16 nt, Homo sapiens
agcguuugcauuugca

SEQ ID NO: 1028593 - RNA, 13 nt, Homo sapiens
agcuaacuuauca

SEQ ID NO: 1028594 - RNA, 23 nt, Homo sapiens
agcuaaggucacauugugccuuu

SEQ ID NO: 1028595 - RNA, 23 nt, Homo sapiens
agcuaaguugcaccaacuuugaa

SEQ ID NO: 1028596 - RNA, 23 nt, Homo sapiens
agcuaccagguguucuacacuca

SEQ ID NO: 1028597 - RNA, 17 nt, Homo sapiens
agcuaccucaaccaaug

SEQ ID NO: 1028598 - RNA, 21 nt, Homo sapiens
agcuaccucacuaugcugcuu

SEQ ID NO: 1028599 - RNA, 16 nt, Homo sapiens
agcuacuaaugauguu

SEQ ID NO: 1028600 - RNA, 20 nt, Homo sapiens
agcuacucaggagguugagg

SEQ ID NO: 1028601 - RNA, 18 nt, Homo sapiens
agcuacucgggaggcuga

SEQ ID NO: 1028602 - RNA, 22 nt, Homo sapiens
agcuacuguuuauuauuuuauu

SEQ ID NO: 1028603 - RNA, 20 nt, Homo sapiens
agcuacuugaaggacacaag

SEQ ID NO: 1028604 - RNA, 12 nt, Homo sapiens
agcuagaaggcc

SEQ ID NO: 1028605 - RNA, 23 nt, Homo sapiens
agcuagaggacuucuggcaggga

SEQ ID NO: 1028606 - RNA, 19 nt, Homo sapiens
agcuauaacuuacuucugu

SEQ ID NO: 1028607 - RNA, 16 nt, Homo sapiens
agcuaucucucaguga

SEQ ID NO: 1028608 - RNA, 22 nt, Homo sapiens
agcucaaagcguggacaggugu

SEQ ID NO: 1028609 - RNA, 17 nt, Homo sapiens
agcucacaccugaccaa

SEQ ID NO: 1028610 - RNA, 16 nt, Homo sapiens
agcucacagugacauu

SEQ ID NO: 1028611 - RNA, 16 nt, Homo sapiens
agcucacgucacacuu

SEQ ID NO: 1028612 - RNA, 16 nt, Homo sapiens
agcucagcauuuccac

SEQ ID NO: 1028613 - RNA, 19 nt, Homo sapiens
agcucagcauuuccacacc

SEQ ID NO: 1028614 - RNA, 23 nt, Homo sapiens
agcucagcgccagccugucccau

SEQ ID NO: 1028615 - RNA, 16 nt, Homo sapiens
agcucaggcacacuuc

SEQ ID NO: 1028616 - RNA, 18 nt, Homo sapiens
agcucagggacuggcaca

SEQ ID NO: 1028617 - RNA, 20 nt, Homo sapiens
agcucaggucccaggccagc

SEQ ID NO: 1028618 - RNA, 12 nt, Homo sapiens
agcucagguguc

SEQ ID NO: 1028619 - RNA, 17 nt, Homo sapiens
agcucagucccaucaga

SEQ ID NO: 1028620 - RNA, 13 nt, Homo sapiens
agcuccacagggc

SEQ ID NO: 1028621 - RNA, 14 nt, Homo sapiens
agcuccacugucac

SEQ ID NO: 1028622 - RNA, 14 nt, Homo sapiens
agcucccaagggau

SEQ ID NO: 1028623 - RNA, 11 nt, Homo sapiens
agcucccauuu

SEQ ID NO: 1028624 - RNA, 18 nt, Homo sapiens
agcucccauuucuacucu

SEQ ID NO: 1028625 - RNA, 17 nt, Homo sapiens
agcucccucugccugaa

SEQ ID NO: 1028626 - RNA, 15 nt, Homo sapiens
agcuccucuccugga

SEQ ID NO: 1028627 - RNA, 23 nt, Homo sapiens
agcuccuucucucuuacauugaa

SEQ ID NO: 1028628 - RNA, 20 nt, Homo sapiens
agugaagaugccagugaaac

SEQ ID NO: 1028629 - RNA, 14 nt, Homo sapiens
agugacagcuugag

SEQ ID NO: 1028630 - RNA, 20 nt, Homo sapiens
agugacagcuugaguggguu

SEQ ID NO: 1028631 - RNA, 21 nt, Homo sapiens
agugacaucucuuugauguca

SEQ ID NO: 1028632 - RNA, 21 nt, Homo sapiens
agugaccgaaagguuauguua

SEQ ID NO: 1028633 - RNA, 22 nt, Homo sapiens
agugacuaugaacuucucucag

SEQ ID NO: 1028634 - RNA, 17 nt, Homo sapiens
agugagaaaaagcuccu

SEQ ID NO: 1028635 - RNA, 13 nt, Homo sapiens
agugagacccugu

SEQ ID NO: 1028636 - RNA, 20 nt, Homo sapiens
agugagagcgugcuccagcc

SEQ ID NO: 1028637 - RNA, 16 nt, Homo sapiens
agugagaugcauucuu

SEQ ID NO: 1028638 - RNA, 15 nt, Homo sapiens
agugaggcauugcac

SEQ ID NO: 1028639 - RNA, 21 nt, Homo sapiens
agugaggcugcacccacccag

SEQ ID NO: 1028640 - RNA, 15 nt, Homo sapiens
agugagggucagaga

SEQ ID NO: 1028641 - RNA, 16 nt, Homo sapiens
agugaguuacagcgag

SEQ ID NO: 1028642 - RNA, 14 nt, Homo sapiens
agugauagaaagaa

SEQ ID NO: 1028643 - RNA, 19 nt, Homo sapiens
agugauccucccaccucag

SEQ ID NO: 1028644 - RNA, 12 nt, Homo sapiens
agugauggagcu

SEQ ID NO: 1028645 - RNA, 12 nt, Homo sapiens
agugaugguugu

SEQ ID NO: 1028646 - RNA, 12 nt, Homo sapiens
agugauguaauc

SEQ ID NO: 1028647 - RNA, 19 nt, Homo sapiens
agugauucugaaucaaggu

SEQ ID NO: 1028648 - RNA, 17 nt, Homo sapiens
agugauugauagagugu

SEQ ID NO: 1028649 - RNA, 22 nt, Homo sapiens
agugcaacagcacuggcucucu

SEQ ID NO: 1028650 - RNA, 19 nt, Homo sapiens
agugcaagagacucuggcc

SEQ ID NO: 1028651 - RNA, 20 nt, Homo sapiens
agugcaaugcacgaucucag

SEQ ID NO: 1028652 - RNA, 20 nt, Homo sapiens
agugcacaacauuacaggga

SEQ ID NO: 1028653 - RNA, 16 nt, Homo sapiens
agugcagucugaucca

SEQ ID NO: 1028654 - RNA, 20 nt, Homo sapiens
agugcaguggcgugaucucg

SEQ ID NO: 1028655 - RNA, 13 nt, Homo sapiens
agugcauccaaag

SEQ ID NO: 1028656 - RNA, 23 nt, Homo sapiens
agugcaucugggaagauuucuac

SEQ ID NO: 1028657 - RNA, 12 nt, Homo sapiens
agugcauuugcc

SEQ ID NO: 1028658 - RNA, 13 nt, Homo sapiens
agugcauuugccu

SEQ ID NO: 1028659 - RNA, 23 nt, Homo sapiens
agugcauuugccuugucaccugu

SEQ ID NO: 1028660 - RNA, 21 nt, Homo sapiens
agugccaagcacagugccugc

SEQ ID NO: 1028661 - RNA, 9 nt, Homo sapiens
agugcccua

SEQ ID NO: 1028662 - RNA, 19 nt, Homo sapiens
agugccuggccaaagggau

SEQ ID NO: 1028663 - RNA, 20 nt, Homo sapiens
agugccuggccaaagggaua

SEQ ID NO: 1028664 - RNA, 13 nt, Homo sapiens
agugccugggaau

SEQ ID NO: 1028665 - RNA, 18 nt, Homo sapiens
agugcggacaaguuuuaa

SEQ ID NO: 1028666 - RNA, 15 nt, Homo sapiens
agugcuauuguagag

SEQ ID NO: 1028667 - RNA, 18 nt, Homo sapiens
agugcugccaguuuccca

SEQ ID NO: 1028668 - RNA, 21 nt, Homo sapiens
agugcugggauuacaggugug

SEQ ID NO: 1028669 - RNA, 18 nt, Homo sapiens
agugcuugcaagauucca

SEQ ID NO: 1028670 - RNA, 14 nt, Homo sapiens
aguggaaugcuucc

SEQ ID NO: 1028671 - RNA, 17 nt, Homo sapiens
aguggaugccugcugca

SEQ ID NO: 1028672 - RNA, 16 nt, Homo sapiens
aguggccucuuugucu

SEQ ID NO: 1028673 - RNA, 15 nt, Homo sapiens
aguggcgugaucucg

SEQ ID NO: 1028674 - RNA, 20 nt, Homo sapiens
aguggcgugaucucggcuca

SEQ ID NO: 1028675 - RNA, 17 nt, Homo sapiens
agugggagccagggcug

SEQ ID NO: 1028676 - RNA, 16 nt, Homo sapiens
agugggccuccaagga

SEQ ID NO: 1028677 - RNA, 14 nt, Homo sapiens
aguggggucagggc

SEQ ID NO: 1028678 - RNA, 17 nt, Homo sapiens
agugggugucucugcau

SEQ ID NO: 1028679 - RNA, 15 nt, Homo sapiens
agugguauccuguga

SEQ ID NO: 1028680 - RNA, 21 nt, Homo sapiens
aguggucagaacagagccuuu

SEQ ID NO: 1028681 - RNA, 15 nt, Homo sapiens
aguggucgcuuacuu

SEQ ID NO: 1028682 - RNA, 13 nt, Homo sapiens
agugguuucccau

SEQ ID NO: 1028683 - RNA, 13 nt, Homo sapiens
aguguacauggaa

SEQ ID NO: 1028684 - RNA, 15 nt, Homo sapiens
aguguagguaucauu

SEQ ID NO: 1028685 - RNA, 17 nt, Homo sapiens
aguguccucuugcucaa

SEQ ID NO: 1028686 - RNA, 18 nt, Homo sapiens
aguguccucuugcucaaa

SEQ ID NO: 1028687 - RNA, 16 nt, Homo sapiens
agugucugugugcaag

SEQ ID NO: 1028688 - RNA, 16 nt, Homo sapiens
agugugaacaaaagau

SEQ ID NO: 1028689 - RNA, 22 nt, Homo sapiens
agugugaaccgaggggcucagg

SEQ ID NO: 1028690 - RNA, 23 nt, Homo sapiens
aguguggccacgugggcaaacag

SEQ ID NO: 1028691 - RNA, 22 nt, Homo sapiens
aguguggcccagggaagccaaa

SEQ ID NO: 1028692 - RNA, 16 nt, Homo sapiens
aguguguccaagugug

SEQ ID NO: 1028693 - RNA, 15 nt, Homo sapiens
agugugugcacaugu

SEQ ID NO: 1028694 - RNA, 19 nt, Homo sapiens
aguguuaagcguucaguga

SEQ ID NO: 1028695 - RNA, 16 nt, Homo sapiens
aguguuccccuuccac

SEQ ID NO: 1028696 - RNA, 19 nt, Homo sapiens
aguuaaacauugaaguaau

SEQ ID NO: 1028697 - RNA, 21 nt, Homo sapiens
aguuaaagcagugcuucucaa

SEQ ID NO: 1028698 - RNA, 19 nt, Homo sapiens
aguuaaggauuguuuuaaa

SEQ ID NO: 1028699 - RNA, 12 nt, Homo sapiens
aguuacuaccug

SEQ ID NO: 1028700 - RNA, 17 nt, Homo sapiens
aguuaggcugagccaca

SEQ ID NO: 1028701 - RNA, 16 nt, Homo sapiens
aguuagguagcuuuag

SEQ ID NO: 1028702 - RNA, 13 nt, Homo sapiens
aguuagugccaua

SEQ ID NO: 1028703 - RNA, 23 nt, Homo sapiens
aguuaugaaaaauaagucacuua

SEQ ID NO: 1028704 - RNA, 15 nt, Homo sapiens
aguucaauggcugcu

SEQ ID NO: 1028705 - RNA, 14 nt, Homo sapiens
aguucacggcaaaa

SEQ ID NO: 1028706 - RNA, 22 nt, Homo sapiens
aguucacuuuuuacagugcuau

SEQ ID NO: 1028707 - RNA, 13 nt, Homo sapiens
aguuccacugcug

SEQ ID NO: 1028708 - RNA, 19 nt, Homo sapiens
aguuccaugaagaccacau

SEQ ID NO: 1028709 - RNA, 18 nt, Homo sapiens
aguucccuagucuauuca

SEQ ID NO: 1028710 - RNA, 17 nt, Homo sapiens
aguucccuuggccucag

SEQ ID NO: 1028711 - RNA, 22 nt, Homo sapiens
aguuccgacugccaucuuggac

SEQ ID NO: 1028712 - RNA, 23 nt, Homo sapiens
aguuccugcuacaacuucagcag

SEQ ID NO: 1028713 - RNA, 21 nt, Homo sapiens
aguuccuucuggugucugcuu

SEQ ID NO: 1028714 - RNA, 18 nt, Homo sapiens
aguuccuugaucuguaua

SEQ ID NO: 1028715 - RNA, 15 nt, Homo sapiens
aguucuaguuugcau

SEQ ID NO: 1028716 - RNA, 13 nt, Homo sapiens
aguucucacuguu

SEQ ID NO: 1028717 - RNA, 19 nt, Homo sapiens
aguucucagggcuccugcc

SEQ ID NO: 1028718 - RNA, 17 nt, Homo sapiens
aguucuccagacagggu

SEQ ID NO: 1028719 - RNA, 18 nt, Homo sapiens
aguucuccagacaggguu

SEQ ID NO: 1028720 - RNA, 14 nt, Homo sapiens
aguucuccauuuca

SEQ ID NO: 1028721 - RNA, 19 nt, Homo sapiens
aguucuggcugaacacugg

SEQ ID NO: 1028722 - RNA, 18 nt, Homo sapiens
aguugaagcuaagauuua

SEQ ID NO: 1028723 - RNA, 15 nt, Homo sapiens
aguugacuugacaga

SEQ ID NO: 1028724 - RNA, 20 nt, Homo sapiens
aguugaucuacaaaggccau

SEQ ID NO: 1028725 - RNA, 17 nt, Homo sapiens
aguugcaauugaauuaa

SEQ ID NO: 1028726 - RNA, 18 nt, Homo sapiens
aguugcguggacucugca

SEQ ID NO: 1028727 - RNA, 11 nt, Homo sapiens
aguugcuguau

SEQ ID NO: 1028728 - RNA, 20 nt, Homo sapiens
aguuggagaagccguggccu

SEQ ID NO: 1028729 - RNA, 15 nt, Homo sapiens
aguugggugauaugu

SEQ ID NO: 1028730 - RNA, 19 nt, Homo sapiens
aguuguagguaauauugca

SEQ ID NO: 1028731 - RNA, 12 nt, Homo sapiens
aguugugcacau

SEQ ID NO: 1028732 - RNA, 15 nt, Homo sapiens
aguuguuaauaaaag

SEQ ID NO: 1028733 - RNA, 18 nt, Homo sapiens
aguuuaauaacuaccuaa

SEQ ID NO: 1028734 - RNA, 19 nt, Homo sapiens
aguuuaccuauguaacaaa

SEQ ID NO: 1028735 - RNA, 24 nt, Homo sapiens
aggaagugggacuggcacuauuug

SEQ ID NO: 1028736 - RNA, 19 nt, Homo sapiens
aggaauacauaaaguaugu

SEQ ID NO: 1028737 - RNA, 14 nt, Homo sapiens
aggaauaccugucc

SEQ ID NO: 1028738 - RNA, 16 nt, Homo sapiens
aggaauccacucccag

SEQ ID NO: 1028739 - RNA, 17 nt, Homo sapiens
aggaauuaaguuaggga

SEQ ID NO: 1028740 - RNA, 19 nt, Homo sapiens
aggaauuucaccuguaaac

SEQ ID NO: 1028741 - RNA, 16 nt, Homo sapiens
aggaauuugcauuuag

SEQ ID NO: 1028742 - RNA, 21 nt, Homo sapiens
aggacaagggaaaugucaggg

SEQ ID NO: 1028743 - RNA, 14 nt, Homo sapiens
aggacacagaugaa

SEQ ID NO: 1028744 - RNA, 18 nt, Homo sapiens
aggacaccuuuuaacuca

SEQ ID NO: 1028745 - RNA, 18 nt, Homo sapiens
aggacagggaggugaccc

SEQ ID NO: 1028746 - RNA, 12 nt, Homo sapiens
aggacauuccaa

SEQ ID NO: 1028747 - RNA, 15 nt, Homo sapiens
aggacccacuuccug

SEQ ID NO: 1028748 - RNA, 14 nt, Homo sapiens
aggacccuucccuu

SEQ ID NO: 1028749 - RNA, 22 nt, Homo sapiens
aggaccuacuguucggacaaaa

SEQ ID NO: 1028750 - RNA, 16 nt, Homo sapiens
aggacuuccauuugcu

SEQ ID NO: 1028751 - RNA, 22 nt, Homo sapiens
aggacuuuaucuaauaccucug

SEQ ID NO: 1028752 - RNA, 16 nt, Homo sapiens
aggagaaaaaaacuuc

SEQ ID NO: 1028753 - RNA, 16 nt, Homo sapiens
aggagacacaacaacu

SEQ ID NO: 1028754 - RNA, 23 nt, Homo sapiens
aggagacuuuacauggaugccaa

SEQ ID NO: 1028755 - RNA, 20 nt, Homo sapiens
aggagagcuagcagcaggga

SEQ ID NO: 1028756 - RNA, 19 nt, Homo sapiens
aggagaggggaagggccag

SEQ ID NO: 1028757 - RNA, 13 nt, Homo sapiens
aggagagucccag

SEQ ID NO: 1028758 - RNA, 23 nt, Homo sapiens
aggagaucgagaccaucuuggcc

SEQ ID NO: 1028759 - RNA, 21 nt, Homo sapiens
aggagccauugcucuccuaga

SEQ ID NO: 1028760 - RNA, 18 nt, Homo sapiens
aggagcgcccucuaggga

SEQ ID NO: 1028761 - RNA, 17 nt, Homo sapiens
aggaggcuggcagguau

SEQ ID NO: 1028762 - RNA, 16 nt, Homo sapiens
aggagggcacuggagc

SEQ ID NO: 1028763 - RNA, 21 nt, Homo sapiens
aggaggggaggaacacugcac

SEQ ID NO: 1028764 - RNA, 21 nt, Homo sapiens
aggagggucaggaaggaugag

SEQ ID NO: 1028765 - RNA, 20 nt, Homo sapiens
aggaggugaccaaaucagug

SEQ ID NO: 1028766 - RNA, 20 nt, Homo sapiens
aggagguggagguugcagug

SEQ ID NO: 1028767 - RNA, 13 nt, Homo sapiens
aggaguacaggug

SEQ ID NO: 1028768 - RNA, 21 nt, Homo sapiens
aggagucccugccaucauguu

SEQ ID NO: 1028769 - RNA, 20 nt, Homo sapiens
aggagugggaaaacacugcc

SEQ ID NO: 1028770 - RNA, 15 nt, Homo sapiens
aggaguucacuucau

SEQ ID NO: 1028771 - RNA, 22 nt, Homo sapiens
aggaguucucaucccucuguca

SEQ ID NO: 1028772 - RNA, 18 nt, Homo sapiens
aggaguuugagaccaacc

SEQ ID NO: 1028773 - RNA, 16 nt, Homo sapiens
aggauaggaguucacu

SEQ ID NO: 1028774 - RNA, 14 nt, Homo sapiens
aggauaucuucucc

SEQ ID NO: 1028775 - RNA, 13 nt, Homo sapiens
aggauaugcagua

SEQ ID NO: 1028776 - RNA, 16 nt, Homo sapiens
aggauauuuucuucca

SEQ ID NO: 1028777 - RNA, 20 nt, Homo sapiens
aggauccccucucuuccuac

SEQ ID NO: 1028778 - RNA, 14 nt, Homo sapiens
aggaucucucagga

SEQ ID NO: 1028779 - RNA, 18 nt, Homo sapiens
aggaucuggagaaccuca

SEQ ID NO: 1028780 - RNA, 19 nt, Homo sapiens
aggaugaaggcaaugccau

SEQ ID NO: 1028781 - RNA, 19 nt, Homo sapiens
aggaugaauguaugugcac

SEQ ID NO: 1028782 - RNA, 21 nt, Homo sapiens
aggaugaauguaugugcacug

SEQ ID NO: 1028783 - RNA, 15 nt, Homo sapiens
aggaugagcauuuag

SEQ ID NO: 1028784 - RNA, 22 nt, Homo sapiens
aggaugaucuaggaagacuuug

SEQ ID NO: 1028785 - RNA, 17 nt, Homo sapiens
aggaugcuuguacauaa

SEQ ID NO: 1028786 - RNA, 18 nt, Homo sapiens
aggauggcaaagagaguc

SEQ ID NO: 1028787 - RNA, 19 nt, Homo sapiens
aggaugguccagaauucac

SEQ ID NO: 1028788 - RNA, 20 nt, Homo sapiens
aggauguuuggucuuuaaug

SEQ ID NO: 1028789 - RNA, 17 nt, Homo sapiens
aggauucauguggaaua

SEQ ID NO: 1028790 - RNA, 13 nt, Homo sapiens
aggauuccaccuu

SEQ ID NO: 1028791 - RNA, 17 nt, Homo sapiens
aggauuuuaugcuuuaa

SEQ ID NO: 1028792 - RNA, 19 nt, Homo sapiens
aggcaaagugcugcuggaa

SEQ ID NO: 1028793 - RNA, 16 nt, Homo sapiens
aggcaaauacaauaga

SEQ ID NO: 1028794 - RNA, 15 nt, Homo sapiens
aggcaaccacaggca

SEQ ID NO: 1028795 - RNA, 18 nt, Homo sapiens
aggcacacgccugccagg

SEQ ID NO: 1028796 - RNA, 13 nt, Homo sapiens
aggcacagaugaa

SEQ ID NO: 1028797 - RNA, 12 nt, Homo sapiens
aggcacaguggc

SEQ ID NO: 1028798 - RNA, 17 nt, Homo sapiens
aggcacauaccacugca

SEQ ID NO: 1028799 - RNA, 16 nt, Homo sapiens
aggcagagaaucauac

SEQ ID NO: 1028800 - RNA, 16 nt, Homo sapiens
aggcagaggacagauc

SEQ ID NO: 1028801 - RNA, 18 nt, Homo sapiens
aggcagagguugcagugu

SEQ ID NO: 1028802 - RNA, 18 nt, Homo sapiens
aggcagagguugugguga

SEQ ID NO: 1028803 - RNA, 18 nt, Homo sapiens
aggcagaucccacuugca

SEQ ID NO: 1028804 - RNA, 12 nt, Homo sapiens
aggcagaucugu

SEQ ID NO: 1028805 - RNA, 23 nt, Homo sapiens
aggcagaucugugccccaugccu

SEQ ID NO: 1028806 - RNA, 18 nt, Homo sapiens
aggcagaugccucuagaa

SEQ ID NO: 1028807 - RNA, 15 nt, Homo sapiens
aggcagcaaacagau

SEQ ID NO: 1028808 - RNA, 20 nt, Homo sapiens
aggcagcuuuuucucuccca

SEQ ID NO: 1028809 - RNA, 19 nt, Homo sapiens
aggcaggagaaucacuuga

SEQ ID NO: 1028810 - RNA, 20 nt, Homo sapiens
aggcaggaggaucacuugag

SEQ ID NO: 1028811 - RNA, 20 nt, Homo sapiens
aggcaggaggauugcuugag

SEQ ID NO: 1028812 - RNA, 21 nt, Homo sapiens
aggcaggcagcugccugcucu

SEQ ID NO: 1028813 - RNA, 16 nt, Homo sapiens
aggcaggugccuccag

SEQ ID NO: 1028814 - RNA, 23 nt, Homo sapiens
aggcagugaugcuggaugcuccu

SEQ ID NO: 1028815 - RNA, 19 nt, Homo sapiens
aggcauaggccugggugcu

SEQ ID NO: 1028816 - RNA, 15 nt, Homo sapiens
aggcaucugcuuuac

SEQ ID NO: 1028817 - RNA, 16 nt, Homo sapiens
aggcaugaaguuuccu

SEQ ID NO: 1028818 - RNA, 15 nt, Homo sapiens
aggcaugacuguaga

SEQ ID NO: 1028819 - RNA, 18 nt, Homo sapiens
aggcaugagucagucuga

SEQ ID NO: 1028820 - RNA, 20 nt, Homo sapiens
aggcauucuguggccagcca

SEQ ID NO: 1028821 - RNA, 16 nt, Homo sapiens
aggccaaaccucuguu

SEQ ID NO: 1028822 - RNA, 22 nt, Homo sapiens
aggccacaccggccuugcauug

SEQ ID NO: 1028823 - RNA, 20 nt, Homo sapiens
aggccagagggagugacaga

SEQ ID NO: 1028824 - RNA, 18 nt, Homo sapiens
aggccaggauggcacugu

SEQ ID NO: 1028825 - RNA, 12 nt, Homo sapiens
aggccaggguca

SEQ ID NO: 1028826 - RNA, 20 nt, Homo sapiens
aggccaggugcaguggcuca

SEQ ID NO: 1028827 - RNA, 21 nt, Homo sapiens
aggccauggcagaauaaucuu

SEQ ID NO: 1028828 - RNA, 15 nt, Homo sapiens
aggccauugucccug

SEQ ID NO: 1028829 - RNA, 18 nt, Homo sapiens
aggccccugucucagggu

SEQ ID NO: 1028830 - RNA, 22 nt, Homo sapiens
aggccccuuuucacucccucca

SEQ ID NO: 1028831 - RNA, 12 nt, Homo sapiens
aggcccucgcug

SEQ ID NO: 1028832 - RNA, 16 nt, Homo sapiens
aggcccuucucuccag

SEQ ID NO: 1028833 - RNA, 15 nt, Homo sapiens
aggccugaggaugag

SEQ ID NO: 1028834 - RNA, 12 nt, Homo sapiens
aggccugccugu

SEQ ID NO: 1028835 - RNA, 17 nt, Homo sapiens
aggccuggcccacagca

SEQ ID NO: 1028836 - RNA, 19 nt, Homo sapiens
aggccuugcgcuguugcgu

SEQ ID NO: 1028837 - RNA, 13 nt, Homo sapiens
aggcgaugugcaa

SEQ ID NO: 1028838 - RNA, 20 nt, Homo sapiens
aggcgauucuccugccucag

SEQ ID NO: 1028839 - RNA, 17 nt, Homo sapiens
aggcgggagcaucucuu

SEQ ID NO: 1028840 - RNA, 20 nt, Homo sapiens
aggcgggcagaucacgaguu

SEQ ID NO: 1028841 - RNA, 18 nt, Homo sapiens
aggcggguggaucaccug

SEQ ID NO: 1028842 - RNA, 19 nt, Homo sapiens
aggcguggagcugccugau

SEQ ID NO: 1028843 - RNA, 19 nt, Homo sapiens
aggcuaagguggguggauc

SEQ ID NO: 1028844 - RNA, 13 nt, Homo sapiens
aggcuacacugac

SEQ ID NO: 1028845 - RNA, 17 nt, Homo sapiens
aggcuagaaccaccugc

SEQ ID NO: 1028846 - RNA, 18 nt, Homo sapiens
aggcuauacuugucuugu

SEQ ID NO: 1028847 - RNA, 14 nt, Homo sapiens
aggcuaugaauaua

SEQ ID NO: 1028848 - RNA, 15 nt, Homo sapiens
aggcuauguauggaa

SEQ ID NO: 1028849 - RNA, 17 nt, Homo sapiens
aggcucaauauuccuga

SEQ ID NO: 1028850 - RNA, 22 nt, Homo sapiens
aggcuccagagggcacucugcu

SEQ ID NO: 1028851 - RNA, 14 nt, Homo sapiens
aggcucucacucca

SEQ ID NO: 1028852 - RNA, 22 nt, Homo sapiens
aggcucugcccugcccuagcuc

SEQ ID NO: 1028853 - RNA, 14 nt, Homo sapiens
aggcucugucucaa

SEQ ID NO: 1028854 - RNA, 14 nt, Homo sapiens
aggcugacuaagaa

SEQ ID NO: 1028855 - RNA, 18 nt, Homo sapiens
aggcugagagcaguggcu

SEQ ID NO: 1028856 - RNA, 17 nt, Homo sapiens
aggcugaggcaagagaa

SEQ ID NO: 1028857 - RNA, 14 nt, Homo sapiens
aggcugaggcagaa

SEQ ID NO: 1028858 - RNA, 15 nt, Homo sapiens
aggcugaucccugag

SEQ ID NO: 1028859 - RNA, 12 nt, Homo sapiens
aggcugcaguga

SEQ ID NO: 1028860 - RNA, 18 nt, Homo sapiens
aggcugcccacucuccau

SEQ ID NO: 1028861 - RNA, 20 nt, Homo sapiens
aggcugcgacugaugaaggc

SEQ ID NO: 1028862 - RNA, 16 nt, Homo sapiens
aggcugcucagggcug

SEQ ID NO: 1028863 - RNA, 16 nt, Homo sapiens
aggcuggagugcaaug

SEQ ID NO: 1028864 - RNA, 14 nt, Homo sapiens
aggcuggagugcag

SEQ ID NO: 1028865 - RNA, 12 nt, Homo sapiens
aggcugggagac

SEQ ID NO: 1028866 - RNA, 20 nt, Homo sapiens
aggcugggagagccuuccag

SEQ ID NO: 1028867 - RNA, 14 nt, Homo sapiens
aggcugucuucuca

SEQ ID NO: 1028868 - RNA, 16 nt, Homo sapiens
aggcugugggccucaa

SEQ ID NO: 1028869 - RNA, 21 nt, Homo sapiens
aggcuuaauaccugggugauu

SEQ ID NO: 1028870 - RNA, 11 nt, Homo sapiens
aggcuuggcac

SEQ ID NO: 1028871 - RNA, 14 nt, Homo sapiens
aggcuuucaagaag

SEQ ID NO: 1028872 - RNA, 16 nt, Homo sapiens
agggaaacacagcagc

SEQ ID NO: 1028873 - RNA, 18 nt, Homo sapiens
agggaacaaguacuucuu

SEQ ID NO: 1028874 - RNA, 21 nt, Homo sapiens
agggaacccucuaagggaccu

SEQ ID NO: 1028875 - RNA, 21 nt, Homo sapiens
agggaacccugcuugcacuuu

SEQ ID NO: 1028876 - RNA, 19 nt, Homo sapiens
agggaacugaacauuccag

SEQ ID NO: 1028877 - RNA, 19 nt, Homo sapiens
agggaagcuggccgagggu

SEQ ID NO: 1028878 - RNA, 15 nt, Homo sapiens
agggaaguccuugca

SEQ ID NO: 1028879 - RNA, 17 nt, Homo sapiens
agggaauaauccagaaa

SEQ ID NO: 1028880 - RNA, 21 nt, Homo sapiens
agggaccacacccuguacugu

SEQ ID NO: 1028881 - RNA, 14 nt, Homo sapiens
agggacccacuuca

SEQ ID NO: 1028882 - RNA, 17 nt, Homo sapiens
agggaccccugcccuug

SEQ ID NO: 1028883 - RNA, 14 nt, Homo sapiens
agggaccuugucuc

SEQ ID NO: 1028884 - RNA, 15 nt, Homo sapiens
cuuuuucauacaagg

SEQ ID NO: 1028885 - RNA, 17 nt, Homo sapiens
cuuuuucauauguugcu

SEQ ID NO: 1028886 - RNA, 21 nt, Homo sapiens
cuuuuuucaaugguaugcaaa

SEQ ID NO: 1028887 - RNA, 23 nt, Homo sapiens
cuuuuuuuuuuuuuaaagacaga

SEQ ID NO: 1028888 - RNA, 13 nt, Homo sapiens
gaaaaaaugccaa

SEQ ID NO: 1028889 - RNA, 19 nt, Homo sapiens
gaaaaaccaccaccaucac

SEQ ID NO: 1028890 - RNA, 12 nt, Homo sapiens
gaaaacaauucu

SEQ ID NO: 1028891 - RNA, 12 nt, Homo sapiens
gaaaaccaucac

SEQ ID NO: 1028892 - RNA, 23 nt, Homo sapiens
gaaaacccaccccguagauuccc

SEQ ID NO: 1028893 - RNA, 20 nt, Homo sapiens
gaaaagaaaccagagucaaa

SEQ ID NO: 1028894 - RNA, 19 nt, Homo sapiens
gaaaagaccaguccaugag

SEQ ID NO: 1028895 - RNA, 17 nt, Homo sapiens
gaaaagcuauuagccag

SEQ ID NO: 1028896 - RNA, 19 nt, Homo sapiens
gaaaaggaaggcucuucuc

SEQ ID NO: 1028897 - RNA, 23 nt, Homo sapiens
gaaaaggaaggcucuucucccca

SEQ ID NO: 1028898 - RNA, 15 nt, Homo sapiens
gaaaagggaucugcu

SEQ ID NO: 1028899 - RNA, 16 nt, Homo sapiens
gaaaauaaaauuuaac

SEQ ID NO: 1028900 - RNA, 18 nt, Homo sapiens
gaaaauacauaagaccau

SEQ ID NO: 1028901 - RNA, 16 nt, Homo sapiens
gaaaauagcucuuuca

SEQ ID NO: 1028902 - RNA, 20 nt, Homo sapiens
gaaaauaguuuggauuacuu

SEQ ID NO: 1028903 - RNA, 16 nt, Homo sapiens
gaaaauauggguugca

SEQ ID NO: 1028904 - RNA, 18 nt, Homo sapiens
gaaaaucucagcaaugau

SEQ ID NO: 1028905 - RNA, 15 nt, Homo sapiens
gaaaaucucugugaa

SEQ ID NO: 1028906 - RNA, 16 nt, Homo sapiens
gaaaaucucugugaaa

SEQ ID NO: 1028907 - RNA, 16 nt, Homo sapiens
gaaaaugaaucuucac

SEQ ID NO: 1028908 - RNA, 14 nt, Homo sapiens
gaaaaugcauugua

SEQ ID NO: 1028909 - RNA, 22 nt, Homo sapiens
gaaaaugccagagcuugugaac

SEQ ID NO: 1028910 - RNA, 20 nt, Homo sapiens
gaaaaugucagaaaccaguu

SEQ ID NO: 1028911 - RNA, 14 nt, Homo sapiens
gaaaauguccuccc

SEQ ID NO: 1028912 - RNA, 13 nt, Homo sapiens
gaaacaacuucua

SEQ ID NO: 1028913 - RNA, 19 nt, Homo sapiens
gaaacaagcaacagaugga

SEQ ID NO: 1028914 - RNA, 17 nt, Homo sapiens
gaaacaauaaauuggaa

SEQ ID NO: 1028915 - RNA, 21 nt, Homo sapiens
gaaacaauacucauaauguga

SEQ ID NO: 1028916 - RNA, 21 nt, Homo sapiens
gaaacauuuuguggucauuaa

SEQ ID NO: 1028917 - RNA, 15 nt, Homo sapiens
gaaaccagagucaaa

SEQ ID NO: 1028918 - RNA, 21 nt, Homo sapiens
gaaaccccuucuuuacuuccc

SEQ ID NO: 1028919 - RNA, 20 nt, Homo sapiens
gaaacccguguaucugggau

SEQ ID NO: 1028920 - RNA, 16 nt, Homo sapiens
gaaacccugucucucc

SEQ ID NO: 1028921 - RNA, 17 nt, Homo sapiens
gaaaccuuauuguaccu

SEQ ID NO: 1028922 - RNA, 13 nt, Homo sapiens
gaaaccuugccuu

SEQ ID NO: 1028923 - RNA, 22 nt, Homo sapiens
gaaacucauaauagacuuccca

SEQ ID NO: 1028924 - RNA, 14 nt, Homo sapiens
gaaacuggcacuga

SEQ ID NO: 1028925 - RNA, 19 nt, Homo sapiens
gaaacuguagucucaggac

SEQ ID NO: 1028926 - RNA, 18 nt, Homo sapiens
gaaacuugugaaguggaa

SEQ ID NO: 1028927 - RNA, 19 nt, Homo sapiens
gaaacuugugaaguggaaa

SEQ ID NO: 1028928 - RNA, 22 nt, Homo sapiens
gaaagaaaaucaggcuggccaa

SEQ ID NO: 1028929 - RNA, 14 nt, Homo sapiens
gaaagaaaugccca

SEQ ID NO: 1028930 - RNA, 12 nt, Homo sapiens
gaaagaagacau

SEQ ID NO: 1028931 - RNA, 18 nt, Homo sapiens
gaaagacugagcucaagg

SEQ ID NO: 1028932 - RNA, 18 nt, Homo sapiens
gaaagaguccuauuugca

SEQ ID NO: 1028933 - RNA, 12 nt, Homo sapiens
gaaagauuacuu

SEQ ID NO: 1028934 - RNA, 18 nt, Homo sapiens
gaaagcaucacuugggau

SEQ ID NO: 1028935 - RNA, 16 nt, Homo sapiens
gaaagccagugacucc

SEQ ID NO: 1028936 - RNA, 22 nt, Homo sapiens
gaaagccgggcaugacggcuca

SEQ ID NO: 1028937 - RNA, 18 nt, Homo sapiens
gaaagcuccuagcagaga

SEQ ID NO: 1028938 - RNA, 23 nt, Homo sapiens
gaaagcuugcccuggugccucac

SEQ ID NO: 1028939 - RNA, 14 nt, Homo sapiens
gaaaggaaagaaga

SEQ ID NO: 1028940 - RNA, 17 nt, Homo sapiens
gaaaggaagcuccacug

SEQ ID NO: 1028941 - RNA, 21 nt, Homo sapiens
gaaaggaccaguaugcuugga

SEQ ID NO: 1028942 - RNA, 22 nt, Homo sapiens
gaaaggcagaaugagugcuuca

SEQ ID NO: 1028943 - RNA, 16 nt, Homo sapiens
gaaaggcauucucuga

SEQ ID NO: 1028944 - RNA, 11 nt, Homo sapiens
gaaaggccagu

SEQ ID NO: 1028945 - RNA, 16 nt, Homo sapiens
gaaaggccaucagagc

SEQ ID NO: 1028946 - RNA, 22 nt, Homo sapiens
gaaaggcuuggcacacagcagg

SEQ ID NO: 1028947 - RNA, 13 nt, Homo sapiens
gaaagggagcuau

SEQ ID NO: 1028948 - RNA, 16 nt, Homo sapiens
gaaagggauaguccaa

SEQ ID NO: 1028949 - RNA, 23 nt, Homo sapiens
gaaaggggccccaccggggucua

SEQ ID NO: 1028950 - RNA, 23 nt, Homo sapiens
ccuggaucaguccuuugaucagu

SEQ ID NO: 1028951 - RNA, 19 nt, Homo sapiens
ccuggaucuccucaagucc

SEQ ID NO: 1028952 - RNA, 22 nt, Homo sapiens
ccuggaugcagccucacagucc

SEQ ID NO: 1028953 - RNA, 21 nt, Homo sapiens
ccuggcaaagaugaucaguau

SEQ ID NO: 1028954 - RNA, 12 nt, Homo sapiens
ccuggcaagaau

SEQ ID NO: 1028955 - RNA, 14 nt, Homo sapiens
ccuggccaggagcu

SEQ ID NO: 1028956 - RNA, 20 nt, Homo sapiens
ccuggcccacugcaucguuu

SEQ ID NO: 1028957 - RNA, 16 nt, Homo sapiens
ccuggccccucagggu

SEQ ID NO: 1028958 - RNA, 15 nt, Homo sapiens
ccuggcccucaguuu

SEQ ID NO: 1028959 - RNA, 15 nt, Homo sapiens
ccuggccggcaaccc

SEQ ID NO: 1028960 - RNA, 14 nt, Homo sapiens
ccuggccucaagug

SEQ ID NO: 1028961 - RNA, 17 nt, Homo sapiens
ccuggcgaaaccccauc

SEQ ID NO: 1028962 - RNA, 14 nt, Homo sapiens
ccugggaccacaga

SEQ ID NO: 1028963 - RNA, 19 nt, Homo sapiens
ccugggagaaccucaggcu

SEQ ID NO: 1028964 - RNA, 15 nt, Homo sapiens
ccugggcaaugugau

SEQ ID NO: 1028965 - RNA, 11 nt, Homo sapiens
ccugggcacag

SEQ ID NO: 1028966 - RNA, 19 nt, Homo sapiens
ccugggcgacagagccaga

SEQ ID NO: 1028967 - RNA, 18 nt, Homo sapiens
ccuggguaacuagggaag

SEQ ID NO: 1028968 - RNA, 21 nt, Homo sapiens
ccugggucuuucaugggguga

SEQ ID NO: 1028969 - RNA, 20 nt, Homo sapiens
ccuggguucugggacuuuua

SEQ ID NO: 1028970 - RNA, 16 nt, Homo sapiens
ccugguacucaagccc

SEQ ID NO: 1028971 - RNA, 11 nt, Homo sapiens
ccuggucaguc

SEQ ID NO: 1028972 - RNA, 13 nt, Homo sapiens
ccuggugcugcug

SEQ ID NO: 1028973 - RNA, 21 nt, Homo sapiens
ccugguggagaaagcacugac

SEQ ID NO: 1028974 - RNA, 22 nt, Homo sapiens
ccuggugggccuccucugucca

SEQ ID NO: 1028975 - RNA, 19 nt, Homo sapiens
ccugguuccggcucugcac

SEQ ID NO: 1028976 - RNA, 19 nt, Homo sapiens
ccuguaauccuagcacuuu

SEQ ID NO: 1028977 - RNA, 17 nt, Homo sapiens
ccuguaaucucacuaca

SEQ ID NO: 1028978 - RNA, 22 nt, Homo sapiens
ccuguagccuucuguaggaauu

SEQ ID NO: 1028979 - RNA, 22 nt, Homo sapiens
ccuguaggaagucauccugcca

SEQ ID NO: 1028980 - RNA, 22 nt, Homo sapiens
ccuguagucccagcuacuugag

SEQ ID NO: 1028981 - RNA, 16 nt, Homo sapiens
cucagcucccauuucu

SEQ ID NO: 1028982 - RNA, 17 nt, Homo sapiens
cucagcuggaucuccau

SEQ ID NO: 1028983 - RNA, 16 nt, Homo sapiens
cucagcuuuuaaaugg

SEQ ID NO: 1028984 - RNA, 18 nt, Homo sapiens
cucaggaguuugagacca

SEQ ID NO: 1028985 - RNA, 21 nt, Homo sapiens
cucaggccaucaucaguggag

SEQ ID NO: 1028986 - RNA, 17 nt, Homo sapiens
cucaggcuuccuuggca

SEQ ID NO: 1028987 - RNA, 15 nt, Homo sapiens
cucaggcuugaaaug

SEQ ID NO: 1028988 - RNA, 16 nt, Homo sapiens
cucaggggucauucau

SEQ ID NO: 1028989 - RNA, 14 nt, Homo sapiens
cucaggugaucuac

SEQ ID NO: 1028990 - RNA, 22 nt, Homo sapiens
cucaguaagaagagcuuggaaa

SEQ ID NO: 1028991 - RNA, 17 nt, Homo sapiens
cucagucccaucagaga

SEQ ID NO: 1028992 - RNA, 21 nt, Homo sapiens
cucagucugggugggacuuau

SEQ ID NO: 1028993 - RNA, 15 nt, Homo sapiens
cucagugucauuuau

SEQ ID NO: 1028994 - RNA, 17 nt, Homo sapiens
cucagugugacuccuca

SEQ ID NO: 1028995 - RNA, 18 nt, Homo sapiens
cucaguuucccuaucucg

SEQ ID NO: 1028996 - RNA, 18 nt, Homo sapiens
cucaguuugugugucuua

SEQ ID NO: 1028997 - RNA, 10 nt, Homo sapiens
cucauaauag

SEQ ID NO: 1028998 - RNA, 21 nt, Homo sapiens
cucauauuuaaagacagggaa

SEQ ID NO: 1028999 - RNA, 15 nt, Homo sapiens
cucaucagucuccau

SEQ ID NO: 1029000 - RNA, 22 nt, Homo sapiens
cucaucauaaaauaaaguauau

SEQ ID NO: 1029001 - RNA, 23 nt, Homo sapiens
cucauccagggcucugaccaguu

SEQ ID NO: 1029002 - RNA, 19 nt, Homo sapiens
cucaucccacgcacuccau

SEQ ID NO: 1029003 - RNA, 18 nt, Homo sapiens
cucaucugccaagcuccu

SEQ ID NO: 1029004 - RNA, 14 nt, Homo sapiens
cucaucuuacugua

SEQ ID NO: 1029005 - RNA, 22 nt, Homo sapiens
cucaucuuagguuggcaaaaag

SEQ ID NO: 1029006 - RNA, 11 nt, Homo sapiens
cucaugccacu

SEQ ID NO: 1029007 - RNA, 12 nt, Homo sapiens
cucaugccugua

SEQ ID NO: 1029008 - RNA, 21 nt, Homo sapiens
cucaugcugcagaggguacuu

SEQ ID NO: 1029009 - RNA, 20 nt, Homo sapiens
cucaugcugugugacucaaa

SEQ ID NO: 1029010 - RNA, 15 nt, Homo sapiens
cucaugcuguuccac

SEQ ID NO: 1029011 - RNA, 16 nt, Homo sapiens
cucauggagauggcag

SEQ ID NO: 1029012 - RNA, 21 nt, Homo sapiens
cucaugugaucacaauuugca

SEQ ID NO: 1029013 - RNA, 12 nt, Homo sapiens
cucaugugaucc

SEQ ID NO: 1029014 - RNA, 13 nt, Homo sapiens
cucauuacuuuac

SEQ ID NO: 1029015 - RNA, 24 nt, Homo sapiens
cucauucagggauagcacugagca

SEQ ID NO: 1029016 - RNA, 10 nt, Homo sapiens
cucauuccac

SEQ ID NO: 1029017 - RNA, 13 nt, Homo sapiens
cucauuccaccuu

SEQ ID NO: 1029018 - RNA, 18 nt, Homo sapiens
cucauuccccaaccacuu

SEQ ID NO: 1029019 - RNA, 13 nt, Homo sapiens
cucauuccuguag

SEQ ID NO: 1029020 - RNA, 23 nt, Homo sapiens
cucauugacaagaacugaaacca

SEQ ID NO: 1029021 - RNA, 16 nt, Homo sapiens
cucauuuaucccucaa

SEQ ID NO: 1029022 - RNA, 22 nt, Homo sapiens
cucauuucuggaaagugcaauu

SEQ ID NO: 1029023 - RNA, 19 nt, Homo sapiens
cucauuugucacacacuuu

SEQ ID NO: 1029024 - RNA, 14 nt, Homo sapiens
cucauuuuaacuca

SEQ ID NO: 1029025 - RNA, 14 nt, Homo sapiens
cucauuuugcucaa

SEQ ID NO: 1029026 - RNA, 20 nt, Homo sapiens
cuccaaaggucugaugucuc

SEQ ID NO: 1029027 - RNA, 23 nt, Homo sapiens
cuccacaauagcagacaguguuu

SEQ ID NO: 1029028 - RNA, 17 nt, Homo sapiens
cuccacagucaauauua

SEQ ID NO: 1029029 - RNA, 12 nt, Homo sapiens
cuccacauaccu

SEQ ID NO: 1029030 - RNA, 12 nt, Homo sapiens
cuccacauguuc

SEQ ID NO: 1029031 - RNA, 14 nt, Homo sapiens
cuccaccacauccu

SEQ ID NO: 1029032 - RNA, 19 nt, Homo sapiens
cuccacccuauauguagua

SEQ ID NO: 1029033 - RNA, 17 nt, Homo sapiens
cuccaccuagacuguaa

SEQ ID NO: 1029034 - RNA, 18 nt, Homo sapiens
cuccaccuagacuguaaa

SEQ ID NO: 1029035 - RNA, 13 nt, Homo sapiens
cuccacuccagau

SEQ ID NO: 1029036 - RNA, 20 nt, Homo sapiens
cuccacugaaagaaguggga

SEQ ID NO: 1029037 - RNA, 12 nt, Homo sapiens
cuccacugucac

SEQ ID NO: 1029038 - RNA, 20 nt, Homo sapiens
cuccagaagggcagcuccac

SEQ ID NO: 1029039 - RNA, 17 nt, Homo sapiens
cuccagaccauucagga

SEQ ID NO: 1029040 - RNA, 19 nt, Homo sapiens
cuccagagggaauugcaga

SEQ ID NO: 1029041 - RNA, 16 nt, Homo sapiens
cuccagagucaaaagg

SEQ ID NO: 1029042 - RNA, 15 nt, Homo sapiens
cuccagaugagagua

SEQ ID NO: 1029043 - RNA, 15 nt, Homo sapiens
cuccaggaaugaucu

SEQ ID NO: 1029044 - RNA, 15 nt, Homo sapiens
cuccaggaugucaac

SEQ ID NO: 1029045 - RNA, 19 nt, Homo sapiens
cuccaggauugaagagcau

SEQ ID NO: 1029046 - RNA, 13 nt, Homo sapiens
cuccaggcaaaau

SEQ ID NO: 1029047 - RNA, 12 nt, Homo sapiens
cuccagugcagg

SEQ ID NO: 1029048 - RNA, 12 nt, Homo sapiens
cuccagugccag

SEQ ID NO: 1029049 - RNA, 18 nt, Homo sapiens
cuccagugccagcaauga

SEQ ID NO: 1029050 - RNA, 23 nt, Homo sapiens
cuccaucaguuagagcugacaca

SEQ ID NO: 1029051 - RNA, 14 nt, Homo sapiens
cuccaucucugucu

SEQ ID NO: 1029052 - RNA, 22 nt, Homo sapiens
cuccaucuuauuuucauguaua

SEQ ID NO: 1029053 - RNA, 19 nt, Homo sapiens
cuccauguagaagccacua

SEQ ID NO: 1029054 - RNA, 14 nt, Homo sapiens
cuccauguuugaug

SEQ ID NO: 1029055 - RNA, 19 nt, Homo sapiens
cuccauucugaccauuuca

SEQ ID NO: 1029056 - RNA, 21 nt, Homo sapiens
cuccauuugcaauugaccucu

SEQ ID NO: 1029057 - RNA, 21 nt, Homo sapiens
cucccaaagugcugagauuac

SEQ ID NO: 1029058 - RNA, 19 nt, Homo sapiens
cucccaaauugcugggauu

SEQ ID NO: 1029059 - RNA, 15 nt, Homo sapiens
cucccaaggcucuga

SEQ ID NO: 1029060 - RNA, 13 nt, Homo sapiens
cucccaagggaug

SEQ ID NO: 1029061 - RNA, 17 nt, Homo sapiens
cucccacaaugcugaau

SEQ ID NO: 1029062 - RNA, 12 nt, Homo sapiens
cucccacuuccu

SEQ ID NO: 1029063 - RNA, 18 nt, Homo sapiens
cucccagccagguucuga

SEQ ID NO: 1029064 - RNA, 15 nt, Homo sapiens
cucccagcuccagcu

SEQ ID NO: 1029065 - RNA, 23 nt, Homo sapiens
cucccagcucuagacaacccugc

SEQ ID NO: 1029066 - RNA, 12 nt, Homo sapiens
cuccccaacagc

SEQ ID NO: 1029067 - RNA, 15 nt, Homo sapiens
cuccccacugcucau

SEQ ID NO: 1029068 - RNA, 16 nt, Homo sapiens
cuccccagagcacugg

SEQ ID NO: 1029069 - RNA, 16 nt, Homo sapiens
cuccccggaguucagu

SEQ ID NO: 1029070 - RNA, 20 nt, Homo sapiens
cuccccuaccacugucuucu

SEQ ID NO: 1029071 - RNA, 12 nt, Homo sapiens
cuccccucaaaa

SEQ ID NO: 1029072 - RNA, 15 nt, Homo sapiens
cuccccuguaccuuu

SEQ ID NO: 1029073 - RNA, 14 nt, Homo sapiens
cucccggggccccu

SEQ ID NO: 1029074 - RNA, 17 nt, Homo sapiens
cucccuaggcugcccac

SEQ ID NO: 1029075 - RNA, 16 nt, Homo sapiens
cucccucaaagcacac

SEQ ID NO: 1029076 - RNA, 20 nt, Homo sapiens
cucccucaaagcacacguca

SEQ ID NO: 1029077 - RNA, 15 nt, Homo sapiens
cucccucacccugag

SEQ ID NO: 1029078 - RNA, 15 nt, Homo sapiens
cucccucauuccacc

SEQ ID NO: 1029079 - RNA, 19 nt, Homo sapiens
cucccucuuggucuuccca

SEQ ID NO: 1029080 - RNA, 18 nt, Homo sapiens
cucccugaagaccaaaau

SEQ ID NO: 1029081 - RNA, 21 nt, Homo sapiens
cucccuggccuguucuguuuu

SEQ ID NO: 1029082 - RNA, 21 nt, Homo sapiens
cucccuuagcucccuguucuu

SEQ ID NO: 1029083 - RNA, 17 nt, Homo sapiens
cucccuucucuaccuca

SEQ ID NO: 1029084 - RNA, 13 nt, Homo sapiens
cucuuuaccuccu

SEQ ID NO: 1029085 - RNA, 19 nt, Homo sapiens
cucuuuauuuuuugauuga

SEQ ID NO: 1029086 - RNA, 15 nt, Homo sapiens
cucuuucaaagcuaa

SEQ ID NO: 1029087 - RNA, 13 nt, Homo sapiens
cucuuucuugacu

SEQ ID NO: 1029088 - RNA, 18 nt, Homo sapiens
cucuuuugaauccaugcu

SEQ ID NO: 1029089 - RNA, 15 nt, Homo sapiens
cugaaaaaaugccaa

SEQ ID NO: 1029090 - RNA, 23 nt, Homo sapiens
cugaaaaaugguaauuguugcua

SEQ ID NO: 1029091 - RNA, 15 nt, Homo sapiens
cugaaaacaagccau

SEQ ID NO: 1029092 - RNA, 19 nt, Homo sapiens
cugaaaagacucaguguuc

SEQ ID NO: 1029093 - RNA, 14 nt, Homo sapiens
cugaaagaagacau

SEQ ID NO: 1029094 - RNA, 18 nt, Homo sapiens
cugaaagaggaaugaagu

SEQ ID NO: 1029095 - RNA, 16 nt, Homo sapiens
cugaaauaacauggcc

SEQ ID NO: 1029096 - RNA, 17 nt, Homo sapiens
cugaaauaacauggccu

SEQ ID NO: 1029097 - RNA, 18 nt, Homo sapiens
cugaaauaacauggccuu

SEQ ID NO: 1029098 - RNA, 19 nt, Homo sapiens
cugaaaugcuagcugcaag

SEQ ID NO: 1029099 - RNA, 22 nt, Homo sapiens
cugaaauuauuuuuaaggauaa

SEQ ID NO: 1029100 - RNA, 22 nt, Homo sapiens
cugaacaaaauguaaagccagc

SEQ ID NO: 1029101 - RNA, 19 nt, Homo sapiens
cugaacaaucaaagcacuu

SEQ ID NO: 1029102 - RNA, 13 nt, Homo sapiens
cugaacacuccaa

SEQ ID NO: 1029103 - RNA, 13 nt, Homo sapiens
cugaacacuguga

SEQ ID NO: 1029104 - RNA, 14 nt, Homo sapiens
cugaacauugcaua

SEQ ID NO: 1029105 - RNA, 13 nt, Homo sapiens
cugaacccugugc

SEQ ID NO: 1029106 - RNA, 16 nt, Homo sapiens
cugaaccuuccaucuc

SEQ ID NO: 1029107 - RNA, 14 nt, Homo sapiens
cugaagauggcauc

SEQ ID NO: 1029108 - RNA, 16 nt, Homo sapiens
cugaagccucacuuau

SEQ ID NO: 1029109 - RNA, 15 nt, Homo sapiens
cugaagcugccugcu

SEQ ID NO: 1029110 - RNA, 20 nt, Homo sapiens
cugaagggcaucaugcaucu

SEQ ID NO: 1029111 - RNA, 17 nt, Homo sapiens
cugaaggggaggucaca

SEQ ID NO: 1029112 - RNA, 15 nt, Homo sapiens
cugaaggucccaccu

SEQ ID NO: 1029113 - RNA, 18 nt, Homo sapiens
cugaaguagugugcaguu

SEQ ID NO: 1029114 - RNA, 18 nt, Homo sapiens
cugaagugcauccaaagg

SEQ ID NO: 1029115 - RNA, 20 nt, Homo sapiens
cugaauacauucugcuuuca

SEQ ID NO: 1029116 - RNA, 16 nt, Homo sapiens
cugaaucacaauguaa

SEQ ID NO: 1029117 - RNA, 23 nt, Homo sapiens
cugaauccaaacuaauccaucac

SEQ ID NO: 1029118 - RNA, 12 nt, Homo sapiens
cugaauccucau

SEQ ID NO: 1029119 - RNA, 20 nt, Homo sapiens
cugaaucuucaagaccaaag

SEQ ID NO: 1029120 - RNA, 17 nt, Homo sapiens
cugaaugcugcuacuua

SEQ ID NO: 1029121 - RNA, 18 nt, Homo sapiens
cugaaugcugcuacuuaa

SEQ ID NO: 1029122 - RNA, 15 nt, Homo sapiens
cugaauuacucucca

SEQ ID NO: 1029123 - RNA, 20 nt, Homo sapiens
cugaauuuggccugcacuaa

SEQ ID NO: 1029124 - RNA, 22 nt, Homo sapiens
cugaauuuuuaaaacccauuua

SEQ ID NO: 1029125 - RNA, 14 nt, Homo sapiens
cugacaagcacugc

SEQ ID NO: 1029126 - RNA, 17 nt, Homo sapiens
cugacaugcacaccucc

SEQ ID NO: 1029127 - RNA, 18 nt, Homo sapiens
cugacauucacacagaga

SEQ ID NO: 1029128 - RNA, 15 nt, Homo sapiens
cugaccaauauugua

SEQ ID NO: 1029129 - RNA, 21 nt, Homo sapiens
cugaccacgugcuacccccau

SEQ ID NO: 1029130 - RNA, 21 nt, Homo sapiens
cugacccaugcugcccuguga

SEQ ID NO: 1029131 - RNA, 16 nt, Homo sapiens
cugaccgugggcgggg

SEQ ID NO: 1029132 - RNA, 19 nt, Homo sapiens
cugaccucaggugauccac

SEQ ID NO: 1029133 - RNA, 23 nt, Homo sapiens
cugaccucgugauccaccugccu

SEQ ID NO: 1029134 - RNA, 17 nt, Homo sapiens
cggcaacggcaaccccc

SEQ ID NO: 1029135 - RNA, 18 nt, Homo sapiens
cggcacccugauccucac

SEQ ID NO: 1029136 - RNA, 19 nt, Homo sapiens
cggcacccugauccucacc

SEQ ID NO: 1029137 - RNA, 13 nt, Homo sapiens
cggccaaccuccc

SEQ ID NO: 1029138 - RNA, 15 nt, Homo sapiens
cggccagaagaucua

SEQ ID NO: 1029139 - RNA, 18 nt, Homo sapiens
cggccuccugucccucau

SEQ ID NO: 1029140 - RNA, 14 nt, Homo sapiens
cggcucauugaacc

SEQ ID NO: 1029141 - RNA, 17 nt, Homo sapiens
cgggaacaaaaugaugu

SEQ ID NO: 1029142 - RNA, 22 nt, Homo sapiens
cgggaauacuagggagaagguu

SEQ ID NO: 1029143 - RNA, 15 nt, Homo sapiens
cgggaggcugagaca

SEQ ID NO: 1029144 - RNA, 21 nt, Homo sapiens
cgggcaaaauaaagugacaga

SEQ ID NO: 1029145 - RNA, 14 nt, Homo sapiens
cggggcacugcagg

SEQ ID NO: 1029146 - RNA, 15 nt, Homo sapiens
cggggcuccacugaa

SEQ ID NO: 1029147 - RNA, 18 nt, Homo sapiens
cgggggaccccuuugccc

SEQ ID NO: 1029148 - RNA, 19 nt, Homo sapiens
cggguguguacaccaaggu

SEQ ID NO: 1029149 - RNA, 21 nt, Homo sapiens
cgguaagcacuuaaugaauga

SEQ ID NO: 1029150 - RNA, 19 nt, Homo sapiens
cggucaauccuguggguga

SEQ ID NO: 1029151 - RNA, 14 nt, Homo sapiens
cggucccacacugg

SEQ ID NO: 1029152 - RNA, 17 nt, Homo sapiens
cggucccacacugguga

SEQ ID NO: 1029153 - RNA, 16 nt, Homo sapiens
cgguggacccagggau

SEQ ID NO: 1029154 - RNA, 13 nt, Homo sapiens
cgguucaccagcc

SEQ ID NO: 1029155 - RNA, 16 nt, Homo sapiens
cgguucaccagccucu

SEQ ID NO: 1029156 - RNA, 15 nt, Homo sapiens
cguaacaacuguggu

SEQ ID NO: 1029157 - RNA, 14 nt, Homo sapiens
cguaauuuugccaa

SEQ ID NO: 1029158 - RNA, 14 nt, Homo sapiens
cguacaguucuucg

SEQ ID NO: 1029159 - RNA, 12 nt, Homo sapiens
cguacauucaau

SEQ ID NO: 1029160 - RNA, 13 nt, Homo sapiens
cguagccaucucu

SEQ ID NO: 1029161 - RNA, 17 nt, Homo sapiens
cguaucuuuccuaggca

SEQ ID NO: 1029162 - RNA, 22 nt, Homo sapiens
cguauuuuuucuaaugugcauu

SEQ ID NO: 1029163 - RNA, 20 nt, Homo sapiens
cgucaguccaagucuucuca

SEQ ID NO: 1029164 - RNA, 13 nt, Homo sapiens
cguccacagggca

SEQ ID NO: 1029165 - RNA, 20 nt, Homo sapiens
cguccgcgcgccagcacaga

SEQ ID NO: 1029166 - RNA, 21 nt, Homo sapiens
cguccgcgcgccagcacagaa

SEQ ID NO: 1029167 - RNA, 17 nt, Homo sapiens
cgucuccgaagauuugg

SEQ ID NO: 1029168 - RNA, 15 nt, Homo sapiens
cgucugggcucccug

SEQ ID NO: 1029169 - RNA, 19 nt, Homo sapiens
cgucuucuguauacugugg

SEQ ID NO: 1029170 - RNA, 16 nt, Homo sapiens
cgugaaaaugcuguau

SEQ ID NO: 1029171 - RNA, 21 nt, Homo sapiens
cgugaagggauuuuagucaca

SEQ ID NO: 1029172 - RNA, 23 nt, Homo sapiens
cgugaccugccaggcacacugag

SEQ ID NO: 1029173 - RNA, 15 nt, Homo sapiens
cgugacuguggcaca

SEQ ID NO: 1029174 - RNA, 19 nt, Homo sapiens
cgugcacugagagugaagu

SEQ ID NO: 1029175 - RNA, 19 nt, Homo sapiens
cgugcugcaugccuggucu

SEQ ID NO: 1029176 - RNA, 18 nt, Homo sapiens
cgugcuuguuugcucacc

SEQ ID NO: 1029177 - RNA, 14 nt, Homo sapiens
cguggacucugcac

SEQ ID NO: 1029178 - RNA, 14 nt, Homo sapiens
cguggagacagggc

SEQ ID NO: 1029179 - RNA, 18 nt, Homo sapiens
cguggccccaaauuugcu

SEQ ID NO: 1029180 - RNA, 15 nt, Homo sapiens
cgugguggcacacac

SEQ ID NO: 1029181 - RNA, 14 nt, Homo sapiens
cguguguccaugug

SEQ ID NO: 1029182 - RNA, 23 nt, Homo sapiens
cguguucugucugugucuucagg

SEQ ID NO: 1029183 - RNA, 23 nt, Homo sapiens
cguuaguguauuuuauguguggc

SEQ ID NO: 1029184 - RNA, 13 nt, Homo sapiens
cguucaccaguug

SEQ ID NO: 1029185 - RNA, 13 nt, Homo sapiens
cguucacucccaa

SEQ ID NO: 1029186 - RNA, 12 nt, Homo sapiens
cguuuaaucaca

SEQ ID NO: 1029187 - RNA, 13 nt, Homo sapiens
cguuuaaucacau

SEQ ID NO: 1029188 - RNA, 19 nt, Homo sapiens
cguuucaaaaacacagugu

SEQ ID NO: 1029189 - RNA, 23 nt, Homo sapiens
cguuuccugagaagugucuaaaa

SEQ ID NO: 1029190 - RNA, 14 nt, Homo sapiens
cguuugaaucacag

SEQ ID NO: 1029191 - RNA, 17 nt, Homo sapiens
cguuuggaacaaucuaa

SEQ ID NO: 1029192 - RNA, 14 nt, Homo sapiens
cuaaaaaacagagg

SEQ ID NO: 1029193 - RNA, 22 nt, Homo sapiens
cuaaaaaacagaggccauggca

SEQ ID NO: 1029194 - RNA, 17 nt, Homo sapiens
cuaaaaauaaaaaagcc

SEQ ID NO: 1029195 - RNA, 14 nt, Homo sapiens
cuaaaaauacaauu

SEQ ID NO: 1029196 - RNA, 14 nt, Homo sapiens
cuaaaacuuaacau

SEQ ID NO: 1029197 - RNA, 17 nt, Homo sapiens
cuaaaaggaaaucucac

SEQ ID NO: 1029198 - RNA, 23 nt, Homo sapiens
cuaaaauaagggcagagucacac

SEQ ID NO: 1029199 - RNA, 16 nt, Homo sapiens
cuaaaaugaguuaccu

SEQ ID NO: 1029200 - RNA, 13 nt, Homo sapiens
cuaaaauuccacu

SEQ ID NO: 1029201 - RNA, 17 nt, Homo sapiens
cuaaacaacuaccuccu

SEQ ID NO: 1029202 - RNA, 23 nt, Homo sapiens
cuaaacaagaaucagucuaucca

SEQ ID NO: 1029203 - RNA, 18 nt, Homo sapiens
cuaaacuuucacacccca

SEQ ID NO: 1029204 - RNA, 15 nt, Homo sapiens
cuaaagaagguuuca

SEQ ID NO: 1029205 - RNA, 21 nt, Homo sapiens
cuaaaguguauuuuuuuacua

SEQ ID NO: 1029206 - RNA, 14 nt, Homo sapiens
cuaaauaggagaua

SEQ ID NO: 1029207 - RNA, 18 nt, Homo sapiens
cuaaaucugccuuuucau

SEQ ID NO: 1029208 - RNA, 20 nt, Homo sapiens
cuaaaucuuaagaacuuuaa

SEQ ID NO: 1029209 - RNA, 18 nt, Homo sapiens
cuaaaugaguaaacccag

SEQ ID NO: 1029210 - RNA, 22 nt, Homo sapiens
cuaaaugugaaugaugauccua

SEQ ID NO: 1029211 - RNA, 15 nt, Homo sapiens
cuaaauuugguucua

SEQ ID NO: 1029212 - RNA, 22 nt, Homo sapiens
cuaacaaugacauuuauaucac

SEQ ID NO: 1029213 - RNA, 13 nt, Homo sapiens
cuaacaauuguga

SEQ ID NO: 1029214 - RNA, 18 nt, Homo sapiens
cuaacgaccacagggucu

SEQ ID NO: 1029215 - RNA, 13 nt, Homo sapiens
cuaacuagcuugg

SEQ ID NO: 1029216 - RNA, 19 nt, Homo sapiens
cuaacuauauuugcuuuuu

SEQ ID NO: 1029217 - RNA, 15 nt, Homo sapiens
cuaacuccagugaag

SEQ ID NO: 1029218 - RNA, 17 nt, Homo sapiens
cuaagaaauaaaacugu

SEQ ID NO: 1029219 - RNA, 14 nt, Homo sapiens
cuaagauggcuuuu

SEQ ID NO: 1029220 - RNA, 20 nt, Homo sapiens
cuaagccacauggcugggau

SEQ ID NO: 1029221 - RNA, 12 nt, Homo sapiens
cuaagccuccuu

SEQ ID NO: 1029222 - RNA, 21 nt, Homo sapiens
cuaaggaaaggaauuggcaug

SEQ ID NO: 1029223 - RNA, 19 nt, Homo sapiens
cuaaggaauaugagcuuua

SEQ ID NO: 1029224 - RNA, 14 nt, Homo sapiens
cuaaggaucucuca

SEQ ID NO: 1029225 - RNA, 21 nt, Homo sapiens
cuaaggaugucacagggccaa

SEQ ID NO: 1029226 - RNA, 16 nt, Homo sapiens
cuaagggcccaaaggc

SEQ ID NO: 1029227 - RNA, 22 nt, Homo sapiens
cuaaggucauuaccacaggcca

SEQ ID NO: 1029228 - RNA, 14 nt, Homo sapiens
cuaaggugugcucu

SEQ ID NO: 1029229 - RNA, 18 nt, Homo sapiens
cuaaguggaauagccucc

SEQ ID NO: 1029230 - RNA, 20 nt, Homo sapiens
cuaauaaaaaacaccuucua

SEQ ID NO: 1029231 - RNA, 16 nt, Homo sapiens
cuaauacaacauguag

SEQ ID NO: 1029232 - RNA, 15 nt, Homo sapiens
cuaaugucagaguag

SEQ ID NO: 1029233 - RNA, 13 nt, Homo sapiens
cuaaugugcauua

SEQ ID NO: 1029234 - RNA, 19 nt, Homo sapiens
cuaaugugguuauuucucu

SEQ ID NO: 1029235 - RNA, 19 nt, Homo sapiens
cuaauuggaagaaauuccu

SEQ ID NO: 1029236 - RNA, 18 nt, Homo sapiens
cuaauuggccucuuuaag

SEQ ID NO: 1029237 - RNA, 23 nt, Homo sapiens
cuaauugucuuuguucugugauu

SEQ ID NO: 1029238 - RNA, 21 nt, Homo sapiens
cuaauuuccucugacauguaa

SEQ ID NO: 1029239 - RNA, 20 nt, Homo sapiens
cuaauuuucuagauuuucua

SEQ ID NO: 1029240 - RNA, 21 nt, Homo sapiens
cuaauuuuucagcuccuucaa

SEQ ID NO: 1029241 - RNA, 15 nt, Homo sapiens
cuaauuuuugcaaau

SEQ ID NO: 1029242 - RNA, 23 nt, Homo sapiens
cuacaaacucccacuugucaugu

SEQ ID NO: 1029243 - RNA, 17 nt, Homo sapiens
agcacguguggccuguu

SEQ ID NO: 1029244 - RNA, 15 nt, Homo sapiens
agcacuaaagcagug

SEQ ID NO: 1029245 - RNA, 23 nt, Homo sapiens
agcacuacauaaacugacuuuau

SEQ ID NO: 1029246 - RNA, 17 nt, Homo sapiens
agcacuccucaucauca

SEQ ID NO: 1029247 - RNA, 19 nt, Homo sapiens
agcacugagcaaagcauug

SEQ ID NO: 1029248 - RNA, 20 nt, Homo sapiens
agcacugagcaaagcauuga

SEQ ID NO: 1029249 - RNA, 18 nt, Homo sapiens
agcacugccucccuuaau

SEQ ID NO: 1029250 - RNA, 12 nt, Homo sapiens
agcacuggguug

SEQ ID NO: 1029251 - RNA, 17 nt, Homo sapiens
agcacugucucaguuuc

SEQ ID NO: 1029252 - RNA, 15 nt, Homo sapiens
agcacuguuccagcc

SEQ ID NO: 1029253 - RNA, 22 nt, Homo sapiens
agcacuugcaaccgucuguuau

SEQ ID NO: 1029254 - RNA, 20 nt, Homo sapiens
agcacuuuggacauggcuca

SEQ ID NO: 1029255 - RNA, 13 nt, Homo sapiens
agcagaaaugccu

SEQ ID NO: 1029256 - RNA, 14 nt, Homo sapiens
agcagaacagugau

SEQ ID NO: 1029257 - RNA, 14 nt, Homo sapiens
agcagaacuuucac

SEQ ID NO: 1029258 - RNA, 16 nt, Homo sapiens
agcagccaagggauga

SEQ ID NO: 1029259 - RNA, 16 nt, Homo sapiens
agcagccacaaccaaa

SEQ ID NO: 1029260 - RNA, 18 nt, Homo sapiens
agcagccacaaccaaaaa

SEQ ID NO: 1029261 - RNA, 21 nt, Homo sapiens
agcagccucagaacaaaguga

SEQ ID NO: 1029262 - RNA, 15 nt, Homo sapiens
agcagcuaucucuca

SEQ ID NO: 1029263 - RNA, 22 nt, Homo sapiens
agcagcucaaaggcacagugaa

SEQ ID NO: 1029264 - RNA, 13 nt, Homo sapiens
agcagcucuguga

SEQ ID NO: 1029265 - RNA, 15 nt, Homo sapiens
agcaggacauggaca

SEQ ID NO: 1029266 - RNA, 14 nt, Homo sapiens
agcaggagaaucac

SEQ ID NO: 1029267 - RNA, 17 nt, Homo sapiens
agcaggagggacaauga

SEQ ID NO: 1029268 - RNA, 16 nt, Homo sapiens
agcaggcuacacugac

SEQ ID NO: 1029269 - RNA, 16 nt, Homo sapiens
agcaggcuacugucag

SEQ ID NO: 1029270 - RNA, 14 nt, Homo sapiens
agcagggacuugaa

SEQ ID NO: 1029271 - RNA, 15 nt, Homo sapiens
agcagggacuugaac

SEQ ID NO: 1029272 - RNA, 14 nt, Homo sapiens
agcagggcucugcc

SEQ ID NO: 1029273 - RNA, 22 nt, Homo sapiens
agcagggucuuuucaucuggga

SEQ ID NO: 1029274 - RNA, 14 nt, Homo sapiens
agcagguggcagaa

SEQ ID NO: 1029275 - RNA, 13 nt, Homo sapiens
agcagugccagcu

SEQ ID NO: 1029276 - RNA, 23 nt, Homo sapiens
agcaguuacaaaaaccuucccca

SEQ ID NO: 1029277 - RNA, 13 nt, Homo sapiens
agcaguuuuguga

SEQ ID NO: 1029278 - RNA, 13 nt, Homo sapiens
agcauacuuuaua

SEQ ID NO: 1029279 - RNA, 13 nt, Homo sapiens
agcauaguggcaa

SEQ ID NO: 1029280 - RNA, 16 nt, Homo sapiens
agcaucaccucaggcc

SEQ ID NO: 1029281 - RNA, 17 nt, Homo sapiens
agcaucaccucaggcca

SEQ ID NO: 1029282 - RNA, 18 nt, Homo sapiens
agcauccucucucacaug

SEQ ID NO: 1029283 - RNA, 22 nt, Homo sapiens
agcaucucccaguucauaauca

SEQ ID NO: 1029284 - RNA, 19 nt, Homo sapiens
agcaucugacucacaagaa

SEQ ID NO: 1029285 - RNA, 16 nt, Homo sapiens
agcaugaauccagucc

SEQ ID NO: 1029286 - RNA, 22 nt, Homo sapiens
agcaugauaggauuuggggcag

SEQ ID NO: 1029287 - RNA, 15 nt, Homo sapiens
agcaugggaagugac

SEQ ID NO: 1029288 - RNA, 20 nt, Homo sapiens
agcaugucucaauaguaaaa

SEQ ID NO: 1029289 - RNA, 15 nt, Homo sapiens
agcauguguauuucc

SEQ ID NO: 1029290 - RNA, 22 nt, Homo sapiens
agcauguguauuuccagugcaa

SEQ ID NO: 1029291 - RNA, 16 nt, Homo sapiens
agcauuaagaacacuu

SEQ ID NO: 1029292 - RNA, 23 nt, Homo sapiens
agcauuccuucuuugauaauguu

SEQ ID NO: 1029293 - RNA, 17 nt, Homo sapiens
agcauuuagacccugca

SEQ ID NO: 1029294 - RNA, 16 nt, Homo sapiens
agcauuuagcacauac

SEQ ID NO: 1029295 - RNA, 18 nt, Homo sapiens
agcauuuagcacauacua

SEQ ID NO: 1029296 - RNA, 18 nt, Homo sapiens
agcauuuccaacaccaca

SEQ ID NO: 1029297 - RNA, 19 nt, Homo sapiens
accucggccucccaaagug

SEQ ID NO: 1029298 - RNA, 22 nt, Homo sapiens
accucggcucacugcagccucc

SEQ ID NO: 1029299 - RNA, 21 nt, Homo sapiens
accucggugggcccagugggg

SEQ ID NO: 1029300 - RNA, 19 nt, Homo sapiens
accucgugauccaccugcc

SEQ ID NO: 1029301 - RNA, 20 nt, Homo sapiens
accucgugauccaccugccu

SEQ ID NO: 1029302 - RNA, 19 nt, Homo sapiens
accucuaacaucagaacau

SEQ ID NO: 1029303 - RNA, 13 nt, Homo sapiens
accucucugggcc

SEQ ID NO: 1029304 - RNA, 18 nt, Homo sapiens
accucuguuguccucccc

SEQ ID NO: 1029305 - RNA, 18 nt, Homo sapiens
accucuucucuuccugua

SEQ ID NO: 1029306 - RNA, 19 nt, Homo sapiens
accucuucucuuccuguaa

SEQ ID NO: 1029307 - RNA, 18 nt, Homo sapiens
accugaaaaaaugccaag

SEQ ID NO: 1029308 - RNA, 19 nt, Homo sapiens
accugaaaacacugugcac

SEQ ID NO: 1029309 - RNA, 13 nt, Homo sapiens
accugagaaccuu

SEQ ID NO: 1029310 - RNA, 20 nt, Homo sapiens
accugaggcuccugugcuac

SEQ ID NO: 1029311 - RNA, 17 nt, Homo sapiens
accugaugcagagccuu

SEQ ID NO: 1029312 - RNA, 21 nt, Homo sapiens
accugcacuuauacccaugaa

SEQ ID NO: 1029313 - RNA, 14 nt, Homo sapiens
accugccacucaca

SEQ ID NO: 1029314 - RNA, 13 nt, Homo sapiens
accugcccugaca

SEQ ID NO: 1029315 - RNA, 19 nt, Homo sapiens
accugcccugacaugcaca

SEQ ID NO: 1029316 - RNA, 19 nt, Homo sapiens
accugccucccuucaugca

SEQ ID NO: 1029317 - RNA, 20 nt, Homo sapiens
accugccugcaucugugaaa

SEQ ID NO: 1029318 - RNA, 17 nt, Homo sapiens
accugcggcugcugugu

SEQ ID NO: 1029319 - RNA, 19 nt, Homo sapiens
accugcugagggaccagcc

SEQ ID NO: 1029320 - RNA, 19 nt, Homo sapiens
accugcuuuacuuugccca

SEQ ID NO: 1029321 - RNA, 22 nt, Homo sapiens
accuggagaacuagaaccugga

SEQ ID NO: 1029322 - RNA, 22 nt, Homo sapiens
accuggagagcuagaaccuaga

SEQ ID NO: 1029323 - RNA, 22 nt, Homo sapiens
accuggaugaucacuaauacua

SEQ ID NO: 1029324 - RNA, 18 nt, Homo sapiens
accuggccucugcacucc

SEQ ID NO: 1029325 - RNA, 13 nt, Homo sapiens
accuguccuugca

SEQ ID NO: 1029326 - RNA, 19 nt, Homo sapiens
accuguccuugcacacucc

SEQ ID NO: 1029327 - RNA, 19 nt, Homo sapiens
accugucuucaacagcucc

SEQ ID NO: 1029328 - RNA, 22 nt, Homo sapiens
accugugacuaaacaacuaccu

SEQ ID NO: 1029329 - RNA, 11 nt, Homo sapiens
accugugauga

SEQ ID NO: 1029330 - RNA, 13 nt, Homo sapiens
accuguuacuuga

SEQ ID NO: 1029331 - RNA, 20 nt, Homo sapiens
accuguugagacugauucag

SEQ ID NO: 1029332 - RNA, 21 nt, Homo sapiens
accuguugauagcaagugaau

SEQ ID NO: 1029333 - RNA, 19 nt, Homo sapiens
accuguuuucgcaccuacc

SEQ ID NO: 1029334 - RNA, 22 nt, Homo sapiens
accuguuuucgcaccuaccauc

SEQ ID NO: 1029335 - RNA, 14 nt, Homo sapiens
accuuaaaauguaa

SEQ ID NO: 1029336 - RNA, 18 nt, Homo sapiens
accuuaccaacuuucugu

SEQ ID NO: 1029337 - RNA, 21 nt, Homo sapiens
accuuauaguguuaauaucuu

SEQ ID NO: 1029338 - RNA, 22 nt, Homo sapiens
accuucaauaaaguaucuacau

SEQ ID NO: 1029339 - RNA, 19 nt, Homo sapiens
accuucagauuuguguuau

SEQ ID NO: 1029340 - RNA, 14 nt, Homo sapiens
accuucagugaaag

SEQ ID NO: 1029341 - RNA, 16 nt, Homo sapiens
accuucccaugcccug

SEQ ID NO: 1029342 - RNA, 14 nt, Homo sapiens
accuucuaccucuu

SEQ ID NO: 1029343 - RNA, 15 nt, Homo sapiens
accuugagacagcuu

SEQ ID NO: 1029344 - RNA, 18 nt, Homo sapiens
accuugaugugccuguga

SEQ ID NO: 1029345 - RNA, 20 nt, Homo sapiens
accuugcacaaacagccccu

SEQ ID NO: 1029346 - RNA, 14 nt, Homo sapiens
accuugcacagguc

SEQ ID NO: 1029347 - RNA, 16 nt, Homo sapiens
accuugucgacaaaga

SEQ ID NO: 1029348 - RNA, 22 nt, Homo sapiens
accuugucucccagcucagggc

SEQ ID NO: 1029349 - RNA, 16 nt, Homo sapiens
accuugugacccagca

SEQ ID NO: 1029350 - RNA, 17 nt, Homo sapiens
accuuucaaauuucaca

SEQ ID NO: 1029351 - RNA, 21 nt, Homo sapiens
accuuucagauaacuguuauu

SEQ ID NO: 1029352 - RNA, 14 nt, Homo sapiens
accuuuccauuuau

SEQ ID NO: 1029353 - RNA, 20 nt, Homo sapiens
accuuugcacgaacaccaag

SEQ ID NO: 1029354 - RNA, 20 nt, Homo sapiens
accuuugcaggcaugcaugu

SEQ ID NO: 1029355 - RNA, 17 nt, Homo sapiens
accuuuggaugcacuuu

SEQ ID NO: 1029356 - RNA, 19 nt, Homo sapiens
accuuuggaugcacuuuau

SEQ ID NO: 1029357 - RNA, 17 nt, Homo sapiens
accuuuugcaccugcuc

SEQ ID NO: 1029358 - RNA, 17 nt, Homo sapiens
accuuuuuuaagauuuu

SEQ ID NO: 1029359 - RNA, 18 nt, Homo sapiens
accuuuuuuauacauaaa

SEQ ID NO: 1029360 - RNA, 12 nt, Homo sapiens
acgaaugaauga

SEQ ID NO: 1029361 - RNA, 20 nt, Homo sapiens
acgaccacagggucugcacu

SEQ ID NO: 1029362 - RNA, 12 nt, Homo sapiens
acgagacuccac

SEQ ID NO: 1029363 - RNA, 22 nt, Homo sapiens
acgagcaggcuacugucagcuc

SEQ ID NO: 1029364 - RNA, 12 nt, Homo sapiens
acgagcagggau

SEQ ID NO: 1029365 - RNA, 18 nt, Homo sapiens
acgaguggaccauuauca

SEQ ID NO: 1029366 - RNA, 19 nt, Homo sapiens
accaccucccucaccaaca

SEQ ID NO: 1029367 - RNA, 17 nt, Homo sapiens
accacuagaacucucca

SEQ ID NO: 1029368 - RNA, 17 nt, Homo sapiens
accacugacuacuggcu

SEQ ID NO: 1029369 - RNA, 19 nt, Homo sapiens
accacuggccaccaggcug

SEQ ID NO: 1029370 - RNA, 16 nt, Homo sapiens
accacuguguauuuaa

SEQ ID NO: 1029371 - RNA, 15 nt, Homo sapiens
accagaagccaaaga

SEQ ID NO: 1029372 - RNA, 22 nt, Homo sapiens
accagacagacaacacugggaa

SEQ ID NO: 1029373 - RNA, 22 nt, Homo sapiens
accagagaagggcuuggacuca

SEQ ID NO: 1029374 - RNA, 13 nt, Homo sapiens
accagagcucaga

SEQ ID NO: 1029375 - RNA, 13 nt, Homo sapiens
accagaggacaaa

SEQ ID NO: 1029376 - RNA, 16 nt, Homo sapiens
accagaggucaggugu

SEQ ID NO: 1029377 - RNA, 14 nt, Homo sapiens
accagcaaagcaau

SEQ ID NO: 1029378 - RNA, 19 nt, Homo sapiens
accagcagaucccagcuca

SEQ ID NO: 1029379 - RNA, 18 nt, Homo sapiens
accagcagcccaagggcu

SEQ ID NO: 1029380 - RNA, 19 nt, Homo sapiens
accagcaucccuugaccag

SEQ ID NO: 1029381 - RNA, 22 nt, Homo sapiens
accagccugcacuacucccuca

SEQ ID NO: 1029382 - RNA, 23 nt, Homo sapiens
accagccugcacuacucccucaa

SEQ ID NO: 1029383 - RNA, 16 nt, Homo sapiens
accaggacuauagccc

SEQ ID NO: 1029384 - RNA, 19 nt, Homo sapiens
accaggcugcucagggcug

SEQ ID NO: 1029385 - RNA, 22 nt, Homo sapiens
accaggcuggccagcaugguga

SEQ ID NO: 1029386 - RNA, 19 nt, Homo sapiens
accaggcugugggccucaa

SEQ ID NO: 1029387 - RNA, 17 nt, Homo sapiens
accagugaaccaaagag

SEQ ID NO: 1029388 - RNA, 20 nt, Homo sapiens
accaguguccccuccacugu

SEQ ID NO: 1029389 - RNA, 13 nt, Homo sapiens
accaguugccguu

SEQ ID NO: 1029390 - RNA, 17 nt, Homo sapiens
accaguugggagcacug

SEQ ID NO: 1029391 - RNA, 22 nt, Homo sapiens
accaguuuaaccugaugcaguc

SEQ ID NO: 1029392 - RNA, 16 nt, Homo sapiens
accauaacaacuucau

SEQ ID NO: 1029393 - RNA, 14 nt, Homo sapiens
accauaauguuaca

SEQ ID NO: 1029394 - RNA, 15 nt, Homo sapiens
accauacacacuguu

SEQ ID NO: 1029395 - RNA, 14 nt, Homo sapiens
accauacugaggga

SEQ ID NO: 1029396 - RNA, 15 nt, Homo sapiens
accaucauaguacag

SEQ ID NO: 1029397 - RNA, 22 nt, Homo sapiens
accaucauuauaaacgugauga

SEQ ID NO: 1029398 - RNA, 15 nt, Homo sapiens
accauccauguauuu

SEQ ID NO: 1029399 - RNA, 12 nt, Homo sapiens
accaucccugaa

SEQ ID NO: 1029400 - RNA, 12 nt, Homo sapiens
accaucucaggc

SEQ ID NO: 1029401 - RNA, 17 nt, Homo sapiens
accaucucuuuaccucc

SEQ ID NO: 1029402 - RNA, 20 nt, Homo sapiens
accaucucuuuaccuccuaa

SEQ ID NO: 1029403 - RNA, 23 nt, Homo sapiens
accaucugugcacgcaguggccu

SEQ ID NO: 1029404 - RNA, 16 nt, Homo sapiens
accaugaaauauccag

SEQ ID NO: 1029405 - RNA, 19 nt, Homo sapiens
accaugagaccacuguuau

SEQ ID NO: 1029406 - RNA, 23 nt, Homo sapiens
accaugauuaaccacuucagcug

SEQ ID NO: 1029407 - RNA, 24 nt, Homo sapiens
accaugauuaaccacuucagcuga

SEQ ID NO: 1029408 - RNA, 20 nt, Homo sapiens
accaugcagugccccuagcu

SEQ ID NO: 1029409 - RNA, 22 nt, Homo sapiens
accauggugaauuaaucacuuu

SEQ ID NO: 1029410 - RNA, 16 nt, Homo sapiens
accauguacauagcuu

SEQ ID NO: 1029411 - RNA, 18 nt, Homo sapiens
accauucaggacacaggg

SEQ ID NO: 1029412 - RNA, 22 nt, Homo sapiens
accauucuccaccugccaggga

SEQ ID NO: 1029413 - RNA, 14 nt, Homo sapiens
accauuucagagag

SEQ ID NO: 1029414 - RNA, 14 nt, Homo sapiens
acccaaaagcucag

SEQ ID NO: 1029415 - RNA, 22 nt, Homo sapiens
acccaagcaaaaucauggaaug

SEQ ID NO: 1029416 - RNA, 14 nt, Homo sapiens
acccaaugauucag

SEQ ID NO: 1029417 - RNA, 17 nt, Homo sapiens
acccacaaaaguacaau

SEQ ID NO: 1029418 - RNA, 20 nt, Homo sapiens
acccacaguggaaagacagc

SEQ ID NO: 1029419 - RNA, 12 nt, Homo sapiens
acccacccagga

SEQ ID NO: 1029420 - RNA, 21 nt, Homo sapiens
acccacuucuaaauagcaauu

SEQ ID NO: 1029421 - RNA, 15 nt, Homo sapiens
acccagaaaucauuu

SEQ ID NO: 1029422 - RNA, 19 nt, Homo sapiens
acccagaaaucauuuuacc

SEQ ID NO: 1029423 - RNA, 17 nt, Homo sapiens
acccagcacugcccaaa

SEQ ID NO: 1029424 - RNA, 20 nt, Homo sapiens
acccaggcuggagugcaaug

SEQ ID NO: 1029425 - RNA, 20 nt, Homo sapiens
acccaggcuggagugcagug

SEQ ID NO: 1029426 - RNA, 21 nt, Homo sapiens
acccaggucuugacaccagcu

SEQ ID NO: 1029427 - RNA, 15 nt, Homo sapiens
acccaguccugcaca

SEQ ID NO: 1029428 - RNA, 12 nt, Homo sapiens
acccaucugcac

SEQ ID NO: 1029429 - RNA, 16 nt, Homo sapiens
acccaugaaucaaaga

SEQ ID NO: 1029430 - RNA, 17 nt, Homo sapiens
acccaugaaucaaagac

SEQ ID NO: 1029431 - RNA, 15 nt, Homo sapiens
acccaugacuuuaua

SEQ ID NO: 1029432 - RNA, 18 nt, Homo sapiens
acccaugagauucauuca

SEQ ID NO: 1029433 - RNA, 18 nt, Homo sapiens
acccaugggaagggucca

SEQ ID NO: 1029434 - RNA, 17 nt, Homo sapiens
acccaugggcucugaca

SEQ ID NO: 1029435 - RNA, 20 nt, Homo sapiens
acccauucguggugaucaau

SEQ ID NO: 1029436 - RNA, 13 nt, Homo sapiens
acccauucuacac

SEQ ID NO: 1029437 - RNA, 18 nt, Homo sapiens
acccauucuacacagagc

SEQ ID NO: 1029438 - RNA, 23 nt, Homo sapiens
acaugaaaaaaggacaauuucaa

SEQ ID NO: 1029439 - RNA, 10 nt, Homo sapiens
acaugaauau

SEQ ID NO: 1029440 - RNA, 18 nt, Homo sapiens
acaugaaucccacccaca

SEQ ID NO: 1029441 - RNA, 13 nt, Homo sapiens
acaugaaugcaca

SEQ ID NO: 1029442 - RNA, 23 nt, Homo sapiens
acaugaauugcauuuuacuuuaa

SEQ ID NO: 1029443 - RNA, 17 nt, Homo sapiens
acaugacaacuuugcca

SEQ ID NO: 1029444 - RNA, 18 nt, Homo sapiens
acaugacaacuuugccag

SEQ ID NO: 1029445 - RNA, 20 nt, Homo sapiens
acaugacacaguuggauuua

SEQ ID NO: 1029446 - RNA, 14 nt, Homo sapiens
acaugagucaagag

SEQ ID NO: 1029447 - RNA, 20 nt, Homo sapiens
acaugauaccucugaucaag

SEQ ID NO: 1029448 - RNA, 21 nt, Homo sapiens
acaugauggagcgcaccugcc

SEQ ID NO: 1029449 - RNA, 17 nt, Homo sapiens
acaugcacucagcucuu

SEQ ID NO: 1029450 - RNA, 15 nt, Homo sapiens
acaugcgaccgugac

SEQ ID NO: 1029451 - RNA, 20 nt, Homo sapiens
acaugcgaccgugaccagga

SEQ ID NO: 1029452 - RNA, 18 nt, Homo sapiens
acaugcugaagccaaagc

SEQ ID NO: 1029453 - RNA, 19 nt, Homo sapiens
acaugcugacuuucauuuc

SEQ ID NO: 1029454 - RNA, 18 nt, Homo sapiens
acaugcugcuaauucaaa

SEQ ID NO: 1029455 - RNA, 14 nt, Homo sapiens
acauggaauuaccu

SEQ ID NO: 1029456 - RNA, 12 nt, Homo sapiens
acauggacaaua

SEQ ID NO: 1029457 - RNA, 17 nt, Homo sapiens
acauggacugcuucauc

SEQ ID NO: 1029458 - RNA, 19 nt, Homo sapiens
acauggccuaugcacauau

SEQ ID NO: 1029459 - RNA, 23 nt, Homo sapiens
acauggugaaaccucaucucuac

SEQ ID NO: 1029460 - RNA, 19 nt, Homo sapiens
acauguaguaguacuugaa

SEQ ID NO: 1029461 - RNA, 20 nt, Homo sapiens
acaugucuagccacugauca

SEQ ID NO: 1029462 - RNA, 19 nt, Homo sapiens
acaugucuuguacaugugu

SEQ ID NO: 1029463 - RNA, 15 nt, Homo sapiens
acaugugacacauau

SEQ ID NO: 1029464 - RNA, 13 nt, Homo sapiens
acaugugcacaug

SEQ ID NO: 1029465 - RNA, 21 nt, Homo sapiens
acaugugcacaugaauccaua

SEQ ID NO: 1029466 - RNA, 14 nt, Homo sapiens
acauguggcccaac

SEQ ID NO: 1029467 - RNA, 20 nt, Homo sapiens
acauguggcccaacacaauu

SEQ ID NO: 1029468 - RNA, 15 nt, Homo sapiens
acauuauacauuuga

SEQ ID NO: 1029469 - RNA, 23 nt, Homo sapiens
acauucaacccuggagaguucaa

SEQ ID NO: 1029470 - RNA, 13 nt, Homo sapiens
acauucaugccug

SEQ ID NO: 1029471 - RNA, 13 nt, Homo sapiens
acauuccacccca

SEQ ID NO: 1029472 - RNA, 16 nt, Homo sapiens
acauuccugggcacag

SEQ ID NO: 1029473 - RNA, 14 nt, Homo sapiens
acauucucugaccu

SEQ ID NO: 1029474 - RNA, 20 nt, Homo sapiens
acauucugcaagcacaucug

SEQ ID NO: 1029475 - RNA, 19 nt, Homo sapiens
acauucuggaaaagcaaaa

SEQ ID NO: 1029476 - RNA, 22 nt, Homo sapiens
acauucuuauaaauaugaagcu

SEQ ID NO: 1029477 - RNA, 23 nt, Homo sapiens
acauucuuauaaauaugaagcuc

SEQ ID NO: 1029478 - RNA, 13 nt, Homo sapiens
acauugagguucc

SEQ ID NO: 1029479 - RNA, 22 nt, Homo sapiens
acauuuaauacagcagugucau

SEQ ID NO: 1029480 - RNA, 12 nt, Homo sapiens
acauuugccuua

SEQ ID NO: 1029481 - RNA, 15 nt, Homo sapiens
acauuuuuaguuuaa

SEQ ID NO: 1029482 - RNA, 12 nt, Homo sapiens
accaaaaacuga

SEQ ID NO: 1029483 - RNA, 15 nt, Homo sapiens
accaaaaagaccaga

SEQ ID NO: 1029484 - RNA, 13 nt, Homo sapiens
accaaaaagggau

SEQ ID NO: 1029485 - RNA, 19 nt, Homo sapiens
accaaaauccccuucucau

SEQ ID NO: 1029486 - RNA, 21 nt, Homo sapiens
accaaagagacuggagcaucu

SEQ ID NO: 1029487 - RNA, 12 nt, Homo sapiens
accaaagcagaa

SEQ ID NO: 1029488 - RNA, 19 nt, Homo sapiens
accaaaugcuuuuccucaa

SEQ ID NO: 1029489 - RNA, 16 nt, Homo sapiens
accaaauuccuuggca

SEQ ID NO: 1029490 - RNA, 13 nt, Homo sapiens
accaacaugguga

SEQ ID NO: 1029491 - RNA, 19 nt, Homo sapiens
accaacccuguuuccugag

SEQ ID NO: 1029492 - RNA, 21 nt, Homo sapiens
accaacccuguuuccugaguu

SEQ ID NO: 1029493 - RNA, 13 nt, Homo sapiens
accaagcaggaag

SEQ ID NO: 1029494 - RNA, 18 nt, Homo sapiens
accaagcaggaagcucag

SEQ ID NO: 1029495 - RNA, 23 nt, Homo sapiens
accaagccuuggcucuacccuga

SEQ ID NO: 1029496 - RNA, 14 nt, Homo sapiens
accaagcucugucc

SEQ ID NO: 1029497 - RNA, 21 nt, Homo sapiens
accaagggggaugacauguga

SEQ ID NO: 1029498 - RNA, 13 nt, Homo sapiens
accaaggucuuca

SEQ ID NO: 1029499 - RNA, 17 nt, Homo sapiens
accaauaaagccuucaa

SEQ ID NO: 1029500 - RNA, 13 nt, Homo sapiens
accaauauucaaa

SEQ ID NO: 1029501 - RNA, 13 nt, Homo sapiens
accaauauuguac

SEQ ID NO: 1029502 - RNA, 12 nt, Homo sapiens
accaauauuugu

SEQ ID NO: 1029503 - RNA, 13 nt, Homo sapiens
accaauguucucu

SEQ ID NO: 1029504 - RNA, 22 nt, Homo sapiens
accacaaagcacaguuugaaca

SEQ ID NO: 1029505 - RNA, 16 nt, Homo sapiens
accacaaggggcucca

SEQ ID NO: 1029506 - RNA, 16 nt, Homo sapiens
accacaccucccugaa

SEQ ID NO: 1029507 - RNA, 11 nt, Homo sapiens
accacagcagc

SEQ ID NO: 1029508 - RNA, 16 nt, Homo sapiens
accacauagcaugagg

SEQ ID NO: 1029509 - RNA, 17 nt, Homo sapiens
accacauccuccgucca

SEQ ID NO: 1029510 - RNA, 17 nt, Homo sapiens
accacaucucuaucugg

SEQ ID NO: 1029511 - RNA, 18 nt, Homo sapiens
accaccagaucagguaua

SEQ ID NO: 1029512 - RNA, 16 nt, Homo sapiens
aaugacauuuugccaa

SEQ ID NO: 1029513 - RNA, 14 nt, Homo sapiens
aaugaccaauauua

SEQ ID NO: 1029514 - RNA, 13 nt, Homo sapiens
aaugacccaaaga

SEQ ID NO: 1029515 - RNA, 21 nt, Homo sapiens
aaugacggcaaacucagucau

SEQ ID NO: 1029516 - RNA, 21 nt, Homo sapiens
aaugagaaauuuuguugauau

SEQ ID NO: 1029517 - RNA, 20 nt, Homo sapiens
aaugagaaggcagccaccag

SEQ ID NO: 1029518 - RNA, 23 nt, Homo sapiens
aaugagacccucguggccuuccc

SEQ ID NO: 1029519 - RNA, 15 nt, Homo sapiens
aaugagccuggcaag

SEQ ID NO: 1029520 - RNA, 16 nt, Homo sapiens
aaugaucauaagucua

SEQ ID NO: 1029521 - RNA, 21 nt, Homo sapiens
aaugaucuagguuuaacucag

SEQ ID NO: 1029522 - RNA, 13 nt, Homo sapiens
aaugaucuuggcu

SEQ ID NO: 1029523 - RNA, 12 nt, Homo sapiens
aaugaucuuucu

SEQ ID NO: 1029524 - RNA, 13 nt, Homo sapiens
aaugaugaggcuc

SEQ ID NO: 1029525 - RNA, 15 nt, Homo sapiens
aaugaugggacaaua

SEQ ID NO: 1029526 - RNA, 16 nt, Homo sapiens
aaugaugggacaauaa

SEQ ID NO: 1029527 - RNA, 14 nt, Homo sapiens
aaugaugggucagu

SEQ ID NO: 1029528 - RNA, 14 nt, Homo sapiens
aaugauguuuuccu

SEQ ID NO: 1029529 - RNA, 11 nt, Homo sapiens
aaugauuagaa

SEQ ID NO: 1029530 - RNA, 21 nt, Homo sapiens
aaugauuguuugucaauauaa

SEQ ID NO: 1029531 - RNA, 22 nt, Homo sapiens
aaugauuuagguacgucaaagc

SEQ ID NO: 1029532 - RNA, 15 nt, Homo sapiens
aaugauuucauucaa

SEQ ID NO: 1029533 - RNA, 18 nt, Homo sapiens
aaugauuuuaucugugaa

SEQ ID NO: 1029534 - RNA, 17 nt, Homo sapiens
aaugcaaaguacaugua

SEQ ID NO: 1029535 - RNA, 17 nt, Homo sapiens
aaugcacuccugaccaa

SEQ ID NO: 1029536 - RNA, 13 nt, Homo sapiens
aaugcacuuucua

SEQ ID NO: 1029537 - RNA, 13 nt, Homo sapiens
aaugcacuuuguu

SEQ ID NO: 1029538 - RNA, 19 nt, Homo sapiens
aaugcagcgugaagggauu

SEQ ID NO: 1029539 - RNA, 20 nt, Homo sapiens
aaugcagggacaaaugccac

SEQ ID NO: 1029540 - RNA, 19 nt, Homo sapiens
aaugcauauccaacaugug

SEQ ID NO: 1029541 - RNA, 14 nt, Homo sapiens
aaugcaucuguccu

SEQ ID NO: 1029542 - RNA, 19 nt, Homo sapiens
aaugcaucuguccucaugu

SEQ ID NO: 1029543 - RNA, 22 nt, Homo sapiens
aaugcauuguuguucugcucaa

SEQ ID NO: 1029544 - RNA, 12 nt, Homo sapiens
aaugccaaaaaa

SEQ ID NO: 1029545 - RNA, 18 nt, Homo sapiens
aaugccaaaauucauuca

SEQ ID NO: 1029546 - RNA, 15 nt, Homo sapiens
aaugccaaauugcag

SEQ ID NO: 1029547 - RNA, 16 nt, Homo sapiens
aaugccugcauggaua

SEQ ID NO: 1029548 - RNA, 20 nt, Homo sapiens
aaugccuuugagacaguuuc

SEQ ID NO: 1029549 - RNA, 17 nt, Homo sapiens
aaugcuaauuaggcaaa

SEQ ID NO: 1029550 - RNA, 19 nt, Homo sapiens
aaugcuacugucucacuga

SEQ ID NO: 1029551 - RNA, 16 nt, Homo sapiens
aaugcucuuuacuuca

SEQ ID NO: 1029552 - RNA, 16 nt, Homo sapiens
aaugcuggcauuugca

SEQ ID NO: 1029553 - RNA, 21 nt, Homo sapiens
aaugcugguuuuucaguuuuc

SEQ ID NO: 1029554 - RNA, 13 nt, Homo sapiens
aauggacugcaua

SEQ ID NO: 1029555 - RNA, 17 nt, Homo sapiens
aauggaggccauugugu

SEQ ID NO: 1029556 - RNA, 21 nt, Homo sapiens
aauggauuugaugcuguuuga

SEQ ID NO: 1029557 - RNA, 10 nt, Homo sapiens
aauggcaaca

SEQ ID NO: 1029558 - RNA, 14 nt, Homo sapiens
aauggcagcugcca

SEQ ID NO: 1029559 - RNA, 16 nt, Homo sapiens
aauggccggcuggaaa

SEQ ID NO: 1029560 - RNA, 20 nt, Homo sapiens
aauggcgugaucucggcuca

SEQ ID NO: 1029561 - RNA, 18 nt, Homo sapiens
aauggggaucacagagac

SEQ ID NO: 1029562 - RNA, 15 nt, Homo sapiens
aaugggggugcauuu

SEQ ID NO: 1029563 - RNA, 16 nt, Homo sapiens
aaugguaauuguugcu

SEQ ID NO: 1029564 - RNA, 19 nt, Homo sapiens
aaugguaggauaucuuggc

SEQ ID NO: 1029565 - RNA, 22 nt, Homo sapiens
aaugguauggaacucucuccac

SEQ ID NO: 1029566 - RNA, 17 nt, Homo sapiens
aauggugaaaugcagag

SEQ ID NO: 1029567 - RNA, 18 nt, Homo sapiens
aauggugauauccucuca

SEQ ID NO: 1029568 - RNA, 17 nt, Homo sapiens
aaugguguuguaugccu

SEQ ID NO: 1029569 - RNA, 16 nt, Homo sapiens
aaugguuccauucucu

SEQ ID NO: 1029570 - RNA, 19 nt, Homo sapiens
aaugguuucaaagauucaa

SEQ ID NO: 1029571 - RNA, 15 nt, Homo sapiens
aauguaaacaauauc

SEQ ID NO: 1029572 - RNA, 23 nt, Homo sapiens
aauguaagaucguucucugccuc

SEQ ID NO: 1029573 - RNA, 23 nt, Homo sapiens
aauguaauacuccuaagacuuau

SEQ ID NO: 1029574 - RNA, 21 nt, Homo sapiens
aauguacaacuuuuuaccuag

SEQ ID NO: 1029575 - RNA, 16 nt, Homo sapiens
aauguagccauuguag

SEQ ID NO: 1029576 - RNA, 14 nt, Homo sapiens
aauguauagcugcu

SEQ ID NO: 1029577 - RNA, 13 nt, Homo sapiens
acacugugcccug

SEQ ID NO: 1029578 - RNA, 14 nt, Homo sapiens
acacuguuugccca

SEQ ID NO: 1029579 - RNA, 16 nt, Homo sapiens
acacuuacagaauuau

SEQ ID NO: 1029580 - RNA, 20 nt, Homo sapiens
acacuucuaaaugaagugca

SEQ ID NO: 1029581 - RNA, 19 nt, Homo sapiens
acacuucugugagaccccc

SEQ ID NO: 1029582 - RNA, 16 nt, Homo sapiens
acagaacuaagaugau

SEQ ID NO: 1029583 - RNA, 18 nt, Homo sapiens
acagaacuauguacuuua

SEQ ID NO: 1029584 - RNA, 15 nt, Homo sapiens
acagaacugcaguca

SEQ ID NO: 1029585 - RNA, 21 nt, Homo sapiens
acagaacugcagucagcauga

SEQ ID NO: 1029586 - RNA, 16 nt, Homo sapiens
acagaagccaggagca

SEQ ID NO: 1029587 - RNA, 18 nt, Homo sapiens
acagaagggcuaacucag

SEQ ID NO: 1029588 - RNA, 17 nt, Homo sapiens
acagacuucucaauaau

SEQ ID NO: 1029589 - RNA, 16 nt, Homo sapiens
acagagaaaagacaua

SEQ ID NO: 1029590 - RNA, 13 nt, Homo sapiens
acagagaguccca

SEQ ID NO: 1029591 - RNA, 15 nt, Homo sapiens
acagagaugugauaa

SEQ ID NO: 1029592 - RNA, 20 nt, Homo sapiens
acagagcaagacucugucuc

SEQ ID NO: 1029593 - RNA, 18 nt, Homo sapiens
acagagcagaacuuucac

SEQ ID NO: 1029594 - RNA, 18 nt, Homo sapiens
acagagcaggacugcaca

SEQ ID NO: 1029595 - RNA, 18 nt, Homo sapiens
acagagccagacugucuc

SEQ ID NO: 1029596 - RNA, 20 nt, Homo sapiens
acagagcgagacuccgucuc

SEQ ID NO: 1029597 - RNA, 20 nt, Homo sapiens
acagagcgagauuccgucuu

SEQ ID NO: 1029598 - RNA, 19 nt, Homo sapiens
acagagcucuccagcucca

SEQ ID NO: 1029599 - RNA, 17 nt, Homo sapiens
acagagcugaagaacuu

SEQ ID NO: 1029600 - RNA, 19 nt, Homo sapiens
acagagcuucccugacuca

SEQ ID NO: 1029601 - RNA, 17 nt, Homo sapiens
acagaggagagucccag

SEQ ID NO: 1029602 - RNA, 21 nt, Homo sapiens
acagagucuggcucugucacc

SEQ ID NO: 1029603 - RNA, 23 nt, Homo sapiens
acagagucuggcucugucaccca

SEQ ID NO: 1029604 - RNA, 20 nt, Homo sapiens
acagagugagacucugucuc

SEQ ID NO: 1029605 - RNA, 17 nt, Homo sapiens
acagagugcauugugag

SEQ ID NO: 1029606 - RNA, 21 nt, Homo sapiens
acagaguggucuuucuggaga

SEQ ID NO: 1029607 - RNA, 14 nt, Homo sapiens
acagaguucacuau

SEQ ID NO: 1029608 - RNA, 17 nt, Homo sapiens
acagauagucaaaccau

SEQ ID NO: 1029609 - RNA, 19 nt, Homo sapiens
acagaucaagcugugagac

SEQ ID NO: 1029610 - RNA, 22 nt, Homo sapiens
acagaucacagcuucagccagg

SEQ ID NO: 1029611 - RNA, 12 nt, Homo sapiens
acagaugaaggu

SEQ ID NO: 1029612 - RNA, 19 nt, Homo sapiens
acagauggauagucugucc

SEQ ID NO: 1029613 - RNA, 20 nt, Homo sapiens
acagauggauagucugucca

SEQ ID NO: 1029614 - RNA, 19 nt, Homo sapiens
acagaugugucagccagga

SEQ ID NO: 1029615 - RNA, 15 nt, Homo sapiens
acagauuugugaacu

SEQ ID NO: 1029616 - RNA, 14 nt, Homo sapiens
acagcaaaacucca

SEQ ID NO: 1029617 - RNA, 18 nt, Homo sapiens
acagcaaaacuccaucuc

SEQ ID NO: 1029618 - RNA, 20 nt, Homo sapiens
acagcaagggugaugggaaa

SEQ ID NO: 1029619 - RNA, 12 nt, Homo sapiens
acagcacuggcu

SEQ ID NO: 1029620 - RNA, 18 nt, Homo sapiens
acagcagauuucagauca

SEQ ID NO: 1029621 - RNA, 17 nt, Homo sapiens
acagcagcaguuacaaa

SEQ ID NO: 1029622 - RNA, 18 nt, Homo sapiens
acagcagcugaacagcca

SEQ ID NO: 1029623 - RNA, 20 nt, Homo sapiens
acagcagcugaacagccaaa

SEQ ID NO: 1029624 - RNA, 19 nt, Homo sapiens
acagcaggagggacaauga

SEQ ID NO: 1029625 - RNA, 17 nt, Homo sapiens
acagcaggcgccucggg

SEQ ID NO: 1029626 - RNA, 16 nt, Homo sapiens
acagcaucauuuugca

SEQ ID NO: 1029627 - RNA, 12 nt, Homo sapiens
acagcauugcuu

SEQ ID NO: 1029628 - RNA, 18 nt, Homo sapiens
acagccacacugugggac

SEQ ID NO: 1029629 - RNA, 14 nt, Homo sapiens
acagccacuuggga

SEQ ID NO: 1029630 - RNA, 20 nt, Homo sapiens
acagccagacuggcacaguu

SEQ ID NO: 1029631 - RNA, 21 nt, Homo sapiens
acagccucccacccccaucuc

SEQ ID NO: 1029632 - RNA, 18 nt, Homo sapiens
acagcgagacuccgucuc

SEQ ID NO: 1029633 - RNA, 19 nt, Homo sapiens
acagcgagacuccgucuca

SEQ ID NO: 1029634 - RNA, 12 nt, Homo sapiens
acagcucaguuc

SEQ ID NO: 1029635 - RNA, 16 nt, Homo sapiens
acagcuccuucugucc

SEQ ID NO: 1029636 - RNA, 20 nt, Homo sapiens
acagcucgggcccucuguga

SEQ ID NO: 1029637 - RNA, 23 nt, Homo sapiens
acagcucgggcccucugugagau

SEQ ID NO: 1029638 - RNA, 21 nt, Homo sapiens
acagcucugcauacucauuag

SEQ ID NO: 1029639 - RNA, 15 nt, Homo sapiens
acagcugagcacauu

SEQ ID NO: 1029640 - RNA, 20 nt, Homo sapiens
acagcuggguggcacugcca

SEQ ID NO: 1029641 - RNA, 13 nt, Homo sapiens
acagcuucagcca

SEQ ID NO: 1029642 - RNA, 19 nt, Homo sapiens
acagcuuuaucaccagaga

SEQ ID NO: 1029643 - RNA, 23 nt, Homo sapiens
acagcuuuaucuccccaggagca

SEQ ID NO: 1029644 - RNA, 20 nt, Homo sapiens
acaggaagcaccccaugcca

SEQ ID NO: 1029645 - RNA, 23 nt, Homo sapiens
acaggaccuaggauaucuucucc

SEQ ID NO: 1029646 - RNA, 15 nt, Homo sapiens
acaggacuagcugga

SEQ ID NO: 1029647 - RNA, 13 nt, Homo sapiens
acaggacucugcc

SEQ ID NO: 1029648 - RNA, 16 nt, Homo sapiens
aauaaaaagaucacuu

SEQ ID NO: 1029649 - RNA, 20 nt, Homo sapiens
aauaaaaagugacacagcag

SEQ ID NO: 1029650 - RNA, 13 nt, Homo sapiens
aauaaaaauaccu

SEQ ID NO: 1029651 - RNA, 24 nt, Homo sapiens
aauaaaacccaacagauacuggaa

SEQ ID NO: 1029652 - RNA, 18 nt, Homo sapiens
aauaaaaugcagagacau

SEQ ID NO: 1029653 - RNA, 22 nt, Homo sapiens
aauaaaauuuuuuuucauguuu

SEQ ID NO: 1029654 - RNA, 19 nt, Homo sapiens
aauaaacuagauuacauuc

SEQ ID NO: 1029655 - RNA, 20 nt, Homo sapiens
aauaaacuagauuacauuca

SEQ ID NO: 1029656 - RNA, 22 nt, Homo sapiens
aauaaagcaacagacuucucaa

SEQ ID NO: 1029657 - RNA, 13 nt, Homo sapiens
aauaaaguacuaa

SEQ ID NO: 1029658 - RNA, 12 nt, Homo sapiens
aauaaaugugaa

SEQ ID NO: 1029659 - RNA, 16 nt, Homo sapiens
aauaaaugugccuuca

SEQ ID NO: 1029660 - RNA, 18 nt, Homo sapiens
aauaaauuaaaacaugca

SEQ ID NO: 1029661 - RNA, 15 nt, Homo sapiens
aauaacagccucauu

SEQ ID NO: 1029662 - RNA, 13 nt, Homo sapiens
aauaacauggccu

SEQ ID NO: 1029663 - RNA, 13 nt, Homo sapiens
aauaaccaauccu

SEQ ID NO: 1029664 - RNA, 17 nt, Homo sapiens
aauaagaaagugcgagu

SEQ ID NO: 1029665 - RNA, 16 nt, Homo sapiens
aauaagauuuaauuca

SEQ ID NO: 1029666 - RNA, 15 nt, Homo sapiens
aauaagcccaacaga

SEQ ID NO: 1029667 - RNA, 13 nt, Homo sapiens
aauaagcugccuu

SEQ ID NO: 1029668 - RNA, 15 nt, Homo sapiens
aauaaguacugugua

SEQ ID NO: 1029669 - RNA, 19 nt, Homo sapiens
aauaaguacuguguacaga

SEQ ID NO: 1029670 - RNA, 14 nt, Homo sapiens
aauaauacacuaau

SEQ ID NO: 1029671 - RNA, 12 nt, Homo sapiens
aauaauaugcau

SEQ ID NO: 1029672 - RNA, 20 nt, Homo sapiens
aauaauccagaaaaacugug

SEQ ID NO: 1029673 - RNA, 14 nt, Homo sapiens
aauaaucucacuac

SEQ ID NO: 1029674 - RNA, 16 nt, Homo sapiens
aauaauguacaucugg

SEQ ID NO: 1029675 - RNA, 20 nt, Homo sapiens
aauaauguuguaauucaugc

SEQ ID NO: 1029676 - RNA, 15 nt, Homo sapiens
aauaauuuccuccac

SEQ ID NO: 1029677 - RNA, 13 nt, Homo sapiens
aauacaacaugua

SEQ ID NO: 1029678 - RNA, 18 nt, Homo sapiens
aauacaccacuacauucu

SEQ ID NO: 1029679 - RNA, 19 nt, Homo sapiens
aauacaugcugcuaauuca

SEQ ID NO: 1029680 - RNA, 20 nt, Homo sapiens
aauacauggacaauaccccc

SEQ ID NO: 1029681 - RNA, 18 nt, Homo sapiens
aauaccaaaauuauuuca

SEQ ID NO: 1029682 - RNA, 20 nt, Homo sapiens
aauaccagugaaccaaagag

SEQ ID NO: 1029683 - RNA, 18 nt, Homo sapiens
aauacgguaaggauacuu

SEQ ID NO: 1029684 - RNA, 22 nt, Homo sapiens
aauacuaguugugaccuuagug

SEQ ID NO: 1029685 - RNA, 22 nt, Homo sapiens
aauacuauauuuauacuguaua

SEQ ID NO: 1029686 - RNA, 15 nt, Homo sapiens
aauacucauguguau

SEQ ID NO: 1029687 - RNA, 22 nt, Homo sapiens
aauacugaaggacacagcagug

SEQ ID NO: 1029688 - RNA, 23 nt, Homo sapiens
aauacugaaggacacagcagugg

SEQ ID NO: 1029689 - RNA, 11 nt, Homo sapiens
aauacugaugu

SEQ ID NO: 1029690 - RNA, 22 nt, Homo sapiens
aauacugauguuccuagugaaa

SEQ ID NO: 1029691 - RNA, 12 nt, Homo sapiens
aauacuguacaa

SEQ ID NO: 1029692 - RNA, 14 nt, Homo sapiens
aauacuuaacucaa

SEQ ID NO: 1029693 - RNA, 11 nt, Homo sapiens
aauacuuucag

SEQ ID NO: 1029694 - RNA, 20 nt, Homo sapiens
aauagaaccacuaugaagcu

SEQ ID NO: 1029695 - RNA, 22 nt, Homo sapiens
aauagaauuugagcaucaguga

SEQ ID NO: 1029696 - RNA, 18 nt, Homo sapiens
aauagccugcgcuguuuu

SEQ ID NO: 1029697 - RNA, 14 nt, Homo sapiens
aauagcucuuucag

SEQ ID NO: 1029698 - RNA, 12 nt, Homo sapiens
aauagggagaaa

SEQ ID NO: 1029699 - RNA, 14 nt, Homo sapiens
aauaguauuuauga

SEQ ID NO: 1029700 - RNA, 14 nt, Homo sapiens
aauagugauuucca

SEQ ID NO: 1029701 - RNA, 14 nt, Homo sapiens
aauauaaacacuau

SEQ ID NO: 1029702 - RNA, 16 nt, Homo sapiens
aauauaaaguguaaua

SEQ ID NO: 1029703 - RNA, 12 nt, Homo sapiens
aauauaauacug

SEQ ID NO: 1029704 - RNA, 14 nt, Homo sapiens
aauauaauacugua

SEQ ID NO: 1029705 - RNA, 15 nt, Homo sapiens
aauauauaaccagug

SEQ ID NO: 1029706 - RNA, 19 nt, Homo sapiens
aauauauaguggacaguaa

SEQ ID NO: 1029707 - RNA, 20 nt, Homo sapiens
aauauauaguggacaguaac

SEQ ID NO: 1029708 - RNA, 20 nt, Homo sapiens
aauauaugauuagccaggca

SEQ ID NO: 1029709 - RNA, 14 nt, Homo sapiens
aauaucacaucacu

SEQ ID NO: 1029710 - RNA, 15 nt, Homo sapiens
aauauccauccugaa

SEQ ID NO: 1029711 - RNA, 14 nt, Homo sapiens
guuugagcuuucau

SEQ ID NO: 1029712 - RNA, 23 nt, Homo sapiens
guuugaucccuguuacccagaga

SEQ ID NO: 1029713 - RNA, 15 nt, Homo sapiens
guuuggccuauucca

SEQ ID NO: 1029714 - RNA, 13 nt, Homo sapiens
guuuggggagcag

SEQ ID NO: 1029715 - RNA, 15 nt, Homo sapiens
guuuggucagacuau

SEQ ID NO: 1029716 - RNA, 16 nt, Homo sapiens
guuugucagacuuuaa

SEQ ID NO: 1029717 - RNA, 20 nt, Homo sapiens
guuuguuccuacagccccuu

SEQ ID NO: 1029718 - RNA, 21 nt, Homo sapiens
guuuuaacucuaucugucaua

SEQ ID NO: 1029719 - RNA, 14 nt, Homo sapiens
guuuuaauuccaau

SEQ ID NO: 1029720 - RNA, 14 nt, Homo sapiens
guuuuacaaagggg

SEQ ID NO: 1029721 - RNA, 22 nt, Homo sapiens
guuuuagauaucccuuacucca

SEQ ID NO: 1029722 - RNA, 17 nt, Homo sapiens
guuuucauggugaaaau

SEQ ID NO: 1029723 - RNA, 11 nt, Homo sapiens
guuuuccugug

SEQ ID NO: 1029724 - RNA, 21 nt, Homo sapiens
guuuucugagcccgggcugcc

SEQ ID NO: 1029725 - RNA, 16 nt, Homo sapiens
guuuucugggugucca

SEQ ID NO: 1029726 - RNA, 16 nt, Homo sapiens
guuuugaaaugcagaa

SEQ ID NO: 1029727 - RNA, 19 nt, Homo sapiens
guuuuggggacucauuuca

SEQ ID NO: 1029728 - RNA, 16 nt, Homo sapiens
guuuugguugcuuuaa

SEQ ID NO: 1029729 - RNA, 17 nt, Homo sapiens
guuuuguaagaugcugg

SEQ ID NO: 1029730 - RNA, 15 nt, Homo sapiens
guuuuuaagcuguuu

SEQ ID NO: 1029731 - RNA, 14 nt, Homo sapiens
guuuuuagcuggug

SEQ ID NO: 1029732 - RNA, 18 nt, Homo sapiens
guuuuucauucacuuuaa

SEQ ID NO: 1029733 - RNA, 18 nt, Homo sapiens
guuuuuccacuacugcua

SEQ ID NO: 1029734 - RNA, 14 nt, Homo sapiens
guuuuuugaugcuu

SEQ ID NO: 1029735 - RNA, 13 nt, Homo sapiens
uaaaaaaacacau

SEQ ID NO: 1029736 - RNA, 14 nt, Homo sapiens
uaaaaaaacacaua

SEQ ID NO: 1029737 - RNA, 12 nt, Homo sapiens
uaaaaacuaaaa

SEQ ID NO: 1029738 - RNA, 22 nt, Homo sapiens
uaaaaagagcuguccugguauc

SEQ ID NO: 1029739 - RNA, 20 nt, Homo sapiens
uaaaaaggaauccacuccca

SEQ ID NO: 1029740 - RNA, 18 nt, Homo sapiens
uaaaaauaaaaaacauau

SEQ ID NO: 1029741 - RNA, 19 nt, Homo sapiens
uaaaaauaaaaaacauaua

SEQ ID NO: 1029742 - RNA, 22 nt, Homo sapiens
uaaaaauaaaaaacauauacaa

SEQ ID NO: 1029743 - RNA, 13 nt, Homo sapiens
accagacagacaa

SEQ ID NO: 1029744 - RNA, 14 nt, Homo sapiens
accagaggacaaag

SEQ ID NO: 1029745 - RNA, 12 nt, Homo sapiens
accagaggucag

SEQ ID NO: 1029746 - RNA, 12 nt, Homo sapiens
accagauuugcu

SEQ ID NO: 1029747 - RNA, 13 nt, Homo sapiens
accagcacugucu

SEQ ID NO: 1029748 - RNA, 20 nt, Homo sapiens
accagcagcuggaaucugaa

SEQ ID NO: 1029749 - RNA, 22 nt, Homo sapiens
accagccaagagggcugcaaaa

SEQ ID NO: 1029750 - RNA, 21 nt, Homo sapiens
accagcccuacaccauuccuu

SEQ ID NO: 1029751 - RNA, 17 nt, Homo sapiens
accagccugcacuacuc

SEQ ID NO: 1029752 - RNA, 19 nt, Homo sapiens
accagcgcccgcugggcug

SEQ ID NO: 1029753 - RNA, 17 nt, Homo sapiens
accaggacuauagccca

SEQ ID NO: 1029754 - RNA, 12 nt, Homo sapiens
accagggacuga

SEQ ID NO: 1029755 - RNA, 21 nt, Homo sapiens
accaggggugauuucagagag

SEQ ID NO: 1029756 - RNA, 22 nt, Homo sapiens
accagguagaacacaaggucau

SEQ ID NO: 1029757 - RNA, 14 nt, Homo sapiens
accaggucagggag

SEQ ID NO: 1029758 - RNA, 13 nt, Homo sapiens
accagucacuguc

SEQ ID NO: 1029759 - RNA, 13 nt, Homo sapiens
accaguccaugag

SEQ ID NO: 1029760 - RNA, 22 nt, Homo sapiens
accaguccuguuugcagggaag

SEQ ID NO: 1029761 - RNA, 12 nt, Homo sapiens
accagugacuuu

SEQ ID NO: 1029762 - RNA, 19 nt, Homo sapiens
accagugcaacagcacugg

SEQ ID NO: 1029763 - RNA, 20 nt, Homo sapiens
accauaaaaaggaauccacu

SEQ ID NO: 1029764 - RNA, 13 nt, Homo sapiens
accauaacagcca

SEQ ID NO: 1029765 - RNA, 14 nt, Homo sapiens
accauaacagccaa

SEQ ID NO: 1029766 - RNA, 11 nt, Homo sapiens
accauaaugua

SEQ ID NO: 1029767 - RNA, 13 nt, Homo sapiens
accauaauguuac

SEQ ID NO: 1029768 - RNA, 14 nt, Homo sapiens
accaucaagccacc

SEQ ID NO: 1029769 - RNA, 20 nt, Homo sapiens
accaucucaggccaccugcc

SEQ ID NO: 1029770 - RNA, 21 nt, Homo sapiens
accaugaacacguuuuuucac

SEQ ID NO: 1029771 - RNA, 21 nt, Homo sapiens
accaugagaccacuguuauca

SEQ ID NO: 1029772 - RNA, 14 nt, Homo sapiens
accaugccauuuaa

SEQ ID NO: 1029773 - RNA, 16 nt, Homo sapiens
accaugggaugaugau

SEQ ID NO: 1029774 - RNA, 20 nt, Homo sapiens
accauguacaugaagaagcu

SEQ ID NO: 1029775 - RNA, 20 nt, Homo sapiens
accauguggauuuggucaca

SEQ ID NO: 1029776 - RNA, 18 nt, Homo sapiens
accauguuggccaggcug

SEQ ID NO: 1029777 - RNA, 19 nt, Homo sapiens
accauucaggacacaggga

SEQ ID NO: 1029778 - RNA, 10 nt, Homo sapiens
accauuugca

SEQ ID NO: 1029779 - RNA, 21 nt, Homo sapiens
accauuuggucaggauuccug

SEQ ID NO: 1029780 - RNA, 19 nt, Homo sapiens
accauuuuugaaaccaaac

SEQ ID NO: 1029781 - RNA, 16 nt, Homo sapiens
accauuuuuuaaggaa

SEQ ID NO: 1029782 - RNA, 14 nt, Homo sapiens
acccaaaaggcaga

SEQ ID NO: 1029783 - RNA, 12 nt, Homo sapiens
acccaaagacca

SEQ ID NO: 1029784 - RNA, 14 nt, Homo sapiens
acccaaaguaucag

SEQ ID NO: 1029785 - RNA, 19 nt, Homo sapiens
acccaauauuuaccagacc

SEQ ID NO: 1029786 - RNA, 16 nt, Homo sapiens
acccaccaucaugucu

SEQ ID NO: 1029787 - RNA, 19 nt, Homo sapiens
acccaccccacaauuccuc

SEQ ID NO: 1029788 - RNA, 14 nt, Homo sapiens
acccaccccagugc

SEQ ID NO: 1029789 - RNA, 18 nt, Homo sapiens
acccaccccguagauucc

SEQ ID NO: 1029790 - RNA, 19 nt, Homo sapiens
acccaccccguagauuccc

SEQ ID NO: 1029791 - RNA, 14 nt, Homo sapiens
acccaccucagccu

SEQ ID NO: 1029792 - RNA, 17 nt, Homo sapiens
acccaccuuucugcaca

SEQ ID NO: 1029793 - RNA, 21 nt, Homo sapiens
acccacugcuuuuggucugug

SEQ ID NO: 1029794 - RNA, 20 nt, Homo sapiens
acccacuuccugaucccuca

SEQ ID NO: 1029795 - RNA, 22 nt, Homo sapiens
acccagaugggggaaagcacag

SEQ ID NO: 1029796 - RNA, 13 nt, Homo sapiens
acccagcaaagag

SEQ ID NO: 1029797 - RNA, 14 nt, Homo sapiens
acccagcacccaca

SEQ ID NO: 1029798 - RNA, 21 nt, Homo sapiens
acccagcccuuguuagauuca

SEQ ID NO: 1029799 - RNA, 13 nt, Homo sapiens
acccagccuguuu

SEQ ID NO: 1029800 - RNA, 15 nt, Homo sapiens
acccaggcaccugca

SEQ ID NO: 1029801 - RNA, 23 nt, Homo sapiens
acccagucagaguugugcacaug

SEQ ID NO: 1029802 - RNA, 17 nt, Homo sapiens
acccaguuagcucucaa

SEQ ID NO: 1029803 - RNA, 15 nt, Homo sapiens
acccaugaggcaaug

SEQ ID NO: 1029804 - RNA, 17 nt, Homo sapiens
acccauucuacacagag

SEQ ID NO: 1029805 - RNA, 22 nt, Homo sapiens
acccauugggcccuuccggcau

SEQ ID NO: 1029806 - RNA, 15 nt, Homo sapiens
accccaaaguguccc

SEQ ID NO: 1029807 - RNA, 15 nt, Homo sapiens
accccaagcaggaac

SEQ ID NO: 1029808 - RNA, 16 nt, Homo sapiens
accccaccagcaauac

SEQ ID NO: 1029809 - RNA, 14 nt, Homo sapiens
accccacuacacag

SEQ ID NO: 1029810 - RNA, 12 nt, Homo sapiens
accccacugcaa

SEQ ID NO: 1029811 - RNA, 20 nt, Homo sapiens
accccagacgaugucuucau

SEQ ID NO: 1029812 - RNA, 17 nt, Homo sapiens
accccagcucccuagga

SEQ ID NO: 1029813 - RNA, 22 nt, Homo sapiens
accccagugcuuguuccucuca

SEQ ID NO: 1029814 - RNA, 22 nt, Homo sapiens
accccagugguauccugugaca

SEQ ID NO: 1029815 - RNA, 20 nt, Homo sapiens
acccccacccccagcucaau

SEQ ID NO: 1029816 - RNA, 22 nt, Homo sapiens
accccccagaaccuguccuugc

SEQ ID NO: 1029817 - RNA, 20 nt, Homo sapiens
accccccccacacacaccau

SEQ ID NO: 1029818 - RNA, 20 nt, Homo sapiens
acccccggaacaagccuaaa

SEQ ID NO: 1029819 - RNA, 14 nt, Homo sapiens
accccgggcucucu

SEQ ID NO: 1029820 - RNA, 13 nt, Homo sapiens
accccuacaugaa

SEQ ID NO: 1029821 - RNA, 15 nt, Homo sapiens
accccucaccuugca

SEQ ID NO: 1029822 - RNA, 14 nt, Homo sapiens
accccucacuguga

SEQ ID NO: 1029823 - RNA, 16 nt, Homo sapiens
accccucacugugacu

SEQ ID NO: 1029824 - RNA, 17 nt, Homo sapiens
accccucacugugacug

SEQ ID NO: 1029825 - RNA, 15 nt, Homo sapiens
accccucuaccuccu

SEQ ID NO: 1029826 - RNA, 23 nt, Homo sapiens
accccugcccugggauguccaca

SEQ ID NO: 1029827 - RNA, 17 nt, Homo sapiens
accccugcuauauacua

SEQ ID NO: 1029828 - RNA, 15 nt, Homo sapiens
acccgcucuggacca

SEQ ID NO: 1029829 - RNA, 20 nt, Homo sapiens
acccuaaaaagcagagcuuu

SEQ ID NO: 1029830 - RNA, 20 nt, Homo sapiens
acccuacuucuuuugcucuu

SEQ ID NO: 1029831 - RNA, 22 nt, Homo sapiens
acccuaugugggugggaccaca

SEQ ID NO: 1029832 - RNA, 20 nt, Homo sapiens
acccuauuuagaaauggauu

SEQ ID NO: 1029833 - RNA, 18 nt, Homo sapiens
acccucagaaacacuggg

SEQ ID NO: 1029834 - RNA, 13 nt, Homo sapiens
acccucaggacaa

SEQ ID NO: 1029835 - RNA, 14 nt, Homo sapiens
acccucaugcugug

SEQ ID NO: 1029836 - RNA, 17 nt, Homo sapiens
acccuccuaucaccucc

SEQ ID NO: 1029837 - RNA, 14 nt, Homo sapiens
acccuccuggugcu

SEQ ID NO: 1029838 - RNA, 14 nt, Homo sapiens
acccuccuguaaau

SEQ ID NO: 1029839 - RNA, 14 nt, Homo sapiens
acccucgaugaagc

SEQ ID NO: 1029840 - RNA, 16 nt, Homo sapiens
acccucuaagggaccu

SEQ ID NO: 1029841 - RNA, 13 nt, Homo sapiens
acccucucagcuc

SEQ ID NO: 1029842 - RNA, 21 nt, Homo sapiens
acccugaaugguuccaugccu

SEQ ID NO: 1029843 - RNA, 16 nt, Homo sapiens
acccugagacuuggcu

SEQ ID NO: 1029844 - RNA, 13 nt, Homo sapiens
acccugaguucau

SEQ ID NO: 1029845 - RNA, 17 nt, Homo sapiens
acccugcaaaaugagac

SEQ ID NO: 1029846 - RNA, 24 nt, Homo sapiens
acccugcaaaauuugaugccagga

SEQ ID NO: 1029847 - RNA, 20 nt, Homo sapiens
acccuggaucaguccuuuga

SEQ ID NO: 1029848 - RNA, 12 nt, Homo sapiens
acccugucugua

SEQ ID NO: 1029849 - RNA, 16 nt, Homo sapiens
acccugugcagaaccu

SEQ ID NO: 1029850 - RNA, 13 nt, Homo sapiens
acccuuauuacac

SEQ ID NO: 1029851 - RNA, 21 nt, Homo sapiens
acccuucccccagcaccauuu

SEQ ID NO: 1029852 - RNA, 17 nt, Homo sapiens
acccuugaaaagacauc

SEQ ID NO: 1029853 - RNA, 15 nt, Homo sapiens
acccuugauuauacu

SEQ ID NO: 1029854 - RNA, 19 nt, Homo sapiens
acccuuguguccacuguga

SEQ ID NO: 1029855 - RNA, 16 nt, Homo sapiens
accgaagccacuuucu

SEQ ID NO: 1029856 - RNA, 19 nt, Homo sapiens
accgagagagauggaauaa

SEQ ID NO: 1029857 - RNA, 17 nt, Homo sapiens
uaacaaagaacaagcau

SEQ ID NO: 1029858 - RNA, 18 nt, Homo sapiens
uaacaacaauaacacugu

SEQ ID NO: 1029859 - RNA, 20 nt, Homo sapiens
uaacaacaauaacacugucu

SEQ ID NO: 1029860 - RNA, 13 nt, Homo sapiens
uaacaacuguggu

SEQ ID NO: 1029861 - RNA, 20 nt, Homo sapiens
uaacaaguagcacccuggau

SEQ ID NO: 1029862 - RNA, 15 nt, Homo sapiens
uaacaauugugaagu

SEQ ID NO: 1029863 - RNA, 12 nt, Homo sapiens
uaacacacucca

SEQ ID NO: 1029864 - RNA, 19 nt, Homo sapiens
uaacagaacagcuucaggu

SEQ ID NO: 1029865 - RNA, 15 nt, Homo sapiens
uaacagaacagucac

SEQ ID NO: 1029866 - RNA, 21 nt, Homo sapiens
uaacagccucauugaugucaa

SEQ ID NO: 1029867 - RNA, 21 nt, Homo sapiens
uaacagcggcaggguguccca

SEQ ID NO: 1029868 - RNA, 16 nt, Homo sapiens
uaacaggaaaauuuua

SEQ ID NO: 1029869 - RNA, 18 nt, Homo sapiens
uaacaggauauuuaauga

SEQ ID NO: 1029870 - RNA, 15 nt, Homo sapiens
uaacagucauuuaaa

SEQ ID NO: 1029871 - RNA, 19 nt, Homo sapiens
uaacaguucacuuuuuaca

SEQ ID NO: 1029872 - RNA, 20 nt, Homo sapiens
uaacaguugugaugacuaug

SEQ ID NO: 1029873 - RNA, 22 nt, Homo sapiens
uaacauccacaaagagauuauu

SEQ ID NO: 1029874 - RNA, 17 nt, Homo sapiens
uaacaugcaauuuugca

SEQ ID NO: 1029875 - RNA, 20 nt, Homo sapiens
uaacauugggaaaucuuaua

SEQ ID NO: 1029876 - RNA, 11 nt, Homo sapiens
uaacauuugcc

SEQ ID NO: 1029877 - RNA, 19 nt, Homo sapiens
uaaccacaaagcacaguuu

SEQ ID NO: 1029878 - RNA, 18 nt, Homo sapiens
uaaccagcagaaaugccu

SEQ ID NO: 1029879 - RNA, 14 nt, Homo sapiens
uaaccaguucuguc

SEQ ID NO: 1029880 - RNA, 21 nt, Homo sapiens
uaaccccuggcaaccaggaau

SEQ ID NO: 1029881 - RNA, 16 nt, Homo sapiens
uaacccucccauggca

SEQ ID NO: 1029882 - RNA, 17 nt, Homo sapiens
uaacgaccacagggucu

SEQ ID NO: 1029883 - RNA, 15 nt, Homo sapiens
uaacuauauuugcuu

SEQ ID NO: 1029884 - RNA, 18 nt, Homo sapiens
uaacuaugaccaugcuga

SEQ ID NO: 1029885 - RNA, 13 nt, Homo sapiens
uaacuauucauaa

SEQ ID NO: 1029886 - RNA, 14 nt, Homo sapiens
uaacuauugcccag

SEQ ID NO: 1029887 - RNA, 23 nt, Homo sapiens
uaacucagaaacaucaguuacuc

SEQ ID NO: 1029888 - RNA, 21 nt, Homo sapiens
uaacucagaucacuacugcag

SEQ ID NO: 1029889 - RNA, 19 nt, Homo sapiens
uaacuccuagcugacucag

SEQ ID NO: 1029890 - RNA, 20 nt, Homo sapiens
uaacucugaccugggagccc

SEQ ID NO: 1029891 - RNA, 17 nt, Homo sapiens
uaacugccuuguguaca

SEQ ID NO: 1029892 - RNA, 13 nt, Homo sapiens
uaacuuauaucau

SEQ ID NO: 1029893 - RNA, 17 nt, Homo sapiens
uaacuuaugaaccuuua

SEQ ID NO: 1029894 - RNA, 20 nt, Homo sapiens
uaacuucaaggcccauaucu

SEQ ID NO: 1029895 - RNA, 21 nt, Homo sapiens
uaacuucaauguaguuuucca

SEQ ID NO: 1029896 - RNA, 19 nt, Homo sapiens
uaacuugcugcaguaugaa

SEQ ID NO: 1029897 - RNA, 21 nt, Homo sapiens
accuccuacgucaaacaugaa

SEQ ID NO: 1029898 - RNA, 11 nt, Homo sapiens
accuccucaug

SEQ ID NO: 1029899 - RNA, 23 nt, Homo sapiens
accucgcccggcccgaucuuucu

SEQ ID NO: 1029900 - RNA, 17 nt, Homo sapiens
accucgcuggacucuca

SEQ ID NO: 1029901 - RNA, 13 nt, Homo sapiens
accucgugaucca

SEQ ID NO: 1029902 - RNA, 13 nt, Homo sapiens
accucuaacugau

SEQ ID NO: 1029903 - RNA, 13 nt, Homo sapiens
accucuaugcaau

SEQ ID NO: 1029904 - RNA, 14 nt, Homo sapiens
accucucaauuucu

SEQ ID NO: 1029905 - RNA, 19 nt, Homo sapiens
accucucuccuuugcugag

SEQ ID NO: 1029906 - RNA, 20 nt, Homo sapiens
accucugccuccuaaguuca

SEQ ID NO: 1029907 - RNA, 20 nt, Homo sapiens
accucugccugaagucacac

SEQ ID NO: 1029908 - RNA, 22 nt, Homo sapiens
accucugccugaagucacacag

SEQ ID NO: 1029909 - RNA, 23 nt, Homo sapiens
accucugccugaagucacacagu

SEQ ID NO: 1029910 - RNA, 21 nt, Homo sapiens
accucuuaaagaaaacccacc

SEQ ID NO: 1029911 - RNA, 14 nt, Homo sapiens
accucuuagcugag

SEQ ID NO: 1029912 - RNA, 14 nt, Homo sapiens
accucuuauugcaa

SEQ ID NO: 1029913 - RNA, 17 nt, Homo sapiens
accucuugagccuugaa

SEQ ID NO: 1029914 - RNA, 23 nt, Homo sapiens
accucuuggccacagaggacuca

SEQ ID NO: 1029915 - RNA, 22 nt, Homo sapiens
accugaaauaaaauucauuagu

SEQ ID NO: 1029916 - RNA, 19 nt, Homo sapiens
accugaggcuccugugcua

SEQ ID NO: 1029917 - RNA, 20 nt, Homo sapiens
accugaucaaugacagagcc

SEQ ID NO: 1029918 - RNA, 17 nt, Homo sapiens
accugcacuuacaggcc

SEQ ID NO: 1029919 - RNA, 19 nt, Homo sapiens
accugccaggcacacugag

SEQ ID NO: 1029920 - RNA, 15 nt, Homo sapiens
accugcccugccuga

SEQ ID NO: 1029921 - RNA, 16 nt, Homo sapiens
accugcccugggccac

SEQ ID NO: 1029922 - RNA, 14 nt, Homo sapiens
accugccugcauuc

SEQ ID NO: 1029923 - RNA, 16 nt, Homo sapiens
accugcgggagcugca

SEQ ID NO: 1029924 - RNA, 18 nt, Homo sapiens
accugcugagggaccagc

SEQ ID NO: 1029925 - RNA, 18 nt, Homo sapiens
accuggaauuguggggca

SEQ ID NO: 1029926 - RNA, 22 nt, Homo sapiens
accuggagggaaugaaccugga

SEQ ID NO: 1029927 - RNA, 21 nt, Homo sapiens
accuggagggcuagaaccuag

SEQ ID NO: 1029928 - RNA, 21 nt, Homo sapiens
accuggaggggcuagaaccua

SEQ ID NO: 1029929 - RNA, 16 nt, Homo sapiens
accuggcaaggacaca

SEQ ID NO: 1029930 - RNA, 19 nt, Homo sapiens
accuggcagccacaacugc

SEQ ID NO: 1029931 - RNA, 21 nt, Homo sapiens
accuggcagguuagaaccuag

SEQ ID NO: 1029932 - RNA, 18 nt, Homo sapiens
accuggcccugugccuug

SEQ ID NO: 1029933 - RNA, 15 nt, Homo sapiens
accugggcaaagccu

SEQ ID NO: 1029934 - RNA, 18 nt, Homo sapiens
accuggguaaaugcagcg

SEQ ID NO: 1029935 - RNA, 16 nt, Homo sapiens
accuguaaucauauaa

SEQ ID NO: 1029936 - RNA, 22 nt, Homo sapiens
accuguagucccagcuacucag

SEQ ID NO: 1029937 - RNA, 11 nt, Homo sapiens
accugucaaug

SEQ ID NO: 1029938 - RNA, 14 nt, Homo sapiens
accuguccuugcac

SEQ ID NO: 1029939 - RNA, 15 nt, Homo sapiens
accuguuacuugaaa

SEQ ID NO: 1029940 - RNA, 20 nt, Homo sapiens
accuguucagugucccgggc

SEQ ID NO: 1029941 - RNA, 15 nt, Homo sapiens
accuguugcuuacaa

SEQ ID NO: 1029942 - RNA, 19 nt, Homo sapiens
accuguuuaaauauuucaa

SEQ ID NO: 1029943 - RNA, 14 nt, Homo sapiens
accuuaaacaagcu

SEQ ID NO: 1029944 - RNA, 19 nt, Homo sapiens
accuuagauuagcucugga

SEQ ID NO: 1029945 - RNA, 16 nt, Homo sapiens
accuuaggcagggaag

SEQ ID NO: 1029946 - RNA, 14 nt, Homo sapiens
accuuaguguuucu

SEQ ID NO: 1029947 - RNA, 17 nt, Homo sapiens
accuuauuguaccucuc

SEQ ID NO: 1029948 - RNA, 11 nt, Homo sapiens
accuuccccag

SEQ ID NO: 1029949 - RNA, 21 nt, Homo sapiens
accuucuaggaagcuccaguu

SEQ ID NO: 1029950 - RNA, 17 nt, Homo sapiens
accuugacggcauugcu

SEQ ID NO: 1029951 - RNA, 18 nt, Homo sapiens
accuuggggcuugacuuu

SEQ ID NO: 1029952 - RNA, 20 nt, Homo sapiens
accuugugacccagcacugc

SEQ ID NO: 1029953 - RNA, 16 nt, Homo sapiens
accuuguuauuucuca

SEQ ID NO: 1029954 - RNA, 23 nt, Homo sapiens
accuuucacaagggcaaacuuuu

SEQ ID NO: 1029955 - RNA, 16 nt, Homo sapiens
accuuuuuauuugcau

SEQ ID NO: 1029956 - RNA, 18 nt, Homo sapiens
accuuuuucauacaaggc

SEQ ID NO: 1029957 - RNA, 19 nt, Homo sapiens
acgaacuuuagcugcaucc

SEQ ID NO: 1029958 - RNA, 21 nt, Homo sapiens
acgaauggcagcauacacaga

SEQ ID NO: 1029959 - RNA, 22 nt, Homo sapiens
acgacaaagccaaacucugcca

SEQ ID NO: 1029960 - RNA, 14 nt, Homo sapiens
acgacucugaccuc

SEQ ID NO: 1029961 - RNA, 22 nt, Homo sapiens
acgagccuauuucucuuugcac

SEQ ID NO: 1029962 - RNA, 14 nt, Homo sapiens
acgaggacagguug

SEQ ID NO: 1029963 - RNA, 18 nt, Homo sapiens
acgcacucaacuuccuuu

SEQ ID NO: 1029964 - RNA, 15 nt, Homo sapiens
acgcagaucacuaaa

SEQ ID NO: 1029965 - RNA, 15 nt, Homo sapiens
acgcaugugcagcua

SEQ ID NO: 1029966 - RNA, 21 nt, Homo sapiens
acgccacugcacuauagccua

SEQ ID NO: 1029967 - RNA, 22 nt, Homo sapiens
acgccauuuccuuuuccuucaa

SEQ ID NO: 1029968 - RNA, 14 nt, Homo sapiens
acgccugagcucac

SEQ ID NO: 1029969 - RNA, 19 nt, Homo sapiens
acgccugcccuccccagag

SEQ ID NO: 1029970 - RNA, 17 nt, Homo sapiens
acgccuguaaucccagc

SEQ ID NO: 1029971 - RNA, 16 nt, Homo sapiens
acgccuguaauccuag

SEQ ID NO: 1029972 - RNA, 15 nt, Homo sapiens
acgcugucuccagac

SEQ ID NO: 1029973 - RNA, 14 nt, Homo sapiens
acgcuuucaugaau

SEQ ID NO: 1029974 - RNA, 20 nt, Homo sapiens
acggaauaaugaguuagaac

SEQ ID NO: 1029975 - RNA, 20 nt, Homo sapiens
acggacuccagucugugugu

SEQ ID NO: 1029976 - RNA, 19 nt, Homo sapiens
acggagucucgcucuguca

SEQ ID NO: 1029977 - RNA, 23 nt, Homo sapiens
acggaugauuggauuauucauuu

SEQ ID NO: 1029978 - RNA, 11 nt, Homo sapiens
acggcaaaaug

SEQ ID NO: 1029979 - RNA, 17 nt, Homo sapiens
acggcucaugccuguaa

SEQ ID NO: 1029980 - RNA, 15 nt, Homo sapiens
acggcucucaccagu

SEQ ID NO: 1029981 - RNA, 20 nt, Homo sapiens
acgggcccgugacaucccca

SEQ ID NO: 1029982 - RNA, 14 nt, Homo sapiens
acgggcucagcaaa

SEQ ID NO: 1029983 - RNA, 16 nt, Homo sapiens
acggggcuugcaacuu

SEQ ID NO: 1029984 - RNA, 20 nt, Homo sapiens
acgggucuguguucgacuca

SEQ ID NO: 1029985 - RNA, 19 nt, Homo sapiens
acggugcagucugggugcu

SEQ ID NO: 1029986 - RNA, 21 nt, Homo sapiens
acggugcagucugggugcucg

SEQ ID NO: 1029987 - RNA, 14 nt, Homo sapiens
acggugggcauuug

SEQ ID NO: 1029988 - RNA, 14 nt, Homo sapiens
acgguucaccagcc

SEQ ID NO: 1029989 - RNA, 17 nt, Homo sapiens
acguaugcaugugaaga

SEQ ID NO: 1029990 - RNA, 22 nt, Homo sapiens
acguauuuuuucuaaugugcau

SEQ ID NO: 1029991 - RNA, 17 nt, Homo sapiens
acgucuguggacugaau

SEQ ID NO: 1029992 - RNA, 17 nt, Homo sapiens
acgugacuguggcacac

SEQ ID NO: 1029993 - RNA, 20 nt, Homo sapiens
acgugagaucauucacucau

SEQ ID NO: 1029994 - RNA, 14 nt, Homo sapiens
acgugagccaggua

SEQ ID NO: 1029995 - RNA, 22 nt, Homo sapiens
acgugauucaauucaacacucc

SEQ ID NO: 1029996 - RNA, 22 nt, Homo sapiens
acguggacuccagacucucugu

SEQ ID NO: 1029997 - RNA, 19 nt, Homo sapiens
acgugggcaaacaggcagu

SEQ ID NO: 1029998 - RNA, 21 nt, Homo sapiens
acguguguauugcaaugggaa

SEQ ID NO: 1029999 - RNA, 17 nt, Homo sapiens
acguuagaccacaaaua

SEQ ID NO: 1030000 - RNA, 13 nt, Homo sapiens
acguugugcauuu

SEQ ID NO: 1030001 - RNA, 14 nt, Homo sapiens
uaauuauuuugaca

SEQ ID NO: 1030002 - RNA, 15 nt, Homo sapiens
uaauucaaacuaaua

SEQ ID NO: 1030003 - RNA, 19 nt, Homo sapiens
uaauucagcacugauuuca

SEQ ID NO: 1030004 - RNA, 12 nt, Homo sapiens
uaauucuucacc

SEQ ID NO: 1030005 - RNA, 15 nt, Homo sapiens
uaauugaacuaacaa

SEQ ID NO: 1030006 - RNA, 19 nt, Homo sapiens
uaauugaucaaauucauuu

SEQ ID NO: 1030007 - RNA, 21 nt, Homo sapiens
uaauuggaagaaauuccugua

SEQ ID NO: 1030008 - RNA, 12 nt, Homo sapiens
uaauugguucuu

SEQ ID NO: 1030009 - RNA, 15 nt, Homo sapiens
uaauuguaucagagg

SEQ ID NO: 1030010 - RNA, 10 nt, Homo sapiens
uaauugugaa

SEQ ID NO: 1030011 - RNA, 13 nt, Homo sapiens
uaauugugaauua

SEQ ID NO: 1030012 - RNA, 12 nt, Homo sapiens
uaauuuaaucuu

SEQ ID NO: 1030013 - RNA, 19 nt, Homo sapiens
uaauuuaaucuuccaugga

SEQ ID NO: 1030014 - RNA, 14 nt, Homo sapiens
uaauuuaaugcaug

SEQ ID NO: 1030015 - RNA, 13 nt, Homo sapiens
uaauuucagaaga

SEQ ID NO: 1030016 - RNA, 21 nt, Homo sapiens
uaauuugauaguauugugcau

SEQ ID NO: 1030017 - RNA, 18 nt, Homo sapiens
uaauuuuaaguaauuuca

SEQ ID NO: 1030018 - RNA, 17 nt, Homo sapiens
uaauuuuguauuuucca

SEQ ID NO: 1030019 - RNA, 23 nt, Homo sapiens
uaauuuuguuuauauuuucccau

SEQ ID NO: 1030020 - RNA, 15 nt, Homo sapiens
uacaaaaaacaacaa

SEQ ID NO: 1030021 - RNA, 17 nt, Homo sapiens
uacaaaaacacagcaag

SEQ ID NO: 1030022 - RNA, 16 nt, Homo sapiens
uacaaaaacauggccu

SEQ ID NO: 1030023 - RNA, 13 nt, Homo sapiens
uacaaacaccugg

SEQ ID NO: 1030024 - RNA, 17 nt, Homo sapiens
uacaaacucccacuugu

SEQ ID NO: 1030025 - RNA, 13 nt, Homo sapiens
uacaaagaaauaa

SEQ ID NO: 1030026 - RNA, 14 nt, Homo sapiens
uacaaaguauuugc

SEQ ID NO: 1030027 - RNA, 16 nt, Homo sapiens
uacaaauagaauuuga

SEQ ID NO: 1030028 - RNA, 15 nt, Homo sapiens
uacaacacacacugu

SEQ ID NO: 1030029 - RNA, 13 nt, Homo sapiens
uacaaguguauau

SEQ ID NO: 1030030 - RNA, 21 nt, Homo sapiens
uacaauaaaacuuugcugcca

SEQ ID NO: 1030031 - RNA, 19 nt, Homo sapiens
uacaaugacuuuauugcau

SEQ ID NO: 1030032 - RNA, 14 nt, Homo sapiens
uacaauguuaaccc

SEQ ID NO: 1030033 - RNA, 17 nt, Homo sapiens
uacaauucaggcuuugg

SEQ ID NO: 1030034 - RNA, 11 nt, Homo sapiens
uacaauuguga

SEQ ID NO: 1030035 - RNA, 20 nt, Homo sapiens
uacaauuuuuuaucaugcau

SEQ ID NO: 1030036 - RNA, 22 nt, Homo sapiens
uacaauuuuuuaucaugcaugu

SEQ ID NO: 1030037 - RNA, 14 nt, Homo sapiens
uacacacagcagua

SEQ ID NO: 1030038 - RNA, 21 nt, Homo sapiens
uacacacuguugucaaaaagu

SEQ ID NO: 1030039 - RNA, 16 nt, Homo sapiens
uacacagaucacagcu

SEQ ID NO: 1030040 - RNA, 16 nt, Homo sapiens
uacacagaugaaggug

SEQ ID NO: 1030041 - RNA, 15 nt, Homo sapiens
uacacauacauguaa

SEQ ID NO: 1030042 - RNA, 18 nt, Homo sapiens
uacaccauuaucuuggaa

SEQ ID NO: 1030043 - RNA, 19 nt, Homo sapiens
uacaccccaacagcacccu

SEQ ID NO: 1030044 - RNA, 15 nt, Homo sapiens
uacacgugacagagu

SEQ ID NO: 1030045 - RNA, 16 nt, Homo sapiens
uacacguggaggaaug

SEQ ID NO: 1030046 - RNA, 21 nt, Homo sapiens
uacacuaaaaggugaccaaug

SEQ ID NO: 1030047 - RNA, 17 nt, Homo sapiens
uacagaacccauuccau

SEQ ID NO: 1030048 - RNA, 18 nt, Homo sapiens
uacagacuucuccagacc

SEQ ID NO: 1030049 - RNA, 15 nt, Homo sapiens
uacagagaaccugga

SEQ ID NO: 1030050 - RNA, 12 nt, Homo sapiens
acuauuuuuacu

SEQ ID NO: 1030051 - RNA, 14 nt, Homo sapiens
acucaaaagagaga

SEQ ID NO: 1030052 - RNA, 14 nt, Homo sapiens
acucaaacugagga

SEQ ID NO: 1030053 - RNA, 14 nt, Homo sapiens
acucaaacugccuu

SEQ ID NO: 1030054 - RNA, 21 nt, Homo sapiens
acucaaaugcucagaccagcu

SEQ ID NO: 1030055 - RNA, 15 nt, Homo sapiens
acucaauucugcagu

SEQ ID NO: 1030056 - RNA, 11 nt, Homo sapiens
acucacacagg

SEQ ID NO: 1030057 - RNA, 21 nt, Homo sapiens
acucacacggacacucaaaag

SEQ ID NO: 1030058 - RNA, 23 nt, Homo sapiens
acucacacggacacucaaaagcu

SEQ ID NO: 1030059 - RNA, 20 nt, Homo sapiens
acucacuuaucccaagagaa

SEQ ID NO: 1030060 - RNA, 18 nt, Homo sapiens
acucagaucacuacugca

SEQ ID NO: 1030061 - RNA, 16 nt, Homo sapiens
acucagccaagcacag

SEQ ID NO: 1030062 - RNA, 21 nt, Homo sapiens
acucagccuggcugauuauca

SEQ ID NO: 1030063 - RNA, 22 nt, Homo sapiens
acucagccuggcugauuaucac

SEQ ID NO: 1030064 - RNA, 18 nt, Homo sapiens
acucagcucuuggcucca

SEQ ID NO: 1030065 - RNA, 19 nt, Homo sapiens
acucagcucuuggcuccac

SEQ ID NO: 1030066 - RNA, 15 nt, Homo sapiens
acucaggaugcccag

SEQ ID NO: 1030067 - RNA, 13 nt, Homo sapiens
acucauagcacuu

SEQ ID NO: 1030068 - RNA, 19 nt, Homo sapiens
acucaucccuguuccucaa

SEQ ID NO: 1030069 - RNA, 17 nt, Homo sapiens
acucaucuuagugccug

SEQ ID NO: 1030070 - RNA, 13 nt, Homo sapiens
acucauucaggga

SEQ ID NO: 1030071 - RNA, 22 nt, Homo sapiens
acucauuucauuccuaacacag

SEQ ID NO: 1030072 - RNA, 17 nt, Homo sapiens
acuccacagucaauauu

SEQ ID NO: 1030073 - RNA, 21 nt, Homo sapiens
acuccagauuuuuuacagcug

SEQ ID NO: 1030074 - RNA, 13 nt, Homo sapiens
acuccagugguga

SEQ ID NO: 1030075 - RNA, 15 nt, Homo sapiens
acuccaguggugaag

SEQ ID NO: 1030076 - RNA, 14 nt, Homo sapiens
acuccaucucuuaa

SEQ ID NO: 1030077 - RNA, 12 nt, Homo sapiens
acuccaugagaa

SEQ ID NO: 1030078 - RNA, 12 nt, Homo sapiens
acuccccugcac

SEQ ID NO: 1030079 - RNA, 15 nt, Homo sapiens
acuccccugcacugg

SEQ ID NO: 1030080 - RNA, 20 nt, Homo sapiens
acucccuccucaccucugga

SEQ ID NO: 1030081 - RNA, 21 nt, Homo sapiens
acucccucguuaaucacagga

SEQ ID NO: 1030082 - RNA, 20 nt, Homo sapiens
acuccgagagcaugcuuaau

SEQ ID NO: 1030083 - RNA, 20 nt, Homo sapiens
acuccuaggcaggacaugcu

SEQ ID NO: 1030084 - RNA, 17 nt, Homo sapiens
acuccuaugaucucagg

SEQ ID NO: 1030085 - RNA, 19 nt, Homo sapiens
acuccucaucaucacucau

SEQ ID NO: 1030086 - RNA, 20 nt, Homo sapiens
acuccucuccgcaguuccug

SEQ ID NO: 1030087 - RNA, 19 nt, Homo sapiens
acuccuguaggaagguuaa

SEQ ID NO: 1030088 - RNA, 17 nt, Homo sapiens
acuccugugucugugua

SEQ ID NO: 1030089 - RNA, 21 nt, Homo sapiens
acuccuuaggcuuuguugaau

SEQ ID NO: 1030090 - RNA, 13 nt, Homo sapiens
acuccuuccauca

SEQ ID NO: 1030091 - RNA, 21 nt, Homo sapiens
acuccuugugguuuaugucau

SEQ ID NO: 1030092 - RNA, 19 nt, Homo sapiens
acucgcccgcccacugucc

SEQ ID NO: 1030093 - RNA, 15 nt, Homo sapiens
acucuaagacuacag

SEQ ID NO: 1030094 - RNA, 14 nt, Homo sapiens
acucuacacuguga

SEQ ID NO: 1030095 - RNA, 18 nt, Homo sapiens
acucuaccagacugugua

SEQ ID NO: 1030096 - RNA, 17 nt, Homo sapiens
acucuaccucauaucag

SEQ ID NO: 1030097 - RNA, 20 nt, Homo sapiens
acucuacuuccucuuaccua

SEQ ID NO: 1030098 - RNA, 21 nt, Homo sapiens
acucuaucugucauacauccu

SEQ ID NO: 1030099 - RNA, 17 nt, Homo sapiens
acucuccuggacugccu

SEQ ID NO: 1030100 - RNA, 20 nt, Homo sapiens
acucuccuugcuacccagaa

SEQ ID NO: 1030101 - RNA, 23 nt, Homo sapiens
acucucuggugagcgaggacauu

SEQ ID NO: 1030102 - RNA, 18 nt, Homo sapiens
acucugaaaucucagaau

SEQ ID NO: 1030103 - RNA, 16 nt, Homo sapiens
acucugacuggcacag

SEQ ID NO: 1030104 - RNA, 15 nt, Homo sapiens
acucugagaucuaag

SEQ ID NO: 1030105 - RNA, 14 nt, Homo sapiens
acucugcacaugaa

SEQ ID NO: 1030106 - RNA, 18 nt, Homo sapiens
acucugcacaugucuugu

SEQ ID NO: 1030107 - RNA, 20 nt, Homo sapiens
acucugcacaugucuuguac

SEQ ID NO: 1030108 - RNA, 19 nt, Homo sapiens
acucugcugcaaaaugaag

SEQ ID NO: 1030109 - RNA, 21 nt, Homo sapiens
acucuggagguuuguuuagaa

SEQ ID NO: 1030110 - RNA, 17 nt, Homo sapiens
acucuuaaguuucucag

SEQ ID NO: 1030111 - RNA, 20 nt, Homo sapiens
acucuuaaguuucucagcuc

SEQ ID NO: 1030112 - RNA, 21 nt, Homo sapiens
acucuuauagaaaguucaaaa

SEQ ID NO: 1030113 - RNA, 13 nt, Homo sapiens
acucuucacggaa

SEQ ID NO: 1030114 - RNA, 16 nt, Homo sapiens
acucuuccaaaggcau

SEQ ID NO: 1030115 - RNA, 21 nt, Homo sapiens
acucuuccgaaaaauccucuu

SEQ ID NO: 1030116 - RNA, 19 nt, Homo sapiens
acucuuugaaugacaaaga

SEQ ID NO: 1030117 - RNA, 16 nt, Homo sapiens
acucuuugguggcuuu

SEQ ID NO: 1030118 - RNA, 15 nt, Homo sapiens
acugaaaaccucucc

SEQ ID NO: 1030119 - RNA, 14 nt, Homo sapiens
acugaaaauacuua

SEQ ID NO: 1030120 - RNA, 14 nt, Homo sapiens
acugaaacauuuaa

SEQ ID NO: 1030121 - RNA, 15 nt, Homo sapiens
acugaaaccaggugg

SEQ ID NO: 1030122 - RNA, 15 nt, Homo sapiens
acugaaagaagacau

SEQ ID NO: 1030123 - RNA, 15 nt, Homo sapiens
acugaagaugcagcu

SEQ ID NO: 1030124 - RNA, 19 nt, Homo sapiens
acugaaguagugugcaguu

SEQ ID NO: 1030125 - RNA, 18 nt, Homo sapiens
acugaagugaacuaugaa

SEQ ID NO: 1030126 - RNA, 18 nt, Homo sapiens
acugaauaaauaccucuu

SEQ ID NO: 1030127 - RNA, 24 nt, Homo sapiens
acugaaucuggaccccaucuguga

SEQ ID NO: 1030128 - RNA, 23 nt, Homo sapiens
acugaaugagaaccaacaaguaa

SEQ ID NO: 1030129 - RNA, 19 nt, Homo sapiens
acugaauguuuauuccuug

SEQ ID NO: 1030130 - RNA, 15 nt, Homo sapiens
acugaauuaaugaca

SEQ ID NO: 1030131 - RNA, 18 nt, Homo sapiens
acugacaguaaaucucac

SEQ ID NO: 1030132 - RNA, 11 nt, Homo sapiens
acugaccagcc

SEQ ID NO: 1030133 - RNA, 22 nt, Homo sapiens
acugagaauauaauacuguauu

SEQ ID NO: 1030134 - RNA, 14 nt, Homo sapiens
acugagagugaagu

SEQ ID NO: 1030135 - RNA, 19 nt, Homo sapiens
acugagaugugaacacauc

SEQ ID NO: 1030136 - RNA, 13 nt, Homo sapiens
acugagauuacag

SEQ ID NO: 1030137 - RNA, 23 nt, Homo sapiens
acugaggaacucacaauuccaaa

SEQ ID NO: 1030138 - RNA, 22 nt, Homo sapiens
acugaggcuccagcaucuagug

SEQ ID NO: 1030139 - RNA, 17 nt, Homo sapiens
acugagggacucugaag

SEQ ID NO: 1030140 - RNA, 17 nt, Homo sapiens
acugaggggguuggggu

SEQ ID NO: 1030141 - RNA, 19 nt, Homo sapiens
acugaguacguugugcauu

SEQ ID NO: 1030142 - RNA, 22 nt, Homo sapiens
acugaguacguugugcauuugg

SEQ ID NO: 1030143 - RNA, 14 nt, Homo sapiens
acugauaaccacuc

SEQ ID NO: 1030144 - RNA, 14 nt, Homo sapiens
acugauauccuccu

SEQ ID NO: 1030145 - RNA, 12 nt, Homo sapiens
acugaugaaggc

SEQ ID NO: 1030146 - RNA, 19 nt, Homo sapiens
acugaugggcaacccccag

SEQ ID NO: 1030147 - RNA, 18 nt, Homo sapiens
agcuggcacugucucugc

SEQ ID NO: 1030148 - RNA, 22 nt, Homo sapiens
agcuggcagcagaguguggccu

SEQ ID NO: 1030149 - RNA, 14 nt, Homo sapiens
agcuggcgucuguc

SEQ ID NO: 1030150 - RNA, 17 nt, Homo sapiens
agcugggacuacaggug

SEQ ID NO: 1030151 - RNA, 20 nt, Homo sapiens
agcugggaugacuggcuuug

SEQ ID NO: 1030152 - RNA, 17 nt, Homo sapiens
agcugggggccaugagc

SEQ ID NO: 1030153 - RNA, 22 nt, Homo sapiens
agcuggguuggaaaacaguauu

SEQ ID NO: 1030154 - RNA, 19 nt, Homo sapiens
agcuggugccccacugaau

SEQ ID NO: 1030155 - RNA, 20 nt, Homo sapiens
agcuggugccccacugaauu

SEQ ID NO: 1030156 - RNA, 15 nt, Homo sapiens
agcugguggcaauaa

SEQ ID NO: 1030157 - RNA, 22 nt, Homo sapiens
agcugucccaucuccacuguua

SEQ ID NO: 1030158 - RNA, 22 nt, Homo sapiens
agcugucuuagagugggaccaa

SEQ ID NO: 1030159 - RNA, 16 nt, Homo sapiens
agcugugacuucucca

SEQ ID NO: 1030160 - RNA, 12 nt, Homo sapiens
agcuguggcuca

SEQ ID NO: 1030161 - RNA, 22 nt, Homo sapiens
agcuguuguacauuuaugauuu

SEQ ID NO: 1030162 - RNA, 20 nt, Homo sapiens
agcuuacuggcaaacaugaa

SEQ ID NO: 1030163 - RNA, 18 nt, Homo sapiens
agcuuagacuaaggccau

SEQ ID NO: 1030164 - RNA, 22 nt, Homo sapiens
agcuuaggggcugcugaccucc

SEQ ID NO: 1030165 - RNA, 18 nt, Homo sapiens
agcuuauauauuacuugu

SEQ ID NO: 1030166 - RNA, 12 nt, Homo sapiens
agcuuaucucag

SEQ ID NO: 1030167 - RNA, 14 nt, Homo sapiens
agcuuaucucaggg

SEQ ID NO: 1030168 - RNA, 14 nt, Homo sapiens
agcuuaugucagac

SEQ ID NO: 1030169 - RNA, 16 nt, Homo sapiens
agcuuauuaaaacuca

SEQ ID NO: 1030170 - RNA, 14 nt, Homo sapiens
agcuucaccagagc

SEQ ID NO: 1030171 - RNA, 17 nt, Homo sapiens
agcuucaccagagcauu

SEQ ID NO: 1030172 - RNA, 16 nt, Homo sapiens
agcuucuaucccagga

SEQ ID NO: 1030173 - RNA, 15 nt, Homo sapiens
agcuucucauccugc

SEQ ID NO: 1030174 - RNA, 18 nt, Homo sapiens
agcuucucugaugugaua

SEQ ID NO: 1030175 - RNA, 18 nt, Homo sapiens
agcuucugcccaccuacu

SEQ ID NO: 1030176 - RNA, 14 nt, Homo sapiens
agcuugaaucuacu

SEQ ID NO: 1030177 - RNA, 13 nt, Homo sapiens
agcuugcagugag

SEQ ID NO: 1030178 - RNA, 23 nt, Homo sapiens
agcuuggauggagacuccaugag

SEQ ID NO: 1030179 - RNA, 24 nt, Homo sapiens
agcuuggccagaagggggccauga

SEQ ID NO: 1030180 - RNA, 19 nt, Homo sapiens
agcuuggcuguagaaggag

SEQ ID NO: 1030181 - RNA, 17 nt, Homo sapiens
agcuuguaaauagcuca

SEQ ID NO: 1030182 - RNA, 19 nt, Homo sapiens
agcuuucaugaguuuccca

SEQ ID NO: 1030183 - RNA, 23 nt, Homo sapiens
agcuuuccugagcugaagugccu

SEQ ID NO: 1030184 - RNA, 12 nt, Homo sapiens
agcuuucugucc

SEQ ID NO: 1030185 - RNA, 19 nt, Homo sapiens
agcuuugccagcugcugcu

SEQ ID NO: 1030186 - RNA, 20 nt, Homo sapiens
agcuuugcuuccgacaccuc

SEQ ID NO: 1030187 - RNA, 17 nt, Homo sapiens
aggaaaaaauuaauacu

SEQ ID NO: 1030188 - RNA, 16 nt, Homo sapiens
aggaaaaaugaguaau

SEQ ID NO: 1030189 - RNA, 18 nt, Homo sapiens
aggaaaagcaaauugaug

SEQ ID NO: 1030190 - RNA, 20 nt, Homo sapiens
aggaaaaguaaggugcaguu

SEQ ID NO: 1030191 - RNA, 15 nt, Homo sapiens
aggaaaauuucacau

SEQ ID NO: 1030192 - RNA, 13 nt, Homo sapiens
aggaaacaacagc

SEQ ID NO: 1030193 - RNA, 16 nt, Homo sapiens
aggaaacucaccugcu

SEQ ID NO: 1030194 - RNA, 22 nt, Homo sapiens
aggaaacuggguuccugcaaug

SEQ ID NO: 1030195 - RNA, 15 nt, Homo sapiens
aggaaagcauguauu

SEQ ID NO: 1030196 - RNA, 23 nt, Homo sapiens
aggaaagggauaguccaaagacu

SEQ ID NO: 1030197 - RNA, 20 nt, Homo sapiens
aggaaauauucuguaaucuu

SEQ ID NO: 1030198 - RNA, 13 nt, Homo sapiens
aggaaaugaauga

SEQ ID NO: 1030199 - RNA, 12 nt, Homo sapiens
aggaacacugca

SEQ ID NO: 1030200 - RNA, 13 nt, Homo sapiens
aggaacauuccuu

SEQ ID NO: 1030201 - RNA, 20 nt, Homo sapiens
aggaacauuccuuagucuca

SEQ ID NO: 1030202 - RNA, 23 nt, Homo sapiens
aggaagaagucuaagagugaagu

SEQ ID NO: 1030203 - RNA, 15 nt, Homo sapiens
aggaagacaauguga

SEQ ID NO: 1030204 - RNA, 14 nt, Homo sapiens
aggaagacuuugga

SEQ ID NO: 1030205 - RNA, 20 nt, Homo sapiens
aggaagccucccacgacugc

SEQ ID NO: 1030206 - RNA, 19 nt, Homo sapiens
aggaagcuccacugucacc

SEQ ID NO: 1030207 - RNA, 22 nt, Homo sapiens
aggaagguggugcuuacauccu

SEQ ID NO: 1030208 - RNA, 23 nt, Homo sapiens
aggaauaaaaugaaauacuaaau

SEQ ID NO: 1030209 - RNA, 23 nt, Homo sapiens
aggaauaguugagccccaagucc

SEQ ID NO: 1030210 - RNA, 15 nt, Homo sapiens
aggaauaugggagaa

SEQ ID NO: 1030211 - RNA, 17 nt, Homo sapiens
aggaauaugggagaaau

SEQ ID NO: 1030212 - RNA, 17 nt, Homo sapiens
aggaaugaagccuuagc

SEQ ID NO: 1030213 - RNA, 21 nt, Homo sapiens
aggaauucgagaccagccuga

SEQ ID NO: 1030214 - RNA, 16 nt, Homo sapiens
aggaauucuaggcauc

SEQ ID NO: 1030215 - RNA, 17 nt, Homo sapiens
aggaauuugcauuuagu

SEQ ID NO: 1030216 - RNA, 12 nt, Homo sapiens
aggacaaagccu

SEQ ID NO: 1030217 - RNA, 21 nt, Homo sapiens
aggacaaccauuccagacugc

SEQ ID NO: 1030218 - RNA, 23 nt, Homo sapiens
aggacacacauagauaccuucaa

SEQ ID NO: 1030219 - RNA, 14 nt, Homo sapiens
aggacacagcagug

SEQ ID NO: 1030220 - RNA, 15 nt, Homo sapiens
aggacagugacccca

SEQ ID NO: 1030221 - RNA, 18 nt, Homo sapiens
aggacauuuuacugcagu

SEQ ID NO: 1030222 - RNA, 15 nt, Homo sapiens
aggaccuagggaugu

SEQ ID NO: 1030223 - RNA, 23 nt, Homo sapiens
aggacggugcaacccaaggacug

SEQ ID NO: 1030224 - RNA, 17 nt, Homo sapiens
aggacguugaggacuuu

SEQ ID NO: 1030225 - RNA, 17 nt, Homo sapiens
aggacuauagcccaggu

SEQ ID NO: 1030226 - RNA, 21 nt, Homo sapiens
aggacucuauuuuaaggacug

SEQ ID NO: 1030227 - RNA, 19 nt, Homo sapiens
aggacugaucgauuugcac

SEQ ID NO: 1030228 - RNA, 20 nt, Homo sapiens
aggacugaucgauuugcacc

SEQ ID NO: 1030229 - RNA, 23 nt, Homo sapiens
aggacugcgggacuugggucuca

SEQ ID NO: 1030230 - RNA, 20 nt, Homo sapiens
aggacuuaacggcuccagga

SEQ ID NO: 1030231 - RNA, 21 nt, Homo sapiens
aggacuuccauuugcuuuguc

SEQ ID NO: 1030232 - RNA, 13 nt, Homo sapiens
aggacuucuggca

SEQ ID NO: 1030233 - RNA, 15 nt, Homo sapiens
aggacuugaaagcau

SEQ ID NO: 1030234 - RNA, 13 nt, Homo sapiens
aggagaaacacau

SEQ ID NO: 1030235 - RNA, 19 nt, Homo sapiens
aggagaaacuggaacucuc

SEQ ID NO: 1030236 - RNA, 15 nt, Homo sapiens
aggagaaucacuuga

SEQ ID NO: 1030237 - RNA, 21 nt, Homo sapiens
aggagaaucacuugaacccag

SEQ ID NO: 1030238 - RNA, 17 nt, Homo sapiens
aggagaaucacuugcac

SEQ ID NO: 1030239 - RNA, 15 nt, Homo sapiens
aggagacuagauugc

SEQ ID NO: 1030240 - RNA, 20 nt, Homo sapiens
aggagauggaaguugcagug

SEQ ID NO: 1030241 - RNA, 22 nt, Homo sapiens
aggagccaggccuugggcuccu

SEQ ID NO: 1030242 - RNA, 15 nt, Homo sapiens
aggagcccugcagug

SEQ ID NO: 1030243 - RNA, 15 nt, Homo sapiens
aggaggaugggcucg

SEQ ID NO: 1030244 - RNA, 20 nt, Homo sapiens
aggaggcagcuguugcagug

SEQ ID NO: 1030245 - RNA, 18 nt, Homo sapiens
aggaggccaccucuccaa

SEQ ID NO: 1030246 - RNA, 21 nt, Homo sapiens
aggaggccuccacuccggauc

SEQ ID NO: 1030247 - RNA, 20 nt, Homo sapiens
aggaggcuuaggacuuucca

SEQ ID NO: 1030248 - RNA, 22 nt, Homo sapiens
aggaggggaggaacacugcacu

SEQ ID NO: 1030249 - RNA, 17 nt, Homo sapiens
aggagggugagugcaag

SEQ ID NO: 1030250 - RNA, 23 nt, Homo sapiens
aggaggugaccaaaucaguguga

SEQ ID NO: 1030251 - RNA, 22 nt, Homo sapiens
aggaggugcuaucgcaccacug

SEQ ID NO: 1030252 - RNA, 23 nt, Homo sapiens
aggaggugcuaucgcaccacugu

SEQ ID NO: 1030253 - RNA, 17 nt, Homo sapiens
aggagguuuaggucaag

SEQ ID NO: 1030254 - RNA, 20 nt, Homo sapiens
aggaguacaccccaacagca

SEQ ID NO: 1030255 - RNA, 22 nt, Homo sapiens
aggaguacaccccaacagcacc

SEQ ID NO: 1030256 - RNA, 15 nt, Homo sapiens
aggaguaguggcccu

SEQ ID NO: 1030257 - RNA, 17 nt, Homo sapiens
aggagucagaaacuguu

SEQ ID NO: 1030258 - RNA, 21 nt, Homo sapiens
aggaguucacuucaucuucuc

SEQ ID NO: 1030259 - RNA, 18 nt, Homo sapiens
aggauacuuuacaugguu

SEQ ID NO: 1030260 - RNA, 24 nt, Homo sapiens
aggauauguucacaccuagcguca

SEQ ID NO: 1030261 - RNA, 13 nt, Homo sapiens
aggauauuaacaa

SEQ ID NO: 1030262 - RNA, 19 nt, Homo sapiens
aggauauuaacaacaauaa

SEQ ID NO: 1030263 - RNA, 21 nt, Homo sapiens
aggauauugggucagugucca

SEQ ID NO: 1030264 - RNA, 18 nt, Homo sapiens
aggauccccucucuuccu

SEQ ID NO: 1030265 - RNA, 13 nt, Homo sapiens
aggaucuugccug

SEQ ID NO: 1030266 - RNA, 19 nt, Homo sapiens
aggaucuugccugcaugaa

SEQ ID NO: 1030267 - RNA, 23 nt, Homo sapiens
aggaugagagcccagagguaaca

SEQ ID NO: 1030268 - RNA, 13 nt, Homo sapiens
aggauggcacugu

SEQ ID NO: 1030269 - RNA, 17 nt, Homo sapiens
aggaugggaaggaggga

SEQ ID NO: 1030270 - RNA, 18 nt, Homo sapiens
aggaugucacagggccaa

SEQ ID NO: 1030271 - RNA, 17 nt, Homo sapiens
aggauguucugggacac

SEQ ID NO: 1030272 - RNA, 12 nt, Homo sapiens
aggauuacccac

SEQ ID NO: 1030273 - RNA, 14 nt, Homo sapiens
aggauugcuacugu

SEQ ID NO: 1030274 - RNA, 15 nt, Homo sapiens
aggauuucaugauuu

SEQ ID NO: 1030275 - RNA, 19 nt, Homo sapiens
aggauuugggcucuuggaa

SEQ ID NO: 1030276 - RNA, 13 nt, Homo sapiens
aggcaaaaagaca

SEQ ID NO: 1030277 - RNA, 20 nt, Homo sapiens
aggcaaaauugauauacuuu

SEQ ID NO: 1030278 - RNA, 13 nt, Homo sapiens
aggcacuaaaaag

SEQ ID NO: 1030279 - RNA, 15 nt, Homo sapiens
aggcacucccaucca

SEQ ID NO: 1030280 - RNA, 23 nt, Homo sapiens
aggcagaacugcuugaacccagg

SEQ ID NO: 1030281 - RNA, 14 nt, Homo sapiens
aggcagagaaucau

SEQ ID NO: 1030282 - RNA, 19 nt, Homo sapiens
aggcagagaggagccagga

SEQ ID NO: 1030283 - RNA, 12 nt, Homo sapiens
aggcagcucaag

SEQ ID NO: 1030284 - RNA, 19 nt, Homo sapiens
aggcagcuggaugagacuu

SEQ ID NO: 1030285 - RNA, 23 nt, Homo sapiens
aggcagcuuuuucucucccacua

SEQ ID NO: 1030286 - RNA, 20 nt, Homo sapiens
aggcagggucucacucuguc

SEQ ID NO: 1030287 - RNA, 22 nt, Homo sapiens
aggcauaagacccuaagccucc

SEQ ID NO: 1030288 - RNA, 15 nt, Homo sapiens
aggcauacugacacu

SEQ ID NO: 1030289 - RNA, 15 nt, Homo sapiens
aggcauaucagucuc

SEQ ID NO: 1030290 - RNA, 12 nt, Homo sapiens
ucagcauaccuu

SEQ ID NO: 1030291 - RNA, 17 nt, Homo sapiens
ucagcaugcauccuuug

SEQ ID NO: 1030292 - RNA, 14 nt, Homo sapiens
ucagccacauucua

SEQ ID NO: 1030293 - RNA, 23 nt, Homo sapiens
ucagccccaccccagguccugca

SEQ ID NO: 1030294 - RNA, 18 nt, Homo sapiens
ucagccuggcugauuauc

SEQ ID NO: 1030295 - RNA, 13 nt, Homo sapiens
ucagccuuucuaa

SEQ ID NO: 1030296 - RNA, 15 nt, Homo sapiens
ucagcgugcuuagcc

SEQ ID NO: 1030297 - RNA, 23 nt, Homo sapiens
ucagcucuuggcuccacugggau

SEQ ID NO: 1030298 - RNA, 17 nt, Homo sapiens
ucagcuuauaaaaucaa

SEQ ID NO: 1030299 - RNA, 20 nt, Homo sapiens
ucaggaaaucaaauaugcaa

SEQ ID NO: 1030300 - RNA, 18 nt, Homo sapiens
ucaggaauucgagaccag

SEQ ID NO: 1030301 - RNA, 19 nt, Homo sapiens
ucaggaauuuuguaaucuc

SEQ ID NO: 1030302 - RNA, 19 nt, Homo sapiens
ucaggaccaggcaauguga

SEQ ID NO: 1030303 - RNA, 15 nt, Homo sapiens
ucaggagcagccuca

SEQ ID NO: 1030304 - RNA, 13 nt, Homo sapiens
ucaggagucccaa

SEQ ID NO: 1030305 - RNA, 16 nt, Homo sapiens
ucaggauacucuguca

SEQ ID NO: 1030306 - RNA, 19 nt, Homo sapiens
ucaggaucaagaaaguguu

SEQ ID NO: 1030307 - RNA, 16 nt, Homo sapiens
ucaggaugaacccagg

SEQ ID NO: 1030308 - RNA, 19 nt, Homo sapiens
ucaggauucuguuccuuag

SEQ ID NO: 1030309 - RNA, 18 nt, Homo sapiens
ucaggcaaagugcugcug

SEQ ID NO: 1030310 - RNA, 17 nt, Homo sapiens
ucaggcgauucuccugc

SEQ ID NO: 1030311 - RNA, 16 nt, Homo sapiens
ucaggcuuuggauguu

SEQ ID NO: 1030312 - RNA, 14 nt, Homo sapiens
ucagggaccaagga

SEQ ID NO: 1030313 - RNA, 15 nt, Homo sapiens
ucagggagcauuuau

SEQ ID NO: 1030314 - RNA, 16 nt, Homo sapiens
ucagggagugggcuaa

SEQ ID NO: 1030315 - RNA, 16 nt, Homo sapiens
ucagggauagcacuga

SEQ ID NO: 1030316 - RNA, 23 nt, Homo sapiens
ucagggauagcacugagcaaagc

SEQ ID NO: 1030317 - RNA, 20 nt, Homo sapiens
ucaggggcggggagggugac

SEQ ID NO: 1030318 - RNA, 21 nt, Homo sapiens
ucagggggucuggaaagaagg

SEQ ID NO: 1030319 - RNA, 21 nt, Homo sapiens
ucaggguuuuuagauuaaaca

SEQ ID NO: 1030320 - RNA, 22 nt, Homo sapiens
ucaggugaucuaccugccucag

SEQ ID NO: 1030321 - RNA, 19 nt, Homo sapiens
ucaggugcauuccaccaca

SEQ ID NO: 1030322 - RNA, 24 nt, Homo sapiens
ucaguaaauuguuuuuacugauga

SEQ ID NO: 1030323 - RNA, 17 nt, Homo sapiens
ucaguaguaucaaugau

SEQ ID NO: 1030324 - RNA, 13 nt, Homo sapiens
ucaguaguuuuac

SEQ ID NO: 1030325 - RNA, 18 nt, Homo sapiens
ucaguauaauuuaacuuc

SEQ ID NO: 1030326 - RNA, 12 nt, Homo sapiens
ucagucaaugaa

SEQ ID NO: 1030327 - RNA, 18 nt, Homo sapiens
ucaguccaugaagaugua

SEQ ID NO: 1030328 - RNA, 16 nt, Homo sapiens
ucaguccccauggcac

SEQ ID NO: 1030329 - RNA, 15 nt, Homo sapiens
ucaguccuuugauca

SEQ ID NO: 1030330 - RNA, 16 nt, Homo sapiens
ucagucuauccacaga

SEQ ID NO: 1030331 - RNA, 19 nt, Homo sapiens
ucagucucugagcagugaa

SEQ ID NO: 1030332 - RNA, 20 nt, Homo sapiens
ucagucucugagggcuuccu

SEQ ID NO: 1030333 - RNA, 18 nt, Homo sapiens
ucagucuuuaaucugaga

SEQ ID NO: 1030334 - RNA, 14 nt, Homo sapiens
ucagugaaagccag

SEQ ID NO: 1030335 - RNA, 20 nt, Homo sapiens
ucagugaaagccagauucaa

SEQ ID NO: 1030336 - RNA, 22 nt, Homo sapiens
ucagugauugcaauuugcacaa

SEQ ID NO: 1030337 - RNA, 21 nt, Homo sapiens
ucagugcucccucacauguca

SEQ ID NO: 1030338 - RNA, 19 nt, Homo sapiens
ucagugcuccuguaaguca

SEQ ID NO: 1030339 - RNA, 14 nt, Homo sapiens
ucaguguacaugga

SEQ ID NO: 1030340 - RNA, 10 nt, Homo sapiens
ucagugucca

SEQ ID NO: 1030341 - RNA, 19 nt, Homo sapiens
ucaguguccucuugcucaa

SEQ ID NO: 1030342 - RNA, 13 nt, Homo sapiens
ucaguuacucuga

SEQ ID NO: 1030343 - RNA, 16 nt, Homo sapiens
ucaguuucacuuucac

SEQ ID NO: 1030344 - RNA, 17 nt, Homo sapiens
ucaguuucccuaucucg

SEQ ID NO: 1030345 - RNA, 16 nt, Homo sapiens
ucaguuuuacucugcu

SEQ ID NO: 1030346 - RNA, 17 nt, Homo sapiens
ucauaaacuucagggau

SEQ ID NO: 1030347 - RNA, 19 nt, Homo sapiens
ucauaagacuuugggauag

SEQ ID NO: 1030348 - RNA, 14 nt, Homo sapiens
ucauaaugugcaaa

SEQ ID NO: 1030349 - RNA, 19 nt, Homo sapiens
ucauaauuucuucacucaa

SEQ ID NO: 1030350 - RNA, 13 nt, Homo sapiens
ucauacacuuauu

SEQ ID NO: 1030351 - RNA, 14 nt, Homo sapiens
ucauacauguuaca

SEQ ID NO: 1030352 - RNA, 20 nt, Homo sapiens
ucauacauuaucucacuugu

SEQ ID NO: 1030353 - RNA, 18 nt, Homo sapiens
ucauagcuaauuuuugca

SEQ ID NO: 1030354 - RNA, 22 nt, Homo sapiens
ucauagcuaauuuuugcaaaua

SEQ ID NO: 1030355 - RNA, 18 nt, Homo sapiens
ucauagcucauugcaagc

SEQ ID NO: 1030356 - RNA, 14 nt, Homo sapiens
ucauauacaauugu

SEQ ID NO: 1030357 - RNA, 17 nt, Homo sapiens
ucauauacaauugucau

SEQ ID NO: 1030358 - RNA, 13 nt, Homo sapiens
ucauauaccagca

SEQ ID NO: 1030359 - RNA, 20 nt, Homo sapiens
ucauauaccagcaauauauc

SEQ ID NO: 1030360 - RNA, 15 nt, Homo sapiens
ucauauguugcucag

SEQ ID NO: 1030361 - RNA, 23 nt, Homo sapiens
ucaucaaggcacugccugaugga

SEQ ID NO: 1030362 - RNA, 17 nt, Homo sapiens
ucaucacucaucugcca

SEQ ID NO: 1030363 - RNA, 19 nt, Homo sapiens
ucaucacucaucugccaag

SEQ ID NO: 1030364 - RNA, 23 nt, Homo sapiens
ucaucagcuaucguuaguguauu

SEQ ID NO: 1030365 - RNA, 21 nt, Homo sapiens
ucaucauaaaauaaaguauau

SEQ ID NO: 1030366 - RNA, 16 nt, Homo sapiens
ucaucaugugugucca

SEQ ID NO: 1030367 - RNA, 13 nt, Homo sapiens
ucaucauuuccau

SEQ ID NO: 1030368 - RNA, 18 nt, Homo sapiens
ucauccaaugcucaagaa

SEQ ID NO: 1030369 - RNA, 16 nt, Homo sapiens
ucauccccaccugucu

SEQ ID NO: 1030370 - RNA, 21 nt, Homo sapiens
ucaucccgagcaccuccacau

SEQ ID NO: 1030371 - RNA, 15 nt, Homo sapiens
ucaucccuaugggau

SEQ ID NO: 1030372 - RNA, 13 nt, Homo sapiens
ucauccuuuccag

SEQ ID NO: 1030373 - RNA, 13 nt, Homo sapiens
ucaucucaaggaa

SEQ ID NO: 1030374 - RNA, 20 nt, Homo sapiens
ucaucucaggccucccucaa

SEQ ID NO: 1030375 - RNA, 20 nt, Homo sapiens
ucaucucauuccaacuuccc

SEQ ID NO: 1030376 - RNA, 13 nt, Homo sapiens
ucaucuguuguuu

SEQ ID NO: 1030377 - RNA, 14 nt, Homo sapiens
ucaugaagauauuu

SEQ ID NO: 1030378 - RNA, 18 nt, Homo sapiens
ucaugaaucugcaaugug

SEQ ID NO: 1030379 - RNA, 18 nt, Homo sapiens
ucaugacaaauccuugaa

SEQ ID NO: 1030380 - RNA, 16 nt, Homo sapiens
ucaugacauguuauau

SEQ ID NO: 1030381 - RNA, 21 nt, Homo sapiens
ucaugauuuugaaaccaugaa

SEQ ID NO: 1030382 - RNA, 16 nt, Homo sapiens
ucaugcaaaugcugua

SEQ ID NO: 1030383 - RNA, 19 nt, Homo sapiens
ucaugcauggaaauucccu

SEQ ID NO: 1030384 - RNA, 23 nt, Homo sapiens
ucaugccaccauggccagccaac

SEQ ID NO: 1030385 - RNA, 15 nt, Homo sapiens
ucauggggugaugcu

SEQ ID NO: 1030386 - RNA, 18 nt, Homo sapiens
ucaugguggguucagggg

SEQ ID NO: 1030387 - RNA, 23 nt, Homo sapiens
aggggucuuguuaagugcagucu

SEQ ID NO: 1030388 - RNA, 17 nt, Homo sapiens
aggggugauuucagaga

SEQ ID NO: 1030389 - RNA, 18 nt, Homo sapiens
aggguagcccgccugcca

SEQ ID NO: 1030390 - RNA, 23 nt, Homo sapiens
aggguagucugguuucuagacuu

SEQ ID NO: 1030391 - RNA, 20 nt, Homo sapiens
aggguaucaggugcugccau

SEQ ID NO: 1030392 - RNA, 20 nt, Homo sapiens
agggucucuagugcugugaa

SEQ ID NO: 1030393 - RNA, 19 nt, Homo sapiens
agggucuucuuacaugcau

SEQ ID NO: 1030394 - RNA, 23 nt, Homo sapiens
agggucuucuuacaugcauuuga

SEQ ID NO: 1030395 - RNA, 17 nt, Homo sapiens
agggucuuugcaagaau

SEQ ID NO: 1030396 - RNA, 23 nt, Homo sapiens
agggugacccugaagugagcaca

SEQ ID NO: 1030397 - RNA, 14 nt, Homo sapiens
agggugagugcaag

SEQ ID NO: 1030398 - RNA, 16 nt, Homo sapiens
aggguggcccuugcag

SEQ ID NO: 1030399 - RNA, 18 nt, Homo sapiens
aggguggcccuugcaguu

SEQ ID NO: 1030400 - RNA, 17 nt, Homo sapiens
aggguggucuugaucuc

SEQ ID NO: 1030401 - RNA, 17 nt, Homo sapiens
aggguuaaccacugugg

SEQ ID NO: 1030402 - RNA, 21 nt, Homo sapiens
aggguucaccaggucagggag

SEQ ID NO: 1030403 - RNA, 22 nt, Homo sapiens
aggguucaccaggucagggaga

SEQ ID NO: 1030404 - RNA, 17 nt, Homo sapiens
aggguugaggggaccaa

SEQ ID NO: 1030405 - RNA, 21 nt, Homo sapiens
agguaaagcguuugcauuugc

SEQ ID NO: 1030406 - RNA, 18 nt, Homo sapiens
agguaaggaauaccuguc

SEQ ID NO: 1030407 - RNA, 13 nt, Homo sapiens
agguaaggccuuu

SEQ ID NO: 1030408 - RNA, 14 nt, Homo sapiens
agguacaaguggcu

SEQ ID NO: 1030409 - RNA, 21 nt, Homo sapiens
agguauaccuguugagacuga

SEQ ID NO: 1030410 - RNA, 19 nt, Homo sapiens
agguaucuguuuaacauuu

SEQ ID NO: 1030411 - RNA, 18 nt, Homo sapiens
agguaugcaaucaaaucu

SEQ ID NO: 1030412 - RNA, 18 nt, Homo sapiens
aggucacauugugccuuu

SEQ ID NO: 1030413 - RNA, 12 nt, Homo sapiens
aggucacuccug

SEQ ID NO: 1030414 - RNA, 20 nt, Homo sapiens
aggucacuuuaccucugugg

SEQ ID NO: 1030415 - RNA, 22 nt, Homo sapiens
aggucagagccugcaguuauua

SEQ ID NO: 1030416 - RNA, 15 nt, Homo sapiens
aggucagggugagga

SEQ ID NO: 1030417 - RNA, 14 nt, Homo sapiens
aggucagguguuca

SEQ ID NO: 1030418 - RNA, 17 nt, Homo sapiens
aggucauagcagugcuu

SEQ ID NO: 1030419 - RNA, 21 nt, Homo sapiens
aggucgaccccaaagccccuu

SEQ ID NO: 1030420 - RNA, 20 nt, Homo sapiens
aggucucacgggcaugggca

SEQ ID NO: 1030421 - RNA, 13 nt, Homo sapiens
aggucuccaaaau

SEQ ID NO: 1030422 - RNA, 19 nt, Homo sapiens
aggugaaaauccaucucau

SEQ ID NO: 1030423 - RNA, 18 nt, Homo sapiens
aggugaaagcuauaucaa

SEQ ID NO: 1030424 - RNA, 18 nt, Homo sapiens
aggugagcaggugaugcc

SEQ ID NO: 1030425 - RNA, 17 nt, Homo sapiens
aggugcuacaaaaacac

SEQ ID NO: 1030426 - RNA, 20 nt, Homo sapiens
aggugcuacaaaaacacagc

SEQ ID NO: 1030427 - RNA, 15 nt, Homo sapiens
aggugcuacugacuu

SEQ ID NO: 1030428 - RNA, 21 nt, Homo sapiens
aggugcuugacauaauuucac

SEQ ID NO: 1030429 - RNA, 10 nt, Homo sapiens
agguggcacu

SEQ ID NO: 1030430 - RNA, 13 nt, Homo sapiens
agguggcucucca

SEQ ID NO: 1030431 - RNA, 19 nt, Homo sapiens
aggugggccuugcuaccuc

SEQ ID NO: 1030432 - RNA, 20 nt, Homo sapiens
aggugguaagcaccaggacg

SEQ ID NO: 1030433 - RNA, 13 nt, Homo sapiens
agguggugcaaau

SEQ ID NO: 1030434 - RNA, 19 nt, Homo sapiens
uccaacccauuagccauuu

SEQ ID NO: 1030435 - RNA, 16 nt, Homo sapiens
uccaaccccaacucca

SEQ ID NO: 1030436 - RNA, 21 nt, Homo sapiens
uccaaccccccaccugccauu

SEQ ID NO: 1030437 - RNA, 23 nt, Homo sapiens
uccaacguggcccagagaagcca

SEQ ID NO: 1030438 - RNA, 14 nt, Homo sapiens
uccaacucuucacg

SEQ ID NO: 1030439 - RNA, 14 nt, Homo sapiens
uccaagaaugcuga

SEQ ID NO: 1030440 - RNA, 14 nt, Homo sapiens
uccaagaccagaga

SEQ ID NO: 1030441 - RNA, 14 nt, Homo sapiens
uccaagcauaccaa

SEQ ID NO: 1030442 - RNA, 22 nt, Homo sapiens
uccaagcauaccaacacgagca

SEQ ID NO: 1030443 - RNA, 16 nt, Homo sapiens
uccaagccucaugucc

SEQ ID NO: 1030444 - RNA, 18 nt, Homo sapiens
uccaaggaguuccaugaa

SEQ ID NO: 1030445 - RNA, 17 nt, Homo sapiens
uccaaggguacuaagga

SEQ ID NO: 1030446 - RNA, 14 nt, Homo sapiens
uccaagucuucuca

SEQ ID NO: 1030447 - RNA, 13 nt, Homo sapiens
uccaagugccaau

SEQ ID NO: 1030448 - RNA, 12 nt, Homo sapiens
uccaaucagaac

SEQ ID NO: 1030449 - RNA, 19 nt, Homo sapiens
uccaauggaauacugaaaa

SEQ ID NO: 1030450 - RNA, 18 nt, Homo sapiens
uccaauuccaaagccaga

SEQ ID NO: 1030451 - RNA, 12 nt, Homo sapiens
uccaauugaacu

SEQ ID NO: 1030452 - RNA, 13 nt, Homo sapiens
uccacacacagcu

SEQ ID NO: 1030453 - RNA, 16 nt, Homo sapiens
uccacaccauucaggu

SEQ ID NO: 1030454 - RNA, 20 nt, Homo sapiens
uccacaccuagcaucucaug

SEQ ID NO: 1030455 - RNA, 14 nt, Homo sapiens
uccacagaaauaca

SEQ ID NO: 1030456 - RNA, 21 nt, Homo sapiens
uccaccccagcaggacaguga

SEQ ID NO: 1030457 - RNA, 14 nt, Homo sapiens
uccaccccauguca

SEQ ID NO: 1030458 - RNA, 13 nt, Homo sapiens
uccacccuuggcc

SEQ ID NO: 1030459 - RNA, 15 nt, Homo sapiens
uccaccuagacugua

SEQ ID NO: 1030460 - RNA, 18 nt, Homo sapiens
uccaccugccguggacuu

SEQ ID NO: 1030461 - RNA, 15 nt, Homo sapiens
uccaccuucccucau

SEQ ID NO: 1030462 - RNA, 23 nt, Homo sapiens
uccacguaucuuuccuaggcaga

SEQ ID NO: 1030463 - RNA, 20 nt, Homo sapiens
uccacuagcaccgaccccac

SEQ ID NO: 1030464 - RNA, 21 nt, Homo sapiens
uccacugaaguagugugcagu

SEQ ID NO: 1030465 - RNA, 15 nt, Homo sapiens
uccacugucaagaaa

SEQ ID NO: 1030466 - RNA, 19 nt, Homo sapiens
uccacuucuuguuccccac

SEQ ID NO: 1030467 - RNA, 11 nt, Homo sapiens
uccacuuuuau

SEQ ID NO: 1030468 - RNA, 16 nt, Homo sapiens
uccagaagugugauug

SEQ ID NO: 1030469 - RNA, 16 nt, Homo sapiens
uccagaauaaaacgca

SEQ ID NO: 1030470 - RNA, 24 nt, Homo sapiens
uccagacaaaccagaagcaacaga

SEQ ID NO: 1030471 - RNA, 14 nt, Homo sapiens
uccagacccggcug

SEQ ID NO: 1030472 - RNA, 18 nt, Homo sapiens
uccagagcuggaucucuc

SEQ ID NO: 1030473 - RNA, 16 nt, Homo sapiens
uccagaucagauucuu

SEQ ID NO: 1030474 - RNA, 19 nt, Homo sapiens
uccagaucauuccucagaa

SEQ ID NO: 1030475 - RNA, 20 nt, Homo sapiens
uccagcaccuucccucucac

SEQ ID NO: 1030476 - RNA, 21 nt, Homo sapiens
uccagccugggcaacacagcg

SEQ ID NO: 1030477 - RNA, 14 nt, Homo sapiens
uccagcuccuguaa

SEQ ID NO: 1030478 - RNA, 19 nt, Homo sapiens
uccagcugcucugucuucu

SEQ ID NO: 1030479 - RNA, 23 nt, Homo sapiens
uccagcugcucugucuucuuugc

SEQ ID NO: 1030480 - RNA, 21 nt, Homo sapiens
uccaggccccaaaaccacagc

SEQ ID NO: 1030481 - RNA, 17 nt, Homo sapiens
uccaggcgaugugcaag

SEQ ID NO: 1030482 - RNA, 23 nt, Homo sapiens
uccaggggugggacacccuguga

SEQ ID NO: 1030483 - RNA, 21 nt, Homo sapiens
uccaggguauggccauggagu

SEQ ID NO: 1030484 - RNA, 23 nt, Homo sapiens
uccagucucuucugcuggcagaa

SEQ ID NO: 1030485 - RNA, 14 nt, Homo sapiens
uccagugcaauugu

SEQ ID NO: 1030486 - RNA, 19 nt, Homo sapiens
uccaguggaacagucuucc

SEQ ID NO: 1030487 - RNA, 20 nt, Homo sapiens
uccaguggaacagucuuccc

SEQ ID NO: 1030488 - RNA, 17 nt, Homo sapiens
uccauaaugcuacuguc

SEQ ID NO: 1030489 - RNA, 13 nt, Homo sapiens
uccauaauuauua

SEQ ID NO: 1030490 - RNA, 23 nt, Homo sapiens
uccauauguuauaucaacagaua

SEQ ID NO: 1030491 - RNA, 17 nt, Homo sapiens
uccaucagcuguaagaa

SEQ ID NO: 1030492 - RNA, 9 nt, Homo sapiens
uccaucucu

SEQ ID NO: 1030493 - RNA, 19 nt, Homo sapiens
uccaugaccuaguuuucca

SEQ ID NO: 1030494 - RNA, 19 nt, Homo sapiens
uccaugauguuuuccauga

SEQ ID NO: 1030495 - RNA, 17 nt, Homo sapiens
uccaugugugugcaagu

SEQ ID NO: 1030496 - RNA, 15 nt, Homo sapiens
uccauguuuguaaaa

SEQ ID NO: 1030497 - RNA, 16 nt, Homo sapiens
uccauucaacugaaaa

SEQ ID NO: 1030498 - RNA, 14 nt, Homo sapiens
uccauuccagaaua

SEQ ID NO: 1030499 - RNA, 17 nt, Homo sapiens
uccauugguguugacau

SEQ ID NO: 1030500 - RNA, 18 nt, Homo sapiens
uccauuguuuggagacau

SEQ ID NO: 1030501 - RNA, 19 nt, Homo sapiens
uccauuuacccuucuuuuc

SEQ ID NO: 1030502 - RNA, 15 nt, Homo sapiens
uccauuugcuuuguc

SEQ ID NO: 1030503 - RNA, 20 nt, Homo sapiens
uccauuugugugugugcaag

SEQ ID NO: 1030504 - RNA, 22 nt, Homo sapiens
uccauuugugugugugcaagug

SEQ ID NO: 1030505 - RNA, 17 nt, Homo sapiens
ucccaaaagcccauuca

SEQ ID NO: 1030506 - RNA, 20 nt, Homo sapiens
ucccaaagugcugagauuau

SEQ ID NO: 1030507 - RNA, 15 nt, Homo sapiens
ucccaaauaaacucc

SEQ ID NO: 1030508 - RNA, 18 nt, Homo sapiens
ucccaaauuuucacauaa

SEQ ID NO: 1030509 - RNA, 21 nt, Homo sapiens
ucccaacuuguauuaaagaca

SEQ ID NO: 1030510 - RNA, 15 nt, Homo sapiens
ucccaagagcauaac

SEQ ID NO: 1030511 - RNA, 12 nt, Homo sapiens
ucccaagaucug

SEQ ID NO: 1030512 - RNA, 13 nt, Homo sapiens
ucccaauacaaaa

SEQ ID NO: 1030513 - RNA, 21 nt, Homo sapiens
ucccacagcgcuggccgggac

SEQ ID NO: 1030514 - RNA, 16 nt, Homo sapiens
ucccacccacauguga

SEQ ID NO: 1030515 - RNA, 20 nt, Homo sapiens
ucccacccacaugugacaca

SEQ ID NO: 1030516 - RNA, 17 nt, Homo sapiens
ucccacccccaucucuc

SEQ ID NO: 1030517 - RNA, 14 nt, Homo sapiens
ucccaccucagccu

SEQ ID NO: 1030518 - RNA, 23 nt, Homo sapiens
ucccaccuccauuugcaauugac

SEQ ID NO: 1030519 - RNA, 22 nt, Homo sapiens
ucccaccucuucucuuccugua

SEQ ID NO: 1030520 - RNA, 23 nt, Homo sapiens
ucccaccucuucucuuccuguaa

SEQ ID NO: 1030521 - RNA, 13 nt, Homo sapiens
ucccacucaagcc

SEQ ID NO: 1030522 - RNA, 17 nt, Homo sapiens
ucccacucuagggcagu

SEQ ID NO: 1030523 - RNA, 21 nt, Homo sapiens
ucccacucuagggcaguggag

SEQ ID NO: 1030524 - RNA, 23 nt, Homo sapiens
ucccagcagcccuaaggaucucu

SEQ ID NO: 1030525 - RNA, 17 nt, Homo sapiens
ucccagcuacucaggag

SEQ ID NO: 1030526 - RNA, 16 nt, Homo sapiens
ucccagcuacucggga

SEQ ID NO: 1030527 - RNA, 17 nt, Homo sapiens
ucccagcuacucgggag

SEQ ID NO: 1030528 - RNA, 19 nt, Homo sapiens
ucccagcuauuccuacucu

SEQ ID NO: 1030529 - RNA, 21 nt, Homo sapiens
ucccagcugaaauacugaggg

SEQ ID NO: 1030530 - RNA, 9 nt, Homo sapiens
ucccagugc

SEQ ID NO: 1030531 - RNA, 19 nt, Homo sapiens
ucccauaccacccaaugcu

SEQ ID NO: 1030532 - RNA, 22 nt, Homo sapiens
ucccaucacuucccuacaugga

SEQ ID NO: 1030533 - RNA, 15 nt, Homo sapiens
ucccauccagugucu

SEQ ID NO: 1030534 - RNA, 18 nt, Homo sapiens
ucccaucucuccauauac

SEQ ID NO: 1030535 - RNA, 18 nt, Homo sapiens
ucccaucugucaccaauu

SEQ ID NO: 1030536 - RNA, 16 nt, Homo sapiens
ucccaugcugaccugu

SEQ ID NO: 1030537 - RNA, 16 nt, Homo sapiens
ucccauggacacucca

SEQ ID NO: 1030538 - RNA, 17 nt, Homo sapiens
ucccauggcaccuucag

SEQ ID NO: 1030539 - RNA, 13 nt, Homo sapiens
ucccauguuaaau

SEQ ID NO: 1030540 - RNA, 15 nt, Homo sapiens
agugaaaaacaucca

SEQ ID NO: 1030541 - RNA, 20 nt, Homo sapiens
agugaaaaucuacacuccag

SEQ ID NO: 1030542 - RNA, 19 nt, Homo sapiens
agugaaagacaagcugcaa

SEQ ID NO: 1030543 - RNA, 14 nt, Homo sapiens
agugaacuaugaag

SEQ ID NO: 1030544 - RNA, 17 nt, Homo sapiens
agugaaggcuguccuua

SEQ ID NO: 1030545 - RNA, 19 nt, Homo sapiens
agugaauaaaccaucaucu

SEQ ID NO: 1030546 - RNA, 20 nt, Homo sapiens
agugaauguaaaaugcaaaa

SEQ ID NO: 1030547 - RNA, 19 nt, Homo sapiens
agugacagcucugccuguu

SEQ ID NO: 1030548 - RNA, 15 nt, Homo sapiens
agugacauguuuaca

SEQ ID NO: 1030549 - RNA, 15 nt, Homo sapiens
agugaccauagcucc

SEQ ID NO: 1030550 - RNA, 15 nt, Homo sapiens
agugacuaugaacuu

SEQ ID NO: 1030551 - RNA, 21 nt, Homo sapiens
agugacuguucaagagcacac

SEQ ID NO: 1030552 - RNA, 17 nt, Homo sapiens
agugagcuccuaagcca

SEQ ID NO: 1030553 - RNA, 19 nt, Homo sapiens
agugagucgaggacaggga

SEQ ID NO: 1030554 - RNA, 13 nt, Homo sapiens
agugagucucuuc

SEQ ID NO: 1030555 - RNA, 19 nt, Homo sapiens
agugauucuccugccucag

SEQ ID NO: 1030556 - RNA, 16 nt, Homo sapiens
agugauuggcucugug

SEQ ID NO: 1030557 - RNA, 16 nt, Homo sapiens
agugcaacagcacugg

SEQ ID NO: 1030558 - RNA, 21 nt, Homo sapiens
agugcaagccccugcuccaga

SEQ ID NO: 1030559 - RNA, 21 nt, Homo sapiens
agugcacaacauuacagggaa

SEQ ID NO: 1030560 - RNA, 12 nt, Homo sapiens
agugcaccacuu

SEQ ID NO: 1030561 - RNA, 18 nt, Homo sapiens
agugcaggagagacagug

SEQ ID NO: 1030562 - RNA, 21 nt, Homo sapiens
agugcagugagccgagaucac

SEQ ID NO: 1030563 - RNA, 18 nt, Homo sapiens
agugcaguggcacgaucu

SEQ ID NO: 1030564 - RNA, 21 nt, Homo sapiens
agugcauauuccuuucuauca

SEQ ID NO: 1030565 - RNA, 15 nt, Homo sapiens
agugcauccaaaggu

SEQ ID NO: 1030566 - RNA, 13 nt, Homo sapiens
agugccaagcaca

SEQ ID NO: 1030567 - RNA, 17 nt, Homo sapiens
agugccaauauuucuga

SEQ ID NO: 1030568 - RNA, 16 nt, Homo sapiens
agugccagcaaugaca

SEQ ID NO: 1030569 - RNA, 17 nt, Homo sapiens
agugcccaacuguuaua

SEQ ID NO: 1030570 - RNA, 15 nt, Homo sapiens
agugccccuagcuua

SEQ ID NO: 1030571 - RNA, 13 nt, Homo sapiens
agugcccuaggcc

SEQ ID NO: 1030572 - RNA, 21 nt, Homo sapiens
agugccuacccaccugugagg

SEQ ID NO: 1030573 - RNA, 14 nt, Homo sapiens
agugccugggaaug

SEQ ID NO: 1030574 - RNA, 14 nt, Homo sapiens
agugccuuuaguuu

SEQ ID NO: 1030575 - RNA, 15 nt, Homo sapiens
agugcguguguagag

SEQ ID NO: 1030576 - RNA, 20 nt, Homo sapiens
agugcugcuggaaguagaau

SEQ ID NO: 1030577 - RNA, 17 nt, Homo sapiens
agugcugggauuacaau

SEQ ID NO: 1030578 - RNA, 15 nt, Homo sapiens
agugcuuggcugcug

SEQ ID NO: 1030579 - RNA, 23 nt, Homo sapiens
auaacucuacccuggcacuauaa

SEQ ID NO: 1030580 - RNA, 12 nt, Homo sapiens
auaacuguuauu

SEQ ID NO: 1030581 - RNA, 13 nt, Homo sapiens
auaacuguucuca

SEQ ID NO: 1030582 - RNA, 17 nt, Homo sapiens
auaacuuagguggcaag

SEQ ID NO: 1030583 - RNA, 20 nt, Homo sapiens
auaacuuuguuuagcccaaa

SEQ ID NO: 1030584 - RNA, 19 nt, Homo sapiens
auaacuuuucuaaagccuu

SEQ ID NO: 1030585 - RNA, 20 nt, Homo sapiens
auaagaguugagauuuugca

SEQ ID NO: 1030586 - RNA, 19 nt, Homo sapiens
auaagauggaagcuuccag

SEQ ID NO: 1030587 - RNA, 23 nt, Homo sapiens
auaagcaaagggagcacuggguu

SEQ ID NO: 1030588 - RNA, 15 nt, Homo sapiens
auaagcacugugcua

SEQ ID NO: 1030589 - RNA, 20 nt, Homo sapiens
auaagcuauagacccgagga

SEQ ID NO: 1030590 - RNA, 22 nt, Homo sapiens
auaagcucuccccaaacuugcu

SEQ ID NO: 1030591 - RNA, 23 nt, Homo sapiens
auaagguuuuaaguuguuugcau

SEQ ID NO: 1030592 - RNA, 13 nt, Homo sapiens
auaaguacauuau

SEQ ID NO: 1030593 - RNA, 16 nt, Homo sapiens
auaauacaguaucuca

SEQ ID NO: 1030594 - RNA, 17 nt, Homo sapiens
auaauacaguaucucag

SEQ ID NO: 1030595 - RNA, 12 nt, Homo sapiens
auaauacuauau

SEQ ID NO: 1030596 - RNA, 23 nt, Homo sapiens
auaauagguuugugacuuuccua

SEQ ID NO: 1030597 - RNA, 20 nt, Homo sapiens
auaauaugcacacagugcuu

SEQ ID NO: 1030598 - RNA, 23 nt, Homo sapiens
auaauauuaaggaagacaaugug

SEQ ID NO: 1030599 - RNA, 19 nt, Homo sapiens
auaaucacauuaucaucug

SEQ ID NO: 1030600 - RNA, 21 nt, Homo sapiens
auaaucacauuaucaucugaa

SEQ ID NO: 1030601 - RNA, 13 nt, Homo sapiens
auaaucacuuuuu

SEQ ID NO: 1030602 - RNA, 22 nt, Homo sapiens
auaaucauucuuauuucaugaa

SEQ ID NO: 1030603 - RNA, 17 nt, Homo sapiens
auaauccagucuucacu

SEQ ID NO: 1030604 - RNA, 12 nt, Homo sapiens
auaaucuacucc

SEQ ID NO: 1030605 - RNA, 22 nt, Homo sapiens
auaaucucuuuaaauggcuuua

SEQ ID NO: 1030606 - RNA, 18 nt, Homo sapiens
auaauucaaagcaccaaa

SEQ ID NO: 1030607 - RNA, 13 nt, Homo sapiens
auaauucagcucu

SEQ ID NO: 1030608 - RNA, 15 nt, Homo sapiens
auaauucccuaucuu

SEQ ID NO: 1030609 - RNA, 21 nt, Homo sapiens
auaauuuguauacccuguccu

SEQ ID NO: 1030610 - RNA, 12 nt, Homo sapiens
auacacacuguu

SEQ ID NO: 1030611 - RNA, 19 nt, Homo sapiens
auacaccaccucacuccug

SEQ ID NO: 1030612 - RNA, 22 nt, Homo sapiens
auacacugaaguuaacagagac

SEQ ID NO: 1030613 - RNA, 22 nt, Homo sapiens
auacagccaaagauaaucucuc

SEQ ID NO: 1030614 - RNA, 22 nt, Homo sapiens
auacagcccucccccagcaguu

SEQ ID NO: 1030615 - RNA, 20 nt, Homo sapiens
auacagcucuacguggcaaa

SEQ ID NO: 1030616 - RNA, 16 nt, Homo sapiens
auacaguaucucaggg

SEQ ID NO: 1030617 - RNA, 21 nt, Homo sapiens
auacauaaacaagaccacguu

SEQ ID NO: 1030618 - RNA, 13 nt, Homo sapiens
auacauaagacca

SEQ ID NO: 1030619 - RNA, 23 nt, Homo sapiens
auacauaagcggcguaaguuuaa

SEQ ID NO: 1030620 - RNA, 22 nt, Homo sapiens
auacaugccagugacacuucca

SEQ ID NO: 1030621 - RNA, 14 nt, Homo sapiens
auacauggacaaua

SEQ ID NO: 1030622 - RNA, 16 nt, Homo sapiens
auacauggacugagag

SEQ ID NO: 1030623 - RNA, 15 nt, Homo sapiens
auacaugugccgaau

SEQ ID NO: 1030624 - RNA, 16 nt, Homo sapiens
auacauucugcuuuca

SEQ ID NO: 1030625 - RNA, 20 nt, Homo sapiens
auacauucuuuaucuugaca

SEQ ID NO: 1030626 - RNA, 15 nt, Homo sapiens
auacauuugauaaag

SEQ ID NO: 1030627 - RNA, 16 nt, Homo sapiens
auaccagugaaccaaa

SEQ ID NO: 1030628 - RNA, 15 nt, Homo sapiens
auacccaaauccucu

SEQ ID NO: 1030629 - RNA, 14 nt, Homo sapiens
auaccuaucaucuu

SEQ ID NO: 1030630 - RNA, 21 nt, Homo sapiens
auaccuguugagacugauuca

SEQ ID NO: 1030631 - RNA, 18 nt, Homo sapiens
auacuaagggaagaaaca

SEQ ID NO: 1030632 - RNA, 23 nt, Homo sapiens
auacuacaaccucacagaagcug

SEQ ID NO: 1030633 - RNA, 19 nt, Homo sapiens
auacuacagcaauacuaca

SEQ ID NO: 1030634 - RNA, 17 nt, Homo sapiens
auacucaaaagagagag

SEQ ID NO: 1030635 - RNA, 14 nt, Homo sapiens
auacugaaggacac

SEQ ID NO: 1030636 - RNA, 21 nt, Homo sapiens
auacugaggaaugucuuucag

SEQ ID NO: 1030637 - RNA, 13 nt, Homo sapiens
auacugcauaaaa

SEQ ID NO: 1030638 - RNA, 19 nt, Homo sapiens
auacugcucaucauuccuu

SEQ ID NO: 1030639 - RNA, 22 nt, Homo sapiens
auacuggcuaacagauguugaa

SEQ ID NO: 1030640 - RNA, 16 nt, Homo sapiens
auacuguauuuuuacc

SEQ ID NO: 1030641 - RNA, 17 nt, Homo sapiens
auacuucaauacuucau

SEQ ID NO: 1030642 - RNA, 15 nt, Homo sapiens
auacuuuaaaggaaa

SEQ ID NO: 1030643 - RNA, 17 nt, Homo sapiens
auagaaacuugcuuauc

SEQ ID NO: 1030644 - RNA, 12 nt, Homo sapiens
auagaaagccaa

SEQ ID NO: 1030645 - RNA, 14 nt, Homo sapiens
auagaaaguucaaa

SEQ ID NO: 1030646 - RNA, 13 nt, Homo sapiens
auagaacagagaa

SEQ ID NO: 1030647 - RNA, 15 nt, Homo sapiens
auagaaccacuauga

SEQ ID NO: 1030648 - RNA, 16 nt, Homo sapiens
auagaagaacugcaaa

SEQ ID NO: 1030649 - RNA, 18 nt, Homo sapiens
auagaauccaguuugcaa

SEQ ID NO: 1030650 - RNA, 12 nt, Homo sapiens
auagaauuaaca

SEQ ID NO: 1030651 - RNA, 13 nt, Homo sapiens
auagacaauuuau

SEQ ID NO: 1030652 - RNA, 18 nt, Homo sapiens
auagacuucccacucuag

SEQ ID NO: 1030653 - RNA, 21 nt, Homo sapiens
auagagccacuaagaugaggg

SEQ ID NO: 1030654 - RNA, 13 nt, Homo sapiens
auagagccugagg

SEQ ID NO: 1030655 - RNA, 22 nt, Homo sapiens
auagagggucuaagauucaucc

SEQ ID NO: 1030656 - RNA, 21 nt, Homo sapiens
auagagugguacagcacuguu

SEQ ID NO: 1030657 - RNA, 20 nt, Homo sapiens
auagaugucuagguacuuca

SEQ ID NO: 1030658 - RNA, 24 nt, Homo sapiens
auagauugagaaguuuuguacaga

SEQ ID NO: 1030659 - RNA, 17 nt, Homo sapiens
auagauuucuacacuga

SEQ ID NO: 1030660 - RNA, 20 nt, Homo sapiens
auagauuucuacacugaggu

SEQ ID NO: 1030661 - RNA, 19 nt, Homo sapiens
auagcaaauguuuugacau

SEQ ID NO: 1030662 - RNA, 15 nt, Homo sapiens
auagccaacacccau

SEQ ID NO: 1030663 - RNA, 15 nt, Homo sapiens
auagccaaucaucua

SEQ ID NO: 1030664 - RNA, 17 nt, Homo sapiens
auagcuaauuuuugcaa

SEQ ID NO: 1030665 - RNA, 17 nt, Homo sapiens
auagcuauauccaugua

SEQ ID NO: 1030666 - RNA, 20 nt, Homo sapiens
auagcuccuucucucuuaca

SEQ ID NO: 1030667 - RNA, 14 nt, Homo sapiens
auagcuguuugaaa

SEQ ID NO: 1030668 - RNA, 13 nt, Homo sapiens
auaggcaaagggg

SEQ ID NO: 1030669 - RNA, 17 nt, Homo sapiens
auaggcccagugagaug

SEQ ID NO: 1030670 - RNA, 15 nt, Homo sapiens
auaggccugggugcu

SEQ ID NO: 1030671 - RNA, 22 nt, Homo sapiens
auaggcuggagaagcucaccca

SEQ ID NO: 1030672 - RNA, 23 nt, Homo sapiens
auaguacagguaaggugagggaa

SEQ ID NO: 1030673 - RNA, 19 nt, Homo sapiens
auaguacuggcaugguacg

SEQ ID NO: 1030674 - RNA, 14 nt, Homo sapiens
auaguauugugcau

SEQ ID NO: 1030675 - RNA, 14 nt, Homo sapiens
auagucacaagagc

SEQ ID NO: 1030676 - RNA, 22 nt, Homo sapiens
auaguggacaguaaccuuucaa

SEQ ID NO: 1030677 - RNA, 16 nt, Homo sapiens
auaguggagagaacug

SEQ ID NO: 1030678 - RNA, 17 nt, Homo sapiens
auaguggggucagggcu

SEQ ID NO: 1030679 - RNA, 10 nt, Homo sapiens
auagugucuu

SEQ ID NO: 1030680 - RNA, 21 nt, Homo sapiens
auaguucccuagucuauucau

SEQ ID NO: 1030681 - RNA, 15 nt, Homo sapiens
auauaaacacuauau

SEQ ID NO: 1030682 - RNA, 21 nt, Homo sapiens
auauaaaugugauugcagcuu

SEQ ID NO: 1030683 - RNA, 16 nt, Homo sapiens
auauaaauuuguguuc

SEQ ID NO: 1030684 - RNA, 19 nt, Homo sapiens
auauaaauuuguguucuca

SEQ ID NO: 1030685 - RNA, 22 nt, Homo sapiens
auauaagaagcuuucaguauua

SEQ ID NO: 1030686 - RNA, 22 nt, Homo sapiens
auauaaggaaagugauccaaaa

SEQ ID NO: 1030687 - RNA, 15 nt, Homo sapiens
auauaauucuguaca

SEQ ID NO: 1030688 - RNA, 15 nt, Homo sapiens
auauacaauaacaua

SEQ ID NO: 1030689 - RNA, 17 nt, Homo sapiens
auauacaauaacauaau

SEQ ID NO: 1030690 - RNA, 14 nt, Homo sapiens
auauacucacuuuc

SEQ ID NO: 1030691 - RNA, 14 nt, Homo sapiens
auauagaacagugc

SEQ ID NO: 1030692 - RNA, 16 nt, Homo sapiens
auauagguugugcaaa

SEQ ID NO: 1030693 - RNA, 13 nt, Homo sapiens
auauauggauaau

SEQ ID NO: 1030694 - RNA, 20 nt, Homo sapiens
auauauguguuuuucacauu

SEQ ID NO: 1030695 - RNA, 15 nt, Homo sapiens
auaucaaucucucuu

SEQ ID NO: 1030696 - RNA, 18 nt, Homo sapiens
auaucaguccucuuucaa

SEQ ID NO: 1030697 - RNA, 13 nt, Homo sapiens
auaucaucagcau

SEQ ID NO: 1030698 - RNA, 20 nt, Homo sapiens
uccuuguauuuaaauauuaa

SEQ ID NO: 1030699 - RNA, 17 nt, Homo sapiens
uccuuuagcgcccaguu

SEQ ID NO: 1030700 - RNA, 18 nt, Homo sapiens
uccuuuaguaccugaaaa

SEQ ID NO: 1030701 - RNA, 16 nt, Homo sapiens
uccuuucauuuacugu

SEQ ID NO: 1030702 - RNA, 18 nt, Homo sapiens
uccuuucauuuacugugg

SEQ ID NO: 1030703 - RNA, 18 nt, Homo sapiens
uccuuuccccucccucag

SEQ ID NO: 1030704 - RNA, 20 nt, Homo sapiens
uccuuuggaaugcuguauua

SEQ ID NO: 1030705 - RNA, 22 nt, Homo sapiens
uccuuuggccauuccaacagcu

SEQ ID NO: 1030706 - RNA, 16 nt, Homo sapiens
uccuuuuaauuuuccu

SEQ ID NO: 1030707 - RNA, 16 nt, Homo sapiens
uccuuuucccuauuuc

SEQ ID NO: 1030708 - RNA, 17 nt, Homo sapiens
ucgaacauggaacucau

SEQ ID NO: 1030709 - RNA, 23 nt, Homo sapiens
ucgaacauggaacucauuccugc

SEQ ID NO: 1030710 - RNA, 18 nt, Homo sapiens
ucgaaugaacaaagucca

SEQ ID NO: 1030711 - RNA, 22 nt, Homo sapiens
ucgaccacgggaagcaucuucc

SEQ ID NO: 1030712 - RNA, 15 nt, Homo sapiens
ucgacucagccucag

SEQ ID NO: 1030713 - RNA, 19 nt, Homo sapiens
ucgacucagccucagggac

SEQ ID NO: 1030714 - RNA, 21 nt, Homo sapiens
ucgagccacaaccgaccagau

SEQ ID NO: 1030715 - RNA, 14 nt, Homo sapiens
ucgaggggcucuca

SEQ ID NO: 1030716 - RNA, 13 nt, Homo sapiens
ucgcaagagccau

SEQ ID NO: 1030717 - RNA, 17 nt, Homo sapiens
ucgcaucucagugcagg

SEQ ID NO: 1030718 - RNA, 16 nt, Homo sapiens
ucgccaccccuccuuc

SEQ ID NO: 1030719 - RNA, 18 nt, Homo sapiens
ucgcccuacucaccugag

SEQ ID NO: 1030720 - RNA, 23 nt, Homo sapiens
ucgccuccucuacaauuugccau

SEQ ID NO: 1030721 - RNA, 18 nt, Homo sapiens
ucgccuuagcauguuugc

SEQ ID NO: 1030722 - RNA, 23 nt, Homo sapiens
ucgcuaccuuuugcuguggcaaa

SEQ ID NO: 1030723 - RNA, 14 nt, Homo sapiens
ucugaggacauucc

SEQ ID NO: 1030724 - RNA, 16 nt, Homo sapiens
ucugaggccucagagu

SEQ ID NO: 1030725 - RNA, 20 nt, Homo sapiens
ucugagggaaagcccagaaa

SEQ ID NO: 1030726 - RNA, 14 nt, Homo sapiens
ucugaguaagcccu

SEQ ID NO: 1030727 - RNA, 20 nt, Homo sapiens
ucugauacccagagcauuac

SEQ ID NO: 1030728 - RNA, 22 nt, Homo sapiens
ucugauaugcaguuuuccuuaa

SEQ ID NO: 1030729 - RNA, 21 nt, Homo sapiens
ucugaugcaagcaagaaacac

SEQ ID NO: 1030730 - RNA, 16 nt, Homo sapiens
ucugauuacacaaaac

SEQ ID NO: 1030731 - RNA, 20 nt, Homo sapiens
ucugauuuuugucccaguag

SEQ ID NO: 1030732 - RNA, 23 nt, Homo sapiens
ucugcaccccccugggcugagag

SEQ ID NO: 1030733 - RNA, 15 nt, Homo sapiens
ucugcagacugcugc

SEQ ID NO: 1030734 - RNA, 19 nt, Homo sapiens
ucugcauguuacauaagau

SEQ ID NO: 1030735 - RNA, 17 nt, Homo sapiens
ucugccacccuaccugu

SEQ ID NO: 1030736 - RNA, 21 nt, Homo sapiens
ucugccccucccugcuucaau

SEQ ID NO: 1030737 - RNA, 16 nt, Homo sapiens
ucugccgugugcccuc

SEQ ID NO: 1030738 - RNA, 20 nt, Homo sapiens
ucugccuccccuucacuccc

SEQ ID NO: 1030739 - RNA, 21 nt, Homo sapiens
ucugccuccccuucacuccca

SEQ ID NO: 1030740 - RNA, 20 nt, Homo sapiens
ucugccugaaccuuccaucu

SEQ ID NO: 1030741 - RNA, 16 nt, Homo sapiens
ucugccugaagucaca

SEQ ID NO: 1030742 - RNA, 19 nt, Homo sapiens
ucugcgccgagccucagaa

SEQ ID NO: 1030743 - RNA, 20 nt, Homo sapiens
ucugcucacauaucugucau

SEQ ID NO: 1030744 - RNA, 18 nt, Homo sapiens
ucugcucaucauucucug

SEQ ID NO: 1030745 - RNA, 22 nt, Homo sapiens
ucugcucugaggcuuccagaga

SEQ ID NO: 1030746 - RNA, 18 nt, Homo sapiens
ucugcugacagacacagg

SEQ ID NO: 1030747 - RNA, 15 nt, Homo sapiens
ucugcugaucucagu

SEQ ID NO: 1030748 - RNA, 16 nt, Homo sapiens
ucugcuuaugcaguuu

SEQ ID NO: 1030749 - RNA, 15 nt, Homo sapiens
ucugcuuuacucugg

SEQ ID NO: 1030750 - RNA, 13 nt, Homo sapiens
ucugcuuugcucu

SEQ ID NO: 1030751 - RNA, 19 nt, Homo sapiens
ucuggaaugcaugggagcu

SEQ ID NO: 1030752 - RNA, 11 nt, Homo sapiens
ucuggacaaag

SEQ ID NO: 1030753 - RNA, 19 nt, Homo sapiens
ucuggaccccaucugugaa

SEQ ID NO: 1030754 - RNA, 15 nt, Homo sapiens
ucuggaugguuccca

SEQ ID NO: 1030755 - RNA, 11 nt, Homo sapiens
ucuggcagcuc

SEQ ID NO: 1030756 - RNA, 22 nt, Homo sapiens
ucuggcaucucuuucugcaaag

SEQ ID NO: 1030757 - RNA, 16 nt, Homo sapiens
ucuggcccuucuugcc

SEQ ID NO: 1030758 - RNA, 19 nt, Homo sapiens
ucuggccguugauguuggc

SEQ ID NO: 1030759 - RNA, 19 nt, Homo sapiens
ucuggcuagugucuaucag

SEQ ID NO: 1030760 - RNA, 15 nt, Homo sapiens
ucuggcucuuccagg

SEQ ID NO: 1030761 - RNA, 18 nt, Homo sapiens
ucuggcugaacccugugc

SEQ ID NO: 1030762 - RNA, 18 nt, Homo sapiens
ucuggcugaggauuucaa

SEQ ID NO: 1030763 - RNA, 23 nt, Homo sapiens
ucugggagaaaugagauaaaaga

SEQ ID NO: 1030764 - RNA, 20 nt, Homo sapiens
ucugggcuuggggcuuccua

SEQ ID NO: 1030765 - RNA, 23 nt, Homo sapiens
ucuggggaugagguugcuuacua

SEQ ID NO: 1030766 - RNA, 23 nt, Homo sapiens
ucugggucuuucugacaucagca

SEQ ID NO: 1030767 - RNA, 15 nt, Homo sapiens
ucugggugaccucac

SEQ ID NO: 1030768 - RNA, 12 nt, Homo sapiens
ucugggugcaug

SEQ ID NO: 1030769 - RNA, 12 nt, Homo sapiens
ucuggucugucc

SEQ ID NO: 1030770 - RNA, 15 nt, Homo sapiens
ucuggugacaccagc

SEQ ID NO: 1030771 - RNA, 17 nt, Homo sapiens
ucuggugcuuucuguca

SEQ ID NO: 1030772 - RNA, 22 nt, Homo sapiens
ucugguuuugcuauuagacugu

SEQ ID NO: 1030773 - RNA, 16 nt, Homo sapiens
ucuguaaacuguguau

SEQ ID NO: 1030774 - RNA, 23 nt, Homo sapiens
ucuguauuaaaauuagaaucuga

SEQ ID NO: 1030775 - RNA, 13 nt, Homo sapiens
ucuguauuugcca

SEQ ID NO: 1030776 - RNA, 18 nt, Homo sapiens
ucugucacaccagccaua

SEQ ID NO: 1030777 - RNA, 17 nt, Homo sapiens
ucugucauacauccuag

SEQ ID NO: 1030778 - RNA, 12 nt, Homo sapiens
ucugucaugaac

SEQ ID NO: 1030779 - RNA, 21 nt, Homo sapiens
ucugucccagguuaucugggc

SEQ ID NO: 1030780 - RNA, 17 nt, Homo sapiens
ucuguccuacucugugu

SEQ ID NO: 1030781 - RNA, 17 nt, Homo sapiens
ucugucuuuauaaucua

SEQ ID NO: 1030782 - RNA, 14 nt, Homo sapiens
ucugugaagcauuc

SEQ ID NO: 1030783 - RNA, 16 nt, Homo sapiens
ucugugcuuugacuca

SEQ ID NO: 1030784 - RNA, 17 nt, Homo sapiens
ucugugcuuugacucac

SEQ ID NO: 1030785 - RNA, 17 nt, Homo sapiens
ucuguggaccacugcau

SEQ ID NO: 1030786 - RNA, 13 nt, Homo sapiens
ucuguggcuuuca

SEQ ID NO: 1030787 - RNA, 14 nt, Homo sapiens
ucugugugugaugu

SEQ ID NO: 1030788 - RNA, 23 nt, Homo sapiens
ucuguguguguguaugugggggu

SEQ ID NO: 1030789 - RNA, 21 nt, Homo sapiens
ucuguguuggcccaagcucuu

SEQ ID NO: 1030790 - RNA, 19 nt, Homo sapiens
ucuguuaccaugucacugu

SEQ ID NO: 1030791 - RNA, 22 nt, Homo sapiens
ucuguuauuaacaaacaucacu

SEQ ID NO: 1030792 - RNA, 17 nt, Homo sapiens
ucuguuggccaguguga

SEQ ID NO: 1030793 - RNA, 20 nt, Homo sapiens
ucuguuggccagugugacaa

SEQ ID NO: 1030794 - RNA, 14 nt, Homo sapiens
ucuguuugagauuu

SEQ ID NO: 1030795 - RNA, 21 nt, Homo sapiens
ucuguuuguuuuauacaaaug

SEQ ID NO: 1030796 - RNA, 13 nt, Homo sapiens
ucuguuuugccug

SEQ ID NO: 1030797 - RNA, 17 nt, Homo sapiens
ucuuaaaauagccauaa

SEQ ID NO: 1030798 - RNA, 23 nt, Homo sapiens
ucuuaagacgugauuuugcugua

SEQ ID NO: 1030799 - RNA, 18 nt, Homo sapiens
ucuuaaucuuuucacaaa

SEQ ID NO: 1030800 - RNA, 22 nt, Homo sapiens
ucuuaauuauuguacauuuaua

SEQ ID NO: 1030801 - RNA, 22 nt, Homo sapiens
ucuuacauaauuuuuuauucaa

SEQ ID NO: 1030802 - RNA, 14 nt, Homo sapiens
ucuuacaugcauuu

SEQ ID NO: 1030803 - RNA, 16 nt, Homo sapiens
ucuuagaaaaaccacc

SEQ ID NO: 1030804 - RNA, 15 nt, Homo sapiens
ucuuagaaaugaagg

SEQ ID NO: 1030805 - RNA, 18 nt, Homo sapiens
ucuuagcacacucacaga

SEQ ID NO: 1030806 - RNA, 11 nt, Homo sapiens
ucuuagcuguc

SEQ ID NO: 1030807 - RNA, 17 nt, Homo sapiens
ucuuagcugucugcuca

SEQ ID NO: 1030808 - RNA, 16 nt, Homo sapiens
ucuuagucgagccaag

SEQ ID NO: 1030809 - RNA, 15 nt, Homo sapiens
ucuuagugucacuua

SEQ ID NO: 1030810 - RNA, 17 nt, Homo sapiens
ucuuaguuguacaaaua

SEQ ID NO: 1030811 - RNA, 14 nt, Homo sapiens
ucuuaguuugcagu

SEQ ID NO: 1030812 - RNA, 14 nt, Homo sapiens
ucuuauauauguga

SEQ ID NO: 1030813 - RNA, 17 nt, Homo sapiens
ucuucaaccucauugac

SEQ ID NO: 1030814 - RNA, 14 nt, Homo sapiens
ucuucaagaccaaa

SEQ ID NO: 1030815 - RNA, 16 nt, Homo sapiens
ucuucacucucugaag

SEQ ID NO: 1030816 - RNA, 12 nt, Homo sapiens
ucuucacucuga

SEQ ID NO: 1030817 - RNA, 16 nt, Homo sapiens
ucuucagagcugacac

SEQ ID NO: 1030818 - RNA, 18 nt, Homo sapiens
ucuucagauacaaacugc

SEQ ID NO: 1030819 - RNA, 11 nt, Homo sapiens
ucuucagccac

SEQ ID NO: 1030820 - RNA, 11 nt, Homo sapiens
ucuucagccau

SEQ ID NO: 1030821 - RNA, 21 nt, Homo sapiens
ucuucauuaagcccucuucca

SEQ ID NO: 1030822 - RNA, 20 nt, Homo sapiens
ucuucauuaccucagugaga

SEQ ID NO: 1030823 - RNA, 13 nt, Homo sapiens
ucuucauugcagu

SEQ ID NO: 1030824 - RNA, 17 nt, Homo sapiens
ucuucauuucauuguau

SEQ ID NO: 1030825 - RNA, 12 nt, Homo sapiens
ucuucauuucua

SEQ ID NO: 1030826 - RNA, 23 nt, Homo sapiens
ucuuccacuggaaaaguguaaua

SEQ ID NO: 1030827 - RNA, 15 nt, Homo sapiens
ucuuccagaaggcaa

SEQ ID NO: 1030828 - RNA, 18 nt, Homo sapiens
ucuucccaggcuggggcu

SEQ ID NO: 1030829 - RNA, 13 nt, Homo sapiens
ucuuccccagaua

SEQ ID NO: 1030830 - RNA, 11 nt, Homo sapiens
ucuucccuacc

SEQ ID NO: 1030831 - RNA, 23 nt, Homo sapiens
ucuucccuguaugauuccuugau

SEQ ID NO: 1030832 - RNA, 14 nt, Homo sapiens
ucuuccugacacuu

SEQ ID NO: 1030833 - RNA, 13 nt, Homo sapiens
ucuuccugcauuc

SEQ ID NO: 1030834 - RNA, 14 nt, Homo sapiens
ucuuccuuuuauca

SEQ ID NO: 1030835 - RNA, 19 nt, Homo sapiens
ucuucguauucccauuaga

SEQ ID NO: 1030836 - RNA, 14 nt, Homo sapiens
ucuucucaagaucc

SEQ ID NO: 1030837 - RNA, 13 nt, Homo sapiens
ucuucucuacucu

SEQ ID NO: 1030838 - RNA, 14 nt, Homo sapiens
ucuucucuacucua

SEQ ID NO: 1030839 - RNA, 20 nt, Homo sapiens
ucuucugaacucaaacugag

SEQ ID NO: 1030840 - RNA, 18 nt, Homo sapiens
ucuucugauuugucccua

SEQ ID NO: 1030841 - RNA, 23 nt, Homo sapiens
ucuucugccccagcuuugcagga

SEQ ID NO: 1030842 - RNA, 13 nt, Homo sapiens
ucuucugccucag

SEQ ID NO: 1030843 - RNA, 14 nt, Homo sapiens
ucuucuuacaugca

SEQ ID NO: 1030844 - RNA, 16 nt, Homo sapiens
ucuucuugaacacuca

SEQ ID NO: 1030845 - RNA, 22 nt, Homo sapiens
ucuucuugaacacucaugcuga

SEQ ID NO: 1030846 - RNA, 14 nt, Homo sapiens
ucuugaaacaagca

SEQ ID NO: 1030847 - RNA, 22 nt, Homo sapiens
ucuugaaauauaggaacuuaaa

SEQ ID NO: 1030848 - RNA, 15 nt, Homo sapiens
ucuugacauucacuu

SEQ ID NO: 1030849 - RNA, 17 nt, Homo sapiens
ucuugauaccugggaua

SEQ ID NO: 1030850 - RNA, 17 nt, Homo sapiens
ucuugaugcaugcacug

SEQ ID NO: 1030851 - RNA, 14 nt, Homo sapiens
ucuugcaauccaca

SEQ ID NO: 1030852 - RNA, 16 nt, Homo sapiens
ucuugcauucccagug

SEQ ID NO: 1030853 - RNA, 18 nt, Homo sapiens
ucuugcuauguugcccag

SEQ ID NO: 1030854 - RNA, 19 nt, Homo sapiens
ucuugggaagaccagcuuu

SEQ ID NO: 1030855 - RNA, 18 nt, Homo sapiens
auccucacccagcaccca

SEQ ID NO: 1030856 - RNA, 20 nt, Homo sapiens
auccucacccagcacccaca

SEQ ID NO: 1030857 - RNA, 20 nt, Homo sapiens
auccucacugggugggguga

SEQ ID NO: 1030858 - RNA, 17 nt, Homo sapiens
auccuccaagaaucuau

SEQ ID NO: 1030859 - RNA, 22 nt, Homo sapiens
auccucugagugugaccaggca

SEQ ID NO: 1030860 - RNA, 12 nt, Homo sapiens
auccugccaacu

SEQ ID NO: 1030861 - RNA, 17 nt, Homo sapiens
auccuggggaacauaga

SEQ ID NO: 1030862 - RNA, 16 nt, Homo sapiens
auccugugacauguaa

SEQ ID NO: 1030863 - RNA, 12 nt, Homo sapiens
auccuguucucu

SEQ ID NO: 1030864 - RNA, 16 nt, Homo sapiens
auccuugauaaaugcc

SEQ ID NO: 1030865 - RNA, 13 nt, Homo sapiens
auccuuuacuguu

SEQ ID NO: 1030866 - RNA, 17 nt, Homo sapiens
aucgagaccaucuuggc

SEQ ID NO: 1030867 - RNA, 13 nt, Homo sapiens
aucgcaagagcca

SEQ ID NO: 1030868 - RNA, 19 nt, Homo sapiens
aucgcaccacugcucucca

SEQ ID NO: 1030869 - RNA, 18 nt, Homo sapiens
augauugcuuaucaguag

SEQ ID NO: 1030870 - RNA, 19 nt, Homo sapiens
augauuucaugcuaucucu

SEQ ID NO: 1030871 - RNA, 14 nt, Homo sapiens
augauuuuauuuga

SEQ ID NO: 1030872 - RNA, 15 nt, Homo sapiens
augauuuuggccuca

SEQ ID NO: 1030873 - RNA, 17 nt, Homo sapiens
augcaaaauccugguga

SEQ ID NO: 1030874 - RNA, 16 nt, Homo sapiens
augcaaaguagcaauu

SEQ ID NO: 1030875 - RNA, 22 nt, Homo sapiens
augcaaccuuuggaugcacuuu

SEQ ID NO: 1030876 - RNA, 24 nt, Homo sapiens
augcaaccuuuggaugcacuuuau

SEQ ID NO: 1030877 - RNA, 21 nt, Homo sapiens
augcaaggggaaaaucucagc

SEQ ID NO: 1030878 - RNA, 13 nt, Homo sapiens
augcaaugaacac

SEQ ID NO: 1030879 - RNA, 20 nt, Homo sapiens
augcacauauggacucugca

SEQ ID NO: 1030880 - RNA, 15 nt, Homo sapiens
augcacgaucucagu

SEQ ID NO: 1030881 - RNA, 13 nt, Homo sapiens
augcagacaugag

SEQ ID NO: 1030882 - RNA, 15 nt, Homo sapiens
augcagaguugacau

SEQ ID NO: 1030883 - RNA, 14 nt, Homo sapiens
augcagcaucuaag

SEQ ID NO: 1030884 - RNA, 15 nt, Homo sapiens
augcagugcuuccaa

SEQ ID NO: 1030885 - RNA, 16 nt, Homo sapiens
augcauaaaugcgauc

SEQ ID NO: 1030886 - RNA, 15 nt, Homo sapiens
augcauacacacaca

SEQ ID NO: 1030887 - RNA, 22 nt, Homo sapiens
augcaucaaguuauugacaaac

SEQ ID NO: 1030888 - RNA, 18 nt, Homo sapiens
augcauggaaauucccuu

SEQ ID NO: 1030889 - RNA, 16 nt, Homo sapiens
augcauuucucugggg

SEQ ID NO: 1030890 - RNA, 16 nt, Homo sapiens
augcauuugcacuauu

SEQ ID NO: 1030891 - RNA, 21 nt, Homo sapiens
augccaaccggucacccagga

SEQ ID NO: 1030892 - RNA, 17 nt, Homo sapiens
augccaagaaaguauuu

SEQ ID NO: 1030893 - RNA, 16 nt, Homo sapiens
augccaagcacugugc

SEQ ID NO: 1030894 - RNA, 20 nt, Homo sapiens
augccaauaaaguuugccca

SEQ ID NO: 1030895 - RNA, 22 nt, Homo sapiens
augccagcucagucccaucaga

SEQ ID NO: 1030896 - RNA, 16 nt, Homo sapiens
augccagcuuaucuca

SEQ ID NO: 1030897 - RNA, 23 nt, Homo sapiens
augccagugaaacuucaagcaaa

SEQ ID NO: 1030898 - RNA, 23 nt, Homo sapiens
augccauagcaagauugcuuaaa

SEQ ID NO: 1030899 - RNA, 17 nt, Homo sapiens
augcccccuccugcaag

SEQ ID NO: 1030900 - RNA, 20 nt, Homo sapiens
augcccucaggggacuugaa

SEQ ID NO: 1030901 - RNA, 19 nt, Homo sapiens
augccucauuaccuugugc

SEQ ID NO: 1030902 - RNA, 15 nt, Homo sapiens
augccuguaauccca

SEQ ID NO: 1030903 - RNA, 17 nt, Homo sapiens
augccuucacuuuacaa

SEQ ID NO: 1030904 - RNA, 18 nt, Homo sapiens
augccuuuaaaucuguga

SEQ ID NO: 1030905 - RNA, 19 nt, Homo sapiens
augcguacguuuccugaga

SEQ ID NO: 1030906 - RNA, 22 nt, Homo sapiens
augcuaaagaaaaagucaucca

SEQ ID NO: 1030907 - RNA, 15 nt, Homo sapiens
augcuacgugugauu

SEQ ID NO: 1030908 - RNA, 16 nt, Homo sapiens
augcuacgugugauuu

SEQ ID NO: 1030909 - RNA, 20 nt, Homo sapiens
augcuacugcugccuaguua

SEQ ID NO: 1030910 - RNA, 20 nt, Homo sapiens
augcuacuuuauuuauacac

SEQ ID NO: 1030911 - RNA, 18 nt, Homo sapiens
augcuauaacuauguuga

SEQ ID NO: 1030912 - RNA, 14 nt, Homo sapiens
augcucagggucaa

SEQ ID NO: 1030913 - RNA, 24 nt, Homo sapiens
augcuccagucaacaaacuauuuc

SEQ ID NO: 1030914 - RNA, 23 nt, Homo sapiens
augcucccuccccugcccugguc

SEQ ID NO: 1030915 - RNA, 17 nt, Homo sapiens
augcuccuuccaacagg

SEQ ID NO: 1030916 - RNA, 16 nt, Homo sapiens
augcucugcauguuac

SEQ ID NO: 1030917 - RNA, 16 nt, Homo sapiens
augcucuuuacuucau

SEQ ID NO: 1030918 - RNA, 18 nt, Homo sapiens
augcugaacauugcauau

SEQ ID NO: 1030919 - RNA, 23 nt, Homo sapiens
augcugagagagcuggaggcacc

SEQ ID NO: 1030920 - RNA, 17 nt, Homo sapiens
augcugauaaacugauu

SEQ ID NO: 1030921 - RNA, 15 nt, Homo sapiens
augcugcuaauucaa

SEQ ID NO: 1030922 - RNA, 15 nt, Homo sapiens
augcugcucaucccc

SEQ ID NO: 1030923 - RNA, 19 nt, Homo sapiens
augcugcuuuccccugugg

SEQ ID NO: 1030924 - RNA, 16 nt, Homo sapiens
augcuggcuguuggcu

SEQ ID NO: 1030925 - RNA, 15 nt, Homo sapiens
augcugugcuaugaa

SEQ ID NO: 1030926 - RNA, 18 nt, Homo sapiens
augcuguuugacaaaguu

SEQ ID NO: 1030927 - RNA, 19 nt, Homo sapiens
augcuuagucccucaugca

SEQ ID NO: 1030928 - RNA, 16 nt, Homo sapiens
augcuucuucucaggc

SEQ ID NO: 1030929 - RNA, 14 nt, Homo sapiens
augcuuuccugcac

SEQ ID NO: 1030930 - RNA, 19 nt, Homo sapiens
augcuuucgauaguguuaa

SEQ ID NO: 1030931 - RNA, 16 nt, Homo sapiens
auggaaaaaucuugga

SEQ ID NO: 1030932 - RNA, 21 nt, Homo sapiens
auggaaaucacauuuacaaaa

SEQ ID NO: 1030933 - RNA, 16 nt, Homo sapiens
auggaacucucuccac

SEQ ID NO: 1030934 - RNA, 17 nt, Homo sapiens
auggaagcuuccagucc

SEQ ID NO: 1030935 - RNA, 23 nt, Homo sapiens
auggaaguugcagugagcugaua

SEQ ID NO: 1030936 - RNA, 15 nt, Homo sapiens
auggaauaaagcccu

SEQ ID NO: 1030937 - RNA, 16 nt, Homo sapiens
auggaauaaagcccuu

SEQ ID NO: 1030938 - RNA, 14 nt, Homo sapiens
auggacacacuggu

SEQ ID NO: 1030939 - RNA, 18 nt, Homo sapiens
auggacacuccagugcca

SEQ ID NO: 1030940 - RNA, 21 nt, Homo sapiens
auggacacuccagugccagca

SEQ ID NO: 1030941 - RNA, 15 nt, Homo sapiens
auggacucaguuuuc

SEQ ID NO: 1030942 - RNA, 12 nt, Homo sapiens
auggacucugca

SEQ ID NO: 1030943 - RNA, 16 nt, Homo sapiens
auggacugcuucaucu

SEQ ID NO: 1030944 - RNA, 20 nt, Homo sapiens
auggacuuccacugccaucc

SEQ ID NO: 1030945 - RNA, 15 nt, Homo sapiens
auggacuuguauauu

SEQ ID NO: 1030946 - RNA, 12 nt, Homo sapiens
auggacuuuguu

SEQ ID NO: 1030947 - RNA, 13 nt, Homo sapiens
auggagacuugag

SEQ ID NO: 1030948 - RNA, 17 nt, Homo sapiens
auggauaagcuugucua

SEQ ID NO: 1030949 - RNA, 16 nt, Homo sapiens
auggauagucugucca

SEQ ID NO: 1030950 - RNA, 17 nt, Homo sapiens
auggaugauucagaaau

SEQ ID NO: 1030951 - RNA, 14 nt, Homo sapiens
auggauuuccagcc

SEQ ID NO: 1030952 - RNA, 22 nt, Homo sapiens
auggcacagcccaaagaaggaa

SEQ ID NO: 1030953 - RNA, 15 nt, Homo sapiens
auggcaccaaagcca

SEQ ID NO: 1030954 - RNA, 22 nt, Homo sapiens
auggcaccacugcacuccagcc

SEQ ID NO: 1030955 - RNA, 11 nt, Homo sapiens
auggcacuggc

SEQ ID NO: 1030956 - RNA, 12 nt, Homo sapiens
auggcacuggca

SEQ ID NO: 1030957 - RNA, 15 nt, Homo sapiens
auggcagaagacacc

SEQ ID NO: 1030958 - RNA, 17 nt, Homo sapiens
auggcagcuuuccucaa

SEQ ID NO: 1030959 - RNA, 15 nt, Homo sapiens
auggcauccugugaa

SEQ ID NO: 1030960 - RNA, 19 nt, Homo sapiens
auggcguggucaagcacuc

SEQ ID NO: 1030961 - RNA, 18 nt, Homo sapiens
auggcuaguaucaaaaga

SEQ ID NO: 1030962 - RNA, 15 nt, Homo sapiens
auggcuauauggcaa

SEQ ID NO: 1030963 - RNA, 16 nt, Homo sapiens
auggcucacuaugaau

SEQ ID NO: 1030964 - RNA, 15 nt, Homo sapiens
auggcucagaugcca

SEQ ID NO: 1030965 - RNA, 20 nt, Homo sapiens
auggcucuaacaaugacauu

SEQ ID NO: 1030966 - RNA, 14 nt, Homo sapiens
auggcuuccuccug

SEQ ID NO: 1030967 - RNA, 15 nt, Homo sapiens
auggcuuuaugcuag

SEQ ID NO: 1030968 - RNA, 15 nt, Homo sapiens
auggcuuugugauuc

SEQ ID NO: 1030969 - RNA, 15 nt, Homo sapiens
auggcuuuugugcau

SEQ ID NO: 1030970 - RNA, 17 nt, Homo sapiens
augggaaccccuucauc

SEQ ID NO: 1030971 - RNA, 15 nt, Homo sapiens
augggagacacugau

SEQ ID NO: 1030972 - RNA, 13 nt, Homo sapiens
augggaugaaugg

SEQ ID NO: 1030973 - RNA, 16 nt, Homo sapiens
augggaugcuugccua

SEQ ID NO: 1030974 - RNA, 23 nt, Homo sapiens
augggcacugccgagaacagcau

SEQ ID NO: 1030975 - RNA, 22 nt, Homo sapiens
auggggagagccuuugccucca

SEQ ID NO: 1030976 - RNA, 23 nt, Homo sapiens
auggggauaaaggagaaggcaug

SEQ ID NO: 1030977 - RNA, 18 nt, Homo sapiens
auggggugggguagggcu

SEQ ID NO: 1030978 - RNA, 19 nt, Homo sapiens
augggguugguguucucau

SEQ ID NO: 1030979 - RNA, 22 nt, Homo sapiens
auggguuagggaaaacauucca

SEQ ID NO: 1030980 - RNA, 16 nt, Homo sapiens
augguaauuguugcua

SEQ ID NO: 1030981 - RNA, 18 nt, Homo sapiens
augguacuauguuagccc

SEQ ID NO: 1030982 - RNA, 20 nt, Homo sapiens
augguaggauaucuuggcuu

SEQ ID NO: 1030983 - RNA, 20 nt, Homo sapiens
augguccuggggcucugugc

SEQ ID NO: 1030984 - RNA, 14 nt, Homo sapiens
augguccugugaug

SEQ ID NO: 1030985 - RNA, 19 nt, Homo sapiens
auggugaaaauauuugaca

SEQ ID NO: 1030986 - RNA, 14 nt, Homo sapiens
auggugaaaugcag

SEQ ID NO: 1030987 - RNA, 16 nt, Homo sapiens
auggugaauuaaucac

SEQ ID NO: 1030988 - RNA, 16 nt, Homo sapiens
auggugagaugcagcu

SEQ ID NO: 1030989 - RNA, 20 nt, Homo sapiens
augguggcgcgcaccuguaa

SEQ ID NO: 1030990 - RNA, 16 nt, Homo sapiens
augguuacucuuguca

SEQ ID NO: 1030991 - RNA, 15 nt, Homo sapiens
augguuccauucucu

SEQ ID NO: 1030992 - RNA, 19 nt, Homo sapiens
augguuccauucucucucc

SEQ ID NO: 1030993 - RNA, 19 nt, Homo sapiens
augguuuuacucaugugca

SEQ ID NO: 1030994 - RNA, 14 nt, Homo sapiens
auguaaaaugcaaa

SEQ ID NO: 1030995 - RNA, 16 nt, Homo sapiens
auguaaacugugcacc

SEQ ID NO: 1030996 - RNA, 15 nt, Homo sapiens
auguaaaugcaucug

SEQ ID NO: 1030997 - RNA, 13 nt, Homo sapiens
auguaacugcauu

SEQ ID NO: 1030998 - RNA, 13 nt, Homo sapiens
auguaacugcuga

SEQ ID NO: 1030999 - RNA, 14 nt, Homo sapiens
auguaacuggaauc

SEQ ID NO: 1031000 - RNA, 20 nt, Homo sapiens
auguaaugaucauaagucua

SEQ ID NO: 1031001 - RNA, 16 nt, Homo sapiens
auguaaugcauaggaa

SEQ ID NO: 1031002 - RNA, 19 nt, Homo sapiens
auguacaucuggccuugaa

SEQ ID NO: 1031003 - RNA, 17 nt, Homo sapiens
auguagcagauccccag

SEQ ID NO: 1031004 - RNA, 21 nt, Homo sapiens
auguagccauuguagcagcuu

SEQ ID NO: 1031005 - RNA, 12 nt, Homo sapiens
auguagucucau

SEQ ID NO: 1031006 - RNA, 14 nt, Homo sapiens
auguauagcugcuu

SEQ ID NO: 1031007 - RNA, 15 nt, Homo sapiens
auguauauacauuua

SEQ ID NO: 1031008 - RNA, 18 nt, Homo sapiens
auguaucaaugaguaaca

SEQ ID NO: 1031009 - RNA, 12 nt, Homo sapiens
auguaugcagcu

SEQ ID NO: 1031010 - RNA, 18 nt, Homo sapiens
auguauuguaaacaugug

SEQ ID NO: 1031011 - RNA, 22 nt, Homo sapiens
auguauuuuccugcauaaucau

SEQ ID NO: 1031012 - RNA, 22 nt, Homo sapiens
augucaacuucuggcuccucaa

SEQ ID NO: 1031013 - RNA, 13 nt, Homo sapiens
ugaauucugggaa

SEQ ID NO: 1031014 - RNA, 18 nt, Homo sapiens
ugagucaaaaaaucucaa

SEQ ID NO: 1031015 - RNA, 15 nt, Homo sapiens
ugagucaaugugcag

SEQ ID NO: 1031016 - RNA, 22 nt, Homo sapiens
ugaguccaagaggguccuuuag

SEQ ID NO: 1031017 - RNA, 18 nt, Homo sapiens
augucacagggccaacuu

SEQ ID NO: 1031018 - RNA, 16 nt, Homo sapiens
augucaucauacauga

SEQ ID NO: 1031019 - RNA, 16 nt, Homo sapiens
augucaugucagcucc

SEQ ID NO: 1031020 - RNA, 12 nt, Homo sapiens
auguccacagau

SEQ ID NO: 1031021 - RNA, 22 nt, Homo sapiens
auguccaugauggaauauuccc

SEQ ID NO: 1031022 - RNA, 15 nt, Homo sapiens
augucccaacuugua

SEQ ID NO: 1031023 - RNA, 15 nt, Homo sapiens
auguccccaccaauc

SEQ ID NO: 1031024 - RNA, 13 nt, Homo sapiens
auguccuggacac

SEQ ID NO: 1031025 - RNA, 22 nt, Homo sapiens
augucuccaucucugucucaaa

SEQ ID NO: 1031026 - RNA, 19 nt, Homo sapiens
augucucuuuaaugucaca

SEQ ID NO: 1031027 - RNA, 20 nt, Homo sapiens
augucugaucuaaaugugga

SEQ ID NO: 1031028 - RNA, 18 nt, Homo sapiens
augucuguagcuccucaa

SEQ ID NO: 1031029 - RNA, 22 nt, Homo sapiens
augucuguagcuccucaacuca

SEQ ID NO: 1031030 - RNA, 17 nt, Homo sapiens
augucuuggacacugua

SEQ ID NO: 1031031 - RNA, 15 nt, Homo sapiens
augucuuucagccaa

SEQ ID NO: 1031032 - RNA, 15 nt, Homo sapiens
augugaaaguuacaa

SEQ ID NO: 1031033 - RNA, 19 nt, Homo sapiens
augugacuccuaugaucuc

SEQ ID NO: 1031034 - RNA, 21 nt, Homo sapiens
augugauuuaauaguguuaau

SEQ ID NO: 1031035 - RNA, 15 nt, Homo sapiens
augugcagcuauuua

SEQ ID NO: 1031036 - RNA, 14 nt, Homo sapiens
augugcaugggagc

SEQ ID NO: 1031037 - RNA, 15 nt, Homo sapiens
augugcgcacacaca

SEQ ID NO: 1031038 - RNA, 14 nt, Homo sapiens
augugcucagggaa

SEQ ID NO: 1031039 - RNA, 17 nt, Homo sapiens
augugcugucaaaacaa

SEQ ID NO: 1031040 - RNA, 18 nt, Homo sapiens
auguggaaaaaugagaga

SEQ ID NO: 1031041 - RNA, 14 nt, Homo sapiens
auguggcauguuca

SEQ ID NO: 1031042 - RNA, 12 nt, Homo sapiens
auguggcccaac

SEQ ID NO: 1031043 - RNA, 22 nt, Homo sapiens
auguggccuaaaaaugcaacuu

SEQ ID NO: 1031044 - RNA, 20 nt, Homo sapiens
augugggguccccaucaucc

SEQ ID NO: 1031045 - RNA, 12 nt, Homo sapiens
auguguacuuaa

SEQ ID NO: 1031046 - RNA, 15 nt, Homo sapiens
augugugaggagcug

SEQ ID NO: 1031047 - RNA, 16 nt, Homo sapiens
augugugugcaagugu

SEQ ID NO: 1031048 - RNA, 21 nt, Homo sapiens
auguguucauuaaagcaugaa

SEQ ID NO: 1031049 - RNA, 14 nt, Homo sapiens
auguguucugucac

SEQ ID NO: 1031050 - RNA, 15 nt, Homo sapiens
auguguugcuauccu

SEQ ID NO: 1031051 - RNA, 14 nt, Homo sapiens
auguguugugauag

SEQ ID NO: 1031052 - RNA, 15 nt, Homo sapiens
auguguuuuucacau

SEQ ID NO: 1031053 - RNA, 16 nt, Homo sapiens
auguuaaccucagugu

SEQ ID NO: 1031054 - RNA, 18 nt, Homo sapiens
auguuaaggaaacucuua

SEQ ID NO: 1031055 - RNA, 13 nt, Homo sapiens
auguuacugacca

SEQ ID NO: 1031056 - RNA, 19 nt, Homo sapiens
auguuaggaaaauuucaca

SEQ ID NO: 1031057 - RNA, 14 nt, Homo sapiens
auguucaacuggag

SEQ ID NO: 1031058 - RNA, 22 nt, Homo sapiens
auguucacuuauugacuauuau

SEQ ID NO: 1031059 - RNA, 21 nt, Homo sapiens
auguucauuguaauguuacug

SEQ ID NO: 1031060 - RNA, 14 nt, Homo sapiens
auguuccacuaacc

SEQ ID NO: 1031061 - RNA, 12 nt, Homo sapiens
auguuccacucc

SEQ ID NO: 1031062 - RNA, 17 nt, Homo sapiens
auguugaaagaucaaaa

SEQ ID NO: 1031063 - RNA, 12 nt, Homo sapiens
auguugaugaaa

SEQ ID NO: 1031064 - RNA, 14 nt, Homo sapiens
auguugcccaggca

SEQ ID NO: 1031065 - RNA, 13 nt, Homo sapiens
auguuggucaaaa

SEQ ID NO: 1031066 - RNA, 20 nt, Homo sapiens
auguuuacuuuucagggcau

SEQ ID NO: 1031067 - RNA, 16 nt, Homo sapiens
auguuuagaguugcaa

SEQ ID NO: 1031068 - RNA, 17 nt, Homo sapiens
auguuuauuuacuaauu

SEQ ID NO: 1031069 - RNA, 22 nt, Homo sapiens
auguuucauguuuugugacuau

SEQ ID NO: 1031070 - RNA, 22 nt, Homo sapiens
auguuucugucacaucagcucc

SEQ ID NO: 1031071 - RNA, 20 nt, Homo sapiens
auguuuuagacaaauacuca

SEQ ID NO: 1031072 - RNA, 17 nt, Homo sapiens
auguuuuagccagugau

SEQ ID NO: 1031073 - RNA, 21 nt, Homo sapiens
auguuuucuagucacuuccuc

SEQ ID NO: 1031074 - RNA, 22 nt, Homo sapiens
auguuuucucuggaguauucua

SEQ ID NO: 1031075 - RNA, 14 nt, Homo sapiens
auuaaaagccauga

SEQ ID NO: 1031076 - RNA, 18 nt, Homo sapiens
auuaaaagugacauuugu

SEQ ID NO: 1031077 - RNA, 14 nt, Homo sapiens
auuaaagacagagg

SEQ ID NO: 1031078 - RNA, 19 nt, Homo sapiens
auuaacaacaauaacacug

SEQ ID NO: 1031079 - RNA, 16 nt, Homo sapiens
auuaacagcugauaca

SEQ ID NO: 1031080 - RNA, 19 nt, Homo sapiens
auuaacaguuuuccaugaa

SEQ ID NO: 1031081 - RNA, 12 nt, Homo sapiens
auuaaccugcca

SEQ ID NO: 1031082 - RNA, 16 nt, Homo sapiens
auuaaccugccaggga

SEQ ID NO: 1031083 - RNA, 17 nt, Homo sapiens
auuaacuaauaugggca

SEQ ID NO: 1031084 - RNA, 18 nt, Homo sapiens
auuaacuuuaauucucuu

SEQ ID NO: 1031085 - RNA, 21 nt, Homo sapiens
auuaacuuuuauaaacuuuac

SEQ ID NO: 1031086 - RNA, 18 nt, Homo sapiens
auuaagaaagacuaucua

SEQ ID NO: 1031087 - RNA, 15 nt, Homo sapiens
auuaagacaugcacu

SEQ ID NO: 1031088 - RNA, 22 nt, Homo sapiens
auuaaggauuuuaugcuuuaaa

SEQ ID NO: 1031089 - RNA, 13 nt, Homo sapiens
auuaaguuaucuu

SEQ ID NO: 1031090 - RNA, 21 nt, Homo sapiens
auuaauauugcagucaaucuc

SEQ ID NO: 1031091 - RNA, 13 nt, Homo sapiens
auuaauauuugcu

SEQ ID NO: 1031092 - RNA, 15 nt, Homo sapiens
auuaaugcacuuucu

SEQ ID NO: 1031093 - RNA, 16 nt, Homo sapiens
auuaauuaauauucau

SEQ ID NO: 1031094 - RNA, 19 nt, Homo sapiens
auuaauugugugucacaag

SEQ ID NO: 1031095 - RNA, 19 nt, Homo sapiens
auuaauuuuggucuaaaac

SEQ ID NO: 1031096 - RNA, 17 nt, Homo sapiens
auuacaaaaacauggcc

SEQ ID NO: 1031097 - RNA, 17 nt, Homo sapiens
auuacaagccuacauga

SEQ ID NO: 1031098 - RNA, 13 nt, Homo sapiens
auuacaggcacau

SEQ ID NO: 1031099 - RNA, 19 nt, Homo sapiens
auuacagggaaugccugag

SEQ ID NO: 1031100 - RNA, 21 nt, Homo sapiens
auuaccaaccuguuaccuacu

SEQ ID NO: 1031101 - RNA, 16 nt, Homo sapiens
auuaccuccugagaaa

SEQ ID NO: 1031102 - RNA, 14 nt, Homo sapiens
auuacugauuuugu

SEQ ID NO: 1031103 - RNA, 20 nt, Homo sapiens
auuacuggaaggcuuccacu

SEQ ID NO: 1031104 - RNA, 16 nt, Homo sapiens
auuacuguauauacuu

SEQ ID NO: 1031105 - RNA, 16 nt, Homo sapiens
auuagaaucugaguau

SEQ ID NO: 1031106 - RNA, 19 nt, Homo sapiens
auuagagaaugauuucaaa

SEQ ID NO: 1031107 - RNA, 14 nt, Homo sapiens
auuagccauuugac

SEQ ID NO: 1031108 - RNA, 19 nt, Homo sapiens
auuagcugaguguagugac

SEQ ID NO: 1031109 - RNA, 19 nt, Homo sapiens
auuaggacuuuuauuguga

SEQ ID NO: 1031110 - RNA, 22 nt, Homo sapiens
auuaguguaugcuuugaaugua

SEQ ID NO: 1031111 - RNA, 12 nt, Homo sapiens
auuaguuuacau

SEQ ID NO: 1031112 - RNA, 18 nt, Homo sapiens
auuauaauuaguuccuca

SEQ ID NO: 1031113 - RNA, 13 nt, Homo sapiens
auuauacauuuga

SEQ ID NO: 1031114 - RNA, 15 nt, Homo sapiens
auuauacuguauuaa

SEQ ID NO: 1031115 - RNA, 16 nt, Homo sapiens
auuauagccacauccc

SEQ ID NO: 1031116 - RNA, 18 nt, Homo sapiens
auuauaggccaaacuggc

SEQ ID NO: 1031117 - RNA, 14 nt, Homo sapiens
auuauagugacaau

SEQ ID NO: 1031118 - RNA, 16 nt, Homo sapiens
auuaucaacagcauuu

SEQ ID NO: 1031119 - RNA, 13 nt, Homo sapiens
auuaucaucugaa

SEQ ID NO: 1031120 - RNA, 12 nt, Homo sapiens
auuaucaugugu

SEQ ID NO: 1031121 - RNA, 17 nt, Homo sapiens
auuaucauguguaauca

SEQ ID NO: 1031122 - RNA, 17 nt, Homo sapiens
auuaucgggaacagugu

SEQ ID NO: 1031123 - RNA, 21 nt, Homo sapiens
auuaucgggagcagugucuuc

SEQ ID NO: 1031124 - RNA, 18 nt, Homo sapiens
auuaucuaugauaugcua

SEQ ID NO: 1031125 - RNA, 13 nt, Homo sapiens
auuaugaagucau

SEQ ID NO: 1031126 - RNA, 22 nt, Homo sapiens
auuaugaagugacucucacaag

SEQ ID NO: 1031127 - RNA, 16 nt, Homo sapiens
auuaugagaggcaaug

SEQ ID NO: 1031128 - RNA, 15 nt, Homo sapiens
auuaugauugcauaa

SEQ ID NO: 1031129 - RNA, 18 nt, Homo sapiens
auuaugccauagcaagau

SEQ ID NO: 1031130 - RNA, 14 nt, Homo sapiens
auuaugcuaccuac

SEQ ID NO: 1031131 - RNA, 18 nt, Homo sapiens
auuauguccacuguguau

SEQ ID NO: 1031132 - RNA, 20 nt, Homo sapiens
auuauuaaugaaaauaagaa

SEQ ID NO: 1031133 - RNA, 12 nt, Homo sapiens
auuauuacuguu

SEQ ID NO: 1031134 - RNA, 21 nt, Homo sapiens
auuauucccauucuacauacu

SEQ ID NO: 1031135 - RNA, 22 nt, Homo sapiens
auuauucuuguaguuuaccucu

SEQ ID NO: 1031136 - RNA, 19 nt, Homo sapiens
auuauugaaauuguacaua

SEQ ID NO: 1031137 - RNA, 16 nt, Homo sapiens
auuauuggacagucuc

SEQ ID NO: 1031138 - RNA, 15 nt, Homo sapiens
auuauuuaauaacau

SEQ ID NO: 1031139 - RNA, 19 nt, Homo sapiens
auuauuuauucagcuucau

SEQ ID NO: 1031140 - RNA, 13 nt, Homo sapiens
auucaaagcucua

SEQ ID NO: 1031141 - RNA, 21 nt, Homo sapiens
auucaaaguuaaaagcaaaca

SEQ ID NO: 1031142 - RNA, 21 nt, Homo sapiens
auucaaauuuuaucuccagau

SEQ ID NO: 1031143 - RNA, 14 nt, Homo sapiens
auucaaccacugua

SEQ ID NO: 1031144 - RNA, 16 nt, Homo sapiens
auucacaagacccaaa

SEQ ID NO: 1031145 - RNA, 17 nt, Homo sapiens
auucacaagacccaaaa

SEQ ID NO: 1031146 - RNA, 20 nt, Homo sapiens
auucacagcaagucacuggc

SEQ ID NO: 1031147 - RNA, 18 nt, Homo sapiens
auucacuagaccagaagu

SEQ ID NO: 1031148 - RNA, 16 nt, Homo sapiens
auucacuucauaaucc

SEQ ID NO: 1031149 - RNA, 16 nt, Homo sapiens
auucacuugcauuucu

SEQ ID NO: 1031150 - RNA, 14 nt, Homo sapiens
auucagcucugcaa

SEQ ID NO: 1031151 - RNA, 17 nt, Homo sapiens
auucagcucugcaagaa

SEQ ID NO: 1031152 - RNA, 14 nt, Homo sapiens
auucaggcuuugga

SEQ ID NO: 1031153 - RNA, 23 nt, Homo sapiens
auucagugagggucuucuuacau

SEQ ID NO: 1031154 - RNA, 12 nt, Homo sapiens
auucaguguuaa

SEQ ID NO: 1031155 - RNA, 16 nt, Homo sapiens
auucaguuuucaggau

SEQ ID NO: 1031156 - RNA, 15 nt, Homo sapiens
auucauacauuaucu

SEQ ID NO: 1031157 - RNA, 15 nt, Homo sapiens
auucaucaaauggaa

SEQ ID NO: 1031158 - RNA, 16 nt, Homo sapiens
auucaucucaaggaau

SEQ ID NO: 1031159 - RNA, 11 nt, Homo sapiens
auucauuccau

SEQ ID NO: 1031160 - RNA, 19 nt, Homo sapiens
ugugaggagguagauuugg

SEQ ID NO: 1031161 - RNA, 15 nt, Homo sapiens
ugugagugugugcaa

SEQ ID NO: 1031162 - RNA, 19 nt, Homo sapiens
ugugagugugugcaaguau

SEQ ID NO: 1031163 - RNA, 20 nt, Homo sapiens
ugugaucuaucaauagucaa

SEQ ID NO: 1031164 - RNA, 19 nt, Homo sapiens
ugugauuauuucacuuuag

SEQ ID NO: 1031165 - RNA, 14 nt, Homo sapiens
ugugauucugccuu

SEQ ID NO: 1031166 - RNA, 17 nt, Homo sapiens
ugugauuuuaacucugu

SEQ ID NO: 1031167 - RNA, 12 nt, Homo sapiens
ugugauuuucag

SEQ ID NO: 1031168 - RNA, 20 nt, Homo sapiens
ugugcaaguguguaugugcg

SEQ ID NO: 1031169 - RNA, 9 nt, Homo sapiens
ugugcaaua

SEQ ID NO: 1031170 - RNA, 15 nt, Homo sapiens
ugugcagaaccuccu

SEQ ID NO: 1031171 - RNA, 18 nt, Homo sapiens
ugugcaugugugugcuca

SEQ ID NO: 1031172 - RNA, 14 nt, Homo sapiens
ugugcccucagauu

SEQ ID NO: 1031173 - RNA, 16 nt, Homo sapiens
ugugccgaaugugcag

SEQ ID NO: 1031174 - RNA, 13 nt, Homo sapiens
ugugcgcacacac

SEQ ID NO: 1031175 - RNA, 14 nt, Homo sapiens
ugugcgcacacaca

SEQ ID NO: 1031176 - RNA, 17 nt, Homo sapiens
ugugcgugaaacacacc

SEQ ID NO: 1031177 - RNA, 17 nt, Homo sapiens
ugugcuaauaacagugc

SEQ ID NO: 1031178 - RNA, 18 nt, Homo sapiens
ugugcucagagaccccuc

SEQ ID NO: 1031179 - RNA, 12 nt, Homo sapiens
ugugcucaggga

SEQ ID NO: 1031180 - RNA, 16 nt, Homo sapiens
ugugcuccgugccucc

SEQ ID NO: 1031181 - RNA, 18 nt, Homo sapiens
ugugcuccgugccuccac

SEQ ID NO: 1031182 - RNA, 22 nt, Homo sapiens
ugugcugaguugguguugacau

SEQ ID NO: 1031183 - RNA, 11 nt, Homo sapiens
ugugcugcuua

SEQ ID NO: 1031184 - RNA, 13 nt, Homo sapiens
ugugcuggggucu

SEQ ID NO: 1031185 - RNA, 14 nt, Homo sapiens
ugugcugguguccu

SEQ ID NO: 1031186 - RNA, 14 nt, Homo sapiens
ugugcuuucccuga

SEQ ID NO: 1031187 - RNA, 15 nt, Homo sapiens
uguggaagcaaaaau

SEQ ID NO: 1031188 - RNA, 15 nt, Homo sapiens
uguggcccaagacaa

SEQ ID NO: 1031189 - RNA, 23 nt, Homo sapiens
uguggcccagggaagccaaaaga

SEQ ID NO: 1031190 - RNA, 15 nt, Homo sapiens
uguggccccaacaca

SEQ ID NO: 1031191 - RNA, 20 nt, Homo sapiens
uguggccugggccuccucac

SEQ ID NO: 1031192 - RNA, 17 nt, Homo sapiens
uguggcugcuagcacuu

SEQ ID NO: 1031193 - RNA, 19 nt, Homo sapiens
uguggcuucuuaaucuuuu

SEQ ID NO: 1031194 - RNA, 22 nt, Homo sapiens
uguggcuucuuaaucuuuucac

SEQ ID NO: 1031195 - RNA, 19 nt, Homo sapiens
ugugggaaugcggcaagaa

SEQ ID NO: 1031196 - RNA, 20 nt, Homo sapiens
ugugggaaugcggcaagaag

SEQ ID NO: 1031197 - RNA, 14 nt, Homo sapiens
ugugggacugagug

SEQ ID NO: 1031198 - RNA, 16 nt, Homo sapiens
ugugggcaggaaguga

SEQ ID NO: 1031199 - RNA, 21 nt, Homo sapiens
uguggggagggauuuggggcu

SEQ ID NO: 1031200 - RNA, 18 nt, Homo sapiens
uguggggugggcacauug

SEQ ID NO: 1031201 - RNA, 14 nt, Homo sapiens
ugugggugggacca

SEQ ID NO: 1031202 - RNA, 19 nt, Homo sapiens
uguggugucuguguuccaa

SEQ ID NO: 1031203 - RNA, 19 nt, Homo sapiens
ugugguuaaugccauggac

SEQ ID NO: 1031204 - RNA, 14 nt, Homo sapiens
ugugguuuauguca

SEQ ID NO: 1031205 - RNA, 16 nt, Homo sapiens
cacccugauccucacc

SEQ ID NO: 1031206 - RNA, 12 nt, Homo sapiens
cacccuguguug

SEQ ID NO: 1031207 - RNA, 23 nt, Homo sapiens
cacccuuugugguuacaguuuga

SEQ ID NO: 1031208 - RNA, 20 nt, Homo sapiens
caccgagaauguuguauuca

SEQ ID NO: 1031209 - RNA, 21 nt, Homo sapiens
caccgugaccccuguccccac

SEQ ID NO: 1031210 - RNA, 16 nt, Homo sapiens
caccuagacuguaaac

SEQ ID NO: 1031211 - RNA, 12 nt, Homo sapiens
caccuagccucg

SEQ ID NO: 1031212 - RNA, 13 nt, Homo sapiens
caccuaugugcca

SEQ ID NO: 1031213 - RNA, 13 nt, Homo sapiens
caccuccauuugc

SEQ ID NO: 1031214 - RNA, 15 nt, Homo sapiens
caccuccuacgucaa

SEQ ID NO: 1031215 - RNA, 15 nt, Homo sapiens
caccuccucuaaggu

SEQ ID NO: 1031216 - RNA, 19 nt, Homo sapiens
caccuccuucucugucuca

SEQ ID NO: 1031217 - RNA, 22 nt, Homo sapiens
caccucuucucuuccuguaaca

SEQ ID NO: 1031218 - RNA, 17 nt, Homo sapiens
caccugacagcuuuauc

SEQ ID NO: 1031219 - RNA, 16 nt, Homo sapiens
caccugaccaaucaga

SEQ ID NO: 1031220 - RNA, 16 nt, Homo sapiens
caccugcuggagugaa

SEQ ID NO: 1031221 - RNA, 14 nt, Homo sapiens
caccuguaauccca

SEQ ID NO: 1031222 - RNA, 18 nt, Homo sapiens
caccuguacucuuccgaa

SEQ ID NO: 1031223 - RNA, 14 nt, Homo sapiens
caccuucuucagcc

SEQ ID NO: 1031224 - RNA, 16 nt, Homo sapiens
caccuugcccuuuacg

SEQ ID NO: 1031225 - RNA, 13 nt, Homo sapiens
caccuugggauga

SEQ ID NO: 1031226 - RNA, 15 nt, Homo sapiens
caccuugugucugua

SEQ ID NO: 1031227 - RNA, 13 nt, Homo sapiens
caccuuucugcac

SEQ ID NO: 1031228 - RNA, 20 nt, Homo sapiens
cacgaauauuaugcccaguu

SEQ ID NO: 1031229 - RNA, 19 nt, Homo sapiens
cacgacugcccggcagggu

SEQ ID NO: 1031230 - RNA, 20 nt, Homo sapiens
cacgagagagggcuuucuca

SEQ ID NO: 1031231 - RNA, 17 nt, Homo sapiens
cacgaucucgacucacu

SEQ ID NO: 1031232 - RNA, 11 nt, Homo sapiens
cacgcacacac

SEQ ID NO: 1031233 - RNA, 12 nt, Homo sapiens
cacgcacgcaca

SEQ ID NO: 1031234 - RNA, 15 nt, Homo sapiens
cacgccugugcagug

SEQ ID NO: 1031235 - RNA, 13 nt, Homo sapiens
cacgcgugcacac

SEQ ID NO: 1031236 - RNA, 16 nt, Homo sapiens
cacgcuggagugcagu

SEQ ID NO: 1031237 - RNA, 16 nt, Homo sapiens
cacggcaaaaugucau

SEQ ID NO: 1031238 - RNA, 17 nt, Homo sapiens
cacggcucucaccagug

SEQ ID NO: 1031239 - RNA, 21 nt, Homo sapiens
cacguaugguggcucaugucu

SEQ ID NO: 1031240 - RNA, 14 nt, Homo sapiens
cacguggugcauuu

SEQ ID NO: 1031241 - RNA, 18 nt, Homo sapiens
cacgugugcacacacacc

SEQ ID NO: 1031242 - RNA, 23 nt, Homo sapiens
cacguuucuaaaggcuaccuuug

SEQ ID NO: 1031243 - RNA, 16 nt, Homo sapiens
cacuaagaagcuugaa

SEQ ID NO: 1031244 - RNA, 17 nt, Homo sapiens
cacuaaggugugcucug

SEQ ID NO: 1031245 - RNA, 23 nt, Homo sapiens
cacuacacaggaggcugaggcag

SEQ ID NO: 1031246 - RNA, 15 nt, Homo sapiens
cacuacgugacugug

SEQ ID NO: 1031247 - RNA, 13 nt, Homo sapiens
cacuagacugugc

SEQ ID NO: 1031248 - RNA, 15 nt, Homo sapiens
cacuagcccaaugaa

SEQ ID NO: 1031249 - RNA, 17 nt, Homo sapiens
cacuagucacauucuug

SEQ ID NO: 1031250 - RNA, 19 nt, Homo sapiens
cacuauaauguaagcucua

SEQ ID NO: 1031251 - RNA, 19 nt, Homo sapiens
cacuauagccuaggugaca

SEQ ID NO: 1031252 - RNA, 12 nt, Homo sapiens
cacuaugcugcu

SEQ ID NO: 1031253 - RNA, 14 nt, Homo sapiens
cacuauuacuggga

SEQ ID NO: 1031254 - RNA, 18 nt, Homo sapiens
cacucaggaauguuugcu

SEQ ID NO: 1031255 - RNA, 21 nt, Homo sapiens
cacucaggccaacaagccaac

SEQ ID NO: 1031256 - RNA, 14 nt, Homo sapiens
cacucaggugaaaa

SEQ ID NO: 1031257 - RNA, 21 nt, Homo sapiens
cacucccuugguggcaagagc

SEQ ID NO: 1031258 - RNA, 19 nt, Homo sapiens
cacucuacccuauacaacu

SEQ ID NO: 1031259 - RNA, 19 nt, Homo sapiens
cacucuagggcaguggagu

SEQ ID NO: 1031260 - RNA, 21 nt, Homo sapiens
cacucuccaaacagucaccau

SEQ ID NO: 1031261 - RNA, 17 nt, Homo sapiens
cacucuggcagcucaga

SEQ ID NO: 1031262 - RNA, 20 nt, Homo sapiens
cacucuuauagaaaguucaa

SEQ ID NO: 1031263 - RNA, 13 nt, Homo sapiens
cacucuuccugag

SEQ ID NO: 1031264 - RNA, 20 nt, Homo sapiens
cacucuucuccccgugcuuu

SEQ ID NO: 1031265 - RNA, 18 nt, Homo sapiens
cacugaaaauucgaacca

SEQ ID NO: 1031266 - RNA, 22 nt, Homo sapiens
cacugaaaugcuagcugcaagu

SEQ ID NO: 1031267 - RNA, 20 nt, Homo sapiens
cacugaauuuuguguguacc

SEQ ID NO: 1031268 - RNA, 19 nt, Homo sapiens
cacugagaagauugugaau

SEQ ID NO: 1031269 - RNA, 21 nt, Homo sapiens
cacugaggaacucacaauucc

SEQ ID NO: 1031270 - RNA, 18 nt, Homo sapiens
cacugcaauccugucuuu

SEQ ID NO: 1031271 - RNA, 13 nt, Homo sapiens
cacugcacuccag

SEQ ID NO: 1031272 - RNA, 12 nt, Homo sapiens
cacugccaaaga

SEQ ID NO: 1031273 - RNA, 18 nt, Homo sapiens
cacugccaugcagggccu

SEQ ID NO: 1031274 - RNA, 23 nt, Homo sapiens
cacugccaugcagggccucacac

SEQ ID NO: 1031275 - RNA, 20 nt, Homo sapiens
cacugccccagacacagugc

SEQ ID NO: 1031276 - RNA, 15 nt, Homo sapiens
cacugccuacugcau

SEQ ID NO: 1031277 - RNA, 13 nt, Homo sapiens
cacugccugaugg

SEQ ID NO: 1031278 - RNA, 20 nt, Homo sapiens
cacugcugcuccagugcagg

SEQ ID NO: 1031279 - RNA, 11 nt, Homo sapiens
cacugcuguag

SEQ ID NO: 1031280 - RNA, 15 nt, Homo sapiens
cacugcuugaggaaa

SEQ ID NO: 1031281 - RNA, 18 nt, Homo sapiens
cacuggaggggucuccuc

SEQ ID NO: 1031282 - RNA, 18 nt, Homo sapiens
cacugggacuugcaaaaa

SEQ ID NO: 1031283 - RNA, 19 nt, Homo sapiens
cacugggagaggugccagc

SEQ ID NO: 1031284 - RNA, 23 nt, Homo sapiens
cacugggaugagccgcugugagc

SEQ ID NO: 1031285 - RNA, 15 nt, Homo sapiens
cacuguacucugcac

SEQ ID NO: 1031286 - RNA, 18 nt, Homo sapiens
cacugugggaaggccagc

SEQ ID NO: 1031287 - RNA, 16 nt, Homo sapiens
cacugugggcuuuuau

SEQ ID NO: 1031288 - RNA, 15 nt, Homo sapiens
cacuguugucaaaaa

SEQ ID NO: 1031289 - RNA, 18 nt, Homo sapiens
cacuuaaaaaauguccau

SEQ ID NO: 1031290 - RNA, 15 nt, Homo sapiens
cacuuacagaauuau

SEQ ID NO: 1031291 - RNA, 16 nt, Homo sapiens
cacuuauugacuauua

SEQ ID NO: 1031292 - RNA, 20 nt, Homo sapiens
cacuucaucuucucagcucc

SEQ ID NO: 1031293 - RNA, 21 nt, Homo sapiens
cacuuccaccagccugcacua

SEQ ID NO: 1031294 - RNA, 15 nt, Homo sapiens
cacuucccucaucuc

SEQ ID NO: 1031295 - RNA, 18 nt, Homo sapiens
cacuuccuuggaaacaga

SEQ ID NO: 1031296 - RNA, 19 nt, Homo sapiens
cacuucgagcacuguccag

SEQ ID NO: 1031297 - RNA, 22 nt, Homo sapiens
cacuucgcgugcccucgcugcu

SEQ ID NO: 1031298 - RNA, 17 nt, Homo sapiens
cacuucgugggaucugc

SEQ ID NO: 1031299 - RNA, 18 nt, Homo sapiens
cacuucuaaaugcauauc

SEQ ID NO: 1031300 - RNA, 21 nt, Homo sapiens
cacuucuuguuccccacugac

SEQ ID NO: 1031301 - RNA, 15 nt, Homo sapiens
cacuugaugugccau

SEQ ID NO: 1031302 - RNA, 14 nt, Homo sapiens
cacuugcagccucc

SEQ ID NO: 1031303 - RNA, 13 nt, Homo sapiens
cacuuggaugcag

SEQ ID NO: 1031304 - RNA, 19 nt, Homo sapiens
cacuugggucuucccugua

SEQ ID NO: 1031305 - RNA, 20 nt, Homo sapiens
cacuuuaccucuguggaccu

SEQ ID NO: 1031306 - RNA, 17 nt, Homo sapiens
cagcagccagcucucag

SEQ ID NO: 1031307 - RNA, 23 nt, Homo sapiens
cagcagcuauuugaaugagauga

SEQ ID NO: 1031308 - RNA, 21 nt, Homo sapiens
cagcagcucaggcacacuucu

SEQ ID NO: 1031309 - RNA, 17 nt, Homo sapiens
cagcagcuucaccagag

SEQ ID NO: 1031310 - RNA, 22 nt, Homo sapiens
cagcagcuucaccagagcauuu

SEQ ID NO: 1031311 - RNA, 22 nt, Homo sapiens
cagcagcuucucuccacugaaa

SEQ ID NO: 1031312 - RNA, 21 nt, Homo sapiens
cagcauaccugcuggugcaga

SEQ ID NO: 1031313 - RNA, 16 nt, Homo sapiens
cagcaucagcucaggg

SEQ ID NO: 1031314 - RNA, 13 nt, Homo sapiens
cagcaucccuuga

SEQ ID NO: 1031315 - RNA, 19 nt, Homo sapiens
cagcaugaaggaugccaua

SEQ ID NO: 1031316 - RNA, 21 nt, Homo sapiens
cagcaugaccugugaccagca

SEQ ID NO: 1031317 - RNA, 15 nt, Homo sapiens
cagccaacuuuugca

SEQ ID NO: 1031318 - RNA, 20 nt, Homo sapiens
cagccaagagggcugcaaaa

SEQ ID NO: 1031319 - RNA, 13 nt, Homo sapiens
cagccaagggaug

SEQ ID NO: 1031320 - RNA, 12 nt, Homo sapiens
cagccacaacca

SEQ ID NO: 1031321 - RNA, 16 nt, Homo sapiens
cagccacaaccaaaaa

SEQ ID NO: 1031322 - RNA, 13 nt, Homo sapiens
cagccagauccuc

SEQ ID NO: 1031323 - RNA, 20 nt, Homo sapiens
cagccagcucauuucacuuu

SEQ ID NO: 1031324 - RNA, 22 nt, Homo sapiens
cagccaggauugaccuuugcac

SEQ ID NO: 1031325 - RNA, 14 nt, Homo sapiens
cagccaggcugcca

SEQ ID NO: 1031326 - RNA, 16 nt, Homo sapiens
cagcccaccccugugc

SEQ ID NO: 1031327 - RNA, 20 nt, Homo sapiens
cagcccaccccugugcccac

SEQ ID NO: 1031328 - RNA, 22 nt, Homo sapiens
cagcccacccuccugucuuccc

SEQ ID NO: 1031329 - RNA, 13 nt, Homo sapiens
cagccccuucuca

SEQ ID NO: 1031330 - RNA, 21 nt, Homo sapiens
cagcccuagagccugccugga

SEQ ID NO: 1031331 - RNA, 12 nt, Homo sapiens
cagcccugugga

SEQ ID NO: 1031332 - RNA, 14 nt, Homo sapiens
cagccgcagcugua

SEQ ID NO: 1031333 - RNA, 13 nt, Homo sapiens
cagccucaaguca

SEQ ID NO: 1031334 - RNA, 13 nt, Homo sapiens
cagccucaagucu

SEQ ID NO: 1031335 - RNA, 16 nt, Homo sapiens
cagccucauugauguc

SEQ ID NO: 1031336 - RNA, 18 nt, Homo sapiens
cagccucccaaguagcug

SEQ ID NO: 1031337 - RNA, 19 nt, Homo sapiens
cagccucccaaguagcugg

SEQ ID NO: 1031338 - RNA, 19 nt, Homo sapiens
cagccucccgaguagcugg

SEQ ID NO: 1031339 - RNA, 20 nt, Homo sapiens
cagccucccucugaccugca

SEQ ID NO: 1031340 - RNA, 20 nt, Homo sapiens
cagccuccugaguagcugga

SEQ ID NO: 1031341 - RNA, 22 nt, Homo sapiens
cagccucugaaaaccaauguuc

SEQ ID NO: 1031342 - RNA, 22 nt, Homo sapiens
cagccucuucuagagccgugau

SEQ ID NO: 1031343 - RNA, 21 nt, Homo sapiens
cagccugaccaacauggugaa

SEQ ID NO: 1031344 - RNA, 19 nt, Homo sapiens
cagccugggcaacagagca

SEQ ID NO: 1031345 - RNA, 22 nt, Homo sapiens
cagccuggggggucguggcaga

SEQ ID NO: 1031346 - RNA, 21 nt, Homo sapiens
cagccuggucaacauggugaa

SEQ ID NO: 1031347 - RNA, 18 nt, Homo sapiens
cagcgaaugaaugcugua

SEQ ID NO: 1031348 - RNA, 17 nt, Homo sapiens
cagcgggacucuucuca

SEQ ID NO: 1031349 - RNA, 15 nt, Homo sapiens
cagcgucccagucuc

SEQ ID NO: 1031350 - RNA, 19 nt, Homo sapiens
cagcuaaggacauuuccca

SEQ ID NO: 1031351 - RNA, 21 nt, Homo sapiens
cagcuaccucuucuauggacu

SEQ ID NO: 1031352 - RNA, 22 nt, Homo sapiens
cagcuacgaauauagaggguuu

SEQ ID NO: 1031353 - RNA, 15 nt, Homo sapiens
cagcuauuugaauga

SEQ ID NO: 1031354 - RNA, 19 nt, Homo sapiens
cagcuauuugaaugagaug

SEQ ID NO: 1031355 - RNA, 20 nt, Homo sapiens
cagcucaaaggcacagugaa

SEQ ID NO: 1031356 - RNA, 14 nt, Homo sapiens
cagcucauuucacu

SEQ ID NO: 1031357 - RNA, 13 nt, Homo sapiens
cagcucccauuuc

SEQ ID NO: 1031358 - RNA, 17 nt, Homo sapiens
cagcuccccaagaaagc

SEQ ID NO: 1031359 - RNA, 16 nt, Homo sapiens
cagcucccuucucugu

SEQ ID NO: 1031360 - RNA, 15 nt, Homo sapiens
cagcuccuucugucc

SEQ ID NO: 1031361 - RNA, 11 nt, Homo sapiens
cagcucugcaa

SEQ ID NO: 1031362 - RNA, 19 nt, Homo sapiens
cagcugaagaacaucucga

SEQ ID NO: 1031363 - RNA, 12 nt, Homo sapiens
uuaagugccuuu

SEQ ID NO: 1031364 - RNA, 22 nt, Homo sapiens
uuaaguuacacauuuuucagau

SEQ ID NO: 1031365 - RNA, 20 nt, Homo sapiens
uuaaguuauugauguuuuaa

SEQ ID NO: 1031366 - RNA, 19 nt, Homo sapiens
uuaaguugauggugaugaa

SEQ ID NO: 1031367 - RNA, 20 nt, Homo sapiens
uuaaguuguugauguuuuaa

SEQ ID NO: 1031368 - RNA, 15 nt, Homo sapiens
uuaaguuuaucuuuc

SEQ ID NO: 1031369 - RNA, 15 nt, Homo sapiens
uuaaguuucucagcu

SEQ ID NO: 1031370 - RNA, 18 nt, Homo sapiens
uuaauaaauuaaaacaug

SEQ ID NO: 1031371 - RNA, 13 nt, Homo sapiens
uuaauacaaagaa

SEQ ID NO: 1031372 - RNA, 22 nt, Homo sapiens
uuaauaccugggugauuacaua

SEQ ID NO: 1031373 - RNA, 14 nt, Homo sapiens
uuaauaguauuuau

SEQ ID NO: 1031374 - RNA, 17 nt, Homo sapiens
uuaauauauacuaugag

SEQ ID NO: 1031375 - RNA, 22 nt, Homo sapiens
uuaauauuuaaacagcaguguu

SEQ ID NO: 1031376 - RNA, 20 nt, Homo sapiens
uuaaucacaggaucccacga

SEQ ID NO: 1031377 - RNA, 14 nt, Homo sapiens
uuaaucaugagaua

SEQ ID NO: 1031378 - RNA, 15 nt, Homo sapiens
uuaaucaugagauaa

SEQ ID NO: 1031379 - RNA, 17 nt, Homo sapiens
uuaaucuuuucacaaau

SEQ ID NO: 1031380 - RNA, 18 nt, Homo sapiens
uuaaugaaauaucuguau

SEQ ID NO: 1031381 - RNA, 17 nt, Homo sapiens
uuaaugcacuuucuauc

SEQ ID NO: 1031382 - RNA, 17 nt, Homo sapiens
uuaaugcuucuuucauu

SEQ ID NO: 1031383 - RNA, 21 nt, Homo sapiens
uuaaugguagcaacugaaaga

SEQ ID NO: 1031384 - RNA, 17 nt, Homo sapiens
uuaaugucuggugcuuu

SEQ ID NO: 1031385 - RNA, 18 nt, Homo sapiens
uuaauuagggguugcuaa

SEQ ID NO: 1031386 - RNA, 19 nt, Homo sapiens
uuaauucucuuucaaagcu

SEQ ID NO: 1031387 - RNA, 13 nt, Homo sapiens
uuaauugugaauu

SEQ ID NO: 1031388 - RNA, 16 nt, Homo sapiens
uuaauuguuaagauau

SEQ ID NO: 1031389 - RNA, 17 nt, Homo sapiens
uuaauuguuaagauaug

SEQ ID NO: 1031390 - RNA, 18 nt, Homo sapiens
uuaauuguuuugcacuuu

SEQ ID NO: 1031391 - RNA, 18 nt, Homo sapiens
uuaauuugauaguauugu

SEQ ID NO: 1031392 - RNA, 17 nt, Homo sapiens
uuacaaaccucaagcca

SEQ ID NO: 1031393 - RNA, 19 nt, Homo sapiens
uuacaaucagccacauucu

SEQ ID NO: 1031394 - RNA, 13 nt, Homo sapiens
uuacacaaaacaa

SEQ ID NO: 1031395 - RNA, 17 nt, Homo sapiens
uuacacaaauuugccug

SEQ ID NO: 1031396 - RNA, 19 nt, Homo sapiens
uuacacaguugcugucaua

SEQ ID NO: 1031397 - RNA, 13 nt, Homo sapiens
uuacacaucucag

SEQ ID NO: 1031398 - RNA, 12 nt, Homo sapiens
uuacagaauuau

SEQ ID NO: 1031399 - RNA, 18 nt, Homo sapiens
uuacagagaaaagacaua

SEQ ID NO: 1031400 - RNA, 21 nt, Homo sapiens
uuacagagaggagaaacacau

SEQ ID NO: 1031401 - RNA, 18 nt, Homo sapiens
uuacagggagcugggaca

SEQ ID NO: 1031402 - RNA, 18 nt, Homo sapiens
uuacauagguauauauau

SEQ ID NO: 1031403 - RNA, 22 nt, Homo sapiens
uuacauguaguaguacuugaaa

SEQ ID NO: 1031404 - RNA, 22 nt, Homo sapiens
uuacauuuccaaaugaaugacc

SEQ ID NO: 1031405 - RNA, 20 nt, Homo sapiens
uuaccaaggaugaaagagga

SEQ ID NO: 1031406 - RNA, 21 nt, Homo sapiens
uuaccagacgguucaccagcc

SEQ ID NO: 1031407 - RNA, 16 nt, Homo sapiens
uuacccaguauuccau

SEQ ID NO: 1031408 - RNA, 15 nt, Homo sapiens
uuaccuaccacaugc

SEQ ID NO: 1031409 - RNA, 14 nt, Homo sapiens
uuaccuccuaucag

SEQ ID NO: 1031410 - RNA, 23 nt, Homo sapiens
uuaccucuuuaaaaacaaaacaa

SEQ ID NO: 1031411 - RNA, 22 nt, Homo sapiens
uuaccugggcauucuuguuuca

SEQ ID NO: 1031412 - RNA, 16 nt, Homo sapiens
uuaccuugugcuaauc

SEQ ID NO: 1031413 - RNA, 21 nt, Homo sapiens
uuacuaagcuuugccagcugc

SEQ ID NO: 1031414 - RNA, 15 nt, Homo sapiens
uuacuaauugucuac

SEQ ID NO: 1031415 - RNA, 14 nt, Homo sapiens
uuacuaucauguca

SEQ ID NO: 1031416 - RNA, 19 nt, Homo sapiens
uuacuaugacugcucccca

SEQ ID NO: 1031417 - RNA, 12 nt, Homo sapiens
uuacuccagugg

SEQ ID NO: 1031418 - RNA, 21 nt, Homo sapiens
uuacugaaagaaaaagaccua

SEQ ID NO: 1031419 - RNA, 23 nt, Homo sapiens
uuacugaacaaucaaagcacuug

SEQ ID NO: 1031420 - RNA, 14 nt, Homo sapiens
uuacugaccagcaa

SEQ ID NO: 1031421 - RNA, 16 nt, Homo sapiens
uuacuguauauaacua

SEQ ID NO: 1031422 - RNA, 13 nt, Homo sapiens
uuacuguggcuuc

SEQ ID NO: 1031423 - RNA, 15 nt, Homo sapiens
uuacuguuucuguca

SEQ ID NO: 1031424 - RNA, 16 nt, Homo sapiens
uuacuugcauugaaua

SEQ ID NO: 1031425 - RNA, 23 nt, Homo sapiens
uuacuuuuuccuggcucaucucu

SEQ ID NO: 1031426 - RNA, 18 nt, Homo sapiens
uuagaaacagcuucucaa

SEQ ID NO: 1031427 - RNA, 14 nt, Homo sapiens
uuagaagucacaca

SEQ ID NO: 1031428 - RNA, 16 nt, Homo sapiens
uuagaagucacacagu

SEQ ID NO: 1031429 - RNA, 23 nt, Homo sapiens
uuagaauauccaugaccuaguuu

SEQ ID NO: 1031430 - RNA, 20 nt, Homo sapiens
uuagacacguguuguuccac

SEQ ID NO: 1031431 - RNA, 13 nt, Homo sapiens
uuagacauaacaa

SEQ ID NO: 1031432 - RNA, 21 nt, Homo sapiens
uuagacccgcccuccccuuuu

SEQ ID NO: 1031433 - RNA, 14 nt, Homo sapiens
uuagacuacauuua

SEQ ID NO: 1031434 - RNA, 18 nt, Homo sapiens
uuagacucaucuuacugu

SEQ ID NO: 1031435 - RNA, 21 nt, Homo sapiens
uuagacuuaauagaaacauug

SEQ ID NO: 1031436 - RNA, 17 nt, Homo sapiens
uuagagaaugauuucaa

SEQ ID NO: 1031437 - RNA, 15 nt, Homo sapiens
uuagcauuuugcuaa

SEQ ID NO: 1031438 - RNA, 14 nt, Homo sapiens
uuagccauuugacu

SEQ ID NO: 1031439 - RNA, 9 nt, Homo sapiens
uuagcucau

SEQ ID NO: 1031440 - RNA, 19 nt, Homo sapiens
uuaggacuuuuauugugaa

SEQ ID NO: 1031441 - RNA, 17 nt, Homo sapiens
uuagggaaaacauucca

SEQ ID NO: 1031442 - RNA, 18 nt, Homo sapiens
uuagggaugacugugauu

SEQ ID NO: 1031443 - RNA, 21 nt, Homo sapiens
uuaggucagcagccucccuga

SEQ ID NO: 1031444 - RNA, 17 nt, Homo sapiens
uuaguccaauuccuugc

SEQ ID NO: 1031445 - RNA, 19 nt, Homo sapiens
uuagugguuacccaguuag

SEQ ID NO: 1031446 - RNA, 20 nt, Homo sapiens
uuaguuuacaaucagccaca

SEQ ID NO: 1031447 - RNA, 24 nt, Homo sapiens
uuauaaaagaugcauuaucuauga

SEQ ID NO: 1031448 - RNA, 17 nt, Homo sapiens
uuauaaaaucaaacaga

SEQ ID NO: 1031449 - RNA, 23 nt, Homo sapiens
uuauaaagggagauaacaaucug

SEQ ID NO: 1031450 - RNA, 18 nt, Homo sapiens
uuccaaguucucaccucu

SEQ ID NO: 1031451 - RNA, 20 nt, Homo sapiens
uuccaauuuacauacucugc

SEQ ID NO: 1031452 - RNA, 21 nt, Homo sapiens
uuccacacccucacugcugua

SEQ ID NO: 1031453 - RNA, 20 nt, Homo sapiens
uuccacaccuagcaucucau

SEQ ID NO: 1031454 - RNA, 20 nt, Homo sapiens
uuccacuggaaaaguguaau

SEQ ID NO: 1031455 - RNA, 14 nt, Homo sapiens
uuccagaagaucug

SEQ ID NO: 1031456 - RNA, 12 nt, Homo sapiens
uuccagauagca

SEQ ID NO: 1031457 - RNA, 18 nt, Homo sapiens
uuccaggcgaugugcaag

SEQ ID NO: 1031458 - RNA, 23 nt, Homo sapiens
uuccauaugugggugucagucag

SEQ ID NO: 1031459 - RNA, 14 nt, Homo sapiens
uuccaugaaguuug

SEQ ID NO: 1031460 - RNA, 22 nt, Homo sapiens
uuccaugagaacagcaggguag

SEQ ID NO: 1031461 - RNA, 15 nt, Homo sapiens
uuccauggacuuugu

SEQ ID NO: 1031462 - RNA, 23 nt, Homo sapiens
uuccaugucgccucugcauucag

SEQ ID NO: 1031463 - RNA, 13 nt, Homo sapiens
uuccauugauuca

SEQ ID NO: 1031464 - RNA, 17 nt, Homo sapiens
uuccauuguuuggagac

SEQ ID NO: 1031465 - RNA, 23 nt, Homo sapiens
uuccauuuuuauuucaaaauaua

SEQ ID NO: 1031466 - RNA, 22 nt, Homo sapiens
uucccaaaagcccauucauucc

SEQ ID NO: 1031467 - RNA, 16 nt, Homo sapiens
uucccaaacuugacag

SEQ ID NO: 1031468 - RNA, 23 nt, Homo sapiens
uucccaauuaggaaguguaacag

SEQ ID NO: 1031469 - RNA, 20 nt, Homo sapiens
uucccaccugcuggagugaa

SEQ ID NO: 1031470 - RNA, 18 nt, Homo sapiens
uucccacucuagggcagu

SEQ ID NO: 1031471 - RNA, 15 nt, Homo sapiens
uucccaggaguacac

SEQ ID NO: 1031472 - RNA, 21 nt, Homo sapiens
uucccaggccagcaagcucuu

SEQ ID NO: 1031473 - RNA, 14 nt, Homo sapiens
uucccauucuugca

SEQ ID NO: 1031474 - RNA, 20 nt, Homo sapiens
uucccauuguggcuccuauc

SEQ ID NO: 1031475 - RNA, 15 nt, Homo sapiens
uuccccacugcacac

SEQ ID NO: 1031476 - RNA, 16 nt, Homo sapiens
uuccccuuccacugag

SEQ ID NO: 1031477 - RNA, 21 nt, Homo sapiens
uucccuaucucgaacauggaa

SEQ ID NO: 1031478 - RNA, 20 nt, Homo sapiens
uucccuauuuugccaguggg

SEQ ID NO: 1031479 - RNA, 22 nt, Homo sapiens
uucccucaugcuguuccaccuc

SEQ ID NO: 1031480 - RNA, 13 nt, Homo sapiens
uucccucccuauc

SEQ ID NO: 1031481 - RNA, 16 nt, Homo sapiens
uucccucccuaucuaa

SEQ ID NO: 1031482 - RNA, 19 nt, Homo sapiens
uucccucucaugacuugca

SEQ ID NO: 1031483 - RNA, 22 nt, Homo sapiens
uucccuguagugaccuguaaaa

SEQ ID NO: 1031484 - RNA, 22 nt, Homo sapiens
uucccuguguauucuagugaau

SEQ ID NO: 1031485 - RNA, 22 nt, Homo sapiens
uucccuucaucuggaaccauca

SEQ ID NO: 1031486 - RNA, 14 nt, Homo sapiens
uucccuugcuggaa

SEQ ID NO: 1031487 - RNA, 21 nt, Homo sapiens
uucccuuuuuuggcugcugaa

SEQ ID NO: 1031488 - RNA, 13 nt, Homo sapiens
uuccgacaccucu

SEQ ID NO: 1031489 - RNA, 21 nt, Homo sapiens
uuccgaggccccugucucagg

SEQ ID NO: 1031490 - RNA, 16 nt, Homo sapiens
uuccuaaaauggugau

SEQ ID NO: 1031491 - RNA, 16 nt, Homo sapiens
uuccuacagauaguca

SEQ ID NO: 1031492 - RNA, 22 nt, Homo sapiens
uuccuacccacaccucugccag

SEQ ID NO: 1031493 - RNA, 16 nt, Homo sapiens
uuccucagaucaucca

SEQ ID NO: 1031494 - RNA, 13 nt, Homo sapiens
uuccucaugugau

SEQ ID NO: 1031495 - RNA, 22 nt, Homo sapiens
uuccucuaugaaaauuauaucu

SEQ ID NO: 1031496 - RNA, 14 nt, Homo sapiens
uuccucugaacaaa

SEQ ID NO: 1031497 - RNA, 14 nt, Homo sapiens
uuccugcacauuaa

SEQ ID NO: 1031498 - RNA, 12 nt, Homo sapiens
uuccugcccuac

SEQ ID NO: 1031499 - RNA, 22 nt, Homo sapiens
uuccugccugcggaccagauga

SEQ ID NO: 1031500 - RNA, 15 nt, Homo sapiens
uuccuggacaguuuu

SEQ ID NO: 1031501 - RNA, 15 nt, Homo sapiens
uuccuggcaauagug

SEQ ID NO: 1031502 - RNA, 22 nt, Homo sapiens
uuccuggcacugcuuccaguga

SEQ ID NO: 1031503 - RNA, 22 nt, Homo sapiens
uuccuguaacacaagccacaga

SEQ ID NO: 1031504 - RNA, 15 nt, Homo sapiens
uuccuguccagagag

SEQ ID NO: 1031505 - RNA, 16 nt, Homo sapiens
uuccuuaaacugugug

SEQ ID NO: 1031506 - RNA, 13 nt, Homo sapiens
uuccuuagucuca

SEQ ID NO: 1031507 - RNA, 15 nt, Homo sapiens
uuccuuagucucaag

SEQ ID NO: 1031508 - RNA, 16 nt, Homo sapiens
uuccuuaucacugaca

SEQ ID NO: 1031509 - RNA, 20 nt, Homo sapiens
uuccuucagacagauuccag

SEQ ID NO: 1031510 - RNA, 16 nt, Homo sapiens
uuccuugggaugaucu

SEQ ID NO: 1031511 - RNA, 15 nt, Homo sapiens
uuccuuguccccaca

SEQ ID NO: 1031512 - RNA, 17 nt, Homo sapiens
uuccuuugaacuuugaa

SEQ ID NO: 1031513 - RNA, 13 nt, Homo sapiens
uuccuuuggguua

SEQ ID NO: 1031514 - RNA, 20 nt, Homo sapiens
uucgacuugcauuuuugcag

SEQ ID NO: 1031515 - RNA, 19 nt, Homo sapiens
uucgagaccagccugacca

SEQ ID NO: 1031516 - RNA, 20 nt, Homo sapiens
uucgcgugcccucgcugcuu

SEQ ID NO: 1031517 - RNA, 15 nt, Homo sapiens
uucgugacaacaugc

SEQ ID NO: 1031518 - RNA, 23 nt, Homo sapiens
uucuaaagauggaaaaaccaccc

SEQ ID NO: 1031519 - RNA, 21 nt, Homo sapiens
cagugagccaagaucacgcca

SEQ ID NO: 1031520 - RNA, 21 nt, Homo sapiens
cagugaugcuggaugcuccuu

SEQ ID NO: 1031521 - RNA, 15 nt, Homo sapiens
cagugcaaagauuug

SEQ ID NO: 1031522 - RNA, 21 nt, Homo sapiens
cagugcaacacugaagcucuu

SEQ ID NO: 1031523 - RNA, 17 nt, Homo sapiens
cagugcaggcacaguau

SEQ ID NO: 1031524 - RNA, 15 nt, Homo sapiens
cagugccaagcacag

SEQ ID NO: 1031525 - RNA, 22 nt, Homo sapiens
cagugccuacccaccugugagg

SEQ ID NO: 1031526 - RNA, 16 nt, Homo sapiens
cagugcggcagguuca

SEQ ID NO: 1031527 - RNA, 17 nt, Homo sapiens
cagugcuauuuugugcc

SEQ ID NO: 1031528 - RNA, 12 nt, Homo sapiens
cagugcugccag

SEQ ID NO: 1031529 - RNA, 20 nt, Homo sapiens
cagugcuugcaagauuccaa

SEQ ID NO: 1031530 - RNA, 15 nt, Homo sapiens
caguggcacgaucuc

SEQ ID NO: 1031531 - RNA, 16 nt, Homo sapiens
caguggcgugaucucg

SEQ ID NO: 1031532 - RNA, 14 nt, Homo sapiens
caguggcuaccuac

SEQ ID NO: 1031533 - RNA, 16 nt, Homo sapiens
cagugguauccuguga

SEQ ID NO: 1031534 - RNA, 15 nt, Homo sapiens
caguggugugaucuu

SEQ ID NO: 1031535 - RNA, 13 nt, Homo sapiens
caguguacagucu

SEQ ID NO: 1031536 - RNA, 12 nt, Homo sapiens
cagugucauuua

SEQ ID NO: 1031537 - RNA, 21 nt, Homo sapiens
caguguccccuccacugucac

SEQ ID NO: 1031538 - RNA, 16 nt, Homo sapiens
cagugucuuccauaau

SEQ ID NO: 1031539 - RNA, 13 nt, Homo sapiens
cagugugaaguua

SEQ ID NO: 1031540 - RNA, 12 nt, Homo sapiens
cagugugacaag

SEQ ID NO: 1031541 - RNA, 15 nt, Homo sapiens
cagugugacuccuca

SEQ ID NO: 1031542 - RNA, 12 nt, Homo sapiens
caguguguuucu

SEQ ID NO: 1031543 - RNA, 19 nt, Homo sapiens
caguguuauuaguguaugc

SEQ ID NO: 1031544 - RNA, 18 nt, Homo sapiens
caguguuccccaucuggg

SEQ ID NO: 1031545 - RNA, 17 nt, Homo sapiens
caguuaaugccacaaaa

SEQ ID NO: 1031546 - RNA, 22 nt, Homo sapiens
caguuacagagugaacacucua

SEQ ID NO: 1031547 - RNA, 19 nt, Homo sapiens
caguuaugcagaauccaaa

SEQ ID NO: 1031548 - RNA, 20 nt, Homo sapiens
caguuauuuuuaaacuguaa

SEQ ID NO: 1031549 - RNA, 16 nt, Homo sapiens
caguucaacucaugga

SEQ ID NO: 1031550 - RNA, 16 nt, Homo sapiens
caguucagaaucacuu

SEQ ID NO: 1031551 - RNA, 21 nt, Homo sapiens
caguucaggagucccaaggaa

SEQ ID NO: 1031552 - RNA, 17 nt, Homo sapiens
caguucagguaugugug

SEQ ID NO: 1031553 - RNA, 18 nt, Homo sapiens
caguucccccaaccucag

SEQ ID NO: 1031554 - RNA, 16 nt, Homo sapiens
caguucuaguuugcau

SEQ ID NO: 1031555 - RNA, 14 nt, Homo sapiens
caguugacagcagg

SEQ ID NO: 1031556 - RNA, 22 nt, Homo sapiens
caguuggauuuauucugccaaa

SEQ ID NO: 1031557 - RNA, 20 nt, Homo sapiens
caguuuaaccugaugcaguc

SEQ ID NO: 1031558 - RNA, 19 nt, Homo sapiens
caguuucuuagcuuuuuaa

SEQ ID NO: 1031559 - RNA, 15 nt, Homo sapiens
caguuugacuguggc

SEQ ID NO: 1031560 - RNA, 23 nt, Homo sapiens
caguuuuauauuuauaagccuua

SEQ ID NO: 1031561 - RNA, 16 nt, Homo sapiens
caguuuucuugcagau

SEQ ID NO: 1031562 - RNA, 17 nt, Homo sapiens
cauaaaaagacaacuca

SEQ ID NO: 1031563 - RNA, 23 nt, Homo sapiens
cauaaacacccaugaaucaaaga

SEQ ID NO: 1031564 - RNA, 17 nt, Homo sapiens
cauaaacugugugcaga

SEQ ID NO: 1031565 - RNA, 23 nt, Homo sapiens
cauaaagaauuuuguauuuucau

SEQ ID NO: 1031566 - RNA, 15 nt, Homo sapiens
cauaaagucagugcc

SEQ ID NO: 1031567 - RNA, 21 nt, Homo sapiens
cauaaagucuuugaagugacu

SEQ ID NO: 1031568 - RNA, 19 nt, Homo sapiens
cauaaaugaagcagcuuua

SEQ ID NO: 1031569 - RNA, 13 nt, Homo sapiens
cauaaauuacuuu

SEQ ID NO: 1031570 - RNA, 22 nt, Homo sapiens
cauaaauuacuuuuucauucuu

SEQ ID NO: 1031571 - RNA, 22 nt, Homo sapiens
cauaaauuagaggucuccaaaa

SEQ ID NO: 1031572 - RNA, 23 nt, Homo sapiens
cauaaauuuaugguucucaggcc

SEQ ID NO: 1031573 - RNA, 20 nt, Homo sapiens
cauaacugaaaaugugcuau

SEQ ID NO: 1031574 - RNA, 14 nt, Homo sapiens
cauaacuguucuca

SEQ ID NO: 1031575 - RNA, 21 nt, Homo sapiens
cauaagccuaccaauguagac

SEQ ID NO: 1031576 - RNA, 17 nt, Homo sapiens
cauaagcgaucacuucc

SEQ ID NO: 1031577 - RNA, 17 nt, Homo sapiens
cauaauaagcuaaagag

SEQ ID NO: 1031578 - RNA, 15 nt, Homo sapiens
cauaaucuguacaau

SEQ ID NO: 1031579 - RNA, 24 nt, Homo sapiens
cauaaugugcaaagucaucaaaga

SEQ ID NO: 1031580 - RNA, 18 nt, Homo sapiens
cauaauguuacauuauua

SEQ ID NO: 1031581 - RNA, 16 nt, Homo sapiens
cauaauuacuauguca

SEQ ID NO: 1031582 - RNA, 19 nt, Homo sapiens
cauaauuuagaguguaugu

SEQ ID NO: 1031583 - RNA, 19 nt, Homo sapiens
cauaauuuguacauaugua

SEQ ID NO: 1031584 - RNA, 13 nt, Homo sapiens
cauacaauuccaa

SEQ ID NO: 1031585 - RNA, 13 nt, Homo sapiens
cauacacacuguu

SEQ ID NO: 1031586 - RNA, 21 nt, Homo sapiens
cauacacacuguugucaaaaa

SEQ ID NO: 1031587 - RNA, 21 nt, Homo sapiens
cauacaugacucagcauaccu

SEQ ID NO: 1031588 - RNA, 19 nt, Homo sapiens
cauaccacccaaugcugau

SEQ ID NO: 1031589 - RNA, 22 nt, Homo sapiens
cauaccuggcccugugccuugg

SEQ ID NO: 1031590 - RNA, 16 nt, Homo sapiens
cauacuacacauucaa

SEQ ID NO: 1031591 - RNA, 16 nt, Homo sapiens
cauacuccuuccauca

SEQ ID NO: 1031592 - RNA, 13 nt, Homo sapiens
cauagagacuuug

SEQ ID NO: 1031593 - RNA, 23 nt, Homo sapiens
cauagagaucuauguacuguaau

SEQ ID NO: 1031594 - RNA, 20 nt, Homo sapiens
gcaugagagaauuguaucau

SEQ ID NO: 1031595 - RNA, 17 nt, Homo sapiens
gcaugccuggucuuucc

SEQ ID NO: 1031596 - RNA, 13 nt, Homo sapiens
gcaugggcacucc

SEQ ID NO: 1031597 - RNA, 14 nt, Homo sapiens
gcauggggugggcc

SEQ ID NO: 1031598 - RNA, 18 nt, Homo sapiens
gcaugucgugaccaacua

SEQ ID NO: 1031599 - RNA, 21 nt, Homo sapiens
gcaugugaagaaaggguguuu

SEQ ID NO: 1031600 - RNA, 17 nt, Homo sapiens
gcaugugcagcuauuua

SEQ ID NO: 1031601 - RNA, 16 nt, Homo sapiens
gcauguguauuuccag

SEQ ID NO: 1031602 - RNA, 22 nt, Homo sapiens
gcauuaucuaugauaugcuaau

SEQ ID NO: 1031603 - RNA, 15 nt, Homo sapiens
gcauucauaacagaa

SEQ ID NO: 1031604 - RNA, 22 nt, Homo sapiens
gcauugaauauauuauaaucuu

SEQ ID NO: 1031605 - RNA, 14 nt, Homo sapiens
gcauugcauggaca

SEQ ID NO: 1031606 - RNA, 14 nt, Homo sapiens
gcauugcuuuccac

SEQ ID NO: 1031607 - RNA, 17 nt, Homo sapiens
gcauuguaacuuaugaa

SEQ ID NO: 1031608 - RNA, 15 nt, Homo sapiens
gcauuuacucucuua

SEQ ID NO: 1031609 - RNA, 14 nt, Homo sapiens
gcauuuaggagaua

SEQ ID NO: 1031610 - RNA, 16 nt, Homo sapiens
gcauuugcagugcauc

SEQ ID NO: 1031611 - RNA, 22 nt, Homo sapiens
gcauuuuguuuguuucuucacu

SEQ ID NO: 1031612 - RNA, 14 nt, Homo sapiens
gccaaaagcugcuc

SEQ ID NO: 1031613 - RNA, 13 nt, Homo sapiens
gccaaaauuauua

SEQ ID NO: 1031614 - RNA, 17 nt, Homo sapiens
gccaaacccaugaggca

SEQ ID NO: 1031615 - RNA, 21 nt, Homo sapiens
gccaaaccuguguaggcauuu

SEQ ID NO: 1031616 - RNA, 15 nt, Homo sapiens
gccaaacucugccag

SEQ ID NO: 1031617 - RNA, 17 nt, Homo sapiens
gccaacugcugcuuuuu

SEQ ID NO: 1031618 - RNA, 15 nt, Homo sapiens
gccaacuuguaaaua

SEQ ID NO: 1031619 - RNA, 20 nt, Homo sapiens
gccaaggagggugagugcaa

SEQ ID NO: 1031620 - RNA, 21 nt, Homo sapiens
gccaaggcuggagugcagugg

SEQ ID NO: 1031621 - RNA, 18 nt, Homo sapiens
gccaauaacacacagcua

SEQ ID NO: 1031622 - RNA, 19 nt, Homo sapiens
gccaaugccccacuggcag

SEQ ID NO: 1031623 - RNA, 20 nt, Homo sapiens
gccacaaaacugacaguaaa

SEQ ID NO: 1031624 - RNA, 11 nt, Homo sapiens
gccacaaccaa

SEQ ID NO: 1031625 - RNA, 14 nt, Homo sapiens
gccacaacccuguu

SEQ ID NO: 1031626 - RNA, 12 nt, Homo sapiens
gccacacucugg

SEQ ID NO: 1031627 - RNA, 21 nt, Homo sapiens
gccacagaccuaggauuucau

SEQ ID NO: 1031628 - RNA, 21 nt, Homo sapiens
gccacagcuggugguaucuga

SEQ ID NO: 1031629 - RNA, 11 nt, Homo sapiens
gccacauggga

SEQ ID NO: 1031630 - RNA, 18 nt, Homo sapiens
gccacauggggcugggca

SEQ ID NO: 1031631 - RNA, 13 nt, Homo sapiens
gccaccaaaagaa

SEQ ID NO: 1031632 - RNA, 14 nt, Homo sapiens
gccaccacauuuag

SEQ ID NO: 1031633 - RNA, 22 nt, Homo sapiens
gccaccacauuuagaacuuugg

SEQ ID NO: 1031634 - RNA, 15 nt, Homo sapiens
gccaccaucuuugca

SEQ ID NO: 1031635 - RNA, 15 nt, Homo sapiens
gccaccccuccuucc

SEQ ID NO: 1031636 - RNA, 23 nt, Homo sapiens
gccaccucucuccuuugcugagg

SEQ ID NO: 1031637 - RNA, 21 nt, Homo sapiens
gccacguauguuuuuguguau

SEQ ID NO: 1031638 - RNA, 13 nt, Homo sapiens
gccacgugcucuc

SEQ ID NO: 1031639 - RNA, 14 nt, Homo sapiens
gccacucacacagc

SEQ ID NO: 1031640 - RNA, 19 nt, Homo sapiens
gccacucagagcucccuca

SEQ ID NO: 1031641 - RNA, 23 nt, Homo sapiens
gccacugagaagugcacuuuaag

SEQ ID NO: 1031642 - RNA, 13 nt, Homo sapiens
gccacugcacucc

SEQ ID NO: 1031643 - RNA, 22 nt, Homo sapiens
gccagaaagcauaaaauucuua

SEQ ID NO: 1031644 - RNA, 15 nt, Homo sapiens
gccagagaagugaca

SEQ ID NO: 1031645 - RNA, 17 nt, Homo sapiens
gccagauggggccucug

SEQ ID NO: 1031646 - RNA, 18 nt, Homo sapiens
gccagcaaugacaucuca

SEQ ID NO: 1031647 - RNA, 19 nt, Homo sapiens
gccagcagucuaccugcuc

SEQ ID NO: 1031648 - RNA, 17 nt, Homo sapiens
gccagccagugaccuga

SEQ ID NO: 1031649 - RNA, 21 nt, Homo sapiens
gccagccugucccauggacac

SEQ ID NO: 1031650 - RNA, 19 nt, Homo sapiens
gccagcuuaucucaggggu

SEQ ID NO: 1031651 - RNA, 19 nt, Homo sapiens
gccaggagcuucucugaug

SEQ ID NO: 1031652 - RNA, 17 nt, Homo sapiens
gccaggauuaaaagcca

SEQ ID NO: 1031653 - RNA, 20 nt, Homo sapiens
gccaggauuaaaagccauga

SEQ ID NO: 1031654 - RNA, 15 nt, Homo sapiens
gccaggcagauccca

SEQ ID NO: 1031655 - RNA, 21 nt, Homo sapiens
gccaggcagaucccacuugca

SEQ ID NO: 1031656 - RNA, 14 nt, Homo sapiens
gccaggcuccuucc

SEQ ID NO: 1031657 - RNA, 20 nt, Homo sapiens
gccaggcugccaaggccaga

SEQ ID NO: 1031658 - RNA, 15 nt, Homo sapiens
gccagguccuugccc

SEQ ID NO: 1031659 - RNA, 13 nt, Homo sapiens
gccaggugcagug

SEQ ID NO: 1031660 - RNA, 22 nt, Homo sapiens
gccaguaccuccugccccaugc

SEQ ID NO: 1031661 - RNA, 23 nt, Homo sapiens
gccagucuuuacagcugagcaca

SEQ ID NO: 1031662 - RNA, 17 nt, Homo sapiens
gccagugacuccaggag

SEQ ID NO: 1031663 - RNA, 21 nt, Homo sapiens
gccaguuggucccccuuccau

SEQ ID NO: 1031664 - RNA, 14 nt, Homo sapiens
gccauacuuuacaa

SEQ ID NO: 1031665 - RNA, 19 nt, Homo sapiens
gccauaggguccugaaugu

SEQ ID NO: 1031666 - RNA, 14 nt, Homo sapiens
gccauauauauuuc

SEQ ID NO: 1031667 - RNA, 18 nt, Homo sapiens
gccauccucaaacacugc

SEQ ID NO: 1031668 - RNA, 20 nt, Homo sapiens
gccaucgccgggacuccaga

SEQ ID NO: 1031669 - RNA, 17 nt, Homo sapiens
gccaucuugaucugugu

SEQ ID NO: 1031670 - RNA, 22 nt, Homo sapiens
gccaugauaacugcaauuuuaa

SEQ ID NO: 1031671 - RNA, 19 nt, Homo sapiens
gccaugauggugcugaccu

SEQ ID NO: 1031672 - RNA, 14 nt, Homo sapiens
gccauucacugccc

SEQ ID NO: 1031673 - RNA, 12 nt, Homo sapiens
gccauugcacuc

SEQ ID NO: 1031674 - RNA, 15 nt, Homo sapiens
gccauuuuugugcuu

SEQ ID NO: 1031675 - RNA, 13 nt, Homo sapiens
gcccaaagugcuu

SEQ ID NO: 1031676 - RNA, 18 nt, Homo sapiens
gcccaauauaaaaggcaa

SEQ ID NO: 1031677 - RNA, 15 nt, Homo sapiens
gcccacagcaggugc

SEQ ID NO: 1031678 - RNA, 18 nt, Homo sapiens
gcccacagcaggugcuga

SEQ ID NO: 1031679 - RNA, 21 nt, Homo sapiens
gcccacgccuguaaucccagc

SEQ ID NO: 1031680 - RNA, 19 nt, Homo sapiens
gcccacuguuaauauucua

SEQ ID NO: 1031681 - RNA, 22 nt, Homo sapiens
gcccacuucaccguacuaacca

SEQ ID NO: 1031682 - RNA, 20 nt, Homo sapiens
gcccagaacuggacucagga

SEQ ID NO: 1031683 - RNA, 20 nt, Homo sapiens
gcccaggauggcuuugaaug

SEQ ID NO: 1031684 - RNA, 18 nt, Homo sapiens
gcccagggagaggccaug

SEQ ID NO: 1031685 - RNA, 20 nt, Homo sapiens
gcccagggccacucugccuc

SEQ ID NO: 1031686 - RNA, 23 nt, Homo sapiens
gcccaggguucccccagcccugu

SEQ ID NO: 1031687 - RNA, 17 nt, Homo sapiens
gcccagucgauaucuca

SEQ ID NO: 1031688 - RNA, 18 nt, Homo sapiens
gcccaguuggguggaugc

SEQ ID NO: 1031689 - RNA, 14 nt, Homo sapiens
gcccauccagucuc

SEQ ID NO: 1031690 - RNA, 19 nt, Homo sapiens
gcccaugcccaccugccca

SEQ ID NO: 1031691 - RNA, 13 nt, Homo sapiens
gccccaauucgau

SEQ ID NO: 1031692 - RNA, 15 nt, Homo sapiens
gccccaauucgaucc

SEQ ID NO: 1031693 - RNA, 18 nt, Homo sapiens
gccccagaaggcagggaa

SEQ ID NO: 1031694 - RNA, 11 nt, Homo sapiens
gccccagagac

SEQ ID NO: 1031695 - RNA, 21 nt, Homo sapiens
gccccagccuucuuugcuugc

SEQ ID NO: 1031696 - RNA, 15 nt, Homo sapiens
gccccaggaagccgu

SEQ ID NO: 1031697 - RNA, 16 nt, Homo sapiens
gccccaggcauugcca

SEQ ID NO: 1031698 - RNA, 19 nt, Homo sapiens
gccccaggcauugccaagg

SEQ ID NO: 1031699 - RNA, 22 nt, Homo sapiens
gccccagugccaagcacagugc

SEQ ID NO: 1031700 - RNA, 21 nt, Homo sapiens
gcccccagaggcucagcacuu

SEQ ID NO: 1031701 - RNA, 16 nt, Homo sapiens
gcccccccuuccacuu

SEQ ID NO: 1031702 - RNA, 14 nt, Homo sapiens
gccccccuccuugc

SEQ ID NO: 1031703 - RNA, 21 nt, Homo sapiens
gccccccuccuugcucugcag

SEQ ID NO: 1031704 - RNA, 15 nt, Homo sapiens
gcccccuccugcaag

SEQ ID NO: 1031705 - RNA, 19 nt, Homo sapiens
gcccccuccuugucugugc

SEQ ID NO: 1031706 - RNA, 13 nt, Homo sapiens
gcccccucuacca

SEQ ID NO: 1031707 - RNA, 22 nt, Homo sapiens
gccccucccagaacacacucca

SEQ ID NO: 1031708 - RNA, 17 nt, Homo sapiens
gccccugauccugugaa

SEQ ID NO: 1031709 - RNA, 13 nt, Homo sapiens
gccccugcacucc

SEQ ID NO: 1031710 - RNA, 15 nt, Homo sapiens
gccccugccuggacu

SEQ ID NO: 1031711 - RNA, 17 nt, Homo sapiens
gccccugcuccagaaga

SEQ ID NO: 1031712 - RNA, 20 nt, Homo sapiens
gccccuguauggcacuggca

SEQ ID NO: 1031713 - RNA, 21 nt, Homo sapiens
gcccgcucugcagacugcugc

SEQ ID NO: 1031714 - RNA, 20 nt, Homo sapiens
gcccgucauguuccucaaaa

SEQ ID NO: 1031715 - RNA, 21 nt, Homo sapiens
gcccgucauguuccucaaaag

SEQ ID NO: 1031716 - RNA, 16 nt, Homo sapiens
gcccuacucaccugag

SEQ ID NO: 1031717 - RNA, 19 nt, Homo sapiens
gcccucagauuccgcacca

SEQ ID NO: 1031718 - RNA, 20 nt, Homo sapiens
gcccucagccccacuucuca

SEQ ID NO: 1031719 - RNA, 16 nt, Homo sapiens
gcccucaggcaccugc

SEQ ID NO: 1031720 - RNA, 19 nt, Homo sapiens
gcccucaggggacuugaau

SEQ ID NO: 1031721 - RNA, 16 nt, Homo sapiens
gcccugacaugcacac

SEQ ID NO: 1031722 - RNA, 16 nt, Homo sapiens
gcccuggcugacccca

SEQ ID NO: 1031723 - RNA, 19 nt, Homo sapiens
gcccuugcccugaccuccc

SEQ ID NO: 1031724 - RNA, 14 nt, Homo sapiens
gcccuugucacugg

SEQ ID NO: 1031725 - RNA, 15 nt, Homo sapiens
gccgaagcucuggcu

SEQ ID NO: 1031726 - RNA, 23 nt, Homo sapiens
gccgcccugcugcugacccagcc

SEQ ID NO: 1031727 - RNA, 23 nt, Homo sapiens
gccgguccuucccucucaugacu

SEQ ID NO: 1031728 - RNA, 15 nt, Homo sapiens
gccuaaaaguuacuu

SEQ ID NO: 1031729 - RNA, 15 nt, Homo sapiens
gccuaacacacucca

SEQ ID NO: 1031730 - RNA, 20 nt, Homo sapiens
gccuaacacacuccaagaua

SEQ ID NO: 1031731 - RNA, 17 nt, Homo sapiens
gccuacucuuccaucuu

SEQ ID NO: 1031732 - RNA, 23 nt, Homo sapiens
gccuagauccacacacagaggaa

SEQ ID NO: 1031733 - RNA, 16 nt, Homo sapiens
gccuagccgaccucag

SEQ ID NO: 1031734 - RNA, 22 nt, Homo sapiens
gccuagcugggaaggugaccac

SEQ ID NO: 1031735 - RNA, 16 nt, Homo sapiens
gccuaggggucaggga

SEQ ID NO: 1031736 - RNA, 12 nt, Homo sapiens
gccuaggguaca

SEQ ID NO: 1031737 - RNA, 14 nt, Homo sapiens
gccuaggugacaga

SEQ ID NO: 1031738 - RNA, 16 nt, Homo sapiens
gccuagucccuuccac

SEQ ID NO: 1031739 - RNA, 20 nt, Homo sapiens
gccuauagucgcagcuacua

SEQ ID NO: 1031740 - RNA, 17 nt, Homo sapiens
gccuauuucucuuugca

SEQ ID NO: 1031741 - RNA, 17 nt, Homo sapiens
gccucaagucacuccca

SEQ ID NO: 1031742 - RNA, 17 nt, Homo sapiens
agugacuucacagagac

SEQ ID NO: 1031743 - RNA, 13 nt, Homo sapiens
agugagaagccag

SEQ ID NO: 1031744 - RNA, 18 nt, Homo sapiens
agugagacuccgucacaa

SEQ ID NO: 1031745 - RNA, 22 nt, Homo sapiens
agugagccugaauuuuguugcu

SEQ ID NO: 1031746 - RNA, 22 nt, Homo sapiens
agugagggucuucuuacaugca

SEQ ID NO: 1031747 - RNA, 22 nt, Homo sapiens
agugauugauagaguguuauca

SEQ ID NO: 1031748 - RNA, 12 nt, Homo sapiens
agugauuuccac

SEQ ID NO: 1031749 - RNA, 14 nt, Homo sapiens
agugcaacacugaa

SEQ ID NO: 1031750 - RNA, 20 nt, Homo sapiens
agugcaauggcgugaucucg

SEQ ID NO: 1031751 - RNA, 16 nt, Homo sapiens
agugcaggcacaguau

SEQ ID NO: 1031752 - RNA, 21 nt, Homo sapiens
agugcaggcuggcaccgccuu

SEQ ID NO: 1031753 - RNA, 20 nt, Homo sapiens
agugcauuaaacugaaucac

SEQ ID NO: 1031754 - RNA, 20 nt, Homo sapiens
agugccaacaauccuagugc

SEQ ID NO: 1031755 - RNA, 20 nt, Homo sapiens
agugccaauauuucugauau

SEQ ID NO: 1031756 - RNA, 14 nt, Homo sapiens
agugccagcaauga

SEQ ID NO: 1031757 - RNA, 21 nt, Homo sapiens
agugccagcaaugacaucuca

SEQ ID NO: 1031758 - RNA, 13 nt, Homo sapiens
agugccagcuuuc

SEQ ID NO: 1031759 - RNA, 12 nt, Homo sapiens
agugccaggacu

SEQ ID NO: 1031760 - RNA, 16 nt, Homo sapiens
agugccguaacaacug

SEQ ID NO: 1031761 - RNA, 21 nt, Homo sapiens
agugccguaacaacugugguc

SEQ ID NO: 1031762 - RNA, 19 nt, Homo sapiens
agugccucuggucugggug

SEQ ID NO: 1031763 - RNA, 17 nt, Homo sapiens
agugccuggccaaaggg

SEQ ID NO: 1031764 - RNA, 15 nt, Homo sapiens
agugcgaguccucca

SEQ ID NO: 1031765 - RNA, 21 nt, Homo sapiens
agugcugagauuauaggcaug

SEQ ID NO: 1031766 - RNA, 19 nt, Homo sapiens
agugcugccaguuucccaa

SEQ ID NO: 1031767 - RNA, 13 nt, Homo sapiens
aguggccacucag

SEQ ID NO: 1031768 - RNA, 14 nt, Homo sapiens
aguggccaugccac

SEQ ID NO: 1031769 - RNA, 15 nt, Homo sapiens
aguggccgaugauuu

SEQ ID NO: 1031770 - RNA, 20 nt, Homo sapiens
aguggcguaaucucggcuca

SEQ ID NO: 1031771 - RNA, 20 nt, Homo sapiens
aguggcuaccuacauacaau

SEQ ID NO: 1031772 - RNA, 21 nt, Homo sapiens
aguggcucacgccuaugaucc

SEQ ID NO: 1031773 - RNA, 20 nt, Homo sapiens
agugggaucugucacaccag

SEQ ID NO: 1031774 - RNA, 18 nt, Homo sapiens
agugggcccaaugcacuu

SEQ ID NO: 1031775 - RNA, 15 nt, Homo sapiens
agugggguagguugg

SEQ ID NO: 1031776 - RNA, 19 nt, Homo sapiens
agugggugaauaauacagu

SEQ ID NO: 1031777 - RNA, 20 nt, Homo sapiens
agugggugccccccuugcca

SEQ ID NO: 1031778 - RNA, 19 nt, Homo sapiens
agugggugguggaucuguc

SEQ ID NO: 1031779 - RNA, 24 nt, Homo sapiens
agugggugguggaucuguccaagg

SEQ ID NO: 1031780 - RNA, 13 nt, Homo sapiens
agugggugucucu

SEQ ID NO: 1031781 - RNA, 14 nt, Homo sapiens
agugguagcaagaa

SEQ ID NO: 1031782 - RNA, 17 nt, Homo sapiens
agugguauccugugaca

SEQ ID NO: 1031783 - RNA, 23 nt, Homo sapiens
aguggugggcccugaugcugcca

SEQ ID NO: 1031784 - RNA, 21 nt, Homo sapiens
agugguguguguuaucagaua

SEQ ID NO: 1031785 - RNA, 19 nt, Homo sapiens
aguguaaccuugcaucuca

SEQ ID NO: 1031786 - RNA, 18 nt, Homo sapiens
aguguagggcaacaauac

SEQ ID NO: 1031787 - RNA, 23 nt, Homo sapiens
aguguauuuuauguguggcccaa

SEQ ID NO: 1031788 - RNA, 21 nt, Homo sapiens
agugucacuuaccuagauuua

SEQ ID NO: 1031789 - RNA, 19 nt, Homo sapiens
aguguccccuccacuguca

SEQ ID NO: 1031790 - RNA, 21 nt, Homo sapiens
agugugaacaaaagaugcucu

SEQ ID NO: 1031791 - RNA, 15 nt, Homo sapiens
agugugacucauuaa

SEQ ID NO: 1031792 - RNA, 12 nt, Homo sapiens
aguguggcccag

SEQ ID NO: 1031793 - RNA, 23 nt, Homo sapiens
aguguggcccagggaagccaaaa

SEQ ID NO: 1031794 - RNA, 13 nt, Homo sapiens
agugugugcaagu

SEQ ID NO: 1031795 - RNA, 13 nt, Homo sapiens
agugugugcacau

SEQ ID NO: 1031796 - RNA, 13 nt, Homo sapiens
agugugugcaugu

SEQ ID NO: 1031797 - RNA, 14 nt, Homo sapiens
aguguucauagcuu

SEQ ID NO: 1031798 - RNA, 19 nt, Homo sapiens
aguguuccccaucuggguc

SEQ ID NO: 1031799 - RNA, 12 nt, Homo sapiens
aguguugcccag

SEQ ID NO: 1031800 - RNA, 12 nt, Homo sapiens
aguguugcuugg

SEQ ID NO: 1031801 - RNA, 20 nt, Homo sapiens
aguguuggaaaaugugcaau

SEQ ID NO: 1031802 - RNA, 16 nt, Homo sapiens
aguguuugcaauggug

SEQ ID NO: 1031803 - RNA, 12 nt, Homo sapiens
uccaccaagaaa

SEQ ID NO: 1031804 - RNA, 15 nt, Homo sapiens
uccacccagcaaaga

SEQ ID NO: 1031805 - RNA, 16 nt, Homo sapiens
uccacccccagcugcu

SEQ ID NO: 1031806 - RNA, 21 nt, Homo sapiens
uccacccuuggccugucucau

SEQ ID NO: 1031807 - RNA, 20 nt, Homo sapiens
uccacuaggguccaccagga

SEQ ID NO: 1031808 - RNA, 21 nt, Homo sapiens
uccacuaggguccaccaggag

SEQ ID NO: 1031809 - RNA, 21 nt, Homo sapiens
uccacuccagauuuuuuacag

SEQ ID NO: 1031810 - RNA, 11 nt, Homo sapiens
uccacucccag

SEQ ID NO: 1031811 - RNA, 17 nt, Homo sapiens
uccacucuacccuccca

SEQ ID NO: 1031812 - RNA, 22 nt, Homo sapiens
uccagaagauagcuucacccca

SEQ ID NO: 1031813 - RNA, 16 nt, Homo sapiens
uccagaaggcaaaaag

SEQ ID NO: 1031814 - RNA, 17 nt, Homo sapiens
uccagaccauucaggac

SEQ ID NO: 1031815 - RNA, 16 nt, Homo sapiens
uccagacccccagcaa

SEQ ID NO: 1031816 - RNA, 18 nt, Homo sapiens
uccagagacugggacuaa

SEQ ID NO: 1031817 - RNA, 17 nt, Homo sapiens
uccagagggaauugcag

SEQ ID NO: 1031818 - RNA, 14 nt, Homo sapiens
uccagaucagauuc

SEQ ID NO: 1031819 - RNA, 20 nt, Homo sapiens
uccagccugagcgacaguga

SEQ ID NO: 1031820 - RNA, 17 nt, Homo sapiens
uccagcgacaauuugaa

SEQ ID NO: 1031821 - RNA, 15 nt, Homo sapiens
uccagcucaccagcc

SEQ ID NO: 1031822 - RNA, 14 nt, Homo sapiens
uccagcuucaggca

SEQ ID NO: 1031823 - RNA, 16 nt, Homo sapiens
uccaggagaaggccaa

SEQ ID NO: 1031824 - RNA, 14 nt, Homo sapiens
uccaggaugucaac

SEQ ID NO: 1031825 - RNA, 14 nt, Homo sapiens
uccaggccccaaaa

SEQ ID NO: 1031826 - RNA, 15 nt, Homo sapiens
uccaggcgaugugca

SEQ ID NO: 1031827 - RNA, 16 nt, Homo sapiens
uccaggcgaugugcaa

SEQ ID NO: 1031828 - RNA, 15 nt, Homo sapiens
uccagggaguccccu

SEQ ID NO: 1031829 - RNA, 20 nt, Homo sapiens
uccaggggugggacacccug

SEQ ID NO: 1031830 - RNA, 17 nt, Homo sapiens
uccaguauccacuuugc

SEQ ID NO: 1031831 - RNA, 12 nt, Homo sapiens
uccagucuuccu

SEQ ID NO: 1031832 - RNA, 22 nt, Homo sapiens
uccagucuuccugacacuuuaa

SEQ ID NO: 1031833 - RNA, 14 nt, Homo sapiens
uccagugagcuuau

SEQ ID NO: 1031834 - RNA, 15 nt, Homo sapiens
uccagugcaggagac

SEQ ID NO: 1031835 - RNA, 19 nt, Homo sapiens
uccagugccagcaaugaca

SEQ ID NO: 1031836 - RNA, 21 nt, Homo sapiens
uccaguggaacagucuuccca

SEQ ID NO: 1031837 - RNA, 13 nt, Homo sapiens
uccaguguuuaca

SEQ ID NO: 1031838 - RNA, 15 nt, Homo sapiens
uccaguuugcaauua

SEQ ID NO: 1031839 - RNA, 19 nt, Homo sapiens
uccauaaugcuacugucuc

SEQ ID NO: 1031840 - RNA, 21 nt, Homo sapiens
uccaucacuagccaugauaac

SEQ ID NO: 1031841 - RNA, 16 nt, Homo sapiens
uccauccuugagucaa

SEQ ID NO: 1031842 - RNA, 21 nt, Homo sapiens
uccauccuugagucaaaaaau

SEQ ID NO: 1031843 - RNA, 18 nt, Homo sapiens
uccaucuaaauaccugcc

SEQ ID NO: 1031844 - RNA, 17 nt, Homo sapiens
uccaucucugucucaaa

SEQ ID NO: 1031845 - RNA, 17 nt, Homo sapiens
uccaucuuuccugaugg

SEQ ID NO: 1031846 - RNA, 14 nt, Homo sapiens
uccaugaauguauc

SEQ ID NO: 1031847 - RNA, 16 nt, Homo sapiens
uccaugagacacaucu

SEQ ID NO: 1031848 - RNA, 16 nt, Homo sapiens
uccaugcugccuccag

SEQ ID NO: 1031849 - RNA, 13 nt, Homo sapiens
uccauguacugua

SEQ ID NO: 1031850 - RNA, 16 nt, Homo sapiens
uccaugugugugcaag

SEQ ID NO: 1031851 - RNA, 18 nt, Homo sapiens
uccaugugugugcaagug

SEQ ID NO: 1031852 - RNA, 20 nt, Homo sapiens
uccauguuugauguaucuga

SEQ ID NO: 1031853 - RNA, 15 nt, Homo sapiens
uccauucucugaguc

SEQ ID NO: 1031854 - RNA, 15 nt, Homo sapiens
uccauugauucaggg

SEQ ID NO: 1031855 - RNA, 16 nt, Homo sapiens
uccauugucugagucu

SEQ ID NO: 1031856 - RNA, 18 nt, Homo sapiens
uccauuugugugugugca

SEQ ID NO: 1031857 - RNA, 22 nt, Homo sapiens
uccauuuuuaaccccauuugca

SEQ ID NO: 1031858 - RNA, 15 nt, Homo sapiens
ucccaaaccagacac

SEQ ID NO: 1031859 - RNA, 19 nt, Homo sapiens
ucccaaagugcugagauua

SEQ ID NO: 1031860 - RNA, 18 nt, Homo sapiens
ucccaaauaaacuccaga

SEQ ID NO: 1031861 - RNA, 15 nt, Homo sapiens
ucccaacucacccca

SEQ ID NO: 1031862 - RNA, 23 nt, Homo sapiens
ucccaagagcauaacuguucuca

SEQ ID NO: 1031863 - RNA, 20 nt, Homo sapiens
ucccaccacagcagguguca

SEQ ID NO: 1031864 - RNA, 17 nt, Homo sapiens
ucccacccacaugugac

SEQ ID NO: 1031865 - RNA, 19 nt, Homo sapiens
ucccacgcuucucuuugga

SEQ ID NO: 1031866 - RNA, 20 nt, Homo sapiens
ucccacugggagcacuuugu

SEQ ID NO: 1031867 - RNA, 15 nt, Homo sapiens
ucccacuugucaugu

SEQ ID NO: 1031868 - RNA, 22 nt, Homo sapiens
ucccagagaugacaaauggaga

SEQ ID NO: 1031869 - RNA, 21 nt, Homo sapiens
ucccagagggugggcuucagg

SEQ ID NO: 1031870 - RNA, 18 nt, Homo sapiens
ucccagaugccccagcaa

SEQ ID NO: 1031871 - RNA, 23 nt, Homo sapiens
ucccagcacuuugggaggccaag

SEQ ID NO: 1031872 - RNA, 11 nt, Homo sapiens
ucccagcauug

SEQ ID NO: 1031873 - RNA, 15 nt, Homo sapiens
ucccagcuacucggg

SEQ ID NO: 1031874 - RNA, 17 nt, Homo sapiens
ucccagcucacgucaca

SEQ ID NO: 1031875 - RNA, 14 nt, Homo sapiens
ucccaggaguacac

SEQ ID NO: 1031876 - RNA, 23 nt, Homo sapiens
ucccaggccagcaagcucuucac

SEQ ID NO: 1031877 - RNA, 18 nt, Homo sapiens
ucccagguuaucugggca

SEQ ID NO: 1031878 - RNA, 15 nt, Homo sapiens
ucccagucucuggca

SEQ ID NO: 1031879 - RNA, 14 nt, Homo sapiens
ucccaguggucaaa

SEQ ID NO: 1031880 - RNA, 16 nt, Homo sapiens
ucccauagccaggaaa

SEQ ID NO: 1031881 - RNA, 16 nt, Homo sapiens
ucccaucccagcugaa

SEQ ID NO: 1031882 - RNA, 20 nt, Homo sapiens
ucccauccccuggacuggga

SEQ ID NO: 1031883 - RNA, 22 nt, Homo sapiens
ucccauuucaauuccugugauu

SEQ ID NO: 1031884 - RNA, 15 nt, Homo sapiens
ucccauuucuacucu

SEQ ID NO: 1031885 - RNA, 12 nt, Homo sapiens
uccccaccuguc

SEQ ID NO: 1031886 - RNA, 19 nt, Homo sapiens
uccccacugccuacugcau

SEQ ID NO: 1031887 - RNA, 13 nt, Homo sapiens
uccccacugccug

SEQ ID NO: 1031888 - RNA, 15 nt, Homo sapiens
uccccacugcucauu

SEQ ID NO: 1031889 - RNA, 16 nt, Homo sapiens
uccccagcagggucuu

SEQ ID NO: 1031890 - RNA, 23 nt, Homo sapiens
uccccagcccuggcucugcaaug

SEQ ID NO: 1031891 - RNA, 13 nt, Homo sapiens
uccccagccucuu

SEQ ID NO: 1031892 - RNA, 14 nt, Homo sapiens
uccccaucauccca

SEQ ID NO: 1031893 - RNA, 19 nt, Homo sapiens
uccccauuagcuuucaauu

SEQ ID NO: 1031894 - RNA, 14 nt, Homo sapiens
ucccccaaccucag

SEQ ID NO: 1031895 - RNA, 18 nt, Homo sapiens
ucccccugacaacacuca

SEQ ID NO: 1031896 - RNA, 19 nt, Homo sapiens
uccccgaguuuccccagac

SEQ ID NO: 1031897 - RNA, 16 nt, Homo sapiens
uccccguccacagggc

SEQ ID NO: 1031898 - RNA, 23 nt, Homo sapiens
uccccuaaaccaaaaacugaaag

SEQ ID NO: 1031899 - RNA, 13 nt, Homo sapiens
uccccucaaccca

SEQ ID NO: 1031900 - RNA, 14 nt, Homo sapiens
uccccucaccuccu

SEQ ID NO: 1031901 - RNA, 13 nt, Homo sapiens
uccccuccacugu

SEQ ID NO: 1031902 - RNA, 23 nt, Homo sapiens
uccccuccuugccuccuguguaa

SEQ ID NO: 1031903 - RNA, 22 nt, Homo sapiens
uccccuugcccagggcucagcc

SEQ ID NO: 1031904 - RNA, 19 nt, Homo sapiens
ucccgaguaacugagauua

SEQ ID NO: 1031905 - RNA, 23 nt, Homo sapiens
ucccgauaucaaaaagacugugg

SEQ ID NO: 1031906 - RNA, 21 nt, Homo sapiens
ucccgauucacccuguccaaa

SEQ ID NO: 1031907 - RNA, 18 nt, Homo sapiens
ucccggggcuccacugaa

SEQ ID NO: 1031908 - RNA, 20 nt, Homo sapiens
ucccuaaaaacacagacauu

SEQ ID NO: 1031909 - RNA, 17 nt, Homo sapiens
ucccuagggccuucaga

SEQ ID NO: 1031910 - RNA, 17 nt, Homo sapiens
ucccuauggaagcauau

SEQ ID NO: 1031911 - RNA, 22 nt, Homo sapiens
ucccuauuuuuuuucuguuaua

SEQ ID NO: 1031912 - RNA, 19 nt, Homo sapiens
ucccucaaaugacccaaag

SEQ ID NO: 1031913 - RNA, 20 nt, Homo sapiens
ucccucaaaugacccaaaga

SEQ ID NO: 1031914 - RNA, 13 nt, Homo sapiens
ucccucaacccca

SEQ ID NO: 1031915 - RNA, 15 nt, Homo sapiens
ucccucacagcacag

SEQ ID NO: 1031916 - RNA, 14 nt, Homo sapiens
ucccuccuaccugu

SEQ ID NO: 1031917 - RNA, 17 nt, Homo sapiens
ucccucgggugugcuau

SEQ ID NO: 1031918 - RNA, 19 nt, Homo sapiens
ucccucuaauuuaucuugu

SEQ ID NO: 1031919 - RNA, 21 nt, Homo sapiens
ucccucugagaauuccaagga

SEQ ID NO: 1031920 - RNA, 17 nt, Homo sapiens
ucccucugcugaucuca

SEQ ID NO: 1031921 - RNA, 17 nt, Homo sapiens
ucccugaacugggaccu

SEQ ID NO: 1031922 - RNA, 19 nt, Homo sapiens
ucccugauaacaaccugga

SEQ ID NO: 1031923 - RNA, 16 nt, Homo sapiens
ucccugcaaacauggg

SEQ ID NO: 1031924 - RNA, 14 nt, Homo sapiens
ucccugcaaccuga

SEQ ID NO: 1031925 - RNA, 15 nt, Homo sapiens
ucccugccaauggac

SEQ ID NO: 1031926 - RNA, 17 nt, Homo sapiens
ucccugcuuaaugaaaa

SEQ ID NO: 1031927 - RNA, 22 nt, Homo sapiens
ucccugggguggggauagggag

SEQ ID NO: 1031928 - RNA, 12 nt, Homo sapiens
ucccuguacaau

SEQ ID NO: 1031929 - RNA, 21 nt, Homo sapiens
ucccuucaucuggaaccauca

SEQ ID NO: 1031930 - RNA, 12 nt, Homo sapiens
ucccuucuccca

SEQ ID NO: 1031931 - RNA, 18 nt, Homo sapiens
ucccuucuuggugcuuac

SEQ ID NO: 1031932 - RNA, 15 nt, Homo sapiens
ucccuugguggcaag

SEQ ID NO: 1031933 - RNA, 17 nt, Homo sapiens
ucccuuuaucaguuuga

SEQ ID NO: 1031934 - RNA, 22 nt, Homo sapiens
ucccuuuccagauauucaaguc

SEQ ID NO: 1031935 - RNA, 19 nt, Homo sapiens
ucccuuugacgccauccca

SEQ ID NO: 1031936 - RNA, 17 nt, Homo sapiens
ucccuuuguaugggagc

SEQ ID NO: 1031937 - RNA, 17 nt, Homo sapiens
ucccuuuguugcacacu

SEQ ID NO: 1031938 - RNA, 19 nt, Homo sapiens
ucccuuuguugcacacuca

SEQ ID NO: 1031939 - RNA, 20 nt, Homo sapiens
ucccuuuuacauacugcugu

SEQ ID NO: 1031940 - RNA, 13 nt, Homo sapiens
ucccuuuugcauc

SEQ ID NO: 1031941 - RNA, 23 nt, Homo sapiens
ucccuuuuuauaucccauuuuua

SEQ ID NO: 1031942 - RNA, 22 nt, Homo sapiens
uccgacaaccgaugcuccagcc

SEQ ID NO: 1031943 - RNA, 13 nt, Homo sapiens
uccgaggccagua

SEQ ID NO: 1031944 - RNA, 21 nt, Homo sapiens
uccgccagggcccacaccccc

SEQ ID NO: 1031945 - RNA, 15 nt, Homo sapiens
uccgccauucucaag

SEQ ID NO: 1031946 - RNA, 19 nt, Homo sapiens
uccggccuccugucccuca

SEQ ID NO: 1031947 - RNA, 21 nt, Homo sapiens
uccgggagggugcggcugugc

SEQ ID NO: 1031948 - RNA, 22 nt, Homo sapiens
uccgggagggugcggcugugca

SEQ ID NO: 1031949 - RNA, 13 nt, Homo sapiens
uccguacauucaa

SEQ ID NO: 1031950 - RNA, 20 nt, Homo sapiens
uccgucaguccaagucuucu

SEQ ID NO: 1031951 - RNA, 15 nt, Homo sapiens
uccuaaaaaguucca

SEQ ID NO: 1031952 - RNA, 14 nt, Homo sapiens
uccuaaaaauacaa

SEQ ID NO: 1031953 - RNA, 16 nt, Homo sapiens
uccuaaaugcagugaa

SEQ ID NO: 1031954 - RNA, 22 nt, Homo sapiens
uccuaagccaugggagacacug

SEQ ID NO: 1031955 - RNA, 16 nt, Homo sapiens
uccuaagcuauucagu

SEQ ID NO: 1031956 - RNA, 21 nt, Homo sapiens
uccuaagcuucaaaucagaag

SEQ ID NO: 1031957 - RNA, 14 nt, Homo sapiens
uccuaagggcucac

SEQ ID NO: 1031958 - RNA, 20 nt, Homo sapiens
uccuaccgaaaccuugccuu

SEQ ID NO: 1031959 - RNA, 12 nt, Homo sapiens
uccuaccucagc

SEQ ID NO: 1031960 - RNA, 18 nt, Homo sapiens
uccuacucugugucaggu

SEQ ID NO: 1031961 - RNA, 18 nt, Homo sapiens
uccuagagauuuggugua

SEQ ID NO: 1031962 - RNA, 16 nt, Homo sapiens
uccuagcaaccuccac

SEQ ID NO: 1031963 - RNA, 18 nt, Homo sapiens
uccuaggcauuugcugaa

SEQ ID NO: 1031964 - RNA, 13 nt, Homo sapiens
uccuauacucuau

SEQ ID NO: 1031965 - RNA, 12 nt, Homo sapiens
uccuaucugugu

SEQ ID NO: 1031966 - RNA, 15 nt, Homo sapiens
uccuauguaacugca

SEQ ID NO: 1031967 - RNA, 22 nt, Homo sapiens
uccuaugugauuuuaacucugu

SEQ ID NO: 1031968 - RNA, 16 nt, Homo sapiens
uccuauuaaaggaaua

SEQ ID NO: 1031969 - RNA, 20 nt, Homo sapiens
uccuauuucuuauagucaau

SEQ ID NO: 1031970 - RNA, 14 nt, Homo sapiens
uccucaaacacugc

SEQ ID NO: 1031971 - RNA, 15 nt, Homo sapiens
uccucaaacacugca

SEQ ID NO: 1031972 - RNA, 23 nt, Homo sapiens
uccucaaaccuaccacucaggaa

SEQ ID NO: 1031973 - RNA, 14 nt, Homo sapiens
uccucaaagggaga

SEQ ID NO: 1031974 - RNA, 14 nt, Homo sapiens
uccucaauccagcu

SEQ ID NO: 1031975 - RNA, 11 nt, Homo sapiens
uccucacuccc

SEQ ID NO: 1031976 - RNA, 17 nt, Homo sapiens
uccucagaucauuauca

SEQ ID NO: 1031977 - RNA, 16 nt, Homo sapiens
uccucagccuccucau

SEQ ID NO: 1031978 - RNA, 16 nt, Homo sapiens
uccucaucagucucca

SEQ ID NO: 1031979 - RNA, 13 nt, Homo sapiens
uccucauguacau

SEQ ID NO: 1031980 - RNA, 17 nt, Homo sapiens
uccuccacaauagcaga

SEQ ID NO: 1031981 - RNA, 18 nt, Homo sapiens
uccuccagaauggagcug

SEQ ID NO: 1031982 - RNA, 12 nt, Homo sapiens
uccuccaggcaa

SEQ ID NO: 1031983 - RNA, 11 nt, Homo sapiens
uccuccagguu

SEQ ID NO: 1031984 - RNA, 14 nt, Homo sapiens
uccucccaccucag

SEQ ID NO: 1031985 - RNA, 15 nt, Homo sapiens
uccucccaccucagc

SEQ ID NO: 1031986 - RNA, 19 nt, Homo sapiens
uccuccuuugcucuuggga

SEQ ID NO: 1031987 - RNA, 19 nt, Homo sapiens
uccucgagggcagggacuu

SEQ ID NO: 1031988 - RNA, 21 nt, Homo sapiens
uccucgagggcagggacuuug

SEQ ID NO: 1031989 - RNA, 14 nt, Homo sapiens
uccucggacucugc

SEQ ID NO: 1031990 - RNA, 13 nt, Homo sapiens
uccucguagccau

SEQ ID NO: 1031991 - RNA, 20 nt, Homo sapiens
uccucuaagccacucuucca

SEQ ID NO: 1031992 - RNA, 19 nt, Homo sapiens
uccucuagcugugggggug

SEQ ID NO: 1031993 - RNA, 12 nt, Homo sapiens
uccucucuggcu

SEQ ID NO: 1031994 - RNA, 21 nt, Homo sapiens
uccucugacugaugcuuucag

SEQ ID NO: 1031995 - RNA, 19 nt, Homo sapiens
uccucugcagcucagggac

SEQ ID NO: 1031996 - RNA, 19 nt, Homo sapiens
uccucuguccaggcacugc

SEQ ID NO: 1031997 - RNA, 15 nt, Homo sapiens
uccucuucuucauug

SEQ ID NO: 1031998 - RNA, 21 nt, Homo sapiens
uccucuugacuccuugugaug

SEQ ID NO: 1031999 - RNA, 12 nt, Homo sapiens
uccucuugccuc

SEQ ID NO: 1032000 - RNA, 14 nt, Homo sapiens
uccucuugcucaaa

SEQ ID NO: 1032001 - RNA, 16 nt, Homo sapiens
uccucuuucaaccuca

SEQ ID NO: 1032002 - RNA, 15 nt, Homo sapiens
uccugacacuuuaau

SEQ ID NO: 1032003 - RNA, 15 nt, Homo sapiens
uccugaccaaguaga

SEQ ID NO: 1032004 - RNA, 19 nt, Homo sapiens
uccugaguagcuggauuac

SEQ ID NO: 1032005 - RNA, 21 nt, Homo sapiens
uccugaugaggagaaaggggc

SEQ ID NO: 1032006 - RNA, 23 nt, Homo sapiens
uccugcaccgagagagauggaau

SEQ ID NO: 1032007 - RNA, 17 nt, Homo sapiens
uccugccaguguggaac

SEQ ID NO: 1032008 - RNA, 16 nt, Homo sapiens
uccugccccaugcugc

SEQ ID NO: 1032009 - RNA, 19 nt, Homo sapiens
uccugccugcggaccagau

SEQ ID NO: 1032010 - RNA, 14 nt, Homo sapiens
uccugccuggccag

SEQ ID NO: 1032011 - RNA, 18 nt, Homo sapiens
uccugccuguagcaguga

SEQ ID NO: 1032012 - RNA, 23 nt, Homo sapiens
uccugcuacucuguuccuucaca

SEQ ID NO: 1032013 - RNA, 17 nt, Homo sapiens
uccuggaaaaaacaaaa

SEQ ID NO: 1032014 - RNA, 19 nt, Homo sapiens
uccuggcacuaacguugag

SEQ ID NO: 1032015 - RNA, 14 nt, Homo sapiens
uccuggcugagaga

SEQ ID NO: 1032016 - RNA, 20 nt, Homo sapiens
uccugggagaaccucaggcu

SEQ ID NO: 1032017 - RNA, 16 nt, Homo sapiens
uccugggagugagcug

SEQ ID NO: 1032018 - RNA, 15 nt, Homo sapiens
uccugggaucacuga

SEQ ID NO: 1032019 - RNA, 15 nt, Homo sapiens
uccugggauguggcu

SEQ ID NO: 1032020 - RNA, 13 nt, Homo sapiens
uccugggcccucu

SEQ ID NO: 1032021 - RNA, 18 nt, Homo sapiens
uccuggggaacauagaac

SEQ ID NO: 1032022 - RNA, 22 nt, Homo sapiens
uccuggggagcuucacaaacau

SEQ ID NO: 1032023 - RNA, 15 nt, Homo sapiens
uccugggucuuucau

SEQ ID NO: 1032024 - RNA, 23 nt, Homo sapiens
uccuggugugaagguccugcuau

SEQ ID NO: 1032025 - RNA, 15 nt, Homo sapiens
uccuguaaauggugu

SEQ ID NO: 1032026 - RNA, 17 nt, Homo sapiens
uccuguacuuuuuccag

SEQ ID NO: 1032027 - RNA, 13 nt, Homo sapiens
uccugucccucau

SEQ ID NO: 1032028 - RNA, 22 nt, Homo sapiens
uccugucuuggaaggacuacua

SEQ ID NO: 1032029 - RNA, 18 nt, Homo sapiens
uccugugauuuaugccaa

SEQ ID NO: 1032030 - RNA, 15 nt, Homo sapiens
uccugugcuacuuug

SEQ ID NO: 1032031 - RNA, 15 nt, Homo sapiens
uccuguggucucuga

SEQ ID NO: 1032032 - RNA, 16 nt, Homo sapiens
uccugugucuguguau

SEQ ID NO: 1032033 - RNA, 17 nt, Homo sapiens
uccuguuuuucugggug

SEQ ID NO: 1032034 - RNA, 16 nt, Homo sapiens
uccuuaaacagggcau

SEQ ID NO: 1032035 - RNA, 13 nt, Homo sapiens
uccuuaacacuga

SEQ ID NO: 1032036 - RNA, 23 nt, Homo sapiens
uccuuaauaacaacagaucugca

SEQ ID NO: 1032037 - RNA, 22 nt, Homo sapiens
uccuuaccagcagagcaccuua

SEQ ID NO: 1032038 - RNA, 19 nt, Homo sapiens
uccuuagucucaagggcua

SEQ ID NO: 1032039 - RNA, 16 nt, Homo sapiens
uccuucaccucugaaa

SEQ ID NO: 1032040 - RNA, 13 nt, Homo sapiens
uccuucagugcau

SEQ ID NO: 1032041 - RNA, 12 nt, Homo sapiens
uccuuccauccc

SEQ ID NO: 1032042 - RNA, 11 nt, Homo sapiens
uccuuccucuc

SEQ ID NO: 1032043 - RNA, 18 nt, Homo sapiens
uccuucugaaguguuuca

SEQ ID NO: 1032044 - RNA, 18 nt, Homo sapiens
uccuucuggugucugcuu

SEQ ID NO: 1032045 - RNA, 23 nt, Homo sapiens
uccuugaccagcagaucccagcu

SEQ ID NO: 1032046 - RNA, 19 nt, Homo sapiens
uccuugagagaccaggcaa

SEQ ID NO: 1032047 - RNA, 18 nt, Homo sapiens
uccuugauaaaugccuca

SEQ ID NO: 1032048 - RNA, 13 nt, Homo sapiens
uccuugauucaca

SEQ ID NO: 1032049 - RNA, 16 nt, Homo sapiens
uccuugcacauaguag

SEQ ID NO: 1032050 - RNA, 15 nt, Homo sapiens
uccuugcuacccaga

SEQ ID NO: 1032051 - RNA, 21 nt, Homo sapiens
uccuuggaagagaaugucuga

SEQ ID NO: 1032052 - RNA, 18 nt, Homo sapiens
uccuugggaugaucuuga

SEQ ID NO: 1032053 - RNA, 20 nt, Homo sapiens
uccuugugguuuaugucauc

SEQ ID NO: 1032054 - RNA, 15 nt, Homo sapiens
uccuuuacuaaucca

SEQ ID NO: 1032055 - RNA, 22 nt, Homo sapiens
uccuuuacuaauccaacccaug

SEQ ID NO: 1032056 - RNA, 12 nt, Homo sapiens
uccuuugcacug

SEQ ID NO: 1032057 - RNA, 17 nt, Homo sapiens
ucgaaauacaagccauu

SEQ ID NO: 1032058 - RNA, 14 nt, Homo sapiens
ucgaagcuccguga

SEQ ID NO: 1032059 - RNA, 12 nt, Homo sapiens
ucgaguguuuca

SEQ ID NO: 1032060 - RNA, 17 nt, Homo sapiens
ucgaugcagugcuucca

SEQ ID NO: 1032061 - RNA, 20 nt, Homo sapiens
ucgcaccuaccaucagggac

SEQ ID NO: 1032062 - RNA, 15 nt, Homo sapiens
ucgcagcuacuaggg

SEQ ID NO: 1032063 - RNA, 16 nt, Homo sapiens
ucgcaucucagugcag

SEQ ID NO: 1032064 - RNA, 19 nt, Homo sapiens
ucgcaucucagugcaggag

SEQ ID NO: 1032065 - RNA, 15 nt, Homo sapiens
ucgcccaccagugac

SEQ ID NO: 1032066 - RNA, 17 nt, Homo sapiens
ucgcccaggagacaucc

SEQ ID NO: 1032067 - RNA, 20 nt, Homo sapiens
ucgcccaggcuggagugcaa

SEQ ID NO: 1032068 - RNA, 21 nt, Homo sapiens
ucgcccaggcuggagugcaau

SEQ ID NO: 1032069 - RNA, 19 nt, Homo sapiens
ucgccucaggaaugggcug

SEQ ID NO: 1032070 - RNA, 17 nt, Homo sapiens
ucgcgccacuaagccaa

SEQ ID NO: 1032071 - RNA, 16 nt, Homo sapiens
ucgcuuuguugcccag

SEQ ID NO: 1032072 - RNA, 18 nt, Homo sapiens
ucggagacagugaucucc

SEQ ID NO: 1032073 - RNA, 14 nt, Homo sapiens
ucggccgucuucac

SEQ ID NO: 1032074 - RNA, 16 nt, Homo sapiens
ucggcuggccagcuga

SEQ ID NO: 1032075 - RNA, 19 nt, Homo sapiens
ucgggcugagaacccugcg

SEQ ID NO: 1032076 - RNA, 17 nt, Homo sapiens
ucguugccugccacuga

SEQ ID NO: 1032077 - RNA, 12 nt, Homo sapiens
ucuaaaacugcc

SEQ ID NO: 1032078 - RNA, 17 nt, Homo sapiens
ucuaaaaucccuuucaa

SEQ ID NO: 1032079 - RNA, 20 nt, Homo sapiens
ucuaaagauggaaaaaccac

SEQ ID NO: 1032080 - RNA, 22 nt, Homo sapiens
ucuaaagauggaaaaaccaccc

SEQ ID NO: 1032081 - RNA, 16 nt, Homo sapiens
ucuaaagugagcucua

SEQ ID NO: 1032082 - RNA, 12 nt, Homo sapiens
ucuaaaugaagu

SEQ ID NO: 1032083 - RNA, 23 nt, Homo sapiens
ucuaacaccaacauaagguacua

SEQ ID NO: 1032084 - RNA, 20 nt, Homo sapiens
ucuaacuagaaaucugccaa

SEQ ID NO: 1032085 - RNA, 17 nt, Homo sapiens
ucuaacuccagugaagu

SEQ ID NO: 1032086 - RNA, 20 nt, Homo sapiens
ucuaagauaagaguugagau

SEQ ID NO: 1032087 - RNA, 17 nt, Homo sapiens
ucuaagccuuuccauaa

SEQ ID NO: 1032088 - RNA, 20 nt, Homo sapiens
ucuaaggaaggcagagaccu

SEQ ID NO: 1032089 - RNA, 19 nt, Homo sapiens
ucuaagguaguaacuuucc

SEQ ID NO: 1032090 - RNA, 13 nt, Homo sapiens
ucuaaguauuuga

SEQ ID NO: 1032091 - RNA, 20 nt, Homo sapiens
ucuaauaaaaaacaccuucu

SEQ ID NO: 1032092 - RNA, 14 nt, Homo sapiens
ucuaauggcuuuau

SEQ ID NO: 1032093 - RNA, 12 nt, Homo sapiens
ucuaaugugcau

SEQ ID NO: 1032094 - RNA, 19 nt, Homo sapiens
ucuaaugugccuaguucuu

SEQ ID NO: 1032095 - RNA, 19 nt, Homo sapiens
ucuacaaacucccacuugu

SEQ ID NO: 1032096 - RNA, 14 nt, Homo sapiens
ucuacaaaggccau

SEQ ID NO: 1032097 - RNA, 19 nt, Homo sapiens
ucuacacauacauguaaaa

SEQ ID NO: 1032098 - RNA, 22 nt, Homo sapiens
ucuacauaauuuagaguguaug

SEQ ID NO: 1032099 - RNA, 15 nt, Homo sapiens
ucuaccagcauaaau

SEQ ID NO: 1032100 - RNA, 15 nt, Homo sapiens
ucuaccccaggagac

SEQ ID NO: 1032101 - RNA, 15 nt, Homo sapiens
ucuacccuauacaac

SEQ ID NO: 1032102 - RNA, 20 nt, Homo sapiens
ucuaccucuuggcugccuug

SEQ ID NO: 1032103 - RNA, 22 nt, Homo sapiens
ucuaccugaccaacaguuccuu

SEQ ID NO: 1032104 - RNA, 22 nt, Homo sapiens
ucuacgcucuccuuucuuucua

SEQ ID NO: 1032105 - RNA, 15 nt, Homo sapiens
ucuacuaaaaauaca

SEQ ID NO: 1032106 - RNA, 16 nt, Homo sapiens
ucuacuuaaugagaua

SEQ ID NO: 1032107 - RNA, 13 nt, Homo sapiens
ucuacuuugucua

SEQ ID NO: 1032108 - RNA, 22 nt, Homo sapiens
ucuagaacacaggcaaaauccu

SEQ ID NO: 1032109 - RNA, 24 nt, Homo sapiens
ucuagagcuugaugccaguaggcu

SEQ ID NO: 1032110 - RNA, 16 nt, Homo sapiens
ucuagauacuguauca

SEQ ID NO: 1032111 - RNA, 21 nt, Homo sapiens
ucuagcaaauguuaugcauaa

SEQ ID NO: 1032112 - RNA, 15 nt, Homo sapiens
ucuagcugugggggu

SEQ ID NO: 1032113 - RNA, 16 nt, Homo sapiens
ucuagggcaguggagu

SEQ ID NO: 1032114 - RNA, 22 nt, Homo sapiens
ucuagguaggggcccacuucac

SEQ ID NO: 1032115 - RNA, 16 nt, Homo sapiens
ucuagguucugagcuc

SEQ ID NO: 1032116 - RNA, 13 nt, Homo sapiens
ucuagugaaugaa

SEQ ID NO: 1032117 - RNA, 17 nt, Homo sapiens
ucuagugaaugaaucuc

SEQ ID NO: 1032118 - RNA, 20 nt, Homo sapiens
ucuauaaagaagaacuugca

SEQ ID NO: 1032119 - RNA, 21 nt, Homo sapiens
ucuauaaagaagaacuugcau

SEQ ID NO: 1032120 - RNA, 13 nt, Homo sapiens
ucuauagcagauu

SEQ ID NO: 1032121 - RNA, 18 nt, Homo sapiens
ucuauauguacuugucaa

SEQ ID NO: 1032122 - RNA, 17 nt, Homo sapiens
ucuaucaauagucaaga

SEQ ID NO: 1032123 - RNA, 13 nt, Homo sapiens
ucuaucuuauaua

SEQ ID NO: 1032124 - RNA, 21 nt, Homo sapiens
ucuaugggcagaucuaccccu

SEQ ID NO: 1032125 - RNA, 20 nt, Homo sapiens
ucuauugaaaaaucaccaca

SEQ ID NO: 1032126 - RNA, 14 nt, Homo sapiens
ucuauugauguaca

SEQ ID NO: 1032127 - RNA, 22 nt, Homo sapiens
ucucaaaaaaaaaaaaaugcac

SEQ ID NO: 1032128 - RNA, 20 nt, Homo sapiens
ucucaaacucuugaccucag

SEQ ID NO: 1032129 - RNA, 16 nt, Homo sapiens
ucucaaaugcacaucu

SEQ ID NO: 1032130 - RNA, 22 nt, Homo sapiens
ucucaaauucauggugcacuga

SEQ ID NO: 1032131 - RNA, 21 nt, Homo sapiens
ucucaaccaccuuucagauaa

SEQ ID NO: 1032132 - RNA, 19 nt, Homo sapiens
ucucaauaauuuccuccac

SEQ ID NO: 1032133 - RNA, 18 nt, Homo sapiens
ucucacaguguugcccag

SEQ ID NO: 1032134 - RNA, 23 nt, Homo sapiens
ucucacgggcaugggcacucccu

SEQ ID NO: 1032135 - RNA, 15 nt, Homo sapiens
ucucacuauaccagu

SEQ ID NO: 1032136 - RNA, 18 nt, Homo sapiens
ucucacuauguugcccag

SEQ ID NO: 1032137 - RNA, 20 nt, Homo sapiens
ucucacucugucgcccaguc

SEQ ID NO: 1032138 - RNA, 17 nt, Homo sapiens
ucucacugaaacauuua

SEQ ID NO: 1032139 - RNA, 14 nt, Homo sapiens
ucucagaagggagg

SEQ ID NO: 1032140 - RNA, 22 nt, Homo sapiens
ucucagacuuuggaaaaugcau

SEQ ID NO: 1032141 - RNA, 23 nt, Homo sapiens
ucucagccccugauccugugaag

SEQ ID NO: 1032142 - RNA, 21 nt, Homo sapiens
ucucagccuaccaugagaaua

SEQ ID NO: 1032143 - RNA, 23 nt, Homo sapiens
ucucaggaaaucaaauaugcaaa

SEQ ID NO: 1032144 - RNA, 22 nt, Homo sapiens
ucucaggaagcccccaaguuga

SEQ ID NO: 1032145 - RNA, 18 nt, Homo sapiens
ucucaggccugacucuca

SEQ ID NO: 1032146 - RNA, 20 nt, Homo sapiens
ucucagucaguaauugccaa

SEQ ID NO: 1032147 - RNA, 19 nt, Homo sapiens
ucucaguggcuucaucugu

SEQ ID NO: 1032148 - RNA, 13 nt, Homo sapiens
ucucauccaucau

SEQ ID NO: 1032149 - RNA, 20 nt, Homo sapiens
ucucauccugcaggcagcuu

SEQ ID NO: 1032150 - RNA, 17 nt, Homo sapiens
ucucaugauagaaggcu

SEQ ID NO: 1032151 - RNA, 18 nt, Homo sapiens
ucucaugcauauuuuauu

SEQ ID NO: 1032152 - RNA, 17 nt, Homo sapiens
ucucauguaucaucugg

SEQ ID NO: 1032153 - RNA, 13 nt, Homo sapiens
ucucauuccagag

SEQ ID NO: 1032154 - RNA, 23 nt, Homo sapiens
ucucauugucuguguagaguguu

SEQ ID NO: 1032155 - RNA, 18 nt, Homo sapiens
ucucauuuaaaaugagau

SEQ ID NO: 1032156 - RNA, 19 nt, Homo sapiens
ucucauuuaaaaugagauc

SEQ ID NO: 1032157 - RNA, 10 nt, Homo sapiens
ucucauuucu

SEQ ID NO: 1032158 - RNA, 17 nt, Homo sapiens
ucuccaaaugagaucua

SEQ ID NO: 1032159 - RNA, 14 nt, Homo sapiens
ucuccaacucuuca

SEQ ID NO: 1032160 - RNA, 23 nt, Homo sapiens
ucuccagagggaauugcagagua

SEQ ID NO: 1032161 - RNA, 12 nt, Homo sapiens
ucuccagaugag

SEQ ID NO: 1032162 - RNA, 19 nt, Homo sapiens
ucuccagaugagaguacac

SEQ ID NO: 1032163 - RNA, 24 nt, Homo sapiens
ucuccagccagcaaugauguccag

SEQ ID NO: 1032164 - RNA, 16 nt, Homo sapiens
ucuccaucagaaugaa

SEQ ID NO: 1032165 - RNA, 12 nt, Homo sapiens
ucuccauuucac

SEQ ID NO: 1032166 - RNA, 16 nt, Homo sapiens
ucucccaccaccucac

SEQ ID NO: 1032167 - RNA, 18 nt, Homo sapiens
ucucccaggacccaucac

SEQ ID NO: 1032168 - RNA, 19 nt, Homo sapiens
ucucccaggacccaucacg

SEQ ID NO: 1032169 - RNA, 21 nt, Homo sapiens
ucucccauggcuuaaugcuuc

SEQ ID NO: 1032170 - RNA, 21 nt, Homo sapiens
ucuccccacucuaggggucag

SEQ ID NO: 1032171 - RNA, 16 nt, Homo sapiens
ucuccccaggguucag

SEQ ID NO: 1032172 - RNA, 17 nt, Homo sapiens
ucucccccugggcucug

SEQ ID NO: 1032173 - RNA, 17 nt, Homo sapiens
ucuccccugauuacacc

SEQ ID NO: 1032174 - RNA, 16 nt, Homo sapiens
ucucccuggcccucag

SEQ ID NO: 1032175 - RNA, 23 nt, Homo sapiens
ucucccuguuggucgguggguug

SEQ ID NO: 1032176 - RNA, 14 nt, Homo sapiens
ucuccucugcagcu

SEQ ID NO: 1032177 - RNA, 14 nt, Homo sapiens
ucuccuuaacacug

SEQ ID NO: 1032178 - RNA, 15 nt, Homo sapiens
ucuccuugcuaccca

SEQ ID NO: 1032179 - RNA, 12 nt, Homo sapiens
ucucgcuuuguu

SEQ ID NO: 1032180 - RNA, 23 nt, Homo sapiens
ucucuaaaauagccacuuaccuu

SEQ ID NO: 1032181 - RNA, 18 nt, Homo sapiens
ucucuaaagaaaaucucu

SEQ ID NO: 1032182 - RNA, 23 nt, Homo sapiens
ucucuacaaacucccacuuguca

SEQ ID NO: 1032183 - RNA, 20 nt, Homo sapiens
ucucuacuaaaaauacaaaa

SEQ ID NO: 1032184 - RNA, 14 nt, Homo sapiens
ucucuagugcugug

SEQ ID NO: 1032185 - RNA, 23 nt, Homo sapiens
ucucuaugccagcucagucccau

SEQ ID NO: 1032186 - RNA, 13 nt, Homo sapiens
ucucucaccucua

SEQ ID NO: 1032187 - RNA, 13 nt, Homo sapiens
ucucucaugacca

SEQ ID NO: 1032188 - RNA, 12 nt, Homo sapiens
ucucuccacuga

SEQ ID NO: 1032189 - RNA, 15 nt, Homo sapiens
ucucucccagucuac

SEQ ID NO: 1032190 - RNA, 22 nt, Homo sapiens
ucucucccagucuacccagaga

SEQ ID NO: 1032191 - RNA, 16 nt, Homo sapiens
ucucucgcaagggaag

SEQ ID NO: 1032192 - RNA, 16 nt, Homo sapiens
ucucucucucuacaaa

SEQ ID NO: 1032193 - RNA, 19 nt, Homo sapiens
ucucugaagcauguuucau

SEQ ID NO: 1032194 - RNA, 17 nt, Homo sapiens
ucucugaauuugagaua

SEQ ID NO: 1032195 - RNA, 16 nt, Homo sapiens
ucucugcccuccaaga

SEQ ID NO: 1032196 - RNA, 18 nt, Homo sapiens
ucucugcuccaccacauc

SEQ ID NO: 1032197 - RNA, 13 nt, Homo sapiens
ucucugcuugcau

SEQ ID NO: 1032198 - RNA, 19 nt, Homo sapiens
ucucuggagccaaguccag

SEQ ID NO: 1032199 - RNA, 13 nt, Homo sapiens
ucucuggaguauu

SEQ ID NO: 1032200 - RNA, 15 nt, Homo sapiens
ucucuggaguauucu

SEQ ID NO: 1032201 - RNA, 22 nt, Homo sapiens
ucucuggcuggggagcagggag

SEQ ID NO: 1032202 - RNA, 17 nt, Homo sapiens
ucucugugggccccacc

SEQ ID NO: 1032203 - RNA, 16 nt, Homo sapiens
ucucugugugcacaaa

SEQ ID NO: 1032204 - RNA, 20 nt, Homo sapiens
ucucuuaagaaaaugaugcu

SEQ ID NO: 1032205 - RNA, 14 nt, Homo sapiens
ucucuuacugcaaa

SEQ ID NO: 1032206 - RNA, 15 nt, Homo sapiens
ucucuuccuacccuu

SEQ ID NO: 1032207 - RNA, 22 nt, Homo sapiens
ucucuuccucauauuucagcag

SEQ ID NO: 1032208 - RNA, 14 nt, Homo sapiens
ucucuucugagcua

SEQ ID NO: 1032209 - RNA, 12 nt, Homo sapiens
ucucuucugugu

SEQ ID NO: 1032210 - RNA, 21 nt, Homo sapiens
ucucuuuaaauggcuuuaugc

SEQ ID NO: 1032211 - RNA, 14 nt, Homo sapiens
ucucuuucugcaaa

SEQ ID NO: 1032212 - RNA, 22 nt, Homo sapiens
ucucuuuuuggaggugcuuaag

SEQ ID NO: 1032213 - RNA, 12 nt, Homo sapiens
ucugaaaaccaa

SEQ ID NO: 1032214 - RNA, 19 nt, Homo sapiens
ucugaaaauuaacacugcu

SEQ ID NO: 1032215 - RNA, 24 nt, Homo sapiens
ucugaagccuucuuuguggccuuu

SEQ ID NO: 1032216 - RNA, 13 nt, Homo sapiens
ucugacacacagc

SEQ ID NO: 1032217 - RNA, 23 nt, Homo sapiens
ucugacagaaagcagauaccuca

SEQ ID NO: 1032218 - RNA, 18 nt, Homo sapiens
ucugaccauuucaggggu

SEQ ID NO: 1032219 - RNA, 18 nt, Homo sapiens
ucugaccucuuggccaca

SEQ ID NO: 1032220 - RNA, 20 nt, Homo sapiens
ucugacucacaagaagacca

SEQ ID NO: 1032221 - RNA, 20 nt, Homo sapiens
ucugacucuuggcacagcau

SEQ ID NO: 1032222 - RNA, 19 nt, Homo sapiens
ucugagcagugaaugauuc

SEQ ID NO: 1032223 - RNA, 16 nt, Homo sapiens
ucugagccaguucagu

SEQ ID NO: 1032224 - RNA, 13 nt, Homo sapiens
ucugagcugugca

SEQ ID NO: 1032225 - RNA, 18 nt, Homo sapiens
ucugaggcuuccagagag

SEQ ID NO: 1032226 - RNA, 21 nt, Homo sapiens
ucugaggcuucuggggcuuca

SEQ ID NO: 1032227 - RNA, 19 nt, Homo sapiens
ucugaguaagcccucagga

SEQ ID NO: 1032228 - RNA, 22 nt, Homo sapiens
ucugauaagagaaucaacauuu

SEQ ID NO: 1032229 - RNA, 13 nt, Homo sapiens
ucugauaccucaa

SEQ ID NO: 1032230 - RNA, 15 nt, Homo sapiens
ucugaucaaguauuu

SEQ ID NO: 1032231 - RNA, 22 nt, Homo sapiens
ucugauccuaguuccaccauca

SEQ ID NO: 1032232 - RNA, 16 nt, Homo sapiens
ucugaugcaagcaaga

SEQ ID NO: 1032233 - RNA, 21 nt, Homo sapiens
ucugauuuuccuggacaguuu

SEQ ID NO: 1032234 - RNA, 16 nt, Homo sapiens
ucugcaagcuuuucaa

SEQ ID NO: 1032235 - RNA, 18 nt, Homo sapiens
ucugcaaggucuuugguu

SEQ ID NO: 1032236 - RNA, 13 nt, Homo sapiens
ucugcacaugcag

SEQ ID NO: 1032237 - RNA, 12 nt, Homo sapiens
ucugcacccagg

SEQ ID NO: 1032238 - RNA, 13 nt, Homo sapiens
ucugcacuacucc

SEQ ID NO: 1032239 - RNA, 16 nt, Homo sapiens
ucugcacuggugugag

SEQ ID NO: 1032240 - RNA, 15 nt, Homo sapiens
ucugcaguagucucu

SEQ ID NO: 1032241 - RNA, 16 nt, Homo sapiens
ucugccacccaguccu

SEQ ID NO: 1032242 - RNA, 13 nt, Homo sapiens
ucugcccaccuac

SEQ ID NO: 1032243 - RNA, 14 nt, Homo sapiens
ucugcccagaauuc

SEQ ID NO: 1032244 - RNA, 20 nt, Homo sapiens
ucugcccagcuugggcccag

SEQ ID NO: 1032245 - RNA, 20 nt, Homo sapiens
ucugccccagcucuggcuuc

SEQ ID NO: 1032246 - RNA, 20 nt, Homo sapiens
ucugccggcccuggggcuag

SEQ ID NO: 1032247 - RNA, 14 nt, Homo sapiens
ucugccucugacac

SEQ ID NO: 1032248 - RNA, 19 nt, Homo sapiens
ucugccucugacacacagc

SEQ ID NO: 1032249 - RNA, 17 nt, Homo sapiens
ucugccugaagucacac

SEQ ID NO: 1032250 - RNA, 19 nt, Homo sapiens
ucugccuguuauaacucug

SEQ ID NO: 1032251 - RNA, 22 nt, Homo sapiens
ucugccuguuauaacucugcac

SEQ ID NO: 1032252 - RNA, 15 nt, Homo sapiens
ucugccuucucagga

SEQ ID NO: 1032253 - RNA, 10 nt, Homo sapiens
ucugcuccac

SEQ ID NO: 1032254 - RNA, 13 nt, Homo sapiens
ucugcugaucuca

SEQ ID NO: 1032255 - RNA, 23 nt, Homo sapiens
ucugcuggaaacagacucgauuc

SEQ ID NO: 1032256 - RNA, 12 nt, Homo sapiens
ucugcugucuca

SEQ ID NO: 1032257 - RNA, 14 nt, Homo sapiens
ucugcuuaaucuga

SEQ ID NO: 1032258 - RNA, 20 nt, Homo sapiens
ucugcuuaaucugagaauca

SEQ ID NO: 1032259 - RNA, 13 nt, Homo sapiens
ucugcuugaucaa

SEQ ID NO: 1032260 - RNA, 19 nt, Homo sapiens
ucugcuugcucuuguccua

SEQ ID NO: 1032261 - RNA, 15 nt, Homo sapiens
ucugcuuuaauuuca

SEQ ID NO: 1032262 - RNA, 16 nt, Homo sapiens
ucugcuuuaauuucau

SEQ ID NO: 1032263 - RNA, 14 nt, Homo sapiens
ucuggaaaagcaaa

SEQ ID NO: 1032264 - RNA, 16 nt, Homo sapiens
ucuggaauacaugaaa

SEQ ID NO: 1032265 - RNA, 19 nt, Homo sapiens
ucuggacacagccccaugu

SEQ ID NO: 1032266 - RNA, 15 nt, Homo sapiens
ucuggaccagccugu

SEQ ID NO: 1032267 - RNA, 17 nt, Homo sapiens
ucuggaccagccuguug

SEQ ID NO: 1032268 - RNA, 20 nt, Homo sapiens
ucuggaccccaucugugaau

SEQ ID NO: 1032269 - RNA, 21 nt, Homo sapiens
ucuggaccccaucugugaaua

SEQ ID NO: 1032270 - RNA, 18 nt, Homo sapiens
ucuggagaaccucaucca

SEQ ID NO: 1032271 - RNA, 16 nt, Homo sapiens
ucuggagccaagucca

SEQ ID NO: 1032272 - RNA, 23 nt, Homo sapiens
ucuggagggguguggcuccuucc

SEQ ID NO: 1032273 - RNA, 13 nt, Homo sapiens
ucuggagugagcu

SEQ ID NO: 1032274 - RNA, 17 nt, Homo sapiens
ucuggauggcaccagag

SEQ ID NO: 1032275 - RNA, 13 nt, Homo sapiens
ucuggcaucucuu

SEQ ID NO: 1032276 - RNA, 20 nt, Homo sapiens
ucuggccuugaaaccaccuu

SEQ ID NO: 1032277 - RNA, 14 nt, Homo sapiens
ucuggcgcccauga

SEQ ID NO: 1032278 - RNA, 20 nt, Homo sapiens
ucuggcuaaauggacaucau

SEQ ID NO: 1032279 - RNA, 12 nt, Homo sapiens
ucuggcucucau

SEQ ID NO: 1032280 - RNA, 19 nt, Homo sapiens
ucuggcucugucacccagg

SEQ ID NO: 1032281 - RNA, 20 nt, Homo sapiens
ucuggcugaacccugugcug

SEQ ID NO: 1032282 - RNA, 16 nt, Homo sapiens
ucugggaagauuucua

SEQ ID NO: 1032283 - RNA, 19 nt, Homo sapiens
ucugggacuuuuaaauuca

SEQ ID NO: 1032284 - RNA, 21 nt, Homo sapiens
ucugggagacuuugaagacca

SEQ ID NO: 1032285 - RNA, 18 nt, Homo sapiens
ucugggccaagucaaaga

SEQ ID NO: 1032286 - RNA, 20 nt, Homo sapiens
ucuggucacauggcugucga

SEQ ID NO: 1032287 - RNA, 22 nt, Homo sapiens
ucuggugguguuaaucauuuca

SEQ ID NO: 1032288 - RNA, 13 nt, Homo sapiens
ucuggugugaacu

SEQ ID NO: 1032289 - RNA, 17 nt, Homo sapiens
ucugguuugagcaauuu

SEQ ID NO: 1032290 - RNA, 14 nt, Homo sapiens
ucugguuugcagag

SEQ ID NO: 1032291 - RNA, 20 nt, Homo sapiens
ucugguuuuaacaauuuccu

SEQ ID NO: 1032292 - RNA, 14 nt, Homo sapiens
ucugguuuugcuau

SEQ ID NO: 1032293 - RNA, 15 nt, Homo sapiens
ucuguaaacuuccaa

SEQ ID NO: 1032294 - RNA, 12 nt, Homo sapiens
ucuguaaucuuc

SEQ ID NO: 1032295 - RNA, 10 nt, Homo sapiens
ucuguacaau

SEQ ID NO: 1032296 - RNA, 18 nt, Homo sapiens
ucuguacgucugacaggc

SEQ ID NO: 1032297 - RNA, 15 nt, Homo sapiens
ucuguaguaaacuau

SEQ ID NO: 1032298 - RNA, 15 nt, Homo sapiens
ucuguagugugaaac

SEQ ID NO: 1032299 - RNA, 22 nt, Homo sapiens
ucuguauuuccccaacauguaa

SEQ ID NO: 1032300 - RNA, 23 nt, Homo sapiens
ucuguauuuccccaacauguaau

SEQ ID NO: 1032301 - RNA, 13 nt, Homo sapiens
ucugucuggcuga

SEQ ID NO: 1032302 - RNA, 12 nt, Homo sapiens
ucugucuugggc

SEQ ID NO: 1032303 - RNA, 17 nt, Homo sapiens
ucugugcaugguggcac

SEQ ID NO: 1032304 - RNA, 14 nt, Homo sapiens
ucugugccccaugc

SEQ ID NO: 1032305 - RNA, 12 nt, Homo sapiens
ucuguguacaaa

SEQ ID NO: 1032306 - RNA, 20 nt, Homo sapiens
ucuguguuuuugaaauauua

SEQ ID NO: 1032307 - RNA, 18 nt, Homo sapiens
ucuguuaugcugugacac

SEQ ID NO: 1032308 - RNA, 16 nt, Homo sapiens
ucuguucugccuuccg

SEQ ID NO: 1032309 - RNA, 16 nt, Homo sapiens
ucuguuucccaccuca

SEQ ID NO: 1032310 - RNA, 18 nt, Homo sapiens
ucuguuuuuaaaaaucau

SEQ ID NO: 1032311 - RNA, 11 nt, Homo sapiens
ucuuaacucac

SEQ ID NO: 1032312 - RNA, 19 nt, Homo sapiens
ucuuaagaaaaugaugcug

SEQ ID NO: 1032313 - RNA, 13 nt, Homo sapiens
ucuuaagacguga

SEQ ID NO: 1032314 - RNA, 22 nt, Homo sapiens
ucuuaagcuuccgccgucucaa

SEQ ID NO: 1032315 - RNA, 16 nt, Homo sapiens
ucuuaaguagggacuu

SEQ ID NO: 1032316 - RNA, 20 nt, Homo sapiens
ucuuaauauuaaauauauga

SEQ ID NO: 1032317 - RNA, 16 nt, Homo sapiens
ucuuaaucuuuucaca

SEQ ID NO: 1032318 - RNA, 14 nt, Homo sapiens
ucuuaauucuuagc

SEQ ID NO: 1032319 - RNA, 17 nt, Homo sapiens
ucuuaauucuuagcuca

SEQ ID NO: 1032320 - RNA, 19 nt, Homo sapiens
ucuuagagcaaagagccag

SEQ ID NO: 1032321 - RNA, 22 nt, Homo sapiens
ucuuagaguuaccacaccccau

SEQ ID NO: 1032322 - RNA, 13 nt, Homo sapiens
ucuuagugucacu

SEQ ID NO: 1032323 - RNA, 16 nt, Homo sapiens
ucuuaguucucacugu

SEQ ID NO: 1032324 - RNA, 14 nt, Homo sapiens
ucuuaguugcugua

SEQ ID NO: 1032325 - RNA, 21 nt, Homo sapiens
ucuuauccaacaucaacaucu

SEQ ID NO: 1032326 - RNA, 15 nt, Homo sapiens
ucuuaugccauguua

SEQ ID NO: 1032327 - RNA, 16 nt, Homo sapiens
ucuuauuuaaugaaag

SEQ ID NO: 1032328 - RNA, 20 nt, Homo sapiens
ucuuauuucauuucuuugag

SEQ ID NO: 1032329 - RNA, 12 nt, Homo sapiens
ucuucaacagcu

SEQ ID NO: 1032330 - RNA, 22 nt, Homo sapiens
ucuucaaccucauugacaagaa

SEQ ID NO: 1032331 - RNA, 14 nt, Homo sapiens
ucuucaccauuugg

SEQ ID NO: 1032332 - RNA, 24 nt, Homo sapiens
ucuucaccauuuggcaaugccauc

SEQ ID NO: 1032333 - RNA, 18 nt, Homo sapiens
ucuucaccccccacucac

SEQ ID NO: 1032334 - RNA, 18 nt, Homo sapiens
ucuucacucaaucucuga

SEQ ID NO: 1032335 - RNA, 18 nt, Homo sapiens
ucuucacuucuaaaugca

SEQ ID NO: 1032336 - RNA, 16 nt, Homo sapiens
ucuucagaagacacug

SEQ ID NO: 1032337 - RNA, 14 nt, Homo sapiens
ucuucauuaccuca

SEQ ID NO: 1032338 - RNA, 13 nt, Homo sapiens
ucuuccaucaccu

SEQ ID NO: 1032339 - RNA, 22 nt, Homo sapiens
ucuucccacacagaauauacau

SEQ ID NO: 1032340 - RNA, 23 nt, Homo sapiens
ucuucccuuuuacauacugcugu

SEQ ID NO: 1032341 - RNA, 23 nt, Homo sapiens
ucuuccuccgaggccaguaccuu

SEQ ID NO: 1032342 - RNA, 20 nt, Homo sapiens
ucuuccuuacccugcgauuu

SEQ ID NO: 1032343 - RNA, 22 nt, Homo sapiens
ucuucuauggguuggacaaccu

SEQ ID NO: 1032344 - RNA, 17 nt, Homo sapiens
ucuucucauagcauuaa

SEQ ID NO: 1032345 - RNA, 22 nt, Homo sapiens
ucuucuuuuggcuuccaugaug

SEQ ID NO: 1032346 - RNA, 13 nt, Homo sapiens
ucuugaagcagua

SEQ ID NO: 1032347 - RNA, 20 nt, Homo sapiens
ucuugacauucaaggcauuu

SEQ ID NO: 1032348 - RNA, 16 nt, Homo sapiens
ucuugaguuuagugau

SEQ ID NO: 1032349 - RNA, 11 nt, Homo sapiens
ucuugaucucc

SEQ ID NO: 1032350 - RNA, 22 nt, Homo sapiens
ucuugccugcaugaaacauguu

SEQ ID NO: 1032351 - RNA, 13 nt, Homo sapiens
ucuuggacacugu

SEQ ID NO: 1032352 - RNA, 19 nt, Homo sapiens
ucuuggaccucugcucuga

SEQ ID NO: 1032353 - RNA, 20 nt, Homo sapiens
ucuuggccaaagaccaaauu

SEQ ID NO: 1032354 - RNA, 17 nt, Homo sapiens
ucuugggaaauauguca

SEQ ID NO: 1032355 - RNA, 15 nt, Homo sapiens
ucuugguacuacuag

SEQ ID NO: 1032356 - RNA, 15 nt, Homo sapiens
ucuuggucacauaca

SEQ ID NO: 1032357 - RNA, 22 nt, Homo sapiens
ucuugguugaggaaacaaacau

SEQ ID NO: 1032358 - RNA, 14 nt, Homo sapiens
ucuugguuuccaaa

SEQ ID NO: 1032359 - RNA, 19 nt, Homo sapiens
ucuugugagggacugagau

SEQ ID NO: 1032360 - RNA, 16 nt, Homo sapiens
ucuuguguuaccugaa

SEQ ID NO: 1032361 - RNA, 16 nt, Homo sapiens
ucuuguuaagugcagu

SEQ ID NO: 1032362 - RNA, 17 nt, Homo sapiens
ucuuguuccccacugac

SEQ ID NO: 1032363 - RNA, 15 nt, Homo sapiens
ucuuguucuacugag

SEQ ID NO: 1032364 - RNA, 14 nt, Homo sapiens
ucuuguugcucaaa

SEQ ID NO: 1032365 - RNA, 12 nt, Homo sapiens
ucuuuaccugag

SEQ ID NO: 1032366 - RNA, 16 nt, Homo sapiens
ucuuuaguucugucag

SEQ ID NO: 1032367 - RNA, 20 nt, Homo sapiens
ucuuuauauggccucaagau

SEQ ID NO: 1032368 - RNA, 16 nt, Homo sapiens
ucuuuauguaaucuau

SEQ ID NO: 1032369 - RNA, 15 nt, Homo sapiens
ucuuucacacuucca

SEQ ID NO: 1032370 - RNA, 23 nt, Homo sapiens
ucuuucacacuuccaccagccug

SEQ ID NO: 1032371 - RNA, 18 nt, Homo sapiens
ucuuucaggacucuaccu

SEQ ID NO: 1032372 - RNA, 17 nt, Homo sapiens
ucuuucucuacuuugag

SEQ ID NO: 1032373 - RNA, 15 nt, Homo sapiens
ucuuucugccaacuu

SEQ ID NO: 1032374 - RNA, 16 nt, Homo sapiens
ucuuucuuacaaggaa

SEQ ID NO: 1032375 - RNA, 17 nt, Homo sapiens
ucuuucuuuaccugaga

SEQ ID NO: 1032376 - RNA, 20 nt, Homo sapiens
ucuuugaacccuugcuugca

SEQ ID NO: 1032377 - RNA, 20 nt, Homo sapiens
ucuuugcagacaggcaagca

SEQ ID NO: 1032378 - RNA, 17 nt, Homo sapiens
ucuuugcccacaaugcu

SEQ ID NO: 1032379 - RNA, 16 nt, Homo sapiens
ucuuugcucauggcaa

SEQ ID NO: 1032380 - RNA, 15 nt, Homo sapiens
ucuuuggacagaagc

SEQ ID NO: 1032381 - RNA, 21 nt, Homo sapiens
ucuuuggaccacuccccucaa

SEQ ID NO: 1032382 - RNA, 17 nt, Homo sapiens
ucuuuggggucagccag

SEQ ID NO: 1032383 - RNA, 21 nt, Homo sapiens
ucuuuguaagaguggaaccaa

SEQ ID NO: 1032384 - RNA, 14 nt, Homo sapiens
ucuuuucacauucu

SEQ ID NO: 1032385 - RNA, 15 nt, Homo sapiens
ucuuuucaucuggga

SEQ ID NO: 1032386 - RNA, 16 nt, Homo sapiens
ucuuuucaucugggaa

SEQ ID NO: 1032387 - RNA, 19 nt, Homo sapiens
ucuuuugagcuaaucuuca

SEQ ID NO: 1032388 - RNA, 19 nt, Homo sapiens
ucuuuuggggaagcuuucu

SEQ ID NO: 1032389 - RNA, 14 nt, Homo sapiens
ucuuuugucccaga

SEQ ID NO: 1032390 - RNA, 20 nt, Homo sapiens
ucuuuuuaauaaaaaggcac

SEQ ID NO: 1032391 - RNA, 21 nt, Homo sapiens
ucuuuuuagagaaauuugcca

SEQ ID NO: 1032392 - RNA, 13 nt, Homo sapiens
ucuuuuugcuuca

SEQ ID NO: 1032393 - RNA, 20 nt, Homo sapiens
ucuuuuuuuuaauaaaccau

SEQ ID NO: 1032394 - RNA, 21 nt, Homo sapiens
ugaaaaaaggacaauuucaaa

SEQ ID NO: 1032395 - RNA, 18 nt, Homo sapiens
ugaaaaacaaaaauaaca

SEQ ID NO: 1032396 - RNA, 12 nt, Homo sapiens
ugaaaaaugccu

SEQ ID NO: 1032397 - RNA, 14 nt, Homo sapiens
ugaaaaauguauau

SEQ ID NO: 1032398 - RNA, 17 nt, Homo sapiens
ugaaaaaugugcaaaac

SEQ ID NO: 1032399 - RNA, 22 nt, Homo sapiens
ugaaaaaugugcaaaacagcgu

SEQ ID NO: 1032400 - RNA, 22 nt, Homo sapiens
ugaaaaauucucagucaguaau

SEQ ID NO: 1032401 - RNA, 15 nt, Homo sapiens
ugaaaacaagugcug

SEQ ID NO: 1032402 - RNA, 16 nt, Homo sapiens
ugaaaacacugugcac

SEQ ID NO: 1032403 - RNA, 13 nt, Homo sapiens
ugaaaacacuguu

SEQ ID NO: 1032404 - RNA, 22 nt, Homo sapiens
ugaaaacucacagaacuaugua

SEQ ID NO: 1032405 - RNA, 23 nt, Homo sapiens
ugaaaacuuagagagguacaagu

SEQ ID NO: 1032406 - RNA, 17 nt, Homo sapiens
ugaaaagacucaguguu

SEQ ID NO: 1032407 - RNA, 17 nt, Homo sapiens
ugaaaaguuacuaccug

SEQ ID NO: 1032408 - RNA, 22 nt, Homo sapiens
ugaaaauaauuguuccaaauga

SEQ ID NO: 1032409 - RNA, 22 nt, Homo sapiens
ugaaaauacaacuuaaauaaua

SEQ ID NO: 1032410 - RNA, 17 nt, Homo sapiens
ugaaaauacuuaggaag

SEQ ID NO: 1032411 - RNA, 17 nt, Homo sapiens
ugaaaauauuuguauca

SEQ ID NO: 1032412 - RNA, 16 nt, Homo sapiens
ugaaaauccaucucau

SEQ ID NO: 1032413 - RNA, 14 nt, Homo sapiens
ugaaaaucuaauau

SEQ ID NO: 1032414 - RNA, 21 nt, Homo sapiens
ugaaaaucuacacuccaguga

SEQ ID NO: 1032415 - RNA, 14 nt, Homo sapiens
ugaaaaugaaucuu

SEQ ID NO: 1032416 - RNA, 16 nt, Homo sapiens
ugaaaaugaaucuuca

SEQ ID NO: 1032417 - RNA, 22 nt, Homo sapiens
ugaaaaugcuguauuagucaca

SEQ ID NO: 1032418 - RNA, 12 nt, Homo sapiens
ugaaaauguuca

SEQ ID NO: 1032419 - RNA, 21 nt, Homo sapiens
ugaaacaagcaacagauggau

SEQ ID NO: 1032420 - RNA, 14 nt, Homo sapiens
ugaaacacaccagg

SEQ ID NO: 1032421 - RNA, 19 nt, Homo sapiens
ugaaaccaagggggaugac

SEQ ID NO: 1032422 - RNA, 23 nt, Homo sapiens
ugaaacuaacagauaagcaagag

SEQ ID NO: 1032423 - RNA, 14 nt, Homo sapiens
ugaaacuuaggaag

SEQ ID NO: 1032424 - RNA, 23 nt, Homo sapiens
ugaaacuuguuuauuauguacaa

SEQ ID NO: 1032425 - RNA, 21 nt, Homo sapiens
ugaaagaacauggacuuguau

SEQ ID NO: 1032426 - RNA, 20 nt, Homo sapiens
ugaaagaguaaaggaaauga

SEQ ID NO: 1032427 - RNA, 17 nt, Homo sapiens
ugaaagggaguauuaca

SEQ ID NO: 1032428 - RNA, 20 nt, Homo sapiens
ugaaaguuaauccacuguga

SEQ ID NO: 1032429 - RNA, 12 nt, Homo sapiens
ugaaauaaagca

SEQ ID NO: 1032430 - RNA, 22 nt, Homo sapiens
ugaaauaccagugaaccaaaga

SEQ ID NO: 1032431 - RNA, 16 nt, Homo sapiens
ugaaaucuguaucugu

SEQ ID NO: 1032432 - RNA, 21 nt, Homo sapiens
ugaaaugcagagucaaugaac

SEQ ID NO: 1032433 - RNA, 19 nt, Homo sapiens
ugaaauggugaaaugcaga

SEQ ID NO: 1032434 - RNA, 18 nt, Homo sapiens
ugaaauguauagcugcuu

SEQ ID NO: 1032435 - RNA, 12 nt, Homo sapiens
ugaaauuacuua

SEQ ID NO: 1032436 - RNA, 20 nt, Homo sapiens
ugaaauuauguauguuuaca

SEQ ID NO: 1032437 - RNA, 21 nt, Homo sapiens
ugaaauucacccccuuuccug

SEQ ID NO: 1032438 - RNA, 18 nt, Homo sapiens
ugaaauuugagagacaaa

SEQ ID NO: 1032439 - RNA, 21 nt, Homo sapiens
ugaaauuuucuagacuuucug

SEQ ID NO: 1032440 - RNA, 15 nt, Homo sapiens
ugaaauuuuuaucua

SEQ ID NO: 1032441 - RNA, 19 nt, Homo sapiens
ugaacaaauuuacagagac

SEQ ID NO: 1032442 - RNA, 23 nt, Homo sapiens
ugaacaaauuuacagagacagaa

SEQ ID NO: 1032443 - RNA, 20 nt, Homo sapiens
ugaacaaucaaagcacuugg

SEQ ID NO: 1032444 - RNA, 19 nt, Homo sapiens
ugaacacucuacuacaugu

SEQ ID NO: 1032445 - RNA, 18 nt, Homo sapiens
ugaacaugugaaguuaua

SEQ ID NO: 1032446 - RNA, 17 nt, Homo sapiens
ugaacauuuaucaauca

SEQ ID NO: 1032447 - RNA, 22 nt, Homo sapiens
ugaaccaagaccauugaauucu

SEQ ID NO: 1032448 - RNA, 19 nt, Homo sapiens
ugaaccuuccaucucgcca

SEQ ID NO: 1032449 - RNA, 15 nt, Homo sapiens
ugaacgcuucugcuu

SEQ ID NO: 1032450 - RNA, 17 nt, Homo sapiens
ugaacggugagcauugu

SEQ ID NO: 1032451 - RNA, 16 nt, Homo sapiens
ugaacuaaacuuucac

SEQ ID NO: 1032452 - RNA, 22 nt, Homo sapiens
ugaacuagauugcaugcuuccu

SEQ ID NO: 1032453 - RNA, 14 nt, Homo sapiens
ugaacucccgccac

SEQ ID NO: 1032454 - RNA, 18 nt, Homo sapiens
ugaacucuucaaucucuu

SEQ ID NO: 1032455 - RNA, 24 nt, Homo sapiens
ugaacuuggaaagaaaugcccauc

SEQ ID NO: 1032456 - RNA, 17 nt, Homo sapiens
ugaacuuucacauagca

SEQ ID NO: 1032457 - RNA, 18 nt, Homo sapiens
ugaacuuuuuuccacuga

SEQ ID NO: 1032458 - RNA, 21 nt, Homo sapiens
ugaagaaaagugaaugcucaa

SEQ ID NO: 1032459 - RNA, 18 nt, Homo sapiens
ugaagaacaguaacugcc

SEQ ID NO: 1032460 - RNA, 19 nt, Homo sapiens
ugaagaagagaaugugaca

SEQ ID NO: 1032461 - RNA, 16 nt, Homo sapiens
ugaagacaacagcaua

SEQ ID NO: 1032462 - RNA, 13 nt, Homo sapiens
ugaagacaggaug

SEQ ID NO: 1032463 - RNA, 18 nt, Homo sapiens
ugaagagaccaagacucu

SEQ ID NO: 1032464 - RNA, 21 nt, Homo sapiens
ugaagagauccuucuguaaag

SEQ ID NO: 1032465 - RNA, 15 nt, Homo sapiens
ugaagagcuauuaua

SEQ ID NO: 1032466 - RNA, 14 nt, Homo sapiens
ugaagagcuucauu

SEQ ID NO: 1032467 - RNA, 22 nt, Homo sapiens
ugaagaggaagggcaaaaccac

SEQ ID NO: 1032468 - RNA, 18 nt, Homo sapiens
ugaagagggagaagcaug

SEQ ID NO: 1032469 - RNA, 18 nt, Homo sapiens
ugaagagggagaagggau

SEQ ID NO: 1032470 - RNA, 13 nt, Homo sapiens
ugaagaugaucau

SEQ ID NO: 1032471 - RNA, 23 nt, Homo sapiens
ugaagaugcagcucacuacccua

SEQ ID NO: 1032472 - RNA, 20 nt, Homo sapiens
ugaagauggcauccugugaa

SEQ ID NO: 1032473 - RNA, 21 nt, Homo sapiens
ugaagauggcauccugugaag

SEQ ID NO: 1032474 - RNA, 19 nt, Homo sapiens
ugaagauucuccugugcua

SEQ ID NO: 1032475 - RNA, 20 nt, Homo sapiens
ugaagauucuccugugcuag

SEQ ID NO: 1032476 - RNA, 16 nt, Homo sapiens
ugaagcaaaucagaaa

SEQ ID NO: 1032477 - RNA, 15 nt, Homo sapiens
ugaagcaaguacaau

SEQ ID NO: 1032478 - RNA, 18 nt, Homo sapiens
ugaagccuauguaugcca

SEQ ID NO: 1032479 - RNA, 15 nt, Homo sapiens
ugaagccucacuuau

SEQ ID NO: 1032480 - RNA, 15 nt, Homo sapiens
ugaaggacugugaca

SEQ ID NO: 1032481 - RNA, 23 nt, Homo sapiens
ugaaggaggugagggaugugaau

SEQ ID NO: 1032482 - RNA, 17 nt, Homo sapiens
ugaaggcaaugccaucc

SEQ ID NO: 1032483 - RNA, 19 nt, Homo sapiens
ugaaggcgggccugcaagc

SEQ ID NO: 1032484 - RNA, 19 nt, Homo sapiens
ugaagggggauaugaaugg

SEQ ID NO: 1032485 - RNA, 15 nt, Homo sapiens
ugaagggguucucac

SEQ ID NO: 1032486 - RNA, 16 nt, Homo sapiens
ugaaggucacucuucc

SEQ ID NO: 1032487 - RNA, 16 nt, Homo sapiens
ugaaguaggugugacu

SEQ ID NO: 1032488 - RNA, 20 nt, Homo sapiens
ugaaguaggugugacuugaa

SEQ ID NO: 1032489 - RNA, 14 nt, Homo sapiens
ugaagucacacagu

SEQ ID NO: 1032490 - RNA, 19 nt, Homo sapiens
ugaagucccagauacuugg

SEQ ID NO: 1032491 - RNA, 18 nt, Homo sapiens
ugaagucucugaagugaa

SEQ ID NO: 1032492 - RNA, 18 nt, Homo sapiens
ugaagugcccuucccuug

SEQ ID NO: 1032493 - RNA, 23 nt, Homo sapiens
ugaaguuagggaugacugugauu

SEQ ID NO: 1032494 - RNA, 22 nt, Homo sapiens
ugaaguucaccauuaaaaggga

SEQ ID NO: 1032495 - RNA, 16 nt, Homo sapiens
ugaaguuuaauugacu

SEQ ID NO: 1032496 - RNA, 18 nt, Homo sapiens
ugaaguuuaauugacuua

SEQ ID NO: 1032497 - RNA, 15 nt, Homo sapiens
ugaaguuuacaauca

SEQ ID NO: 1032498 - RNA, 15 nt, Homo sapiens
ugaaguuuccuuggc

SEQ ID NO: 1032499 - RNA, 23 nt, Homo sapiens
ugaauacacgagguaugaggucu

SEQ ID NO: 1032500 - RNA, 17 nt, Homo sapiens
ugaauaugauuaguaaa

SEQ ID NO: 1032501 - RNA, 20 nt, Homo sapiens
ugaauaugcugcucaucccc

SEQ ID NO: 1032502 - RNA, 15 nt, Homo sapiens
ugaaucacaauguaa

SEQ ID NO: 1032503 - RNA, 22 nt, Homo sapiens
ugaaucaugguuuuucuuagua

SEQ ID NO: 1032504 - RNA, 18 nt, Homo sapiens
ugaauccaaacuaaucca

SEQ ID NO: 1032505 - RNA, 17 nt, Homo sapiens
ugaauccucaugaggcu

SEQ ID NO: 1032506 - RNA, 18 nt, Homo sapiens
ugaauccucaugaggcuu

SEQ ID NO: 1032507 - RNA, 13 nt, Homo sapiens
ugaaucuauuaua

SEQ ID NO: 1032508 - RNA, 17 nt, Homo sapiens
ugaaucuauuauacugu

SEQ ID NO: 1032509 - RNA, 21 nt, Homo sapiens
ugaaugaaacccccacacaca

SEQ ID NO: 1032510 - RNA, 14 nt, Homo sapiens
ugaaugauaaacuc

SEQ ID NO: 1032511 - RNA, 14 nt, Homo sapiens
ugaaugcaaaguag

SEQ ID NO: 1032512 - RNA, 18 nt, Homo sapiens
ugaaugcacacuagccuc

SEQ ID NO: 1032513 - RNA, 16 nt, Homo sapiens
ugaaugcuccagucaa

SEQ ID NO: 1032514 - RNA, 12 nt, Homo sapiens
ugaaugcuuccu

SEQ ID NO: 1032515 - RNA, 17 nt, Homo sapiens
ugaaugggcaaaacuga

SEQ ID NO: 1032516 - RNA, 15 nt, Homo sapiens
ugaauguaaaaugca

SEQ ID NO: 1032517 - RNA, 15 nt, Homo sapiens
ugaauguaugugcac

SEQ ID NO: 1032518 - RNA, 22 nt, Homo sapiens
ugaauuacaguugaaagcugua

SEQ ID NO: 1032519 - RNA, 15 nt, Homo sapiens
ugaauucauaucgcc

SEQ ID NO: 1032520 - RNA, 14 nt, Homo sapiens
ugaauuucaguaaa

SEQ ID NO: 1032521 - RNA, 18 nt, Homo sapiens
ugaauuugccuuccucau

SEQ ID NO: 1032522 - RNA, 20 nt, Homo sapiens
ugacaaccgaguggcuguca

SEQ ID NO: 1032523 - RNA, 15 nt, Homo sapiens
ugacaacuuugccag

SEQ ID NO: 1032524 - RNA, 17 nt, Homo sapiens
ugacaaggccccagaga

SEQ ID NO: 1032525 - RNA, 22 nt, Homo sapiens
ugacaaggggcaguggugguuu

SEQ ID NO: 1032526 - RNA, 23 nt, Homo sapiens
ugacaaucaacucuaauagugcu

SEQ ID NO: 1032527 - RNA, 14 nt, Homo sapiens
ugacacauaugcac

SEQ ID NO: 1032528 - RNA, 14 nt, Homo sapiens
ugacaccagccuuu

SEQ ID NO: 1032529 - RNA, 19 nt, Homo sapiens
ugacaccauuuuccugccu

SEQ ID NO: 1032530 - RNA, 21 nt, Homo sapiens
ugacacccauugggcccuucc

SEQ ID NO: 1032531 - RNA, 19 nt, Homo sapiens
ugacacuagcuaauaucaa

SEQ ID NO: 1032532 - RNA, 23 nt, Homo sapiens
ugacagaaagcagauaccucacc

SEQ ID NO: 1032533 - RNA, 18 nt, Homo sapiens
ugacagaguucacuauaa

SEQ ID NO: 1032534 - RNA, 20 nt, Homo sapiens
ugacagaucaagcugugaga

SEQ ID NO: 1032535 - RNA, 17 nt, Homo sapiens
ugacagcaggugggaaa

SEQ ID NO: 1032536 - RNA, 22 nt, Homo sapiens
ugacagcugaccuuugucaucu

SEQ ID NO: 1032537 - RNA, 13 nt, Homo sapiens
ugacagcuuuauc

SEQ ID NO: 1032538 - RNA, 18 nt, Homo sapiens
ugacaguaaaucacacaa

SEQ ID NO: 1032539 - RNA, 17 nt, Homo sapiens
ugacaguaaaucucaca

SEQ ID NO: 1032540 - RNA, 16 nt, Homo sapiens
ugacagucuugugcuu

SEQ ID NO: 1032541 - RNA, 15 nt, Homo sapiens
ugacaucaguggcau

SEQ ID NO: 1032542 - RNA, 14 nt, Homo sapiens
ugacaucucagggg

SEQ ID NO: 1032543 - RNA, 16 nt, Homo sapiens
ugacaucucugcaauc

SEQ ID NO: 1032544 - RNA, 12 nt, Homo sapiens
ugacaugugcuu

SEQ ID NO: 1032545 - RNA, 15 nt, Homo sapiens
ugacauuauaugcac

SEQ ID NO: 1032546 - RNA, 20 nt, Homo sapiens
ugacauuccuaaacuaucuu

SEQ ID NO: 1032547 - RNA, 13 nt, Homo sapiens
ugacauugauaca

SEQ ID NO: 1032548 - RNA, 14 nt, Homo sapiens
ugacauuguuggcc

SEQ ID NO: 1032549 - RNA, 20 nt, Homo sapiens
ugaccaaaacaaacaaacag

SEQ ID NO: 1032550 - RNA, 15 nt, Homo sapiens
ugaccaagcaggaag

SEQ ID NO: 1032551 - RNA, 24 nt, Homo sapiens
ugaccaaguuauaaaucaauguca

SEQ ID NO: 1032552 - RNA, 22 nt, Homo sapiens
ugaccaauauuauacuaagaaa

SEQ ID NO: 1032553 - RNA, 22 nt, Homo sapiens
ugaccacucuuccugaguucag

SEQ ID NO: 1032554 - RNA, 21 nt, Homo sapiens
ugaccagcagaucccagcuca

SEQ ID NO: 1032555 - RNA, 22 nt, Homo sapiens
ugaccaggcauccuccacaaua

SEQ ID NO: 1032556 - RNA, 17 nt, Homo sapiens
ugaccaguuuaaccuga

SEQ ID NO: 1032557 - RNA, 14 nt, Homo sapiens
ugaccauagcuccu

SEQ ID NO: 1032558 - RNA, 15 nt, Homo sapiens
ugacccaaagaccaa

SEQ ID NO: 1032559 - RNA, 15 nt, Homo sapiens
ugacccaaugauuca

SEQ ID NO: 1032560 - RNA, 21 nt, Homo sapiens
ugacccacccuagaucuuccc

SEQ ID NO: 1032561 - RNA, 14 nt, Homo sapiens
ugacccagccuguu

SEQ ID NO: 1032562 - RNA, 22 nt, Homo sapiens
ugacccagucagaguugugcac

SEQ ID NO: 1032563 - RNA, 23 nt, Homo sapiens
ugaccccuguccccacacugacc

SEQ ID NO: 1032564 - RNA, 15 nt, Homo sapiens
ugaccuaguuuucca

SEQ ID NO: 1032565 - RNA, 18 nt, Homo sapiens
ugaccucauuuguaaaau

SEQ ID NO: 1032566 - RNA, 19 nt, Homo sapiens
ugaccugaggaagcgugaa

SEQ ID NO: 1032567 - RNA, 21 nt, Homo sapiens
ugaccugccaggcacacugag

SEQ ID NO: 1032568 - RNA, 17 nt, Homo sapiens
ugaccugccucccuuca

SEQ ID NO: 1032569 - RNA, 20 nt, Homo sapiens
ugaccuugcacaaacagccc

SEQ ID NO: 1032570 - RNA, 21 nt, Homo sapiens
ugaccuuguugcaugauguau

SEQ ID NO: 1032571 - RNA, 14 nt, Homo sapiens
ugaccuuugucuca

SEQ ID NO: 1032572 - RNA, 17 nt, Homo sapiens
ugacgaacuuccauggc

SEQ ID NO: 1032573 - RNA, 15 nt, Homo sapiens
ugacgacagugcauu

SEQ ID NO: 1032574 - RNA, 22 nt, Homo sapiens
ugacggggaggaaccacugcac

SEQ ID NO: 1032575 - RNA, 22 nt, Homo sapiens
ugacgucacuggaccacugggc

SEQ ID NO: 1032576 - RNA, 12 nt, Homo sapiens
ugacuaaacaac

SEQ ID NO: 1032577 - RNA, 19 nt, Homo sapiens
ugacuauggcuaccaaaaa

SEQ ID NO: 1032578 - RNA, 16 nt, Homo sapiens
ugacucacuuauccca

SEQ ID NO: 1032579 - RNA, 22 nt, Homo sapiens
ugacucagcauagauuguauaa

SEQ ID NO: 1032580 - RNA, 15 nt, Homo sapiens
ugacucaggacaucc

SEQ ID NO: 1032581 - RNA, 15 nt, Homo sapiens
ugacuccuaugaucu

SEQ ID NO: 1032582 - RNA, 19 nt, Homo sapiens
ugacuccucuaagccacuc

SEQ ID NO: 1032583 - RNA, 22 nt, Homo sapiens
ugacuccuuucucuaaaacugc

SEQ ID NO: 1032584 - RNA, 19 nt, Homo sapiens
ugacucgucugacugugug

SEQ ID NO: 1032585 - RNA, 16 nt, Homo sapiens
ugacucucagcagcua

SEQ ID NO: 1032586 - RNA, 13 nt, Homo sapiens
ugacucugagcua

SEQ ID NO: 1032587 - RNA, 16 nt, Homo sapiens
ugacugauggugaaau

SEQ ID NO: 1032588 - RNA, 18 nt, Homo sapiens
ugacugauguuacaucac

SEQ ID NO: 1032589 - RNA, 17 nt, Homo sapiens
ugacuggcacagucuuu

SEQ ID NO: 1032590 - RNA, 18 nt, Homo sapiens
ugacuuaguguacaugaa

SEQ ID NO: 1032591 - RNA, 14 nt, Homo sapiens
ugacuucaaugaua

SEQ ID NO: 1032592 - RNA, 15 nt, Homo sapiens
ugacuuccuuacuaa

SEQ ID NO: 1032593 - RNA, 16 nt, Homo sapiens
ugagaaaacuaaguca

SEQ ID NO: 1032594 - RNA, 18 nt, Homo sapiens
ugagaaagacuauucaaa

SEQ ID NO: 1032595 - RNA, 20 nt, Homo sapiens
ugagaaagccuucauaagcc

SEQ ID NO: 1032596 - RNA, 20 nt, Homo sapiens
ugagaacaccagagaccuca

SEQ ID NO: 1032597 - RNA, 12 nt, Homo sapiens
ugagaacacugu

SEQ ID NO: 1032598 - RNA, 18 nt, Homo sapiens
ugagaacuacucagggaa

SEQ ID NO: 1032599 - RNA, 13 nt, Homo sapiens
ugagaacucugcc

SEQ ID NO: 1032600 - RNA, 20 nt, Homo sapiens
ugagaacucugcccaggugu

SEQ ID NO: 1032601 - RNA, 17 nt, Homo sapiens
ugagaagugcacuuuaa

SEQ ID NO: 1032602 - RNA, 18 nt, Homo sapiens
ugagacagcucugcauac

SEQ ID NO: 1032603 - RNA, 20 nt, Homo sapiens
ugagacaguuucuuagcuuu

SEQ ID NO: 1032604 - RNA, 22 nt, Homo sapiens
ugagaccagccugggcagcaua

SEQ ID NO: 1032605 - RNA, 18 nt, Homo sapiens
ugagaccuggcagccaca

SEQ ID NO: 1032606 - RNA, 16 nt, Homo sapiens
ugagacuccgucacaa

SEQ ID NO: 1032607 - RNA, 17 nt, Homo sapiens
ugagacucugucucaaa

SEQ ID NO: 1032608 - RNA, 13 nt, Homo sapiens
ugagagaaccuca

SEQ ID NO: 1032609 - RNA, 15 nt, Homo sapiens
ugagagacaggacua

SEQ ID NO: 1032610 - RNA, 14 nt, Homo sapiens
ugagagcauucugc

SEQ ID NO: 1032611 - RNA, 20 nt, Homo sapiens
ugagagcccuucaugcauuu

SEQ ID NO: 1032612 - RNA, 19 nt, Homo sapiens
ugagagcugcucuggaaaa

SEQ ID NO: 1032613 - RNA, 14 nt, Homo sapiens
ugagaggcaaugau

SEQ ID NO: 1032614 - RNA, 14 nt, Homo sapiens
ugagaggcucugug

SEQ ID NO: 1032615 - RNA, 13 nt, Homo sapiens
ugagagggugcua

SEQ ID NO: 1032616 - RNA, 11 nt, Homo sapiens
ugagaguacac

SEQ ID NO: 1032617 - RNA, 17 nt, Homo sapiens
ugagauagcauugugaa

SEQ ID NO: 1032618 - RNA, 15 nt, Homo sapiens
ugagauccuuuaaau

SEQ ID NO: 1032619 - RNA, 23 nt, Homo sapiens
ugagauccuuuaaauccuuccau

SEQ ID NO: 1032620 - RNA, 23 nt, Homo sapiens
ugagaucuaaggaugucacaggg

SEQ ID NO: 1032621 - RNA, 14 nt, Homo sapiens
ugagaugauucaga

SEQ ID NO: 1032622 - RNA, 23 nt, Homo sapiens
ugagauugcaccacugcacucca

SEQ ID NO: 1032623 - RNA, 19 nt, Homo sapiens
ugagcaaagggaacaguga

SEQ ID NO: 1032624 - RNA, 14 nt, Homo sapiens
ugagcaaaggugau

SEQ ID NO: 1032625 - RNA, 14 nt, Homo sapiens
ugagcacacuuuag

SEQ ID NO: 1032626 - RNA, 20 nt, Homo sapiens
ugagcacauucuggcucagg

SEQ ID NO: 1032627 - RNA, 14 nt, Homo sapiens
ugagcauggagcug

SEQ ID NO: 1032628 - RNA, 11 nt, Homo sapiens
ugagcauuuag

SEQ ID NO: 1032629 - RNA, 17 nt, Homo sapiens
ugagcccacaaagccuu

SEQ ID NO: 1032630 - RNA, 22 nt, Homo sapiens
ugagcccacaaagccuuaucaa

SEQ ID NO: 1032631 - RNA, 16 nt, Homo sapiens
ugagccccuaccccac

SEQ ID NO: 1032632 - RNA, 15 nt, Homo sapiens
ugagccggguggauc

SEQ ID NO: 1032633 - RNA, 15 nt, Homo sapiens
ugagccuaauauuug

SEQ ID NO: 1032634 - RNA, 15 nt, Homo sapiens
ugagccucagaauaa

SEQ ID NO: 1032635 - RNA, 20 nt, Homo sapiens
ugagcgacaaagaugauuua

SEQ ID NO: 1032636 - RNA, 14 nt, Homo sapiens
ugagcuaaucuuca

SEQ ID NO: 1032637 - RNA, 22 nt, Homo sapiens
ugagcuauuuccauuccagaau

SEQ ID NO: 1032638 - RNA, 15 nt, Homo sapiens
ugagcuguugccuca

SEQ ID NO: 1032639 - RNA, 14 nt, Homo sapiens
ugagcuuagugaaa

SEQ ID NO: 1032640 - RNA, 23 nt, Homo sapiens
ugagcuuggccagaagggggcca

SEQ ID NO: 1032641 - RNA, 21 nt, Homo sapiens
ugaggaaaagcggacaucagc

SEQ ID NO: 1032642 - RNA, 17 nt, Homo sapiens
ugaggaaagcauguauu

SEQ ID NO: 1032643 - RNA, 15 nt, Homo sapiens
ugaggaacccuuaca

SEQ ID NO: 1032644 - RNA, 17 nt, Homo sapiens
ugaggaauauuugcaag

SEQ ID NO: 1032645 - RNA, 15 nt, Homo sapiens
ugaggacauguggaa

SEQ ID NO: 1032646 - RNA, 21 nt, Homo sapiens
ugaggacugaauuacucucca

SEQ ID NO: 1032647 - RNA, 13 nt, Homo sapiens
ugaggagucuugu

SEQ ID NO: 1032648 - RNA, 15 nt, Homo sapiens
ugaggaugagcugga

SEQ ID NO: 1032649 - RNA, 20 nt, Homo sapiens
ugaggcaaccacaggcagca

SEQ ID NO: 1032650 - RNA, 13 nt, Homo sapiens
ugaggcaggagaa

SEQ ID NO: 1032651 - RNA, 14 nt, Homo sapiens
ugaggccucucauu

SEQ ID NO: 1032652 - RNA, 21 nt, Homo sapiens
ugaggcggguggaucacuuga

SEQ ID NO: 1032653 - RNA, 18 nt, Homo sapiens
ugaggcuccugugcuacu

SEQ ID NO: 1032654 - RNA, 17 nt, Homo sapiens
ugaggcuuagcuuugcu

SEQ ID NO: 1032655 - RNA, 14 nt, Homo sapiens
ugaggcuucucagc

SEQ ID NO: 1032656 - RNA, 22 nt, Homo sapiens
ugaggcuuuaaaacuuauccuc

SEQ ID NO: 1032657 - RNA, 16 nt, Homo sapiens
ugagggaaaaugagua

SEQ ID NO: 1032658 - RNA, 16 nt, Homo sapiens
ugaggggcuccuggaa

SEQ ID NO: 1032659 - RNA, 18 nt, Homo sapiens
ugaggggcucucucauga

SEQ ID NO: 1032660 - RNA, 11 nt, Homo sapiens
ugagggucccc

SEQ ID NO: 1032661 - RNA, 21 nt, Homo sapiens
ugaggguccucaguccacugc

SEQ ID NO: 1032662 - RNA, 20 nt, Homo sapiens
ugagggugacuauggagcug

SEQ ID NO: 1032663 - RNA, 19 nt, Homo sapiens
ugaggguuucugagcugcu

SEQ ID NO: 1032664 - RNA, 20 nt, Homo sapiens
ugaguaagaaaugcugccca

SEQ ID NO: 1032665 - RNA, 19 nt, Homo sapiens
ugaguaaugguuacuaggc

SEQ ID NO: 1032666 - RNA, 13 nt, Homo sapiens
ugaguacccaaaa

SEQ ID NO: 1032667 - RNA, 20 nt, Homo sapiens
ugaguagcuggauuacaggc

SEQ ID NO: 1032668 - RNA, 22 nt, Homo sapiens
ugaguagcuggauuacaggcau

SEQ ID NO: 1032669 - RNA, 13 nt, Homo sapiens
ugaguaucuccuc

SEQ ID NO: 1032670 - RNA, 20 nt, Homo sapiens
ugagucaccaagcccaguua

SEQ ID NO: 1032671 - RNA, 16 nt, Homo sapiens
ugagucccagagccaa

SEQ ID NO: 1032672 - RNA, 18 nt, Homo sapiens
ugagucucaaguuuuauu

SEQ ID NO: 1032673 - RNA, 19 nt, Homo sapiens
ugagugccuguaaucacag

SEQ ID NO: 1032674 - RNA, 15 nt, Homo sapiens
ugagugcgugcucag

SEQ ID NO: 1032675 - RNA, 17 nt, Homo sapiens
ugaguggaugauguuuc

SEQ ID NO: 1032676 - RNA, 22 nt, Homo sapiens
ugagugguguguguuaucagau

SEQ ID NO: 1032677 - RNA, 15 nt, Homo sapiens
ugagugugugcaagu

SEQ ID NO: 1032678 - RNA, 17 nt, Homo sapiens
ugaguguugcucucuag

SEQ ID NO: 1032679 - RNA, 22 nt, Homo sapiens
ugaguuacuuccuaucaagcca

SEQ ID NO: 1032680 - RNA, 19 nt, Homo sapiens
ugaguuaggcugagccaca

SEQ ID NO: 1032681 - RNA, 19 nt, Homo sapiens
ugaguugcccaucuuguuu

SEQ ID NO: 1032682 - RNA, 15 nt, Homo sapiens
ugaguuuguacaguc

SEQ ID NO: 1032683 - RNA, 14 nt, Homo sapiens
ugaguuuucagugg

SEQ ID NO: 1032684 - RNA, 21 nt, Homo sapiens
ugaguuuuugauagcuuuauu

SEQ ID NO: 1032685 - RNA, 17 nt, Homo sapiens
ugauaagcugagcuccu

SEQ ID NO: 1032686 - RNA, 20 nt, Homo sapiens
ugauacaaauugcagacugu

SEQ ID NO: 1032687 - RNA, 19 nt, Homo sapiens
ugauacaagaaagcaaugc

SEQ ID NO: 1032688 - RNA, 19 nt, Homo sapiens
ugauacaguugcauguuau

SEQ ID NO: 1032689 - RNA, 14 nt, Homo sapiens
ugauacauauguga

SEQ ID NO: 1032690 - RNA, 21 nt, Homo sapiens
ugauacuguacauagcuguuu

SEQ ID NO: 1032691 - RNA, 16 nt, Homo sapiens
ugauagaguguuauca

SEQ ID NO: 1032692 - RNA, 20 nt, Homo sapiens
ugauagauuucuacacugag

SEQ ID NO: 1032693 - RNA, 13 nt, Homo sapiens
ugauagccuuccg

SEQ ID NO: 1032694 - RNA, 11 nt, Homo sapiens
ugauagcuuua

SEQ ID NO: 1032695 - RNA, 21 nt, Homo sapiens
ugauauagaacagugcuugcc

SEQ ID NO: 1032696 - RNA, 17 nt, Homo sapiens
ugauauauaaaugugau

SEQ ID NO: 1032697 - RNA, 21 nt, Homo sapiens
ugauauauaaaugugauugca

SEQ ID NO: 1032698 - RNA, 14 nt, Homo sapiens
ugauauauauaugc

SEQ ID NO: 1032699 - RNA, 23 nt, Homo sapiens
ugauauuucccuccccuggggac

SEQ ID NO: 1032700 - RNA, 15 nt, Homo sapiens
ugauauuuuccaaau

SEQ ID NO: 1032701 - RNA, 14 nt, Homo sapiens
ugaucaaugaauaa

SEQ ID NO: 1032702 - RNA, 15 nt, Homo sapiens
ugaucacaauuugca

SEQ ID NO: 1032703 - RNA, 15 nt, Homo sapiens
ugaucacagacacca

SEQ ID NO: 1032704 - RNA, 20 nt, Homo sapiens
ugaucagcgccgcaccagcc

SEQ ID NO: 1032705 - RNA, 18 nt, Homo sapiens
ugaucaguaugaaaaugu

SEQ ID NO: 1032706 - RNA, 13 nt, Homo sapiens
ugaucauuugccc

SEQ ID NO: 1032707 - RNA, 21 nt, Homo sapiens
ugauccacagaaauacaugaa

SEQ ID NO: 1032708 - RNA, 13 nt, Homo sapiens
ugauccacccacc

SEQ ID NO: 1032709 - RNA, 17 nt, Homo sapiens
ugauccacccaccucag

SEQ ID NO: 1032710 - RNA, 17 nt, Homo sapiens
ugauccacuucucucag

SEQ ID NO: 1032711 - RNA, 16 nt, Homo sapiens
ugauccagagcacaga

SEQ ID NO: 1032712 - RNA, 18 nt, Homo sapiens
ugauccagagcacagauc

SEQ ID NO: 1032713 - RNA, 22 nt, Homo sapiens
ugauccguguguaccaucuuug

SEQ ID NO: 1032714 - RNA, 18 nt, Homo sapiens
ugauccuaaugaaugcau

SEQ ID NO: 1032715 - RNA, 20 nt, Homo sapiens
ugauccuaaugaaugcauaa

SEQ ID NO: 1032716 - RNA, 18 nt, Homo sapiens
ugauccugcaauuccacu

SEQ ID NO: 1032717 - RNA, 17 nt, Homo sapiens
ugaucuaccugccucag

SEQ ID NO: 1032718 - RNA, 19 nt, Homo sapiens
ugaucucggcucacugcaa

SEQ ID NO: 1032719 - RNA, 12 nt, Homo sapiens
ugaucugaugca

SEQ ID NO: 1032720 - RNA, 12 nt, Homo sapiens
ugaucuugagca

SEQ ID NO: 1032721 - RNA, 23 nt, Homo sapiens
ugaugaggccucuuggaccucug

SEQ ID NO: 1032722 - RNA, 17 nt, Homo sapiens
ugaugauuaauucaccu

SEQ ID NO: 1032723 - RNA, 20 nt, Homo sapiens
ugaugcaagcaagaaacacu

SEQ ID NO: 1032724 - RNA, 13 nt, Homo sapiens
ugaugccaagaaa

SEQ ID NO: 1032725 - RNA, 22 nt, Homo sapiens
ugaugcugccaggccugggacc

SEQ ID NO: 1032726 - RNA, 17 nt, Homo sapiens
ugaugcuggucaucgca

SEQ ID NO: 1032727 - RNA, 21 nt, Homo sapiens
ugauggagauauuuacaugaa

SEQ ID NO: 1032728 - RNA, 17 nt, Homo sapiens
ugauggagucagguuug

SEQ ID NO: 1032729 - RNA, 21 nt, Homo sapiens
ugauggcaccacugcacucca

SEQ ID NO: 1032730 - RNA, 21 nt, Homo sapiens
ugauggggaguaaacccugga

SEQ ID NO: 1032731 - RNA, 17 nt, Homo sapiens
ugaugucguuugaauca

SEQ ID NO: 1032732 - RNA, 15 nt, Homo sapiens
ugaugugaaacauua

SEQ ID NO: 1032733 - RNA, 20 nt, Homo sapiens
ugaugugagcuuggacuugc

SEQ ID NO: 1032734 - RNA, 14 nt, Homo sapiens
ugauguuacuguau

SEQ ID NO: 1032735 - RNA, 11 nt, Homo sapiens
ugauguugcug

SEQ ID NO: 1032736 - RNA, 16 nt, Homo sapiens
ugauuagccauuugac

SEQ ID NO: 1032737 - RNA, 15 nt, Homo sapiens
ugauuauagugacaa

SEQ ID NO: 1032738 - RNA, 15 nt, Homo sapiens
ugauucacaguguga

SEQ ID NO: 1032739 - RNA, 16 nt, Homo sapiens
ugauucagacagcugc

SEQ ID NO: 1032740 - RNA, 16 nt, Homo sapiens
ugauucccuccugcua

SEQ ID NO: 1032741 - RNA, 22 nt, Homo sapiens
ugauucccuccugcuacucugu

SEQ ID NO: 1032742 - RNA, 21 nt, Homo sapiens
ugauugaguccuuucuuccau

SEQ ID NO: 1032743 - RNA, 17 nt, Homo sapiens
ugauugucagcuacuaa

SEQ ID NO: 1032744 - RNA, 13 nt, Homo sapiens
ugauugugauuau

SEQ ID NO: 1032745 - RNA, 20 nt, Homo sapiens
ugauuuaaaagggaagucua

SEQ ID NO: 1032746 - RNA, 14 nt, Homo sapiens
ugauuuaaaucagc

SEQ ID NO: 1032747 - RNA, 13 nt, Homo sapiens
ugauuuaagacac

SEQ ID NO: 1032748 - RNA, 18 nt, Homo sapiens
ugauuugucccuaugcau

SEQ ID NO: 1032749 - RNA, 17 nt, Homo sapiens
ugauuuugaaaccauga

SEQ ID NO: 1032750 - RNA, 14 nt, Homo sapiens
ugcaaaaacagagg

SEQ ID NO: 1032751 - RNA, 16 nt, Homo sapiens
ugcaaaauccugguga

SEQ ID NO: 1032752 - RNA, 13 nt, Homo sapiens
ugcaaacuuuauu

SEQ ID NO: 1032753 - RNA, 16 nt, Homo sapiens
ugcaaagauuugcuuu

SEQ ID NO: 1032754 - RNA, 16 nt, Homo sapiens
ugcaaaggaaauacca

SEQ ID NO: 1032755 - RNA, 20 nt, Homo sapiens
ugcaaaggaaauaccaguuc

SEQ ID NO: 1032756 - RNA, 19 nt, Homo sapiens
ugcaaaggcgucugaaugu

SEQ ID NO: 1032757 - RNA, 21 nt, Homo sapiens
ugcaaauccuugauacugcuc

SEQ ID NO: 1032758 - RNA, 14 nt, Homo sapiens
ugcaacagcacugg

SEQ ID NO: 1032759 - RNA, 16 nt, Homo sapiens
ugcaacaguagcauag

SEQ ID NO: 1032760 - RNA, 16 nt, Homo sapiens
ugcaacuucaugucaa

SEQ ID NO: 1032761 - RNA, 15 nt, Homo sapiens
ugcaagagacucugg

SEQ ID NO: 1032762 - RNA, 12 nt, Homo sapiens
ugcaagauucca

SEQ ID NO: 1032763 - RNA, 11 nt, Homo sapiens
ugcaagcuuuu

SEQ ID NO: 1032764 - RNA, 18 nt, Homo sapiens
ugcaaggggaaaaucuca

SEQ ID NO: 1032765 - RNA, 23 nt, Homo sapiens
ugcaagugugugcacaugugugc

SEQ ID NO: 1032766 - RNA, 19 nt, Homo sapiens
ugcaauaaaagugcuuuau

SEQ ID NO: 1032767 - RNA, 17 nt, Homo sapiens
ugcaauagaacagagaa

SEQ ID NO: 1032768 - RNA, 14 nt, Homo sapiens
ugcaauauguauua

SEQ ID NO: 1032769 - RNA, 14 nt, Homo sapiens
ugcaaucuguguuc

SEQ ID NO: 1032770 - RNA, 23 nt, Homo sapiens
ugcaaucuguguucgauggcuca

SEQ ID NO: 1032771 - RNA, 12 nt, Homo sapiens
ugcaauuccacu

SEQ ID NO: 1032772 - RNA, 18 nt, Homo sapiens
ugcacaaacucaccaucu

SEQ ID NO: 1032773 - RNA, 17 nt, Homo sapiens
ugcacaaagcccuucca

SEQ ID NO: 1032774 - RNA, 12 nt, Homo sapiens
ugcacacaaaac

SEQ ID NO: 1032775 - RNA, 14 nt, Homo sapiens
ugcacacaaaacaa

SEQ ID NO: 1032776 - RNA, 16 nt, Homo sapiens
ugcacacucacuugua

SEQ ID NO: 1032777 - RNA, 21 nt, Homo sapiens
ugcacacucacuuguaagaaa

SEQ ID NO: 1032778 - RNA, 21 nt, Homo sapiens
ugcacacugccuggcccaaaa

SEQ ID NO: 1032779 - RNA, 17 nt, Homo sapiens
ugcacaggucccacugc

SEQ ID NO: 1032780 - RNA, 23 nt, Homo sapiens
ugcacaugucuuguacaugugua

SEQ ID NO: 1032781 - RNA, 17 nt, Homo sapiens
ugcacauuuaugaauca

SEQ ID NO: 1032782 - RNA, 14 nt, Homo sapiens
ugcaccacugcacu

SEQ ID NO: 1032783 - RNA, 23 nt, Homo sapiens
ugcacccaccuuucugcacauaa

SEQ ID NO: 1032784 - RNA, 20 nt, Homo sapiens
ugcaccgagagagauggaau

SEQ ID NO: 1032785 - RNA, 22 nt, Homo sapiens
ugcaccuugugucuguacacgu

SEQ ID NO: 1032786 - RNA, 20 nt, Homo sapiens
ugcacuccagccugggcaac

SEQ ID NO: 1032787 - RNA, 23 nt, Homo sapiens
ugcacucuaaaagguucagggaa

SEQ ID NO: 1032788 - RNA, 15 nt, Homo sapiens
ugcacugagggccac

SEQ ID NO: 1032789 - RNA, 21 nt, Homo sapiens
ugcacuguucccccugugcag

SEQ ID NO: 1032790 - RNA, 21 nt, Homo sapiens
ugcacuugcacgcccaugugu

SEQ ID NO: 1032791 - RNA, 17 nt, Homo sapiens
ugcagaaacaguucacc

SEQ ID NO: 1032792 - RNA, 18 nt, Homo sapiens
ugcagaauccaaaguaaa

SEQ ID NO: 1032793 - RNA, 16 nt, Homo sapiens
ugcagaccgccccuca

SEQ ID NO: 1032794 - RNA, 20 nt, Homo sapiens
ugcagacucuacagaggcca

SEQ ID NO: 1032795 - RNA, 13 nt, Homo sapiens
ugcagagagccau

SEQ ID NO: 1032796 - RNA, 21 nt, Homo sapiens
ugcagagcgccgugaguucuc

SEQ ID NO: 1032797 - RNA, 12 nt, Homo sapiens
ugcagagucaau

SEQ ID NO: 1032798 - RNA, 23 nt, Homo sapiens
ugcagcagcgguggccucuuuuc

SEQ ID NO: 1032799 - RNA, 22 nt, Homo sapiens
ugcagcagugagucucuucaga

SEQ ID NO: 1032800 - RNA, 19 nt, Homo sapiens
ugcagcccagaauagcuuu

SEQ ID NO: 1032801 - RNA, 22 nt, Homo sapiens
ugcagcccccauuguggucaca

SEQ ID NO: 1032802 - RNA, 16 nt, Homo sapiens
ugcagccucaaccucc

SEQ ID NO: 1032803 - RNA, 13 nt, Homo sapiens
ugcagcuaucugg

SEQ ID NO: 1032804 - RNA, 14 nt, Homo sapiens
ugcagcucagggac

SEQ ID NO: 1032805 - RNA, 20 nt, Homo sapiens
ugcagcuggaaaagggucuu

SEQ ID NO: 1032806 - RNA, 15 nt, Homo sapiens
ugcagcuuauauuca

SEQ ID NO: 1032807 - RNA, 20 nt, Homo sapiens
ugcaggacccugaucuuuug

SEQ ID NO: 1032808 - RNA, 17 nt, Homo sapiens
ugcaggagagacaguga

SEQ ID NO: 1032809 - RNA, 21 nt, Homo sapiens
ugcaggauuuguuguucugac

SEQ ID NO: 1032810 - RNA, 18 nt, Homo sapiens
ugcaggcaugcaugugcu

SEQ ID NO: 1032811 - RNA, 15 nt, Homo sapiens
ugcaggccccagcaa

SEQ ID NO: 1032812 - RNA, 20 nt, Homo sapiens
ugcagucacagcuacacaga

SEQ ID NO: 1032813 - RNA, 13 nt, Homo sapiens
ugcagugcuucca

SEQ ID NO: 1032814 - RNA, 19 nt, Homo sapiens
ugcaguggcccccacagaa

SEQ ID NO: 1032815 - RNA, 20 nt, Homo sapiens
ugcaguggcccccacagaaa

SEQ ID NO: 1032816 - RNA, 17 nt, Homo sapiens
ugcaguggcgugaucuc

SEQ ID NO: 1032817 - RNA, 18 nt, Homo sapiens
ugcagugguaugaucacg

SEQ ID NO: 1032818 - RNA, 19 nt, Homo sapiens
ugcaguucaccugcacuua

SEQ ID NO: 1032819 - RNA, 18 nt, Homo sapiens
ugcaguucagcaccaccc

SEQ ID NO: 1032820 - RNA, 22 nt, Homo sapiens
ugcaguuuuugccuggguccca

SEQ ID NO: 1032821 - RNA, 22 nt, Homo sapiens
ugcauaaaugcgauccacagaa

SEQ ID NO: 1032822 - RNA, 16 nt, Homo sapiens
ugcauaagugcaugac

SEQ ID NO: 1032823 - RNA, 16 nt, Homo sapiens
ugcauacacacacaca

SEQ ID NO: 1032824 - RNA, 22 nt, Homo sapiens
ugcauaggugaucucauuuaau

SEQ ID NO: 1032825 - RNA, 14 nt, Homo sapiens
ugcauaguauucca

SEQ ID NO: 1032826 - RNA, 16 nt, Homo sapiens
ugcauagucauguaag

SEQ ID NO: 1032827 - RNA, 13 nt, Homo sapiens
ugcauauauacau

SEQ ID NO: 1032828 - RNA, 19 nt, Homo sapiens
ugcauauguaaggaaguca

SEQ ID NO: 1032829 - RNA, 15 nt, Homo sapiens
ugcauauguaugacu

SEQ ID NO: 1032830 - RNA, 15 nt, Homo sapiens
ugcauauucuuaugu

SEQ ID NO: 1032831 - RNA, 14 nt, Homo sapiens
ugcaucguggagac

SEQ ID NO: 1032832 - RNA, 15 nt, Homo sapiens
ugcaucuguacucac

SEQ ID NO: 1032833 - RNA, 20 nt, Homo sapiens
ugcaugaaacauguucucaa

SEQ ID NO: 1032834 - RNA, 16 nt, Homo sapiens
ugcaugcagcaucuaa

SEQ ID NO: 1032835 - RNA, 23 nt, Homo sapiens
ugcaugccuggcacaacaucaag

SEQ ID NO: 1032836 - RNA, 16 nt, Homo sapiens
ugcauggauacuacag

SEQ ID NO: 1032837 - RNA, 14 nt, Homo sapiens
ugcauggcuccaga

SEQ ID NO: 1032838 - RNA, 19 nt, Homo sapiens
ugcauguacccuaagguca

SEQ ID NO: 1032839 - RNA, 12 nt, Homo sapiens
ugcaugugaaga

SEQ ID NO: 1032840 - RNA, 22 nt, Homo sapiens
ugcaugugugcgagugugugca

SEQ ID NO: 1032841 - RNA, 16 nt, Homo sapiens
ugcaugugugugcuca

SEQ ID NO: 1032842 - RNA, 16 nt, Homo sapiens
ugcauugugaggguua

SEQ ID NO: 1032843 - RNA, 20 nt, Homo sapiens
ugcauuuaaaacagacacug

SEQ ID NO: 1032844 - RNA, 23 nt, Homo sapiens
ugcauuuaaauacagucuuccau

SEQ ID NO: 1032845 - RNA, 24 nt, Homo sapiens
ugugcucugaucauccacugugcc

SEQ ID NO: 1032846 - RNA, 21 nt, Homo sapiens
ugugcuucuuaaaauagccau

SEQ ID NO: 1032847 - RNA, 23 nt, Homo sapiens
uguggaauauaaagauggcugac

SEQ ID NO: 1032848 - RNA, 17 nt, Homo sapiens
uguggaaucuggaguga

SEQ ID NO: 1032849 - RNA, 13 nt, Homo sapiens
uguggacacagcu

SEQ ID NO: 1032850 - RNA, 18 nt, Homo sapiens
uguggaggagcucaggac

SEQ ID NO: 1032851 - RNA, 21 nt, Homo sapiens
uguggaucaaccaucgcuuua

SEQ ID NO: 1032852 - RNA, 18 nt, Homo sapiens
uguggaugauaaaacaca

SEQ ID NO: 1032853 - RNA, 14 nt, Homo sapiens
uguggcccaagaca

SEQ ID NO: 1032854 - RNA, 20 nt, Homo sapiens
uguggccuucggacaacuca

SEQ ID NO: 1032855 - RNA, 21 nt, Homo sapiens
uguggcugcuagcacuuggag

SEQ ID NO: 1032856 - RNA, 13 nt, Homo sapiens
uguggcuucuuaa

SEQ ID NO: 1032857 - RNA, 15 nt, Homo sapiens
ugugggaaauccaca

SEQ ID NO: 1032858 - RNA, 13 nt, Homo sapiens
ugugggacugaga

SEQ ID NO: 1032859 - RNA, 17 nt, Homo sapiens
ugugggagccugcaaac

SEQ ID NO: 1032860 - RNA, 15 nt, Homo sapiens
ugugggcuccauuca

SEQ ID NO: 1032861 - RNA, 24 nt, Homo sapiens
ugugggucuauguaaaugcaucug

SEQ ID NO: 1032862 - RNA, 18 nt, Homo sapiens
ugugggugggaccacaga

SEQ ID NO: 1032863 - RNA, 16 nt, Homo sapiens
ugugguacaaucucaa

SEQ ID NO: 1032864 - RNA, 13 nt, Homo sapiens
uguggucaauccg

SEQ ID NO: 1032865 - RNA, 20 nt, Homo sapiens
ugugguccacugagcuauaa

SEQ ID NO: 1032866 - RNA, 21 nt, Homo sapiens
ugugguuuucagccuuucuaa

SEQ ID NO: 1032867 - RNA, 13 nt, Homo sapiens
uguguacagggaa

SEQ ID NO: 1032868 - RNA, 16 nt, Homo sapiens
uguguauguuugcaca

SEQ ID NO: 1032869 - RNA, 19 nt, Homo sapiens
uguguccaagugugugugc

SEQ ID NO: 1032870 - RNA, 17 nt, Homo sapiens
uguguccaugugugugc

SEQ ID NO: 1032871 - RNA, 16 nt, Homo sapiens
ugugucccuccuggga

SEQ ID NO: 1032872 - RNA, 16 nt, Homo sapiens
uguguccuugugcaug

SEQ ID NO: 1032873 - RNA, 13 nt, Homo sapiens
ugugucuguacac

SEQ ID NO: 1032874 - RNA, 21 nt, Homo sapiens
ugugugagugugugcaaguau

SEQ ID NO: 1032875 - RNA, 18 nt, Homo sapiens
ugugugaucugugggcac

SEQ ID NO: 1032876 - RNA, 20 nt, Homo sapiens
ugugugcaagugugugcaca

SEQ ID NO: 1032877 - RNA, 14 nt, Homo sapiens
uguguggacuguga

SEQ ID NO: 1032878 - RNA, 14 nt, Homo sapiens
ugugugggcuguga

SEQ ID NO: 1032879 - RNA, 12 nt, Homo sapiens
ugugugggucua

SEQ ID NO: 1032880 - RNA, 15 nt, Homo sapiens
ugugugugcaagugu

SEQ ID NO: 1032881 - RNA, 16 nt, Homo sapiens
ugugugugcguguguc

SEQ ID NO: 1032882 - RNA, 15 nt, Homo sapiens
uguguucaguacaau

SEQ ID NO: 1032883 - RNA, 20 nt, Homo sapiens
uguguuccaacaaccauuuu

SEQ ID NO: 1032884 - RNA, 18 nt, Homo sapiens
uguguucucuauugcugc

SEQ ID NO: 1032885 - RNA, 14 nt, Homo sapiens
uguguuuccuucag

SEQ ID NO: 1032886 - RNA, 20 nt, Homo sapiens
uguguuuuauugacaucucu

SEQ ID NO: 1032887 - RNA, 19 nt, Homo sapiens
uguguuuuguuuuguauca

SEQ ID NO: 1032888 - RNA, 22 nt, Homo sapiens
uguguuuuuucugccaccaaag

SEQ ID NO: 1032889 - RNA, 21 nt, Homo sapiens
uguuaacauggacaugaucuu

SEQ ID NO: 1032890 - RNA, 13 nt, Homo sapiens
uguuaagugcagu

SEQ ID NO: 1032891 - RNA, 16 nt, Homo sapiens
uguuacaccagccuuu

SEQ ID NO: 1032892 - RNA, 15 nt, Homo sapiens
uguuaccuccuauaa

SEQ ID NO: 1032893 - RNA, 15 nt, Homo sapiens
uguuacuauuccuuu

SEQ ID NO: 1032894 - RNA, 16 nt, Homo sapiens
uguuacucugguucuu

SEQ ID NO: 1032895 - RNA, 17 nt, Homo sapiens
uguuagugguuacccag

SEQ ID NO: 1032896 - RNA, 19 nt, Homo sapiens
uguuauaacucugcacuac

SEQ ID NO: 1032897 - RNA, 18 nt, Homo sapiens
uguuaucuaucaacuaua

SEQ ID NO: 1032898 - RNA, 22 nt, Homo sapiens
uguuauuuucuguugaaguuua

SEQ ID NO: 1032899 - RNA, 20 nt, Homo sapiens
uguucacagccagacuggca

SEQ ID NO: 1032900 - RNA, 13 nt, Homo sapiens
uguucagaugcuu

SEQ ID NO: 1032901 - RNA, 13 nt, Homo sapiens
uguuccauugaau

SEQ ID NO: 1032902 - RNA, 15 nt, Homo sapiens
uguucccaaauuuuc

SEQ ID NO: 1032903 - RNA, 16 nt, Homo sapiens
uguuccccaucaucug

SEQ ID NO: 1032904 - RNA, 18 nt, Homo sapiens
uguuccuuauauuuacuc

SEQ ID NO: 1032905 - RNA, 12 nt, Homo sapiens
uguucgacucag

SEQ ID NO: 1032906 - RNA, 22 nt, Homo sapiens
uguucuaaagguggugaggcaa

SEQ ID NO: 1032907 - RNA, 14 nt, Homo sapiens
uguucuaaguauuu

SEQ ID NO: 1032908 - RNA, 22 nt, Homo sapiens
uguucuaagucuuuccauugga

SEQ ID NO: 1032909 - RNA, 20 nt, Homo sapiens
uguucugacccugcuucaaa

SEQ ID NO: 1032910 - RNA, 16 nt, Homo sapiens
uguucugggacacagu

SEQ ID NO: 1032911 - RNA, 17 nt, Homo sapiens
uguugaaaauguucaga

SEQ ID NO: 1032912 - RNA, 15 nt, Homo sapiens
uguugagccuaauau

SEQ ID NO: 1032913 - RNA, 22 nt, Homo sapiens
uguugaggacaauuucauucca

SEQ ID NO: 1032914 - RNA, 23 nt, Homo sapiens
uguugaugaggcagaugccucua

SEQ ID NO: 1032915 - RNA, 13 nt, Homo sapiens
uguugcacccagc

SEQ ID NO: 1032916 - RNA, 21 nt, Homo sapiens
uguugcaugggcuaaugaaga

SEQ ID NO: 1032917 - RNA, 14 nt, Homo sapiens
uguugccuuuaugg

SEQ ID NO: 1032918 - RNA, 18 nt, Homo sapiens
uguuggaaaaugugcaau

SEQ ID NO: 1032919 - RNA, 19 nt, Homo sapiens
uguuggaaaaugugcaaua

SEQ ID NO: 1032920 - RNA, 17 nt, Homo sapiens
uguuggcaaaucagaug

SEQ ID NO: 1032921 - RNA, 15 nt, Homo sapiens
uguuggccaguguga

SEQ ID NO: 1032922 - RNA, 16 nt, Homo sapiens
uguuggggcaguggua

SEQ ID NO: 1032923 - RNA, 20 nt, Homo sapiens
uguuguguauagaugcaaga

SEQ ID NO: 1032924 - RNA, 21 nt, Homo sapiens
uguuguugagaauugugcuca

SEQ ID NO: 1032925 - RNA, 21 nt, Homo sapiens
uguuuaaaaucauuucugcau

SEQ ID NO: 1032926 - RNA, 19 nt, Homo sapiens
uguuuacagaggacaguau

SEQ ID NO: 1032927 - RNA, 23 nt, Homo sapiens
uguuuacauaucaccucauggcc

SEQ ID NO: 1032928 - RNA, 13 nt, Homo sapiens
uguuuacccagua

SEQ ID NO: 1032929 - RNA, 23 nt, Homo sapiens
uguuuaccuaaacuauaugccau

SEQ ID NO: 1032930 - RNA, 15 nt, Homo sapiens
uguuuauacagcuca

SEQ ID NO: 1032931 - RNA, 18 nt, Homo sapiens
uguuuccugugcaaguca

SEQ ID NO: 1032932 - RNA, 14 nt, Homo sapiens
uguuucuauucuaa

SEQ ID NO: 1032933 - RNA, 14 nt, Homo sapiens
uguuucugaucuga

SEQ ID NO: 1032934 - RNA, 19 nt, Homo sapiens
uguuugauaugaaguguua

SEQ ID NO: 1032935 - RNA, 16 nt, Homo sapiens
uguuugcacguuaugg

SEQ ID NO: 1032936 - RNA, 14 nt, Homo sapiens
uguuugcauaaagu

SEQ ID NO: 1032937 - RNA, 14 nt, Homo sapiens
uguuuuagauaucc

SEQ ID NO: 1032938 - RNA, 22 nt, Homo sapiens
uguuuuagcuccuugacuccuu

SEQ ID NO: 1032939 - RNA, 19 nt, Homo sapiens
uguuuuccuuugucaucau

SEQ ID NO: 1032940 - RNA, 13 nt, Homo sapiens
uguuuuuaagcug

SEQ ID NO: 1032941 - RNA, 19 nt, Homo sapiens
uguuuuuaauaaagacagg

SEQ ID NO: 1032942 - RNA, 20 nt, Homo sapiens
uguuuuuagcugguggcaau

SEQ ID NO: 1032943 - RNA, 19 nt, Homo sapiens
uuaaaaaaaaauacugaug

SEQ ID NO: 1032944 - RNA, 20 nt, Homo sapiens
uuaaaaaaaaauacugaugu

SEQ ID NO: 1032945 - RNA, 19 nt, Homo sapiens
uuaaaaaauaaaaacugac

SEQ ID NO: 1032946 - RNA, 12 nt, Homo sapiens
uuaaaaacuaaa

SEQ ID NO: 1032947 - RNA, 23 nt, Homo sapiens
uuaaaaacuaaaaagccaucuga

SEQ ID NO: 1032948 - RNA, 16 nt, Homo sapiens
uuaaaaaucuguaaau

SEQ ID NO: 1032949 - RNA, 18 nt, Homo sapiens
uuaaaaucugucacguag

SEQ ID NO: 1032950 - RNA, 15 nt, Homo sapiens
uuaaacaccuccuca

SEQ ID NO: 1032951 - RNA, 21 nt, Homo sapiens
uuaaacacggggcuugcaacu

SEQ ID NO: 1032952 - RNA, 21 nt, Homo sapiens
uuaaacccuauugguaaagaa

SEQ ID NO: 1032953 - RNA, 17 nt, Homo sapiens
uuaaacccucugccuuu

SEQ ID NO: 1032954 - RNA, 16 nt, Homo sapiens
uuaaacucagggacag

SEQ ID NO: 1032955 - RNA, 21 nt, Homo sapiens
uuaaacucagggagcauuuau

SEQ ID NO: 1032956 - RNA, 14 nt, Homo sapiens
uuaaacugauucau

SEQ ID NO: 1032957 - RNA, 13 nt, Homo sapiens
uuaaagccuccuc

SEQ ID NO: 1032958 - RNA, 17 nt, Homo sapiens
uuaaaggaauaaggugu

SEQ ID NO: 1032959 - RNA, 21 nt, Homo sapiens
uuaaagucagguccaauuugu

SEQ ID NO: 1032960 - RNA, 15 nt, Homo sapiens
uuaaaguuacuuugu

SEQ ID NO: 1032961 - RNA, 23 nt, Homo sapiens
uuaaauaaaucauaaaacuugau

SEQ ID NO: 1032962 - RNA, 19 nt, Homo sapiens
uuaaauaaaucauuaauac

SEQ ID NO: 1032963 - RNA, 19 nt, Homo sapiens
uuaaauaagauuuaauuca

SEQ ID NO: 1032964 - RNA, 20 nt, Homo sapiens
uuaaauaaugugaaacugga

SEQ ID NO: 1032965 - RNA, 13 nt, Homo sapiens
uuaaaucuugaua

SEQ ID NO: 1032966 - RNA, 15 nt, Homo sapiens
uuaaaucuugcaacu

SEQ ID NO: 1032967 - RNA, 16 nt, Homo sapiens
uuaaaugcucaucugg

SEQ ID NO: 1032968 - RNA, 18 nt, Homo sapiens
uuaaauuauacuggagaa

SEQ ID NO: 1032969 - RNA, 14 nt, Homo sapiens
uuaaauuaugggaa

SEQ ID NO: 1032970 - RNA, 22 nt, Homo sapiens
uuaaauucugaacaauucucuc

SEQ ID NO: 1032971 - RNA, 11 nt, Homo sapiens
uuaaauugcag

SEQ ID NO: 1032972 - RNA, 18 nt, Homo sapiens
uuaaauuuuauaugggcu

SEQ ID NO: 1032973 - RNA, 18 nt, Homo sapiens
uuaacauggacaugaucu

SEQ ID NO: 1032974 - RNA, 13 nt, Homo sapiens
uuaaccacugugg

SEQ ID NO: 1032975 - RNA, 22 nt, Homo sapiens
uuaaccaguucugucuucagcu

SEQ ID NO: 1032976 - RNA, 15 nt, Homo sapiens
uuaaccugaugcagu

SEQ ID NO: 1032977 - RNA, 19 nt, Homo sapiens
uuaacucaccucucaaggu

SEQ ID NO: 1032978 - RNA, 12 nt, Homo sapiens
uuaacucagauc

SEQ ID NO: 1032979 - RNA, 15 nt, Homo sapiens
uuaacugauguuacu

SEQ ID NO: 1032980 - RNA, 22 nt, Homo sapiens
uuaacuggcuucagccucccca

SEQ ID NO: 1032981 - RNA, 15 nt, Homo sapiens
uuaacuucagccagc

SEQ ID NO: 1032982 - RNA, 14 nt, Homo sapiens
uuaagagccauaua

SEQ ID NO: 1032983 - RNA, 15 nt, Homo sapiens
uuaagauaugauguc

SEQ ID NO: 1032984 - RNA, 14 nt, Homo sapiens
uuaagcacuacaua

SEQ ID NO: 1032985 - RNA, 16 nt, Homo sapiens
uuaagcgugucuguau

SEQ ID NO: 1032986 - RNA, 21 nt, Homo sapiens
uuaagcuuccgccgucucaac

SEQ ID NO: 1032987 - RNA, 18 nt, Homo sapiens
uuaaggaaaaauaaauau

SEQ ID NO: 1032988 - RNA, 21 nt, Homo sapiens
uuaaggaaacucuuaucucag

SEQ ID NO: 1032989 - RNA, 19 nt, Homo sapiens
uuaaggaugcuuguacaua

SEQ ID NO: 1032990 - RNA, 20 nt, Homo sapiens
uuaaggauuuuaugcuuuaa

SEQ ID NO: 1032991 - RNA, 19 nt, Homo sapiens
uuaagguaugguacaagca

SEQ ID NO: 1032992 - RNA, 22 nt, Homo sapiens
uuaaguaagcaacagcauaaca

SEQ ID NO: 1032993 - RNA, 23 nt, Homo sapiens
uuaauaaucagcaagaauuugau

SEQ ID NO: 1032994 - RNA, 17 nt, Homo sapiens
ucaucauacaugacuca

SEQ ID NO: 1032995 - RNA, 12 nt, Homo sapiens
ucaucauguauc

SEQ ID NO: 1032996 - RNA, 18 nt, Homo sapiens
ucaucauucucugucuca

SEQ ID NO: 1032997 - RNA, 13 nt, Homo sapiens
ucauccaccccau

SEQ ID NO: 1032998 - RNA, 19 nt, Homo sapiens
ucauccccaggggucccag

SEQ ID NO: 1032999 - RNA, 22 nt, Homo sapiens
ucauccuaaaaaguuccaugaa

SEQ ID NO: 1033000 - RNA, 13 nt, Homo sapiens
ucaucucagugcu

SEQ ID NO: 1033001 - RNA, 18 nt, Homo sapiens
ucaucucagugcuguaaa

SEQ ID NO: 1033002 - RNA, 14 nt, Homo sapiens
ucaucucuuuauuc

SEQ ID NO: 1033003 - RNA, 19 nt, Homo sapiens
ucaucugccaagcuccuca

SEQ ID NO: 1033004 - RNA, 19 nt, Homo sapiens
ucaucugggggaguggaau

SEQ ID NO: 1033005 - RNA, 23 nt, Homo sapiens
ucaucugugauucccuccugcua

SEQ ID NO: 1033006 - RNA, 23 nt, Homo sapiens
ucaucuuagugccugagaguauu

SEQ ID NO: 1033007 - RNA, 20 nt, Homo sapiens
ucaucuugaccaagcaggaa

SEQ ID NO: 1033008 - RNA, 12 nt, Homo sapiens
ucaucuugccac

SEQ ID NO: 1033009 - RNA, 15 nt, Homo sapiens
ucaugaaauaugcau

SEQ ID NO: 1033010 - RNA, 13 nt, Homo sapiens
ucaugaagauauu

SEQ ID NO: 1033011 - RNA, 17 nt, Homo sapiens
ucaugaagcccaaguga

SEQ ID NO: 1033012 - RNA, 22 nt, Homo sapiens
ucaugacaaauccuugaauguu

SEQ ID NO: 1033013 - RNA, 13 nt, Homo sapiens
ucaugcaucucca

SEQ ID NO: 1033014 - RNA, 19 nt, Homo sapiens
ucaugcauguccuguaaag

SEQ ID NO: 1033015 - RNA, 19 nt, Homo sapiens
ucaugcuguuccaccuccc

SEQ ID NO: 1033016 - RNA, 15 nt, Homo sapiens
ucauggugcacugag

SEQ ID NO: 1033017 - RNA, 22 nt, Homo sapiens
ucauguauauguguucauuaaa

SEQ ID NO: 1033018 - RNA, 21 nt, Homo sapiens
ucauguaucgcuucauguaac

SEQ ID NO: 1033019 - RNA, 20 nt, Homo sapiens
ucauguccccaaaccugcaa

SEQ ID NO: 1033020 - RNA, 23 nt, Homo sapiens
ucaugucuauaaucccagcacuu

SEQ ID NO: 1033021 - RNA, 23 nt, Homo sapiens
ucauguguguccacgacugucuc

SEQ ID NO: 1033022 - RNA, 15 nt, Homo sapiens
ucauguuccucaaaa

SEQ ID NO: 1033023 - RNA, 11 nt, Homo sapiens
ucauuaccuca

SEQ ID NO: 1033024 - RNA, 11 nt, Homo sapiens
ucauuaucuca

SEQ ID NO: 1033025 - RNA, 19 nt, Homo sapiens
ucauuauuuuucacugccc

SEQ ID NO: 1033026 - RNA, 13 nt, Homo sapiens
ucauuccaccuuc

SEQ ID NO: 1033027 - RNA, 16 nt, Homo sapiens
ucauuccauucuggaa

SEQ ID NO: 1033028 - RNA, 19 nt, Homo sapiens
ucauucccuagaucuuucu

SEQ ID NO: 1033029 - RNA, 22 nt, Homo sapiens
ucauuccugaaagaaacaguua

SEQ ID NO: 1033030 - RNA, 21 nt, Homo sapiens
ucauucucugucucauccauc

SEQ ID NO: 1033031 - RNA, 21 nt, Homo sapiens
ucauugaaguauuuuccucca

SEQ ID NO: 1033032 - RNA, 14 nt, Homo sapiens
ucauugacuaucaa

SEQ ID NO: 1033033 - RNA, 17 nt, Homo sapiens
ucauugcuuugaagcag

SEQ ID NO: 1033034 - RNA, 14 nt, Homo sapiens
ucauuguaaucacu

SEQ ID NO: 1033035 - RNA, 18 nt, Homo sapiens
ucauuguaaucacuguug

SEQ ID NO: 1033036 - RNA, 17 nt, Homo sapiens
ucauuguucuugugaac

SEQ ID NO: 1033037 - RNA, 22 nt, Homo sapiens
ucauuguucuugugaacccaaa

SEQ ID NO: 1033038 - RNA, 20 nt, Homo sapiens
ucauuguuuauuaacaaauu

SEQ ID NO: 1033039 - RNA, 14 nt, Homo sapiens
ucauuucaaauaca

SEQ ID NO: 1033040 - RNA, 15 nt, Homo sapiens
ucauuucuacuguga

SEQ ID NO: 1033041 - RNA, 20 nt, Homo sapiens
ucauuucuggaaagugcaau

SEQ ID NO: 1033042 - RNA, 16 nt, Homo sapiens
ucauuucuugagguac

SEQ ID NO: 1033043 - RNA, 13 nt, Homo sapiens
ucauuugaacaac

SEQ ID NO: 1033044 - RNA, 23 nt, Homo sapiens
ucauuuuaacuuuaucacauuau

SEQ ID NO: 1033045 - RNA, 22 nt, Homo sapiens
ucauuuuuccuucccuucucca

SEQ ID NO: 1033046 - RNA, 23 nt, Homo sapiens
ucauuuuuccuucccuucuccau

SEQ ID NO: 1033047 - RNA, 18 nt, Homo sapiens
ucauuuuuguaucuacau

SEQ ID NO: 1033048 - RNA, 17 nt, Homo sapiens
uccaaaaaaauacugcc

SEQ ID NO: 1033049 - RNA, 20 nt, Homo sapiens
uccaaaaaaauacugccaga

SEQ ID NO: 1033050 - RNA, 13 nt, Homo sapiens
uccaaaagcacuu

SEQ ID NO: 1033051 - RNA, 16 nt, Homo sapiens
uccaaaccuccacugc

SEQ ID NO: 1033052 - RNA, 12 nt, Homo sapiens
uccaaagccaga

SEQ ID NO: 1033053 - RNA, 19 nt, Homo sapiens
uccaaaggcauaagacccu

SEQ ID NO: 1033054 - RNA, 16 nt, Homo sapiens
uccaaaugcccagcuu

SEQ ID NO: 1033055 - RNA, 16 nt, Homo sapiens
uccaacacugcugcuc

SEQ ID NO: 1033056 - RNA, 19 nt, Homo sapiens
uccaacagcucaagucuuc

SEQ ID NO: 1033057 - RNA, 23 nt, Homo sapiens
uccaacaugaaaacaauucuuau

SEQ ID NO: 1033058 - RNA, 14 nt, Homo sapiens
uccaacaugugcuc

SEQ ID NO: 1033059 - RNA, 17 nt, Homo sapiens
uccaacauuaaaagcca

SEQ ID NO: 1033060 - RNA, 16 nt, Homo sapiens
uccaacguggcccaga

SEQ ID NO: 1033061 - RNA, 17 nt, Homo sapiens
uccaacuguacuuuuaa

SEQ ID NO: 1033062 - RNA, 16 nt, Homo sapiens
uccaacuucccaguuc

SEQ ID NO: 1033063 - RNA, 21 nt, Homo sapiens
uccaaggaaaccacagcugcu

SEQ ID NO: 1033064 - RNA, 17 nt, Homo sapiens
uccaauaggcauuugau

SEQ ID NO: 1033065 - RNA, 20 nt, Homo sapiens
uccaauauucgcugugucag

SEQ ID NO: 1033066 - RNA, 13 nt, Homo sapiens
uccaaucagguag

SEQ ID NO: 1033067 - RNA, 16 nt, Homo sapiens
uccaaugcauugcuaa

SEQ ID NO: 1033068 - RNA, 14 nt, Homo sapiens
uccaaugcucaaga

SEQ ID NO: 1033069 - RNA, 22 nt, Homo sapiens
uccaaugucuuuuuaagcuuau

SEQ ID NO: 1033070 - RNA, 18 nt, Homo sapiens
uccaauuccuugcacaua

SEQ ID NO: 1033071 - RNA, 19 nt, Homo sapiens
uccaauuccuugcacauag

SEQ ID NO: 1033072 - RNA, 20 nt, Homo sapiens
uccaauugaacuuucacaua

SEQ ID NO: 1033073 - RNA, 19 nt, Homo sapiens
uccacaaauuauuaaugaa

SEQ ID NO: 1033074 - RNA, 16 nt, Homo sapiens
uccacaauaaggucaa

SEQ ID NO: 1033075 - RNA, 14 nt, Homo sapiens
uccacaaucugaca

SEQ ID NO: 1033076 - RNA, 13 nt, Homo sapiens
uccacauguucaa

SEQ ID NO: 1033077 - RNA, 14 nt, Homo sapiens
uccacauuauacau

SEQ ID NO: 1033078 - RNA, 21 nt, Homo sapiens
uucuaaguggaaaaaguauua

SEQ ID NO: 1033079 - RNA, 13 nt, Homo sapiens
uucuaaucaaagc

SEQ ID NO: 1033080 - RNA, 14 nt, Homo sapiens
uucuacaaaauccu

SEQ ID NO: 1033081 - RNA, 14 nt, Homo sapiens
uucuacagcagaua

SEQ ID NO: 1033082 - RNA, 15 nt, Homo sapiens
uucuaccauuugaau

SEQ ID NO: 1033083 - RNA, 14 nt, Homo sapiens
uucuacccaggugc

SEQ ID NO: 1033084 - RNA, 13 nt, Homo sapiens
uucuacucuccca

SEQ ID NO: 1033085 - RNA, 17 nt, Homo sapiens
uucuaggaagcuccagu

SEQ ID NO: 1033086 - RNA, 22 nt, Homo sapiens
uucuagucuccuuugcacugag

SEQ ID NO: 1033087 - RNA, 21 nt, Homo sapiens
uucuauggguuggacaaccuc

SEQ ID NO: 1033088 - RNA, 19 nt, Homo sapiens
uucuauucaucucaaggaa

SEQ ID NO: 1033089 - RNA, 20 nt, Homo sapiens
uucuauugaaaaaucaccac

SEQ ID NO: 1033090 - RNA, 15 nt, Homo sapiens
uucucaagaagaaca

SEQ ID NO: 1033091 - RNA, 19 nt, Homo sapiens
uucucacacacauacauac

SEQ ID NO: 1033092 - RNA, 21 nt, Homo sapiens
uucucagggcuccugccuucu

SEQ ID NO: 1033093 - RNA, 22 nt, Homo sapiens
uucucauccuuccucauuugca

SEQ ID NO: 1033094 - RNA, 13 nt, Homo sapiens
uucucaugaucca

SEQ ID NO: 1033095 - RNA, 14 nt, Homo sapiens
uucuccaaaugaga

SEQ ID NO: 1033096 - RNA, 21 nt, Homo sapiens
uucuccaccuagacuguaaac

SEQ ID NO: 1033097 - RNA, 14 nt, Homo sapiens
uucuccagacaaac

SEQ ID NO: 1033098 - RNA, 17 nt, Homo sapiens
uucucccaccaccucac

SEQ ID NO: 1033099 - RNA, 16 nt, Homo sapiens
uucucuaccucauggg

SEQ ID NO: 1033100 - RNA, 12 nt, Homo sapiens
uucucugccuca

SEQ ID NO: 1033101 - RNA, 17 nt, Homo sapiens
uucucugcuccaccaca

SEQ ID NO: 1033102 - RNA, 13 nt, Homo sapiens
uucugaaagggac

SEQ ID NO: 1033103 - RNA, 17 nt, Homo sapiens
uucugaagccucacuua

SEQ ID NO: 1033104 - RNA, 14 nt, Homo sapiens
uucugaaugcugcu

SEQ ID NO: 1033105 - RNA, 16 nt, Homo sapiens
uucugaccacagcauc

SEQ ID NO: 1033106 - RNA, 17 nt, Homo sapiens
uucugagaaagacuauu

SEQ ID NO: 1033107 - RNA, 20 nt, Homo sapiens
uucugaggguccacuacuca

SEQ ID NO: 1033108 - RNA, 11 nt, Homo sapiens
uucugauuaca

SEQ ID NO: 1033109 - RNA, 13 nt, Homo sapiens
uucugcaagcuuu

SEQ ID NO: 1033110 - RNA, 15 nt, Homo sapiens
uucugcaucuugggg

SEQ ID NO: 1033111 - RNA, 23 nt, Homo sapiens
uucugccuaucuucuuucacaua

SEQ ID NO: 1033112 - RNA, 13 nt, Homo sapiens
uucugcucacaua

SEQ ID NO: 1033113 - RNA, 17 nt, Homo sapiens
uucugcugaugcuacug

SEQ ID NO: 1033114 - RNA, 17 nt, Homo sapiens
uucuggccucccacaga

SEQ ID NO: 1033115 - RNA, 18 nt, Homo sapiens
uucugggaacuuccucag

SEQ ID NO: 1033116 - RNA, 17 nt, Homo sapiens
uucugggcuucaucugg

SEQ ID NO: 1033117 - RNA, 15 nt, Homo sapiens
uucuguauucacuua

SEQ ID NO: 1033118 - RNA, 18 nt, Homo sapiens
uucugucaggagagcagc

SEQ ID NO: 1033119 - RNA, 19 nt, Homo sapiens
uucugucgccuuagcaugu

SEQ ID NO: 1033120 - RNA, 21 nt, Homo sapiens
uucugucugugucuucaggag

SEQ ID NO: 1033121 - RNA, 21 nt, Homo sapiens
uucuguggaccacugcaugag

SEQ ID NO: 1033122 - RNA, 21 nt, Homo sapiens
uucuguucugucucauaugau

SEQ ID NO: 1033123 - RNA, 13 nt, Homo sapiens
uucuguugccaca

SEQ ID NO: 1033124 - RNA, 21 nt, Homo sapiens
uucuuaaauaauaaagaucau

SEQ ID NO: 1033125 - RNA, 14 nt, Homo sapiens
uucuuacaugcauu

SEQ ID NO: 1033126 - RNA, 16 nt, Homo sapiens
uucuucauuaccucag

SEQ ID NO: 1033127 - RNA, 16 nt, Homo sapiens
uucuucccuacaguug

SEQ ID NO: 1033128 - RNA, 23 nt, Homo sapiens
uucuucuacugcccugagccuga

SEQ ID NO: 1033129 - RNA, 12 nt, Homo sapiens
uucuucuauggg

SEQ ID NO: 1033130 - RNA, 22 nt, Homo sapiens
uucuucuucagaagacacugca

SEQ ID NO: 1033131 - RNA, 19 nt, Homo sapiens
uucuugaagcaguagccua

SEQ ID NO: 1033132 - RNA, 18 nt, Homo sapiens
uucuugcuacccaugacu

SEQ ID NO: 1033133 - RNA, 22 nt, Homo sapiens
uucuuguugugccccuuuccaa

SEQ ID NO: 1033134 - RNA, 14 nt, Homo sapiens
uucuuugcuugccu

SEQ ID NO: 1033135 - RNA, 13 nt, Homo sapiens
uucuuuucugacu

SEQ ID NO: 1033136 - RNA, 16 nt, Homo sapiens
uucuuuuggcuuccau

SEQ ID NO: 1033137 - RNA, 18 nt, Homo sapiens
uucuuuuucguuggugua

SEQ ID NO: 1033138 - RNA, 17 nt, Homo sapiens
uugaaaaaagcugaauu

SEQ ID NO: 1033139 - RNA, 13 nt, Homo sapiens
uugaaaaccuggc

SEQ ID NO: 1033140 - RNA, 13 nt, Homo sapiens
uugaaaagacauc

SEQ ID NO: 1033141 - RNA, 12 nt, Homo sapiens
uugaaaauguuc

SEQ ID NO: 1033142 - RNA, 18 nt, Homo sapiens
uugaaacauagagaucua

SEQ ID NO: 1033143 - RNA, 20 nt, Homo sapiens
uugaaagaucaaaagguuaa

SEQ ID NO: 1033144 - RNA, 17 nt, Homo sapiens
uugaaauaccagugaac

SEQ ID NO: 1033145 - RNA, 16 nt, Homo sapiens
uugaaauagucugugu

SEQ ID NO: 1033146 - RNA, 13 nt, Homo sapiens
uugaaaucuauga

SEQ ID NO: 1033147 - RNA, 23 nt, Homo sapiens
uugaacaacuaggcuucagcaua

SEQ ID NO: 1033148 - RNA, 19 nt, Homo sapiens
uugaaccagggagucagag

SEQ ID NO: 1033149 - RNA, 18 nt, Homo sapiens
uugaacugguucaugaaa

SEQ ID NO: 1033150 - RNA, 13 nt, Homo sapiens
uugaacuuugacc

SEQ ID NO: 1033151 - RNA, 22 nt, Homo sapiens
uugaagcucuggugacaccagc

SEQ ID NO: 1033152 - RNA, 23 nt, Homo sapiens
uugaagcucuggugacaccagcc

SEQ ID NO: 1033153 - RNA, 18 nt, Homo sapiens
uugaagugacuucacaga

SEQ ID NO: 1033154 - RNA, 14 nt, Homo sapiens
uugaagugagcuga

SEQ ID NO: 1033155 - RNA, 14 nt, Homo sapiens
uugaauaaacuaga

SEQ ID NO: 1033156 - RNA, 18 nt, Homo sapiens
uugaauaaagccugcuuu

SEQ ID NO: 1033157 - RNA, 17 nt, Homo sapiens
uugaaucaaagcaguua

SEQ ID NO: 1033158 - RNA, 18 nt, Homo sapiens
uugaaucuacaacucuga

SEQ ID NO: 1033159 - RNA, 20 nt, Homo sapiens
uugaaucuacaacucugaaa

SEQ ID NO: 1033160 - RNA, 22 nt, Homo sapiens
uugaauggcaugcuaguagcag

SEQ ID NO: 1033161 - RNA, 15 nt, Homo sapiens
uugaauggguuugcu

SEQ ID NO: 1033162 - RNA, 19 nt, Homo sapiens
uugaauguucucuuaagaa

SEQ ID NO: 1033163 - RNA, 15 nt, Homo sapiens
uugacagaacacugu

SEQ ID NO: 1033164 - RNA, 14 nt, Homo sapiens
uugacaucaaugau

SEQ ID NO: 1033165 - RNA, 20 nt, Homo sapiens
uugacauugcuuuacuguca

SEQ ID NO: 1033166 - RNA, 12 nt, Homo sapiens
uugaccacagag

SEQ ID NO: 1033167 - RNA, 11 nt, Homo sapiens
uugaccagcag

SEQ ID NO: 1033168 - RNA, 18 nt, Homo sapiens
uugaccucaaccugugau

SEQ ID NO: 1033169 - RNA, 13 nt, Homo sapiens
uugacuccaagaa

SEQ ID NO: 1033170 - RNA, 11 nt, Homo sapiens
uugagacagag

SEQ ID NO: 1033171 - RNA, 14 nt, Homo sapiens
uugagacaggagac

SEQ ID NO: 1033172 - RNA, 18 nt, Homo sapiens
uugagacuauugagauau

SEQ ID NO: 1033173 - RNA, 23 nt, Homo sapiens
uugagaguauauuauguauuuau

SEQ ID NO: 1033174 - RNA, 13 nt, Homo sapiens
uugagcaugugau

SEQ ID NO: 1033175 - RNA, 19 nt, Homo sapiens
uugagcuuaagaauuuuga

SEQ ID NO: 1033176 - RNA, 17 nt, Homo sapiens
uugaggauuuugaucca

SEQ ID NO: 1033177 - RNA, 14 nt, Homo sapiens
uugaggcaggagga

SEQ ID NO: 1033178 - RNA, 22 nt, Homo sapiens
uugaggguccucaguccacugc

SEQ ID NO: 1033179 - RNA, 20 nt, Homo sapiens
uugagugacucgaggguugg

SEQ ID NO: 1033180 - RNA, 14 nt, Homo sapiens
uugauaaugggaug

SEQ ID NO: 1033181 - RNA, 12 nt, Homo sapiens
uugauauacuuu

SEQ ID NO: 1033182 - RNA, 12 nt, Homo sapiens
uugaucaaugaa

SEQ ID NO: 1033183 - RNA, 20 nt, Homo sapiens
uugaucccuguuacccagag

SEQ ID NO: 1033184 - RNA, 18 nt, Homo sapiens
uugaugccaguaggcuca

SEQ ID NO: 1033185 - RNA, 17 nt, Homo sapiens
uugauuguuguuauuaa

SEQ ID NO: 1033186 - RNA, 17 nt, Homo sapiens
uugcaaauaaaauacua

SEQ ID NO: 1033187 - RNA, 23 nt, Homo sapiens
uugcaaauccacuagcaccgacc

SEQ ID NO: 1033188 - RNA, 14 nt, Homo sapiens
uugcaaccucgcug

SEQ ID NO: 1033189 - RNA, 15 nt, Homo sapiens
uugcaagaaucauua

SEQ ID NO: 1033190 - RNA, 13 nt, Homo sapiens
uugcaagauucca

SEQ ID NO: 1033191 - RNA, 21 nt, Homo sapiens
uugcaaggcaaagacuauucc

SEQ ID NO: 1033192 - RNA, 14 nt, Homo sapiens
uugcaauggcagcc

SEQ ID NO: 1033193 - RNA, 19 nt, Homo sapiens
uugcacaaaaucacacagc

SEQ ID NO: 1033194 - RNA, 18 nt, Homo sapiens
uugcacaggucccacugc

SEQ ID NO: 1033195 - RNA, 22 nt, Homo sapiens
uugcacauaguagguacccaau

SEQ ID NO: 1033196 - RNA, 14 nt, Homo sapiens
uugcaccacugcac

SEQ ID NO: 1033197 - RNA, 14 nt, Homo sapiens
uugcagaugacaaa

SEQ ID NO: 1033198 - RNA, 20 nt, Homo sapiens
uugcagcagugagucucuuc

SEQ ID NO: 1033199 - RNA, 18 nt, Homo sapiens
uugcaggaccucagguga

SEQ ID NO: 1033200 - RNA, 22 nt, Homo sapiens
uugcagggaagccccacuugaa

SEQ ID NO: 1033201 - RNA, 20 nt, Homo sapiens
uugcaguucaccugcacuua

SEQ ID NO: 1033202 - RNA, 20 nt, Homo sapiens
uugcauaguaccaaucauuu

SEQ ID NO: 1033203 - RNA, 14 nt, Homo sapiens
uugcaucagcaaca

SEQ ID NO: 1033204 - RNA, 21 nt, Homo sapiens
uugcaucagcaacaaccagca

SEQ ID NO: 1033205 - RNA, 20 nt, Homo sapiens
uugcaucuggguagcuguaa

SEQ ID NO: 1033206 - RNA, 13 nt, Homo sapiens
uugcaugaggcua

SEQ ID NO: 1033207 - RNA, 22 nt, Homo sapiens
uugcauggagugaccauagcuc

SEQ ID NO: 1033208 - RNA, 18 nt, Homo sapiens
uugcauggcuccagaaau

SEQ ID NO: 1033209 - RNA, 14 nt, Homo sapiens
uugcaugugaaaau

SEQ ID NO: 1033210 - RNA, 10 nt, Homo sapiens
uugcauuugg

SEQ ID NO: 1033211 - RNA, 23 nt, Homo sapiens
uugcauuuuugcaggagcaguau

SEQ ID NO: 1033212 - RNA, 14 nt, Homo sapiens
uugccaaacagcca

SEQ ID NO: 1033213 - RNA, 16 nt, Homo sapiens
uugccacaacccuguu

SEQ ID NO: 1033214 - RNA, 18 nt, Homo sapiens
uugccagaugcaauacaa

SEQ ID NO: 1033215 - RNA, 16 nt, Homo sapiens
uugccagcugcugcug

SEQ ID NO: 1033216 - RNA, 15 nt, Homo sapiens
uugccauuacucaau

SEQ ID NO: 1033217 - RNA, 20 nt, Homo sapiens
uugcccaggcuggagugcaa

SEQ ID NO: 1033218 - RNA, 13 nt, Homo sapiens
uugcccagugugu

SEQ ID NO: 1033219 - RNA, 19 nt, Homo sapiens
uugccccacccaacaagcc

SEQ ID NO: 1033220 - RNA, 19 nt, Homo sapiens
uugcccuugcccugaccuc

SEQ ID NO: 1033221 - RNA, 17 nt, Homo sapiens
uugccgcgucgcccucc

SEQ ID NO: 1033222 - RNA, 19 nt, Homo sapiens
uugccuaauaaacauccuu

SEQ ID NO: 1033223 - RNA, 16 nt, Homo sapiens
uugccugccacugagc

SEQ ID NO: 1033224 - RNA, 20 nt, Homo sapiens
uugccuuauuggcagcucua

SEQ ID NO: 1033225 - RNA, 15 nt, Homo sapiens
uugccuugggcugcu

SEQ ID NO: 1033226 - RNA, 20 nt, Homo sapiens
uugcgccauugcacuccagc

SEQ ID NO: 1033227 - RNA, 22 nt, Homo sapiens
uugcuaagaagcgagcacugac

SEQ ID NO: 1033228 - RNA, 14 nt, Homo sapiens
uuuauugugaucua

SEQ ID NO: 1033229 - RNA, 15 nt, Homo sapiens
uuuauugugaucuau

SEQ ID NO: 1033230 - RNA, 19 nt, Homo sapiens
uuuauuuuauagagcagaa

SEQ ID NO: 1033231 - RNA, 19 nt, Homo sapiens
uuuauuuuuguagagccag

SEQ ID NO: 1033232 - RNA, 22 nt, Homo sapiens
uuucaaaaaaucugaccaaaac

SEQ ID NO: 1033233 - RNA, 11 nt, Homo sapiens
uuucaaaaaga

SEQ ID NO: 1033234 - RNA, 16 nt, Homo sapiens
uuucaaaaccuuuuga

SEQ ID NO: 1033235 - RNA, 19 nt, Homo sapiens
uuucaaaauauacauucaa

SEQ ID NO: 1033236 - RNA, 15 nt, Homo sapiens
uuucaaaugugcugu

SEQ ID NO: 1033237 - RNA, 13 nt, Homo sapiens
uuucaacuugcau

SEQ ID NO: 1033238 - RNA, 20 nt, Homo sapiens
uuucaacuugucucuauaau

SEQ ID NO: 1033239 - RNA, 18 nt, Homo sapiens
uuucaagcauuaagaaca

SEQ ID NO: 1033240 - RNA, 15 nt, Homo sapiens
uuucaauaaaccuaa

SEQ ID NO: 1033241 - RNA, 23 nt, Homo sapiens
uuucaaucaaaacucaguaucau

SEQ ID NO: 1033242 - RNA, 18 nt, Homo sapiens
uuucaauugaaggugcug

SEQ ID NO: 1033243 - RNA, 18 nt, Homo sapiens
uuucacacuuccaccagc

SEQ ID NO: 1033244 - RNA, 13 nt, Homo sapiens
uuucacugccaua

SEQ ID NO: 1033245 - RNA, 17 nt, Homo sapiens
uuucacuuugugauuau

SEQ ID NO: 1033246 - RNA, 17 nt, Homo sapiens
uuucagauaaacaacaa

SEQ ID NO: 1033247 - RNA, 13 nt, Homo sapiens
uuucagaucaugg

SEQ ID NO: 1033248 - RNA, 17 nt, Homo sapiens
uuucagcgauguaugca

SEQ ID NO: 1033249 - RNA, 20 nt, Homo sapiens
uuucagcuccuucaaugcaa

SEQ ID NO: 1033250 - RNA, 18 nt, Homo sapiens
uuucaguauaauuuaacu

SEQ ID NO: 1033251 - RNA, 22 nt, Homo sapiens
uuucaguauaauuuaacuucag

SEQ ID NO: 1033252 - RNA, 19 nt, Homo sapiens
uuucagugaaagcaucacu

SEQ ID NO: 1033253 - RNA, 18 nt, Homo sapiens
uuucauaaacuucaggga

SEQ ID NO: 1033254 - RNA, 13 nt, Homo sapiens
uuucauacacuua

SEQ ID NO: 1033255 - RNA, 20 nt, Homo sapiens
uuucaucugggaaagacauc

SEQ ID NO: 1033256 - RNA, 14 nt, Homo sapiens
uuucaugugugauu

SEQ ID NO: 1033257 - RNA, 15 nt, Homo sapiens
uuuccaaaaccagaa

SEQ ID NO: 1033258 - RNA, 16 nt, Homo sapiens
uuuccaguguuuacaa

SEQ ID NO: 1033259 - RNA, 21 nt, Homo sapiens
uuuccauaaacacccaugaau

SEQ ID NO: 1033260 - RNA, 16 nt, Homo sapiens
uuuccauaaucacuca

SEQ ID NO: 1033261 - RNA, 19 nt, Homo sapiens
uuucccaccucaccugaga

SEQ ID NO: 1033262 - RNA, 22 nt, Homo sapiens
uuuccccaaagacgaccagcau

SEQ ID NO: 1033263 - RNA, 18 nt, Homo sapiens
uuuccccacacaugccua

SEQ ID NO: 1033264 - RNA, 20 nt, Homo sapiens
uuuccgaggccccugucuca

SEQ ID NO: 1033265 - RNA, 20 nt, Homo sapiens
uuuccucaugugaucacaau

SEQ ID NO: 1033266 - RNA, 21 nt, Homo sapiens
uuuccuccuguguacagggaa

SEQ ID NO: 1033267 - RNA, 14 nt, Homo sapiens
uuuccucuauugau

SEQ ID NO: 1033268 - RNA, 11 nt, Homo sapiens
uuuccuuugaa

SEQ ID NO: 1033269 - RNA, 18 nt, Homo sapiens
uuucuaacuccagugaag

SEQ ID NO: 1033270 - RNA, 18 nt, Homo sapiens
uuucuaauggacuuucag

SEQ ID NO: 1033271 - RNA, 12 nt, Homo sapiens
uuucuacccagc

SEQ ID NO: 1033272 - RNA, 22 nt, Homo sapiens
uuucuacuuugaagucauacca

SEQ ID NO: 1033273 - RNA, 21 nt, Homo sapiens
uuucuaguuucuugugggcua

SEQ ID NO: 1033274 - RNA, 14 nt, Homo sapiens
uuucucaaaugcac

SEQ ID NO: 1033275 - RNA, 16 nt, Homo sapiens
uuucucagacuuugga

SEQ ID NO: 1033276 - RNA, 13 nt, Homo sapiens
uuucuccaugagu

SEQ ID NO: 1033277 - RNA, 15 nt, Homo sapiens
uuucuccauucagga

SEQ ID NO: 1033278 - RNA, 12 nt, Homo sapiens
uuucuccauugu

SEQ ID NO: 1033279 - RNA, 15 nt, Homo sapiens
uuucucuguauagua

SEQ ID NO: 1033280 - RNA, 18 nt, Homo sapiens
uuucucuugaagaacuga

SEQ ID NO: 1033281 - RNA, 19 nt, Homo sapiens
uuucucuugaagaacugac

SEQ ID NO: 1033282 - RNA, 19 nt, Homo sapiens
uuucugaaauaacauggcc

SEQ ID NO: 1033283 - RNA, 17 nt, Homo sapiens
uuucugacucugagcua

SEQ ID NO: 1033284 - RNA, 14 nt, Homo sapiens
uuucugagaaagac

SEQ ID NO: 1033285 - RNA, 13 nt, Homo sapiens
uuucugcacauaa

SEQ ID NO: 1033286 - RNA, 20 nt, Homo sapiens
uuucugccaccaaaggccag

SEQ ID NO: 1033287 - RNA, 13 nt, Homo sapiens
uuucugccuaucu

SEQ ID NO: 1033288 - RNA, 12 nt, Homo sapiens
uuucugcuuuaa

SEQ ID NO: 1033289 - RNA, 18 nt, Homo sapiens
uuucuggaaaacugccuu

SEQ ID NO: 1033290 - RNA, 21 nt, Homo sapiens
uuucugggagacagaaaacau

SEQ ID NO: 1033291 - RNA, 19 nt, Homo sapiens
uuucugggguccauucucu

SEQ ID NO: 1033292 - RNA, 13 nt, Homo sapiens
uuucuguaaacuc

SEQ ID NO: 1033293 - RNA, 14 nt, Homo sapiens
uuucuguaguguga

SEQ ID NO: 1033294 - RNA, 15 nt, Homo sapiens
uuucuguagugugaa

SEQ ID NO: 1033295 - RNA, 11 nt, Homo sapiens
uuucugucaag

SEQ ID NO: 1033296 - RNA, 15 nt, Homo sapiens
uuucugugugugaug

SEQ ID NO: 1033297 - RNA, 17 nt, Homo sapiens
uuucuguugccacaacc

SEQ ID NO: 1033298 - RNA, 22 nt, Homo sapiens
uuucuuauagucaauguuucuu

SEQ ID NO: 1033299 - RNA, 23 nt, Homo sapiens
uuucuuccagaaggcaaaaagac

SEQ ID NO: 1033300 - RNA, 12 nt, Homo sapiens
uuucuucuacug

SEQ ID NO: 1033301 - RNA, 12 nt, Homo sapiens
uuucuucugcua

SEQ ID NO: 1033302 - RNA, 19 nt, Homo sapiens
uuugaaacaauuaugugaa

SEQ ID NO: 1033303 - RNA, 17 nt, Homo sapiens
uuugaaaccaaaccaga

SEQ ID NO: 1033304 - RNA, 14 nt, Homo sapiens
uuugaacucaggga

SEQ ID NO: 1033305 - RNA, 14 nt, Homo sapiens
uuugaagaccaguc

SEQ ID NO: 1033306 - RNA, 16 nt, Homo sapiens
uuugaaggucugcaag

SEQ ID NO: 1033307 - RNA, 19 nt, Homo sapiens
uuugaauacaggcauagag

SEQ ID NO: 1033308 - RNA, 16 nt, Homo sapiens
uuugaaugcggcccaa

SEQ ID NO: 1033309 - RNA, 14 nt, Homo sapiens
uuugacauuuacug

SEQ ID NO: 1033310 - RNA, 15 nt, Homo sapiens
uuugagaaaugcaua

SEQ ID NO: 1033311 - RNA, 15 nt, Homo sapiens
uuugagaagcacugu

SEQ ID NO: 1033312 - RNA, 17 nt, Homo sapiens
uuugagauguauuucaa

SEQ ID NO: 1033313 - RNA, 23 nt, Homo sapiens
uuugagcuaaucuucauuucuaa

SEQ ID NO: 1033314 - RNA, 15 nt, Homo sapiens
uuugaguuucucuca

SEQ ID NO: 1033315 - RNA, 19 nt, Homo sapiens
uuugauacaagaaagcaau

SEQ ID NO: 1033316 - RNA, 22 nt, Homo sapiens
uuugaugaacaaaauuuccuaa

SEQ ID NO: 1033317 - RNA, 14 nt, Homo sapiens
uuugauguuuacag

SEQ ID NO: 1033318 - RNA, 17 nt, Homo sapiens
uuugauuaaagacucca

SEQ ID NO: 1033319 - RNA, 12 nt, Homo sapiens
uuugcacugagg

SEQ ID NO: 1033320 - RNA, 19 nt, Homo sapiens
uuugcagcagugagucucu

SEQ ID NO: 1033321 - RNA, 22 nt, Homo sapiens
uuugcaucagcaacaaccagca

SEQ ID NO: 1033322 - RNA, 18 nt, Homo sapiens
uuugcauuugcagugcau

SEQ ID NO: 1033323 - RNA, 18 nt, Homo sapiens
uuugccagugggaacucc

SEQ ID NO: 1033324 - RNA, 14 nt, Homo sapiens
uuugccuucuccac

SEQ ID NO: 1033325 - RNA, 19 nt, Homo sapiens
uuugccuuggcuuugccag

SEQ ID NO: 1033326 - RNA, 21 nt, Homo sapiens
uuugcuaaaugugaaugauga

SEQ ID NO: 1033327 - RNA, 22 nt, Homo sapiens
uuugcucuuagcugucugcuca

SEQ ID NO: 1033328 - RNA, 11 nt, Homo sapiens
uuugcuguaga

SEQ ID NO: 1033329 - RNA, 20 nt, Homo sapiens
uuuggaaguccagagcugga

SEQ ID NO: 1033330 - RNA, 17 nt, Homo sapiens
uuuggacuguaacugac

SEQ ID NO: 1033331 - RNA, 15 nt, Homo sapiens
uuuggauuacuuaaa

SEQ ID NO: 1033332 - RNA, 17 nt, Homo sapiens
uuuggauugacucugca

SEQ ID NO: 1033333 - RNA, 14 nt, Homo sapiens
uuuggccauuccaa

SEQ ID NO: 1033334 - RNA, 22 nt, Homo sapiens
uuugggaggcugaggcaggaga

SEQ ID NO: 1033335 - RNA, 21 nt, Homo sapiens
uuuggggaaaggcuuggcaca

SEQ ID NO: 1033336 - RNA, 23 nt, Homo sapiens
uuuggggaagugaggaagccagg

SEQ ID NO: 1033337 - RNA, 17 nt, Homo sapiens
uuuggggacucauuuca

SEQ ID NO: 1033338 - RNA, 21 nt, Homo sapiens
uuugggguguggaugucgaga

SEQ ID NO: 1033339 - RNA, 20 nt, Homo sapiens
uuugggguugaaaauucaaa

SEQ ID NO: 1033340 - RNA, 23 nt, Homo sapiens
uuuggguggaauggacuacucca

SEQ ID NO: 1033341 - RNA, 22 nt, Homo sapiens
uuuguaaugggaacugccucuu

SEQ ID NO: 1033342 - RNA, 15 nt, Homo sapiens
uuuacaaggugacaa

SEQ ID NO: 1033343 - RNA, 12 nt, Homo sapiens
uuuacaccaguu

SEQ ID NO: 1033344 - RNA, 13 nt, Homo sapiens
uuuacacugggag

SEQ ID NO: 1033345 - RNA, 21 nt, Homo sapiens
uuuacauacugcugucuaugu

SEQ ID NO: 1033346 - RNA, 15 nt, Homo sapiens
uuuacauguggccca

SEQ ID NO: 1033347 - RNA, 17 nt, Homo sapiens
uuuacauuauuaagaaa

SEQ ID NO: 1033348 - RNA, 16 nt, Homo sapiens
uuuacuagaaaggcau

SEQ ID NO: 1033349 - RNA, 16 nt, Homo sapiens
uuuacugaugauguag

SEQ ID NO: 1033350 - RNA, 17 nt, Homo sapiens
uuuacuuuuaaacugug

SEQ ID NO: 1033351 - RNA, 18 nt, Homo sapiens
uuuagauuaaacaaacaa

SEQ ID NO: 1033352 - RNA, 20 nt, Homo sapiens
uuuagccaguuguugccaac

SEQ ID NO: 1033353 - RNA, 14 nt, Homo sapiens
uuuagcuaccucac

SEQ ID NO: 1033354 - RNA, 16 nt, Homo sapiens
uuuauaagagcuaaag

SEQ ID NO: 1033355 - RNA, 16 nt, Homo sapiens
uuuauacguguagcua

SEQ ID NO: 1033356 - RNA, 19 nt, Homo sapiens
uuuauacucaccuuuuaug

SEQ ID NO: 1033357 - RNA, 23 nt, Homo sapiens
uuuauagagcagaacccuagucu

SEQ ID NO: 1033358 - RNA, 14 nt, Homo sapiens
uuuauaucucucau

SEQ ID NO: 1033359 - RNA, 19 nt, Homo sapiens
uuuaucaaguguauuugaa

SEQ ID NO: 1033360 - RNA, 19 nt, Homo sapiens
uuuaucacacuucugugag

SEQ ID NO: 1033361 - RNA, 13 nt, Homo sapiens
uuuaucugugauu

SEQ ID NO: 1033362 - RNA, 19 nt, Homo sapiens
uuuaugaucuuggcuguau

SEQ ID NO: 1033363 - RNA, 12 nt, Homo sapiens
uuuaugcuccua

SEQ ID NO: 1033364 - RNA, 12 nt, Homo sapiens
uuuaugcugcug

SEQ ID NO: 1033365 - RNA, 19 nt, Homo sapiens
uuuauggcucacuaugaau

SEQ ID NO: 1033366 - RNA, 12 nt, Homo sapiens
uuuaugguucuc

SEQ ID NO: 1033367 - RNA, 13 nt, Homo sapiens
uuuaugugcaaua

SEQ ID NO: 1033368 - RNA, 16 nt, Homo sapiens
uuuauuaccucugaua

SEQ ID NO: 1033369 - RNA, 13 nt, Homo sapiens
uuuauuauauaua

SEQ ID NO: 1033370 - RNA, 20 nt, Homo sapiens
uuuauuggcugagauaugaa

SEQ ID NO: 1033371 - RNA, 13 nt, Homo sapiens
uuuauugugaucu

SEQ ID NO: 1033372 - RNA, 15 nt, Homo sapiens
ugcauuucucugggg

SEQ ID NO: 1033373 - RNA, 13 nt, Homo sapiens
ugcauuugcacua

SEQ ID NO: 1033374 - RNA, 15 nt, Homo sapiens
ugcauuuggugguuu

SEQ ID NO: 1033375 - RNA, 15 nt, Homo sapiens
ugcauuuugcuauug

SEQ ID NO: 1033376 - RNA, 15 nt, Homo sapiens
ugcauuuugcuuguu

SEQ ID NO: 1033377 - RNA, 17 nt, Homo sapiens
ugcauuuuuaaauacaa

SEQ ID NO: 1033378 - RNA, 16 nt, Homo sapiens
ugcauuuuugugaaau

SEQ ID NO: 1033379 - RNA, 15 nt, Homo sapiens
ugccaaaaaaagaca

SEQ ID NO: 1033380 - RNA, 22 nt, Homo sapiens
ugccaaaccuguguaggcauuu

SEQ ID NO: 1033381 - RNA, 15 nt, Homo sapiens
ugccaaccggucacc

SEQ ID NO: 1033382 - RNA, 20 nt, Homo sapiens
ugccaaccggucacccagga

SEQ ID NO: 1033383 - RNA, 19 nt, Homo sapiens
ugccaacuucuucagagcu

SEQ ID NO: 1033384 - RNA, 18 nt, Homo sapiens
ugccaagaaaguauuugg

SEQ ID NO: 1033385 - RNA, 17 nt, Homo sapiens
ugccaagcucaggacca

SEQ ID NO: 1033386 - RNA, 12 nt, Homo sapiens
ugccaauggaac

SEQ ID NO: 1033387 - RNA, 15 nt, Homo sapiens
ugccaauuagcaauu

SEQ ID NO: 1033388 - RNA, 18 nt, Homo sapiens
ugccaccaaaagaagaaa

SEQ ID NO: 1033389 - RNA, 12 nt, Homo sapiens
aaaaaaaagccu

SEQ ID NO: 1033390 - RNA, 12 nt, Homo sapiens
aaaaaaacguau

SEQ ID NO: 1033391 - RNA, 12 nt, Homo sapiens
aaaaaaacuucu

SEQ ID NO: 1033392 - RNA, 12 nt, Homo sapiens
aaaaaacauaua

SEQ ID NO: 1033393 - RNA, 20 nt, Homo sapiens
aaaaaaguaaguaccacuca

SEQ ID NO: 1033394 - RNA, 12 nt, Homo sapiens
aaaaaaucugac

SEQ ID NO: 1033395 - RNA, 17 nt, Homo sapiens
aaaaaauuaauacugaa

SEQ ID NO: 1033396 - RNA, 19 nt, Homo sapiens
aaaaacacagacauucugc

SEQ ID NO: 1033397 - RNA, 12 nt, Homo sapiens
aaaaacacauaa

SEQ ID NO: 1033398 - RNA, 17 nt, Homo sapiens
aaaaacagagguggaua

SEQ ID NO: 1033399 - RNA, 13 nt, Homo sapiens
aaaaacauggccu

SEQ ID NO: 1033400 - RNA, 13 nt, Homo sapiens
aaaaacauucuua

SEQ ID NO: 1033401 - RNA, 14 nt, Homo sapiens
aaaaacguauugca

SEQ ID NO: 1033402 - RNA, 15 nt, Homo sapiens
uucuguacucaaaug

SEQ ID NO: 1033403 - RNA, 22 nt, Homo sapiens
uucuguagcuuguucccugucu

SEQ ID NO: 1033404 - RNA, 14 nt, Homo sapiens
uucugucagcagua

SEQ ID NO: 1033405 - RNA, 20 nt, Homo sapiens
uucuguccgagcuuugaaaa

SEQ ID NO: 1033406 - RNA, 19 nt, Homo sapiens
uucuguccuggugucacuu

SEQ ID NO: 1033407 - RNA, 21 nt, Homo sapiens
uucuguccuuuuggcacugag

SEQ ID NO: 1033408 - RNA, 19 nt, Homo sapiens
uucuguggagguauugccu

SEQ ID NO: 1033409 - RNA, 21 nt, Homo sapiens
uucuuaaacaaauguaugauu

SEQ ID NO: 1033410 - RNA, 13 nt, Homo sapiens
uucuuaaauucau

SEQ ID NO: 1033411 - RNA, 14 nt, Homo sapiens
uucuuaauugcacu

SEQ ID NO: 1033412 - RNA, 16 nt, Homo sapiens
uucuuacaaacaugug

SEQ ID NO: 1033413 - RNA, 17 nt, Homo sapiens
uucuucacucaaucucu

SEQ ID NO: 1033414 - RNA, 16 nt, Homo sapiens
uucuucugcuauguga

SEQ ID NO: 1033415 - RNA, 19 nt, Homo sapiens
uucuugaaauuuuaaccua

SEQ ID NO: 1033416 - RNA, 16 nt, Homo sapiens
uucuugcuaauucuca

SEQ ID NO: 1033417 - RNA, 13 nt, Homo sapiens
uucuugugccuca

SEQ ID NO: 1033418 - RNA, 22 nt, Homo sapiens
uucuugugccucagccucccaa

SEQ ID NO: 1033419 - RNA, 20 nt, Homo sapiens
uucuuuagagcauugccauu

SEQ ID NO: 1033420 - RNA, 15 nt, Homo sapiens
uucuuuaucuugaca

SEQ ID NO: 1033421 - RNA, 12 nt, Homo sapiens
uucuuugcccac

SEQ ID NO: 1033422 - RNA, 15 nt, Homo sapiens
uucuuugggcugugg

SEQ ID NO: 1033423 - RNA, 17 nt, Homo sapiens
uugaaaagacuccaaag

SEQ ID NO: 1033424 - RNA, 16 nt, Homo sapiens
uugaaagcauccaugu

SEQ ID NO: 1033425 - RNA, 17 nt, Homo sapiens
uugaaauaagaaagugc

SEQ ID NO: 1033426 - RNA, 23 nt, Homo sapiens
uugaaauaccagugaaccaaaga

SEQ ID NO: 1033427 - RNA, 14 nt, Homo sapiens
uugaaaucacugau

SEQ ID NO: 1033428 - RNA, 15 nt, Homo sapiens
uugaaaucugaaugc

SEQ ID NO: 1033429 - RNA, 17 nt, Homo sapiens
uugaaauuaaccauaga

SEQ ID NO: 1033430 - RNA, 22 nt, Homo sapiens
uugaaccacuucccucaucucu

SEQ ID NO: 1033431 - RNA, 15 nt, Homo sapiens
uugaacccaggagau

SEQ ID NO: 1033432 - RNA, 14 nt, Homo sapiens
uugaacucagggag

SEQ ID NO: 1033433 - RNA, 23 nt, Homo sapiens
uugaacuuaaauaaaugucauua

SEQ ID NO: 1033434 - RNA, 22 nt, Homo sapiens
uugaacuucauaagguaauuca

SEQ ID NO: 1033435 - RNA, 11 nt, Homo sapiens
uugaagaccag

SEQ ID NO: 1033436 - RNA, 17 nt, Homo sapiens
uugaagauaucuugaaa

SEQ ID NO: 1033437 - RNA, 18 nt, Homo sapiens
uugaagauaucuugaaau

SEQ ID NO: 1033438 - RNA, 21 nt, Homo sapiens
uugaagaugcuuguauuuuac

SEQ ID NO: 1033439 - RNA, 23 nt, Homo sapiens
uugaagcccuccaaaagcacuua

SEQ ID NO: 1033440 - RNA, 14 nt, Homo sapiens
uugaaguaugguug

SEQ ID NO: 1033441 - RNA, 18 nt, Homo sapiens
uugaagucagauguggua

SEQ ID NO: 1033442 - RNA, 21 nt, Homo sapiens
uugaauaaagccugcuuuuua

SEQ ID NO: 1033443 - RNA, 19 nt, Homo sapiens
uugaaucccuuaaacucag

SEQ ID NO: 1033444 - RNA, 20 nt, Homo sapiens
uugaaucuacaaaaaacaac

SEQ ID NO: 1033445 - RNA, 22 nt, Homo sapiens
uugaaugaaaaauuuaagcauu

SEQ ID NO: 1033446 - RNA, 19 nt, Homo sapiens
uugaauuggacaauaaucu

SEQ ID NO: 1033447 - RNA, 19 nt, Homo sapiens
uugaauuugccuuccucau

SEQ ID NO: 1033448 - RNA, 17 nt, Homo sapiens
uugacaaaguuacugau

SEQ ID NO: 1033449 - RNA, 15 nt, Homo sapiens
uugacaauaauuuca

SEQ ID NO: 1033450 - RNA, 19 nt, Homo sapiens
uugacagaucaagcuguga

SEQ ID NO: 1033451 - RNA, 17 nt, Homo sapiens
uugacaggaauacuuaa

SEQ ID NO: 1033452 - RNA, 18 nt, Homo sapiens
uugacaggcuuauggaag

SEQ ID NO: 1033453 - RNA, 16 nt, Homo sapiens
uugacauaauuucacu

SEQ ID NO: 1033454 - RNA, 11 nt, Homo sapiens
uugacaucucu

SEQ ID NO: 1033455 - RNA, 22 nt, Homo sapiens
uugaccacucuuccugaguuca

SEQ ID NO: 1033456 - RNA, 21 nt, Homo sapiens
uugaccccugcccaccucucc

SEQ ID NO: 1033457 - RNA, 15 nt, Homo sapiens
uugaccuuugcacga

SEQ ID NO: 1033458 - RNA, 22 nt, Homo sapiens
uugacuggguuucucuguauag

SEQ ID NO: 1033459 - RNA, 23 nt, Homo sapiens
uugacugucacuguuccuuguca

SEQ ID NO: 1033460 - RNA, 13 nt, Homo sapiens
uugagaagcacug

SEQ ID NO: 1033461 - RNA, 13 nt, Homo sapiens
uugagaaugguua

SEQ ID NO: 1033462 - RNA, 17 nt, Homo sapiens
uugagaaugguuacaaa

SEQ ID NO: 1033463 - RNA, 13 nt, Homo sapiens
uugagacagaguc

SEQ ID NO: 1033464 - RNA, 21 nt, Homo sapiens
uuaauaguuuugauccuaaau

SEQ ID NO: 1033465 - RNA, 14 nt, Homo sapiens
uuaauauaucccag

SEQ ID NO: 1033466 - RNA, 13 nt, Homo sapiens
uuaauauugcagu

SEQ ID NO: 1033467 - RNA, 18 nt, Homo sapiens
uuaaucugagaggccaca

SEQ ID NO: 1033468 - RNA, 15 nt, Homo sapiens
uuaaucuuuucacaa

SEQ ID NO: 1033469 - RNA, 20 nt, Homo sapiens
uuaaugaacaugugaaguua

SEQ ID NO: 1033470 - RNA, 21 nt, Homo sapiens
uuaauguauuuguuugcaauu

SEQ ID NO: 1033471 - RNA, 19 nt, Homo sapiens
uuaauuccaauaugaugac

SEQ ID NO: 1033472 - RNA, 16 nt, Homo sapiens
uuacaaaaacauggcc

SEQ ID NO: 1033473 - RNA, 15 nt, Homo sapiens
uuacaaaaguauuau

SEQ ID NO: 1033474 - RNA, 15 nt, Homo sapiens
uuacaaaugucuaag

SEQ ID NO: 1033475 - RNA, 19 nt, Homo sapiens
uuacacaaaacaaaugcca

SEQ ID NO: 1033476 - RNA, 15 nt, Homo sapiens
uuacacguaccucuc

SEQ ID NO: 1033477 - RNA, 14 nt, Homo sapiens
uuacagagacagaa

SEQ ID NO: 1033478 - RNA, 20 nt, Homo sapiens
uuacagcuggguggcacugc

SEQ ID NO: 1033479 - RNA, 16 nt, Homo sapiens
uuacaguuugagacuu

SEQ ID NO: 1033480 - RNA, 18 nt, Homo sapiens
uuacauaaucuguacaau

SEQ ID NO: 1033481 - RNA, 13 nt, Homo sapiens
uuacaucuuucac

SEQ ID NO: 1033482 - RNA, 14 nt, Homo sapiens
uuacaugcauuuga

SEQ ID NO: 1033483 - RNA, 19 nt, Homo sapiens
uuacauuugaaaucuauga

SEQ ID NO: 1033484 - RNA, 20 nt, Homo sapiens
uuaccagacgguucaccagc

SEQ ID NO: 1033485 - RNA, 22 nt, Homo sapiens
uuaccagacgguucaccagccu

SEQ ID NO: 1033486 - RNA, 17 nt, Homo sapiens
uuaccaugucacugugg

SEQ ID NO: 1033487 - RNA, 17 nt, Homo sapiens
uuacccacucaucagaa

SEQ ID NO: 1033488 - RNA, 22 nt, Homo sapiens
uuacccagagaauauauacauu

SEQ ID NO: 1033489 - RNA, 17 nt, Homo sapiens
uuaccguucaccaguug

SEQ ID NO: 1033490 - RNA, 12 nt, Homo sapiens
uuaccucugaua

SEQ ID NO: 1033491 - RNA, 20 nt, Homo sapiens
uuaccuguuuucgcaccuac

SEQ ID NO: 1033492 - RNA, 20 nt, Homo sapiens
uuaccuucuaccucuuggcu

SEQ ID NO: 1033493 - RNA, 15 nt, Homo sapiens
uuacgagcagggaug

SEQ ID NO: 1033494 - RNA, 13 nt, Homo sapiens
uuacgugagccag

SEQ ID NO: 1033495 - RNA, 16 nt, Homo sapiens
uuacuaagcuuugcca

SEQ ID NO: 1033496 - RNA, 23 nt, Homo sapiens
uuacuaagcuuugccagcugcug

SEQ ID NO: 1033497 - RNA, 22 nt, Homo sapiens
uuacuaaggaguaaucugugua

SEQ ID NO: 1033498 - RNA, 19 nt, Homo sapiens
uuacuagaagaugaauaca

SEQ ID NO: 1033499 - RNA, 15 nt, Homo sapiens
uuacuaucaugucaa

SEQ ID NO: 1033500 - RNA, 16 nt, Homo sapiens
uuacuaucaugucaaa

SEQ ID NO: 1033501 - RNA, 21 nt, Homo sapiens
uuacuauuuauugcugaauga

SEQ ID NO: 1033502 - RNA, 23 nt, Homo sapiens
uuacuauuuauugcugaaugacu

SEQ ID NO: 1033503 - RNA, 23 nt, Homo sapiens
uuacucaaggaauuugcauuuag

SEQ ID NO: 1033504 - RNA, 16 nt, Homo sapiens
uuacucaugacuccuu

SEQ ID NO: 1033505 - RNA, 21 nt, Homo sapiens
uuacucaugugcagguuuuga

SEQ ID NO: 1033506 - RNA, 11 nt, Homo sapiens
uuacucugaag

SEQ ID NO: 1033507 - RNA, 12 nt, Homo sapiens
uuacugaaucuu

SEQ ID NO: 1033508 - RNA, 15 nt, Homo sapiens
uuacugaaucuucaa

SEQ ID NO: 1033509 - RNA, 19 nt, Homo sapiens
uuacugguagaaaggcagu

SEQ ID NO: 1033510 - RNA, 15 nt, Homo sapiens
uuacuuaaaggaaua

SEQ ID NO: 1033511 - RNA, 15 nt, Homo sapiens
uuacuucacuuuaau

SEQ ID NO: 1033512 - RNA, 16 nt, Homo sapiens
uuacuucccuaaugaa

SEQ ID NO: 1033513 - RNA, 20 nt, Homo sapiens
uuacuuccuaucaagccagu

SEQ ID NO: 1033514 - RNA, 19 nt, Homo sapiens
uuacuuuuuccuggcucau

SEQ ID NO: 1033515 - RNA, 21 nt, Homo sapiens
uuagaaaaauccuacaaggcu

SEQ ID NO: 1033516 - RNA, 12 nt, Homo sapiens
uuagaaauggau

SEQ ID NO: 1033517 - RNA, 12 nt, Homo sapiens
uuagaacuauua

SEQ ID NO: 1033518 - RNA, 18 nt, Homo sapiens
uuagaauauccaugaccu

SEQ ID NO: 1033519 - RNA, 23 nt, Homo sapiens
uuagacacguguuguuccaccuu

SEQ ID NO: 1033520 - RNA, 15 nt, Homo sapiens
uuagacccugcauuu

SEQ ID NO: 1033521 - RNA, 23 nt, Homo sapiens
uuagagcccauuucaauucucaa

SEQ ID NO: 1033522 - RNA, 20 nt, Homo sapiens
uuagagcugccugugccuuu

SEQ ID NO: 1033523 - RNA, 19 nt, Homo sapiens
uuagaguuaccacacccca

SEQ ID NO: 1033524 - RNA, 15 nt, Homo sapiens
uuagaucaaauacuu

SEQ ID NO: 1033525 - RNA, 23 nt, Homo sapiens
uuagauguucuaagucuuuccau

SEQ ID NO: 1033526 - RNA, 20 nt, Homo sapiens
uuagauuguuaaaauaacua

SEQ ID NO: 1033527 - RNA, 20 nt, Homo sapiens
uuagauuuuguauucagggg

SEQ ID NO: 1033528 - RNA, 23 nt, Homo sapiens
uuagcaaaaauuagaauuuuggu

SEQ ID NO: 1033529 - RNA, 15 nt, Homo sapiens
uuagcaaauacauau

SEQ ID NO: 1033530 - RNA, 14 nt, Homo sapiens
uuagcacacucaca

SEQ ID NO: 1033531 - RNA, 22 nt, Homo sapiens
uuagcaguuuugugauaaguuc

SEQ ID NO: 1033532 - RNA, 22 nt, Homo sapiens
uuagcauaaaauuuucuacucu

SEQ ID NO: 1033533 - RNA, 14 nt, Homo sapiens
uuagcauaauguga

SEQ ID NO: 1033534 - RNA, 13 nt, Homo sapiens
uuagccaaaggau

SEQ ID NO: 1033535 - RNA, 17 nt, Homo sapiens
uuagccaggaggccagg

SEQ ID NO: 1033536 - RNA, 17 nt, Homo sapiens
uuagccagguaauguga

SEQ ID NO: 1033537 - RNA, 17 nt, Homo sapiens
uuagcuuagaccucagc

SEQ ID NO: 1033538 - RNA, 21 nt, Homo sapiens
uuaggaauaaucuccuguuaa

SEQ ID NO: 1033539 - RNA, 21 nt, Homo sapiens
uuaggaccaauaccuccucca

SEQ ID NO: 1033540 - RNA, 23 nt, Homo sapiens
uuaggauuuaacagucauuuaaa

SEQ ID NO: 1033541 - RNA, 16 nt, Homo sapiens
uuaggccauauauauu

SEQ ID NO: 1033542 - RNA, 15 nt, Homo sapiens
uuaggcuauucacaa

SEQ ID NO: 1033543 - RNA, 13 nt, Homo sapiens
uuagguagcuuua

SEQ ID NO: 1033544 - RNA, 14 nt, Homo sapiens
uuaguauaaguaca

SEQ ID NO: 1033545 - RNA, 18 nt, Homo sapiens
uuaguauuugcauauucu

SEQ ID NO: 1033546 - RNA, 15 nt, Homo sapiens
uuagucgagccaagu

SEQ ID NO: 1033547 - RNA, 16 nt, Homo sapiens
uuagucucaagggcua

SEQ ID NO: 1033548 - RNA, 15 nt, Homo sapiens
uuagugauggagcuu

SEQ ID NO: 1033549 - RNA, 14 nt, Homo sapiens
uuagugucauguca

SEQ ID NO: 1033550 - RNA, 15 nt, Homo sapiens
uuauaaaagaugcau

SEQ ID NO: 1033551 - RNA, 17 nt, Homo sapiens
uuauaaaagaugcauua

SEQ ID NO: 1033552 - RNA, 13 nt, Homo sapiens
uuauaaaaucaaa

SEQ ID NO: 1033553 - RNA, 21 nt, Homo sapiens
uuauaaauuuuauaacagaau

SEQ ID NO: 1033554 - RNA, 22 nt, Homo sapiens
uuauaacagaauuaaaguagau

SEQ ID NO: 1033555 - RNA, 14 nt, Homo sapiens
uuauaagcauguau

SEQ ID NO: 1033556 - RNA, 15 nt, Homo sapiens
uuauaauaaaaggaa

SEQ ID NO: 1033557 - RNA, 12 nt, Homo sapiens
uuauaaucuacu

SEQ ID NO: 1033558 - RNA, 15 nt, Homo sapiens
uuauacaacagugcu

SEQ ID NO: 1033559 - RNA, 13 nt, Homo sapiens
uuauacacugucu

SEQ ID NO: 1033560 - RNA, 13 nt, Homo sapiens
uuauacccaugaa

SEQ ID NO: 1033561 - RNA, 19 nt, Homo sapiens
uuauacuguggcuaugcaa

SEQ ID NO: 1033562 - RNA, 15 nt, Homo sapiens
uuauagaaguagcaa

SEQ ID NO: 1033563 - RNA, 16 nt, Homo sapiens
uuccacaauucacuag

SEQ ID NO: 1033564 - RNA, 18 nt, Homo sapiens
uuccacaccuagcaucuc

SEQ ID NO: 1033565 - RNA, 20 nt, Homo sapiens
uuccacacucaccucuaaaa

SEQ ID NO: 1033566 - RNA, 22 nt, Homo sapiens
uuccagaaggcaaaaagacauu

SEQ ID NO: 1033567 - RNA, 13 nt, Homo sapiens
uuccagacugcuu

SEQ ID NO: 1033568 - RNA, 22 nt, Homo sapiens
uuccagcaugaggaacuagcca

SEQ ID NO: 1033569 - RNA, 16 nt, Homo sapiens
uuccagcuccuguaac

SEQ ID NO: 1033570 - RNA, 16 nt, Homo sapiens
uuccaggcgaugugca

SEQ ID NO: 1033571 - RNA, 17 nt, Homo sapiens
uuccaggcgaugugcaa

SEQ ID NO: 1033572 - RNA, 21 nt, Homo sapiens
uuccaggcgaugugcaagugu

SEQ ID NO: 1033573 - RNA, 19 nt, Homo sapiens
uuccagugguccauggaau

SEQ ID NO: 1033574 - RNA, 18 nt, Homo sapiens
uuccauaaacacccauga

SEQ ID NO: 1033575 - RNA, 19 nt, Homo sapiens
uuccauaaacacccaugaa

SEQ ID NO: 1033576 - RNA, 17 nt, Homo sapiens
uuccaucauguccccaa

SEQ ID NO: 1033577 - RNA, 20 nt, Homo sapiens
uuccauccuucaaauaaaca

SEQ ID NO: 1033578 - RNA, 18 nt, Homo sapiens
uuccaugaauucuugauu

SEQ ID NO: 1033579 - RNA, 15 nt, Homo sapiens
uuccaugaugguuau

SEQ ID NO: 1033580 - RNA, 16 nt, Homo sapiens
uuccauuaugauucuu

SEQ ID NO: 1033581 - RNA, 18 nt, Homo sapiens
uuccauuucgccccucau

SEQ ID NO: 1033582 - RNA, 16 nt, Homo sapiens
uuccauuugcaaggga

SEQ ID NO: 1033583 - RNA, 19 nt, Homo sapiens
uuccauuugugugugugca

SEQ ID NO: 1033584 - RNA, 17 nt, Homo sapiens
uucccacaggacauuuc

SEQ ID NO: 1033585 - RNA, 18 nt, Homo sapiens
uucccagaaggcauauca

SEQ ID NO: 1033586 - RNA, 14 nt, Homo sapiens
uucccagaaucaaa

SEQ ID NO: 1033587 - RNA, 21 nt, Homo sapiens
uucccauaccacccaaugcug

SEQ ID NO: 1033588 - RNA, 15 nt, Homo sapiens
uucccaucuccauug

SEQ ID NO: 1033589 - RNA, 12 nt, Homo sapiens
uucccaugcauu

SEQ ID NO: 1033590 - RNA, 23 nt, Homo sapiens
uuccccaaagacgaccagcauuu

SEQ ID NO: 1033591 - RNA, 17 nt, Homo sapiens
uuccccacacaugccua

SEQ ID NO: 1033592 - RNA, 12 nt, Homo sapiens
uuccccacugac

SEQ ID NO: 1033593 - RNA, 23 nt, Homo sapiens
uuccccagcgucccagucucugg

SEQ ID NO: 1033594 - RNA, 18 nt, Homo sapiens
uucccccuuuacucauag

SEQ ID NO: 1033595 - RNA, 19 nt, Homo sapiens
uucccccuuuucugcauuu

SEQ ID NO: 1033596 - RNA, 21 nt, Homo sapiens
uuccccgcccguuuuacaaag

SEQ ID NO: 1033597 - RNA, 18 nt, Homo sapiens
uucccuaaaaucagggaa

SEQ ID NO: 1033598 - RNA, 14 nt, Homo sapiens
uucccuaaugaagu

SEQ ID NO: 1033599 - RNA, 19 nt, Homo sapiens
uucccucaugcuguuccac

SEQ ID NO: 1033600 - RNA, 15 nt, Homo sapiens
uucccugcuuaauga

SEQ ID NO: 1033601 - RNA, 19 nt, Homo sapiens
uucccuggguuuucugccc

SEQ ID NO: 1033602 - RNA, 20 nt, Homo sapiens
uucccuguaugauuccuuga

SEQ ID NO: 1033603 - RNA, 23 nt, Homo sapiens
uuccgaggccccugucucagggu

SEQ ID NO: 1033604 - RNA, 13 nt, Homo sapiens
uuccgcaccaaua

SEQ ID NO: 1033605 - RNA, 16 nt, Homo sapiens
uuccguggcacugcau

SEQ ID NO: 1033606 - RNA, 17 nt, Homo sapiens
uuccguggcacugcaua

SEQ ID NO: 1033607 - RNA, 17 nt, Homo sapiens
uuccuacccaaccacuc

SEQ ID NO: 1033608 - RNA, 23 nt, Homo sapiens
uuccuauaugcacuuauucucaa

SEQ ID NO: 1033609 - RNA, 17 nt, Homo sapiens
uuccucaaaacuucaga

SEQ ID NO: 1033610 - RNA, 15 nt, Homo sapiens
uuccucacaccacaa

SEQ ID NO: 1033611 - RNA, 14 nt, Homo sapiens
uuccucaugugauc

SEQ ID NO: 1033612 - RNA, 18 nt, Homo sapiens
uuccucauuagcauuuug

SEQ ID NO: 1033613 - RNA, 23 nt, Homo sapiens
uuccucauuagcauuuugcuaaa

SEQ ID NO: 1033614 - RNA, 13 nt, Homo sapiens
uuccuccaccugc

SEQ ID NO: 1033615 - RNA, 16 nt, Homo sapiens
uuccugagaccacaga

SEQ ID NO: 1033616 - RNA, 17 nt, Homo sapiens
uuccugauggcaggaug

SEQ ID NO: 1033617 - RNA, 14 nt, Homo sapiens
uuccugccaccagu

SEQ ID NO: 1033618 - RNA, 19 nt, Homo sapiens
uuccugcugccauccucac

SEQ ID NO: 1033619 - RNA, 17 nt, Homo sapiens
uucaaaaacacaguguu

SEQ ID NO: 1033620 - RNA, 21 nt, Homo sapiens
uucaaaagcacuuugugcugu

SEQ ID NO: 1033621 - RNA, 18 nt, Homo sapiens
uucaaacuaauagaauua

SEQ ID NO: 1033622 - RNA, 18 nt, Homo sapiens
uucaaacugcaugauuca

SEQ ID NO: 1033623 - RNA, 15 nt, Homo sapiens
uucaaaugcuguaac

SEQ ID NO: 1033624 - RNA, 21 nt, Homo sapiens
uucaaauggacaaacugccag

SEQ ID NO: 1033625 - RNA, 22 nt, Homo sapiens
uucaaaugugcugucaaaacaa

SEQ ID NO: 1033626 - RNA, 20 nt, Homo sapiens
uucaaauucuucugaacuca

SEQ ID NO: 1033627 - RNA, 16 nt, Homo sapiens
uucaacaggagaauuu

SEQ ID NO: 1033628 - RNA, 15 nt, Homo sapiens
uucaaccucauugac

SEQ ID NO: 1033629 - RNA, 22 nt, Homo sapiens
uucaaguaauucugcugucuca

SEQ ID NO: 1033630 - RNA, 15 nt, Homo sapiens
uucaaguacuguaac

SEQ ID NO: 1033631 - RNA, 19 nt, Homo sapiens
uucaaguacuguaacugug

SEQ ID NO: 1033632 - RNA, 11 nt, Homo sapiens
uucaagugauu

SEQ ID NO: 1033633 - RNA, 12 nt, Homo sapiens
uucaaguguaaa

SEQ ID NO: 1033634 - RNA, 12 nt, Homo sapiens
uucaaguguaca

SEQ ID NO: 1033635 - RNA, 16 nt, Homo sapiens
uucaaugcaaaguaca

SEQ ID NO: 1033636 - RNA, 13 nt, Homo sapiens
uucaauguauuga

SEQ ID NO: 1033637 - RNA, 12 nt, Homo sapiens
uucaaugugacu

SEQ ID NO: 1033638 - RNA, 21 nt, Homo sapiens
uucacaccuagcgucaguauu

SEQ ID NO: 1033639 - RNA, 17 nt, Homo sapiens
uucacacuuccaccagc

SEQ ID NO: 1033640 - RNA, 18 nt, Homo sapiens
uucacacuuccaccagcc

SEQ ID NO: 1033641 - RNA, 16 nt, Homo sapiens
uucacagaugugugau

SEQ ID NO: 1033642 - RNA, 16 nt, Homo sapiens
uucacaucuaaccuca

SEQ ID NO: 1033643 - RNA, 11 nt, Homo sapiens
uucaccagagc

SEQ ID NO: 1033644 - RNA, 15 nt, Homo sapiens
uucaccagauuugcu

SEQ ID NO: 1033645 - RNA, 21 nt, Homo sapiens
uucaccugggcugaggcaucc

SEQ ID NO: 1033646 - RNA, 13 nt, Homo sapiens
uucaccuguaaac

SEQ ID NO: 1033647 - RNA, 19 nt, Homo sapiens
uucacgaaguguugcaugg

SEQ ID NO: 1033648 - RNA, 23 nt, Homo sapiens
uucacggaaagugccugcaaaaa

SEQ ID NO: 1033649 - RNA, 15 nt, Homo sapiens
uucacggcaggacaa

SEQ ID NO: 1033650 - RNA, 15 nt, Homo sapiens
uucacuagacugugc

SEQ ID NO: 1033651 - RNA, 14 nt, Homo sapiens
uucacucaaucucu

SEQ ID NO: 1033652 - RNA, 15 nt, Homo sapiens
uucacucauacaucu

SEQ ID NO: 1033653 - RNA, 16 nt, Homo sapiens
uucacucccaaccuga

SEQ ID NO: 1033654 - RNA, 18 nt, Homo sapiens
uucacugcaaccucugcc

SEQ ID NO: 1033655 - RNA, 22 nt, Homo sapiens
uucacugccccagacacagugc

SEQ ID NO: 1033656 - RNA, 22 nt, Homo sapiens
uucacuggguucccauucugag

SEQ ID NO: 1033657 - RNA, 14 nt, Homo sapiens
uucacuuuacaaau

SEQ ID NO: 1033658 - RNA, 14 nt, Homo sapiens
uucagaagacacug

SEQ ID NO: 1033659 - RNA, 17 nt, Homo sapiens
uucagaagagaugggcu

SEQ ID NO: 1033660 - RNA, 13 nt, Homo sapiens
uucagaaucucuc

SEQ ID NO: 1033661 - RNA, 17 nt, Homo sapiens
uucagauacaaacugca

SEQ ID NO: 1033662 - RNA, 19 nt, Homo sapiens
uucagaucauauuucacaa

SEQ ID NO: 1033663 - RNA, 15 nt, Homo sapiens
uucagcagacuauga

SEQ ID NO: 1033664 - RNA, 15 nt, Homo sapiens
uucagccugaggcug

SEQ ID NO: 1033665 - RNA, 13 nt, Homo sapiens
uucaggagucuca

SEQ ID NO: 1033666 - RNA, 15 nt, Homo sapiens
uucagggaacugcau

SEQ ID NO: 1033667 - RNA, 17 nt, Homo sapiens
uucagggauagcacuga

SEQ ID NO: 1033668 - RNA, 18 nt, Homo sapiens
uucagguauguguguaua

SEQ ID NO: 1033669 - RNA, 17 nt, Homo sapiens
uucagugcuguacuuga

SEQ ID NO: 1033670 - RNA, 13 nt, Homo sapiens
uucagugcuucuu

SEQ ID NO: 1033671 - RNA, 16 nt, Homo sapiens
uucaguguacauggaa

SEQ ID NO: 1033672 - RNA, 22 nt, Homo sapiens
uucaguguacauggaauaacau

SEQ ID NO: 1033673 - RNA, 19 nt, Homo sapiens
uucaguugaucacuggcaa

SEQ ID NO: 1033674 - RNA, 16 nt, Homo sapiens
uucauaaguauuucaa

SEQ ID NO: 1033675 - RNA, 19 nt, Homo sapiens
uucauaauuucuucacuca

SEQ ID NO: 1033676 - RNA, 17 nt, Homo sapiens
uucauacauuaucucac

SEQ ID NO: 1033677 - RNA, 18 nt, Homo sapiens
uucauacauuaucucacu

SEQ ID NO: 1033678 - RNA, 20 nt, Homo sapiens
uucauauauuuguaugaucc

SEQ ID NO: 1033679 - RNA, 23 nt, Homo sapiens
uucauauuguggcacaagcaaaa

SEQ ID NO: 1033680 - RNA, 12 nt, Homo sapiens
uucaucaggggc

SEQ ID NO: 1033681 - RNA, 14 nt, Homo sapiens
uucaucccacaauc

SEQ ID NO: 1033682 - RNA, 20 nt, Homo sapiens
uucaucucaggccucccuca

SEQ ID NO: 1033683 - RNA, 15 nt, Homo sapiens
uucaucuucucagcu

SEQ ID NO: 1033684 - RNA, 17 nt, Homo sapiens
uucaucuuuuguauagu

SEQ ID NO: 1033685 - RNA, 21 nt, Homo sapiens
uucaugaaaagauuaugaucu

SEQ ID NO: 1033686 - RNA, 16 nt, Homo sapiens
uucaugcauuugcacu

SEQ ID NO: 1033687 - RNA, 17 nt, Homo sapiens
uucaugguuuccuccag

SEQ ID NO: 1033688 - RNA, 17 nt, Homo sapiens
uucaugugucaacuuca

SEQ ID NO: 1033689 - RNA, 23 nt, Homo sapiens
uucauuaagcccucuuccaucau

SEQ ID NO: 1033690 - RNA, 15 nt, Homo sapiens
uucauuacagcuuaa

SEQ ID NO: 1033691 - RNA, 20 nt, Homo sapiens
uucauuauuggaauuaaccu

SEQ ID NO: 1033692 - RNA, 21 nt, Homo sapiens
uucauucaagucuaugaugcu

SEQ ID NO: 1033693 - RNA, 10 nt, Homo sapiens
uucauuccau

SEQ ID NO: 1033694 - RNA, 13 nt, Homo sapiens
uucauugacugau

SEQ ID NO: 1033695 - RNA, 23 nt, Homo sapiens
uucauugcccccagggcacuuca

SEQ ID NO: 1033696 - RNA, 15 nt, Homo sapiens
uucauuguguucucu

SEQ ID NO: 1033697 - RNA, 22 nt, Homo sapiens
uucauuuacuguggcuucuuaa

SEQ ID NO: 1033698 - RNA, 17 nt, Homo sapiens
uucauuuugagaucaag

SEQ ID NO: 1033699 - RNA, 19 nt, Homo sapiens
uucauuuuuaaucaugaaa

SEQ ID NO: 1033700 - RNA, 21 nt, Homo sapiens
uucauuuuuacccuuacuugg

SEQ ID NO: 1033701 - RNA, 17 nt, Homo sapiens
uucauuuuuuucacugg

SEQ ID NO: 1033702 - RNA, 19 nt, Homo sapiens
uuccaaacacauacaggaa

SEQ ID NO: 1033703 - RNA, 20 nt, Homo sapiens
uuccaaaggcauaagacccu

SEQ ID NO: 1033704 - RNA, 14 nt, Homo sapiens
uuccaaaugaauga

SEQ ID NO: 1033705 - RNA, 21 nt, Homo sapiens
uuccaacaccacagacacaca

SEQ ID NO: 1033706 - RNA, 19 nt, Homo sapiens
uuccaaggguacuaaggaa

SEQ ID NO: 1033707 - RNA, 23 nt, Homo sapiens
uuccacacccccaccccuugcuc

SEQ ID NO: 1033708 - RNA, 23 nt, Homo sapiens
uuccacguguuuuauuccuguau

SEQ ID NO: 1033709 - RNA, 10 nt, Homo sapiens
uuccacugag

SEQ ID NO: 1033710 - RNA, 13 nt, Homo sapiens
uuccagauauuca

SEQ ID NO: 1033711 - RNA, 19 nt, Homo sapiens
uuccaggaaaaucugcacu

SEQ ID NO: 1033712 - RNA, 19 nt, Homo sapiens
uuccaggcgaugugcaagu

SEQ ID NO: 1033713 - RNA, 22 nt, Homo sapiens
uuccaucccaggcuuuugaaaa

SEQ ID NO: 1033714 - RNA, 15 nt, Homo sapiens
uuccaugaagaccac

SEQ ID NO: 1033715 - RNA, 15 nt, Homo sapiens
uuccauuccaagccu

SEQ ID NO: 1033716 - RNA, 13 nt, Homo sapiens
uuccauucuggaa

SEQ ID NO: 1033717 - RNA, 13 nt, Homo sapiens
uuccauuuaguaa

SEQ ID NO: 1033718 - RNA, 18 nt, Homo sapiens
uucccaaauuucauaccu

SEQ ID NO: 1033719 - RNA, 16 nt, Homo sapiens
uucccaagcccaugag

SEQ ID NO: 1033720 - RNA, 11 nt, Homo sapiens
uucccaccacc

SEQ ID NO: 1033721 - RNA, 21 nt, Homo sapiens
uucccaccaggcugcucaggg

SEQ ID NO: 1033722 - RNA, 22 nt, Homo sapiens
uucccacuggaggucacauuca

SEQ ID NO: 1033723 - RNA, 20 nt, Homo sapiens
uucccaguggucaaaccgca

SEQ ID NO: 1033724 - RNA, 21 nt, Homo sapiens
uuccccaaagacgaccagcau

SEQ ID NO: 1033725 - RNA, 16 nt, Homo sapiens
uuccccaacaguguga

SEQ ID NO: 1033726 - RNA, 22 nt, Homo sapiens
uuccccaccccagcucaugccc

SEQ ID NO: 1033727 - RNA, 21 nt, Homo sapiens
uuccccagcgucccagucucu

SEQ ID NO: 1033728 - RNA, 14 nt, Homo sapiens
uuccccucacuauc

SEQ ID NO: 1033729 - RNA, 19 nt, Homo sapiens
uuccccucccuggguucag

SEQ ID NO: 1033730 - RNA, 21 nt, Homo sapiens
uuccccuugcccagggcucag

SEQ ID NO: 1033731 - RNA, 16 nt, Homo sapiens
uucccggccauucucc

SEQ ID NO: 1033732 - RNA, 19 nt, Homo sapiens
uucccggcgucccuaccuc

SEQ ID NO: 1033733 - RNA, 18 nt, Homo sapiens
uucccguauugacaggaa

SEQ ID NO: 1033734 - RNA, 21 nt, Homo sapiens
uucccuauuuugccaguggga

SEQ ID NO: 1033735 - RNA, 19 nt, Homo sapiens
uucccugaaaccguuaaaa

SEQ ID NO: 1033736 - RNA, 19 nt, Homo sapiens
uucccuuuuguauucucuu

SEQ ID NO: 1033737 - RNA, 21 nt, Homo sapiens
uuccggccuccugucccucau

SEQ ID NO: 1033738 - RNA, 16 nt, Homo sapiens
uuccuauaugcacuua

SEQ ID NO: 1033739 - RNA, 22 nt, Homo sapiens
uuccuauggcuggccacugcac

SEQ ID NO: 1033740 - RNA, 15 nt, Homo sapiens
uuccuauguaacugc

SEQ ID NO: 1033741 - RNA, 20 nt, Homo sapiens
uuccuauuuggggcuugcau

SEQ ID NO: 1033742 - RNA, 19 nt, Homo sapiens
uuccuauuuguuuucaugg

SEQ ID NO: 1033743 - RNA, 15 nt, Homo sapiens
uuccuccaucuccaa

SEQ ID NO: 1033744 - RNA, 22 nt, Homo sapiens
uuccucgcuagaguucuccaga

SEQ ID NO: 1033745 - RNA, 12 nt, Homo sapiens
uuccugaggcug

SEQ ID NO: 1033746 - RNA, 11 nt, Homo sapiens
uuccugcaaug

SEQ ID NO: 1033747 - RNA, 21 nt, Homo sapiens
uuccugcaaugaagucucuga

SEQ ID NO: 1033748 - RNA, 18 nt, Homo sapiens
uuccugcauucacccaga

SEQ ID NO: 1033749 - RNA, 14 nt, Homo sapiens
uuccuguagccuuc

SEQ ID NO: 1033750 - RNA, 22 nt, Homo sapiens
ucaccucacugaaaacaucugg

SEQ ID NO: 1033751 - RNA, 16 nt, Homo sapiens
ucaccucugaaaacgg

SEQ ID NO: 1033752 - RNA, 17 nt, Homo sapiens
ucaccugaggucaggag

SEQ ID NO: 1033753 - RNA, 16 nt, Homo sapiens
ucaccuguaaaccuga

SEQ ID NO: 1033754 - RNA, 19 nt, Homo sapiens
ucaccuuaggaauaaucuc

SEQ ID NO: 1033755 - RNA, 14 nt, Homo sapiens
ucacgauauuauua

SEQ ID NO: 1033756 - RNA, 15 nt, Homo sapiens
ucacgcaggagccau

SEQ ID NO: 1033757 - RNA, 16 nt, Homo sapiens
ucacggcucacugcag

SEQ ID NO: 1033758 - RNA, 16 nt, Homo sapiens
ucacguaaagcuagaa

SEQ ID NO: 1033759 - RNA, 19 nt, Homo sapiens
ucacuaaaguauaucuuua

SEQ ID NO: 1033760 - RNA, 14 nt, Homo sapiens
ucacuagacugugc

SEQ ID NO: 1033761 - RNA, 23 nt, Homo sapiens
ucacuagccaugauaacugcaau

SEQ ID NO: 1033762 - RNA, 17 nt, Homo sapiens
ucacuauggugccaaug

SEQ ID NO: 1033763 - RNA, 19 nt, Homo sapiens
ucacucagugauugcaauu

SEQ ID NO: 1033764 - RNA, 14 nt, Homo sapiens
ucacucccagucca

SEQ ID NO: 1033765 - RNA, 16 nt, Homo sapiens
ucacucugaauccuca

SEQ ID NO: 1033766 - RNA, 14 nt, Homo sapiens
ucacucuuguggau

SEQ ID NO: 1033767 - RNA, 14 nt, Homo sapiens
ucacugagaagauu

SEQ ID NO: 1033768 - RNA, 18 nt, Homo sapiens
ucacugagaagauuguga

SEQ ID NO: 1033769 - RNA, 22 nt, Homo sapiens
ucacugagaagauugugaauau

SEQ ID NO: 1033770 - RNA, 16 nt, Homo sapiens
ucacugccuuugcucc

SEQ ID NO: 1033771 - RNA, 14 nt, Homo sapiens
ucacugcuaccucu

SEQ ID NO: 1033772 - RNA, 13 nt, Homo sapiens
ucacuggaugaaa

SEQ ID NO: 1033773 - RNA, 14 nt, Homo sapiens
ucacuguccuccaa

SEQ ID NO: 1033774 - RNA, 21 nt, Homo sapiens
ucacuuaauaauguguacauu

SEQ ID NO: 1033775 - RNA, 15 nt, Homo sapiens
ucacuugaaccuggg

SEQ ID NO: 1033776 - RNA, 14 nt, Homo sapiens
ucacuugagaccag

SEQ ID NO: 1033777 - RNA, 13 nt, Homo sapiens
ucacuuguacaaa

SEQ ID NO: 1033778 - RNA, 20 nt, Homo sapiens
ucacuugugcaguguugaca

SEQ ID NO: 1033779 - RNA, 14 nt, Homo sapiens
ucacuuguucuuaa

SEQ ID NO: 1033780 - RNA, 16 nt, Homo sapiens
ucacuuuaauucucau

SEQ ID NO: 1033781 - RNA, 20 nt, Homo sapiens
ucacuuuugaagcaauauca

SEQ ID NO: 1033782 - RNA, 19 nt, Homo sapiens
ucacuuuuuacagugcuau

SEQ ID NO: 1033783 - RNA, 23 nt, Homo sapiens
ucacuuuuuuucuuuucucugcc

SEQ ID NO: 1033784 - RNA, 14 nt, Homo sapiens
ucagaaacacuggg

SEQ ID NO: 1033785 - RNA, 12 nt, Homo sapiens
ucagaaaccaaa

SEQ ID NO: 1033786 - RNA, 14 nt, Homo sapiens
ucagaaauguacaa

SEQ ID NO: 1033787 - RNA, 22 nt, Homo sapiens
ucagaacucuguguugugaaug

SEQ ID NO: 1033788 - RNA, 16 nt, Homo sapiens
ucagaagaaauucugc

SEQ ID NO: 1033789 - RNA, 20 nt, Homo sapiens
ucagaaggggaggggagaca

SEQ ID NO: 1033790 - RNA, 14 nt, Homo sapiens
ucagaauacagaca

SEQ ID NO: 1033791 - RNA, 19 nt, Homo sapiens
ucagacuccugugcaacuu

SEQ ID NO: 1033792 - RNA, 21 nt, Homo sapiens
ucagacuccugugcaacuuuc

SEQ ID NO: 1033793 - RNA, 21 nt, Homo sapiens
ucagacugcugggacuggcca

SEQ ID NO: 1033794 - RNA, 22 nt, Homo sapiens
ucagacuuuggaaaaugcauug

SEQ ID NO: 1033795 - RNA, 17 nt, Homo sapiens
ucagagagggugacaag

SEQ ID NO: 1033796 - RNA, 14 nt, Homo sapiens
ucagaggccuauaa

SEQ ID NO: 1033797 - RNA, 18 nt, Homo sapiens
ucagagggcguguuguuu

SEQ ID NO: 1033798 - RNA, 19 nt, Homo sapiens
ucagaguuccgacugccau

SEQ ID NO: 1033799 - RNA, 22 nt, Homo sapiens
ucagaguugcugcaaaccugac

SEQ ID NO: 1033800 - RNA, 15 nt, Homo sapiens
ucagaguugugcaca

SEQ ID NO: 1033801 - RNA, 21 nt, Homo sapiens
ucagauacaugguugugaccu

SEQ ID NO: 1033802 - RNA, 12 nt, Homo sapiens
ucagaugaacuc

SEQ ID NO: 1033803 - RNA, 12 nt, Homo sapiens
ucagauggacaa

SEQ ID NO: 1033804 - RNA, 13 nt, Homo sapiens
ucagaugucucug

SEQ ID NO: 1033805 - RNA, 17 nt, Homo sapiens
ucagauugcaugugacu

SEQ ID NO: 1033806 - RNA, 18 nt, Homo sapiens
ucagauuguuaucuauca

SEQ ID NO: 1033807 - RNA, 22 nt, Homo sapiens
ucagauuguuaucuaucaacua

SEQ ID NO: 1033808 - RNA, 21 nt, Homo sapiens
ucagauuuuaaaaagucuuca

SEQ ID NO: 1033809 - RNA, 19 nt, Homo sapiens
ucagcaaaagaugcuucuc

SEQ ID NO: 1033810 - RNA, 17 nt, Homo sapiens
ucagcaacaaccagcau

SEQ ID NO: 1033811 - RNA, 17 nt, Homo sapiens
ucagcaagaauuugauc

SEQ ID NO: 1033812 - RNA, 12 nt, Homo sapiens
ucagcaaugauu

SEQ ID NO: 1033813 - RNA, 16 nt, Homo sapiens
ucagcaccuacagugu

SEQ ID NO: 1033814 - RNA, 22 nt, Homo sapiens
ucagcaccuacaguguacaguc

SEQ ID NO: 1033815 - RNA, 14 nt, Homo sapiens
ucagcauaccugcu

SEQ ID NO: 1033816 - RNA, 20 nt, Homo sapiens
ucagcaugaaggaugccaua

SEQ ID NO: 1033817 - RNA, 22 nt, Homo sapiens
ucagcaugcauccuuugcacug

SEQ ID NO: 1033818 - RNA, 21 nt, Homo sapiens
ucagccccugauccugugaag

SEQ ID NO: 1033819 - RNA, 13 nt, Homo sapiens
ucagcccuggauu

SEQ ID NO: 1033820 - RNA, 19 nt, Homo sapiens
ucagccgcuucugacugcu

SEQ ID NO: 1033821 - RNA, 18 nt, Homo sapiens
ucagccuagccgaccuca

SEQ ID NO: 1033822 - RNA, 19 nt, Homo sapiens
ucagccucccgaauagcug

SEQ ID NO: 1033823 - RNA, 20 nt, Homo sapiens
ucagccucuuaaagcugccu

SEQ ID NO: 1033824 - RNA, 14 nt, Homo sapiens
ucagccugagucuc

SEQ ID NO: 1033825 - RNA, 17 nt, Homo sapiens
ucagccugucucuucca

SEQ ID NO: 1033826 - RNA, 20 nt, Homo sapiens
ucagcuacuucugaaacugc

SEQ ID NO: 1033827 - RNA, 16 nt, Homo sapiens
ucagcucacuguucua

SEQ ID NO: 1033828 - RNA, 19 nt, Homo sapiens
ucagcucuugagagcauuc

SEQ ID NO: 1033829 - RNA, 19 nt, Homo sapiens
ugcuuaggaugugugcaug

SEQ ID NO: 1033830 - RNA, 22 nt, Homo sapiens
ugcuuaguaaugcuacguguga

SEQ ID NO: 1033831 - RNA, 17 nt, Homo sapiens
ugcuuagucccucaugc

SEQ ID NO: 1033832 - RNA, 19 nt, Homo sapiens
ugcuuagucccucaugcaa

SEQ ID NO: 1033833 - RNA, 13 nt, Homo sapiens
ugcuucagccucc

SEQ ID NO: 1033834 - RNA, 13 nt, Homo sapiens
ugcuucaucugcu

SEQ ID NO: 1033835 - RNA, 14 nt, Homo sapiens
ugcuucaugcucag

SEQ ID NO: 1033836 - RNA, 23 nt, Homo sapiens
ugcuuccuccuuugcucuuggga

SEQ ID NO: 1033837 - RNA, 18 nt, Homo sapiens
ugcuuccugucugaguaa

SEQ ID NO: 1033838 - RNA, 16 nt, Homo sapiens
ugcuucgcagaugucc

SEQ ID NO: 1033839 - RNA, 17 nt, Homo sapiens
ugcuugaaaccaaagau

SEQ ID NO: 1033840 - RNA, 17 nt, Homo sapiens
uuaauaccacagcuuuu

SEQ ID NO: 1033841 - RNA, 23 nt, Homo sapiens
uuaauauaugcaucccuggugaa

SEQ ID NO: 1033842 - RNA, 19 nt, Homo sapiens
uuaauaucaucaguauuga

SEQ ID NO: 1033843 - RNA, 23 nt, Homo sapiens
uuaauauguuaaccucaguguca

SEQ ID NO: 1033844 - RNA, 14 nt, Homo sapiens
uuaauauuccucag

SEQ ID NO: 1033845 - RNA, 16 nt, Homo sapiens
uuaauauugugcaaac

SEQ ID NO: 1033846 - RNA, 20 nt, Homo sapiens
uuaaucacaccguccuccac

SEQ ID NO: 1033847 - RNA, 11 nt, Homo sapiens
uuaaucaccaa

SEQ ID NO: 1033848 - RNA, 14 nt, Homo sapiens
uuaaucacuuuuga

SEQ ID NO: 1033849 - RNA, 12 nt, Homo sapiens
uuaauccagaau

SEQ ID NO: 1033850 - RNA, 14 nt, Homo sapiens
uuaaucuuuucaca

SEQ ID NO: 1033851 - RNA, 18 nt, Homo sapiens
uuaaugaagaaaguggaa

SEQ ID NO: 1033852 - RNA, 20 nt, Homo sapiens
uuaauggcucaugaccugga

SEQ ID NO: 1033853 - RNA, 18 nt, Homo sapiens
uuaaugugcuguguaaag

SEQ ID NO: 1033854 - RNA, 12 nt, Homo sapiens
uuaauuacauaa

SEQ ID NO: 1033855 - RNA, 18 nt, Homo sapiens
uuaauuauuguacauuua

SEQ ID NO: 1033856 - RNA, 20 nt, Homo sapiens
uuaauuuauugaggcuuuaa

SEQ ID NO: 1033857 - RNA, 18 nt, Homo sapiens
uuacaaagggggaggcua

SEQ ID NO: 1033858 - RNA, 11 nt, Homo sapiens
uuacaagcccc

SEQ ID NO: 1033859 - RNA, 20 nt, Homo sapiens
uuacaaucagccacauucua

SEQ ID NO: 1033860 - RNA, 20 nt, Homo sapiens
uuacaaugcauucugaggua

SEQ ID NO: 1033861 - RNA, 13 nt, Homo sapiens
uuacaauugugag

SEQ ID NO: 1033862 - RNA, 18 nt, Homo sapiens
uuacagcugagcacauuc

SEQ ID NO: 1033863 - RNA, 19 nt, Homo sapiens
uuacagcugagcacauucu

SEQ ID NO: 1033864 - RNA, 11 nt, Homo sapiens
uuacagcugcc

SEQ ID NO: 1033865 - RNA, 24 nt, Homo sapiens
uuacagcugccugcaguacuuuac

SEQ ID NO: 1033866 - RNA, 17 nt, Homo sapiens
uuacaggcgugagccac

SEQ ID NO: 1033867 - RNA, 12 nt, Homo sapiens
uuacaguguaug

SEQ ID NO: 1033868 - RNA, 20 nt, Homo sapiens
uuacaguugaaagcuguauu

SEQ ID NO: 1033869 - RNA, 14 nt, Homo sapiens
uuacauaucaccuc

SEQ ID NO: 1033870 - RNA, 14 nt, Homo sapiens
uuacauucaucuca

SEQ ID NO: 1033871 - RNA, 15 nt, Homo sapiens
uuacauuuccaaaug

SEQ ID NO: 1033872 - RNA, 21 nt, Homo sapiens
uuacauuuccaaaugaaugac

SEQ ID NO: 1033873 - RNA, 17 nt, Homo sapiens
uuacauuugaaaucuau

SEQ ID NO: 1033874 - RNA, 19 nt, Homo sapiens
uuaccaaggaugaaagagg

SEQ ID NO: 1033875 - RNA, 14 nt, Homo sapiens
uuaccacaccccau

SEQ ID NO: 1033876 - RNA, 17 nt, Homo sapiens
uuaccagaagcuuccau

SEQ ID NO: 1033877 - RNA, 22 nt, Homo sapiens
uuaccaggaagcagauacauau

SEQ ID NO: 1033878 - RNA, 13 nt, Homo sapiens
uuacccuuaggga

SEQ ID NO: 1033879 - RNA, 14 nt, Homo sapiens
uuaccuaaacagau

SEQ ID NO: 1033880 - RNA, 21 nt, Homo sapiens
uuaccuagauuuacagccuca

SEQ ID NO: 1033881 - RNA, 19 nt, Homo sapiens
uuaccuaguagucauuuca

SEQ ID NO: 1033882 - RNA, 16 nt, Homo sapiens
uuaccuauguaacaaa

SEQ ID NO: 1033883 - RNA, 15 nt, Homo sapiens
uuaccucacagugau

SEQ ID NO: 1033884 - RNA, 22 nt, Homo sapiens
uuaccugaaauaaaauucauua

SEQ ID NO: 1033885 - RNA, 12 nt, Homo sapiens
uuacgugcaaua

SEQ ID NO: 1033886 - RNA, 17 nt, Homo sapiens
uuacuaaaguacagaca

SEQ ID NO: 1033887 - RNA, 16 nt, Homo sapiens
uuacuaagcauagcaa

SEQ ID NO: 1033888 - RNA, 19 nt, Homo sapiens
uuacuauauucuuacccua

SEQ ID NO: 1033889 - RNA, 17 nt, Homo sapiens
uuacuaucaugucaaac

SEQ ID NO: 1033890 - RNA, 15 nt, Homo sapiens
uuacuccagugccaa

SEQ ID NO: 1033891 - RNA, 12 nt, Homo sapiens
uuacugaaguua

SEQ ID NO: 1033892 - RNA, 20 nt, Homo sapiens
uuacugagcuucucugugaa

SEQ ID NO: 1033893 - RNA, 19 nt, Homo sapiens
uuacugauuaggacuuuua

SEQ ID NO: 1033894 - RNA, 17 nt, Homo sapiens
uuacugauucauacauu

SEQ ID NO: 1033895 - RNA, 19 nt, Homo sapiens
uuacugcaaccuuugccuc

SEQ ID NO: 1033896 - RNA, 21 nt, Homo sapiens
uuacugcuucuuuucacuuca

SEQ ID NO: 1033897 - RNA, 23 nt, Homo sapiens
uuacugugaaacuggcacugaau

SEQ ID NO: 1033898 - RNA, 22 nt, Homo sapiens
uuacuguugugaccugaaguuc

SEQ ID NO: 1033899 - RNA, 20 nt, Homo sapiens
uuacuuaaagauuuaucaaa

SEQ ID NO: 1033900 - RNA, 21 nt, Homo sapiens
uuacuucacuuuaauucucau

SEQ ID NO: 1033901 - RNA, 19 nt, Homo sapiens
uuacuuuaccacccccaca

SEQ ID NO: 1033902 - RNA, 15 nt, Homo sapiens
uuacuuuggaauaca

SEQ ID NO: 1033903 - RNA, 16 nt, Homo sapiens
uuacuuuguguucacc

SEQ ID NO: 1033904 - RNA, 13 nt, Homo sapiens
uuagaaaaaccac

SEQ ID NO: 1033905 - RNA, 19 nt, Homo sapiens
uuagaaaaaccaccaccau

SEQ ID NO: 1033906 - RNA, 17 nt, Homo sapiens
uuagacagagucucacu

SEQ ID NO: 1033907 - RNA, 14 nt, Homo sapiens
uuagacauaacaaa

SEQ ID NO: 1033908 - RNA, 22 nt, Homo sapiens
uuagacaugacugaugacauau

SEQ ID NO: 1033909 - RNA, 23 nt, Homo sapiens
uuagacuguaggaagaguagcau

SEQ ID NO: 1033910 - RNA, 19 nt, Homo sapiens
uuagacuucugcuuuccac

SEQ ID NO: 1033911 - RNA, 12 nt, Homo sapiens
uuagacuugaaa

SEQ ID NO: 1033912 - RNA, 14 nt, Homo sapiens
uuagagacaucaaa

SEQ ID NO: 1033913 - RNA, 20 nt, Homo sapiens
uuagagcauugccauucccu

SEQ ID NO: 1033914 - RNA, 16 nt, Homo sapiens
uuagagcugccugugc

SEQ ID NO: 1033915 - RNA, 20 nt, Homo sapiens
uuagaggaucccucucugga

SEQ ID NO: 1033916 - RNA, 17 nt, Homo sapiens
uuagagugucuuuccac

SEQ ID NO: 1033917 - RNA, 17 nt, Homo sapiens
uuagauuagcucuggac

SEQ ID NO: 1033918 - RNA, 21 nt, Homo sapiens
uuagcauaaaauuuucuacuc

SEQ ID NO: 1033919 - RNA, 22 nt, Homo sapiens
uuagcuaccucacuaugcugcu

SEQ ID NO: 1033920 - RNA, 23 nt, Homo sapiens
uuagcuaccucacuaugcugcuu

SEQ ID NO: 1033921 - RNA, 20 nt, Homo sapiens
uuagcugguggcaauaaaua

SEQ ID NO: 1033922 - RNA, 12 nt, Homo sapiens
uuagcuuuacaa

SEQ ID NO: 1033923 - RNA, 13 nt, Homo sapiens
uuaggacuuucca

SEQ ID NO: 1033924 - RNA, 20 nt, Homo sapiens
uuaggauuucuguauuugcc

SEQ ID NO: 1033925 - RNA, 20 nt, Homo sapiens
uuaggcaggaucuguacaau

SEQ ID NO: 1033926 - RNA, 16 nt, Homo sapiens
uuagggagagucauau

SEQ ID NO: 1033927 - RNA, 16 nt, Homo sapiens
uuagggaugacuguga

SEQ ID NO: 1033928 - RNA, 17 nt, Homo sapiens
uuagguuuuguacaauu

SEQ ID NO: 1033929 - RNA, 17 nt, Homo sapiens
uuaguaacauagacaaa

SEQ ID NO: 1033930 - RNA, 15 nt, Homo sapiens
uuaguaaggcugugu

SEQ ID NO: 1033931 - RNA, 16 nt, Homo sapiens
uuaguagagacagggu

SEQ ID NO: 1033932 - RNA, 21 nt, Homo sapiens
uuaguagagaugggguuucac

SEQ ID NO: 1033933 - RNA, 22 nt, Homo sapiens
uuagucauucaauaaauuguaa

SEQ ID NO: 1033934 - RNA, 21 nt, Homo sapiens
uuagugacagcucugccuguu

SEQ ID NO: 1033935 - RNA, 18 nt, Homo sapiens
uuaguggauuacugccau

SEQ ID NO: 1033936 - RNA, 14 nt, Homo sapiens
uuaguguacaugaa

SEQ ID NO: 1033937 - RNA, 14 nt, Homo sapiens
uuaguucuuuggaa

SEQ ID NO: 1033938 - RNA, 23 nt, Homo sapiens
uuauaaaagaauaaaauugcacu

SEQ ID NO: 1033939 - RNA, 21 nt, Homo sapiens
uuauaaacuuuagaguagcau

SEQ ID NO: 1033940 - RNA, 20 nt, Homo sapiens
uuauaacauccacaaagaga

SEQ ID NO: 1033941 - RNA, 23 nt, Homo sapiens
uuauaagagugccguaacaacug

SEQ ID NO: 1033942 - RNA, 14 nt, Homo sapiens
uuauaauauacuau

SEQ ID NO: 1033943 - RNA, 21 nt, Homo sapiens
uuauaauucuugaaugaggca

SEQ ID NO: 1033944 - RNA, 18 nt, Homo sapiens
uuauacauuaacuucagc

SEQ ID NO: 1033945 - RNA, 21 nt, Homo sapiens
uuauagaauauuuauuaccuc

SEQ ID NO: 1033946 - RNA, 23 nt, Homo sapiens
uuauagggaugaguccccuguga

SEQ ID NO: 1033947 - RNA, 17 nt, Homo sapiens
uuauagugacaaugaag

SEQ ID NO: 1033948 - RNA, 22 nt, Homo sapiens
uuauauauacaguaacuuuaug

SEQ ID NO: 1033949 - RNA, 16 nt, Homo sapiens
uuauauauuacuuguu

SEQ ID NO: 1033950 - RNA, 19 nt, Homo sapiens
uuauauauuuauaacucau

SEQ ID NO: 1033951 - RNA, 13 nt, Homo sapiens
uuauauggaugau

SEQ ID NO: 1033952 - RNA, 16 nt, Homo sapiens
uuauauuaaaauaugg

SEQ ID NO: 1033953 - RNA, 14 nt, Homo sapiens
uuauauuucacuau

SEQ ID NO: 1033954 - RNA, 20 nt, Homo sapiens
uuaucaaacuucagcuguac

SEQ ID NO: 1033955 - RNA, 19 nt, Homo sapiens
uuaucacacuucugugaga

SEQ ID NO: 1033956 - RNA, 18 nt, Homo sapiens
uuaucaccgugggcuccc

SEQ ID NO: 1033957 - RNA, 21 nt, Homo sapiens
uuaucaugcaaaugcuguauu

SEQ ID NO: 1033958 - RNA, 14 nt, Homo sapiens
uuauccuguucucu

SEQ ID NO: 1033959 - RNA, 18 nt, Homo sapiens
uuaucucacuugugccaa

SEQ ID NO: 1033960 - RNA, 13 nt, Homo sapiens
uuaucugugcaaa

SEQ ID NO: 1033961 - RNA, 15 nt, Homo sapiens
uuaucuuggacugac

SEQ ID NO: 1033962 - RNA, 15 nt, Homo sapiens
uuaucuuuauaugaa

SEQ ID NO: 1033963 - RNA, 16 nt, Homo sapiens
uuaugaguggcuuuaa

SEQ ID NO: 1033964 - RNA, 16 nt, Homo sapiens
uuaugcauaaagucag

SEQ ID NO: 1033965 - RNA, 15 nt, Homo sapiens
uuaugccuucacuuu

SEQ ID NO: 1033966 - RNA, 13 nt, Homo sapiens
uuauguaaucuca

SEQ ID NO: 1033967 - RNA, 14 nt, Homo sapiens
uuauguaaucucac

SEQ ID NO: 1033968 - RNA, 14 nt, Homo sapiens
uuaugucugcugaa

SEQ ID NO: 1033969 - RNA, 19 nt, Homo sapiens
uuaugugugaggagcugcu

SEQ ID NO: 1033970 - RNA, 14 nt, Homo sapiens
uuauguuagcauug

SEQ ID NO: 1033971 - RNA, 16 nt, Homo sapiens
uuauuaaacguaugca

SEQ ID NO: 1033972 - RNA, 14 nt, Homo sapiens
uuauuaacauugau

SEQ ID NO: 1033973 - RNA, 16 nt, Homo sapiens
uuauuacaucuuucac

SEQ ID NO: 1033974 - RNA, 17 nt, Homo sapiens
uuauuacuaauugucua

SEQ ID NO: 1033975 - RNA, 19 nt, Homo sapiens
uuauuaggaaguaugguuu

SEQ ID NO: 1033976 - RNA, 18 nt, Homo sapiens
uuauuaggauuccaccuu

SEQ ID NO: 1033977 - RNA, 15 nt, Homo sapiens
uuauuauaacaucca

SEQ ID NO: 1033978 - RNA, 15 nt, Homo sapiens
uuauucugauuccac

SEQ ID NO: 1033979 - RNA, 22 nt, Homo sapiens
uuauugaaacaggauacacaca

SEQ ID NO: 1033980 - RNA, 12 nt, Homo sapiens
uuauugaaucua

SEQ ID NO: 1033981 - RNA, 12 nt, Homo sapiens
uuauugcauaau

SEQ ID NO: 1033982 - RNA, 18 nt, Homo sapiens
uuauuguauuuauuccau

SEQ ID NO: 1033983 - RNA, 14 nt, Homo sapiens
uuauugugccucag

SEQ ID NO: 1033984 - RNA, 23 nt, Homo sapiens
uuauuuaccugaaauaaaauuca

SEQ ID NO: 1033985 - RNA, 22 nt, Homo sapiens
uuauuuaguuggaggccuuuag

SEQ ID NO: 1033986 - RNA, 13 nt, Homo sapiens
uuauuuugacaaa

SEQ ID NO: 1033987 - RNA, 19 nt, Homo sapiens
uuauuuuuauaucagccug

SEQ ID NO: 1033988 - RNA, 17 nt, Homo sapiens
uuauuuuuuuacuuccu

SEQ ID NO: 1033989 - RNA, 15 nt, Homo sapiens
gaagaugaugcuauu

SEQ ID NO: 1033990 - RNA, 23 nt, Homo sapiens
gaagcaaaucagaaacuugugaa

SEQ ID NO: 1033991 - RNA, 19 nt, Homo sapiens
gaagcaacaggaaucaaga

SEQ ID NO: 1033992 - RNA, 12 nt, Homo sapiens
gaagcacagcuu

SEQ ID NO: 1033993 - RNA, 13 nt, Homo sapiens
gaagcagcugcuu

SEQ ID NO: 1033994 - RNA, 18 nt, Homo sapiens
gaagcaggcuacacugac

SEQ ID NO: 1033995 - RNA, 19 nt, Homo sapiens
gaagcagugccuuccauaa

SEQ ID NO: 1033996 - RNA, 21 nt, Homo sapiens
gaagcaucacauaaaaaugau

SEQ ID NO: 1033997 - RNA, 15 nt, Homo sapiens
gaagcauuuacuuug

SEQ ID NO: 1033998 - RNA, 14 nt, Homo sapiens
gaagccaaagccaa

SEQ ID NO: 1033999 - RNA, 16 nt, Homo sapiens
gaagccaacuuggcuu

SEQ ID NO: 1034000 - RNA, 21 nt, Homo sapiens
gaagccucacugcaagcacug

SEQ ID NO: 1034001 - RNA, 16 nt, Homo sapiens
gaagccucuggcuaga

SEQ ID NO: 1034002 - RNA, 22 nt, Homo sapiens
gaagccuuagccaggaggccag

SEQ ID NO: 1034003 - RNA, 17 nt, Homo sapiens
gaagcucacccaauaaa

SEQ ID NO: 1034004 - RNA, 22 nt, Homo sapiens
gaagcucaccuguugcuuacaa

SEQ ID NO: 1034005 - RNA, 22 nt, Homo sapiens
gaagcucccugaaguaagcaaa

SEQ ID NO: 1034006 - RNA, 21 nt, Homo sapiens
gaagcucuggugacaccagcc

SEQ ID NO: 1034007 - RNA, 13 nt, Homo sapiens
gaagcugcuccgu

SEQ ID NO: 1034008 - RNA, 20 nt, Homo sapiens
gaagcugcuguucuuagcaa

SEQ ID NO: 1034009 - RNA, 15 nt, Homo sapiens
gaagcuuccauucca

SEQ ID NO: 1034010 - RNA, 21 nt, Homo sapiens
gaaggaagucagcaugccucu

SEQ ID NO: 1034011 - RNA, 13 nt, Homo sapiens
gaaggacauuuua

SEQ ID NO: 1034012 - RNA, 13 nt, Homo sapiens
gaaggaugaauga

SEQ ID NO: 1034013 - RNA, 23 nt, Homo sapiens
gaaggaugucccggguguguaca

SEQ ID NO: 1034014 - RNA, 13 nt, Homo sapiens
gaaggcaaaaaga

SEQ ID NO: 1034015 - RNA, 16 nt, Homo sapiens
gaaggcaaaugacuuu

SEQ ID NO: 1034016 - RNA, 12 nt, Homo sapiens
gaaggccaagag

SEQ ID NO: 1034017 - RNA, 22 nt, Homo sapiens
gaaggcucuucugacuacuggg

SEQ ID NO: 1034018 - RNA, 12 nt, Homo sapiens
gaagggccaguc

SEQ ID NO: 1034019 - RNA, 15 nt, Homo sapiens
gaagggcuaacucag

SEQ ID NO: 1034020 - RNA, 19 nt, Homo sapiens
gaagggcuagaaccuggag

SEQ ID NO: 1034021 - RNA, 18 nt, Homo sapiens
gaagguggggauugccca

SEQ ID NO: 1034022 - RNA, 20 nt, Homo sapiens
gaagguucucugugcuccuc

SEQ ID NO: 1034023 - RNA, 19 nt, Homo sapiens
gaagguuuguauauuguca

SEQ ID NO: 1034024 - RNA, 16 nt, Homo sapiens
gaaguaacauuugccu

SEQ ID NO: 1034025 - RNA, 19 nt, Homo sapiens
gaaguaagcaaagacuuuc

SEQ ID NO: 1034026 - RNA, 21 nt, Homo sapiens
gaaguaagcaaagacuuuccu

SEQ ID NO: 1034027 - RNA, 13 nt, Homo sapiens
gaagucacaucac

SEQ ID NO: 1034028 - RNA, 16 nt, Homo sapiens
gaagucuagaguuccu

SEQ ID NO: 1034029 - RNA, 12 nt, Homo sapiens
gaagucuuccau

SEQ ID NO: 1034030 - RNA, 12 nt, Homo sapiens
gaagugccaguu

SEQ ID NO: 1034031 - RNA, 20 nt, Homo sapiens
gaauaaaaauauguacaagu

SEQ ID NO: 1034032 - RNA, 18 nt, Homo sapiens
gaauaaaauuagcuugag

SEQ ID NO: 1034033 - RNA, 22 nt, Homo sapiens
gaauaaacuagauuacauucag

SEQ ID NO: 1034034 - RNA, 20 nt, Homo sapiens
gaauaacuguguuuccuacc

SEQ ID NO: 1034035 - RNA, 14 nt, Homo sapiens
gaauaauaccuaag

SEQ ID NO: 1034036 - RNA, 13 nt, Homo sapiens
gaauaauccagaa

SEQ ID NO: 1034037 - RNA, 16 nt, Homo sapiens
gaauaaugaauggacu

SEQ ID NO: 1034038 - RNA, 19 nt, Homo sapiens
gaauacaaacaccuggacu

SEQ ID NO: 1034039 - RNA, 14 nt, Homo sapiens
gaauacaaagugau

SEQ ID NO: 1034040 - RNA, 17 nt, Homo sapiens
gaauacauaaaguaugu

SEQ ID NO: 1034041 - RNA, 14 nt, Homo sapiens
gaauaccaguguua

SEQ ID NO: 1034042 - RNA, 14 nt, Homo sapiens
gaauacuuaacuca

SEQ ID NO: 1034043 - RNA, 18 nt, Homo sapiens
gaauagcaaggugcucac

SEQ ID NO: 1034044 - RNA, 15 nt, Homo sapiens
gaauaguaaguggug

SEQ ID NO: 1034045 - RNA, 18 nt, Homo sapiens
gaauauaaggaaagcaau

SEQ ID NO: 1034046 - RNA, 21 nt, Homo sapiens
gaauauaauacuguauuugag

SEQ ID NO: 1034047 - RNA, 19 nt, Homo sapiens
gaauauacuaaauuaacuu

SEQ ID NO: 1034048 - RNA, 20 nt, Homo sapiens
gaauauauuauaaucuucca

SEQ ID NO: 1034049 - RNA, 21 nt, Homo sapiens
gaauauauuauaaucuuccau

SEQ ID NO: 1034050 - RNA, 14 nt, Homo sapiens
gaauaugggagaaa

SEQ ID NO: 1034051 - RNA, 19 nt, Homo sapiens
gaauauggugggcacagaa

SEQ ID NO: 1034052 - RNA, 17 nt, Homo sapiens
gaauauguaaauagaaa

SEQ ID NO: 1034053 - RNA, 17 nt, Homo sapiens
gaauauuaugcccaguu

SEQ ID NO: 1034054 - RNA, 20 nt, Homo sapiens
gaaucaaggugauugugauu

SEQ ID NO: 1034055 - RNA, 14 nt, Homo sapiens
gaaucacucuugug

SEQ ID NO: 1034056 - RNA, 16 nt, Homo sapiens
gaaucacuucugagaa

SEQ ID NO: 1034057 - RNA, 15 nt, Homo sapiens
gaaucagcugggaug

SEQ ID NO: 1034058 - RNA, 14 nt, Homo sapiens
gaaucauuaucuua

SEQ ID NO: 1034059 - RNA, 19 nt, Homo sapiens
gaauccagaucauuccuca

SEQ ID NO: 1034060 - RNA, 22 nt, Homo sapiens
gaauccaguccagauauuucac

SEQ ID NO: 1034061 - RNA, 20 nt, Homo sapiens
gaaucccacccacaugugac

SEQ ID NO: 1034062 - RNA, 22 nt, Homo sapiens
gaaucuguuaccagaggacaaa

SEQ ID NO: 1034063 - RNA, 20 nt, Homo sapiens
gaaucuucacaaaacacuuc

SEQ ID NO: 1034064 - RNA, 23 nt, Homo sapiens
gaaucuuuuucagaaacagugag

SEQ ID NO: 1034065 - RNA, 21 nt, Homo sapiens
gaaugaaccuucuggccuccc

SEQ ID NO: 1034066 - RNA, 21 nt, Homo sapiens
gaaugaagccuuagccaggag

SEQ ID NO: 1034067 - RNA, 17 nt, Homo sapiens
gaaugacggcaaacuca

SEQ ID NO: 1034068 - RNA, 14 nt, Homo sapiens
gaaugagaagaaug

SEQ ID NO: 1034069 - RNA, 19 nt, Homo sapiens
gaaugagccuacgcugaag

SEQ ID NO: 1034070 - RNA, 14 nt, Homo sapiens
gaaugaggcuugcu

SEQ ID NO: 1034071 - RNA, 15 nt, Homo sapiens
gaaugaggcuugcug

SEQ ID NO: 1034072 - RNA, 24 nt, Homo sapiens
gaaugcacacuagccucuccagga

SEQ ID NO: 1034073 - RNA, 11 nt, Homo sapiens
gaaugcagugg

SEQ ID NO: 1034074 - RNA, 14 nt, Homo sapiens
gaauggcagcugcc

SEQ ID NO: 1034075 - RNA, 23 nt, Homo sapiens
gaauggcucacuauggugccaau

SEQ ID NO: 1034076 - RNA, 18 nt, Homo sapiens
gaaugguguuguaugccu

SEQ ID NO: 1034077 - RNA, 14 nt, Homo sapiens
gaauguacucuguu

SEQ ID NO: 1034078 - RNA, 16 nt, Homo sapiens
gaauguagcagauccc

SEQ ID NO: 1034079 - RNA, 20 nt, Homo sapiens
gaauguauugaacuuggaaa

SEQ ID NO: 1034080 - RNA, 15 nt, Homo sapiens
gaaugugauauuuga

SEQ ID NO: 1034081 - RNA, 18 nt, Homo sapiens
gaaugugccucucucuug

SEQ ID NO: 1034082 - RNA, 23 nt, Homo sapiens
gaaugugccucucucuugcuuac

SEQ ID NO: 1034083 - RNA, 14 nt, Homo sapiens
gaauguuugccucu

SEQ ID NO: 1034084 - RNA, 15 nt, Homo sapiens
gaauuaacacaugau

SEQ ID NO: 1034085 - RNA, 21 nt, Homo sapiens
gaauuaagaauugguugccau

SEQ ID NO: 1034086 - RNA, 23 nt, Homo sapiens
gaauuaaguuagggaauggcaca

SEQ ID NO: 1034087 - RNA, 13 nt, Homo sapiens
gaauuaauggaau

SEQ ID NO: 1034088 - RNA, 18 nt, Homo sapiens
gaauuaguccuugcuugg

SEQ ID NO: 1034089 - RNA, 13 nt, Homo sapiens
gaauucuugaguu

SEQ ID NO: 1034090 - RNA, 17 nt, Homo sapiens
gaauugaggacuaugga

SEQ ID NO: 1034091 - RNA, 14 nt, Homo sapiens
gaauugguugccau

SEQ ID NO: 1034092 - RNA, 18 nt, Homo sapiens
gaauugugacucggcuag

SEQ ID NO: 1034093 - RNA, 17 nt, Homo sapiens
gaauuuauucaauuccu

SEQ ID NO: 1034094 - RNA, 20 nt, Homo sapiens
gaauuucuaaaaaacagagg

SEQ ID NO: 1034095 - RNA, 12 nt, Homo sapiens
gaauuugagugc

SEQ ID NO: 1034096 - RNA, 14 nt, Homo sapiens
gaauuugguaaauu

SEQ ID NO: 1034097 - RNA, 20 nt, Homo sapiens
gaauuuguuaucaguaagaa

SEQ ID NO: 1034098 - RNA, 15 nt, Homo sapiens
gaauuuuaagugcuu

SEQ ID NO: 1034099 - RNA, 19 nt, Homo sapiens
gaauuuucucuaacuucaa

SEQ ID NO: 1034100 - RNA, 20 nt, Homo sapiens
gaauuuucucuaacuucaag

SEQ ID NO: 1034101 - RNA, 14 nt, Homo sapiens
gaauuuucuuccaa

SEQ ID NO: 1034102 - RNA, 21 nt, Homo sapiens
gaauuuuuauauccacuaaaa

SEQ ID NO: 1034103 - RNA, 23 nt, Homo sapiens
gacaaaaagccuuuuccagaaga

SEQ ID NO: 1034104 - RNA, 11 nt, Homo sapiens
gacaaaccucu

SEQ ID NO: 1034105 - RNA, 19 nt, Homo sapiens
gacaaaccucuaacccagg

SEQ ID NO: 1034106 - RNA, 12 nt, Homo sapiens
gacaaagccaaa

SEQ ID NO: 1034107 - RNA, 17 nt, Homo sapiens
gacaaagguuuuccucu

SEQ ID NO: 1034108 - RNA, 16 nt, Homo sapiens
gacaaauaauaagcaa

SEQ ID NO: 1034109 - RNA, 14 nt, Homo sapiens
gacaaaucaaagca

SEQ ID NO: 1034110 - RNA, 22 nt, Homo sapiens
gacaaauccuugaauguucucu

SEQ ID NO: 1034111 - RNA, 23 nt, Homo sapiens
gacaaauccuugaauguucucuu

SEQ ID NO: 1034112 - RNA, 18 nt, Homo sapiens
gacaaaugccacacggcu

SEQ ID NO: 1034113 - RNA, 14 nt, Homo sapiens
gacaacacugggaa

SEQ ID NO: 1034114 - RNA, 18 nt, Homo sapiens
gacaacagcccugucuca

SEQ ID NO: 1034115 - RNA, 12 nt, Homo sapiens
gacaacauuucu

SEQ ID NO: 1034116 - RNA, 15 nt, Homo sapiens
gacaaggucuugcua

SEQ ID NO: 1034117 - RNA, 19 nt, Homo sapiens
gacaaggucuugcuauguu

SEQ ID NO: 1034118 - RNA, 17 nt, Homo sapiens
gacaaguggggacugca

SEQ ID NO: 1034119 - RNA, 18 nt, Homo sapiens
gacaauacagaacccauu

SEQ ID NO: 1034120 - RNA, 20 nt, Homo sapiens
gacaaugaagaugaugcuau

SEQ ID NO: 1034121 - RNA, 15 nt, Homo sapiens
gacacaaaccugccu

SEQ ID NO: 1034122 - RNA, 12 nt, Homo sapiens
gacacacuggug

SEQ ID NO: 1034123 - RNA, 20 nt, Homo sapiens
gacacaggaugaaggcaaug

SEQ ID NO: 1034124 - RNA, 16 nt, Homo sapiens
gacacaggcccggcuc

SEQ ID NO: 1034125 - RNA, 14 nt, Homo sapiens
gacacagugcccaa

SEQ ID NO: 1034126 - RNA, 13 nt, Homo sapiens
gacacauaugcac

SEQ ID NO: 1034127 - RNA, 17 nt, Homo sapiens
gacacaugcaaggucau

SEQ ID NO: 1034128 - RNA, 16 nt, Homo sapiens
gacacauguccaagaa

SEQ ID NO: 1034129 - RNA, 22 nt, Homo sapiens
gacaccagagcagaugcagaga

SEQ ID NO: 1034130 - RNA, 17 nt, Homo sapiens
gacacgcaacuggcuca

SEQ ID NO: 1034131 - RNA, 13 nt, Homo sapiens
gacagaacacugu

SEQ ID NO: 1034132 - RNA, 14 nt, Homo sapiens
gacagaaccuuguu

SEQ ID NO: 1034133 - RNA, 16 nt, Homo sapiens
gacagaacgagacucc

SEQ ID NO: 1034134 - RNA, 14 nt, Homo sapiens
gacagaagcagcuc

SEQ ID NO: 1034135 - RNA, 23 nt, Homo sapiens
gacagaauaaugaauggacucaa

SEQ ID NO: 1034136 - RNA, 18 nt, Homo sapiens
gacagacaacacugggaa

SEQ ID NO: 1034137 - RNA, 17 nt, Homo sapiens
gacagagaccuccugcc

SEQ ID NO: 1034138 - RNA, 13 nt, Homo sapiens
gacaggguuucac

SEQ ID NO: 1034139 - RNA, 19 nt, Homo sapiens
gacagucccugccaaugga

SEQ ID NO: 1034140 - RNA, 21 nt, Homo sapiens
gacagucucaccuccugccau

SEQ ID NO: 1034141 - RNA, 16 nt, Homo sapiens
gacagugaccccaguc

SEQ ID NO: 1034142 - RNA, 14 nt, Homo sapiens
gacagugccuggga

SEQ ID NO: 1034143 - RNA, 17 nt, Homo sapiens
gacaguguuuucuggga

SEQ ID NO: 1034144 - RNA, 19 nt, Homo sapiens
gacauaagcaaagacuaug

SEQ ID NO: 1034145 - RNA, 21 nt, Homo sapiens
gacauagccaacugcuguuca

SEQ ID NO: 1034146 - RNA, 17 nt, Homo sapiens
gacaucaagcacagaag

SEQ ID NO: 1034147 - RNA, 19 nt, Homo sapiens
gacauccccacccuuggag

SEQ ID NO: 1034148 - RNA, 19 nt, Homo sapiens
gacauccccacucacgaau

SEQ ID NO: 1034149 - RNA, 13 nt, Homo sapiens
gacaucucagggg

SEQ ID NO: 1034150 - RNA, 21 nt, Homo sapiens
gacaugcugaagccaaagcca

SEQ ID NO: 1034151 - RNA, 12 nt, Homo sapiens
gacauggcucac

SEQ ID NO: 1034152 - RNA, 18 nt, Homo sapiens
gacauuaaaucuaugaag

SEQ ID NO: 1034153 - RNA, 16 nt, Homo sapiens
gacauucaaggcauuu

SEQ ID NO: 1034154 - RNA, 23 nt, Homo sapiens
gacauucucaucaccacagggau

SEQ ID NO: 1034155 - RNA, 20 nt, Homo sapiens
gacauucuggaaaagcaaaa

SEQ ID NO: 1034156 - RNA, 20 nt, Homo sapiens
gaccaaaugcuuuuccucaa

SEQ ID NO: 1034157 - RNA, 13 nt, Homo sapiens
gaccaauauucaa

SEQ ID NO: 1034158 - RNA, 19 nt, Homo sapiens
gaccaaugucuugaugcau

SEQ ID NO: 1034159 - RNA, 14 nt, Homo sapiens
gaccacaucuuuau

SEQ ID NO: 1034160 - RNA, 12 nt, Homo sapiens
gaccacuccugu

SEQ ID NO: 1034161 - RNA, 20 nt, Homo sapiens
gaccacucuuccugaguuca

SEQ ID NO: 1034162 - RNA, 17 nt, Homo sapiens
gaccacugggcaaugau

SEQ ID NO: 1034163 - RNA, 17 nt, Homo sapiens
gaccagcccaccccugu

SEQ ID NO: 1034164 - RNA, 18 nt, Homo sapiens
gaccagcuuugcagugac

SEQ ID NO: 1034165 - RNA, 18 nt, Homo sapiens
gaccagggauuuccauga

SEQ ID NO: 1034166 - RNA, 19 nt, Homo sapiens
gaccagggauuuccaugau

SEQ ID NO: 1034167 - RNA, 17 nt, Homo sapiens
gaccaguccuguuugca

SEQ ID NO: 1034168 - RNA, 20 nt, Homo sapiens
gaccaguugggagcacugga

SEQ ID NO: 1034169 - RNA, 20 nt, Homo sapiens
gaccaguuuaaccugaugca

SEQ ID NO: 1034170 - RNA, 16 nt, Homo sapiens
gaccauccuauuuaac

SEQ ID NO: 1034171 - RNA, 17 nt, Homo sapiens
gaccauuguaacaauag

SEQ ID NO: 1034172 - RNA, 20 nt, Homo sapiens
gacccaccccugugcuccgu

SEQ ID NO: 1034173 - RNA, 13 nt, Homo sapiens
gacccagcacugc

SEQ ID NO: 1034174 - RNA, 16 nt, Homo sapiens
gacccagcacugccca

SEQ ID NO: 1034175 - RNA, 23 nt, Homo sapiens
gacccagucagaguugugcacau

SEQ ID NO: 1034176 - RNA, 13 nt, Homo sapiens
gacccaugcugcc

SEQ ID NO: 1034177 - RNA, 19 nt, Homo sapiens
gacccggagcuaacacugg

SEQ ID NO: 1034178 - RNA, 15 nt, Homo sapiens
gaccgccccucacca

SEQ ID NO: 1034179 - RNA, 19 nt, Homo sapiens
gaccuacuguucggacaaa

SEQ ID NO: 1034180 - RNA, 20 nt, Homo sapiens
gaccuacuguucggacaaaa

SEQ ID NO: 1034181 - RNA, 18 nt, Homo sapiens
gaccucuuggccacagag

SEQ ID NO: 1034182 - RNA, 16 nt, Homo sapiens
gaccugccuccugccu

SEQ ID NO: 1034183 - RNA, 20 nt, Homo sapiens
gaccugggagcccucaggca

SEQ ID NO: 1034184 - RNA, 22 nt, Homo sapiens
gaccugugaccagcacugucuc

SEQ ID NO: 1034185 - RNA, 12 nt, Homo sapiens
gaccuguguucc

SEQ ID NO: 1034186 - RNA, 12 nt, Homo sapiens
gaccuucuagga

SEQ ID NO: 1034187 - RNA, 13 nt, Homo sapiens
gaccuucuaggaa

SEQ ID NO: 1034188 - RNA, 17 nt, Homo sapiens
gaccuucuccccauucu

SEQ ID NO: 1034189 - RNA, 18 nt, Homo sapiens
gaccuugaaggguaaaga

SEQ ID NO: 1034190 - RNA, 20 nt, Homo sapiens
gaccuuggguucccaauaca

SEQ ID NO: 1034191 - RNA, 19 nt, Homo sapiens
gaccuuuaccuccugccuu

SEQ ID NO: 1034192 - RNA, 20 nt, Homo sapiens
gacgcaacuuaagcugggau

SEQ ID NO: 1034193 - RNA, 15 nt, Homo sapiens
gacggaugauuggau

SEQ ID NO: 1034194 - RNA, 23 nt, Homo sapiens
gacgggcaaaauaaagugacaga

SEQ ID NO: 1034195 - RNA, 15 nt, Homo sapiens
gacggggacugggga

SEQ ID NO: 1034196 - RNA, 15 nt, Homo sapiens
gacgguucaccagcc

SEQ ID NO: 1034197 - RNA, 22 nt, Homo sapiens
gacgugcacugagagugaagug

SEQ ID NO: 1034198 - RNA, 15 nt, Homo sapiens
gacgugugccuauag

SEQ ID NO: 1034199 - RNA, 16 nt, Homo sapiens
gacuaagaaucccuaa

SEQ ID NO: 1034200 - RNA, 16 nt, Homo sapiens
gacuaauggaaauauu

SEQ ID NO: 1034201 - RNA, 18 nt, Homo sapiens
gacuacagcacacgucau

SEQ ID NO: 1034202 - RNA, 12 nt, Homo sapiens
gacuacaggugu

SEQ ID NO: 1034203 - RNA, 17 nt, Homo sapiens
gacuacuccaagggaau

SEQ ID NO: 1034204 - RNA, 17 nt, Homo sapiens
gacuagaggcuugcaua

SEQ ID NO: 1034205 - RNA, 13 nt, Homo sapiens
gacuagcuuucag

SEQ ID NO: 1034206 - RNA, 12 nt, Homo sapiens
gacuauggagcu

SEQ ID NO: 1034207 - RNA, 17 nt, Homo sapiens
gacuauggcuaccaaaa

SEQ ID NO: 1034208 - RNA, 20 nt, Homo sapiens
gacuauggcucuacuuucag

SEQ ID NO: 1034209 - RNA, 23 nt, Homo sapiens
gacuauucccuucuaaccugaac

SEQ ID NO: 1034210 - RNA, 17 nt, Homo sapiens
gacucaaaaauagggaa

SEQ ID NO: 1034211 - RNA, 14 nt, Homo sapiens
gacucacuugccca

SEQ ID NO: 1034212 - RNA, 13 nt, Homo sapiens
gacucagccucag

SEQ ID NO: 1034213 - RNA, 21 nt, Homo sapiens
gacucagggccaugccugccc

SEQ ID NO: 1034214 - RNA, 15 nt, Homo sapiens
gacucaucauuucca

SEQ ID NO: 1034215 - RNA, 23 nt, Homo sapiens
gacuccaaagaaauguaagggaa

SEQ ID NO: 1034216 - RNA, 15 nt, Homo sapiens
gacuccggcccuccu

SEQ ID NO: 1034217 - RNA, 16 nt, Homo sapiens
gacuccgucucaagga

SEQ ID NO: 1034218 - RNA, 16 nt, Homo sapiens
gacuccucuaagccac

SEQ ID NO: 1034219 - RNA, 18 nt, Homo sapiens
gacuccugaggacagcug

SEQ ID NO: 1034220 - RNA, 22 nt, Homo sapiens
gacuccuuagagacaucaaaau

SEQ ID NO: 1034221 - RNA, 20 nt, Homo sapiens
gacucuaccagacuguguau

SEQ ID NO: 1034222 - RNA, 15 nt, Homo sapiens
gacucucaaaucuuu

SEQ ID NO: 1034223 - RNA, 20 nt, Homo sapiens
gacucuccaaauagcauuag

SEQ ID NO: 1034224 - RNA, 13 nt, Homo sapiens
gacucuugcucuu

SEQ ID NO: 1034225 - RNA, 17 nt, Homo sapiens
gacucuuggcacagcau

SEQ ID NO: 1034226 - RNA, 20 nt, Homo sapiens
gacugaagugaacuaugaag

SEQ ID NO: 1034227 - RNA, 15 nt, Homo sapiens
gacugagcucaaggu

SEQ ID NO: 1034228 - RNA, 13 nt, Homo sapiens
gacugaguccucg

SEQ ID NO: 1034229 - RNA, 13 nt, Homo sapiens
gacugauggugaa

SEQ ID NO: 1034230 - RNA, 17 nt, Homo sapiens
gacugauguuacaucac

SEQ ID NO: 1034231 - RNA, 17 nt, Homo sapiens
gacugccccugccuuuu

SEQ ID NO: 1034232 - RNA, 15 nt, Homo sapiens
gacuggaguggagca

SEQ ID NO: 1034233 - RNA, 20 nt, Homo sapiens
gacuguggcugcuagcacuu

SEQ ID NO: 1034234 - RNA, 22 nt, Homo sapiens
gacuuaaaauauuccugcauuu

SEQ ID NO: 1034235 - RNA, 15 nt, Homo sapiens
gacuuaaaaucuaau

SEQ ID NO: 1034236 - RNA, 13 nt, Homo sapiens
gacuuaacaccca

SEQ ID NO: 1034237 - RNA, 10 nt, Homo sapiens
gacuuccuug

SEQ ID NO: 1034238 - RNA, 16 nt, Homo sapiens
gacuugaaauacuacu

SEQ ID NO: 1034239 - RNA, 15 nt, Homo sapiens
gacuuuauugcaucu

SEQ ID NO: 1034240 - RNA, 23 nt, Homo sapiens
gacuuucaggaauuuuguaaucu

SEQ ID NO: 1034241 - RNA, 17 nt, Homo sapiens
gagaaaagaaaccagag

SEQ ID NO: 1034242 - RNA, 14 nt, Homo sapiens
gagaaaagacauaa

SEQ ID NO: 1034243 - RNA, 22 nt, Homo sapiens
gagaaaccuuauuguaccucuc

SEQ ID NO: 1034244 - RNA, 19 nt, Homo sapiens
gagaaacuguagucucagg

SEQ ID NO: 1034245 - RNA, 19 nt, Homo sapiens
gagaaagguggacuggaag

SEQ ID NO: 1034246 - RNA, 19 nt, Homo sapiens
gagaaaugaauaauuuccc

SEQ ID NO: 1034247 - RNA, 22 nt, Homo sapiens
gagaaauugacagaucaagcug

SEQ ID NO: 1034248 - RNA, 12 nt, Homo sapiens
gagaaccuucca

SEQ ID NO: 1034249 - RNA, 19 nt, Homo sapiens
gagaacugcauauguuucg

SEQ ID NO: 1034250 - RNA, 18 nt, Homo sapiens
gagaagaaugacuaugca

SEQ ID NO: 1034251 - RNA, 22 nt, Homo sapiens
gagaagagcuguucacagccag

SEQ ID NO: 1034252 - RNA, 13 nt, Homo sapiens
gagaagccaaaag

SEQ ID NO: 1034253 - RNA, 21 nt, Homo sapiens
gagaagccagcuuuccucauc

SEQ ID NO: 1034254 - RNA, 11 nt, Homo sapiens
gagaagccauu

SEQ ID NO: 1034255 - RNA, 15 nt, Homo sapiens
gagaagcucacccaa

SEQ ID NO: 1034256 - RNA, 17 nt, Homo sapiens
gagaagcucacccaaua

SEQ ID NO: 1034257 - RNA, 17 nt, Homo sapiens
gagaagcugucagggac

SEQ ID NO: 1034258 - RNA, 16 nt, Homo sapiens
gagaagcuuugcccuc

SEQ ID NO: 1034259 - RNA, 21 nt, Homo sapiens
gagaaguccccuuccauccca

SEQ ID NO: 1034260 - RNA, 20 nt, Homo sapiens
gagaagucuuagacuugaaa

SEQ ID NO: 1034261 - RNA, 16 nt, Homo sapiens
gagaaguuaucagaca

SEQ ID NO: 1034262 - RNA, 19 nt, Homo sapiens
gagaaucaacauuucucaa

SEQ ID NO: 1034263 - RNA, 18 nt, Homo sapiens
gagaaucagaucauuuca

SEQ ID NO: 1034264 - RNA, 17 nt, Homo sapiens
gagaaucccuggcaaag

SEQ ID NO: 1034265 - RNA, 17 nt, Homo sapiens
gagacaccaccuauacc

SEQ ID NO: 1034266 - RNA, 22 nt, Homo sapiens
gagacacuauuuaucugugcaa

SEQ ID NO: 1034267 - RNA, 22 nt, Homo sapiens
gagacagaaagcagaacaguga

SEQ ID NO: 1034268 - RNA, 13 nt, Homo sapiens
gagacagaagcag

SEQ ID NO: 1034269 - RNA, 14 nt, Homo sapiens
gagacagagcucac

SEQ ID NO: 1034270 - RNA, 12 nt, Homo sapiens
gagacaggguuu

SEQ ID NO: 1034271 - RNA, 15 nt, Homo sapiens
gagacauaggccaug

SEQ ID NO: 1034272 - RNA, 13 nt, Homo sapiens
gagacauuggcuu

SEQ ID NO: 1034273 - RNA, 20 nt, Homo sapiens
gagacccucguggccuuccc

SEQ ID NO: 1034274 - RNA, 17 nt, Homo sapiens
gagaccuuuucaacuug

SEQ ID NO: 1034275 - RNA, 13 nt, Homo sapiens
gagacgggaccgg

SEQ ID NO: 1034276 - RNA, 13 nt, Homo sapiens
gagacugggucuc

SEQ ID NO: 1034277 - RNA, 12 nt, Homo sapiens
gagagaacugaa

SEQ ID NO: 1034278 - RNA, 21 nt, Homo sapiens
gagagaagggacacauucaac

SEQ ID NO: 1034279 - RNA, 17 nt, Homo sapiens
gagagagcuggaggcac

SEQ ID NO: 1034280 - RNA, 22 nt, Homo sapiens
gagagaugggagcuccucuccu

SEQ ID NO: 1034281 - RNA, 12 nt, Homo sapiens
gagagauguuuu

SEQ ID NO: 1034282 - RNA, 20 nt, Homo sapiens
gagagcaaauaaagaccuga

SEQ ID NO: 1034283 - RNA, 17 nt, Homo sapiens
gagagccuggugcugcu

SEQ ID NO: 1034284 - RNA, 13 nt, Homo sapiens
gagagccuuccag

SEQ ID NO: 1034285 - RNA, 20 nt, Homo sapiens
gagaggaguucaaugaucua

SEQ ID NO: 1034286 - RNA, 22 nt, Homo sapiens
gagaggcccugggguucucccc

SEQ ID NO: 1034287 - RNA, 18 nt, Homo sapiens
gagagggaagagugcauu

SEQ ID NO: 1034288 - RNA, 14 nt, Homo sapiens
gagagggugacaag

SEQ ID NO: 1034289 - RNA, 20 nt, Homo sapiens
gagaguacagugagccaaga

SEQ ID NO: 1034290 - RNA, 22 nt, Homo sapiens
gagaguagaugguuugagccug

SEQ ID NO: 1034291 - RNA, 22 nt, Homo sapiens
gagagucccacugccucagguu

SEQ ID NO: 1034292 - RNA, 22 nt, Homo sapiens
gagagucgcaucucagugcagg

SEQ ID NO: 1034293 - RNA, 15 nt, Homo sapiens
gagagugagacucag

SEQ ID NO: 1034294 - RNA, 20 nt, Homo sapiens
gagaguucaauggcugcuga

SEQ ID NO: 1034295 - RNA, 16 nt, Homo sapiens
gagaguuuugucuuga

SEQ ID NO: 1034296 - RNA, 19 nt, Homo sapiens
gagauagcauugugaacug

SEQ ID NO: 1034297 - RNA, 17 nt, Homo sapiens
gagauccuuuaaauccu

SEQ ID NO: 1034298 - RNA, 20 nt, Homo sapiens
gagaucgcaucauugcacuc

SEQ ID NO: 1034299 - RNA, 21 nt, Homo sapiens
gagaucgcaucauugcacucu

SEQ ID NO: 1034300 - RNA, 20 nt, Homo sapiens
gagaucguuguuuacagugu

SEQ ID NO: 1034301 - RNA, 21 nt, Homo sapiens
gagaucguuguuuacagugua

SEQ ID NO: 1034302 - RNA, 14 nt, Homo sapiens
gagaucuugaucca

SEQ ID NO: 1034303 - RNA, 19 nt, Homo sapiens
gagaugaccucuaacugau

SEQ ID NO: 1034304 - RNA, 12 nt, Homo sapiens
gagaugcagcug

SEQ ID NO: 1034305 - RNA, 13 nt, Homo sapiens
gagauggaguucu

SEQ ID NO: 1034306 - RNA, 21 nt, Homo sapiens
gagaugggagaaucacuugaa

SEQ ID NO: 1034307 - RNA, 20 nt, Homo sapiens
gagaugggguuucacugugu

SEQ ID NO: 1034308 - RNA, 22 nt, Homo sapiens
gagauguuuuagaguuaacaau

SEQ ID NO: 1034309 - RNA, 19 nt, Homo sapiens
gagauuccugagccagugu

SEQ ID NO: 1034310 - RNA, 20 nt, Homo sapiens
gagauugcaccacugcacuc

SEQ ID NO: 1034311 - RNA, 18 nt, Homo sapiens
gagauuguuguuugccau

SEQ ID NO: 1034312 - RNA, 19 nt, Homo sapiens
gagauuuugcaaucugugu

SEQ ID NO: 1034313 - RNA, 23 nt, Homo sapiens
gagcaaacuaacuugacuuuuaa

SEQ ID NO: 1034314 - RNA, 16 nt, Homo sapiens
gagcaaaggcugagaa

SEQ ID NO: 1034315 - RNA, 19 nt, Homo sapiens
gagcaaagggaacagugag

SEQ ID NO: 1034316 - RNA, 19 nt, Homo sapiens
gagcaaauaaagaccugag

SEQ ID NO: 1034317 - RNA, 21 nt, Homo sapiens
gagcaaauaaagaccugagaa

SEQ ID NO: 1034318 - RNA, 13 nt, Homo sapiens
gagcaacugcugu

SEQ ID NO: 1034319 - RNA, 18 nt, Homo sapiens
gagcacacuuaugggcca

SEQ ID NO: 1034320 - RNA, 15 nt, Homo sapiens
gagcagaacuuucac

SEQ ID NO: 1034321 - RNA, 16 nt, Homo sapiens
gagcaggaagcauuca

SEQ ID NO: 1034322 - RNA, 14 nt, Homo sapiens
gagcaggcuacugu

SEQ ID NO: 1034323 - RNA, 17 nt, Homo sapiens
gagcaggcuacugucag

SEQ ID NO: 1034324 - RNA, 17 nt, Homo sapiens
gagcaguaucaugaagc

SEQ ID NO: 1034325 - RNA, 21 nt, Homo sapiens
gagcagugcuugaaugaaguu

SEQ ID NO: 1034326 - RNA, 22 nt, Homo sapiens
gagcauccucucucacauggaa

SEQ ID NO: 1034327 - RNA, 19 nt, Homo sapiens
gagcaucucuugaggccag

SEQ ID NO: 1034328 - RNA, 19 nt, Homo sapiens
gagcauuuauaaauggaca

SEQ ID NO: 1034329 - RNA, 21 nt, Homo sapiens
gagccaagaucgcaccacugc

SEQ ID NO: 1034330 - RNA, 20 nt, Homo sapiens
gagccaccacguccagcugg

SEQ ID NO: 1034331 - RNA, 15 nt, Homo sapiens
gagccagcaacucca

SEQ ID NO: 1034332 - RNA, 16 nt, Homo sapiens
gagccagcacccugau

SEQ ID NO: 1034333 - RNA, 17 nt, Homo sapiens
gagccagccuugcagua

SEQ ID NO: 1034334 - RNA, 13 nt, Homo sapiens
gagccaguucagu

SEQ ID NO: 1034335 - RNA, 18 nt, Homo sapiens
gagccauauaaguuugaa

SEQ ID NO: 1034336 - RNA, 13 nt, Homo sapiens
gagccauaugaau

SEQ ID NO: 1034337 - RNA, 15 nt, Homo sapiens
gagccaugcugggaa

SEQ ID NO: 1034338 - RNA, 17 nt, Homo sapiens
gagccauuuugugaaug

SEQ ID NO: 1034339 - RNA, 23 nt, Homo sapiens
gagcccacgcccccacuggugac

SEQ ID NO: 1034340 - RNA, 13 nt, Homo sapiens
gagcccaguuuca

SEQ ID NO: 1034341 - RNA, 22 nt, Homo sapiens
gagcccucuaugguguggcaaa

SEQ ID NO: 1034342 - RNA, 16 nt, Homo sapiens
gagcccuggcaggaug

SEQ ID NO: 1034343 - RNA, 21 nt, Homo sapiens
gagccgagauugcaccacugc

SEQ ID NO: 1034344 - RNA, 14 nt, Homo sapiens
gagccgcugugagc

SEQ ID NO: 1034345 - RNA, 12 nt, Homo sapiens
gagccugcaguu

SEQ ID NO: 1034346 - RNA, 12 nt, Homo sapiens
gagccuggacaa

SEQ ID NO: 1034347 - RNA, 13 nt, Homo sapiens
gagccuggugccc

SEQ ID NO: 1034348 - RNA, 21 nt, Homo sapiens
gagccuuaaaacccacaaaag

SEQ ID NO: 1034349 - RNA, 14 nt, Homo sapiens
gagcgagacuuggu

SEQ ID NO: 1034350 - RNA, 19 nt, Homo sapiens
gagcgccccucccuaguga

SEQ ID NO: 1034351 - RNA, 16 nt, Homo sapiens
gagcuaaucuucauuu

SEQ ID NO: 1034352 - RNA, 12 nt, Homo sapiens
gagcucagagag

SEQ ID NO: 1034353 - RNA, 21 nt, Homo sapiens
gagcucaggucccaggccagc

SEQ ID NO: 1034354 - RNA, 15 nt, Homo sapiens
gagcuccccaaaaac

SEQ ID NO: 1034355 - RNA, 15 nt, Homo sapiens
gagcuccuaagccau

SEQ ID NO: 1034356 - RNA, 17 nt, Homo sapiens
gagcuccuuagccuuug

SEQ ID NO: 1034357 - RNA, 16 nt, Homo sapiens
gagcugacacaggaug

SEQ ID NO: 1034358 - RNA, 14 nt, Homo sapiens
gagcugagccucuc

SEQ ID NO: 1034359 - RNA, 20 nt, Homo sapiens
gagcugcccuccuuguccac

SEQ ID NO: 1034360 - RNA, 14 nt, Homo sapiens
gagcuggaucucuc

SEQ ID NO: 1034361 - RNA, 17 nt, Homo sapiens
gagcuggccuccuaugc

SEQ ID NO: 1034362 - RNA, 11 nt, Homo sapiens
gagcugggaug

SEQ ID NO: 1034363 - RNA, 13 nt, Homo sapiens
gagcugggcagaa

SEQ ID NO: 1034364 - RNA, 13 nt, Homo sapiens
gagcugggggcca

SEQ ID NO: 1034365 - RNA, 17 nt, Homo sapiens
gagcuggggggcgugga

SEQ ID NO: 1034366 - RNA, 11 nt, Homo sapiens
gagcugugcag

SEQ ID NO: 1034367 - RNA, 13 nt, Homo sapiens
gagcuuggccaga

SEQ ID NO: 1034368 - RNA, 21 nt, Homo sapiens
gaggaaaaguaaggugcaguu

SEQ ID NO: 1034369 - RNA, 13 nt, Homo sapiens
gaggaaacuugca

SEQ ID NO: 1034370 - RNA, 14 nt, Homo sapiens
gaggaacacugcac

SEQ ID NO: 1034371 - RNA, 12 nt, Homo sapiens
gaggaagggaca

SEQ ID NO: 1034372 - RNA, 18 nt, Homo sapiens
gaggaagugauaguuucu

SEQ ID NO: 1034373 - RNA, 24 nt, Homo sapiens
gaggaaucacucuuguggauguuu

SEQ ID NO: 1034374 - RNA, 19 nt, Homo sapiens
gaggaauucugaagccauu

SEQ ID NO: 1034375 - RNA, 23 nt, Homo sapiens
gaggaauuucuugauuaauguug

SEQ ID NO: 1034376 - RNA, 22 nt, Homo sapiens
gaggacaagggaaaugucaggg

SEQ ID NO: 1034377 - RNA, 12 nt, Homo sapiens
gaggacaauuca

SEQ ID NO: 1034378 - RNA, 18 nt, Homo sapiens
gaggacacuaaccacgcu

SEQ ID NO: 1034379 - RNA, 17 nt, Homo sapiens
gaggacuuuucuuugug

SEQ ID NO: 1034380 - RNA, 15 nt, Homo sapiens
gaggagaaaaaaacu

SEQ ID NO: 1034381 - RNA, 16 nt, Homo sapiens
gaggagaaacuggaac

SEQ ID NO: 1034382 - RNA, 14 nt, Homo sapiens
gaggagcagugcag

SEQ ID NO: 1034383 - RNA, 21 nt, Homo sapiens
gaggaguucaaugaucuaggu

SEQ ID NO: 1034384 - RNA, 16 nt, Homo sapiens
gaggauaggaguucac

SEQ ID NO: 1034385 - RNA, 20 nt, Homo sapiens
gaggcaagagaauugcuuga

SEQ ID NO: 1034386 - RNA, 19 nt, Homo sapiens
gaggcagaaaauugcacaa

SEQ ID NO: 1034387 - RNA, 18 nt, Homo sapiens
gaggcagacagcagcuca

SEQ ID NO: 1034388 - RNA, 14 nt, Homo sapiens
gaggcagaggacag

SEQ ID NO: 1034389 - RNA, 22 nt, Homo sapiens
gaggcagccccauucugccugc

SEQ ID NO: 1034390 - RNA, 18 nt, Homo sapiens
gaggcagcuguugcagug

SEQ ID NO: 1034391 - RNA, 20 nt, Homo sapiens
gaggcaggagaaucacuuga

SEQ ID NO: 1034392 - RNA, 20 nt, Homo sapiens
gaggcaggagaauggcguga

SEQ ID NO: 1034393 - RNA, 20 nt, Homo sapiens
gaggcaggaggaucacuuga

SEQ ID NO: 1034394 - RNA, 20 nt, Homo sapiens
gaggcaggaggauugcuuga

SEQ ID NO: 1034395 - RNA, 12 nt, Homo sapiens
gaggcagggaag

SEQ ID NO: 1034396 - RNA, 21 nt, Homo sapiens
gaggcccccuggugugucuga

SEQ ID NO: 1034397 - RNA, 19 nt, Homo sapiens
gaggccccugucucagggu

SEQ ID NO: 1034398 - RNA, 13 nt, Homo sapiens
gaggccuauaaug

SEQ ID NO: 1034399 - RNA, 16 nt, Homo sapiens
gaggccucucauucca

SEQ ID NO: 1034400 - RNA, 20 nt, Homo sapiens
gaggccugcccucagggauc

SEQ ID NO: 1034401 - RNA, 19 nt, Homo sapiens
gaggcggagaguacaguga

SEQ ID NO: 1034402 - RNA, 19 nt, Homo sapiens
gaggcggguggaucacuug

SEQ ID NO: 1034403 - RNA, 15 nt, Homo sapiens
gaggcuccugugcua

SEQ ID NO: 1034404 - RNA, 20 nt, Homo sapiens
gaggcugcacccacccagga

SEQ ID NO: 1034405 - RNA, 20 nt, Homo sapiens
gaggcugucuucucaggcuc

SEQ ID NO: 1034406 - RNA, 15 nt, Homo sapiens
gagggagacuccauc

SEQ ID NO: 1034407 - RNA, 13 nt, Homo sapiens
gagggcacuggag

SEQ ID NO: 1034408 - RNA, 15 nt, Homo sapiens
gaggggaagggccag

SEQ ID NO: 1034409 - RNA, 21 nt, Homo sapiens
gaggggacuauuuaugaaggc

SEQ ID NO: 1034410 - RNA, 18 nt, Homo sapiens
gagggguaacuugcaccu

SEQ ID NO: 1034411 - RNA, 14 nt, Homo sapiens
gaggguccucaguc

SEQ ID NO: 1034412 - RNA, 21 nt, Homo sapiens
gaggguccuuuaguaccugaa

SEQ ID NO: 1034413 - RNA, 15 nt, Homo sapiens
gagggucuucuuaca

SEQ ID NO: 1034414 - RNA, 15 nt, Homo sapiens
gaggguuuugcucuu

SEQ ID NO: 1034415 - RNA, 13 nt, Homo sapiens
gagguacacucuu

SEQ ID NO: 1034416 - RNA, 18 nt, Homo sapiens
gaggucuuuugacaugug

SEQ ID NO: 1034417 - RNA, 17 nt, Homo sapiens
gaggugaaagcuauauc

SEQ ID NO: 1034418 - RNA, 13 nt, Homo sapiens
gaggugaaggcag

SEQ ID NO: 1034419 - RNA, 16 nt, Homo sapiens
gaggugacacccauug

SEQ ID NO: 1034420 - RNA, 19 nt, Homo sapiens
gaaaauagaaacuugcuua

SEQ ID NO: 1034421 - RNA, 20 nt, Homo sapiens
gaaaauauguaacuggaauc

SEQ ID NO: 1034422 - RNA, 22 nt, Homo sapiens
gaaaaucgugacaacacuugug

SEQ ID NO: 1034423 - RNA, 12 nt, Homo sapiens
gaaaaugaaucu

SEQ ID NO: 1034424 - RNA, 13 nt, Homo sapiens
gaaaaugaugcug

SEQ ID NO: 1034425 - RNA, 21 nt, Homo sapiens
gaaaaugcuguauuagucaca

SEQ ID NO: 1034426 - RNA, 14 nt, Homo sapiens
gaaaauguacaaua

SEQ ID NO: 1034427 - RNA, 15 nt, Homo sapiens
gaaaaugugacccag

SEQ ID NO: 1034428 - RNA, 15 nt, Homo sapiens
gaaaaugugcaauau

SEQ ID NO: 1034429 - RNA, 14 nt, Homo sapiens
gaaaauuaacacug

SEQ ID NO: 1034430 - RNA, 23 nt, Homo sapiens
gaaaauuguauguuaaguuacuu

SEQ ID NO: 1034431 - RNA, 13 nt, Homo sapiens
gaaacaacagcuu

SEQ ID NO: 1034432 - RNA, 13 nt, Homo sapiens
gaaacaacucuuu

SEQ ID NO: 1034433 - RNA, 19 nt, Homo sapiens
gaaacaauaugcaauguga

SEQ ID NO: 1034434 - RNA, 18 nt, Homo sapiens
gaaacacugggcuucuag

SEQ ID NO: 1034435 - RNA, 16 nt, Homo sapiens
gaaacauuaugccuua

SEQ ID NO: 1034436 - RNA, 20 nt, Homo sapiens
gaaaccccccagagcucuuu

SEQ ID NO: 1034437 - RNA, 19 nt, Homo sapiens
gaaacccguguaucuggga

SEQ ID NO: 1034438 - RNA, 23 nt, Homo sapiens
gaaaccuucagauuuguguuaua

SEQ ID NO: 1034439 - RNA, 20 nt, Homo sapiens
gaaacuaauauuuuauguga

SEQ ID NO: 1034440 - RNA, 21 nt, Homo sapiens
gaaacucuuaucucagucaug

SEQ ID NO: 1034441 - RNA, 14 nt, Homo sapiens
gaaagaagugggga

SEQ ID NO: 1034442 - RNA, 21 nt, Homo sapiens
gaaagacauagccaacugcug

SEQ ID NO: 1034443 - RNA, 15 nt, Homo sapiens
gaaagacauccauaa

SEQ ID NO: 1034444 - RNA, 23 nt, Homo sapiens
gaaagagagagugugugggucua

SEQ ID NO: 1034445 - RNA, 14 nt, Homo sapiens
gaaagaggaaugaa

SEQ ID NO: 1034446 - RNA, 18 nt, Homo sapiens
gaaagcauaacaaaaaga

SEQ ID NO: 1034447 - RNA, 22 nt, Homo sapiens
gaaagcaucugagcuaacuuau

SEQ ID NO: 1034448 - RNA, 23 nt, Homo sapiens
gaaagcuauaucaaucucucuua

SEQ ID NO: 1034449 - RNA, 22 nt, Homo sapiens
gaaagcuguggccagcuuguua

SEQ ID NO: 1034450 - RNA, 20 nt, Homo sapiens
gaaaggaauuggcaugugua

SEQ ID NO: 1034451 - RNA, 22 nt, Homo sapiens
gaaaggagaacuauccaaaacu

SEQ ID NO: 1034452 - RNA, 15 nt, Homo sapiens
gaaaggggcccaguc

SEQ ID NO: 1034453 - RNA, 13 nt, Homo sapiens
gaaaggggcccca

SEQ ID NO: 1034454 - RNA, 16 nt, Homo sapiens
gaaaguaucaccaggg

SEQ ID NO: 1034455 - RNA, 20 nt, Homo sapiens
gaaaguccaauuccaaagcc

SEQ ID NO: 1034456 - RNA, 20 nt, Homo sapiens
gaaagugcauuaaacugaau

SEQ ID NO: 1034457 - RNA, 19 nt, Homo sapiens
gaaaguuaauccacuguga

SEQ ID NO: 1034458 - RNA, 12 nt, Homo sapiens
gaaaguucuuaa

SEQ ID NO: 1034459 - RNA, 15 nt, Homo sapiens
gaaauaacauggccu

SEQ ID NO: 1034460 - RNA, 16 nt, Homo sapiens
gaaauaacauggccuu

SEQ ID NO: 1034461 - RNA, 13 nt, Homo sapiens
gaaauaagccaga

SEQ ID NO: 1034462 - RNA, 15 nt, Homo sapiens
gaaauacauggacaa

SEQ ID NO: 1034463 - RNA, 17 nt, Homo sapiens
gaaauaccagugaacca

SEQ ID NO: 1034464 - RNA, 22 nt, Homo sapiens
gaaauaccagugaaccaaagag

SEQ ID NO: 1034465 - RNA, 20 nt, Homo sapiens
gaaauagaagcaaaugacaa

SEQ ID NO: 1034466 - RNA, 16 nt, Homo sapiens
gaaauagacaguauau

SEQ ID NO: 1034467 - RNA, 22 nt, Homo sapiens
gaaauauauauguguguguaug

SEQ ID NO: 1034468 - RNA, 17 nt, Homo sapiens
gaaauaucaugcuccau

SEQ ID NO: 1034469 - RNA, 19 nt, Homo sapiens
gaaauauccagaacauacu

SEQ ID NO: 1034470 - RNA, 13 nt, Homo sapiens
gaaauaugucaaa

SEQ ID NO: 1034471 - RNA, 20 nt, Homo sapiens
gaaauaugugguuuccacga

SEQ ID NO: 1034472 - RNA, 23 nt, Homo sapiens
gaaauccaucuaaauaccugccc

SEQ ID NO: 1034473 - RNA, 23 nt, Homo sapiens
gaaaucguugcugcacccuuccc

SEQ ID NO: 1034474 - RNA, 19 nt, Homo sapiens
gaaaucuauagaacugaau

SEQ ID NO: 1034475 - RNA, 21 nt, Homo sapiens
gaaaugcccaucuaugucccu

SEQ ID NO: 1034476 - RNA, 20 nt, Homo sapiens
gaaaugcugccugccugucu

SEQ ID NO: 1034477 - RNA, 23 nt, Homo sapiens
gaaaugcugguuuuucaguuuuc

SEQ ID NO: 1034478 - RNA, 20 nt, Homo sapiens
gaaauggauuuaucaucacc

SEQ ID NO: 1034479 - RNA, 21 nt, Homo sapiens
gaaauuacuggaaggcuucca

SEQ ID NO: 1034480 - RNA, 14 nt, Homo sapiens
gaaauuauuauuca

SEQ ID NO: 1034481 - RNA, 16 nt, Homo sapiens
gaaauugacagaucaa

SEQ ID NO: 1034482 - RNA, 20 nt, Homo sapiens
gaacaaaaugaauucuggga

SEQ ID NO: 1034483 - RNA, 21 nt, Homo sapiens
gaacaaaaugaauucugggaa

SEQ ID NO: 1034484 - RNA, 12 nt, Homo sapiens
gaacacacuugg

SEQ ID NO: 1034485 - RNA, 21 nt, Homo sapiens
gaacacccgacuccucaaaag

SEQ ID NO: 1034486 - RNA, 11 nt, Homo sapiens
gaacacuaacc

SEQ ID NO: 1034487 - RNA, 14 nt, Homo sapiens
gaacacuccuucac

SEQ ID NO: 1034488 - RNA, 12 nt, Homo sapiens
gaacacugcacu

SEQ ID NO: 1034489 - RNA, 20 nt, Homo sapiens
gaacacugggggaggggaca

SEQ ID NO: 1034490 - RNA, 11 nt, Homo sapiens
gaacacuguga

SEQ ID NO: 1034491 - RNA, 23 nt, Homo sapiens
gaacagaauguuuuacugugaaa

SEQ ID NO: 1034492 - RNA, 16 nt, Homo sapiens
gaacagacaacagaag

SEQ ID NO: 1034493 - RNA, 20 nt, Homo sapiens
gaacagacaacagaagucau

SEQ ID NO: 1034494 - RNA, 15 nt, Homo sapiens
gaacaguaacugcca

SEQ ID NO: 1034495 - RNA, 13 nt, Homo sapiens
gaacaguguuucc

SEQ ID NO: 1034496 - RNA, 12 nt, Homo sapiens
gaacaguuugua

SEQ ID NO: 1034497 - RNA, 14 nt, Homo sapiens
gaacauaaagccuu

SEQ ID NO: 1034498 - RNA, 17 nt, Homo sapiens
gaaccaagaagggcuag

SEQ ID NO: 1034499 - RNA, 13 nt, Homo sapiens
gaaccacuaugaa

SEQ ID NO: 1034500 - RNA, 21 nt, Homo sapiens
gaaccacucauaauucuucac

SEQ ID NO: 1034501 - RNA, 21 nt, Homo sapiens
gaaccacucuaucaaguauua

SEQ ID NO: 1034502 - RNA, 16 nt, Homo sapiens
gaaccacugcaccacc

SEQ ID NO: 1034503 - RNA, 23 nt, Homo sapiens
gaaccagauguuagaucagggga

SEQ ID NO: 1034504 - RNA, 16 nt, Homo sapiens
gaaccaggaaauggaa

SEQ ID NO: 1034505 - RNA, 21 nt, Homo sapiens
gaacccauuuugagugacucg

SEQ ID NO: 1034506 - RNA, 19 nt, Homo sapiens
gaacccugcuugcacuuug

SEQ ID NO: 1034507 - RNA, 18 nt, Homo sapiens
gaaccgaggggcucagga

SEQ ID NO: 1034508 - RNA, 17 nt, Homo sapiens
gaaccuagaagggcuag

SEQ ID NO: 1034509 - RNA, 12 nt, Homo sapiens
gaaccucagggc

SEQ ID NO: 1034510 - RNA, 20 nt, Homo sapiens
gaaccuccuuucucuucucu

SEQ ID NO: 1034511 - RNA, 20 nt, Homo sapiens
gaaccuguccuugcacacuc

SEQ ID NO: 1034512 - RNA, 21 nt, Homo sapiens
gaaccuucuggccucccacag

SEQ ID NO: 1034513 - RNA, 21 nt, Homo sapiens
gaacucaaggaaaucuguguc

SEQ ID NO: 1034514 - RNA, 13 nt, Homo sapiens
gaacucuguaaaa

SEQ ID NO: 1034515 - RNA, 19 nt, Homo sapiens
gaacugaaaacaagccaug

SEQ ID NO: 1034516 - RNA, 15 nt, Homo sapiens
gaacugaacauucca

SEQ ID NO: 1034517 - RNA, 18 nt, Homo sapiens
gaacugaaguuucacaug

SEQ ID NO: 1034518 - RNA, 22 nt, Homo sapiens
gaacugaauaaacaggaaaaug

SEQ ID NO: 1034519 - RNA, 19 nt, Homo sapiens
gaacuggaggaguuccuug

SEQ ID NO: 1034520 - RNA, 15 nt, Homo sapiens
gaacuuggcacacuc

SEQ ID NO: 1034521 - RNA, 19 nt, Homo sapiens
gaacuuggcacacucucca

SEQ ID NO: 1034522 - RNA, 23 nt, Homo sapiens
gaagaaaauaguggugugauuug

SEQ ID NO: 1034523 - RNA, 20 nt, Homo sapiens
gaagaacaguaacugccauc

SEQ ID NO: 1034524 - RNA, 14 nt, Homo sapiens
gaagaacuugcaug

SEQ ID NO: 1034525 - RNA, 20 nt, Homo sapiens
gaagaacuuggcacacucuc

SEQ ID NO: 1034526 - RNA, 15 nt, Homo sapiens
gaagaaugaacaaau

SEQ ID NO: 1034527 - RNA, 17 nt, Homo sapiens
gaagacaaugacuuacu

SEQ ID NO: 1034528 - RNA, 12 nt, Homo sapiens
gaagacacugaa

SEQ ID NO: 1034529 - RNA, 15 nt, Homo sapiens
gaagacacugcaaag

SEQ ID NO: 1034530 - RNA, 15 nt, Homo sapiens
gaagacagagggaaa

SEQ ID NO: 1034531 - RNA, 18 nt, Homo sapiens
gaagacagauacuccucc

SEQ ID NO: 1034532 - RNA, 11 nt, Homo sapiens
gaagacauaaa

SEQ ID NO: 1034533 - RNA, 16 nt, Homo sapiens
gaagacauccugagca

SEQ ID NO: 1034534 - RNA, 17 nt, Homo sapiens
gaagaccacacuuggug

SEQ ID NO: 1034535 - RNA, 17 nt, Homo sapiens
gaagaccagcuuugcag

SEQ ID NO: 1034536 - RNA, 21 nt, Homo sapiens
gaagaccaguccuguuugcag

SEQ ID NO: 1034537 - RNA, 21 nt, Homo sapiens
gaagacucuaccagacugugu

SEQ ID NO: 1034538 - RNA, 13 nt, Homo sapiens
gaagagaagggca

SEQ ID NO: 1034539 - RNA, 16 nt, Homo sapiens
gaagagaaugugacag

SEQ ID NO: 1034540 - RNA, 17 nt, Homo sapiens
gaagagaggaguucaau

SEQ ID NO: 1034541 - RNA, 17 nt, Homo sapiens
gaagagauccuucugua

SEQ ID NO: 1034542 - RNA, 13 nt, Homo sapiens
gaagagcauugca

SEQ ID NO: 1034543 - RNA, 13 nt, Homo sapiens
gaagaggggacag

SEQ ID NO: 1034544 - RNA, 15 nt, Homo sapiens
gaagaguuaaaacag

SEQ ID NO: 1034545 - RNA, 18 nt, Homo sapiens
gaagaugaucauuugccc

SEQ ID NO: 1034546 - RNA, 14 nt, Homo sapiens
agaaucaacauuuc

SEQ ID NO: 1034547 - RNA, 20 nt, Homo sapiens
agaaucagugcaaagauuug

SEQ ID NO: 1034548 - RNA, 18 nt, Homo sapiens
agaaucaugugaacccgg

SEQ ID NO: 1034549 - RNA, 18 nt, Homo sapiens
agaaucauugaaguauuu

SEQ ID NO: 1034550 - RNA, 19 nt, Homo sapiens
agaaucauugaaguauuuu

SEQ ID NO: 1034551 - RNA, 17 nt, Homo sapiens
agaauccaguuugcaau

SEQ ID NO: 1034552 - RNA, 18 nt, Homo sapiens
agaaucccuagucuucaa

SEQ ID NO: 1034553 - RNA, 14 nt, Homo sapiens
agaaucucaaauaa

SEQ ID NO: 1034554 - RNA, 14 nt, Homo sapiens
agaaucugcagcua

SEQ ID NO: 1034555 - RNA, 22 nt, Homo sapiens
agaaucuguuaccagaggacaa

SEQ ID NO: 1034556 - RNA, 21 nt, Homo sapiens
agaaucuguuucccagcagug

SEQ ID NO: 1034557 - RNA, 22 nt, Homo sapiens
agaaucuguuucccagcagugg

SEQ ID NO: 1034558 - RNA, 21 nt, Homo sapiens
agaaugaaagcuccucgaggg

SEQ ID NO: 1034559 - RNA, 16 nt, Homo sapiens
agaaugagcaagaggc

SEQ ID NO: 1034560 - RNA, 13 nt, Homo sapiens
agaaugguuacaa

SEQ ID NO: 1034561 - RNA, 15 nt, Homo sapiens
agaaugugacaggca

SEQ ID NO: 1034562 - RNA, 17 nt, Homo sapiens
agaaugugauauuugaa

SEQ ID NO: 1034563 - RNA, 18 nt, Homo sapiens
agaauuaguggcacuugc

SEQ ID NO: 1034564 - RNA, 21 nt, Homo sapiens
agaauuauaauuaguuccuca

SEQ ID NO: 1034565 - RNA, 19 nt, Homo sapiens
agaauugcuugaacccagg

SEQ ID NO: 1034566 - RNA, 14 nt, Homo sapiens
agaauuguaucauu

SEQ ID NO: 1034567 - RNA, 18 nt, Homo sapiens
agaauuugagugcucuga

SEQ ID NO: 1034568 - RNA, 15 nt, Homo sapiens
agaauuuguccaaua

SEQ ID NO: 1034569 - RNA, 19 nt, Homo sapiens
agacaaaaucuuaaaugcc

SEQ ID NO: 1034570 - RNA, 22 nt, Homo sapiens
agacaaugugaaaagaaaaaug

SEQ ID NO: 1034571 - RNA, 22 nt, Homo sapiens
agacacaucuccuccauacuca

SEQ ID NO: 1034572 - RNA, 18 nt, Homo sapiens
agacaccaaguuccguca

SEQ ID NO: 1034573 - RNA, 18 nt, Homo sapiens
agacacugaaauauacac

SEQ ID NO: 1034574 - RNA, 21 nt, Homo sapiens
agacagaaccccuacaugaaa

SEQ ID NO: 1034575 - RNA, 22 nt, Homo sapiens
agacagaguuuucacucuuauu

SEQ ID NO: 1034576 - RNA, 14 nt, Homo sapiens
agacagcuucucau

SEQ ID NO: 1034577 - RNA, 17 nt, Homo sapiens
agacaggacccugggac

SEQ ID NO: 1034578 - RNA, 18 nt, Homo sapiens
agacaguaugagucaaug

SEQ ID NO: 1034579 - RNA, 19 nt, Homo sapiens
agacaguguuuucugggau

SEQ ID NO: 1034580 - RNA, 16 nt, Homo sapiens
agacauaaauuacuuu

SEQ ID NO: 1034581 - RNA, 18 nt, Homo sapiens
agacauaaauuacuuuuu

SEQ ID NO: 1034582 - RNA, 17 nt, Homo sapiens
agacauaggccaugaaa

SEQ ID NO: 1034583 - RNA, 21 nt, Homo sapiens
agacauaguugugcaugccug

SEQ ID NO: 1034584 - RNA, 15 nt, Homo sapiens
agacauccugagcag

SEQ ID NO: 1034585 - RNA, 14 nt, Homo sapiens
agacaugaaugcac

SEQ ID NO: 1034586 - RNA, 20 nt, Homo sapiens
agacaugagccuccgcgccu

SEQ ID NO: 1034587 - RNA, 15 nt, Homo sapiens
agacaugagugcgug

SEQ ID NO: 1034588 - RNA, 18 nt, Homo sapiens
agacauggaauuaccuua

SEQ ID NO: 1034589 - RNA, 23 nt, Homo sapiens
agacaugucuagccacugaucau

SEQ ID NO: 1034590 - RNA, 19 nt, Homo sapiens
agacauuaaaucuaugaag

SEQ ID NO: 1034591 - RNA, 12 nt, Homo sapiens
agaccaaaauaa

SEQ ID NO: 1034592 - RNA, 21 nt, Homo sapiens
agaccacaaaaauugacucaa

SEQ ID NO: 1034593 - RNA, 13 nt, Homo sapiens
agaccacaaauag

SEQ ID NO: 1034594 - RNA, 13 nt, Homo sapiens
agaccagaaccag

SEQ ID NO: 1034595 - RNA, 18 nt, Homo sapiens
agaccagaagauucuauc

SEQ ID NO: 1034596 - RNA, 14 nt, Homo sapiens
agaccagaagugga

SEQ ID NO: 1034597 - RNA, 23 nt, Homo sapiens
agaccaggcuggccagcauggug

SEQ ID NO: 1034598 - RNA, 19 nt, Homo sapiens
agaccaguugggagcacug

SEQ ID NO: 1034599 - RNA, 14 nt, Homo sapiens
agaccauaauguua

SEQ ID NO: 1034600 - RNA, 17 nt, Homo sapiens
agaccaucccugaaggc

SEQ ID NO: 1034601 - RNA, 21 nt, Homo sapiens
agaccaucuacauacacagug

SEQ ID NO: 1034602 - RNA, 14 nt, Homo sapiens
agaccaucuuggcc

SEQ ID NO: 1034603 - RNA, 20 nt, Homo sapiens
agaccauuuaucugggauua

SEQ ID NO: 1034604 - RNA, 20 nt, Homo sapiens
agacccaacauuacuaacaa

SEQ ID NO: 1034605 - RNA, 17 nt, Homo sapiens
agacccaccacaccgca

SEQ ID NO: 1034606 - RNA, 12 nt, Homo sapiens
agacccggcugc

SEQ ID NO: 1034607 - RNA, 17 nt, Homo sapiens
agaccgccccucaccaa

SEQ ID NO: 1034608 - RNA, 16 nt, Homo sapiens
agaccuaccucagguu

SEQ ID NO: 1034609 - RNA, 21 nt, Homo sapiens
agaccuaccucagguugcugg

SEQ ID NO: 1034610 - RNA, 22 nt, Homo sapiens
agaccucagugccuuccuguuu

SEQ ID NO: 1034611 - RNA, 22 nt, Homo sapiens
agaccucucaauuucuggaaaa

SEQ ID NO: 1034612 - RNA, 15 nt, Homo sapiens
agaccuggcacugga

SEQ ID NO: 1034613 - RNA, 21 nt, Homo sapiens
agaccuggcacuggaugcaga

SEQ ID NO: 1034614 - RNA, 15 nt, Homo sapiens
agaccuucuccuuca

SEQ ID NO: 1034615 - RNA, 23 nt, Homo sapiens
agacgaccuuuaccuccugccuu

SEQ ID NO: 1034616 - RNA, 20 nt, Homo sapiens
agacggagucucgcucuguc

SEQ ID NO: 1034617 - RNA, 21 nt, Homo sapiens
agacggagucucgcucuguca

SEQ ID NO: 1034618 - RNA, 21 nt, Homo sapiens
agacgugauuuugcuguagaa

SEQ ID NO: 1034619 - RNA, 15 nt, Homo sapiens
agacuaugucaccca

SEQ ID NO: 1034620 - RNA, 17 nt, Homo sapiens
agacuauucaaacaguc

SEQ ID NO: 1034621 - RNA, 17 nt, Homo sapiens
agacucaucuuacugua

SEQ ID NO: 1034622 - RNA, 17 nt, Homo sapiens
agacuccgucucaagga

SEQ ID NO: 1034623 - RNA, 20 nt, Homo sapiens
agacucuacagaggccaugg

SEQ ID NO: 1034624 - RNA, 12 nt, Homo sapiens
agacucuaccag

SEQ ID NO: 1034625 - RNA, 20 nt, Homo sapiens
agacucuggaaguauacuuu

SEQ ID NO: 1034626 - RNA, 13 nt, Homo sapiens
agacucugucuca

SEQ ID NO: 1034627 - RNA, 14 nt, Homo sapiens
agacucugucucaa

SEQ ID NO: 1034628 - RNA, 20 nt, Homo sapiens
agacugaguacguugugcau

SEQ ID NO: 1034629 - RNA, 22 nt, Homo sapiens
agacugcauguaccauuugcau

SEQ ID NO: 1034630 - RNA, 14 nt, Homo sapiens
agacuggaaggugg

SEQ ID NO: 1034631 - RNA, 16 nt, Homo sapiens
agacugggcugaggga

SEQ ID NO: 1034632 - RNA, 21 nt, Homo sapiens
agacugguugaguucagguag

SEQ ID NO: 1034633 - RNA, 13 nt, Homo sapiens
agacugucaguag

SEQ ID NO: 1034634 - RNA, 22 nt, Homo sapiens
agacuguggcugcuagcacuug

SEQ ID NO: 1034635 - RNA, 20 nt, Homo sapiens
agacuuagaaaaauccuaca

SEQ ID NO: 1034636 - RNA, 21 nt, Homo sapiens
agacuuagaaaaauccuacaa

SEQ ID NO: 1034637 - RNA, 13 nt, Homo sapiens
agacuucccugaa

SEQ ID NO: 1034638 - RNA, 15 nt, Homo sapiens
agacuucguaauuaa

SEQ ID NO: 1034639 - RNA, 17 nt, Homo sapiens
agacuucugcuuuccac

SEQ ID NO: 1034640 - RNA, 14 nt, Homo sapiens
agacuugguuucaa

SEQ ID NO: 1034641 - RNA, 14 nt, Homo sapiens
agacuuuacaugga

SEQ ID NO: 1034642 - RNA, 20 nt, Homo sapiens
agacuuugacucuccagaaa

SEQ ID NO: 1034643 - RNA, 15 nt, Homo sapiens
agagaaaagaaacca

SEQ ID NO: 1034644 - RNA, 15 nt, Homo sapiens
agagaaaagacauaa

SEQ ID NO: 1034645 - RNA, 16 nt, Homo sapiens
agagaaaguacuucuc

SEQ ID NO: 1034646 - RNA, 14 nt, Homo sapiens
agagaaauacuuuc

SEQ ID NO: 1034647 - RNA, 14 nt, Homo sapiens
agagaaccaaaggg

SEQ ID NO: 1034648 - RNA, 17 nt, Homo sapiens
agagaaccgagcaaaga

SEQ ID NO: 1034649 - RNA, 13 nt, Homo sapiens
agagaagcugaug

SEQ ID NO: 1034650 - RNA, 19 nt, Homo sapiens
agagaagggacacauucaa

SEQ ID NO: 1034651 - RNA, 21 nt, Homo sapiens
agagacaggguuuugccaugu

SEQ ID NO: 1034652 - RNA, 23 nt, Homo sapiens
agagaccaggcaaagcaagugau

SEQ ID NO: 1034653 - RNA, 18 nt, Homo sapiens
agagaccgagccucuguc

SEQ ID NO: 1034654 - RNA, 15 nt, Homo sapiens
agagacuccuugaga

SEQ ID NO: 1034655 - RNA, 13 nt, Homo sapiens
agagacucuggcc

SEQ ID NO: 1034656 - RNA, 19 nt, Homo sapiens
agagacugaaaacuugccg

SEQ ID NO: 1034657 - RNA, 22 nt, Homo sapiens
agagagauggaauaaagcccuu

SEQ ID NO: 1034658 - RNA, 15 nt, Homo sapiens
agagaggccaggugc

SEQ ID NO: 1034659 - RNA, 17 nt, Homo sapiens
agagaggguggugaccu

SEQ ID NO: 1034660 - RNA, 16 nt, Homo sapiens
agagaguccucuggau

SEQ ID NO: 1034661 - RNA, 16 nt, Homo sapiens
agagagucgcaucuca

SEQ ID NO: 1034662 - RNA, 14 nt, Homo sapiens
agagaguuaaguga

SEQ ID NO: 1034663 - RNA, 19 nt, Homo sapiens
agagaucacaauacucaaa

SEQ ID NO: 1034664 - RNA, 20 nt, Homo sapiens
agagauggggucucacagug

SEQ ID NO: 1034665 - RNA, 21 nt, Homo sapiens
agagaugggguuucaccaugu

SEQ ID NO: 1034666 - RNA, 14 nt, Homo sapiens
agagauucauuauu

SEQ ID NO: 1034667 - RNA, 22 nt, Homo sapiens
agagauuccugagccaguguca

SEQ ID NO: 1034668 - RNA, 23 nt, Homo sapiens
agagauuggaaugggcagcucau

SEQ ID NO: 1034669 - RNA, 13 nt, Homo sapiens
agagcacacugua

SEQ ID NO: 1034670 - RNA, 22 nt, Homo sapiens
agagcacacuuggcccaagugg

SEQ ID NO: 1034671 - RNA, 10 nt, Homo sapiens
agagcacugg

SEQ ID NO: 1034672 - RNA, 15 nt, Homo sapiens
agagcagaugcagag

SEQ ID NO: 1034673 - RNA, 23 nt, Homo sapiens
agagcagcuuuaaacucagggac

SEQ ID NO: 1034674 - RNA, 19 nt, Homo sapiens
agagcaguuucuguccugc

SEQ ID NO: 1034675 - RNA, 14 nt, Homo sapiens
agagcauugccauu

SEQ ID NO: 1034676 - RNA, 22 nt, Homo sapiens
agagcauuuccaacaccacaga

SEQ ID NO: 1034677 - RNA, 22 nt, Homo sapiens
agagccagacugucucaaauaa

SEQ ID NO: 1034678 - RNA, 21 nt, Homo sapiens
agagcccggcgccccugccac

SEQ ID NO: 1034679 - RNA, 18 nt, Homo sapiens
agagccucuggcaucucu

SEQ ID NO: 1034680 - RNA, 14 nt, Homo sapiens
agagccuggagaag

SEQ ID NO: 1034681 - RNA, 12 nt, Homo sapiens
agagccuuccag

SEQ ID NO: 1034682 - RNA, 19 nt, Homo sapiens
agagcuagaaccuagaagg

SEQ ID NO: 1034683 - RNA, 17 nt, Homo sapiens
agagcugaacuauuaga

SEQ ID NO: 1034684 - RNA, 17 nt, Homo sapiens
agagcuggagccuggug

SEQ ID NO: 1034685 - RNA, 15 nt, Homo sapiens
agagcuggaucucuc

SEQ ID NO: 1034686 - RNA, 23 nt, Homo sapiens
agagcugggauguuucugucaca

SEQ ID NO: 1034687 - RNA, 19 nt, Homo sapiens
agagcuggggagggagagc

SEQ ID NO: 1034688 - RNA, 21 nt, Homo sapiens
agagcuuggacuggaugcaug

SEQ ID NO: 1034689 - RNA, 22 nt, Homo sapiens
agaggaaaaguaaggugcaguu

SEQ ID NO: 1034690 - RNA, 19 nt, Homo sapiens
agaggaaagaaugaaagag

SEQ ID NO: 1034691 - RNA, 14 nt, Homo sapiens
agaggacaguauuu

SEQ ID NO: 1034692 - RNA, 16 nt, Homo sapiens
agaggacucacuugcc

SEQ ID NO: 1034693 - RNA, 18 nt, Homo sapiens
agaggacucacuugccca

SEQ ID NO: 1034694 - RNA, 20 nt, Homo sapiens
acuuaaaaaauguccaugau

SEQ ID NO: 1034695 - RNA, 17 nt, Homo sapiens
acuuaaaagaacaugua

SEQ ID NO: 1034696 - RNA, 13 nt, Homo sapiens
acuuaacauucug

SEQ ID NO: 1034697 - RNA, 15 nt, Homo sapiens
acuuaagacugugua

SEQ ID NO: 1034698 - RNA, 14 nt, Homo sapiens
acuuaauaaugugu

SEQ ID NO: 1034699 - RNA, 18 nt, Homo sapiens
acuuaccuagauuuacag

SEQ ID NO: 1034700 - RNA, 14 nt, Homo sapiens
acuuacuuuacuca

SEQ ID NO: 1034701 - RNA, 23 nt, Homo sapiens
acuuaggaaauggcuuugugauu

SEQ ID NO: 1034702 - RNA, 21 nt, Homo sapiens
acuuauauuuaaaacuugccu

SEQ ID NO: 1034703 - RNA, 14 nt, Homo sapiens
acuuaucaacauuu

SEQ ID NO: 1034704 - RNA, 14 nt, Homo sapiens
acuuaucacaugga

SEQ ID NO: 1034705 - RNA, 20 nt, Homo sapiens
acuuauguauuuaugaccuu

SEQ ID NO: 1034706 - RNA, 16 nt, Homo sapiens
acuucaaacugagauc

SEQ ID NO: 1034707 - RNA, 23 nt, Homo sapiens
acuucaagaacccugacuccucu

SEQ ID NO: 1034708 - RNA, 13 nt, Homo sapiens
acuucaagugacc

SEQ ID NO: 1034709 - RNA, 20 nt, Homo sapiens
acuucaaguuaaagugaaua

SEQ ID NO: 1034710 - RNA, 18 nt, Homo sapiens
acuucaguugcuuugcag

SEQ ID NO: 1034711 - RNA, 19 nt, Homo sapiens
acuucaucuucucagcucc

SEQ ID NO: 1034712 - RNA, 13 nt, Homo sapiens
acuuccaccagcc

SEQ ID NO: 1034713 - RNA, 23 nt, Homo sapiens
acuuccagugcaacacugaagcu

SEQ ID NO: 1034714 - RNA, 16 nt, Homo sapiens
acuuccauuaacuuag

SEQ ID NO: 1034715 - RNA, 13 nt, Homo sapiens
acuuccauuugcu

SEQ ID NO: 1034716 - RNA, 16 nt, Homo sapiens
acuucccuaaugaagu

SEQ ID NO: 1034717 - RNA, 19 nt, Homo sapiens
acuuccuauaugcacuuau

SEQ ID NO: 1034718 - RNA, 17 nt, Homo sapiens
acuucucuauuaucuca

SEQ ID NO: 1034719 - RNA, 17 nt, Homo sapiens
acuucugaccacacuuc

SEQ ID NO: 1034720 - RNA, 15 nt, Homo sapiens
acuucuggcuccuca

SEQ ID NO: 1034721 - RNA, 15 nt, Homo sapiens
acuucugucuucaca

SEQ ID NO: 1034722 - RNA, 21 nt, Homo sapiens
acuucuuacuucccuaaugaa

SEQ ID NO: 1034723 - RNA, 17 nt, Homo sapiens
acuucuuauacauuuga

SEQ ID NO: 1034724 - RNA, 11 nt, Homo sapiens
acuucuuggcu

SEQ ID NO: 1034725 - RNA, 20 nt, Homo sapiens
acuucuuuaaaaaaacacau

SEQ ID NO: 1034726 - RNA, 21 nt, Homo sapiens
acuucuuuaaaaaaacacaua

SEQ ID NO: 1034727 - RNA, 20 nt, Homo sapiens
acuugaaagcauccaugugu

SEQ ID NO: 1034728 - RNA, 22 nt, Homo sapiens
acuugaaauaccagugaaccaa

SEQ ID NO: 1034729 - RNA, 21 nt, Homo sapiens
acuugaaucaaagcaguuaac

SEQ ID NO: 1034730 - RNA, 17 nt, Homo sapiens
acuugauguguuaucuc

SEQ ID NO: 1034731 - RNA, 22 nt, Homo sapiens
acuugcaccucugaccuaucac

SEQ ID NO: 1034732 - RNA, 15 nt, Homo sapiens
acuugcauacagaga

SEQ ID NO: 1034733 - RNA, 21 nt, Homo sapiens
acuugcuuuaugccuucuuau

SEQ ID NO: 1034734 - RNA, 17 nt, Homo sapiens
acuuggaauucucucac

SEQ ID NO: 1034735 - RNA, 18 nt, Homo sapiens
acuuggaauucucucacc

SEQ ID NO: 1034736 - RNA, 17 nt, Homo sapiens
acuuggacucuugcucu

SEQ ID NO: 1034737 - RNA, 21 nt, Homo sapiens
acuuggagccccagugccaag

SEQ ID NO: 1034738 - RNA, 19 nt, Homo sapiens
acuuggcuacacagggaug

SEQ ID NO: 1034739 - RNA, 20 nt, Homo sapiens
acuugggccacugugaagag

SEQ ID NO: 1034740 - RNA, 15 nt, Homo sapiens
acuugggccauagcu

SEQ ID NO: 1034741 - RNA, 23 nt, Homo sapiens
acuuggggagauggaguucuugu

SEQ ID NO: 1034742 - RNA, 15 nt, Homo sapiens
acuugucuuugacuu

SEQ ID NO: 1034743 - RNA, 17 nt, Homo sapiens
acuuuacaaaaguauua

SEQ ID NO: 1034744 - RNA, 12 nt, Homo sapiens
acuuuaccuuuu

SEQ ID NO: 1034745 - RNA, 18 nt, Homo sapiens
acuuuaucuaauaccucu

SEQ ID NO: 1034746 - RNA, 23 nt, Homo sapiens
acuuucccagaaaaaaaaaaacu

SEQ ID NO: 1034747 - RNA, 17 nt, Homo sapiens
acuuucucaguuuucau

SEQ ID NO: 1034748 - RNA, 14 nt, Homo sapiens
acuuugaaucaaaa

SEQ ID NO: 1034749 - RNA, 23 nt, Homo sapiens
acuuugaccucugcagcaauaaa

SEQ ID NO: 1034750 - RNA, 18 nt, Homo sapiens
acuuugauaggaugugga

SEQ ID NO: 1034751 - RNA, 15 nt, Homo sapiens
acuuugggaggccaa

SEQ ID NO: 1034752 - RNA, 17 nt, Homo sapiens
acuuugggaggccaagg

SEQ ID NO: 1034753 - RNA, 14 nt, Homo sapiens
acuuuguaugucau

SEQ ID NO: 1034754 - RNA, 23 nt, Homo sapiens
acuuuguauuuguucaguaugca

SEQ ID NO: 1034755 - RNA, 14 nt, Homo sapiens
acuuuguguucacc

SEQ ID NO: 1034756 - RNA, 17 nt, Homo sapiens
acuuuuaaguugcugau

SEQ ID NO: 1034757 - RNA, 21 nt, Homo sapiens
acuuuucuuuccucagaucau

SEQ ID NO: 1034758 - RNA, 17 nt, Homo sapiens
acuuuuuaaaacacaac

SEQ ID NO: 1034759 - RNA, 17 nt, Homo sapiens
acuuuuuccuggcucau

SEQ ID NO: 1034760 - RNA, 21 nt, Homo sapiens
acuuuuuccuggcucaucucu

SEQ ID NO: 1034761 - RNA, 15 nt, Homo sapiens
acuuuuugcauuuaa

SEQ ID NO: 1034762 - RNA, 16 nt, Homo sapiens
acuuuuuuuugacaua

SEQ ID NO: 1034763 - RNA, 15 nt, Homo sapiens
agaaaaaaacuucuu

SEQ ID NO: 1034764 - RNA, 16 nt, Homo sapiens
agaaaaaaaguaggaa

SEQ ID NO: 1034765 - RNA, 11 nt, Homo sapiens
agaaaaaccac

SEQ ID NO: 1034766 - RNA, 14 nt, Homo sapiens
agaaaaagaagaac

SEQ ID NO: 1034767 - RNA, 13 nt, Homo sapiens
agaaaaaugucau

SEQ ID NO: 1034768 - RNA, 12 nt, Homo sapiens
agaaaacauguu

SEQ ID NO: 1034769 - RNA, 14 nt, Homo sapiens
agaaaacuaaguca

SEQ ID NO: 1034770 - RNA, 21 nt, Homo sapiens
agaaaauaaaauuuaacucac

SEQ ID NO: 1034771 - RNA, 20 nt, Homo sapiens
agaaaauaguggugugauuu

SEQ ID NO: 1034772 - RNA, 14 nt, Homo sapiens
agaaaaugaugcug

SEQ ID NO: 1034773 - RNA, 23 nt, Homo sapiens
agaaacaaccguuggaaacauaa

SEQ ID NO: 1034774 - RNA, 21 nt, Homo sapiens
agaaacaacuucuacuucugc

SEQ ID NO: 1034775 - RNA, 20 nt, Homo sapiens
agaaacacuaaagcauucaa

SEQ ID NO: 1034776 - RNA, 23 nt, Homo sapiens
agaaacagcuucucaauuucuac

SEQ ID NO: 1034777 - RNA, 22 nt, Homo sapiens
agaaacgucuauguguacagau

SEQ ID NO: 1034778 - RNA, 20 nt, Homo sapiens
agaaacguuuggaacaaucu

SEQ ID NO: 1034779 - RNA, 17 nt, Homo sapiens
agaaacuguagucucag

SEQ ID NO: 1034780 - RNA, 16 nt, Homo sapiens
agaaacuugcuuauca

SEQ ID NO: 1034781 - RNA, 18 nt, Homo sapiens
agaaacuugugaagugga

SEQ ID NO: 1034782 - RNA, 23 nt, Homo sapiens
agaaagacuauucaaacagucuc

SEQ ID NO: 1034783 - RNA, 19 nt, Homo sapiens
agaaagccuucauaagccu

SEQ ID NO: 1034784 - RNA, 18 nt, Homo sapiens
agaaagugaagcaaauca

SEQ ID NO: 1034785 - RNA, 21 nt, Homo sapiens
agaaagugcauuaaacugaau

SEQ ID NO: 1034786 - RNA, 13 nt, Homo sapiens
agaaaguuaugaa

SEQ ID NO: 1034787 - RNA, 12 nt, Homo sapiens
agaaaguucuca

SEQ ID NO: 1034788 - RNA, 12 nt, Homo sapiens
agaaauaagccc

SEQ ID NO: 1034789 - RNA, 23 nt, Homo sapiens
agaaauacaauucuacauuguca

SEQ ID NO: 1034790 - RNA, 17 nt, Homo sapiens
agaaauacuuucaggca

SEQ ID NO: 1034791 - RNA, 19 nt, Homo sapiens
agaaauaucugaaaaugua

SEQ ID NO: 1034792 - RNA, 19 nt, Homo sapiens
agaaaucuagaagacuguc

SEQ ID NO: 1034793 - RNA, 22 nt, Homo sapiens
agaaaucuuguuggcaaaucag

SEQ ID NO: 1034794 - RNA, 12 nt, Homo sapiens
agaaaugucuaa

SEQ ID NO: 1034795 - RNA, 14 nt, Homo sapiens
agaaauguguuauc

SEQ ID NO: 1034796 - RNA, 18 nt, Homo sapiens
agaaauuaugucagcuua

SEQ ID NO: 1034797 - RNA, 22 nt, Homo sapiens
agaaauuccuguagcaucuucu

SEQ ID NO: 1034798 - RNA, 17 nt, Homo sapiens
agaaauugacagaucaa

SEQ ID NO: 1034799 - RNA, 19 nt, Homo sapiens
agaaauuugccaauuuacu

SEQ ID NO: 1034800 - RNA, 16 nt, Homo sapiens
agaacacaaggucauu

SEQ ID NO: 1034801 - RNA, 13 nt, Homo sapiens
agaacacuaaccu

SEQ ID NO: 1034802 - RNA, 12 nt, Homo sapiens
agaacacuguga

SEQ ID NO: 1034803 - RNA, 12 nt, Homo sapiens
agaacagccgcu

SEQ ID NO: 1034804 - RNA, 15 nt, Homo sapiens
agaacaggcaaguga

SEQ ID NO: 1034805 - RNA, 19 nt, Homo sapiens
agaacaguaacugccauca

SEQ ID NO: 1034806 - RNA, 20 nt, Homo sapiens
agaaccaaaaguuuuccuga

SEQ ID NO: 1034807 - RNA, 18 nt, Homo sapiens
agaaccacucauaauucu

SEQ ID NO: 1034808 - RNA, 23 nt, Homo sapiens
agaaccauccauaguaguaugau

SEQ ID NO: 1034809 - RNA, 18 nt, Homo sapiens
agaaccgagcaaagauca

SEQ ID NO: 1034810 - RNA, 11 nt, Homo sapiens
agaaccucagg

SEQ ID NO: 1034811 - RNA, 13 nt, Homo sapiens
agaaccucuuccc

SEQ ID NO: 1034812 - RNA, 23 nt, Homo sapiens
agaaccuugugccuggcucagag

SEQ ID NO: 1034813 - RNA, 16 nt, Homo sapiens
agaacucugagcagug

SEQ ID NO: 1034814 - RNA, 16 nt, Homo sapiens
agaacugcagucagca

SEQ ID NO: 1034815 - RNA, 16 nt, Homo sapiens
agaacuggacucagga

SEQ ID NO: 1034816 - RNA, 18 nt, Homo sapiens
agaagaaaauaguggugu

SEQ ID NO: 1034817 - RNA, 16 nt, Homo sapiens
agaagaaugacuaugc

SEQ ID NO: 1034818 - RNA, 13 nt, Homo sapiens
agaagaccagacu

SEQ ID NO: 1034819 - RNA, 23 nt, Homo sapiens
agaagacugucagcuuccaaaca

SEQ ID NO: 1034820 - RNA, 19 nt, Homo sapiens
agaagagacccaaccacuu

SEQ ID NO: 1034821 - RNA, 21 nt, Homo sapiens
agaagaggagaaaaaaacuuc

SEQ ID NO: 1034822 - RNA, 18 nt, Homo sapiens
agaagagugccacauuua

SEQ ID NO: 1034823 - RNA, 13 nt, Homo sapiens
agaagcaaguggu

SEQ ID NO: 1034824 - RNA, 16 nt, Homo sapiens
agaagcacauaugaac

SEQ ID NO: 1034825 - RNA, 20 nt, Homo sapiens
agaagcacccaggacuucca

SEQ ID NO: 1034826 - RNA, 16 nt, Homo sapiens
agaagcagaaacuggc

SEQ ID NO: 1034827 - RNA, 14 nt, Homo sapiens
agaagcagaccuca

SEQ ID NO: 1034828 - RNA, 10 nt, Homo sapiens
agaagccagu

SEQ ID NO: 1034829 - RNA, 20 nt, Homo sapiens
agaagcugagcaccagggga

SEQ ID NO: 1034830 - RNA, 12 nt, Homo sapiens
agaagcuuccau

SEQ ID NO: 1034831 - RNA, 19 nt, Homo sapiens
agaaggacauuuuacugca

SEQ ID NO: 1034832 - RNA, 13 nt, Homo sapiens
agaaggagggaga

SEQ ID NO: 1034833 - RNA, 14 nt, Homo sapiens
agaaggcauaucag

SEQ ID NO: 1034834 - RNA, 17 nt, Homo sapiens
agaaggccaagaaucaa

SEQ ID NO: 1034835 - RNA, 20 nt, Homo sapiens
agaaggucauaagggagcau

SEQ ID NO: 1034836 - RNA, 20 nt, Homo sapiens
agaagguuaccaagaagccu

SEQ ID NO: 1034837 - RNA, 13 nt, Homo sapiens
agaaguaggcaug

SEQ ID NO: 1034838 - RNA, 20 nt, Homo sapiens
agaaguccccuuccauccca

SEQ ID NO: 1034839 - RNA, 16 nt, Homo sapiens
agaagugccaguugau

SEQ ID NO: 1034840 - RNA, 16 nt, Homo sapiens
agaagugucuaaaaac

SEQ ID NO: 1034841 - RNA, 18 nt, Homo sapiens
agaauauaauacuguauu

SEQ ID NO: 1034842 - RNA, 13 nt, Homo sapiens
agaaucaaaugca

SEQ ID NO: 1034843 - RNA, 16 nt, Homo sapiens
acucaggggucauuca

SEQ ID NO: 1034844 - RNA, 17 nt, Homo sapiens
acucaggggucauucau

SEQ ID NO: 1034845 - RNA, 18 nt, Homo sapiens
acucagucuuuaaucuga

SEQ ID NO: 1034846 - RNA, 16 nt, Homo sapiens
acucagugauugcaau

SEQ ID NO: 1034847 - RNA, 20 nt, Homo sapiens
acucauaauagacuucccac

SEQ ID NO: 1034848 - RNA, 16 nt, Homo sapiens
acucauagcacuuccc

SEQ ID NO: 1034849 - RNA, 20 nt, Homo sapiens
acucauaggcuuauuuccaa

SEQ ID NO: 1034850 - RNA, 18 nt, Homo sapiens
acucaucccuguuccuca

SEQ ID NO: 1034851 - RNA, 12 nt, Homo sapiens
acucaucugcca

SEQ ID NO: 1034852 - RNA, 15 nt, Homo sapiens
acucaucugccaagc

SEQ ID NO: 1034853 - RNA, 18 nt, Homo sapiens
acucaucuuagugccuga

SEQ ID NO: 1034854 - RNA, 17 nt, Homo sapiens
acucauuuuuguuuuca

SEQ ID NO: 1034855 - RNA, 16 nt, Homo sapiens
acuccagaaccgcaga

SEQ ID NO: 1034856 - RNA, 17 nt, Homo sapiens
acuccagagggccuucc

SEQ ID NO: 1034857 - RNA, 13 nt, Homo sapiens
acuccagccugag

SEQ ID NO: 1034858 - RNA, 23 nt, Homo sapiens
acuccagccugagcgacagugag

SEQ ID NO: 1034859 - RNA, 15 nt, Homo sapiens
acuccagccugggca

SEQ ID NO: 1034860 - RNA, 21 nt, Homo sapiens
acuccagccugggcaacacag

SEQ ID NO: 1034861 - RNA, 15 nt, Homo sapiens
acucccacuuggcau

SEQ ID NO: 1034862 - RNA, 16 nt, Homo sapiens
acucccccucuuucac

SEQ ID NO: 1034863 - RNA, 17 nt, Homo sapiens
acucccuugguggcaag

SEQ ID NO: 1034864 - RNA, 15 nt, Homo sapiens
acuccggagguagag

SEQ ID NO: 1034865 - RNA, 18 nt, Homo sapiens
acuccuaagacuuaugua

SEQ ID NO: 1034866 - RNA, 16 nt, Homo sapiens
acuccuaugaucucag

SEQ ID NO: 1034867 - RNA, 17 nt, Homo sapiens
acuccuccuaguacuaa

SEQ ID NO: 1034868 - RNA, 19 nt, Homo sapiens
acuccucuguccaggcacu

SEQ ID NO: 1034869 - RNA, 14 nt, Homo sapiens
acuccugaccucag

SEQ ID NO: 1034870 - RNA, 20 nt, Homo sapiens
acuccugaggacagcugucc

SEQ ID NO: 1034871 - RNA, 16 nt, Homo sapiens
acuccugcccuguugu

SEQ ID NO: 1034872 - RNA, 19 nt, Homo sapiens
acuccuggguugagcuguu

SEQ ID NO: 1034873 - RNA, 17 nt, Homo sapiens
acuccuuagagacauca

SEQ ID NO: 1034874 - RNA, 17 nt, Homo sapiens
acucgucugacugugug

SEQ ID NO: 1034875 - RNA, 13 nt, Homo sapiens
acucuacccuaua

SEQ ID NO: 1034876 - RNA, 17 nt, Homo sapiens
acucuaggcagugacag

SEQ ID NO: 1034877 - RNA, 18 nt, Homo sapiens
acucuaggcagugacagu

SEQ ID NO: 1034878 - RNA, 20 nt, Homo sapiens
acucuaggggucaggcucca

SEQ ID NO: 1034879 - RNA, 21 nt, Homo sapiens
acucuaggggucaggcuccau

SEQ ID NO: 1034880 - RNA, 23 nt, Homo sapiens
acucucacaagauggaaaucaca

SEQ ID NO: 1034881 - RNA, 17 nt, Homo sapiens
acucuccaaacagucac

SEQ ID NO: 1034882 - RNA, 18 nt, Homo sapiens
acucucugugaccugccc

SEQ ID NO: 1034883 - RNA, 22 nt, Homo sapiens
acucucuuuguaaaaauuuugu

SEQ ID NO: 1034884 - RNA, 19 nt, Homo sapiens
acucugacuggcacagucu

SEQ ID NO: 1034885 - RNA, 19 nt, Homo sapiens
acucugcacaugucuugua

SEQ ID NO: 1034886 - RNA, 15 nt, Homo sapiens
acucugcacuacucc

SEQ ID NO: 1034887 - RNA, 16 nt, Homo sapiens
acucugcacuacuccu

SEQ ID NO: 1034888 - RNA, 13 nt, Homo sapiens
acucugcacuggu

SEQ ID NO: 1034889 - RNA, 13 nt, Homo sapiens
acucugggcucca

SEQ ID NO: 1034890 - RNA, 21 nt, Homo sapiens
acucuuaaguuucucagcucc

SEQ ID NO: 1034891 - RNA, 19 nt, Homo sapiens
acucuuaguuacucauuca

SEQ ID NO: 1034892 - RNA, 23 nt, Homo sapiens
acucuuaguuacucauucaggga

SEQ ID NO: 1034893 - RNA, 17 nt, Homo sapiens
acucuuccugaguucag

SEQ ID NO: 1034894 - RNA, 23 nt, Homo sapiens
acugaaaaaugguaauuguugcu

SEQ ID NO: 1034895 - RNA, 14 nt, Homo sapiens
acugaaagugaaag

SEQ ID NO: 1034896 - RNA, 16 nt, Homo sapiens
acugaaauauacacac

SEQ ID NO: 1034897 - RNA, 18 nt, Homo sapiens
acugaacaaucaaagcac

SEQ ID NO: 1034898 - RNA, 23 nt, Homo sapiens
acugaagggcccuucacugccuu

SEQ ID NO: 1034899 - RNA, 18 nt, Homo sapiens
acugaauguaaacaaagg

SEQ ID NO: 1034900 - RNA, 19 nt, Homo sapiens
acugacacuuugccagaaa

SEQ ID NO: 1034901 - RNA, 20 nt, Homo sapiens
acugacccugauacaggcau

SEQ ID NO: 1034902 - RNA, 17 nt, Homo sapiens
acugacugccuugcuaa

SEQ ID NO: 1034903 - RNA, 15 nt, Homo sapiens
acugacuuucucagc

SEQ ID NO: 1034904 - RNA, 15 nt, Homo sapiens
acugagagucugcac

SEQ ID NO: 1034905 - RNA, 15 nt, Homo sapiens
acugagagugaagug

SEQ ID NO: 1034906 - RNA, 17 nt, Homo sapiens
acugagcaaagcauuga

SEQ ID NO: 1034907 - RNA, 16 nt, Homo sapiens
acugagccagucccag

SEQ ID NO: 1034908 - RNA, 12 nt, Homo sapiens
acugagcuguca

SEQ ID NO: 1034909 - RNA, 14 nt, Homo sapiens
acugaggcagacag

SEQ ID NO: 1034910 - RNA, 22 nt, Homo sapiens
acugaguuaaauuauacuggag

SEQ ID NO: 1034911 - RNA, 13 nt, Homo sapiens
acugauaaucucu

SEQ ID NO: 1034912 - RNA, 13 nt, Homo sapiens
acugaucauuaaa

SEQ ID NO: 1034913 - RNA, 16 nt, Homo sapiens
acugaucgauuugcac

SEQ ID NO: 1034914 - RNA, 20 nt, Homo sapiens
acugauuucacaacagauca

SEQ ID NO: 1034915 - RNA, 17 nt, Homo sapiens
acugauuuuuagcuuua

SEQ ID NO: 1034916 - RNA, 20 nt, Homo sapiens
acugauuuuuagcuuuacaa

SEQ ID NO: 1034917 - RNA, 13 nt, Homo sapiens
acugcaaauguca

SEQ ID NO: 1034918 - RNA, 14 nt, Homo sapiens
acugcaagcacugc

SEQ ID NO: 1034919 - RNA, 21 nt, Homo sapiens
acugcaagcacugcaugggca

SEQ ID NO: 1034920 - RNA, 10 nt, Homo sapiens
acugcaauaa

SEQ ID NO: 1034921 - RNA, 20 nt, Homo sapiens
acugcaccgggccacagaga

SEQ ID NO: 1034922 - RNA, 20 nt, Homo sapiens
acugcacuccagccugggug

SEQ ID NO: 1034923 - RNA, 20 nt, Homo sapiens
acugcacuccagucugggug

SEQ ID NO: 1034924 - RNA, 13 nt, Homo sapiens
acugcagcuuugu

SEQ ID NO: 1034925 - RNA, 17 nt, Homo sapiens
acugcaggggucuggug

SEQ ID NO: 1034926 - RNA, 22 nt, Homo sapiens
acugcagucagcaugaauccag

SEQ ID NO: 1034927 - RNA, 21 nt, Homo sapiens
acugcauaaaaagugccugua

SEQ ID NO: 1034928 - RNA, 22 nt, Homo sapiens
acugcaucguuucaucuuccaa

SEQ ID NO: 1034929 - RNA, 19 nt, Homo sapiens
acugcauuccacagguggg

SEQ ID NO: 1034930 - RNA, 18 nt, Homo sapiens
acugccaaagaacuugga

SEQ ID NO: 1034931 - RNA, 20 nt, Homo sapiens
acugccauauacucuucaag

SEQ ID NO: 1034932 - RNA, 13 nt, Homo sapiens
acugccaucuuag

SEQ ID NO: 1034933 - RNA, 21 nt, Homo sapiens
acugccaucuuggacuuguca

SEQ ID NO: 1034934 - RNA, 15 nt, Homo sapiens
acugccaugccagcu

SEQ ID NO: 1034935 - RNA, 19 nt, Homo sapiens
acugccccagacacagugc

SEQ ID NO: 1034936 - RNA, 23 nt, Homo sapiens
acugccccccugccuugcucccc

SEQ ID NO: 1034937 - RNA, 13 nt, Homo sapiens
acugccucagguu

SEQ ID NO: 1034938 - RNA, 20 nt, Homo sapiens
acugccucuuccucccucau

SEQ ID NO: 1034939 - RNA, 18 nt, Homo sapiens
acugcguuguccacaaga

SEQ ID NO: 1034940 - RNA, 20 nt, Homo sapiens
acugcucauuuggaucccag

SEQ ID NO: 1034941 - RNA, 22 nt, Homo sapiens
acugcugcccagccuccaagcu

SEQ ID NO: 1034942 - RNA, 17 nt, Homo sapiens
acugcugcuccagugca

SEQ ID NO: 1034943 - RNA, 15 nt, Homo sapiens
acugcuguuguugaa

SEQ ID NO: 1034944 - RNA, 14 nt, Homo sapiens
acugcuugaggaaa

SEQ ID NO: 1034945 - RNA, 18 nt, Homo sapiens
acuggaaaaguguaauag

SEQ ID NO: 1034946 - RNA, 23 nt, Homo sapiens
acuggaagguggggacagggaug

SEQ ID NO: 1034947 - RNA, 20 nt, Homo sapiens
acuggacuugagcuuggcag

SEQ ID NO: 1034948 - RNA, 12 nt, Homo sapiens
acuggaucccag

SEQ ID NO: 1034949 - RNA, 19 nt, Homo sapiens
acuggcacagucuuugcau

SEQ ID NO: 1034950 - RNA, 13 nt, Homo sapiens
acuggcagcaucu

SEQ ID NO: 1034951 - RNA, 22 nt, Homo sapiens
acuggcagggacgaggacaaau

SEQ ID NO: 1034952 - RNA, 16 nt, Homo sapiens
acuggcaguuuuccau

SEQ ID NO: 1034953 - RNA, 12 nt, Homo sapiens
acuggccugcac

SEQ ID NO: 1034954 - RNA, 13 nt, Homo sapiens
acuggcucuccaa

SEQ ID NO: 1034955 - RNA, 15 nt, Homo sapiens
acuggcucucuccag

SEQ ID NO: 1034956 - RNA, 23 nt, Homo sapiens
acugggacuaaguguaccagaga

SEQ ID NO: 1034957 - RNA, 13 nt, Homo sapiens
acugggacuugca

SEQ ID NO: 1034958 - RNA, 21 nt, Homo sapiens
acugggagaggugccagcaac

SEQ ID NO: 1034959 - RNA, 22 nt, Homo sapiens
acugggaugagccgcugugagc

SEQ ID NO: 1034960 - RNA, 13 nt, Homo sapiens
acugggcuucuag

SEQ ID NO: 1034961 - RNA, 15 nt, Homo sapiens
acuggguucccauuc

SEQ ID NO: 1034962 - RNA, 16 nt, Homo sapiens
acugguauguguggau

SEQ ID NO: 1034963 - RNA, 23 nt, Homo sapiens
acugguucauauuggacugauaa

SEQ ID NO: 1034964 - RNA, 23 nt, Homo sapiens
acuguacaaugacuuuauugcau

SEQ ID NO: 1034965 - RNA, 12 nt, Homo sapiens
acuguacaugaa

SEQ ID NO: 1034966 - RNA, 17 nt, Homo sapiens
acuguaccgacuuugau

SEQ ID NO: 1034967 - RNA, 14 nt, Homo sapiens
acuguacucugcac

SEQ ID NO: 1034968 - RNA, 23 nt, Homo sapiens
acuguagaaaugaugauguggaa

SEQ ID NO: 1034969 - RNA, 21 nt, Homo sapiens
acuguagacucuggaaguaua

SEQ ID NO: 1034970 - RNA, 17 nt, Homo sapiens
acuguauauacuuugcc

SEQ ID NO: 1034971 - RNA, 18 nt, Homo sapiens
acuguauauauaauacug

SEQ ID NO: 1034972 - RNA, 13 nt, Homo sapiens
acugucacuuugc

SEQ ID NO: 1034973 - RNA, 22 nt, Homo sapiens
acuguccagagagcaacucuga

SEQ ID NO: 1034974 - RNA, 14 nt, Homo sapiens
acuguccuacccac

SEQ ID NO: 1034975 - RNA, 13 nt, Homo sapiens
acugucuccaugg

SEQ ID NO: 1034976 - RNA, 19 nt, Homo sapiens
acugucuccuuucucuuau

SEQ ID NO: 1034977 - RNA, 16 nt, Homo sapiens
acugucuugaagacaa

SEQ ID NO: 1034978 - RNA, 21 nt, Homo sapiens
acugucuugaagacaauggcu

SEQ ID NO: 1034979 - RNA, 21 nt, Homo sapiens
acugugaccuagagacuucac

SEQ ID NO: 1034980 - RNA, 18 nt, Homo sapiens
acugugaggguaaaggcu

SEQ ID NO: 1034981 - RNA, 19 nt, Homo sapiens
acuguggagguacacucuu

SEQ ID NO: 1034982 - RNA, 21 nt, Homo sapiens
acuguggccuguuaacuggua

SEQ ID NO: 1034983 - RNA, 16 nt, Homo sapiens
acuguguggacuguga

SEQ ID NO: 1034984 - RNA, 19 nt, Homo sapiens
acuguguggacugugaugc

SEQ ID NO: 1034985 - RNA, 20 nt, Homo sapiens
acuguuaaauugcuguguau

SEQ ID NO: 1034986 - RNA, 18 nt, Homo sapiens
acuguuauuuauaaucac

SEQ ID NO: 1034987 - RNA, 18 nt, Homo sapiens
acuguucccccugugcag

SEQ ID NO: 1034988 - RNA, 13 nt, Homo sapiens
acuguugcccagg

SEQ ID NO: 1034989 - RNA, 16 nt, Homo sapiens
acuguuugucuucucc

SEQ ID NO: 1034990 - RNA, 12 nt, Homo sapiens
acuguuuuuacc

SEQ ID NO: 1034991 - RNA, 19 nt, Homo sapiens
aacccuauugguaaagaau

SEQ ID NO: 1034992 - RNA, 19 nt, Homo sapiens
aacccucagaaacacuggg

SEQ ID NO: 1034993 - RNA, 21 nt, Homo sapiens
aacccugcguggggacagggc

SEQ ID NO: 1034994 - RNA, 12 nt, Homo sapiens
aacccugucucu

SEQ ID NO: 1034995 - RNA, 16 nt, Homo sapiens
aaccggucacccagga

SEQ ID NO: 1034996 - RNA, 23 nt, Homo sapiens
aaccguuuccuuucauuuacugu

SEQ ID NO: 1034997 - RNA, 15 nt, Homo sapiens
aaccuaauaaucuga

SEQ ID NO: 1034998 - RNA, 20 nt, Homo sapiens
aaccuaccaccccuuccugu

SEQ ID NO: 1034999 - RNA, 16 nt, Homo sapiens
aaccucaaagugacua

SEQ ID NO: 1035000 - RNA, 20 nt, Homo sapiens
aaccucaggcuuccuuggca

SEQ ID NO: 1035001 - RNA, 11 nt, Homo sapiens
aaccucagggc

SEQ ID NO: 1035002 - RNA, 23 nt, Homo sapiens
aaccucagugauuggcucugugg

SEQ ID NO: 1035003 - RNA, 14 nt, Homo sapiens
aaccucuaugcaau

SEQ ID NO: 1035004 - RNA, 18 nt, Homo sapiens
aaccucucuucuaccuua

SEQ ID NO: 1035005 - RNA, 23 nt, Homo sapiens
aaccugaauauaaauuuguguuc

SEQ ID NO: 1035006 - RNA, 21 nt, Homo sapiens
aaccugccagggagacagagc

SEQ ID NO: 1035007 - RNA, 21 nt, Homo sapiens
aaccuggagccacuucuaucu

SEQ ID NO: 1035008 - RNA, 21 nt, Homo sapiens
aaccuggagggcuagaaccua

SEQ ID NO: 1035009 - RNA, 17 nt, Homo sapiens
aaccuggugcuggauau

SEQ ID NO: 1035010 - RNA, 14 nt, Homo sapiens
aaccuguccuugca

SEQ ID NO: 1035011 - RNA, 15 nt, Homo sapiens
aaccuguccuugcac

SEQ ID NO: 1035012 - RNA, 14 nt, Homo sapiens
aaccugugugccau

SEQ ID NO: 1035013 - RNA, 14 nt, Homo sapiens
aaccuuccaucucg

SEQ ID NO: 1035014 - RNA, 20 nt, Homo sapiens
aacgcuucugcuuaaucuga

SEQ ID NO: 1035015 - RNA, 14 nt, Homo sapiens
aacguaaauacaca

SEQ ID NO: 1035016 - RNA, 15 nt, Homo sapiens
aacgucuauguguac

SEQ ID NO: 1035017 - RNA, 17 nt, Homo sapiens
aacguuuugaacuaaua

SEQ ID NO: 1035018 - RNA, 15 nt, Homo sapiens
aacuaaacagauaaa

SEQ ID NO: 1035019 - RNA, 14 nt, Homo sapiens
aacuaaauaaagcu

SEQ ID NO: 1035020 - RNA, 17 nt, Homo sapiens
aacuaauaaaagcauaa

SEQ ID NO: 1035021 - RNA, 19 nt, Homo sapiens
aacuacaauguagucucau

SEQ ID NO: 1035022 - RNA, 21 nt, Homo sapiens
aacuauaugccauaaaccuca

SEQ ID NO: 1035023 - RNA, 13 nt, Homo sapiens
aacuauauucuca

SEQ ID NO: 1035024 - RNA, 21 nt, Homo sapiens
aacuauuggagggugggagag

SEQ ID NO: 1035025 - RNA, 21 nt, Homo sapiens
aacucaaggaaaucuguguca

SEQ ID NO: 1035026 - RNA, 11 nt, Homo sapiens
aacucaauauu

SEQ ID NO: 1035027 - RNA, 16 nt, Homo sapiens
aacucagaaacaucag

SEQ ID NO: 1035028 - RNA, 12 nt, Homo sapiens
aacucagaucac

SEQ ID NO: 1035029 - RNA, 18 nt, Homo sapiens
aacucagaucugucugau

SEQ ID NO: 1035030 - RNA, 20 nt, Homo sapiens
aacucagcgugaguuacccu

SEQ ID NO: 1035031 - RNA, 10 nt, Homo sapiens
aacucaggga

SEQ ID NO: 1035032 - RNA, 11 nt, Homo sapiens
aacucagggag

SEQ ID NO: 1035033 - RNA, 21 nt, Homo sapiens
aacucauaauagacuucccac

SEQ ID NO: 1035034 - RNA, 18 nt, Homo sapiens
aacucauuacuuuuccau

SEQ ID NO: 1035035 - RNA, 15 nt, Homo sapiens
aacucauuccugccu

SEQ ID NO: 1035036 - RNA, 19 nt, Homo sapiens
aacuccuuuagcagguggu

SEQ ID NO: 1035037 - RNA, 18 nt, Homo sapiens
aacucuaagacuacagca

SEQ ID NO: 1035038 - RNA, 15 nt, Homo sapiens
aacucuaucugucau

SEQ ID NO: 1035039 - RNA, 21 nt, Homo sapiens
aacucuccuggacugccuuga

SEQ ID NO: 1035040 - RNA, 12 nt, Homo sapiens
aacucucuccac

SEQ ID NO: 1035041 - RNA, 15 nt, Homo sapiens
aacucugcacuacuc

SEQ ID NO: 1035042 - RNA, 16 nt, Homo sapiens
aacucugccagccaca

SEQ ID NO: 1035043 - RNA, 17 nt, Homo sapiens
aacucugggcugccaug

SEQ ID NO: 1035044 - RNA, 16 nt, Homo sapiens
aacucuguaaaaccuc

SEQ ID NO: 1035045 - RNA, 19 nt, Homo sapiens
aacucuguuuucuuucuaa

SEQ ID NO: 1035046 - RNA, 15 nt, Homo sapiens
aacugaacauuccag

SEQ ID NO: 1035047 - RNA, 18 nt, Homo sapiens
aacugaauaaauaccucu

SEQ ID NO: 1035048 - RNA, 19 nt, Homo sapiens
aacugaauaaauaccucuu

SEQ ID NO: 1035049 - RNA, 22 nt, Homo sapiens
aacugaaugcuccagucaacaa

SEQ ID NO: 1035050 - RNA, 13 nt, Homo sapiens
aacugacaguaaa

SEQ ID NO: 1035051 - RNA, 18 nt, Homo sapiens
aacugacugccuugcuaa

SEQ ID NO: 1035052 - RNA, 23 nt, Homo sapiens
aacugacugccuugcuaaaagau

SEQ ID NO: 1035053 - RNA, 16 nt, Homo sapiens
aacugagaccaaagaa

SEQ ID NO: 1035054 - RNA, 21 nt, Homo sapiens
aacugccuuggcuucagggga

SEQ ID NO: 1035055 - RNA, 21 nt, Homo sapiens
aacuggaggaguuccuugauc

SEQ ID NO: 1035056 - RNA, 16 nt, Homo sapiens
aacugggcaugguagu

SEQ ID NO: 1035057 - RNA, 18 nt, Homo sapiens
aacuggggauauaauacu

SEQ ID NO: 1035058 - RNA, 15 nt, Homo sapiens
aacugggguggauuu

SEQ ID NO: 1035059 - RNA, 15 nt, Homo sapiens
aacugguucaugaaa

SEQ ID NO: 1035060 - RNA, 13 nt, Homo sapiens
aacuguagucuca

SEQ ID NO: 1035061 - RNA, 17 nt, Homo sapiens
aacuguauauauuccca

SEQ ID NO: 1035062 - RNA, 17 nt, Homo sapiens
aacugugcuccucacuu

SEQ ID NO: 1035063 - RNA, 21 nt, Homo sapiens
aacugugugcagacucaauaa

SEQ ID NO: 1035064 - RNA, 13 nt, Homo sapiens
aacuguuaugaaa

SEQ ID NO: 1035065 - RNA, 22 nt, Homo sapiens
aacuguuauuuauaaucacuuu

SEQ ID NO: 1035066 - RNA, 12 nt, Homo sapiens
aacuuagcucac

SEQ ID NO: 1035067 - RNA, 14 nt, Homo sapiens
aacuuauaucauca

SEQ ID NO: 1035068 - RNA, 12 nt, Homo sapiens
aacuuccaguca

SEQ ID NO: 1035069 - RNA, 11 nt, Homo sapiens
aacuuccucag

SEQ ID NO: 1035070 - RNA, 17 nt, Homo sapiens
aacuucuacuucugccc

SEQ ID NO: 1035071 - RNA, 15 nt, Homo sapiens
aacuugcugcugagu

SEQ ID NO: 1035072 - RNA, 23 nt, Homo sapiens
aacuuggaaauagugauuuccac

SEQ ID NO: 1035073 - RNA, 18 nt, Homo sapiens
aacuuggcacacucucca

SEQ ID NO: 1035074 - RNA, 12 nt, Homo sapiens
aacuugggccac

SEQ ID NO: 1035075 - RNA, 15 nt, Homo sapiens
aacuuguagcauuaa

SEQ ID NO: 1035076 - RNA, 18 nt, Homo sapiens
aacuuguauuaaagacag

SEQ ID NO: 1035077 - RNA, 16 nt, Homo sapiens
aacuuucuuacacuga

SEQ ID NO: 1035078 - RNA, 20 nt, Homo sapiens
aacuuuggaguccccucacc

SEQ ID NO: 1035079 - RNA, 20 nt, Homo sapiens
aacuuuguggaugucuuccu

SEQ ID NO: 1035080 - RNA, 23 nt, Homo sapiens
aacuuuguuuagcccaaaaccaa

SEQ ID NO: 1035081 - RNA, 22 nt, Homo sapiens
aacuuuuauaaacuuuaccuuu

SEQ ID NO: 1035082 - RNA, 15 nt, Homo sapiens
aacuuuugugcuccc

SEQ ID NO: 1035083 - RNA, 19 nt, Homo sapiens
aacuuuuugcaaggcauuu

SEQ ID NO: 1035084 - RNA, 13 nt, Homo sapiens
aagaaaauggauu

SEQ ID NO: 1035085 - RNA, 20 nt, Homo sapiens
agaggacuucuggcagggaa

SEQ ID NO: 1035086 - RNA, 17 nt, Homo sapiens
agaggagaaacuggaac

SEQ ID NO: 1035087 - RNA, 21 nt, Homo sapiens
agaggagagagacuccagcug

SEQ ID NO: 1035088 - RNA, 14 nt, Homo sapiens
agaggagagccaga

SEQ ID NO: 1035089 - RNA, 22 nt, Homo sapiens
agaggcaaugauuguuaauuua

SEQ ID NO: 1035090 - RNA, 23 nt, Homo sapiens
agaggcagaucuggacuuggcaa

SEQ ID NO: 1035091 - RNA, 14 nt, Homo sapiens
agaggcaggggcuu

SEQ ID NO: 1035092 - RNA, 19 nt, Homo sapiens
agaggcugcagaaggccaa

SEQ ID NO: 1035093 - RNA, 15 nt, Homo sapiens
agaggcuguucccac

SEQ ID NO: 1035094 - RNA, 15 nt, Homo sapiens
agagggacugacacc

SEQ ID NO: 1035095 - RNA, 20 nt, Homo sapiens
agagggagacuccaucucaa

SEQ ID NO: 1035096 - RNA, 19 nt, Homo sapiens
agagggcacacacugugua

SEQ ID NO: 1035097 - RNA, 16 nt, Homo sapiens
agaggggaagggccag

SEQ ID NO: 1035098 - RNA, 11 nt, Homo sapiens
agaggggacag

SEQ ID NO: 1035099 - RNA, 13 nt, Homo sapiens
agaggguacuuua

SEQ ID NO: 1035100 - RNA, 14 nt, Homo sapiens
agagguuucaguga

SEQ ID NO: 1035101 - RNA, 13 nt, Homo sapiens
agaguacacccca

SEQ ID NO: 1035102 - RNA, 21 nt, Homo sapiens
agaguacaccccaacagcacc

SEQ ID NO: 1035103 - RNA, 16 nt, Homo sapiens
agaguauaugcacuuu

SEQ ID NO: 1035104 - RNA, 15 nt, Homo sapiens
agaguaucacuccca

SEQ ID NO: 1035105 - RNA, 14 nt, Homo sapiens
agagucccacugcc

SEQ ID NO: 1035106 - RNA, 21 nt, Homo sapiens
agagucccacugccucagguu

SEQ ID NO: 1035107 - RNA, 21 nt, Homo sapiens
agaguccuauuugcacuguag

SEQ ID NO: 1035108 - RNA, 13 nt, Homo sapiens
agaguccucugga

SEQ ID NO: 1035109 - RNA, 15 nt, Homo sapiens
agaguccugcacagu

SEQ ID NO: 1035110 - RNA, 15 nt, Homo sapiens
agagucucacucugu

SEQ ID NO: 1035111 - RNA, 20 nt, Homo sapiens
agagucucacucuguugccc

SEQ ID NO: 1035112 - RNA, 23 nt, Homo sapiens
agagugaagugaagagaggcaaa

SEQ ID NO: 1035113 - RNA, 16 nt, Homo sapiens
agagugagagggcaug

SEQ ID NO: 1035114 - RNA, 21 nt, Homo sapiens
agagugccguaacaacugugg

SEQ ID NO: 1035115 - RNA, 22 nt, Homo sapiens
agagugccguaacaacuguggu

SEQ ID NO: 1035116 - RNA, 21 nt, Homo sapiens
agagugggguagguugggaga

SEQ ID NO: 1035117 - RNA, 16 nt, Homo sapiens
agaguggguuucacaa

SEQ ID NO: 1035118 - RNA, 22 nt, Homo sapiens
agagugguuaagacuacugaag

SEQ ID NO: 1035119 - RNA, 13 nt, Homo sapiens
agagugucuuucc

SEQ ID NO: 1035120 - RNA, 15 nt, Homo sapiens
agaguucugcucuag

SEQ ID NO: 1035121 - RNA, 12 nt, Homo sapiens
agaguugacaug

SEQ ID NO: 1035122 - RNA, 21 nt, Homo sapiens
agaguuugcuauuagagcauu

SEQ ID NO: 1035123 - RNA, 13 nt, Homo sapiens
agauaaaugugcu

SEQ ID NO: 1035124 - RNA, 14 nt, Homo sapiens
agauaaaugugcug

SEQ ID NO: 1035125 - RNA, 13 nt, Homo sapiens
agauaacugagaa

SEQ ID NO: 1035126 - RNA, 15 nt, Homo sapiens
agauaaucucucagc

SEQ ID NO: 1035127 - RNA, 13 nt, Homo sapiens
agauaaugcaguc

SEQ ID NO: 1035128 - RNA, 17 nt, Homo sapiens
agauaauucuagcuuug

SEQ ID NO: 1035129 - RNA, 19 nt, Homo sapiens
agauacuuugucagcaaua

SEQ ID NO: 1035130 - RNA, 16 nt, Homo sapiens
agauagauauaugcuc

SEQ ID NO: 1035131 - RNA, 16 nt, Homo sapiens
agauagcuucacccca

SEQ ID NO: 1035132 - RNA, 17 nt, Homo sapiens
agauagguuaccaguaa

SEQ ID NO: 1035133 - RNA, 20 nt, Homo sapiens
agauaguagcauacauuuau

SEQ ID NO: 1035134 - RNA, 19 nt, Homo sapiens
agauauauuaagugacugu

SEQ ID NO: 1035135 - RNA, 15 nt, Homo sapiens
agaucacaauacuca

SEQ ID NO: 1035136 - RNA, 12 nt, Homo sapiens
agaucacgccac

SEQ ID NO: 1035137 - RNA, 17 nt, Homo sapiens
agaucacgccacugcac

SEQ ID NO: 1035138 - RNA, 18 nt, Homo sapiens
agaucacgccacugcacu

SEQ ID NO: 1035139 - RNA, 19 nt, Homo sapiens
agaucacgccauugcacuc

SEQ ID NO: 1035140 - RNA, 20 nt, Homo sapiens
agaucacgccauugcacucc

SEQ ID NO: 1035141 - RNA, 16 nt, Homo sapiens
agaucacguugcaaug

SEQ ID NO: 1035142 - RNA, 13 nt, Homo sapiens
auggcagcugcca

SEQ ID NO: 1035143 - RNA, 22 nt, Homo sapiens
auggcauaggcugacuuuugca

SEQ ID NO: 1035144 - RNA, 23 nt, Homo sapiens
auggcauugaacugguucaugaa

SEQ ID NO: 1035145 - RNA, 16 nt, Homo sapiens
auggccagugucuguc

SEQ ID NO: 1035146 - RNA, 20 nt, Homo sapiens
auggccagugugaucccaag

SEQ ID NO: 1035147 - RNA, 17 nt, Homo sapiens
auggcccugcaaaagga

SEQ ID NO: 1035148 - RNA, 16 nt, Homo sapiens
auggcuauaggugcua

SEQ ID NO: 1035149 - RNA, 18 nt, Homo sapiens
auggcucagaugccacuu

SEQ ID NO: 1035150 - RNA, 15 nt, Homo sapiens
auggcucaugaccug

SEQ ID NO: 1035151 - RNA, 18 nt, Homo sapiens
auggcuggagugauucug

SEQ ID NO: 1035152 - RNA, 17 nt, Homo sapiens
auggcuggccacugcac

SEQ ID NO: 1035153 - RNA, 22 nt, Homo sapiens
auggcuuaauguuuauuccuga

SEQ ID NO: 1035154 - RNA, 19 nt, Homo sapiens
auggcuuugugauucaauc

SEQ ID NO: 1035155 - RNA, 15 nt, Homo sapiens
augggaaggguccau

SEQ ID NO: 1035156 - RNA, 16 nt, Homo sapiens
augggacucaaugcac

SEQ ID NO: 1035157 - RNA, 23 nt, Homo sapiens
augggcucgcccaccagugacuu

SEQ ID NO: 1035158 - RNA, 17 nt, Homo sapiens
augggggaaauggugcc

SEQ ID NO: 1035159 - RNA, 20 nt, Homo sapiens
augguauggaacucucucca

SEQ ID NO: 1035160 - RNA, 21 nt, Homo sapiens
augguccuggggcucugugca

SEQ ID NO: 1035161 - RNA, 18 nt, Homo sapiens
auggugaaaauauuugac

SEQ ID NO: 1035162 - RNA, 23 nt, Homo sapiens
auggugaaacccugucucuccua

SEQ ID NO: 1035163 - RNA, 20 nt, Homo sapiens
auggugaaaccucaucucua

SEQ ID NO: 1035164 - RNA, 21 nt, Homo sapiens
auggugaaaccucaucucuac

SEQ ID NO: 1035165 - RNA, 14 nt, Homo sapiens
auggugaugaaaug

SEQ ID NO: 1035166 - RNA, 19 nt, Homo sapiens
auggugcacuaauuucacu

SEQ ID NO: 1035167 - RNA, 17 nt, Homo sapiens
auggugggcacagaagu

SEQ ID NO: 1035168 - RNA, 19 nt, Homo sapiens
auggugguaaacauucucu

SEQ ID NO: 1035169 - RNA, 11 nt, Homo sapiens
augguguuucu

SEQ ID NO: 1035170 - RNA, 22 nt, Homo sapiens
augguuacuaggcuuaauaccu

SEQ ID NO: 1035171 - RNA, 19 nt, Homo sapiens
augguugauggguucuaau

SEQ ID NO: 1035172 - RNA, 21 nt, Homo sapiens
augguuugcaaggaagccaca

SEQ ID NO: 1035173 - RNA, 14 nt, Homo sapiens
augguuuuacucau

SEQ ID NO: 1035174 - RNA, 16 nt, Homo sapiens
auguaaaauguugaau

SEQ ID NO: 1035175 - RNA, 15 nt, Homo sapiens
auguaaacugugcac

SEQ ID NO: 1035176 - RNA, 21 nt, Homo sapiens
auguaaagauauuuuuaucuu

SEQ ID NO: 1035177 - RNA, 13 nt, Homo sapiens
auguaaagccagc

SEQ ID NO: 1035178 - RNA, 21 nt, Homo sapiens
auguaaaugcaucuguccuca

SEQ ID NO: 1035179 - RNA, 14 nt, Homo sapiens
auguaacagaaagg

SEQ ID NO: 1035180 - RNA, 21 nt, Homo sapiens
auguaaccgauucaucucuca

SEQ ID NO: 1035181 - RNA, 18 nt, Homo sapiens
auguaagaucguucucug

SEQ ID NO: 1035182 - RNA, 16 nt, Homo sapiens
auguaauaaugugaau

SEQ ID NO: 1035183 - RNA, 23 nt, Homo sapiens
auguaaugcauaggaaguauggc

SEQ ID NO: 1035184 - RNA, 16 nt, Homo sapiens
auguacaaaaccauuu

SEQ ID NO: 1035185 - RNA, 12 nt, Homo sapiens
auguacaaauag

SEQ ID NO: 1035186 - RNA, 16 nt, Homo sapiens
auguacauagcuugau

SEQ ID NO: 1035187 - RNA, 16 nt, Homo sapiens
auguagcaaaacgcau

SEQ ID NO: 1035188 - RNA, 19 nt, Homo sapiens
auguaguuuuauuacacau

SEQ ID NO: 1035189 - RNA, 18 nt, Homo sapiens
auguaguuuuccauccuu

SEQ ID NO: 1035190 - RNA, 15 nt, Homo sapiens
auguauaugcaauau

SEQ ID NO: 1035191 - RNA, 14 nt, Homo sapiens
auguauaugcacuu

SEQ ID NO: 1035192 - RNA, 14 nt, Homo sapiens
auguauaugucauc

SEQ ID NO: 1035193 - RNA, 20 nt, Homo sapiens
auguauccccacuuaucucg

SEQ ID NO: 1035194 - RNA, 12 nt, Homo sapiens
auguaugugcac

SEQ ID NO: 1035195 - RNA, 15 nt, Homo sapiens
auguauucagcuuua

SEQ ID NO: 1035196 - RNA, 14 nt, Homo sapiens
augucaagccauaa

SEQ ID NO: 1035197 - RNA, 17 nt, Homo sapiens
augucaccaauuaacca

SEQ ID NO: 1035198 - RNA, 14 nt, Homo sapiens
augucacucagaug

SEQ ID NO: 1035199 - RNA, 17 nt, Homo sapiens
augucaucauacaugac

SEQ ID NO: 1035200 - RNA, 22 nt, Homo sapiens
auguccagaagaauauucagga

SEQ ID NO: 1035201 - RNA, 19 nt, Homo sapiens
auguccuaaggacacacua

SEQ ID NO: 1035202 - RNA, 22 nt, Homo sapiens
auguccuucuuuaucugugaua

SEQ ID NO: 1035203 - RNA, 17 nt, Homo sapiens
augucguuugaaucaca

SEQ ID NO: 1035204 - RNA, 22 nt, Homo sapiens
augucuauaaucccagcacuuu

SEQ ID NO: 1035205 - RNA, 22 nt, Homo sapiens
augucuccacuuucacccgcag

SEQ ID NO: 1035206 - RNA, 19 nt, Homo sapiens
augucuguucuacauagau

SEQ ID NO: 1035207 - RNA, 20 nt, Homo sapiens
augucuucucguuaaggaga

SEQ ID NO: 1035208 - RNA, 18 nt, Homo sapiens
augucuucuguauucacu

SEQ ID NO: 1035209 - RNA, 19 nt, Homo sapiens
augucuucuguauucacuu

SEQ ID NO: 1035210 - RNA, 20 nt, Homo sapiens
augucuuggacacuguacaa

SEQ ID NO: 1035211 - RNA, 17 nt, Homo sapiens
augucuuguacaugugu

SEQ ID NO: 1035212 - RNA, 17 nt, Homo sapiens
augugaaaguuacaaau

SEQ ID NO: 1035213 - RNA, 17 nt, Homo sapiens
augugaacacaucagcu

SEQ ID NO: 1035214 - RNA, 23 nt, Homo sapiens
augugaagagggagaagcaugaa

SEQ ID NO: 1035215 - RNA, 19 nt, Homo sapiens
augugacauuauaugcacu

SEQ ID NO: 1035216 - RNA, 17 nt, Homo sapiens
augugaccugugucacu

SEQ ID NO: 1035217 - RNA, 23 nt, Homo sapiens
augugacuccuaugaucucaggu

SEQ ID NO: 1035218 - RNA, 12 nt, Homo sapiens
augugagugugu

SEQ ID NO: 1035219 - RNA, 11 nt, Homo sapiens
augugaugaau

SEQ ID NO: 1035220 - RNA, 14 nt, Homo sapiens
augugaugaucuac

SEQ ID NO: 1035221 - RNA, 14 nt, Homo sapiens
augugauugcagcu

SEQ ID NO: 1035222 - RNA, 20 nt, Homo sapiens
augugcaaagucaucaaaga

SEQ ID NO: 1035223 - RNA, 23 nt, Homo sapiens
augugcuuuuaaaaaaaaauacu

SEQ ID NO: 1035224 - RNA, 16 nt, Homo sapiens
auguggcccaacacaa

SEQ ID NO: 1035225 - RNA, 22 nt, Homo sapiens
augugggguccccaucauccca

SEQ ID NO: 1035226 - RNA, 19 nt, Homo sapiens
augugggucaaggaauuaa

SEQ ID NO: 1035227 - RNA, 18 nt, Homo sapiens
augugggugggaccacag

SEQ ID NO: 1035228 - RNA, 20 nt, Homo sapiens
augugggugucagucaggga

SEQ ID NO: 1035229 - RNA, 24 nt, Homo sapiens
augugguuaaugccauggacagaa

SEQ ID NO: 1035230 - RNA, 18 nt, Homo sapiens
augugugagugugugcaa

SEQ ID NO: 1035231 - RNA, 14 nt, Homo sapiens
auguguggacucaa

SEQ ID NO: 1035232 - RNA, 16 nt, Homo sapiens
auguguggcauuuuca

SEQ ID NO: 1035233 - RNA, 17 nt, Homo sapiens
augugugugcaagugug

SEQ ID NO: 1035234 - RNA, 13 nt, Homo sapiens
augugugugcuca

SEQ ID NO: 1035235 - RNA, 22 nt, Homo sapiens
auguguguguaugcuacuacaa

SEQ ID NO: 1035236 - RNA, 19 nt, Homo sapiens
auguuaauauugugcaaac

SEQ ID NO: 1035237 - RNA, 17 nt, Homo sapiens
auguuacacuaagggug

SEQ ID NO: 1035238 - RNA, 14 nt, Homo sapiens
auguuacugaccag

SEQ ID NO: 1035239 - RNA, 18 nt, Homo sapiens
auguuagccacaguguau

SEQ ID NO: 1035240 - RNA, 16 nt, Homo sapiens
auguuauuugcucuaa

SEQ ID NO: 1035241 - RNA, 17 nt, Homo sapiens
auguuauuugcucuaau

SEQ ID NO: 1035242 - RNA, 22 nt, Homo sapiens
auguucacuuuugacaaaggca

SEQ ID NO: 1035243 - RNA, 16 nt, Homo sapiens
auguuccuacgggcuu

SEQ ID NO: 1035244 - RNA, 19 nt, Homo sapiens
auguuccucugucaaugaa

SEQ ID NO: 1035245 - RNA, 17 nt, Homo sapiens
auguucucugaggacac

SEQ ID NO: 1035246 - RNA, 14 nt, Homo sapiens
auguucugggacac

SEQ ID NO: 1035247 - RNA, 16 nt, Homo sapiens
auguucugggacacag

SEQ ID NO: 1035248 - RNA, 22 nt, Homo sapiens
auguugaaaaaguucugcagau

SEQ ID NO: 1035249 - RNA, 21 nt, Homo sapiens
auguugaagugagcugagauu

SEQ ID NO: 1035250 - RNA, 14 nt, Homo sapiens
auguugcccagugu

SEQ ID NO: 1035251 - RNA, 12 nt, Homo sapiens
auguugccuguc

SEQ ID NO: 1035252 - RNA, 15 nt, Homo sapiens
auguugccuuuaugg

SEQ ID NO: 1035253 - RNA, 23 nt, Homo sapiens
auguugguguuccacguguuuua

SEQ ID NO: 1035254 - RNA, 18 nt, Homo sapiens
auguuguaauucaugcca

SEQ ID NO: 1035255 - RNA, 12 nt, Homo sapiens
auguuuacuucu

SEQ ID NO: 1035256 - RNA, 21 nt, Homo sapiens
auguuucaagaaaauggauuu

SEQ ID NO: 1035257 - RNA, 12 nt, Homo sapiens
auguuugcacac

SEQ ID NO: 1035258 - RNA, 17 nt, Homo sapiens
auguuuguggccucaga

SEQ ID NO: 1035259 - RNA, 21 nt, Homo sapiens
auguuuuagccauuguuggcu

SEQ ID NO: 1035260 - RNA, 18 nt, Homo sapiens
auguuuucccuuuauuca

SEQ ID NO: 1035261 - RNA, 14 nt, Homo sapiens
auguuuucuaguca

SEQ ID NO: 1035262 - RNA, 13 nt, Homo sapiens
auugggcaccuga

SEQ ID NO: 1035263 - RNA, 18 nt, Homo sapiens
auuggggaagacuguggc

SEQ ID NO: 1035264 - RNA, 14 nt, Homo sapiens
auuguaaacaugug

SEQ ID NO: 1035265 - RNA, 17 nt, Homo sapiens
auuguaacuuaugaacc

SEQ ID NO: 1035266 - RNA, 21 nt, Homo sapiens
auuguacauauuuguggaaua

SEQ ID NO: 1035267 - RNA, 19 nt, Homo sapiens
auuguaucaaaugugacau

SEQ ID NO: 1035268 - RNA, 15 nt, Homo sapiens
auuguauuacuagaa

SEQ ID NO: 1035269 - RNA, 19 nt, Homo sapiens
auuguauuauuagucuguu

SEQ ID NO: 1035270 - RNA, 19 nt, Homo sapiens
auugucagaguucugcucu

SEQ ID NO: 1035271 - RNA, 20 nt, Homo sapiens
auugucagaguucugcucua

SEQ ID NO: 1035272 - RNA, 19 nt, Homo sapiens
auugucagcuacuaaugau

SEQ ID NO: 1035273 - RNA, 16 nt, Homo sapiens
auugugaauuacaguu

SEQ ID NO: 1035274 - RNA, 19 nt, Homo sapiens
auugugcacauacuugaga

SEQ ID NO: 1035275 - RNA, 19 nt, Homo sapiens
auugugccacuucacucca

SEQ ID NO: 1035276 - RNA, 23 nt, Homo sapiens
auugugccgagaaaagcauuuua

SEQ ID NO: 1035277 - RNA, 16 nt, Homo sapiens
auugugcuucgaguga

SEQ ID NO: 1035278 - RNA, 20 nt, Homo sapiens
auugugcuucgagugacuga

SEQ ID NO: 1035279 - RNA, 20 nt, Homo sapiens
auugugugaguguaccauaa

SEQ ID NO: 1035280 - RNA, 14 nt, Homo sapiens
auugugugucacaa

SEQ ID NO: 1035281 - RNA, 22 nt, Homo sapiens
auuguguucucuauugcugcuc

SEQ ID NO: 1035282 - RNA, 15 nt, Homo sapiens
auuguuaaaauaacu

SEQ ID NO: 1035283 - RNA, 21 nt, Homo sapiens
auuguuccaaaugaauguugu

SEQ ID NO: 1035284 - RNA, 14 nt, Homo sapiens
ccacagaagccagg

SEQ ID NO: 1035285 - RNA, 20 nt, Homo sapiens
ccacagaccuaggauuucau

SEQ ID NO: 1035286 - RNA, 11 nt, Homo sapiens
ccacagacuca

SEQ ID NO: 1035287 - RNA, 18 nt, Homo sapiens
ccacagacucaaaugcuc

SEQ ID NO: 1035288 - RNA, 18 nt, Homo sapiens
ccacagagagaggggaga

SEQ ID NO: 1035289 - RNA, 12 nt, Homo sapiens
ccacagcaguug

SEQ ID NO: 1035290 - RNA, 12 nt, Homo sapiens
ccacagccaugg

SEQ ID NO: 1035291 - RNA, 17 nt, Homo sapiens
ccacaggcagcauuuag

SEQ ID NO: 1035292 - RNA, 16 nt, Homo sapiens
ccacaggcucugacca

SEQ ID NO: 1035293 - RNA, 23 nt, Homo sapiens
ccacagggcgagacuccgucuca

SEQ ID NO: 1035294 - RNA, 20 nt, Homo sapiens
ccacaguggaaagacagcuu

SEQ ID NO: 1035295 - RNA, 23 nt, Homo sapiens
ccacauccuccacguucugcuca

SEQ ID NO: 1035296 - RNA, 14 nt, Homo sapiens
ccagugcaacagca

SEQ ID NO: 1035297 - RNA, 18 nt, Homo sapiens
ccagugcaacagcacugg

SEQ ID NO: 1035298 - RNA, 16 nt, Homo sapiens
ccagugccaagcacag

SEQ ID NO: 1035299 - RNA, 13 nt, Homo sapiens
ccaguggcugcug

SEQ ID NO: 1035300 - RNA, 12 nt, Homo sapiens
ccagugggcaug

SEQ ID NO: 1035301 - RNA, 16 nt, Homo sapiens
ccaguguggaaccacu

SEQ ID NO: 1035302 - RNA, 20 nt, Homo sapiens
ccaguguuuacaaggugaca

SEQ ID NO: 1035303 - RNA, 19 nt, Homo sapiens
ccaguugaucaaugaauaa

SEQ ID NO: 1035304 - RNA, 14 nt, Homo sapiens
ccaguuguugccaa

SEQ ID NO: 1035305 - RNA, 23 nt, Homo sapiens
ccaguuucagagaaauacuuuca

SEQ ID NO: 1035306 - RNA, 22 nt, Homo sapiens
ccauaaaaauaaaucaguucau

SEQ ID NO: 1035307 - RNA, 14 nt, Homo sapiens
ccauaaaccucaag

SEQ ID NO: 1035308 - RNA, 12 nt, Homo sapiens
ccauaacagcca

SEQ ID NO: 1035309 - RNA, 20 nt, Homo sapiens
ccauaaccccggaagccaaa

SEQ ID NO: 1035310 - RNA, 13 nt, Homo sapiens
ccauaauguuaca

SEQ ID NO: 1035311 - RNA, 14 nt, Homo sapiens
ccauaauguuacau

SEQ ID NO: 1035312 - RNA, 19 nt, Homo sapiens
ccauacuuugucugaaaaa

SEQ ID NO: 1035313 - RNA, 17 nt, Homo sapiens
aaaucuauagaacugaa

SEQ ID NO: 1035314 - RNA, 19 nt, Homo sapiens
aaaucuaugaaguauauaa

SEQ ID NO: 1035315 - RNA, 22 nt, Homo sapiens
aaaucuauuuuguaacuuucuc

SEQ ID NO: 1035316 - RNA, 15 nt, Homo sapiens
aaaucucacaaauga

SEQ ID NO: 1035317 - RNA, 22 nt, Homo sapiens
aaaucucacuuuucuccaugag

SEQ ID NO: 1035318 - RNA, 23 nt, Homo sapiens
aaaucucuuuuugacucuugcaa

SEQ ID NO: 1035319 - RNA, 12 nt, Homo sapiens
aaaucugugaug

SEQ ID NO: 1035320 - RNA, 17 nt, Homo sapiens
aaaugaaaaugucuugu

SEQ ID NO: 1035321 - RNA, 13 nt, Homo sapiens
aaaugaacugaag

SEQ ID NO: 1035322 - RNA, 17 nt, Homo sapiens
aaaugaaugaucuuggc

SEQ ID NO: 1035323 - RNA, 14 nt, Homo sapiens
aaaugaauguuguc

SEQ ID NO: 1035324 - RNA, 20 nt, Homo sapiens
aaaugacuaaaagucuucgg

SEQ ID NO: 1035325 - RNA, 14 nt, Homo sapiens
aaaugagcaaaagu

SEQ ID NO: 1035326 - RNA, 17 nt, Homo sapiens
aaaugaucgcuaucuag

SEQ ID NO: 1035327 - RNA, 20 nt, Homo sapiens
aaaugaugucaugucagcuc

SEQ ID NO: 1035328 - RNA, 16 nt, Homo sapiens
aaaugauuuuaucugu

SEQ ID NO: 1035329 - RNA, 20 nt, Homo sapiens
aaaugcaaaauccuggugau

SEQ ID NO: 1035330 - RNA, 20 nt, Homo sapiens
aaaugccacacggcucucac

SEQ ID NO: 1035331 - RNA, 15 nt, Homo sapiens
aaaugcuuuuccuca

SEQ ID NO: 1035332 - RNA, 20 nt, Homo sapiens
aaauggaggccuguccugac

SEQ ID NO: 1035333 - RNA, 15 nt, Homo sapiens
aaauggagugacuua

SEQ ID NO: 1035334 - RNA, 14 nt, Homo sapiens
aaauggcuuaucca

SEQ ID NO: 1035335 - RNA, 20 nt, Homo sapiens
aaaugggcuacuuuguccuu

SEQ ID NO: 1035336 - RNA, 16 nt, Homo sapiens
aaauggguuggugcuu

SEQ ID NO: 1035337 - RNA, 17 nt, Homo sapiens
aaaugguagcauacuuu

SEQ ID NO: 1035338 - RNA, 13 nt, Homo sapiens
aaauguaacuuga

SEQ ID NO: 1035339 - RNA, 20 nt, Homo sapiens
aaauguaauacuccuaagac

SEQ ID NO: 1035340 - RNA, 11 nt, Homo sapiens
aaauguacaau

SEQ ID NO: 1035341 - RNA, 13 nt, Homo sapiens
aaauguacagcaa

SEQ ID NO: 1035342 - RNA, 16 nt, Homo sapiens
aaauguauagcugcuu

SEQ ID NO: 1035343 - RNA, 20 nt, Homo sapiens
aaaugucaggccuuccccac

SEQ ID NO: 1035344 - RNA, 22 nt, Homo sapiens
aaaugucauuguucuugugaac

SEQ ID NO: 1035345 - RNA, 19 nt, Homo sapiens
aaaugucuuaaucaugaga

SEQ ID NO: 1035346 - RNA, 19 nt, Homo sapiens
aaaugucuucuguauucac

SEQ ID NO: 1035347 - RNA, 22 nt, Homo sapiens
aaaugucuucuguauucacuua

SEQ ID NO: 1035348 - RNA, 18 nt, Homo sapiens
aaaugugaccugugucac

SEQ ID NO: 1035349 - RNA, 12 nt, Homo sapiens
aaaugugcaaua

SEQ ID NO: 1035350 - RNA, 14 nt, Homo sapiens
aaaugugccuucau

SEQ ID NO: 1035351 - RNA, 19 nt, Homo sapiens
aaaugugguuacacacuuu

SEQ ID NO: 1035352 - RNA, 17 nt, Homo sapiens
aaauguuuuucuaugua

SEQ ID NO: 1035353 - RNA, 17 nt, Homo sapiens
aaauuaauacugaagga

SEQ ID NO: 1035354 - RNA, 19 nt, Homo sapiens
aaauuagcuugagcaaccu

SEQ ID NO: 1035355 - RNA, 22 nt, Homo sapiens
aaauuauuugaaaacauauaaa

SEQ ID NO: 1035356 - RNA, 20 nt, Homo sapiens
aaauuccacacuaccacauu

SEQ ID NO: 1035357 - RNA, 17 nt, Homo sapiens
aaauuccuugauucaca

SEQ ID NO: 1035358 - RNA, 23 nt, Homo sapiens
aaauuccuuggcaugccuuccag

SEQ ID NO: 1035359 - RNA, 15 nt, Homo sapiens
aaauucgcaaacuuu

SEQ ID NO: 1035360 - RNA, 23 nt, Homo sapiens
aaauucgcugcaaccuguugaua

SEQ ID NO: 1035361 - RNA, 20 nt, Homo sapiens
aaauucuauaggaacauaug

SEQ ID NO: 1035362 - RNA, 15 nt, Homo sapiens
aaauugacagaucaa

SEQ ID NO: 1035363 - RNA, 15 nt, Homo sapiens
aaauugauguuacug

SEQ ID NO: 1035364 - RNA, 17 nt, Homo sapiens
aaauuggaacaccuccu

SEQ ID NO: 1035365 - RNA, 12 nt, Homo sapiens
aaauuggacuua

SEQ ID NO: 1035366 - RNA, 13 nt, Homo sapiens
aaauuuaagcauu

SEQ ID NO: 1035367 - RNA, 24 nt, Homo sapiens
aaauuuaagugcguguguagaguu

SEQ ID NO: 1035368 - RNA, 17 nt, Homo sapiens
aaauuuaauauagcuau

SEQ ID NO: 1035369 - RNA, 22 nt, Homo sapiens
aaauuuaggaccaauaccuccu

SEQ ID NO: 1035370 - RNA, 21 nt, Homo sapiens
aaauuucacuuaauaaugugu

SEQ ID NO: 1035371 - RNA, 14 nt, Homo sapiens
aaauuuccagagaa

SEQ ID NO: 1035372 - RNA, 23 nt, Homo sapiens
aaauuuccaguaccuuugucaca

SEQ ID NO: 1035373 - RNA, 13 nt, Homo sapiens
aaauuuucaccug

SEQ ID NO: 1035374 - RNA, 23 nt, Homo sapiens
aaauuuucuuuuuauacuauuaa

SEQ ID NO: 1035375 - RNA, 16 nt, Homo sapiens
aaauuuuuguuuauaa

SEQ ID NO: 1035376 - RNA, 16 nt, Homo sapiens
aacaaaaaaagcauug

SEQ ID NO: 1035377 - RNA, 19 nt, Homo sapiens
aacaaaaauguaaugauca

SEQ ID NO: 1035378 - RNA, 15 nt, Homo sapiens
aacaaacaaacaauu

SEQ ID NO: 1035379 - RNA, 23 nt, Homo sapiens
aacaaacuacauguaauccauca

SEQ ID NO: 1035380 - RNA, 12 nt, Homo sapiens
aacaaagccaga

SEQ ID NO: 1035381 - RNA, 14 nt, Homo sapiens
aacaaauaauuugu

SEQ ID NO: 1035382 - RNA, 21 nt, Homo sapiens
aacaaauuagguuuuguacaa

SEQ ID NO: 1035383 - RNA, 15 nt, Homo sapiens
aacaaauuauguuac

SEQ ID NO: 1035384 - RNA, 20 nt, Homo sapiens
aacaaauucauauucugucu

SEQ ID NO: 1035385 - RNA, 21 nt, Homo sapiens
aacaaccguuggaaacauaac

SEQ ID NO: 1035386 - RNA, 15 nt, Homo sapiens
aacaaccuggucaca

SEQ ID NO: 1035387 - RNA, 22 nt, Homo sapiens
aacaacuaggcuucagcauauu

SEQ ID NO: 1035388 - RNA, 22 nt, Homo sapiens
aacaacuccuagggccacugaa

SEQ ID NO: 1035389 - RNA, 18 nt, Homo sapiens
aacaagcuccaccuucca

SEQ ID NO: 1035390 - RNA, 16 nt, Homo sapiens
aacaagucccuguaau

SEQ ID NO: 1035391 - RNA, 13 nt, Homo sapiens
aacaauagcacaa

SEQ ID NO: 1035392 - RNA, 21 nt, Homo sapiens
aacaauuacauggcucuaaaa

SEQ ID NO: 1035393 - RNA, 18 nt, Homo sapiens
aacacaauuguaaguaau

SEQ ID NO: 1035394 - RNA, 12 nt, Homo sapiens
aacacacaugca

SEQ ID NO: 1035395 - RNA, 22 nt, Homo sapiens
aacacagcgagacuccgucuca

SEQ ID NO: 1035396 - RNA, 14 nt, Homo sapiens
aacaccacagacac

SEQ ID NO: 1035397 - RNA, 12 nt, Homo sapiens
aacacccaugaa

SEQ ID NO: 1035398 - RNA, 21 nt, Homo sapiens
aacaccuucucuggagccaag

SEQ ID NO: 1035399 - RNA, 19 nt, Homo sapiens
aacacggggcuugcaacuu

SEQ ID NO: 1035400 - RNA, 20 nt, Homo sapiens
aacacggggcuugcaacuua

SEQ ID NO: 1035401 - RNA, 23 nt, Homo sapiens
aacacucacauuuauucugcuca

SEQ ID NO: 1035402 - RNA, 15 nt, Homo sapiens
aacacucaugcugaa

SEQ ID NO: 1035403 - RNA, 10 nt, Homo sapiens
aacacugcac

SEQ ID NO: 1035404 - RNA, 19 nt, Homo sapiens
aacacugcaggcaucacag

SEQ ID NO: 1035405 - RNA, 10 nt, Homo sapiens
aacacugggg

SEQ ID NO: 1035406 - RNA, 16 nt, Homo sapiens
aacacuucgagcacug

SEQ ID NO: 1035407 - RNA, 15 nt, Homo sapiens
aacagacaacagaag

SEQ ID NO: 1035408 - RNA, 16 nt, Homo sapiens
aaacagggcaucucca

SEQ ID NO: 1035409 - RNA, 12 nt, Homo sapiens
aaacaggucaau

SEQ ID NO: 1035410 - RNA, 21 nt, Homo sapiens
aaacaguccuucaaacuucca

SEQ ID NO: 1035411 - RNA, 18 nt, Homo sapiens
aaacagugucauauacaa

SEQ ID NO: 1035412 - RNA, 19 nt, Homo sapiens
aaacauaaagagaacucug

SEQ ID NO: 1035413 - RNA, 20 nt, Homo sapiens
aaacaugugguuaaugccau

SEQ ID NO: 1035414 - RNA, 12 nt, Homo sapiens
aaacauguucuc

SEQ ID NO: 1035415 - RNA, 23 nt, Homo sapiens
aaacauugauuauaagcauguau

SEQ ID NO: 1035416 - RNA, 21 nt, Homo sapiens
aaacauugguucuuguauuaa

SEQ ID NO: 1035417 - RNA, 11 nt, Homo sapiens
aaaccaaagau

SEQ ID NO: 1035418 - RNA, 18 nt, Homo sapiens
aaaccaaaguaaccuuuu

SEQ ID NO: 1035419 - RNA, 14 nt, Homo sapiens
aaaccaaaucacug

SEQ ID NO: 1035420 - RNA, 14 nt, Homo sapiens
aaaccaaggcuaga

SEQ ID NO: 1035421 - RNA, 15 nt, Homo sapiens
aaaccacagcccugu

SEQ ID NO: 1035422 - RNA, 16 nt, Homo sapiens
aaaccacuagaacucu

SEQ ID NO: 1035423 - RNA, 21 nt, Homo sapiens
aaaccacuagaacucuccauc

SEQ ID NO: 1035424 - RNA, 12 nt, Homo sapiens
aaaccagguggc

SEQ ID NO: 1035425 - RNA, 16 nt, Homo sapiens
aaacccauggagacag

SEQ ID NO: 1035426 - RNA, 15 nt, Homo sapiens
aaaccgagugcaaug

SEQ ID NO: 1035427 - RNA, 13 nt, Homo sapiens
aaaccuacuaauc

SEQ ID NO: 1035428 - RNA, 19 nt, Homo sapiens
aaaccuccaaaacuccugc

SEQ ID NO: 1035429 - RNA, 18 nt, Homo sapiens
aaaccuccacugcugcuc

SEQ ID NO: 1035430 - RNA, 22 nt, Homo sapiens
aaaccucccccaagcagagcuu

SEQ ID NO: 1035431 - RNA, 14 nt, Homo sapiens
aaaccucuccucau

SEQ ID NO: 1035432 - RNA, 16 nt, Homo sapiens
aaaccugaccccugcu

SEQ ID NO: 1035433 - RNA, 22 nt, Homo sapiens
aaaccugauguuaaaauuccau

SEQ ID NO: 1035434 - RNA, 16 nt, Homo sapiens
aaaccuuaguacugag

SEQ ID NO: 1035435 - RNA, 21 nt, Homo sapiens
aaaccuugaugugccugugaa

SEQ ID NO: 1035436 - RNA, 18 nt, Homo sapiens
aaacgguaauacgugaaa

SEQ ID NO: 1035437 - RNA, 17 nt, Homo sapiens
aaacgguggaggccagg

SEQ ID NO: 1035438 - RNA, 15 nt, Homo sapiens
aaacuaaaaagccau

SEQ ID NO: 1035439 - RNA, 17 nt, Homo sapiens
aaacuaagucagaaagu

SEQ ID NO: 1035440 - RNA, 15 nt, Homo sapiens
aaacuacaagccacg

SEQ ID NO: 1035441 - RNA, 18 nt, Homo sapiens
aaacuacacaucccuaau

SEQ ID NO: 1035442 - RNA, 14 nt, Homo sapiens
aaacuauauucuca

SEQ ID NO: 1035443 - RNA, 17 nt, Homo sapiens
aaacuauguaacaugua

SEQ ID NO: 1035444 - RNA, 13 nt, Homo sapiens
aaacucaccaucu

SEQ ID NO: 1035445 - RNA, 11 nt, Homo sapiens
aaacucaggga

SEQ ID NO: 1035446 - RNA, 12 nt, Homo sapiens
aaacucagggac

SEQ ID NO: 1035447 - RNA, 14 nt, Homo sapiens
aaacucaguaucau

SEQ ID NO: 1035448 - RNA, 13 nt, Homo sapiens
aaacuccaucuca

SEQ ID NO: 1035449 - RNA, 12 nt, Homo sapiens
aaacuccauuga

SEQ ID NO: 1035450 - RNA, 17 nt, Homo sapiens
aaacuccugacuuugug

SEQ ID NO: 1035451 - RNA, 19 nt, Homo sapiens
aaacuccugugucugugua

SEQ ID NO: 1035452 - RNA, 21 nt, Homo sapiens
aaacugacaguaaaucucaca

SEQ ID NO: 1035453 - RNA, 20 nt, Homo sapiens
aaacugauuuuuagcuuuac

SEQ ID NO: 1035454 - RNA, 20 nt, Homo sapiens
aaacugccaguuuuguuucc

SEQ ID NO: 1035455 - RNA, 17 nt, Homo sapiens
aaacugccuuccacaau

SEQ ID NO: 1035456 - RNA, 21 nt, Homo sapiens
aagaaucagaaacaggugcau

SEQ ID NO: 1035457 - RNA, 22 nt, Homo sapiens
aagaaucuucugccccagcuuu

SEQ ID NO: 1035458 - RNA, 21 nt, Homo sapiens
aagaauggggaucacagagac

SEQ ID NO: 1035459 - RNA, 17 nt, Homo sapiens
aagaauuuaaaacgcau

SEQ ID NO: 1035460 - RNA, 22 nt, Homo sapiens
aagaauuuaaaacgcaugugca

SEQ ID NO: 1035461 - RNA, 21 nt, Homo sapiens
aagaauuuuuauauccacuaa

SEQ ID NO: 1035462 - RNA, 22 nt, Homo sapiens
aagaauuuuuuuuaacauucca

SEQ ID NO: 1035463 - RNA, 14 nt, Homo sapiens
aagacaaacugcau

SEQ ID NO: 1035464 - RNA, 18 nt, Homo sapiens
aagacaacagcauaacua

SEQ ID NO: 1035465 - RNA, 16 nt, Homo sapiens
aagacaacauuucuca

SEQ ID NO: 1035466 - RNA, 13 nt, Homo sapiens
aagacaagcugca

SEQ ID NO: 1035467 - RNA, 18 nt, Homo sapiens
aagacaauucuuuauaca

SEQ ID NO: 1035468 - RNA, 16 nt, Homo sapiens
aagacagauacuccuc

SEQ ID NO: 1035469 - RNA, 17 nt, Homo sapiens
aagacagauacuccucc

SEQ ID NO: 1035470 - RNA, 23 nt, Homo sapiens
aagacaggacccugggaccacag

SEQ ID NO: 1035471 - RNA, 19 nt, Homo sapiens
aagacagggaagagcagaa

SEQ ID NO: 1035472 - RNA, 15 nt, Homo sapiens
aagacaucaagcaca

SEQ ID NO: 1035473 - RNA, 21 nt, Homo sapiens
aagacauccugagcagugcca

SEQ ID NO: 1035474 - RNA, 22 nt, Homo sapiens
aagacauggggaggaaggacaa

SEQ ID NO: 1035475 - RNA, 12 nt, Homo sapiens
aagaccaaagca

SEQ ID NO: 1035476 - RNA, 12 nt, Homo sapiens
aagaccaagaca

SEQ ID NO: 1035477 - RNA, 18 nt, Homo sapiens
aagaccaagacacagauc

SEQ ID NO: 1035478 - RNA, 21 nt, Homo sapiens
aagaccacacuugguguuacc

SEQ ID NO: 1035479 - RNA, 20 nt, Homo sapiens
aagaccaguccuguuugcag

SEQ ID NO: 1035480 - RNA, 18 nt, Homo sapiens
aagaccuucuccuucacc

SEQ ID NO: 1035481 - RNA, 23 nt, Homo sapiens
aagacgugauuuugcuguagaag

SEQ ID NO: 1035482 - RNA, 15 nt, Homo sapiens
aagacuacagcacac

SEQ ID NO: 1035483 - RNA, 18 nt, Homo sapiens
aagacuagaggcuugcau

SEQ ID NO: 1035484 - RNA, 23 nt, Homo sapiens
aagacuauucccuucuaaccuga

SEQ ID NO: 1035485 - RNA, 21 nt, Homo sapiens
aagacucauucccuagaucuu

SEQ ID NO: 1035486 - RNA, 13 nt, Homo sapiens
aagacuccaaaga

SEQ ID NO: 1035487 - RNA, 19 nt, Homo sapiens
aagagaaaaaauauuuucc

SEQ ID NO: 1035488 - RNA, 21 nt, Homo sapiens
aagagaaugaaauugcugaaa

SEQ ID NO: 1035489 - RNA, 17 nt, Homo sapiens
aagagacccaaccacuu

SEQ ID NO: 1035490 - RNA, 15 nt, Homo sapiens
aagagacucuggccu

SEQ ID NO: 1035491 - RNA, 20 nt, Homo sapiens
aagagacuggagcaucugac

SEQ ID NO: 1035492 - RNA, 21 nt, Homo sapiens
aagagagaucuugauccacag

SEQ ID NO: 1035493 - RNA, 17 nt, Homo sapiens
aagagaggaguucaaug

SEQ ID NO: 1035494 - RNA, 22 nt, Homo sapiens
aagagaggaguucaaugaucua

SEQ ID NO: 1035495 - RNA, 17 nt, Homo sapiens
aagagagucgcaucuca

SEQ ID NO: 1035496 - RNA, 17 nt, Homo sapiens
aagagaucacaauacuc

SEQ ID NO: 1035497 - RNA, 20 nt, Homo sapiens
aagagaucacaauacucaaa

SEQ ID NO: 1035498 - RNA, 23 nt, Homo sapiens
aagagaucacaauacucaaaaga

SEQ ID NO: 1035499 - RNA, 22 nt, Homo sapiens
aagagauccuucuguaaagguu

SEQ ID NO: 1035500 - RNA, 18 nt, Homo sapiens
aagagauuguuguuugcc

SEQ ID NO: 1035501 - RNA, 16 nt, Homo sapiens
aagagauuuuucauga

SEQ ID NO: 1035502 - RNA, 22 nt, Homo sapiens
aagagcccccuugacaccgggg

SEQ ID NO: 1035503 - RNA, 16 nt, Homo sapiens
aagaggaaagaaugaa

SEQ ID NO: 1035504 - RNA, 19 nt, Homo sapiens
aagaggcaccacuaaaaga

SEQ ID NO: 1035505 - RNA, 23 nt, Homo sapiens
aagaggcagcuugaaacugagau

SEQ ID NO: 1035506 - RNA, 23 nt, Homo sapiens
aagaggcccugucuguaccuaac

SEQ ID NO: 1035507 - RNA, 12 nt, Homo sapiens
aagaggcuggau

SEQ ID NO: 1035508 - RNA, 19 nt, Homo sapiens
aagagggcacacacugugu

SEQ ID NO: 1035509 - RNA, 20 nt, Homo sapiens
aagaguaaaacucugucuca

SEQ ID NO: 1035510 - RNA, 18 nt, Homo sapiens
aagaguaaaggaaaugau

SEQ ID NO: 1035511 - RNA, 21 nt, Homo sapiens
aagagugggggagagcaggcu

SEQ ID NO: 1035512 - RNA, 22 nt, Homo sapiens
aagaguggguuucacaagugaa

SEQ ID NO: 1035513 - RNA, 20 nt, Homo sapiens
aagaguugagauuuugcaau

SEQ ID NO: 1035514 - RNA, 12 nt, Homo sapiens
aagauaagaguu

SEQ ID NO: 1035515 - RNA, 14 nt, Homo sapiens
aagauaaucucuca

SEQ ID NO: 1035516 - RNA, 17 nt, Homo sapiens
aagauacagaacucuuu

SEQ ID NO: 1035517 - RNA, 15 nt, Homo sapiens
aagauauaugacugc

SEQ ID NO: 1035518 - RNA, 17 nt, Homo sapiens
aagaucguucucugccu

SEQ ID NO: 1035519 - RNA, 15 nt, Homo sapiens
aagaugacauugcua

SEQ ID NO: 1035520 - RNA, 18 nt, Homo sapiens
aagaugaccuuugucuca

SEQ ID NO: 1035521 - RNA, 18 nt, Homo sapiens
aagaugagagaacuggag

SEQ ID NO: 1035522 - RNA, 20 nt, Homo sapiens
aagaugagcuuuucuaggcu

SEQ ID NO: 1035523 - RNA, 17 nt, Homo sapiens
aagaugaucauuugccc

SEQ ID NO: 1035524 - RNA, 16 nt, Homo sapiens
aagaugaugaugaucu

SEQ ID NO: 1035525 - RNA, 20 nt, Homo sapiens
aagaugcauuaucuaugaua

SEQ ID NO: 1035526 - RNA, 21 nt, Homo sapiens
aagaugccagugaaacuucaa

SEQ ID NO: 1035527 - RNA, 16 nt, Homo sapiens
aagaugcccacugagg

SEQ ID NO: 1035528 - RNA, 22 nt, Homo sapiens
aagaugcuucucacugccaugc

SEQ ID NO: 1035529 - RNA, 17 nt, Homo sapiens
aagauggaacaggcuca

SEQ ID NO: 1035530 - RNA, 16 nt, Homo sapiens
aagaugggaacacugg

SEQ ID NO: 1035531 - RNA, 14 nt, Homo sapiens
aagauguacuugug

SEQ ID NO: 1035532 - RNA, 23 nt, Homo sapiens
aagauguagaggagaaacuggaa

SEQ ID NO: 1035533 - RNA, 11 nt, Homo sapiens
aagauuacuuu

SEQ ID NO: 1035534 - RNA, 16 nt, Homo sapiens
aagauuagaagcugaa

SEQ ID NO: 1035535 - RNA, 23 nt, Homo sapiens
aagauuccugguuaaauuugaau

SEQ ID NO: 1035536 - RNA, 21 nt, Homo sapiens
aagauuucagauuugugacca

SEQ ID NO: 1035537 - RNA, 19 nt, Homo sapiens
aagauuuugaaugcuuccu

SEQ ID NO: 1035538 - RNA, 21 nt, Homo sapiens
aagcaaagacuaugaggaaua

SEQ ID NO: 1035539 - RNA, 17 nt, Homo sapiens
aagcaacagauggauag

SEQ ID NO: 1035540 - RNA, 23 nt, Homo sapiens
aagcaacagauggauagucuguc

SEQ ID NO: 1035541 - RNA, 18 nt, Homo sapiens
aagcaacccaaauguuca

SEQ ID NO: 1035542 - RNA, 12 nt, Homo sapiens
aagcaagcuccc

SEQ ID NO: 1035543 - RNA, 15 nt, Homo sapiens
aagcaaggcuuuaaa

SEQ ID NO: 1035544 - RNA, 16 nt, Homo sapiens
aagcaauaaccucaaa

SEQ ID NO: 1035545 - RNA, 19 nt, Homo sapiens
aagcaauaauggucccauc

SEQ ID NO: 1035546 - RNA, 13 nt, Homo sapiens
aagcacagcaccc

SEQ ID NO: 1035547 - RNA, 13 nt, Homo sapiens
aagcacagguccu

SEQ ID NO: 1035548 - RNA, 13 nt, Homo sapiens
aagcacagugccu

SEQ ID NO: 1035549 - RNA, 15 nt, Homo sapiens
aagcacaguuugaac

SEQ ID NO: 1035550 - RNA, 13 nt, Homo sapiens
aagcacaucugca

SEQ ID NO: 1035551 - RNA, 14 nt, Homo sapiens
aagcaccaagcuca

SEQ ID NO: 1035552 - RNA, 15 nt, Homo sapiens
aagcaccccaugcca

SEQ ID NO: 1035553 - RNA, 22 nt, Homo sapiens
aagcacgugucucagacugcau

SEQ ID NO: 1035554 - RNA, 19 nt, Homo sapiens
aagcacuacauaaacugac

SEQ ID NO: 1035555 - RNA, 12 nt, Homo sapiens
aagcacugugcu

SEQ ID NO: 1035556 - RNA, 14 nt, Homo sapiens
aagcacugugcuaa

SEQ ID NO: 1035557 - RNA, 12 nt, Homo sapiens
aagcacuuugug

SEQ ID NO: 1035558 - RNA, 15 nt, Homo sapiens
aagcagaagcacaua

SEQ ID NO: 1035559 - RNA, 17 nt, Homo sapiens
aagcagauuuaacaauu

SEQ ID NO: 1035560 - RNA, 22 nt, Homo sapiens
aagcagcgaccgcccccuccuc

SEQ ID NO: 1035561 - RNA, 15 nt, Homo sapiens
aagcagcucaaaggc

SEQ ID NO: 1035562 - RNA, 14 nt, Homo sapiens
aagcagcucuugcu

SEQ ID NO: 1035563 - RNA, 20 nt, Homo sapiens
aagcaggaaaugaaaauguc

SEQ ID NO: 1035564 - RNA, 15 nt, Homo sapiens
aagcagggcucugcc

SEQ ID NO: 1035565 - RNA, 19 nt, Homo sapiens
aagcagguggcaucucuaa

SEQ ID NO: 1035566 - RNA, 16 nt, Homo sapiens
aagcagugcuucucaa

SEQ ID NO: 1035567 - RNA, 20 nt, Homo sapiens
aagcauaaaaauuagccaag

SEQ ID NO: 1035568 - RNA, 16 nt, Homo sapiens
aagcaucaccucaggc

SEQ ID NO: 1035569 - RNA, 16 nt, Homo sapiens
aagcaucacuugggau

SEQ ID NO: 1035570 - RNA, 23 nt, Homo sapiens
aagcaucucagccuaccaugaga

SEQ ID NO: 1035571 - RNA, 15 nt, Homo sapiens
aagcaugaaaaagca

SEQ ID NO: 1035572 - RNA, 21 nt, Homo sapiens
aagcauuccuucuuugauaau

SEQ ID NO: 1035573 - RNA, 16 nt, Homo sapiens
aagccacacucugggc

SEQ ID NO: 1035574 - RNA, 21 nt, Homo sapiens
aagccacgaaugaaugaauua

SEQ ID NO: 1035575 - RNA, 11 nt, Homo sapiens
aagccacugaa

SEQ ID NO: 1035576 - RNA, 20 nt, Homo sapiens
aagccagacagcaacgggga

SEQ ID NO: 1035577 - RNA, 16 nt, Homo sapiens
aagccagcuuuccuca

SEQ ID NO: 1035578 - RNA, 17 nt, Homo sapiens
aagcccaagugaaauca

SEQ ID NO: 1035579 - RNA, 19 nt, Homo sapiens
aagccccagaguggcucac

SEQ ID NO: 1035580 - RNA, 23 nt, Homo sapiens
aagcccccaaguugauauuucua

SEQ ID NO: 1035581 - RNA, 20 nt, Homo sapiens
aagcccuccgccauucucaa

SEQ ID NO: 1035582 - RNA, 15 nt, Homo sapiens
aagcccuuuacuuga

SEQ ID NO: 1035583 - RNA, 19 nt, Homo sapiens
aagccuagcccuucucuca

SEQ ID NO: 1035584 - RNA, 21 nt, Homo sapiens
aagccucagagaauugcugau

SEQ ID NO: 1035585 - RNA, 22 nt, Homo sapiens
aagccucuggucacauggcugu

SEQ ID NO: 1035586 - RNA, 17 nt, Homo sapiens
aagccuuuggcucuucu

SEQ ID NO: 1035587 - RNA, 16 nt, Homo sapiens
aagccuuuugcucaca

SEQ ID NO: 1035588 - RNA, 17 nt, Homo sapiens
aagcgaauguguacaaa

SEQ ID NO: 1035589 - RNA, 19 nt, Homo sapiens
aagcguaauuuugccaaau

SEQ ID NO: 1035590 - RNA, 15 nt, Homo sapiens
aagcuaaaaugauuu

SEQ ID NO: 1035591 - RNA, 18 nt, Homo sapiens
aagcuaacaccagacaga

SEQ ID NO: 1035592 - RNA, 11 nt, Homo sapiens
aagcuacaggu

SEQ ID NO: 1035593 - RNA, 13 nt, Homo sapiens
aagcuacuugaag

SEQ ID NO: 1035594 - RNA, 17 nt, Homo sapiens
aagcuagaaggccacau

SEQ ID NO: 1035595 - RNA, 20 nt, Homo sapiens
aagcuauuagccaggaucau

SEQ ID NO: 1035596 - RNA, 18 nt, Homo sapiens
aagcucaggaccaggcaa

SEQ ID NO: 1035597 - RNA, 15 nt, Homo sapiens
aagcuccacugucac

SEQ ID NO: 1035598 - RNA, 16 nt, Homo sapiens
aagcuccuagcagaga

SEQ ID NO: 1035599 - RNA, 22 nt, Homo sapiens
aagcuccuguccucccaucccc

SEQ ID NO: 1035600 - RNA, 17 nt, Homo sapiens
aauuucuggaaaacugc

SEQ ID NO: 1035601 - RNA, 22 nt, Homo sapiens
aauuugaaaacauaaucugcaa

SEQ ID NO: 1035602 - RNA, 21 nt, Homo sapiens
aauuugguaaauuaguauuua

SEQ ID NO: 1035603 - RNA, 24 nt, Homo sapiens
aauuugugguccacugagcuauaa

SEQ ID NO: 1035604 - RNA, 13 nt, Homo sapiens
aauuuuaauugau

SEQ ID NO: 1035605 - RNA, 12 nt, Homo sapiens
aauuuuacccuu

SEQ ID NO: 1035606 - RNA, 23 nt, Homo sapiens
aauuuucuguguuuugcuguacc

SEQ ID NO: 1035607 - RNA, 13 nt, Homo sapiens
aauuuucuuccaa

SEQ ID NO: 1035608 - RNA, 15 nt, Homo sapiens
aauuuuguaaucuca

SEQ ID NO: 1035609 - RNA, 14 nt, Homo sapiens
aauuuuguugauau

SEQ ID NO: 1035610 - RNA, 19 nt, Homo sapiens
aauuuuucagcuccuucaa

SEQ ID NO: 1035611 - RNA, 11 nt, Homo sapiens
aauuuuuccau

SEQ ID NO: 1035612 - RNA, 20 nt, Homo sapiens
aauuuuugaacaacuguugg

SEQ ID NO: 1035613 - RNA, 23 nt, Homo sapiens
aauuuuuuagagagcuguuccca

SEQ ID NO: 1035614 - RNA, 21 nt, Homo sapiens
acaaaaaaagcauuguaacuu

SEQ ID NO: 1035615 - RNA, 18 nt, Homo sapiens
acaaaaaacaacaaauaa

SEQ ID NO: 1035616 - RNA, 14 nt, Homo sapiens
acaaaaaauuagcu

SEQ ID NO: 1035617 - RNA, 20 nt, Homo sapiens
acaaaauuuaguuuuuguuc

SEQ ID NO: 1035618 - RNA, 12 nt, Homo sapiens
acaaacaugugg

SEQ ID NO: 1035619 - RNA, 14 nt, Homo sapiens
acaaacaugugguu

SEQ ID NO: 1035620 - RNA, 21 nt, Homo sapiens
acaaaccgagugcaaugaaug

SEQ ID NO: 1035621 - RNA, 17 nt, Homo sapiens
acaaacuaucagaggaa

SEQ ID NO: 1035622 - RNA, 18 nt, Homo sapiens
acaaacuucccugacucu

SEQ ID NO: 1035623 - RNA, 21 nt, Homo sapiens
acaaagaagguuaccaagaag

SEQ ID NO: 1035624 - RNA, 19 nt, Homo sapiens
acaaagaguagacauuucu

SEQ ID NO: 1035625 - RNA, 16 nt, Homo sapiens
acaaagcacaguuuga

SEQ ID NO: 1035626 - RNA, 18 nt, Homo sapiens
acaaagcccuuccauguc

SEQ ID NO: 1035627 - RNA, 12 nt, Homo sapiens
acaaagccuuau

SEQ ID NO: 1035628 - RNA, 15 nt, Homo sapiens
acaaagcuacuugaa

SEQ ID NO: 1035629 - RNA, 16 nt, Homo sapiens
acaaagcuacuugaag

SEQ ID NO: 1035630 - RNA, 13 nt, Homo sapiens
acaaagcuucuau

SEQ ID NO: 1035631 - RNA, 24 nt, Homo sapiens
acaaaggagagcuagcagcaggga

SEQ ID NO: 1035632 - RNA, 16 nt, Homo sapiens
acaaauaaagucccag

SEQ ID NO: 1035633 - RNA, 18 nt, Homo sapiens
acaaauacucauguguau

SEQ ID NO: 1035634 - RNA, 22 nt, Homo sapiens
acaaauauggaugagguggaga

SEQ ID NO: 1035635 - RNA, 20 nt, Homo sapiens
acaaauccuugaauguucuc

SEQ ID NO: 1035636 - RNA, 18 nt, Homo sapiens
acaaaugguagcauacuu

SEQ ID NO: 1035637 - RNA, 17 nt, Homo sapiens
acaaauuauguuacauc

SEQ ID NO: 1035638 - RNA, 19 nt, Homo sapiens
acaaauuuacagagacaga

SEQ ID NO: 1035639 - RNA, 13 nt, Homo sapiens
acaacacugggaa

SEQ ID NO: 1035640 - RNA, 18 nt, Homo sapiens
acaacagaaaccaaaacu

SEQ ID NO: 1035641 - RNA, 12 nt, Homo sapiens
acaacagugcua

SEQ ID NO: 1035642 - RNA, 14 nt, Homo sapiens
acaacagugcuaaa

SEQ ID NO: 1035643 - RNA, 19 nt, Homo sapiens
acaacauccuuaagucaaa

SEQ ID NO: 1035644 - RNA, 19 nt, Homo sapiens
acaacaugcgaccgugacc

SEQ ID NO: 1035645 - RNA, 22 nt, Homo sapiens
acaacauuucucaaaugcacau

SEQ ID NO: 1035646 - RNA, 16 nt, Homo sapiens
acaaccaaaaaauucu

SEQ ID NO: 1035647 - RNA, 18 nt, Homo sapiens
acaacgaggaagcccuaa

SEQ ID NO: 1035648 - RNA, 13 nt, Homo sapiens
acaacuaccuccu

SEQ ID NO: 1035649 - RNA, 16 nt, Homo sapiens
acaacuucagcaguac

SEQ ID NO: 1035650 - RNA, 18 nt, Homo sapiens
acaacuugaauaauacac

SEQ ID NO: 1035651 - RNA, 16 nt, Homo sapiens
acaagaagaccagacu

SEQ ID NO: 1035652 - RNA, 22 nt, Homo sapiens
acaagaccaucuacauacacag

SEQ ID NO: 1035653 - RNA, 17 nt, Homo sapiens
acaagaccccgucucaa

SEQ ID NO: 1035654 - RNA, 18 nt, Homo sapiens
acaagaggcucccucuua

SEQ ID NO: 1035655 - RNA, 17 nt, Homo sapiens
acaagauaacugagaau

SEQ ID NO: 1035656 - RNA, 18 nt, Homo sapiens
acaagauccuuaaugcag

SEQ ID NO: 1035657 - RNA, 19 nt, Homo sapiens
acaagauccuuaaugcaga

SEQ ID NO: 1035658 - RNA, 20 nt, Homo sapiens
acaagauccuuaaugcagag

SEQ ID NO: 1035659 - RNA, 20 nt, Homo sapiens
acaagcaauuagacaagaac

SEQ ID NO: 1035660 - RNA, 16 nt, Homo sapiens
acaagcugcacccuca

SEQ ID NO: 1035661 - RNA, 20 nt, Homo sapiens
acaagguucccucugagaau

SEQ ID NO: 1035662 - RNA, 15 nt, Homo sapiens
acaauagaaaccugu

SEQ ID NO: 1035663 - RNA, 18 nt, Homo sapiens
acaauagugauugauaga

SEQ ID NO: 1035664 - RNA, 23 nt, Homo sapiens
acaaucaacucuaauagugcuua

SEQ ID NO: 1035665 - RNA, 18 nt, Homo sapiens
acaaucaugaaauaugca

SEQ ID NO: 1035666 - RNA, 19 nt, Homo sapiens
acaaucaugaaauaugcau

SEQ ID NO: 1035667 - RNA, 23 nt, Homo sapiens
acaauccaucucucaaguagugu

SEQ ID NO: 1035668 - RNA, 15 nt, Homo sapiens
acaaugaaaugcucu

SEQ ID NO: 1035669 - RNA, 22 nt, Homo sapiens
acaaugaagaugaugcuauuaa

SEQ ID NO: 1035670 - RNA, 19 nt, Homo sapiens
acaaugacauuuauaucac

SEQ ID NO: 1035671 - RNA, 18 nt, Homo sapiens
acaaugacuaaagacaua

SEQ ID NO: 1035672 - RNA, 17 nt, Homo sapiens
acaaugacuuacuguac

SEQ ID NO: 1035673 - RNA, 15 nt, Homo sapiens
acaaugauacaguug

SEQ ID NO: 1035674 - RNA, 21 nt, Homo sapiens
acaauggcuaauucccagagu

SEQ ID NO: 1035675 - RNA, 13 nt, Homo sapiens
acaaugugaaaag

SEQ ID NO: 1035676 - RNA, 14 nt, Homo sapiens
acaauugucaugua

SEQ ID NO: 1035677 - RNA, 22 nt, Homo sapiens
acaauuugcaguaaacuuuuaa

SEQ ID NO: 1035678 - RNA, 14 nt, Homo sapiens
acacaauuacuaaa

SEQ ID NO: 1035679 - RNA, 11 nt, Homo sapiens
acacacacagg

SEQ ID NO: 1035680 - RNA, 22 nt, Homo sapiens
acacacacucuacccuauacaa

SEQ ID NO: 1035681 - RNA, 22 nt, Homo sapiens
acacacagaaaauauacuguaa

SEQ ID NO: 1035682 - RNA, 12 nt, Homo sapiens
acacacagcucu

SEQ ID NO: 1035683 - RNA, 16 nt, Homo sapiens
acacacucaaaucaag

SEQ ID NO: 1035684 - RNA, 10 nt, Homo sapiens
acacacucca

SEQ ID NO: 1035685 - RNA, 13 nt, Homo sapiens
acacacuccauca

SEQ ID NO: 1035686 - RNA, 15 nt, Homo sapiens
acacagcagcaguua

SEQ ID NO: 1035687 - RNA, 17 nt, Homo sapiens
acacagccaagccaguc

SEQ ID NO: 1035688 - RNA, 18 nt, Homo sapiens
acacagccaagccaguca

SEQ ID NO: 1035689 - RNA, 17 nt, Homo sapiens
acacagccccauguaca

SEQ ID NO: 1035690 - RNA, 14 nt, Homo sapiens
acacagcugggcug

SEQ ID NO: 1035691 - RNA, 19 nt, Homo sapiens
acacaggaggcugaggcag

SEQ ID NO: 1035692 - RNA, 17 nt, Homo sapiens
acacaguauuacuucug

SEQ ID NO: 1035693 - RNA, 18 nt, Homo sapiens
acacaguguuuuuguaaa

SEQ ID NO: 1035694 - RNA, 22 nt, Homo sapiens
acacaguuggauuuauucugcc

SEQ ID NO: 1035695 - RNA, 17 nt, Homo sapiens
acacauucuuaacacau

SEQ ID NO: 1035696 - RNA, 21 nt, Homo sapiens
acacauuguacaugguacgaa

SEQ ID NO: 1035697 - RNA, 21 nt, Homo sapiens
acacauuuuuuaaaugcaccu

SEQ ID NO: 1035698 - RNA, 18 nt, Homo sapiens
acaccacaaaucugaaug

SEQ ID NO: 1035699 - RNA, 20 nt, Homo sapiens
acaccaccuauaccaauauu

SEQ ID NO: 1035700 - RNA, 22 nt, Homo sapiens
acaccaugagccuccucgucac

SEQ ID NO: 1035701 - RNA, 17 nt, Homo sapiens
acaccauuuuccugccu

SEQ ID NO: 1035702 - RNA, 19 nt, Homo sapiens
acaccauuuuccugccuca

SEQ ID NO: 1035703 - RNA, 23 nt, Homo sapiens
acacccgccgccuccugcaccga

SEQ ID NO: 1035704 - RNA, 13 nt, Homo sapiens
acacccuguacug

SEQ ID NO: 1035705 - RNA, 20 nt, Homo sapiens
acaccguguaaaccaaagcc

SEQ ID NO: 1035706 - RNA, 15 nt, Homo sapiens
acaccuacucuauca

SEQ ID NO: 1035707 - RNA, 15 nt, Homo sapiens
acaccuagcuuuauu

SEQ ID NO: 1035708 - RNA, 21 nt, Homo sapiens
acaccucagaggcuguucuug

SEQ ID NO: 1035709 - RNA, 21 nt, Homo sapiens
acaccuggaggugaaggcaga

SEQ ID NO: 1035710 - RNA, 21 nt, Homo sapiens
acaccuggcacugcugugcug

SEQ ID NO: 1035711 - RNA, 22 nt, Homo sapiens
acaccuggcacugcugugcugu

SEQ ID NO: 1035712 - RNA, 19 nt, Homo sapiens
acaccuguagucccagcua

SEQ ID NO: 1035713 - RNA, 15 nt, Homo sapiens
acaccuugacagggc

SEQ ID NO: 1035714 - RNA, 20 nt, Homo sapiens
acacgagguaugaggucuag

SEQ ID NO: 1035715 - RNA, 15 nt, Homo sapiens
acacgcaacuggcuc

SEQ ID NO: 1035716 - RNA, 21 nt, Homo sapiens
acacgcaacuggcucaaagac

SEQ ID NO: 1035717 - RNA, 23 nt, Homo sapiens
acacgcccccacaggcucugacc

SEQ ID NO: 1035718 - RNA, 12 nt, Homo sapiens
acacgcuuucac

SEQ ID NO: 1035719 - RNA, 15 nt, Homo sapiens
acacguguuguucca

SEQ ID NO: 1035720 - RNA, 19 nt, Homo sapiens
acacuauaaagguugacaa

SEQ ID NO: 1035721 - RNA, 17 nt, Homo sapiens
acacucaaaucaagaaa

SEQ ID NO: 1035722 - RNA, 13 nt, Homo sapiens
acacucaugcuga

SEQ ID NO: 1035723 - RNA, 12 nt, Homo sapiens
acacuccagugc

SEQ ID NO: 1035724 - RNA, 20 nt, Homo sapiens
acacucccacuuggcaucau

SEQ ID NO: 1035725 - RNA, 16 nt, Homo sapiens
acacuccccugcacug

SEQ ID NO: 1035726 - RNA, 19 nt, Homo sapiens
acacucccuucccaugacc

SEQ ID NO: 1035727 - RNA, 16 nt, Homo sapiens
acacucuccaaacagu

SEQ ID NO: 1035728 - RNA, 15 nt, Homo sapiens
acacugaaguuaaca

SEQ ID NO: 1035729 - RNA, 12 nt, Homo sapiens
acacuguacaag

SEQ ID NO: 1035730 - RNA, 19 nt, Homo sapiens
acacugugcccagcccgga

SEQ ID NO: 1035731 - RNA, 22 nt, Homo sapiens
acacugugcugagucugaaggc

SEQ ID NO: 1035732 - RNA, 15 nt, Homo sapiens
acacuguucugaaag

SEQ ID NO: 1035733 - RNA, 23 nt, Homo sapiens
acacuguugucaaaaaguuccau

SEQ ID NO: 1035734 - RNA, 23 nt, Homo sapiens
acacuugugugugggcugugagu

SEQ ID NO: 1035735 - RNA, 17 nt, Homo sapiens
acagaaagacugagcuc

SEQ ID NO: 1035736 - RNA, 19 nt, Homo sapiens
acagaaaguggugcucagu

SEQ ID NO: 1035737 - RNA, 15 nt, Homo sapiens
acagaaaguucuuaa

SEQ ID NO: 1035738 - RNA, 21 nt, Homo sapiens
acagaaaguucuuaaacucag

SEQ ID NO: 1035739 - RNA, 22 nt, Homo sapiens
acagaacuaagaugaucaucuc

SEQ ID NO: 1035740 - RNA, 12 nt, Homo sapiens
acagaagccagg

SEQ ID NO: 1035741 - RNA, 23 nt, Homo sapiens
acagaagcuucugcccaccuacu

SEQ ID NO: 1035742 - RNA, 17 nt, Homo sapiens
acagaagggcuaacuca

SEQ ID NO: 1035743 - RNA, 13 nt, Homo sapiens
acagacaacacug

SEQ ID NO: 1035744 - RNA, 15 nt, Homo sapiens
acgccuguaauccca

SEQ ID NO: 1035745 - RNA, 12 nt, Homo sapiens
acgcgugcacac

SEQ ID NO: 1035746 - RNA, 21 nt, Homo sapiens
acgcuaguuaucaugcauguu

SEQ ID NO: 1035747 - RNA, 21 nt, Homo sapiens
acggaagccaacuuggcuuuc

SEQ ID NO: 1035748 - RNA, 12 nt, Homo sapiens
acggacacucaa

SEQ ID NO: 1035749 - RNA, 20 nt, Homo sapiens
acggagucucgcucugucac

SEQ ID NO: 1035750 - RNA, 17 nt, Homo sapiens
acggccaacaaagcugu

SEQ ID NO: 1035751 - RNA, 15 nt, Homo sapiens
acggccagguacaac

SEQ ID NO: 1035752 - RNA, 21 nt, Homo sapiens
acggcgugccuggacacugua

SEQ ID NO: 1035753 - RNA, 17 nt, Homo sapiens
acgggagaauauacaaa

SEQ ID NO: 1035754 - RNA, 13 nt, Homo sapiens
acggggacugggg

SEQ ID NO: 1035755 - RNA, 17 nt, Homo sapiens
acggggaggaaccacug

SEQ ID NO: 1035756 - RNA, 22 nt, Homo sapiens
acggggcuugcaacuuagcuca

SEQ ID NO: 1035757 - RNA, 15 nt, Homo sapiens
acgggggcagcugau

SEQ ID NO: 1035758 - RNA, 20 nt, Homo sapiens
acgguagugccugaaauuuc

SEQ ID NO: 1035759 - RNA, 20 nt, Homo sapiens
acgguggcucacgccuguaa

SEQ ID NO: 1035760 - RNA, 16 nt, Homo sapiens
acgguggucacuggaa

SEQ ID NO: 1035761 - RNA, 21 nt, Homo sapiens
acguacaaaauccagcuauga

SEQ ID NO: 1035762 - RNA, 14 nt, Homo sapiens
acgucugacaggca

SEQ ID NO: 1035763 - RNA, 22 nt, Homo sapiens
acguggcccagagaagccaaaa

SEQ ID NO: 1035764 - RNA, 21 nt, Homo sapiens
acguggucuuucuuacaagga

SEQ ID NO: 1035765 - RNA, 20 nt, Homo sapiens
acgugugugcacguacacac

SEQ ID NO: 1035766 - RNA, 15 nt, Homo sapiens
acguuaagugaugaa

SEQ ID NO: 1035767 - RNA, 18 nt, Homo sapiens
acuaaacaacuaccuccu

SEQ ID NO: 1035768 - RNA, 21 nt, Homo sapiens
acuaaacaacuaccuccucag

SEQ ID NO: 1035769 - RNA, 18 nt, Homo sapiens
acuaaauugacacuuaaa

SEQ ID NO: 1035770 - RNA, 18 nt, Homo sapiens
acuaaccuggguucccuu

SEQ ID NO: 1035771 - RNA, 15 nt, Homo sapiens
acuaacguacauuca

SEQ ID NO: 1035772 - RNA, 21 nt, Homo sapiens
acuaacuccuaggaaaauacu

SEQ ID NO: 1035773 - RNA, 20 nt, Homo sapiens
acuaagauugugcucaauac

SEQ ID NO: 1035774 - RNA, 22 nt, Homo sapiens
acuaaggugugcucugaucauc

SEQ ID NO: 1035775 - RNA, 20 nt, Homo sapiens
acuaauagaauuaauggaau

SEQ ID NO: 1035776 - RNA, 17 nt, Homo sapiens
acuaauccucucugcaa

SEQ ID NO: 1035777 - RNA, 14 nt, Homo sapiens
acuaauggaaauau

SEQ ID NO: 1035778 - RNA, 16 nt, Homo sapiens
acuacaaagcuucuau

SEQ ID NO: 1035779 - RNA, 18 nt, Homo sapiens
acuacaauuuaaagcaaa

SEQ ID NO: 1035780 - RNA, 16 nt, Homo sapiens
acuacaggcaccugcc

SEQ ID NO: 1035781 - RNA, 23 nt, Homo sapiens
acuacaugugacuggcaguauua

SEQ ID NO: 1035782 - RNA, 21 nt, Homo sapiens
acuaccccaaaguuugcucaa

SEQ ID NO: 1035783 - RNA, 16 nt, Homo sapiens
acuacuacucaauggc

SEQ ID NO: 1035784 - RNA, 15 nt, Homo sapiens
acuacucugugccag

SEQ ID NO: 1035785 - RNA, 16 nt, Homo sapiens
acuagaagggccaguc

SEQ ID NO: 1035786 - RNA, 21 nt, Homo sapiens
acuagagaucugguuuugcua

SEQ ID NO: 1035787 - RNA, 16 nt, Homo sapiens
acuagccacugagaag

SEQ ID NO: 1035788 - RNA, 19 nt, Homo sapiens
acuagugacacauuguaca

SEQ ID NO: 1035789 - RNA, 21 nt, Homo sapiens
acuauaagcagaagcacauau

SEQ ID NO: 1035790 - RNA, 18 nt, Homo sapiens
acuauaauguaagcucua

SEQ ID NO: 1035791 - RNA, 22 nt, Homo sapiens
acuauagccuaggugacagagu

SEQ ID NO: 1035792 - RNA, 18 nt, Homo sapiens
acuaucaaacugaagcca

SEQ ID NO: 1035793 - RNA, 17 nt, Homo sapiens
acuaucugaaccauuaa

SEQ ID NO: 1035794 - RNA, 16 nt, Homo sapiens
acuaucugauuuccua

SEQ ID NO: 1035795 - RNA, 23 nt, Homo sapiens
acuaucuuuuuuuuauuccacau

SEQ ID NO: 1035796 - RNA, 13 nt, Homo sapiens
acuaugaaucuau

SEQ ID NO: 1035797 - RNA, 21 nt, Homo sapiens
acuaugaaugggcaaaacuga

SEQ ID NO: 1035798 - RNA, 12 nt, Homo sapiens
acuaugcugcuu

SEQ ID NO: 1035799 - RNA, 23 nt, Homo sapiens
acuauggacggugcuccaggcag

SEQ ID NO: 1035800 - RNA, 18 nt, Homo sapiens
acuauggcucuacuuuca

SEQ ID NO: 1035801 - RNA, 18 nt, Homo sapiens
acuauguugcccaggcag

SEQ ID NO: 1035802 - RNA, 16 nt, Homo sapiens
acuauuaaaacagcca

SEQ ID NO: 1035803 - RNA, 16 nt, Homo sapiens
acuauuacaccaaaua

SEQ ID NO: 1035804 - RNA, 12 nt, Homo sapiens
acuauuacuggg

SEQ ID NO: 1035805 - RNA, 19 nt, Homo sapiens
acuauucugauuacacaaa

SEQ ID NO: 1035806 - RNA, 20 nt, Homo sapiens
acuauugaaaucaagcuuau

SEQ ID NO: 1035807 - RNA, 18 nt, Homo sapiens
acuauugaaguugcagau

SEQ ID NO: 1035808 - RNA, 16 nt, Homo sapiens
acuauugcuugcacaa

SEQ ID NO: 1035809 - RNA, 18 nt, Homo sapiens
acuauuuagauauaacac

SEQ ID NO: 1035810 - RNA, 15 nt, Homo sapiens
acuauuugagguuaa

SEQ ID NO: 1035811 - RNA, 21 nt, Homo sapiens
acuauuuucauucucuuguua

SEQ ID NO: 1035812 - RNA, 21 nt, Homo sapiens
acucaaaacccaucugggcuc

SEQ ID NO: 1035813 - RNA, 15 nt, Homo sapiens
acucaaaugcucaga

SEQ ID NO: 1035814 - RNA, 12 nt, Homo sapiens
acucaacauguu

SEQ ID NO: 1035815 - RNA, 23 nt, Homo sapiens
acucaacauguuacugaccagca

SEQ ID NO: 1035816 - RNA, 19 nt, Homo sapiens
acucaagccaagcagccaa

SEQ ID NO: 1035817 - RNA, 18 nt, Homo sapiens
acucaaugagcucuucca

SEQ ID NO: 1035818 - RNA, 14 nt, Homo sapiens
acucacugcucaag

SEQ ID NO: 1035819 - RNA, 15 nt, Homo sapiens
acucacuuguaagaa

SEQ ID NO: 1035820 - RNA, 19 nt, Homo sapiens
acucagaucacuacugcag

SEQ ID NO: 1035821 - RNA, 15 nt, Homo sapiens
acucagccaagcaca

SEQ ID NO: 1035822 - RNA, 12 nt, Homo sapiens
acucagcuuugc

SEQ ID NO: 1035823 - RNA, 14 nt, Homo sapiens
acucaggcauuuga

SEQ ID NO: 1035824 - RNA, 19 nt, Homo sapiens
acucaguaaaauguuuaau

SEQ ID NO: 1035825 - RNA, 21 nt, Homo sapiens
acucagucccuaaaaacacag

SEQ ID NO: 1035826 - RNA, 21 nt, Homo sapiens
acucagugauugcaauuugca

SEQ ID NO: 1035827 - RNA, 22 nt, Homo sapiens
acucaguuugucagacuuuaaa

SEQ ID NO: 1035828 - RNA, 15 nt, Homo sapiens
acucaucauuuccau

SEQ ID NO: 1035829 - RNA, 22 nt, Homo sapiens
acucaucugccaagcuccucaa

SEQ ID NO: 1035830 - RNA, 20 nt, Homo sapiens
acucaucuuagugccugaga

SEQ ID NO: 1035831 - RNA, 20 nt, Homo sapiens
acucaugcugaaagcccaag

SEQ ID NO: 1035832 - RNA, 12 nt, Homo sapiens
acucauuccugc

SEQ ID NO: 1035833 - RNA, 22 nt, Homo sapiens
acucauucuucuguacgucuga

SEQ ID NO: 1035834 - RNA, 12 nt, Homo sapiens
acuccacuuugu

SEQ ID NO: 1035835 - RNA, 20 nt, Homo sapiens
acuccagauuuuuuacagcu

SEQ ID NO: 1035836 - RNA, 18 nt, Homo sapiens
acuccagccugggugaca

SEQ ID NO: 1035837 - RNA, 16 nt, Homo sapiens
acuccaggacagugga

SEQ ID NO: 1035838 - RNA, 18 nt, Homo sapiens
acuccaggcugucuuuca

SEQ ID NO: 1035839 - RNA, 13 nt, Homo sapiens
acuccagugccag

SEQ ID NO: 1035840 - RNA, 12 nt, Homo sapiens
acuccaucucaa

SEQ ID NO: 1035841 - RNA, 15 nt, Homo sapiens
acuccaucucaaauu

SEQ ID NO: 1035842 - RNA, 23 nt, Homo sapiens
acucccagugcuugcaagauucc

SEQ ID NO: 1035843 - RNA, 14 nt, Homo sapiens
acucccgaccucag

SEQ ID NO: 1035844 - RNA, 13 nt, Homo sapiens
acuccggggagcg

SEQ ID NO: 1035845 - RNA, 13 nt, Homo sapiens
acuccuaaaucaa

SEQ ID NO: 1035846 - RNA, 14 nt, Homo sapiens
acuccuaaaucaag

SEQ ID NO: 1035847 - RNA, 16 nt, Homo sapiens
acuccuaggcaggaca

SEQ ID NO: 1035848 - RNA, 14 nt, Homo sapiens
acuccuagggccac

SEQ ID NO: 1035849 - RNA, 14 nt, Homo sapiens
acuccucaucauca

SEQ ID NO: 1035850 - RNA, 16 nt, Homo sapiens
acuccuccaaggcaca

SEQ ID NO: 1035851 - RNA, 17 nt, Homo sapiens
acuccuccugagcucug

SEQ ID NO: 1035852 - RNA, 14 nt, Homo sapiens
acuccucuuuacac

SEQ ID NO: 1035853 - RNA, 16 nt, Homo sapiens
acuccugccgcaguga

SEQ ID NO: 1035854 - RNA, 16 nt, Homo sapiens
acucuaauagugcuua

SEQ ID NO: 1035855 - RNA, 18 nt, Homo sapiens
acucuagggaaaaaccag

SEQ ID NO: 1035856 - RNA, 17 nt, Homo sapiens
acucuaucugucauaca

SEQ ID NO: 1035857 - RNA, 22 nt, Homo sapiens
acucuccagaaagcucaucuca

SEQ ID NO: 1035858 - RNA, 22 nt, Homo sapiens
acucucugugaacccuaugaga

SEQ ID NO: 1035859 - RNA, 17 nt, Homo sapiens
acucugaauccucauga

SEQ ID NO: 1035860 - RNA, 17 nt, Homo sapiens
acucugagaucuaagga

SEQ ID NO: 1035861 - RNA, 23 nt, Homo sapiens
acucugaggcucuuucugggcca

SEQ ID NO: 1035862 - RNA, 15 nt, Homo sapiens
acucugcacaugucu

SEQ ID NO: 1035863 - RNA, 15 nt, Homo sapiens
acucugcccaggugu

SEQ ID NO: 1035864 - RNA, 22 nt, Homo sapiens
acucuggguuuauuacauggca

SEQ ID NO: 1035865 - RNA, 13 nt, Homo sapiens
acucuuaagccau

SEQ ID NO: 1035866 - RNA, 16 nt, Homo sapiens
acucuuaaguuucuca

SEQ ID NO: 1035867 - RNA, 14 nt, Homo sapiens
acucuugagaucuu

SEQ ID NO: 1035868 - RNA, 15 nt, Homo sapiens
acucuugcaauccac

SEQ ID NO: 1035869 - RNA, 17 nt, Homo sapiens
acucuugcaggucucaa

SEQ ID NO: 1035870 - RNA, 19 nt, Homo sapiens
acucuuguuuucaguuuca

SEQ ID NO: 1035871 - RNA, 12 nt, Homo sapiens
acugaaacugga

SEQ ID NO: 1035872 - RNA, 13 nt, Homo sapiens
acugaaacuggaa

SEQ ID NO: 1035873 - RNA, 19 nt, Homo sapiens
acugaacauguacacuggu

SEQ ID NO: 1035874 - RNA, 16 nt, Homo sapiens
acugaaggacacagca

SEQ ID NO: 1035875 - RNA, 19 nt, Homo sapiens
acugaaggacacagcagug

SEQ ID NO: 1035876 - RNA, 12 nt, Homo sapiens
acugaaugcacc

SEQ ID NO: 1035877 - RNA, 16 nt, Homo sapiens
acugaccagccuccau

SEQ ID NO: 1035878 - RNA, 19 nt, Homo sapiens
acugaccagccuccaugcu

SEQ ID NO: 1035879 - RNA, 12 nt, Homo sapiens
acugacuccuua

SEQ ID NO: 1035880 - RNA, 18 nt, Homo sapiens
acugacugccuugcuaaa

SEQ ID NO: 1035881 - RNA, 18 nt, Homo sapiens
acugacuuucucagccuc

SEQ ID NO: 1035882 - RNA, 13 nt, Homo sapiens
acugagaauauaa

SEQ ID NO: 1035883 - RNA, 20 nt, Homo sapiens
acugagauuuugguauuaca

SEQ ID NO: 1035884 - RNA, 15 nt, Homo sapiens
acugaggaauuucac

SEQ ID NO: 1035885 - RNA, 12 nt, Homo sapiens
acugagggccac

SEQ ID NO: 1035886 - RNA, 19 nt, Homo sapiens
acugagguugggguguacu

SEQ ID NO: 1035887 - RNA, 23 nt, Homo sapiens
acugaguccucguagccaucucu

SEQ ID NO: 1035888 - RNA, 19 nt, Homo sapiens
acugaguuuauacucaccu

SEQ ID NO: 1035889 - RNA, 18 nt, Homo sapiens
agacauggcuugccacag

SEQ ID NO: 1035890 - RNA, 18 nt, Homo sapiens
agacauuaaaucuaugaa

SEQ ID NO: 1035891 - RNA, 13 nt, Homo sapiens
agacauuggcuua

SEQ ID NO: 1035892 - RNA, 18 nt, Homo sapiens
agacauuugcuaugagcu

SEQ ID NO: 1035893 - RNA, 19 nt, Homo sapiens
agaccaagacacagaucac

SEQ ID NO: 1035894 - RNA, 13 nt, Homo sapiens
agaccacauccac

SEQ ID NO: 1035895 - RNA, 14 nt, Homo sapiens
agaccacugauaaa

SEQ ID NO: 1035896 - RNA, 12 nt, Homo sapiens
agaccagcuuug

SEQ ID NO: 1035897 - RNA, 19 nt, Homo sapiens
agaccaggagggcacugga

SEQ ID NO: 1035898 - RNA, 18 nt, Homo sapiens
agaccaguugggagcacu

SEQ ID NO: 1035899 - RNA, 18 nt, Homo sapiens
agaccaucuacauacaca

SEQ ID NO: 1035900 - RNA, 15 nt, Homo sapiens
agaccauuaucagug

SEQ ID NO: 1035901 - RNA, 17 nt, Homo sapiens
agacccccacaccucag

SEQ ID NO: 1035902 - RNA, 20 nt, Homo sapiens
agaccccucucccagcuauu

SEQ ID NO: 1035903 - RNA, 15 nt, Homo sapiens
agaccugacaagcac

SEQ ID NO: 1035904 - RNA, 19 nt, Homo sapiens
agaccugacaagcacugcu

SEQ ID NO: 1035905 - RNA, 23 nt, Homo sapiens
agaccuggguugagccucagaau

SEQ ID NO: 1035906 - RNA, 23 nt, Homo sapiens
agacggagucucgcucugucacc

SEQ ID NO: 1035907 - RNA, 18 nt, Homo sapiens
agacguuuaaaagccauc

SEQ ID NO: 1035908 - RNA, 13 nt, Homo sapiens
agacuaaggccau

SEQ ID NO: 1035909 - RNA, 13 nt, Homo sapiens
agacuacagcaca

SEQ ID NO: 1035910 - RNA, 22 nt, Homo sapiens
agacuauaagcagaagcacaua

SEQ ID NO: 1035911 - RNA, 22 nt, Homo sapiens
agacuaugaggaauauuugcaa

SEQ ID NO: 1035912 - RNA, 19 nt, Homo sapiens
agacuauucccuucuaacc

SEQ ID NO: 1035913 - RNA, 17 nt, Homo sapiens
agacucaguuugucaga

SEQ ID NO: 1035914 - RNA, 23 nt, Homo sapiens
agacucauucccuagaucuuucu

SEQ ID NO: 1035915 - RNA, 16 nt, Homo sapiens
agacucccaagcugga

SEQ ID NO: 1035916 - RNA, 14 nt, Homo sapiens
agacuccgucucaa

SEQ ID NO: 1035917 - RNA, 15 nt, Homo sapiens
agacuccugugcaac

SEQ ID NO: 1035918 - RNA, 19 nt, Homo sapiens
agacucguuuuuaaggugg

SEQ ID NO: 1035919 - RNA, 16 nt, Homo sapiens
agacugagcucaaggu

SEQ ID NO: 1035920 - RNA, 19 nt, Homo sapiens
agacugcugggacuggcca

SEQ ID NO: 1035921 - RNA, 14 nt, Homo sapiens
agacugcuguguuu

SEQ ID NO: 1035922 - RNA, 16 nt, Homo sapiens
agacuggauacugccc

SEQ ID NO: 1035923 - RNA, 22 nt, Homo sapiens
agacuggcagggacgaggacaa

SEQ ID NO: 1035924 - RNA, 20 nt, Homo sapiens
agacugggucucgcuuuguu

SEQ ID NO: 1035925 - RNA, 17 nt, Homo sapiens
agacugucagcuuccaa

SEQ ID NO: 1035926 - RNA, 23 nt, Homo sapiens
agacuguugcucaaaucuauuca

SEQ ID NO: 1035927 - RNA, 21 nt, Homo sapiens
agacuuaauagaaacauugaa

SEQ ID NO: 1035928 - RNA, 15 nt, Homo sapiens
agacuucccacucua

SEQ ID NO: 1035929 - RNA, 16 nt, Homo sapiens
agacuucgacucagga

SEQ ID NO: 1035930 - RNA, 15 nt, Homo sapiens
agacuucucaauaau

SEQ ID NO: 1035931 - RNA, 13 nt, Homo sapiens
agacuucuuggcu

SEQ ID NO: 1035932 - RNA, 18 nt, Homo sapiens
agacuugaaauacuacuu

SEQ ID NO: 1035933 - RNA, 19 nt, Homo sapiens
agacuuggcuccaccacug

SEQ ID NO: 1035934 - RNA, 21 nt, Homo sapiens
agacuuggcuccaccacugau

SEQ ID NO: 1035935 - RNA, 22 nt, Homo sapiens
agacuuggcuccaccacugaua

SEQ ID NO: 1035936 - RNA, 19 nt, Homo sapiens
agacuuggggaaauugcuu

SEQ ID NO: 1035937 - RNA, 18 nt, Homo sapiens
agacuuucuuaucacuua

SEQ ID NO: 1035938 - RNA, 12 nt, Homo sapiens
agacuuugacuc

SEQ ID NO: 1035939 - RNA, 14 nt, Homo sapiens
agacuuugggauag

SEQ ID NO: 1035940 - RNA, 17 nt, Homo sapiens
agagaaaucaaugaagc

SEQ ID NO: 1035941 - RNA, 14 nt, Homo sapiens
agagaaauuugcca

SEQ ID NO: 1035942 - RNA, 14 nt, Homo sapiens
agagaacaacuacu

SEQ ID NO: 1035943 - RNA, 18 nt, Homo sapiens
agagaacccagauguugu

SEQ ID NO: 1035944 - RNA, 20 nt, Homo sapiens
agagaaccucacgcaccucc

SEQ ID NO: 1035945 - RNA, 9 nt, Homo sapiens
agagaagau

SEQ ID NO: 1035946 - RNA, 20 nt, Homo sapiens
agagaagauagcagggcaug

SEQ ID NO: 1035947 - RNA, 22 nt, Homo sapiens
agagaauuguaucauuugaaca

SEQ ID NO: 1035948 - RNA, 19 nt, Homo sapiens
agagacagauaacucuccu

SEQ ID NO: 1035949 - RNA, 18 nt, Homo sapiens
agagacaggacuagcugg

SEQ ID NO: 1035950 - RNA, 13 nt, Homo sapiens
agagaccaggagg

SEQ ID NO: 1035951 - RNA, 18 nt, Homo sapiens
agagacuaucugauuucc

SEQ ID NO: 1035952 - RNA, 13 nt, Homo sapiens
agagacuggagca

SEQ ID NO: 1035953 - RNA, 19 nt, Homo sapiens
agagacuuugacucuccag

SEQ ID NO: 1035954 - RNA, 16 nt, Homo sapiens
agagagaaaagcucac

SEQ ID NO: 1035955 - RNA, 19 nt, Homo sapiens
agagagaagcaaguggugg

SEQ ID NO: 1035956 - RNA, 14 nt, Homo sapiens
agagagaagugccc

SEQ ID NO: 1035957 - RNA, 19 nt, Homo sapiens
agagagccuggugcugcug

SEQ ID NO: 1035958 - RNA, 15 nt, Homo sapiens
agagagcuguuccca

SEQ ID NO: 1035959 - RNA, 15 nt, Homo sapiens
agagaggagccagga

SEQ ID NO: 1035960 - RNA, 14 nt, Homo sapiens
agagaggaguucaa

SEQ ID NO: 1035961 - RNA, 23 nt, Homo sapiens
agagaggcaaaggcucucacucc

SEQ ID NO: 1035962 - RNA, 17 nt, Homo sapiens
agagaggccaggugcag

SEQ ID NO: 1035963 - RNA, 17 nt, Homo sapiens
agagaggccuuguccca

SEQ ID NO: 1035964 - RNA, 18 nt, Homo sapiens
agagagucccacugccuc

SEQ ID NO: 1035965 - RNA, 23 nt, Homo sapiens
agagauggaauaaagcccuugaa

SEQ ID NO: 1035966 - RNA, 13 nt, Homo sapiens
agagcaaaugcua

SEQ ID NO: 1035967 - RNA, 21 nt, Homo sapiens
agagcaacaauccaucucuca

SEQ ID NO: 1035968 - RNA, 19 nt, Homo sapiens
agagcacacuguagcauua

SEQ ID NO: 1035969 - RNA, 20 nt, Homo sapiens
agagcacacuuaugggccaa

SEQ ID NO: 1035970 - RNA, 21 nt, Homo sapiens
agagcaggcuggcagcucucc

SEQ ID NO: 1035971 - RNA, 13 nt, Homo sapiens
agagccagggucu

SEQ ID NO: 1035972 - RNA, 22 nt, Homo sapiens
agagccauggacucuacacugu

SEQ ID NO: 1035973 - RNA, 17 nt, Homo sapiens
agagcccgggagcugcu

SEQ ID NO: 1035974 - RNA, 14 nt, Homo sapiens
agagccuccuccag

SEQ ID NO: 1035975 - RNA, 20 nt, Homo sapiens
agagcgagacuccgucucaa

SEQ ID NO: 1035976 - RNA, 15 nt, Homo sapiens
agagcucacuaaaau

SEQ ID NO: 1035977 - RNA, 22 nt, Homo sapiens
agagcucuuuaccaaggaugaa

SEQ ID NO: 1035978 - RNA, 13 nt, Homo sapiens
agagcugguuggg

SEQ ID NO: 1035979 - RNA, 16 nt, Homo sapiens
agagcuucucccaaac

SEQ ID NO: 1035980 - RNA, 19 nt, Homo sapiens
agaggaagagcugcaacgg

SEQ ID NO: 1035981 - RNA, 21 nt, Homo sapiens
agaggaaugaaguacucauac

SEQ ID NO: 1035982 - RNA, 16 nt, Homo sapiens
agaggagaaaaaaacu

SEQ ID NO: 1035983 - RNA, 15 nt, Homo sapiens
agaggagcgggaccu

SEQ ID NO: 1035984 - RNA, 19 nt, Homo sapiens
agaggaguucaaugaucua

SEQ ID NO: 1035985 - RNA, 14 nt, Homo sapiens
agaggaugaaugua

SEQ ID NO: 1035986 - RNA, 13 nt, Homo sapiens
agaggcagagaaa

SEQ ID NO: 1035987 - RNA, 15 nt, Homo sapiens
agaggcucagcacuu

SEQ ID NO: 1035988 - RNA, 12 nt, Homo sapiens
agaggcucugug

SEQ ID NO: 1035989 - RNA, 14 nt, Homo sapiens
agagggcccaggca

SEQ ID NO: 1035990 - RNA, 20 nt, Homo sapiens
agaggggaacagacuggaag

SEQ ID NO: 1035991 - RNA, 13 nt, Homo sapiens
agaggggacaggu

SEQ ID NO: 1035992 - RNA, 13 nt, Homo sapiens
agaggggguagcu

SEQ ID NO: 1035993 - RNA, 22 nt, Homo sapiens
agagggguggaguuuuaacugu

SEQ ID NO: 1035994 - RNA, 16 nt, Homo sapiens
agaggguuuccauggg

SEQ ID NO: 1035995 - RNA, 20 nt, Homo sapiens
agaguauaugcacuuuccaa

SEQ ID NO: 1035996 - RNA, 20 nt, Homo sapiens
agagucaaugaacuuuccac

SEQ ID NO: 1035997 - RNA, 21 nt, Homo sapiens
agaguccugcacaguuuucug

SEQ ID NO: 1035998 - RNA, 14 nt, Homo sapiens
agagucgcaucuca

SEQ ID NO: 1035999 - RNA, 21 nt, Homo sapiens
agagucgcaucucagugcagg

SEQ ID NO: 1036000 - RNA, 13 nt, Homo sapiens
agagucugcacuu

SEQ ID NO: 1036001 - RNA, 20 nt, Homo sapiens
agagugagacucugucucaa

SEQ ID NO: 1036002 - RNA, 22 nt, Homo sapiens
agagugcaagccccugcuccag

SEQ ID NO: 1036003 - RNA, 21 nt, Homo sapiens
agagugcccagaacuggacuc

SEQ ID NO: 1036004 - RNA, 23 nt, Homo sapiens
agagugccguaacaacugugguc

SEQ ID NO: 1036005 - RNA, 19 nt, Homo sapiens
agagugcugccaguccucu

SEQ ID NO: 1036006 - RNA, 17 nt, Homo sapiens
agagugugaaacuuccu

SEQ ID NO: 1036007 - RNA, 17 nt, Homo sapiens
agaguuaacaaugauau

SEQ ID NO: 1036008 - RNA, 17 nt, Homo sapiens
agaguuaccacacccca

SEQ ID NO: 1036009 - RNA, 21 nt, Homo sapiens
agaguucuccagacaggguuc

SEQ ID NO: 1036010 - RNA, 19 nt, Homo sapiens
agaguugagauuuugcaau

SEQ ID NO: 1036011 - RNA, 12 nt, Homo sapiens
agaguugugcac

SEQ ID NO: 1036012 - RNA, 14 nt, Homo sapiens
agaguugugcacau

SEQ ID NO: 1036013 - RNA, 14 nt, Homo sapiens
agaguuuaguugua

SEQ ID NO: 1036014 - RNA, 18 nt, Homo sapiens
agaguuuguguguugucu

SEQ ID NO: 1036015 - RNA, 23 nt, Homo sapiens
agauaaaagaaccgagcaauuuu

SEQ ID NO: 1036016 - RNA, 13 nt, Homo sapiens
agauaaacaguag

SEQ ID NO: 1036017 - RNA, 18 nt, Homo sapiens
agauaaccuguacuucaa

SEQ ID NO: 1036018 - RNA, 13 nt, Homo sapiens
agauaacucuccu

SEQ ID NO: 1036019 - RNA, 15 nt, Homo sapiens
agauacaaacauguu

SEQ ID NO: 1036020 - RNA, 12 nt, Homo sapiens
agauacaaugua

SEQ ID NO: 1036021 - RNA, 18 nt, Homo sapiens
agauacaggacauucuca

SEQ ID NO: 1036022 - RNA, 17 nt, Homo sapiens
agauagaagaacugcaa

SEQ ID NO: 1036023 - RNA, 14 nt, Homo sapiens
agauagcagggcau

SEQ ID NO: 1036024 - RNA, 22 nt, Homo sapiens
agauagcuucaccccaauccca

SEQ ID NO: 1036025 - RNA, 18 nt, Homo sapiens
agauauuaaaugauguuu

SEQ ID NO: 1036026 - RNA, 22 nt, Homo sapiens
agauauugucagaguucugcuc

SEQ ID NO: 1036027 - RNA, 21 nt, Homo sapiens
agauauuuugcuuugugauuu

SEQ ID NO: 1036028 - RNA, 22 nt, Homo sapiens
agaucaaaauaaaaagugacac

SEQ ID NO: 1036029 - RNA, 14 nt, Homo sapiens
agaucaaauacuuu

SEQ ID NO: 1036030 - RNA, 14 nt, Homo sapiens
agaucaacucuguc

SEQ ID NO: 1036031 - RNA, 16 nt, Homo sapiens
agaucacgagaucaag

SEQ ID NO: 1036032 - RNA, 22 nt, Homo sapiens
agaucacgccauugcacuccag

SEQ ID NO: 1036033 - RNA, 21 nt, Homo sapiens
agaucagccugggcaauguga

SEQ ID NO: 1036034 - RNA, 16 nt, Homo sapiens
auucacucauacaucu

SEQ ID NO: 1036035 - RNA, 16 nt, Homo sapiens
auucagagagcagcuu

SEQ ID NO: 1036036 - RNA, 16 nt, Homo sapiens
auucagccaggagaug

SEQ ID NO: 1036037 - RNA, 21 nt, Homo sapiens
auucaggacuuaacggcucca

SEQ ID NO: 1036038 - RNA, 17 nt, Homo sapiens
auucagggagugggcua

SEQ ID NO: 1036039 - RNA, 23 nt, Homo sapiens
auucagguauguugccuuuaugg

SEQ ID NO: 1036040 - RNA, 13 nt, Homo sapiens
auucauacauuau

SEQ ID NO: 1036041 - RNA, 17 nt, Homo sapiens
auucauacauuaucuca

SEQ ID NO: 1036042 - RNA, 17 nt, Homo sapiens
auucauauuuacuucuu

SEQ ID NO: 1036043 - RNA, 22 nt, Homo sapiens
auucaugccagggacugacaaa

SEQ ID NO: 1036044 - RNA, 15 nt, Homo sapiens
auucauguggaauau

SEQ ID NO: 1036045 - RNA, 20 nt, Homo sapiens
auucauuuaaaaugauuaga

SEQ ID NO: 1036046 - RNA, 21 nt, Homo sapiens
auuccaaacacauacaggaag

SEQ ID NO: 1036047 - RNA, 16 nt, Homo sapiens
auuccaacaaaggguu

SEQ ID NO: 1036048 - RNA, 19 nt, Homo sapiens
auuccaaggaguuccauga

SEQ ID NO: 1036049 - RNA, 18 nt, Homo sapiens
auuccacacuaccacauu

SEQ ID NO: 1036050 - RNA, 23 nt, Homo sapiens
auuccaccccagcaggacaguga

SEQ ID NO: 1036051 - RNA, 16 nt, Homo sapiens
auuccaggcgaugugc

SEQ ID NO: 1036052 - RNA, 16 nt, Homo sapiens
auuccagucucugcau

SEQ ID NO: 1036053 - RNA, 22 nt, Homo sapiens
auuccauucuggaagugacuuu

SEQ ID NO: 1036054 - RNA, 15 nt, Homo sapiens
auucccacaccucca

SEQ ID NO: 1036055 - RNA, 16 nt, Homo sapiens
auuccccacccugaaa

SEQ ID NO: 1036056 - RNA, 17 nt, Homo sapiens
auuccccauugccuccu

SEQ ID NO: 1036057 - RNA, 19 nt, Homo sapiens
auuccuauauaguuuauug

SEQ ID NO: 1036058 - RNA, 22 nt, Homo sapiens
auuccucccucgcucagaggga

SEQ ID NO: 1036059 - RNA, 16 nt, Homo sapiens
auuccugggcacaguu

SEQ ID NO: 1036060 - RNA, 13 nt, Homo sapiens
auuccuugauuca

SEQ ID NO: 1036061 - RNA, 22 nt, Homo sapiens
auucggcucccuggagccagac

SEQ ID NO: 1036062 - RNA, 18 nt, Homo sapiens
auucuaacuuuuuugcua

SEQ ID NO: 1036063 - RNA, 22 nt, Homo sapiens
auucuaaggaauaugagcuuua

SEQ ID NO: 1036064 - RNA, 18 nt, Homo sapiens
auucuaagucaauccaag

SEQ ID NO: 1036065 - RNA, 20 nt, Homo sapiens
auucuaaugucuucauuuca

SEQ ID NO: 1036066 - RNA, 20 nt, Homo sapiens
auucuagugaaugaaucuca

SEQ ID NO: 1036067 - RNA, 15 nt, Homo sapiens
auucucaaccuacca

SEQ ID NO: 1036068 - RNA, 22 nt, Homo sapiens
auucuccaccugccagggacag

SEQ ID NO: 1036069 - RNA, 15 nt, Homo sapiens
auucuccugccucag

SEQ ID NO: 1036070 - RNA, 14 nt, Homo sapiens
auucucgcuuaaaa

SEQ ID NO: 1036071 - RNA, 21 nt, Homo sapiens
auucucucaggcuugcugcca

SEQ ID NO: 1036072 - RNA, 19 nt, Homo sapiens
auucucuccuguaccucuu

SEQ ID NO: 1036073 - RNA, 16 nt, Homo sapiens
auucucucuccuguac

SEQ ID NO: 1036074 - RNA, 14 nt, Homo sapiens
auucugauuacaca

SEQ ID NO: 1036075 - RNA, 18 nt, Homo sapiens
auucugauuacacaaaac

SEQ ID NO: 1036076 - RNA, 17 nt, Homo sapiens
auucugccgugugcccu

SEQ ID NO: 1036077 - RNA, 20 nt, Homo sapiens
auucugcuaccucacugggg

SEQ ID NO: 1036078 - RNA, 12 nt, Homo sapiens
auucugcugaug

SEQ ID NO: 1036079 - RNA, 22 nt, Homo sapiens
auucuggaaaagcaaaacugua

SEQ ID NO: 1036080 - RNA, 14 nt, Homo sapiens
auucugggaaucca

SEQ ID NO: 1036081 - RNA, 17 nt, Homo sapiens
auucugggaauccacag

SEQ ID NO: 1036082 - RNA, 14 nt, Homo sapiens
auucuguggaacaa

SEQ ID NO: 1036083 - RNA, 22 nt, Homo sapiens
auucuuaaaauauauuucagau

SEQ ID NO: 1036084 - RNA, 19 nt, Homo sapiens
auucuuaagggaacuucca

SEQ ID NO: 1036085 - RNA, 20 nt, Homo sapiens
auucuuacaaacaugugguu

SEQ ID NO: 1036086 - RNA, 17 nt, Homo sapiens
auucuuacauuuuacuu

SEQ ID NO: 1036087 - RNA, 20 nt, Homo sapiens
auucuuauuuaaguuauuga

SEQ ID NO: 1036088 - RNA, 18 nt, Homo sapiens
auucuucaaccucauuga

SEQ ID NO: 1036089 - RNA, 22 nt, Homo sapiens
auucuucagauacaaacugcag

SEQ ID NO: 1036090 - RNA, 15 nt, Homo sapiens
auucuucugccucag

SEQ ID NO: 1036091 - RNA, 13 nt, Homo sapiens
auucuucuuccaa

SEQ ID NO: 1036092 - RNA, 13 nt, Homo sapiens
auucuuggaauac

SEQ ID NO: 1036093 - RNA, 19 nt, Homo sapiens
auucuuguuuuaagugccu

SEQ ID NO: 1036094 - RNA, 20 nt, Homo sapiens
auucuuucccaauucacauc

SEQ ID NO: 1036095 - RNA, 20 nt, Homo sapiens
auucuuuucuuuuccauuua

SEQ ID NO: 1036096 - RNA, 21 nt, Homo sapiens
auugaaaggcauucucugaag

SEQ ID NO: 1036097 - RNA, 24 nt, Homo sapiens
auugaacuuucacauagcacagaa

SEQ ID NO: 1036098 - RNA, 23 nt, Homo sapiens
auugaagcccuccaaaagcacuu

SEQ ID NO: 1036099 - RNA, 13 nt, Homo sapiens
auugaauuaucuu

SEQ ID NO: 1036100 - RNA, 21 nt, Homo sapiens
auugacaucucuuuugagcua

SEQ ID NO: 1036101 - RNA, 13 nt, Homo sapiens
auugacucauaca

SEQ ID NO: 1036102 - RNA, 17 nt, Homo sapiens
auugacucugcauuuga

SEQ ID NO: 1036103 - RNA, 17 nt, Homo sapiens
auugacugucacuguuc

SEQ ID NO: 1036104 - RNA, 15 nt, Homo sapiens
auugagcucucucau

SEQ ID NO: 1036105 - RNA, 17 nt, Homo sapiens
auugaggacuauggaaa

SEQ ID NO: 1036106 - RNA, 20 nt, Homo sapiens
auugaugucaaaaacuucaa

SEQ ID NO: 1036107 - RNA, 12 nt, Homo sapiens
auugauguugcu

SEQ ID NO: 1036108 - RNA, 13 nt, Homo sapiens
auugauguugcug

SEQ ID NO: 1036109 - RNA, 18 nt, Homo sapiens
auugauuucaacagaauc

SEQ ID NO: 1036110 - RNA, 15 nt, Homo sapiens
auugcagacugugua

SEQ ID NO: 1036111 - RNA, 20 nt, Homo sapiens
auugcagcgauuaauaacag

SEQ ID NO: 1036112 - RNA, 16 nt, Homo sapiens
auugcaggagucccug

SEQ ID NO: 1036113 - RNA, 21 nt, Homo sapiens
auugcagguggaacucaguca

SEQ ID NO: 1036114 - RNA, 15 nt, Homo sapiens
auugcaugugacucu

SEQ ID NO: 1036115 - RNA, 19 nt, Homo sapiens
auugcccauccaucugcuu

SEQ ID NO: 1036116 - RNA, 20 nt, Homo sapiens
auugcccccagggcacuuca

SEQ ID NO: 1036117 - RNA, 19 nt, Homo sapiens
auugccuuuagugaucaca

SEQ ID NO: 1036118 - RNA, 22 nt, Homo sapiens
auugcugccccaucagugcucc

SEQ ID NO: 1036119 - RNA, 13 nt, Homo sapiens
auugcugcucucu

SEQ ID NO: 1036120 - RNA, 21 nt, Homo sapiens
auugcuuaucaguaguaucaa

SEQ ID NO: 1036121 - RNA, 19 nt, Homo sapiens
auugcuugcacaaaccaau

SEQ ID NO: 1036122 - RNA, 15 nt, Homo sapiens
auugcuuuuaugaua

SEQ ID NO: 1036123 - RNA, 18 nt, Homo sapiens
auuggaaauuuguuauaa

SEQ ID NO: 1036124 - RNA, 21 nt, Homo sapiens
auugggagugagaugccugca

SEQ ID NO: 1036125 - RNA, 23 nt, Homo sapiens
auugggcccuuccggcaugcccc

SEQ ID NO: 1036126 - RNA, 19 nt, Homo sapiens
auuggguacccaguuaaau

SEQ ID NO: 1036127 - RNA, 21 nt, Homo sapiens
auugguccgaucuuugacucu

SEQ ID NO: 1036128 - RNA, 21 nt, Homo sapiens
auugguggggcuggguaccaa

SEQ ID NO: 1036129 - RNA, 20 nt, Homo sapiens
auuguacauauuuguggaau

SEQ ID NO: 1036130 - RNA, 12 nt, Homo sapiens
auugucccugaa

SEQ ID NO: 1036131 - RNA, 23 nt, Homo sapiens
auugugauuauagugacaaugaa

SEQ ID NO: 1036132 - RNA, 12 nt, Homo sapiens
auuguggcugca

SEQ ID NO: 1036133 - RNA, 21 nt, Homo sapiens
auugugugucacaagaauuua

SEQ ID NO: 1036134 - RNA, 12 nt, Homo sapiens
auuguguucucu

SEQ ID NO: 1036135 - RNA, 16 nt, Homo sapiens
auuguuaucuaucaac

SEQ ID NO: 1036136 - RNA, 14 nt, Homo sapiens
auuguucccaguga

SEQ ID NO: 1036137 - RNA, 20 nt, Homo sapiens
auuuaaaaaaaaaagaggaa

SEQ ID NO: 1036138 - RNA, 21 nt, Homo sapiens
auuuaaaaaacuaacacccag

SEQ ID NO: 1036139 - RNA, 15 nt, Homo sapiens
auuuaaaacauguaa

SEQ ID NO: 1036140 - RNA, 16 nt, Homo sapiens
auuuaaacaccuccuc

SEQ ID NO: 1036141 - RNA, 15 nt, Homo sapiens
auuuaaagacaaaga

SEQ ID NO: 1036142 - RNA, 13 nt, Homo sapiens
auuuaaagcacau

SEQ ID NO: 1036143 - RNA, 12 nt, Homo sapiens
auuuaaagcaua

SEQ ID NO: 1036144 - RNA, 20 nt, Homo sapiens
auuuaaauuuuuuuccuuac

SEQ ID NO: 1036145 - RNA, 17 nt, Homo sapiens
auuuaagagacagucac

SEQ ID NO: 1036146 - RNA, 17 nt, Homo sapiens
auuuaaguucaagagaa

SEQ ID NO: 1036147 - RNA, 21 nt, Homo sapiens
auuuaauaaaugugccuucau

SEQ ID NO: 1036148 - RNA, 16 nt, Homo sapiens
auuuaauaguguuaau

SEQ ID NO: 1036149 - RNA, 20 nt, Homo sapiens
auuuacagccucacuugaau

SEQ ID NO: 1036150 - RNA, 17 nt, Homo sapiens
auuuaccuucuaccucu

SEQ ID NO: 1036151 - RNA, 18 nt, Homo sapiens
auuuaccuucuaccucuu

SEQ ID NO: 1036152 - RNA, 14 nt, Homo sapiens
auuuacucaauauc

SEQ ID NO: 1036153 - RNA, 21 nt, Homo sapiens
auuuacugaaguuauuuauua

SEQ ID NO: 1036154 - RNA, 11 nt, Homo sapiens
auuuacuuaac

SEQ ID NO: 1036155 - RNA, 19 nt, Homo sapiens
auuuacuuaacagaacagu

SEQ ID NO: 1036156 - RNA, 18 nt, Homo sapiens
auuuagacccugcauuua

SEQ ID NO: 1036157 - RNA, 13 nt, Homo sapiens
auuuagcacauac

SEQ ID NO: 1036158 - RNA, 11 nt, Homo sapiens
auuuagccaau

SEQ ID NO: 1036159 - RNA, 18 nt, Homo sapiens
auuuaggaccaauaccuc

SEQ ID NO: 1036160 - RNA, 16 nt, Homo sapiens
auuuagggaaagguag

SEQ ID NO: 1036161 - RNA, 15 nt, Homo sapiens
auuuauaacucauca

SEQ ID NO: 1036162 - RNA, 15 nt, Homo sapiens
auuuaucugugcaaa

SEQ ID NO: 1036163 - RNA, 19 nt, Homo sapiens
auuuaucugugcaaauccu

SEQ ID NO: 1036164 - RNA, 23 nt, Homo sapiens
auuuaucugugcaaauccuugau

SEQ ID NO: 1036165 - RNA, 19 nt, Homo sapiens
auuuaugagaaaguucuca

SEQ ID NO: 1036166 - RNA, 20 nt, Homo sapiens
auuuaugccucuguauuuaa

SEQ ID NO: 1036167 - RNA, 20 nt, Homo sapiens
auuuauggucaacacuuaag

SEQ ID NO: 1036168 - RNA, 14 nt, Homo sapiens
auuuauuauuucaa

SEQ ID NO: 1036169 - RNA, 16 nt, Homo sapiens
auuuauucugccaaac

SEQ ID NO: 1036170 - RNA, 21 nt, Homo sapiens
auuuauugugcuucgagugac

SEQ ID NO: 1036171 - RNA, 18 nt, Homo sapiens
auuuauuuaacuauucau

SEQ ID NO: 1036172 - RNA, 20 nt, Homo sapiens
auuuauuuuuuuacuuccuc

SEQ ID NO: 1036173 - RNA, 23 nt, Homo sapiens
auuucaaaacucauuuccuaugu

SEQ ID NO: 1036174 - RNA, 19 nt, Homo sapiens
auuucaaaugugcugucaa

SEQ ID NO: 1036175 - RNA, 20 nt, Homo sapiens
auuucaagaauguuauucaa

SEQ ID NO: 1036176 - RNA, 14 nt, Homo sapiens
auuucacagugugu

SEQ ID NO: 1036177 - RNA, 18 nt, Homo sapiens
auuucagauaaacaacaa

SEQ ID NO: 1036178 - RNA, 20 nt, Homo sapiens
caagacuuggcaacagaagc

SEQ ID NO: 1036179 - RNA, 19 nt, Homo sapiens
caagagagaaaagcucacu

SEQ ID NO: 1036180 - RNA, 17 nt, Homo sapiens
caagagcuggcaaaggu

SEQ ID NO: 1036181 - RNA, 15 nt, Homo sapiens
caagaggcuaacuca

SEQ ID NO: 1036182 - RNA, 20 nt, Homo sapiens
caagaucgcgccacugcacu

SEQ ID NO: 1036183 - RNA, 14 nt, Homo sapiens
caagaucugaauuu

SEQ ID NO: 1036184 - RNA, 15 nt, Homo sapiens
caagcacagaaggag

SEQ ID NO: 1036185 - RNA, 15 nt, Homo sapiens
caagcauuuaaugua

SEQ ID NO: 1036186 - RNA, 23 nt, Homo sapiens
caagccagccuugcuccuggcug

SEQ ID NO: 1036187 - RNA, 17 nt, Homo sapiens
caagcccccccuuccac

SEQ ID NO: 1036188 - RNA, 21 nt, Homo sapiens
caagccgagcucuccuuguua

SEQ ID NO: 1036189 - RNA, 16 nt, Homo sapiens
caagccugccuaggaa

SEQ ID NO: 1036190 - RNA, 14 nt, Homo sapiens
caagcuagaaggcc

SEQ ID NO: 1036191 - RNA, 22 nt, Homo sapiens
caagcuagaaggccacauguca

SEQ ID NO: 1036192 - RNA, 12 nt, Homo sapiens
caagcucaagug

SEQ ID NO: 1036193 - RNA, 12 nt, Homo sapiens
caagcuccucaa

SEQ ID NO: 1036194 - RNA, 19 nt, Homo sapiens
caagcuccuggucuugaga

SEQ ID NO: 1036195 - RNA, 11 nt, Homo sapiens
caagcucugcu

SEQ ID NO: 1036196 - RNA, 16 nt, Homo sapiens
caagcuggaagcacau

SEQ ID NO: 1036197 - RNA, 16 nt, Homo sapiens
caagcuggacuauggc

SEQ ID NO: 1036198 - RNA, 17 nt, Homo sapiens
caagcugggagcacagg

SEQ ID NO: 1036199 - RNA, 21 nt, Homo sapiens
caagcuggucccacucagucc

SEQ ID NO: 1036200 - RNA, 20 nt, Homo sapiens
caagcuuggcuguagaagga

SEQ ID NO: 1036201 - RNA, 20 nt, Homo sapiens
caagcuuuucaaaauuggac

SEQ ID NO: 1036202 - RNA, 13 nt, Homo sapiens
caaggacacagau

SEQ ID NO: 1036203 - RNA, 15 nt, Homo sapiens
caaggacacagauga

SEQ ID NO: 1036204 - RNA, 22 nt, Homo sapiens
caaggagacacaacaacuccua

SEQ ID NO: 1036205 - RNA, 18 nt, Homo sapiens
caaggcaaagacuauucc

SEQ ID NO: 1036206 - RNA, 13 nt, Homo sapiens
caaggcacugccu

SEQ ID NO: 1036207 - RNA, 20 nt, Homo sapiens
caaggccuuucuguguguga

SEQ ID NO: 1036208 - RNA, 15 nt, Homo sapiens
caaggcuccacaagc

SEQ ID NO: 1036209 - RNA, 19 nt, Homo sapiens
caaggcugggggaagaagc

SEQ ID NO: 1036210 - RNA, 19 nt, Homo sapiens
caaggcuuuauauuuuuaa

SEQ ID NO: 1036211 - RNA, 13 nt, Homo sapiens
caagggagaguga

SEQ ID NO: 1036212 - RNA, 21 nt, Homo sapiens
caagggccagcuggaggugaa

SEQ ID NO: 1036213 - RNA, 16 nt, Homo sapiens
caaggguuuguugaac

SEQ ID NO: 1036214 - RNA, 14 nt, Homo sapiens
caaggucuuugguu

SEQ ID NO: 1036215 - RNA, 12 nt, Homo sapiens
caaggugacaaa

SEQ ID NO: 1036216 - RNA, 23 nt, Homo sapiens
caaggugggccuugcuaccucaa

SEQ ID NO: 1036217 - RNA, 14 nt, Homo sapiens
caaguaaguaugaa

SEQ ID NO: 1036218 - RNA, 17 nt, Homo sapiens
caaguagcuggaauuac

SEQ ID NO: 1036219 - RNA, 21 nt, Homo sapiens
caaguauguugagaguugcug

SEQ ID NO: 1036220 - RNA, 18 nt, Homo sapiens
caagucaagugaaaaagg

SEQ ID NO: 1036221 - RNA, 17 nt, Homo sapiens
caagucaccggagcuuu

SEQ ID NO: 1036222 - RNA, 12 nt, Homo sapiens
caagucaccucc

SEQ ID NO: 1036223 - RNA, 21 nt, Homo sapiens
caagucaggacaucagucuga

SEQ ID NO: 1036224 - RNA, 21 nt, Homo sapiens
caaguccugugaauuucuuca

SEQ ID NO: 1036225 - RNA, 15 nt, Homo sapiens
caagucgaugaacua

SEQ ID NO: 1036226 - RNA, 16 nt, Homo sapiens
caagucuaugaugcug

SEQ ID NO: 1036227 - RNA, 12 nt, Homo sapiens
caagucuucccu

SEQ ID NO: 1036228 - RNA, 14 nt, Homo sapiens
caagugacaucucu

SEQ ID NO: 1036229 - RNA, 21 nt, Homo sapiens
caagugcuggcaccaccaggc

SEQ ID NO: 1036230 - RNA, 21 nt, Homo sapiens
caaguguaugcacgugugcac

SEQ ID NO: 1036231 - RNA, 18 nt, Homo sapiens
caagugucugugugcaag

SEQ ID NO: 1036232 - RNA, 16 nt, Homo sapiens
caaguguguaugugcg

SEQ ID NO: 1036233 - RNA, 17 nt, Homo sapiens
caaguguguaugugcgu

SEQ ID NO: 1036234 - RNA, 13 nt, Homo sapiens
caagugugugcac

SEQ ID NO: 1036235 - RNA, 15 nt, Homo sapiens
caagugugugugcgu

SEQ ID NO: 1036236 - RNA, 22 nt, Homo sapiens
caaguuagaaaacauaaucuuc

SEQ ID NO: 1036237 - RNA, 16 nt, Homo sapiens
caaguuagcucaggag

SEQ ID NO: 1036238 - RNA, 18 nt, Homo sapiens
caaguuccgucaguccaa

SEQ ID NO: 1036239 - RNA, 22 nt, Homo sapiens
caaguuggaaauauucaugcuu

SEQ ID NO: 1036240 - RNA, 17 nt, Homo sapiens
caaguuucaucagucaa

SEQ ID NO: 1036241 - RNA, 16 nt, Homo sapiens
caaguuuuucugucaa

SEQ ID NO: 1036242 - RNA, 16 nt, Homo sapiens
caauaaaaauggcuca

SEQ ID NO: 1036243 - RNA, 13 nt, Homo sapiens
caauaaagaccac

SEQ ID NO: 1036244 - RNA, 19 nt, Homo sapiens
caauaaauaccagacacgu

SEQ ID NO: 1036245 - RNA, 13 nt, Homo sapiens
caauaaauuggaa

SEQ ID NO: 1036246 - RNA, 23 nt, Homo sapiens
caauaaauuggaacaccuccuca

SEQ ID NO: 1036247 - RNA, 16 nt, Homo sapiens
caauaacacugucucc

SEQ ID NO: 1036248 - RNA, 13 nt, Homo sapiens
caauaacagguca

SEQ ID NO: 1036249 - RNA, 12 nt, Homo sapiens
caauaaucucac

SEQ ID NO: 1036250 - RNA, 22 nt, Homo sapiens
caauaaucucacuaccuuauua

SEQ ID NO: 1036251 - RNA, 15 nt, Homo sapiens
caauacaugcugcua

SEQ ID NO: 1036252 - RNA, 18 nt, Homo sapiens
caauacaugcugcuaauu

SEQ ID NO: 1036253 - RNA, 21 nt, Homo sapiens
caauacaugcugcuaauucaa

SEQ ID NO: 1036254 - RNA, 16 nt, Homo sapiens
caauaccuacaaguca

SEQ ID NO: 1036255 - RNA, 10 nt, Homo sapiens
caauagucaa

SEQ ID NO: 1036256 - RNA, 15 nt, Homo sapiens
caauaguuguugauu

SEQ ID NO: 1036257 - RNA, 13 nt, Homo sapiens
caauaugcaaugu

SEQ ID NO: 1036258 - RNA, 12 nt, Homo sapiens
caauaugcauuu

SEQ ID NO: 1036259 - RNA, 13 nt, Homo sapiens
caauauugccaug

SEQ ID NO: 1036260 - RNA, 19 nt, Homo sapiens
caauauugccaugguuuua

SEQ ID NO: 1036261 - RNA, 22 nt, Homo sapiens
caauauuuuccuucucucucaa

SEQ ID NO: 1036262 - RNA, 17 nt, Homo sapiens
caaucagagagcucacu

SEQ ID NO: 1036263 - RNA, 19 nt, Homo sapiens
caaucaguagccagcaucu

SEQ ID NO: 1036264 - RNA, 23 nt, Homo sapiens
caaucaguagccagcaucugccu

SEQ ID NO: 1036265 - RNA, 19 nt, Homo sapiens
caaucaguauaauucugua

SEQ ID NO: 1036266 - RNA, 17 nt, Homo sapiens
caaucagugcuccugua

SEQ ID NO: 1036267 - RNA, 17 nt, Homo sapiens
caaucaugaaauaugca

SEQ ID NO: 1036268 - RNA, 15 nt, Homo sapiens
caauccaucucucaa

SEQ ID NO: 1036269 - RNA, 12 nt, Homo sapiens
caauccugugga

SEQ ID NO: 1036270 - RNA, 12 nt, Homo sapiens
caaucuguguuc

SEQ ID NO: 1036271 - RNA, 18 nt, Homo sapiens
caaucuuaaggggcagcu

SEQ ID NO: 1036272 - RNA, 13 nt, Homo sapiens
caaucuucucaga

SEQ ID NO: 1036273 - RNA, 16 nt, Homo sapiens
caaugaaaugauguca

SEQ ID NO: 1036274 - RNA, 15 nt, Homo sapiens
caaugaauuuugcuu

SEQ ID NO: 1036275 - RNA, 15 nt, Homo sapiens
caaugacacagucuu

SEQ ID NO: 1036276 - RNA, 17 nt, Homo sapiens
caaugaguaacaggaaa

SEQ ID NO: 1036277 - RNA, 17 nt, Homo sapiens
caaugauacagucccua

SEQ ID NO: 1036278 - RNA, 11 nt, Homo sapiens
caaugaucuag

SEQ ID NO: 1036279 - RNA, 12 nt, Homo sapiens
caaugauucagc

SEQ ID NO: 1036280 - RNA, 16 nt, Homo sapiens
caaugcacgaucucag

SEQ ID NO: 1036281 - RNA, 20 nt, Homo sapiens
caaugcagccagaccuauuc

SEQ ID NO: 1036282 - RNA, 16 nt, Homo sapiens
caaugcauucugaggu

SEQ ID NO: 1036283 - RNA, 22 nt, Homo sapiens
caaugcuauaacuauguugaua

SEQ ID NO: 1036284 - RNA, 18 nt, Homo sapiens
caaugcugucugguugcg

SEQ ID NO: 1036285 - RNA, 16 nt, Homo sapiens
caauggcgugaucucg

SEQ ID NO: 1036286 - RNA, 16 nt, Homo sapiens
caaugggcacugggau

SEQ ID NO: 1036287 - RNA, 20 nt, Homo sapiens
caauguauugagcaugugau

SEQ ID NO: 1036288 - RNA, 18 nt, Homo sapiens
caaugucugccacacaaa

SEQ ID NO: 1036289 - RNA, 22 nt, Homo sapiens
caauuaaggauuuuaugcuuua

SEQ ID NO: 1036290 - RNA, 20 nt, Homo sapiens
caauuagacaagaacuugga

SEQ ID NO: 1036291 - RNA, 18 nt, Homo sapiens
caauuauugaaacaggau

SEQ ID NO: 1036292 - RNA, 22 nt, Homo sapiens
caauuauuuauuaaaugcccag

SEQ ID NO: 1036293 - RNA, 23 nt, Homo sapiens
caauucacuagaccagaagugga

SEQ ID NO: 1036294 - RNA, 22 nt, Homo sapiens
caauucauauauuugaagugga

SEQ ID NO: 1036295 - RNA, 12 nt, Homo sapiens
caauucaugaac

SEQ ID NO: 1036296 - RNA, 20 nt, Homo sapiens
caauuccaaaggaaucucca

SEQ ID NO: 1036297 - RNA, 20 nt, Homo sapiens
caauucuaacuuuuuugcua

SEQ ID NO: 1036298 - RNA, 20 nt, Homo sapiens
caauugacugucacuguucc

SEQ ID NO: 1036299 - RNA, 17 nt, Homo sapiens
caauugcuuugcacuuu

SEQ ID NO: 1036300 - RNA, 20 nt, Homo sapiens
caauuuucacacacgugaga

SEQ ID NO: 1036301 - RNA, 14 nt, Homo sapiens
caauuuuugaacaa

SEQ ID NO: 1036302 - RNA, 17 nt, Homo sapiens
caauuuuugguugaaua

SEQ ID NO: 1036303 - RNA, 18 nt, Homo sapiens
caauuuuuuaucaugcau

SEQ ID NO: 1036304 - RNA, 18 nt, Homo sapiens
cacaaaauaaccaauccu

SEQ ID NO: 1036305 - RNA, 16 nt, Homo sapiens
cacaaaaucuguccaa

SEQ ID NO: 1036306 - RNA, 22 nt, Homo sapiens
cacaaacucuugguuucuucaa

SEQ ID NO: 1036307 - RNA, 12 nt, Homo sapiens
cacaaagugaaa

SEQ ID NO: 1036308 - RNA, 14 nt, Homo sapiens
cacaaaugguagca

SEQ ID NO: 1036309 - RNA, 17 nt, Homo sapiens
cacaacauuacagggaa

SEQ ID NO: 1036310 - RNA, 17 nt, Homo sapiens
cacaacauuuacuuaac

SEQ ID NO: 1036311 - RNA, 16 nt, Homo sapiens
cacaaccacucauuca

SEQ ID NO: 1036312 - RNA, 20 nt, Homo sapiens
cacaagaagaccagacugug

SEQ ID NO: 1036313 - RNA, 17 nt, Homo sapiens
cacaagcuggaagcaca

SEQ ID NO: 1036314 - RNA, 21 nt, Homo sapiens
cacaaggcugaccaagagaga

SEQ ID NO: 1036315 - RNA, 15 nt, Homo sapiens
cacaaggggcuccac

SEQ ID NO: 1036316 - RNA, 17 nt, Homo sapiens
cacaaggugcaaaucaa

SEQ ID NO: 1036317 - RNA, 14 nt, Homo sapiens
cacaaguccuguga

SEQ ID NO: 1036318 - RNA, 15 nt, Homo sapiens
cacaaguccugugaa

SEQ ID NO: 1036319 - RNA, 13 nt, Homo sapiens
cacaauaugaaua

SEQ ID NO: 1036320 - RNA, 23 nt, Homo sapiens
cacaauccuguggaucugggcaa

SEQ ID NO: 1036321 - RNA, 14 nt, Homo sapiens
cacaauuugcagua

SEQ ID NO: 1036322 - RNA, 20 nt, Homo sapiens
cacaauuuuaauucaaaaga

SEQ ID NO: 1036323 - RNA, 14 nt, Homo sapiens
cacacacacacuca

SEQ ID NO: 1036324 - RNA, 20 nt, Homo sapiens
cagagacaggcccaagagau

SEQ ID NO: 1036325 - RNA, 23 nt, Homo sapiens
cagagaccagcccaccccugugc

SEQ ID NO: 1036326 - RNA, 13 nt, Homo sapiens
cagagacugggac

SEQ ID NO: 1036327 - RNA, 22 nt, Homo sapiens
cagagagggcaggcaugaaguu

SEQ ID NO: 1036328 - RNA, 12 nt, Homo sapiens
cagagcacagau

SEQ ID NO: 1036329 - RNA, 23 nt, Homo sapiens
cagagcaggaagcauucagagag

SEQ ID NO: 1036330 - RNA, 19 nt, Homo sapiens
cagagcccugggcaucaga

SEQ ID NO: 1036331 - RNA, 20 nt, Homo sapiens
cagagcgagacuccgucuca

SEQ ID NO: 1036332 - RNA, 20 nt, Homo sapiens
cagagcgagauuccgucuua

SEQ ID NO: 1036333 - RNA, 22 nt, Homo sapiens
cagagcgccccucccuagugac

SEQ ID NO: 1036334 - RNA, 19 nt, Homo sapiens
cagagcucuuuaccaagga

SEQ ID NO: 1036335 - RNA, 17 nt, Homo sapiens
cagagcugaagaacuug

SEQ ID NO: 1036336 - RNA, 17 nt, Homo sapiens
cagagcugacacaggau

SEQ ID NO: 1036337 - RNA, 16 nt, Homo sapiens
cagagcugagcccuca

SEQ ID NO: 1036338 - RNA, 22 nt, Homo sapiens
cagagcugccucucgguggcca

SEQ ID NO: 1036339 - RNA, 15 nt, Homo sapiens
cagagcuucccugac

SEQ ID NO: 1036340 - RNA, 22 nt, Homo sapiens
cagagcuuggacuggaugcaug

SEQ ID NO: 1036341 - RNA, 19 nt, Homo sapiens
cagaggaacuguccagaga

SEQ ID NO: 1036342 - RNA, 18 nt, Homo sapiens
cagaggaguacaggugaa

SEQ ID NO: 1036343 - RNA, 15 nt, Homo sapiens
cagaggccauggcag

SEQ ID NO: 1036344 - RNA, 20 nt, Homo sapiens
cagaggcucagcacuuugga

SEQ ID NO: 1036345 - RNA, 19 nt, Homo sapiens
cagaggcugcagaaggcca

SEQ ID NO: 1036346 - RNA, 17 nt, Homo sapiens
cagaggcuuaaucacac

SEQ ID NO: 1036347 - RNA, 20 nt, Homo sapiens
cagagggcguguuguuuuac

SEQ ID NO: 1036348 - RNA, 14 nt, Homo sapiens
cagaggggaaacca

SEQ ID NO: 1036349 - RNA, 22 nt, Homo sapiens
cagagggguaggcagagccuuu

SEQ ID NO: 1036350 - RNA, 16 nt, Homo sapiens
cagaggugaaagcuau

SEQ ID NO: 1036351 - RNA, 20 nt, Homo sapiens
cagaguaaauagcauucucu

SEQ ID NO: 1036352 - RNA, 16 nt, Homo sapiens
cagagucaaauuugaa

SEQ ID NO: 1036353 - RNA, 16 nt, Homo sapiens
cagagucaaugaacuu

SEQ ID NO: 1036354 - RNA, 19 nt, Homo sapiens
cagagucaggcuguugcgc

SEQ ID NO: 1036355 - RNA, 17 nt, Homo sapiens
cagagucucacucuguu

SEQ ID NO: 1036356 - RNA, 20 nt, Homo sapiens
cagagucucgcucuguugcc

SEQ ID NO: 1036357 - RNA, 21 nt, Homo sapiens
cagagucucgcucuguugccc

SEQ ID NO: 1036358 - RNA, 20 nt, Homo sapiens
cagagugagacucugucuca

SEQ ID NO: 1036359 - RNA, 11 nt, Homo sapiens
cagagugugaa

SEQ ID NO: 1036360 - RNA, 21 nt, Homo sapiens
cagaguucuauaauguaaaca

SEQ ID NO: 1036361 - RNA, 13 nt, Homo sapiens
cagaguugugcac

SEQ ID NO: 1036362 - RNA, 15 nt, Homo sapiens
cagaguuuccaaaac

SEQ ID NO: 1036363 - RNA, 15 nt, Homo sapiens
cagauaaacaacaaa

SEQ ID NO: 1036364 - RNA, 14 nt, Homo sapiens
cagauaacucuccu

SEQ ID NO: 1036365 - RNA, 13 nt, Homo sapiens
cagauacuccucc

SEQ ID NO: 1036366 - RNA, 14 nt, Homo sapiens
cagaucacuacugc

SEQ ID NO: 1036367 - RNA, 18 nt, Homo sapiens
cagaucacuacugcaguc

SEQ ID NO: 1036368 - RNA, 20 nt, Homo sapiens
cagaucagauucuucucuua

SEQ ID NO: 1036369 - RNA, 16 nt, Homo sapiens
cagaucugugccccau

SEQ ID NO: 1036370 - RNA, 14 nt, Homo sapiens
cagaugaaugggag

SEQ ID NO: 1036371 - RNA, 21 nt, Homo sapiens
cagaugacaaaaauucaacuc

SEQ ID NO: 1036372 - RNA, 14 nt, Homo sapiens
cagaugagaguaca

SEQ ID NO: 1036373 - RNA, 17 nt, Homo sapiens
cagaugagaguacaccc

SEQ ID NO: 1036374 - RNA, 20 nt, Homo sapiens
cagaugagaguacaccccaa

SEQ ID NO: 1036375 - RNA, 16 nt, Homo sapiens
cagaugcaaugacuca

SEQ ID NO: 1036376 - RNA, 14 nt, Homo sapiens
cagaugcaccagcc

SEQ ID NO: 1036377 - RNA, 21 nt, Homo sapiens
cagaugcugauguucagugua

SEQ ID NO: 1036378 - RNA, 20 nt, Homo sapiens
cagaugcuuuucugucucug

SEQ ID NO: 1036379 - RNA, 19 nt, Homo sapiens
cagauggaaacucuuuaac

SEQ ID NO: 1036380 - RNA, 21 nt, Homo sapiens
cagauggacuccagccugccu

SEQ ID NO: 1036381 - RNA, 14 nt, Homo sapiens
cagauggauugaua

SEQ ID NO: 1036382 - RNA, 17 nt, Homo sapiens
cagauggcacuuugaag

SEQ ID NO: 1036383 - RNA, 22 nt, Homo sapiens
cagaugucuucugccuguuaua

SEQ ID NO: 1036384 - RNA, 21 nt, Homo sapiens
cagauuacugcccaauaugca

SEQ ID NO: 1036385 - RNA, 23 nt, Homo sapiens
cagauuccaggcgaugugcaagu

SEQ ID NO: 1036386 - RNA, 17 nt, Homo sapiens
cagauugaacaagagcu

SEQ ID NO: 1036387 - RNA, 13 nt, Homo sapiens
cagauugcaugug

SEQ ID NO: 1036388 - RNA, 17 nt, Homo sapiens
cagcaacagcaaaucac

SEQ ID NO: 1036389 - RNA, 20 nt, Homo sapiens
cagcaacggggaggccaagu

SEQ ID NO: 1036390 - RNA, 18 nt, Homo sapiens
cagcaaugacaucucagg

SEQ ID NO: 1036391 - RNA, 15 nt, Homo sapiens
cagcacaguuuuuaa

SEQ ID NO: 1036392 - RNA, 11 nt, Homo sapiens
cagcacccaca

SEQ ID NO: 1036393 - RNA, 21 nt, Homo sapiens
cagcaccccugucucuagcca

SEQ ID NO: 1036394 - RNA, 15 nt, Homo sapiens
cagcacccucuccag

SEQ ID NO: 1036395 - RNA, 19 nt, Homo sapiens
cagcacccucuccagauga

SEQ ID NO: 1036396 - RNA, 15 nt, Homo sapiens
cagcacccugcaaaa

SEQ ID NO: 1036397 - RNA, 20 nt, Homo sapiens
cagcaccugcgggagcugca

SEQ ID NO: 1036398 - RNA, 23 nt, Homo sapiens
cagcacguguggccuguucuucu

SEQ ID NO: 1036399 - RNA, 10 nt, Homo sapiens
cagcacuaac

SEQ ID NO: 1036400 - RNA, 16 nt, Homo sapiens
cagcacuccucaucau

SEQ ID NO: 1036401 - RNA, 16 nt, Homo sapiens
cagcagcccuaaggau

SEQ ID NO: 1036402 - RNA, 18 nt, Homo sapiens
cagcaggccuuucgaucc

SEQ ID NO: 1036403 - RNA, 14 nt, Homo sapiens
cagcaggguggccu

SEQ ID NO: 1036404 - RNA, 15 nt, Homo sapiens
cagcaggugcucaau

SEQ ID NO: 1036405 - RNA, 14 nt, Homo sapiens
cagcaguggacuca

SEQ ID NO: 1036406 - RNA, 20 nt, Homo sapiens
cagcaucuagugguggaccg

SEQ ID NO: 1036407 - RNA, 18 nt, Homo sapiens
cagcaucuguccucauca

SEQ ID NO: 1036408 - RNA, 15 nt, Homo sapiens
cagcauggagucaca

SEQ ID NO: 1036409 - RNA, 15 nt, Homo sapiens
cagcauugcugguuc

SEQ ID NO: 1036410 - RNA, 20 nt, Homo sapiens
cagcauuuuacuacuuuaaa

SEQ ID NO: 1036411 - RNA, 17 nt, Homo sapiens
cagccaaaaaggacuuu

SEQ ID NO: 1036412 - RNA, 14 nt, Homo sapiens
cagccacaacugca

SEQ ID NO: 1036413 - RNA, 22 nt, Homo sapiens
cagccacacugugggacucuuc

SEQ ID NO: 1036414 - RNA, 16 nt, Homo sapiens
cagccagguucugacu

SEQ ID NO: 1036415 - RNA, 19 nt, Homo sapiens
cagccagugaccugaggaa

SEQ ID NO: 1036416 - RNA, 21 nt, Homo sapiens
cagccaugcauuguuaaucau

SEQ ID NO: 1036417 - RNA, 12 nt, Homo sapiens
cagccauguauu

SEQ ID NO: 1036418 - RNA, 16 nt, Homo sapiens
cagcccugacuggugc

SEQ ID NO: 1036419 - RNA, 19 nt, Homo sapiens
cagcccugaggugaaaggg

SEQ ID NO: 1036420 - RNA, 23 nt, Homo sapiens
cagccucacuugaaugugucacu

SEQ ID NO: 1036421 - RNA, 13 nt, Homo sapiens
cagccucaucucu

SEQ ID NO: 1036422 - RNA, 23 nt, Homo sapiens
cagccucccaaagugcugagauu

SEQ ID NO: 1036423 - RNA, 20 nt, Homo sapiens
cagccucccaaguagcugga

SEQ ID NO: 1036424 - RNA, 20 nt, Homo sapiens
cagccucccgaauagcuggg

SEQ ID NO: 1036425 - RNA, 14 nt, Homo sapiens
cagccuccugcuaa

SEQ ID NO: 1036426 - RNA, 14 nt, Homo sapiens
cagccucuagggac

SEQ ID NO: 1036427 - RNA, 22 nt, Homo sapiens
cagccucugggucugagucaug

SEQ ID NO: 1036428 - RNA, 17 nt, Homo sapiens
cagccugaccaacaugg

SEQ ID NO: 1036429 - RNA, 18 nt, Homo sapiens
cagccuggauguuuuuuc

SEQ ID NO: 1036430 - RNA, 14 nt, Homo sapiens
cagccuggcaaggg

SEQ ID NO: 1036431 - RNA, 22 nt, Homo sapiens
cagccuggcgaaaccccaucuc

SEQ ID NO: 1036432 - RNA, 20 nt, Homo sapiens
cagccugggcaacagagcaa

SEQ ID NO: 1036433 - RNA, 19 nt, Homo sapiens
cagccugggcagcauagca

SEQ ID NO: 1036434 - RNA, 19 nt, Homo sapiens
cagccugggugacagagca

SEQ ID NO: 1036435 - RNA, 18 nt, Homo sapiens
cagccugucccauggaca

SEQ ID NO: 1036436 - RNA, 17 nt, Homo sapiens
cagccugucucuuccau

SEQ ID NO: 1036437 - RNA, 19 nt, Homo sapiens
cagcgaaccaauauuugua

SEQ ID NO: 1036438 - RNA, 17 nt, Homo sapiens
cagcgaaugaaugcugu

SEQ ID NO: 1036439 - RNA, 18 nt, Homo sapiens
cagcgagacuccgucuca

SEQ ID NO: 1036440 - RNA, 21 nt, Homo sapiens
cagcgagcuaugaucgcgcca

SEQ ID NO: 1036441 - RNA, 14 nt, Homo sapiens
cagcgcggggagcc

SEQ ID NO: 1036442 - RNA, 23 nt, Homo sapiens
cagcggccacacuguacucugca

SEQ ID NO: 1036443 - RNA, 18 nt, Homo sapiens
cagcgggacucuucucau

SEQ ID NO: 1036444 - RNA, 15 nt, Homo sapiens
cagcgugcuuagccu

SEQ ID NO: 1036445 - RNA, 12 nt, Homo sapiens
cagcuaacacac

SEQ ID NO: 1036446 - RNA, 14 nt, Homo sapiens
cagcuaaugggaca

SEQ ID NO: 1036447 - RNA, 18 nt, Homo sapiens
cagcuaccucaaccaaug

SEQ ID NO: 1036448 - RNA, 11 nt, Homo sapiens
cagcucaaagg

SEQ ID NO: 1036449 - RNA, 14 nt, Homo sapiens
cagcucaaaggcac

SEQ ID NO: 1036450 - RNA, 14 nt, Homo sapiens
cagcucacacauga

SEQ ID NO: 1036451 - RNA, 19 nt, Homo sapiens
cagcucagggacuggcaca

SEQ ID NO: 1036452 - RNA, 12 nt, Homo sapiens
cagcucaucucu

SEQ ID NO: 1036453 - RNA, 20 nt, Homo sapiens
cagcucauuucacuuuacac

SEQ ID NO: 1036454 - RNA, 16 nt, Homo sapiens
cagcuccccuucugaa

SEQ ID NO: 1036455 - RNA, 19 nt, Homo sapiens
cagcuccccuucugaauca

SEQ ID NO: 1036456 - RNA, 20 nt, Homo sapiens
cagcuccucccuuguucucu

SEQ ID NO: 1036457 - RNA, 14 nt, Homo sapiens
cagcuccuguaaca

SEQ ID NO: 1036458 - RNA, 23 nt, Homo sapiens
cagcucuccccucagagugcaag

SEQ ID NO: 1036459 - RNA, 15 nt, Homo sapiens
cagcucugcaagaau

SEQ ID NO: 1036460 - RNA, 21 nt, Homo sapiens
cagcucugcauuaucugaggu

SEQ ID NO: 1036461 - RNA, 17 nt, Homo sapiens
cagcucugggagaggau

SEQ ID NO: 1036462 - RNA, 17 nt, Homo sapiens
cagcucuguccugggag

SEQ ID NO: 1036463 - RNA, 21 nt, Homo sapiens
cagcucuugcuaaucaguguc

SEQ ID NO: 1036464 - RNA, 14 nt, Homo sapiens
cagcugaacagcca

SEQ ID NO: 1036465 - RNA, 15 nt, Homo sapiens
cagcugaacagccaa

SEQ ID NO: 1036466 - RNA, 15 nt, Homo sapiens
cagcugauugggcac

SEQ ID NO: 1036467 - RNA, 14 nt, Homo sapiens
cagcugcaccugcc

SEQ ID NO: 1036468 - RNA, 22 nt, Homo sapiens
cauuguaaaacuaucugaacca

SEQ ID NO: 1036469 - RNA, 14 nt, Homo sapiens
cauuguaaucacug

SEQ ID NO: 1036470 - RNA, 22 nt, Homo sapiens
cauuguaugauguguugugaua

SEQ ID NO: 1036471 - RNA, 15 nt, Homo sapiens
cauugugaggguuaa

SEQ ID NO: 1036472 - RNA, 21 nt, Homo sapiens
cauuguggcuccuaucugugu

SEQ ID NO: 1036473 - RNA, 19 nt, Homo sapiens
cauuguucagaugcuucuu

SEQ ID NO: 1036474 - RNA, 19 nt, Homo sapiens
cauuguugagguggucuga

SEQ ID NO: 1036475 - RNA, 18 nt, Homo sapiens
cauuguuguucugcucaa

SEQ ID NO: 1036476 - RNA, 22 nt, Homo sapiens
cauuguuuagaaagaauauuca

SEQ ID NO: 1036477 - RNA, 22 nt, Homo sapiens
cauuuaagagacagucacccca

SEQ ID NO: 1036478 - RNA, 20 nt, Homo sapiens
cauuuaauacagcaguguca

SEQ ID NO: 1036479 - RNA, 14 nt, Homo sapiens
cauuuaauguauau

SEQ ID NO: 1036480 - RNA, 12 nt, Homo sapiens
cauuuacugugg

SEQ ID NO: 1036481 - RNA, 18 nt, Homo sapiens
cauuuacuguggcuucuu

SEQ ID NO: 1036482 - RNA, 13 nt, Homo sapiens
cauuuagaacuug

SEQ ID NO: 1036483 - RNA, 21 nt, Homo sapiens
cauuuagaacuugcagcugau

SEQ ID NO: 1036484 - RNA, 18 nt, Homo sapiens
cauuuauauagauuauaa

SEQ ID NO: 1036485 - RNA, 15 nt, Homo sapiens
cauuuauuauuucaa

SEQ ID NO: 1036486 - RNA, 17 nt, Homo sapiens
cauuuauuuuuauaucu

SEQ ID NO: 1036487 - RNA, 13 nt, Homo sapiens
cauuucaaaggga

SEQ ID NO: 1036488 - RNA, 17 nt, Homo sapiens
cauuucaauuccuguga

SEQ ID NO: 1036489 - RNA, 23 nt, Homo sapiens
cauuucagagaggccuuuuggaa

SEQ ID NO: 1036490 - RNA, 18 nt, Homo sapiens
cauuuccaacaccacaga

SEQ ID NO: 1036491 - RNA, 17 nt, Homo sapiens
cauuuccaugcauaaau

SEQ ID NO: 1036492 - RNA, 15 nt, Homo sapiens
cauuucgccccucau

SEQ ID NO: 1036493 - RNA, 14 nt, Homo sapiens
cauuucuacuguga

SEQ ID NO: 1036494 - RNA, 15 nt, Homo sapiens
cauuucuagcaguga

SEQ ID NO: 1036495 - RNA, 21 nt, Homo sapiens
cauuucuauuuauuuacugag

SEQ ID NO: 1036496 - RNA, 22 nt, Homo sapiens
cauuucucaaaugcacaucuca

SEQ ID NO: 1036497 - RNA, 20 nt, Homo sapiens
cauuucugagaucaaaacgg

SEQ ID NO: 1036498 - RNA, 22 nt, Homo sapiens
cauuucuggaaagugcaauuau

SEQ ID NO: 1036499 - RNA, 18 nt, Homo sapiens
cauuugagaaaugcauau

SEQ ID NO: 1036500 - RNA, 19 nt, Homo sapiens
cauuugaggggaaaacacc

SEQ ID NO: 1036501 - RNA, 16 nt, Homo sapiens
cauuugaguauuacaa

SEQ ID NO: 1036502 - RNA, 15 nt, Homo sapiens
cauuugcagugcauc

SEQ ID NO: 1036503 - RNA, 19 nt, Homo sapiens
cauuugcgaaugguuccau

SEQ ID NO: 1036504 - RNA, 14 nt, Homo sapiens
cauuugcuuugucc

SEQ ID NO: 1036505 - RNA, 14 nt, Homo sapiens
cauuugucaacaaa

SEQ ID NO: 1036506 - RNA, 12 nt, Homo sapiens
cauuugugucaa

SEQ ID NO: 1036507 - RNA, 21 nt, Homo sapiens
cauuuguuggaaugaauuaaa

SEQ ID NO: 1036508 - RNA, 15 nt, Homo sapiens
cauuuuaagaguuac

SEQ ID NO: 1036509 - RNA, 17 nt, Homo sapiens
cauuuuaugucauuaaa

SEQ ID NO: 1036510 - RNA, 14 nt, Homo sapiens
cauuuucaccccac

SEQ ID NO: 1036511 - RNA, 15 nt, Homo sapiens
cauuuucugcauuua

SEQ ID NO: 1036512 - RNA, 14 nt, Homo sapiens
cauuuucugccuau

SEQ ID NO: 1036513 - RNA, 14 nt, Homo sapiens
cauuuugcauucaa

SEQ ID NO: 1036514 - RNA, 12 nt, Homo sapiens
cauuuugccaaa

SEQ ID NO: 1036515 - RNA, 21 nt, Homo sapiens
cauuuuguugcuuuugugaac

SEQ ID NO: 1036516 - RNA, 21 nt, Homo sapiens
cauuuuuaguagagacagggu

SEQ ID NO: 1036517 - RNA, 13 nt, Homo sapiens
ccaaaaaccucac

SEQ ID NO: 1036518 - RNA, 17 nt, Homo sapiens
ccaaaaagaccagacua

SEQ ID NO: 1036519 - RNA, 18 nt, Homo sapiens
ccaaaacaaacaaacaga

SEQ ID NO: 1036520 - RNA, 18 nt, Homo sapiens
ccaaaaccacagcccugu

SEQ ID NO: 1036521 - RNA, 20 nt, Homo sapiens
ccaaaagcccauucauucca

SEQ ID NO: 1036522 - RNA, 16 nt, Homo sapiens
ccaaaagcugcucagg

SEQ ID NO: 1036523 - RNA, 17 nt, Homo sapiens
ccaaaauuaccaaaaau

SEQ ID NO: 1036524 - RNA, 18 nt, Homo sapiens
ccaaacacauacaggaag

SEQ ID NO: 1036525 - RNA, 19 nt, Homo sapiens
ccaaagaaauguaagggaa

SEQ ID NO: 1036526 - RNA, 23 nt, Homo sapiens
ccaaagagacuggagcaucugac

SEQ ID NO: 1036527 - RNA, 15 nt, Homo sapiens
ccaaagcagaaaaga

SEQ ID NO: 1036528 - RNA, 22 nt, Homo sapiens
ccaaagccaauaacacacagcu

SEQ ID NO: 1036529 - RNA, 11 nt, Homo sapiens
ccaaagggaua

SEQ ID NO: 1036530 - RNA, 20 nt, Homo sapiens
ccaaaguaaauguccugcua

SEQ ID NO: 1036531 - RNA, 18 nt, Homo sapiens
ccaaagugcugagauuau

SEQ ID NO: 1036532 - RNA, 15 nt, Homo sapiens
ccaaauaaauauauu

SEQ ID NO: 1036533 - RNA, 16 nt, Homo sapiens
ccaaauaagaagggau

SEQ ID NO: 1036534 - RNA, 20 nt, Homo sapiens
ccaaauuacguguacuacaa

SEQ ID NO: 1036535 - RNA, 14 nt, Homo sapiens
ccaaauugcagcuu

SEQ ID NO: 1036536 - RNA, 13 nt, Homo sapiens
ccaacagaugugu

SEQ ID NO: 1036537 - RNA, 12 nt, Homo sapiens
ccaacagcaccc

SEQ ID NO: 1036538 - RNA, 14 nt, Homo sapiens
ccaacagcacccuc

SEQ ID NO: 1036539 - RNA, 20 nt, Homo sapiens
ccaacaucaacaucuugguc

SEQ ID NO: 1036540 - RNA, 18 nt, Homo sapiens
ccaacaugugcucaggga

SEQ ID NO: 1036541 - RNA, 21 nt, Homo sapiens
ccaacauuaaaagccaccccc

SEQ ID NO: 1036542 - RNA, 22 nt, Homo sapiens
ccaaccuggaguauaauauuca

SEQ ID NO: 1036543 - RNA, 17 nt, Homo sapiens
ccaacguggcccagaga

SEQ ID NO: 1036544 - RNA, 19 nt, Homo sapiens
ccaacuaacguacauucaa

SEQ ID NO: 1036545 - RNA, 21 nt, Homo sapiens
ccaacuaaugccuuacucuuc

SEQ ID NO: 1036546 - RNA, 18 nt, Homo sapiens
ccaacuagacauucuguc

SEQ ID NO: 1036547 - RNA, 19 nt, Homo sapiens
ccaacuucauuugaugcua

SEQ ID NO: 1036548 - RNA, 21 nt, Homo sapiens
ccaagagcauaacuguucuca

SEQ ID NO: 1036549 - RNA, 22 nt, Homo sapiens
ccaagcaaccuggguccaaaua

SEQ ID NO: 1036550 - RNA, 18 nt, Homo sapiens
ccaagcacagugccugca

SEQ ID NO: 1036551 - RNA, 13 nt, Homo sapiens
ccaagccugacca

SEQ ID NO: 1036552 - RNA, 22 nt, Homo sapiens
ccaagcuccuugggaggcccca

SEQ ID NO: 1036553 - RNA, 15 nt, Homo sapiens
ccaaggaaaccacag

SEQ ID NO: 1036554 - RNA, 16 nt, Homo sapiens
ccaaggaaacuugaau

SEQ ID NO: 1036555 - RNA, 19 nt, Homo sapiens
ccaaggaggggcuguaaaa

SEQ ID NO: 1036556 - RNA, 18 nt, Homo sapiens
ccaaggauggaccacaca

SEQ ID NO: 1036557 - RNA, 21 nt, Homo sapiens
ccaagggcuucugcacccucc

SEQ ID NO: 1036558 - RNA, 18 nt, Homo sapiens
ccaaggguacuaaggaau

SEQ ID NO: 1036559 - RNA, 16 nt, Homo sapiens
ccaagugccagucuug

SEQ ID NO: 1036560 - RNA, 14 nt, Homo sapiens
ccaaguuccacugc

SEQ ID NO: 1036561 - RNA, 13 nt, Homo sapiens
ccaaguuccguca

SEQ ID NO: 1036562 - RNA, 21 nt, Homo sapiens
ccaaguucuuaguugcuguau

SEQ ID NO: 1036563 - RNA, 17 nt, Homo sapiens
ccaaguuguggugcuga

SEQ ID NO: 1036564 - RNA, 18 nt, Homo sapiens
ccaauagggcugagcucu

SEQ ID NO: 1036565 - RNA, 16 nt, Homo sapiens
ccaauauuuaccagac

SEQ ID NO: 1036566 - RNA, 21 nt, Homo sapiens
ccaauauuuaccagaccacaa

SEQ ID NO: 1036567 - RNA, 19 nt, Homo sapiens
ccaauauuucucagacauc

SEQ ID NO: 1036568 - RNA, 18 nt, Homo sapiens
ccaaucagaucaacucug

SEQ ID NO: 1036569 - RNA, 23 nt, Homo sapiens
ccaaugcauugcuaaaauauuau

SEQ ID NO: 1036570 - RNA, 22 nt, Homo sapiens
ccaaugcugucugguugcgcca

SEQ ID NO: 1036571 - RNA, 16 nt, Homo sapiens
ccaauuccuugcacau

SEQ ID NO: 1036572 - RNA, 22 nt, Homo sapiens
ccaauuuaaagaaaacuguuaa

SEQ ID NO: 1036573 - RNA, 14 nt, Homo sapiens
ccacaaaaguacaa

SEQ ID NO: 1036574 - RNA, 15 nt, Homo sapiens
ccacaaaaguacaau

SEQ ID NO: 1036575 - RNA, 18 nt, Homo sapiens
ccacaaccgaccagaugc

SEQ ID NO: 1036576 - RNA, 19 nt, Homo sapiens
ccacaaggcuguugcaugg

SEQ ID NO: 1036577 - RNA, 19 nt, Homo sapiens
ccacaaucugacauucuca

SEQ ID NO: 1036578 - RNA, 14 nt, Homo sapiens
ccacacacagagga

SEQ ID NO: 1036579 - RNA, 14 nt, Homo sapiens
ccacaccaagcagc

SEQ ID NO: 1036580 - RNA, 10 nt, Homo sapiens
ccacaccaga

SEQ ID NO: 1036581 - RNA, 16 nt, Homo sapiens
ccacacccucacugcu

SEQ ID NO: 1036582 - RNA, 16 nt, Homo sapiens
ccacacggaggcaucu

SEQ ID NO: 1036583 - RNA, 15 nt, Homo sapiens
ccacacuguacucug

SEQ ID NO: 1036584 - RNA, 23 nt, Homo sapiens
ccacagcaguugaaaagacucca

SEQ ID NO: 1036585 - RNA, 11 nt, Homo sapiens
ccacagccauc

SEQ ID NO: 1036586 - RNA, 19 nt, Homo sapiens
ccacaggcauuuccugcuu

SEQ ID NO: 1036587 - RNA, 17 nt, Homo sapiens
ccacaggcucugaccag

SEQ ID NO: 1036588 - RNA, 18 nt, Homo sapiens
ccacagggcagggccuca

SEQ ID NO: 1036589 - RNA, 21 nt, Homo sapiens
ccacaguggaaagacagcuuc

SEQ ID NO: 1036590 - RNA, 14 nt, Homo sapiens
ccacaguggcuuca

SEQ ID NO: 1036591 - RNA, 14 nt, Homo sapiens
ccacaguuuccuca

SEQ ID NO: 1036592 - RNA, 14 nt, Homo sapiens
ccacauaccuggcc

SEQ ID NO: 1036593 - RNA, 21 nt, Homo sapiens
ccacauccuccacguucugcu

SEQ ID NO: 1036594 - RNA, 20 nt, Homo sapiens
ccacaugugacacauaugca

SEQ ID NO: 1036595 - RNA, 14 nt, Homo sapiens
ccacaugugcacau

SEQ ID NO: 1036596 - RNA, 19 nt, Homo sapiens
ccacauuauacauuugaug

SEQ ID NO: 1036597 - RNA, 17 nt, Homo sapiens
ccacauuccugaugcuu

SEQ ID NO: 1036598 - RNA, 20 nt, Homo sapiens
ccaccaacagcccucagguc

SEQ ID NO: 1036599 - RNA, 15 nt, Homo sapiens
ccaccaacauacucc

SEQ ID NO: 1036600 - RNA, 19 nt, Homo sapiens
ccaccacauuuagaacuuu

SEQ ID NO: 1036601 - RNA, 15 nt, Homo sapiens
ccaccaccacuggcc

SEQ ID NO: 1036602 - RNA, 14 nt, Homo sapiens
ccaccacggccacu

SEQ ID NO: 1036603 - RNA, 19 nt, Homo sapiens
ccaccacugauauccuccu

SEQ ID NO: 1036604 - RNA, 13 nt, Homo sapiens
ccaccaggcaccu

SEQ ID NO: 1036605 - RNA, 15 nt, Homo sapiens
ccaccaucaccagac

SEQ ID NO: 1036606 - RNA, 18 nt, Homo sapiens
ccacccaguccugcacac

SEQ ID NO: 1036607 - RNA, 13 nt, Homo sapiens
ccaccccagcuca

SEQ ID NO: 1036608 - RNA, 14 nt, Homo sapiens
ccacccccagcuca

SEQ ID NO: 1036609 - RNA, 19 nt, Homo sapiens
ccacccgugggaaugcugc

SEQ ID NO: 1036610 - RNA, 24 nt, Homo sapiens
ccacccucaugcugugugacucaa

SEQ ID NO: 1036611 - RNA, 18 nt, Homo sapiens
ccacccucccacugccaa

SEQ ID NO: 1036612 - RNA, 22 nt, Homo sapiens
ccaccgaaguggacuggccccu

SEQ ID NO: 1036613 - RNA, 13 nt, Homo sapiens
ccucaggugaucc

SEQ ID NO: 1036614 - RNA, 20 nt, Homo sapiens
ccucagguggccccaguuca

SEQ ID NO: 1036615 - RNA, 17 nt, Homo sapiens
ccucaguuuuaucauuu

SEQ ID NO: 1036616 - RNA, 20 nt, Homo sapiens
ccucaguuuuaucauuuuca

SEQ ID NO: 1036617 - RNA, 14 nt, Homo sapiens
ccucauccauagca

SEQ ID NO: 1036618 - RNA, 20 nt, Homo sapiens
ccucaugauaugucagggcg

SEQ ID NO: 1036619 - RNA, 13 nt, Homo sapiens
ccucauuagcauu

SEQ ID NO: 1036620 - RNA, 20 nt, Homo sapiens
ccucauuagcauuuugcuaa

SEQ ID NO: 1036621 - RNA, 17 nt, Homo sapiens
ccucauuuaucccucaa

SEQ ID NO: 1036622 - RNA, 16 nt, Homo sapiens
ccuccaaaugccaacu

SEQ ID NO: 1036623 - RNA, 17 nt, Homo sapiens
ccuccacgccggcucuu

SEQ ID NO: 1036624 - RNA, 13 nt, Homo sapiens
ccuccacugcugc

SEQ ID NO: 1036625 - RNA, 22 nt, Homo sapiens
ccuccagcuucaggcaggccaa

SEQ ID NO: 1036626 - RNA, 23 nt, Homo sapiens
ccuccaggugugcacguggcaug

SEQ ID NO: 1036627 - RNA, 15 nt, Homo sapiens
ccuccauucugacca

SEQ ID NO: 1036628 - RNA, 20 nt, Homo sapiens
ccucccaaagugcugagauu

SEQ ID NO: 1036629 - RNA, 16 nt, Homo sapiens
ccucccaaguagcuag

SEQ ID NO: 1036630 - RNA, 17 nt, Homo sapiens
ccuccccaccaccaauu

SEQ ID NO: 1036631 - RNA, 13 nt, Homo sapiens
ccuccccauguga

SEQ ID NO: 1036632 - RNA, 21 nt, Homo sapiens
ccucccuagccagcacuugua

SEQ ID NO: 1036633 - RNA, 22 nt, Homo sapiens
ccucccucucucuucugcucca

SEQ ID NO: 1036634 - RNA, 15 nt, Homo sapiens
ccucccuggucccuu

SEQ ID NO: 1036635 - RNA, 17 nt, Homo sapiens
ccucccuuggguucuga

SEQ ID NO: 1036636 - RNA, 15 nt, Homo sapiens
ccuccgccauucuca

SEQ ID NO: 1036637 - RNA, 14 nt, Homo sapiens
ccuccucaaaccua

SEQ ID NO: 1036638 - RNA, 23 nt, Homo sapiens
ccuccuccagccgccaugcuccu

SEQ ID NO: 1036639 - RNA, 21 nt, Homo sapiens
ccuccugaguagcugggacca

SEQ ID NO: 1036640 - RNA, 20 nt, Homo sapiens
ccuccuuuucuuucucucuc

SEQ ID NO: 1036641 - RNA, 20 nt, Homo sapiens
ccucgaaaaccaucacauga

SEQ ID NO: 1036642 - RNA, 23 nt, Homo sapiens
ccucgacacgcaacuggcucaaa

SEQ ID NO: 1036643 - RNA, 18 nt, Homo sapiens
ccucgaggcggaucuuug

SEQ ID NO: 1036644 - RNA, 21 nt, Homo sapiens
ccucgggcgagucacugccuc

SEQ ID NO: 1036645 - RNA, 15 nt, Homo sapiens
ccucuacaauuugcc

SEQ ID NO: 1036646 - RNA, 18 nt, Homo sapiens
ccucuacuuaaugagaua

SEQ ID NO: 1036647 - RNA, 14 nt, Homo sapiens
ccucuagaggcaag

SEQ ID NO: 1036648 - RNA, 16 nt, Homo sapiens
ccucucagagcuacuu

SEQ ID NO: 1036649 - RNA, 21 nt, Homo sapiens
ccucuccagaugagaguacac

SEQ ID NO: 1036650 - RNA, 13 nt, Homo sapiens
ccucuccagcuau

SEQ ID NO: 1036651 - RNA, 20 nt, Homo sapiens
ccucuccaggaaugccuccu

SEQ ID NO: 1036652 - RNA, 16 nt, Homo sapiens
ccucucccauccagug

SEQ ID NO: 1036653 - RNA, 19 nt, Homo sapiens
ccucucucccuggaccuca

SEQ ID NO: 1036654 - RNA, 16 nt, Homo sapiens
ccucucuuauagaaua

SEQ ID NO: 1036655 - RNA, 19 nt, Homo sapiens
ccucugaagccuucuuugu

SEQ ID NO: 1036656 - RNA, 17 nt, Homo sapiens
ccucugaccugcacugg

SEQ ID NO: 1036657 - RNA, 20 nt, Homo sapiens
ccucugacugaugcuuucag

SEQ ID NO: 1036658 - RNA, 20 nt, Homo sapiens
ccucugagcuuugcauguuc

SEQ ID NO: 1036659 - RNA, 22 nt, Homo sapiens
ccucugagggaaagcccagaaa

SEQ ID NO: 1036660 - RNA, 23 nt, Homo sapiens
ccucugcaaaggaaauaccaguu

SEQ ID NO: 1036661 - RNA, 16 nt, Homo sapiens
ccucugcuacuagcca

SEQ ID NO: 1036662 - RNA, 13 nt, Homo sapiens
ccucugcucugag

SEQ ID NO: 1036663 - RNA, 15 nt, Homo sapiens
ccucuggacacagcc

SEQ ID NO: 1036664 - RNA, 18 nt, Homo sapiens
ccucugggcacugguaau

SEQ ID NO: 1036665 - RNA, 18 nt, Homo sapiens
ccucuguccaggcacuga

SEQ ID NO: 1036666 - RNA, 11 nt, Homo sapiens
ccucuguggac

SEQ ID NO: 1036667 - RNA, 14 nt, Homo sapiens
ccucuuauugcaaa

SEQ ID NO: 1036668 - RNA, 18 nt, Homo sapiens
ccucuuccccuugcccuu

SEQ ID NO: 1036669 - RNA, 21 nt, Homo sapiens
ccucuuccgugacgucacugg

SEQ ID NO: 1036670 - RNA, 21 nt, Homo sapiens
ccucuucucuacucuagggaa

SEQ ID NO: 1036671 - RNA, 19 nt, Homo sapiens
ccucuugccuccuggaaaa

SEQ ID NO: 1036672 - RNA, 18 nt, Homo sapiens
ccucuuugucuaaaacaa

SEQ ID NO: 1036673 - RNA, 15 nt, Homo sapiens
ccucuuuucucugug

SEQ ID NO: 1036674 - RNA, 16 nt, Homo sapiens
ccugaaccuuccaucu

SEQ ID NO: 1036675 - RNA, 21 nt, Homo sapiens
ccugaagaacaguaacugcca

SEQ ID NO: 1036676 - RNA, 18 nt, Homo sapiens
ccugacagcuuuaucucc

SEQ ID NO: 1036677 - RNA, 14 nt, Homo sapiens
ccugacaugcacac

SEQ ID NO: 1036678 - RNA, 14 nt, Homo sapiens
ccugaccacccucc

SEQ ID NO: 1036679 - RNA, 14 nt, Homo sapiens
ccugaccugucuca

SEQ ID NO: 1036680 - RNA, 20 nt, Homo sapiens
ccugacuccucuaagccacu

SEQ ID NO: 1036681 - RNA, 17 nt, Homo sapiens
ccugacucgucugacug

SEQ ID NO: 1036682 - RNA, 15 nt, Homo sapiens
ccugagacaaaugga

SEQ ID NO: 1036683 - RNA, 21 nt, Homo sapiens
ccugaggugaaagggagcuau

SEQ ID NO: 1036684 - RNA, 19 nt, Homo sapiens
ccugaguuugggauugugg

SEQ ID NO: 1036685 - RNA, 21 nt, Homo sapiens
ccugaucagagccgugguccu

SEQ ID NO: 1036686 - RNA, 20 nt, Homo sapiens
ccugauccaaguuuacucaa

SEQ ID NO: 1036687 - RNA, 16 nt, Homo sapiens
ccugaugcagagccuu

SEQ ID NO: 1036688 - RNA, 12 nt, Homo sapiens
ccugauguuaaa

SEQ ID NO: 1036689 - RNA, 15 nt, Homo sapiens
ccugauuauuuucua

SEQ ID NO: 1036690 - RNA, 23 nt, Homo sapiens
ccugcaccgagagagauggaaua

SEQ ID NO: 1036691 - RNA, 13 nt, Homo sapiens
ccugcacuacucu

SEQ ID NO: 1036692 - RNA, 19 nt, Homo sapiens
ccugcaggccaagagcaga

SEQ ID NO: 1036693 - RNA, 13 nt, Homo sapiens
ccugcaggugcug

SEQ ID NO: 1036694 - RNA, 16 nt, Homo sapiens
ccugcagucuggcuga

SEQ ID NO: 1036695 - RNA, 16 nt, Homo sapiens
ccugcccagugcacac

SEQ ID NO: 1036696 - RNA, 23 nt, Homo sapiens
ccugcccuacagaggucucugcc

SEQ ID NO: 1036697 - RNA, 14 nt, Homo sapiens
ccugcccuagcucc

SEQ ID NO: 1036698 - RNA, 22 nt, Homo sapiens
ccugcccuccccagagcacugg

SEQ ID NO: 1036699 - RNA, 21 nt, Homo sapiens
ccugcccugacaugcacaccu

SEQ ID NO: 1036700 - RNA, 20 nt, Homo sapiens
ccugcccugggauguccaca

SEQ ID NO: 1036701 - RNA, 21 nt, Homo sapiens
ccugcggcugcugugugccuu

SEQ ID NO: 1036702 - RNA, 16 nt, Homo sapiens
ccugcggugcuaucuc

SEQ ID NO: 1036703 - RNA, 13 nt, Homo sapiens
ccugcuaaggagu

SEQ ID NO: 1036704 - RNA, 13 nt, Homo sapiens
ccugcuccagaag

SEQ ID NO: 1036705 - RNA, 21 nt, Homo sapiens
ccugcucuucuaccauuugaa

SEQ ID NO: 1036706 - RNA, 17 nt, Homo sapiens
ccugcuguguuccccaa

SEQ ID NO: 1036707 - RNA, 16 nt, Homo sapiens
ccugcuugcacuuugu

SEQ ID NO: 1036708 - RNA, 23 nt, Homo sapiens
ccugcuuggguggagaagccauu

SEQ ID NO: 1036709 - RNA, 15 nt, Homo sapiens
ccugcuuuucacugc

SEQ ID NO: 1036710 - RNA, 22 nt, Homo sapiens
ccugcuuuucacugcugcaagg

SEQ ID NO: 1036711 - RNA, 20 nt, Homo sapiens
ccuggaacaucaucaaggca

SEQ ID NO: 1036712 - RNA, 15 nt, Homo sapiens
ccuggaagagggcaa

SEQ ID NO: 1036713 - RNA, 14 nt, Homo sapiens
ccuggacacuguac

SEQ ID NO: 1036714 - RNA, 20 nt, Homo sapiens
ccuggacaguuuucugcuuu

SEQ ID NO: 1036715 - RNA, 12 nt, Homo sapiens
ccuggaccucag

SEQ ID NO: 1036716 - RNA, 22 nt, Homo sapiens
ccuggacuagagggaccucucc

SEQ ID NO: 1036717 - RNA, 21 nt, Homo sapiens
ccuggaguaacacaaagugaa

SEQ ID NO: 1036718 - RNA, 16 nt, Homo sapiens
ccuggaguccuugacc

SEQ ID NO: 1036719 - RNA, 21 nt, Homo sapiens
ccuggaugaucacuaauacua

SEQ ID NO: 1036720 - RNA, 19 nt, Homo sapiens
ccuggaugucugggugacc

SEQ ID NO: 1036721 - RNA, 21 nt, Homo sapiens
ccuggauuuccugcugccauc

SEQ ID NO: 1036722 - RNA, 22 nt, Homo sapiens
ccuggcaaggacacagaugaaa

SEQ ID NO: 1036723 - RNA, 15 nt, Homo sapiens
ccuggcacacaucag

SEQ ID NO: 1036724 - RNA, 19 nt, Homo sapiens
ccuggcagaacugagcucc

SEQ ID NO: 1036725 - RNA, 20 nt, Homo sapiens
ccuggccaacaugaugaaac

SEQ ID NO: 1036726 - RNA, 17 nt, Homo sapiens
ccuggcucugcaauggg

SEQ ID NO: 1036727 - RNA, 22 nt, Homo sapiens
ccuggcugagagaggaagagcu

SEQ ID NO: 1036728 - RNA, 13 nt, Homo sapiens
ccugggaccacag

SEQ ID NO: 1036729 - RNA, 19 nt, Homo sapiens
ccugggaguuuuguauuca

SEQ ID NO: 1036730 - RNA, 14 nt, Homo sapiens
ccugggcaaagccu

SEQ ID NO: 1036731 - RNA, 17 nt, Homo sapiens
ccugggcaauuccgcau

SEQ ID NO: 1036732 - RNA, 19 nt, Homo sapiens
ccuggggagucugggcaca

SEQ ID NO: 1036733 - RNA, 14 nt, Homo sapiens
ccuggggcuucuga

SEQ ID NO: 1036734 - RNA, 22 nt, Homo sapiens
ccugggugacagagcaagugag

SEQ ID NO: 1036735 - RNA, 13 nt, Homo sapiens
ccugggugggugg

SEQ ID NO: 1036736 - RNA, 18 nt, Homo sapiens
ccugguaccuagcaaagc

SEQ ID NO: 1036737 - RNA, 16 nt, Homo sapiens
ccugguauauccaaaa

SEQ ID NO: 1036738 - RNA, 21 nt, Homo sapiens
ccugguuaaauuugaauuuca

SEQ ID NO: 1036739 - RNA, 13 nt, Homo sapiens
ccuguaacacaag

SEQ ID NO: 1036740 - RNA, 18 nt, Homo sapiens
ccuguaagucaaaugugu

SEQ ID NO: 1036741 - RNA, 23 nt, Homo sapiens
ccuguaauuccagcacuuuggga

SEQ ID NO: 1036742 - RNA, 20 nt, Homo sapiens
ccugucaagguuuguguuac

SEQ ID NO: 1036743 - RNA, 19 nt, Homo sapiens
ccugucccauggacacucc

SEQ ID NO: 1036744 - RNA, 20 nt, Homo sapiens
ccugucgucccagcuacuca

SEQ ID NO: 1036745 - RNA, 16 nt, Homo sapiens
ccugucuaacugcugu

SEQ ID NO: 1036746 - RNA, 21 nt, Homo sapiens
ccugucucuacuaaaaauaca

SEQ ID NO: 1036747 - RNA, 17 nt, Homo sapiens
ccugucucuagccacuu

SEQ ID NO: 1036748 - RNA, 21 nt, Homo sapiens
ccugugaaguccuucaccuca

SEQ ID NO: 1036749 - RNA, 21 nt, Homo sapiens
ccugugaggcagccuucugau

SEQ ID NO: 1036750 - RNA, 18 nt, Homo sapiens
ccugugcaacuuucccaa

SEQ ID NO: 1036751 - RNA, 15 nt, Homo sapiens
ccugugccuuuugcc

SEQ ID NO: 1036752 - RNA, 18 nt, Homo sapiens
ccuguguauucauucuca

SEQ ID NO: 1036753 - RNA, 17 nt, Homo sapiens
ccuguguauucuaguga

SEQ ID NO: 1036754 - RNA, 13 nt, Homo sapiens
ccuguguugacac

SEQ ID NO: 1036755 - RNA, 20 nt, Homo sapiens
ccuguucuuggguaaggaaa

SEQ ID NO: 1036756 - RNA, 15 nt, Homo sapiens
ccuguugcacccagc

SEQ ID NO: 1036757 - RNA, 21 nt, Homo sapiens
cuuuccugucugcacaaguga

SEQ ID NO: 1036758 - RNA, 14 nt, Homo sapiens
cuuucuacccagcg

SEQ ID NO: 1036759 - RNA, 17 nt, Homo sapiens
cuuucucgauugguguc

SEQ ID NO: 1036760 - RNA, 18 nt, Homo sapiens
cuuucugaaauuagggcc

SEQ ID NO: 1036761 - RNA, 15 nt, Homo sapiens
cuuucuggaaaagag

SEQ ID NO: 1036762 - RNA, 15 nt, Homo sapiens
cuuucugggccaagu

SEQ ID NO: 1036763 - RNA, 20 nt, Homo sapiens
cuuucuucccuacaguugaa

SEQ ID NO: 1036764 - RNA, 20 nt, Homo sapiens
cuuugaagcuagugcauugg

SEQ ID NO: 1036765 - RNA, 15 nt, Homo sapiens
cuuugaagucugauu

SEQ ID NO: 1036766 - RNA, 18 nt, Homo sapiens
cuuugaaugcggcccaac

SEQ ID NO: 1036767 - RNA, 13 nt, Homo sapiens
cuuugaauguggc

SEQ ID NO: 1036768 - RNA, 17 nt, Homo sapiens
cuuugagacugggucuc

SEQ ID NO: 1036769 - RNA, 22 nt, Homo sapiens
cuuugagauagaagaacugcaa

SEQ ID NO: 1036770 - RNA, 17 nt, Homo sapiens
cuuugaucuucagggaa

SEQ ID NO: 1036771 - RNA, 23 nt, Homo sapiens
cuuugaugguaaccauaauggaa

SEQ ID NO: 1036772 - RNA, 19 nt, Homo sapiens
cuuugcacgaacaccaagu

SEQ ID NO: 1036773 - RNA, 19 nt, Homo sapiens
cuuugccacacacaguuac

SEQ ID NO: 1036774 - RNA, 18 nt, Homo sapiens
cuuugcuaacugugcucc

SEQ ID NO: 1036775 - RNA, 13 nt, Homo sapiens
cuuugcuugccuc

SEQ ID NO: 1036776 - RNA, 21 nt, Homo sapiens
cuuuggaaacaauaugcaaug

SEQ ID NO: 1036777 - RNA, 20 nt, Homo sapiens
cuuuggaaacaggaccacaa

SEQ ID NO: 1036778 - RNA, 15 nt, Homo sapiens
cuuuggaaaucacac

SEQ ID NO: 1036779 - RNA, 13 nt, Homo sapiens
cuuuggacacuca

SEQ ID NO: 1036780 - RNA, 17 nt, Homo sapiens
cuuuggagaucaaggag

SEQ ID NO: 1036781 - RNA, 21 nt, Homo sapiens
cuuuggagcagcuucugggac

SEQ ID NO: 1036782 - RNA, 23 nt, Homo sapiens
cuuuggauugacucugcauuuga

SEQ ID NO: 1036783 - RNA, 18 nt, Homo sapiens
cuuuggcaaucagugcuc

SEQ ID NO: 1036784 - RNA, 15 nt, Homo sapiens
cuuuggccauuccaa

SEQ ID NO: 1036785 - RNA, 18 nt, Homo sapiens
cuuugggauucuuuccau

SEQ ID NO: 1036786 - RNA, 23 nt, Homo sapiens
cuuuggguuaaauuaaaagcccu

SEQ ID NO: 1036787 - RNA, 14 nt, Homo sapiens
cuuugguaaucucu

SEQ ID NO: 1036788 - RNA, 21 nt, Homo sapiens
cuuugguaaucucugugaaau

SEQ ID NO: 1036789 - RNA, 15 nt, Homo sapiens
cuuugucagcaauac

SEQ ID NO: 1036790 - RNA, 13 nt, Homo sapiens
cuuuguguagaaa

SEQ ID NO: 1036791 - RNA, 18 nt, Homo sapiens
cuuuguguagaaagccaa

SEQ ID NO: 1036792 - RNA, 20 nt, Homo sapiens
cuuuguguagaaagccaaau

SEQ ID NO: 1036793 - RNA, 21 nt, Homo sapiens
cuuuguguagaaagccaaaua

SEQ ID NO: 1036794 - RNA, 16 nt, Homo sapiens
cuuuguuaucuuccac

SEQ ID NO: 1036795 - RNA, 16 nt, Homo sapiens
cuuuuaaaauacauuu

SEQ ID NO: 1036796 - RNA, 16 nt, Homo sapiens
cuuuuaaaugcauaaa

SEQ ID NO: 1036797 - RNA, 15 nt, Homo sapiens
cuuuuaaggcuaaaa

SEQ ID NO: 1036798 - RNA, 22 nt, Homo sapiens
cuuuuaauguauuuguuugcaa

SEQ ID NO: 1036799 - RNA, 14 nt, Homo sapiens
cuuuuacaccaguu

SEQ ID NO: 1036800 - RNA, 15 nt, Homo sapiens
cuuuuauuacugggg

SEQ ID NO: 1036801 - RNA, 16 nt, Homo sapiens
cuuuuauugugaauua

SEQ ID NO: 1036802 - RNA, 19 nt, Homo sapiens
cuuuucaauguuagccaca

SEQ ID NO: 1036803 - RNA, 13 nt, Homo sapiens
cuuuucacaaaua

SEQ ID NO: 1036804 - RNA, 13 nt, Homo sapiens
cuuuuccauuuga

SEQ ID NO: 1036805 - RNA, 15 nt, Homo sapiens
cuuuucuaaagccuu

SEQ ID NO: 1036806 - RNA, 13 nt, Homo sapiens
cuuuugaaaaaca

SEQ ID NO: 1036807 - RNA, 17 nt, Homo sapiens
cuuuugacaaaggcaag

SEQ ID NO: 1036808 - RNA, 21 nt, Homo sapiens
cuuuugagcaacuuucuuaca

SEQ ID NO: 1036809 - RNA, 21 nt, Homo sapiens
cuuuugcauaagugcaugaca

SEQ ID NO: 1036810 - RNA, 22 nt, Homo sapiens
cuuuuggcuuguaaaguacaga

SEQ ID NO: 1036811 - RNA, 11 nt, Homo sapiens
cuuuugugcau

SEQ ID NO: 1036812 - RNA, 22 nt, Homo sapiens
cuuuugugcuccccuuugccua

SEQ ID NO: 1036813 - RNA, 23 nt, Homo sapiens
cuuuuuaaaguguuucuguuauu

SEQ ID NO: 1036814 - RNA, 15 nt, Homo sapiens
cuuuuuauacuauua

SEQ ID NO: 1036815 - RNA, 13 nt, Homo sapiens
cuuuuuaugcauu

SEQ ID NO: 1036816 - RNA, 13 nt, Homo sapiens
cuuuuucauucuu

SEQ ID NO: 1036817 - RNA, 13 nt, Homo sapiens
cuuuuucuuugaa

SEQ ID NO: 1036818 - RNA, 22 nt, Homo sapiens
cuuuuugaaaucagcauacuca

SEQ ID NO: 1036819 - RNA, 17 nt, Homo sapiens
cuuuuugguuugcagau

SEQ ID NO: 1036820 - RNA, 21 nt, Homo sapiens
cuuuuuuggcugcugaaggcu

SEQ ID NO: 1036821 - RNA, 18 nt, Homo sapiens
cuuuuuuuuaaguuacac

SEQ ID NO: 1036822 - RNA, 21 nt, Homo sapiens
cuuuuuuuuuuuuuccuuuga

SEQ ID NO: 1036823 - RNA, 20 nt, Homo sapiens
gaaaaaaaaaaaaaagccuu

SEQ ID NO: 1036824 - RNA, 17 nt, Homo sapiens
gaaaaaaacuucuuuaa

SEQ ID NO: 1036825 - RNA, 15 nt, Homo sapiens
gaaaaacuuccauga

SEQ ID NO: 1036826 - RNA, 20 nt, Homo sapiens
gaaaaagaccuaugagcaca

SEQ ID NO: 1036827 - RNA, 16 nt, Homo sapiens
gaaaaauaagucacuu

SEQ ID NO: 1036828 - RNA, 23 nt, Homo sapiens
gaaaacaauuguaauaaugcuaa

SEQ ID NO: 1036829 - RNA, 14 nt, Homo sapiens
gaaaacacugugca

SEQ ID NO: 1036830 - RNA, 19 nt, Homo sapiens
gaaaacacugugcacaucu

SEQ ID NO: 1036831 - RNA, 12 nt, Homo sapiens
gaaaacacuguu

SEQ ID NO: 1036832 - RNA, 17 nt, Homo sapiens
gaaaacaguauuuucca

SEQ ID NO: 1036833 - RNA, 21 nt, Homo sapiens
gaaaagcugaauccagaucau

SEQ ID NO: 1036834 - RNA, 20 nt, Homo sapiens
gaaaagcugcugacaguguu

SEQ ID NO: 1036835 - RNA, 16 nt, Homo sapiens
gaaaaggaagacuaga

SEQ ID NO: 1036836 - RNA, 14 nt, Homo sapiens
gaaaaggauaugca

SEQ ID NO: 1036837 - RNA, 17 nt, Homo sapiens
gaaaagggaacugaaca

SEQ ID NO: 1036838 - RNA, 16 nt, Homo sapiens
gaaaaguguaauagca

SEQ ID NO: 1036839 - RNA, 22 nt, Homo sapiens
gaaaaguuucaaaccuacuaau

SEQ ID NO: 1036840 - RNA, 17 nt, Homo sapiens
gaaaauaauuguuccaa

SEQ ID NO: 1036841 - RNA, 17 nt, Homo sapiens
gaaaauaugauguuuca

SEQ ID NO: 1036842 - RNA, 15 nt, Homo sapiens
gaaaauccaucucau

SEQ ID NO: 1036843 - RNA, 20 nt, Homo sapiens
gaaaaucuacacuccaguga

SEQ ID NO: 1036844 - RNA, 19 nt, Homo sapiens
gaaaaucugcacugugggc

SEQ ID NO: 1036845 - RNA, 17 nt, Homo sapiens
gaaaaugaaucuucaca

SEQ ID NO: 1036846 - RNA, 11 nt, Homo sapiens
gaaaaugucag

SEQ ID NO: 1036847 - RNA, 14 nt, Homo sapiens
gaaaauuauaucuc

SEQ ID NO: 1036848 - RNA, 20 nt, Homo sapiens
gaaaauucaaaaaguguuua

SEQ ID NO: 1036849 - RNA, 23 nt, Homo sapiens
gaaacaccuucucuggagccaag

SEQ ID NO: 1036850 - RNA, 19 nt, Homo sapiens
gaaacacuaaagcauucaa

SEQ ID NO: 1036851 - RNA, 20 nt, Homo sapiens
gaaacacuuugguauucuuu

SEQ ID NO: 1036852 - RNA, 15 nt, Homo sapiens
gaaacagcgcugggu

SEQ ID NO: 1036853 - RNA, 17 nt, Homo sapiens
gaaacagcugcccugug

SEQ ID NO: 1036854 - RNA, 17 nt, Homo sapiens
gaaacaguuaauaccau

SEQ ID NO: 1036855 - RNA, 17 nt, Homo sapiens
gaaacauuaugccuuaa

SEQ ID NO: 1036856 - RNA, 18 nt, Homo sapiens
gaaaccacacagacuugg

SEQ ID NO: 1036857 - RNA, 13 nt, Homo sapiens
gaaaccacagcug

SEQ ID NO: 1036858 - RNA, 22 nt, Homo sapiens
gaaaccagagucaaauuugaaa

SEQ ID NO: 1036859 - RNA, 17 nt, Homo sapiens
gaaacccuauuucccca

SEQ ID NO: 1036860 - RNA, 18 nt, Homo sapiens
gaaaccugcccugccuga

SEQ ID NO: 1036861 - RNA, 19 nt, Homo sapiens
gaaacgaaguagaaagggg

SEQ ID NO: 1036862 - RNA, 21 nt, Homo sapiens
gaaacucauaauagacuuccc

SEQ ID NO: 1036863 - RNA, 17 nt, Homo sapiens
gaaacugagaccaaaga

SEQ ID NO: 1036864 - RNA, 19 nt, Homo sapiens
gaaacuggaugaggucaua

SEQ ID NO: 1036865 - RNA, 15 nt, Homo sapiens
gaaacuguacuacau

SEQ ID NO: 1036866 - RNA, 22 nt, Homo sapiens
gaaacuguagucucaggaccua

SEQ ID NO: 1036867 - RNA, 13 nt, Homo sapiens
gaaacuguaugaa

SEQ ID NO: 1036868 - RNA, 16 nt, Homo sapiens
gaaacuguucccaccu

SEQ ID NO: 1036869 - RNA, 21 nt, Homo sapiens
gaaacuuauuuuuuucugauu

SEQ ID NO: 1036870 - RNA, 20 nt, Homo sapiens
gaaacuugcauacagagaca

SEQ ID NO: 1036871 - RNA, 16 nt, Homo sapiens
gaaacuugcuuaucaa

SEQ ID NO: 1036872 - RNA, 14 nt, Homo sapiens
gaaagaaguaggca

SEQ ID NO: 1036873 - RNA, 18 nt, Homo sapiens
gaaagacuauucaaacag

SEQ ID NO: 1036874 - RNA, 17 nt, Homo sapiens
gaaagacugagcucaag

SEQ ID NO: 1036875 - RNA, 19 nt, Homo sapiens
gaaagaguccuauuugcac

SEQ ID NO: 1036876 - RNA, 22 nt, Homo sapiens
gaaagcacaggugggcuuccca

SEQ ID NO: 1036877 - RNA, 17 nt, Homo sapiens
gaaagcagggacuugaa

SEQ ID NO: 1036878 - RNA, 23 nt, Homo sapiens
gaaagcaucauuauuugcagaga

SEQ ID NO: 1036879 - RNA, 20 nt, Homo sapiens
gaaaggaagcuccacuguca

SEQ ID NO: 1036880 - RNA, 21 nt, Homo sapiens
gaaaggaagugggacuggcac

SEQ ID NO: 1036881 - RNA, 14 nt, Homo sapiens
gaaaggagacuaga

SEQ ID NO: 1036882 - RNA, 13 nt, Homo sapiens
gaaaggcucaguc

SEQ ID NO: 1036883 - RNA, 18 nt, Homo sapiens
gaaagggauaguccaaag

SEQ ID NO: 1036884 - RNA, 21 nt, Homo sapiens
gaaaggggcccaguccuggcc

SEQ ID NO: 1036885 - RNA, 17 nt, Homo sapiens
gaaagugguucuaugau

SEQ ID NO: 1036886 - RNA, 14 nt, Homo sapiens
gaaaguucaaaaag

SEQ ID NO: 1036887 - RNA, 15 nt, Homo sapiens
gaaaguuugcacugu

SEQ ID NO: 1036888 - RNA, 19 nt, Homo sapiens
gaaauaacaagucgaugaa

SEQ ID NO: 1036889 - RNA, 15 nt, Homo sapiens
gaaauaacaauguua

SEQ ID NO: 1036890 - RNA, 15 nt, Homo sapiens
gaaauaccagugaac

SEQ ID NO: 1036891 - RNA, 20 nt, Homo sapiens
gaaauaccagugaaccaaag

SEQ ID NO: 1036892 - RNA, 13 nt, Homo sapiens
gaaauaccaguuc

SEQ ID NO: 1036893 - RNA, 15 nt, Homo sapiens
gaaauagacaguaua

SEQ ID NO: 1036894 - RNA, 22 nt, Homo sapiens
gaaauagugauuuccacaguga

SEQ ID NO: 1036895 - RNA, 20 nt, Homo sapiens
gaaauauaacaaguggguga

SEQ ID NO: 1036896 - RNA, 21 nt, Homo sapiens
gaaauauauuaugauugcaua

SEQ ID NO: 1036897 - RNA, 16 nt, Homo sapiens
gaaauauuauuggugu

SEQ ID NO: 1036898 - RNA, 12 nt, Homo sapiens
gaaaucaagggc

SEQ ID NO: 1036899 - RNA, 18 nt, Homo sapiens
gaaaucaaugaagcaagu

SEQ ID NO: 1036900 - RNA, 19 nt, Homo sapiens
gaaauccgucuaguuaaca

SEQ ID NO: 1036901 - RNA, 21 nt, Homo sapiens
gagcauuguggcugucagcag

SEQ ID NO: 1036902 - RNA, 22 nt, Homo sapiens
gagcauuuccaacaccacagac

SEQ ID NO: 1036903 - RNA, 13 nt, Homo sapiens
gagccaacaucac

SEQ ID NO: 1036904 - RNA, 13 nt, Homo sapiens
gagccaaggguuc

SEQ ID NO: 1036905 - RNA, 20 nt, Homo sapiens
gagccaaguccagauuuaca

SEQ ID NO: 1036906 - RNA, 12 nt, Homo sapiens
gagccacuaaga

SEQ ID NO: 1036907 - RNA, 18 nt, Homo sapiens
gagccacugcaccgggcc

SEQ ID NO: 1036908 - RNA, 16 nt, Homo sapiens
gagccaggacugugga

SEQ ID NO: 1036909 - RNA, 21 nt, Homo sapiens
gagcccauuucaauucucaaa

SEQ ID NO: 1036910 - RNA, 14 nt, Homo sapiens
gagccccacacgga

SEQ ID NO: 1036911 - RNA, 23 nt, Homo sapiens
gagcccggaguggacugauuuuc

SEQ ID NO: 1036912 - RNA, 16 nt, Homo sapiens
gagccuccucgucacc

SEQ ID NO: 1036913 - RNA, 18 nt, Homo sapiens
gagccugagccacaaaaa

SEQ ID NO: 1036914 - RNA, 16 nt, Homo sapiens
gagccuggcaagaaug

SEQ ID NO: 1036915 - RNA, 19 nt, Homo sapiens
gagccuggcuccaaacccu

SEQ ID NO: 1036916 - RNA, 14 nt, Homo sapiens
gagccuuccagggg

SEQ ID NO: 1036917 - RNA, 18 nt, Homo sapiens
gagcgagacuccgucuca

SEQ ID NO: 1036918 - RNA, 16 nt, Homo sapiens
gagcuacuugggccau

SEQ ID NO: 1036919 - RNA, 11 nt, Homo sapiens
gagcuagaagc

SEQ ID NO: 1036920 - RNA, 18 nt, Homo sapiens
gagcucagagaggcuaga

SEQ ID NO: 1036921 - RNA, 22 nt, Homo sapiens
gagcucagagagggcaggcaug

SEQ ID NO: 1036922 - RNA, 22 nt, Homo sapiens
gagcugaacccauuuugaguga

SEQ ID NO: 1036923 - RNA, 21 nt, Homo sapiens
gagcugaauuaccuuucacuu

SEQ ID NO: 1036924 - RNA, 18 nt, Homo sapiens
gagcugacacaaaccugc

SEQ ID NO: 1036925 - RNA, 13 nt, Homo sapiens
gagcuggaggcac

SEQ ID NO: 1036926 - RNA, 21 nt, Homo sapiens
gagcugggcagaaggccaaga

SEQ ID NO: 1036927 - RNA, 14 nt, Homo sapiens
gagcugggggccau

SEQ ID NO: 1036928 - RNA, 18 nt, Homo sapiens
gagcuucauauaccagca

SEQ ID NO: 1036929 - RNA, 12 nt, Homo sapiens
gagcuuccucag

SEQ ID NO: 1036930 - RNA, 23 nt, Homo sapiens
gagcuuggccagaagggggccau

SEQ ID NO: 1036931 - RNA, 14 nt, Homo sapiens
gagcuuucugcuau

SEQ ID NO: 1036932 - RNA, 23 nt, Homo sapiens
gagcuuugcauguuccacuaacc

SEQ ID NO: 1036933 - RNA, 15 nt, Homo sapiens
gaggaaacucaccug

SEQ ID NO: 1036934 - RNA, 14 nt, Homo sapiens
gaggaaacuuugau

SEQ ID NO: 1036935 - RNA, 16 nt, Homo sapiens
gaggaaaggccagcug

SEQ ID NO: 1036936 - RNA, 20 nt, Homo sapiens
gaggaaaggccagcuggcag

SEQ ID NO: 1036937 - RNA, 18 nt, Homo sapiens
gaggaacuguccagagag

SEQ ID NO: 1036938 - RNA, 22 nt, Homo sapiens
gaggacauucuggaaaagcaaa

SEQ ID NO: 1036939 - RNA, 19 nt, Homo sapiens
gaggacuugugucucugug

SEQ ID NO: 1036940 - RNA, 22 nt, Homo sapiens
gaggagggaugcugccugaguc

SEQ ID NO: 1036941 - RNA, 12 nt, Homo sapiens
gaggaguucaau

SEQ ID NO: 1036942 - RNA, 15 nt, Homo sapiens
gaggaguucaaugau

SEQ ID NO: 1036943 - RNA, 23 nt, Homo sapiens
gaggauguguggcauuuucacuu

SEQ ID NO: 1036944 - RNA, 19 nt, Homo sapiens
gaggcagcuguugcaguga

SEQ ID NO: 1036945 - RNA, 18 nt, Homo sapiens
gaggcauugcacagggag

SEQ ID NO: 1036946 - RNA, 18 nt, Homo sapiens
gaggccaaggagggugga

SEQ ID NO: 1036947 - RNA, 20 nt, Homo sapiens
gaggccaauccuauggcaga

SEQ ID NO: 1036948 - RNA, 16 nt, Homo sapiens
gaggccaccucuccaa

SEQ ID NO: 1036949 - RNA, 21 nt, Homo sapiens
gaggccccuucuagguggcaa

SEQ ID NO: 1036950 - RNA, 22 nt, Homo sapiens
gaggccccuucuagguggcaag

SEQ ID NO: 1036951 - RNA, 11 nt, Homo sapiens
gaggccuauaa

SEQ ID NO: 1036952 - RNA, 21 nt, Homo sapiens
gaggccuauaaugaagcuuua

SEQ ID NO: 1036953 - RNA, 23 nt, Homo sapiens
gaggccuauaaugaagcuuuaua

SEQ ID NO: 1036954 - RNA, 12 nt, Homo sapiens
gaggccuguccu

SEQ ID NO: 1036955 - RNA, 14 nt, Homo sapiens
gaggcggaucuuug

SEQ ID NO: 1036956 - RNA, 23 nt, Homo sapiens
gaggcgggaguggaguggaagaa

SEQ ID NO: 1036957 - RNA, 21 nt, Homo sapiens
gaggcucagggaaaggccagu

SEQ ID NO: 1036958 - RNA, 20 nt, Homo sapiens
gaggcucccacuucuuggga

SEQ ID NO: 1036959 - RNA, 21 nt, Homo sapiens
gaggcucccucuuaacgcagc

SEQ ID NO: 1036960 - RNA, 12 nt, Homo sapiens
gaggcuccugug

SEQ ID NO: 1036961 - RNA, 19 nt, Homo sapiens
gaggcugcaaucacacuga

SEQ ID NO: 1036962 - RNA, 12 nt, Homo sapiens
gaggcugcagaa

SEQ ID NO: 1036963 - RNA, 20 nt, Homo sapiens
gaggcuugccccacccaaca

SEQ ID NO: 1036964 - RNA, 12 nt, Homo sapiens
gaggcuugcuga

SEQ ID NO: 1036965 - RNA, 12 nt, Homo sapiens
gaggcuuggaaa

SEQ ID NO: 1036966 - RNA, 15 nt, Homo sapiens
gaggcuugggaccgc

SEQ ID NO: 1036967 - RNA, 13 nt, Homo sapiens
gagggaagccuga

SEQ ID NO: 1036968 - RNA, 15 nt, Homo sapiens
gagggcacacacugu

SEQ ID NO: 1036969 - RNA, 21 nt, Homo sapiens
gagggcacuggagcugucuug

SEQ ID NO: 1036970 - RNA, 19 nt, Homo sapiens
gagggccgugagggguccc

SEQ ID NO: 1036971 - RNA, 17 nt, Homo sapiens
gagggcgucuucuaggg

SEQ ID NO: 1036972 - RNA, 23 nt, Homo sapiens
gaggguuggguucaucugagcaa

SEQ ID NO: 1036973 - RNA, 20 nt, Homo sapiens
gaggguugguccucuugccu

SEQ ID NO: 1036974 - RNA, 21 nt, Homo sapiens
gagguaaaagugugagcagug

SEQ ID NO: 1036975 - RNA, 16 nt, Homo sapiens
gagguacucugcacau

SEQ ID NO: 1036976 - RNA, 18 nt, Homo sapiens
gaggucaagauuucagga

SEQ ID NO: 1036977 - RNA, 16 nt, Homo sapiens
gaggucucuugaggga

SEQ ID NO: 1036978 - RNA, 21 nt, Homo sapiens
gaggucuguacguuaccucuu

SEQ ID NO: 1036979 - RNA, 15 nt, Homo sapiens
gaggugggauccucc

SEQ ID NO: 1036980 - RNA, 14 nt, Homo sapiens
gagguugcagggag

SEQ ID NO: 1036981 - RNA, 17 nt, Homo sapiens
gagguuugccagcauuu

SEQ ID NO: 1036982 - RNA, 21 nt, Homo sapiens
gaguaaguguaagaaaaugau

SEQ ID NO: 1036983 - RNA, 16 nt, Homo sapiens
gaguauaaauuuacuu

SEQ ID NO: 1036984 - RNA, 13 nt, Homo sapiens
gaguaucacuccc

SEQ ID NO: 1036985 - RNA, 16 nt, Homo sapiens
gagucaaugugcagug

SEQ ID NO: 1036986 - RNA, 23 nt, Homo sapiens
gagucacacgggggcagcugaua

SEQ ID NO: 1036987 - RNA, 15 nt, Homo sapiens
gagucauaaaccuua

SEQ ID NO: 1036988 - RNA, 20 nt, Homo sapiens
gaguccacucccagugcuug

SEQ ID NO: 1036989 - RNA, 17 nt, Homo sapiens
gagucgaggacagggag

SEQ ID NO: 1036990 - RNA, 17 nt, Homo sapiens
gagucucacuguugccc

SEQ ID NO: 1036991 - RNA, 23 nt, Homo sapiens
gagucuggggucuccuauacucu

SEQ ID NO: 1036992 - RNA, 18 nt, Homo sapiens
gagugaaggggccaagga

SEQ ID NO: 1036993 - RNA, 22 nt, Homo sapiens
gagugacggucccacacuggug

SEQ ID NO: 1036994 - RNA, 20 nt, Homo sapiens
gagugacuuaguguacauga

SEQ ID NO: 1036995 - RNA, 13 nt, Homo sapiens
gagugagcugguu

SEQ ID NO: 1036996 - RNA, 19 nt, Homo sapiens
gagugcaauggcgugaucu

SEQ ID NO: 1036997 - RNA, 20 nt, Homo sapiens
gagugcaguggcacgaucuc

SEQ ID NO: 1036998 - RNA, 14 nt, Homo sapiens
gagugcccccaaca

SEQ ID NO: 1036999 - RNA, 13 nt, Homo sapiens
gaguggagcauug

SEQ ID NO: 1037000 - RNA, 20 nt, Homo sapiens
gaguggcucacccuguccag

SEQ ID NO: 1037001 - RNA, 20 nt, Homo sapiens
gagugggguagguugggaga

SEQ ID NO: 1037002 - RNA, 16 nt, Homo sapiens
gaguggguuucacaag

SEQ ID NO: 1037003 - RNA, 14 nt, Homo sapiens
gagugugugcaugu

SEQ ID NO: 1037004 - RNA, 17 nt, Homo sapiens
gagugugugcaugugug

SEQ ID NO: 1037005 - RNA, 22 nt, Homo sapiens
gaguguuccccuuccacugagg

SEQ ID NO: 1037006 - RNA, 23 nt, Homo sapiens
gaguuccaugaagaccacaucca

SEQ ID NO: 1037007 - RNA, 16 nt, Homo sapiens
gaguuccgacugccau

SEQ ID NO: 1037008 - RNA, 21 nt, Homo sapiens
gaguugauucagcucugcaag

SEQ ID NO: 1037009 - RNA, 15 nt, Homo sapiens
gaguuuaacaugugu

SEQ ID NO: 1037010 - RNA, 19 nt, Homo sapiens
gaguuuccccagacaccgc

SEQ ID NO: 1037011 - RNA, 14 nt, Homo sapiens
gaguuucgagguag

SEQ ID NO: 1037012 - RNA, 18 nt, Homo sapiens
gaguuucuuuccugccuu

SEQ ID NO: 1037013 - RNA, 23 nt, Homo sapiens
gaguuugaaggaggugagggaug

SEQ ID NO: 1037014 - RNA, 15 nt, Homo sapiens
gaguuugcuuucaaa

SEQ ID NO: 1037015 - RNA, 13 nt, Homo sapiens
gauaaacucagaa

SEQ ID NO: 1037016 - RNA, 13 nt, Homo sapiens
gauaaagggccaa

SEQ ID NO: 1037017 - RNA, 16 nt, Homo sapiens
gauaaauuccacugga

SEQ ID NO: 1037018 - RNA, 22 nt, Homo sapiens
gauaacaugcuuuggguggaau

SEQ ID NO: 1037019 - RNA, 15 nt, Homo sapiens
gauaaggaaauaaga

SEQ ID NO: 1037020 - RNA, 20 nt, Homo sapiens
gauaaguucuaguugcuugu

SEQ ID NO: 1037021 - RNA, 13 nt, Homo sapiens
gauaauaguuuac

SEQ ID NO: 1037022 - RNA, 15 nt, Homo sapiens
gauaaucagccucuu

SEQ ID NO: 1037023 - RNA, 12 nt, Homo sapiens
gauacaaacugc

SEQ ID NO: 1037024 - RNA, 15 nt, Homo sapiens
gauacagaacucuuu

SEQ ID NO: 1037025 - RNA, 16 nt, Homo sapiens
gauacagccugcaagu

SEQ ID NO: 1037026 - RNA, 21 nt, Homo sapiens
gauaccucaacccccauuucu

SEQ ID NO: 1037027 - RNA, 22 nt, Homo sapiens
gauacugcucaucauuccuuga

SEQ ID NO: 1037028 - RNA, 13 nt, Homo sapiens
gauagaugucuau

SEQ ID NO: 1037029 - RNA, 23 nt, Homo sapiens
gauaguggggagacuucuuggcu

SEQ ID NO: 1037030 - RNA, 17 nt, Homo sapiens
gauaguggggucagggc

SEQ ID NO: 1037031 - RNA, 12 nt, Homo sapiens
gauaguuuaccu

SEQ ID NO: 1037032 - RNA, 15 nt, Homo sapiens
gauaguuuaccugaa

SEQ ID NO: 1037033 - RNA, 19 nt, Homo sapiens
gauauaaaaggcaaauaca

SEQ ID NO: 1037034 - RNA, 20 nt, Homo sapiens
gauauacuauuuucauucuc

SEQ ID NO: 1037035 - RNA, 17 nt, Homo sapiens
gauauaugacugcuuca

SEQ ID NO: 1037036 - RNA, 13 nt, Homo sapiens
gauauaugcucug

SEQ ID NO: 1037037 - RNA, 19 nt, Homo sapiens
gauaucaaaaagacugugg

SEQ ID NO: 1037038 - RNA, 16 nt, Homo sapiens
gauaucccuuacucca

SEQ ID NO: 1037039 - RNA, 19 nt, Homo sapiens
gauaucccuuacuccagag

SEQ ID NO: 1037040 - RNA, 18 nt, Homo sapiens
gauaucuuggcuuugcca

SEQ ID NO: 1037041 - RNA, 14 nt, Homo sapiens
gauaugcaguaugc

SEQ ID NO: 1037042 - RNA, 22 nt, Homo sapiens
gaucaaaauaaaaagugacaca

SEQ ID NO: 1037043 - RNA, 20 nt, Homo sapiens
gaucaaaguguaaacaccau

SEQ ID NO: 1037044 - RNA, 14 nt, Homo sapiens
gaucaacucugucu

SEQ ID NO: 1037045 - RNA, 19 nt, Homo sapiens
gccuacaggagugagcacu

SEQ ID NO: 1037046 - RNA, 17 nt, Homo sapiens
gccuagcugcuacaaag

SEQ ID NO: 1037047 - RNA, 16 nt, Homo sapiens
gccuaugcacauaugg

SEQ ID NO: 1037048 - RNA, 14 nt, Homo sapiens
gccuaugugcaugc

SEQ ID NO: 1037049 - RNA, 14 nt, Homo sapiens
gccucaagaucaau

SEQ ID NO: 1037050 - RNA, 13 nt, Homo sapiens
gccucacaguccu

SEQ ID NO: 1037051 - RNA, 16 nt, Homo sapiens
gccucagccuccugag

SEQ ID NO: 1037052 - RNA, 23 nt, Homo sapiens
gccucauauuuaaagacagggaa

SEQ ID NO: 1037053 - RNA, 15 nt, Homo sapiens
gccucauuacuuuac

SEQ ID NO: 1037054 - RNA, 18 nt, Homo sapiens
gccucccaaagugcugag

SEQ ID NO: 1037055 - RNA, 19 nt, Homo sapiens
gccucccaggagaaucacu

SEQ ID NO: 1037056 - RNA, 16 nt, Homo sapiens
gccuccccaacccugc

SEQ ID NO: 1037057 - RNA, 17 nt, Homo sapiens
gccucccuucaugcaug

SEQ ID NO: 1037058 - RNA, 11 nt, Homo sapiens
gccuccucacc

SEQ ID NO: 1037059 - RNA, 14 nt, Homo sapiens
gccuccucacccac

SEQ ID NO: 1037060 - RNA, 20 nt, Homo sapiens
gccuccuccagaauggagcu

SEQ ID NO: 1037061 - RNA, 21 nt, Homo sapiens
gccuccuuuccccucccucag

SEQ ID NO: 1037062 - RNA, 14 nt, Homo sapiens
gccucugaagccua

SEQ ID NO: 1037063 - RNA, 16 nt, Homo sapiens
gccucugcacuccccu

SEQ ID NO: 1037064 - RNA, 16 nt, Homo sapiens
gccucugccugcauuc

SEQ ID NO: 1037065 - RNA, 17 nt, Homo sapiens
gccucugccugcauucu

SEQ ID NO: 1037066 - RNA, 20 nt, Homo sapiens
gccucugcuccccugugaac

SEQ ID NO: 1037067 - RNA, 18 nt, Homo sapiens
gccucuggcucucauggg

SEQ ID NO: 1037068 - RNA, 20 nt, Homo sapiens
gccucuggcucucauggggu

SEQ ID NO: 1037069 - RNA, 14 nt, Homo sapiens
gccucuuccaggaa

SEQ ID NO: 1037070 - RNA, 17 nt, Homo sapiens
gccugaaauuucaccau

SEQ ID NO: 1037071 - RNA, 15 nt, Homo sapiens
gccugaaccuuccau

SEQ ID NO: 1037072 - RNA, 15 nt, Homo sapiens
gccugaagucacaca

SEQ ID NO: 1037073 - RNA, 13 nt, Homo sapiens
gccugaccaacau

SEQ ID NO: 1037074 - RNA, 22 nt, Homo sapiens
gccugacuuggggagauggagu

SEQ ID NO: 1037075 - RNA, 22 nt, Homo sapiens
gccugagacagcugucuuguga

SEQ ID NO: 1037076 - RNA, 22 nt, Homo sapiens
gccugagcuggccuccuaugcc

SEQ ID NO: 1037077 - RNA, 17 nt, Homo sapiens
gccugagggcgagggga

SEQ ID NO: 1037078 - RNA, 16 nt, Homo sapiens
gccugcacuaauuuga

SEQ ID NO: 1037079 - RNA, 13 nt, Homo sapiens
gccugcauucugc

SEQ ID NO: 1037080 - RNA, 22 nt, Homo sapiens
gccugccccccucaucucauuc

SEQ ID NO: 1037081 - RNA, 14 nt, Homo sapiens
gccugccucuucuc

SEQ ID NO: 1037082 - RNA, 16 nt, Homo sapiens
gccugccuggcaggcu

SEQ ID NO: 1037083 - RNA, 14 nt, Homo sapiens
gccugcuuuucacu

SEQ ID NO: 1037084 - RNA, 20 nt, Homo sapiens
gccugcuuuucacugcugca

SEQ ID NO: 1037085 - RNA, 23 nt, Homo sapiens
gccuggacuagagggaccucucc

SEQ ID NO: 1037086 - RNA, 23 nt, Homo sapiens
gccuggaucuccccacucuaggg

SEQ ID NO: 1037087 - RNA, 17 nt, Homo sapiens
gccuggccagaugcaug

SEQ ID NO: 1037088 - RNA, 22 nt, Homo sapiens
gccuggcccccacccucugcca

SEQ ID NO: 1037089 - RNA, 15 nt, Homo sapiens
gccugggaugaugca

SEQ ID NO: 1037090 - RNA, 23 nt, Homo sapiens
gccuggggucugacaauaccucg

SEQ ID NO: 1037091 - RNA, 17 nt, Homo sapiens
gccugguacucaagccc

SEQ ID NO: 1037092 - RNA, 16 nt, Homo sapiens
gccuggucguuuucaa

SEQ ID NO: 1037093 - RNA, 14 nt, Homo sapiens
gccuguaaucccag

SEQ ID NO: 1037094 - RNA, 21 nt, Homo sapiens
gccuguaaucccagcacuuug

SEQ ID NO: 1037095 - RNA, 19 nt, Homo sapiens
gccuguaaucucacuacac

SEQ ID NO: 1037096 - RNA, 19 nt, Homo sapiens
gccuguagucccagcuacu

SEQ ID NO: 1037097 - RNA, 21 nt, Homo sapiens
gccugucccauggacacucca

SEQ ID NO: 1037098 - RNA, 18 nt, Homo sapiens
gccugucuguuacacugg

SEQ ID NO: 1037099 - RNA, 12 nt, Homo sapiens
gccugucuuucc

SEQ ID NO: 1037100 - RNA, 15 nt, Homo sapiens
gccuguuaacuggua

SEQ ID NO: 1037101 - RNA, 22 nt, Homo sapiens
gccuguuagacucuuacuuuuu

SEQ ID NO: 1037102 - RNA, 16 nt, Homo sapiens
gccuguucaguuacag

SEQ ID NO: 1037103 - RNA, 22 nt, Homo sapiens
gccuguuugcuuagcauuccua

SEQ ID NO: 1037104 - RNA, 15 nt, Homo sapiens
gccuuaaccaugagg

SEQ ID NO: 1037105 - RNA, 19 nt, Homo sapiens
gccuuaaguaauguuaauu

SEQ ID NO: 1037106 - RNA, 22 nt, Homo sapiens
gccuuccacgcugucuccagac

SEQ ID NO: 1037107 - RNA, 15 nt, Homo sapiens
gccuugcaguaggca

SEQ ID NO: 1037108 - RNA, 18 nt, Homo sapiens
gccuugccuccucaccca

SEQ ID NO: 1037109 - RNA, 14 nt, Homo sapiens
gccuugggcugcuc

SEQ ID NO: 1037110 - RNA, 16 nt, Homo sapiens
gccuugguauagcaua

SEQ ID NO: 1037111 - RNA, 17 nt, Homo sapiens
gccuuguccccugccug

SEQ ID NO: 1037112 - RNA, 16 nt, Homo sapiens
gccuuuaaaucuguga

SEQ ID NO: 1037113 - RNA, 18 nt, Homo sapiens
gccuuuauauccaaaaua

SEQ ID NO: 1037114 - RNA, 23 nt, Homo sapiens
gccuuucucccaggccaggcucc

SEQ ID NO: 1037115 - RNA, 16 nt, Homo sapiens
gcgagacuccgucuca

SEQ ID NO: 1037116 - RNA, 14 nt, Homo sapiens
gcgagucacugccu

SEQ ID NO: 1037117 - RNA, 15 nt, Homo sapiens
gcgagucacugccuc

SEQ ID NO: 1037118 - RNA, 22 nt, Homo sapiens
gcgauccaccugucucagccuc

SEQ ID NO: 1037119 - RNA, 15 nt, Homo sapiens
gcgauguaugcagcu

SEQ ID NO: 1037120 - RNA, 14 nt, Homo sapiens
gcgaugugcaagug

SEQ ID NO: 1037121 - RNA, 17 nt, Homo sapiens
gcgccacuaagccaaga

SEQ ID NO: 1037122 - RNA, 15 nt, Homo sapiens
gcgcccuuaccuucc

SEQ ID NO: 1037123 - RNA, 18 nt, Homo sapiens
gcgccuugccuccucacc

SEQ ID NO: 1037124 - RNA, 15 nt, Homo sapiens
gcggaucucuggagu

SEQ ID NO: 1037125 - RNA, 18 nt, Homo sapiens
gcggaucuuuggacagaa

SEQ ID NO: 1037126 - RNA, 22 nt, Homo sapiens
gcgugaaggccgagaagcaaga

SEQ ID NO: 1037127 - RNA, 16 nt, Homo sapiens
gcguggacucugcaca

SEQ ID NO: 1037128 - RNA, 23 nt, Homo sapiens
gcguguggcucacgugugugacu

SEQ ID NO: 1037129 - RNA, 16 nt, Homo sapiens
gcguguguccaugugu

SEQ ID NO: 1037130 - RNA, 20 nt, Homo sapiens
gcguguguccaugugugugc

SEQ ID NO: 1037131 - RNA, 13 nt, Homo sapiens
gcgugugugcaag

SEQ ID NO: 1037132 - RNA, 22 nt, Homo sapiens
gcguguuucugacucugagcua

SEQ ID NO: 1037133 - RNA, 17 nt, Homo sapiens
gcguuugaacucaggga

SEQ ID NO: 1037134 - RNA, 19 nt, Homo sapiens
gcuaaugaagaucauauac

SEQ ID NO: 1037135 - RNA, 18 nt, Homo sapiens
gcuaauucucagcagaaa

SEQ ID NO: 1037136 - RNA, 21 nt, Homo sapiens
gcuaauugcuggcuggcugcc

SEQ ID NO: 1037137 - RNA, 19 nt, Homo sapiens
gcuacacugacacugguau

SEQ ID NO: 1037138 - RNA, 22 nt, Homo sapiens
gcuacccgcagaguucucagaa

SEQ ID NO: 1037139 - RNA, 14 nt, Homo sapiens
gcuaccuugugacc

SEQ ID NO: 1037140 - RNA, 18 nt, Homo sapiens
gcuacucgggaggcugaa

SEQ ID NO: 1037141 - RNA, 20 nt, Homo sapiens
gcuacucuguuccuucacau

SEQ ID NO: 1037142 - RNA, 15 nt, Homo sapiens
gcuacuucugaaacu

SEQ ID NO: 1037143 - RNA, 13 nt, Homo sapiens
gcuacuugggagg

SEQ ID NO: 1037144 - RNA, 11 nt, Homo sapiens
gcuagaaccua

SEQ ID NO: 1037145 - RNA, 21 nt, Homo sapiens
gcuagaaggccacaugucacc

SEQ ID NO: 1037146 - RNA, 14 nt, Homo sapiens
gcuagaguccucac

SEQ ID NO: 1037147 - RNA, 15 nt, Homo sapiens
gcuagcaaauuugag

SEQ ID NO: 1037148 - RNA, 23 nt, Homo sapiens
gcuagccaucuugaucuguguuu

SEQ ID NO: 1037149 - RNA, 14 nt, Homo sapiens
gcuaggaacacucc

SEQ ID NO: 1037150 - RNA, 15 nt, Homo sapiens
gcuagggaauaucaa

SEQ ID NO: 1037151 - RNA, 19 nt, Homo sapiens
gcuaggguggcccuugcag

SEQ ID NO: 1037152 - RNA, 18 nt, Homo sapiens
gcuaguucguagcuuucc

SEQ ID NO: 1037153 - RNA, 17 nt, Homo sapiens
gcuauaacuuacuucug

SEQ ID NO: 1037154 - RNA, 15 nt, Homo sapiens
gcuauagcucaggac

SEQ ID NO: 1037155 - RNA, 13 nt, Homo sapiens
gcuauaggugcua

SEQ ID NO: 1037156 - RNA, 23 nt, Homo sapiens
gcuaucucucagugaacugugag

SEQ ID NO: 1037157 - RNA, 11 nt, Homo sapiens
gcuaucucugu

SEQ ID NO: 1037158 - RNA, 19 nt, Homo sapiens
gcuaugaauauaguaccug

SEQ ID NO: 1037159 - RNA, 11 nt, Homo sapiens
gcuaugaauga

SEQ ID NO: 1037160 - RNA, 20 nt, Homo sapiens
gcuauggggagaaaagacau

SEQ ID NO: 1037161 - RNA, 14 nt, Homo sapiens
gcuauggugagaug

SEQ ID NO: 1037162 - RNA, 17 nt, Homo sapiens
gcuaugucaggcuuuca

SEQ ID NO: 1037163 - RNA, 22 nt, Homo sapiens
gcuaugucaggcuuucaucuaa

SEQ ID NO: 1037164 - RNA, 22 nt, Homo sapiens
gcuauuucaucuauuuuuggca

SEQ ID NO: 1037165 - RNA, 17 nt, Homo sapiens
gcucaaaggcacaguga

SEQ ID NO: 1037166 - RNA, 14 nt, Homo sapiens
gcucaacauugugu

SEQ ID NO: 1037167 - RNA, 23 nt, Homo sapiens
gcucaauauuccugaaugaaaua

SEQ ID NO: 1037168 - RNA, 17 nt, Homo sapiens
gcucacaccugaccaau

SEQ ID NO: 1037169 - RNA, 20 nt, Homo sapiens
gcucaccccccacacucacu

SEQ ID NO: 1037170 - RNA, 22 nt, Homo sapiens
gcucacuguucuauucaucuca

SEQ ID NO: 1037171 - RNA, 20 nt, Homo sapiens
gcucagcaugcauccuuugc

SEQ ID NO: 1037172 - RNA, 20 nt, Homo sapiens
gcucagcccaccccccucau

SEQ ID NO: 1037173 - RNA, 21 nt, Homo sapiens
gcucagcccugacuggugcua

SEQ ID NO: 1037174 - RNA, 19 nt, Homo sapiens
gcucagggaaaagcagcuc

SEQ ID NO: 1037175 - RNA, 22 nt, Homo sapiens
gcucagggagguuaagugacuu

SEQ ID NO: 1037176 - RNA, 15 nt, Homo sapiens
gcucaggggcgugug

SEQ ID NO: 1037177 - RNA, 20 nt, Homo sapiens
gcucaggugucccugcacuu

SEQ ID NO: 1037178 - RNA, 15 nt, Homo sapiens
gcucaucauucucug

SEQ ID NO: 1037179 - RNA, 16 nt, Homo sapiens
gcucaucugauuuuug

SEQ ID NO: 1037180 - RNA, 18 nt, Homo sapiens
gcucauuucacuuuacac

SEQ ID NO: 1037181 - RNA, 17 nt, Homo sapiens
gcucauuuuuucuuaca

SEQ ID NO: 1037182 - RNA, 21 nt, Homo sapiens
gcuccaccuuccaaaggaccu

SEQ ID NO: 1037183 - RNA, 13 nt, Homo sapiens
gcuccacugaaca

SEQ ID NO: 1037184 - RNA, 13 nt, Homo sapiens
gcuccacugucac

SEQ ID NO: 1037185 - RNA, 18 nt, Homo sapiens
gcuccagaagauagcuuc

SEQ ID NO: 1037186 - RNA, 23 nt, Homo sapiens
gcuccagacacaccugaacacau

SEQ ID NO: 1037187 - RNA, 17 nt, Homo sapiens
gcuccagugcaggagac

SEQ ID NO: 1037188 - RNA, 13 nt, Homo sapiens
gcuccauguagaa

SEQ ID NO: 1037189 - RNA, 18 nt, Homo sapiens
gguuggugcacagugauu

SEQ ID NO: 1037190 - RNA, 17 nt, Homo sapiens
gguuguacuaugcuguu

SEQ ID NO: 1037191 - RNA, 17 nt, Homo sapiens
gguuucuccagagggaa

SEQ ID NO: 1037192 - RNA, 15 nt, Homo sapiens
gguuucuggggucca

SEQ ID NO: 1037193 - RNA, 17 nt, Homo sapiens
gguuugucagaggcuaa

SEQ ID NO: 1037194 - RNA, 18 nt, Homo sapiens
gguuuguugcagccaaag

SEQ ID NO: 1037195 - RNA, 16 nt, Homo sapiens
gguuuuaacaauuucc

SEQ ID NO: 1037196 - RNA, 22 nt, Homo sapiens
gguuuuguagguagaggaauaa

SEQ ID NO: 1037197 - RNA, 21 nt, Homo sapiens
guaaaacuauauucucagugu

SEQ ID NO: 1037198 - RNA, 14 nt, Homo sapiens
guaaaaucuuggca

SEQ ID NO: 1037199 - RNA, 13 nt, Homo sapiens
guaaaaugaaauu

SEQ ID NO: 1037200 - RNA, 13 nt, Homo sapiens
guaaaauugaaag

SEQ ID NO: 1037201 - RNA, 12 nt, Homo sapiens
guaaacaaugaa

SEQ ID NO: 1037202 - RNA, 14 nt, Homo sapiens
guaaacugugcacc

SEQ ID NO: 1037203 - RNA, 12 nt, Homo sapiens
guaaacuuccaa

SEQ ID NO: 1037204 - RNA, 21 nt, Homo sapiens
guaaagaaauauauaugauau

SEQ ID NO: 1037205 - RNA, 18 nt, Homo sapiens
guaaagaguuaguuugag

SEQ ID NO: 1037206 - RNA, 16 nt, Homo sapiens
guaaagcucacuuuac

SEQ ID NO: 1037207 - RNA, 16 nt, Homo sapiens
guaaagcuuugugcag

SEQ ID NO: 1037208 - RNA, 19 nt, Homo sapiens
guaaaggcuauacuugucu

SEQ ID NO: 1037209 - RNA, 17 nt, Homo sapiens
guaaaguacagacuuuu

SEQ ID NO: 1037210 - RNA, 22 nt, Homo sapiens
guaaaguauuauuuauuugaau

SEQ ID NO: 1037211 - RNA, 16 nt, Homo sapiens
guaaaucuauuggcca

SEQ ID NO: 1037212 - RNA, 11 nt, Homo sapiens
guaaaucucac

SEQ ID NO: 1037213 - RNA, 20 nt, Homo sapiens
guaaaugggggugcauuuga

SEQ ID NO: 1037214 - RNA, 21 nt, Homo sapiens
guaaaugggggugcauuugag

SEQ ID NO: 1037215 - RNA, 21 nt, Homo sapiens
guaaaugguguacauaaugua

SEQ ID NO: 1037216 - RNA, 15 nt, Homo sapiens
guaaauguccugcua

SEQ ID NO: 1037217 - RNA, 15 nt, Homo sapiens
guaaauguuuagguu

SEQ ID NO: 1037218 - RNA, 19 nt, Homo sapiens
guaacaaaccugcacuuau

SEQ ID NO: 1037219 - RNA, 13 nt, Homo sapiens
guaacaacugugg

SEQ ID NO: 1037220 - RNA, 15 nt, Homo sapiens
guaacacaaagugaa

SEQ ID NO: 1037221 - RNA, 18 nt, Homo sapiens
guaacacaagccacagaa

SEQ ID NO: 1037222 - RNA, 14 nt, Homo sapiens
guaacauagacaaa

SEQ ID NO: 1037223 - RNA, 21 nt, Homo sapiens
guaacccgcucaucacuggau

SEQ ID NO: 1037224 - RNA, 17 nt, Homo sapiens
guaaccgauucaucucu

SEQ ID NO: 1037225 - RNA, 13 nt, Homo sapiens
guaacuccagcuc

SEQ ID NO: 1037226 - RNA, 11 nt, Homo sapiens
guaacugcuga

SEQ ID NO: 1037227 - RNA, 16 nt, Homo sapiens
guaacuggcaguuuuc

SEQ ID NO: 1037228 - RNA, 13 nt, Homo sapiens
guaacuuacuuag

SEQ ID NO: 1037229 - RNA, 19 nt, Homo sapiens
guaacuugcaccucugacc

SEQ ID NO: 1037230 - RNA, 22 nt, Homo sapiens
guaagcucuacugaggugcuau

SEQ ID NO: 1037231 - RNA, 22 nt, Homo sapiens
guaaggaaauggaauacugaag

SEQ ID NO: 1037232 - RNA, 13 nt, Homo sapiens
guaaggugcaguu

SEQ ID NO: 1037233 - RNA, 19 nt, Homo sapiens
guaauaauacagccaaaga

SEQ ID NO: 1037234 - RNA, 22 nt, Homo sapiens
guaauauagugacuaugaacuu

SEQ ID NO: 1037235 - RNA, 16 nt, Homo sapiens
guaauccuagcacuuu

SEQ ID NO: 1037236 - RNA, 14 nt, Homo sapiens
guaaucucugugaa

SEQ ID NO: 1037237 - RNA, 19 nt, Homo sapiens
guaaucuguguacaaagaa

SEQ ID NO: 1037238 - RNA, 18 nt, Homo sapiens
guaaugaaacaccuucuc

SEQ ID NO: 1037239 - RNA, 20 nt, Homo sapiens
guaauguuuuauacuguuua

SEQ ID NO: 1037240 - RNA, 18 nt, Homo sapiens
guaauuaaaggaacagag

SEQ ID NO: 1037241 - RNA, 17 nt, Homo sapiens
guaauucucaggccauc

SEQ ID NO: 1037242 - RNA, 20 nt, Homo sapiens
guaauuugugauacaaugcu

SEQ ID NO: 1037243 - RNA, 16 nt, Homo sapiens
guaauuuuauuuacau

SEQ ID NO: 1037244 - RNA, 18 nt, Homo sapiens
guacaccacaagggucac

SEQ ID NO: 1037245 - RNA, 15 nt, Homo sapiens
guacagaagagacag

SEQ ID NO: 1037246 - RNA, 15 nt, Homo sapiens
guacaggcaacaaug

SEQ ID NO: 1037247 - RNA, 13 nt, Homo sapiens
guacagucuugca

SEQ ID NO: 1037248 - RNA, 14 nt, Homo sapiens
guacauagcuguuu

SEQ ID NO: 1037249 - RNA, 21 nt, Homo sapiens
guacauggaauaacauguaau

SEQ ID NO: 1037250 - RNA, 13 nt, Homo sapiens
guacauucuuccu

SEQ ID NO: 1037251 - RNA, 23 nt, Homo sapiens
guacccuaaggucauuaccacag

SEQ ID NO: 1037252 - RNA, 14 nt, Homo sapiens
guacccucucagcu

SEQ ID NO: 1037253 - RNA, 16 nt, Homo sapiens
guaccgcaaugugacu

SEQ ID NO: 1037254 - RNA, 20 nt, Homo sapiens
guaccuauuuucauuguaaa

SEQ ID NO: 1037255 - RNA, 14 nt, Homo sapiens
guaccucucuuaua

SEQ ID NO: 1037256 - RNA, 18 nt, Homo sapiens
guaccugcccccaaucca

SEQ ID NO: 1037257 - RNA, 21 nt, Homo sapiens
guaccuucaaacuagggccaa

SEQ ID NO: 1037258 - RNA, 20 nt, Homo sapiens
guacuaagauugugcucaau

SEQ ID NO: 1037259 - RNA, 16 nt, Homo sapiens
guacuagcaguguuuc

SEQ ID NO: 1037260 - RNA, 19 nt, Homo sapiens
guacuuagcagcuaucucu

SEQ ID NO: 1037261 - RNA, 15 nt, Homo sapiens
guacuugucaaagaa

SEQ ID NO: 1037262 - RNA, 18 nt, Homo sapiens
guacuugugaccauugua

SEQ ID NO: 1037263 - RNA, 16 nt, Homo sapiens
guagaaacucuacaua

SEQ ID NO: 1037264 - RNA, 18 nt, Homo sapiens
guagaaauaauaugcauu

SEQ ID NO: 1037265 - RNA, 13 nt, Homo sapiens
guagaacuuggau

SEQ ID NO: 1037266 - RNA, 20 nt, Homo sapiens
guagaauagugguugccaau

SEQ ID NO: 1037267 - RNA, 22 nt, Homo sapiens
guagagacaggguuuugccaug

SEQ ID NO: 1037268 - RNA, 19 nt, Homo sapiens
guagaggcugggggcucca

SEQ ID NO: 1037269 - RNA, 14 nt, Homo sapiens
guagauaacagauu

SEQ ID NO: 1037270 - RNA, 18 nt, Homo sapiens
guagcaaguucuagagaa

SEQ ID NO: 1037271 - RNA, 15 nt, Homo sapiens
guagcauacauuuau

SEQ ID NO: 1037272 - RNA, 18 nt, Homo sapiens
guagccuaacacacucca

SEQ ID NO: 1037273 - RNA, 12 nt, Homo sapiens
guagcuagccug

SEQ ID NO: 1037274 - RNA, 15 nt, Homo sapiens
guagcuagccugaga

SEQ ID NO: 1037275 - RNA, 10 nt, Homo sapiens
guagcucucc

SEQ ID NO: 1037276 - RNA, 20 nt, Homo sapiens
guagcugccccuggcucuga

SEQ ID NO: 1037277 - RNA, 11 nt, Homo sapiens
guagcuggaau

SEQ ID NO: 1037278 - RNA, 16 nt, Homo sapiens
guaggaaaugaaugau

SEQ ID NO: 1037279 - RNA, 22 nt, Homo sapiens
guaggaaaugaaugaucuuggc

SEQ ID NO: 1037280 - RNA, 23 nt, Homo sapiens
guaggcgaaucauuuguucaaag

SEQ ID NO: 1037281 - RNA, 14 nt, Homo sapiens
guaggggcaaaaau

SEQ ID NO: 1037282 - RNA, 17 nt, Homo sapiens
guagguggcacacuggg

SEQ ID NO: 1037283 - RNA, 17 nt, Homo sapiens
guaggugugacuugaac

SEQ ID NO: 1037284 - RNA, 16 nt, Homo sapiens
guagucccagccacuc

SEQ ID NO: 1037285 - RNA, 22 nt, Homo sapiens
guagugggugccuguaauccca

SEQ ID NO: 1037286 - RNA, 19 nt, Homo sapiens
guauaacacaauaugaaua

SEQ ID NO: 1037287 - RNA, 15 nt, Homo sapiens
guauaacugaguuaa

SEQ ID NO: 1037288 - RNA, 16 nt, Homo sapiens
guauaaguccuugcaa

SEQ ID NO: 1037289 - RNA, 18 nt, Homo sapiens
guauaaugguugacuggg

SEQ ID NO: 1037290 - RNA, 20 nt, Homo sapiens
guauacuuuuugcauaugua

SEQ ID NO: 1037291 - RNA, 17 nt, Homo sapiens
guauauaguaugaaugc

SEQ ID NO: 1037292 - RNA, 15 nt, Homo sapiens
guauauauaauacug

SEQ ID NO: 1037293 - RNA, 13 nt, Homo sapiens
guaucaacacugu

SEQ ID NO: 1037294 - RNA, 14 nt, Homo sapiens
guaucaacacuguu

SEQ ID NO: 1037295 - RNA, 16 nt, Homo sapiens
guaucaacacuguuac

SEQ ID NO: 1037296 - RNA, 14 nt, Homo sapiens
guaucaaugaguaa

SEQ ID NO: 1037297 - RNA, 24 nt, Homo sapiens
guaucacagacuggcaacaagaag

SEQ ID NO: 1037298 - RNA, 20 nt, Homo sapiens
guaucucuuuugaauccaug

SEQ ID NO: 1037299 - RNA, 17 nt, Homo sapiens
guaucugauagcucuuu

SEQ ID NO: 1037300 - RNA, 14 nt, Homo sapiens
guaugaaugcagug

SEQ ID NO: 1037301 - RNA, 23 nt, Homo sapiens
guaugaggucuaggaacauacuu

SEQ ID NO: 1037302 - RNA, 13 nt, Homo sapiens
guaugcaugugaa

SEQ ID NO: 1037303 - RNA, 16 nt, Homo sapiens
guauggagcucagaga

SEQ ID NO: 1037304 - RNA, 10 nt, Homo sapiens
guaugugcac

SEQ ID NO: 1037305 - RNA, 14 nt, Homo sapiens
guauguguguauau

SEQ ID NO: 1037306 - RNA, 21 nt, Homo sapiens
guauguuugggagacugcuga

SEQ ID NO: 1037307 - RNA, 15 nt, Homo sapiens
guauuaaguuguuaa

SEQ ID NO: 1037308 - RNA, 14 nt, Homo sapiens
guauuauaccuuuu

SEQ ID NO: 1037309 - RNA, 16 nt, Homo sapiens
guauuauuagucuguu

SEQ ID NO: 1037310 - RNA, 16 nt, Homo sapiens
guauucaucuuuugua

SEQ ID NO: 1037311 - RNA, 18 nt, Homo sapiens
guauucauugaagucaga

SEQ ID NO: 1037312 - RNA, 12 nt, Homo sapiens
guauuccauuuu

SEQ ID NO: 1037313 - RNA, 20 nt, Homo sapiens
guauucuacagcagauacuu

SEQ ID NO: 1037314 - RNA, 15 nt, Homo sapiens
guauucuuauuuaau

SEQ ID NO: 1037315 - RNA, 19 nt, Homo sapiens
guauucuuugauguuaaca

SEQ ID NO: 1037316 - RNA, 23 nt, Homo sapiens
guauugaaucauguaguaucaaa

SEQ ID NO: 1037317 - RNA, 18 nt, Homo sapiens
guauugacaggaauacuu

SEQ ID NO: 1037318 - RNA, 19 nt, Homo sapiens
guauuuccagugcaauugu

SEQ ID NO: 1037319 - RNA, 15 nt, Homo sapiens
guauuuuaugaucuu

SEQ ID NO: 1037320 - RNA, 18 nt, Homo sapiens
guauuuuuucacuuguac

SEQ ID NO: 1037321 - RNA, 14 nt, Homo sapiens
gucaacuaugauau

SEQ ID NO: 1037322 - RNA, 20 nt, Homo sapiens
gucaagcaguagacaagcaa

SEQ ID NO: 1037323 - RNA, 21 nt, Homo sapiens
gucacaauccuaacacauuau

SEQ ID NO: 1037324 - RNA, 15 nt, Homo sapiens
gucacacaguauuaa

SEQ ID NO: 1037325 - RNA, 19 nt, Homo sapiens
gucacagaggaucugcuug

SEQ ID NO: 1037326 - RNA, 11 nt, Homo sapiens
gucacagggac

SEQ ID NO: 1037327 - RNA, 21 nt, Homo sapiens
gucacagggccaacuugaggg

SEQ ID NO: 1037328 - RNA, 20 nt, Homo sapiens
gucacaugaaacauuugcaa

SEQ ID NO: 1037329 - RNA, 23 nt, Homo sapiens
gucacauggccuaugcacauaug

SEQ ID NO: 1037330 - RNA, 22 nt, Homo sapiens
gucaccaaaucagcugcuacua

SEQ ID NO: 1037331 - RNA, 16 nt, Homo sapiens
gucacuaaacucucau

SEQ ID NO: 1037332 - RNA, 15 nt, Homo sapiens
gucacucuggcagcu

SEQ ID NO: 1037333 - RNA, 16 nt, Homo sapiens
gucacuggcucuccaa

SEQ ID NO: 1037334 - RNA, 20 nt, Homo sapiens
gucacuucgugggaucugcc

SEQ ID NO: 1037335 - RNA, 15 nt, Homo sapiens
uccacugugccaugu

SEQ ID NO: 1037336 - RNA, 15 nt, Homo sapiens
uccagaagaucugaa

SEQ ID NO: 1037337 - RNA, 13 nt, Homo sapiens
uccagaaguguga

SEQ ID NO: 1037338 - RNA, 14 nt, Homo sapiens
uccagaccauucag

SEQ ID NO: 1037339 - RNA, 17 nt, Homo sapiens
uccagaugagaguacac

SEQ ID NO: 1037340 - RNA, 20 nt, Homo sapiens
uccagaugagaguacacccc

SEQ ID NO: 1037341 - RNA, 17 nt, Homo sapiens
uccagcaccauccgcca

SEQ ID NO: 1037342 - RNA, 19 nt, Homo sapiens
uccagcaucuaguggugga

SEQ ID NO: 1037343 - RNA, 15 nt, Homo sapiens
uccagcccugcagcu

SEQ ID NO: 1037344 - RNA, 17 nt, Homo sapiens
uccagcccugcagcuau

SEQ ID NO: 1037345 - RNA, 17 nt, Homo sapiens
uccagccgccauugcca

SEQ ID NO: 1037346 - RNA, 23 nt, Homo sapiens
uccagcuucugguacucuccuag

SEQ ID NO: 1037347 - RNA, 23 nt, Homo sapiens
uccaggcaaaauugauauacuuu

SEQ ID NO: 1037348 - RNA, 20 nt, Homo sapiens
uccaggcgaugugcaagugu

SEQ ID NO: 1037349 - RNA, 18 nt, Homo sapiens
uccaggcgugguggcaca

SEQ ID NO: 1037350 - RNA, 23 nt, Homo sapiens
uccaggcgugguggcacacaccu

SEQ ID NO: 1037351 - RNA, 12 nt, Homo sapiens
uccaggggccac

SEQ ID NO: 1037352 - RNA, 22 nt, Homo sapiens
uccaggguuaaccacuguggug

SEQ ID NO: 1037353 - RNA, 21 nt, Homo sapiens
uccagguuuccuuaagggaca

SEQ ID NO: 1037354 - RNA, 18 nt, Homo sapiens
uccaguagaaagcauaac

SEQ ID NO: 1037355 - RNA, 19 nt, Homo sapiens
uccaguauucuugucaaaa

SEQ ID NO: 1037356 - RNA, 22 nt, Homo sapiens
uccagucuuccgacaaacuaac

SEQ ID NO: 1037357 - RNA, 13 nt, Homo sapiens
uccagugcaggag

SEQ ID NO: 1037358 - RNA, 20 nt, Homo sapiens
uccagugccagcaaugacau

SEQ ID NO: 1037359 - RNA, 16 nt, Homo sapiens
uccaguugucuauuca

SEQ ID NO: 1037360 - RNA, 11 nt, Homo sapiens
uccaguuugca

SEQ ID NO: 1037361 - RNA, 18 nt, Homo sapiens
uccauaaacacccaugaa

SEQ ID NO: 1037362 - RNA, 19 nt, Homo sapiens
uccauaaacacccaugaau

SEQ ID NO: 1037363 - RNA, 19 nt, Homo sapiens
uccauaguaguaugaugau

SEQ ID NO: 1037364 - RNA, 18 nt, Homo sapiens
uccauauauuagcauuua

SEQ ID NO: 1037365 - RNA, 21 nt, Homo sapiens
uccaucaguuagagcugacac

SEQ ID NO: 1037366 - RNA, 20 nt, Homo sapiens
uccauccauggggcugauug

SEQ ID NO: 1037367 - RNA, 14 nt, Homo sapiens
uccaucccuacccc

SEQ ID NO: 1037368 - RNA, 18 nt, Homo sapiens
uccaucgcugucaucuca

SEQ ID NO: 1037369 - RNA, 14 nt, Homo sapiens
uccaugaagaccac

SEQ ID NO: 1037370 - RNA, 16 nt, Homo sapiens
uccaugauguuuucca

SEQ ID NO: 1037371 - RNA, 22 nt, Homo sapiens
uccaugucgccucugcauucag

SEQ ID NO: 1037372 - RNA, 15 nt, Homo sapiens
uccaugugugugcaa

SEQ ID NO: 1037373 - RNA, 18 nt, Homo sapiens
uccauguucuauuucagu

SEQ ID NO: 1037374 - RNA, 14 nt, Homo sapiens
uccauuauuuauau

SEQ ID NO: 1037375 - RNA, 13 nt, Homo sapiens
uccauucucugag

SEQ ID NO: 1037376 - RNA, 20 nt, Homo sapiens
ucccaaaaucauaagauauu

SEQ ID NO: 1037377 - RNA, 20 nt, Homo sapiens
ucccaaagugcugagauuac

SEQ ID NO: 1037378 - RNA, 21 nt, Homo sapiens
ucccaaauuucauaccuauca

SEQ ID NO: 1037379 - RNA, 20 nt, Homo sapiens
ucccaaguagcuggaauuac

SEQ ID NO: 1037380 - RNA, 23 nt, Homo sapiens
ucccacacagaauauacauuguc

SEQ ID NO: 1037381 - RNA, 13 nt, Homo sapiens
ucccacaggacau

SEQ ID NO: 1037382 - RNA, 12 nt, Homo sapiens
ucccaccacagc

SEQ ID NO: 1037383 - RNA, 19 nt, Homo sapiens
ucccacccacaugugacac

SEQ ID NO: 1037384 - RNA, 21 nt, Homo sapiens
ucccacccacaugugacacau

SEQ ID NO: 1037385 - RNA, 18 nt, Homo sapiens
ucccacccccaucucucc

SEQ ID NO: 1037386 - RNA, 15 nt, Homo sapiens
ucccacucaguccau

SEQ ID NO: 1037387 - RNA, 18 nt, Homo sapiens
ucccacuguuuaaggagu

SEQ ID NO: 1037388 - RNA, 13 nt, Homo sapiens
ucccacuuggcau

SEQ ID NO: 1037389 - RNA, 18 nt, Homo sapiens
ucccagaaucaaagcaau

SEQ ID NO: 1037390 - RNA, 14 nt, Homo sapiens
ucccagcaguggac

SEQ ID NO: 1037391 - RNA, 19 nt, Homo sapiens
ucccagcccuauggaugug

SEQ ID NO: 1037392 - RNA, 13 nt, Homo sapiens
ucccagcuacuca

SEQ ID NO: 1037393 - RNA, 15 nt, Homo sapiens
ucccagcuacuuggg

SEQ ID NO: 1037394 - RNA, 15 nt, Homo sapiens
ucccaggaacugggc

SEQ ID NO: 1037395 - RNA, 15 nt, Homo sapiens
ucccaggagaaucac

SEQ ID NO: 1037396 - RNA, 21 nt, Homo sapiens
ucccaggagaaucacuugaac

SEQ ID NO: 1037397 - RNA, 17 nt, Homo sapiens
ucccaggaguacacccc

SEQ ID NO: 1037398 - RNA, 19 nt, Homo sapiens
ucccaggcuggagugcagu

SEQ ID NO: 1037399 - RNA, 20 nt, Homo sapiens
ucccaguggcugcugcccag

SEQ ID NO: 1037400 - RNA, 15 nt, Homo sapiens
ucccaucacuucccu

SEQ ID NO: 1037401 - RNA, 16 nt, Homo sapiens
ucccaucucacacaug

SEQ ID NO: 1037402 - RNA, 15 nt, Homo sapiens
ucccaucugugaaag

SEQ ID NO: 1037403 - RNA, 16 nt, Homo sapiens
ucccaugacccaggcu

SEQ ID NO: 1037404 - RNA, 16 nt, Homo sapiens
ucccauggaucaucaa

SEQ ID NO: 1037405 - RNA, 15 nt, Homo sapiens
ucccauguaccagca

SEQ ID NO: 1037406 - RNA, 22 nt, Homo sapiens
ucccauguaccagcagcuggaa

SEQ ID NO: 1037407 - RNA, 14 nt, Homo sapiens
ucccauguauuuau

SEQ ID NO: 1037408 - RNA, 12 nt, Homo sapiens
ucccauucugag

SEQ ID NO: 1037409 - RNA, 22 nt, Homo sapiens
ucccauuguggcuccuaucugu

SEQ ID NO: 1037410 - RNA, 17 nt, Homo sapiens
ucccauuucuacucuua

SEQ ID NO: 1037411 - RNA, 24 nt, Homo sapiens
uccccaacagugugaaguuagaau

SEQ ID NO: 1037412 - RNA, 16 nt, Homo sapiens
uccccaaccacuucau

SEQ ID NO: 1037413 - RNA, 21 nt, Homo sapiens
uccccaaccucccccaggugc

SEQ ID NO: 1037414 - RNA, 16 nt, Homo sapiens
uccccaccaccaauug

SEQ ID NO: 1037415 - RNA, 12 nt, Homo sapiens
uccccacugcuc

SEQ ID NO: 1037416 - RNA, 23 nt, Homo sapiens
uccccagacaccgccacauggcu

SEQ ID NO: 1037417 - RNA, 18 nt, Homo sapiens
uccccaggggaaaaugaa

SEQ ID NO: 1037418 - RNA, 21 nt, Homo sapiens
uccccaguucauugcacuuug

SEQ ID NO: 1037419 - RNA, 21 nt, Homo sapiens
uccccauuacccucaggacaa

SEQ ID NO: 1037420 - RNA, 17 nt, Homo sapiens
uccccauuugcuuacuu

SEQ ID NO: 1037421 - RNA, 13 nt, Homo sapiens
ucccccaacagau

SEQ ID NO: 1037422 - RNA, 17 nt, Homo sapiens
ucccccagccucaaguc

SEQ ID NO: 1037423 - RNA, 17 nt, Homo sapiens
ucccccuaauauuaggg

SEQ ID NO: 1037424 - RNA, 15 nt, Homo sapiens
ucccccuucucccac

SEQ ID NO: 1037425 - RNA, 19 nt, Homo sapiens
uccccgcccguuuuacaaa

SEQ ID NO: 1037426 - RNA, 22 nt, Homo sapiens
uccccuagcuuuccccagacac

SEQ ID NO: 1037427 - RNA, 16 nt, Homo sapiens
uccccucagagugcaa

SEQ ID NO: 1037428 - RNA, 20 nt, Homo sapiens
uccccucucagagcuacuug

SEQ ID NO: 1037429 - RNA, 16 nt, Homo sapiens
uccccuggacugggag

SEQ ID NO: 1037430 - RNA, 23 nt, Homo sapiens
uccccugucacgugugggcaaug

SEQ ID NO: 1037431 - RNA, 14 nt, Homo sapiens
uccccuucacuccc

SEQ ID NO: 1037432 - RNA, 14 nt, Homo sapiens
uccccuucugcaau

SEQ ID NO: 1037433 - RNA, 15 nt, Homo sapiens
uccccuuucacaggu

SEQ ID NO: 1037434 - RNA, 14 nt, Homo sapiens
ucccggacugcaag

SEQ ID NO: 1037435 - RNA, 20 nt, Homo sapiens
ucccggcgucccuaccuccu

SEQ ID NO: 1037436 - RNA, 16 nt, Homo sapiens
ucccggguguguacac

SEQ ID NO: 1037437 - RNA, 12 nt, Homo sapiens
ucccuaccucag

SEQ ID NO: 1037438 - RNA, 10 nt, Homo sapiens
ucccuaucua

SEQ ID NO: 1037439 - RNA, 22 nt, Homo sapiens
ucccuaucuuugccacccucau

SEQ ID NO: 1037440 - RNA, 17 nt, Homo sapiens
ucccucaaagcacacgu

SEQ ID NO: 1037441 - RNA, 23 nt, Homo sapiens
ucccucacaccgcgucuggugac

SEQ ID NO: 1037442 - RNA, 18 nt, Homo sapiens
ucccucacuguugaauuu

SEQ ID NO: 1037443 - RNA, 14 nt, Homo sapiens
ucccucauccauag

SEQ ID NO: 1037444 - RNA, 17 nt, Homo sapiens
ucccucaugcuguucca

SEQ ID NO: 1037445 - RNA, 20 nt, Homo sapiens
ucccuccccaguucauugca

SEQ ID NO: 1037446 - RNA, 16 nt, Homo sapiens
ucccuccccugccauu

SEQ ID NO: 1037447 - RNA, 21 nt, Homo sapiens
ucccuccuuuggaaugcugua

SEQ ID NO: 1037448 - RNA, 13 nt, Homo sapiens
ucccucuggauca

SEQ ID NO: 1037449 - RNA, 24 nt, Homo sapiens
ucccucuuaacgcagcacuuagac

SEQ ID NO: 1037450 - RNA, 18 nt, Homo sapiens
ucccucuuggucuuccca

SEQ ID NO: 1037451 - RNA, 23 nt, Homo sapiens
ucccugaaaauguuuuucugcca

SEQ ID NO: 1037452 - RNA, 23 nt, Homo sapiens
ucccugaaguaagcaaagacuuu

SEQ ID NO: 1037453 - RNA, 21 nt, Homo sapiens
ucccugaaucccccuugccac

SEQ ID NO: 1037454 - RNA, 20 nt, Homo sapiens
ucccugauaacaaccuggag

SEQ ID NO: 1037455 - RNA, 24 nt, Homo sapiens
ucccugccucucaucaacugaaug

SEQ ID NO: 1037456 - RNA, 21 nt, Homo sapiens
ucccuggcucccaugaccaua

SEQ ID NO: 1037457 - RNA, 21 nt, Homo sapiens
ucccuguaauuguuguuugua

SEQ ID NO: 1037458 - RNA, 21 nt, Homo sapiens
ucccuguucuuggaucugcca

SEQ ID NO: 1037459 - RNA, 16 nt, Homo sapiens
ucccuucccauaagcu

SEQ ID NO: 1037460 - RNA, 16 nt, Homo sapiens
ucccuucuaaccugaa

SEQ ID NO: 1037461 - RNA, 15 nt, Homo sapiens
ucccuucuccaucuc

SEQ ID NO: 1037462 - RNA, 16 nt, Homo sapiens
ucccuucuccaucucu

SEQ ID NO: 1037463 - RNA, 17 nt, Homo sapiens
ucccuugaggaaacaac

SEQ ID NO: 1037464 - RNA, 16 nt, Homo sapiens
ucccuuggguucugau

SEQ ID NO: 1037465 - RNA, 18 nt, Homo sapiens
ucccuuuccuacucucag

SEQ ID NO: 1037466 - RNA, 13 nt, Homo sapiens
ucccuuucuuccc

SEQ ID NO: 1037467 - RNA, 21 nt, Homo sapiens
ucccuuuguugcacacucacu

SEQ ID NO: 1037468 - RNA, 15 nt, Homo sapiens
uccgaagucuuccau

SEQ ID NO: 1037469 - RNA, 18 nt, Homo sapiens
uccgacaccucuguuucc

SEQ ID NO: 1037470 - RNA, 21 nt, Homo sapiens
uccgaggccccugucucaggg

SEQ ID NO: 1037471 - RNA, 22 nt, Homo sapiens
uccgaggccccugucucagggu

SEQ ID NO: 1037472 - RNA, 14 nt, Homo sapiens
uccgcuuucacuuc

SEQ ID NO: 1037473 - RNA, 21 nt, Homo sapiens
uccgcuuucucuugcugccac

SEQ ID NO: 1037474 - RNA, 14 nt, Homo sapiens
uccggggcuuguac

SEQ ID NO: 1037475 - RNA, 12 nt, Homo sapiens
uccguguaaaau

SEQ ID NO: 1037476 - RNA, 13 nt, Homo sapiens
uccuaaaaauaca

SEQ ID NO: 1037477 - RNA, 20 nt, Homo sapiens
uccuaacaaguagcacccug

SEQ ID NO: 1037478 - RNA, 19 nt, Homo sapiens
uccuaaccuuccuguaaac

SEQ ID NO: 1037479 - RNA, 16 nt, Homo sapiens
ugacgacagugcauuu

SEQ ID NO: 1037480 - RNA, 19 nt, Homo sapiens
ugacggggaggaaccacug

SEQ ID NO: 1037481 - RNA, 22 nt, Homo sapiens
ugacgugccuuuugcaccccuc

SEQ ID NO: 1037482 - RNA, 18 nt, Homo sapiens
ugacucagcauaccugcu

SEQ ID NO: 1037483 - RNA, 16 nt, Homo sapiens
ugacuccuaugaucuc

SEQ ID NO: 1037484 - RNA, 16 nt, Homo sapiens
ugacuccuuucucuaa

SEQ ID NO: 1037485 - RNA, 14 nt, Homo sapiens
ugacucuccagaaa

SEQ ID NO: 1037486 - RNA, 23 nt, Homo sapiens
ugacucucuggugagcgaggaca

SEQ ID NO: 1037487 - RNA, 12 nt, Homo sapiens
ugacucugcauu

SEQ ID NO: 1037488 - RNA, 13 nt, Homo sapiens
ugacucugcauuu

SEQ ID NO: 1037489 - RNA, 14 nt, Homo sapiens
ugacucuuggcaca

SEQ ID NO: 1037490 - RNA, 19 nt, Homo sapiens
ugacugaagugaacuauga

SEQ ID NO: 1037491 - RNA, 15 nt, Homo sapiens
ugacugagaauauaa

SEQ ID NO: 1037492 - RNA, 20 nt, Homo sapiens
ugacuguguguggaggaguc

SEQ ID NO: 1037493 - RNA, 19 nt, Homo sapiens
ugacuugacagaacacugu

SEQ ID NO: 1037494 - RNA, 17 nt, Homo sapiens
ugacuuuauugcaucug

SEQ ID NO: 1037495 - RNA, 19 nt, Homo sapiens
ugagaaaacuaagucagaa

SEQ ID NO: 1037496 - RNA, 18 nt, Homo sapiens
ugagaaaagccucuccag

SEQ ID NO: 1037497 - RNA, 17 nt, Homo sapiens
ugagaaagaaacuaaua

SEQ ID NO: 1037498 - RNA, 14 nt, Homo sapiens
ugagaaaguucuca

SEQ ID NO: 1037499 - RNA, 13 nt, Homo sapiens
ugagaacacugug

SEQ ID NO: 1037500 - RNA, 22 nt, Homo sapiens
ugagaacccugcguggggacag

SEQ ID NO: 1037501 - RNA, 14 nt, Homo sapiens
ugagaagaaugacu

SEQ ID NO: 1037502 - RNA, 13 nt, Homo sapiens
ugagaagugcacu

SEQ ID NO: 1037503 - RNA, 18 nt, Homo sapiens
ugagaauauaauacugua

SEQ ID NO: 1037504 - RNA, 16 nt, Homo sapiens
ugagaauugugcucaa

SEQ ID NO: 1037505 - RNA, 13 nt, Homo sapiens
ugagaccuggcag

SEQ ID NO: 1037506 - RNA, 20 nt, Homo sapiens
ugagagaagggacacauuca

SEQ ID NO: 1037507 - RNA, 15 nt, Homo sapiens
ugagagcacagcagg

SEQ ID NO: 1037508 - RNA, 13 nt, Homo sapiens
ugagaggaugaau

SEQ ID NO: 1037509 - RNA, 19 nt, Homo sapiens
ugagaggccacagugcaau

SEQ ID NO: 1037510 - RNA, 19 nt, Homo sapiens
ugagagggcugcugaccau

SEQ ID NO: 1037511 - RNA, 13 nt, Homo sapiens
ugagagucacuug

SEQ ID NO: 1037512 - RNA, 21 nt, Homo sapiens
ugagauagaagaacugcaaag

SEQ ID NO: 1037513 - RNA, 13 nt, Homo sapiens
ugagaucauucac

SEQ ID NO: 1037514 - RNA, 16 nt, Homo sapiens
ugagaucauucacuca

SEQ ID NO: 1037515 - RNA, 21 nt, Homo sapiens
ugagaucuugguccuguguuu

SEQ ID NO: 1037516 - RNA, 22 nt, Homo sapiens
ugagaugcaggauuucuucaca

SEQ ID NO: 1037517 - RNA, 14 nt, Homo sapiens
ugagauggacacac

SEQ ID NO: 1037518 - RNA, 23 nt, Homo sapiens
ugagaugggagaaucacuugaac

SEQ ID NO: 1037519 - RNA, 18 nt, Homo sapiens
ugagcagaaguggagcug

SEQ ID NO: 1037520 - RNA, 23 nt, Homo sapiens
ugagcagguguucuucauuaccu

SEQ ID NO: 1037521 - RNA, 19 nt, Homo sapiens
ugagcagugccagcuuucu

SEQ ID NO: 1037522 - RNA, 15 nt, Homo sapiens
ugagcaucccaggau

SEQ ID NO: 1037523 - RNA, 12 nt, Homo sapiens
ugagcaugugau

SEQ ID NO: 1037524 - RNA, 13 nt, Homo sapiens
ugagcaugugaug

SEQ ID NO: 1037525 - RNA, 20 nt, Homo sapiens
ugagccccuggaggcacuga

SEQ ID NO: 1037526 - RNA, 23 nt, Homo sapiens
ugagcccucuaugguguggcaaa

SEQ ID NO: 1037527 - RNA, 14 nt, Homo sapiens
ugagccgcugugag

SEQ ID NO: 1037528 - RNA, 16 nt, Homo sapiens
ugagcuauaacuuacu

SEQ ID NO: 1037529 - RNA, 19 nt, Homo sapiens
ugagcugccuguaacuuga

SEQ ID NO: 1037530 - RNA, 14 nt, Homo sapiens
ugagcuggggaccu

SEQ ID NO: 1037531 - RNA, 17 nt, Homo sapiens
ugagcuggggaugucuc

SEQ ID NO: 1037532 - RNA, 18 nt, Homo sapiens
ugagcuggggaugucucu

SEQ ID NO: 1037533 - RNA, 22 nt, Homo sapiens
ugagcuggggaugucucucaug

SEQ ID NO: 1037534 - RNA, 21 nt, Homo sapiens
ugagcuuaagaauuuugagca

SEQ ID NO: 1037535 - RNA, 20 nt, Homo sapiens
ugagcuucauauaccagcaa

SEQ ID NO: 1037536 - RNA, 22 nt, Homo sapiens
ugagcuuuauguaauaauguga

SEQ ID NO: 1037537 - RNA, 15 nt, Homo sapiens
ugaggaaacaacagc

SEQ ID NO: 1037538 - RNA, 15 nt, Homo sapiens
ugaggaccacuccug

SEQ ID NO: 1037539 - RNA, 20 nt, Homo sapiens
ugaggauaggaguucacuuc

SEQ ID NO: 1037540 - RNA, 19 nt, Homo sapiens
ugaggauaucaaaggacaa

SEQ ID NO: 1037541 - RNA, 18 nt, Homo sapiens
ugaggaugcagagucagc

SEQ ID NO: 1037542 - RNA, 20 nt, Homo sapiens
ugaggauuuugauccaagcu

SEQ ID NO: 1037543 - RNA, 18 nt, Homo sapiens
ugaggcaggagaaucacu

SEQ ID NO: 1037544 - RNA, 22 nt, Homo sapiens
ugaggcuacagggaguguagua

SEQ ID NO: 1037545 - RNA, 14 nt, Homo sapiens
ugaggcugcaauca

SEQ ID NO: 1037546 - RNA, 20 nt, Homo sapiens
ugagggacuggaaccaggga

SEQ ID NO: 1037547 - RNA, 16 nt, Homo sapiens
ugagggcccagagcag

SEQ ID NO: 1037548 - RNA, 14 nt, Homo sapiens
ugagggcuuccuuu

SEQ ID NO: 1037549 - RNA, 17 nt, Homo sapiens
ugaggggcuggcacuga

SEQ ID NO: 1037550 - RNA, 20 nt, Homo sapiens
ugagggguaaaagcugaucu

SEQ ID NO: 1037551 - RNA, 13 nt, Homo sapiens
ugagggucagaga

SEQ ID NO: 1037552 - RNA, 15 nt, Homo sapiens
ugaggguuaaugaaa

SEQ ID NO: 1037553 - RNA, 22 nt, Homo sapiens
ugagguacagcagaaaggagaa

SEQ ID NO: 1037554 - RNA, 16 nt, Homo sapiens
ugaguacguugugcau

SEQ ID NO: 1037555 - RNA, 17 nt, Homo sapiens
ugaguacguugugcauu

SEQ ID NO: 1037556 - RNA, 16 nt, Homo sapiens
ugaguacuacaguccu

SEQ ID NO: 1037557 - RNA, 13 nt, Homo sapiens
ugaguagggacuc

SEQ ID NO: 1037558 - RNA, 19 nt, Homo sapiens
ugagucaaaaaaucucaau

SEQ ID NO: 1037559 - RNA, 15 nt, Homo sapiens
ugagucuccugugcc

SEQ ID NO: 1037560 - RNA, 15 nt, Homo sapiens
ugagucugcaucuua

SEQ ID NO: 1037561 - RNA, 18 nt, Homo sapiens
ugagucugcaucuuaggg

SEQ ID NO: 1037562 - RNA, 14 nt, Homo sapiens
ugagucugugccac

SEQ ID NO: 1037563 - RNA, 16 nt, Homo sapiens
ugagugccuguaauca

SEQ ID NO: 1037564 - RNA, 15 nt, Homo sapiens
ugagugggugaauaa

SEQ ID NO: 1037565 - RNA, 14 nt, Homo sapiens
ugagugugugcaag

SEQ ID NO: 1037566 - RNA, 19 nt, Homo sapiens
ugaguuacuaucaugucaa

SEQ ID NO: 1037567 - RNA, 15 nt, Homo sapiens
ugaguuuagugaucu

SEQ ID NO: 1037568 - RNA, 18 nt, Homo sapiens
ugaguuugcuguuugcaa

SEQ ID NO: 1037569 - RNA, 19 nt, Homo sapiens
ugaguuugggauuguggua

SEQ ID NO: 1037570 - RNA, 21 nt, Homo sapiens
ugauaagagggcacacacugu

SEQ ID NO: 1037571 - RNA, 22 nt, Homo sapiens
ugauaagagggcacacacugug

SEQ ID NO: 1037572 - RNA, 22 nt, Homo sapiens
ugauacaaauugcagacugugu

SEQ ID NO: 1037573 - RNA, 14 nt, Homo sapiens
ugauacagagggau

SEQ ID NO: 1037574 - RNA, 14 nt, Homo sapiens
ugauacccugaauu

SEQ ID NO: 1037575 - RNA, 19 nt, Homo sapiens
ugauagauuucuacacuga

SEQ ID NO: 1037576 - RNA, 13 nt, Homo sapiens
ugauagcuuuauu

SEQ ID NO: 1037577 - RNA, 15 nt, Homo sapiens
ugauauagccagaaa

SEQ ID NO: 1037578 - RNA, 20 nt, Homo sapiens
ugauaugaaaaauaugauau

SEQ ID NO: 1037579 - RNA, 19 nt, Homo sapiens
ugauauguucaacuggaga

SEQ ID NO: 1037580 - RNA, 12 nt, Homo sapiens
ugauauugcagc

SEQ ID NO: 1037581 - RNA, 13 nt, Homo sapiens
ugauauugcagcu

SEQ ID NO: 1037582 - RNA, 15 nt, Homo sapiens
ugauauugcagcuua

SEQ ID NO: 1037583 - RNA, 17 nt, Homo sapiens
ugauauuuuuacuugca

SEQ ID NO: 1037584 - RNA, 18 nt, Homo sapiens
ugaucaaagccacacucu

SEQ ID NO: 1037585 - RNA, 14 nt, Homo sapiens
ugaucacaauuugc

SEQ ID NO: 1037586 - RNA, 15 nt, Homo sapiens
ugaucacacucuggg

SEQ ID NO: 1037587 - RNA, 17 nt, Homo sapiens
ugaucagugggccucca

SEQ ID NO: 1037588 - RNA, 17 nt, Homo sapiens
ugauccguuccauugca

SEQ ID NO: 1037589 - RNA, 10 nt, Homo sapiens
ugauccucac

SEQ ID NO: 1037590 - RNA, 23 nt, Homo sapiens
ugauccugcaauuccacuuauag

SEQ ID NO: 1037591 - RNA, 12 nt, Homo sapiens
ugauccugugaa

SEQ ID NO: 1037592 - RNA, 23 nt, Homo sapiens
ugaucggagccuccucucucaaa

SEQ ID NO: 1037593 - RNA, 11 nt, Homo sapiens
ugaucucaggu

SEQ ID NO: 1037594 - RNA, 20 nt, Homo sapiens
ugaucugacauccccacuca

SEQ ID NO: 1037595 - RNA, 17 nt, Homo sapiens
ugaucuugauugugggu

SEQ ID NO: 1037596 - RNA, 23 nt, Homo sapiens
ugaugaaaagcagcuauuugccu

SEQ ID NO: 1037597 - RNA, 18 nt, Homo sapiens
ugaugaaauguaaauacu

SEQ ID NO: 1037598 - RNA, 19 nt, Homo sapiens
ugaugacagacacuucuaa

SEQ ID NO: 1037599 - RNA, 13 nt, Homo sapiens
ugaugcugggauu

SEQ ID NO: 1037600 - RNA, 21 nt, Homo sapiens
ugaugcugggauuuacacuug

SEQ ID NO: 1037601 - RNA, 18 nt, Homo sapiens
ugauggcaaaaacaaagg

SEQ ID NO: 1037602 - RNA, 16 nt, Homo sapiens
ugaugggagggauuga

SEQ ID NO: 1037603 - RNA, 14 nt, Homo sapiens
ugaugguugcaaaa

SEQ ID NO: 1037604 - RNA, 19 nt, Homo sapiens
ugauguacagucugucaug

SEQ ID NO: 1037605 - RNA, 23 nt, Homo sapiens
ugaugucauaagcgaucacuucc

SEQ ID NO: 1037606 - RNA, 16 nt, Homo sapiens
ugauuaggacuuuuau

SEQ ID NO: 1037607 - RNA, 13 nt, Homo sapiens
ugauucacaauga

SEQ ID NO: 1037608 - RNA, 13 nt, Homo sapiens
ugauucacagugu

SEQ ID NO: 1037609 - RNA, 13 nt, Homo sapiens
ugauucacugcau

SEQ ID NO: 1037610 - RNA, 20 nt, Homo sapiens
ugauugcuuaucaguaguau

SEQ ID NO: 1037611 - RNA, 13 nt, Homo sapiens
ugauuggcucacc

SEQ ID NO: 1037612 - RNA, 13 nt, Homo sapiens
ugauuucaagacc

SEQ ID NO: 1037613 - RNA, 18 nt, Homo sapiens
ugauuucacaacagauca

SEQ ID NO: 1037614 - RNA, 14 nt, Homo sapiens
ugauuucauuucaa

SEQ ID NO: 1037615 - RNA, 14 nt, Homo sapiens
ugauuuuacaauug

SEQ ID NO: 1037616 - RNA, 15 nt, Homo sapiens
ugauuuugaaaucau

SEQ ID NO: 1037617 - RNA, 18 nt, Homo sapiens
ugauuuugaaaucaugaa

SEQ ID NO: 1037618 - RNA, 13 nt, Homo sapiens
ugcaaaauuucca

SEQ ID NO: 1037619 - RNA, 21 nt, Homo sapiens
ugcaaaggcgcagugcuucuc

SEQ ID NO: 1037620 - RNA, 16 nt, Homo sapiens
ugcaaaguacauguau

SEQ ID NO: 1037621 - RNA, 22 nt, Homo sapiens
ugcaaaguacauguauuuuuaa

SEQ ID NO: 1037622 - RNA, 17 nt, Homo sapiens
ugcaaagucaugcaaag

SEQ ID NO: 1037623 - RNA, 20 nt, Homo sapiens
ugcaaaucagccaugugcug

SEQ ID NO: 1037624 - RNA, 22 nt, Homo sapiens
ugcaaaucagccaugugcugcg

SEQ ID NO: 1037625 - RNA, 16 nt, Homo sapiens
ugggaaaacacugcca

SEQ ID NO: 1037626 - RNA, 18 nt, Homo sapiens
ugggaagcagucucuucc

SEQ ID NO: 1037627 - RNA, 22 nt, Homo sapiens
ugggaaggggccuuugucuugu

SEQ ID NO: 1037628 - RNA, 22 nt, Homo sapiens
ugggaaggguccaucucagaga

SEQ ID NO: 1037629 - RNA, 16 nt, Homo sapiens
ugggacaaaggacauu

SEQ ID NO: 1037630 - RNA, 21 nt, Homo sapiens
ugggaccacacagacaggguu

SEQ ID NO: 1037631 - RNA, 22 nt, Homo sapiens
ugggaccacacagacaggguuu

SEQ ID NO: 1037632 - RNA, 13 nt, Homo sapiens
ugggaccacagag

SEQ ID NO: 1037633 - RNA, 14 nt, Homo sapiens
ugggacuacaggca

SEQ ID NO: 1037634 - RNA, 16 nt, Homo sapiens
ugggacuggcacuauu

SEQ ID NO: 1037635 - RNA, 17 nt, Homo sapiens
ugggacuggcacuauuu

SEQ ID NO: 1037636 - RNA, 18 nt, Homo sapiens
ugggacuucagcucagag

SEQ ID NO: 1037637 - RNA, 19 nt, Homo sapiens
ugggagaaaacgucuugcu

SEQ ID NO: 1037638 - RNA, 21 nt, Homo sapiens
ugggagcacuuuguaggcauu

SEQ ID NO: 1037639 - RNA, 16 nt, Homo sapiens
ugggaggccaaggugg

SEQ ID NO: 1037640 - RNA, 19 nt, Homo sapiens
ugggaggcgggaguggagu

SEQ ID NO: 1037641 - RNA, 23 nt, Homo sapiens
ugggauauuuccauauggcaaua

SEQ ID NO: 1037642 - RNA, 20 nt, Homo sapiens
ugggauccuaagggcucacc

SEQ ID NO: 1037643 - RNA, 13 nt, Homo sapiens
ugggauuacaggg

SEQ ID NO: 1037644 - RNA, 21 nt, Homo sapiens
ugggauugggggcuggugcca

SEQ ID NO: 1037645 - RNA, 19 nt, Homo sapiens
ugggauuuaaagccuuuag

SEQ ID NO: 1037646 - RNA, 19 nt, Homo sapiens
ugggcaacaacagcaaaac

SEQ ID NO: 1037647 - RNA, 18 nt, Homo sapiens
ugggcaacacagcgagac

SEQ ID NO: 1037648 - RNA, 22 nt, Homo sapiens
ugggcacucccuugguggcaag

SEQ ID NO: 1037649 - RNA, 23 nt, Homo sapiens
ugggcacucccuugguggcaaga

SEQ ID NO: 1037650 - RNA, 15 nt, Homo sapiens
ugggcagacacuguu

SEQ ID NO: 1037651 - RNA, 22 nt, Homo sapiens
ugggcagacacuguuugcccag

SEQ ID NO: 1037652 - RNA, 16 nt, Homo sapiens
ugggcagagcagagac

SEQ ID NO: 1037653 - RNA, 18 nt, Homo sapiens
ugggcagggugacccuga

SEQ ID NO: 1037654 - RNA, 19 nt, Homo sapiens
ugggcaggugguggcacug

SEQ ID NO: 1037655 - RNA, 18 nt, Homo sapiens
ugggcauucuuguuucaa

SEQ ID NO: 1037656 - RNA, 19 nt, Homo sapiens
ugggccaagucaaagacau

SEQ ID NO: 1037657 - RNA, 22 nt, Homo sapiens
ugggccacucaggggucauuca

SEQ ID NO: 1037658 - RNA, 14 nt, Homo sapiens
ugggccacugugaa

SEQ ID NO: 1037659 - RNA, 14 nt, Homo sapiens
ugggccauccucac

SEQ ID NO: 1037660 - RNA, 16 nt, Homo sapiens
ugggcggcacagccuu

SEQ ID NO: 1037661 - RNA, 21 nt, Homo sapiens
ugggcguuugaacucagggag

SEQ ID NO: 1037662 - RNA, 20 nt, Homo sapiens
ugggcuccuggggcaauggg

SEQ ID NO: 1037663 - RNA, 18 nt, Homo sapiens
ugggcuguuuuuggccua

SEQ ID NO: 1037664 - RNA, 13 nt, Homo sapiens
ugggcuucuagaa

SEQ ID NO: 1037665 - RNA, 16 nt, Homo sapiens
uggggaaguguuccag

SEQ ID NO: 1037666 - RNA, 13 nt, Homo sapiens
uggggacagggcu

SEQ ID NO: 1037667 - RNA, 15 nt, Homo sapiens
uggggagaaaagaca

SEQ ID NO: 1037668 - RNA, 17 nt, Homo sapiens
uggggagacuucuuggc

SEQ ID NO: 1037669 - RNA, 17 nt, Homo sapiens
uggggagcccgucucag

SEQ ID NO: 1037670 - RNA, 17 nt, Homo sapiens
uggggaugguccacugu

SEQ ID NO: 1037671 - RNA, 20 nt, Homo sapiens
uggggauugcccauccaucu

SEQ ID NO: 1037672 - RNA, 16 nt, Homo sapiens
uggggcaggucacuuu

SEQ ID NO: 1037673 - RNA, 19 nt, Homo sapiens
uggggcagucucugcccaa

SEQ ID NO: 1037674 - RNA, 20 nt, Homo sapiens
uggggccgaaagaacagucc

SEQ ID NO: 1037675 - RNA, 10 nt, Homo sapiens
uggggcuccu

SEQ ID NO: 1037676 - RNA, 16 nt, Homo sapiens
ugggggaaauggugcc

SEQ ID NO: 1037677 - RNA, 23 nt, Homo sapiens
ugggggaagaccuggcaaggaca

SEQ ID NO: 1037678 - RNA, 14 nt, Homo sapiens
uggggguauuguau

SEQ ID NO: 1037679 - RNA, 18 nt, Homo sapiens
ugggguacccacugcucu

SEQ ID NO: 1037680 - RNA, 16 nt, Homo sapiens
uggggucuccuauacu

SEQ ID NO: 1037681 - RNA, 15 nt, Homo sapiens
uggggucuuuuuaug

SEQ ID NO: 1037682 - RNA, 14 nt, Homo sapiens
uggggugaugcugg

SEQ ID NO: 1037683 - RNA, 19 nt, Homo sapiens
ugggguugcaaccacugca

SEQ ID NO: 1037684 - RNA, 18 nt, Homo sapiens
ugggguuucuggggucca

SEQ ID NO: 1037685 - RNA, 21 nt, Homo sapiens
ugggugauuacauaaucugua

SEQ ID NO: 1037686 - RNA, 16 nt, Homo sapiens
ugggugggaccacaga

SEQ ID NO: 1037687 - RNA, 18 nt, Homo sapiens
ugggugucagucagggac

SEQ ID NO: 1037688 - RNA, 23 nt, Homo sapiens
uggguucacagaagcacagcacc

SEQ ID NO: 1037689 - RNA, 15 nt, Homo sapiens
ugguaaacauucucu

SEQ ID NO: 1037690 - RNA, 16 nt, Homo sapiens
ugguaaauuaguauuu

SEQ ID NO: 1037691 - RNA, 17 nt, Homo sapiens
ugguaaauuaguauuua

SEQ ID NO: 1037692 - RNA, 23 nt, Homo sapiens
ugguaacuuuuuuuuaaagcuca

SEQ ID NO: 1037693 - RNA, 20 nt, Homo sapiens
ugguacaaucucaaauucuc

SEQ ID NO: 1037694 - RNA, 15 nt, Homo sapiens
ugguacucaagcccg

SEQ ID NO: 1037695 - RNA, 17 nt, Homo sapiens
ugguacuuguaccuccg

SEQ ID NO: 1037696 - RNA, 13 nt, Homo sapiens
ugguagagauuca

SEQ ID NO: 1037697 - RNA, 18 nt, Homo sapiens
ugguagcaagaagugauu

SEQ ID NO: 1037698 - RNA, 17 nt, Homo sapiens
ugguaggauaucuuggc

SEQ ID NO: 1037699 - RNA, 19 nt, Homo sapiens
ugguauccugugacaugua

SEQ ID NO: 1037700 - RNA, 12 nt, Homo sapiens
ugguaugaucac

SEQ ID NO: 1037701 - RNA, 23 nt, Homo sapiens
ugguauguguguguaugcuacua

SEQ ID NO: 1037702 - RNA, 18 nt, Homo sapiens
uggucaagcacucgggaa

SEQ ID NO: 1037703 - RNA, 13 nt, Homo sapiens
uggucaccaaauc

SEQ ID NO: 1037704 - RNA, 20 nt, Homo sapiens
ugguccauagagagcaagac

SEQ ID NO: 1037705 - RNA, 18 nt, Homo sapiens
uggucccccuuccaugga

SEQ ID NO: 1037706 - RNA, 14 nt, Homo sapiens
ugguccgaucuuug

SEQ ID NO: 1037707 - RNA, 20 nt, Homo sapiens
uggucguuuucaacagaauu

SEQ ID NO: 1037708 - RNA, 14 nt, Homo sapiens
uggucuacacugug

SEQ ID NO: 1037709 - RNA, 18 nt, Homo sapiens
uggucuugagaugucuuc

SEQ ID NO: 1037710 - RNA, 20 nt, Homo sapiens
uggucuuguggaauugggag

SEQ ID NO: 1037711 - RNA, 16 nt, Homo sapiens
uggugaaaauguacug

SEQ ID NO: 1037712 - RNA, 23 nt, Homo sapiens
uggugaaagaaaauucuuggaau

SEQ ID NO: 1037713 - RNA, 17 nt, Homo sapiens
uggugaaauggcuggag

SEQ ID NO: 1037714 - RNA, 17 nt, Homo sapiens
uggugacaccagccuuu

SEQ ID NO: 1037715 - RNA, 18 nt, Homo sapiens
uggugacccagucagagu

SEQ ID NO: 1037716 - RNA, 21 nt, Homo sapiens
uggugagaaaucguugcugca

SEQ ID NO: 1037717 - RNA, 19 nt, Homo sapiens
uggugagccgagauugcac

SEQ ID NO: 1037718 - RNA, 13 nt, Homo sapiens
uggugaggcaaua

SEQ ID NO: 1037719 - RNA, 17 nt, Homo sapiens
uggugcacugagcugca

SEQ ID NO: 1037720 - RNA, 20 nt, Homo sapiens
uggugcuguggccaggguga

SEQ ID NO: 1037721 - RNA, 23 nt, Homo sapiens
ugguggacucgccuguaaucuca

SEQ ID NO: 1037722 - RNA, 19 nt, Homo sapiens
ugguggagaaagcacugac

SEQ ID NO: 1037723 - RNA, 15 nt, Homo sapiens
ugguggagggccaca

SEQ ID NO: 1037724 - RNA, 16 nt, Homo sapiens
ugguggaucuguccaa

SEQ ID NO: 1037725 - RNA, 12 nt, Homo sapiens
ugguggcagcuc

SEQ ID NO: 1037726 - RNA, 19 nt, Homo sapiens
ugguggcucacgccuguaa

SEQ ID NO: 1037727 - RNA, 19 nt, Homo sapiens
uggugggggugcagaugag

SEQ ID NO: 1037728 - RNA, 22 nt, Homo sapiens
ugguguaaagccaacacccugu

SEQ ID NO: 1037729 - RNA, 13 nt, Homo sapiens
uggugugcugcuu

SEQ ID NO: 1037730 - RNA, 17 nt, Homo sapiens
ugguguuaaucauuuca

SEQ ID NO: 1037731 - RNA, 22 nt, Homo sapiens
ugguuauggccgaaaaggauau

SEQ ID NO: 1037732 - RNA, 17 nt, Homo sapiens
ugguuccggcucugcac

SEQ ID NO: 1037733 - RNA, 20 nt, Homo sapiens
ugguucugaugaugugccug

SEQ ID NO: 1037734 - RNA, 17 nt, Homo sapiens
ugguugaguucagguag

SEQ ID NO: 1037735 - RNA, 15 nt, Homo sapiens
ugguuggguccucac

SEQ ID NO: 1037736 - RNA, 17 nt, Homo sapiens
ugguuucccaucuccau

SEQ ID NO: 1037737 - RNA, 17 nt, Homo sapiens
ugguuuuauaaucugau

SEQ ID NO: 1037738 - RNA, 18 nt, Homo sapiens
ugguuuuucaguuuucag

SEQ ID NO: 1037739 - RNA, 14 nt, Homo sapiens
uguaaaacuaucug

SEQ ID NO: 1037740 - RNA, 22 nt, Homo sapiens
uguaaaauggaggccauugugu

SEQ ID NO: 1037741 - RNA, 12 nt, Homo sapiens
uguaaagccagc

SEQ ID NO: 1037742 - RNA, 18 nt, Homo sapiens
uguaaagugauauuuccc

SEQ ID NO: 1037743 - RNA, 18 nt, Homo sapiens
uguaaauacacauagcau

SEQ ID NO: 1037744 - RNA, 21 nt, Homo sapiens
uguaaauaguuacuccagugc

SEQ ID NO: 1037745 - RNA, 13 nt, Homo sapiens
uguaacagucuga

SEQ ID NO: 1037746 - RNA, 15 nt, Homo sapiens
uguaacaucagggac

SEQ ID NO: 1037747 - RNA, 17 nt, Homo sapiens
uguaagaaacacacuga

SEQ ID NO: 1037748 - RNA, 16 nt, Homo sapiens
uguaagaaauacugua

SEQ ID NO: 1037749 - RNA, 16 nt, Homo sapiens
uguaagacucauuccc

SEQ ID NO: 1037750 - RNA, 23 nt, Homo sapiens
uguaagaucguucucugccucac

SEQ ID NO: 1037751 - RNA, 22 nt, Homo sapiens
uguaagcucuacugaggugcua

SEQ ID NO: 1037752 - RNA, 17 nt, Homo sapiens
uguaagguggucacugu

SEQ ID NO: 1037753 - RNA, 18 nt, Homo sapiens
uguaaucaguuuuaucca

SEQ ID NO: 1037754 - RNA, 20 nt, Homo sapiens
uguaaucccaacauuuuggg

SEQ ID NO: 1037755 - RNA, 20 nt, Homo sapiens
uguaaucucauaacuuucca

SEQ ID NO: 1037756 - RNA, 12 nt, Homo sapiens
uguaaugcauag

SEQ ID NO: 1037757 - RNA, 23 nt, Homo sapiens
uguaauuuuaaauaaaagugauc

SEQ ID NO: 1037758 - RNA, 20 nt, Homo sapiens
uguacaaugaacccccauga

SEQ ID NO: 1037759 - RNA, 21 nt, Homo sapiens
uguacaaugacuuuauugcau

SEQ ID NO: 1037760 - RNA, 19 nt, Homo sapiens
uguacaguguguaaagugu

SEQ ID NO: 1037761 - RNA, 22 nt, Homo sapiens
uguacauguguagccugugcau

SEQ ID NO: 1037762 - RNA, 19 nt, Homo sapiens
uguaccaaaaaauauugcu

SEQ ID NO: 1037763 - RNA, 15 nt, Homo sapiens
uguaccacaaacaca

SEQ ID NO: 1037764 - RNA, 23 nt, Homo sapiens
uguaccagcagcuggaaucugaa

SEQ ID NO: 1037765 - RNA, 18 nt, Homo sapiens
uguacucaauggauuuga

SEQ ID NO: 1037766 - RNA, 15 nt, Homo sapiens
uguacuugccuuauu

SEQ ID NO: 1037767 - RNA, 18 nt, Homo sapiens
uguagaagauggcacuua

SEQ ID NO: 1037768 - RNA, 15 nt, Homo sapiens
uucucucguaacugg

SEQ ID NO: 1037769 - RNA, 16 nt, Homo sapiens
uucugaaguguuucac

SEQ ID NO: 1037770 - RNA, 17 nt, Homo sapiens
uucugaaucaaggugau

SEQ ID NO: 1037771 - RNA, 15 nt, Homo sapiens
uucugagaaggugag

SEQ ID NO: 1037772 - RNA, 17 nt, Homo sapiens
uucugaggacauuccaa

SEQ ID NO: 1037773 - RNA, 21 nt, Homo sapiens
uucugaggacauuccaagaca

SEQ ID NO: 1037774 - RNA, 21 nt, Homo sapiens
uucugaggguccacuacucaa

SEQ ID NO: 1037775 - RNA, 22 nt, Homo sapiens
uucugauuugucccuaugcaua

SEQ ID NO: 1037776 - RNA, 22 nt, Homo sapiens
uucugcagauaaacaguaguga

SEQ ID NO: 1037777 - RNA, 20 nt, Homo sapiens
uucugcagcaugaccuguga

SEQ ID NO: 1037778 - RNA, 23 nt, Homo sapiens
uucugcccgggaaggucaccagc

SEQ ID NO: 1037779 - RNA, 21 nt, Homo sapiens
uucugccuccauucugaccau

SEQ ID NO: 1037780 - RNA, 17 nt, Homo sapiens
uucugccuucucaggaa

SEQ ID NO: 1037781 - RNA, 19 nt, Homo sapiens
uucugccuucucaugaucc

SEQ ID NO: 1037782 - RNA, 18 nt, Homo sapiens
uucuggagucuccagugg

SEQ ID NO: 1037783 - RNA, 23 nt, Homo sapiens
uucugggagacacccaaagggug

SEQ ID NO: 1037784 - RNA, 18 nt, Homo sapiens
uucugggcaaucaguguu

SEQ ID NO: 1037785 - RNA, 19 nt, Homo sapiens
uucuggguggccucgggac

SEQ ID NO: 1037786 - RNA, 20 nt, Homo sapiens
uucuggugggguguguucca

SEQ ID NO: 1037787 - RNA, 21 nt, Homo sapiens
uucuguaggaugugucacugu

SEQ ID NO: 1037788 - RNA, 14 nt, Homo sapiens
uucuguauuugcca

SEQ ID NO: 1037789 - RNA, 16 nt, Homo sapiens
uucugucuggagugac

SEQ ID NO: 1037790 - RNA, 18 nt, Homo sapiens
uucuguggaccacugcau

SEQ ID NO: 1037791 - RNA, 16 nt, Homo sapiens
uucuguugaaguuuac

SEQ ID NO: 1037792 - RNA, 22 nt, Homo sapiens
uucuuaaaaguugugauuccag

SEQ ID NO: 1037793 - RNA, 17 nt, Homo sapiens
uucuuaaagaguucuua

SEQ ID NO: 1037794 - RNA, 21 nt, Homo sapiens
uucuuaaucuuuucacaaaua

SEQ ID NO: 1037795 - RNA, 13 nt, Homo sapiens
uucuuacaaacau

SEQ ID NO: 1037796 - RNA, 18 nt, Homo sapiens
uucuuacagacugcaugu

SEQ ID NO: 1037797 - RNA, 19 nt, Homo sapiens
uucuuacuucccuaaugaa

SEQ ID NO: 1037798 - RNA, 14 nt, Homo sapiens
uucuuaggccacau

SEQ ID NO: 1037799 - RNA, 14 nt, Homo sapiens
uucuuagugucacu

SEQ ID NO: 1037800 - RNA, 17 nt, Homo sapiens
uucuuauguugcccagu

SEQ ID NO: 1037801 - RNA, 19 nt, Homo sapiens
uucuucagagacuccugca

SEQ ID NO: 1037802 - RNA, 21 nt, Homo sapiens
uucuucagauacaaacugcag

SEQ ID NO: 1037803 - RNA, 19 nt, Homo sapiens
uucuucaggguccugagau

SEQ ID NO: 1037804 - RNA, 17 nt, Homo sapiens
uucuucaugcaaugaca

SEQ ID NO: 1037805 - RNA, 12 nt, Homo sapiens
uucuucucaggc

SEQ ID NO: 1037806 - RNA, 13 nt, Homo sapiens
uucuucugccuca

SEQ ID NO: 1037807 - RNA, 16 nt, Homo sapiens
uucuucuguauguuag

SEQ ID NO: 1037808 - RNA, 13 nt, Homo sapiens
uucuuguugcaaa

SEQ ID NO: 1037809 - RNA, 19 nt, Homo sapiens
uucuuuaaauuucaucuca

SEQ ID NO: 1037810 - RNA, 14 nt, Homo sapiens
uucuuuaccugaga

SEQ ID NO: 1037811 - RNA, 23 nt, Homo sapiens
uucuuuccucuuccccuugcccu

SEQ ID NO: 1037812 - RNA, 12 nt, Homo sapiens
uucuuuccugag

SEQ ID NO: 1037813 - RNA, 14 nt, Homo sapiens
uucuuuccugccuu

SEQ ID NO: 1037814 - RNA, 13 nt, Homo sapiens
uucuuuugcucuu

SEQ ID NO: 1037815 - RNA, 19 nt, Homo sapiens
uucuuuuggcuuccaugau

SEQ ID NO: 1037816 - RNA, 16 nt, Homo sapiens
uugaaaacucacagaa

SEQ ID NO: 1037817 - RNA, 14 nt, Homo sapiens
uugaaaagcuauua

SEQ ID NO: 1037818 - RNA, 17 nt, Homo sapiens
uugaaaauaauuguucc

SEQ ID NO: 1037819 - RNA, 15 nt, Homo sapiens
uugaaacaaagaagg

SEQ ID NO: 1037820 - RNA, 15 nt, Homo sapiens
uugaaacugagaugu

SEQ ID NO: 1037821 - RNA, 23 nt, Homo sapiens
uugaaauaauaaaucugguagaa

SEQ ID NO: 1037822 - RNA, 21 nt, Homo sapiens
uugaaauaccagugaaccaaa

SEQ ID NO: 1037823 - RNA, 14 nt, Homo sapiens
uugaaauaguugau

SEQ ID NO: 1037824 - RNA, 12 nt, Homo sapiens
uugaacugguuc

SEQ ID NO: 1037825 - RNA, 12 nt, Homo sapiens
uugaacuuggaa

SEQ ID NO: 1037826 - RNA, 14 nt, Homo sapiens
uugaagagauuuua

SEQ ID NO: 1037827 - RNA, 18 nt, Homo sapiens
uugaagagcauugcaugg

SEQ ID NO: 1037828 - RNA, 15 nt, Homo sapiens
uugaaggacacaaga

SEQ ID NO: 1037829 - RNA, 20 nt, Homo sapiens
uugaaggaguccuugcauca

SEQ ID NO: 1037830 - RNA, 22 nt, Homo sapiens
uugaaggguguugcacccuuuu

SEQ ID NO: 1037831 - RNA, 14 nt, Homo sapiens
uugaaggucugcaa

SEQ ID NO: 1037832 - RNA, 19 nt, Homo sapiens
uugaaguaggacuuuccua

SEQ ID NO: 1037833 - RNA, 13 nt, Homo sapiens
uugaaguuuacaa

SEQ ID NO: 1037834 - RNA, 21 nt, Homo sapiens
uugaaguuuuagcggucaauu

SEQ ID NO: 1037835 - RNA, 13 nt, Homo sapiens
uugaaugacaaag

SEQ ID NO: 1037836 - RNA, 13 nt, Homo sapiens
uugaauguucucu

SEQ ID NO: 1037837 - RNA, 23 nt, Homo sapiens
uugacaaacucucccuucacucc

SEQ ID NO: 1037838 - RNA, 16 nt, Homo sapiens
uugacagaacacuguc

SEQ ID NO: 1037839 - RNA, 20 nt, Homo sapiens
uugacaucaaugaugaggcu

SEQ ID NO: 1037840 - RNA, 20 nt, Homo sapiens
uugaccacggacuccagucu

SEQ ID NO: 1037841 - RNA, 23 nt, Homo sapiens
uugaccacucuuccugaguucag

SEQ ID NO: 1037842 - RNA, 12 nt, Homo sapiens
uugaccucaggu

SEQ ID NO: 1037843 - RNA, 20 nt, Homo sapiens
uugacuauuauagaauggaa

SEQ ID NO: 1037844 - RNA, 14 nt, Homo sapiens
uugacucugcauuu

SEQ ID NO: 1037845 - RNA, 21 nt, Homo sapiens
uugacucuuguuuucaguuuc

SEQ ID NO: 1037846 - RNA, 17 nt, Homo sapiens
uugacuugacagaacac

SEQ ID NO: 1037847 - RNA, 18 nt, Homo sapiens
uugacuuuagggacucaa

SEQ ID NO: 1037848 - RNA, 17 nt, Homo sapiens
uugagaaagccuucaua

SEQ ID NO: 1037849 - RNA, 16 nt, Homo sapiens
uugagaaugguuacaa

SEQ ID NO: 1037850 - RNA, 17 nt, Homo sapiens
uugagacaggaugguua

SEQ ID NO: 1037851 - RNA, 16 nt, Homo sapiens
uugagacuuccaaagg

SEQ ID NO: 1037852 - RNA, 13 nt, Homo sapiens
uugagcaagccga

SEQ ID NO: 1037853 - RNA, 19 nt, Homo sapiens
uugagcaucagugagguua

SEQ ID NO: 1037854 - RNA, 23 nt, Homo sapiens
uugagcuccccaaaaaccucacc

SEQ ID NO: 1037855 - RNA, 17 nt, Homo sapiens
uugagcucuucuuaaag

SEQ ID NO: 1037856 - RNA, 21 nt, Homo sapiens
uugagcuucauauaccagcaa

SEQ ID NO: 1037857 - RNA, 21 nt, Homo sapiens
uugaggacaaccauuccagac

SEQ ID NO: 1037858 - RNA, 19 nt, Homo sapiens
uugaggggcuggccuuccu

SEQ ID NO: 1037859 - RNA, 15 nt, Homo sapiens
uugagggguggaccc

SEQ ID NO: 1037860 - RNA, 16 nt, Homo sapiens
uugaggguccucaguc

SEQ ID NO: 1037861 - RNA, 20 nt, Homo sapiens
uugauaaucaacugggcuga

SEQ ID NO: 1037862 - RNA, 16 nt, Homo sapiens
uugauaccaccuauau

SEQ ID NO: 1037863 - RNA, 13 nt, Homo sapiens
uugauagauuucu

SEQ ID NO: 1037864 - RNA, 17 nt, Homo sapiens
uugauauuuuccaaaug

SEQ ID NO: 1037865 - RNA, 21 nt, Homo sapiens
uugaucaggcacaguggcuca

SEQ ID NO: 1037866 - RNA, 15 nt, Homo sapiens
uugaucuguucuggg

SEQ ID NO: 1037867 - RNA, 14 nt, Homo sapiens
uugaugcaugcacu

SEQ ID NO: 1037868 - RNA, 14 nt, Homo sapiens
uugauggugaugaa

SEQ ID NO: 1037869 - RNA, 19 nt, Homo sapiens
uugaugucaaaaacuucaa

SEQ ID NO: 1037870 - RNA, 17 nt, Homo sapiens
uugauucacaaugaaau

SEQ ID NO: 1037871 - RNA, 20 nt, Homo sapiens
uugauugcguggaauugugc

SEQ ID NO: 1037872 - RNA, 15 nt, Homo sapiens
uugauuucauuaaua

SEQ ID NO: 1037873 - RNA, 19 nt, Homo sapiens
uugcaaagguuccaacugu

SEQ ID NO: 1037874 - RNA, 21 nt, Homo sapiens
uugcaaagguuccaacuguau

SEQ ID NO: 1037875 - RNA, 21 nt, Homo sapiens
uugcaaaguaucccuacugua

SEQ ID NO: 1037876 - RNA, 14 nt, Homo sapiens
uugcaacuuagcuc

SEQ ID NO: 1037877 - RNA, 21 nt, Homo sapiens
uugcacaaaaucacacagcca

SEQ ID NO: 1037878 - RNA, 23 nt, Homo sapiens
uugcacagcucuccggucucucu

SEQ ID NO: 1037879 - RNA, 11 nt, Homo sapiens
uugcacuuugu

SEQ ID NO: 1037880 - RNA, 16 nt, Homo sapiens
uugcagaugacaaaaa

SEQ ID NO: 1037881 - RNA, 15 nt, Homo sapiens
uugcagcugauguug

SEQ ID NO: 1037882 - RNA, 20 nt, Homo sapiens
uugcaggaccucaggugaga

SEQ ID NO: 1037883 - RNA, 13 nt, Homo sapiens
uugcagguugcuu

SEQ ID NO: 1037884 - RNA, 15 nt, Homo sapiens
uugcagugagccaag

SEQ ID NO: 1037885 - RNA, 21 nt, Homo sapiens
uugcauggauguuuuagccau

SEQ ID NO: 1037886 - RNA, 13 nt, Homo sapiens
uugcauugcagag

SEQ ID NO: 1037887 - RNA, 20 nt, Homo sapiens
uugccaaacagccacacugu

SEQ ID NO: 1037888 - RNA, 19 nt, Homo sapiens
uugccauuacgcuaguuau

SEQ ID NO: 1037889 - RNA, 17 nt, Homo sapiens
uugcccccagacuuccu

SEQ ID NO: 1037890 - RNA, 15 nt, Homo sapiens
uugccuccuggaaaa

SEQ ID NO: 1037891 - RNA, 21 nt, Homo sapiens
uugccucugaagccuauguau

SEQ ID NO: 1037892 - RNA, 13 nt, Homo sapiens
uugccuguucagu

SEQ ID NO: 1037893 - RNA, 20 nt, Homo sapiens
uugccuucuccacuuuggga

SEQ ID NO: 1037894 - RNA, 14 nt, Homo sapiens
uugccuugugaauu

SEQ ID NO: 1037895 - RNA, 22 nt, Homo sapiens
uugccuugugaauuugcugcua

SEQ ID NO: 1037896 - RNA, 13 nt, Homo sapiens
uugcggacagcca

SEQ ID NO: 1037897 - RNA, 17 nt, Homo sapiens
uugcggggauaaagaga

SEQ ID NO: 1037898 - RNA, 17 nt, Homo sapiens
uugcguggacucugcac

SEQ ID NO: 1037899 - RNA, 23 nt, Homo sapiens
uugcuaaaagauuauagaaguag

SEQ ID NO: 1037900 - RNA, 23 nt, Homo sapiens
uugcuaacugugcuccucacuuc

SEQ ID NO: 1037901 - RNA, 15 nt, Homo sapiens
uugcuaccucaaggg

SEQ ID NO: 1037902 - RNA, 17 nt, Homo sapiens
uugcuagccaucuugau

SEQ ID NO: 1037903 - RNA, 23 nt, Homo sapiens
uugcuauggggagaaaagacaug

SEQ ID NO: 1037904 - RNA, 13 nt, Homo sapiens
uugcucuuuggua

SEQ ID NO: 1037905 - RNA, 23 nt, Homo sapiens
uugcuggggcucgugcccugcau

SEQ ID NO: 1037906 - RNA, 11 nt, Homo sapiens
uugcuguagaa

SEQ ID NO: 1037907 - RNA, 13 nt, Homo sapiens
uugcugugagcaa

SEQ ID NO: 1037908 - RNA, 23 nt, Homo sapiens
uugcuucccggcgucccuaccuc

SEQ ID NO: 1037909 - RNA, 16 nt, Homo sapiens
uugcuuccgacaccuc

SEQ ID NO: 1037910 - RNA, 11 nt, Homo sapiens
uugcuugccuc

SEQ ID NO: 1037911 - RNA, 22 nt, Homo sapiens
uugcuuuagcacaggacaacuu

SEQ ID NO: 1037912 - RNA, 10 nt, Homo sapiens
uugcuuuaug

SEQ ID NO: 1037913 - RNA, 16 nt, Homo sapiens
auaagaaagugcgagu

SEQ ID NO: 1037914 - RNA, 22 nt, Homo sapiens
auaagaaagugcgaguccucca

SEQ ID NO: 1037915 - RNA, 20 nt, Homo sapiens
auaagaagcuuucaguauua

SEQ ID NO: 1037916 - RNA, 21 nt, Homo sapiens
auaagagggcacacacugugu

SEQ ID NO: 1037917 - RNA, 18 nt, Homo sapiens
auaagagugccguaacaa

SEQ ID NO: 1037918 - RNA, 21 nt, Homo sapiens
auaagaguugagauuuugcaa

SEQ ID NO: 1037919 - RNA, 22 nt, Homo sapiens
auaagaguugagauuuugcaau

SEQ ID NO: 1037920 - RNA, 18 nt, Homo sapiens
auaagauuuaauucacau

SEQ ID NO: 1037921 - RNA, 11 nt, Homo sapiens
auaagcaagag

SEQ ID NO: 1037922 - RNA, 17 nt, Homo sapiens
auaagcacugugcuaau

SEQ ID NO: 1037923 - RNA, 15 nt, Homo sapiens
auaagcuguuuuuau

SEQ ID NO: 1037924 - RNA, 15 nt, Homo sapiens
auaaggaaagcaaua

SEQ ID NO: 1037925 - RNA, 16 nt, Homo sapiens
auaaggaaagcaauaa

SEQ ID NO: 1037926 - RNA, 19 nt, Homo sapiens
auaagucaauuccuagaag

SEQ ID NO: 1037927 - RNA, 12 nt, Homo sapiens
auaaguccuugc

SEQ ID NO: 1037928 - RNA, 19 nt, Homo sapiens
auaaguuauugcaguuuau

SEQ ID NO: 1037929 - RNA, 20 nt, Homo sapiens
auaaguucuuaugccauguu

SEQ ID NO: 1037930 - RNA, 14 nt, Homo sapiens
auaaguuucacuga

SEQ ID NO: 1037931 - RNA, 21 nt, Homo sapiens
auaaguuuuauguuaaaucaa

SEQ ID NO: 1037932 - RNA, 16 nt, Homo sapiens
auaauaaacaguggaa

SEQ ID NO: 1037933 - RNA, 16 nt, Homo sapiens
auaauaagcuaaagag

SEQ ID NO: 1037934 - RNA, 16 nt, Homo sapiens
auaauacuagucuuau

SEQ ID NO: 1037935 - RNA, 16 nt, Homo sapiens
auaauaugagaaucag

SEQ ID NO: 1037936 - RNA, 14 nt, Homo sapiens
auaaucaacugggc

SEQ ID NO: 1037937 - RNA, 13 nt, Homo sapiens
auaaucaaugaag

SEQ ID NO: 1037938 - RNA, 21 nt, Homo sapiens
auaaucauucuuauuucauga

SEQ ID NO: 1037939 - RNA, 16 nt, Homo sapiens
auaaucuguacaauga

SEQ ID NO: 1037940 - RNA, 20 nt, Homo sapiens
auaaucuuuggguaacuuca

SEQ ID NO: 1037941 - RNA, 21 nt, Homo sapiens
auaaucuuuggguaacuucaa

SEQ ID NO: 1037942 - RNA, 21 nt, Homo sapiens
auaaugcgugcauaccacuuu

SEQ ID NO: 1037943 - RNA, 14 nt, Homo sapiens
auaaugcuaaagaa

SEQ ID NO: 1037944 - RNA, 21 nt, Homo sapiens
auaauguuacauuauuaucaa

SEQ ID NO: 1037945 - RNA, 22 nt, Homo sapiens
auaauguuaucuguguagcaag

SEQ ID NO: 1037946 - RNA, 16 nt, Homo sapiens
auaauucuguacauag

SEQ ID NO: 1037947 - RNA, 22 nt, Homo sapiens
auaauucuuuucuuuuccauuu

SEQ ID NO: 1037948 - RNA, 13 nt, Homo sapiens
auaauugcauuca

SEQ ID NO: 1037949 - RNA, 17 nt, Homo sapiens
auacaaaaauaccuacu

SEQ ID NO: 1037950 - RNA, 12 nt, Homo sapiens
auacaaagugau

SEQ ID NO: 1037951 - RNA, 13 nt, Homo sapiens
auacaaagugaug

SEQ ID NO: 1037952 - RNA, 16 nt, Homo sapiens
auacaauuagccaggu

SEQ ID NO: 1037953 - RNA, 19 nt, Homo sapiens
auacaauuauuuuuacagu

SEQ ID NO: 1037954 - RNA, 22 nt, Homo sapiens
auacaauuauuuuuacaguucu

SEQ ID NO: 1037955 - RNA, 19 nt, Homo sapiens
auacaauuccaaacacaua

SEQ ID NO: 1037956 - RNA, 13 nt, Homo sapiens
auacaauugucau

SEQ ID NO: 1037957 - RNA, 16 nt, Homo sapiens
auacacagaugaaggu

SEQ ID NO: 1037958 - RNA, 13 nt, Homo sapiens
auacacuaugaag

SEQ ID NO: 1037959 - RNA, 15 nt, Homo sapiens
auacacuaugaagau

SEQ ID NO: 1037960 - RNA, 16 nt, Homo sapiens
auacagcucagcuuuu

SEQ ID NO: 1037961 - RNA, 16 nt, Homo sapiens
auacaggacauucuca

SEQ ID NO: 1037962 - RNA, 17 nt, Homo sapiens
auacaggacauucucau

SEQ ID NO: 1037963 - RNA, 15 nt, Homo sapiens
auacaguaucucagg

SEQ ID NO: 1037964 - RNA, 12 nt, Homo sapiens
auacagugucuu

SEQ ID NO: 1037965 - RNA, 17 nt, Homo sapiens
auacaguuugucacaug

SEQ ID NO: 1037966 - RNA, 20 nt, Homo sapiens
auacaguuugucacaugaaa

SEQ ID NO: 1037967 - RNA, 13 nt, Homo sapiens
auacaugcugcua

SEQ ID NO: 1037968 - RNA, 14 nt, Homo sapiens
acaggaaaaugcca

SEQ ID NO: 1037969 - RNA, 13 nt, Homo sapiens
acaggaaaccacu

SEQ ID NO: 1037970 - RNA, 22 nt, Homo sapiens
acaggaagccugcaguccugga

SEQ ID NO: 1037971 - RNA, 23 nt, Homo sapiens
acaggaagguagaaauaucugaa

SEQ ID NO: 1037972 - RNA, 18 nt, Homo sapiens
acaggaauacuuaacuca

SEQ ID NO: 1037973 - RNA, 19 nt, Homo sapiens
acaggaauacuuaacucaa

SEQ ID NO: 1037974 - RNA, 14 nt, Homo sapiens
acaggagcugggau

SEQ ID NO: 1037975 - RNA, 23 nt, Homo sapiens
acaggagcugggauccuaagggc

SEQ ID NO: 1037976 - RNA, 23 nt, Homo sapiens
acaggaggcccccaucuaugagc

SEQ ID NO: 1037977 - RNA, 13 nt, Homo sapiens
acaggagugggaa

SEQ ID NO: 1037978 - RNA, 17 nt, Homo sapiens
acaggaugaccuggaua

SEQ ID NO: 1037979 - RNA, 14 nt, Homo sapiens
acaggcaagcaccu

SEQ ID NO: 1037980 - RNA, 14 nt, Homo sapiens
acaggcaagugaag

SEQ ID NO: 1037981 - RNA, 13 nt, Homo sapiens
acaggcacccacc

SEQ ID NO: 1037982 - RNA, 18 nt, Homo sapiens
acaggccauacuuuacaa

SEQ ID NO: 1037983 - RNA, 15 nt, Homo sapiens
acaggcucugaccag

SEQ ID NO: 1037984 - RNA, 18 nt, Homo sapiens
acagggacugaaaaccuc

SEQ ID NO: 1037985 - RNA, 20 nt, Homo sapiens
acagggucucuagugcugug

SEQ ID NO: 1037986 - RNA, 22 nt, Homo sapiens
acaggguuuugccauguuggcc

SEQ ID NO: 1037987 - RNA, 14 nt, Homo sapiens
acagguaucugucc

SEQ ID NO: 1037988 - RNA, 14 nt, Homo sapiens
acaggucaacuuca

SEQ ID NO: 1037989 - RNA, 17 nt, Homo sapiens
acaggucccacugcccu

SEQ ID NO: 1037990 - RNA, 19 nt, Homo sapiens
acagguggcaggaccagga

SEQ ID NO: 1037991 - RNA, 13 nt, Homo sapiens
acaggugugaacc

SEQ ID NO: 1037992 - RNA, 14 nt, Homo sapiens
acaguaacugccau

SEQ ID NO: 1037993 - RNA, 12 nt, Homo sapiens
acaguaucucag

SEQ ID NO: 1037994 - RNA, 14 nt, Homo sapiens
acaguaucucaggg

SEQ ID NO: 1037995 - RNA, 21 nt, Homo sapiens
acaguaugagucaaugugcag

SEQ ID NO: 1037996 - RNA, 23 nt, Homo sapiens
acaguaugagucaaugugcagug

SEQ ID NO: 1037997 - RNA, 15 nt, Homo sapiens
acaguaugucccaua

SEQ ID NO: 1037998 - RNA, 13 nt, Homo sapiens
acagucauuuaaa

SEQ ID NO: 1037999 - RNA, 15 nt, Homo sapiens
acaguccucccaucu

SEQ ID NO: 1038000 - RNA, 20 nt, Homo sapiens
acagugacuccacucugagu

SEQ ID NO: 1038001 - RNA, 16 nt, Homo sapiens
acagugaggugcccag

SEQ ID NO: 1038002 - RNA, 12 nt, Homo sapiens
acagugaugcug

SEQ ID NO: 1038003 - RNA, 11 nt, Homo sapiens
acagugcauuu

SEQ ID NO: 1038004 - RNA, 15 nt, Homo sapiens
acagugccugggaau

SEQ ID NO: 1038005 - RNA, 13 nt, Homo sapiens
acaguuaaugcca

SEQ ID NO: 1038006 - RNA, 16 nt, Homo sapiens
acaguuacuccaguau

SEQ ID NO: 1038007 - RNA, 22 nt, Homo sapiens
acaguucaauucucauuuguca

SEQ ID NO: 1038008 - RNA, 13 nt, Homo sapiens
acaguuccuucag

SEQ ID NO: 1038009 - RNA, 18 nt, Homo sapiens
acaguugcauguuauauu

SEQ ID NO: 1038010 - RNA, 16 nt, Homo sapiens
acaguuuucugagaaa

SEQ ID NO: 1038011 - RNA, 20 nt, Homo sapiens
acaguuuugguugcuuuaau

SEQ ID NO: 1038012 - RNA, 20 nt, Homo sapiens
acauaacguuuuuccuuuaa

SEQ ID NO: 1038013 - RNA, 21 nt, Homo sapiens
acauaagacagacagcaguuu

SEQ ID NO: 1038014 - RNA, 20 nt, Homo sapiens
acauaagaccauaacagcca

SEQ ID NO: 1038015 - RNA, 12 nt, Homo sapiens
acauacucccau

SEQ ID NO: 1038016 - RNA, 14 nt, Homo sapiens
acauacucccaucu

SEQ ID NO: 1038017 - RNA, 20 nt, Homo sapiens
acauagaauuaacacaugau

SEQ ID NO: 1038018 - RNA, 18 nt, Homo sapiens
acauagaugucccuuucu

SEQ ID NO: 1038019 - RNA, 23 nt, Homo sapiens
acauagccuauauuuacagugaa

SEQ ID NO: 1038020 - RNA, 12 nt, Homo sapiens
acauagcugugc

SEQ ID NO: 1038021 - RNA, 22 nt, Homo sapiens
acauaguagguacccaauucaa

SEQ ID NO: 1038022 - RNA, 14 nt, Homo sapiens
acauauaaagcacu

SEQ ID NO: 1038023 - RNA, 18 nt, Homo sapiens
acauauaaagcacuauac

SEQ ID NO: 1038024 - RNA, 17 nt, Homo sapiens
acauauggacucugcac

SEQ ID NO: 1038025 - RNA, 20 nt, Homo sapiens
acauauggacucugcacaug

SEQ ID NO: 1038026 - RNA, 17 nt, Homo sapiens
acauauuaggaaaauau

SEQ ID NO: 1038027 - RNA, 18 nt, Homo sapiens
acauauucuuuaaauuuc

SEQ ID NO: 1038028 - RNA, 15 nt, Homo sapiens
acauauuuguuaaau

SEQ ID NO: 1038029 - RNA, 13 nt, Homo sapiens
acaucaagcacag

SEQ ID NO: 1038030 - RNA, 18 nt, Homo sapiens
acaucaagccugugauug

SEQ ID NO: 1038031 - RNA, 15 nt, Homo sapiens
acaucaagcgaugaa

SEQ ID NO: 1038032 - RNA, 13 nt, Homo sapiens
acaucaaugauga

SEQ ID NO: 1038033 - RNA, 17 nt, Homo sapiens
acaucaaugaugaggcu

SEQ ID NO: 1038034 - RNA, 14 nt, Homo sapiens
acaucaauguucau

SEQ ID NO: 1038035 - RNA, 21 nt, Homo sapiens
acaucaguuuaaacaaaggga

SEQ ID NO: 1038036 - RNA, 20 nt, Homo sapiens
acaucaucaaggcacugccu

SEQ ID NO: 1038037 - RNA, 21 nt, Homo sapiens
acauccaaccccccaccugcc

SEQ ID NO: 1038038 - RNA, 21 nt, Homo sapiens
acauccaaggagaaacagaga

SEQ ID NO: 1038039 - RNA, 16 nt, Homo sapiens
acauccccuucugcaa

SEQ ID NO: 1038040 - RNA, 16 nt, Homo sapiens
acaucuuggcacauuu

SEQ ID NO: 1038041 - RNA, 18 nt, Homo sapiens
acaucuuucacacuucca

SEQ ID NO: 1038042 - RNA, 14 nt, Homo sapiens
acaucuuuccuguc

SEQ ID NO: 1038043 - RNA, 14 nt, Homo sapiens
acaugaauccauau

SEQ ID NO: 1038044 - RNA, 21 nt, Homo sapiens
acaugacacaguuggauuuau

SEQ ID NO: 1038045 - RNA, 16 nt, Homo sapiens
acaugaccacauagca

SEQ ID NO: 1038046 - RNA, 17 nt, Homo sapiens
acaugagaucuagguga

SEQ ID NO: 1038047 - RNA, 16 nt, Homo sapiens
acaugagucccagugg

SEQ ID NO: 1038048 - RNA, 14 nt, Homo sapiens
acaugauccugcaa

SEQ ID NO: 1038049 - RNA, 22 nt, Homo sapiens
acaugauggagcgcaccugccc

SEQ ID NO: 1038050 - RNA, 21 nt, Homo sapiens
acaugcacacacacacaucuc

SEQ ID NO: 1038051 - RNA, 14 nt, Homo sapiens
acaugcacucagcu

SEQ ID NO: 1038052 - RNA, 23 nt, Homo sapiens
acaugcagcccagaauagcuuug

SEQ ID NO: 1038053 - RNA, 16 nt, Homo sapiens
acaugcauugagcucu

SEQ ID NO: 1038054 - RNA, 18 nt, Homo sapiens
acaugccaagcacugugc

SEQ ID NO: 1038055 - RNA, 15 nt, Homo sapiens
acaugccagugacac

SEQ ID NO: 1038056 - RNA, 21 nt, Homo sapiens
acaugcugaagccaaagccaa

SEQ ID NO: 1038057 - RNA, 17 nt, Homo sapiens
acauggaacgcuuucau

SEQ ID NO: 1038058 - RNA, 20 nt, Homo sapiens
acauggaauuaccuuagauu

SEQ ID NO: 1038059 - RNA, 16 nt, Homo sapiens
acauggccuaugcaca

SEQ ID NO: 1038060 - RNA, 17 nt, Homo sapiens
acauggugaaacccugu

SEQ ID NO: 1038061 - RNA, 21 nt, Homo sapiens
acauguaaaauaugucuuucu

SEQ ID NO: 1038062 - RNA, 19 nt, Homo sapiens
acauguaauuaaguacuau

SEQ ID NO: 1038063 - RNA, 16 nt, Homo sapiens
acauguacuguucucu

SEQ ID NO: 1038064 - RNA, 17 nt, Homo sapiens
acaugugacacauaugc

SEQ ID NO: 1038065 - RNA, 18 nt, Homo sapiens
acaugugacacauaugca

SEQ ID NO: 1038066 - RNA, 12 nt, Homo sapiens
acaugugcacau

SEQ ID NO: 1038067 - RNA, 16 nt, Homo sapiens
acaugugcacaugcac

SEQ ID NO: 1038068 - RNA, 15 nt, Homo sapiens
acaugugcacuugaa

SEQ ID NO: 1038069 - RNA, 10 nt, Homo sapiens
acaugugcuu

SEQ ID NO: 1038070 - RNA, 19 nt, Homo sapiens
acauguguagccugugcau

SEQ ID NO: 1038071 - RNA, 23 nt, Homo sapiens
acaugugugcgugugcgugcaug

SEQ ID NO: 1038072 - RNA, 22 nt, Homo sapiens
acauguguuuuaauuccaauau

SEQ ID NO: 1038073 - RNA, 18 nt, Homo sapiens
acauuaccuuacugugga

SEQ ID NO: 1038074 - RNA, 15 nt, Homo sapiens
acauuagucauucaa

SEQ ID NO: 1038075 - RNA, 15 nt, Homo sapiens
acauuaucaucugaa

SEQ ID NO: 1038076 - RNA, 22 nt, Homo sapiens
acauuaucaucugaaaaucugg

SEQ ID NO: 1038077 - RNA, 23 nt, Homo sapiens
acauuauuuuauuauaacaucca

SEQ ID NO: 1038078 - RNA, 21 nt, Homo sapiens
acauucaaggcauuucuauca

SEQ ID NO: 1038079 - RNA, 24 nt, Homo sapiens
acauuccuuagucucaagggcuag

SEQ ID NO: 1038080 - RNA, 20 nt, Homo sapiens
acauucuaaaggcuugauau

SEQ ID NO: 1038081 - RNA, 22 nt, Homo sapiens
acauucucaucaccacagggau

SEQ ID NO: 1038082 - RNA, 23 nt, Homo sapiens
acauucugcaagcacaucugcau

SEQ ID NO: 1038083 - RNA, 17 nt, Homo sapiens
acauucuggcucaggga

SEQ ID NO: 1038084 - RNA, 20 nt, Homo sapiens
acauucuuagaguuaccaca

SEQ ID NO: 1038085 - RNA, 15 nt, Homo sapiens
acauucuugcuaauu

SEQ ID NO: 1038086 - RNA, 22 nt, Homo sapiens
acauucuuguuuuaagugccuu

SEQ ID NO: 1038087 - RNA, 19 nt, Homo sapiens
acauugaaagagaaccagu

SEQ ID NO: 1038088 - RNA, 17 nt, Homo sapiens
acauuguggcacauucu

SEQ ID NO: 1038089 - RNA, 20 nt, Homo sapiens
acauuguuugucugucuuca

SEQ ID NO: 1038090 - RNA, 15 nt, Homo sapiens
acauuuaagagacag

SEQ ID NO: 1038091 - RNA, 14 nt, Homo sapiens
acauuuacugugga

SEQ ID NO: 1038092 - RNA, 15 nt, Homo sapiens
acauuuacuguggau

SEQ ID NO: 1038093 - RNA, 16 nt, Homo sapiens
acauuuccaaaugaau

SEQ ID NO: 1038094 - RNA, 18 nt, Homo sapiens
acauuuuguaacaaagaa

SEQ ID NO: 1038095 - RNA, 23 nt, Homo sapiens
acauuuuuaaaaugcaacaugug

SEQ ID NO: 1038096 - RNA, 14 nt, Homo sapiens
accaaaaacugaaa

SEQ ID NO: 1038097 - RNA, 13 nt, Homo sapiens
accaaagagacug

SEQ ID NO: 1038098 - RNA, 15 nt, Homo sapiens
accaaagagacugga

SEQ ID NO: 1038099 - RNA, 13 nt, Homo sapiens
accaaaucacuga

SEQ ID NO: 1038100 - RNA, 19 nt, Homo sapiens
accaacaguuccuucagcu

SEQ ID NO: 1038101 - RNA, 18 nt, Homo sapiens
accaacauacucccaucu

SEQ ID NO: 1038102 - RNA, 13 nt, Homo sapiens
accaacccagaga

SEQ ID NO: 1038103 - RNA, 18 nt, Homo sapiens
accaacccuguuuccuga

SEQ ID NO: 1038104 - RNA, 22 nt, Homo sapiens
accaacugcugcugugcacauu

SEQ ID NO: 1038105 - RNA, 18 nt, Homo sapiens
accaacugggcccaagac

SEQ ID NO: 1038106 - RNA, 23 nt, Homo sapiens
accaagaagggcuagaaccugga

SEQ ID NO: 1038107 - RNA, 15 nt, Homo sapiens
accaagcucugucca

SEQ ID NO: 1038108 - RNA, 23 nt, Homo sapiens
accaaggcaaggcaggugccucc

SEQ ID NO: 1038109 - RNA, 14 nt, Homo sapiens
accaauaaagccuu

SEQ ID NO: 1038110 - RNA, 16 nt, Homo sapiens
accaauaccuccucca

SEQ ID NO: 1038111 - RNA, 15 nt, Homo sapiens
accacuccacuggcc

SEQ ID NO: 1038112 - RNA, 17 nt, Homo sapiens
accacugauaaaaccau

SEQ ID NO: 1038113 - RNA, 10 nt, Homo sapiens
accacugcac

SEQ ID NO: 1038114 - RNA, 20 nt, Homo sapiens
accacugcagaagacaguau

SEQ ID NO: 1038115 - RNA, 15 nt, Homo sapiens
accacugcucuccag

SEQ ID NO: 1038116 - RNA, 23 nt, Homo sapiens
accacugugguggugugcugcuu

SEQ ID NO: 1038117 - RNA, 13 nt, Homo sapiens
accagaaguggac

SEQ ID NO: 1038118 - RNA, 16 nt, Homo sapiens
accagaauaaacccag

SEQ ID NO: 1038119 - RNA, 19 nt, Homo sapiens
accagacagacaacacugg

SEQ ID NO: 1038120 - RNA, 14 nt, Homo sapiens
accagacuguguau

SEQ ID NO: 1038121 - RNA, 14 nt, Homo sapiens
accagagcauuucc

SEQ ID NO: 1038122 - RNA, 17 nt, Homo sapiens
accagaggaaacuugca

SEQ ID NO: 1038123 - RNA, 18 nt, Homo sapiens
accagaggacaaagccuu

SEQ ID NO: 1038124 - RNA, 17 nt, Homo sapiens
accagaggcugcagaag

SEQ ID NO: 1038125 - RNA, 22 nt, Homo sapiens
accagaggcugcagaaggccaa

SEQ ID NO: 1038126 - RNA, 17 nt, Homo sapiens
accagagucaaauuuga

SEQ ID NO: 1038127 - RNA, 15 nt, Homo sapiens
accagcaaagcaaug

SEQ ID NO: 1038128 - RNA, 16 nt, Homo sapiens
accagcaauacaaaga

SEQ ID NO: 1038129 - RNA, 21 nt, Homo sapiens
accagcagagcaccuuagaca

SEQ ID NO: 1038130 - RNA, 21 nt, Homo sapiens
accagcagaucccagcucacg

SEQ ID NO: 1038131 - RNA, 17 nt, Homo sapiens
accagcagcccaagggc

SEQ ID NO: 1038132 - RNA, 15 nt, Homo sapiens
accagcagcuggaau

SEQ ID NO: 1038133 - RNA, 23 nt, Homo sapiens
accagcagcuggaaucugaaggc

SEQ ID NO: 1038134 - RNA, 14 nt, Homo sapiens
accagccauacuua

SEQ ID NO: 1038135 - RNA, 22 nt, Homo sapiens
accagccuggucaacaugguga

SEQ ID NO: 1038136 - RNA, 15 nt, Homo sapiens
accagcuuugcagug

SEQ ID NO: 1038137 - RNA, 22 nt, Homo sapiens
accaggaaccuccuccacacca

SEQ ID NO: 1038138 - RNA, 18 nt, Homo sapiens
accaggagggcacuggag

SEQ ID NO: 1038139 - RNA, 18 nt, Homo sapiens
accaggcaaagcaaguga

SEQ ID NO: 1038140 - RNA, 17 nt, Homo sapiens
accaggcccacagccca

SEQ ID NO: 1038141 - RNA, 23 nt, Homo sapiens
accaggggaggccugaggcuuca

SEQ ID NO: 1038142 - RNA, 13 nt, Homo sapiens
accaggucaggga

SEQ ID NO: 1038143 - RNA, 19 nt, Homo sapiens
accaguaacggaacaguau

SEQ ID NO: 1038144 - RNA, 14 nt, Homo sapiens
accagucacugucc

SEQ ID NO: 1038145 - RNA, 19 nt, Homo sapiens
accagucugucuucuguag

SEQ ID NO: 1038146 - RNA, 23 nt, Homo sapiens
accagugaaccaaagagacugga

SEQ ID NO: 1038147 - RNA, 19 nt, Homo sapiens
accaguugggagcacugga

SEQ ID NO: 1038148 - RNA, 19 nt, Homo sapiens
accaguuuaaccugaugca

SEQ ID NO: 1038149 - RNA, 16 nt, Homo sapiens
accaguuucagagaaa

SEQ ID NO: 1038150 - RNA, 20 nt, Homo sapiens
accauagggacccauucuac

SEQ ID NO: 1038151 - RNA, 17 nt, Homo sapiens
accaucacaugaccaca

SEQ ID NO: 1038152 - RNA, 17 nt, Homo sapiens
accaucagggacaggau

SEQ ID NO: 1038153 - RNA, 12 nt, Homo sapiens
accaucuuggcc

SEQ ID NO: 1038154 - RNA, 13 nt, Homo sapiens
accaucuuugcag

SEQ ID NO: 1038155 - RNA, 23 nt, Homo sapiens
accaugcagugccccuagcuuag

SEQ ID NO: 1038156 - RNA, 15 nt, Homo sapiens
accaugccaggcuaa

SEQ ID NO: 1038157 - RNA, 15 nt, Homo sapiens
accauguacauagcu

SEQ ID NO: 1038158 - RNA, 17 nt, Homo sapiens
accauguuagccaggau

SEQ ID NO: 1038159 - RNA, 13 nt, Homo sapiens
accauucaggaca

SEQ ID NO: 1038160 - RNA, 20 nt, Homo sapiens
accauugcugucaaguuccu

SEQ ID NO: 1038161 - RNA, 12 nt, Homo sapiens
accauuugcacu

SEQ ID NO: 1038162 - RNA, 19 nt, Homo sapiens
accauuuugggguacccac

SEQ ID NO: 1038163 - RNA, 21 nt, Homo sapiens
accauuuugggguacccacug

SEQ ID NO: 1038164 - RNA, 18 nt, Homo sapiens
accauuuuugaaaccaaa

SEQ ID NO: 1038165 - RNA, 17 nt, Homo sapiens
acccaaauguucaucaa

SEQ ID NO: 1038166 - RNA, 18 nt, Homo sapiens
acccacaccucugccaga

SEQ ID NO: 1038167 - RNA, 14 nt, Homo sapiens
acccaccccugugc

SEQ ID NO: 1038168 - RNA, 14 nt, Homo sapiens
acccacuuccugau

SEQ ID NO: 1038169 - RNA, 16 nt, Homo sapiens
acccagacagcucccu

SEQ ID NO: 1038170 - RNA, 16 nt, Homo sapiens
acccagcuaugguucu

SEQ ID NO: 1038171 - RNA, 17 nt, Homo sapiens
acccaggagguggaggu

SEQ ID NO: 1038172 - RNA, 17 nt, Homo sapiens
acccaggaguguggcca

SEQ ID NO: 1038173 - RNA, 21 nt, Homo sapiens
acccagucagaguugugcaca

SEQ ID NO: 1038174 - RNA, 16 nt, Homo sapiens
acccaguuagcucuca

SEQ ID NO: 1038175 - RNA, 14 nt, Homo sapiens
acccauauuacaga

SEQ ID NO: 1038176 - RNA, 22 nt, Homo sapiens
acccaugaaucaaagacaugga

SEQ ID NO: 1038177 - RNA, 13 nt, Homo sapiens
acccaugacuuua

SEQ ID NO: 1038178 - RNA, 12 nt, Homo sapiens
accccaacagca

SEQ ID NO: 1038179 - RNA, 13 nt, Homo sapiens
accccaacagcac

SEQ ID NO: 1038180 - RNA, 22 nt, Homo sapiens
accccaacagcacccucuccag

SEQ ID NO: 1038181 - RNA, 18 nt, Homo sapiens
accccaaggagggagaug

SEQ ID NO: 1038182 - RNA, 13 nt, Homo sapiens
accccaccacuuc

SEQ ID NO: 1038183 - RNA, 13 nt, Homo sapiens
accccaccuugcc

SEQ ID NO: 1038184 - RNA, 20 nt, Homo sapiens
accccagguccugcagucug

SEQ ID NO: 1038185 - RNA, 16 nt, Homo sapiens
accccaucucuacuga

SEQ ID NO: 1038186 - RNA, 15 nt, Homo sapiens
accccaucugugaau

SEQ ID NO: 1038187 - RNA, 23 nt, Homo sapiens
accccaugcuguugauugcuaaa

SEQ ID NO: 1038188 - RNA, 16 nt, Homo sapiens
acccccacaccuggaa

SEQ ID NO: 1038189 - RNA, 20 nt, Homo sapiens
acccccaccccuugcucuca

SEQ ID NO: 1038190 - RNA, 13 nt, Homo sapiens
acccccagcucaa

SEQ ID NO: 1038191 - RNA, 15 nt, Homo sapiens
accccccagaaccug

SEQ ID NO: 1038192 - RNA, 19 nt, Homo sapiens
accccccugggcugagaga

SEQ ID NO: 1038193 - RNA, 22 nt, Homo sapiens
accccgaccaccugcccaaccu

SEQ ID NO: 1038194 - RNA, 20 nt, Homo sapiens
accccggaagccaaaccucu

SEQ ID NO: 1038195 - RNA, 21 nt, Homo sapiens
accccgucgaggggcucucag

SEQ ID NO: 1038196 - RNA, 16 nt, Homo sapiens
accccucaacaccucu

SEQ ID NO: 1038197 - RNA, 18 nt, Homo sapiens
accccucacugugacuga

SEQ ID NO: 1038198 - RNA, 14 nt, Homo sapiens
accccuccaggaau

SEQ ID NO: 1038199 - RNA, 23 nt, Homo sapiens
accccuccucccuuuuuccuugu

SEQ ID NO: 1038200 - RNA, 15 nt, Homo sapiens
accccugcuaaggag

SEQ ID NO: 1038201 - RNA, 18 nt, Homo sapiens
accccuuagccucccuga

SEQ ID NO: 1038202 - RNA, 14 nt, Homo sapiens
accccuuugcccuu

SEQ ID NO: 1038203 - RNA, 18 nt, Homo sapiens
acccgacugaaacuggaa

SEQ ID NO: 1038204 - RNA, 16 nt, Homo sapiens
acccgcucuggaccaa

SEQ ID NO: 1038205 - RNA, 21 nt, Homo sapiens
acccguggagaugggaugcuu

SEQ ID NO: 1038206 - RNA, 22 nt, Homo sapiens
acccuaaaaagcagagcuuugc

SEQ ID NO: 1038207 - RNA, 20 nt, Homo sapiens
acccuaaggucauuaccaca

SEQ ID NO: 1038208 - RNA, 20 nt, Homo sapiens
acccuaguuucccugaagga

SEQ ID NO: 1038209 - RNA, 21 nt, Homo sapiens
acccuaugugggugggaccac

SEQ ID NO: 1038210 - RNA, 12 nt, Homo sapiens
acccucaugcug

SEQ ID NO: 1038211 - RNA, 11 nt, Homo sapiens
acccucccacu

SEQ ID NO: 1038212 - RNA, 19 nt, Homo sapiens
acccucccccgccacuccu

SEQ ID NO: 1038213 - RNA, 21 nt, Homo sapiens
acccucccuggaguguggcug

SEQ ID NO: 1038214 - RNA, 19 nt, Homo sapiens
acccucuccccacugcuca

SEQ ID NO: 1038215 - RNA, 23 nt, Homo sapiens
acccugacuccucuuugugcaga

SEQ ID NO: 1038216 - RNA, 17 nt, Homo sapiens
acccugcaaaggacugu

SEQ ID NO: 1038217 - RNA, 22 nt, Homo sapiens
acccugcgcccaguccuuccac

SEQ ID NO: 1038218 - RNA, 21 nt, Homo sapiens
acccuggagcccauccagucu

SEQ ID NO: 1038219 - RNA, 14 nt, Homo sapiens
acccugggaccaca

SEQ ID NO: 1038220 - RNA, 13 nt, Homo sapiens
acccuguccaaac

SEQ ID NO: 1038221 - RNA, 14 nt, Homo sapiens
acccuguuuuacaa

SEQ ID NO: 1038222 - RNA, 18 nt, Homo sapiens
acccuguuuucagcuaaa

SEQ ID NO: 1038223 - RNA, 15 nt, Homo sapiens
acccuuaucaccagc

SEQ ID NO: 1038224 - RNA, 17 nt, Homo sapiens
acccuuaucaccagcug

SEQ ID NO: 1038225 - RNA, 20 nt, Homo sapiens
acccuuaucaccagcugccu

SEQ ID NO: 1038226 - RNA, 17 nt, Homo sapiens
acccuucagauuugccu

SEQ ID NO: 1038227 - RNA, 22 nt, Homo sapiens
acccuuccuacagauagucaaa

SEQ ID NO: 1038228 - RNA, 17 nt, Homo sapiens
acccuucuuuucugacu

SEQ ID NO: 1038229 - RNA, 17 nt, Homo sapiens
acccuucuuuugaagga

SEQ ID NO: 1038230 - RNA, 22 nt, Homo sapiens
accgaaaaguuggugucaauga

SEQ ID NO: 1038231 - RNA, 14 nt, Homo sapiens
accgaaaccuugcc

SEQ ID NO: 1038232 - RNA, 14 nt, Homo sapiens
accgaggacaugaa

SEQ ID NO: 1038233 - RNA, 12 nt, Homo sapiens
accgagugcaau

SEQ ID NO: 1038234 - RNA, 19 nt, Homo sapiens
accgggaaaagggaaccau

SEQ ID NO: 1038235 - RNA, 20 nt, Homo sapiens
accgucaauaggcaaagggg

SEQ ID NO: 1038236 - RNA, 19 nt, Homo sapiens
accguggaccuuccugcca

SEQ ID NO: 1038237 - RNA, 13 nt, Homo sapiens
accguucaccagu

SEQ ID NO: 1038238 - RNA, 13 nt, Homo sapiens
acuacaggcacac

SEQ ID NO: 1038239 - RNA, 17 nt, Homo sapiens
acuacaggcaccugcca

SEQ ID NO: 1038240 - RNA, 17 nt, Homo sapiens
acuacaggcucaugcca

SEQ ID NO: 1038241 - RNA, 15 nt, Homo sapiens
acuacaucuaguuaa

SEQ ID NO: 1038242 - RNA, 21 nt, Homo sapiens
acuacaugugacuggcaguau

SEQ ID NO: 1038243 - RNA, 23 nt, Homo sapiens
acuaccuugguucccccacugau

SEQ ID NO: 1038244 - RNA, 12 nt, Homo sapiens
acuacugcaguc

SEQ ID NO: 1038245 - RNA, 13 nt, Homo sapiens
acuacugggcaaa

SEQ ID NO: 1038246 - RNA, 14 nt, Homo sapiens
acuacugugaucag

SEQ ID NO: 1038247 - RNA, 15 nt, Homo sapiens
acuagacaaguccag

SEQ ID NO: 1038248 - RNA, 15 nt, Homo sapiens
acuaggacucugagg

SEQ ID NO: 1038249 - RNA, 14 nt, Homo sapiens
acuaggagcacugu

SEQ ID NO: 1038250 - RNA, 11 nt, Homo sapiens
acuagggccaa

SEQ ID NO: 1038251 - RNA, 17 nt, Homo sapiens
acuaguuuuuauuccuu

SEQ ID NO: 1038252 - RNA, 17 nt, Homo sapiens
acuauaagcccacuguu

SEQ ID NO: 1038253 - RNA, 13 nt, Homo sapiens
acuauaucuguau

SEQ ID NO: 1038254 - RNA, 16 nt, Homo sapiens
acuauauucucagugu

SEQ ID NO: 1038255 - RNA, 14 nt, Homo sapiens
acuauccuacccca

SEQ ID NO: 1038256 - RNA, 17 nt, Homo sapiens
acuaugaaugggcaaaa

SEQ ID NO: 1038257 - RNA, 23 nt, Homo sapiens
acuaugaaugggcaaaacugaau

SEQ ID NO: 1038258 - RNA, 11 nt, Homo sapiens
acuaugcacaa

SEQ ID NO: 1038259 - RNA, 21 nt, Homo sapiens
acuauggagcugagcaggugu

SEQ ID NO: 1038260 - RNA, 15 nt, Homo sapiens
acuauucaaacaguc

SEQ ID NO: 1038261 - RNA, 21 nt, Homo sapiens
acuauuuaaagccuccucauc

SEQ ID NO: 1038262 - RNA, 17 nt, Homo sapiens
acuauuuaucugugcaa

SEQ ID NO: 1038263 - RNA, 12 nt, Homo sapiens
acucaaaccaaa

SEQ ID NO: 1038264 - RNA, 21 nt, Homo sapiens
acucaagaagcaggcuacacu

SEQ ID NO: 1038265 - RNA, 19 nt, Homo sapiens
acucaagaggcugaggcag

SEQ ID NO: 1038266 - RNA, 17 nt, Homo sapiens
acucaaggaauuugcau

SEQ ID NO: 1038267 - RNA, 21 nt, Homo sapiens
acucaauaaauauuuuugcug

SEQ ID NO: 1038268 - RNA, 16 nt, Homo sapiens
ccauaucugugaaaug

SEQ ID NO: 1038269 - RNA, 15 nt, Homo sapiens
ccauaugaauaacau

SEQ ID NO: 1038270 - RNA, 23 nt, Homo sapiens
ccauauggagcuuuuccugaugu

SEQ ID NO: 1038271 - RNA, 20 nt, Homo sapiens
ccauauuuucaccauuugau

SEQ ID NO: 1038272 - RNA, 22 nt, Homo sapiens
ccaucacgcggccgagacaugg

SEQ ID NO: 1038273 - RNA, 18 nt, Homo sapiens
ccaucagaaacacccuca

SEQ ID NO: 1038274 - RNA, 14 nt, Homo sapiens
ccaucagugcuccc

SEQ ID NO: 1038275 - RNA, 21 nt, Homo sapiens
ccaucaguuagagcugacaca

SEQ ID NO: 1038276 - RNA, 12 nt, Homo sapiens
ccaucaucccag

SEQ ID NO: 1038277 - RNA, 19 nt, Homo sapiens
ccauccaucugcuuacaau

SEQ ID NO: 1038278 - RNA, 23 nt, Homo sapiens
ccaucccagcugaaauacugagg

SEQ ID NO: 1038279 - RNA, 10 nt, Homo sapiens
ccauccucac

SEQ ID NO: 1038280 - RNA, 16 nt, Homo sapiens
ccauccucacauguga

SEQ ID NO: 1038281 - RNA, 15 nt, Homo sapiens
ccaucuaugucccuu

SEQ ID NO: 1038282 - RNA, 16 nt, Homo sapiens
ccaucucuuuaccucc

SEQ ID NO: 1038283 - RNA, 18 nt, Homo sapiens
ccaucugcuuacaauucc

SEQ ID NO: 1038284 - RNA, 13 nt, Homo sapiens
ccaucuugaucug

SEQ ID NO: 1038285 - RNA, 15 nt, Homo sapiens
ccaugaaaaugcaac

SEQ ID NO: 1038286 - RNA, 19 nt, Homo sapiens
ccaugaaccaagaccauug

SEQ ID NO: 1038287 - RNA, 18 nt, Homo sapiens
ccaugaccuaguuuucca

SEQ ID NO: 1038288 - RNA, 11 nt, Homo sapiens
ccaugagacac

SEQ ID NO: 1038289 - RNA, 17 nt, Homo sapiens
ccaugaggcaaugucag

SEQ ID NO: 1038290 - RNA, 19 nt, Homo sapiens
ccaugauaacugcaauuuu

SEQ ID NO: 1038291 - RNA, 14 nt, Homo sapiens
ccaugccugagggu

SEQ ID NO: 1038292 - RNA, 21 nt, Homo sapiens
ccaugcguguuucugacucug

SEQ ID NO: 1038293 - RNA, 16 nt, Homo sapiens
ccaugcugauaaacug

SEQ ID NO: 1038294 - RNA, 20 nt, Homo sapiens
ccaugcugcccgcuucucac

SEQ ID NO: 1038295 - RNA, 18 nt, Homo sapiens
ccauggaagguucucugu

SEQ ID NO: 1038296 - RNA, 22 nt, Homo sapiens
ccauggacacuccagugccagc

SEQ ID NO: 1038297 - RNA, 10 nt, Homo sapiens
ccauggacuu

SEQ ID NO: 1038298 - RNA, 22 nt, Homo sapiens
ccauggcuuaaugcuucuuuca

SEQ ID NO: 1038299 - RNA, 23 nt, Homo sapiens
ccaugggaaggguccaucucaga

SEQ ID NO: 1038300 - RNA, 16 nt, Homo sapiens
ccauggggaagggaua

SEQ ID NO: 1038301 - RNA, 21 nt, Homo sapiens
ccauggggcugauuguauuua

SEQ ID NO: 1038302 - RNA, 16 nt, Homo sapiens
ccauguaccagcagcu

SEQ ID NO: 1038303 - RNA, 15 nt, Homo sapiens
ccauguagaagcugc

SEQ ID NO: 1038304 - RNA, 17 nt, Homo sapiens
ccauguagaagcugcau

SEQ ID NO: 1038305 - RNA, 22 nt, Homo sapiens
ccauguagaagcugcaucuugu

SEQ ID NO: 1038306 - RNA, 21 nt, Homo sapiens
ccaugugugagugugugcaag

SEQ ID NO: 1038307 - RNA, 16 nt, Homo sapiens
ccaugugugugcaagu

SEQ ID NO: 1038308 - RNA, 20 nt, Homo sapiens
ccauguucacaccgcugcac

SEQ ID NO: 1038309 - RNA, 17 nt, Homo sapiens
ccauguuggccaggcug

SEQ ID NO: 1038310 - RNA, 22 nt, Homo sapiens
ccauguuuucccuuuauucauc

SEQ ID NO: 1038311 - RNA, 15 nt, Homo sapiens
ccauuaaaguucuca

SEQ ID NO: 1038312 - RNA, 16 nt, Homo sapiens
ccauuaaaguucucaa

SEQ ID NO: 1038313 - RNA, 19 nt, Homo sapiens
ccauucacuucauaaucca

SEQ ID NO: 1038314 - RNA, 17 nt, Homo sapiens
ccauuccagacugcuuc

SEQ ID NO: 1038315 - RNA, 22 nt, Homo sapiens
ccauuccauuuaucuuucuaca

SEQ ID NO: 1038316 - RNA, 14 nt, Homo sapiens
ccauuguggucaca

SEQ ID NO: 1038317 - RNA, 23 nt, Homo sapiens
ccauuuagccaccaucuuugcag

SEQ ID NO: 1038318 - RNA, 18 nt, Homo sapiens
ccauuucagcuguuucac

SEQ ID NO: 1038319 - RNA, 13 nt, Homo sapiens
ccauuucuacucu

SEQ ID NO: 1038320 - RNA, 19 nt, Homo sapiens
ccauuugcguuccaugaug

SEQ ID NO: 1038321 - RNA, 21 nt, Homo sapiens
ccauuuggcaaugccaucauc

SEQ ID NO: 1038322 - RNA, 18 nt, Homo sapiens
ccauuuuagucacuuuuu

SEQ ID NO: 1038323 - RNA, 14 nt, Homo sapiens
ccauuuugugaaug

SEQ ID NO: 1038324 - RNA, 22 nt, Homo sapiens
cccaaaacugauacccuuugaa

SEQ ID NO: 1038325 - RNA, 22 nt, Homo sapiens
cccaaaagcccauucauuccau

SEQ ID NO: 1038326 - RNA, 13 nt, Homo sapiens
cccaaacagugac

SEQ ID NO: 1038327 - RNA, 18 nt, Homo sapiens
cccaaauucuuucagugg

SEQ ID NO: 1038328 - RNA, 16 nt, Homo sapiens
cccaaauuucauaccu

SEQ ID NO: 1038329 - RNA, 18 nt, Homo sapiens
cccaacaggaggacaauu

SEQ ID NO: 1038330 - RNA, 22 nt, Homo sapiens
cccaagagauuguuguuugcca

SEQ ID NO: 1038331 - RNA, 23 nt, Homo sapiens
cccaagucuacagagugauagcc

SEQ ID NO: 1038332 - RNA, 18 nt, Homo sapiens
cccaaucaccuuuccugu

SEQ ID NO: 1038333 - RNA, 19 nt, Homo sapiens
cccaauggcaacaucuugc

SEQ ID NO: 1038334 - RNA, 16 nt, Homo sapiens
cccaauucacaucuaa

SEQ ID NO: 1038335 - RNA, 19 nt, Homo sapiens
cccacacuccuacaccuaa

SEQ ID NO: 1038336 - RNA, 17 nt, Homo sapiens
cccacacuggagccauc

SEQ ID NO: 1038337 - RNA, 18 nt, Homo sapiens
cccacagccgcagcugua

SEQ ID NO: 1038338 - RNA, 13 nt, Homo sapiens
cccacagguauga

SEQ ID NO: 1038339 - RNA, 22 nt, Homo sapiens
cccaccagcuaaggacauuucc

SEQ ID NO: 1038340 - RNA, 21 nt, Homo sapiens
cccacccccuucucugcucca

SEQ ID NO: 1038341 - RNA, 19 nt, Homo sapiens
cccacuaucugggugcaug

SEQ ID NO: 1038342 - RNA, 22 nt, Homo sapiens
cccacucccuggcucucagaag

SEQ ID NO: 1038343 - RNA, 15 nt, Homo sapiens
cccacuucugccaua

SEQ ID NO: 1038344 - RNA, 16 nt, Homo sapiens
cccagaacuggacuca

SEQ ID NO: 1038345 - RNA, 12 nt, Homo sapiens
cccagaaggcag

SEQ ID NO: 1038346 - RNA, 14 nt, Homo sapiens
cccagaagguugug

SEQ ID NO: 1038347 - RNA, 18 nt, Homo sapiens
cccagaaugccuccugca

SEQ ID NO: 1038348 - RNA, 18 nt, Homo sapiens
cccagagcaaaauaauuu

SEQ ID NO: 1038349 - RNA, 20 nt, Homo sapiens
cccagagcaggaagcauuca

SEQ ID NO: 1038350 - RNA, 18 nt, Homo sapiens
cccagagguaacagaaca

SEQ ID NO: 1038351 - RNA, 23 nt, Homo sapiens
cccagagguaacagaacagcuuc

SEQ ID NO: 1038352 - RNA, 22 nt, Homo sapiens
cccagagugcugggauuacaau

SEQ ID NO: 1038353 - RNA, 15 nt, Homo sapiens
cccagauacuuccca

SEQ ID NO: 1038354 - RNA, 21 nt, Homo sapiens
cccagaucggaucuguugcaa

SEQ ID NO: 1038355 - RNA, 15 nt, Homo sapiens
cccagaucugguccc

SEQ ID NO: 1038356 - RNA, 16 nt, Homo sapiens
cccagcaacacaagcu

SEQ ID NO: 1038357 - RNA, 11 nt, Homo sapiens
cccagcacugc

SEQ ID NO: 1038358 - RNA, 15 nt, Homo sapiens
cccagccacucggga

SEQ ID NO: 1038359 - RNA, 20 nt, Homo sapiens
cccagcccacuucugccaua

SEQ ID NO: 1038360 - RNA, 14 nt, Homo sapiens
cuguagucccagcu

SEQ ID NO: 1038361 - RNA, 22 nt, Homo sapiens
cuguaguugcguggacucugca

SEQ ID NO: 1038362 - RNA, 16 nt, Homo sapiens
cuguauagggcucguu

SEQ ID NO: 1038363 - RNA, 19 nt, Homo sapiens
cuguaucacagacuggcaa

SEQ ID NO: 1038364 - RNA, 22 nt, Homo sapiens
cuguaucuugggggacagggcu

SEQ ID NO: 1038365 - RNA, 19 nt, Homo sapiens
cuguaucuuguuuuuccac

SEQ ID NO: 1038366 - RNA, 18 nt, Homo sapiens
cuguaugaaugucugugg

SEQ ID NO: 1038367 - RNA, 18 nt, Homo sapiens
cuguaugccaagugaaaa

SEQ ID NO: 1038368 - RNA, 14 nt, Homo sapiens
cuguauuagucaca

SEQ ID NO: 1038369 - RNA, 17 nt, Homo sapiens
cuguauuagucacagag

SEQ ID NO: 1038370 - RNA, 18 nt, Homo sapiens
cugucaaacaaagccaga

SEQ ID NO: 1038371 - RNA, 22 nt, Homo sapiens
cugucaaacaaagccagaagcu

SEQ ID NO: 1038372 - RNA, 15 nt, Homo sapiens
cugucaaagcuguca

SEQ ID NO: 1038373 - RNA, 19 nt, Homo sapiens
cugucacguagaacuugga

SEQ ID NO: 1038374 - RNA, 23 nt, Homo sapiens
cugucacugaugguggcucuggu

SEQ ID NO: 1038375 - RNA, 18 nt, Homo sapiens
cugucagcuuccaaacau

SEQ ID NO: 1038376 - RNA, 11 nt, Homo sapiens
cugucagggac

SEQ ID NO: 1038377 - RNA, 15 nt, Homo sapiens
cugucaucagccugu

SEQ ID NO: 1038378 - RNA, 13 nt, Homo sapiens
cuguccaaaugga

SEQ ID NO: 1038379 - RNA, 15 nt, Homo sapiens
cuguccccacacuga

SEQ ID NO: 1038380 - RNA, 16 nt, Homo sapiens
cuguccccacacugac

SEQ ID NO: 1038381 - RNA, 23 nt, Homo sapiens
cugucccucaaaugacccaaaga

SEQ ID NO: 1038382 - RNA, 19 nt, Homo sapiens
cugucccucauccauagca

SEQ ID NO: 1038383 - RNA, 13 nt, Homo sapiens
cuguccuuucuca

SEQ ID NO: 1038384 - RNA, 15 nt, Homo sapiens
cugucgucuuagcaa

SEQ ID NO: 1038385 - RNA, 22 nt, Homo sapiens
cugucucaaaaccggguugcca

SEQ ID NO: 1038386 - RNA, 13 nt, Homo sapiens
cugucucagggug

SEQ ID NO: 1038387 - RNA, 21 nt, Homo sapiens
cugucucauaugauugugcac

SEQ ID NO: 1038388 - RNA, 13 nt, Homo sapiens
cugucuuguccuu

SEQ ID NO: 1038389 - RNA, 13 nt, Homo sapiens
cugugaaacuggc

SEQ ID NO: 1038390 - RNA, 16 nt, Homo sapiens
cugugaacccacugaa

SEQ ID NO: 1038391 - RNA, 15 nt, Homo sapiens
cugugaaucaccuag

SEQ ID NO: 1038392 - RNA, 15 nt, Homo sapiens
cugugaauuagcuca

SEQ ID NO: 1038393 - RNA, 18 nt, Homo sapiens
cugugacuucuccagguc

SEQ ID NO: 1038394 - RNA, 19 nt, Homo sapiens
cugugagacagugggaaau

SEQ ID NO: 1038395 - RNA, 17 nt, Homo sapiens
cugugauucgguggaga

SEQ ID NO: 1038396 - RNA, 16 nt, Homo sapiens
cugugauuuaugccaa

SEQ ID NO: 1038397 - RNA, 24 nt, Homo sapiens
cugugcaguccugggauguggcug

SEQ ID NO: 1038398 - RNA, 20 nt, Homo sapiens
cugugcccaccaugacccuc

SEQ ID NO: 1038399 - RNA, 14 nt, Homo sapiens
cugugcguuacuaa

SEQ ID NO: 1038400 - RNA, 21 nt, Homo sapiens
cugugcugguguccugaccac

SEQ ID NO: 1038401 - RNA, 22 nt, Homo sapiens
cuguggagaaauaaaaauaccu

SEQ ID NO: 1038402 - RNA, 16 nt, Homo sapiens
cuguggcaucuuugcc

SEQ ID NO: 1038403 - RNA, 20 nt, Homo sapiens
cuguggccugugucccauga

SEQ ID NO: 1038404 - RNA, 18 nt, Homo sapiens
cuguggccuguuaacugg

SEQ ID NO: 1038405 - RNA, 19 nt, Homo sapiens
cuguggcucuacaacugag

SEQ ID NO: 1038406 - RNA, 22 nt, Homo sapiens
cugugggcauggucaaaggcuc

SEQ ID NO: 1038407 - RNA, 23 nt, Homo sapiens
cuguggugugucccccucugucc

SEQ ID NO: 1038408 - RNA, 22 nt, Homo sapiens
cuguguaaaacuauauucucag

SEQ ID NO: 1038409 - RNA, 16 nt, Homo sapiens
cuguguacauaacuga

SEQ ID NO: 1038410 - RNA, 14 nt, Homo sapiens
cuguguaucugaua

SEQ ID NO: 1038411 - RNA, 21 nt, Homo sapiens
cuguguauuuaacugccuugu

SEQ ID NO: 1038412 - RNA, 19 nt, Homo sapiens
cugugucaguggaugcugc

SEQ ID NO: 1038413 - RNA, 14 nt, Homo sapiens
cugugucuguguau

SEQ ID NO: 1038414 - RNA, 20 nt, Homo sapiens
cugugucuuuuuucacuaca

SEQ ID NO: 1038415 - RNA, 13 nt, Homo sapiens
cugugugaugaug

SEQ ID NO: 1038416 - RNA, 19 nt, Homo sapiens
cugugugcaagugugugca

SEQ ID NO: 1038417 - RNA, 22 nt, Homo sapiens
cugugugcaagugugugcacau

SEQ ID NO: 1038418 - RNA, 16 nt, Homo sapiens
cuguguuccuggcaau

SEQ ID NO: 1038419 - RNA, 22 nt, Homo sapiens
cuguguuuuuucugccaccaaa

SEQ ID NO: 1038420 - RNA, 20 nt, Homo sapiens
cuguuaacuuaauaguauuu

SEQ ID NO: 1038421 - RNA, 15 nt, Homo sapiens
cuguuaauauucuau

SEQ ID NO: 1038422 - RNA, 16 nt, Homo sapiens
cuguuacuauuccuuu

SEQ ID NO: 1038423 - RNA, 17 nt, Homo sapiens
cuguuagcauaauguga

SEQ ID NO: 1038424 - RNA, 13 nt, Homo sapiens
cuguucaaaaagg

SEQ ID NO: 1038425 - RNA, 14 nt, Homo sapiens
cuguucacuuugua

SEQ ID NO: 1038426 - RNA, 17 nt, Homo sapiens
cuguucagcugguugag

SEQ ID NO: 1038427 - RNA, 11 nt, Homo sapiens
cuguuccucaa

SEQ ID NO: 1038428 - RNA, 21 nt, Homo sapiens
cuguucugggccaggucccag

SEQ ID NO: 1038429 - RNA, 16 nt, Homo sapiens
cuguucuuuuguccca

SEQ ID NO: 1038430 - RNA, 22 nt, Homo sapiens
cuguugaaaauuauuuuaaaca

SEQ ID NO: 1038431 - RNA, 13 nt, Homo sapiens
cuguugaagcucu

SEQ ID NO: 1038432 - RNA, 21 nt, Homo sapiens
cuguugaagcucuggugacac

SEQ ID NO: 1038433 - RNA, 14 nt, Homo sapiens
cuguugaugccguu

SEQ ID NO: 1038434 - RNA, 21 nt, Homo sapiens
cuguugauuucuuuccagagg

SEQ ID NO: 1038435 - RNA, 16 nt, Homo sapiens
cuguugcauuguaaua

SEQ ID NO: 1038436 - RNA, 19 nt, Homo sapiens
cuguugccucaguccccca

SEQ ID NO: 1038437 - RNA, 16 nt, Homo sapiens
cuguuggccaguguga

SEQ ID NO: 1038438 - RNA, 21 nt, Homo sapiens
cuguuggccagugugacaagg

SEQ ID NO: 1038439 - RNA, 22 nt, Homo sapiens
cuguuguaacuaggcucagaga

SEQ ID NO: 1038440 - RNA, 16 nt, Homo sapiens
cuguuguugaaauuga

SEQ ID NO: 1038441 - RNA, 19 nt, Homo sapiens
cuguuguugaaauugaugu

SEQ ID NO: 1038442 - RNA, 16 nt, Homo sapiens
cuguuuaaagugucac

SEQ ID NO: 1038443 - RNA, 15 nt, Homo sapiens
cuguuuaacauuucc

SEQ ID NO: 1038444 - RNA, 15 nt, Homo sapiens
cuguuuuucagggag

SEQ ID NO: 1038445 - RNA, 18 nt, Homo sapiens
cuuaaaaaaauaugccuu

SEQ ID NO: 1038446 - RNA, 14 nt, Homo sapiens
cuuaaaaaguauuu

SEQ ID NO: 1038447 - RNA, 16 nt, Homo sapiens
cuuaaaauagccauaa

SEQ ID NO: 1038448 - RNA, 19 nt, Homo sapiens
cuuaaaaugaauuauguua

SEQ ID NO: 1038449 - RNA, 23 nt, Homo sapiens
cuuaaaccgccaaggcuggggga

SEQ ID NO: 1038450 - RNA, 20 nt, Homo sapiens
cuuaaagcauuccccaaaga

SEQ ID NO: 1038451 - RNA, 12 nt, Homo sapiens
cuuaacauucau

SEQ ID NO: 1038452 - RNA, 14 nt, Homo sapiens
cuuaacauucugua

SEQ ID NO: 1038453 - RNA, 18 nt, Homo sapiens
cuuaacugcauuuuuaga

SEQ ID NO: 1038454 - RNA, 19 nt, Homo sapiens
cuuaagaaaaugaugcugg

SEQ ID NO: 1038455 - RNA, 20 nt, Homo sapiens
cuuaagaacuuuaauugaca

SEQ ID NO: 1038456 - RNA, 12 nt, Homo sapiens
cuuaagauuugg

SEQ ID NO: 1038457 - RNA, 16 nt, Homo sapiens
cuuaagcagaagcauu

SEQ ID NO: 1038458 - RNA, 21 nt, Homo sapiens
cuuaagccuuuugcucacaaa

SEQ ID NO: 1038459 - RNA, 21 nt, Homo sapiens
cuuaagcuuccgccgucucaa

SEQ ID NO: 1038460 - RNA, 17 nt, Homo sapiens
cuuaaggggcagcuucu

SEQ ID NO: 1038461 - RNA, 20 nt, Homo sapiens
cuuaaguaagcaacagcaua

SEQ ID NO: 1038462 - RNA, 18 nt, Homo sapiens
cuuaagucuuaauauuaa

SEQ ID NO: 1038463 - RNA, 14 nt, Homo sapiens
cuuaauaaugugua

SEQ ID NO: 1038464 - RNA, 22 nt, Homo sapiens
cuuaauaguaggguaaguuguu

SEQ ID NO: 1038465 - RNA, 18 nt, Homo sapiens
cuuaauauuaaauauaug

SEQ ID NO: 1038466 - RNA, 19 nt, Homo sapiens
cuuaaucuuuucacaaaua

SEQ ID NO: 1038467 - RNA, 21 nt, Homo sapiens
cuuaaugauccguuccauugc

SEQ ID NO: 1038468 - RNA, 16 nt, Homo sapiens
cuuaaugguagcaacu

SEQ ID NO: 1038469 - RNA, 15 nt, Homo sapiens
cuuaauguuuauucc

SEQ ID NO: 1038470 - RNA, 20 nt, Homo sapiens
cuuauuuuuuucugauugua

SEQ ID NO: 1038471 - RNA, 14 nt, Homo sapiens
cuucaaaucagaag

SEQ ID NO: 1038472 - RNA, 22 nt, Homo sapiens
cuucaaaugucuaagguaguaa

SEQ ID NO: 1038473 - RNA, 19 nt, Homo sapiens
cuucaacauuuacauguau

SEQ ID NO: 1038474 - RNA, 21 nt, Homo sapiens
cuucaagaacccugacuccuc

SEQ ID NO: 1038475 - RNA, 23 nt, Homo sapiens
cuucaagccuagcccuucucuca

SEQ ID NO: 1038476 - RNA, 19 nt, Homo sapiens
cuucaaguuaaagugaaua

SEQ ID NO: 1038477 - RNA, 21 nt, Homo sapiens
cuucaaugcaaaguacaugua

SEQ ID NO: 1038478 - RNA, 16 nt, Homo sapiens
cuucaauguaguuuuc

SEQ ID NO: 1038479 - RNA, 22 nt, Homo sapiens
cuucaauguauugagcauguga

SEQ ID NO: 1038480 - RNA, 21 nt, Homo sapiens
cuucaauugcuuugcacuuuu

SEQ ID NO: 1038481 - RNA, 20 nt, Homo sapiens
cuucacagaaaguucuuaaa

SEQ ID NO: 1038482 - RNA, 19 nt, Homo sapiens
cuucacagagugugcugga

SEQ ID NO: 1038483 - RNA, 13 nt, Homo sapiens
cuucacaguguuu

SEQ ID NO: 1038484 - RNA, 17 nt, Homo sapiens
cuucacucaaucucuga

SEQ ID NO: 1038485 - RNA, 22 nt, Homo sapiens
cuucacuguccuccaagccagc

SEQ ID NO: 1038486 - RNA, 16 nt, Homo sapiens
cuucagaagacacugc

SEQ ID NO: 1038487 - RNA, 20 nt, Homo sapiens
cuucagaagacacugcaaag

SEQ ID NO: 1038488 - RNA, 15 nt, Homo sapiens
cuucagacguguaug

SEQ ID NO: 1038489 - RNA, 23 nt, Homo sapiens
cuucagacguguaugcaaaugag

SEQ ID NO: 1038490 - RNA, 18 nt, Homo sapiens
cuucagacugaacaugua

SEQ ID NO: 1038491 - RNA, 15 nt, Homo sapiens
cuucagagacuaucu

SEQ ID NO: 1038492 - RNA, 21 nt, Homo sapiens
cuucagagcugacacaggaug

SEQ ID NO: 1038493 - RNA, 14 nt, Homo sapiens
cuucagauuugccu

SEQ ID NO: 1038494 - RNA, 17 nt, Homo sapiens
cuucagggaacugcaua

SEQ ID NO: 1038495 - RNA, 22 nt, Homo sapiens
cuucagguuaucgaaauaacaa

SEQ ID NO: 1038496 - RNA, 22 nt, Homo sapiens
cuucaguauuuuuaaauuguaa

SEQ ID NO: 1038497 - RNA, 16 nt, Homo sapiens
cuucauugcaguuauu

SEQ ID NO: 1038498 - RNA, 20 nt, Homo sapiens
cuucauugcaguuauuuaga

SEQ ID NO: 1038499 - RNA, 14 nt, Homo sapiens
cuucauugccuuaa

SEQ ID NO: 1038500 - RNA, 13 nt, Homo sapiens
cuucauuuagcca

SEQ ID NO: 1038501 - RNA, 14 nt, Homo sapiens
cuucauuuagccaa

SEQ ID NO: 1038502 - RNA, 19 nt, Homo sapiens
cuuccaaacagaacuaugg

SEQ ID NO: 1038503 - RNA, 21 nt, Homo sapiens
cuuccaaacagaacuauggaa

SEQ ID NO: 1038504 - RNA, 14 nt, Homo sapiens
cuuccaaaccugac

SEQ ID NO: 1038505 - RNA, 16 nt, Homo sapiens
cuuccaacguggccca

SEQ ID NO: 1038506 - RNA, 21 nt, Homo sapiens
cuuccaacucaaacucuuaaa

SEQ ID NO: 1038507 - RNA, 17 nt, Homo sapiens
cuuccaaggcagaagca

SEQ ID NO: 1038508 - RNA, 17 nt, Homo sapiens
cuuccacaccuagcauc

SEQ ID NO: 1038509 - RNA, 21 nt, Homo sapiens
cuuccacacucaccucuaaaa

SEQ ID NO: 1038510 - RNA, 14 nt, Homo sapiens
cuuccacugagggc

SEQ ID NO: 1038511 - RNA, 19 nt, Homo sapiens
cuuccagugcaacacugaa

SEQ ID NO: 1038512 - RNA, 13 nt, Homo sapiens
cuuccaucaugga

SEQ ID NO: 1038513 - RNA, 24 nt, Homo sapiens
cuuccauuaacuuagcauguguug

SEQ ID NO: 1038514 - RNA, 13 nt, Homo sapiens
cuuccccauggga

SEQ ID NO: 1038515 - RNA, 22 nt, Homo sapiens
cuucccccuuuacucauagcac

SEQ ID NO: 1038516 - RNA, 14 nt, Homo sapiens
cuucccuaaugaag

SEQ ID NO: 1038517 - RNA, 13 nt, Homo sapiens
cuucccuaccuca

SEQ ID NO: 1038518 - RNA, 16 nt, Homo sapiens
cuucccucccuaucua

SEQ ID NO: 1038519 - RNA, 16 nt, Homo sapiens
cuuccguaacccaacu

SEQ ID NO: 1038520 - RNA, 15 nt, Homo sapiens
cuuccucacaccaca

SEQ ID NO: 1038521 - RNA, 16 nt, Homo sapiens
cuuccuccccauguga

SEQ ID NO: 1038522 - RNA, 15 nt, Homo sapiens
cuuccugucugagua

SEQ ID NO: 1038523 - RNA, 12 nt, Homo sapiens
cuuccuugcucu

SEQ ID NO: 1038524 - RNA, 21 nt, Homo sapiens
cuuccuuggaggggggagcca

SEQ ID NO: 1038525 - RNA, 20 nt, Homo sapiens
cuuccuugggaugaucuuga

SEQ ID NO: 1038526 - RNA, 15 nt, Homo sapiens
cuucguacaguucuu

SEQ ID NO: 1038527 - RNA, 14 nt, Homo sapiens
cuucuaaucaaagc

SEQ ID NO: 1038528 - RNA, 17 nt, Homo sapiens
cuucuaaucaaagcuuu

SEQ ID NO: 1038529 - RNA, 23 nt, Homo sapiens
cuucuaccucuuggcugccuugu

SEQ ID NO: 1038530 - RNA, 15 nt, Homo sapiens
cuucuagggagacaa

SEQ ID NO: 1038531 - RNA, 16 nt, Homo sapiens
cuucucaagugccuua

SEQ ID NO: 1038532 - RNA, 15 nt, Homo sapiens
cuucucauacgucca

SEQ ID NO: 1038533 - RNA, 16 nt, Homo sapiens
cuucuccaaaugagau

SEQ ID NO: 1038534 - RNA, 18 nt, Homo sapiens
cuucuccauccacauggg

SEQ ID NO: 1038535 - RNA, 18 nt, Homo sapiens
cuucucuacagacuucuc

SEQ ID NO: 1038536 - RNA, 13 nt, Homo sapiens
cuucucugcucca

SEQ ID NO: 1038537 - RNA, 22 nt, Homo sapiens
cuucucuggaaaggggggagcu

SEQ ID NO: 1038538 - RNA, 21 nt, Homo sapiens
cuucucugucucaugugugcu

SEQ ID NO: 1038539 - RNA, 15 nt, Homo sapiens
cuucugaaugcugcu

SEQ ID NO: 1038540 - RNA, 15 nt, Homo sapiens
cuucugacuacuggg

SEQ ID NO: 1038541 - RNA, 23 nt, Homo sapiens
cuucugaggcgcugcuuugucaa

SEQ ID NO: 1038542 - RNA, 15 nt, Homo sapiens
cuucugccuucucag

SEQ ID NO: 1038543 - RNA, 22 nt, Homo sapiens
cuucugcuggcagaaagcaaau

SEQ ID NO: 1038544 - RNA, 17 nt, Homo sapiens
cuucugcuuaaucugag

SEQ ID NO: 1038545 - RNA, 13 nt, Homo sapiens
cuucugcuucuca

SEQ ID NO: 1038546 - RNA, 21 nt, Homo sapiens
cuucuggcagggaagugggga

SEQ ID NO: 1038547 - RNA, 18 nt, Homo sapiens
cuucugggaacuuccuca

SEQ ID NO: 1038548 - RNA, 19 nt, Homo sapiens
cuucuggggguagaucuca

SEQ ID NO: 1038549 - RNA, 13 nt, Homo sapiens
cuucuguaaaggu

SEQ ID NO: 1038550 - RNA, 17 nt, Homo sapiens
cuucuguccuacucugu

SEQ ID NO: 1038551 - RNA, 21 nt, Homo sapiens
cuucuuaaucuuuucacaaau

SEQ ID NO: 1038552 - RNA, 19 nt, Homo sapiens
cuucuuacaugcauuugag

SEQ ID NO: 1038553 - RNA, 18 nt, Homo sapiens
cuucuucccucccuaucu

SEQ ID NO: 1038554 - RNA, 22 nt, Homo sapiens
cuucuugaacacucaugcugaa

SEQ ID NO: 1038555 - RNA, 15 nt, Homo sapiens
cuucuuggucucagu

SEQ ID NO: 1038556 - RNA, 21 nt, Homo sapiens
cuucuuggucucagugucaau

SEQ ID NO: 1038557 - RNA, 17 nt, Homo sapiens
cuucuuuaaaaaaacac

SEQ ID NO: 1038558 - RNA, 16 nt, Homo sapiens
cuucuuuaucugugau

SEQ ID NO: 1038559 - RNA, 13 nt, Homo sapiens
cuucuuugcccac

SEQ ID NO: 1038560 - RNA, 14 nt, Homo sapiens
cuucuuuuacucau

SEQ ID NO: 1038561 - RNA, 20 nt, Homo sapiens
cuucuuuuaguuguaucucu

SEQ ID NO: 1038562 - RNA, 20 nt, Homo sapiens
cuucuuuuggcuuccaugau

SEQ ID NO: 1038563 - RNA, 16 nt, Homo sapiens
cuucuuuuugcuucaa

SEQ ID NO: 1038564 - RNA, 17 nt, Homo sapiens
cuucuuuuuguucuuca

SEQ ID NO: 1038565 - RNA, 20 nt, Homo sapiens
cuucuuuuuuuuugagaugg

SEQ ID NO: 1038566 - RNA, 18 nt, Homo sapiens
cuugaaaacacuguucuc

SEQ ID NO: 1038567 - RNA, 22 nt, Homo sapiens
cuugaaagaaaauaccaaggaa

SEQ ID NO: 1038568 - RNA, 19 nt, Homo sapiens
cuugaaagaaaauaugcau

SEQ ID NO: 1038569 - RNA, 22 nt, Homo sapiens
cuugaaagaaaauaugcaucua

SEQ ID NO: 1038570 - RNA, 16 nt, Homo sapiens
cuugaaauaccaguga

SEQ ID NO: 1038571 - RNA, 14 nt, Homo sapiens
cuugaacacagucu

SEQ ID NO: 1038572 - RNA, 19 nt, Homo sapiens
cuugaaccagggagucaga

SEQ ID NO: 1038573 - RNA, 18 nt, Homo sapiens
cuugaagacaauggcuua

SEQ ID NO: 1038574 - RNA, 19 nt, Homo sapiens
cuugaagggggauaugaau

SEQ ID NO: 1038575 - RNA, 20 nt, Homo sapiens
cuugaagggggauaugaaug

SEQ ID NO: 1038576 - RNA, 17 nt, Homo sapiens
cuugaaucaaagcaguu

SEQ ID NO: 1038577 - RNA, 17 nt, Homo sapiens
cuugacuccuugugaug

SEQ ID NO: 1038578 - RNA, 21 nt, Homo sapiens
cuugagaggaugaauguaugu

SEQ ID NO: 1038579 - RNA, 22 nt, Homo sapiens
cuugagaggguggaauauccaa

SEQ ID NO: 1038580 - RNA, 22 nt, Homo sapiens
cuugaggcugcaaucacacuga

SEQ ID NO: 1038581 - RNA, 20 nt, Homo sapiens
cuugagggugcuuguucccu

SEQ ID NO: 1038582 - RNA, 15 nt, Homo sapiens
cuugagguacucugc

SEQ ID NO: 1038583 - RNA, 13 nt, Homo sapiens
cuugauauuuucc

SEQ ID NO: 1038584 - RNA, 18 nt, Homo sapiens
cuuggggucagagacugc

SEQ ID NO: 1038585 - RNA, 22 nt, Homo sapiens
cuugggucucauuuagaacuug

SEQ ID NO: 1038586 - RNA, 18 nt, Homo sapiens
cuuggucacauacaauua

SEQ ID NO: 1038587 - RNA, 16 nt, Homo sapiens
cuuggucaccagcucc

SEQ ID NO: 1038588 - RNA, 18 nt, Homo sapiens
cuugguuuccaaaggcau

SEQ ID NO: 1038589 - RNA, 23 nt, Homo sapiens
cuuguaaauagcucagguguccc

SEQ ID NO: 1038590 - RNA, 23 nt, Homo sapiens
cuuguaaugguucuuuacacauc

SEQ ID NO: 1038591 - RNA, 16 nt, Homo sapiens
cuuguauaguguaaaa

SEQ ID NO: 1038592 - RNA, 16 nt, Homo sapiens
cuuguauauacgcauc

SEQ ID NO: 1038593 - RNA, 17 nt, Homo sapiens
cuugucaugugacaggu

SEQ ID NO: 1038594 - RNA, 15 nt, Homo sapiens
cuugucauugccagc

SEQ ID NO: 1038595 - RNA, 18 nt, Homo sapiens
cuugucuuugacuugugu

SEQ ID NO: 1038596 - RNA, 16 nt, Homo sapiens
cuuguguccacuguga

SEQ ID NO: 1038597 - RNA, 15 nt, Homo sapiens
cuuguguguuuugag

SEQ ID NO: 1038598 - RNA, 15 nt, Homo sapiens
cuuguguuaugaagc

SEQ ID NO: 1038599 - RNA, 15 nt, Homo sapiens
cuuguucguggguca

SEQ ID NO: 1038600 - RNA, 13 nt, Homo sapiens
cuuguugcucaaa

SEQ ID NO: 1038601 - RNA, 24 nt, Homo sapiens
cuuguuuacagcacuacucugugc

SEQ ID NO: 1038602 - RNA, 13 nt, Homo sapiens
cuuuaaacucagg

SEQ ID NO: 1038603 - RNA, 16 nt, Homo sapiens
cuuuaaaucugugaug

SEQ ID NO: 1038604 - RNA, 18 nt, Homo sapiens
cuuuaaauuucaucucag

SEQ ID NO: 1038605 - RNA, 22 nt, Homo sapiens
cuuuaauaguuuugauccuaaa

SEQ ID NO: 1038606 - RNA, 20 nt, Homo sapiens
cuuuaauugacaguuucaau

SEQ ID NO: 1038607 - RNA, 19 nt, Homo sapiens
cuuuaauuuuuuacuauuu

SEQ ID NO: 1038608 - RNA, 19 nt, Homo sapiens
cuuuacuguuagucauuug

SEQ ID NO: 1038609 - RNA, 13 nt, Homo sapiens
cuuuacuucccag

SEQ ID NO: 1038610 - RNA, 18 nt, Homo sapiens
cuuuagagcauugccauu

SEQ ID NO: 1038611 - RNA, 19 nt, Homo sapiens
cuuuagugguggccauuua

SEQ ID NO: 1038612 - RNA, 22 nt, Homo sapiens
cuuuaguuuuugugaaguuuaa

SEQ ID NO: 1038613 - RNA, 16 nt, Homo sapiens
cuuuauacaacagugc

SEQ ID NO: 1038614 - RNA, 14 nt, Homo sapiens
cuuuaucaccagag

SEQ ID NO: 1038615 - RNA, 21 nt, Homo sapiens
cuuuaugcuaguuugaccuca

SEQ ID NO: 1038616 - RNA, 22 nt, Homo sapiens
cuuuauuacaguuuaucuaugg

SEQ ID NO: 1038617 - RNA, 14 nt, Homo sapiens
cuuuauugugaucu

SEQ ID NO: 1038618 - RNA, 18 nt, Homo sapiens
cuuucaaagcuaaauucc

SEQ ID NO: 1038619 - RNA, 16 nt, Homo sapiens
cuuucaaccucaguga

SEQ ID NO: 1038620 - RNA, 20 nt, Homo sapiens
cuuucaaguuugucacuaaa

SEQ ID NO: 1038621 - RNA, 19 nt, Homo sapiens
cuuucaccacaugugcaca

SEQ ID NO: 1038622 - RNA, 21 nt, Homo sapiens
cuuucaggccacauggcuaaa

SEQ ID NO: 1038623 - RNA, 12 nt, Homo sapiens
cuuucaguauua

SEQ ID NO: 1038624 - RNA, 20 nt, Homo sapiens
cuuucauaaacuucagggau

SEQ ID NO: 1038625 - RNA, 22 nt, Homo sapiens
cuuucaugaauucugucauuuc

SEQ ID NO: 1038626 - RNA, 21 nt, Homo sapiens
cuuucaugaguuucccagaga

SEQ ID NO: 1038627 - RNA, 15 nt, Homo sapiens
cuuuccaaaggccau

SEQ ID NO: 1038628 - RNA, 16 nt, Homo sapiens
cuuuccccucccucag

SEQ ID NO: 1038629 - RNA, 15 nt, Homo sapiens
cuuucccuuuaucag

SEQ ID NO: 1038630 - RNA, 19 nt, Homo sapiens
cuuuccucagaucauccag

SEQ ID NO: 1038631 - RNA, 17 nt, Homo sapiens
cuuuccugaauccaaac

SEQ ID NO: 1038632 - RNA, 23 nt, Homo sapiens
cuuucuaggagggagacacuggc

SEQ ID NO: 1038633 - RNA, 22 nt, Homo sapiens
cuuucuauugaaaaaucaccac

SEQ ID NO: 1038634 - RNA, 22 nt, Homo sapiens
cuuucucccaggccaggcuccu

SEQ ID NO: 1038635 - RNA, 16 nt, Homo sapiens
cuuucugacaaaaagu

SEQ ID NO: 1038636 - RNA, 20 nt, Homo sapiens
cuuucugcaaaggcaccuga

SEQ ID NO: 1038637 - RNA, 15 nt, Homo sapiens
cuuucugcacauaag

SEQ ID NO: 1038638 - RNA, 16 nt, Homo sapiens
cuuucugcacauaagu

SEQ ID NO: 1038639 - RNA, 19 nt, Homo sapiens
cuuucugcuaucaaagagg

SEQ ID NO: 1038640 - RNA, 15 nt, Homo sapiens
cuuucuguugccaca

SEQ ID NO: 1038641 - RNA, 15 nt, Homo sapiens
cuuucuuacacugaa

SEQ ID NO: 1038642 - RNA, 11 nt, Homo sapiens
cuuucuucccu

SEQ ID NO: 1038643 - RNA, 16 nt, Homo sapiens
cuuucuugaagaacaa

SEQ ID NO: 1038644 - RNA, 13 nt, Homo sapiens
cuuucuugacucu

SEQ ID NO: 1038645 - RNA, 22 nt, Homo sapiens
cuuucuuuuuuaaauaggguug

SEQ ID NO: 1038646 - RNA, 13 nt, Homo sapiens
cuuugaaucaaaa

SEQ ID NO: 1038647 - RNA, 13 nt, Homo sapiens
cuuugaaugacaa

SEQ ID NO: 1038648 - RNA, 17 nt, Homo sapiens
cuuugacgggguuuucc

SEQ ID NO: 1038649 - RNA, 14 nt, Homo sapiens
cuuugaucaguaua

SEQ ID NO: 1038650 - RNA, 13 nt, Homo sapiens
cuuugcacugagg

SEQ ID NO: 1038651 - RNA, 18 nt, Homo sapiens
cuuugcaggcaugcaugu

SEQ ID NO: 1038652 - RNA, 14 nt, Homo sapiens
cuuugccacacaca

SEQ ID NO: 1038653 - RNA, 14 nt, Homo sapiens
cuuugccccugaga

SEQ ID NO: 1038654 - RNA, 18 nt, Homo sapiens
cuuugcucuuucuugacu

SEQ ID NO: 1038655 - RNA, 20 nt, Homo sapiens
cuuugcugagccuguaaaau

SEQ ID NO: 1038656 - RNA, 18 nt, Homo sapiens
cuuuggaaacaauaugca

SEQ ID NO: 1038657 - RNA, 19 nt, Homo sapiens
cuuuggacagaagcagcuc

SEQ ID NO: 1038658 - RNA, 16 nt, Homo sapiens
cuuuggacauggcuca

SEQ ID NO: 1038659 - RNA, 19 nt, Homo sapiens
cuuuggaccuaauccaagc

SEQ ID NO: 1038660 - RNA, 17 nt, Homo sapiens
cuuuggagcagcuucug

SEQ ID NO: 1038661 - RNA, 14 nt, Homo sapiens
cuuuggccauucca

SEQ ID NO: 1038662 - RNA, 21 nt, Homo sapiens
cuuugggauugcuaugaauga

SEQ ID NO: 1038663 - RNA, 19 nt, Homo sapiens
cuuuguaacggcucuuagc

SEQ ID NO: 1038664 - RNA, 18 nt, Homo sapiens
cuuuguaagaguguagaa

SEQ ID NO: 1038665 - RNA, 15 nt, Homo sapiens
cuuuguauuccuuaa

SEQ ID NO: 1038666 - RNA, 16 nt, Homo sapiens
cuuugucaaaaggaag

SEQ ID NO: 1038667 - RNA, 11 nt, Homo sapiens
cuuugucacaa

SEQ ID NO: 1038668 - RNA, 20 nt, Homo sapiens
cuuugucccccaaugccugc

SEQ ID NO: 1038669 - RNA, 13 nt, Homo sapiens
cuuugucugaaaa

SEQ ID NO: 1038670 - RNA, 20 nt, Homo sapiens
cuuugugaacaagucccugu

SEQ ID NO: 1038671 - RNA, 12 nt, Homo sapiens
cuuugugcugug

SEQ ID NO: 1038672 - RNA, 19 nt, Homo sapiens
cuuuguguagaaagccaaa

SEQ ID NO: 1038673 - RNA, 11 nt, Homo sapiens
cuuuguugccc

SEQ ID NO: 1038674 - RNA, 21 nt, Homo sapiens
cuuuguuuagcccaaaaccaa

SEQ ID NO: 1038675 - RNA, 13 nt, Homo sapiens
cuuuuauaacuag

SEQ ID NO: 1038676 - RNA, 20 nt, Homo sapiens
cuuuuaucugcccagaauuc

SEQ ID NO: 1038677 - RNA, 19 nt, Homo sapiens
cuuuuauuaaugcacuuuc

SEQ ID NO: 1038678 - RNA, 15 nt, Homo sapiens
cuuuuauugccauga

SEQ ID NO: 1038679 - RNA, 23 nt, Homo sapiens
cuuuuauuuuuuaagguaacaaa

SEQ ID NO: 1038680 - RNA, 19 nt, Homo sapiens
cuuuucaaaauuggacuua

SEQ ID NO: 1038681 - RNA, 22 nt, Homo sapiens
cuuuucagcgauguaugcagcu

SEQ ID NO: 1038682 - RNA, 17 nt, Homo sapiens
cuuuucaucuaauguga

SEQ ID NO: 1038683 - RNA, 15 nt, Homo sapiens
cuuuuccacaaauca

SEQ ID NO: 1038684 - RNA, 15 nt, Homo sapiens
cuuuuccugauguuc

SEQ ID NO: 1038685 - RNA, 16 nt, Homo sapiens
cuuuucuaacucuccc

SEQ ID NO: 1038686 - RNA, 11 nt, Homo sapiens
cuuuucucugc

SEQ ID NO: 1038687 - RNA, 19 nt, Homo sapiens
cuuuucuggaauguaauca

SEQ ID NO: 1038688 - RNA, 15 nt, Homo sapiens
cuuuucuuuccucag

SEQ ID NO: 1038689 - RNA, 16 nt, Homo sapiens
cuuuucuuuuucuccc

SEQ ID NO: 1038690 - RNA, 16 nt, Homo sapiens
cuuuugaaguaauccc

SEQ ID NO: 1038691 - RNA, 19 nt, Homo sapiens
cuuuugcauaagugcauga

SEQ ID NO: 1038692 - RNA, 19 nt, Homo sapiens
cuuuuguucagggcuguga

SEQ ID NO: 1038693 - RNA, 18 nt, Homo sapiens
cuuuuguuuugaguuacu

SEQ ID NO: 1038694 - RNA, 18 nt, Homo sapiens
cuuuuuaaagaaugcucu

SEQ ID NO: 1038695 - RNA, 20 nt, Homo sapiens
cuuuuuaauauugauaugcu

SEQ ID NO: 1038696 - RNA, 22 nt, Homo sapiens
cuuuuucagaaacagugaguua

SEQ ID NO: 1038697 - RNA, 18 nt, Homo sapiens
cuuuuucuucuucccucc

SEQ ID NO: 1038698 - RNA, 13 nt, Homo sapiens
cuuuuucuuugag

SEQ ID NO: 1038699 - RNA, 14 nt, Homo sapiens
cuuuuuugucccau

SEQ ID NO: 1038700 - RNA, 16 nt, Homo sapiens
cuuuuuugucccauua

SEQ ID NO: 1038701 - RNA, 22 nt, Homo sapiens
cuuuuuuuauaucagaaugagg

SEQ ID NO: 1038702 - RNA, 22 nt, Homo sapiens
cuuuuuuuuuuuuuccuuugaa

SEQ ID NO: 1038703 - RNA, 13 nt, Homo sapiens
gaaaaacuuccau

SEQ ID NO: 1038704 - RNA, 20 nt, Homo sapiens
gaaaaagucauccaaucuaa

SEQ ID NO: 1038705 - RNA, 17 nt, Homo sapiens
gaggugggcagguggug

SEQ ID NO: 1038706 - RNA, 23 nt, Homo sapiens
gaguaagcccucaggagccucug

SEQ ID NO: 1038707 - RNA, 14 nt, Homo sapiens
gaguaaucugugua

SEQ ID NO: 1038708 - RNA, 17 nt, Homo sapiens
gaguaaucuguguacaa

SEQ ID NO: 1038709 - RNA, 15 nt, Homo sapiens
gaguacaccccaaca

SEQ ID NO: 1038710 - RNA, 17 nt, Homo sapiens
gaguacaccccaacagc

SEQ ID NO: 1038711 - RNA, 18 nt, Homo sapiens
gaguacaccccaacagca

SEQ ID NO: 1038712 - RNA, 19 nt, Homo sapiens
gaguacaccccaacagcac

SEQ ID NO: 1038713 - RNA, 18 nt, Homo sapiens
gaguacuacaguccuccc

SEQ ID NO: 1038714 - RNA, 12 nt, Homo sapiens
gaguagcuggau

SEQ ID NO: 1038715 - RNA, 17 nt, Homo sapiens
gaguagggacucagggc

SEQ ID NO: 1038716 - RNA, 19 nt, Homo sapiens
gaguauccuuucaguguua

SEQ ID NO: 1038717 - RNA, 17 nt, Homo sapiens
gagucacaguugacaaa

SEQ ID NO: 1038718 - RNA, 17 nt, Homo sapiens
gagucagcagaacuggg

SEQ ID NO: 1038719 - RNA, 17 nt, Homo sapiens
gagucagugccaggucc

SEQ ID NO: 1038720 - RNA, 20 nt, Homo sapiens
gagucaucucaaccaucccc

SEQ ID NO: 1038721 - RNA, 14 nt, Homo sapiens
gaguccucacuccc

SEQ ID NO: 1038722 - RNA, 20 nt, Homo sapiens
gagucgcaucucagugcagg

SEQ ID NO: 1038723 - RNA, 13 nt, Homo sapiens
gagucgggacuaa

SEQ ID NO: 1038724 - RNA, 20 nt, Homo sapiens
gagucucacucuguugccca

SEQ ID NO: 1038725 - RNA, 14 nt, Homo sapiens
gagucugaagcaga

SEQ ID NO: 1038726 - RNA, 21 nt, Homo sapiens
gagucuggcucugucacccag

SEQ ID NO: 1038727 - RNA, 16 nt, Homo sapiens
gagucuguuucaggag

SEQ ID NO: 1038728 - RNA, 20 nt, Homo sapiens
gagucuugugugcauugcug

SEQ ID NO: 1038729 - RNA, 18 nt, Homo sapiens
gagugacucgaggguugg

SEQ ID NO: 1038730 - RNA, 22 nt, Homo sapiens
gagugaggguuucugagcugcu

SEQ ID NO: 1038731 - RNA, 20 nt, Homo sapiens
gagugcaccacuucaaguga

SEQ ID NO: 1038732 - RNA, 19 nt, Homo sapiens
gagugcaguuuccaauccc

SEQ ID NO: 1038733 - RNA, 21 nt, Homo sapiens
gagugcauuacuuugaaucaa

SEQ ID NO: 1038734 - RNA, 23 nt, Homo sapiens
gagugccuuuucgagacuggcag

SEQ ID NO: 1038735 - RNA, 19 nt, Homo sapiens
gagugcgccgagucugucu

SEQ ID NO: 1038736 - RNA, 23 nt, Homo sapiens
gagugucuuuccacggagccacu

SEQ ID NO: 1038737 - RNA, 21 nt, Homo sapiens
gaguguuccccuuccacugag

SEQ ID NO: 1038738 - RNA, 13 nt, Homo sapiens
gaguuagugccau

SEQ ID NO: 1038739 - RNA, 16 nt, Homo sapiens
gaguuaguuugaguua

SEQ ID NO: 1038740 - RNA, 21 nt, Homo sapiens
gaguuauuuuuauuuauuuaa

SEQ ID NO: 1038741 - RNA, 16 nt, Homo sapiens
gaguucaaugaucuag

SEQ ID NO: 1038742 - RNA, 15 nt, Homo sapiens
gaguucaauggcugc

SEQ ID NO: 1038743 - RNA, 19 nt, Homo sapiens
gaguucgaggcugcaguca

SEQ ID NO: 1038744 - RNA, 15 nt, Homo sapiens
gaguugagugauaga

SEQ ID NO: 1038745 - RNA, 17 nt, Homo sapiens
gaguugucaagucucug

SEQ ID NO: 1038746 - RNA, 13 nt, Homo sapiens
gaguuuucagugg

SEQ ID NO: 1038747 - RNA, 15 nt, Homo sapiens
gauaaacauuuaacu

SEQ ID NO: 1038748 - RNA, 16 nt, Homo sapiens
gauaaagaugcaagga

SEQ ID NO: 1038749 - RNA, 15 nt, Homo sapiens
gauaaagcacccugu

SEQ ID NO: 1038750 - RNA, 13 nt, Homo sapiens
gauaaauuguaua

SEQ ID NO: 1038751 - RNA, 15 nt, Homo sapiens
gauaacugagaauuu

SEQ ID NO: 1038752 - RNA, 14 nt, Homo sapiens
gauaacugcaauuu

SEQ ID NO: 1038753 - RNA, 16 nt, Homo sapiens
gauaacuuagguggca

SEQ ID NO: 1038754 - RNA, 21 nt, Homo sapiens
gauaagcuugucuaugguaca

SEQ ID NO: 1038755 - RNA, 18 nt, Homo sapiens
gauaauauuguggugcca

SEQ ID NO: 1038756 - RNA, 15 nt, Homo sapiens
gauacaaacauguuc

SEQ ID NO: 1038757 - RNA, 17 nt, Homo sapiens
gauacacaccuuucaca

SEQ ID NO: 1038758 - RNA, 13 nt, Homo sapiens
gauacccagagca

SEQ ID NO: 1038759 - RNA, 16 nt, Homo sapiens
gauacccagagcauua

SEQ ID NO: 1038760 - RNA, 21 nt, Homo sapiens
gauacccauagcuuccaugag

SEQ ID NO: 1038761 - RNA, 22 nt, Homo sapiens
gauacuguaucaugacaaagac

SEQ ID NO: 1038762 - RNA, 14 nt, Homo sapiens
gauagaaggcuaug

SEQ ID NO: 1038763 - RNA, 13 nt, Homo sapiens
gauagagucuugc

SEQ ID NO: 1038764 - RNA, 20 nt, Homo sapiens
gauagauauaugcucugcau

SEQ ID NO: 1038765 - RNA, 12 nt, Homo sapiens
gauagcaaguga

SEQ ID NO: 1038766 - RNA, 13 nt, Homo sapiens
gauaggaguucac

SEQ ID NO: 1038767 - RNA, 14 nt, Homo sapiens
gauaggaguucacu

SEQ ID NO: 1038768 - RNA, 18 nt, Homo sapiens
gauaggaguucacuucau

SEQ ID NO: 1038769 - RNA, 12 nt, Homo sapiens
gauagucugucc

SEQ ID NO: 1038770 - RNA, 22 nt, Homo sapiens
gauagugggcaccccacugcaa

SEQ ID NO: 1038771 - RNA, 23 nt, Homo sapiens
gauauauacauguuuaguauuau

SEQ ID NO: 1038772 - RNA, 17 nt, Homo sapiens
gauauauaccacuuucc

SEQ ID NO: 1038773 - RNA, 22 nt, Homo sapiens
gauauauauaugcuuggcuaac

SEQ ID NO: 1038774 - RNA, 22 nt, Homo sapiens
gauauaugcucugcauguuaca

SEQ ID NO: 1038775 - RNA, 17 nt, Homo sapiens
gauauauuaagugacug

SEQ ID NO: 1038776 - RNA, 21 nt, Homo sapiens
gauaucaugccccuguacucc

SEQ ID NO: 1038777 - RNA, 12 nt, Homo sapiens
gauaucuucucc

SEQ ID NO: 1038778 - RNA, 21 nt, Homo sapiens
gaucaaaauaaaaagugacac

SEQ ID NO: 1038779 - RNA, 13 nt, Homo sapiens
gaucaaauacuuu

SEQ ID NO: 1038780 - RNA, 23 nt, Homo sapiens
gaucaagggaauguaacugcuga

SEQ ID NO: 1038781 - RNA, 18 nt, Homo sapiens
gaucaauaaaaugugauu

SEQ ID NO: 1038782 - RNA, 23 nt, Homo sapiens
gaucacagggccccagaaggcag

SEQ ID NO: 1038783 - RNA, 19 nt, Homo sapiens
gaucacgccauugcacucc

SEQ ID NO: 1038784 - RNA, 17 nt, Homo sapiens
gaucacuaaaguauauc

SEQ ID NO: 1038785 - RNA, 20 nt, Homo sapiens
gaucagccugggcaauguga

SEQ ID NO: 1038786 - RNA, 16 nt, Homo sapiens
gaucaucuuuccuguu

SEQ ID NO: 1038787 - RNA, 14 nt, Homo sapiens
gauccaagcugguc

SEQ ID NO: 1038788 - RNA, 13 nt, Homo sapiens
gaucccagcucac

SEQ ID NO: 1038789 - RNA, 16 nt, Homo sapiens
gauccccaagugugaa

SEQ ID NO: 1038790 - RNA, 22 nt, Homo sapiens
gauccccccuuuccuucuaauu

SEQ ID NO: 1038791 - RNA, 16 nt, Homo sapiens
gauccccucucuuccu

SEQ ID NO: 1038792 - RNA, 15 nt, Homo sapiens
gaucccucucuggau

SEQ ID NO: 1038793 - RNA, 20 nt, Homo sapiens
gauccucacccgaaucuccu

SEQ ID NO: 1038794 - RNA, 17 nt, Homo sapiens
gauccuguugggaaaga

SEQ ID NO: 1038795 - RNA, 21 nt, Homo sapiens
gauccuugauaaaugccucau

SEQ ID NO: 1038796 - RNA, 19 nt, Homo sapiens
gaucgagaccaucuuggcc

SEQ ID NO: 1038797 - RNA, 20 nt, Homo sapiens
gaucggagccuccucucuca

SEQ ID NO: 1038798 - RNA, 18 nt, Homo sapiens
gaucguucucugccucac

SEQ ID NO: 1038799 - RNA, 20 nt, Homo sapiens
gaucuaagccuuuccauaag

SEQ ID NO: 1038800 - RNA, 21 nt, Homo sapiens
gaucuaaggaugucacagggc

SEQ ID NO: 1038801 - RNA, 17 nt, Homo sapiens
gaucuauguacuguaau

SEQ ID NO: 1038802 - RNA, 19 nt, Homo sapiens
gaucuccaaggaccagguu

SEQ ID NO: 1038803 - RNA, 16 nt, Homo sapiens
gaucucgacucacugc

SEQ ID NO: 1038804 - RNA, 21 nt, Homo sapiens
gaucucuucuuuuggcuucca

SEQ ID NO: 1038805 - RNA, 23 nt, Homo sapiens
gaucugaacagaaauaccaaaau

SEQ ID NO: 1038806 - RNA, 20 nt, Homo sapiens
gaucugacauccccacucac

SEQ ID NO: 1038807 - RNA, 21 nt, Homo sapiens
gaucugacauccccacucacg

SEQ ID NO: 1038808 - RNA, 17 nt, Homo sapiens
gaucugaugcaagcaag

SEQ ID NO: 1038809 - RNA, 15 nt, Homo sapiens
gaucuggugccucca

SEQ ID NO: 1038810 - RNA, 19 nt, Homo sapiens
gaucuguguuuuauugaca

SEQ ID NO: 1038811 - RNA, 20 nt, Homo sapiens
gaucuuaaagcauuccccaa

SEQ ID NO: 1038812 - RNA, 19 nt, Homo sapiens
gaucuucagggaacugcau

SEQ ID NO: 1038813 - RNA, 13 nt, Homo sapiens
gaucuuccucaca

SEQ ID NO: 1038814 - RNA, 18 nt, Homo sapiens
gaucuugguccuguguuu

SEQ ID NO: 1038815 - RNA, 15 nt, Homo sapiens
gaucuuuggacagaa

SEQ ID NO: 1038816 - RNA, 18 nt, Homo sapiens
gaugaaaaugaaucuuca

SEQ ID NO: 1038817 - RNA, 14 nt, Homo sapiens
gaugaaacuggaaa

SEQ ID NO: 1038818 - RNA, 19 nt, Homo sapiens
gaugaaacuggaaaacuac

SEQ ID NO: 1038819 - RNA, 16 nt, Homo sapiens
gaugaaauaacuccuu

SEQ ID NO: 1038820 - RNA, 20 nt, Homo sapiens
gaugaaauuuucuagacuuu

SEQ ID NO: 1038821 - RNA, 18 nt, Homo sapiens
gaugaccagaacaagguu

SEQ ID NO: 1038822 - RNA, 13 nt, Homo sapiens
gaugagaguacac

SEQ ID NO: 1038823 - RNA, 16 nt, Homo sapiens
gaugagccgcugugag

SEQ ID NO: 1038824 - RNA, 17 nt, Homo sapiens
gaugaggcuggccaagc

SEQ ID NO: 1038825 - RNA, 13 nt, Homo sapiens
gaugagguugcuu

SEQ ID NO: 1038826 - RNA, 16 nt, Homo sapiens
gaugauaaaacacaaa

SEQ ID NO: 1038827 - RNA, 14 nt, Homo sapiens
gaugauaaacacug

SEQ ID NO: 1038828 - RNA, 15 nt, Homo sapiens
gaugauauucucacc

SEQ ID NO: 1038829 - RNA, 13 nt, Homo sapiens
gaugaucaucucc

SEQ ID NO: 1038830 - RNA, 21 nt, Homo sapiens
gaugaucuaggaagacuuugg

SEQ ID NO: 1038831 - RNA, 21 nt, Homo sapiens
gaugaucuggauccaccaaga

SEQ ID NO: 1038832 - RNA, 22 nt, Homo sapiens
gaugaucuuuaaaauacacacu

SEQ ID NO: 1038833 - RNA, 13 nt, Homo sapiens
gaugcaagcaaga

SEQ ID NO: 1038834 - RNA, 16 nt, Homo sapiens
gaugcaggauuucuuc

SEQ ID NO: 1038835 - RNA, 18 nt, Homo sapiens
gaugcauguucaaaccaa

SEQ ID NO: 1038836 - RNA, 14 nt, Homo sapiens
gaugcugugcuaug

SEQ ID NO: 1038837 - RNA, 22 nt, Homo sapiens
gauggacaagauuaccccaccu

SEQ ID NO: 1038838 - RNA, 23 nt, Homo sapiens
gauggaggggugguccugacuca

SEQ ID NO: 1038839 - RNA, 15 nt, Homo sapiens
gauggauaagcuugu

SEQ ID NO: 1038840 - RNA, 16 nt, Homo sapiens
gauggauagucugucc

SEQ ID NO: 1038841 - RNA, 18 nt, Homo sapiens
gauggauagucuguccaa

SEQ ID NO: 1038842 - RNA, 16 nt, Homo sapiens
gauggcaccacugcac

SEQ ID NO: 1038843 - RNA, 14 nt, Homo sapiens
gauggcaccagagg

SEQ ID NO: 1038844 - RNA, 16 nt, Homo sapiens
gauggcauccugugaa

SEQ ID NO: 1038845 - RNA, 21 nt, Homo sapiens
gauggcugacuuugcucuuuc

SEQ ID NO: 1038846 - RNA, 16 nt, Homo sapiens
gauggcuuugccagcu

SEQ ID NO: 1038847 - RNA, 19 nt, Homo sapiens
gauggcuuuuucuccuugg

SEQ ID NO: 1038848 - RNA, 14 nt, Homo sapiens
gaugggagguugug

SEQ ID NO: 1038849 - RNA, 16 nt, Homo sapiens
cuaguagucauuucau

SEQ ID NO: 1038850 - RNA, 15 nt, Homo sapiens
cuagucuauucauua

SEQ ID NO: 1038851 - RNA, 22 nt, Homo sapiens
cuagugaaagaggcagcuugaa

SEQ ID NO: 1038852 - RNA, 16 nt, Homo sapiens
cuagugacaagcuccu

SEQ ID NO: 1038853 - RNA, 16 nt, Homo sapiens
cuaguggucuuuguaa

SEQ ID NO: 1038854 - RNA, 14 nt, Homo sapiens
cuaguuucccugaa

SEQ ID NO: 1038855 - RNA, 16 nt, Homo sapiens
cuauaaaguaaagcua

SEQ ID NO: 1038856 - RNA, 16 nt, Homo sapiens
cuauaagcccacuguu

SEQ ID NO: 1038857 - RNA, 17 nt, Homo sapiens
cuauaauaaaacuaaac

SEQ ID NO: 1038858 - RNA, 19 nt, Homo sapiens
cuauaaucccagcacuuug

SEQ ID NO: 1038859 - RNA, 22 nt, Homo sapiens
cuauaauguugucauuucaaga

SEQ ID NO: 1038860 - RNA, 14 nt, Homo sapiens
cuauagcucaggac

SEQ ID NO: 1038861 - RNA, 12 nt, Homo sapiens
cuauagucccag

SEQ ID NO: 1038862 - RNA, 21 nt, Homo sapiens
cuauagucccagcuacucaga

SEQ ID NO: 1038863 - RNA, 19 nt, Homo sapiens
cuauauaauaaagcuacug

SEQ ID NO: 1038864 - RNA, 23 nt, Homo sapiens
cuauauaguuuauugacaauaau

SEQ ID NO: 1038865 - RNA, 14 nt, Homo sapiens
cuauauauguguau

SEQ ID NO: 1038866 - RNA, 14 nt, Homo sapiens
cuauaugcacuuau

SEQ ID NO: 1038867 - RNA, 19 nt, Homo sapiens
cuauaugccauaaaccuca

SEQ ID NO: 1038868 - RNA, 18 nt, Homo sapiens
cuauauguaguauaaaga

SEQ ID NO: 1038869 - RNA, 18 nt, Homo sapiens
cuauauuuauacuguaua

SEQ ID NO: 1038870 - RNA, 14 nt, Homo sapiens
cuaucaauagucaa

SEQ ID NO: 1038871 - RNA, 19 nt, Homo sapiens
cuaucuggccuuugcaugg

SEQ ID NO: 1038872 - RNA, 17 nt, Homo sapiens
cuaucuuuuaguuuuag

SEQ ID NO: 1038873 - RNA, 20 nt, Homo sapiens
cuaugaaaacagcuaucuca

SEQ ID NO: 1038874 - RNA, 18 nt, Homo sapiens
cuaugaaaauuauaucuc

SEQ ID NO: 1038875 - RNA, 15 nt, Homo sapiens
cuaugaaugggcaaa

SEQ ID NO: 1038876 - RNA, 17 nt, Homo sapiens
cuaugaauuuucaagua

SEQ ID NO: 1038877 - RNA, 21 nt, Homo sapiens
cuaugagaauugggauuacau

SEQ ID NO: 1038878 - RNA, 15 nt, Homo sapiens
cuaugauaugcuaau

SEQ ID NO: 1038879 - RNA, 19 nt, Homo sapiens
cuaugcaacagcucucacc

SEQ ID NO: 1038880 - RNA, 14 nt, Homo sapiens
cuaugcaaucugag

SEQ ID NO: 1038881 - RNA, 10 nt, Homo sapiens
cuauggaugu

SEQ ID NO: 1038882 - RNA, 18 nt, Homo sapiens
cuauggcucuacuuucag

SEQ ID NO: 1038883 - RNA, 19 nt, Homo sapiens
cuauggugagaugcagcug

SEQ ID NO: 1038884 - RNA, 22 nt, Homo sapiens
cuauguauggaauacaguguua

SEQ ID NO: 1038885 - RNA, 13 nt, Homo sapiens
cuaugugcaugca

SEQ ID NO: 1038886 - RNA, 14 nt, Homo sapiens
cuaugugcaugcag

SEQ ID NO: 1038887 - RNA, 15 nt, Homo sapiens
cuauguggcuguauc

SEQ ID NO: 1038888 - RNA, 22 nt, Homo sapiens
cuauguucuaagaagugaaaau

SEQ ID NO: 1038889 - RNA, 13 nt, Homo sapiens
cuauguugauaaa

SEQ ID NO: 1038890 - RNA, 20 nt, Homo sapiens
cuauuaaaacagccaaaacu

SEQ ID NO: 1038891 - RNA, 23 nt, Homo sapiens
cuauuaacuuuaauucucuuuca

SEQ ID NO: 1038892 - RNA, 14 nt, Homo sapiens
cuauuaccaugaga

SEQ ID NO: 1038893 - RNA, 15 nt, Homo sapiens
cuauuacgugcaaua

SEQ ID NO: 1038894 - RNA, 16 nt, Homo sapiens
cuauuagagcauugaa

SEQ ID NO: 1038895 - RNA, 23 nt, Homo sapiens
cuauuagagcugccugugccuuu

SEQ ID NO: 1038896 - RNA, 12 nt, Homo sapiens
cuauucaucuca

SEQ ID NO: 1038897 - RNA, 14 nt, Homo sapiens
cuauuccaaagugc

SEQ ID NO: 1038898 - RNA, 17 nt, Homo sapiens
cuauucuaaguaauucc

SEQ ID NO: 1038899 - RNA, 21 nt, Homo sapiens
cuauugauguacagucuguca

SEQ ID NO: 1038900 - RNA, 14 nt, Homo sapiens
cuauugccugagag

SEQ ID NO: 1038901 - RNA, 23 nt, Homo sapiens
cuauuucaucuauuuuuggcagu

SEQ ID NO: 1038902 - RNA, 17 nt, Homo sapiens
cuauuuccauuccagaa

SEQ ID NO: 1038903 - RNA, 12 nt, Homo sapiens
cuauuugccaug

SEQ ID NO: 1038904 - RNA, 15 nt, Homo sapiens
cuauuugccaugggc

SEQ ID NO: 1038905 - RNA, 13 nt, Homo sapiens
cuauuuucauucu

SEQ ID NO: 1038906 - RNA, 15 nt, Homo sapiens
cucaaaaauagggaa

SEQ ID NO: 1038907 - RNA, 18 nt, Homo sapiens
cucaaaacuucagacaua

SEQ ID NO: 1038908 - RNA, 22 nt, Homo sapiens
cucaaaccuaccacucaggaau

SEQ ID NO: 1038909 - RNA, 19 nt, Homo sapiens
cucaaacucuuaaaaccca

SEQ ID NO: 1038910 - RNA, 22 nt, Homo sapiens
cucaaacucuugaccucaggug

SEQ ID NO: 1038911 - RNA, 21 nt, Homo sapiens
cugaaagugaaaguccagaaa

SEQ ID NO: 1038912 - RNA, 17 nt, Homo sapiens
cugaaauaaaauucauu

SEQ ID NO: 1038913 - RNA, 21 nt, Homo sapiens
cugaaauauacacacagcagu

SEQ ID NO: 1038914 - RNA, 23 nt, Homo sapiens
cugaaauuuuaauugaacuaaca

SEQ ID NO: 1038915 - RNA, 18 nt, Homo sapiens
cugaacacaucgugauga

SEQ ID NO: 1038916 - RNA, 12 nt, Homo sapiens
cugaacagccaa

SEQ ID NO: 1038917 - RNA, 23 nt, Homo sapiens
cugaacauaggaaaauagaaacu

SEQ ID NO: 1038918 - RNA, 15 nt, Homo sapiens
cugaacccugugcug

SEQ ID NO: 1038919 - RNA, 16 nt, Homo sapiens
cugaacgcuucugcuu

SEQ ID NO: 1038920 - RNA, 19 nt, Homo sapiens
cugaacucaaacugaggaa

SEQ ID NO: 1038921 - RNA, 12 nt, Homo sapiens
cugaacugaugg

SEQ ID NO: 1038922 - RNA, 13 nt, Homo sapiens
cugaagaaaccuu

SEQ ID NO: 1038923 - RNA, 21 nt, Homo sapiens
cugaagaaaccuucagauuug

SEQ ID NO: 1038924 - RNA, 17 nt, Homo sapiens
cugaagaacuuggcaca

SEQ ID NO: 1038925 - RNA, 14 nt, Homo sapiens
cugaaggacuguga

SEQ ID NO: 1038926 - RNA, 16 nt, Homo sapiens
cugaaggacugugaca

SEQ ID NO: 1038927 - RNA, 17 nt, Homo sapiens
cugaagggcaucaugca

SEQ ID NO: 1038928 - RNA, 17 nt, Homo sapiens
cugaaguaagcaaagac

SEQ ID NO: 1038929 - RNA, 13 nt, Homo sapiens
cugaagucacaca

SEQ ID NO: 1038930 - RNA, 16 nt, Homo sapiens
cugaagucacaucaca

SEQ ID NO: 1038931 - RNA, 11 nt, Homo sapiens
cugaauaugaa

SEQ ID NO: 1038932 - RNA, 15 nt, Homo sapiens
cugaauccagaucau

SEQ ID NO: 1038933 - RNA, 23 nt, Homo sapiens
cugaauccauaaaggcauaccuu

SEQ ID NO: 1038934 - RNA, 18 nt, Homo sapiens
cugaauccucaugaggcu

SEQ ID NO: 1038935 - RNA, 20 nt, Homo sapiens
cugaaugccucaaugugacc

SEQ ID NO: 1038936 - RNA, 21 nt, Homo sapiens
cugaaugcuccagucaacaaa

SEQ ID NO: 1038937 - RNA, 19 nt, Homo sapiens
cugaauguuagauaguuac

SEQ ID NO: 1038938 - RNA, 21 nt, Homo sapiens
cugaauucuuuccccaaagac

SEQ ID NO: 1038939 - RNA, 19 nt, Homo sapiens
cugaauugaggacuaugga

SEQ ID NO: 1038940 - RNA, 13 nt, Homo sapiens
cugacaagcacug

SEQ ID NO: 1038941 - RNA, 15 nt, Homo sapiens
cugacaccuuugcag

SEQ ID NO: 1038942 - RNA, 12 nt, Homo sapiens
cugaccaagaga

SEQ ID NO: 1038943 - RNA, 22 nt, Homo sapiens
cugaccaguuuaaccugaugca

SEQ ID NO: 1038944 - RNA, 16 nt, Homo sapiens
cugaccauuuggucag

SEQ ID NO: 1038945 - RNA, 17 nt, Homo sapiens
cugacccagagccuagg

SEQ ID NO: 1038946 - RNA, 16 nt, Homo sapiens
cugaccccagugguau

SEQ ID NO: 1038947 - RNA, 19 nt, Homo sapiens
cugacccugcuucaaauau

SEQ ID NO: 1038948 - RNA, 20 nt, Homo sapiens
cugacggggaggaaccacug

SEQ ID NO: 1038949 - RNA, 21 nt, Homo sapiens
cugacuauugaaguugcagau

SEQ ID NO: 1038950 - RNA, 20 nt, Homo sapiens
cugacucacaagaagaccag

SEQ ID NO: 1038951 - RNA, 21 nt, Homo sapiens
cugacucacaagaagaccaga

SEQ ID NO: 1038952 - RNA, 17 nt, Homo sapiens
cugacucuucaagugcc

SEQ ID NO: 1038953 - RNA, 20 nt, Homo sapiens
cugacugaagugaacuauga

SEQ ID NO: 1038954 - RNA, 15 nt, Homo sapiens
cugacuuugugaucc

SEQ ID NO: 1038955 - RNA, 18 nt, Homo sapiens
cugacuuuugcagaugga

SEQ ID NO: 1038956 - RNA, 16 nt, Homo sapiens
cugagaaaacuaaguc

SEQ ID NO: 1038957 - RNA, 19 nt, Homo sapiens
cugagaaaacuaagucaga

SEQ ID NO: 1038958 - RNA, 16 nt, Homo sapiens
cugagaacacugugaa

SEQ ID NO: 1038959 - RNA, 18 nt, Homo sapiens
cugagaagugcacuuuaa

SEQ ID NO: 1038960 - RNA, 12 nt, Homo sapiens
cugagaauucca

SEQ ID NO: 1038961 - RNA, 13 nt, Homo sapiens
cugagaccaaaga

SEQ ID NO: 1038962 - RNA, 23 nt, Homo sapiens
cugagaccaaagaagcugcuguu

SEQ ID NO: 1038963 - RNA, 23 nt, Homo sapiens
cugagaccaguugggagcacugg

SEQ ID NO: 1038964 - RNA, 22 nt, Homo sapiens
cugagacuucaggugcauucca

SEQ ID NO: 1038965 - RNA, 16 nt, Homo sapiens
cugagagaaacugagg

SEQ ID NO: 1038966 - RNA, 15 nt, Homo sapiens
cugagagaaccucac

SEQ ID NO: 1038967 - RNA, 16 nt, Homo sapiens
cugagagacaggacua

SEQ ID NO: 1038968 - RNA, 14 nt, Homo sapiens
cugagagucugcac

SEQ ID NO: 1038969 - RNA, 18 nt, Homo sapiens
cugagagucugcacuuaa

SEQ ID NO: 1038970 - RNA, 14 nt, Homo sapiens
cugagagugaagug

SEQ ID NO: 1038971 - RNA, 14 nt, Homo sapiens
cugagauaccagcg

SEQ ID NO: 1038972 - RNA, 12 nt, Homo sapiens
cugagauuacag

SEQ ID NO: 1038973 - RNA, 22 nt, Homo sapiens
cugagauuacagacaugagccu

SEQ ID NO: 1038974 - RNA, 18 nt, Homo sapiens
cugagcacccaagccagg

SEQ ID NO: 1038975 - RNA, 19 nt, Homo sapiens
cugagcagguguucuucau

SEQ ID NO: 1038976 - RNA, 15 nt, Homo sapiens
cugagccagucccag

SEQ ID NO: 1038977 - RNA, 13 nt, Homo sapiens
cugagcccuggca

SEQ ID NO: 1038978 - RNA, 13 nt, Homo sapiens
cugagcuauuuca

SEQ ID NO: 1038979 - RNA, 20 nt, Homo sapiens
cugagcugaacccauuuuga

SEQ ID NO: 1038980 - RNA, 14 nt, Homo sapiens
cugagcugcucuga

SEQ ID NO: 1038981 - RNA, 19 nt, Homo sapiens
cugagcuggccuccuaugc

SEQ ID NO: 1038982 - RNA, 17 nt, Homo sapiens
cugaggaaugucuuuca

SEQ ID NO: 1038983 - RNA, 13 nt, Homo sapiens
cugaggauuucaa

SEQ ID NO: 1038984 - RNA, 22 nt, Homo sapiens
cugaggcaagagaauugcuuga

SEQ ID NO: 1038985 - RNA, 18 nt, Homo sapiens
cugaggcaggaggauugc

SEQ ID NO: 1038986 - RNA, 22 nt, Homo sapiens
cugaggcgcugcuuugucaaaa

SEQ ID NO: 1038987 - RNA, 16 nt, Homo sapiens
cugaggcuuccagaga

SEQ ID NO: 1038988 - RNA, 17 nt, Homo sapiens
cugagggcuuccuuugg

SEQ ID NO: 1038989 - RNA, 16 nt, Homo sapiens
cugaggggcaucugcc

SEQ ID NO: 1038990 - RNA, 22 nt, Homo sapiens
cugaggguccccaccugggacc

SEQ ID NO: 1038991 - RNA, 23 nt, Homo sapiens
cugaggguugggguggggaagca

SEQ ID NO: 1038992 - RNA, 16 nt, Homo sapiens
cugaggucucuugagg

SEQ ID NO: 1038993 - RNA, 20 nt, Homo sapiens
cugaguaagaaaugcugccc

SEQ ID NO: 1038994 - RNA, 18 nt, Homo sapiens
cugaguaagcccucagga

SEQ ID NO: 1038995 - RNA, 19 nt, Homo sapiens
cugaguggaucuccaagga

SEQ ID NO: 1038996 - RNA, 11 nt, Homo sapiens
cugaguuugcu

SEQ ID NO: 1038997 - RNA, 15 nt, Homo sapiens
cugaguuugcuuuca

SEQ ID NO: 1038998 - RNA, 22 nt, Homo sapiens
cugauaagagaaucaacauuuc

SEQ ID NO: 1038999 - RNA, 19 nt, Homo sapiens
cugauaagcuaacaccaga

SEQ ID NO: 1039000 - RNA, 15 nt, Homo sapiens
cugauaauaauugau

SEQ ID NO: 1039001 - RNA, 21 nt, Homo sapiens
cugauacaaauugcagacugu

SEQ ID NO: 1039002 - RNA, 19 nt, Homo sapiens
cugauauucaaauggacaa

SEQ ID NO: 1039003 - RNA, 18 nt, Homo sapiens
cugaucauuaaagccuga

SEQ ID NO: 1039004 - RNA, 14 nt, Homo sapiens
cugaucgauuugca

SEQ ID NO: 1039005 - RNA, 15 nt, Homo sapiens
cugaucucaguuucc

SEQ ID NO: 1039006 - RNA, 13 nt, Homo sapiens
cugaucugaugca

SEQ ID NO: 1039007 - RNA, 18 nt, Homo sapiens
cugaugaaggcaugccua

SEQ ID NO: 1039008 - RNA, 14 nt, Homo sapiens
cugaugcagucacg

SEQ ID NO: 1039009 - RNA, 23 nt, Homo sapiens
cugaugcuuugcuucaaauccau

SEQ ID NO: 1039010 - RNA, 18 nt, Homo sapiens
gcacguuaugguguuucu

SEQ ID NO: 1039011 - RNA, 19 nt, Homo sapiens
gcacuacauaaacugacuu

SEQ ID NO: 1039012 - RNA, 13 nt, Homo sapiens
gcacuacucugug

SEQ ID NO: 1039013 - RNA, 21 nt, Homo sapiens
gcacuauaauguaagcucuac

SEQ ID NO: 1039014 - RNA, 19 nt, Homo sapiens
gcacucagaagacacugau

SEQ ID NO: 1039015 - RNA, 20 nt, Homo sapiens
gcacucuaaaagguucaggg

SEQ ID NO: 1039016 - RNA, 15 nt, Homo sapiens
gcacugacugggcau

SEQ ID NO: 1039017 - RNA, 17 nt, Homo sapiens
gcacugaggaccagcca

SEQ ID NO: 1039018 - RNA, 14 nt, Homo sapiens
gcacugagggccac

SEQ ID NO: 1039019 - RNA, 21 nt, Homo sapiens
gcacugccugauggaccuguc

SEQ ID NO: 1039020 - RNA, 21 nt, Homo sapiens
gcacugcuaggcgagugccag

SEQ ID NO: 1039021 - RNA, 16 nt, Homo sapiens
gcacugcugugcugug

SEQ ID NO: 1039022 - RNA, 21 nt, Homo sapiens
gcacugugcuaauaacagugc

SEQ ID NO: 1039023 - RNA, 20 nt, Homo sapiens
gcacuguucccccugugcag

SEQ ID NO: 1039024 - RNA, 13 nt, Homo sapiens
gcacuuauucuca

SEQ ID NO: 1039025 - RNA, 21 nt, Homo sapiens
gcacuucacagagugugcugg

SEQ ID NO: 1039026 - RNA, 21 nt, Homo sapiens
gcacuugucuuugacuugugu

SEQ ID NO: 1039027 - RNA, 12 nt, Homo sapiens
gcacuuuggaca

SEQ ID NO: 1039028 - RNA, 18 nt, Homo sapiens
gcacuuugggaggccaag

SEQ ID NO: 1039029 - RNA, 15 nt, Homo sapiens
gcagaaaaacucugg

SEQ ID NO: 1039030 - RNA, 16 nt, Homo sapiens
gcagaaaauugccuaa

SEQ ID NO: 1039031 - RNA, 21 nt, Homo sapiens
gcagaagccuccccagcucac

SEQ ID NO: 1039032 - RNA, 14 nt, Homo sapiens
gcagaauccagcua

SEQ ID NO: 1039033 - RNA, 14 nt, Homo sapiens
gcagaccacugaua

SEQ ID NO: 1039034 - RNA, 14 nt, Homo sapiens
gcagaccugacucu

SEQ ID NO: 1039035 - RNA, 22 nt, Homo sapiens
gcagagcagagaccaucccuga

SEQ ID NO: 1039036 - RNA, 21 nt, Homo sapiens
gcagagcuugaacacagucuc

SEQ ID NO: 1039037 - RNA, 20 nt, Homo sapiens
gcagagguaaaagugugagc

SEQ ID NO: 1039038 - RNA, 16 nt, Homo sapiens
gcagaguacuggcuga

SEQ ID NO: 1039039 - RNA, 23 nt, Homo sapiens
gcagaguacuggcugauggagua

SEQ ID NO: 1039040 - RNA, 14 nt, Homo sapiens
gcagauacauauga

SEQ ID NO: 1039041 - RNA, 13 nt, Homo sapiens
gcagauccagagg

SEQ ID NO: 1039042 - RNA, 21 nt, Homo sapiens
gcagaucuaccccuuacuuau

SEQ ID NO: 1039043 - RNA, 17 nt, Homo sapiens
gcagaucugugccccau

SEQ ID NO: 1039044 - RNA, 15 nt, Homo sapiens
gcagcauacacagau

SEQ ID NO: 1039045 - RNA, 17 nt, Homo sapiens
gcagcauacacagauga

SEQ ID NO: 1039046 - RNA, 12 nt, Homo sapiens
gcagccaaggga

SEQ ID NO: 1039047 - RNA, 15 nt, Homo sapiens
gcagccaagggauga

SEQ ID NO: 1039048 - RNA, 12 nt, Homo sapiens
gcagccaccagc

SEQ ID NO: 1039049 - RNA, 16 nt, Homo sapiens
gcagccacugugcuga

SEQ ID NO: 1039050 - RNA, 20 nt, Homo sapiens
gcagcccuaaggaucucuca

SEQ ID NO: 1039051 - RNA, 18 nt, Homo sapiens
gcagccuggggucugaca

SEQ ID NO: 1039052 - RNA, 18 nt, Homo sapiens
gcagcgccucaucuucaa

SEQ ID NO: 1039053 - RNA, 19 nt, Homo sapiens
gcagcuaucucucagugaa

SEQ ID NO: 1039054 - RNA, 12 nt, Homo sapiens
gcagcucaggga

SEQ ID NO: 1039055 - RNA, 13 nt, Homo sapiens
gcagcucuacucu

SEQ ID NO: 1039056 - RNA, 22 nt, Homo sapiens
gcagcucuugcuaaucaguguc

SEQ ID NO: 1039057 - RNA, 15 nt, Homo sapiens
gcagcugccagagaa

SEQ ID NO: 1039058 - RNA, 16 nt, Homo sapiens
gcagcuguugcaguga

SEQ ID NO: 1039059 - RNA, 14 nt, Homo sapiens
gcagcuuauucaca

SEQ ID NO: 1039060 - RNA, 18 nt, Homo sapiens
gcagcuuauucacaagac

SEQ ID NO: 1039061 - RNA, 20 nt, Homo sapiens
gcagcuucaccagagcauuu

SEQ ID NO: 1039062 - RNA, 17 nt, Homo sapiens
gcagcuugaaacugaga

SEQ ID NO: 1039063 - RNA, 21 nt, Homo sapiens
gcaggaacuugcacaaaauca

SEQ ID NO: 1039064 - RNA, 21 nt, Homo sapiens
gcaggaagcaacgaagggaaa

SEQ ID NO: 1039065 - RNA, 15 nt, Homo sapiens
gcaggaagugucuag

SEQ ID NO: 1039066 - RNA, 12 nt, Homo sapiens
gcaggaccagga

SEQ ID NO: 1039067 - RNA, 12 nt, Homo sapiens
gcaggaccucag

SEQ ID NO: 1039068 - RNA, 17 nt, Homo sapiens
gcaggagaaucgcuuga

SEQ ID NO: 1039069 - RNA, 17 nt, Homo sapiens
gcaggagaauggcguga

SEQ ID NO: 1039070 - RNA, 22 nt, Homo sapiens
gcaggauuugggcucuuggaau

SEQ ID NO: 1039071 - RNA, 14 nt, Homo sapiens
gcaggcagccccac

SEQ ID NO: 1039072 - RNA, 15 nt, Homo sapiens
gcagggaaacagcua

SEQ ID NO: 1039073 - RNA, 18 nt, Homo sapiens
gcagggacuuuggucuau

SEQ ID NO: 1039074 - RNA, 19 nt, Homo sapiens
gcaggggcuugcuuugcag

SEQ ID NO: 1039075 - RNA, 21 nt, Homo sapiens
gcaggggggcaguaacucccc

SEQ ID NO: 1039076 - RNA, 20 nt, Homo sapiens
gcagggggugugucugcuca

SEQ ID NO: 1039077 - RNA, 16 nt, Homo sapiens
gcagggguugcaguga

SEQ ID NO: 1039078 - RNA, 15 nt, Homo sapiens
gcagguauggaaggg

SEQ ID NO: 1039079 - RNA, 12 nt, Homo sapiens
gcaggugccucc

SEQ ID NO: 1039080 - RNA, 20 nt, Homo sapiens
gcaggugcugagcaaaggga

SEQ ID NO: 1039081 - RNA, 17 nt, Homo sapiens
gcagguggaucacugga

SEQ ID NO: 1039082 - RNA, 19 nt, Homo sapiens
gcagguguucuucauuacc

SEQ ID NO: 1039083 - RNA, 23 nt, Homo sapiens
gcagguuggugggggccucggug

SEQ ID NO: 1039084 - RNA, 19 nt, Homo sapiens
gcaguagaaauaauaugca

SEQ ID NO: 1039085 - RNA, 19 nt, Homo sapiens
gcaguaucaugaagccuaa

SEQ ID NO: 1039086 - RNA, 13 nt, Homo sapiens
gcagucacagcua

SEQ ID NO: 1039087 - RNA, 22 nt, Homo sapiens
gcagucauuaugagaggcaaug

SEQ ID NO: 1039088 - RNA, 19 nt, Homo sapiens
gcaguccugccucagccuc

SEQ ID NO: 1039089 - RNA, 13 nt, Homo sapiens
gcagucuggcuga

SEQ ID NO: 1039090 - RNA, 21 nt, Homo sapiens
gcagugaugcuggaugcuccu

SEQ ID NO: 1039091 - RNA, 13 nt, Homo sapiens
gcaguggaacuaa

SEQ ID NO: 1039092 - RNA, 16 nt, Homo sapiens
gcaguggaacuaagaa

SEQ ID NO: 1039093 - RNA, 22 nt, Homo sapiens
gcaguggcacgaucucgacuca

SEQ ID NO: 1039094 - RNA, 20 nt, Homo sapiens
gcaguucugcagcuguuuua

SEQ ID NO: 1039095 - RNA, 19 nt, Homo sapiens
gcaguugaaaagacuccaa

SEQ ID NO: 1039096 - RNA, 21 nt, Homo sapiens
gcaguuuugugauaaguucua

SEQ ID NO: 1039097 - RNA, 20 nt, Homo sapiens
gcauaaauaugcagugauau

SEQ ID NO: 1039098 - RNA, 12 nt, Homo sapiens
gcauaacuuauu

SEQ ID NO: 1039099 - RNA, 19 nt, Homo sapiens
gcauaagaaaacuaagaaa

SEQ ID NO: 1039100 - RNA, 18 nt, Homo sapiens
gcauaaguuaacuuccaa

SEQ ID NO: 1039101 - RNA, 16 nt, Homo sapiens
gcauaaguuucuggga

SEQ ID NO: 1039102 - RNA, 22 nt, Homo sapiens
gcauacacacacacacacagcc

SEQ ID NO: 1039103 - RNA, 20 nt, Homo sapiens
gcauaccuuuauugugaucu

SEQ ID NO: 1039104 - RNA, 23 nt, Homo sapiens
gcauauaacuuauauuguaagaa

SEQ ID NO: 1039105 - RNA, 15 nt, Homo sapiens
gcauauauacauaua

SEQ ID NO: 1039106 - RNA, 15 nt, Homo sapiens
gcauauuaaaaguca

SEQ ID NO: 1039107 - RNA, 21 nt, Homo sapiens
gcaucaccuuaggcagggaag

SEQ ID NO: 1039108 - RNA, 17 nt, Homo sapiens
gcaucagcaacaaccag

SEQ ID NO: 1039109 - RNA, 19 nt, Homo sapiens
gcaucaucaaaaacuuugg

SEQ ID NO: 1039110 - RNA, 19 nt, Homo sapiens
gcauccccuuggcugugag

SEQ ID NO: 1039111 - RNA, 20 nt, Homo sapiens
gcauccuggccaacauggug

SEQ ID NO: 1039112 - RNA, 14 nt, Homo sapiens
gcauccuuugcacu

SEQ ID NO: 1039113 - RNA, 23 nt, Homo sapiens
gcaucuccuguuuuuugaugcuu

SEQ ID NO: 1039114 - RNA, 21 nt, Homo sapiens
gcaucuggguagcuguaaggc

SEQ ID NO: 1039115 - RNA, 14 nt, Homo sapiens
gcaugaacauguac

SEQ ID NO: 1039116 - RNA, 16 nt, Homo sapiens
gcaugaaggaugccaa

SEQ ID NO: 1039117 - RNA, 17 nt, Homo sapiens
gcaugaauccaguccag

SEQ ID NO: 1039118 - RNA, 14 nt, Homo sapiens
gcaugaccugugac

SEQ ID NO: 1039119 - RNA, 19 nt, Homo sapiens
gcaugagcuacgccugccu

SEQ ID NO: 1039120 - RNA, 22 nt, Homo sapiens
gcaugaucuugagcaaguuccu

SEQ ID NO: 1039121 - RNA, 17 nt, Homo sapiens
gcaugcaugugcuugug

SEQ ID NO: 1039122 - RNA, 17 nt, Homo sapiens
gcaugccaaauguucca

SEQ ID NO: 1039123 - RNA, 21 nt, Homo sapiens
gcaugcccccuccugcaaggg

SEQ ID NO: 1039124 - RNA, 23 nt, Homo sapiens
gcauggaggcugcgacugaugaa

SEQ ID NO: 1039125 - RNA, 15 nt, Homo sapiens
gcauggauacuacag

SEQ ID NO: 1039126 - RNA, 13 nt, Homo sapiens
gcauggugcaguu

SEQ ID NO: 1039127 - RNA, 14 nt, Homo sapiens
gcaugugcagcuau

SEQ ID NO: 1039128 - RNA, 15 nt, Homo sapiens
gcaugugcagcuauu

SEQ ID NO: 1039129 - RNA, 15 nt, Homo sapiens
gcauguuugugauug

SEQ ID NO: 1039130 - RNA, 21 nt, Homo sapiens
gcauuaaaaaaaaaaucaaug

SEQ ID NO: 1039131 - RNA, 13 nt, Homo sapiens
gcauucaagugua

SEQ ID NO: 1039132 - RNA, 17 nt, Homo sapiens
gcauucaaguguacagu

SEQ ID NO: 1039133 - RNA, 17 nt, Homo sapiens
gcauuguaaaugugcuu

SEQ ID NO: 1039134 - RNA, 19 nt, Homo sapiens
gcauuguaucgauguuaug

SEQ ID NO: 1039135 - RNA, 22 nt, Homo sapiens
gcauugucccugugccuaacac

SEQ ID NO: 1039136 - RNA, 21 nt, Homo sapiens
gcauuguugagguggucugaa

SEQ ID NO: 1039137 - RNA, 23 nt, Homo sapiens
gcauuuaaccgucaauaggcaaa

SEQ ID NO: 1039138 - RNA, 20 nt, Homo sapiens
gcauuuagacccugcauuua

SEQ ID NO: 1039139 - RNA, 22 nt, Homo sapiens
gcauuucauucuucucuagcug

SEQ ID NO: 1039140 - RNA, 18 nt, Homo sapiens
gcauuucugaaguggacu

SEQ ID NO: 1039141 - RNA, 12 nt, Homo sapiens
aaaaaacacaua

SEQ ID NO: 1039142 - RNA, 20 nt, Homo sapiens
aaaaaacguauugcauuuaa

SEQ ID NO: 1039143 - RNA, 12 nt, Homo sapiens
aaaaaaugcaca

SEQ ID NO: 1039144 - RNA, 15 nt, Homo sapiens
aaaaaaugcauuuaa

SEQ ID NO: 1039145 - RNA, 14 nt, Homo sapiens
aaaaacacacuccu

SEQ ID NO: 1039146 - RNA, 18 nt, Homo sapiens
aaaaacacacuccuuugc

SEQ ID NO: 1039147 - RNA, 22 nt, Homo sapiens
aaaaaccucuaugcaaucugag

SEQ ID NO: 1039148 - RNA, 15 nt, Homo sapiens
aaaaacguauugcau

SEQ ID NO: 1039149 - RNA, 11 nt, Homo sapiens
aaaaacuaaaa

SEQ ID NO: 1039150 - RNA, 17 nt, Homo sapiens
aaaaacugaaaauacuu

SEQ ID NO: 1039151 - RNA, 19 nt, Homo sapiens
aaaaacugaaaauacuuag

SEQ ID NO: 1039152 - RNA, 21 nt, Homo sapiens
aaaaagaugaccuuugucuca

SEQ ID NO: 1039153 - RNA, 15 nt, Homo sapiens
aaaaagccaucugau

SEQ ID NO: 1039154 - RNA, 22 nt, Homo sapiens
aaaaagggauccguacauucaa

SEQ ID NO: 1039155 - RNA, 13 nt, Homo sapiens
aaaaagucacaaa

SEQ ID NO: 1039156 - RNA, 12 nt, Homo sapiens
aaaaaguguuua

SEQ ID NO: 1039157 - RNA, 23 nt, Homo sapiens
aaaaaguucagcaugaaggaugc

SEQ ID NO: 1039158 - RNA, 23 nt, Homo sapiens
aaaaauacugccagaugcugaug

SEQ ID NO: 1039159 - RNA, 10 nt, Homo sapiens
aaaaauacuu

SEQ ID NO: 1039160 - RNA, 21 nt, Homo sapiens
aaaaauagccugccucuucuc

SEQ ID NO: 1039161 - RNA, 13 nt, Homo sapiens
aaaaauauuauaa

SEQ ID NO: 1039162 - RNA, 21 nt, Homo sapiens
aaaaauccauaaaauccuuaa

SEQ ID NO: 1039163 - RNA, 13 nt, Homo sapiens
aaaaaugagcucg

SEQ ID NO: 1039164 - RNA, 12 nt, Homo sapiens
aaaaaugaguaa

SEQ ID NO: 1039165 - RNA, 13 nt, Homo sapiens
aaaaauggcucag

SEQ ID NO: 1039166 - RNA, 23 nt, Homo sapiens
aaaaauuggucacccuaaggaaa

SEQ ID NO: 1039167 - RNA, 21 nt, Homo sapiens
aaaaauuuauuuauauuucaa

SEQ ID NO: 1039168 - RNA, 18 nt, Homo sapiens
aaaaauuugcuucacuca

SEQ ID NO: 1039169 - RNA, 14 nt, Homo sapiens
aaaacacacuccuu

SEQ ID NO: 1039170 - RNA, 23 nt, Homo sapiens
aaaacacagagaugcugcaaaua

SEQ ID NO: 1039171 - RNA, 15 nt, Homo sapiens
aaaacacaucuuucc

SEQ ID NO: 1039172 - RNA, 15 nt, Homo sapiens
aaaacacugugcaca

SEQ ID NO: 1039173 - RNA, 13 nt, Homo sapiens
aaaacacuuccau

SEQ ID NO: 1039174 - RNA, 13 nt, Homo sapiens
aaaacagaaagca

SEQ ID NO: 1039175 - RNA, 23 nt, Homo sapiens
aaaacaguuuugucagucuuucu

SEQ ID NO: 1039176 - RNA, 18 nt, Homo sapiens
aaaacaugauuguuuaca

SEQ ID NO: 1039177 - RNA, 16 nt, Homo sapiens
aaaacauguuugcacu

SEQ ID NO: 1039178 - RNA, 18 nt, Homo sapiens
aaaaccaaaacugugcag

SEQ ID NO: 1039179 - RNA, 22 nt, Homo sapiens
aaaaccaaaagaacaagaauuu

SEQ ID NO: 1039180 - RNA, 20 nt, Homo sapiens
aaaaccaaauuuguauuuaa

SEQ ID NO: 1039181 - RNA, 16 nt, Homo sapiens
aaaaccaauagcuuua

SEQ ID NO: 1039182 - RNA, 22 nt, Homo sapiens
aaaacccuugauuauacucugu

SEQ ID NO: 1039183 - RNA, 15 nt, Homo sapiens
aaaaccucuaugcaa

SEQ ID NO: 1039184 - RNA, 18 nt, Homo sapiens
aaaaccuuucaaauuuca

SEQ ID NO: 1039185 - RNA, 15 nt, Homo sapiens
aaaacgcaugugcag

SEQ ID NO: 1039186 - RNA, 13 nt, Homo sapiens
aaaacgucuugcu

SEQ ID NO: 1039187 - RNA, 15 nt, Homo sapiens
aaaacuauauucuca

SEQ ID NO: 1039188 - RNA, 17 nt, Homo sapiens
aaaacugaaaauacuua

SEQ ID NO: 1039189 - RNA, 18 nt, Homo sapiens
gcauuuaaauuagauaac

SEQ ID NO: 1039190 - RNA, 19 nt, Homo sapiens
gcauuuacuuuguguucac

SEQ ID NO: 1039191 - RNA, 22 nt, Homo sapiens
gcauuuauggucaacacuuaag

SEQ ID NO: 1039192 - RNA, 19 nt, Homo sapiens
gcauuuccaacaccacaga

SEQ ID NO: 1039193 - RNA, 22 nt, Homo sapiens
gcauuugacugaagaugcagcu

SEQ ID NO: 1039194 - RNA, 16 nt, Homo sapiens
gcauuugauuuugccc

SEQ ID NO: 1039195 - RNA, 16 nt, Homo sapiens
gcauuugucaacaaag

SEQ ID NO: 1039196 - RNA, 22 nt, Homo sapiens
gcauuuuggaaagcuccuagca

SEQ ID NO: 1039197 - RNA, 15 nt, Homo sapiens
gcauuuuuaaauaca

SEQ ID NO: 1039198 - RNA, 15 nt, Homo sapiens
gcauuuuuugcaagu

SEQ ID NO: 1039199 - RNA, 13 nt, Homo sapiens
gccaaaagccuuu

SEQ ID NO: 1039200 - RNA, 18 nt, Homo sapiens
gccaaacagccccaaagu

SEQ ID NO: 1039201 - RNA, 23 nt, Homo sapiens
gccaaaccucuguucaguguaaa

SEQ ID NO: 1039202 - RNA, 15 nt, Homo sapiens
gccaaauaaaaucua

SEQ ID NO: 1039203 - RNA, 13 nt, Homo sapiens
gccaaauguaauu

SEQ ID NO: 1039204 - RNA, 17 nt, Homo sapiens
gccaaccggucacccag

SEQ ID NO: 1039205 - RNA, 15 nt, Homo sapiens
gccaacugcugcuuu

SEQ ID NO: 1039206 - RNA, 19 nt, Homo sapiens
gccaagaaucaagcuagaa

SEQ ID NO: 1039207 - RNA, 16 nt, Homo sapiens
gccaagagaauauccg

SEQ ID NO: 1039208 - RNA, 19 nt, Homo sapiens
gccaagagggcugcaaaag

SEQ ID NO: 1039209 - RNA, 21 nt, Homo sapiens
gccaagaucacgccauugcac

SEQ ID NO: 1039210 - RNA, 11 nt, Homo sapiens
gccaagccagu

SEQ ID NO: 1039211 - RNA, 14 nt, Homo sapiens
gccaagcuccucaa

SEQ ID NO: 1039212 - RNA, 22 nt, Homo sapiens
gccaaggcggguggaucacuug

SEQ ID NO: 1039213 - RNA, 19 nt, Homo sapiens
gccaaggcuggagugcagu

SEQ ID NO: 1039214 - RNA, 23 nt, Homo sapiens
gccaaggugggguauuuaccaca

SEQ ID NO: 1039215 - RNA, 12 nt, Homo sapiens
gccaagugcagg

SEQ ID NO: 1039216 - RNA, 17 nt, Homo sapiens
gccaauaacacacagcu

SEQ ID NO: 1039217 - RNA, 18 nt, Homo sapiens
gccaaucaguagccagca

SEQ ID NO: 1039218 - RNA, 16 nt, Homo sapiens
gccacacggcucucac

SEQ ID NO: 1039219 - RNA, 19 nt, Homo sapiens
gccacacuguacucugcac

SEQ ID NO: 1039220 - RNA, 22 nt, Homo sapiens
gccacacugugggacucuucuu

SEQ ID NO: 1039221 - RNA, 15 nt, Homo sapiens
gccacagaagccagg

SEQ ID NO: 1039222 - RNA, 14 nt, Homo sapiens
gccacagugcaauu

SEQ ID NO: 1039223 - RNA, 16 nt, Homo sapiens
gccacaucccuuugaa

SEQ ID NO: 1039224 - RNA, 21 nt, Homo sapiens
gccacaucuccuguggucucu

SEQ ID NO: 1039225 - RNA, 17 nt, Homo sapiens
gccacauggcugggauu

SEQ ID NO: 1039226 - RNA, 11 nt, Homo sapiens
gccacccagca

SEQ ID NO: 1039227 - RNA, 13 nt, Homo sapiens
gccacccuaccug

SEQ ID NO: 1039228 - RNA, 18 nt, Homo sapiens
gccacgaaugaaugaauu

SEQ ID NO: 1039229 - RNA, 16 nt, Homo sapiens
gccacuauuacuggga

SEQ ID NO: 1039230 - RNA, 16 nt, Homo sapiens
gccacucauuccugua

SEQ ID NO: 1039231 - RNA, 15 nt, Homo sapiens
gccacugagcagucu

SEQ ID NO: 1039232 - RNA, 17 nt, Homo sapiens
gccagaagggggccaug

SEQ ID NO: 1039233 - RNA, 18 nt, Homo sapiens
gccagacugucucaaaua

SEQ ID NO: 1039234 - RNA, 13 nt, Homo sapiens
gccagagccucug

SEQ ID NO: 1039235 - RNA, 21 nt, Homo sapiens
gccagcaaugacaucucaggg

SEQ ID NO: 1039236 - RNA, 12 nt, Homo sapiens
gccagcacagaa

SEQ ID NO: 1039237 - RNA, 15 nt, Homo sapiens
gccagccaugcauug

SEQ ID NO: 1039238 - RNA, 18 nt, Homo sapiens
gccagcucauuucacuuu

SEQ ID NO: 1039239 - RNA, 17 nt, Homo sapiens
gccagcuuaucucaggg

SEQ ID NO: 1039240 - RNA, 22 nt, Homo sapiens
gccaggauugaccuuugcacga

SEQ ID NO: 1039241 - RNA, 18 nt, Homo sapiens
gccaggcacgguggcuga

SEQ ID NO: 1039242 - RNA, 20 nt, Homo sapiens
gccaggcaggugccuggaca

SEQ ID NO: 1039243 - RNA, 17 nt, Homo sapiens
gccaggcucugugcuga

SEQ ID NO: 1039244 - RNA, 18 nt, Homo sapiens
gccagggcccugcagagg

SEQ ID NO: 1039245 - RNA, 14 nt, Homo sapiens
gccagggucucacu

SEQ ID NO: 1039246 - RNA, 21 nt, Homo sapiens
gccaggguggucuugaucucc

SEQ ID NO: 1039247 - RNA, 20 nt, Homo sapiens
gccagguucugacucuuggc

SEQ ID NO: 1039248 - RNA, 22 nt, Homo sapiens
gccaguaaacagaggaguacag

SEQ ID NO: 1039249 - RNA, 20 nt, Homo sapiens
gccauaauuacuaugucauu

SEQ ID NO: 1039250 - RNA, 22 nt, Homo sapiens
gccauauucuguuggccagugu

SEQ ID NO: 1039251 - RNA, 17 nt, Homo sapiens
gccauccucccaagggg

SEQ ID NO: 1039252 - RNA, 15 nt, Homo sapiens
gccaucucuuccuca

SEQ ID NO: 1039253 - RNA, 16 nt, Homo sapiens
gccaucucuuccucau

SEQ ID NO: 1039254 - RNA, 21 nt, Homo sapiens
gccaugacuugagaaacaaau

SEQ ID NO: 1039255 - RNA, 17 nt, Homo sapiens
gccaugauggugcugac

SEQ ID NO: 1039256 - RNA, 18 nt, Homo sapiens
gccaugauggugcugacc

SEQ ID NO: 1039257 - RNA, 20 nt, Homo sapiens
gccaugauggugcugaccuc

SEQ ID NO: 1039258 - RNA, 16 nt, Homo sapiens
gccaugauguggagug

SEQ ID NO: 1039259 - RNA, 18 nt, Homo sapiens
gccaugggccuccugugu

SEQ ID NO: 1039260 - RNA, 21 nt, Homo sapiens
gccauucacuucauaauccag

SEQ ID NO: 1039261 - RNA, 15 nt, Homo sapiens
gccauugcacuccag

SEQ ID NO: 1039262 - RNA, 22 nt, Homo sapiens
gccauuuuggguuuugggucuu

SEQ ID NO: 1039263 - RNA, 13 nt, Homo sapiens
gcccaaacauaaa

SEQ ID NO: 1039264 - RNA, 15 nt, Homo sapiens
gcccaacgcaaauuc

SEQ ID NO: 1039265 - RNA, 20 nt, Homo sapiens
gcccaaguuguggugcugac

SEQ ID NO: 1039266 - RNA, 14 nt, Homo sapiens
gcccaccagugacu

SEQ ID NO: 1039267 - RNA, 23 nt, Homo sapiens
gcccacccuuguguccacuguga

SEQ ID NO: 1039268 - RNA, 22 nt, Homo sapiens
gcccaccuuccccagaaccagg

SEQ ID NO: 1039269 - RNA, 20 nt, Homo sapiens
gcccacgcuggagugcagug

SEQ ID NO: 1039270 - RNA, 14 nt, Homo sapiens
gcccacuucccucc

SEQ ID NO: 1039271 - RNA, 20 nt, Homo sapiens
gcccagagaagccaaaagau

SEQ ID NO: 1039272 - RNA, 20 nt, Homo sapiens
gcccagcagggccucaaagu

SEQ ID NO: 1039273 - RNA, 16 nt, Homo sapiens
gcccagccucaucucu

SEQ ID NO: 1039274 - RNA, 21 nt, Homo sapiens
gcccagccuccaagcuccauc

SEQ ID NO: 1039275 - RNA, 13 nt, Homo sapiens
gcccagcggcccc

SEQ ID NO: 1039276 - RNA, 16 nt, Homo sapiens
gcccagcuaaagcaau

SEQ ID NO: 1039277 - RNA, 18 nt, Homo sapiens
gcccaggcaacaguacuu

SEQ ID NO: 1039278 - RNA, 17 nt, Homo sapiens
gcccaggcaggucuuga

SEQ ID NO: 1039279 - RNA, 17 nt, Homo sapiens
gcccaggccugccuguu

SEQ ID NO: 1039280 - RNA, 17 nt, Homo sapiens
gcccaggcuggucuuga

SEQ ID NO: 1039281 - RNA, 16 nt, Homo sapiens
gcccagggaagccaaa

SEQ ID NO: 1039282 - RNA, 16 nt, Homo sapiens
gcccagggacaccagc

SEQ ID NO: 1039283 - RNA, 19 nt, Homo sapiens
gcccagggccacucugccu

SEQ ID NO: 1039284 - RNA, 15 nt, Homo sapiens
gcccaggugugcagg

SEQ ID NO: 1039285 - RNA, 15 nt, Homo sapiens
gcccaguccuuccac

SEQ ID NO: 1039286 - RNA, 13 nt, Homo sapiens
gcccagugcacac

SEQ ID NO: 1039287 - RNA, 15 nt, Homo sapiens
gcccaguguguuucu

SEQ ID NO: 1039288 - RNA, 19 nt, Homo sapiens
gcccaguguuugugcaagg

SEQ ID NO: 1039289 - RNA, 17 nt, Homo sapiens
gcccaguuucugccucu

SEQ ID NO: 1039290 - RNA, 14 nt, Homo sapiens
gcccauaucuguga

SEQ ID NO: 1039291 - RNA, 22 nt, Homo sapiens
gcccaucacaggguugggccca

SEQ ID NO: 1039292 - RNA, 23 nt, Homo sapiens
gcccauggcuuuagcuaccucac

SEQ ID NO: 1039293 - RNA, 16 nt, Homo sapiens
aaacugcgaggccagu

SEQ ID NO: 1039294 - RNA, 19 nt, Homo sapiens
aaacuggguuccugcaaug

SEQ ID NO: 1039295 - RNA, 20 nt, Homo sapiens
aaacuuauccuccaugaaua

SEQ ID NO: 1039296 - RNA, 13 nt, Homo sapiens
aaacuucaagggu

SEQ ID NO: 1039297 - RNA, 13 nt, Homo sapiens
aaacuuccaguca

SEQ ID NO: 1039298 - RNA, 22 nt, Homo sapiens
aaacuuccagugcaacacugaa

SEQ ID NO: 1039299 - RNA, 21 nt, Homo sapiens
aaacuucuuuaaaaaaacaca

SEQ ID NO: 1039300 - RNA, 15 nt, Homo sapiens
aaacuugcuuaucaa

SEQ ID NO: 1039301 - RNA, 23 nt, Homo sapiens
aaacuuggaauuuguaaccucag

SEQ ID NO: 1039302 - RNA, 19 nt, Homo sapiens
aaacuuguaaaugcuguca

SEQ ID NO: 1039303 - RNA, 17 nt, Homo sapiens
aaacuuguuacuaaaga

SEQ ID NO: 1039304 - RNA, 21 nt, Homo sapiens
aaacuuuagaguagcaugaga

SEQ ID NO: 1039305 - RNA, 18 nt, Homo sapiens
aaacuuuaugcuaaguga

SEQ ID NO: 1039306 - RNA, 20 nt, Homo sapiens
aaacuuuaugcuaagugaaa

SEQ ID NO: 1039307 - RNA, 18 nt, Homo sapiens
aaagaaaaagaccuauga

SEQ ID NO: 1039308 - RNA, 21 nt, Homo sapiens
aaagaaaaucaggcuggccaa

SEQ ID NO: 1039309 - RNA, 19 nt, Homo sapiens
aaagaaaaucucugugaaa

SEQ ID NO: 1039310 - RNA, 18 nt, Homo sapiens
aaagaaagccucagagaa

SEQ ID NO: 1039311 - RNA, 18 nt, Homo sapiens
aaagaaaucuucauuuau

SEQ ID NO: 1039312 - RNA, 16 nt, Homo sapiens
aaagaaaugcccaucu

SEQ ID NO: 1039313 - RNA, 14 nt, Homo sapiens
aaagaacuuggaaa

SEQ ID NO: 1039314 - RNA, 22 nt, Homo sapiens
aaagaagcugcuguucuuagca

SEQ ID NO: 1039315 - RNA, 21 nt, Homo sapiens
aaagaauauucauaguuuaau

SEQ ID NO: 1039316 - RNA, 18 nt, Homo sapiens
aaagacaggguuucacca

SEQ ID NO: 1039317 - RNA, 21 nt, Homo sapiens
aaagaccaaauuccuuggcau

SEQ ID NO: 1039318 - RNA, 20 nt, Homo sapiens
aaagaccaauauucaaaugc

SEQ ID NO: 1039319 - RNA, 16 nt, Homo sapiens
aaagacuggcuuuuau

SEQ ID NO: 1039320 - RNA, 19 nt, Homo sapiens
aaagacuguacaaaguaga

SEQ ID NO: 1039321 - RNA, 18 nt, Homo sapiens
aaagacuuaacugguuca

SEQ ID NO: 1039322 - RNA, 19 nt, Homo sapiens
aaagacuuuccucuuaguc

SEQ ID NO: 1039323 - RNA, 22 nt, Homo sapiens
aaagaggacaggcuaccccuuu

SEQ ID NO: 1039324 - RNA, 15 nt, Homo sapiens
aaagaggcagcuuga

SEQ ID NO: 1039325 - RNA, 20 nt, Homo sapiens
aaagauaacaagaucuuuca

SEQ ID NO: 1039326 - RNA, 22 nt, Homo sapiens
aaagaugcauuaucuaugauau

SEQ ID NO: 1039327 - RNA, 15 nt, Homo sapiens
aaagaugcccacuga

SEQ ID NO: 1039328 - RNA, 15 nt, Homo sapiens
aaagauggaugugcu

SEQ ID NO: 1039329 - RNA, 21 nt, Homo sapiens
aaagauggcugugccucugcc

SEQ ID NO: 1039330 - RNA, 21 nt, Homo sapiens
aaagauuauagaaguagcaaa

SEQ ID NO: 1039331 - RNA, 16 nt, Homo sapiens
aaagauuugcuuuaau

SEQ ID NO: 1039332 - RNA, 19 nt, Homo sapiens
aaagauuugcuuuaauugu

SEQ ID NO: 1039333 - RNA, 16 nt, Homo sapiens
ggcuccuggggcaaug

SEQ ID NO: 1039334 - RNA, 13 nt, Homo sapiens
ggcuccugugcuu

SEQ ID NO: 1039335 - RNA, 21 nt, Homo sapiens
ggcucgucggggggacagcuc

SEQ ID NO: 1039336 - RNA, 22 nt, Homo sapiens
ggcucugggagacuuugaagac

SEQ ID NO: 1039337 - RNA, 14 nt, Homo sapiens
ggcucuuuccuugc

SEQ ID NO: 1039338 - RNA, 19 nt, Homo sapiens
ggcugaaggaaaccagugc

SEQ ID NO: 1039339 - RNA, 11 nt, Homo sapiens
ggcugacauug

SEQ ID NO: 1039340 - RNA, 19 nt, Homo sapiens
ggcugacucuaggugcccu

SEQ ID NO: 1039341 - RNA, 16 nt, Homo sapiens
ggcugagaacacugug

SEQ ID NO: 1039342 - RNA, 19 nt, Homo sapiens
ggcugagagaggaagagcu

SEQ ID NO: 1039343 - RNA, 15 nt, Homo sapiens
ggcugagcucuuauc

SEQ ID NO: 1039344 - RNA, 21 nt, Homo sapiens
ggcugauuauuaaaguccuuu

SEQ ID NO: 1039345 - RNA, 13 nt, Homo sapiens
ggcugcagcucac

SEQ ID NO: 1039346 - RNA, 15 nt, Homo sapiens
ggcuggagugcagug

SEQ ID NO: 1039347 - RNA, 19 nt, Homo sapiens
ggcuggaugugguggcaua

SEQ ID NO: 1039348 - RNA, 11 nt, Homo sapiens
ggcugggagac

SEQ ID NO: 1039349 - RNA, 22 nt, Homo sapiens
ggcugggggccucagugccacu

SEQ ID NO: 1039350 - RNA, 14 nt, Homo sapiens
ggcuggguggcacc

SEQ ID NO: 1039351 - RNA, 15 nt, Homo sapiens
ggcuuaauaccuggg

SEQ ID NO: 1039352 - RNA, 17 nt, Homo sapiens
ggcuuaauaccugggug

SEQ ID NO: 1039353 - RNA, 20 nt, Homo sapiens
ggcuuacacccacaguggaa

SEQ ID NO: 1039354 - RNA, 21 nt, Homo sapiens
ggcuucagucuuuuccaugaa

SEQ ID NO: 1039355 - RNA, 16 nt, Homo sapiens
ggcuucaguggcagcu

SEQ ID NO: 1039356 - RNA, 23 nt, Homo sapiens
ggcuucaguuuuacucugcugca

SEQ ID NO: 1039357 - RNA, 19 nt, Homo sapiens
ggcuuccagguaucuccag

SEQ ID NO: 1039358 - RNA, 16 nt, Homo sapiens
ggcuugaaaugcauua

SEQ ID NO: 1039359 - RNA, 18 nt, Homo sapiens
ggcuuguguguuucacuu

SEQ ID NO: 1039360 - RNA, 19 nt, Homo sapiens
ggcuuuaaaacuuauccuc

SEQ ID NO: 1039361 - RNA, 24 nt, Homo sapiens
ggcuuuaaaacuuauccuccauga

SEQ ID NO: 1039362 - RNA, 14 nt, Homo sapiens
gggaaagccaguga

SEQ ID NO: 1039363 - RNA, 19 nt, Homo sapiens
gggaaaguaaauauuucag

SEQ ID NO: 1039364 - RNA, 15 nt, Homo sapiens
gggaaaucaggguua

SEQ ID NO: 1039365 - RNA, 12 nt, Homo sapiens
gggaaauugcuu

SEQ ID NO: 1039366 - RNA, 12 nt, Homo sapiens
gggaagccaaaa

SEQ ID NO: 1039367 - RNA, 21 nt, Homo sapiens
gggaaggguccaucucagaga

SEQ ID NO: 1039368 - RNA, 16 nt, Homo sapiens
gggaaggucaccagca

SEQ ID NO: 1039369 - RNA, 19 nt, Homo sapiens
gggaaugaggcuugcugag

SEQ ID NO: 1039370 - RNA, 15 nt, Homo sapiens
gggaauggauccugg

SEQ ID NO: 1039371 - RNA, 17 nt, Homo sapiens
gggacaauaaauuuugc

SEQ ID NO: 1039372 - RNA, 11 nt, Homo sapiens
gggacaggaug

SEQ ID NO: 1039373 - RNA, 13 nt, Homo sapiens
gggacagggauga

SEQ ID NO: 1039374 - RNA, 20 nt, Homo sapiens
gggacauugggaaggggacc

SEQ ID NO: 1039375 - RNA, 16 nt, Homo sapiens
gggaccacaccucccu

SEQ ID NO: 1039376 - RNA, 16 nt, Homo sapiens
gggaccacagacucac

SEQ ID NO: 1039377 - RNA, 21 nt, Homo sapiens
gggaccacagacucacauccu

SEQ ID NO: 1039378 - RNA, 21 nt, Homo sapiens
gggaccuugucucccagcuca

SEQ ID NO: 1039379 - RNA, 20 nt, Homo sapiens
gggacuaaguguaccagaga

SEQ ID NO: 1039380 - RNA, 19 nt, Homo sapiens
gggacuggcgagucugcuu

SEQ ID NO: 1039381 - RNA, 13 nt, Homo sapiens
gggacuuccuugc

SEQ ID NO: 1039382 - RNA, 17 nt, Homo sapiens
gggacuuccuugcucuc

SEQ ID NO: 1039383 - RNA, 13 nt, Homo sapiens
gggagacucugaa

SEQ ID NO: 1039384 - RNA, 15 nt, Homo sapiens
gggagagguggagca

SEQ ID NO: 1039385 - RNA, 15 nt, Homo sapiens
gggagcagaugcaau

SEQ ID NO: 1039386 - RNA, 14 nt, Homo sapiens
gggagcccucaggc

SEQ ID NO: 1039387 - RNA, 20 nt, Homo sapiens
gggagcggaaagcagcucaa

SEQ ID NO: 1039388 - RNA, 17 nt, Homo sapiens
gggaggaagcagguuga

SEQ ID NO: 1039389 - RNA, 21 nt, Homo sapiens
gggaggaggccaccucuccaa

SEQ ID NO: 1039390 - RNA, 23 nt, Homo sapiens
gggaggauugcuugaacccaaga

SEQ ID NO: 1039391 - RNA, 20 nt, Homo sapiens
gggaggcagagguugcagug

SEQ ID NO: 1039392 - RNA, 20 nt, Homo sapiens
gggauauuugguuuggccau

SEQ ID NO: 1039393 - RNA, 12 nt, Homo sapiens
gggaugagcaug

SEQ ID NO: 1039394 - RNA, 19 nt, Homo sapiens
gggaugagccgcugugagc

SEQ ID NO: 1039395 - RNA, 22 nt, Homo sapiens
gggaugcugccugagucaccca

SEQ ID NO: 1039396 - RNA, 14 nt, Homo sapiens
gggcaacaacagca

SEQ ID NO: 1039397 - RNA, 23 nt, Homo sapiens
gggcagacacuguuugcccagug

SEQ ID NO: 1039398 - RNA, 15 nt, Homo sapiens
gggcagaucaccaga

SEQ ID NO: 1039399 - RNA, 22 nt, Homo sapiens
gggcagggcuggcaccucucaa

SEQ ID NO: 1039400 - RNA, 19 nt, Homo sapiens
gggcauagaugcaggugag

SEQ ID NO: 1039401 - RNA, 18 nt, Homo sapiens
gggcaucugccccucccc

SEQ ID NO: 1039402 - RNA, 14 nt, Homo sapiens
gggcauuguaguua

SEQ ID NO: 1039403 - RNA, 16 nt, Homo sapiens
gggccagggcccugca

SEQ ID NO: 1039404 - RNA, 14 nt, Homo sapiens
gggcccaccuggcc

SEQ ID NO: 1039405 - RNA, 17 nt, Homo sapiens
gggccucaaggacuuga

SEQ ID NO: 1039406 - RNA, 17 nt, Homo sapiens
gggcgagucacugccuc

SEQ ID NO: 1039407 - RNA, 19 nt, Homo sapiens
gggcggcacagccuucucc

SEQ ID NO: 1039408 - RNA, 22 nt, Homo sapiens
gggcucaaggaaaggggguccc

SEQ ID NO: 1039409 - RNA, 15 nt, Homo sapiens
gggcuccauguagaa

SEQ ID NO: 1039410 - RNA, 18 nt, Homo sapiens
gggcucuaaugugucucu

SEQ ID NO: 1039411 - RNA, 17 nt, Homo sapiens
gggcuggguaccaaugc

SEQ ID NO: 1039412 - RNA, 15 nt, Homo sapiens
gggcuuacacgugga

SEQ ID NO: 1039413 - RNA, 19 nt, Homo sapiens
gggcuucuagaaccaggca

SEQ ID NO: 1039414 - RNA, 22 nt, Homo sapiens
gggcuuggcugugcccucagau

SEQ ID NO: 1039415 - RNA, 14 nt, Homo sapiens
ggggaaauggugcc

SEQ ID NO: 1039416 - RNA, 22 nt, Homo sapiens
ggggcccaaauucuuucagugg

SEQ ID NO: 1039417 - RNA, 17 nt, Homo sapiens
ggggcgaucgcggcgga

SEQ ID NO: 1039418 - RNA, 16 nt, Homo sapiens
ggggcucucagcucag

SEQ ID NO: 1039419 - RNA, 16 nt, Homo sapiens
ggggcucugugcaggg

SEQ ID NO: 1039420 - RNA, 15 nt, Homo sapiens
gggggcuccacccca

SEQ ID NO: 1039421 - RNA, 14 nt, Homo sapiens
gggguuagaccacu

SEQ ID NO: 1039422 - RNA, 16 nt, Homo sapiens
gggguugguguucuca

SEQ ID NO: 1039423 - RNA, 19 nt, Homo sapiens
ggguaaccaaauguuggcc

SEQ ID NO: 1039424 - RNA, 16 nt, Homo sapiens
ggguaccaaugcugca

SEQ ID NO: 1039425 - RNA, 21 nt, Homo sapiens
ggguacugagagucugcacuu

SEQ ID NO: 1039426 - RNA, 12 nt, Homo sapiens
ggguccaccagg

SEQ ID NO: 1039427 - RNA, 17 nt, Homo sapiens
ggguccaucucagagaa

SEQ ID NO: 1039428 - RNA, 23 nt, Homo sapiens
gggucccugauaacaaccuggag

SEQ ID NO: 1039429 - RNA, 15 nt, Homo sapiens
ggguccuugguguga

SEQ ID NO: 1039430 - RNA, 19 nt, Homo sapiens
gggucucgcuuuguugccc

SEQ ID NO: 1039431 - RNA, 20 nt, Homo sapiens
gggucucgcuuuguugccca

SEQ ID NO: 1039432 - RNA, 21 nt, Homo sapiens
gggucucgcuuuguugcccag

SEQ ID NO: 1039433 - RNA, 20 nt, Homo sapiens
gggucucuagugcugugaaa

SEQ ID NO: 1039434 - RNA, 21 nt, Homo sapiens
gggugacagaacgagacucca

SEQ ID NO: 1039435 - RNA, 13 nt, Homo sapiens
gggugagugcaag

SEQ ID NO: 1039436 - RNA, 12 nt, Homo sapiens
gggugggaccac

SEQ ID NO: 1039437 - RNA, 11 nt, Homo sapiens
gggugggagag

SEQ ID NO: 1039438 - RNA, 13 nt, Homo sapiens
ggguggguggugg

SEQ ID NO: 1039439 - RNA, 14 nt, Homo sapiens
gggugugucugcuc

SEQ ID NO: 1039440 - RNA, 13 nt, Homo sapiens
ggguguguguagc

SEQ ID NO: 1039441 - RNA, 20 nt, Homo sapiens
ggguuaaauuaaaagcccua

SEQ ID NO: 1039442 - RNA, 16 nt, Homo sapiens
ggguucugauauugcc

SEQ ID NO: 1039443 - RNA, 15 nt, Homo sapiens
gguaaaaguuacuua

SEQ ID NO: 1039444 - RNA, 23 nt, Homo sapiens
gguaaauuuccccaacaguguga

SEQ ID NO: 1039445 - RNA, 16 nt, Homo sapiens
gguaacuugcaccucu

SEQ ID NO: 1039446 - RNA, 14 nt, Homo sapiens
gguaagcaccagga

SEQ ID NO: 1039447 - RNA, 18 nt, Homo sapiens
gguaauauaaaguguaau

SEQ ID NO: 1039448 - RNA, 18 nt, Homo sapiens
gguaauuaguaacaugug

SEQ ID NO: 1039449 - RNA, 16 nt, Homo sapiens
gguacccagccaucug

SEQ ID NO: 1039450 - RNA, 20 nt, Homo sapiens
gguacuauuuagauauaaca

SEQ ID NO: 1039451 - RNA, 19 nt, Homo sapiens
gguagagacuuugacucuc

SEQ ID NO: 1039452 - RNA, 20 nt, Homo sapiens
gguaguacuccugcaaaauu

SEQ ID NO: 1039453 - RNA, 17 nt, Homo sapiens
gguauaauuuuuaucca

SEQ ID NO: 1039454 - RNA, 17 nt, Homo sapiens
gguaucagcaucugucc

SEQ ID NO: 1039455 - RNA, 21 nt, Homo sapiens
gguaucauuuucugcauuuaa

SEQ ID NO: 1039456 - RNA, 23 nt, Homo sapiens
gguaugaucacggcucacugcag

SEQ ID NO: 1039457 - RNA, 18 nt, Homo sapiens
gguauugccuugugaauu

SEQ ID NO: 1039458 - RNA, 23 nt, Homo sapiens
gguauuucaaaacacaucuuucc

SEQ ID NO: 1039459 - RNA, 19 nt, Homo sapiens
ggucaaacaaacucucuga

SEQ ID NO: 1039460 - RNA, 12 nt, Homo sapiens
ggucacccagga

SEQ ID NO: 1039461 - RNA, 20 nt, Homo sapiens
ggucacccuaaggaaaggaa

SEQ ID NO: 1039462 - RNA, 14 nt, Homo sapiens
ggucagcgugcuua

SEQ ID NO: 1039463 - RNA, 15 nt, Homo sapiens
gguccauucucugag

SEQ ID NO: 1039464 - RNA, 17 nt, Homo sapiens
ggucccaccuccauuug

SEQ ID NO: 1039465 - RNA, 17 nt, Homo sapiens
gguccccaucaucccag

SEQ ID NO: 1039466 - RNA, 16 nt, Homo sapiens
gguccugggucuuuca

SEQ ID NO: 1039467 - RNA, 20 nt, Homo sapiens
gguccuucccucucaugacu

SEQ ID NO: 1039468 - RNA, 21 nt, Homo sapiens
gguccuucccucucaugacuu

SEQ ID NO: 1039469 - RNA, 18 nt, Homo sapiens
ggucuaaagugagcucua

SEQ ID NO: 1039470 - RNA, 16 nt, Homo sapiens
ggucucaaacuccuga

SEQ ID NO: 1039471 - RNA, 17 nt, Homo sapiens
ggucucuagugcuguga

SEQ ID NO: 1039472 - RNA, 21 nt, Homo sapiens
ggucucuggcccuucuugccu

SEQ ID NO: 1039473 - RNA, 16 nt, Homo sapiens
ggucugauuucaggau

SEQ ID NO: 1039474 - RNA, 17 nt, Homo sapiens
ggucugggacuuccuug

SEQ ID NO: 1039475 - RNA, 21 nt, Homo sapiens
ggucugggacuuccuugcucu

SEQ ID NO: 1039476 - RNA, 15 nt, Homo sapiens
ggucuucccuaccuc

SEQ ID NO: 1039477 - RNA, 15 nt, Homo sapiens
ggucuugacaccagc

SEQ ID NO: 1039478 - RNA, 18 nt, Homo sapiens
aauggcagcauacacaga

SEQ ID NO: 1039479 - RNA, 21 nt, Homo sapiens
aauggcuuuaugcuaguuuga

SEQ ID NO: 1039480 - RNA, 18 nt, Homo sapiens
aaugggcagcucaucucu

SEQ ID NO: 1039481 - RNA, 18 nt, Homo sapiens
aaugguagcaacugaaag

SEQ ID NO: 1039482 - RNA, 20 nt, Homo sapiens
aaugguaggauaucuuggcu

SEQ ID NO: 1039483 - RNA, 22 nt, Homo sapiens
aauggugcaaauccuacugaau

SEQ ID NO: 1039484 - RNA, 19 nt, Homo sapiens
ggugagcagaaguggagcu

SEQ ID NO: 1039485 - RNA, 15 nt, Homo sapiens
ggugauauccucuca

SEQ ID NO: 1039486 - RNA, 16 nt, Homo sapiens
ggugauauguccuaua

SEQ ID NO: 1039487 - RNA, 22 nt, Homo sapiens
ggugcagguugggaaugaggcu

SEQ ID NO: 1039488 - RNA, 17 nt, Homo sapiens
ggugcaugaagguuucu

SEQ ID NO: 1039489 - RNA, 19 nt, Homo sapiens
ggugcaugaagguuucuga

SEQ ID NO: 1039490 - RNA, 18 nt, Homo sapiens
ggugcggcugcagcucac

SEQ ID NO: 1039491 - RNA, 15 nt, Homo sapiens
ggugcuauccauuuc

SEQ ID NO: 1039492 - RNA, 15 nt, Homo sapiens
gguggagaagccauu

SEQ ID NO: 1039493 - RNA, 13 nt, Homo sapiens
gguggaugccugg

SEQ ID NO: 1039494 - RNA, 21 nt, Homo sapiens
gguggaugccugguggcagcu

SEQ ID NO: 1039495 - RNA, 12 nt, Homo sapiens
gguggcaauaaa

SEQ ID NO: 1039496 - RNA, 17 nt, Homo sapiens
gguggcccacgccugua

SEQ ID NO: 1039497 - RNA, 11 nt, Homo sapiens
ggugggguccu

SEQ ID NO: 1039498 - RNA, 20 nt, Homo sapiens
gguggguuuugaacauaaag

SEQ ID NO: 1039499 - RNA, 18 nt, Homo sapiens
ggugucaaugaauuuugc

SEQ ID NO: 1039500 - RNA, 17 nt, Homo sapiens
ggugucagucagggaca

SEQ ID NO: 1039501 - RNA, 19 nt, Homo sapiens
ggugucuggauucccagga

SEQ ID NO: 1039502 - RNA, 20 nt, Homo sapiens
gguuaaacccacagccaaac

SEQ ID NO: 1039503 - RNA, 14 nt, Homo sapiens
gguuaaauuugaau

SEQ ID NO: 1039504 - RNA, 12 nt, Homo sapiens
gguuaacagcug

SEQ ID NO: 1039505 - RNA, 18 nt, Homo sapiens
gguuaagugacuugccca

SEQ ID NO: 1039506 - RNA, 20 nt, Homo sapiens
gguuagggaaaacauuccau

SEQ ID NO: 1039507 - RNA, 15 nt, Homo sapiens
gguuaucugggcaua

SEQ ID NO: 1039508 - RNA, 19 nt, Homo sapiens
gguucaccaggucagggag

SEQ ID NO: 1039509 - RNA, 16 nt, Homo sapiens
gguucuacccaggugc

SEQ ID NO: 1039510 - RNA, 11 nt, Homo sapiens
gguucucaggc

SEQ ID NO: 1039511 - RNA, 15 nt, Homo sapiens
gguugagccucagaa

SEQ ID NO: 1039512 - RNA, 19 nt, Homo sapiens
gguugcuuuaauaucauca

SEQ ID NO: 1039513 - RNA, 14 nt, Homo sapiens
gguugguguucuca

SEQ ID NO: 1039514 - RNA, 16 nt, Homo sapiens
gguuuaacucagauca

SEQ ID NO: 1039515 - RNA, 17 nt, Homo sapiens
gguuuaacucagaucac

SEQ ID NO: 1039516 - RNA, 12 nt, Homo sapiens
gguuucauucug

SEQ ID NO: 1039517 - RNA, 19 nt, Homo sapiens
gguuuccaaaggcauuuua

SEQ ID NO: 1039518 - RNA, 14 nt, Homo sapiens
gguuucucuguaua

SEQ ID NO: 1039519 - RNA, 22 nt, Homo sapiens
gguuugagauggacacacuggu

SEQ ID NO: 1039520 - RNA, 17 nt, Homo sapiens
gguuuggggucugccac

SEQ ID NO: 1039521 - RNA, 19 nt, Homo sapiens
gguuuguguuugaguuuua

SEQ ID NO: 1039522 - RNA, 22 nt, Homo sapiens
gguuuuccaucuuaucugucuu

SEQ ID NO: 1039523 - RNA, 13 nt, Homo sapiens
guaaaaacagcau

SEQ ID NO: 1039524 - RNA, 16 nt, Homo sapiens
guaaaaccacagcagu

SEQ ID NO: 1039525 - RNA, 16 nt, Homo sapiens
guaaaacuauauucuc

SEQ ID NO: 1039526 - RNA, 17 nt, Homo sapiens
guaaaacuauauucuca

SEQ ID NO: 1039527 - RNA, 18 nt, Homo sapiens
guaaaauguuuuagcaau

SEQ ID NO: 1039528 - RNA, 20 nt, Homo sapiens
guaaacagauggcacuuuga

SEQ ID NO: 1039529 - RNA, 21 nt, Homo sapiens
guaaacagauggcacuuugaa

SEQ ID NO: 1039530 - RNA, 14 nt, Homo sapiens
guaaacauucucuc

SEQ ID NO: 1039531 - RNA, 17 nt, Homo sapiens
guaaagcuuugugcaga

SEQ ID NO: 1039532 - RNA, 17 nt, Homo sapiens
guaaauagcucaggugu

SEQ ID NO: 1039533 - RNA, 18 nt, Homo sapiens
guaaaucaggacaggugg

SEQ ID NO: 1039534 - RNA, 14 nt, Homo sapiens
guaaaugguguaca

SEQ ID NO: 1039535 - RNA, 15 nt, Homo sapiens
guaaauuaguauuua

SEQ ID NO: 1039536 - RNA, 20 nt, Homo sapiens
guaacagccaggaguguuaa

SEQ ID NO: 1039537 - RNA, 16 nt, Homo sapiens
guaacauccuuucuau

SEQ ID NO: 1039538 - RNA, 18 nt, Homo sapiens
guaacaugcaauuuugca

SEQ ID NO: 1039539 - RNA, 22 nt, Homo sapiens
guaacauuggguccugggucuu

SEQ ID NO: 1039540 - RNA, 16 nt, Homo sapiens
guaaccaaauguuggc

SEQ ID NO: 1039541 - RNA, 22 nt, Homo sapiens
guaaccgauucaucucucagaa

SEQ ID NO: 1039542 - RNA, 22 nt, Homo sapiens
guaaccggauggcggacaccug

SEQ ID NO: 1039543 - RNA, 19 nt, Homo sapiens
guaacuggaaucucaaaag

SEQ ID NO: 1039544 - RNA, 16 nt, Homo sapiens
guaagaaacacacuga

SEQ ID NO: 1039545 - RNA, 12 nt, Homo sapiens
guaagaaaguga

SEQ ID NO: 1039546 - RNA, 14 nt, Homo sapiens
guaagcucuacuga

SEQ ID NO: 1039547 - RNA, 15 nt, Homo sapiens
guaaggaaauggaau

SEQ ID NO: 1039548 - RNA, 21 nt, Homo sapiens
guaaggaaauggaauacugaa

SEQ ID NO: 1039549 - RNA, 15 nt, Homo sapiens
guaagggaaacugcc

SEQ ID NO: 1039550 - RNA, 20 nt, Homo sapiens
guaaguaccacucaggccaa

SEQ ID NO: 1039551 - RNA, 18 nt, Homo sapiens
guaaucccaagaucugug

SEQ ID NO: 1039552 - RNA, 16 nt, Homo sapiens
guaaucccagcuacuu

SEQ ID NO: 1039553 - RNA, 20 nt, Homo sapiens
guaaucccagcuacuuggga

SEQ ID NO: 1039554 - RNA, 18 nt, Homo sapiens
guaauccuagcacuuugg

SEQ ID NO: 1039555 - RNA, 15 nt, Homo sapiens
guaaucucggcucac

SEQ ID NO: 1039556 - RNA, 13 nt, Homo sapiens
guaaucuguguac

SEQ ID NO: 1039557 - RNA, 23 nt, Homo sapiens
guaaugaaacaccuucucuggag

SEQ ID NO: 1039558 - RNA, 18 nt, Homo sapiens
guaaugauauagccagaa

SEQ ID NO: 1039559 - RNA, 23 nt, Homo sapiens
guaauucuaaaugaauguuuaca

SEQ ID NO: 1039560 - RNA, 13 nt, Homo sapiens
guaauucucaggc

SEQ ID NO: 1039561 - RNA, 22 nt, Homo sapiens
guaauuucuuugccuguucagu

SEQ ID NO: 1039562 - RNA, 19 nt, Homo sapiens
guacaaaaaaaaaguuuua

SEQ ID NO: 1039563 - RNA, 18 nt, Homo sapiens
guacaaggcaacauauag

SEQ ID NO: 1039564 - RNA, 17 nt, Homo sapiens
guacaccacaaggguca

SEQ ID NO: 1039565 - RNA, 19 nt, Homo sapiens
guacaccccaacagcaccc

SEQ ID NO: 1039566 - RNA, 17 nt, Homo sapiens
guacagaauucugcuac

SEQ ID NO: 1039567 - RNA, 12 nt, Homo sapiens
guacagacacuc

SEQ ID NO: 1039568 - RNA, 13 nt, Homo sapiens
guacagacacucc

SEQ ID NO: 1039569 - RNA, 16 nt, Homo sapiens
guacaggcaacaauga

SEQ ID NO: 1039570 - RNA, 17 nt, Homo sapiens
guacagguaaggugagg

SEQ ID NO: 1039571 - RNA, 18 nt, Homo sapiens
guacauuucccugugcug

SEQ ID NO: 1039572 - RNA, 22 nt, Homo sapiens
guaccagcagcuggaaucugaa

SEQ ID NO: 1039573 - RNA, 17 nt, Homo sapiens
guacccagccaucugcc

SEQ ID NO: 1039574 - RNA, 23 nt, Homo sapiens
guacccuuccuacagauagucaa

SEQ ID NO: 1039575 - RNA, 13 nt, Homo sapiens
guaccgacuuuga

SEQ ID NO: 1039576 - RNA, 18 nt, Homo sapiens
guaccuugaacacugggg

SEQ ID NO: 1039577 - RNA, 22 nt, Homo sapiens
guacguaucagcggccccuuga

SEQ ID NO: 1039578 - RNA, 17 nt, Homo sapiens
guacguugugcauuugg

SEQ ID NO: 1039579 - RNA, 24 nt, Homo sapiens
guacuaagcaguaagcuaucuuca

SEQ ID NO: 1039580 - RNA, 17 nt, Homo sapiens
guacucaagggcuuuau

SEQ ID NO: 1039581 - RNA, 16 nt, Homo sapiens
guacucagcgaaugaa

SEQ ID NO: 1039582 - RNA, 20 nt, Homo sapiens
guacuccagccugggugaca

SEQ ID NO: 1039583 - RNA, 23 nt, Homo sapiens
guagaaaaagcaguaacugacaa

SEQ ID NO: 1039584 - RNA, 22 nt, Homo sapiens
guagaaaauuuguuauuuugca

SEQ ID NO: 1039585 - RNA, 19 nt, Homo sapiens
guagacaagcguugagcca

SEQ ID NO: 1039586 - RNA, 16 nt, Homo sapiens
guagacauuugcuaug

SEQ ID NO: 1039587 - RNA, 17 nt, Homo sapiens
guagagaauguagccau

SEQ ID NO: 1039588 - RNA, 22 nt, Homo sapiens
guagagggaguugucaagucuc

SEQ ID NO: 1039589 - RNA, 16 nt, Homo sapiens
guagagggcccuggug

SEQ ID NO: 1039590 - RNA, 16 nt, Homo sapiens
guagaucauguucacu

SEQ ID NO: 1039591 - RNA, 17 nt, Homo sapiens
guagaugacauggugaa

SEQ ID NO: 1039592 - RNA, 20 nt, Homo sapiens
guagccaaagguucacucuc

SEQ ID NO: 1039593 - RNA, 16 nt, Homo sapiens
guagccacuucacuuu

SEQ ID NO: 1039594 - RNA, 16 nt, Homo sapiens
guagccugugcaugua

SEQ ID NO: 1039595 - RNA, 16 nt, Homo sapiens
guagcucucccuaggc

SEQ ID NO: 1039596 - RNA, 21 nt, Homo sapiens
guagcugagaaaacuaaguca

SEQ ID NO: 1039597 - RNA, 18 nt, Homo sapiens
guaggaagaguagcauuu

SEQ ID NO: 1039598 - RNA, 17 nt, Homo sapiens
guaggggcccacuucac

SEQ ID NO: 1039599 - RNA, 15 nt, Homo sapiens
guaggugucugcacc

SEQ ID NO: 1039600 - RNA, 20 nt, Homo sapiens
guagguuggaagcuagcucc

SEQ ID NO: 1039601 - RNA, 13 nt, Homo sapiens
guagucauuucau

SEQ ID NO: 1039602 - RNA, 18 nt, Homo sapiens
guaguccagguguucucc

SEQ ID NO: 1039603 - RNA, 17 nt, Homo sapiens
guagucccagcuacuca

SEQ ID NO: 1039604 - RNA, 19 nt, Homo sapiens
guagucccagcuacucagg

SEQ ID NO: 1039605 - RNA, 13 nt, Homo sapiens
guagucucaggac

SEQ ID NO: 1039606 - RNA, 15 nt, Homo sapiens
guagucucauuacuu

SEQ ID NO: 1039607 - RNA, 15 nt, Homo sapiens
guauaaacuaucagu

SEQ ID NO: 1039608 - RNA, 15 nt, Homo sapiens
guauagacaucugcc

SEQ ID NO: 1039609 - RNA, 14 nt, Homo sapiens
guauauauaauacu

SEQ ID NO: 1039610 - RNA, 16 nt, Homo sapiens
guauauauaauacuga

SEQ ID NO: 1039611 - RNA, 15 nt, Homo sapiens
guauauucauuucaa

SEQ ID NO: 1039612 - RNA, 20 nt, Homo sapiens
guauauuucucuuugucaga

SEQ ID NO: 1039613 - RNA, 15 nt, Homo sapiens
guaucagaggccuau

SEQ ID NO: 1039614 - RNA, 16 nt, Homo sapiens
guaucaggugcugcca

SEQ ID NO: 1039615 - RNA, 20 nt, Homo sapiens
guauccaauaggcauuugau

SEQ ID NO: 1039616 - RNA, 18 nt, Homo sapiens
guauccugugacauguaa

SEQ ID NO: 1039617 - RNA, 16 nt, Homo sapiens
guaucguauagcugua

SEQ ID NO: 1039618 - RNA, 14 nt, Homo sapiens
guaugacuaaagag

SEQ ID NO: 1039619 - RNA, 23 nt, Homo sapiens
guaugauccuaaugaaugcauaa

SEQ ID NO: 1039620 - RNA, 17 nt, Homo sapiens
guaugcacgugugcaca

SEQ ID NO: 1039621 - RNA, 16 nt, Homo sapiens
guaugcagaauguuuu

SEQ ID NO: 1039622 - RNA, 14 nt, Homo sapiens
guaugccaagugaa

SEQ ID NO: 1039623 - RNA, 21 nt, Homo sapiens
acagcuucacaaauucucaca

SEQ ID NO: 1039624 - RNA, 15 nt, Homo sapiens
acaggaaaccacuua

SEQ ID NO: 1039625 - RNA, 18 nt, Homo sapiens
acaggacccugggaccac

SEQ ID NO: 1039626 - RNA, 20 nt, Homo sapiens
acaggacccugggaccacag

SEQ ID NO: 1039627 - RNA, 21 nt, Homo sapiens
acaggacccugggaccacaga

SEQ ID NO: 1039628 - RNA, 13 nt, Homo sapiens
acaggcacaaaau

SEQ ID NO: 1039629 - RNA, 12 nt, Homo sapiens
acaggcacucaa

SEQ ID NO: 1039630 - RNA, 14 nt, Homo sapiens
acaggcagcauuua

SEQ ID NO: 1039631 - RNA, 13 nt, Homo sapiens
acaggcauuuccu

SEQ ID NO: 1039632 - RNA, 19 nt, Homo sapiens
acaggcccggcuccaggcu

SEQ ID NO: 1039633 - RNA, 22 nt, Homo sapiens
acagggaacucagaauacagac

SEQ ID NO: 1039634 - RNA, 22 nt, Homo sapiens
acagggaaugccugagugccug

SEQ ID NO: 1039635 - RNA, 14 nt, Homo sapiens
acaggguucauuga

SEQ ID NO: 1039636 - RNA, 22 nt, Homo sapiens
acagguauucugcugaugcuac

SEQ ID NO: 1039637 - RNA, 13 nt, Homo sapiens
acaggucccucac

SEQ ID NO: 1039638 - RNA, 15 nt, Homo sapiens
acaggucuucucucc

SEQ ID NO: 1039639 - RNA, 20 nt, Homo sapiens
acagguuacaacagauuugu

SEQ ID NO: 1039640 - RNA, 19 nt, Homo sapiens
acaguaaauggcuuaucca

SEQ ID NO: 1039641 - RNA, 15 nt, Homo sapiens
acaguaaccuuucaa

SEQ ID NO: 1039642 - RNA, 17 nt, Homo sapiens
acaguaacugccaucaa

SEQ ID NO: 1039643 - RNA, 19 nt, Homo sapiens
acaguaacuuuauguguaa

SEQ ID NO: 1039644 - RNA, 16 nt, Homo sapiens
gugaauuugcugcuau

SEQ ID NO: 1039645 - RNA, 13 nt, Homo sapiens
gugacacauaugc

SEQ ID NO: 1039646 - RNA, 18 nt, Homo sapiens
gugacagggaagcuacag

SEQ ID NO: 1039647 - RNA, 14 nt, Homo sapiens
gugaccagggguga

SEQ ID NO: 1039648 - RNA, 22 nt, Homo sapiens
gugaccuguaaaaaguacucaa

SEQ ID NO: 1039649 - RNA, 13 nt, Homo sapiens
gugacuccaggag

SEQ ID NO: 1039650 - RNA, 17 nt, Homo sapiens
gugacuguggcacacgc

SEQ ID NO: 1039651 - RNA, 19 nt, Homo sapiens
gugacuucuccaggucuca

SEQ ID NO: 1039652 - RNA, 20 nt, Homo sapiens
gugacuuucaagcuacucac

SEQ ID NO: 1039653 - RNA, 19 nt, Homo sapiens
gugagaaguccccuuccau

SEQ ID NO: 1039654 - RNA, 18 nt, Homo sapiens
gugagacagcucugcaua

SEQ ID NO: 1039655 - RNA, 12 nt, Homo sapiens
gugagacccagc

SEQ ID NO: 1039656 - RNA, 13 nt, Homo sapiens
gugagaugcagcu

SEQ ID NO: 1039657 - RNA, 13 nt, Homo sapiens
gugagauguaauu

SEQ ID NO: 1039658 - RNA, 15 nt, Homo sapiens
gugagccaagauugc

SEQ ID NO: 1039659 - RNA, 22 nt, Homo sapiens
gugaggaugucugggccacuca

SEQ ID NO: 1039660 - RNA, 14 nt, Homo sapiens
gugaggggcucucu

SEQ ID NO: 1039661 - RNA, 15 nt, Homo sapiens
gugaguguguccaag

SEQ ID NO: 1039662 - RNA, 13 nt, Homo sapiens
gugauacccaagu

SEQ ID NO: 1039663 - RNA, 18 nt, Homo sapiens
gugauacuguacauagcu

SEQ ID NO: 1039664 - RNA, 13 nt, Homo sapiens
gugauauguuggu

SEQ ID NO: 1039665 - RNA, 22 nt, Homo sapiens
gugaucagaccauaauguuaca

SEQ ID NO: 1039666 - RNA, 18 nt, Homo sapiens
gugauccucccaccucag

SEQ ID NO: 1039667 - RNA, 20 nt, Homo sapiens
gugaucuaucaauagucaag

SEQ ID NO: 1039668 - RNA, 21 nt, Homo sapiens
gugaugaugaaaugaggucag

SEQ ID NO: 1039669 - RNA, 16 nt, Homo sapiens
gugauggauaaggaug

SEQ ID NO: 1039670 - RNA, 15 nt, Homo sapiens
gugauuucagagagg

SEQ ID NO: 1039671 - RNA, 19 nt, Homo sapiens
gugcaaaguucccuacuuc

SEQ ID NO: 1039672 - RNA, 17 nt, Homo sapiens
gugcaagugugugcaca

SEQ ID NO: 1039673 - RNA, 17 nt, Homo sapiens
gugcaagugugugcaug

SEQ ID NO: 1039674 - RNA, 14 nt, Homo sapiens
gugcaaugaaugau

SEQ ID NO: 1039675 - RNA, 19 nt, Homo sapiens
gugcaauggcgugaucucg

SEQ ID NO: 1039676 - RNA, 12 nt, Homo sapiens
gugcacauuuau

SEQ ID NO: 1039677 - RNA, 17 nt, Homo sapiens
gugcacugagagugaag

SEQ ID NO: 1039678 - RNA, 22 nt, Homo sapiens
gugcacuuuaagaggugggagc

SEQ ID NO: 1039679 - RNA, 16 nt, Homo sapiens
gugcagcugauuuuaa

SEQ ID NO: 1039680 - RNA, 20 nt, Homo sapiens
gugcagugagccgagaucac

SEQ ID NO: 1039681 - RNA, 19 nt, Homo sapiens
gugcaguucuaguuugcau

SEQ ID NO: 1039682 - RNA, 18 nt, Homo sapiens
gugcauagagccacguau

SEQ ID NO: 1039683 - RNA, 13 nt, Homo sapiens
gugccaagcacag

SEQ ID NO: 1039684 - RNA, 20 nt, Homo sapiens
gugccaauauguauuguaaa

SEQ ID NO: 1039685 - RNA, 20 nt, Homo sapiens
gugccacaaauaaaauggau

SEQ ID NO: 1039686 - RNA, 14 nt, Homo sapiens
gugccacucauucc

SEQ ID NO: 1039687 - RNA, 16 nt, Homo sapiens
gugccaggauggaaug

SEQ ID NO: 1039688 - RNA, 18 nt, Homo sapiens
gugccagguccuugcccu

SEQ ID NO: 1039689 - RNA, 15 nt, Homo sapiens
gugccgaaugugcag

SEQ ID NO: 1039690 - RNA, 22 nt, Homo sapiens
gugccucugggacuggacaauu

SEQ ID NO: 1039691 - RNA, 13 nt, Homo sapiens
gugccugcugcug

SEQ ID NO: 1039692 - RNA, 18 nt, Homo sapiens
gugccuggccuggcacac

SEQ ID NO: 1039693 - RNA, 13 nt, Homo sapiens
gugcgaguccucc

SEQ ID NO: 1039694 - RNA, 15 nt, Homo sapiens
gugcgagugugugca

SEQ ID NO: 1039695 - RNA, 18 nt, Homo sapiens
gugcuaaacgcacacagu

SEQ ID NO: 1039696 - RNA, 15 nt, Homo sapiens
gugcuagaugugcaa

SEQ ID NO: 1039697 - RNA, 18 nt, Homo sapiens
gugcuauaggcuggagaa

SEQ ID NO: 1039698 - RNA, 21 nt, Homo sapiens
gugcucaauacacagaaaagu

SEQ ID NO: 1039699 - RNA, 17 nt, Homo sapiens
gugcuccucacuuccuc

SEQ ID NO: 1039700 - RNA, 14 nt, Homo sapiens
gugcugagcaaagg

SEQ ID NO: 1039701 - RNA, 19 nt, Homo sapiens
gugcugggauuacagggau

SEQ ID NO: 1039702 - RNA, 21 nt, Homo sapiens
gugcugggauuacagguguga

SEQ ID NO: 1039703 - RNA, 16 nt, Homo sapiens
gugcugggcauuuuua

SEQ ID NO: 1039704 - RNA, 18 nt, Homo sapiens
gugcuuaaaaaucauuga

SEQ ID NO: 1039705 - RNA, 20 nt, Homo sapiens
gugcuuaagcagaagcauua

SEQ ID NO: 1039706 - RNA, 19 nt, Homo sapiens
gugcuuagccuccugaccu

SEQ ID NO: 1039707 - RNA, 18 nt, Homo sapiens
guggaaagugaauuugaa

SEQ ID NO: 1039708 - RNA, 14 nt, Homo sapiens
guggaacucaguca

SEQ ID NO: 1039709 - RNA, 15 nt, Homo sapiens
guggaauugugcuga

SEQ ID NO: 1039710 - RNA, 17 nt, Homo sapiens
guggaccacugcaugag

SEQ ID NO: 1039711 - RNA, 12 nt, Homo sapiens
guggacugugau

SEQ ID NO: 1039712 - RNA, 20 nt, Homo sapiens
guggagaaauuccuugauuc

SEQ ID NO: 1039713 - RNA, 21 nt, Homo sapiens
guggagaaauuccuugauuca

SEQ ID NO: 1039714 - RNA, 12 nt, Homo sapiens
guggagaacucc

SEQ ID NO: 1039715 - RNA, 20 nt, Homo sapiens
guggagccccacacuggggu

SEQ ID NO: 1039716 - RNA, 21 nt, Homo sapiens
guggauauuaaaaaucuguaa

SEQ ID NO: 1039717 - RNA, 23 nt, Homo sapiens
guggaucaccugaggucaggagu

SEQ ID NO: 1039718 - RNA, 18 nt, Homo sapiens
guggauuaaccugccagg

SEQ ID NO: 1039719 - RNA, 15 nt, Homo sapiens
guggcacaagcaaaa

SEQ ID NO: 1039720 - RNA, 15 nt, Homo sapiens
guggcacugccaugc

SEQ ID NO: 1039721 - RNA, 21 nt, Homo sapiens
guggcagauaaucagccucuu

SEQ ID NO: 1039722 - RNA, 21 nt, Homo sapiens
guggcagcugcuuuugucuau

SEQ ID NO: 1039723 - RNA, 21 nt, Homo sapiens
guggcaucccaguggccucaa

SEQ ID NO: 1039724 - RNA, 16 nt, Homo sapiens
guggcauuuucacuuu

SEQ ID NO: 1039725 - RNA, 14 nt, Homo sapiens
guggcccaagacaa

SEQ ID NO: 1039726 - RNA, 13 nt, Homo sapiens
guggcccagagaa

SEQ ID NO: 1039727 - RNA, 19 nt, Homo sapiens
guggccccaaauuugcuau

SEQ ID NO: 1039728 - RNA, 15 nt, Homo sapiens
guggccccaacacaa

SEQ ID NO: 1039729 - RNA, 12 nt, Homo sapiens
guggccucagaa

SEQ ID NO: 1039730 - RNA, 16 nt, Homo sapiens
guggcucaacauugug

SEQ ID NO: 1039731 - RNA, 22 nt, Homo sapiens
guggcuggaucugugaggggcu

SEQ ID NO: 1039732 - RNA, 17 nt, Homo sapiens
guggcuucuuaaucuuu

SEQ ID NO: 1039733 - RNA, 21 nt, Homo sapiens
gugggaaggucccuuguuucc

SEQ ID NO: 1039734 - RNA, 17 nt, Homo sapiens
gugggaccacagacuca

SEQ ID NO: 1039735 - RNA, 13 nt, Homo sapiens
gugggacugagau

SEQ ID NO: 1039736 - RNA, 20 nt, Homo sapiens
gugggagagagacguguaca

SEQ ID NO: 1039737 - RNA, 21 nt, Homo sapiens
gugggagcagcgguuugggga

SEQ ID NO: 1039738 - RNA, 14 nt, Homo sapiens
gugggauccuccag

SEQ ID NO: 1039739 - RNA, 11 nt, Homo sapiens
gugggccacag

SEQ ID NO: 1039740 - RNA, 21 nt, Homo sapiens
guggggaggcggacguuccag

SEQ ID NO: 1039741 - RNA, 22 nt, Homo sapiens
guggguacuauucugauuacac

SEQ ID NO: 1039742 - RNA, 22 nt, Homo sapiens
gugggugccccccuugccagac

SEQ ID NO: 1039743 - RNA, 22 nt, Homo sapiens
gugguauccugugacauguaac

SEQ ID NO: 1039744 - RNA, 18 nt, Homo sapiens
guggucaaaccgcacuca

SEQ ID NO: 1039745 - RNA, 15 nt, Homo sapiens
guggucuugaucucc

SEQ ID NO: 1039746 - RNA, 23 nt, Homo sapiens
guggugagccgagauugcaccau

SEQ ID NO: 1039747 - RNA, 16 nt, Homo sapiens
guggugcauuuugcuu

SEQ ID NO: 1039748 - RNA, 23 nt, Homo sapiens
guggugggcccugaugcugccag

SEQ ID NO: 1039749 - RNA, 13 nt, Homo sapiens
gugguugcuguug

SEQ ID NO: 1039750 - RNA, 21 nt, Homo sapiens
gugguuuaugucaucauacau

SEQ ID NO: 1039751 - RNA, 18 nt, Homo sapiens
guguaaaauacguuugaa

SEQ ID NO: 1039752 - RNA, 22 nt, Homo sapiens
guguacacggaggucucuguaa

SEQ ID NO: 1039753 - RNA, 11 nt, Homo sapiens
guguacaggga

SEQ ID NO: 1039754 - RNA, 20 nt, Homo sapiens
guguacagugaaaagucucc

SEQ ID NO: 1039755 - RNA, 13 nt, Homo sapiens
guguaccagagaa

SEQ ID NO: 1039756 - RNA, 14 nt, Homo sapiens
guguagccugugca

SEQ ID NO: 1039757 - RNA, 23 nt, Homo sapiens
guguauauaguaugaaugcagug

SEQ ID NO: 1039758 - RNA, 23 nt, Homo sapiens
guguaucggaugcuuuuguucag

SEQ ID NO: 1039759 - RNA, 19 nt, Homo sapiens
guguaugcacgugugcaca

SEQ ID NO: 1039760 - RNA, 19 nt, Homo sapiens
guguaugguucugugccaa

SEQ ID NO: 1039761 - RNA, 20 nt, Homo sapiens
guguauucuagugaaugaau

SEQ ID NO: 1039762 - RNA, 23 nt, Homo sapiens
gugucaccccucacugugacuga

SEQ ID NO: 1039763 - RNA, 13 nt, Homo sapiens
gugucacccuuag

SEQ ID NO: 1039764 - RNA, 16 nt, Homo sapiens
gugucagucagggaca

SEQ ID NO: 1039765 - RNA, 20 nt, Homo sapiens
gugucauauauggggggcca

SEQ ID NO: 1039766 - RNA, 16 nt, Homo sapiens
gugucaugaauuccuu

SEQ ID NO: 1039767 - RNA, 23 nt, Homo sapiens
gugucaugucagcaucagcucag

SEQ ID NO: 1039768 - RNA, 13 nt, Homo sapiens
accgcaaugugac

SEQ ID NO: 1039769 - RNA, 17 nt, Homo sapiens
accgcagucgucgcaca

SEQ ID NO: 1039770 - RNA, 13 nt, Homo sapiens
accgccacugggc

SEQ ID NO: 1039771 - RNA, 16 nt, Homo sapiens
accgccccucaccaac

SEQ ID NO: 1039772 - RNA, 19 nt, Homo sapiens
accggagaaccccaggacg

SEQ ID NO: 1039773 - RNA, 21 nt, Homo sapiens
accgggcacucagaagacacu

SEQ ID NO: 1039774 - RNA, 22 nt, Homo sapiens
accguccucgagcaacugcugu

SEQ ID NO: 1039775 - RNA, 15 nt, Homo sapiens
accgugaccaggaac

SEQ ID NO: 1039776 - RNA, 21 nt, Homo sapiens
accguuuccuuucauuuacug

SEQ ID NO: 1039777 - RNA, 17 nt, Homo sapiens
accuaacgagaaauaga

SEQ ID NO: 1039778 - RNA, 21 nt, Homo sapiens
accuaacuggcuuacuuccua

SEQ ID NO: 1039779 - RNA, 18 nt, Homo sapiens
accuacauuuuaaugcac

SEQ ID NO: 1039780 - RNA, 15 nt, Homo sapiens
accuaccacaguguc

SEQ ID NO: 1039781 - RNA, 21 nt, Homo sapiens
accuaccacaugccaagcacu

SEQ ID NO: 1039782 - RNA, 22 nt, Homo sapiens
accuacuaauccucucugcaag

SEQ ID NO: 1039783 - RNA, 19 nt, Homo sapiens
accuacuuuucuuuccuca

SEQ ID NO: 1039784 - RNA, 20 nt, Homo sapiens
accuacuuuucuuuccucag

SEQ ID NO: 1039785 - RNA, 14 nt, Homo sapiens
accuagacuguaaa

SEQ ID NO: 1039786 - RNA, 17 nt, Homo sapiens
accuagcgucaguauuu

SEQ ID NO: 1039787 - RNA, 20 nt, Homo sapiens
accuagcuuuauucuucaga

SEQ ID NO: 1039788 - RNA, 18 nt, Homo sapiens
accuaguagucauuucau

SEQ ID NO: 1039789 - RNA, 12 nt, Homo sapiens
accuauaccaau

SEQ ID NO: 1039790 - RNA, 14 nt, Homo sapiens
accuauaccaauau

SEQ ID NO: 1039791 - RNA, 21 nt, Homo sapiens
accuaugucccuucucaugcc

SEQ ID NO: 1039792 - RNA, 18 nt, Homo sapiens
accucaaacuuccaguca

SEQ ID NO: 1039793 - RNA, 17 nt, Homo sapiens
accucaaccuaugguau

SEQ ID NO: 1039794 - RNA, 16 nt, Homo sapiens
accucacuccuguuac

SEQ ID NO: 1039795 - RNA, 21 nt, Homo sapiens
accucagaguauggagcucag

SEQ ID NO: 1039796 - RNA, 19 nt, Homo sapiens
accucagccucccaaagug

SEQ ID NO: 1039797 - RNA, 23 nt, Homo sapiens
accucauagcuaauuuuugcaaa

SEQ ID NO: 1039798 - RNA, 15 nt, Homo sapiens
accuccacagcuucc

SEQ ID NO: 1039799 - RNA, 13 nt, Homo sapiens
accucccaaagug

SEQ ID NO: 1039800 - RNA, 12 nt, Homo sapiens
accucccacugc

SEQ ID NO: 1039801 - RNA, 15 nt, Homo sapiens
accucccagcccuau

SEQ ID NO: 1039802 - RNA, 18 nt, Homo sapiens
accuccccuccuugccuc

SEQ ID NO: 1039803 - RNA, 23 nt, Homo sapiens
accuccuaauuccacacccucac

SEQ ID NO: 1039804 - RNA, 16 nt, Homo sapiens
uaaaaauacaaaaaau

SEQ ID NO: 1039805 - RNA, 19 nt, Homo sapiens
uaaaaaucauugauuguca

SEQ ID NO: 1039806 - RNA, 18 nt, Homo sapiens
uaaaaauggccauuugcu

SEQ ID NO: 1039807 - RNA, 19 nt, Homo sapiens
uaaaaauggccauuugcuu

SEQ ID NO: 1039808 - RNA, 11 nt, Homo sapiens
uaaaacaaaca

SEQ ID NO: 1039809 - RNA, 20 nt, Homo sapiens
uaaaacaacacucacauuua

SEQ ID NO: 1039810 - RNA, 22 nt, Homo sapiens
uaaaacagccaaaacuccacag

SEQ ID NO: 1039811 - RNA, 21 nt, Homo sapiens
uaaaacauguaauauaaagau

SEQ ID NO: 1039812 - RNA, 20 nt, Homo sapiens
uaaaacauguuugcacuugu

SEQ ID NO: 1039813 - RNA, 18 nt, Homo sapiens
uaaaacauuaugaguuuc

SEQ ID NO: 1039814 - RNA, 14 nt, Homo sapiens
uaaaaccacagcag

SEQ ID NO: 1039815 - RNA, 18 nt, Homo sapiens
uaaaacccaagugccuua

SEQ ID NO: 1039816 - RNA, 20 nt, Homo sapiens
uaaaacccacaaaaguacaa

SEQ ID NO: 1039817 - RNA, 15 nt, Homo sapiens
uaaaaccccaucucu

SEQ ID NO: 1039818 - RNA, 18 nt, Homo sapiens
uaaaaccugugugccauu

SEQ ID NO: 1039819 - RNA, 22 nt, Homo sapiens
uaaaacggauaccaaguugauu

SEQ ID NO: 1039820 - RNA, 17 nt, Homo sapiens
uaaaacuauauucucag

SEQ ID NO: 1039821 - RNA, 17 nt, Homo sapiens
uaaaacuuaacauucau

SEQ ID NO: 1039822 - RNA, 21 nt, Homo sapiens
uaaaagaugcauuaucuauga

SEQ ID NO: 1039823 - RNA, 18 nt, Homo sapiens
uaaaagcaauuccaaccu

SEQ ID NO: 1039824 - RNA, 23 nt, Homo sapiens
uaaaagcacacucauccccucac

SEQ ID NO: 1039825 - RNA, 19 nt, Homo sapiens
uaaaagcagcaucugcuaa

SEQ ID NO: 1039826 - RNA, 12 nt, Homo sapiens
uaaaagccauga

SEQ ID NO: 1039827 - RNA, 19 nt, Homo sapiens
uaaaaggcaaauguguaca

SEQ ID NO: 1039828 - RNA, 23 nt, Homo sapiens
uaaaagggaagucuagaguuccu

SEQ ID NO: 1039829 - RNA, 15 nt, Homo sapiens
uaaaagucacucuga

SEQ ID NO: 1039830 - RNA, 12 nt, Homo sapiens
uaaaagugcuuu

SEQ ID NO: 1039831 - RNA, 22 nt, Homo sapiens
uaaaaguugcauguuaugugag

SEQ ID NO: 1039832 - RNA, 17 nt, Homo sapiens
uaaaauaaaaugcagac

SEQ ID NO: 1039833 - RNA, 23 nt, Homo sapiens
uaaaauaaaguauauauagaauc

SEQ ID NO: 1039834 - RNA, 24 nt, Homo sapiens
uaaaauaacuuauaucaucagcau

SEQ ID NO: 1039835 - RNA, 18 nt, Homo sapiens
uaaaauaagcacugugcu

SEQ ID NO: 1039836 - RNA, 18 nt, Homo sapiens
uaaaauauauuucagaua

SEQ ID NO: 1039837 - RNA, 21 nt, Homo sapiens
uaaaauauuuuuaugugcaau

SEQ ID NO: 1039838 - RNA, 18 nt, Homo sapiens
uaaaaucauguacauuuc

SEQ ID NO: 1039839 - RNA, 19 nt, Homo sapiens
uaaaaucauuucugcauca

SEQ ID NO: 1039840 - RNA, 16 nt, Homo sapiens
uaaaaucccuccuuca

SEQ ID NO: 1039841 - RNA, 22 nt, Homo sapiens
uaaaaugaaguggugagcuuaa

SEQ ID NO: 1039842 - RNA, 11 nt, Homo sapiens
uaaaaugacau

SEQ ID NO: 1039843 - RNA, 21 nt, Homo sapiens
uaaaaugcaaaauccugguga

SEQ ID NO: 1039844 - RNA, 22 nt, Homo sapiens
uaaaaugcuaauuaggcaaaga

SEQ ID NO: 1039845 - RNA, 11 nt, Homo sapiens
uaaaauggagg

SEQ ID NO: 1039846 - RNA, 15 nt, Homo sapiens
uaaaauuagcuugag

SEQ ID NO: 1039847 - RNA, 15 nt, Homo sapiens
uaaaauuaugccaua

SEQ ID NO: 1039848 - RNA, 14 nt, Homo sapiens
uaaaauuauuccuu

SEQ ID NO: 1039849 - RNA, 16 nt, Homo sapiens
uaaaauuuaacucaca

SEQ ID NO: 1039850 - RNA, 14 nt, Homo sapiens
uaaaauuucacuua

SEQ ID NO: 1039851 - RNA, 15 nt, Homo sapiens
uaaacaaauucauau

SEQ ID NO: 1039852 - RNA, 18 nt, Homo sapiens
uaaacagauggcacuuug

SEQ ID NO: 1039853 - RNA, 19 nt, Homo sapiens
uaaaccaaaaacugaaagu

SEQ ID NO: 1039854 - RNA, 23 nt, Homo sapiens
uaaaccagguuuagacaguauga

SEQ ID NO: 1039855 - RNA, 17 nt, Homo sapiens
uaaacuaucuuggugaa

SEQ ID NO: 1039856 - RNA, 19 nt, Homo sapiens
uaaacuugucaggguauaa

SEQ ID NO: 1039857 - RNA, 21 nt, Homo sapiens
uaaagaaaaguagguuuacau

SEQ ID NO: 1039858 - RNA, 17 nt, Homo sapiens
uaaagaaacuuuauuca

SEQ ID NO: 1039859 - RNA, 15 nt, Homo sapiens
uaaagaagaacuugc

SEQ ID NO: 1039860 - RNA, 14 nt, Homo sapiens
uaaagaaguuugau

SEQ ID NO: 1039861 - RNA, 10 nt, Homo sapiens
uaaagacaga

SEQ ID NO: 1039862 - RNA, 14 nt, Homo sapiens
uaaagaccacuuua

SEQ ID NO: 1039863 - RNA, 19 nt, Homo sapiens
uaaagacccaacauuacua

SEQ ID NO: 1039864 - RNA, 20 nt, Homo sapiens
uaaagaccgggaaaagggaa

SEQ ID NO: 1039865 - RNA, 21 nt, Homo sapiens
uaaagagaccuaccucagguu

SEQ ID NO: 1039866 - RNA, 15 nt, Homo sapiens
uaaagaucauguaaa

SEQ ID NO: 1039867 - RNA, 17 nt, Homo sapiens
uaaagcauucaauuuau

SEQ ID NO: 1039868 - RNA, 14 nt, Homo sapiens
uaaagcuauuuccu

SEQ ID NO: 1039869 - RNA, 16 nt, Homo sapiens
uaaaguacagacuuuu

SEQ ID NO: 1039870 - RNA, 14 nt, Homo sapiens
uaaagucaguaacu

SEQ ID NO: 1039871 - RNA, 16 nt, Homo sapiens
uaaauaaaauuuguug

SEQ ID NO: 1039872 - RNA, 21 nt, Homo sapiens
uaaauaaacucaaugagcucu

SEQ ID NO: 1039873 - RNA, 16 nt, Homo sapiens
uaaauaacuaaugucu

SEQ ID NO: 1039874 - RNA, 21 nt, Homo sapiens
uaaauaagauuuaauucacau

SEQ ID NO: 1039875 - RNA, 19 nt, Homo sapiens
uaaauagaccucucaauuu

SEQ ID NO: 1039876 - RNA, 18 nt, Homo sapiens
uaaauagccaacacccau

SEQ ID NO: 1039877 - RNA, 13 nt, Homo sapiens
uaaauaugcagug

SEQ ID NO: 1039878 - RNA, 16 nt, Homo sapiens
uaaauaugcagugaua

SEQ ID NO: 1039879 - RNA, 22 nt, Homo sapiens
uaaauauuacacaucaagcgau

SEQ ID NO: 1039880 - RNA, 22 nt, Homo sapiens
uaaauauuuauuuaacuauuca

SEQ ID NO: 1039881 - RNA, 16 nt, Homo sapiens
uaaauauuucaggcau

SEQ ID NO: 1039882 - RNA, 20 nt, Homo sapiens
uaaaucaggacagguggugc

SEQ ID NO: 1039883 - RNA, 21 nt, Homo sapiens
uaaauccauccauccaaaggc

SEQ ID NO: 1039884 - RNA, 23 nt, Homo sapiens
uaaaucccauucauaacuuucau

SEQ ID NO: 1039885 - RNA, 13 nt, Homo sapiens
uaaauccuuccau

SEQ ID NO: 1039886 - RNA, 14 nt, Homo sapiens
uaaaucgcuaccuu

SEQ ID NO: 1039887 - RNA, 13 nt, Homo sapiens
uaaaucugugaug

SEQ ID NO: 1039888 - RNA, 20 nt, Homo sapiens
uaaaucugugaugauccuca

SEQ ID NO: 1039889 - RNA, 20 nt, Homo sapiens
uaaaucuguuauuuugcuau

SEQ ID NO: 1039890 - RNA, 16 nt, Homo sapiens
uaaaugaagugcaaau

SEQ ID NO: 1039891 - RNA, 19 nt, Homo sapiens
uaaaugaggggccucaggu

SEQ ID NO: 1039892 - RNA, 16 nt, Homo sapiens
uaaaugauuucauuca

SEQ ID NO: 1039893 - RNA, 21 nt, Homo sapiens
uaaaugcugucaacuaugaua

SEQ ID NO: 1039894 - RNA, 17 nt, Homo sapiens
uaaauguaacagucuga

SEQ ID NO: 1039895 - RNA, 17 nt, Homo sapiens
uaaauguaucauagaaa

SEQ ID NO: 1039896 - RNA, 21 nt, Homo sapiens
uaaaugucuucuguauucacu

SEQ ID NO: 1039897 - RNA, 13 nt, Homo sapiens
uaaauuauaucaa

SEQ ID NO: 1039898 - RNA, 20 nt, Homo sapiens
uaaauuaugggaaucaagau

SEQ ID NO: 1039899 - RNA, 22 nt, Homo sapiens
uaaauuauuuuuguucauauaa

SEQ ID NO: 1039900 - RNA, 13 nt, Homo sapiens
uaaauuccacacu

SEQ ID NO: 1039901 - RNA, 23 nt, Homo sapiens
uaaauucuauaggaacauaugaa

SEQ ID NO: 1039902 - RNA, 21 nt, Homo sapiens
uaaauuuaugguucucaggcc

SEQ ID NO: 1039903 - RNA, 16 nt, Homo sapiens
uaaauuuaugugaugg

SEQ ID NO: 1039904 - RNA, 20 nt, Homo sapiens
uaaauuucaguaguggugau

SEQ ID NO: 1039905 - RNA, 22 nt, Homo sapiens
uaaauuuccccaacagugugaa

SEQ ID NO: 1039906 - RNA, 17 nt, Homo sapiens
uaaauuuuacccuuuag

SEQ ID NO: 1039907 - RNA, 18 nt, Homo sapiens
uaaauuuuauaaucauga

SEQ ID NO: 1039908 - RNA, 13 nt, Homo sapiens
uaacaaacaucac

SEQ ID NO: 1039909 - RNA, 22 nt, Homo sapiens
uaacaaacaucacucugcugcu

SEQ ID NO: 1039910 - RNA, 14 nt, Homo sapiens
uaacaaacucugag

SEQ ID NO: 1039911 - RNA, 15 nt, Homo sapiens
uaacaaagaacaagc

SEQ ID NO: 1039912 - RNA, 16 nt, Homo sapiens
acguuuauagccgaaa

SEQ ID NO: 1039913 - RNA, 21 nt, Homo sapiens
acguuugcuccuugacuccaa

SEQ ID NO: 1039914 - RNA, 16 nt, Homo sapiens
acuaaaaauacaaaaa

SEQ ID NO: 1039915 - RNA, 14 nt, Homo sapiens
acuaaaaauauuau

SEQ ID NO: 1039916 - RNA, 19 nt, Homo sapiens
acuaaaagguaugcaauca

SEQ ID NO: 1039917 - RNA, 22 nt, Homo sapiens
acuaaaauuguaucaaauguga

SEQ ID NO: 1039918 - RNA, 12 nt, Homo sapiens
acuaaacuuuca

SEQ ID NO: 1039919 - RNA, 17 nt, Homo sapiens
acuaacagauaagcaag

SEQ ID NO: 1039920 - RNA, 15 nt, Homo sapiens
acuaagaaauaugca

SEQ ID NO: 1039921 - RNA, 19 nt, Homo sapiens
acuaagcauagcaaacaga

SEQ ID NO: 1039922 - RNA, 12 nt, Homo sapiens
acuaagucagaa

SEQ ID NO: 1039923 - RNA, 16 nt, Homo sapiens
acuaauacagacuaug

SEQ ID NO: 1039924 - RNA, 16 nt, Homo sapiens
acuaauccucucugca

SEQ ID NO: 1039925 - RNA, 17 nt, Homo sapiens
acuaaucgaaugaacaa

SEQ ID NO: 1039926 - RNA, 16 nt, Homo sapiens
acuaaugauguuuucc

SEQ ID NO: 1039927 - RNA, 16 nt, Homo sapiens
acuaaugucucuacaa

SEQ ID NO: 1039928 - RNA, 17 nt, Homo sapiens
acuacaauguagucuca

SEQ ID NO: 1039929 - RNA, 19 nt, Homo sapiens
acuacgugacuguggcaca

SEQ ID NO: 1039930 - RNA, 19 nt, Homo sapiens
acuacucccucaaagcaca

SEQ ID NO: 1039931 - RNA, 13 nt, Homo sapiens
acuagaaccugga

SEQ ID NO: 1039932 - RNA, 15 nt, Homo sapiens
acuagaacucuccau

SEQ ID NO: 1039933 - RNA, 18 nt, Homo sapiens
acuagaccuguaacuuuu

SEQ ID NO: 1039934 - RNA, 18 nt, Homo sapiens
acuagaggcuugcauaau

SEQ ID NO: 1039935 - RNA, 13 nt, Homo sapiens
acuagauacugaa

SEQ ID NO: 1039936 - RNA, 14 nt, Homo sapiens
acuagauuacauuc

SEQ ID NO: 1039937 - RNA, 15 nt, Homo sapiens
acuagauugcaugcu

SEQ ID NO: 1039938 - RNA, 13 nt, Homo sapiens
acuaggacacucc

SEQ ID NO: 1039939 - RNA, 14 nt, Homo sapiens
acuaggcucagaga

SEQ ID NO: 1039940 - RNA, 15 nt, Homo sapiens
acuagggaucccuca

SEQ ID NO: 1039941 - RNA, 19 nt, Homo sapiens
acuagucacauucuuguuu

SEQ ID NO: 1039942 - RNA, 14 nt, Homo sapiens
acuauagcccaggu

SEQ ID NO: 1039943 - RNA, 18 nt, Homo sapiens
acuauauuuauacuguau

SEQ ID NO: 1039944 - RNA, 19 nt, Homo sapiens
acuauauuuauacuguaua

SEQ ID NO: 1039945 - RNA, 19 nt, Homo sapiens
acuaugaagcuaccucaaa

SEQ ID NO: 1039946 - RNA, 19 nt, Homo sapiens
acuaugaaguaagcaacaa

SEQ ID NO: 1039947 - RNA, 16 nt, Homo sapiens
acuaugaaugggcaaa

SEQ ID NO: 1039948 - RNA, 11 nt, Homo sapiens
acuauggaaau

SEQ ID NO: 1039949 - RNA, 14 nt, Homo sapiens
acuauggaaaugua

SEQ ID NO: 1039950 - RNA, 15 nt, Homo sapiens
acuauguuucuauuc

SEQ ID NO: 1039951 - RNA, 17 nt, Homo sapiens
acuauuaaacagucugu

SEQ ID NO: 1039952 - RNA, 16 nt, Homo sapiens
acuauugaaaucaagc

SEQ ID NO: 1039953 - RNA, 18 nt, Homo sapiens
acuauuuaaagccuccuc

SEQ ID NO: 1039954 - RNA, 22 nt, Homo sapiens
acuauuuagauauaacacuaug

SEQ ID NO: 1039955 - RNA, 17 nt, Homo sapiens
acuauuuaugaaggcaa

SEQ ID NO: 1039956 - RNA, 13 nt, Homo sapiens
acuauuuucauuc

SEQ ID NO: 1039957 - RNA, 21 nt, Homo sapiens
uaacuuggagccccagugcca

SEQ ID NO: 1039958 - RNA, 15 nt, Homo sapiens
uaacuuguuuccaau

SEQ ID NO: 1039959 - RNA, 16 nt, Homo sapiens
uaacuuuaaguuucag

SEQ ID NO: 1039960 - RNA, 16 nt, Homo sapiens
uaacuuucucuaugaa

SEQ ID NO: 1039961 - RNA, 15 nt, Homo sapiens
uaacuuugcuugcag

SEQ ID NO: 1039962 - RNA, 16 nt, Homo sapiens
uaagaaaauacauaag

SEQ ID NO: 1039963 - RNA, 21 nt, Homo sapiens
uaagaaagugcgaguccucca

SEQ ID NO: 1039964 - RNA, 23 nt, Homo sapiens
uaagaaccacucauaauucuuca

SEQ ID NO: 1039965 - RNA, 14 nt, Homo sapiens
uaagaacugcuuuc

SEQ ID NO: 1039966 - RNA, 18 nt, Homo sapiens
uaagaauuuagggagaaa

SEQ ID NO: 1039967 - RNA, 14 nt, Homo sapiens
uaagacaaacugca

SEQ ID NO: 1039968 - RNA, 18 nt, Homo sapiens
uaagaccauaacagccaa

SEQ ID NO: 1039969 - RNA, 16 nt, Homo sapiens
uaagacgaaugauuua

SEQ ID NO: 1039970 - RNA, 13 nt, Homo sapiens
uaagacuacugaa

SEQ ID NO: 1039971 - RNA, 19 nt, Homo sapiens
uaagacuguaaugaaucua

SEQ ID NO: 1039972 - RNA, 20 nt, Homo sapiens
uaagagaaucaacauuucuc

SEQ ID NO: 1039973 - RNA, 21 nt, Homo sapiens
uaagagccauauaaguuugaa

SEQ ID NO: 1039974 - RNA, 20 nt, Homo sapiens
uaagagggcacacacugugu

SEQ ID NO: 1039975 - RNA, 24 nt, Homo sapiens
uaagaguagcaaguucuagagaag

SEQ ID NO: 1039976 - RNA, 22 nt, Homo sapiens
uaagagugccguaacaacugug

SEQ ID NO: 1039977 - RNA, 13 nt, Homo sapiens
uaagaguuacuua

SEQ ID NO: 1039978 - RNA, 13 nt, Homo sapiens
uaagaugaucauc

SEQ ID NO: 1039979 - RNA, 17 nt, Homo sapiens
uaagaugaucaucucca

SEQ ID NO: 1039980 - RNA, 18 nt, Homo sapiens
uaagaugaucaucuccag

SEQ ID NO: 1039981 - RNA, 17 nt, Homo sapiens
uaagauggaagcuucca

SEQ ID NO: 1039982 - RNA, 13 nt, Homo sapiens
uaagauucaucca

SEQ ID NO: 1039983 - RNA, 14 nt, Homo sapiens
uaagauuuaauuca

SEQ ID NO: 1039984 - RNA, 20 nt, Homo sapiens
uaagcaaaaugugauaugua

SEQ ID NO: 1039985 - RNA, 15 nt, Homo sapiens
uaagcacugugcuaa

SEQ ID NO: 1039986 - RNA, 22 nt, Homo sapiens
uaagccacauggcugggauuua

SEQ ID NO: 1039987 - RNA, 14 nt, Homo sapiens
uaagccacucuucc

SEQ ID NO: 1039988 - RNA, 14 nt, Homo sapiens
uaagcccacuguua

SEQ ID NO: 1039989 - RNA, 20 nt, Homo sapiens
uaagcucuacugaggugcua

SEQ ID NO: 1039990 - RNA, 12 nt, Homo sapiens
uaagcucuggcu

SEQ ID NO: 1039991 - RNA, 20 nt, Homo sapiens
uaaggaauaugagcuuuaug

SEQ ID NO: 1039992 - RNA, 14 nt, Homo sapiens
uaaggacauuuccc

SEQ ID NO: 1039993 - RNA, 16 nt, Homo sapiens
uaaggagaaaucuaua

SEQ ID NO: 1039994 - RNA, 18 nt, Homo sapiens
uaaggaugucacagggcc

SEQ ID NO: 1039995 - RNA, 15 nt, Homo sapiens
uaaggauugugauau

SEQ ID NO: 1039996 - RNA, 14 nt, Homo sapiens
uaaggcguggagcu

SEQ ID NO: 1039997 - RNA, 14 nt, Homo sapiens
uaagggaaacugcc

SEQ ID NO: 1039998 - RNA, 20 nt, Homo sapiens
uaaggucacauugugccuuu

SEQ ID NO: 1039999 - RNA, 12 nt, Homo sapiens
uaaggugcaguu

SEQ ID NO: 1040000 - RNA, 16 nt, Homo sapiens
uaagguggguggauca

SEQ ID NO: 1040001 - RNA, 13 nt, Homo sapiens
uaaguacuaugua

SEQ ID NO: 1040002 - RNA, 16 nt, Homo sapiens
uaagucuuaauauuaa

SEQ ID NO: 1040003 - RNA, 13 nt, Homo sapiens
uaagugccuucca

SEQ ID NO: 1040004 - RNA, 19 nt, Homo sapiens
uaagugcuuuguaauggga

SEQ ID NO: 1040005 - RNA, 19 nt, Homo sapiens
uaaguugauggugaugaaa

SEQ ID NO: 1040006 - RNA, 18 nt, Homo sapiens
uaaguugcaccaacuuug

SEQ ID NO: 1040007 - RNA, 15 nt, Homo sapiens
uaaguuguugauguu

SEQ ID NO: 1040008 - RNA, 13 nt, Homo sapiens
uaaguuucacuga

SEQ ID NO: 1040009 - RNA, 23 nt, Homo sapiens
uaaguuucaggauacaugugccg

SEQ ID NO: 1040010 - RNA, 19 nt, Homo sapiens
uaaguuucucagcucccau

SEQ ID NO: 1040011 - RNA, 14 nt, Homo sapiens
uaaguuucugggac

SEQ ID NO: 1040012 - RNA, 22 nt, Homo sapiens
uaaguuuuauacuugauuguau

SEQ ID NO: 1040013 - RNA, 22 nt, Homo sapiens
uaaguuuuauguuaaaucaaua

SEQ ID NO: 1040014 - RNA, 19 nt, Homo sapiens
uaauaaaacuaaacuuuca

SEQ ID NO: 1040015 - RNA, 13 nt, Homo sapiens
uaauaacagugca

SEQ ID NO: 1040016 - RNA, 22 nt, Homo sapiens
uaauaacuuuucuaaagccuua

SEQ ID NO: 1040017 - RNA, 18 nt, Homo sapiens
uaauaaguuucacugacu

SEQ ID NO: 1040018 - RNA, 17 nt, Homo sapiens
uaauaauacagccaaag

SEQ ID NO: 1040019 - RNA, 15 nt, Homo sapiens
uaauaauguuuaaua

SEQ ID NO: 1040020 - RNA, 14 nt, Homo sapiens
uaauacagcagugu

SEQ ID NO: 1040021 - RNA, 15 nt, Homo sapiens
uaauacagggcauuu

SEQ ID NO: 1040022 - RNA, 15 nt, Homo sapiens
uaauagaaacauuga

SEQ ID NO: 1040023 - RNA, 18 nt, Homo sapiens
uaauaguuuugauccuaa

SEQ ID NO: 1040024 - RNA, 23 nt, Homo sapiens
uaauaucagcaagucucuuuaua

SEQ ID NO: 1040025 - RNA, 14 nt, Homo sapiens
uaauaugcugccaa

SEQ ID NO: 1040026 - RNA, 20 nt, Homo sapiens
uaauaugguguacauucuuc

SEQ ID NO: 1040027 - RNA, 15 nt, Homo sapiens
uaauauugcagucaa

SEQ ID NO: 1040028 - RNA, 20 nt, Homo sapiens
uaaucacucagugauugcaa

SEQ ID NO: 1040029 - RNA, 21 nt, Homo sapiens
uaaucagcaagaauuugaucg

SEQ ID NO: 1040030 - RNA, 18 nt, Homo sapiens
uaaucaucuauaaagaag

SEQ ID NO: 1040031 - RNA, 19 nt, Homo sapiens
uaaucaugaaagcaucuga

SEQ ID NO: 1040032 - RNA, 18 nt, Homo sapiens
uaaucauuuuaagugcau

SEQ ID NO: 1040033 - RNA, 22 nt, Homo sapiens
uaauccacugugacuuugccca

SEQ ID NO: 1040034 - RNA, 22 nt, Homo sapiens
uaaucuggacuccucuguccag

SEQ ID NO: 1040035 - RNA, 13 nt, Homo sapiens
uaaucuuuucaca

SEQ ID NO: 1040036 - RNA, 22 nt, Homo sapiens
uaaugaaagacuguacaaagua

SEQ ID NO: 1040037 - RNA, 13 nt, Homo sapiens
uaaugaacaugug

SEQ ID NO: 1040038 - RNA, 19 nt, Homo sapiens
uaaugaaucuaagcagcau

SEQ ID NO: 1040039 - RNA, 18 nt, Homo sapiens
uaaugacaaaggcacuga

SEQ ID NO: 1040040 - RNA, 22 nt, Homo sapiens
uaaugagauaaugugauauuau

SEQ ID NO: 1040041 - RNA, 11 nt, Homo sapiens
uaaugagggac

SEQ ID NO: 1040042 - RNA, 15 nt, Homo sapiens
uaaugauagcuacug

SEQ ID NO: 1040043 - RNA, 23 nt, Homo sapiens
uaaugaugucguuugaaucacag

SEQ ID NO: 1040044 - RNA, 20 nt, Homo sapiens
uaaugauugacguacuuagc

SEQ ID NO: 1040045 - RNA, 13 nt, Homo sapiens
uaaugcaccugaa

SEQ ID NO: 1040046 - RNA, 22 nt, Homo sapiens
uaaugcuaaagaaaaagucauc

SEQ ID NO: 1040047 - RNA, 17 nt, Homo sapiens
uaauggccggcuggaaa

SEQ ID NO: 1040048 - RNA, 19 nt, Homo sapiens
uaauggcucaugaccugga

SEQ ID NO: 1040049 - RNA, 13 nt, Homo sapiens
uaaugggacacua

SEQ ID NO: 1040050 - RNA, 21 nt, Homo sapiens
uaauguauuuguuugcaauuu

SEQ ID NO: 1040051 - RNA, 23 nt, Homo sapiens
uaaugugaaguagaauccuaaau

SEQ ID NO: 1040052 - RNA, 18 nt, Homo sapiens
uaauguuuaauauugaga

SEQ ID NO: 1040053 - RNA, 14 nt, Homo sapiens
uaauuaaaugcuca

SEQ ID NO: 1040054 - RNA, 16 nt, Homo sapiens
uaauuaguaacaugug

SEQ ID NO: 1040055 - RNA, 14 nt, Homo sapiens
uaauuaguuccuca

SEQ ID NO: 1040056 - RNA, 21 nt, Homo sapiens
uaauuaucggaagcagugccu

SEQ ID NO: 1040057 - RNA, 20 nt, Homo sapiens
uaauuaugaguuugcuuaug

SEQ ID NO: 1040058 - RNA, 21 nt, Homo sapiens
acugauguuacaucacagugu

SEQ ID NO: 1040059 - RNA, 21 nt, Homo sapiens
acugauucauacauuaucuca

SEQ ID NO: 1040060 - RNA, 14 nt, Homo sapiens
acugauuucacaac

SEQ ID NO: 1040061 - RNA, 19 nt, Homo sapiens
acugauuucacaacagauc

SEQ ID NO: 1040062 - RNA, 16 nt, Homo sapiens
acugcaacuucugccu

SEQ ID NO: 1040063 - RNA, 22 nt, Homo sapiens
acugcaaugcuggacacuacag

SEQ ID NO: 1040064 - RNA, 15 nt, Homo sapiens
acugcacacugccug

SEQ ID NO: 1040065 - RNA, 20 nt, Homo sapiens
acugcacacugccuggccca

SEQ ID NO: 1040066 - RNA, 20 nt, Homo sapiens
acugcacuauagccuaggug

SEQ ID NO: 1040067 - RNA, 19 nt, Homo sapiens
acugcagaccuguccuccu

SEQ ID NO: 1040068 - RNA, 18 nt, Homo sapiens
acugcagcuaacuuauca

SEQ ID NO: 1040069 - RNA, 18 nt, Homo sapiens
acugcaggcaucacagcu

SEQ ID NO: 1040070 - RNA, 22 nt, Homo sapiens
acugcagggaaaauuauuugca

SEQ ID NO: 1040071 - RNA, 14 nt, Homo sapiens
acugcagugagaau

SEQ ID NO: 1040072 - RNA, 20 nt, Homo sapiens
acugcauaaaaagugccugu

SEQ ID NO: 1040073 - RNA, 14 nt, Homo sapiens
acugcauacaaucu

SEQ ID NO: 1040074 - RNA, 20 nt, Homo sapiens
acugccaugcuagacaagcu

SEQ ID NO: 1040075 - RNA, 13 nt, Homo sapiens
acugcgacuguga

SEQ ID NO: 1040076 - RNA, 17 nt, Homo sapiens
acugcucaucauuccuu

SEQ ID NO: 1040077 - RNA, 16 nt, Homo sapiens
acugcugggcuuggca

SEQ ID NO: 1040078 - RNA, 17 nt, Homo sapiens
acugcugggcuuggcag

SEQ ID NO: 1040079 - RNA, 12 nt, Homo sapiens
acugcugugaau

SEQ ID NO: 1040080 - RNA, 20 nt, Homo sapiens
acugcuguguuugagcucug

SEQ ID NO: 1040081 - RNA, 15 nt, Homo sapiens
acuggagaagucuua

SEQ ID NO: 1040082 - RNA, 22 nt, Homo sapiens
acuggagaggcuagaaccaaga

SEQ ID NO: 1040083 - RNA, 13 nt, Homo sapiens
acuggaguccagu

SEQ ID NO: 1040084 - RNA, 19 nt, Homo sapiens
acuggcacacuggccucca

SEQ ID NO: 1040085 - RNA, 16 nt, Homo sapiens
acuggcagcaucuuca

SEQ ID NO: 1040086 - RNA, 21 nt, Homo sapiens
acuggcuaacagauguugaaa

SEQ ID NO: 1040087 - RNA, 17 nt, Homo sapiens
acuggcucaaagacaau

SEQ ID NO: 1040088 - RNA, 14 nt, Homo sapiens
acuggcugauggag

SEQ ID NO: 1040089 - RNA, 14 nt, Homo sapiens
acuggcugcaaagg

SEQ ID NO: 1040090 - RNA, 17 nt, Homo sapiens
acuggcugucaguauga

SEQ ID NO: 1040091 - RNA, 20 nt, Homo sapiens
acugggagaaaugacuuuga

SEQ ID NO: 1040092 - RNA, 16 nt, Homo sapiens
acuggggcuggcacaa

SEQ ID NO: 1040093 - RNA, 21 nt, Homo sapiens
acuggguuuggaccccagcug

SEQ ID NO: 1040094 - RNA, 12 nt, Homo sapiens
acugguccaaaa

SEQ ID NO: 1040095 - RNA, 21 nt, Homo sapiens
acuggucuuguggaauuggga

SEQ ID NO: 1040096 - RNA, 17 nt, Homo sapiens
acugguuguugccaaac

SEQ ID NO: 1040097 - RNA, 21 nt, Homo sapiens
acuguaaagcuuugugcagau

SEQ ID NO: 1040098 - RNA, 23 nt, Homo sapiens
acuguaaauguggcccccagugg

SEQ ID NO: 1040099 - RNA, 18 nt, Homo sapiens
acuguaacugacugccuu

SEQ ID NO: 1040100 - RNA, 16 nt, Homo sapiens
acuguacaaaauaagu

SEQ ID NO: 1040101 - RNA, 18 nt, Homo sapiens
acuguacucugcacuggu

SEQ ID NO: 1040102 - RNA, 17 nt, Homo sapiens
acugucacuuugcucug

SEQ ID NO: 1040103 - RNA, 14 nt, Homo sapiens
acugucauagaaau

SEQ ID NO: 1040104 - RNA, 22 nt, Homo sapiens
acugucggccagagucuguuuc

SEQ ID NO: 1040105 - RNA, 22 nt, Homo sapiens
acugucuugaagacaauggcuu

SEQ ID NO: 1040106 - RNA, 12 nt, Homo sapiens
acugucuuucag

SEQ ID NO: 1040107 - RNA, 21 nt, Homo sapiens
acugucuuucagauacauggu

SEQ ID NO: 1040108 - RNA, 20 nt, Homo sapiens
acugugaacuuggggaacaa

SEQ ID NO: 1040109 - RNA, 14 nt, Homo sapiens
acugugacugauau

SEQ ID NO: 1040110 - RNA, 21 nt, Homo sapiens
acugugcuggagccacuaacu

SEQ ID NO: 1040111 - RNA, 23 nt, Homo sapiens
acuguggagaaauaaaaauaccu

SEQ ID NO: 1040112 - RNA, 20 nt, Homo sapiens
acuguggcugcuagcacuug

SEQ ID NO: 1040113 - RNA, 11 nt, Homo sapiens
acuguggcuuc

SEQ ID NO: 1040114 - RNA, 23 nt, Homo sapiens
acuguggcuucuuaaucuuuuca

SEQ ID NO: 1040115 - RNA, 24 nt, Homo sapiens
acuguggcuucuuaaucuuuucac

SEQ ID NO: 1040116 - RNA, 18 nt, Homo sapiens
acuguguacauaacugaa

SEQ ID NO: 1040117 - RNA, 16 nt, Homo sapiens
acuguguauuccaaga

SEQ ID NO: 1040118 - RNA, 19 nt, Homo sapiens
acuguuggcaaggugacau

SEQ ID NO: 1040119 - RNA, 14 nt, Homo sapiens
acuguuucugucag

SEQ ID NO: 1040120 - RNA, 16 nt, Homo sapiens
acuguuugcccagugu

SEQ ID NO: 1040121 - RNA, 14 nt, Homo sapiens
acuguuugucuucu

SEQ ID NO: 1040122 - RNA, 21 nt, Homo sapiens
acuguuuuauaaacugcugua

SEQ ID NO: 1040123 - RNA, 17 nt, Homo sapiens
acuguuuuucagggagg

SEQ ID NO: 1040124 - RNA, 17 nt, Homo sapiens
acuuaaaaucuaauuca

SEQ ID NO: 1040125 - RNA, 21 nt, Homo sapiens
acuuaaauaauaaacagugga

SEQ ID NO: 1040126 - RNA, 19 nt, Homo sapiens
acuuaaggauggagccagc

SEQ ID NO: 1040127 - RNA, 19 nt, Homo sapiens
acuuacaggccuugcucac

SEQ ID NO: 1040128 - RNA, 22 nt, Homo sapiens
acuuacccucaccugucaggcc

SEQ ID NO: 1040129 - RNA, 20 nt, Homo sapiens
acuuacuguuucugucagga

SEQ ID NO: 1040130 - RNA, 16 nt, Homo sapiens
acuuacuuacccucac

SEQ ID NO: 1040131 - RNA, 23 nt, Homo sapiens
acuuagcagcuaucucucaguga

SEQ ID NO: 1040132 - RNA, 12 nt, Homo sapiens
acuuagcucaca

SEQ ID NO: 1040133 - RNA, 21 nt, Homo sapiens
acuuagguggcaagcugugac

SEQ ID NO: 1040134 - RNA, 16 nt, Homo sapiens
acuuagguguggggga

SEQ ID NO: 1040135 - RNA, 22 nt, Homo sapiens
acuuauaauuaugcuaccuacu

SEQ ID NO: 1040136 - RNA, 14 nt, Homo sapiens
acuuaucaucacac

SEQ ID NO: 1040137 - RNA, 22 nt, Homo sapiens
acuuaucccaagagaaugaaau

SEQ ID NO: 1040138 - RNA, 16 nt, Homo sapiens
acuuauccuguucucu

SEQ ID NO: 1040139 - RNA, 22 nt, Homo sapiens
acuuauuggaacucugcuugau

SEQ ID NO: 1040140 - RNA, 13 nt, Homo sapiens
acuucaaggguuu

SEQ ID NO: 1040141 - RNA, 22 nt, Homo sapiens
acuucaaggguuuguugaacaa

SEQ ID NO: 1040142 - RNA, 16 nt, Homo sapiens
acuucaauguaguuuu

SEQ ID NO: 1040143 - RNA, 23 nt, Homo sapiens
acuucaauguauugagcauguga

SEQ ID NO: 1040144 - RNA, 14 nt, Homo sapiens
acuucacacacagg

SEQ ID NO: 1040145 - RNA, 18 nt, Homo sapiens
acuucacagagugugcug

SEQ ID NO: 1040146 - RNA, 19 nt, Homo sapiens
acuucacagagugugcugg

SEQ ID NO: 1040147 - RNA, 20 nt, Homo sapiens
acuucagagacuaucugauu

SEQ ID NO: 1040148 - RNA, 12 nt, Homo sapiens
acuucagcagua

SEQ ID NO: 1040149 - RNA, 14 nt, Homo sapiens
acuucauaauccag

SEQ ID NO: 1040150 - RNA, 22 nt, Homo sapiens
acuucaucuucucagcucccau

SEQ ID NO: 1040151 - RNA, 18 nt, Homo sapiens
acuucauuugaugcuaaa

SEQ ID NO: 1040152 - RNA, 23 nt, Homo sapiens
acuuccaagcuggcuuuucccau

SEQ ID NO: 1040153 - RNA, 13 nt, Homo sapiens
acuuccacauuau

SEQ ID NO: 1040154 - RNA, 16 nt, Homo sapiens
acuuccacugccaucc

SEQ ID NO: 1040155 - RNA, 14 nt, Homo sapiens
acuuccauuugcuu

SEQ ID NO: 1040156 - RNA, 14 nt, Homo sapiens
acuucccuaaugaa

SEQ ID NO: 1040157 - RNA, 17 nt, Homo sapiens
acuuccuccccauguga

SEQ ID NO: 1040158 - RNA, 19 nt, Homo sapiens
acuuccugugacuucagcu

SEQ ID NO: 1040159 - RNA, 15 nt, Homo sapiens
acuuccuugcuuaag

SEQ ID NO: 1040160 - RNA, 13 nt, Homo sapiens
acuucgacuguga

SEQ ID NO: 1040161 - RNA, 21 nt, Homo sapiens
acuucuaaaugaagugcaaau

SEQ ID NO: 1040162 - RNA, 19 nt, Homo sapiens
acuucuagagauaguacau

SEQ ID NO: 1040163 - RNA, 22 nt, Homo sapiens
acuucucagccugguacuugua

SEQ ID NO: 1040164 - RNA, 19 nt, Homo sapiens
acuucucucagacuuacuu

SEQ ID NO: 1040165 - RNA, 18 nt, Homo sapiens
acuucucugccaccauca

SEQ ID NO: 1040166 - RNA, 15 nt, Homo sapiens
acuucugcuuuccac

SEQ ID NO: 1040167 - RNA, 17 nt, Homo sapiens
acuucugcuuugcucuu

SEQ ID NO: 1040168 - RNA, 16 nt, Homo sapiens
acuucuggcagggaag

SEQ ID NO: 1040169 - RNA, 22 nt, Homo sapiens
acuucugucuucacaacagauu

SEQ ID NO: 1040170 - RNA, 18 nt, Homo sapiens
acuucuuauacauuugau

SEQ ID NO: 1040171 - RNA, 19 nt, Homo sapiens
acuucuuauacauuugaua

SEQ ID NO: 1040172 - RNA, 19 nt, Homo sapiens
acuugaaagcauccaugug

SEQ ID NO: 1040173 - RNA, 20 nt, Homo sapiens
acuugaugacccccaaccaa

SEQ ID NO: 1040174 - RNA, 11 nt, Homo sapiens
acuugcacaaa

SEQ ID NO: 1040175 - RNA, 15 nt, Homo sapiens
acuugcacaaaauca

SEQ ID NO: 1040176 - RNA, 20 nt, Homo sapiens
acuugcacaaaaucacacag

SEQ ID NO: 1040177 - RNA, 21 nt, Homo sapiens
acuugcacaaaaucacacagc

SEQ ID NO: 1040178 - RNA, 21 nt, Homo sapiens
acuugcaucguggagacaggg

SEQ ID NO: 1040179 - RNA, 17 nt, Homo sapiens
acuugcugcaguaugaa

SEQ ID NO: 1040180 - RNA, 14 nt, Homo sapiens
acuugcugccugaa

SEQ ID NO: 1040181 - RNA, 17 nt, Homo sapiens
acuuggaacacaaugac

SEQ ID NO: 1040182 - RNA, 22 nt, Homo sapiens
acuugucaggguauaaaaugac

SEQ ID NO: 1040183 - RNA, 21 nt, Homo sapiens
acuugucccacuaucugggug

SEQ ID NO: 1040184 - RNA, 14 nt, Homo sapiens
acuuguggacacag

SEQ ID NO: 1040185 - RNA, 22 nt, Homo sapiens
acuugugugugggcugugagug

SEQ ID NO: 1040186 - RNA, 23 nt, Homo sapiens
acuuguguuuuauuaacauugau

SEQ ID NO: 1040187 - RNA, 16 nt, Homo sapiens
acuuguuccagcucuu

SEQ ID NO: 1040188 - RNA, 19 nt, Homo sapiens
acuuguuuucacuuuauca

SEQ ID NO: 1040189 - RNA, 15 nt, Homo sapiens
acuuuaaagcccuuu

SEQ ID NO: 1040190 - RNA, 14 nt, Homo sapiens
acuuuaagauguuu

SEQ ID NO: 1040191 - RNA, 13 nt, Homo sapiens
acuuuaagcacua

SEQ ID NO: 1040192 - RNA, 13 nt, Homo sapiens
acuuuaauucuca

SEQ ID NO: 1040193 - RNA, 17 nt, Homo sapiens
acuuuaccucuguggac

SEQ ID NO: 1040194 - RNA, 21 nt, Homo sapiens
acuuucugaaauaacauggcc

SEQ ID NO: 1040195 - RNA, 16 nt, Homo sapiens
acuuucuuacacugaa

SEQ ID NO: 1040196 - RNA, 15 nt, Homo sapiens
acuuugcacagcucu

SEQ ID NO: 1040197 - RNA, 22 nt, Homo sapiens
acuuugcuaacugugcuccuca

SEQ ID NO: 1040198 - RNA, 21 nt, Homo sapiens
acuuuggaguccccucaccuc

SEQ ID NO: 1040199 - RNA, 17 nt, Homo sapiens
acuuugguacauggcca

SEQ ID NO: 1040200 - RNA, 12 nt, Homo sapiens
acuuugugaaaa

SEQ ID NO: 1040201 - RNA, 17 nt, Homo sapiens
aggcaucacaugcucaa

SEQ ID NO: 1040202 - RNA, 20 nt, Homo sapiens
aggcauccuuccucacacca

SEQ ID NO: 1040203 - RNA, 13 nt, Homo sapiens
aggcaugaaauga

SEQ ID NO: 1040204 - RNA, 20 nt, Homo sapiens
aggcaugagccaccgcgccu

SEQ ID NO: 1040205 - RNA, 15 nt, Homo sapiens
aggcauucucugaag

SEQ ID NO: 1040206 - RNA, 14 nt, Homo sapiens
aggcauuucuauca

SEQ ID NO: 1040207 - RNA, 21 nt, Homo sapiens
aggccaaacuggcaaacuuca

SEQ ID NO: 1040208 - RNA, 21 nt, Homo sapiens
aggccaagaggcuguucccac

SEQ ID NO: 1040209 - RNA, 16 nt, Homo sapiens
aggccacaccaucucc

SEQ ID NO: 1040210 - RNA, 14 nt, Homo sapiens
aggccacaccggcc

SEQ ID NO: 1040211 - RNA, 17 nt, Homo sapiens
aggccacagugcaauuu

SEQ ID NO: 1040212 - RNA, 21 nt, Homo sapiens
aggccaccuggccaggagcuu

SEQ ID NO: 1040213 - RNA, 14 nt, Homo sapiens
aggccagagugcug

SEQ ID NO: 1040214 - RNA, 17 nt, Homo sapiens
aggccagagugcugcca

SEQ ID NO: 1040215 - RNA, 19 nt, Homo sapiens
aggccagcuggcagcagag

SEQ ID NO: 1040216 - RNA, 20 nt, Homo sapiens
aggccaugaaaaaaaugauc

SEQ ID NO: 1040217 - RNA, 16 nt, Homo sapiens
aggccccugucucagg

SEQ ID NO: 1040218 - RNA, 18 nt, Homo sapiens
aggccgagaagcaagaaa

SEQ ID NO: 1040219 - RNA, 20 nt, Homo sapiens
aggccggaugcgguggcuca

SEQ ID NO: 1040220 - RNA, 21 nt, Homo sapiens
aggccggugugggcugugucg

SEQ ID NO: 1040221 - RNA, 14 nt, Homo sapiens
aggccucaguggac

SEQ ID NO: 1040222 - RNA, 21 nt, Homo sapiens
aggccucccuagccagcacuu

SEQ ID NO: 1040223 - RNA, 13 nt, Homo sapiens
aggccucccucaa

SEQ ID NO: 1040224 - RNA, 15 nt, Homo sapiens
aggccucuguggcac

SEQ ID NO: 1040225 - RNA, 17 nt, Homo sapiens
aggccuugcucacagcu

SEQ ID NO: 1040226 - RNA, 20 nt, Homo sapiens
aggcgggagcaucucuugag

SEQ ID NO: 1040227 - RNA, 20 nt, Homo sapiens
aggcggguggaucacuugag

SEQ ID NO: 1040228 - RNA, 20 nt, Homo sapiens
aggcgugagccaccgcgccu

SEQ ID NO: 1040229 - RNA, 14 nt, Homo sapiens
aggcucagcacuuu

SEQ ID NO: 1040230 - RNA, 20 nt, Homo sapiens
aggcuccaggagcagccaca

SEQ ID NO: 1040231 - RNA, 14 nt, Homo sapiens
aggcuccugugcua

SEQ ID NO: 1040232 - RNA, 19 nt, Homo sapiens
aggcuccugugcuacuuug

SEQ ID NO: 1040233 - RNA, 15 nt, Homo sapiens
aggcucgagcaugcc

SEQ ID NO: 1040234 - RNA, 17 nt, Homo sapiens
aggcucguugacuggcu

SEQ ID NO: 1040235 - RNA, 15 nt, Homo sapiens
aggcucucacuccag

SEQ ID NO: 1040236 - RNA, 15 nt, Homo sapiens
aggcugacuaagaau

SEQ ID NO: 1040237 - RNA, 15 nt, Homo sapiens
aggcugacuuuugca

SEQ ID NO: 1040238 - RNA, 14 nt, Homo sapiens
aggcugaggacuua

SEQ ID NO: 1040239 - RNA, 19 nt, Homo sapiens
aggcugaggggaggaucac

SEQ ID NO: 1040240 - RNA, 13 nt, Homo sapiens
aggcugcagugag

SEQ ID NO: 1040241 - RNA, 18 nt, Homo sapiens
aggcugcgacugaugaag

SEQ ID NO: 1040242 - RNA, 19 nt, Homo sapiens
aggcugcgacugaugaagg

SEQ ID NO: 1040243 - RNA, 18 nt, Homo sapiens
aggcugcuggacacgucg

SEQ ID NO: 1040244 - RNA, 19 nt, Homo sapiens
aggcuggagugcaaugcac

SEQ ID NO: 1040245 - RNA, 15 nt, Homo sapiens
aggcuggagugcagu

SEQ ID NO: 1040246 - RNA, 17 nt, Homo sapiens
aggcuggauccuagccu

SEQ ID NO: 1040247 - RNA, 17 nt, Homo sapiens
aggcugggccugaacua

SEQ ID NO: 1040248 - RNA, 21 nt, Homo sapiens
aggcuggggcugaccuuccuc

SEQ ID NO: 1040249 - RNA, 22 nt, Homo sapiens
aggcuguucaccaccaucucca

SEQ ID NO: 1040250 - RNA, 19 nt, Homo sapiens
aggcuucaguuuuacucug

SEQ ID NO: 1040251 - RNA, 13 nt, Homo sapiens
agggaaaaaccag

SEQ ID NO: 1040252 - RNA, 16 nt, Homo sapiens
agggaaaacauuccau

SEQ ID NO: 1040253 - RNA, 13 nt, Homo sapiens
agggaaaagcagc

SEQ ID NO: 1040254 - RNA, 18 nt, Homo sapiens
agggaaaauuauuugcau

SEQ ID NO: 1040255 - RNA, 15 nt, Homo sapiens
agggaaacacagcag

SEQ ID NO: 1040256 - RNA, 18 nt, Homo sapiens
agggaagccccacuugaa

SEQ ID NO: 1040257 - RNA, 18 nt, Homo sapiens
agggaagcugucccucac

SEQ ID NO: 1040258 - RNA, 22 nt, Homo sapiens
agggaaggaacucuggcuucca

SEQ ID NO: 1040259 - RNA, 20 nt, Homo sapiens
agggacaggcuccucugggg

SEQ ID NO: 1040260 - RNA, 18 nt, Homo sapiens
agggaccaaggaccccuc

SEQ ID NO: 1040261 - RNA, 20 nt, Homo sapiens
agggacugacaaaagacuug

SEQ ID NO: 1040262 - RNA, 22 nt, Homo sapiens
agggacuucugucuucacaaca

SEQ ID NO: 1040263 - RNA, 17 nt, Homo sapiens
agggacuuuagagaaua

SEQ ID NO: 1040264 - RNA, 15 nt, Homo sapiens
agggagagccaucac

SEQ ID NO: 1040265 - RNA, 14 nt, Homo sapiens
agggagcacugggu

SEQ ID NO: 1040266 - RNA, 16 nt, Homo sapiens
agggagccgagaucac

SEQ ID NO: 1040267 - RNA, 14 nt, Homo sapiens
agggagcuggaaaa

SEQ ID NO: 1040268 - RNA, 19 nt, Homo sapiens
agggaggaggccaccucuc

SEQ ID NO: 1040269 - RNA, 21 nt, Homo sapiens
agggagguuaagugacuugcc

SEQ ID NO: 1040270 - RNA, 17 nt, Homo sapiens
agggagugggcuaagca

SEQ ID NO: 1040271 - RNA, 17 nt, Homo sapiens
agggauagcacugagca

SEQ ID NO: 1040272 - RNA, 19 nt, Homo sapiens
agggaucuugcauucccag

SEQ ID NO: 1040273 - RNA, 17 nt, Homo sapiens
agggaugcugccugagu

SEQ ID NO: 1040274 - RNA, 23 nt, Homo sapiens
agggcaacaauacaugcugcuaa

SEQ ID NO: 1040275 - RNA, 15 nt, Homo sapiens
agggcagaaagguuc

SEQ ID NO: 1040276 - RNA, 20 nt, Homo sapiens
agggcagggcuggcaccucu

SEQ ID NO: 1040277 - RNA, 12 nt, Homo sapiens
agggcauugcuu

SEQ ID NO: 1040278 - RNA, 14 nt, Homo sapiens
agggccacauggga

SEQ ID NO: 1040279 - RNA, 17 nt, Homo sapiens
agggcuagaaccuggaa

SEQ ID NO: 1040280 - RNA, 23 nt, Homo sapiens
agggcuagaaccuggagagcuag

SEQ ID NO: 1040281 - RNA, 15 nt, Homo sapiens
agggcugaaagccau

SEQ ID NO: 1040282 - RNA, 17 nt, Homo sapiens
agggcuugagguuggug

SEQ ID NO: 1040283 - RNA, 23 nt, Homo sapiens
aggggagcaaaaucgaugcagug

SEQ ID NO: 1040284 - RNA, 13 nt, Homo sapiens
aggggcacagggu

SEQ ID NO: 1040285 - RNA, 22 nt, Homo sapiens
aggggcccaaauucuuucagug

SEQ ID NO: 1040286 - RNA, 14 nt, Homo sapiens
aggggcccacaggg

SEQ ID NO: 1040287 - RNA, 19 nt, Homo sapiens
aggggccucagguuugccu

SEQ ID NO: 1040288 - RNA, 21 nt, Homo sapiens
aggggcugaaagaacauggac

SEQ ID NO: 1040289 - RNA, 14 nt, Homo sapiens
aggggcuggcacug

SEQ ID NO: 1040290 - RNA, 22 nt, Homo sapiens
aggggcuuguugcaggcugugg

SEQ ID NO: 1040291 - RNA, 19 nt, Homo sapiens
agggguacauuucccugug

SEQ ID NO: 1040292 - RNA, 22 nt, Homo sapiens
agggguacauuucccugugcug

SEQ ID NO: 1040293 - RNA, 21 nt, Homo sapiens
aggggucugguggucucugcu

SEQ ID NO: 1040294 - RNA, 15 nt, Homo sapiens
ucacugcagccucaa

SEQ ID NO: 1040295 - RNA, 22 nt, Homo sapiens
ucacugcaggggucuggugguc

SEQ ID NO: 1040296 - RNA, 16 nt, Homo sapiens
ucacugccauauacuc

SEQ ID NO: 1040297 - RNA, 14 nt, Homo sapiens
ucacugcucaagaa

SEQ ID NO: 1040298 - RNA, 16 nt, Homo sapiens
ucacugcuuaacuuca

SEQ ID NO: 1040299 - RNA, 17 nt, Homo sapiens
ucacugucccucaaaug

SEQ ID NO: 1040300 - RNA, 13 nt, Homo sapiens
ucacuguccucca

SEQ ID NO: 1040301 - RNA, 16 nt, Homo sapiens
ucacuguuucucugcu

SEQ ID NO: 1040302 - RNA, 18 nt, Homo sapiens
ucacuuauccuguucucu

SEQ ID NO: 1040303 - RNA, 13 nt, Homo sapiens
ucacuucaguugc

SEQ ID NO: 1040304 - RNA, 15 nt, Homo sapiens
ucacuucauaaucca

SEQ ID NO: 1040305 - RNA, 15 nt, Homo sapiens
ucacuucauagcuca

SEQ ID NO: 1040306 - RNA, 18 nt, Homo sapiens
ucacuucccuacauggag

SEQ ID NO: 1040307 - RNA, 15 nt, Homo sapiens
ucacuuccuauaugc

SEQ ID NO: 1040308 - RNA, 19 nt, Homo sapiens
ucacuuccuauaugcacuu

SEQ ID NO: 1040309 - RNA, 17 nt, Homo sapiens
ucacuugaggucaggag

SEQ ID NO: 1040310 - RNA, 19 nt, Homo sapiens
ucacuugugccaacacuca

SEQ ID NO: 1040311 - RNA, 20 nt, Homo sapiens
ucacuuuacaaauucaagcc

SEQ ID NO: 1040312 - RNA, 14 nt, Homo sapiens
ucacuuuuagggag

SEQ ID NO: 1040313 - RNA, 15 nt, Homo sapiens
ucagaaacagugagu

SEQ ID NO: 1040314 - RNA, 16 nt, Homo sapiens
ucagaaacgaaaucua

SEQ ID NO: 1040315 - RNA, 23 nt, Homo sapiens
ucagaaagugcauuaaacugaau

SEQ ID NO: 1040316 - RNA, 17 nt, Homo sapiens
ucagaaauguguuauca

SEQ ID NO: 1040317 - RNA, 15 nt, Homo sapiens
ucagaagacacugca

SEQ ID NO: 1040318 - RNA, 23 nt, Homo sapiens
ucagaagcaucgcuccucuccag

SEQ ID NO: 1040319 - RNA, 15 nt, Homo sapiens
ucagaagcucuucua

SEQ ID NO: 1040320 - RNA, 16 nt, Homo sapiens
ucagaauauacccauc

SEQ ID NO: 1040321 - RNA, 17 nt, Homo sapiens
ucagaauggauuuauca

SEQ ID NO: 1040322 - RNA, 11 nt, Homo sapiens
ucagacacucu

SEQ ID NO: 1040323 - RNA, 19 nt, Homo sapiens
ucagacagcugccugggau

SEQ ID NO: 1040324 - RNA, 16 nt, Homo sapiens
ucagacuccugugcaa

SEQ ID NO: 1040325 - RNA, 17 nt, Homo sapiens
ucagagaaauacuuuca

SEQ ID NO: 1040326 - RNA, 19 nt, Homo sapiens
ucagagagggcaggcauga

SEQ ID NO: 1040327 - RNA, 14 nt, Homo sapiens
ucagagaugugcac

SEQ ID NO: 1040328 - RNA, 14 nt, Homo sapiens
ucagagcacagcag

SEQ ID NO: 1040329 - RNA, 20 nt, Homo sapiens
ucagaggagcggccagaaga

SEQ ID NO: 1040330 - RNA, 18 nt, Homo sapiens
ucagauaaacaacaaaua

SEQ ID NO: 1040331 - RNA, 22 nt, Homo sapiens
ucagauaaagcacccuguauca

SEQ ID NO: 1040332 - RNA, 15 nt, Homo sapiens
ucagauaaauuguau

SEQ ID NO: 1040333 - RNA, 21 nt, Homo sapiens
ucagauauuuuuucagaaaua

SEQ ID NO: 1040334 - RNA, 17 nt, Homo sapiens
ucagaucauauuucaca

SEQ ID NO: 1040335 - RNA, 15 nt, Homo sapiens
ucagaucauggcauc

SEQ ID NO: 1040336 - RNA, 20 nt, Homo sapiens
ucagauuguuaucuaucaac

SEQ ID NO: 1040337 - RNA, 12 nt, Homo sapiens
ucagauuugccu

SEQ ID NO: 1040338 - RNA, 15 nt, Homo sapiens
ucagauuuguguuau

SEQ ID NO: 1040339 - RNA, 19 nt, Homo sapiens
ucagcaauacagacuacuu

SEQ ID NO: 1040340 - RNA, 17 nt, Homo sapiens
ucagcaauacuaaggga

SEQ ID NO: 1040341 - RNA, 20 nt, Homo sapiens
ucagcaccccugucucuagc

SEQ ID NO: 1040342 - RNA, 18 nt, Homo sapiens
ucagcacuccucaucauc

SEQ ID NO: 1040343 - RNA, 15 nt, Homo sapiens
ucagcagagaacugg

SEQ ID NO: 1040344 - RNA, 11 nt, Homo sapiens
ucagcagcuau

SEQ ID NO: 1040345 - RNA, 23 nt, Homo sapiens
ucagcagcuauuugaaugagaug

SEQ ID NO: 1040346 - RNA, 15 nt, Homo sapiens
aggugucugcaccca

SEQ ID NO: 1040347 - RNA, 23 nt, Homo sapiens
agguguucuucauuaccucagug

SEQ ID NO: 1040348 - RNA, 15 nt, Homo sapiens
agguguuuaguugca

SEQ ID NO: 1040349 - RNA, 13 nt, Homo sapiens
agguuagaaccua

SEQ ID NO: 1040350 - RNA, 19 nt, Homo sapiens
agguuauagaguagaagau

SEQ ID NO: 1040351 - RNA, 18 nt, Homo sapiens
agguucuuagugucacuu

SEQ ID NO: 1040352 - RNA, 15 nt, Homo sapiens
agguuggacuggaaa

SEQ ID NO: 1040353 - RNA, 16 nt, Homo sapiens
agguugggaaugaggc

SEQ ID NO: 1040354 - RNA, 22 nt, Homo sapiens
agguuguggugagccaacauca

SEQ ID NO: 1040355 - RNA, 19 nt, Homo sapiens
agguuucuggcagccagua

SEQ ID NO: 1040356 - RNA, 17 nt, Homo sapiens
agguuuuaaagugauua

SEQ ID NO: 1040357 - RNA, 15 nt, Homo sapiens
aguaaaaaucaauac

SEQ ID NO: 1040358 - RNA, 13 nt, Homo sapiens
aguaaacaaugaa

SEQ ID NO: 1040359 - RNA, 17 nt, Homo sapiens
aguaacaggaaaccacu

SEQ ID NO: 1040360 - RNA, 14 nt, Homo sapiens
aguaacaguuguga

SEQ ID NO: 1040361 - RNA, 11 nt, Homo sapiens
aguaacaugug

SEQ ID NO: 1040362 - RNA, 12 nt, Homo sapiens
aguaacauuugc

SEQ ID NO: 1040363 - RNA, 22 nt, Homo sapiens
aguaaccuggguaaaugcagcg

SEQ ID NO: 1040364 - RNA, 13 nt, Homo sapiens
aguaacugagauu

SEQ ID NO: 1040365 - RNA, 11 nt, Homo sapiens
aguaagcccuu

SEQ ID NO: 1040366 - RNA, 13 nt, Homo sapiens
aguaaguacgugu

SEQ ID NO: 1040367 - RNA, 22 nt, Homo sapiens
aguaaguuugauuucauuaaua

SEQ ID NO: 1040368 - RNA, 21 nt, Homo sapiens
aguaaugaauuuuuaugauau

SEQ ID NO: 1040369 - RNA, 13 nt, Homo sapiens
aguaaugaugucg

SEQ ID NO: 1040370 - RNA, 18 nt, Homo sapiens
aguaauucugcugucuca

SEQ ID NO: 1040371 - RNA, 16 nt, Homo sapiens
aguacaccccaacagc

SEQ ID NO: 1040372 - RNA, 23 nt, Homo sapiens
aguacacuguuucaaacuuuacu

SEQ ID NO: 1040373 - RNA, 13 nt, Homo sapiens
aguacagacuuuu

SEQ ID NO: 1040374 - RNA, 14 nt, Homo sapiens
aguacagacuuuuu

SEQ ID NO: 1040375 - RNA, 13 nt, Homo sapiens
aguacaggugaag

SEQ ID NO: 1040376 - RNA, 18 nt, Homo sapiens
aguacagugagccaagau

SEQ ID NO: 1040377 - RNA, 17 nt, Homo sapiens
aguacauggucaaguau

SEQ ID NO: 1040378 - RNA, 22 nt, Homo sapiens
aguaccuuuccauuuauucuuu

SEQ ID NO: 1040379 - RNA, 21 nt, Homo sapiens
aguacguguuauuuuuuucaa

SEQ ID NO: 1040380 - RNA, 17 nt, Homo sapiens
aguacuggcaugguacg

SEQ ID NO: 1040381 - RNA, 13 nt, Homo sapiens
aguagacaagcaa

SEQ ID NO: 1040382 - RNA, 14 nt, Homo sapiens
aguagagacagggu

SEQ ID NO: 1040383 - RNA, 16 nt, Homo sapiens
aguagcauacauuuau

SEQ ID NO: 1040384 - RNA, 15 nt, Homo sapiens
aguaggaggccucca

SEQ ID NO: 1040385 - RNA, 15 nt, Homo sapiens
aguaggauccaguga

SEQ ID NO: 1040386 - RNA, 22 nt, Homo sapiens
aguagguuuacauucaucucau

SEQ ID NO: 1040387 - RNA, 14 nt, Homo sapiens
aguaguaucaauga

SEQ ID NO: 1040388 - RNA, 13 nt, Homo sapiens
aguagucauuuca

SEQ ID NO: 1040389 - RNA, 12 nt, Homo sapiens
aguagucucugu

SEQ ID NO: 1040390 - RNA, 19 nt, Homo sapiens
aguaguugguuuccuucac

SEQ ID NO: 1040391 - RNA, 14 nt, Homo sapiens
aguauaauuuaacu

SEQ ID NO: 1040392 - RNA, 20 nt, Homo sapiens
aguaucaaauauuagaugug

SEQ ID NO: 1040393 - RNA, 12 nt, Homo sapiens
aguaugcauuaa

SEQ ID NO: 1040394 - RNA, 22 nt, Homo sapiens
aguaugcuuaaugguagcaacu

SEQ ID NO: 1040395 - RNA, 20 nt, Homo sapiens
aguauuaagugacagugcua

SEQ ID NO: 1040396 - RNA, 20 nt, Homo sapiens
aguauuacaaaaacauggcc

SEQ ID NO: 1040397 - RNA, 18 nt, Homo sapiens
aguauuucaugcugggaa

SEQ ID NO: 1040398 - RNA, 16 nt, Homo sapiens
aguauuugcauauucu

SEQ ID NO: 1040399 - RNA, 15 nt, Homo sapiens
agucaaaacagagau

SEQ ID NO: 1040400 - RNA, 13 nt, Homo sapiens
agucaaagacauu

SEQ ID NO: 1040401 - RNA, 15 nt, Homo sapiens
agucaagauuuccau

SEQ ID NO: 1040402 - RNA, 22 nt, Homo sapiens
agucaauccaagagucugauga

SEQ ID NO: 1040403 - RNA, 21 nt, Homo sapiens
agucacacgggggcagcugau

SEQ ID NO: 1040404 - RNA, 20 nt, Homo sapiens
agucacagagauaauucuag

SEQ ID NO: 1040405 - RNA, 17 nt, Homo sapiens
agucacucaucucagaa

SEQ ID NO: 1040406 - RNA, 17 nt, Homo sapiens
agucacuugaugugcca

SEQ ID NO: 1040407 - RNA, 23 nt, Homo sapiens
agucagaggauggccagugucug

SEQ ID NO: 1040408 - RNA, 17 nt, Homo sapiens
agucagaguugugcaca

SEQ ID NO: 1040409 - RNA, 14 nt, Homo sapiens
agucauauaccuau

SEQ ID NO: 1040410 - RNA, 13 nt, Homo sapiens
agucauauugccc

SEQ ID NO: 1040411 - RNA, 16 nt, Homo sapiens
agucauccucagauca

SEQ ID NO: 1040412 - RNA, 14 nt, Homo sapiens
agucauccugccaa

SEQ ID NO: 1040413 - RNA, 13 nt, Homo sapiens
agucaugccaagc

SEQ ID NO: 1040414 - RNA, 17 nt, Homo sapiens
agucauggcaccaaagc

SEQ ID NO: 1040415 - RNA, 17 nt, Homo sapiens
aguccaaaccacuccac

SEQ ID NO: 1040416 - RNA, 23 nt, Homo sapiens
aguccaaggaaaccacagcugcu

SEQ ID NO: 1040417 - RNA, 13 nt, Homo sapiens
aguccacugcuga

SEQ ID NO: 1040418 - RNA, 20 nt, Homo sapiens
aguccagagcuggaucucuc

SEQ ID NO: 1040419 - RNA, 21 nt, Homo sapiens
aguccagagcuggaucucuca

SEQ ID NO: 1040420 - RNA, 13 nt, Homo sapiens
aguccagauuuac

SEQ ID NO: 1040421 - RNA, 18 nt, Homo sapiens
aguccagauuuacacugg

SEQ ID NO: 1040422 - RNA, 20 nt, Homo sapiens
aguccagauuuacacuggga

SEQ ID NO: 1040423 - RNA, 20 nt, Homo sapiens
aguccagccuggagaugaaa

SEQ ID NO: 1040424 - RNA, 21 nt, Homo sapiens
aguccagccuggcaaggguuc

SEQ ID NO: 1040425 - RNA, 20 nt, Homo sapiens
agucccauccucuugucagg

SEQ ID NO: 1040426 - RNA, 20 nt, Homo sapiens
agucccuaaaaacacagaca

SEQ ID NO: 1040427 - RNA, 17 nt, Homo sapiens
aguccuagccacucagg

SEQ ID NO: 1040428 - RNA, 23 nt, Homo sapiens
aguccucuggauggcaccagagg

SEQ ID NO: 1040429 - RNA, 20 nt, Homo sapiens
aguccuggaagccagcuuuc

SEQ ID NO: 1040430 - RNA, 17 nt, Homo sapiens
aguccuucccuuucauu

SEQ ID NO: 1040431 - RNA, 16 nt, Homo sapiens
aguccuugcuuggcug

SEQ ID NO: 1040432 - RNA, 19 nt, Homo sapiens
aguccuuucuaaguauuuu

SEQ ID NO: 1040433 - RNA, 21 nt, Homo sapiens
agucuacuugaggcugcaauc

SEQ ID NO: 1040434 - RNA, 23 nt, Homo sapiens
agucucaccuccugccauagggu

SEQ ID NO: 1040435 - RNA, 16 nt, Homo sapiens
agucucacuguugccc

SEQ ID NO: 1040436 - RNA, 14 nt, Homo sapiens
agucucaggaccua

SEQ ID NO: 1040437 - RNA, 16 nt, Homo sapiens
agucucccuucuccca

SEQ ID NO: 1040438 - RNA, 19 nt, Homo sapiens
agucucgcucugucaccca

SEQ ID NO: 1040439 - RNA, 16 nt, Homo sapiens
agucucuagguucuga

SEQ ID NO: 1040440 - RNA, 17 nt, Homo sapiens
agucucuucugcuggca

SEQ ID NO: 1040441 - RNA, 16 nt, Homo sapiens
agucugcaacuuuaag

SEQ ID NO: 1040442 - RNA, 12 nt, Homo sapiens
agucugcacuua

SEQ ID NO: 1040443 - RNA, 15 nt, Homo sapiens
agucugucucuguca

SEQ ID NO: 1040444 - RNA, 19 nt, Homo sapiens
agucuuccucccuguguau

SEQ ID NO: 1040445 - RNA, 21 nt, Homo sapiens
agucuucucauagcauuaacu

SEQ ID NO: 1040446 - RNA, 20 nt, Homo sapiens
agucuuuauuguguaucaua

SEQ ID NO: 1040447 - RNA, 19 nt, Homo sapiens
agucuuugguaaauggcaa

SEQ ID NO: 1040448 - RNA, 23 nt, Homo sapiens
ucaugguuuccuccagaggagac

SEQ ID NO: 1040449 - RNA, 14 nt, Homo sapiens
ucauguaacuagaa

SEQ ID NO: 1040450 - RNA, 20 nt, Homo sapiens
ucaugugaucacaauuugca

SEQ ID NO: 1040451 - RNA, 16 nt, Homo sapiens
ucauguucacugcaau

SEQ ID NO: 1040452 - RNA, 14 nt, Homo sapiens
ucauguuccucaaa

SEQ ID NO: 1040453 - RNA, 19 nt, Homo sapiens
ucauguuuacagaggacag

SEQ ID NO: 1040454 - RNA, 19 nt, Homo sapiens
ucauguuugcuucauaaau

SEQ ID NO: 1040455 - RNA, 23 nt, Homo sapiens
ucauuaaugacacuuguccccaa

SEQ ID NO: 1040456 - RNA, 17 nt, Homo sapiens
ucauuagcauuuugcua

SEQ ID NO: 1040457 - RNA, 20 nt, Homo sapiens
ucauuauaaacgugaugauc

SEQ ID NO: 1040458 - RNA, 13 nt, Homo sapiens
ucauuauuggaau

SEQ ID NO: 1040459 - RNA, 20 nt, Homo sapiens
ucauucaauaaauuguaauu

SEQ ID NO: 1040460 - RNA, 21 nt, Homo sapiens
ucauuccugaaagaaacaguu

SEQ ID NO: 1040461 - RNA, 18 nt, Homo sapiens
ucauugacaagaacugaa

SEQ ID NO: 1040462 - RNA, 20 nt, Homo sapiens
ucauugaccugaggcccuuc

SEQ ID NO: 1040463 - RNA, 14 nt, Homo sapiens
ucauugacugaugg

SEQ ID NO: 1040464 - RNA, 15 nt, Homo sapiens
ucauugcacuuugau

SEQ ID NO: 1040465 - RNA, 24 nt, Homo sapiens
ucauugcccccagggcacuucaca

SEQ ID NO: 1040466 - RNA, 22 nt, Homo sapiens
ucauuggaccuguucaaaaagg

SEQ ID NO: 1040467 - RNA, 16 nt, Homo sapiens
ucauuguuguuaauag

SEQ ID NO: 1040468 - RNA, 13 nt, Homo sapiens
ucauuuacugugg

SEQ ID NO: 1040469 - RNA, 14 nt, Homo sapiens
ucauuuagaacuug

SEQ ID NO: 1040470 - RNA, 21 nt, Homo sapiens
ucauuuauuauuucaauguga

SEQ ID NO: 1040471 - RNA, 14 nt, Homo sapiens
ucauuucaaaggga

SEQ ID NO: 1040472 - RNA, 17 nt, Homo sapiens
ucauuucaaauacaucu

SEQ ID NO: 1040473 - RNA, 22 nt, Homo sapiens
ucauuucacuuuacacgcucau

SEQ ID NO: 1040474 - RNA, 17 nt, Homo sapiens
ucauuucagauaaacaa

SEQ ID NO: 1040475 - RNA, 21 nt, Homo sapiens
ucauuuccuauguaacugcau

SEQ ID NO: 1040476 - RNA, 14 nt, Homo sapiens
ucauuugaugcuaa

SEQ ID NO: 1040477 - RNA, 20 nt, Homo sapiens
ucauuuuaaaaaauggaaca

SEQ ID NO: 1040478 - RNA, 14 nt, Homo sapiens
ucauuuugcucaac

SEQ ID NO: 1040479 - RNA, 23 nt, Homo sapiens
ucauuuuuuucacuggaguuaca

SEQ ID NO: 1040480 - RNA, 12 nt, Homo sapiens
uccaaaacuccu

SEQ ID NO: 1040481 - RNA, 14 nt, Homo sapiens
uccaaaagcacuua

SEQ ID NO: 1040482 - RNA, 12 nt, Homo sapiens
uccaaaccucca

SEQ ID NO: 1040483 - RNA, 19 nt, Homo sapiens
uccaaaccuccacugcugc

SEQ ID NO: 1040484 - RNA, 17 nt, Homo sapiens
uccaaaggaaucuccag

SEQ ID NO: 1040485 - RNA, 14 nt, Homo sapiens
uccaaaggccaugg

SEQ ID NO: 1040486 - RNA, 17 nt, Homo sapiens
uccaaaguacacuguuu

SEQ ID NO: 1040487 - RNA, 15 nt, Homo sapiens
uccaaauguccucca

SEQ ID NO: 1040488 - RNA, 14 nt, Homo sapiens
uccaacaccacaga

SEQ ID NO: 1040489 - RNA, 17 nt, Homo sapiens
uccaacaccacagacac

SEQ ID NO: 1040490 - RNA, 15 nt, Homo sapiens
uccaacaugugcuca

SEQ ID NO: 1040491 - RNA, 17 nt, Homo sapiens
agugcuuguuccucuca

SEQ ID NO: 1040492 - RNA, 22 nt, Homo sapiens
aguggaaagacagcuucucauc

SEQ ID NO: 1040493 - RNA, 14 nt, Homo sapiens
aguggaaggcauca

SEQ ID NO: 1040494 - RNA, 12 nt, Homo sapiens
aguggacuggag

SEQ ID NO: 1040495 - RNA, 20 nt, Homo sapiens
aguggagcaaucucggcuca

SEQ ID NO: 1040496 - RNA, 12 nt, Homo sapiens
aguggagccaug

SEQ ID NO: 1040497 - RNA, 15 nt, Homo sapiens
aguggaguggaagaa

SEQ ID NO: 1040498 - RNA, 16 nt, Homo sapiens
aguggauuacugccau

SEQ ID NO: 1040499 - RNA, 14 nt, Homo sapiens
aguggcuucaucug

SEQ ID NO: 1040500 - RNA, 21 nt, Homo sapiens
aguggcuuuuuuccuccugug

SEQ ID NO: 1040501 - RNA, 19 nt, Homo sapiens
agugggaaauauuuagcaa

SEQ ID NO: 1040502 - RNA, 20 nt, Homo sapiens
agugggagcugaguggggga

SEQ ID NO: 1040503 - RNA, 15 nt, Homo sapiens
agugggggaucacag

SEQ ID NO: 1040504 - RNA, 13 nt, Homo sapiens
aguggguggugga

SEQ ID NO: 1040505 - RNA, 13 nt, Homo sapiens
agugguagguuaa

SEQ ID NO: 1040506 - RNA, 15 nt, Homo sapiens
agugguguucagcca

SEQ ID NO: 1040507 - RNA, 13 nt, Homo sapiens
agugguuacccag

SEQ ID NO: 1040508 - RNA, 20 nt, Homo sapiens
agugguuguuuugucaugaa

SEQ ID NO: 1040509 - RNA, 15 nt, Homo sapiens
aguguaaacaccaua

SEQ ID NO: 1040510 - RNA, 15 nt, Homo sapiens
aguguaccagagaag

SEQ ID NO: 1040511 - RNA, 16 nt, Homo sapiens
aguguagccuugcccg

SEQ ID NO: 1040512 - RNA, 17 nt, Homo sapiens
aguguaugcacgugugc

SEQ ID NO: 1040513 - RNA, 21 nt, Homo sapiens
aguguauuuuauguguggccc

SEQ ID NO: 1040514 - RNA, 23 nt, Homo sapiens
agugucaccccucacugugacug

SEQ ID NO: 1040515 - RNA, 21 nt, Homo sapiens
agugucaugucagcaucagcu

SEQ ID NO: 1040516 - RNA, 22 nt, Homo sapiens
agugucccccuuguggaaccaa

SEQ ID NO: 1040517 - RNA, 20 nt, Homo sapiens
aguguccccuccacugucac

SEQ ID NO: 1040518 - RNA, 14 nt, Homo sapiens
aguguccucuugcu

SEQ ID NO: 1040519 - RNA, 12 nt, Homo sapiens
agugugauccca

SEQ ID NO: 1040520 - RNA, 14 nt, Homo sapiens
agugugaucccaag

SEQ ID NO: 1040521 - RNA, 12 nt, Homo sapiens
aguguggaacca

SEQ ID NO: 1040522 - RNA, 14 nt, Homo sapiens
aguguguaugugcg

SEQ ID NO: 1040523 - RNA, 13 nt, Homo sapiens
agugugugugcgu

SEQ ID NO: 1040524 - RNA, 16 nt, Homo sapiens
aguguguuuccuucag

SEQ ID NO: 1040525 - RNA, 17 nt, Homo sapiens
aguguuaucagucauaa

SEQ ID NO: 1040526 - RNA, 22 nt, Homo sapiens
aguguuaucagucauaacuaaa

SEQ ID NO: 1040527 - RNA, 23 nt, Homo sapiens
aguguugcccaggcuggucucaa

SEQ ID NO: 1040528 - RNA, 22 nt, Homo sapiens
aguguuuacaaggugacaaaug

SEQ ID NO: 1040529 - RNA, 23 nt, Homo sapiens
aguguuuggguauauucauuuca

SEQ ID NO: 1040530 - RNA, 22 nt, Homo sapiens
aguuaaaaauaaaaaacauaua

SEQ ID NO: 1040531 - RNA, 23 nt, Homo sapiens
aguuaaagugaauaaccacuuaa

SEQ ID NO: 1040532 - RNA, 14 nt, Homo sapiens
aguuaacaaugaua

SEQ ID NO: 1040533 - RNA, 18 nt, Homo sapiens
aguuaagaagcuguugua

SEQ ID NO: 1040534 - RNA, 16 nt, Homo sapiens
aguuaagcaacaucua

SEQ ID NO: 1040535 - RNA, 13 nt, Homo sapiens
aguuacaaaaacc

SEQ ID NO: 1040536 - RNA, 12 nt, Homo sapiens
aguuacauauua

SEQ ID NO: 1040537 - RNA, 16 nt, Homo sapiens
aguuaccacaccccau

SEQ ID NO: 1040538 - RNA, 16 nt, Homo sapiens
aguuacuaccugucaa

SEQ ID NO: 1040539 - RNA, 13 nt, Homo sapiens
aguuacucauuca

SEQ ID NO: 1040540 - RNA, 18 nt, Homo sapiens
aguuacucauucagggau

SEQ ID NO: 1040541 - RNA, 15 nt, Homo sapiens
aguuagguagcuuua

SEQ ID NO: 1040542 - RNA, 20 nt, Homo sapiens
aguuaugguuuuccaucuua

SEQ ID NO: 1040543 - RNA, 13 nt, Homo sapiens
aguuauuuuuaca

SEQ ID NO: 1040544 - RNA, 22 nt, Homo sapiens
aguucaaauucuucugaacuca

SEQ ID NO: 1040545 - RNA, 19 nt, Homo sapiens
aguucaauaaaugucuguu

SEQ ID NO: 1040546 - RNA, 11 nt, Homo sapiens
aguucaaugau

SEQ ID NO: 1040547 - RNA, 16 nt, Homo sapiens
aguucaauggcugcug

SEQ ID NO: 1040548 - RNA, 18 nt, Homo sapiens
aguucaauggcugcugaa

SEQ ID NO: 1040549 - RNA, 16 nt, Homo sapiens
aguucaccugcacuua

SEQ ID NO: 1040550 - RNA, 22 nt, Homo sapiens
aguucagaaucacuucugagaa

SEQ ID NO: 1040551 - RNA, 16 nt, Homo sapiens
aguucauauguaccau

SEQ ID NO: 1040552 - RNA, 18 nt, Homo sapiens
aguucauauguaccaugu

SEQ ID NO: 1040553 - RNA, 13 nt, Homo sapiens
aguucccuuggcc

SEQ ID NO: 1040554 - RNA, 23 nt, Homo sapiens
aguuccucauuuuugaauacagg

SEQ ID NO: 1040555 - RNA, 15 nt, Homo sapiens
aguuccuucagcuuc

SEQ ID NO: 1040556 - RNA, 23 nt, Homo sapiens
aguucucaucccucugucagggu

SEQ ID NO: 1040557 - RNA, 13 nt, Homo sapiens
aguugaaacaaga

SEQ ID NO: 1040558 - RNA, 22 nt, Homo sapiens
aguugacuugacagaacacugu

SEQ ID NO: 1040559 - RNA, 17 nt, Homo sapiens
aguugauggugaugaaa

SEQ ID NO: 1040560 - RNA, 22 nt, Homo sapiens
aguugccaucugcgugacaaua

SEQ ID NO: 1040561 - RNA, 17 nt, Homo sapiens
aguugccguugaggguu

SEQ ID NO: 1040562 - RNA, 21 nt, Homo sapiens
aguugcguggacucugcacau

SEQ ID NO: 1040563 - RNA, 17 nt, Homo sapiens
aguugcugaugaacucu

SEQ ID NO: 1040564 - RNA, 20 nt, Homo sapiens
aguugcuuguaaaauuucac

SEQ ID NO: 1040565 - RNA, 23 nt, Homo sapiens
aguuguaccgcaaugugacuuaa

SEQ ID NO: 1040566 - RNA, 17 nt, Homo sapiens
aguugucuuuccuggca

SEQ ID NO: 1040567 - RNA, 11 nt, Homo sapiens
aguuguugaug

SEQ ID NO: 1040568 - RNA, 16 nt, Homo sapiens
aguuuaaccugaugca

SEQ ID NO: 1040569 - RNA, 22 nt, Homo sapiens
aguuuaaggaauaugggagaaa

SEQ ID NO: 1040570 - RNA, 14 nt, Homo sapiens
aguuuaccuaugua

SEQ ID NO: 1040571 - RNA, 12 nt, Homo sapiens
aguuuaccucuu

SEQ ID NO: 1040572 - RNA, 20 nt, Homo sapiens
aguuuauaaaugugaacuua

SEQ ID NO: 1040573 - RNA, 19 nt, Homo sapiens
aguuuauacuucucuauua

SEQ ID NO: 1040574 - RNA, 23 nt, Homo sapiens
aguuuauagaccagaaccagagc

SEQ ID NO: 1040575 - RNA, 16 nt, Homo sapiens
aguuuauaucucucau

SEQ ID NO: 1040576 - RNA, 20 nt, Homo sapiens
aguuuauaucucucaugcau

SEQ ID NO: 1040577 - RNA, 17 nt, Homo sapiens
aguuucaaaccuacuaa

SEQ ID NO: 1040578 - RNA, 15 nt, Homo sapiens
aguuucacaugagcu

SEQ ID NO: 1040579 - RNA, 14 nt, Homo sapiens
aguuucaucaguca

SEQ ID NO: 1040580 - RNA, 17 nt, Homo sapiens
aguuuccauauguuaua

SEQ ID NO: 1040581 - RNA, 12 nt, Homo sapiens
aguuucccugaa

SEQ ID NO: 1040582 - RNA, 20 nt, Homo sapiens
aguuucucagcucccauuuc

SEQ ID NO: 1040583 - RNA, 19 nt, Homo sapiens
aguuugagaccaaccuggg

SEQ ID NO: 1040584 - RNA, 16 nt, Homo sapiens
aguuugagaccagccu

SEQ ID NO: 1040585 - RNA, 13 nt, Homo sapiens
aguuugauuucau

SEQ ID NO: 1040586 - RNA, 11 nt, Homo sapiens
aguuugcaguu

SEQ ID NO: 1040587 - RNA, 22 nt, Homo sapiens
aguuuguacagacguaugcuua

SEQ ID NO: 1040588 - RNA, 12 nt, Homo sapiens
aguuuguuucau

SEQ ID NO: 1040589 - RNA, 22 nt, Homo sapiens
aguuuguuuuuaaaaaaaucua

SEQ ID NO: 1040590 - RNA, 15 nt, Homo sapiens
aguuuuaaauaagcu

SEQ ID NO: 1040591 - RNA, 23 nt, Homo sapiens
aguuuuaggacaaacagcucagu

SEQ ID NO: 1040592 - RNA, 18 nt, Homo sapiens
aguuuuauuuuuguagag

SEQ ID NO: 1040593 - RNA, 13 nt, Homo sapiens
aguuuuccaugaa

SEQ ID NO: 1040594 - RNA, 20 nt, Homo sapiens
aguuuucugcuuuaauuuca

SEQ ID NO: 1040595 - RNA, 13 nt, Homo sapiens
auaaaaaacaguc

SEQ ID NO: 1040596 - RNA, 14 nt, Homo sapiens
auaaaaacaaauac

SEQ ID NO: 1040597 - RNA, 12 nt, Homo sapiens
auaaaaauaccu

SEQ ID NO: 1040598 - RNA, 21 nt, Homo sapiens
auaaaagaaccgagcaauuuu

SEQ ID NO: 1040599 - RNA, 23 nt, Homo sapiens
auaaaauauuuuugaaaggcaug

SEQ ID NO: 1040600 - RNA, 15 nt, Homo sapiens
auaaaaucagaguug

SEQ ID NO: 1040601 - RNA, 14 nt, Homo sapiens
auaaaaugaaauac

SEQ ID NO: 1040602 - RNA, 19 nt, Homo sapiens
ucccauuucuacucuccca

SEQ ID NO: 1040603 - RNA, 17 nt, Homo sapiens
uccccacgaacuggccu

SEQ ID NO: 1040604 - RNA, 18 nt, Homo sapiens
uccccacugccugcugga

SEQ ID NO: 1040605 - RNA, 21 nt, Homo sapiens
uccccagcagggucuuuucau

SEQ ID NO: 1040606 - RNA, 22 nt, Homo sapiens
uccccaggagcagcaucucuga

SEQ ID NO: 1040607 - RNA, 21 nt, Homo sapiens
uccccaggguucaguccucaa

SEQ ID NO: 1040608 - RNA, 16 nt, Homo sapiens
uccccauccuccagcu

SEQ ID NO: 1040609 - RNA, 19 nt, Homo sapiens
uccccaucuggguccuugc

SEQ ID NO: 1040610 - RNA, 12 nt, Homo sapiens
uccccauugccu

SEQ ID NO: 1040611 - RNA, 23 nt, Homo sapiens
ucccccaccagcuaaggacauuu

SEQ ID NO: 1040612 - RNA, 12 nt, Homo sapiens
ucccccacugau

SEQ ID NO: 1040613 - RNA, 17 nt, Homo sapiens
ucccccucucugcccug

SEQ ID NO: 1040614 - RNA, 14 nt, Homo sapiens
ucccccucuuucac

SEQ ID NO: 1040615 - RNA, 17 nt, Homo sapiens
ucccccugcuugucuuc

SEQ ID NO: 1040616 - RNA, 14 nt, Homo sapiens
ucccccuuccaugg

SEQ ID NO: 1040617 - RNA, 16 nt, Homo sapiens
uccccuaaaccaaaaa

SEQ ID NO: 1040618 - RNA, 17 nt, Homo sapiens
uccccuaaaccaaaaac

SEQ ID NO: 1040619 - RNA, 22 nt, Homo sapiens
uccccuccacugucacauugua

SEQ ID NO: 1040620 - RNA, 13 nt, Homo sapiens
uccccucccucag

SEQ ID NO: 1040621 - RNA, 22 nt, Homo sapiens
uccccucccuggcucccaugac

SEQ ID NO: 1040622 - RNA, 20 nt, Homo sapiens
uccccuccguggcaucaccu

SEQ ID NO: 1040623 - RNA, 18 nt, Homo sapiens
uccccuccuugggcacuu

SEQ ID NO: 1040624 - RNA, 12 nt, Homo sapiens
uccccugcugaa

SEQ ID NO: 1040625 - RNA, 22 nt, Homo sapiens
uccccugcugaagguggggauu

SEQ ID NO: 1040626 - RNA, 22 nt, Homo sapiens
uccccuggggagucugggcaca

SEQ ID NO: 1040627 - RNA, 15 nt, Homo sapiens
uccccuuccauccca

SEQ ID NO: 1040628 - RNA, 18 nt, Homo sapiens
uccccuuuguguagaaag

SEQ ID NO: 1040629 - RNA, 15 nt, Homo sapiens
ucccggccauucucc

SEQ ID NO: 1040630 - RNA, 19 nt, Homo sapiens
ucccggcgucccuaccucc

SEQ ID NO: 1040631 - RNA, 14 nt, Homo sapiens
ucccuaaaaacaca

SEQ ID NO: 1040632 - RNA, 20 nt, Homo sapiens
ucccuacauggaguauaugu

SEQ ID NO: 1040633 - RNA, 12 nt, Homo sapiens
ucccuaccuccu

SEQ ID NO: 1040634 - RNA, 18 nt, Homo sapiens
ucccuagucuauucauua

SEQ ID NO: 1040635 - RNA, 19 nt, Homo sapiens
ucccuaucucgaacaugga

SEQ ID NO: 1040636 - RNA, 17 nt, Homo sapiens
ucggaggcuugggaccg

SEQ ID NO: 1040637 - RNA, 13 nt, Homo sapiens
ucggcacccugca

SEQ ID NO: 1040638 - RNA, 20 nt, Homo sapiens
ucgggaagagaggaguucaa

SEQ ID NO: 1040639 - RNA, 19 nt, Homo sapiens
ucgggaauacuagggagaa

SEQ ID NO: 1040640 - RNA, 18 nt, Homo sapiens
ucgggcgagucacugccu

SEQ ID NO: 1040641 - RNA, 13 nt, Homo sapiens
ucguagccaucuc

SEQ ID NO: 1040642 - RNA, 14 nt, Homo sapiens
ucguagccaucucu

SEQ ID NO: 1040643 - RNA, 18 nt, Homo sapiens
ucguauccccaagccaca

SEQ ID NO: 1040644 - RNA, 14 nt, Homo sapiens
ucgucugggcuccc

SEQ ID NO: 1040645 - RNA, 15 nt, Homo sapiens
ucgugacaacacuug

SEQ ID NO: 1040646 - RNA, 15 nt, Homo sapiens
ucgugcuaaacgcac

SEQ ID NO: 1040647 - RNA, 21 nt, Homo sapiens
ucguggguguguguagccaag

SEQ ID NO: 1040648 - RNA, 16 nt, Homo sapiens
ucuaaaaauccauaaa

SEQ ID NO: 1040649 - RNA, 22 nt, Homo sapiens
ucuaaaacauguuugcacuugu

SEQ ID NO: 1040650 - RNA, 17 nt, Homo sapiens
ucuaaaagguucaggga

SEQ ID NO: 1040651 - RNA, 19 nt, Homo sapiens
ucuaaauagccaacaccca

SEQ ID NO: 1040652 - RNA, 23 nt, Homo sapiens
ucuaaaugaagugcaaauuugau

SEQ ID NO: 1040653 - RNA, 23 nt, Homo sapiens
ucuaaaugcauauccugagccau

SEQ ID NO: 1040654 - RNA, 16 nt, Homo sapiens
ucuaacaaaaacuaca

SEQ ID NO: 1040655 - RNA, 15 nt, Homo sapiens
ucuaagaaagaaauu

SEQ ID NO: 1040656 - RNA, 20 nt, Homo sapiens
ucuaagccuucugguuuuau

SEQ ID NO: 1040657 - RNA, 19 nt, Homo sapiens
ucuaaggaauaugagcuuu

SEQ ID NO: 1040658 - RNA, 22 nt, Homo sapiens
ucuaaggaauaugagcuuuaug

SEQ ID NO: 1040659 - RNA, 14 nt, Homo sapiens
ucuaagggaccuca

SEQ ID NO: 1040660 - RNA, 19 nt, Homo sapiens
ucuaaguaaaaccacagca

SEQ ID NO: 1040661 - RNA, 14 nt, Homo sapiens
ucuaagucuuucca

SEQ ID NO: 1040662 - RNA, 22 nt, Homo sapiens
ucuaaucuuuuaauguauuugu

SEQ ID NO: 1040663 - RNA, 13 nt, Homo sapiens
ucuacacauacau

SEQ ID NO: 1040664 - RNA, 19 nt, Homo sapiens
ucuacagagcuucccugac

SEQ ID NO: 1040665 - RNA, 14 nt, Homo sapiens
ucuacagaggccau

SEQ ID NO: 1040666 - RNA, 15 nt, Homo sapiens
ucuacauacuaugga

SEQ ID NO: 1040667 - RNA, 13 nt, Homo sapiens
ucuacccaggugc

SEQ ID NO: 1040668 - RNA, 15 nt, Homo sapiens
ucuacccuggcacua

SEQ ID NO: 1040669 - RNA, 16 nt, Homo sapiens
ucuacuacaugugacu

SEQ ID NO: 1040670 - RNA, 16 nt, Homo sapiens
ucuacugaggugcuau

SEQ ID NO: 1040671 - RNA, 20 nt, Homo sapiens
ucuacugcccugagccugaa

SEQ ID NO: 1040672 - RNA, 22 nt, Homo sapiens
ucuacugugacugauguuacau

SEQ ID NO: 1040673 - RNA, 16 nt, Homo sapiens
ucuacuucugcccuug

SEQ ID NO: 1040674 - RNA, 15 nt, Homo sapiens
ucuagaaacagaucu

SEQ ID NO: 1040675 - RNA, 22 nt, Homo sapiens
ucuagacacugccacacagggu

SEQ ID NO: 1040676 - RNA, 15 nt, Homo sapiens
ucuagaggcaaggag

SEQ ID NO: 1040677 - RNA, 18 nt, Homo sapiens
ucuagauuuucuacuuua

SEQ ID NO: 1040678 - RNA, 14 nt, Homo sapiens
ucuaggugcccuug

SEQ ID NO: 1040679 - RNA, 16 nt, Homo sapiens
ucuagguuuaacucag

SEQ ID NO: 1040680 - RNA, 21 nt, Homo sapiens
ucuagugaaugaaucucaaga

SEQ ID NO: 1040681 - RNA, 17 nt, Homo sapiens
ucuaguuaacauuucaa

SEQ ID NO: 1040682 - RNA, 23 nt, Homo sapiens
ucuaguuaacauuucaagggcaa

SEQ ID NO: 1040683 - RNA, 15 nt, Homo sapiens
ucuaguuuugucaaa

SEQ ID NO: 1040684 - RNA, 16 nt, Homo sapiens
ucuauccucuguaaac

SEQ ID NO: 1040685 - RNA, 14 nt, Homo sapiens
ucuaugacacaugc

SEQ ID NO: 1040686 - RNA, 15 nt, Homo sapiens
ucuaugacacaugca

SEQ ID NO: 1040687 - RNA, 16 nt, Homo sapiens
ucuaugacacaugcaa

SEQ ID NO: 1040688 - RNA, 18 nt, Homo sapiens
ucuauggcacccaugcac

SEQ ID NO: 1040689 - RNA, 23 nt, Homo sapiens
ucuaugggacucaaugcacugac

SEQ ID NO: 1040690 - RNA, 19 nt, Homo sapiens
ucuauggguuggacaaccu

SEQ ID NO: 1040691 - RNA, 16 nt, Homo sapiens
ucuauuacgugcaaua

SEQ ID NO: 1040692 - RNA, 21 nt, Homo sapiens
ucuauugagugaacagaauug

SEQ ID NO: 1040693 - RNA, 22 nt, Homo sapiens
ucuauugcuggcaaagacagaa

SEQ ID NO: 1040694 - RNA, 19 nt, Homo sapiens
ucuauuucuccuccauggg

SEQ ID NO: 1040695 - RNA, 20 nt, Homo sapiens
ucuauuuugagaucauugca

SEQ ID NO: 1040696 - RNA, 19 nt, Homo sapiens
ucucaaaaccggguugcca

SEQ ID NO: 1040697 - RNA, 21 nt, Homo sapiens
ucucaaaacugcacugucaag

SEQ ID NO: 1040698 - RNA, 14 nt, Homo sapiens
ucucaaacuccuga

SEQ ID NO: 1040699 - RNA, 20 nt, Homo sapiens
ucucaaacuccugaccucaa

SEQ ID NO: 1040700 - RNA, 18 nt, Homo sapiens
ucucaaaugcacaucuca

SEQ ID NO: 1040701 - RNA, 19 nt, Homo sapiens
ucucaaaugcacaucucau

SEQ ID NO: 1040702 - RNA, 13 nt, Homo sapiens
ucucaaauucuca

SEQ ID NO: 1040703 - RNA, 16 nt, Homo sapiens
ucucaaccaccuuuca

SEQ ID NO: 1040704 - RNA, 20 nt, Homo sapiens
ucucaacccaggagcaucca

SEQ ID NO: 1040705 - RNA, 22 nt, Homo sapiens
ucucaagaagaacaucuuuaug

SEQ ID NO: 1040706 - RNA, 23 nt, Homo sapiens
ucucaagaagaacaucuuuaugg

SEQ ID NO: 1040707 - RNA, 18 nt, Homo sapiens
ucucaaguuaucagggua

SEQ ID NO: 1040708 - RNA, 22 nt, Homo sapiens
ucucacaagauggaaaucacau

SEQ ID NO: 1040709 - RNA, 23 nt, Homo sapiens
ucucaccccugcuauaacuauga

SEQ ID NO: 1040710 - RNA, 15 nt, Homo sapiens
ucucacuccaggaca

SEQ ID NO: 1040711 - RNA, 22 nt, Homo sapiens
ucucacugugggaaggccagcu

SEQ ID NO: 1040712 - RNA, 20 nt, Homo sapiens
ucucacuuuucuccaugagu

SEQ ID NO: 1040713 - RNA, 18 nt, Homo sapiens
ucucagaagccuagggga

SEQ ID NO: 1040714 - RNA, 16 nt, Homo sapiens
ucucagccuaccauga

SEQ ID NO: 1040715 - RNA, 14 nt, Homo sapiens
ucucagccucugaa

SEQ ID NO: 1040716 - RNA, 21 nt, Homo sapiens
ucucaggggccagaggaacug

SEQ ID NO: 1040717 - RNA, 17 nt, Homo sapiens
ucucauagguugccaau

SEQ ID NO: 1040718 - RNA, 12 nt, Homo sapiens
ucucauaugauu

SEQ ID NO: 1040719 - RNA, 22 nt, Homo sapiens
ucucauaugauugugcacauac

SEQ ID NO: 1040720 - RNA, 23 nt, Homo sapiens
ucucaucaguguccucuugcuca

SEQ ID NO: 1040721 - RNA, 19 nt, Homo sapiens
ucucaucccacgcacucca

SEQ ID NO: 1040722 - RNA, 12 nt, Homo sapiens
ucucauccugca

SEQ ID NO: 1040723 - RNA, 14 nt, Homo sapiens
ucucaucugugauu

SEQ ID NO: 1040724 - RNA, 14 nt, Homo sapiens
ucucaugauuauua

SEQ ID NO: 1040725 - RNA, 14 nt, Homo sapiens
ucuccaaaugagau

SEQ ID NO: 1040726 - RNA, 17 nt, Homo sapiens
ucuccaacggcaaggga

SEQ ID NO: 1040727 - RNA, 16 nt, Homo sapiens
ucuccaagaaugcuga

SEQ ID NO: 1040728 - RNA, 18 nt, Homo sapiens
ucuccacccccagcugcu

SEQ ID NO: 1040729 - RNA, 20 nt, Homo sapiens
ucuccagaaagcucaucuca

SEQ ID NO: 1040730 - RNA, 17 nt, Homo sapiens
ucuccagacccaccaca

SEQ ID NO: 1040731 - RNA, 20 nt, Homo sapiens
ucuccagagggaauugcaga

SEQ ID NO: 1040732 - RNA, 21 nt, Homo sapiens
ucuccagguccucuacuuaau

SEQ ID NO: 1040733 - RNA, 22 nt, Homo sapiens
ucuccagugguugcuguugaug

SEQ ID NO: 1040734 - RNA, 18 nt, Homo sapiens
ucuccaucucugucucaa

SEQ ID NO: 1040735 - RNA, 13 nt, Homo sapiens
ucuccauucagga

SEQ ID NO: 1040736 - RNA, 21 nt, Homo sapiens
ucucccaggccaggcuccuuc

SEQ ID NO: 1040737 - RNA, 19 nt, Homo sapiens
ucucccauccagugucuca

SEQ ID NO: 1040738 - RNA, 17 nt, Homo sapiens
ucuccuguuuuuugaug

SEQ ID NO: 1040739 - RNA, 22 nt, Homo sapiens
ucuccuuauccccccaaaugga

SEQ ID NO: 1040740 - RNA, 14 nt, Homo sapiens
ucuccuucugaaag

SEQ ID NO: 1040741 - RNA, 21 nt, Homo sapiens
ucuccuuucucuuaugcuuaa

SEQ ID NO: 1040742 - RNA, 18 nt, Homo sapiens
ucuccuuugcaggcucau

SEQ ID NO: 1040743 - RNA, 18 nt, Homo sapiens
ucuccuuuggccauucca

SEQ ID NO: 1040744 - RNA, 15 nt, Homo sapiens
ucucguuucaaaaac

SEQ ID NO: 1040745 - RNA, 13 nt, Homo sapiens
ucucuaaaacugc

SEQ ID NO: 1040746 - RNA, 15 nt, Homo sapiens
ucucuaaaauagcca

SEQ ID NO: 1040747 - RNA, 17 nt, Homo sapiens
ucucuagugucuuuugc

SEQ ID NO: 1040748 - RNA, 19 nt, Homo sapiens
ucucuaguuuccagaggcu

SEQ ID NO: 1040749 - RNA, 18 nt, Homo sapiens
ucucucagugaacuguga

SEQ ID NO: 1040750 - RNA, 14 nt, Homo sapiens
ucucucuucuccac

SEQ ID NO: 1040751 - RNA, 14 nt, Homo sapiens
ucucugaagggagg

SEQ ID NO: 1040752 - RNA, 19 nt, Homo sapiens
ucucugagcagugaaugau

SEQ ID NO: 1040753 - RNA, 16 nt, Homo sapiens
ucucugccgcaauaca

SEQ ID NO: 1040754 - RNA, 15 nt, Homo sapiens
ucucugccuugguau

SEQ ID NO: 1040755 - RNA, 19 nt, Homo sapiens
ucucugugcuuugacucac

SEQ ID NO: 1040756 - RNA, 18 nt, Homo sapiens
ucucuucagaaaacccuu

SEQ ID NO: 1040757 - RNA, 13 nt, Homo sapiens
ucucuucugccuu

SEQ ID NO: 1040758 - RNA, 18 nt, Homo sapiens
ucucuugcacucaaagcu

SEQ ID NO: 1040759 - RNA, 13 nt, Homo sapiens
auaucaugcucca

SEQ ID NO: 1040760 - RNA, 22 nt, Homo sapiens
auauccaacaugugcucaggga

SEQ ID NO: 1040761 - RNA, 13 nt, Homo sapiens
auaucgaucucuu

SEQ ID NO: 1040762 - RNA, 15 nt, Homo sapiens
auaucugcuguccag

SEQ ID NO: 1040763 - RNA, 17 nt, Homo sapiens
auaugaaacuuaggaag

SEQ ID NO: 1040764 - RNA, 16 nt, Homo sapiens
auaugauauguaaaca

SEQ ID NO: 1040765 - RNA, 19 nt, Homo sapiens
auaugauuuaaaacaugua

SEQ ID NO: 1040766 - RNA, 14 nt, Homo sapiens
auaugcaaagcacu

SEQ ID NO: 1040767 - RNA, 21 nt, Homo sapiens
auaugcacuuauucucaagaa

SEQ ID NO: 1040768 - RNA, 14 nt, Homo sapiens
auaugcagugauau

SEQ ID NO: 1040769 - RNA, 16 nt, Homo sapiens
auaugcaguucugcag

SEQ ID NO: 1040770 - RNA, 18 nt, Homo sapiens
auaugccuuuuugaagca

SEQ ID NO: 1040771 - RNA, 20 nt, Homo sapiens
auaugcuuauacacuuacac

SEQ ID NO: 1040772 - RNA, 23 nt, Homo sapiens
auauggagcuuuuccugauguuc

SEQ ID NO: 1040773 - RNA, 18 nt, Homo sapiens
auaugguugauaguuuac

SEQ ID NO: 1040774 - RNA, 18 nt, Homo sapiens
auauguaaggaagucaga

SEQ ID NO: 1040775 - RNA, 20 nt, Homo sapiens
auaugucucaggucccugca

SEQ ID NO: 1040776 - RNA, 16 nt, Homo sapiens
auauguucaacuggag

SEQ ID NO: 1040777 - RNA, 21 nt, Homo sapiens
auauuaaaauaagcacugugc

SEQ ID NO: 1040778 - RNA, 17 nt, Homo sapiens
auauuaaaauauggcua

SEQ ID NO: 1040779 - RNA, 23 nt, Homo sapiens
auauuaaacauucuugcugcugc

SEQ ID NO: 1040780 - RNA, 18 nt, Homo sapiens
aucgcuuuugauaaucaa

SEQ ID NO: 1040781 - RNA, 19 nt, Homo sapiens
aucgggaauacuagggaga

SEQ ID NO: 1040782 - RNA, 12 nt, Homo sapiens
aucgugcuaaau

SEQ ID NO: 1040783 - RNA, 16 nt, Homo sapiens
aucguggagacagggc

SEQ ID NO: 1040784 - RNA, 14 nt, Homo sapiens
aucuaaggauguca

SEQ ID NO: 1040785 - RNA, 14 nt, Homo sapiens
aucuacacuccagu

SEQ ID NO: 1040786 - RNA, 23 nt, Homo sapiens
aucuacauacacaguggccaagc

SEQ ID NO: 1040787 - RNA, 14 nt, Homo sapiens
aucuaccaacgaaa

SEQ ID NO: 1040788 - RNA, 14 nt, Homo sapiens
aucuaccagcauaa

SEQ ID NO: 1040789 - RNA, 22 nt, Homo sapiens
aucuacuucaacacuucaugua

SEQ ID NO: 1040790 - RNA, 16 nt, Homo sapiens
aucuaggaagacuuug

SEQ ID NO: 1040791 - RNA, 15 nt, Homo sapiens
aucuaucaacuauaa

SEQ ID NO: 1040792 - RNA, 16 nt, Homo sapiens
aucuaugauaugcuaa

SEQ ID NO: 1040793 - RNA, 21 nt, Homo sapiens
aucucaaacuacuggcaauuu

SEQ ID NO: 1040794 - RNA, 22 nt, Homo sapiens
aucucaaacuacuggcaauuug

SEQ ID NO: 1040795 - RNA, 14 nt, Homo sapiens
aucucaaauucuca

SEQ ID NO: 1040796 - RNA, 18 nt, Homo sapiens
aucucaggccaccugccc

SEQ ID NO: 1040797 - RNA, 15 nt, Homo sapiens
aucuccaagaccaga

SEQ ID NO: 1040798 - RNA, 12 nt, Homo sapiens
aucuccaaggac

SEQ ID NO: 1040799 - RNA, 19 nt, Homo sapiens
aucuccagcugaucacaga

SEQ ID NO: 1040800 - RNA, 21 nt, Homo sapiens
aucuccagcugaucacagaca

SEQ ID NO: 1040801 - RNA, 23 nt, Homo sapiens
aucuccaguagaaagcauaacaa

SEQ ID NO: 1040802 - RNA, 20 nt, Homo sapiens
aucuccaguauucuugucaa

SEQ ID NO: 1040803 - RNA, 20 nt, Homo sapiens
aucucgccaccccuccuucc

SEQ ID NO: 1040804 - RNA, 17 nt, Homo sapiens
aucucggcucauugaac

SEQ ID NO: 1040805 - RNA, 23 nt, Homo sapiens
aucucuaauuggaagaaauuccu

SEQ ID NO: 1040806 - RNA, 19 nt, Homo sapiens
aucucuacugaaaguacaa

SEQ ID NO: 1040807 - RNA, 22 nt, Homo sapiens
aucucucccuccccugccauuu

SEQ ID NO: 1040808 - RNA, 22 nt, Homo sapiens
aucucugcuuuggaaaucacac

SEQ ID NO: 1040809 - RNA, 12 nt, Homo sapiens
aucucugugaaa

SEQ ID NO: 1040810 - RNA, 16 nt, Homo sapiens
aucucuuauuuuacaa

SEQ ID NO: 1040811 - RNA, 17 nt, Homo sapiens
aucucuuauuuuacaau

SEQ ID NO: 1040812 - RNA, 23 nt, Homo sapiens
aucucuuguauaugaugaucugg

SEQ ID NO: 1040813 - RNA, 14 nt, Homo sapiens
aucucuuuaccucc

SEQ ID NO: 1040814 - RNA, 15 nt, Homo sapiens
aucucuuuaccuccu

SEQ ID NO: 1040815 - RNA, 15 nt, Homo sapiens
aucucuuugauguca

SEQ ID NO: 1040816 - RNA, 16 nt, Homo sapiens
aucucuuugaugucau

SEQ ID NO: 1040817 - RNA, 14 nt, Homo sapiens
aucugaaaauguau

SEQ ID NO: 1040818 - RNA, 19 nt, Homo sapiens
aucugaacagaaauaccaa

SEQ ID NO: 1040819 - RNA, 13 nt, Homo sapiens
aucugaccaaaac

SEQ ID NO: 1040820 - RNA, 13 nt, Homo sapiens
aucugcaaugugg

SEQ ID NO: 1040821 - RNA, 21 nt, Homo sapiens
aucugcucuuaggugcuucuu

SEQ ID NO: 1040822 - RNA, 23 nt, Homo sapiens
aucugcuuuugguuauaaugugu

SEQ ID NO: 1040823 - RNA, 22 nt, Homo sapiens
aucuggaaguaaccauuugcac

SEQ ID NO: 1040824 - RNA, 21 nt, Homo sapiens
aucuggaccccaucugugaau

SEQ ID NO: 1040825 - RNA, 20 nt, Homo sapiens
aucuggaguugaacagcaaa

SEQ ID NO: 1040826 - RNA, 15 nt, Homo sapiens
aucugggauucccac

SEQ ID NO: 1040827 - RNA, 23 nt, Homo sapiens
aucugggcauagaugcaggugag

SEQ ID NO: 1040828 - RNA, 18 nt, Homo sapiens
aucugggggaguggaaua

SEQ ID NO: 1040829 - RNA, 16 nt, Homo sapiens
aucuggucccuugcag

SEQ ID NO: 1040830 - RNA, 16 nt, Homo sapiens
aucugguuuugcuauu

SEQ ID NO: 1040831 - RNA, 11 nt, Homo sapiens
aucuguacaau

SEQ ID NO: 1040832 - RNA, 13 nt, Homo sapiens
aucuguaccucug

SEQ ID NO: 1040833 - RNA, 23 nt, Homo sapiens
aucugugaggggcucucucauga

SEQ ID NO: 1040834 - RNA, 17 nt, Homo sapiens
aucugugcaaauccuug

SEQ ID NO: 1040835 - RNA, 15 nt, Homo sapiens
aucuguguacaaaga

SEQ ID NO: 1040836 - RNA, 23 nt, Homo sapiens
aucuuagggcaucgaucuuccuc

SEQ ID NO: 1040837 - RNA, 18 nt, Homo sapiens
aucuuaguauuugcauau

SEQ ID NO: 1040838 - RNA, 13 nt, Homo sapiens
aucuucaacagac

SEQ ID NO: 1040839 - RNA, 12 nt, Homo sapiens
aucuucaccaga

SEQ ID NO: 1040840 - RNA, 18 nt, Homo sapiens
aucuucagcuugugcaca

SEQ ID NO: 1040841 - RNA, 22 nt, Homo sapiens
aucuucagggaacugcauagau

SEQ ID NO: 1040842 - RNA, 13 nt, Homo sapiens
aucuuccaagggu

SEQ ID NO: 1040843 - RNA, 19 nt, Homo sapiens
aucuuccagaagugugauu

SEQ ID NO: 1040844 - RNA, 15 nt, Homo sapiens
aucuuccauggauuu

SEQ ID NO: 1040845 - RNA, 19 nt, Homo sapiens
aucuuccccaagagggacu

SEQ ID NO: 1040846 - RNA, 13 nt, Homo sapiens
aucuucucagcuc

SEQ ID NO: 1040847 - RNA, 14 nt, Homo sapiens
aucuucucagcucc

SEQ ID NO: 1040848 - RNA, 15 nt, Homo sapiens
aucuucuuaugcaau

SEQ ID NO: 1040849 - RNA, 19 nt, Homo sapiens
aucuugaaaugaaaguaua

SEQ ID NO: 1040850 - RNA, 17 nt, Homo sapiens
aucuugcucugcugaca

SEQ ID NO: 1040851 - RNA, 18 nt, Homo sapiens
aucuuggcuuugccacac

SEQ ID NO: 1040852 - RNA, 24 nt, Homo sapiens
aucuuguuuuuccacuacugcuac

SEQ ID NO: 1040853 - RNA, 23 nt, Homo sapiens
aucuuuuaguuuuaguugcagaa

SEQ ID NO: 1040854 - RNA, 22 nt, Homo sapiens
aucuuuuucucuaaaauagcca

SEQ ID NO: 1040855 - RNA, 20 nt, Homo sapiens
augaaacaccuucucuggag

SEQ ID NO: 1040856 - RNA, 13 nt, Homo sapiens
augaaauaugcau

SEQ ID NO: 1040857 - RNA, 22 nt, Homo sapiens
augaaaugaggucagagccugc

SEQ ID NO: 1040858 - RNA, 18 nt, Homo sapiens
augaacaugugaaguuau

SEQ ID NO: 1040859 - RNA, 20 nt, Homo sapiens
augaacuauggacggugcuc

SEQ ID NO: 1040860 - RNA, 14 nt, Homo sapiens
augaacuuuccaca

SEQ ID NO: 1040861 - RNA, 18 nt, Homo sapiens
augaagacagauacuccu

SEQ ID NO: 1040862 - RNA, 15 nt, Homo sapiens
augaagaugaugcua

SEQ ID NO: 1040863 - RNA, 18 nt, Homo sapiens
augaagcuuuauacgugu

SEQ ID NO: 1040864 - RNA, 23 nt, Homo sapiens
augaagcuuuauacguguagcua

SEQ ID NO: 1040865 - RNA, 21 nt, Homo sapiens
augaagguuucugaaaauuaa

SEQ ID NO: 1040866 - RNA, 17 nt, Homo sapiens
augaaguacucauacau

SEQ ID NO: 1040867 - RNA, 13 nt, Homo sapiens
augaaguagcuga

SEQ ID NO: 1040868 - RNA, 16 nt, Homo sapiens
augaaguagcugagaa

SEQ ID NO: 1040869 - RNA, 17 nt, Homo sapiens
augaagugacucucaca

SEQ ID NO: 1040870 - RNA, 12 nt, Homo sapiens
augaagugcaaa

SEQ ID NO: 1040871 - RNA, 14 nt, Homo sapiens
augaaucacaguau

SEQ ID NO: 1040872 - RNA, 21 nt, Homo sapiens
augaauccauauggagcuuuu

SEQ ID NO: 1040873 - RNA, 20 nt, Homo sapiens
augaauggacucaaacugcc

SEQ ID NO: 1040874 - RNA, 15 nt, Homo sapiens
augaaugggcaaaac

SEQ ID NO: 1040875 - RNA, 15 nt, Homo sapiens
augaauguaugugca

SEQ ID NO: 1040876 - RNA, 16 nt, Homo sapiens
augaauguaugugcac

SEQ ID NO: 1040877 - RNA, 16 nt, Homo sapiens
augacaacuuugccag

SEQ ID NO: 1040878 - RNA, 17 nt, Homo sapiens
augacacagcuuuauca

SEQ ID NO: 1040879 - RNA, 12 nt, Homo sapiens
augacacagucu

SEQ ID NO: 1040880 - RNA, 14 nt, Homo sapiens
augacacuuguccc

SEQ ID NO: 1040881 - RNA, 14 nt, Homo sapiens
augacaucagcaau

SEQ ID NO: 1040882 - RNA, 13 nt, Homo sapiens
augacauucaugc

SEQ ID NO: 1040883 - RNA, 15 nt, Homo sapiens
augacccaaagacca

SEQ ID NO: 1040884 - RNA, 19 nt, Homo sapiens
augacccaccccugugcuc

SEQ ID NO: 1040885 - RNA, 18 nt, Homo sapiens
augaccuuauaguguuaa

SEQ ID NO: 1040886 - RNA, 21 nt, Homo sapiens
augacggcaaacucagucaua

SEQ ID NO: 1040887 - RNA, 17 nt, Homo sapiens
augacuuuuuauacuuu

SEQ ID NO: 1040888 - RNA, 16 nt, Homo sapiens
augagaaggaauuuga

SEQ ID NO: 1040889 - RNA, 21 nt, Homo sapiens
augagcaagaggcuaacucag

SEQ ID NO: 1040890 - RNA, 11 nt, Homo sapiens
augagcauuua

SEQ ID NO: 1040891 - RNA, 21 nt, Homo sapiens
augagccucagcauccuggca

SEQ ID NO: 1040892 - RNA, 17 nt, Homo sapiens
augagccuccucgucac

SEQ ID NO: 1040893 - RNA, 18 nt, Homo sapiens
augagcugacaucucagu

SEQ ID NO: 1040894 - RNA, 17 nt, Homo sapiens
augaggaauauuugcaa

SEQ ID NO: 1040895 - RNA, 22 nt, Homo sapiens
augaggacuugugucucugugc

SEQ ID NO: 1040896 - RNA, 13 nt, Homo sapiens
augaggcauuugu

SEQ ID NO: 1040897 - RNA, 16 nt, Homo sapiens
augagggaaaaugagu

SEQ ID NO: 1040898 - RNA, 18 nt, Homo sapiens
augagugauucuugacau

SEQ ID NO: 1040899 - RNA, 16 nt, Homo sapiens
augaguggcuuuaaug

SEQ ID NO: 1040900 - RNA, 20 nt, Homo sapiens
augaguuuuugauagcuuua

SEQ ID NO: 1040901 - RNA, 16 nt, Homo sapiens
augauacacaccuuuc

SEQ ID NO: 1040902 - RNA, 15 nt, Homo sapiens
augauacacuaugaa

SEQ ID NO: 1040903 - RNA, 18 nt, Homo sapiens
augauauugcauaugcau

SEQ ID NO: 1040904 - RNA, 20 nt, Homo sapiens
augaucacggcucacugcag

SEQ ID NO: 1040905 - RNA, 20 nt, Homo sapiens
augaucagcuguuugucaua

SEQ ID NO: 1040906 - RNA, 14 nt, Homo sapiens
augaucaguaugaa

SEQ ID NO: 1040907 - RNA, 14 nt, Homo sapiens
augaucauuugccc

SEQ ID NO: 1040908 - RNA, 18 nt, Homo sapiens
augauccccaagugugaa

SEQ ID NO: 1040909 - RNA, 18 nt, Homo sapiens
augauccuaaugaaugca

SEQ ID NO: 1040910 - RNA, 13 nt, Homo sapiens
augauccugcaau

SEQ ID NO: 1040911 - RNA, 12 nt, Homo sapiens
augaucuagguu

SEQ ID NO: 1040912 - RNA, 17 nt, Homo sapiens
augaucuggauccacca

SEQ ID NO: 1040913 - RNA, 13 nt, Homo sapiens
augaucuuuucaa

SEQ ID NO: 1040914 - RNA, 19 nt, Homo sapiens
augaugaucuuuaaaauac

SEQ ID NO: 1040915 - RNA, 17 nt, Homo sapiens
ucuugucauugccagcu

SEQ ID NO: 1040916 - RNA, 15 nt, Homo sapiens
ucuuguuaagugcag

SEQ ID NO: 1040917 - RNA, 18 nt, Homo sapiens
ucuuuaaaaaaacacaua

SEQ ID NO: 1040918 - RNA, 19 nt, Homo sapiens
ucuuuaagaguauguugcu

SEQ ID NO: 1040919 - RNA, 17 nt, Homo sapiens
ucuuuauaaucuacucc

SEQ ID NO: 1040920 - RNA, 18 nt, Homo sapiens
ucuuuauaaucuacuccu

SEQ ID NO: 1040921 - RNA, 13 nt, Homo sapiens
ucuuuauaauucu

SEQ ID NO: 1040922 - RNA, 12 nt, Homo sapiens
ucuuucacuuca

SEQ ID NO: 1040923 - RNA, 21 nt, Homo sapiens
ucuuucaguggcuaccuacau

SEQ ID NO: 1040924 - RNA, 16 nt, Homo sapiens
ucuuucaucucugcuu

SEQ ID NO: 1040925 - RNA, 23 nt, Homo sapiens
ugaauuugagauacaaacauguu

SEQ ID NO: 1040926 - RNA, 16 nt, Homo sapiens
ugacaaucaacucuaa

SEQ ID NO: 1040927 - RNA, 18 nt, Homo sapiens
ugacaaucaacucuaaua

SEQ ID NO: 1040928 - RNA, 20 nt, Homo sapiens
ugacaauggcaacaauuuga

SEQ ID NO: 1040929 - RNA, 12 nt, Homo sapiens
ugacacacagcu

SEQ ID NO: 1040930 - RNA, 22 nt, Homo sapiens
ugacacaggaugaaggcaaugc

SEQ ID NO: 1040931 - RNA, 13 nt, Homo sapiens
ugacacagucuug

SEQ ID NO: 1040932 - RNA, 15 nt, Homo sapiens
ugacacauaugcacc

SEQ ID NO: 1040933 - RNA, 20 nt, Homo sapiens
ugacaccagccuuucuccca

SEQ ID NO: 1040934 - RNA, 20 nt, Homo sapiens
ugacacucccuugggcuccc

SEQ ID NO: 1040935 - RNA, 19 nt, Homo sapiens
ugacacugguauuccugcc

SEQ ID NO: 1040936 - RNA, 18 nt, Homo sapiens
ugacacuuuaauuaccaa

SEQ ID NO: 1040937 - RNA, 17 nt, Homo sapiens
ugacacuuugccagaaa

SEQ ID NO: 1040938 - RNA, 17 nt, Homo sapiens
ugacacuuuucaugugu

SEQ ID NO: 1040939 - RNA, 18 nt, Homo sapiens
ugacagaagcuucugccc

SEQ ID NO: 1040940 - RNA, 16 nt, Homo sapiens
ugacagaccacaucuu

SEQ ID NO: 1040941 - RNA, 19 nt, Homo sapiens
ugacagaucaagcugugag

SEQ ID NO: 1040942 - RNA, 21 nt, Homo sapiens
ugacagaucaagcugugagac

SEQ ID NO: 1040943 - RNA, 12 nt, Homo sapiens
ugacagccuccc

SEQ ID NO: 1040944 - RNA, 21 nt, Homo sapiens
ugacaggcagcagagacuugg

SEQ ID NO: 1040945 - RNA, 16 nt, Homo sapiens
ugacaguaaaucucac

SEQ ID NO: 1040946 - RNA, 13 nt, Homo sapiens
ugacaguaugcau

SEQ ID NO: 1040947 - RNA, 17 nt, Homo sapiens
ugacagugccugggaau

SEQ ID NO: 1040948 - RNA, 16 nt, Homo sapiens
ugacaucaguggcaug

SEQ ID NO: 1040949 - RNA, 18 nt, Homo sapiens
ugacaucucaguucacug

SEQ ID NO: 1040950 - RNA, 11 nt, Homo sapiens
ugacaugcaca

SEQ ID NO: 1040951 - RNA, 14 nt, Homo sapiens
ugacaugugcuuug

SEQ ID NO: 1040952 - RNA, 16 nt, Homo sapiens
ugacauucaugccugg

SEQ ID NO: 1040953 - RNA, 19 nt, Homo sapiens
ugacauuccuaaacuaucu

SEQ ID NO: 1040954 - RNA, 17 nt, Homo sapiens
ugacauugcuuuacugu

SEQ ID NO: 1040955 - RNA, 18 nt, Homo sapiens
ugacauuguggcacauuc

SEQ ID NO: 1040956 - RNA, 19 nt, Homo sapiens
ugacauuguggcacauucu

SEQ ID NO: 1040957 - RNA, 21 nt, Homo sapiens
ugaccaaaauccccuucucau

SEQ ID NO: 1040958 - RNA, 20 nt, Homo sapiens
ugaccaagagagaaagaagu

SEQ ID NO: 1040959 - RNA, 19 nt, Homo sapiens
ugaccaauauuguacaguu

SEQ ID NO: 1040960 - RNA, 17 nt, Homo sapiens
ugaccagcagaucccag

SEQ ID NO: 1040961 - RNA, 21 nt, Homo sapiens
ugacccaugcugcccugugag

SEQ ID NO: 1040962 - RNA, 14 nt, Homo sapiens
ugaccccugcucag

SEQ ID NO: 1040963 - RNA, 22 nt, Homo sapiens
ugaccccuguccccacacugac

SEQ ID NO: 1040964 - RNA, 18 nt, Homo sapiens
ugacccucuccccacugc

SEQ ID NO: 1040965 - RNA, 18 nt, Homo sapiens
ugacccugauacaggcau

SEQ ID NO: 1040966 - RNA, 20 nt, Homo sapiens
ugaccuaucacuuccacugc

SEQ ID NO: 1040967 - RNA, 18 nt, Homo sapiens
ugaccugaggaagcguga

SEQ ID NO: 1040968 - RNA, 22 nt, Homo sapiens
ugaccugaggcuccugugcuac

SEQ ID NO: 1040969 - RNA, 15 nt, Homo sapiens
ugaccuguguucccu

SEQ ID NO: 1040970 - RNA, 19 nt, Homo sapiens
ugaccuuguaccucucuuu

SEQ ID NO: 1040971 - RNA, 20 nt, Homo sapiens
ugacggucccacacugguga

SEQ ID NO: 1040972 - RNA, 23 nt, Homo sapiens
ugacgugcaccuguacucaggag

SEQ ID NO: 1040973 - RNA, 20 nt, Homo sapiens
ugacuaaacaacuaccuccu

SEQ ID NO: 1040974 - RNA, 15 nt, Homo sapiens
ugacuacugggcaaa

SEQ ID NO: 1040975 - RNA, 18 nt, Homo sapiens
ugacuacugggcaaagag

SEQ ID NO: 1040976 - RNA, 17 nt, Homo sapiens
ugacuauggcuaccaaa

SEQ ID NO: 1040977 - RNA, 19 nt, Homo sapiens
ugacucaacauguuacuga

SEQ ID NO: 1040978 - RNA, 20 nt, Homo sapiens
ugacucuccagaaagcucau

SEQ ID NO: 1040979 - RNA, 15 nt, Homo sapiens
ugacuggcaguauua

SEQ ID NO: 1040980 - RNA, 15 nt, Homo sapiens
ugacuuguguuuuau

SEQ ID NO: 1040981 - RNA, 13 nt, Homo sapiens
ugacuuugcauca

SEQ ID NO: 1040982 - RNA, 12 nt, Homo sapiens
ugagaaagccuu

SEQ ID NO: 1040983 - RNA, 14 nt, Homo sapiens
ugagaacaccagag

SEQ ID NO: 1040984 - RNA, 14 nt, Homo sapiens
ugagaacacuguga

SEQ ID NO: 1040985 - RNA, 15 nt, Homo sapiens
ugagaacacugugaa

SEQ ID NO: 1040986 - RNA, 17 nt, Homo sapiens
ugagaacuacucaggga

SEQ ID NO: 1040987 - RNA, 19 nt, Homo sapiens
ugagaaggcagccaccagc

SEQ ID NO: 1040988 - RNA, 20 nt, Homo sapiens
ugagaagugucuaaaaacac

SEQ ID NO: 1040989 - RNA, 14 nt, Homo sapiens
ugagaauauaaaaa

SEQ ID NO: 1040990 - RNA, 23 nt, Homo sapiens
ugagaauauaauacuguauuuga

SEQ ID NO: 1040991 - RNA, 19 nt, Homo sapiens
ugagaaugagggccaagaa

SEQ ID NO: 1040992 - RNA, 22 nt, Homo sapiens
ugagacagcucugcauacucau

SEQ ID NO: 1040993 - RNA, 22 nt, Homo sapiens
ugagacagcuucgguuucuaac

SEQ ID NO: 1040994 - RNA, 23 nt, Homo sapiens
ugagacaggagaccuggcacugg

SEQ ID NO: 1040995 - RNA, 17 nt, Homo sapiens
ugagaccacuguuauca

SEQ ID NO: 1040996 - RNA, 22 nt, Homo sapiens
ugagagaagggacacauucaac

SEQ ID NO: 1040997 - RNA, 14 nt, Homo sapiens
ugagagaccaggag

SEQ ID NO: 1040998 - RNA, 15 nt, Homo sapiens
ugagagaccaggcaa

SEQ ID NO: 1040999 - RNA, 19 nt, Homo sapiens
ugagaggagagagacucca

SEQ ID NO: 1041000 - RNA, 23 nt, Homo sapiens
ugagaggagagagacuccagcug

SEQ ID NO: 1041001 - RNA, 18 nt, Homo sapiens
ugagaggggaacagacug

SEQ ID NO: 1041002 - RNA, 16 nt, Homo sapiens
ugagaguacaccccaa

SEQ ID NO: 1041003 - RNA, 12 nt, Homo sapiens
ugagaguauuua

SEQ ID NO: 1041004 - RNA, 19 nt, Homo sapiens
ugagauagcauugugaacu

SEQ ID NO: 1041005 - RNA, 16 nt, Homo sapiens
ugagaucauugcaaac

SEQ ID NO: 1041006 - RNA, 17 nt, Homo sapiens
ugagaucguuguuuaca

SEQ ID NO: 1041007 - RNA, 16 nt, Homo sapiens
ugagaugcagcuggaa

SEQ ID NO: 1041008 - RNA, 17 nt, Homo sapiens
ugagaugcagcuggaaa

SEQ ID NO: 1041009 - RNA, 19 nt, Homo sapiens
ugagauggucccaucugca

SEQ ID NO: 1041010 - RNA, 16 nt, Homo sapiens
ugagauuacaggcacc

SEQ ID NO: 1041011 - RNA, 22 nt, Homo sapiens
ugagauuuugaaaaucuaccaa

SEQ ID NO: 1041012 - RNA, 14 nt, Homo sapiens
ugagcaaaaccaaa

SEQ ID NO: 1041013 - RNA, 21 nt, Homo sapiens
ugagcaaaaccaaauauucca

SEQ ID NO: 1041014 - RNA, 20 nt, Homo sapiens
ugagcaaagggaacagugag

SEQ ID NO: 1041015 - RNA, 17 nt, Homo sapiens
ugagcacccaagccagg

SEQ ID NO: 1041016 - RNA, 17 nt, Homo sapiens
ugagcaccgucauggcu

SEQ ID NO: 1041017 - RNA, 21 nt, Homo sapiens
ugagcacucccaagucuacag

SEQ ID NO: 1041018 - RNA, 21 nt, Homo sapiens
ugagcagugcuugaaugaagu

SEQ ID NO: 1041019 - RNA, 21 nt, Homo sapiens
ugagcauuguggcugucagca

SEQ ID NO: 1041020 - RNA, 15 nt, Homo sapiens
ugagccacucagagc

SEQ ID NO: 1041021 - RNA, 22 nt, Homo sapiens
ugagccagccuugcaguaggca

SEQ ID NO: 1041022 - RNA, 12 nt, Homo sapiens
ugagccagguaa

SEQ ID NO: 1041023 - RNA, 13 nt, Homo sapiens
ugagccaguguca

SEQ ID NO: 1041024 - RNA, 21 nt, Homo sapiens
ugagcccccccaacacugugc

SEQ ID NO: 1041025 - RNA, 14 nt, Homo sapiens
ugagccccuacccc

SEQ ID NO: 1041026 - RNA, 18 nt, Homo sapiens
ugagcccggaugcuucuc

SEQ ID NO: 1041027 - RNA, 14 nt, Homo sapiens
ugagcgaggacauu

SEQ ID NO: 1041028 - RNA, 12 nt, Homo sapiens
ugagcuaacuua

SEQ ID NO: 1041029 - RNA, 15 nt, Homo sapiens
ugagcuccccaaaaa

SEQ ID NO: 1041030 - RNA, 12 nt, Homo sapiens
ugagcucucuca

SEQ ID NO: 1041031 - RNA, 20 nt, Homo sapiens
ugagcuggggaugucucuca

SEQ ID NO: 1041032 - RNA, 12 nt, Homo sapiens
ugagcugugcag

SEQ ID NO: 1041033 - RNA, 16 nt, Homo sapiens
ugagcuguugccucag

SEQ ID NO: 1041034 - RNA, 19 nt, Homo sapiens
ugagcuuagugaaauuacu

SEQ ID NO: 1041035 - RNA, 21 nt, Homo sapiens
ugagcuuggaaaggaccagua

SEQ ID NO: 1041036 - RNA, 16 nt, Homo sapiens
ugagcuuggacuugca

SEQ ID NO: 1041037 - RNA, 21 nt, Homo sapiens
ugaggaaaggccagcuggcag

SEQ ID NO: 1041038 - RNA, 16 nt, Homo sapiens
ugaggaagugaacauu

SEQ ID NO: 1041039 - RNA, 17 nt, Homo sapiens
ugaggaaugucuuucag

SEQ ID NO: 1041040 - RNA, 17 nt, Homo sapiens
ugaggacccgaggacag

SEQ ID NO: 1041041 - RNA, 14 nt, Homo sapiens
ugaggacuauggaa

SEQ ID NO: 1041042 - RNA, 23 nt, Homo sapiens
ugaggacuuaaaauauuccugca

SEQ ID NO: 1041043 - RNA, 22 nt, Homo sapiens
ugaggaggcuugccccacccaa

SEQ ID NO: 1041044 - RNA, 16 nt, Homo sapiens
ugaggagugaggaaua

SEQ ID NO: 1041045 - RNA, 16 nt, Homo sapiens
ugaggaugcagaguca

SEQ ID NO: 1041046 - RNA, 15 nt, Homo sapiens
ugaggaugucacuca

SEQ ID NO: 1041047 - RNA, 14 nt, Homo sapiens
ugaggcaauaaaaa

SEQ ID NO: 1041048 - RNA, 20 nt, Homo sapiens
ugaggcaggagaaucacuug

SEQ ID NO: 1041049 - RNA, 22 nt, Homo sapiens
ugaggcaggagaauggcgugaa

SEQ ID NO: 1041050 - RNA, 19 nt, Homo sapiens
ugaggcagguggaucacug

SEQ ID NO: 1041051 - RNA, 23 nt, Homo sapiens
ugaggccacugcugcuucuccau

SEQ ID NO: 1041052 - RNA, 19 nt, Homo sapiens
ugaggccuccagcuucagg

SEQ ID NO: 1041053 - RNA, 13 nt, Homo sapiens
ugaggccucucau

SEQ ID NO: 1041054 - RNA, 16 nt, Homo sapiens
ugaggcuccugugcua

SEQ ID NO: 1041055 - RNA, 20 nt, Homo sapiens
ugaggcugcaaucacacuga

SEQ ID NO: 1041056 - RNA, 14 nt, Homo sapiens
ugaggcugcaccca

SEQ ID NO: 1041057 - RNA, 15 nt, Homo sapiens
ugaggcugggcuccc

SEQ ID NO: 1041058 - RNA, 15 nt, Homo sapiens
ugagggaaaaugagu

SEQ ID NO: 1041059 - RNA, 18 nt, Homo sapiens
ugagggaaagcccagaaa

SEQ ID NO: 1041060 - RNA, 18 nt, Homo sapiens
ugagggcgucuucuaggg

SEQ ID NO: 1041061 - RNA, 14 nt, Homo sapiens
ugagguacagcaga

SEQ ID NO: 1041062 - RNA, 16 nt, Homo sapiens
ugaggucucuugaggg

SEQ ID NO: 1041063 - RNA, 16 nt, Homo sapiens
ugaggugccuguccca

SEQ ID NO: 1041064 - RNA, 21 nt, Homo sapiens
ugagguuucuuugacuucaau

SEQ ID NO: 1041065 - RNA, 18 nt, Homo sapiens
ugaguaagcccucaggag

SEQ ID NO: 1041066 - RNA, 18 nt, Homo sapiens
ugaguacguugugcauuu

SEQ ID NO: 1041067 - RNA, 19 nt, Homo sapiens
ugaguacuacaguccuccc

SEQ ID NO: 1041068 - RNA, 16 nt, Homo sapiens
ugaguauaaauuuacu

SEQ ID NO: 1041069 - RNA, 20 nt, Homo sapiens
cacuuugaaggggccucacc

SEQ ID NO: 1041070 - RNA, 23 nt, Homo sapiens
cacuuuggacauggcucacaaac

SEQ ID NO: 1041071 - RNA, 20 nt, Homo sapiens
cacuuugggaggcugaggcg

SEQ ID NO: 1041072 - RNA, 21 nt, Homo sapiens
cacuuuguaggcauugcauga

SEQ ID NO: 1041073 - RNA, 14 nt, Homo sapiens
cagaaaaacugugg

SEQ ID NO: 1041074 - RNA, 14 nt, Homo sapiens
cagaaaacaaaaaa

SEQ ID NO: 1041075 - RNA, 22 nt, Homo sapiens
cagaaaaguuucaaaccuacua

SEQ ID NO: 1041076 - RNA, 20 nt, Homo sapiens
cagaaacuugugaaguggaa

SEQ ID NO: 1041077 - RNA, 18 nt, Homo sapiens
cagaaagcagaacaguga

SEQ ID NO: 1041078 - RNA, 16 nt, Homo sapiens
cagaaagcauccuaaa

SEQ ID NO: 1041079 - RNA, 17 nt, Homo sapiens
cagaaagcauccuaaau

SEQ ID NO: 1041080 - RNA, 20 nt, Homo sapiens
cagaaaguagaauagugguu

SEQ ID NO: 1041081 - RNA, 20 nt, Homo sapiens
cagaaagugcauuaaacuga

SEQ ID NO: 1041082 - RNA, 21 nt, Homo sapiens
cagaaagugcauuaaacugaa

SEQ ID NO: 1041083 - RNA, 13 nt, Homo sapiens
cagaaauacauau

SEQ ID NO: 1041084 - RNA, 21 nt, Homo sapiens
cagaaaugucuaaaugcugaa

SEQ ID NO: 1041085 - RNA, 15 nt, Homo sapiens
cagaaauuuaauuca

SEQ ID NO: 1041086 - RNA, 18 nt, Homo sapiens
cagaaauuuaauucaugu

SEQ ID NO: 1041087 - RNA, 14 nt, Homo sapiens
cagaacacacucca

SEQ ID NO: 1041088 - RNA, 16 nt, Homo sapiens
cagaacagagccuuug

SEQ ID NO: 1041089 - RNA, 19 nt, Homo sapiens
cagaacagcuucagguuau

SEQ ID NO: 1041090 - RNA, 14 nt, Homo sapiens
cagaacaguuugua

SEQ ID NO: 1041091 - RNA, 19 nt, Homo sapiens
cagaaccuuguuauuucuc

SEQ ID NO: 1041092 - RNA, 14 nt, Homo sapiens
cagaagacacugca

SEQ ID NO: 1041093 - RNA, 20 nt, Homo sapiens
cagaagagacccaaccacuu

SEQ ID NO: 1041094 - RNA, 22 nt, Homo sapiens
cagaagauaacuugagcaccgu

SEQ ID NO: 1041095 - RNA, 22 nt, Homo sapiens
cagaagcaucgcuccucuccag

SEQ ID NO: 1041096 - RNA, 20 nt, Homo sapiens
cagaagccuccccagcucac

SEQ ID NO: 1041097 - RNA, 14 nt, Homo sapiens
cagaagguauuccu

SEQ ID NO: 1041098 - RNA, 15 nt, Homo sapiens
cagaauaacuagcac

SEQ ID NO: 1041099 - RNA, 14 nt, Homo sapiens
cagaauaauaagag

SEQ ID NO: 1041100 - RNA, 21 nt, Homo sapiens
cagaauaaugaauggacucaa

SEQ ID NO: 1041101 - RNA, 15 nt, Homo sapiens
cagaaucucaaauaa

SEQ ID NO: 1041102 - RNA, 21 nt, Homo sapiens
cagaaucucucuucuuuucaa

SEQ ID NO: 1041103 - RNA, 19 nt, Homo sapiens
cagaauuaugaagagguau

SEQ ID NO: 1041104 - RNA, 16 nt, Homo sapiens
cagacaacacugggaa

SEQ ID NO: 1041105 - RNA, 19 nt, Homo sapiens
cagacacacacacacacaa

SEQ ID NO: 1041106 - RNA, 20 nt, Homo sapiens
cagacagacaacacugggaa

SEQ ID NO: 1041107 - RNA, 14 nt, Homo sapiens
cagacauucugcca

SEQ ID NO: 1041108 - RNA, 20 nt, Homo sapiens
cagaccacugauaaaaccau

SEQ ID NO: 1041109 - RNA, 15 nt, Homo sapiens
cagaccauucaggac

SEQ ID NO: 1041110 - RNA, 23 nt, Homo sapiens
cagaccauucaggacacagggaa

SEQ ID NO: 1041111 - RNA, 18 nt, Homo sapiens
cagaccccacacuccaug

SEQ ID NO: 1041112 - RNA, 16 nt, Homo sapiens
cagacgguucaccagc

SEQ ID NO: 1041113 - RNA, 14 nt, Homo sapiens
cagacuagcuuuca

SEQ ID NO: 1041114 - RNA, 21 nt, Homo sapiens
cagacuagcuuucagucuucu

SEQ ID NO: 1041115 - RNA, 21 nt, Homo sapiens
cagacuaugaauauuauagua

SEQ ID NO: 1041116 - RNA, 18 nt, Homo sapiens
cagacucaauaaaaucau

SEQ ID NO: 1041117 - RNA, 15 nt, Homo sapiens
ugugguuuaugucau

SEQ ID NO: 1041118 - RNA, 20 nt, Homo sapiens
ugugguuuaugucaucauac

SEQ ID NO: 1041119 - RNA, 14 nt, Homo sapiens
ugugguuugucaga

SEQ ID NO: 1041120 - RNA, 22 nt, Homo sapiens
uguguacauuagucauucaaua

SEQ ID NO: 1041121 - RNA, 16 nt, Homo sapiens
uguguaccugugacua

SEQ ID NO: 1041122 - RNA, 20 nt, Homo sapiens
uguguaccugugacuaaaca

SEQ ID NO: 1041123 - RNA, 20 nt, Homo sapiens
uguguacuuuuggguucaca

SEQ ID NO: 1041124 - RNA, 15 nt, Homo sapiens
uguguagccugugca

SEQ ID NO: 1041125 - RNA, 19 nt, Homo sapiens
uguguauuuccagugcaau

SEQ ID NO: 1041126 - RNA, 24 nt, Homo sapiens
uguguauuuccagugcaauuguag

SEQ ID NO: 1041127 - RNA, 12 nt, Homo sapiens
ugugucagcaua

SEQ ID NO: 1041128 - RNA, 18 nt, Homo sapiens
ugugucccccucugucca

SEQ ID NO: 1041129 - RNA, 16 nt, Homo sapiens
ugugucuguacacgug

SEQ ID NO: 1041130 - RNA, 23 nt, Homo sapiens
ugugugaaaggaagcuccacugu

SEQ ID NO: 1041131 - RNA, 15 nt, Homo sapiens
ugugugaguguacca

SEQ ID NO: 1041132 - RNA, 17 nt, Homo sapiens
ugugugagugugugcaa

SEQ ID NO: 1041133 - RNA, 13 nt, Homo sapiens
ugugugcaagugu

SEQ ID NO: 1041134 - RNA, 17 nt, Homo sapiens
ugugugcaagugugugc

SEQ ID NO: 1041135 - RNA, 15 nt, Homo sapiens
ugugugcaugugugc

SEQ ID NO: 1041136 - RNA, 15 nt, Homo sapiens
ugugugcgucacugu

SEQ ID NO: 1041137 - RNA, 17 nt, Homo sapiens
ugugugcgugugcgugc

SEQ ID NO: 1041138 - RNA, 16 nt, Homo sapiens
uguguggcauuuucac

SEQ ID NO: 1041139 - RNA, 13 nt, Homo sapiens
uguguguagccaa

SEQ ID NO: 1041140 - RNA, 18 nt, Homo sapiens
uguguguauguuugcaca

SEQ ID NO: 1041141 - RNA, 13 nt, Homo sapiens
ugugugugugcaa

SEQ ID NO: 1041142 - RNA, 16 nt, Homo sapiens
uguguguuuaccuaaa

SEQ ID NO: 1041143 - RNA, 14 nt, Homo sapiens
uguguuaucucuua

SEQ ID NO: 1041144 - RNA, 10 nt, Homo sapiens
uguguuccaa

SEQ ID NO: 1041145 - RNA, 14 nt, Homo sapiens
uguguuucuuacag

SEQ ID NO: 1041146 - RNA, 13 nt, Homo sapiens
uguguuucuuuag

SEQ ID NO: 1041147 - RNA, 22 nt, Homo sapiens
uguguuuugaaugguguuguau

SEQ ID NO: 1041148 - RNA, 20 nt, Homo sapiens
uguguuuuuaauaaagacag

SEQ ID NO: 1041149 - RNA, 14 nt, Homo sapiens
uguuaaagcuauuu

SEQ ID NO: 1041150 - RNA, 18 nt, Homo sapiens
uguuaaauugcuguguau

SEQ ID NO: 1041151 - RNA, 18 nt, Homo sapiens
uguuaacauggacaugau

SEQ ID NO: 1041152 - RNA, 22 nt, Homo sapiens
uguuaaggaaacucuuaucuca

SEQ ID NO: 1041153 - RNA, 14 nt, Homo sapiens
uguuaaucauuuca

SEQ ID NO: 1041154 - RNA, 20 nt, Homo sapiens
uguuaccugaaaacacugug

SEQ ID NO: 1041155 - RNA, 16 nt, Homo sapiens
uguuacugaucaugca

SEQ ID NO: 1041156 - RNA, 19 nt, Homo sapiens
uguuagauagaauuuccaa

SEQ ID NO: 1041157 - RNA, 22 nt, Homo sapiens
uguuauauuauuacuaauuguc

SEQ ID NO: 1041158 - RNA, 16 nt, Homo sapiens
uguuaucaguaagaaa

SEQ ID NO: 1041159 - RNA, 14 nt, Homo sapiens
uguuaucagucaua

SEQ ID NO: 1041160 - RNA, 20 nt, Homo sapiens
uguuauuauaaaaguacuag

SEQ ID NO: 1041161 - RNA, 13 nt, Homo sapiens
uguucacugcaau

SEQ ID NO: 1041162 - RNA, 18 nt, Homo sapiens
uguucagcuggacaauau

SEQ ID NO: 1041163 - RNA, 17 nt, Homo sapiens
uguucagggcugugauc

SEQ ID NO: 1041164 - RNA, 15 nt, Homo sapiens
uguucauguuacuca

SEQ ID NO: 1041165 - RNA, 22 nt, Homo sapiens
uguuccaugaaggcagagccau

SEQ ID NO: 1041166 - RNA, 15 nt, Homo sapiens
uguuccccaucaucu

SEQ ID NO: 1041167 - RNA, 15 nt, Homo sapiens
uguucccuauuuugc

SEQ ID NO: 1041168 - RNA, 23 nt, Homo sapiens
uguucccuauuuugccaguggga

SEQ ID NO: 1041169 - RNA, 22 nt, Homo sapiens
uguucccuccccgaucaucuuu

SEQ ID NO: 1041170 - RNA, 21 nt, Homo sapiens
uguucgacucagccucaggga

SEQ ID NO: 1041171 - RNA, 22 nt, Homo sapiens
uguucuaaaaauaaaaguauug

SEQ ID NO: 1041172 - RNA, 16 nt, Homo sapiens
uguucuauuugugcuu

SEQ ID NO: 1041173 - RNA, 13 nt, Homo sapiens
uguucucccuccu

SEQ ID NO: 1041174 - RNA, 13 nt, Homo sapiens
uguucugggacac

SEQ ID NO: 1041175 - RNA, 20 nt, Homo sapiens
uguucugggccaggucccag

SEQ ID NO: 1041176 - RNA, 18 nt, Homo sapiens
uguucuguggaaagugua

SEQ ID NO: 1041177 - RNA, 14 nt, Homo sapiens
uguucuuaauugca

SEQ ID NO: 1041178 - RNA, 23 nt, Homo sapiens
uguucuucauuaccucagugaga

SEQ ID NO: 1041179 - RNA, 15 nt, Homo sapiens
uguucuugaagcagu

SEQ ID NO: 1041180 - RNA, 16 nt, Homo sapiens
uguucuuuuuauugaa

SEQ ID NO: 1041181 - RNA, 13 nt, Homo sapiens
uguugaacaauag

SEQ ID NO: 1041182 - RNA, 14 nt, Homo sapiens
uguugagccuaaua

SEQ ID NO: 1041183 - RNA, 12 nt, Homo sapiens
uguugaggacaa

SEQ ID NO: 1041184 - RNA, 13 nt, Homo sapiens
uguugauagcaag

SEQ ID NO: 1041185 - RNA, 15 nt, Homo sapiens
uguugauuuccucug

SEQ ID NO: 1041186 - RNA, 14 nt, Homo sapiens
uguugcacacucac

SEQ ID NO: 1041187 - RNA, 17 nt, Homo sapiens
uguuggaaaaugugcaa

SEQ ID NO: 1041188 - RNA, 14 nt, Homo sapiens
uguuggagccugca

SEQ ID NO: 1041189 - RNA, 21 nt, Homo sapiens
uguuggcuuucccuuaucaaa

SEQ ID NO: 1041190 - RNA, 18 nt, Homo sapiens
uguugucacccaagagau

SEQ ID NO: 1041191 - RNA, 16 nt, Homo sapiens
uguuguucugcucaau

SEQ ID NO: 1041192 - RNA, 21 nt, Homo sapiens
uguuguuuuaggaauacauaa

SEQ ID NO: 1041193 - RNA, 15 nt, Homo sapiens
uguuuacagcacuac

SEQ ID NO: 1041194 - RNA, 16 nt, Homo sapiens
uguuuacccaguauuc

SEQ ID NO: 1041195 - RNA, 12 nt, Homo sapiens
uguuuaccuaaa

SEQ ID NO: 1041196 - RNA, 18 nt, Homo sapiens
uguuuagcccaaaaccaa

SEQ ID NO: 1041197 - RNA, 12 nt, Homo sapiens
uguuuaguugca

SEQ ID NO: 1041198 - RNA, 17 nt, Homo sapiens
uguuucacuuuuaggga

SEQ ID NO: 1041199 - RNA, 18 nt, Homo sapiens
uguuucaucccauguaca

SEQ ID NO: 1041200 - RNA, 14 nt, Homo sapiens
uguuucccaccuca

SEQ ID NO: 1041201 - RNA, 22 nt, Homo sapiens
uguuucgguugacccaggucau

SEQ ID NO: 1041202 - RNA, 15 nt, Homo sapiens
uguuucugaaaggga

SEQ ID NO: 1041203 - RNA, 18 nt, Homo sapiens
uguuucugaucugaugca

SEQ ID NO: 1041204 - RNA, 12 nt, Homo sapiens
uguuucuuccaa

SEQ ID NO: 1041205 - RNA, 13 nt, Homo sapiens
uguuucuuccaaa

SEQ ID NO: 1041206 - RNA, 16 nt, Homo sapiens
uguuucuuuugguucc

SEQ ID NO: 1041207 - RNA, 23 nt, Homo sapiens
uguuugacgacagugcauuugcc

SEQ ID NO: 1041208 - RNA, 17 nt, Homo sapiens
uguuugacgggaaacaa

SEQ ID NO: 1041209 - RNA, 14 nt, Homo sapiens
uguuugcccagugu

SEQ ID NO: 1041210 - RNA, 13 nt, Homo sapiens
uguuuuaaguuua

SEQ ID NO: 1041211 - RNA, 23 nt, Homo sapiens
uguuuuaauuccaauaugaugac

SEQ ID NO: 1041212 - RNA, 13 nt, Homo sapiens
uguuuuagcuccu

SEQ ID NO: 1041213 - RNA, 17 nt, Homo sapiens
uguuuuagcuccuugac

SEQ ID NO: 1041214 - RNA, 18 nt, Homo sapiens
cagggcauuuugguccaa

SEQ ID NO: 1041215 - RNA, 14 nt, Homo sapiens
cagggcccaagucc

SEQ ID NO: 1041216 - RNA, 13 nt, Homo sapiens
cagggcgugggac

SEQ ID NO: 1041217 - RNA, 22 nt, Homo sapiens
cagggcucagccuggugggccu

SEQ ID NO: 1041218 - RNA, 18 nt, Homo sapiens
cagggcucgccucaggaa

SEQ ID NO: 1041219 - RNA, 23 nt, Homo sapiens
cagggcugucuucguauucccau

SEQ ID NO: 1041220 - RNA, 17 nt, Homo sapiens
caggggcuugcuuugca

SEQ ID NO: 1041221 - RNA, 12 nt, Homo sapiens
cagggucucacu

SEQ ID NO: 1041222 - RNA, 21 nt, Homo sapiens
cagggucucacucugucgccc

SEQ ID NO: 1041223 - RNA, 20 nt, Homo sapiens
cagggugacccugaagugag

SEQ ID NO: 1041224 - RNA, 17 nt, Homo sapiens
cagggugaggugcuuga

SEQ ID NO: 1041225 - RNA, 21 nt, Homo sapiens
caggguuacaaaucuucuuga

SEQ ID NO: 1041226 - RNA, 14 nt, Homo sapiens
cagguaaugugaau

SEQ ID NO: 1041227 - RNA, 20 nt, Homo sapiens
cagguagaacacaaggucau

SEQ ID NO: 1041228 - RNA, 17 nt, Homo sapiens
caggucaauacaguaca

SEQ ID NO: 1041229 - RNA, 13 nt, Homo sapiens
caggucacuuuac

SEQ ID NO: 1041230 - RNA, 16 nt, Homo sapiens
cagguccaauuuguaa

SEQ ID NO: 1041231 - RNA, 19 nt, Homo sapiens
cagguccucuacuuaauga

SEQ ID NO: 1041232 - RNA, 12 nt, Homo sapiens
caggucuucucu

SEQ ID NO: 1041233 - RNA, 17 nt, Homo sapiens
caggugauccaccugcc

SEQ ID NO: 1041234 - RNA, 15 nt, Homo sapiens
caggugcugccaucc

SEQ ID NO: 1041235 - RNA, 20 nt, Homo sapiens
caggugcuguuuuuguucua

SEQ ID NO: 1041236 - RNA, 20 nt, Homo sapiens
cagguggacacacaaggugc

SEQ ID NO: 1041237 - RNA, 16 nt, Homo sapiens
cagguggcaucucuaa

SEQ ID NO: 1041238 - RNA, 14 nt, Homo sapiens
cagguggugcaaau

SEQ ID NO: 1041239 - RNA, 15 nt, Homo sapiens
caggugguggcacug

SEQ ID NO: 1041240 - RNA, 19 nt, Homo sapiens
caggugugaaccaccacac

SEQ ID NO: 1041241 - RNA, 14 nt, Homo sapiens
caggugugagucac

SEQ ID NO: 1041242 - RNA, 22 nt, Homo sapiens
cagguguucuacacucaucuua

SEQ ID NO: 1041243 - RNA, 21 nt, Homo sapiens
cagguguucuucauuaccuca

SEQ ID NO: 1041244 - RNA, 23 nt, Homo sapiens
cagguuuucuggguguccaaagg

SEQ ID NO: 1041245 - RNA, 22 nt, Homo sapiens
caguaaagcacuugcaaccguc

SEQ ID NO: 1041246 - RNA, 12 nt, Homo sapiens
caguaacugaca

SEQ ID NO: 1041247 - RNA, 18 nt, Homo sapiens
caguaacuuuauguguaa

SEQ ID NO: 1041248 - RNA, 17 nt, Homo sapiens
caguaagcuaucuucaa

SEQ ID NO: 1041249 - RNA, 18 nt, Homo sapiens
caguacaggcagcacaga

SEQ ID NO: 1041250 - RNA, 18 nt, Homo sapiens
caguacccucucagcucc

SEQ ID NO: 1041251 - RNA, 18 nt, Homo sapiens
caguagaaauaauaugca

SEQ ID NO: 1041252 - RNA, 19 nt, Homo sapiens
caguagagcaaaucuauga

SEQ ID NO: 1041253 - RNA, 16 nt, Homo sapiens
caguagagucaucucc

SEQ ID NO: 1041254 - RNA, 20 nt, Homo sapiens
caguaggcaguagacuauaa

SEQ ID NO: 1041255 - RNA, 13 nt, Homo sapiens
caguagucccugc

SEQ ID NO: 1041256 - RNA, 22 nt, Homo sapiens
caguauuuuccaaacuaccuuc

SEQ ID NO: 1041257 - RNA, 13 nt, Homo sapiens
cagucaaccuggg

SEQ ID NO: 1041258 - RNA, 15 nt, Homo sapiens
cagucaaggauggau

SEQ ID NO: 1041259 - RNA, 19 nt, Homo sapiens
cagucaaugaggaagauuu

SEQ ID NO: 1041260 - RNA, 19 nt, Homo sapiens
cagucaccgacaacaugcu

SEQ ID NO: 1041261 - RNA, 19 nt, Homo sapiens
cagucagaguugugcacau

SEQ ID NO: 1041262 - RNA, 21 nt, Homo sapiens
cagucauaacuaaauaaagcu

SEQ ID NO: 1041263 - RNA, 21 nt, Homo sapiens
cagucauggcaccaaagccac

SEQ ID NO: 1041264 - RNA, 18 nt, Homo sapiens
caguccaaggaaaccaca

SEQ ID NO: 1041265 - RNA, 13 nt, Homo sapiens
caguccaaucuca

SEQ ID NO: 1041266 - RNA, 22 nt, Homo sapiens
cagucccagcuaacucugaccu

SEQ ID NO: 1041267 - RNA, 19 nt, Homo sapiens
cagucccuaaaaacacaga

SEQ ID NO: 1041268 - RNA, 20 nt, Homo sapiens
cagucccuauguauuugcag

SEQ ID NO: 1041269 - RNA, 19 nt, Homo sapiens
caguccugggauguggcug

SEQ ID NO: 1041270 - RNA, 14 nt, Homo sapiens
cagucuuccauuug

SEQ ID NO: 1041271 - RNA, 14 nt, Homo sapiens
cagugaaagccaga

SEQ ID NO: 1041272 - RNA, 17 nt, Homo sapiens
cagugaagaugccagug

SEQ ID NO: 1041273 - RNA, 23 nt, Homo sapiens
cagugacagaacuaagaugauca

SEQ ID NO: 1041274 - RNA, 12 nt, Homo sapiens
cagugacaguau

SEQ ID NO: 1041275 - RNA, 16 nt, Homo sapiens
cagugacagugcccag

SEQ ID NO: 1041276 - RNA, 12 nt, Homo sapiens
cagugacauuua

SEQ ID NO: 1041277 - RNA, 14 nt, Homo sapiens
cagugagaugcauu

SEQ ID NO: 1041278 - RNA, 14 nt, Homo sapiens
cagugagccaagau

SEQ ID NO: 1041279 - RNA, 20 nt, Homo sapiens
uucaagaccagccugaccaa

SEQ ID NO: 1041280 - RNA, 16 nt, Homo sapiens
uucaagagcacacuug

SEQ ID NO: 1041281 - RNA, 18 nt, Homo sapiens
uucaaggcaucaugcaga

SEQ ID NO: 1041282 - RNA, 23 nt, Homo sapiens
uucaaggcauuucuaucacauau

SEQ ID NO: 1041283 - RNA, 16 nt, Homo sapiens
uucaaguaauugugaa

SEQ ID NO: 1041284 - RNA, 22 nt, Homo sapiens
uucaaguuaaagugaauaacca

SEQ ID NO: 1041285 - RNA, 20 nt, Homo sapiens
uucaaguuugucacuaaacu

SEQ ID NO: 1041286 - RNA, 13 nt, Homo sapiens
uucaauacccaaa

SEQ ID NO: 1041287 - RNA, 12 nt, Homo sapiens
uucaaucucuug

SEQ ID NO: 1041288 - RNA, 10 nt, Homo sapiens
uucaaugauc

SEQ ID NO: 1041289 - RNA, 22 nt, Homo sapiens
uucaauucucauuugucacaca

SEQ ID NO: 1041290 - RNA, 15 nt, Homo sapiens
uucacaaugaaaugc

SEQ ID NO: 1041291 - RNA, 15 nt, Homo sapiens
uucacaccuagcguc

SEQ ID NO: 1041292 - RNA, 19 nt, Homo sapiens
uucacagccagacuggcac

SEQ ID NO: 1041293 - RNA, 12 nt, Homo sapiens
uucacagugugu

SEQ ID NO: 1041294 - RNA, 17 nt, Homo sapiens
uucaccacaugugcaca

SEQ ID NO: 1041295 - RNA, 17 nt, Homo sapiens
uucaccagagcauuucc

SEQ ID NO: 1041296 - RNA, 18 nt, Homo sapiens
uucaccagagcauuucca

SEQ ID NO: 1041297 - RNA, 15 nt, Homo sapiens
uucaccucacugaaa

SEQ ID NO: 1041298 - RNA, 22 nt, Homo sapiens
uucacgccuguaaucccagcac

SEQ ID NO: 1041299 - RNA, 22 nt, Homo sapiens
uucacggaaagugccugcaaaa

SEQ ID NO: 1041300 - RNA, 12 nt, Homo sapiens
uucacuacauua

SEQ ID NO: 1041301 - RNA, 18 nt, Homo sapiens
uucacuauaaaugguguu

SEQ ID NO: 1041302 - RNA, 17 nt, Homo sapiens
uucacugccuuugcucc

SEQ ID NO: 1041303 - RNA, 12 nt, Homo sapiens
uucacuggccac

SEQ ID NO: 1041304 - RNA, 20 nt, Homo sapiens
uucacuguagaaugauuuca

SEQ ID NO: 1041305 - RNA, 21 nt, Homo sapiens
uucacuuaauaauguguacau

SEQ ID NO: 1041306 - RNA, 12 nt, Homo sapiens
uucacuuuacaa

SEQ ID NO: 1041307 - RNA, 14 nt, Homo sapiens
uucacuuuuaggga

SEQ ID NO: 1041308 - RNA, 15 nt, Homo sapiens
uucacuuuugacaaa

SEQ ID NO: 1041309 - RNA, 15 nt, Homo sapiens
uucagaagacacugc

SEQ ID NO: 1041310 - RNA, 21 nt, Homo sapiens
uucagaccacaaggggcucca

SEQ ID NO: 1041311 - RNA, 23 nt, Homo sapiens
uucagagagcagcuuuaaacuca

SEQ ID NO: 1041312 - RNA, 18 nt, Homo sapiens
uucagagcugacacagga

SEQ ID NO: 1041313 - RNA, 23 nt, Homo sapiens
uucagauauaaaagacugaccaa

SEQ ID NO: 1041314 - RNA, 19 nt, Homo sapiens
uucagauauauuuuucaca

SEQ ID NO: 1041315 - RNA, 19 nt, Homo sapiens
uucagaucauggcauccaa

SEQ ID NO: 1041316 - RNA, 19 nt, Homo sapiens
uucagaugcuucugggaga

SEQ ID NO: 1041317 - RNA, 15 nt, Homo sapiens
uucagauuugccuua

SEQ ID NO: 1041318 - RNA, 14 nt, Homo sapiens
uucagcaguaccua

SEQ ID NO: 1041319 - RNA, 13 nt, Homo sapiens
uucagccaccucu

SEQ ID NO: 1041320 - RNA, 14 nt, Homo sapiens
uucagccaggagau

SEQ ID NO: 1041321 - RNA, 21 nt, Homo sapiens
uucagccuagccgaccucagc

SEQ ID NO: 1041322 - RNA, 16 nt, Homo sapiens
uucagccugaaagagg

SEQ ID NO: 1041323 - RNA, 14 nt, Homo sapiens
uucagccuuucuaa

SEQ ID NO: 1041324 - RNA, 18 nt, Homo sapiens
uucagcucacacaugaga

SEQ ID NO: 1041325 - RNA, 17 nt, Homo sapiens
uucagcuguacauacuc

SEQ ID NO: 1041326 - RNA, 17 nt, Homo sapiens
uucaggaagaugaaaga

SEQ ID NO: 1041327 - RNA, 20 nt, Homo sapiens
uucaggacacagggaaauca

SEQ ID NO: 1041328 - RNA, 23 nt, Homo sapiens
uucaggccauucuccugccucag

SEQ ID NO: 1041329 - RNA, 23 nt, Homo sapiens
uucaggcgauucuccugccucag

SEQ ID NO: 1041330 - RNA, 22 nt, Homo sapiens
uucagggaaccguuauuauaau

SEQ ID NO: 1041331 - RNA, 18 nt, Homo sapiens
uucagggcagggcucuga

SEQ ID NO: 1041332 - RNA, 13 nt, Homo sapiens
uucaguaauaacu

SEQ ID NO: 1041333 - RNA, 16 nt, Homo sapiens
uucagugauguggggu

SEQ ID NO: 1041334 - RNA, 13 nt, Homo sapiens
uucaguucccaga

SEQ ID NO: 1041335 - RNA, 21 nt, Homo sapiens
uucaguuggcugacuuccaca

SEQ ID NO: 1041336 - RNA, 15 nt, Homo sapiens
uucaguuuucaggag

SEQ ID NO: 1041337 - RNA, 17 nt, Homo sapiens
uucauaacagaacaaga

SEQ ID NO: 1041338 - RNA, 17 nt, Homo sapiens
uucauaccuacauguau

SEQ ID NO: 1041339 - RNA, 18 nt, Homo sapiens
uucauauauuuguaugau

SEQ ID NO: 1041340 - RNA, 20 nt, Homo sapiens
uucauauguaccauguacau

SEQ ID NO: 1041341 - RNA, 21 nt, Homo sapiens
uucaucccucgggugugcuau

SEQ ID NO: 1041342 - RNA, 18 nt, Homo sapiens
uucauccugacucugccc

SEQ ID NO: 1041343 - RNA, 18 nt, Homo sapiens
uucaucguggggcucuca

SEQ ID NO: 1041344 - RNA, 18 nt, Homo sapiens
uucaucuauuucugagaa

SEQ ID NO: 1041345 - RNA, 21 nt, Homo sapiens
uucaucugggaaagacaucca

SEQ ID NO: 1041346 - RNA, 15 nt, Homo sapiens
uucaugaucaucaca

SEQ ID NO: 1041347 - RNA, 19 nt, Homo sapiens
uucaugauuagcaaguuac

SEQ ID NO: 1041348 - RNA, 22 nt, Homo sapiens
uucauggugcacugagcugcaa

SEQ ID NO: 1041349 - RNA, 21 nt, Homo sapiens
uucauuaccuuuuuugauaaa

SEQ ID NO: 1041350 - RNA, 21 nt, Homo sapiens
uucauuccuaacacagcaugu

SEQ ID NO: 1041351 - RNA, 19 nt, Homo sapiens
uucauugacugauggugaa

SEQ ID NO: 1041352 - RNA, 14 nt, Homo sapiens
uucauuuacugugg

SEQ ID NO: 1041353 - RNA, 13 nt, Homo sapiens
uucauuuagccaa

SEQ ID NO: 1041354 - RNA, 23 nt, Homo sapiens
uucauuucagauaaacaacaaau

SEQ ID NO: 1041355 - RNA, 16 nt, Homo sapiens
uuccaaacacauacag

SEQ ID NO: 1041356 - RNA, 23 nt, Homo sapiens
uuccaacaccacagacacacaca

SEQ ID NO: 1041357 - RNA, 19 nt, Homo sapiens
uuccaacguggcccagaga

SEQ ID NO: 1041358 - RNA, 22 nt, Homo sapiens
cagcuuguaaauagcucaggug

SEQ ID NO: 1041359 - RNA, 14 nt, Homo sapiens
cagcuuugcaguga

SEQ ID NO: 1041360 - RNA, 14 nt, Homo sapiens
caggaaaccacuua

SEQ ID NO: 1041361 - RNA, 20 nt, Homo sapiens
caggaaagcuggugucugau

SEQ ID NO: 1041362 - RNA, 17 nt, Homo sapiens
caggaaaggcuccagga

SEQ ID NO: 1041363 - RNA, 23 nt, Homo sapiens
caggaaauauauaugugugugua

SEQ ID NO: 1041364 - RNA, 14 nt, Homo sapiens
caggaaaucaaaua

SEQ ID NO: 1041365 - RNA, 15 nt, Homo sapiens
caggaacagaaggau

SEQ ID NO: 1041366 - RNA, 16 nt, Homo sapiens
caggaagaugaaagag

SEQ ID NO: 1041367 - RNA, 13 nt, Homo sapiens
caggaagcucagg

SEQ ID NO: 1041368 - RNA, 12 nt, Homo sapiens
caggaaugggcu

SEQ ID NO: 1041369 - RNA, 20 nt, Homo sapiens
caggacaacuuuacaaaaca

SEQ ID NO: 1041370 - RNA, 13 nt, Homo sapiens
caggacaagagaa

SEQ ID NO: 1041371 - RNA, 15 nt, Homo sapiens
caggacagguggugc

SEQ ID NO: 1041372 - RNA, 16 nt, Homo sapiens
caggacccugggacca

SEQ ID NO: 1041373 - RNA, 20 nt, Homo sapiens
caggacccugggaccacaga

SEQ ID NO: 1041374 - RNA, 12 nt, Homo sapiens
caggacuagcug

SEQ ID NO: 1041375 - RNA, 21 nt, Homo sapiens
caggacuccaucucuuaaaaa

SEQ ID NO: 1041376 - RNA, 19 nt, Homo sapiens
caggacucugacgucucuu

SEQ ID NO: 1041377 - RNA, 20 nt, Homo sapiens
caggacugaucgauuugcac

SEQ ID NO: 1041378 - RNA, 17 nt, Homo sapiens
caggagaaccacuacau

SEQ ID NO: 1041379 - RNA, 18 nt, Homo sapiens
caggagaaucacuugaac

SEQ ID NO: 1041380 - RNA, 21 nt, Homo sapiens
caggagaauuuuacuguguuu

SEQ ID NO: 1041381 - RNA, 21 nt, Homo sapiens
caggagagaaugcccagugac

SEQ ID NO: 1041382 - RNA, 23 nt, Homo sapiens
caggagcaaauguuucugcagua

SEQ ID NO: 1041383 - RNA, 17 nt, Homo sapiens
caggagcauggggauaa

SEQ ID NO: 1041384 - RNA, 15 nt, Homo sapiens
caggaggauggcaaa

SEQ ID NO: 1041385 - RNA, 20 nt, Homo sapiens
caggaggcagcuguugcagu

SEQ ID NO: 1041386 - RNA, 22 nt, Homo sapiens
caggaggcagcuguugcaguga

SEQ ID NO: 1041387 - RNA, 20 nt, Homo sapiens
caggaggcccccaucuauga

SEQ ID NO: 1041388 - RNA, 19 nt, Homo sapiens
caggagguaaagaaauagc

SEQ ID NO: 1041389 - RNA, 19 nt, Homo sapiens
caggaguacaccccaacag

SEQ ID NO: 1041390 - RNA, 13 nt, Homo sapiens
caggagucccugc

SEQ ID NO: 1041391 - RNA, 20 nt, Homo sapiens
caggaguguggccacguggg

SEQ ID NO: 1041392 - RNA, 17 nt, Homo sapiens
caggauaagagggauua

SEQ ID NO: 1041393 - RNA, 22 nt, Homo sapiens
caggauccuauucucaccagga

SEQ ID NO: 1041394 - RNA, 21 nt, Homo sapiens
caggauugaccuuugcacgaa

SEQ ID NO: 1041395 - RNA, 17 nt, Homo sapiens
caggauuuguuguucug

SEQ ID NO: 1041396 - RNA, 18 nt, Homo sapiens
caggauuuguuguucuga

SEQ ID NO: 1041397 - RNA, 14 nt, Homo sapiens
caggcaaacuugca

SEQ ID NO: 1041398 - RNA, 17 nt, Homo sapiens
caggcaaagugcugcug

SEQ ID NO: 1041399 - RNA, 13 nt, Homo sapiens
caggcaagcaccu

SEQ ID NO: 1041400 - RNA, 12 nt, Homo sapiens
caggcacaaaau

SEQ ID NO: 1041401 - RNA, 17 nt, Homo sapiens
caggcacccaccaucau

SEQ ID NO: 1041402 - RNA, 20 nt, Homo sapiens
caggcagaucccacuugcag

SEQ ID NO: 1041403 - RNA, 16 nt, Homo sapiens
caggcagaucugugcc

SEQ ID NO: 1041404 - RNA, 22 nt, Homo sapiens
caggcagcauuuagcacauacu

SEQ ID NO: 1041405 - RNA, 18 nt, Homo sapiens
caggcagcgauggucuca

SEQ ID NO: 1041406 - RNA, 15 nt, Homo sapiens
caggcagggucuguu

SEQ ID NO: 1041407 - RNA, 13 nt, Homo sapiens
caggcaugcaugu

SEQ ID NO: 1041408 - RNA, 17 nt, Homo sapiens
caggcaugcaugugcuu

SEQ ID NO: 1041409 - RNA, 22 nt, Homo sapiens
caggcaugugccacccacccaa

SEQ ID NO: 1041410 - RNA, 13 nt, Homo sapiens
caggccaccugcc

SEQ ID NO: 1041411 - RNA, 14 nt, Homo sapiens
caggccaggccacc

SEQ ID NO: 1041412 - RNA, 18 nt, Homo sapiens
caggccauugucccugaa

SEQ ID NO: 1041413 - RNA, 20 nt, Homo sapiens
caggccauugucccugaaga

SEQ ID NO: 1041414 - RNA, 17 nt, Homo sapiens
caggcccacagcccagc

SEQ ID NO: 1041415 - RNA, 23 nt, Homo sapiens
caggcccuccuugucuuuuuacu

SEQ ID NO: 1041416 - RNA, 18 nt, Homo sapiens
caggccgggguggagcau

SEQ ID NO: 1041417 - RNA, 22 nt, Homo sapiens
caggccucuuggcagucacauc

SEQ ID NO: 1041418 - RNA, 21 nt, Homo sapiens
caggccuuaauuuucaguaua

SEQ ID NO: 1041419 - RNA, 19 nt, Homo sapiens
caggccuuaccgcucuguu

SEQ ID NO: 1041420 - RNA, 16 nt, Homo sapiens
caggccuuaucuccaa

SEQ ID NO: 1041421 - RNA, 16 nt, Homo sapiens
caggcgaugugcaagu

SEQ ID NO: 1041422 - RNA, 15 nt, Homo sapiens
caggcgugaccugcc

SEQ ID NO: 1041423 - RNA, 16 nt, Homo sapiens
caggcucagaucucau

SEQ ID NO: 1041424 - RNA, 19 nt, Homo sapiens
caggcuggagugcaaugca

SEQ ID NO: 1041425 - RNA, 19 nt, Homo sapiens
caggcuggagugcaauggc

SEQ ID NO: 1041426 - RNA, 20 nt, Homo sapiens
caggcuggagugcaauggcg

SEQ ID NO: 1041427 - RNA, 21 nt, Homo sapiens
caggcuggcgcagccaaggcc

SEQ ID NO: 1041428 - RNA, 18 nt, Homo sapiens
caggcuggucuugaacuc

SEQ ID NO: 1041429 - RNA, 17 nt, Homo sapiens
caggcuguucaccacca

SEQ ID NO: 1041430 - RNA, 20 nt, Homo sapiens
cagggaagccccacuugaag

SEQ ID NO: 1041431 - RNA, 19 nt, Homo sapiens
cagggaagcugucccucac

SEQ ID NO: 1041432 - RNA, 15 nt, Homo sapiens
cagggacagagccau

SEQ ID NO: 1041433 - RNA, 13 nt, Homo sapiens
cagggacuugaac

SEQ ID NO: 1041434 - RNA, 18 nt, Homo sapiens
cagggauucuuccugcuu

SEQ ID NO: 1041435 - RNA, 20 nt, Homo sapiens
cagggauucuuccugcuuag

SEQ ID NO: 1041436 - RNA, 14 nt, Homo sapiens
cagggccucaaagu

SEQ ID NO: 1041437 - RNA, 13 nt, Homo sapiens
cagggccugagcc

SEQ ID NO: 1041438 - RNA, 18 nt, Homo sapiens
cagggcucagccuggugg

SEQ ID NO: 1041439 - RNA, 19 nt, Homo sapiens
cagggcucccugcccugac

SEQ ID NO: 1041440 - RNA, 22 nt, Homo sapiens
cagggcucuaaugugucucuca

SEQ ID NO: 1041441 - RNA, 13 nt, Homo sapiens
cagggcugauaag

SEQ ID NO: 1041442 - RNA, 12 nt, Homo sapiens
cagggcugugau

SEQ ID NO: 1041443 - RNA, 14 nt, Homo sapiens
cagggcugugaucg

SEQ ID NO: 1041444 - RNA, 15 nt, Homo sapiens
cagggcuguguguac

SEQ ID NO: 1041445 - RNA, 22 nt, Homo sapiens
caggggacuugaaucuuuccaa

SEQ ID NO: 1041446 - RNA, 18 nt, Homo sapiens
caggggaguguucagggc

SEQ ID NO: 1041447 - RNA, 14 nt, Homo sapiens
cagggggaaggugg

SEQ ID NO: 1041448 - RNA, 23 nt, Homo sapiens
caggggucucccuggagugcagu

SEQ ID NO: 1041449 - RNA, 22 nt, Homo sapiens
cagggucucuagugcugugaaa

SEQ ID NO: 1041450 - RNA, 19 nt, Homo sapiens
caggguggucuugaucucc

SEQ ID NO: 1041451 - RNA, 19 nt, Homo sapiens
caggguugagguccagccc

SEQ ID NO: 1041452 - RNA, 20 nt, Homo sapiens
caggguuucaccauguuggc

SEQ ID NO: 1041453 - RNA, 21 nt, Homo sapiens
caggguuucaccauguuggcc

SEQ ID NO: 1041454 - RNA, 20 nt, Homo sapiens
caggguuucgagaagcugcu

SEQ ID NO: 1041455 - RNA, 20 nt, Homo sapiens
caggguuuugccauguuggc

SEQ ID NO: 1041456 - RNA, 21 nt, Homo sapiens
cagguaacgucuguaagcuga

SEQ ID NO: 1041457 - RNA, 14 nt, Homo sapiens
caggucaacuucag

SEQ ID NO: 1041458 - RNA, 13 nt, Homo sapiens
caggucccacugc

SEQ ID NO: 1041459 - RNA, 20 nt, Homo sapiens
cagguccuuuccacccugag

SEQ ID NO: 1041460 - RNA, 23 nt, Homo sapiens
caggucuucucuccaacucuuca

SEQ ID NO: 1041461 - RNA, 17 nt, Homo sapiens
caggugaacugggagca

SEQ ID NO: 1041462 - RNA, 13 nt, Homo sapiens
caggugaagcacc

SEQ ID NO: 1041463 - RNA, 21 nt, Homo sapiens
caggugauccacccaccucag

SEQ ID NO: 1041464 - RNA, 19 nt, Homo sapiens
caggugccaguuauggcua

SEQ ID NO: 1041465 - RNA, 16 nt, Homo sapiens
caggugcuuguggaca

SEQ ID NO: 1041466 - RNA, 17 nt, Homo sapiens
cagguggccccaguuca

SEQ ID NO: 1041467 - RNA, 19 nt, Homo sapiens
caggugguaagcaccagga

SEQ ID NO: 1041468 - RNA, 19 nt, Homo sapiens
caggugugccgacagaagg

SEQ ID NO: 1041469 - RNA, 22 nt, Homo sapiens
cagguucaugccaccauggcca

SEQ ID NO: 1041470 - RNA, 17 nt, Homo sapiens
cagguucugacucuugg

SEQ ID NO: 1041471 - RNA, 15 nt, Homo sapiens
cagguuuuucaauua

SEQ ID NO: 1041472 - RNA, 21 nt, Homo sapiens
caguaaacuuuggcuuauaaa

SEQ ID NO: 1041473 - RNA, 16 nt, Homo sapiens
caguaaaucucacaaa

SEQ ID NO: 1041474 - RNA, 17 nt, Homo sapiens
caguaaaucucacaaau

SEQ ID NO: 1041475 - RNA, 21 nt, Homo sapiens
caguaaauggcuuauccagcu

SEQ ID NO: 1041476 - RNA, 16 nt, Homo sapiens
caguaacgcaggggaa

SEQ ID NO: 1041477 - RNA, 17 nt, Homo sapiens
caguaacuccccaacuc

SEQ ID NO: 1041478 - RNA, 14 nt, Homo sapiens
caguaacuuuaugu

SEQ ID NO: 1041479 - RNA, 21 nt, Homo sapiens
caguaauuuuaaguaauuuca

SEQ ID NO: 1041480 - RNA, 16 nt, Homo sapiens
caguacccucucagcu

SEQ ID NO: 1041481 - RNA, 14 nt, Homo sapiens
caguaccuccugcc

SEQ ID NO: 1041482 - RNA, 18 nt, Homo sapiens
caguagaaagcauaacaa

SEQ ID NO: 1041483 - RNA, 19 nt, Homo sapiens
caguagaaauaauaugcau

SEQ ID NO: 1041484 - RNA, 20 nt, Homo sapiens
caguagggaugaguacccaa

SEQ ID NO: 1041485 - RNA, 16 nt, Homo sapiens
caguagguuggcagua

SEQ ID NO: 1041486 - RNA, 12 nt, Homo sapiens
caguaguaucaa

SEQ ID NO: 1041487 - RNA, 15 nt, Homo sapiens
caguaugagucaaug

SEQ ID NO: 1041488 - RNA, 17 nt, Homo sapiens
caguaugagucaaugug

SEQ ID NO: 1041489 - RNA, 14 nt, Homo sapiens
caguauuaagugug

SEQ ID NO: 1041490 - RNA, 16 nt, Homo sapiens
cagucaaguucagagu

SEQ ID NO: 1041491 - RNA, 20 nt, Homo sapiens
cagucagaguugugcacaug

SEQ ID NO: 1041492 - RNA, 15 nt, Homo sapiens
caguccacugcugag

SEQ ID NO: 1041493 - RNA, 21 nt, Homo sapiens
cagucccagcuaacucugacc

SEQ ID NO: 1041494 - RNA, 23 nt, Homo sapiens
cagucccuaaagaaaaaaaauca

SEQ ID NO: 1041495 - RNA, 21 nt, Homo sapiens
caguccugggauguggcugca

SEQ ID NO: 1041496 - RNA, 13 nt, Homo sapiens
cagucuacccaga

SEQ ID NO: 1041497 - RNA, 16 nt, Homo sapiens
cagucugauccaggag

SEQ ID NO: 1041498 - RNA, 23 nt, Homo sapiens
cagucuuccucccuguguauuca

SEQ ID NO: 1041499 - RNA, 15 nt, Homo sapiens
cagugaaccaaagag

SEQ ID NO: 1041500 - RNA, 21 nt, Homo sapiens
cagugaaccaaagagacugga

SEQ ID NO: 1041501 - RNA, 20 nt, Homo sapiens
cagugaaggcuguccuuacc

SEQ ID NO: 1041502 - RNA, 15 nt, Homo sapiens
caucucagugcugua

SEQ ID NO: 1041503 - RNA, 18 nt, Homo sapiens
caucuccaagaaugcuga

SEQ ID NO: 1041504 - RNA, 20 nt, Homo sapiens
caucucuacugaaaguacaa

SEQ ID NO: 1041505 - RNA, 23 nt, Homo sapiens
caucucucccuccccugccauuu

SEQ ID NO: 1041506 - RNA, 22 nt, Homo sapiens
cacaccccagacgaugucuuca

SEQ ID NO: 1041507 - RNA, 20 nt, Homo sapiens
cacacccgccgccuccugca

SEQ ID NO: 1041508 - RNA, 19 nt, Homo sapiens
cacaccucuccuuugugac

SEQ ID NO: 1041509 - RNA, 13 nt, Homo sapiens
cacaccuguaauc

SEQ ID NO: 1041510 - RNA, 19 nt, Homo sapiens
cacacggggugcgucuccc

SEQ ID NO: 1041511 - RNA, 19 nt, Homo sapiens
cacacgucauguuucuuca

SEQ ID NO: 1041512 - RNA, 18 nt, Homo sapiens
cacacucaccucuaaaac

SEQ ID NO: 1041513 - RNA, 18 nt, Homo sapiens
cacacuccccugcacugg

SEQ ID NO: 1041514 - RNA, 19 nt, Homo sapiens
cacacuguucugaaaguga

SEQ ID NO: 1041515 - RNA, 19 nt, Homo sapiens
cacacuguugucaaaaagu

SEQ ID NO: 1041516 - RNA, 15 nt, Homo sapiens
cacacuugugugugg

SEQ ID NO: 1041517 - RNA, 18 nt, Homo sapiens
cacacuuuccgcuuucac

SEQ ID NO: 1041518 - RNA, 12 nt, Homo sapiens
cacacuuugcca

SEQ ID NO: 1041519 - RNA, 16 nt, Homo sapiens
cacagaaacauuuuca

SEQ ID NO: 1041520 - RNA, 20 nt, Homo sapiens
cacagaaagacugagcucaa

SEQ ID NO: 1041521 - RNA, 15 nt, Homo sapiens
cacagacaccagcaa

SEQ ID NO: 1041522 - RNA, 16 nt, Homo sapiens
cacagacugcgauuug

SEQ ID NO: 1041523 - RNA, 14 nt, Homo sapiens
cacagagaguccca

SEQ ID NO: 1041524 - RNA, 15 nt, Homo sapiens
cacagaggacucacu

SEQ ID NO: 1041525 - RNA, 16 nt, Homo sapiens
cacagauaaaguuuuc

SEQ ID NO: 1041526 - RNA, 21 nt, Homo sapiens
cacagcaagggugaugggaaa

SEQ ID NO: 1041527 - RNA, 13 nt, Homo sapiens
cacagcacccaug

SEQ ID NO: 1041528 - RNA, 21 nt, Homo sapiens
cacagcagccccugcacaaag

SEQ ID NO: 1041529 - RNA, 19 nt, Homo sapiens
cacagcaggagggacaaug

SEQ ID NO: 1041530 - RNA, 20 nt, Homo sapiens
cacagcaggcuuucaagaag

SEQ ID NO: 1041531 - RNA, 22 nt, Homo sapiens
cacagcaggugcugagcaaagg

SEQ ID NO: 1041532 - RNA, 19 nt, Homo sapiens
cacagcguccuguccacac

SEQ ID NO: 1041533 - RNA, 20 nt, Homo sapiens
cacagcucccauaaccgcug

SEQ ID NO: 1041534 - RNA, 18 nt, Homo sapiens
cacaggacaacuuuacaa

SEQ ID NO: 1041535 - RNA, 15 nt, Homo sapiens
cacaggcagcauuua

SEQ ID NO: 1041536 - RNA, 18 nt, Homo sapiens
cacaggcagguccagggu

SEQ ID NO: 1041537 - RNA, 14 nt, Homo sapiens
cacaggcccggcuc

SEQ ID NO: 1041538 - RNA, 23 nt, Homo sapiens
cacaguauuacuucugcuacaua

SEQ ID NO: 1041539 - RNA, 22 nt, Homo sapiens
cacagucucuuuaaucuucagu

SEQ ID NO: 1041540 - RNA, 23 nt, Homo sapiens
cacagugugaaucuuggugucua

SEQ ID NO: 1041541 - RNA, 18 nt, Homo sapiens
cacaguucuccauuucac

SEQ ID NO: 1041542 - RNA, 22 nt, Homo sapiens
cacaguucuccauuucacuuga

SEQ ID NO: 1041543 - RNA, 23 nt, Homo sapiens
cacaguuuauuuuuauacuuuca

SEQ ID NO: 1041544 - RNA, 19 nt, Homo sapiens
cacaguuuugguugcuuua

SEQ ID NO: 1041545 - RNA, 23 nt, Homo sapiens
cacauaccuggcccugugccuug

SEQ ID NO: 1041546 - RNA, 17 nt, Homo sapiens
cacauacuacacauuca

SEQ ID NO: 1041547 - RNA, 16 nt, Homo sapiens
cacauagauaccuuca

SEQ ID NO: 1041548 - RNA, 18 nt, Homo sapiens
cacauauggacucugcac

SEQ ID NO: 1041549 - RNA, 22 nt, Homo sapiens
cacauauggacucugcacauga

SEQ ID NO: 1041550 - RNA, 15 nt, Homo sapiens
cacaucccuuugaaa

SEQ ID NO: 1041551 - RNA, 17 nt, Homo sapiens
cacauccugaccuugca

SEQ ID NO: 1041552 - RNA, 20 nt, Homo sapiens
cacauccugaccuugcacaa

SEQ ID NO: 1041553 - RNA, 14 nt, Homo sapiens
cacaugcacgugug

SEQ ID NO: 1041554 - RNA, 19 nt, Homo sapiens
cacaugcacgugugugcac

SEQ ID NO: 1041555 - RNA, 17 nt, Homo sapiens
cacaugccaagcacugu

SEQ ID NO: 1041556 - RNA, 18 nt, Homo sapiens
cacauggaacgcuuucau

SEQ ID NO: 1041557 - RNA, 16 nt, Homo sapiens
cacauggccuaugcac

SEQ ID NO: 1041558 - RNA, 22 nt, Homo sapiens
cacaugucuuguacauguguag

SEQ ID NO: 1041559 - RNA, 18 nt, Homo sapiens
cacaugugacacauaugc

SEQ ID NO: 1041560 - RNA, 14 nt, Homo sapiens
cacaugugugcgug

SEQ ID NO: 1041561 - RNA, 16 nt, Homo sapiens
cacauucaauaagcau

SEQ ID NO: 1041562 - RNA, 12 nt, Homo sapiens
cacauuccugau

SEQ ID NO: 1041563 - RNA, 18 nt, Homo sapiens
cacauucuggcucaggga

SEQ ID NO: 1041564 - RNA, 17 nt, Homo sapiens
cacauugagucuaucaa

SEQ ID NO: 1041565 - RNA, 19 nt, Homo sapiens
cacauuuauucugcucaca

SEQ ID NO: 1041566 - RNA, 20 nt, Homo sapiens
cacauuuauuuuuauaucua

SEQ ID NO: 1041567 - RNA, 22 nt, Homo sapiens
caccaaaagaagaaaccuucau

SEQ ID NO: 1041568 - RNA, 21 nt, Homo sapiens
caccaauauuucucagacauc

SEQ ID NO: 1041569 - RNA, 16 nt, Homo sapiens
caccacagacacacac

SEQ ID NO: 1041570 - RNA, 15 nt, Homo sapiens
caccacaugugcaca

SEQ ID NO: 1041571 - RNA, 19 nt, Homo sapiens
caccacggccucacccagg

SEQ ID NO: 1041572 - RNA, 18 nt, Homo sapiens
caccacgguagugccuga

SEQ ID NO: 1041573 - RNA, 14 nt, Homo sapiens
caccacuggccacc

SEQ ID NO: 1041574 - RNA, 14 nt, Homo sapiens
caccaggcccacag

SEQ ID NO: 1041575 - RNA, 23 nt, Homo sapiens
caccagggacuaugaaugggcaa

SEQ ID NO: 1041576 - RNA, 15 nt, Homo sapiens
caccaggucagggag

SEQ ID NO: 1041577 - RNA, 15 nt, Homo sapiens
caccagucacugucc

SEQ ID NO: 1041578 - RNA, 22 nt, Homo sapiens
caccaguguccccuccacuguc

SEQ ID NO: 1041579 - RNA, 14 nt, Homo sapiens
caccaguugccguu

SEQ ID NO: 1041580 - RNA, 22 nt, Homo sapiens
caccaucuuuugugagauguaa

SEQ ID NO: 1041581 - RNA, 15 nt, Homo sapiens
caccauuaacuccuc

SEQ ID NO: 1041582 - RNA, 16 nt, Homo sapiens
caccauucaggucuuu

SEQ ID NO: 1041583 - RNA, 16 nt, Homo sapiens
caccauuggaccccac

SEQ ID NO: 1041584 - RNA, 15 nt, Homo sapiens
cacccaacaagccau

SEQ ID NO: 1041585 - RNA, 22 nt, Homo sapiens
cacccaacugucucgaugcaau

SEQ ID NO: 1041586 - RNA, 13 nt, Homo sapiens
cacccacauguga

SEQ ID NO: 1041587 - RNA, 17 nt, Homo sapiens
cacccaggcaucugcuu

SEQ ID NO: 1041588 - RNA, 18 nt, Homo sapiens
cacccaggcuggagugca

SEQ ID NO: 1041589 - RNA, 19 nt, Homo sapiens
cacccaggcuggagugcaa

SEQ ID NO: 1041590 - RNA, 18 nt, Homo sapiens
cacccaugaaucaaagac

SEQ ID NO: 1041591 - RNA, 14 nt, Homo sapiens
cacccccgugucca

SEQ ID NO: 1041592 - RNA, 18 nt, Homo sapiens
cacccccucuguugcaca

SEQ ID NO: 1041593 - RNA, 21 nt, Homo sapiens
caccccgucguauacccugga

SEQ ID NO: 1041594 - RNA, 16 nt, Homo sapiens
caccccuuauccagga

SEQ ID NO: 1041595 - RNA, 16 nt, Homo sapiens
cacccgacuccucaaa

SEQ ID NO: 1041596 - RNA, 17 nt, Homo sapiens
cacccucccacugccaa

SEQ ID NO: 1041597 - RNA, 17 nt, Homo sapiens
cacccuccugucuuccc

SEQ ID NO: 1041598 - RNA, 23 nt, Homo sapiens
cacccuggggccuggaccugccu

SEQ ID NO: 1041599 - RNA, 16 nt, Homo sapiens
cacccuucucauucca

SEQ ID NO: 1041600 - RNA, 15 nt, Homo sapiens
caccgacaacaugcu

SEQ ID NO: 1041601 - RNA, 18 nt, Homo sapiens
caccgagacaccaccuau

SEQ ID NO: 1041602 - RNA, 22 nt, Homo sapiens
caccgcgcccagccucaucucu

SEQ ID NO: 1041603 - RNA, 18 nt, Homo sapiens
caccggccuugcauugcc

SEQ ID NO: 1041604 - RNA, 21 nt, Homo sapiens
caccguggaccuuccugccac

SEQ ID NO: 1041605 - RNA, 21 nt, Homo sapiens
caccuaauguuuaugagccag

SEQ ID NO: 1041606 - RNA, 22 nt, Homo sapiens
caccuaccaucagggacaggau

SEQ ID NO: 1041607 - RNA, 19 nt, Homo sapiens
caccuacgcgagucuuacu

SEQ ID NO: 1041608 - RNA, 15 nt, Homo sapiens
caccuagacuguaaa

SEQ ID NO: 1041609 - RNA, 23 nt, Homo sapiens
caccuagcaucucaugagugcca

SEQ ID NO: 1041610 - RNA, 17 nt, Homo sapiens
caccuagcgucaguauu

SEQ ID NO: 1041611 - RNA, 12 nt, Homo sapiens
caccuaugugcc

SEQ ID NO: 1041612 - RNA, 21 nt, Homo sapiens
caccucagaguauggagcuca

SEQ ID NO: 1041613 - RNA, 20 nt, Homo sapiens
caccuccucauguacauacc

SEQ ID NO: 1041614 - RNA, 16 nt, Homo sapiens
caccugaaugugucug

SEQ ID NO: 1041615 - RNA, 22 nt, Homo sapiens
caccugccugcaucugugaaaa

SEQ ID NO: 1041616 - RNA, 21 nt, Homo sapiens
caccuggaugucugggugacc

SEQ ID NO: 1041617 - RNA, 16 nt, Homo sapiens
caccugggcugaggca

SEQ ID NO: 1041618 - RNA, 15 nt, Homo sapiens
caccuggggcugcug

SEQ ID NO: 1041619 - RNA, 21 nt, Homo sapiens
caccugucaaacaaagccaga

SEQ ID NO: 1041620 - RNA, 18 nt, Homo sapiens
caccuguugcuuacaauu

SEQ ID NO: 1041621 - RNA, 16 nt, Homo sapiens
caccuucagacuuugc

SEQ ID NO: 1041622 - RNA, 14 nt, Homo sapiens
caccuuccaaagga

SEQ ID NO: 1041623 - RNA, 21 nt, Homo sapiens
caccuuccagcuccuguaaca

SEQ ID NO: 1041624 - RNA, 17 nt, Homo sapiens
caccuuccccagaacca

SEQ ID NO: 1041625 - RNA, 16 nt, Homo sapiens
caccuuggccucccaa

SEQ ID NO: 1041626 - RNA, 17 nt, Homo sapiens
caccuugugucuguaca

SEQ ID NO: 1041627 - RNA, 14 nt, Homo sapiens
caccuuuuaacuca

SEQ ID NO: 1041628 - RNA, 22 nt, Homo sapiens
caccuuuucagcgauguaugca

SEQ ID NO: 1041629 - RNA, 13 nt, Homo sapiens
cacgaaugaucuu

SEQ ID NO: 1041630 - RNA, 18 nt, Homo sapiens
cacgccauugcacuccag

SEQ ID NO: 1041631 - RNA, 13 nt, Homo sapiens
cacgccuguaauc

SEQ ID NO: 1041632 - RNA, 17 nt, Homo sapiens
cacgcuggagugcagug

SEQ ID NO: 1041633 - RNA, 18 nt, Homo sapiens
cacggaugacuuaacugc

SEQ ID NO: 1041634 - RNA, 21 nt, Homo sapiens
cacggcaaaaugucauuguuc

SEQ ID NO: 1041635 - RNA, 18 nt, Homo sapiens
cacggcuuguaaauguga

SEQ ID NO: 1041636 - RNA, 18 nt, Homo sapiens
cacgggcaugggcacucc

SEQ ID NO: 1041637 - RNA, 16 nt, Homo sapiens
cacgguagugccugaa

SEQ ID NO: 1041638 - RNA, 23 nt, Homo sapiens
cacgguggcucacgccuguaauu

SEQ ID NO: 1041639 - RNA, 16 nt, Homo sapiens
cacgguggcucaggcc

SEQ ID NO: 1041640 - RNA, 17 nt, Homo sapiens
cacgguggucacuggaa

SEQ ID NO: 1041641 - RNA, 20 nt, Homo sapiens
ccuguaucagcacuccucau

SEQ ID NO: 1041642 - RNA, 23 nt, Homo sapiens
ccuguaucuugggggacagggcu

SEQ ID NO: 1041643 - RNA, 18 nt, Homo sapiens
ccuguauucuacagcaga

SEQ ID NO: 1041644 - RNA, 20 nt, Homo sapiens
ccuguauucuacagcagaua

SEQ ID NO: 1041645 - RNA, 16 nt, Homo sapiens
ccuguccagaccuuug

SEQ ID NO: 1041646 - RNA, 17 nt, Homo sapiens
ccugucuuccugcauuc

SEQ ID NO: 1041647 - RNA, 15 nt, Homo sapiens
ccugucuuuaaggaa

SEQ ID NO: 1041648 - RNA, 17 nt, Homo sapiens
ccugugaccagcacugu

SEQ ID NO: 1041649 - RNA, 10 nt, Homo sapiens
ccugugagcu

SEQ ID NO: 1041650 - RNA, 15 nt, Homo sapiens
ccugugaggugcaga

SEQ ID NO: 1041651 - RNA, 23 nt, Homo sapiens
ccugugaugcuuugaaguacaau

SEQ ID NO: 1041652 - RNA, 19 nt, Homo sapiens
ccugugccuaacaccagcg

SEQ ID NO: 1041653 - RNA, 23 nt, Homo sapiens
ccuguuaccuacuuugacuuuuu

SEQ ID NO: 1041654 - RNA, 23 nt, Homo sapiens
ccuguuacuugaaauaccaguga

SEQ ID NO: 1041655 - RNA, 12 nt, Homo sapiens
ccuguuccucaa

SEQ ID NO: 1041656 - RNA, 18 nt, Homo sapiens
ccuguucucugaagaugu

SEQ ID NO: 1041657 - RNA, 20 nt, Homo sapiens
ccuguucucuuccacucucc

SEQ ID NO: 1041658 - RNA, 12 nt, Homo sapiens
ccuguugaagcu

SEQ ID NO: 1041659 - RNA, 20 nt, Homo sapiens
ccuuaacacugagcugucau

SEQ ID NO: 1041660 - RNA, 21 nt, Homo sapiens
ccuuaagggacaacauccuua

SEQ ID NO: 1041661 - RNA, 15 nt, Homo sapiens
ccuuaauauguuaac

SEQ ID NO: 1041662 - RNA, 22 nt, Homo sapiens
ccuuacagaacacgcuuucaca

SEQ ID NO: 1041663 - RNA, 14 nt, Homo sapiens
ccuuaccgcucugu

SEQ ID NO: 1041664 - RNA, 13 nt, Homo sapiens
ccuuagacagucc

SEQ ID NO: 1041665 - RNA, 14 nt, Homo sapiens
ccuuagacaguccc

SEQ ID NO: 1041666 - RNA, 16 nt, Homo sapiens
ccuuagauuagcucug

SEQ ID NO: 1041667 - RNA, 20 nt, Homo sapiens
ccuuagccaggaggccaggc

SEQ ID NO: 1041668 - RNA, 22 nt, Homo sapiens
ccuuagcuggcauuacagcugg

SEQ ID NO: 1041669 - RNA, 12 nt, Homo sapiens
ccuuauaguguu

SEQ ID NO: 1041670 - RNA, 20 nt, Homo sapiens
ccuuauuagagugucuuucc

SEQ ID NO: 1041671 - RNA, 21 nt, Homo sapiens
ccuuauuguaccucucuuaua

SEQ ID NO: 1041672 - RNA, 22 nt, Homo sapiens
ccuucaccucacugaaaacauc

SEQ ID NO: 1041673 - RNA, 13 nt, Homo sapiens
ccuucacuucuga

SEQ ID NO: 1041674 - RNA, 14 nt, Homo sapiens
ccuucacuuuacaa

SEQ ID NO: 1041675 - RNA, 22 nt, Homo sapiens
ccuucaugaucaucacaaucau

SEQ ID NO: 1041676 - RNA, 22 nt, Homo sapiens
ccuuccaacccauuagccauuu

SEQ ID NO: 1041677 - RNA, 20 nt, Homo sapiens
ccuuccacacucaccucuaa

SEQ ID NO: 1041678 - RNA, 21 nt, Homo sapiens
ccuuccagcacccugcaaaau

SEQ ID NO: 1041679 - RNA, 15 nt, Homo sapiens
ccuuccccagccucu

SEQ ID NO: 1041680 - RNA, 23 nt, Homo sapiens
ccuuccccagcgucccagucucu

SEQ ID NO: 1041681 - RNA, 17 nt, Homo sapiens
ccuuccucacuuccaua

SEQ ID NO: 1041682 - RNA, 19 nt, Homo sapiens
ccuuccugucccaccucuu

SEQ ID NO: 1041683 - RNA, 16 nt, Homo sapiens
ccuucgccucccagga

SEQ ID NO: 1041684 - RNA, 18 nt, Homo sapiens
ccuucgccucccaggaga

SEQ ID NO: 1041685 - RNA, 22 nt, Homo sapiens
ccuucuccacuggccggaguca

SEQ ID NO: 1041686 - RNA, 19 nt, Homo sapiens
ccuucuccauccacauggg

SEQ ID NO: 1041687 - RNA, 20 nt, Homo sapiens
ccuucucugcuccaccacau

SEQ ID NO: 1041688 - RNA, 19 nt, Homo sapiens
ccuucugaggacauuccaa

SEQ ID NO: 1041689 - RNA, 18 nt, Homo sapiens
ccuucuuuuuguucuuca

SEQ ID NO: 1041690 - RNA, 15 nt, Homo sapiens
ccuugaaaagacauc

SEQ ID NO: 1041691 - RNA, 19 nt, Homo sapiens
ccuugaaggucacucuucc

SEQ ID NO: 1041692 - RNA, 18 nt, Homo sapiens
ccuugagggcgucuucua

SEQ ID NO: 1041693 - RNA, 14 nt, Homo sapiens
ccuugaugcucaua

SEQ ID NO: 1041694 - RNA, 14 nt, Homo sapiens
ccuugauucacaau

SEQ ID NO: 1041695 - RNA, 13 nt, Homo sapiens
ccuugcacacucc

SEQ ID NO: 1041696 - RNA, 16 nt, Homo sapiens
ccuugcuacccagaaa

SEQ ID NO: 1041697 - RNA, 11 nt, Homo sapiens
ccuugcucugc

SEQ ID NO: 1041698 - RNA, 19 nt, Homo sapiens
ccuuggagggacaugacua

SEQ ID NO: 1041699 - RNA, 15 nt, Homo sapiens
ccuuggcucaauccu

SEQ ID NO: 1041700 - RNA, 15 nt, Homo sapiens
ccuugggaugaucuu

SEQ ID NO: 1041701 - RNA, 23 nt, Homo sapiens
ccuugggcacuuuuuaauucacc

SEQ ID NO: 1041702 - RNA, 14 nt, Homo sapiens
ccuuggugugaccc

SEQ ID NO: 1041703 - RNA, 11 nt, Homo sapiens
ccuugucuccc

SEQ ID NO: 1041704 - RNA, 12 nt, Homo sapiens
ccuugugaccca

SEQ ID NO: 1041705 - RNA, 16 nt, Homo sapiens
ccuugugcguggguga

SEQ ID NO: 1041706 - RNA, 14 nt, Homo sapiens
ccuuguggaaccaa

SEQ ID NO: 1041707 - RNA, 21 nt, Homo sapiens
ccuuguguacaguuauuuaug

SEQ ID NO: 1041708 - RNA, 23 nt, Homo sapiens
ccuuuaaaucugugaugauccuc

SEQ ID NO: 1041709 - RNA, 14 nt, Homo sapiens
ccuuuacuaaucca

SEQ ID NO: 1041710 - RNA, 22 nt, Homo sapiens
ccuuuagauauuauucauucau

SEQ ID NO: 1041711 - RNA, 17 nt, Homo sapiens
ccuuuaguaccugaaaa

SEQ ID NO: 1041712 - RNA, 16 nt, Homo sapiens
ccuuuaguggcuucau

SEQ ID NO: 1041713 - RNA, 19 nt, Homo sapiens
ccuuuauguggaaaacaga

SEQ ID NO: 1041714 - RNA, 13 nt, Homo sapiens
ccuuuccauuuau

SEQ ID NO: 1041715 - RNA, 16 nt, Homo sapiens
ccuuucccaucuucca

SEQ ID NO: 1041716 - RNA, 17 nt, Homo sapiens
ccuuuccccucccucag

SEQ ID NO: 1041717 - RNA, 17 nt, Homo sapiens
ccuuucucuaaaacugc

SEQ ID NO: 1041718 - RNA, 16 nt, Homo sapiens
ccuuugagacuauuga

SEQ ID NO: 1041719 - RNA, 22 nt, Homo sapiens
ccuuugagcaagccgagcucuc

SEQ ID NO: 1041720 - RNA, 17 nt, Homo sapiens
ccuuuggaaugcuguau

SEQ ID NO: 1041721 - RNA, 22 nt, Homo sapiens
ccuuuggauugacucugcauuu

SEQ ID NO: 1041722 - RNA, 17 nt, Homo sapiens
ccuuuggcagaguucua

SEQ ID NO: 1041723 - RNA, 21 nt, Homo sapiens
ccuuuggggugaacuaccuug

SEQ ID NO: 1041724 - RNA, 19 nt, Homo sapiens
ccuuuguauauuauuucua

SEQ ID NO: 1041725 - RNA, 19 nt, Homo sapiens
ccuuuguguagaaagccaa

SEQ ID NO: 1041726 - RNA, 15 nt, Homo sapiens
ccuuuuaacucaccu

SEQ ID NO: 1041727 - RNA, 21 nt, Homo sapiens
ccuuuuagccuaguucaucca

SEQ ID NO: 1041728 - RNA, 14 nt, Homo sapiens
ccuuuuauaccugc

SEQ ID NO: 1041729 - RNA, 12 nt, Homo sapiens
ccuuuuccagaa

SEQ ID NO: 1041730 - RNA, 13 nt, Homo sapiens
ccuuuugccaucc

SEQ ID NO: 1041731 - RNA, 18 nt, Homo sapiens
ccuuuuuuaaaaaugcaa

SEQ ID NO: 1041732 - RNA, 23 nt, Homo sapiens
ccuuuuuugaucaggcacagugg

SEQ ID NO: 1041733 - RNA, 17 nt, Homo sapiens
cgaaaaggauaugcagu

SEQ ID NO: 1041734 - RNA, 20 nt, Homo sapiens
cgaaacuccauugagucauu

SEQ ID NO: 1041735 - RNA, 16 nt, Homo sapiens
cgaaccaggaaaugga

SEQ ID NO: 1041736 - RNA, 13 nt, Homo sapiens
cgaagucuuccau

SEQ ID NO: 1041737 - RNA, 19 nt, Homo sapiens
cgaauauuaugcccaguuu

SEQ ID NO: 1041738 - RNA, 14 nt, Homo sapiens
cgaauggcagcaua

SEQ ID NO: 1041739 - RNA, 16 nt, Homo sapiens
cgacaaagcuacuuga

SEQ ID NO: 1041740 - RNA, 17 nt, Homo sapiens
cgacagagccagacugu

SEQ ID NO: 1041741 - RNA, 16 nt, Homo sapiens
cgacugaugaaggcau

SEQ ID NO: 1041742 - RNA, 20 nt, Homo sapiens
cgagacuugguuucaaaaaa

SEQ ID NO: 1041743 - RNA, 19 nt, Homo sapiens
cgagaucacgccacugcac

SEQ ID NO: 1041744 - RNA, 21 nt, Homo sapiens
cgagaucacgccacugcacuc

SEQ ID NO: 1041745 - RNA, 20 nt, Homo sapiens
cgagaucgcgccacugcacu

SEQ ID NO: 1041746 - RNA, 16 nt, Homo sapiens
cgagcacuguccagua

SEQ ID NO: 1041747 - RNA, 14 nt, Homo sapiens
cgagccaggaacug

SEQ ID NO: 1041748 - RNA, 22 nt, Homo sapiens
cgagccucugucacugcaggca

SEQ ID NO: 1041749 - RNA, 19 nt, Homo sapiens
cgagcugggggccaugagc

SEQ ID NO: 1041750 - RNA, 20 nt, Homo sapiens
cgaggacuguauuugugacu

SEQ ID NO: 1041751 - RNA, 20 nt, Homo sapiens
cgaggccccugucucagggu

SEQ ID NO: 1041752 - RNA, 15 nt, Homo sapiens
cgaggggcucaggaa

SEQ ID NO: 1041753 - RNA, 18 nt, Homo sapiens
cgaggggcucucagcuca

SEQ ID NO: 1041754 - RNA, 10 nt, Homo sapiens
cgaguacuuc

SEQ ID NO: 1041755 - RNA, 22 nt, Homo sapiens
cuacaagccacgaaugaaugaa

SEQ ID NO: 1041756 - RNA, 19 nt, Homo sapiens
cuacaaggcuggcagugac

SEQ ID NO: 1041757 - RNA, 22 nt, Homo sapiens
cuacacauucaauaagcaucaa

SEQ ID NO: 1041758 - RNA, 22 nt, Homo sapiens
cuacagacaccaaguuccguca

SEQ ID NO: 1041759 - RNA, 14 nt, Homo sapiens
cuacagaggccaug

SEQ ID NO: 1041760 - RNA, 19 nt, Homo sapiens
cuacagauagucaaaccau

SEQ ID NO: 1041761 - RNA, 20 nt, Homo sapiens
cuacaggaagcaccccaugc

SEQ ID NO: 1041762 - RNA, 14 nt, Homo sapiens
cuacauacacagug

SEQ ID NO: 1041763 - RNA, 11 nt, Homo sapiens
cuacaugccuc

SEQ ID NO: 1041764 - RNA, 15 nt, Homo sapiens
cuacauuuuaaugca

SEQ ID NO: 1041765 - RNA, 14 nt, Homo sapiens
cuaccaauguagac

SEQ ID NO: 1041766 - RNA, 13 nt, Homo sapiens
cuaccacaguguc

SEQ ID NO: 1041767 - RNA, 15 nt, Homo sapiens
cuaccacagugucug

SEQ ID NO: 1041768 - RNA, 21 nt, Homo sapiens
cuaccagguguucuacacuca

SEQ ID NO: 1041769 - RNA, 22 nt, Homo sapiens
cuaccauuugcagaguccugca

SEQ ID NO: 1041770 - RNA, 15 nt, Homo sapiens
cuaccccuuuacaaa

SEQ ID NO: 1041771 - RNA, 19 nt, Homo sapiens
cuacccuuccagugcccua

SEQ ID NO: 1041772 - RNA, 18 nt, Homo sapiens
cuaccucaggcagcucaa

SEQ ID NO: 1041773 - RNA, 13 nt, Homo sapiens
cuaccucagguug

SEQ ID NO: 1041774 - RNA, 13 nt, Homo sapiens
cuaccugucugua

SEQ ID NO: 1041775 - RNA, 18 nt, Homo sapiens
cuaccuuuugcuguggca

SEQ ID NO: 1041776 - RNA, 22 nt, Homo sapiens
cuacgucaaacaugaagugugu

SEQ ID NO: 1041777 - RNA, 23 nt, Homo sapiens
cuacuaaaaauacaauuagccag

SEQ ID NO: 1041778 - RNA, 21 nt, Homo sapiens
cuacuccucugcagugccuug

SEQ ID NO: 1041779 - RNA, 23 nt, Homo sapiens
cuacucuaggcagugacagugcc

SEQ ID NO: 1041780 - RNA, 14 nt, Homo sapiens
cuacugagccuuca

SEQ ID NO: 1041781 - RNA, 16 nt, Homo sapiens
cuacugaggugcuaug

SEQ ID NO: 1041782 - RNA, 19 nt, Homo sapiens
cuacuuuuuuuugacauaa

SEQ ID NO: 1041783 - RNA, 20 nt, Homo sapiens
cuagaaauaagcccaacaga

SEQ ID NO: 1041784 - RNA, 18 nt, Homo sapiens
cuagaaccuguagagcua

SEQ ID NO: 1041785 - RNA, 19 nt, Homo sapiens
cuagagauuugguguacaa

SEQ ID NO: 1041786 - RNA, 22 nt, Homo sapiens
cuagaggcuugcauaauaagcu

SEQ ID NO: 1041787 - RNA, 15 nt, Homo sapiens
cuagagggggucuca

SEQ ID NO: 1041788 - RNA, 14 nt, Homo sapiens
cuagagguacuuuc

SEQ ID NO: 1041789 - RNA, 14 nt, Homo sapiens
cuagaguguuguug

SEQ ID NO: 1041790 - RNA, 17 nt, Homo sapiens
cuagauacaugcuuuuu

SEQ ID NO: 1041791 - RNA, 20 nt, Homo sapiens
cuagaugauugauuaccaag

SEQ ID NO: 1041792 - RNA, 19 nt, Homo sapiens
cuagauuuucuacuuuauu

SEQ ID NO: 1041793 - RNA, 14 nt, Homo sapiens
cuagcagaaaucua

SEQ ID NO: 1041794 - RNA, 17 nt, Homo sapiens
cuagcaucucaugagug

SEQ ID NO: 1041795 - RNA, 13 nt, Homo sapiens
ccccuugcucuca

SEQ ID NO: 1041796 - RNA, 14 nt, Homo sapiens
ccccuuggcuguga

SEQ ID NO: 1041797 - RNA, 20 nt, Homo sapiens
ccccuuuacucauagcacuu

SEQ ID NO: 1041798 - RNA, 20 nt, Homo sapiens
ccccuuuucugcauuuugcu

SEQ ID NO: 1041799 - RNA, 18 nt, Homo sapiens
cccgaguaacugagauua

SEQ ID NO: 1041800 - RNA, 22 nt, Homo sapiens
cccgccacccucccacugccaa

SEQ ID NO: 1041801 - RNA, 22 nt, Homo sapiens
cccgccucuucuucuucagaag

SEQ ID NO: 1041802 - RNA, 12 nt, Homo sapiens
cccgcucugcag

SEQ ID NO: 1041803 - RNA, 13 nt, Homo sapiens
cccggaguucagu

SEQ ID NO: 1041804 - RNA, 23 nt, Homo sapiens
cccgggacgcagggguugcagug

SEQ ID NO: 1041805 - RNA, 19 nt, Homo sapiens
cccgggcugccugggcugu

SEQ ID NO: 1041806 - RNA, 17 nt, Homo sapiens
cccggggcuccacugaa

SEQ ID NO: 1041807 - RNA, 20 nt, Homo sapiens
cccgucauguuccucaaaag

SEQ ID NO: 1041808 - RNA, 18 nt, Homo sapiens
cccgucgaggggcucuca

SEQ ID NO: 1041809 - RNA, 18 nt, Homo sapiens
cccgugggagucaucuca

SEQ ID NO: 1041810 - RNA, 21 nt, Homo sapiens
cccuaaaccaaaaacugaaag

SEQ ID NO: 1041811 - RNA, 15 nt, Homo sapiens
cccuacucaccugag

SEQ ID NO: 1041812 - RNA, 17 nt, Homo sapiens
cccuagucuuuuaaaca

SEQ ID NO: 1041813 - RNA, 22 nt, Homo sapiens
cccuauggaagcauauuguuau

SEQ ID NO: 1041814 - RNA, 23 nt, Homo sapiens
cccuaugugggugggaccacaga

SEQ ID NO: 1041815 - RNA, 20 nt, Homo sapiens
cccucaaaugacccaaagac

SEQ ID NO: 1041816 - RNA, 19 nt, Homo sapiens
cccucaacugugucugaug

SEQ ID NO: 1041817 - RNA, 18 nt, Homo sapiens
cccucacagcacagagaa

SEQ ID NO: 1041818 - RNA, 12 nt, Homo sapiens
cccucacaggag

SEQ ID NO: 1041819 - RNA, 20 nt, Homo sapiens
cccucaccugggcaccuggg

SEQ ID NO: 1041820 - RNA, 17 nt, Homo sapiens
cccucagagugcaagcc

SEQ ID NO: 1041821 - RNA, 18 nt, Homo sapiens
cccucagagugcaagccc

SEQ ID NO: 1041822 - RNA, 11 nt, Homo sapiens
cccucaugcaa

SEQ ID NO: 1041823 - RNA, 21 nt, Homo sapiens
cccucaugcugugugacucaa

SEQ ID NO: 1041824 - RNA, 16 nt, Homo sapiens
cccuccaaaagcacuu

SEQ ID NO: 1041825 - RNA, 21 nt, Homo sapiens
cccuccaaaggucugaugucu

SEQ ID NO: 1041826 - RNA, 18 nt, Homo sapiens
cccuccuggcucuugaua

SEQ ID NO: 1041827 - RNA, 22 nt, Homo sapiens
cccucgaggcggaucuuuggac

SEQ ID NO: 1041828 - RNA, 13 nt, Homo sapiens
cccucggugggcc

SEQ ID NO: 1041829 - RNA, 19 nt, Homo sapiens
cccucuagaaauuuuucag

SEQ ID NO: 1041830 - RNA, 18 nt, Homo sapiens
cccucuccccacugcuca

SEQ ID NO: 1041831 - RNA, 16 nt, Homo sapiens
cccugaccucccagcc

SEQ ID NO: 1041832 - RNA, 21 nt, Homo sapiens
cccugacugggaguugaucgc

SEQ ID NO: 1041833 - RNA, 17 nt, Homo sapiens
cccugcaaaaugagacc

SEQ ID NO: 1041834 - RNA, 18 nt, Homo sapiens
cccugcagggccaagcac

SEQ ID NO: 1041835 - RNA, 15 nt, Homo sapiens
cccugccagcucuuc

SEQ ID NO: 1041836 - RNA, 11 nt, Homo sapiens
cccugccauca

SEQ ID NO: 1041837 - RNA, 15 nt, Homo sapiens
cccugccccugccuu

SEQ ID NO: 1041838 - RNA, 15 nt, Homo sapiens
cccugcccuggucca

SEQ ID NO: 1041839 - RNA, 19 nt, Homo sapiens
cccugcguggggacagggc

SEQ ID NO: 1041840 - RNA, 12 nt, Homo sapiens
cccugcuugcaa

SEQ ID NO: 1041841 - RNA, 14 nt, Homo sapiens
cccuggagaguuca

SEQ ID NO: 1041842 - RNA, 20 nt, Homo sapiens
cccuggagaguucaauggcu

SEQ ID NO: 1041843 - RNA, 15 nt, Homo sapiens
cccuggcaaccagga

SEQ ID NO: 1041844 - RNA, 22 nt, Homo sapiens
cccuggcucugaccgaaacagc

SEQ ID NO: 1041845 - RNA, 20 nt, Homo sapiens
cccuggcugaaggacuguga

SEQ ID NO: 1041846 - RNA, 20 nt, Homo sapiens
cccuggggagucugggcaca

SEQ ID NO: 1041847 - RNA, 20 nt, Homo sapiens
cccugggggcugugauauua

SEQ ID NO: 1041848 - RNA, 21 nt, Homo sapiens
cccuguaccacaaacacauua

SEQ ID NO: 1041849 - RNA, 14 nt, Homo sapiens
cccuguaugauucc

SEQ ID NO: 1041850 - RNA, 16 nt, Homo sapiens
cccuguccugaugguc

SEQ ID NO: 1041851 - RNA, 15 nt, Homo sapiens
cccuguccuuucuca

SEQ ID NO: 1041852 - RNA, 20 nt, Homo sapiens
cccuguguauucuagugaau

SEQ ID NO: 1041853 - RNA, 14 nt, Homo sapiens
cccuguucuuggau

SEQ ID NO: 1041854 - RNA, 23 nt, Homo sapiens
cccuguuuucugagcccgggcug

SEQ ID NO: 1041855 - RNA, 22 nt, Homo sapiens
cccuuauccaggacucugucaa

SEQ ID NO: 1041856 - RNA, 16 nt, Homo sapiens
cccuuauuuucaagaa

SEQ ID NO: 1041857 - RNA, 20 nt, Homo sapiens
cccuucaguacccucucagc

SEQ ID NO: 1041858 - RNA, 15 nt, Homo sapiens
cccuucucuaccuca

SEQ ID NO: 1041859 - RNA, 19 nt, Homo sapiens
cccuucuuacaaugcauuc

SEQ ID NO: 1041860 - RNA, 17 nt, Homo sapiens
cccuucuuuacuuccca

SEQ ID NO: 1041861 - RNA, 16 nt, Homo sapiens
cccuucuuuucugacu

SEQ ID NO: 1041862 - RNA, 13 nt, Homo sapiens
cccuugcagcuag

SEQ ID NO: 1041863 - RNA, 18 nt, Homo sapiens
cccuugcuuguugggauu

SEQ ID NO: 1041864 - RNA, 15 nt, Homo sapiens
cccuuuacaaauaga

SEQ ID NO: 1041865 - RNA, 15 nt, Homo sapiens
cccuuuccaaaggcc

SEQ ID NO: 1041866 - RNA, 18 nt, Homo sapiens
cccuuucuugaagaacaa

SEQ ID NO: 1041867 - RNA, 22 nt, Homo sapiens
cccuuuuguauucucuuccuca

SEQ ID NO: 1041868 - RNA, 20 nt, Homo sapiens
ccgaaaaggauaugcaguau

SEQ ID NO: 1041869 - RNA, 18 nt, Homo sapiens
ccgaacuuuaauuucagg

SEQ ID NO: 1041870 - RNA, 22 nt, Homo sapiens
ccgacggugggcauuugugagg

SEQ ID NO: 1041871 - RNA, 16 nt, Homo sapiens
ccgagagagauggaau

SEQ ID NO: 1041872 - RNA, 17 nt, Homo sapiens
ccgagagagauggaaua

SEQ ID NO: 1041873 - RNA, 12 nt, Homo sapiens
ccgagcaaagau

SEQ ID NO: 1041874 - RNA, 14 nt, Homo sapiens
ccgagccucuguca

SEQ ID NO: 1041875 - RNA, 18 nt, Homo sapiens
ccgagccuggcuccaaac

SEQ ID NO: 1041876 - RNA, 22 nt, Homo sapiens
ccgagcuuugaaaauucagugg

SEQ ID NO: 1041877 - RNA, 13 nt, Homo sapiens
ccgagugcaauga

SEQ ID NO: 1041878 - RNA, 19 nt, Homo sapiens
ccgcaaaagacaagucuuu

SEQ ID NO: 1041879 - RNA, 22 nt, Homo sapiens
ccgcaaugugacuuaaugccac

SEQ ID NO: 1041880 - RNA, 22 nt, Homo sapiens
ccgcauaauuuuuuucugcaac

SEQ ID NO: 1041881 - RNA, 21 nt, Homo sapiens
ccgccacccucccacugccaa

SEQ ID NO: 1041882 - RNA, 19 nt, Homo sapiens
ccgccacugggccugucac

SEQ ID NO: 1041883 - RNA, 19 nt, Homo sapiens
ccgcucugcagacugcugc

SEQ ID NO: 1041884 - RNA, 14 nt, Homo sapiens
ccgggacgcagggg

SEQ ID NO: 1041885 - RNA, 23 nt, Homo sapiens
ccgggaggcagagguugcagugu

SEQ ID NO: 1041886 - RNA, 20 nt, Homo sapiens
ccgggcugggagcucugcag

SEQ ID NO: 1041887 - RNA, 18 nt, Homo sapiens
ccguaacaacugugguca

SEQ ID NO: 1041888 - RNA, 13 nt, Homo sapiens
ccgucacagccuc

SEQ ID NO: 1041889 - RNA, 20 nt, Homo sapiens
ccguccucgagcaacugcug

SEQ ID NO: 1041890 - RNA, 17 nt, Homo sapiens
ccgugagcgacaaagau

SEQ ID NO: 1041891 - RNA, 21 nt, Homo sapiens
ccgugagugaaccaucauuau

SEQ ID NO: 1041892 - RNA, 18 nt, Homo sapiens
ccuaaaacugaggugggg

SEQ ID NO: 1041893 - RNA, 18 nt, Homo sapiens
ccuaaaaggaaaucucac

SEQ ID NO: 1041894 - RNA, 22 nt, Homo sapiens
ccuaaagaccgggaaaagggaa

SEQ ID NO: 1041895 - RNA, 17 nt, Homo sapiens
ccuaacacacuccaaga

SEQ ID NO: 1041896 - RNA, 16 nt, Homo sapiens
ccuaagacgucccuuu

SEQ ID NO: 1041897 - RNA, 19 nt, Homo sapiens
ccuaagagagagagacaga

SEQ ID NO: 1041898 - RNA, 19 nt, Homo sapiens
ccuaaguuuuauacuugau

SEQ ID NO: 1041899 - RNA, 12 nt, Homo sapiens
ccuaaugaaguu

SEQ ID NO: 1041900 - RNA, 22 nt, Homo sapiens
ccuacaagucaucauaauucag

SEQ ID NO: 1041901 - RNA, 15 nt, Homo sapiens
ccuacagauagucaa

SEQ ID NO: 1041902 - RNA, 22 nt, Homo sapiens
ccuacauuuuaaugcaccugaa

SEQ ID NO: 1041903 - RNA, 14 nt, Homo sapiens
ccuaccacaguguc

SEQ ID NO: 1041904 - RNA, 15 nt, Homo sapiens
ccuaccacagugucu

SEQ ID NO: 1041905 - RNA, 15 nt, Homo sapiens
ccuaccaucagggac

SEQ ID NO: 1041906 - RNA, 14 nt, Homo sapiens
ccuacucuguguca

SEQ ID NO: 1041907 - RNA, 18 nt, Homo sapiens
ccuacucuuccaucuuuc

SEQ ID NO: 1041908 - RNA, 16 nt, Homo sapiens
ccuacuucuuuugcuc

SEQ ID NO: 1041909 - RNA, 15 nt, Homo sapiens
ccuagccgaccucag

SEQ ID NO: 1041910 - RNA, 21 nt, Homo sapiens
ccuagccuuagaagucacaca

SEQ ID NO: 1041911 - RNA, 21 nt, Homo sapiens
ccuagcugcccacagagggca

SEQ ID NO: 1041912 - RNA, 17 nt, Homo sapiens
ccuaggauugugccugu

SEQ ID NO: 1041913 - RNA, 20 nt, Homo sapiens
ccuaggauuucaugauuuca

SEQ ID NO: 1041914 - RNA, 14 nt, Homo sapiens
ccuaggcagaucac

SEQ ID NO: 1041915 - RNA, 15 nt, Homo sapiens
ccuaggcauuugcug

SEQ ID NO: 1041916 - RNA, 12 nt, Homo sapiens
caaaaauguaau

SEQ ID NO: 1041917 - RNA, 19 nt, Homo sapiens
caaaacacucggcauuuca

SEQ ID NO: 1041918 - RNA, 16 nt, Homo sapiens
caaaaccccacuacac

SEQ ID NO: 1041919 - RNA, 15 nt, Homo sapiens
caaaacuaauuuccu

SEQ ID NO: 1041920 - RNA, 16 nt, Homo sapiens
caaaacuccaucucaa

SEQ ID NO: 1041921 - RNA, 12 nt, Homo sapiens
caaaacucuccu

SEQ ID NO: 1041922 - RNA, 15 nt, Homo sapiens
caaaacugacaguaa

SEQ ID NO: 1041923 - RNA, 17 nt, Homo sapiens
caaaacugcacugucaa

SEQ ID NO: 1041924 - RNA, 19 nt, Homo sapiens
caaaagaagaaaccuucau

SEQ ID NO: 1041925 - RNA, 23 nt, Homo sapiens
caaaagaagacaacauuucucaa

SEQ ID NO: 1041926 - RNA, 12 nt, Homo sapiens
caaaagacaauu

SEQ ID NO: 1041927 - RNA, 22 nt, Homo sapiens
caaaagcaagacuguugcucaa

SEQ ID NO: 1041928 - RNA, 12 nt, Homo sapiens
caaaagcacuua

SEQ ID NO: 1041929 - RNA, 19 nt, Homo sapiens
caaaagcacuuugugcugu

SEQ ID NO: 1041930 - RNA, 21 nt, Homo sapiens
caaaagcccaauguaaugcau

SEQ ID NO: 1041931 - RNA, 14 nt, Homo sapiens
caaaagcugcucag

SEQ ID NO: 1041932 - RNA, 20 nt, Homo sapiens
caaaagcugcucagggaaaa

SEQ ID NO: 1041933 - RNA, 17 nt, Homo sapiens
caaaagggccauguuuc

SEQ ID NO: 1041934 - RNA, 15 nt, Homo sapiens
caaaagggugucuga

SEQ ID NO: 1041935 - RNA, 21 nt, Homo sapiens
caagaugcuggaugucugcca

SEQ ID NO: 1041936 - RNA, 21 nt, Homo sapiens
caagauugcgccauugcacuc

SEQ ID NO: 1041937 - RNA, 19 nt, Homo sapiens
caagcaaaaucauggaaug

SEQ ID NO: 1041938 - RNA, 19 nt, Homo sapiens
caagcacagugccugcaug

SEQ ID NO: 1041939 - RNA, 18 nt, Homo sapiens
caagcacugcaugggcaa

SEQ ID NO: 1041940 - RNA, 18 nt, Homo sapiens
caagcagccaagcuccuu

SEQ ID NO: 1041941 - RNA, 17 nt, Homo sapiens
caagcagccaagggaug

SEQ ID NO: 1041942 - RNA, 20 nt, Homo sapiens
caagcaggaaccccaggaga

SEQ ID NO: 1041943 - RNA, 18 nt, Homo sapiens
caagcaggugaacuggga

SEQ ID NO: 1041944 - RNA, 23 nt, Homo sapiens
caagcaguuaguuccuucaugau

SEQ ID NO: 1041945 - RNA, 20 nt, Homo sapiens
caagcauaccaacacgagca

SEQ ID NO: 1041946 - RNA, 20 nt, Homo sapiens
caagcaugaaccuuguuuaa

SEQ ID NO: 1041947 - RNA, 21 nt, Homo sapiens
caagcauuuaauguagccaug

SEQ ID NO: 1041948 - RNA, 17 nt, Homo sapiens
caagccacgaaugaaug

SEQ ID NO: 1041949 - RNA, 21 nt, Homo sapiens
caagccuagcccuucucucau

SEQ ID NO: 1041950 - RNA, 12 nt, Homo sapiens
caagcuauucaa

SEQ ID NO: 1041951 - RNA, 13 nt, Homo sapiens
caagcucccaagg

SEQ ID NO: 1041952 - RNA, 14 nt, Homo sapiens
caagcuccucaauc

SEQ ID NO: 1041953 - RNA, 15 nt, Homo sapiens
caaggaagguggugg

SEQ ID NO: 1041954 - RNA, 14 nt, Homo sapiens
caaggagacacaac

SEQ ID NO: 1041955 - RNA, 21 nt, Homo sapiens
caaggcaaagacuauucccuu

SEQ ID NO: 1041956 - RNA, 16 nt, Homo sapiens
caaggcacugccugau

SEQ ID NO: 1041957 - RNA, 23 nt, Homo sapiens
caaggcggguggaucacuugaga

SEQ ID NO: 1041958 - RNA, 15 nt, Homo sapiens
caaggcugcagugag

SEQ ID NO: 1041959 - RNA, 19 nt, Homo sapiens
caaggcugcagugagccau

SEQ ID NO: 1041960 - RNA, 16 nt, Homo sapiens
caaggcuggcagugac

SEQ ID NO: 1041961 - RNA, 18 nt, Homo sapiens
caaggcugggcagugucc

SEQ ID NO: 1041962 - RNA, 20 nt, Homo sapiens
caagggcuccccacugccua

SEQ ID NO: 1041963 - RNA, 22 nt, Homo sapiens
caaggggcugaaaagaucugaa

SEQ ID NO: 1041964 - RNA, 15 nt, Homo sapiens
caaggucauuugcua

SEQ ID NO: 1041965 - RNA, 15 nt, Homo sapiens
caaggugaacacuuc

SEQ ID NO: 1041966 - RNA, 18 nt, Homo sapiens
caagguggggggaucaca

SEQ ID NO: 1041967 - RNA, 17 nt, Homo sapiens
caagguuauuggacacc

SEQ ID NO: 1041968 - RNA, 21 nt, Homo sapiens
caagguucuucccuuuuacau

SEQ ID NO: 1041969 - RNA, 14 nt, Homo sapiens
caaguaagggcaca

SEQ ID NO: 1041970 - RNA, 19 nt, Homo sapiens
caaguauguugagaguugc

SEQ ID NO: 1041971 - RNA, 20 nt, Homo sapiens
caaguauuuuugacauuuac

SEQ ID NO: 1041972 - RNA, 12 nt, Homo sapiens
caaguccaagca

SEQ ID NO: 1041973 - RNA, 18 nt, Homo sapiens
caaguccaagcauaccaa

SEQ ID NO: 1041974 - RNA, 18 nt, Homo sapiens
caaguccagauuuacacu

SEQ ID NO: 1041975 - RNA, 23 nt, Homo sapiens
caaguccagauuuacacugggag

SEQ ID NO: 1041976 - RNA, 16 nt, Homo sapiens
caagucccuuugugac

SEQ ID NO: 1041977 - RNA, 22 nt, Homo sapiens
caagucccuuugugacuucaag

SEQ ID NO: 1041978 - RNA, 16 nt, Homo sapiens
caagugaaaucaaagg

SEQ ID NO: 1041979 - RNA, 21 nt, Homo sapiens
caagugagagagaugggagcu

SEQ ID NO: 1041980 - RNA, 17 nt, Homo sapiens
caagugauucuugugcc

SEQ ID NO: 1041981 - RNA, 14 nt, Homo sapiens
caagugggugaaug

SEQ ID NO: 1041982 - RNA, 14 nt, Homo sapiens
caaguguacaguga

SEQ ID NO: 1041983 - RNA, 24 nt, Homo sapiens
caaguguguaugugcgugugugca

SEQ ID NO: 1041984 - RNA, 20 nt, Homo sapiens
caagugugugcacaugugug

SEQ ID NO: 1041985 - RNA, 18 nt, Homo sapiens
caagugugugcaugugug

SEQ ID NO: 1041986 - RNA, 13 nt, Homo sapiens
caaguuacaguga

SEQ ID NO: 1041987 - RNA, 17 nt, Homo sapiens
caaguuacagugaugcu

SEQ ID NO: 1041988 - RNA, 23 nt, Homo sapiens
caaguuauaaaucaaugucacuu

SEQ ID NO: 1041989 - RNA, 17 nt, Homo sapiens
caaguuccgucagucca

SEQ ID NO: 1041990 - RNA, 20 nt, Homo sapiens
caaguucuuaguugcuguau

SEQ ID NO: 1041991 - RNA, 21 nt, Homo sapiens
caaguucuuaguugcuguaug

SEQ ID NO: 1041992 - RNA, 20 nt, Homo sapiens
caaguuguggugcugacaaa

SEQ ID NO: 1041993 - RNA, 17 nt, Homo sapiens
caaguuguuugagaaau

SEQ ID NO: 1041994 - RNA, 21 nt, Homo sapiens
caaguuuuucugucaagaaga

SEQ ID NO: 1041995 - RNA, 19 nt, Homo sapiens
caauaaaauagcaauccua

SEQ ID NO: 1041996 - RNA, 15 nt, Homo sapiens
caauaaaccuaauaa

SEQ ID NO: 1041997 - RNA, 20 nt, Homo sapiens
caauaaagaugcccacugag

SEQ ID NO: 1041998 - RNA, 13 nt, Homo sapiens
caauaaagccuuc

SEQ ID NO: 1041999 - RNA, 19 nt, Homo sapiens
caauaaagccuucaaacuc

SEQ ID NO: 1042000 - RNA, 17 nt, Homo sapiens
caauaaauuggaacacc

SEQ ID NO: 1042001 - RNA, 20 nt, Homo sapiens
caauaaauuggaacaccucc

SEQ ID NO: 1042002 - RNA, 18 nt, Homo sapiens
caauaacacacagcuaac

SEQ ID NO: 1042003 - RNA, 14 nt, Homo sapiens
caauaacacugucu

SEQ ID NO: 1042004 - RNA, 15 nt, Homo sapiens
caauaacacugucuc

SEQ ID NO: 1042005 - RNA, 17 nt, Homo sapiens
caauaaucaaugaagua

SEQ ID NO: 1042006 - RNA, 17 nt, Homo sapiens
caauacaugcugcuaau

SEQ ID NO: 1042007 - RNA, 18 nt, Homo sapiens
caauacucaaaagagaga

SEQ ID NO: 1042008 - RNA, 14 nt, Homo sapiens
caauagaacagaga

SEQ ID NO: 1042009 - RNA, 21 nt, Homo sapiens
caauagaaggauguacauuuc

SEQ ID NO: 1042010 - RNA, 19 nt, Homo sapiens
caauaguaauucucaggcc

SEQ ID NO: 1042011 - RNA, 15 nt, Homo sapiens
caauaugcaauguga

SEQ ID NO: 1042012 - RNA, 16 nt, Homo sapiens
caauauuguacaguuu

SEQ ID NO: 1042013 - RNA, 23 nt, Homo sapiens
caauauugucauuccuguauuca

SEQ ID NO: 1042014 - RNA, 14 nt, Homo sapiens
caaucaaagcacuu

SEQ ID NO: 1042015 - RNA, 22 nt, Homo sapiens
caaucaauucauaucuauuuau

SEQ ID NO: 1042016 - RNA, 16 nt, Homo sapiens
caaucagagagcucac

SEQ ID NO: 1042017 - RNA, 17 nt, Homo sapiens
caaucagccacauucua

SEQ ID NO: 1042018 - RNA, 23 nt, Homo sapiens
caaucauagccaagaucccaucu

SEQ ID NO: 1042019 - RNA, 22 nt, Homo sapiens
caaucaugaaauaugcaucuca

SEQ ID NO: 1042020 - RNA, 18 nt, Homo sapiens
caauccgaaguaugaggg

SEQ ID NO: 1042021 - RNA, 15 nt, Homo sapiens
caauccuagugcuuu

SEQ ID NO: 1042022 - RNA, 15 nt, Homo sapiens
caaucuaaccacauc

SEQ ID NO: 1042023 - RNA, 13 nt, Homo sapiens
caaucugacauuc

SEQ ID NO: 1042024 - RNA, 20 nt, Homo sapiens
caaucugcccauucaucuuc

SEQ ID NO: 1042025 - RNA, 12 nt, Homo sapiens
caaucuguaaac

SEQ ID NO: 1042026 - RNA, 20 nt, Homo sapiens
caaucuucucagaaggcaaa

SEQ ID NO: 1042027 - RNA, 20 nt, Homo sapiens
caaugaauaacagccucauu

SEQ ID NO: 1042028 - RNA, 13 nt, Homo sapiens
caaugacaucuca

SEQ ID NO: 1042029 - RNA, 14 nt, Homo sapiens
caaugacaucucag

SEQ ID NO: 1042030 - RNA, 17 nt, Homo sapiens
caaugauacaguugcau

SEQ ID NO: 1042031 - RNA, 16 nt, Homo sapiens
caaugauggcaauuuu

SEQ ID NO: 1042032 - RNA, 17 nt, Homo sapiens
caaugauuuacucaaua

SEQ ID NO: 1042033 - RNA, 18 nt, Homo sapiens
caaugcaaaguacaugua

SEQ ID NO: 1042034 - RNA, 14 nt, Homo sapiens
caauguagucucau

SEQ ID NO: 1042035 - RNA, 21 nt, Homo sapiens
caauguaguuuuauuacacau

SEQ ID NO: 1042036 - RNA, 19 nt, Homo sapiens
caaugucaggaacagaagg

SEQ ID NO: 1042037 - RNA, 21 nt, Homo sapiens
caaugugauucuaaugucuuc

SEQ ID NO: 1042038 - RNA, 20 nt, Homo sapiens
caaugugggcagagauugga

SEQ ID NO: 1042039 - RNA, 15 nt, Homo sapiens
caauguuuaugcaag

SEQ ID NO: 1042040 - RNA, 21 nt, Homo sapiens
caauguuuaugcaaggaagga

SEQ ID NO: 1042041 - RNA, 16 nt, Homo sapiens
caauuagccaggugug

SEQ ID NO: 1042042 - RNA, 18 nt, Homo sapiens
caauuauagaaagccaaa

SEQ ID NO: 1042043 - RNA, 15 nt, Homo sapiens
caauuccucugggaa

SEQ ID NO: 1042044 - RNA, 20 nt, Homo sapiens
caauucuauuacgugcaaua

SEQ ID NO: 1042045 - RNA, 19 nt, Homo sapiens
caauucuuacaaacaugug

SEQ ID NO: 1042046 - RNA, 21 nt, Homo sapiens
caauuuacuugccauuacuca

SEQ ID NO: 1042047 - RNA, 23 nt, Homo sapiens
caauuuacuugccauuacucaau

SEQ ID NO: 1042048 - RNA, 19 nt, Homo sapiens
caauuugagauguauuuca

SEQ ID NO: 1042049 - RNA, 19 nt, Homo sapiens
caauuuguaauugcuuaca

SEQ ID NO: 1042050 - RNA, 17 nt, Homo sapiens
caauuuuaaaucugaga

SEQ ID NO: 1042051 - RNA, 23 nt, Homo sapiens
caauuuuaauugauuauucugau

SEQ ID NO: 1042052 - RNA, 20 nt, Homo sapiens
cacaaaauguaggguuauaa

SEQ ID NO: 1042053 - RNA, 21 nt, Homo sapiens
cacaaacguauguaaauguau

SEQ ID NO: 1042054 - RNA, 12 nt, Homo sapiens
cacaaagccuua

SEQ ID NO: 1042055 - RNA, 20 nt, Homo sapiens
cacaaaugguagcauacuuu

SEQ ID NO: 1042056 - RNA, 23 nt, Homo sapiens
cacaacccuucagauuugccuua

SEQ ID NO: 1042057 - RNA, 18 nt, Homo sapiens
cacaagccacagaagcca

SEQ ID NO: 1042058 - RNA, 15 nt, Homo sapiens
cacaaggcugaccaa

SEQ ID NO: 1042059 - RNA, 14 nt, Homo sapiens
cacaaggggcucca

SEQ ID NO: 1042060 - RNA, 16 nt, Homo sapiens
cacaaggucacuagau

SEQ ID NO: 1042061 - RNA, 13 nt, Homo sapiens
cacaauacaauaa

SEQ ID NO: 1042062 - RNA, 20 nt, Homo sapiens
cacaauagcaguugaaacaa

SEQ ID NO: 1042063 - RNA, 14 nt, Homo sapiens
cacaaugcugaaua

SEQ ID NO: 1042064 - RNA, 12 nt, Homo sapiens
cacaauucacua

SEQ ID NO: 1042065 - RNA, 17 nt, Homo sapiens
cacaauucuguuuuagg

SEQ ID NO: 1042066 - RNA, 16 nt, Homo sapiens
cacacaaggugcaaau

SEQ ID NO: 1042067 - RNA, 23 nt, Homo sapiens
aggguuggguucaucugagcaag

SEQ ID NO: 1042068 - RNA, 19 nt, Homo sapiens
aggguugguccucuugccu

SEQ ID NO: 1042069 - RNA, 16 nt, Homo sapiens
aggguuucugagcugc

SEQ ID NO: 1042070 - RNA, 19 nt, Homo sapiens
aggguuucugagcugcucu

SEQ ID NO: 1042071 - RNA, 22 nt, Homo sapiens
aggguuucugagcugcucugaa

SEQ ID NO: 1042072 - RNA, 15 nt, Homo sapiens
agguaaggugaggga

SEQ ID NO: 1042073 - RNA, 16 nt, Homo sapiens
agguaaggugagggaa

SEQ ID NO: 1042074 - RNA, 19 nt, Homo sapiens
agguacuucaggggcacuu

SEQ ID NO: 1042075 - RNA, 22 nt, Homo sapiens
agguacuucaggggcacuucau

SEQ ID NO: 1042076 - RNA, 19 nt, Homo sapiens
agguagaaauaucugaaaa

SEQ ID NO: 1042077 - RNA, 18 nt, Homo sapiens
agguagcuuuagggcaau

SEQ ID NO: 1042078 - RNA, 22 nt, Homo sapiens
agguaucauuuucugcauuuaa

SEQ ID NO: 1042079 - RNA, 21 nt, Homo sapiens
agguaugguuaauaaguuuca

SEQ ID NO: 1042080 - RNA, 13 nt, Homo sapiens
agguauguugccu

SEQ ID NO: 1042081 - RNA, 16 nt, Homo sapiens
aggucaaggcugcagu

SEQ ID NO: 1042082 - RNA, 21 nt, Homo sapiens
aggucagcccagccccuccaa

SEQ ID NO: 1042083 - RNA, 14 nt, Homo sapiens
aggucagcgugcuu

SEQ ID NO: 1042084 - RNA, 18 nt, Homo sapiens
aggucagcgugcuuagcc

SEQ ID NO: 1042085 - RNA, 17 nt, Homo sapiens
aggucauuaaaauuaca

SEQ ID NO: 1042086 - RNA, 22 nt, Homo sapiens
agguccacggucuguucuugaa

SEQ ID NO: 1042087 - RNA, 23 nt, Homo sapiens
aggucccuugucccaaguuccac

SEQ ID NO: 1042088 - RNA, 13 nt, Homo sapiens
agguccucuacuu

SEQ ID NO: 1042089 - RNA, 23 nt, Homo sapiens
agguccuggcaaagaugaucagu

SEQ ID NO: 1042090 - RNA, 18 nt, Homo sapiens
aggucuaggaacauacuu

SEQ ID NO: 1042091 - RNA, 16 nt, Homo sapiens
aggucugacacgucug

SEQ ID NO: 1042092 - RNA, 15 nt, Homo sapiens
aggucuucucuccaa

SEQ ID NO: 1042093 - RNA, 18 nt, Homo sapiens
aggugaaaauccaucuca

SEQ ID NO: 1042094 - RNA, 14 nt, Homo sapiens
aggugaaagcuaua

SEQ ID NO: 1042095 - RNA, 17 nt, Homo sapiens
aggugaacugggagcag

SEQ ID NO: 1042096 - RNA, 19 nt, Homo sapiens
aggugaagcaccaagcuca

SEQ ID NO: 1042097 - RNA, 21 nt, Homo sapiens
aggugacccaaugauucagcu

SEQ ID NO: 1042098 - RNA, 16 nt, Homo sapiens
aggugauccacccacc

SEQ ID NO: 1042099 - RNA, 20 nt, Homo sapiens
aggugauccacccaccucag

SEQ ID NO: 1042100 - RNA, 15 nt, Homo sapiens
aggugaucuaccugc

SEQ ID NO: 1042101 - RNA, 18 nt, Homo sapiens
aggugcuacaaaaacaca

SEQ ID NO: 1042102 - RNA, 21 nt, Homo sapiens
aggugcuauguucuuagugga

SEQ ID NO: 1042103 - RNA, 13 nt, Homo sapiens
aggugcugagcaa

SEQ ID NO: 1042104 - RNA, 15 nt, Homo sapiens
aggugcuucuucacu

SEQ ID NO: 1042105 - RNA, 16 nt, Homo sapiens
agguggaacucaguca

SEQ ID NO: 1042106 - RNA, 11 nt, Homo sapiens
agguggcaagc

SEQ ID NO: 1042107 - RNA, 20 nt, Homo sapiens
aggugggaggauugcuugag

SEQ ID NO: 1042108 - RNA, 19 nt, Homo sapiens
aggugggaucacuaaggga

SEQ ID NO: 1042109 - RNA, 16 nt, Homo sapiens
agguggggacagggau

SEQ ID NO: 1042110 - RNA, 20 nt, Homo sapiens
aggugguauguuugggagac

SEQ ID NO: 1042111 - RNA, 13 nt, Homo sapiens
agguggugccaau

SEQ ID NO: 1042112 - RNA, 21 nt, Homo sapiens
aggugucugcacccaggggug

SEQ ID NO: 1042113 - RNA, 21 nt, Homo sapiens
agguguucuucauuaccucag

SEQ ID NO: 1042114 - RNA, 12 nt, Homo sapiens
agguuaacauua

SEQ ID NO: 1042115 - RNA, 21 nt, Homo sapiens
agguuaagacaaacugcauau

SEQ ID NO: 1042116 - RNA, 17 nt, Homo sapiens
agguucaggaagaccac

SEQ ID NO: 1042117 - RNA, 20 nt, Homo sapiens
agguugaggggcuccuggaa

SEQ ID NO: 1042118 - RNA, 17 nt, Homo sapiens
agguugugggcauugau

SEQ ID NO: 1042119 - RNA, 14 nt, Homo sapiens
agguuuacauucau

SEQ ID NO: 1042120 - RNA, 15 nt, Homo sapiens
agguuuacauuguca

SEQ ID NO: 1042121 - RNA, 13 nt, Homo sapiens
agguuuccuucag

SEQ ID NO: 1042122 - RNA, 18 nt, Homo sapiens
agguuucuuugacuucaa

SEQ ID NO: 1042123 - RNA, 15 nt, Homo sapiens
agguuugccagcauu

SEQ ID NO: 1042124 - RNA, 15 nt, Homo sapiens
agguuuuuacuguga

SEQ ID NO: 1042125 - RNA, 17 nt, Homo sapiens
aguaaauagcauucucu

SEQ ID NO: 1042126 - RNA, 17 nt, Homo sapiens
aguaaauauuucaggca

SEQ ID NO: 1042127 - RNA, 19 nt, Homo sapiens
aguaacaggaaaccacuua

SEQ ID NO: 1042128 - RNA, 16 nt, Homo sapiens
aguaaccauuugcacu

SEQ ID NO: 1042129 - RNA, 15 nt, Homo sapiens
aguaagaagacauga

SEQ ID NO: 1042130 - RNA, 20 nt, Homo sapiens
aguaaguaccacucaggcca

SEQ ID NO: 1042131 - RNA, 21 nt, Homo sapiens
aguaaguaccacucaggccaa

SEQ ID NO: 1042132 - RNA, 17 nt, Homo sapiens
aguaauaugcacacauu

SEQ ID NO: 1042133 - RNA, 16 nt, Homo sapiens
aguaauguuaauucuu

SEQ ID NO: 1042134 - RNA, 20 nt, Homo sapiens
aguacaauguuaacccuaaa

SEQ ID NO: 1042135 - RNA, 18 nt, Homo sapiens
aguacaccccaacagcac

SEQ ID NO: 1042136 - RNA, 23 nt, Homo sapiens
aguacaccccaacagcacccucu

SEQ ID NO: 1042137 - RNA, 15 nt, Homo sapiens
aguaccacucaggcc

SEQ ID NO: 1042138 - RNA, 21 nt, Homo sapiens
aguaccugaaaaaaugccaag

SEQ ID NO: 1042139 - RNA, 15 nt, Homo sapiens
aguacuccugcaaaa

SEQ ID NO: 1042140 - RNA, 22 nt, Homo sapiens
aguagaagauuuuaugcugcug

SEQ ID NO: 1042141 - RNA, 16 nt, Homo sapiens
aguagaucauguucac

SEQ ID NO: 1042142 - RNA, 22 nt, Homo sapiens
aguagccuaacacacuccaaga

SEQ ID NO: 1042143 - RNA, 23 nt, Homo sapiens
aguagcuuaccagaagcuuccau

SEQ ID NO: 1042144 - RNA, 16 nt, Homo sapiens
aguaggacuuuccuaa

SEQ ID NO: 1042145 - RNA, 16 nt, Homo sapiens
aguaggaggccuccac

SEQ ID NO: 1042146 - RNA, 16 nt, Homo sapiens
aguagguuuacauuca

SEQ ID NO: 1042147 - RNA, 13 nt, Homo sapiens
aguaguacuugaa

SEQ ID NO: 1042148 - RNA, 23 nt, Homo sapiens
aguaguugggauuaccaguagau

SEQ ID NO: 1042149 - RNA, 13 nt, Homo sapiens
aguaucaugaagc

SEQ ID NO: 1042150 - RNA, 16 nt, Homo sapiens
aguaucccuacuguaa

SEQ ID NO: 1042151 - RNA, 19 nt, Homo sapiens
aguauccugcuucugauau

SEQ ID NO: 1042152 - RNA, 22 nt, Homo sapiens
aguaucuagcaaucacaacacu

SEQ ID NO: 1042153 - RNA, 11 nt, Homo sapiens
aguaucuauau

SEQ ID NO: 1042154 - RNA, 18 nt, Homo sapiens
aguauggcaugaacaucu

SEQ ID NO: 1042155 - RNA, 15 nt, Homo sapiens
aguauguggaagugu

SEQ ID NO: 1042156 - RNA, 14 nt, Homo sapiens
aguauuaucagaug

SEQ ID NO: 1042157 - RNA, 12 nt, Homo sapiens
aguauuccauuu

SEQ ID NO: 1042158 - RNA, 12 nt, Homo sapiens
aguauugugcau

SEQ ID NO: 1042159 - RNA, 15 nt, Homo sapiens
aguauuguggcugca

SEQ ID NO: 1042160 - RNA, 16 nt, Homo sapiens
agucaaaagagagaag

SEQ ID NO: 1042161 - RNA, 14 nt, Homo sapiens
agucaacaaacuau

SEQ ID NO: 1042162 - RNA, 21 nt, Homo sapiens
agucaaccugccugacauuug

SEQ ID NO: 1042163 - RNA, 13 nt, Homo sapiens
agucaaugugcag

SEQ ID NO: 1042164 - RNA, 16 nt, Homo sapiens
agucacagcuacacag

SEQ ID NO: 1042165 - RNA, 21 nt, Homo sapiens
agucacaguuagguagcuuua

SEQ ID NO: 1042166 - RNA, 21 nt, Homo sapiens
agucacauggccuaugcacau

SEQ ID NO: 1042167 - RNA, 13 nt, Homo sapiens
agucacugacccu

SEQ ID NO: 1042168 - RNA, 19 nt, Homo sapiens
agucacugacccugugcag

SEQ ID NO: 1042169 - RNA, 17 nt, Homo sapiens
agucagaacucuguguu

SEQ ID NO: 1042170 - RNA, 21 nt, Homo sapiens
gcacauuuaagagacagucac

SEQ ID NO: 1042171 - RNA, 15 nt, Homo sapiens
gcaccaauaaagccu

SEQ ID NO: 1042172 - RNA, 15 nt, Homo sapiens
gcaccacaucucuau

SEQ ID NO: 1042173 - RNA, 19 nt, Homo sapiens
gcaccacuguguauuuaac

SEQ ID NO: 1042174 - RNA, 13 nt, Homo sapiens
gcaccaucucuga

SEQ ID NO: 1042175 - RNA, 15 nt, Homo sapiens
gcaccauugcgcucu

SEQ ID NO: 1042176 - RNA, 22 nt, Homo sapiens
gcacccaggacuuccauuugcu

SEQ ID NO: 1042177 - RNA, 15 nt, Homo sapiens
gcacccucuccagau

SEQ ID NO: 1042178 - RNA, 21 nt, Homo sapiens
gcacccuggauugaucggagc

SEQ ID NO: 1042179 - RNA, 23 nt, Homo sapiens
gcacccuggggccuggaccugcc

SEQ ID NO: 1042180 - RNA, 19 nt, Homo sapiens
gcaccgagagagauggaau

SEQ ID NO: 1042181 - RNA, 14 nt, Homo sapiens
gcaccgucauggcu

SEQ ID NO: 1042182 - RNA, 19 nt, Homo sapiens
gcaccuaccaucagggaca

SEQ ID NO: 1042183 - RNA, 12 nt, Homo sapiens
gcaccuaccuca

SEQ ID NO: 1042184 - RNA, 13 nt, Homo sapiens
gcaccugaccaca

SEQ ID NO: 1042185 - RNA, 24 nt, Homo sapiens
gcaccuugugucuguacacguguc

SEQ ID NO: 1042186 - RNA, 13 nt, Homo sapiens
gcacgaucucagu

SEQ ID NO: 1042187 - RNA, 22 nt, Homo sapiens
gcacgaucucgacucacugcaa

SEQ ID NO: 1042188 - RNA, 14 nt, Homo sapiens
gcacgcccaugugu

SEQ ID NO: 1042189 - RNA, 18 nt, Homo sapiens
gcacgguggcucaggccu

SEQ ID NO: 1042190 - RNA, 22 nt, Homo sapiens
gcacguguggccuguucuucua

SEQ ID NO: 1042191 - RNA, 18 nt, Homo sapiens
gcacucaaagcuuguuaa

SEQ ID NO: 1042192 - RNA, 13 nt, Homo sapiens
gcacucuauguuc

SEQ ID NO: 1042193 - RNA, 21 nt, Homo sapiens
gcacugacauuguuggccaaa

SEQ ID NO: 1042194 - RNA, 12 nt, Homo sapiens
gcacugggauga

SEQ ID NO: 1042195 - RNA, 22 nt, Homo sapiens
gcacuggggagcccgucucagu

SEQ ID NO: 1042196 - RNA, 14 nt, Homo sapiens
gcacugugcuaaua

SEQ ID NO: 1042197 - RNA, 22 nt, Homo sapiens
gcacuucacagagugugcugga

SEQ ID NO: 1042198 - RNA, 20 nt, Homo sapiens
gcacuugcacgcccaugugu

SEQ ID NO: 1042199 - RNA, 14 nt, Homo sapiens
gcacuugcuuuuau

SEQ ID NO: 1042200 - RNA, 16 nt, Homo sapiens
gcacuuuaaacauuua

SEQ ID NO: 1042201 - RNA, 22 nt, Homo sapiens
gcacuuugggaggcugaggcag

SEQ ID NO: 1042202 - RNA, 22 nt, Homo sapiens
gcacuuuguucuggcucuucca

SEQ ID NO: 1042203 - RNA, 20 nt, Homo sapiens
gcagaaauacauauuuccaa

SEQ ID NO: 1042204 - RNA, 12 nt, Homo sapiens
gcagaacaguga

SEQ ID NO: 1042205 - RNA, 16 nt, Homo sapiens
gcagaaccuccuggaa

SEQ ID NO: 1042206 - RNA, 22 nt, Homo sapiens
gcagaacugcuugaacccagga

SEQ ID NO: 1042207 - RNA, 13 nt, Homo sapiens
gcagaacuuucac

SEQ ID NO: 1042208 - RNA, 14 nt, Homo sapiens
gcagaagacaguau

SEQ ID NO: 1042209 - RNA, 21 nt, Homo sapiens
gcagaagagacccaaccacuu

SEQ ID NO: 1042210 - RNA, 19 nt, Homo sapiens
gcagaauccuggcccucug

SEQ ID NO: 1042211 - RNA, 20 nt, Homo sapiens
gcagaaucuguuaccagagg

SEQ ID NO: 1042212 - RNA, 21 nt, Homo sapiens
gcagaccacugauaaaaccau

SEQ ID NO: 1042213 - RNA, 13 nt, Homo sapiens
gcagacuaugaau

SEQ ID NO: 1042214 - RNA, 12 nt, Homo sapiens
gcagacugcugc

SEQ ID NO: 1042215 - RNA, 20 nt, Homo sapiens
gcagagaaccaaaggggcca

SEQ ID NO: 1042216 - RNA, 21 nt, Homo sapiens
gcagagaacuggaaagacaua

SEQ ID NO: 1042217 - RNA, 15 nt, Homo sapiens
gcagagcuuccucag

SEQ ID NO: 1042218 - RNA, 19 nt, Homo sapiens
gcagagguaaaagugugag

SEQ ID NO: 1042219 - RNA, 20 nt, Homo sapiens
gcagaguacuggcugaugga

SEQ ID NO: 1042220 - RNA, 19 nt, Homo sapiens
gcagaucacguugcaaugg

SEQ ID NO: 1042221 - RNA, 20 nt, Homo sapiens
gcagaucuaccccuuacuua

SEQ ID NO: 1042222 - RNA, 19 nt, Homo sapiens
gcagaucuggacuuggcaa

SEQ ID NO: 1042223 - RNA, 13 nt, Homo sapiens
gcagaugacaaaa

SEQ ID NO: 1042224 - RNA, 14 nt, Homo sapiens
gcagcauuucugaa

SEQ ID NO: 1042225 - RNA, 18 nt, Homo sapiens
gcagccaaacccaugagg

SEQ ID NO: 1042226 - RNA, 19 nt, Homo sapiens
gcagccacaaccaaaaaau

SEQ ID NO: 1042227 - RNA, 16 nt, Homo sapiens
gcagccacauuccuga

SEQ ID NO: 1042228 - RNA, 16 nt, Homo sapiens
gcagccccacacccgc

SEQ ID NO: 1042229 - RNA, 18 nt, Homo sapiens
gcagccgugaucaaggga

SEQ ID NO: 1042230 - RNA, 20 nt, Homo sapiens
gcagccucacaguccuuacc

SEQ ID NO: 1042231 - RNA, 22 nt, Homo sapiens
gcagcuaccagguguucuacac

SEQ ID NO: 1042232 - RNA, 18 nt, Homo sapiens
gcagcuaucucucaguga

SEQ ID NO: 1042233 - RNA, 18 nt, Homo sapiens
gcagcucaggcacacuuc

SEQ ID NO: 1042234 - RNA, 14 nt, Homo sapiens
gcagcuccacaggg

SEQ ID NO: 1042235 - RNA, 22 nt, Homo sapiens
gcagcuccacagggcagggccu

SEQ ID NO: 1042236 - RNA, 14 nt, Homo sapiens
gcagcucuggaggg

SEQ ID NO: 1042237 - RNA, 13 nt, Homo sapiens
gcagcucugugac

SEQ ID NO: 1042238 - RNA, 23 nt, Homo sapiens
gcagcuguugcagugagccaaga

SEQ ID NO: 1042239 - RNA, 23 nt, Homo sapiens
gcagcuguuuuaguuaaauuucu

SEQ ID NO: 1042240 - RNA, 18 nt, Homo sapiens
gcagcuucucuccacuga

SEQ ID NO: 1042241 - RNA, 19 nt, Homo sapiens
gcagcuuuaaacucaggga

SEQ ID NO: 1042242 - RNA, 22 nt, Homo sapiens
gcaggaacucccagcaacacaa

SEQ ID NO: 1042243 - RNA, 18 nt, Homo sapiens
gcaggaagcauucagaga

SEQ ID NO: 1042244 - RNA, 15 nt, Homo sapiens
gcaggaagcucagac

SEQ ID NO: 1042245 - RNA, 18 nt, Homo sapiens
gcaggacuaaaugucuag

SEQ ID NO: 1042246 - RNA, 13 nt, Homo sapiens
gcaggacugcaca

SEQ ID NO: 1042247 - RNA, 12 nt, Homo sapiens
gcaggagaauca

SEQ ID NO: 1042248 - RNA, 18 nt, Homo sapiens
gcaggagaaucacuugaa

SEQ ID NO: 1042249 - RNA, 23 nt, Homo sapiens
gcaggagagaaugcccagugacc

SEQ ID NO: 1042250 - RNA, 16 nt, Homo sapiens
gcaggaguauaugagc

SEQ ID NO: 1042251 - RNA, 24 nt, Homo sapiens
gcaggauuucuucacaccucuccu

SEQ ID NO: 1042252 - RNA, 16 nt, Homo sapiens
gcaggauuuguuguuc

SEQ ID NO: 1042253 - RNA, 22 nt, Homo sapiens
gcaggcaccuuaguggcuuuuu

SEQ ID NO: 1042254 - RNA, 14 nt, Homo sapiens
gcaggcuacacuga

SEQ ID NO: 1042255 - RNA, 16 nt, Homo sapiens
gcaggcuacacugaca

SEQ ID NO: 1042256 - RNA, 16 nt, Homo sapiens
gcagggacacccgacc

SEQ ID NO: 1042257 - RNA, 16 nt, Homo sapiens
gcagggacugccaguc

SEQ ID NO: 1042258 - RNA, 13 nt, Homo sapiens
gcagggcucugau

SEQ ID NO: 1042259 - RNA, 14 nt, Homo sapiens
gcagggcugacucu

SEQ ID NO: 1042260 - RNA, 23 nt, Homo sapiens
gcagggguccuuggugugacccu

SEQ ID NO: 1042261 - RNA, 18 nt, Homo sapiens
gcaggugcugagcaaagg

SEQ ID NO: 1042262 - RNA, 20 nt, Homo sapiens
gcagguggggagacugggcu

SEQ ID NO: 1042263 - RNA, 14 nt, Homo sapiens
gcagguugcuuugc

SEQ ID NO: 1042264 - RNA, 14 nt, Homo sapiens
cucaauacacagaa

SEQ ID NO: 1042265 - RNA, 20 nt, Homo sapiens
cucaauggauuugaugcugu

SEQ ID NO: 1042266 - RNA, 18 nt, Homo sapiens
cucaauuuuuuucaccuc

SEQ ID NO: 1042267 - RNA, 18 nt, Homo sapiens
cucacaaaccaugcaaau

SEQ ID NO: 1042268 - RNA, 21 nt, Homo sapiens
cucacaagaagaccagacugu

SEQ ID NO: 1042269 - RNA, 15 nt, Homo sapiens
cucacacaugagauc

SEQ ID NO: 1042270 - RNA, 16 nt, Homo sapiens
cucacacaugagaucu

SEQ ID NO: 1042271 - RNA, 11 nt, Homo sapiens
cucacacccca

SEQ ID NO: 1042272 - RNA, 19 nt, Homo sapiens
cucacaccuguaaucccaa

SEQ ID NO: 1042273 - RNA, 22 nt, Homo sapiens
cucacacggacacucaaaagcu

SEQ ID NO: 1042274 - RNA, 17 nt, Homo sapiens
cucacagaaaugagauc

SEQ ID NO: 1042275 - RNA, 18 nt, Homo sapiens
cucacauccucugucuau

SEQ ID NO: 1042276 - RNA, 12 nt, Homo sapiens
cucacaucuugg

SEQ ID NO: 1042277 - RNA, 17 nt, Homo sapiens
cucacauuuauucugcu

SEQ ID NO: 1042278 - RNA, 23 nt, Homo sapiens
cucacccccagcuuugcuaccaa

SEQ ID NO: 1042279 - RNA, 17 nt, Homo sapiens
cucaccugcuggccccu

SEQ ID NO: 1042280 - RNA, 22 nt, Homo sapiens
cucacgaauauuaugcccaguu

SEQ ID NO: 1042281 - RNA, 17 nt, Homo sapiens
cucacgccuguaauccc

SEQ ID NO: 1042282 - RNA, 12 nt, Homo sapiens
cucacuaugaau

SEQ ID NO: 1042283 - RNA, 14 nt, Homo sapiens
cucacuccuguuac

SEQ ID NO: 1042284 - RNA, 10 nt, Homo sapiens
cucacuccuu

SEQ ID NO: 1042285 - RNA, 20 nt, Homo sapiens
cucacugaaaacaucuggaa

SEQ ID NO: 1042286 - RNA, 21 nt, Homo sapiens
cucacugugggaaggccagcu

SEQ ID NO: 1042287 - RNA, 20 nt, Homo sapiens
cucacuguggugucuguguu

SEQ ID NO: 1042288 - RNA, 18 nt, Homo sapiens
cucacuugugcaguguug

SEQ ID NO: 1042289 - RNA, 23 nt, Homo sapiens
cucacuuucuagauuaagauaug

SEQ ID NO: 1042290 - RNA, 22 nt, Homo sapiens
cucagaagacacugaugggcaa

SEQ ID NO: 1042291 - RNA, 14 nt, Homo sapiens
cucagaauaaaaga

SEQ ID NO: 1042292 - RNA, 23 nt, Homo sapiens
cucagaauauacccauccaugca

SEQ ID NO: 1042293 - RNA, 16 nt, Homo sapiens
cucagaccagcucuuc

SEQ ID NO: 1042294 - RNA, 14 nt, Homo sapiens
cucagagaugugca

SEQ ID NO: 1042295 - RNA, 21 nt, Homo sapiens
cucagagggauccucccacac

SEQ ID NO: 1042296 - RNA, 20 nt, Homo sapiens
cucagaucacuacugcaguc

SEQ ID NO: 1042297 - RNA, 23 nt, Homo sapiens
cucagaucauuaucagccugugc

SEQ ID NO: 1042298 - RNA, 13 nt, Homo sapiens
cucagaugccacu

SEQ ID NO: 1042299 - RNA, 16 nt, Homo sapiens
cucagauuauuuuucc

SEQ ID NO: 1042300 - RNA, 14 nt, Homo sapiens
cucagcaaugauua

SEQ ID NO: 1042301 - RNA, 15 nt, Homo sapiens
cucagcaccccuguc

SEQ ID NO: 1042302 - RNA, 23 nt, Homo sapiens
cucagcaugcauccuuugcacug

SEQ ID NO: 1042303 - RNA, 14 nt, Homo sapiens
cucagcauuuccac

SEQ ID NO: 1042304 - RNA, 13 nt, Homo sapiens
cucagcccugugc

SEQ ID NO: 1042305 - RNA, 14 nt, Homo sapiens
cucagccucaggga

SEQ ID NO: 1042306 - RNA, 20 nt, Homo sapiens
cucagccucccaaguagcug

SEQ ID NO: 1042307 - RNA, 14 nt, Homo sapiens
ggaccacauuuuau

SEQ ID NO: 1042308 - RNA, 22 nt, Homo sapiens
ggaccccgagccuggcuccaaa

SEQ ID NO: 1042309 - RNA, 12 nt, Homo sapiens
ggaccucaaagg

SEQ ID NO: 1042310 - RNA, 17 nt, Homo sapiens
ggaccugcccugggcca

SEQ ID NO: 1042311 - RNA, 19 nt, Homo sapiens
ggacuagagggaccucucc

SEQ ID NO: 1042312 - RNA, 13 nt, Homo sapiens
ggacuagcuggau

SEQ ID NO: 1042313 - RNA, 21 nt, Homo sapiens
ggacuauggcucuacuuucag

SEQ ID NO: 1042314 - RNA, 18 nt, Homo sapiens
ggacucaagcaagauuuc

SEQ ID NO: 1042315 - RNA, 23 nt, Homo sapiens
ggacucaaugcacugacauuguu

SEQ ID NO: 1042316 - RNA, 21 nt, Homo sapiens
ggacuccagaaucuaaagcca

SEQ ID NO: 1042317 - RNA, 16 nt, Homo sapiens
ggacucuacacuguga

SEQ ID NO: 1042318 - RNA, 19 nt, Homo sapiens
ggacucuuacugcuaacuu

SEQ ID NO: 1042319 - RNA, 15 nt, Homo sapiens
ggacucuucucaucc

SEQ ID NO: 1042320 - RNA, 13 nt, Homo sapiens
ggacugaguuuau

SEQ ID NO: 1042321 - RNA, 19 nt, Homo sapiens
ggacugaucgauuugcacc

SEQ ID NO: 1042322 - RNA, 17 nt, Homo sapiens
ggacuggaaccagggag

SEQ ID NO: 1042323 - RNA, 10 nt, Homo sapiens
ggacugggag

SEQ ID NO: 1042324 - RNA, 21 nt, Homo sapiens
ggacuuaccgccuggaggcag

SEQ ID NO: 1042325 - RNA, 15 nt, Homo sapiens
ggacuuccauuugcu

SEQ ID NO: 1042326 - RNA, 18 nt, Homo sapiens
ggacuucuggcagggaag

SEQ ID NO: 1042327 - RNA, 10 nt, Homo sapiens
ggacuuuguu

SEQ ID NO: 1042328 - RNA, 18 nt, Homo sapiens
ggagaaacccuugaaaag

SEQ ID NO: 1042329 - RNA, 21 nt, Homo sapiens
ggagaaacuguagucucagga

SEQ ID NO: 1042330 - RNA, 23 nt, Homo sapiens
ggagaaccucaggcuuccuuggc

SEQ ID NO: 1042331 - RNA, 18 nt, Homo sapiens
ggagaagagcuguucaca

SEQ ID NO: 1042332 - RNA, 17 nt, Homo sapiens
ggagaagcaugaaaaag

SEQ ID NO: 1042333 - RNA, 18 nt, Homo sapiens
ggagaaucacuugcacuc

SEQ ID NO: 1042334 - RNA, 24 nt, Homo sapiens
ggagaauuauauagguugugcaaa

SEQ ID NO: 1042335 - RNA, 17 nt, Homo sapiens
ggagaauuuuacugugu

SEQ ID NO: 1042336 - RNA, 23 nt, Homo sapiens
ggagacaacagcccugucucaaa

SEQ ID NO: 1042337 - RNA, 23 nt, Homo sapiens
ggagacacuauuuaucugugcaa

SEQ ID NO: 1042338 - RNA, 21 nt, Homo sapiens
ggagacagagcugguugggaa

SEQ ID NO: 1042339 - RNA, 15 nt, Homo sapiens
ggagaccuggcacug

SEQ ID NO: 1042340 - RNA, 13 nt, Homo sapiens
ggagacuccauga

SEQ ID NO: 1042341 - RNA, 12 nt, Homo sapiens
ggagacuuguau

SEQ ID NO: 1042342 - RNA, 15 nt, Homo sapiens
ggagagcccagccau

SEQ ID NO: 1042343 - RNA, 20 nt, Homo sapiens
ggagagcuggggaagcuucu

SEQ ID NO: 1042344 - RNA, 13 nt, Homo sapiens
ggagaggccauga

SEQ ID NO: 1042345 - RNA, 16 nt, Homo sapiens
ggagaguacagugagc

SEQ ID NO: 1042346 - RNA, 20 nt, Homo sapiens
ggagaguacagugagccaag

SEQ ID NO: 1042347 - RNA, 14 nt, Homo sapiens
ggagagugcaacag

SEQ ID NO: 1042348 - RNA, 17 nt, Homo sapiens
ggagauaaucuagaaca

SEQ ID NO: 1042349 - RNA, 21 nt, Homo sapiens
ggagauuucuuguugcucaaa

SEQ ID NO: 1042350 - RNA, 20 nt, Homo sapiens
ggagcaaaaucgaugcagug

SEQ ID NO: 1042351 - RNA, 23 nt, Homo sapiens
ggagcaaaggcugagaacacugu

SEQ ID NO: 1042352 - RNA, 23 nt, Homo sapiens
ggagcagcuucugggaccauaag

SEQ ID NO: 1042353 - RNA, 21 nt, Homo sapiens
ggagcaggagccugagccuug

SEQ ID NO: 1042354 - RNA, 17 nt, Homo sapiens
ggagcauuggcugagag

SEQ ID NO: 1042355 - RNA, 17 nt, Homo sapiens
ggagcucaggucccagg

SEQ ID NO: 1042356 - RNA, 19 nt, Homo sapiens
ggagcugccuguucagcuc

SEQ ID NO: 1042357 - RNA, 17 nt, Homo sapiens
ggagcuggggaaacuca

SEQ ID NO: 1042358 - RNA, 16 nt, Homo sapiens
ggagcuguaaaccaga

SEQ ID NO: 1042359 - RNA, 21 nt, Homo sapiens
ggagcuuuuccugauguucca

SEQ ID NO: 1042360 - RNA, 18 nt, Homo sapiens
ggaggaaugcucccccau

SEQ ID NO: 1042361 - RNA, 19 nt, Homo sapiens
ggaggacggugcaacccaa

SEQ ID NO: 1042362 - RNA, 12 nt, Homo sapiens
ggaggauguucu

SEQ ID NO: 1042363 - RNA, 17 nt, Homo sapiens
ggaggcacccaugccau

SEQ ID NO: 1042364 - RNA, 20 nt, Homo sapiens
ggaggcagagguugcaguga

SEQ ID NO: 1042365 - RNA, 16 nt, Homo sapiens
ggaggccagccaguga

SEQ ID NO: 1042366 - RNA, 14 nt, Homo sapiens
ggaggccuuucauc

SEQ ID NO: 1042367 - RNA, 20 nt, Homo sapiens
ggaggcggagcuugcaguga

SEQ ID NO: 1042368 - RNA, 18 nt, Homo sapiens
ggaggcugucuucucagg

SEQ ID NO: 1042369 - RNA, 20 nt, Homo sapiens
ggagggauugacauguuuca

SEQ ID NO: 1042370 - RNA, 18 nt, Homo sapiens
ggagggguauuuuugccc

SEQ ID NO: 1042371 - RNA, 15 nt, Homo sapiens
ggagguaaugaauua

SEQ ID NO: 1042372 - RNA, 14 nt, Homo sapiens
ggaggucucuguaa

SEQ ID NO: 1042373 - RNA, 19 nt, Homo sapiens
ggagguggagguugcagug

SEQ ID NO: 1042374 - RNA, 19 nt, Homo sapiens
ggagguggcuggguuuaca

SEQ ID NO: 1042375 - RNA, 16 nt, Homo sapiens
ggagguuaagugacuu

SEQ ID NO: 1042376 - RNA, 14 nt, Homo sapiens
ggaguacaccccaa

SEQ ID NO: 1042377 - RNA, 15 nt, Homo sapiens
ggaguccaggccaug

SEQ ID NO: 1042378 - RNA, 13 nt, Homo sapiens
ggagucugcacau

SEQ ID NO: 1042379 - RNA, 24 nt, Homo sapiens
ggagugagggguaaaagcugaucu

SEQ ID NO: 1042380 - RNA, 22 nt, Homo sapiens
ggagugcaguggcgugaucucg

SEQ ID NO: 1042381 - RNA, 17 nt, Homo sapiens
ggagugcccccaacagc

SEQ ID NO: 1042382 - RNA, 22 nt, Homo sapiens
ggagugggcccaaugcacuuug

SEQ ID NO: 1042383 - RNA, 21 nt, Homo sapiens
ggaguguucagggccagcccu

SEQ ID NO: 1042384 - RNA, 18 nt, Homo sapiens
ggaguuaggcuauucaca

SEQ ID NO: 1042385 - RNA, 14 nt, Homo sapiens
ggaguucacuucau

SEQ ID NO: 1042386 - RNA, 20 nt, Homo sapiens
ggaguucgaggcugcaguca

SEQ ID NO: 1042387 - RNA, 19 nt, Homo sapiens
ggauaacuuagguggcaag

SEQ ID NO: 1042388 - RNA, 23 nt, Homo sapiens
ggauaaucacauuaucaucugaa

SEQ ID NO: 1042389 - RNA, 23 nt, Homo sapiens
ggauacgcaucagacagauggaa

SEQ ID NO: 1042390 - RNA, 20 nt, Homo sapiens
ggauacugcccggggcagcu

SEQ ID NO: 1042391 - RNA, 16 nt, Homo sapiens
ggauauaggucaguga

SEQ ID NO: 1042392 - RNA, 15 nt, Homo sapiens
ggauauuuucuucca

SEQ ID NO: 1042393 - RNA, 16 nt, Homo sapiens
ggaucacaaggucacu

SEQ ID NO: 1042394 - RNA, 20 nt, Homo sapiens
ggaucacaaggucacuagau

SEQ ID NO: 1042395 - RNA, 17 nt, Homo sapiens
ggaucccguguugccau

SEQ ID NO: 1042396 - RNA, 19 nt, Homo sapiens
ggaucuccaaggaccaggu

SEQ ID NO: 1042397 - RNA, 13 nt, Homo sapiens
ggaugaugcaguu

SEQ ID NO: 1042398 - RNA, 12 nt, Homo sapiens
ggaugaugccuc

SEQ ID NO: 1042399 - RNA, 15 nt, Homo sapiens
ggaugcagagucagc

SEQ ID NO: 1042400 - RNA, 22 nt, Homo sapiens
ggaugcaggguuugagaauguu

SEQ ID NO: 1042401 - RNA, 14 nt, Homo sapiens
ggauggcaccagag

SEQ ID NO: 1042402 - RNA, 12 nt, Homo sapiens
ggaugucucuca

SEQ ID NO: 1042403 - RNA, 16 nt, Homo sapiens
ggaugugguggcagug

SEQ ID NO: 1042404 - RNA, 22 nt, Homo sapiens
ggauguugaagugagcugagau

SEQ ID NO: 1042405 - RNA, 13 nt, Homo sapiens
ggauuacagggau

SEQ ID NO: 1042406 - RNA, 16 nt, Homo sapiens
ggauuauuuaauaaca

SEQ ID NO: 1042407 - RNA, 21 nt, Homo sapiens
ggauucuggccuagucccuuc

SEQ ID NO: 1042408 - RNA, 16 nt, Homo sapiens
ggauucuguaugccaa

SEQ ID NO: 1042409 - RNA, 16 nt, Homo sapiens
ggauugaagcccucca

SEQ ID NO: 1042410 - RNA, 17 nt, Homo sapiens
ggauugaagcccuccaa

SEQ ID NO: 1042411 - RNA, 15 nt, Homo sapiens
ggauugugccuguau

SEQ ID NO: 1042412 - RNA, 15 nt, Homo sapiens
ggauuuauucugcca

SEQ ID NO: 1042413 - RNA, 19 nt, Homo sapiens
ggauuuauuuuuccauuua

SEQ ID NO: 1042414 - RNA, 20 nt, Homo sapiens
ggauuugaugcuguuugaca

SEQ ID NO: 1042415 - RNA, 15 nt, Homo sapiens
ggauuuggguuggaa

SEQ ID NO: 1042416 - RNA, 16 nt, Homo sapiens
ggcaaaaaaauuaaau

SEQ ID NO: 1042417 - RNA, 14 nt, Homo sapiens
ggcaaaaugucauu

SEQ ID NO: 1042418 - RNA, 21 nt, Homo sapiens
ggcaacaacagcaaaacucca

SEQ ID NO: 1042419 - RNA, 18 nt, Homo sapiens
ggcaacagagcaagaucc

SEQ ID NO: 1042420 - RNA, 17 nt, Homo sapiens
ggcaacaucuugcaaaa

SEQ ID NO: 1042421 - RNA, 23 nt, Homo sapiens
ggcaacuugggaacuagacuccc

SEQ ID NO: 1042422 - RNA, 21 nt, Homo sapiens
ggcaauguucccccucuccuc

SEQ ID NO: 1042423 - RNA, 17 nt, Homo sapiens
ggcacacugagccagca

SEQ ID NO: 1042424 - RNA, 22 nt, Homo sapiens
ggcacacugggugcccaagcuc

SEQ ID NO: 1042425 - RNA, 22 nt, Homo sapiens
ggcaccuccuacgucaaacaug

SEQ ID NO: 1042426 - RNA, 23 nt, Homo sapiens
ggcacgaggccaggcagauccca

SEQ ID NO: 1042427 - RNA, 19 nt, Homo sapiens
ggcacgaucucgacucacu

SEQ ID NO: 1042428 - RNA, 18 nt, Homo sapiens
ggcacucaacaugaguca

SEQ ID NO: 1042429 - RNA, 14 nt, Homo sapiens
ggcacucccaucca

SEQ ID NO: 1042430 - RNA, 22 nt, Homo sapiens
ggcacugcaggggccgagccau

SEQ ID NO: 1042431 - RNA, 16 nt, Homo sapiens
ggcacugccaugcagg

SEQ ID NO: 1042432 - RNA, 13 nt, Homo sapiens
ggcacugccugau

SEQ ID NO: 1042433 - RNA, 22 nt, Homo sapiens
ggcacuggcauugucccugugc

SEQ ID NO: 1042434 - RNA, 11 nt, Homo sapiens
ggcacugggau

SEQ ID NO: 1042435 - RNA, 14 nt, Homo sapiens
ggcacuucacagag

SEQ ID NO: 1042436 - RNA, 17 nt, Homo sapiens
ggcagaacugcuugaac

SEQ ID NO: 1042437 - RNA, 11 nt, Homo sapiens
ggcagaagcag

SEQ ID NO: 1042438 - RNA, 20 nt, Homo sapiens
ggcagaccugacucucuuaa

SEQ ID NO: 1042439 - RNA, 17 nt, Homo sapiens
ggcagauguggcugaac

SEQ ID NO: 1042440 - RNA, 17 nt, Homo sapiens
ggcagcauuuagcacau

SEQ ID NO: 1042441 - RNA, 13 nt, Homo sapiens
ggcagccacgugc

SEQ ID NO: 1042442 - RNA, 13 nt, Homo sapiens
ggcagcuugcccc

SEQ ID NO: 1042443 - RNA, 14 nt, Homo sapiens
ggcagggucucacu

SEQ ID NO: 1042444 - RNA, 15 nt, Homo sapiens
ggcaggucacuuuac

SEQ ID NO: 1042445 - RNA, 19 nt, Homo sapiens
ggcagucucugcccaaaca

SEQ ID NO: 1042446 - RNA, 14 nt, Homo sapiens
ggcauagaugcagg

SEQ ID NO: 1042447 - RNA, 16 nt, Homo sapiens
ggcauaggccugggug

SEQ ID NO: 1042448 - RNA, 17 nt, Homo sapiens
ggcauauccaccaccuc

SEQ ID NO: 1042449 - RNA, 21 nt, Homo sapiens
ggcaucaugcagaguugacau

SEQ ID NO: 1042450 - RNA, 21 nt, Homo sapiens
ggcaucuccugugcaugggug

SEQ ID NO: 1042451 - RNA, 20 nt, Homo sapiens
ggcaugagggaucacagggc

SEQ ID NO: 1042452 - RNA, 22 nt, Homo sapiens
guguucugucacucagcuuugc

SEQ ID NO: 1042453 - RNA, 14 nt, Homo sapiens
guguucuucauuac

SEQ ID NO: 1042454 - RNA, 19 nt, Homo sapiens
guguucuucauuaccucag

SEQ ID NO: 1042455 - RNA, 22 nt, Homo sapiens
guguuugugauuguuugcucug

SEQ ID NO: 1042456 - RNA, 17 nt, Homo sapiens
guguuuuaaaauugaug

SEQ ID NO: 1042457 - RNA, 15 nt, Homo sapiens
guguuuuauugacau

SEQ ID NO: 1042458 - RNA, 18 nt, Homo sapiens
guguuuuucacauuugcg

SEQ ID NO: 1042459 - RNA, 17 nt, Homo sapiens
guguuuuuuuacauacg

SEQ ID NO: 1042460 - RNA, 19 nt, Homo sapiens
guuaaacccacagccaaac

SEQ ID NO: 1042461 - RNA, 22 nt, Homo sapiens
guuaaacuaaggcccucuugaa

SEQ ID NO: 1042462 - RNA, 18 nt, Homo sapiens
guuaaaugaaauuguaaa

SEQ ID NO: 1042463 - RNA, 18 nt, Homo sapiens
guuaaggguuaguuuaca

SEQ ID NO: 1042464 - RNA, 18 nt, Homo sapiens
guuaauaaguuucacuga

SEQ ID NO: 1042465 - RNA, 17 nt, Homo sapiens
guuaauauugugcaaac

SEQ ID NO: 1042466 - RNA, 14 nt, Homo sapiens
guuaaucauuucau

SEQ ID NO: 1042467 - RNA, 14 nt, Homo sapiens
guuaaugguuugaa

SEQ ID NO: 1042468 - RNA, 19 nt, Homo sapiens
guuaauuauuuugacaaau

SEQ ID NO: 1042469 - RNA, 22 nt, Homo sapiens
guuacaguuugagacuuccaaa

SEQ ID NO: 1042470 - RNA, 22 nt, Homo sapiens
guuacauaagauaaaugugcug

SEQ ID NO: 1042471 - RNA, 15 nt, Homo sapiens
guuaccaacuaccua

SEQ ID NO: 1042472 - RNA, 17 nt, Homo sapiens
guuacuugaaauaccag

SEQ ID NO: 1042473 - RNA, 21 nt, Homo sapiens
guuagaaaauggacacugugc

SEQ ID NO: 1042474 - RNA, 18 nt, Homo sapiens
guuagcuaaaggaucuua

SEQ ID NO: 1042475 - RNA, 17 nt, Homo sapiens
guuaggaaaauuucaca

SEQ ID NO: 1042476 - RNA, 17 nt, Homo sapiens
guuauaaaucaauguca

SEQ ID NO: 1042477 - RNA, 22 nt, Homo sapiens
guuauaauaauguuaacaugga

SEQ ID NO: 1042478 - RNA, 12 nt, Homo sapiens
guuauaaugugu

SEQ ID NO: 1042479 - RNA, 19 nt, Homo sapiens
guuaucugucccagguuau

SEQ ID NO: 1042480 - RNA, 17 nt, Homo sapiens
guuaucuuccacuggaa

SEQ ID NO: 1042481 - RNA, 22 nt, Homo sapiens
guuauuugaaaauuugauuuug

SEQ ID NO: 1042482 - RNA, 23 nt, Homo sapiens
guuauuugaaaauuugauuuuga

SEQ ID NO: 1042483 - RNA, 12 nt, Homo sapiens
guuauuugcucu

SEQ ID NO: 1042484 - RNA, 15 nt, Homo sapiens
guuauuuuaauuauc

SEQ ID NO: 1042485 - RNA, 19 nt, Homo sapiens
guuauuuugcuauuugccu

SEQ ID NO: 1042486 - RNA, 20 nt, Homo sapiens
guucaaaaccuugcacaggu

SEQ ID NO: 1042487 - RNA, 16 nt, Homo sapiens
guucaaauucuucuga

SEQ ID NO: 1042488 - RNA, 17 nt, Homo sapiens
guucaauggcugcugaa

SEQ ID NO: 1042489 - RNA, 16 nt, Homo sapiens
guucaccuugggauga

SEQ ID NO: 1042490 - RNA, 23 nt, Homo sapiens
guucaccuugggaugaugccuca

SEQ ID NO: 1042491 - RNA, 12 nt, Homo sapiens
guucagaccgac

SEQ ID NO: 1042492 - RNA, 17 nt, Homo sapiens
guucauauuaagacaua

SEQ ID NO: 1042493 - RNA, 23 nt, Homo sapiens
guucaucauccuaagcuauucag

SEQ ID NO: 1042494 - RNA, 16 nt, Homo sapiens
guucauugcacuuuga

SEQ ID NO: 1042495 - RNA, 14 nt, Homo sapiens
guucccauucugag

SEQ ID NO: 1042496 - RNA, 17 nt, Homo sapiens
guucccauuucagcuga

SEQ ID NO: 1042497 - RNA, 14 nt, Homo sapiens
guucccccacugau

SEQ ID NO: 1042498 - RNA, 14 nt, Homo sapiens
guuccgacugccau

SEQ ID NO: 1042499 - RNA, 22 nt, Homo sapiens
guuccggauuggcuuguguguu

SEQ ID NO: 1042500 - RNA, 21 nt, Homo sapiens
guuccuauuuggggcuugcau

SEQ ID NO: 1042501 - RNA, 12 nt, Homo sapiens
guuccucaaaag

SEQ ID NO: 1042502 - RNA, 20 nt, Homo sapiens
guuccuuuauuuuauguaaa

SEQ ID NO: 1042503 - RNA, 13 nt, Homo sapiens
guucgauggcuca

SEQ ID NO: 1042504 - RNA, 21 nt, Homo sapiens
guucuaccucaggcagcucaa

SEQ ID NO: 1042505 - RNA, 14 nt, Homo sapiens
guucuaguuugcau

SEQ ID NO: 1042506 - RNA, 22 nt, Homo sapiens
guucucuauugcugcucucuca

SEQ ID NO: 1042507 - RNA, 18 nt, Homo sapiens
guucucucguaacugguu

SEQ ID NO: 1042508 - RNA, 15 nt, Homo sapiens
guucugaaagugacu

SEQ ID NO: 1042509 - RNA, 16 nt, Homo sapiens
uaaaaauggcucagau

SEQ ID NO: 1042510 - RNA, 15 nt, Homo sapiens
uaaaaauugugauca

SEQ ID NO: 1042511 - RNA, 19 nt, Homo sapiens
uaaaacaaaagcucaucca

SEQ ID NO: 1042512 - RNA, 22 nt, Homo sapiens
uaaaacaaauccauaauuauua

SEQ ID NO: 1042513 - RNA, 23 nt, Homo sapiens
uaaaacagguggagaaauuccuu

SEQ ID NO: 1042514 - RNA, 15 nt, Homo sapiens
uaaaacaugcacaaa

SEQ ID NO: 1042515 - RNA, 18 nt, Homo sapiens
uaaaacauuuucacacaa

SEQ ID NO: 1042516 - RNA, 20 nt, Homo sapiens
uaaaacauuuucacacaaua

SEQ ID NO: 1042517 - RNA, 12 nt, Homo sapiens
uaaaaccuuuca

SEQ ID NO: 1042518 - RNA, 17 nt, Homo sapiens
uaaaacggauaccaagu

SEQ ID NO: 1042519 - RNA, 17 nt, Homo sapiens
uaaaacuacacaucccu

SEQ ID NO: 1042520 - RNA, 16 nt, Homo sapiens
uaaaacuauauucuca

SEQ ID NO: 1042521 - RNA, 21 nt, Homo sapiens
uaaaacugauuuuuagcuuua

SEQ ID NO: 1042522 - RNA, 16 nt, Homo sapiens
uaaaagagauuucaag

SEQ ID NO: 1042523 - RNA, 19 nt, Homo sapiens
uaaaagcuauggugagaug

SEQ ID NO: 1042524 - RNA, 16 nt, Homo sapiens
uaaaagguaugcaauc

SEQ ID NO: 1042525 - RNA, 23 nt, Homo sapiens
uaaaaguacauguuaaacuuacu

SEQ ID NO: 1042526 - RNA, 13 nt, Homo sapiens
uaaaaguuacuua

SEQ ID NO: 1042527 - RNA, 18 nt, Homo sapiens
uaaaaguuucaaugugau

SEQ ID NO: 1042528 - RNA, 13 nt, Homo sapiens
uaaaauaacuuca

SEQ ID NO: 1042529 - RNA, 17 nt, Homo sapiens
uaaaauaagaaugauuu

SEQ ID NO: 1042530 - RNA, 17 nt, Homo sapiens
uaaaauacacacucaaa

SEQ ID NO: 1042531 - RNA, 22 nt, Homo sapiens
uaaaauacuauuuuuacugcca

SEQ ID NO: 1042532 - RNA, 21 nt, Homo sapiens
uaaaauagaaauaagugguua

SEQ ID NO: 1042533 - RNA, 14 nt, Homo sapiens
uaaaauagccacuu

SEQ ID NO: 1042534 - RNA, 18 nt, Homo sapiens
uaaaauagccacuuaccu

SEQ ID NO: 1042535 - RNA, 19 nt, Homo sapiens
uaaaauauuccugcauuug

SEQ ID NO: 1042536 - RNA, 20 nt, Homo sapiens
uaaaauauuuuuaugugcaa

SEQ ID NO: 1042537 - RNA, 23 nt, Homo sapiens
uaaaauauuuuuaugugcaauaa

SEQ ID NO: 1042538 - RNA, 19 nt, Homo sapiens
uaaaaugaaauuacuacaa

SEQ ID NO: 1042539 - RNA, 22 nt, Homo sapiens
uaaaaugagaucguuguuuaca

SEQ ID NO: 1042540 - RNA, 16 nt, Homo sapiens
uaaaauguuuaaugaa

SEQ ID NO: 1042541 - RNA, 20 nt, Homo sapiens
uaaaauuacauugagguucc

SEQ ID NO: 1042542 - RNA, 23 nt, Homo sapiens
uaaaauuagaaucugaguauaaa

SEQ ID NO: 1042543 - RNA, 18 nt, Homo sapiens
uaaaauuaugccauagca

SEQ ID NO: 1042544 - RNA, 14 nt, Homo sapiens
uaaaauugugaugu

SEQ ID NO: 1042545 - RNA, 18 nt, Homo sapiens
uaaaauuucacuuaauaa

SEQ ID NO: 1042546 - RNA, 17 nt, Homo sapiens
uaaacaaaggaauuaug

SEQ ID NO: 1042547 - RNA, 16 nt, Homo sapiens
uaaacaacuaccuccu

SEQ ID NO: 1042548 - RNA, 18 nt, Homo sapiens
uaaacaauaucagacuuu

SEQ ID NO: 1042549 - RNA, 14 nt, Homo sapiens
uaaacacccaugaa

SEQ ID NO: 1042550 - RNA, 15 nt, Homo sapiens
uaaacaccuccucau

SEQ ID NO: 1042551 - RNA, 21 nt, Homo sapiens
uaaacacggggcuugcaacuu

SEQ ID NO: 1042552 - RNA, 20 nt, Homo sapiens
uaaacagauggcacuuugaa

SEQ ID NO: 1042553 - RNA, 15 nt, Homo sapiens
uaaacaguagugaua

SEQ ID NO: 1042554 - RNA, 17 nt, Homo sapiens
uaaacaguggaauauaa

SEQ ID NO: 1042555 - RNA, 14 nt, Homo sapiens
uaaacaugcuugca

SEQ ID NO: 1042556 - RNA, 10 nt, Homo sapiens
uaaacauuca

SEQ ID NO: 1042557 - RNA, 17 nt, Homo sapiens
uaaacauucuugcugcu

SEQ ID NO: 1042558 - RNA, 22 nt, Homo sapiens
uaaacauuuaacuuguuuccaa

SEQ ID NO: 1042559 - RNA, 18 nt, Homo sapiens
uaaaccuaauaaucugaa

SEQ ID NO: 1042560 - RNA, 13 nt, Homo sapiens
uaaacucagggac

SEQ ID NO: 1042561 - RNA, 14 nt, Homo sapiens
uaaacugauuuauc

SEQ ID NO: 1042562 - RNA, 22 nt, Homo sapiens
uaacuaguccuuuacuaaucca

SEQ ID NO: 1042563 - RNA, 14 nt, Homo sapiens
uaacuauauuugcu

SEQ ID NO: 1042564 - RNA, 17 nt, Homo sapiens
uaacuauggaauuuuga

SEQ ID NO: 1042565 - RNA, 11 nt, Homo sapiens
uaacuauucau

SEQ ID NO: 1042566 - RNA, 18 nt, Homo sapiens
uaacucaccucucaaggu

SEQ ID NO: 1042567 - RNA, 16 nt, Homo sapiens
uaacuccagugaagua

SEQ ID NO: 1042568 - RNA, 16 nt, Homo sapiens
uaacugacaacuugaa

SEQ ID NO: 1042569 - RNA, 14 nt, Homo sapiens
uaacugcauugaga

SEQ ID NO: 1042570 - RNA, 21 nt, Homo sapiens
uaacugcauugagaacugcau

SEQ ID NO: 1042571 - RNA, 15 nt, Homo sapiens
uaacuggcaguuuuc

SEQ ID NO: 1042572 - RNA, 13 nt, Homo sapiens
uaacuuauuuucc

SEQ ID NO: 1042573 - RNA, 13 nt, Homo sapiens
uaacuucaaugua

SEQ ID NO: 1042574 - RNA, 19 nt, Homo sapiens
uaacuugcaccucugaccu

SEQ ID NO: 1042575 - RNA, 13 nt, Homo sapiens
uaacuuguuucca

SEQ ID NO: 1042576 - RNA, 14 nt, Homo sapiens
uaacuuguuuccaa

SEQ ID NO: 1042577 - RNA, 17 nt, Homo sapiens
uaacuuuuguaagacaa

SEQ ID NO: 1042578 - RNA, 18 nt, Homo sapiens
uaagaaaaaaacuugucu

SEQ ID NO: 1042579 - RNA, 18 nt, Homo sapiens
uaagaaaaagaagaacua

SEQ ID NO: 1042580 - RNA, 17 nt, Homo sapiens
uaagaaaacaucacuga

SEQ ID NO: 1042581 - RNA, 13 nt, Homo sapiens
uaagaaagacuau

SEQ ID NO: 1042582 - RNA, 14 nt, Homo sapiens
uaagaaugcugguu

SEQ ID NO: 1042583 - RNA, 16 nt, Homo sapiens
uaagaauuauuuugau

SEQ ID NO: 1042584 - RNA, 21 nt, Homo sapiens
uaagacauacuccuuccauca

SEQ ID NO: 1042585 - RNA, 15 nt, Homo sapiens
uaagacggauuuauu

SEQ ID NO: 1042586 - RNA, 17 nt, Homo sapiens
uaagagccauuuagggg

SEQ ID NO: 1042587 - RNA, 21 nt, Homo sapiens
uaagagggagggagggcucca

SEQ ID NO: 1042588 - RNA, 24 nt, Homo sapiens
uaagaguggaaccaacacuaacau

SEQ ID NO: 1042589 - RNA, 21 nt, Homo sapiens
uaagaucguucucugccucac

SEQ ID NO: 1042590 - RNA, 14 nt, Homo sapiens
uaagauucauccau

SEQ ID NO: 1042591 - RNA, 16 nt, Homo sapiens
uaagauuuaauucaca

SEQ ID NO: 1042592 - RNA, 15 nt, Homo sapiens
uaagcaaagacuuuc

SEQ ID NO: 1042593 - RNA, 15 nt, Homo sapiens
uaagcaacagcauaa

SEQ ID NO: 1042594 - RNA, 15 nt, Homo sapiens
uaagcacuugcuuag

SEQ ID NO: 1042595 - RNA, 15 nt, Homo sapiens
uaagcagaagcacau

SEQ ID NO: 1042596 - RNA, 16 nt, Homo sapiens
uaagcagaagcauuaa

SEQ ID NO: 1042597 - RNA, 13 nt, Homo sapiens
uaagcauaacuua

SEQ ID NO: 1042598 - RNA, 20 nt, Homo sapiens
uaagcauuaccacucaggca

SEQ ID NO: 1042599 - RNA, 17 nt, Homo sapiens
uaagccuuccacacuca

SEQ ID NO: 1042600 - RNA, 21 nt, Homo sapiens
uaagcuaucuucaaaugucua

SEQ ID NO: 1042601 - RNA, 20 nt, Homo sapiens
uaagcucaauuuaauuuugc

SEQ ID NO: 1042602 - RNA, 20 nt, Homo sapiens
uaagcugagcuccuuagccu

SEQ ID NO: 1042603 - RNA, 12 nt, Homo sapiens
uaagcugggaua

SEQ ID NO: 1042604 - RNA, 16 nt, Homo sapiens
uaaggaagaaucuucu

SEQ ID NO: 1042605 - RNA, 14 nt, Homo sapiens
uaaggaucucucag

SEQ ID NO: 1042606 - RNA, 16 nt, Homo sapiens
uaaggaugucacaggg

SEQ ID NO: 1042607 - RNA, 13 nt, Homo sapiens
uaaggcaugaagg

SEQ ID NO: 1042608 - RNA, 19 nt, Homo sapiens
uaaggcccucuugaaucuc

SEQ ID NO: 1042609 - RNA, 14 nt, Homo sapiens
uaagggacaacauc

SEQ ID NO: 1042610 - RNA, 15 nt, Homo sapiens
uaaggucaaugccag

SEQ ID NO: 1042611 - RNA, 14 nt, Homo sapiens
uaaguaaaaccaca

SEQ ID NO: 1042612 - RNA, 14 nt, Homo sapiens
uacaggugugaguc

SEQ ID NO: 1042613 - RNA, 15 nt, Homo sapiens
uacagguuacaacag

SEQ ID NO: 1042614 - RNA, 22 nt, Homo sapiens
uacaguaggagcccagcucuga

SEQ ID NO: 1042615 - RNA, 10 nt, Homo sapiens
uacaguauua

SEQ ID NO: 1042616 - RNA, 19 nt, Homo sapiens
uacaguuugucacaugaaa

SEQ ID NO: 1042617 - RNA, 19 nt, Homo sapiens
uacauaaaguaugugcaua

SEQ ID NO: 1042618 - RNA, 20 nt, Homo sapiens
uacauaaaguaugugcauau

SEQ ID NO: 1042619 - RNA, 15 nt, Homo sapiens
uacauaacacauauc

SEQ ID NO: 1042620 - RNA, 23 nt, Homo sapiens
uacauacaggccauacuuuacaa

SEQ ID NO: 1042621 - RNA, 16 nt, Homo sapiens
uacauacuauggaauu

SEQ ID NO: 1042622 - RNA, 15 nt, Homo sapiens
uacauaguacauaca

SEQ ID NO: 1042623 - RNA, 21 nt, Homo sapiens
uacauauuucuuugccuuuau

SEQ ID NO: 1042624 - RNA, 18 nt, Homo sapiens
uacaucaaugguguguua

SEQ ID NO: 1042625 - RNA, 19 nt, Homo sapiens
uacaucaaugguguguuaa

SEQ ID NO: 1042626 - RNA, 11 nt, Homo sapiens
uacaucuggcc

SEQ ID NO: 1042627 - RNA, 12 nt, Homo sapiens
uacaucuuucac

SEQ ID NO: 1042628 - RNA, 13 nt, Homo sapiens
uacaugacauuua

SEQ ID NO: 1042629 - RNA, 20 nt, Homo sapiens
uacaugacucagcauaccug

SEQ ID NO: 1042630 - RNA, 18 nt, Homo sapiens
uacaugcagcccaugccc

SEQ ID NO: 1042631 - RNA, 19 nt, Homo sapiens
uacaugugccgaaugugca

SEQ ID NO: 1042632 - RNA, 14 nt, Homo sapiens
uacauuaacuucag

SEQ ID NO: 1042633 - RNA, 19 nt, Homo sapiens
uacauuagucauucaauaa

SEQ ID NO: 1042634 - RNA, 20 nt, Homo sapiens
uacauucugcaagcacaucu

SEQ ID NO: 1042635 - RNA, 22 nt, Homo sapiens
uacauucugcaagcacaucugc

SEQ ID NO: 1042636 - RNA, 15 nt, Homo sapiens
uacauucuugcuaau

SEQ ID NO: 1042637 - RNA, 20 nt, Homo sapiens
uacauuuaaacuugucaggg

SEQ ID NO: 1042638 - RNA, 13 nt, Homo sapiens
uacauuuccaaau

SEQ ID NO: 1042639 - RNA, 14 nt, Homo sapiens
uaccaaguauuuau

SEQ ID NO: 1042640 - RNA, 13 nt, Homo sapiens
uaccaaucauuuu

SEQ ID NO: 1042641 - RNA, 15 nt, Homo sapiens
uaccacagacuguac

SEQ ID NO: 1042642 - RNA, 22 nt, Homo sapiens
uaccacaugccaagcacugugc

SEQ ID NO: 1042643 - RNA, 18 nt, Homo sapiens
uaccaccccuuccugucc

SEQ ID NO: 1042644 - RNA, 21 nt, Homo sapiens
uaccacugucuucuucagggu

SEQ ID NO: 1042645 - RNA, 17 nt, Homo sapiens
uaccagugaaccaaaga

SEQ ID NO: 1042646 - RNA, 23 nt, Homo sapiens
uaccauuuuuuaaggaaacaaua

SEQ ID NO: 1042647 - RNA, 19 nt, Homo sapiens
uaccccaauuuacuugcca

SEQ ID NO: 1042648 - RNA, 17 nt, Homo sapiens
uaccccugaucugacau

SEQ ID NO: 1042649 - RNA, 16 nt, Homo sapiens
uacccucaggacaaug

SEQ ID NO: 1042650 - RNA, 23 nt, Homo sapiens
uacccuccuguaaaugguguaca

SEQ ID NO: 1042651 - RNA, 18 nt, Homo sapiens
uacccuuccucaccacuu

SEQ ID NO: 1042652 - RNA, 12 nt, Homo sapiens
uacccuuugaau

SEQ ID NO: 1042653 - RNA, 18 nt, Homo sapiens
uacccuuuuucuccagcu

SEQ ID NO: 1042654 - RNA, 16 nt, Homo sapiens
uaccuaacauuauuua

SEQ ID NO: 1042655 - RNA, 17 nt, Homo sapiens
ccaaagccuugugucua

SEQ ID NO: 1042656 - RNA, 17 nt, Homo sapiens
ccaaagcuuucauguaa

SEQ ID NO: 1042657 - RNA, 15 nt, Homo sapiens
ccaaaggaagacgug

SEQ ID NO: 1042658 - RNA, 19 nt, Homo sapiens
ccaaaggacuugacuugca

SEQ ID NO: 1042659 - RNA, 21 nt, Homo sapiens
ccaaaggacuugacuugcaau

SEQ ID NO: 1042660 - RNA, 21 nt, Homo sapiens
ccaaagggugaagcuauuuau

SEQ ID NO: 1042661 - RNA, 20 nt, Homo sapiens
ccaaagugccacucauuccu

SEQ ID NO: 1042662 - RNA, 15 nt, Homo sapiens
ccaaagugcugcgau

SEQ ID NO: 1042663 - RNA, 13 nt, Homo sapiens
ccaaaguuugcuc

SEQ ID NO: 1042664 - RNA, 19 nt, Homo sapiens
ccaaaguuugcucaaggag

SEQ ID NO: 1042665 - RNA, 15 nt, Homo sapiens
ccaaauggacauaag

SEQ ID NO: 1042666 - RNA, 13 nt, Homo sapiens
ccaaauguuccau

SEQ ID NO: 1042667 - RNA, 16 nt, Homo sapiens
ccaacagcacccucuc

SEQ ID NO: 1042668 - RNA, 21 nt, Homo sapiens
ccaacagcacccucuccagau

SEQ ID NO: 1042669 - RNA, 15 nt, Homo sapiens
ccaaccucuggagca

SEQ ID NO: 1042670 - RNA, 23 nt, Homo sapiens
ccaacugcuguucauguuacuca

SEQ ID NO: 1042671 - RNA, 19 nt, Homo sapiens
ccaacuguauauauuccca

SEQ ID NO: 1042672 - RNA, 21 nt, Homo sapiens
ccaacuucauuugaugcuaaa

SEQ ID NO: 1042673 - RNA, 22 nt, Homo sapiens
ccaacuugagggcccagagcag

SEQ ID NO: 1042674 - RNA, 20 nt, Homo sapiens
ccaacuuugaagucugauuu

SEQ ID NO: 1042675 - RNA, 16 nt, Homo sapiens
ccaacuuuguuuucca

SEQ ID NO: 1042676 - RNA, 18 nt, Homo sapiens
ccaagaggagacuuuaau

SEQ ID NO: 1042677 - RNA, 18 nt, Homo sapiens
ccaagagggcugcaaaag

SEQ ID NO: 1042678 - RNA, 20 nt, Homo sapiens
ccaagaucccaucucuccau

SEQ ID NO: 1042679 - RNA, 23 nt, Homo sapiens
ccaagcaaccuggguccaaauaa

SEQ ID NO: 1042680 - RNA, 21 nt, Homo sapiens
ccaagcacagugccugcaugu

SEQ ID NO: 1042681 - RNA, 22 nt, Homo sapiens
ccaagcaggaaaugaaaauguc

SEQ ID NO: 1042682 - RNA, 17 nt, Homo sapiens
ccaagcuccucaaucau

SEQ ID NO: 1042683 - RNA, 16 nt, Homo sapiens
ccaaggaacaggaaac

SEQ ID NO: 1042684 - RNA, 19 nt, Homo sapiens
ccaaggagggugagugcaa

SEQ ID NO: 1042685 - RNA, 21 nt, Homo sapiens
ccaaggccuucuccuccccac

SEQ ID NO: 1042686 - RNA, 18 nt, Homo sapiens
ccaaggcuggagugcagu

SEQ ID NO: 1042687 - RNA, 12 nt, Homo sapiens
ccaaggugggag

SEQ ID NO: 1042688 - RNA, 16 nt, Homo sapiens
ccaagucaaagacauu

SEQ ID NO: 1042689 - RNA, 16 nt, Homo sapiens
ccaaguccagauuuac

SEQ ID NO: 1042690 - RNA, 16 nt, Homo sapiens
ccaagugccaauauuu

SEQ ID NO: 1042691 - RNA, 17 nt, Homo sapiens
ccaagugccggacuagc

SEQ ID NO: 1042692 - RNA, 11 nt, Homo sapiens
ccaagugugaa

SEQ ID NO: 1042693 - RNA, 14 nt, Homo sapiens
ccaaguuuacucaa

SEQ ID NO: 1042694 - RNA, 19 nt, Homo sapiens
ccaaguuuauauacaauua

SEQ ID NO: 1042695 - RNA, 15 nt, Homo sapiens
ccaauaaaaugccuc

SEQ ID NO: 1042696 - RNA, 17 nt, Homo sapiens
ccaauaaaaugccucaa

SEQ ID NO: 1042697 - RNA, 13 nt, Homo sapiens
ccaauaaagccuu

SEQ ID NO: 1042698 - RNA, 12 nt, Homo sapiens
ccaauagcuuua

SEQ ID NO: 1042699 - RNA, 19 nt, Homo sapiens
ccaauagggcugagcucuc

SEQ ID NO: 1042700 - RNA, 20 nt, Homo sapiens
ccaauauuucucagacaucg

SEQ ID NO: 1042701 - RNA, 21 nt, Homo sapiens
ccaaucaccuuuccuguucca

SEQ ID NO: 1042702 - RNA, 13 nt, Homo sapiens
ccaaucagaucaa

SEQ ID NO: 1042703 - RNA, 12 nt, Homo sapiens
ccaauccccucc

SEQ ID NO: 1042704 - RNA, 18 nt, Homo sapiens
ccaaugccaaaaaaagac

SEQ ID NO: 1042705 - RNA, 20 nt, Homo sapiens
ccaauggcaacaucuugcaa

SEQ ID NO: 1042706 - RNA, 19 nt, Homo sapiens
ccaauucaauuacuauuga

SEQ ID NO: 1042707 - RNA, 18 nt, Homo sapiens
ccaauuccaaagccagac

SEQ ID NO: 1042708 - RNA, 14 nt, Homo sapiens
ccaauuuacauacu

SEQ ID NO: 1042709 - RNA, 14 nt, Homo sapiens
ccaauuuacuuugu

SEQ ID NO: 1042710 - RNA, 15 nt, Homo sapiens
ccacaaagagauuau

SEQ ID NO: 1042711 - RNA, 23 nt, Homo sapiens
ccacaaagcacaguuugaacaaa

SEQ ID NO: 1042712 - RNA, 13 nt, Homo sapiens
ccacaaccaaaaa

SEQ ID NO: 1042713 - RNA, 14 nt, Homo sapiens
ccacaaccaaaaaa

SEQ ID NO: 1042714 - RNA, 17 nt, Homo sapiens
ccacaaccaaaaaauuc

SEQ ID NO: 1042715 - RNA, 16 nt, Homo sapiens
ccacaaccgaccagau

SEQ ID NO: 1042716 - RNA, 22 nt, Homo sapiens
ccacaagacccuugugguccca

SEQ ID NO: 1042717 - RNA, 21 nt, Homo sapiens
ccacaauagcagacaguguuu

SEQ ID NO: 1042718 - RNA, 22 nt, Homo sapiens
ccacaaucuuaaggggcagcuu

SEQ ID NO: 1042719 - RNA, 20 nt, Homo sapiens
ccacaauucacuagaccaga

SEQ ID NO: 1042720 - RNA, 23 nt, Homo sapiens
ccacacacagcugggcuguggua

SEQ ID NO: 1042721 - RNA, 17 nt, Homo sapiens
ccacacagacaggguuu

SEQ ID NO: 1042722 - RNA, 13 nt, Homo sapiens
ccacaccaucucc

SEQ ID NO: 1042723 - RNA, 11 nt, Homo sapiens
ccacaccucag

SEQ ID NO: 1042724 - RNA, 13 nt, Homo sapiens
ccacacuggacuc

SEQ ID NO: 1042725 - RNA, 17 nt, Homo sapiens
ccacacuguacucugca

SEQ ID NO: 1042726 - RNA, 21 nt, Homo sapiens
ccacacuuccuguccagagag

SEQ ID NO: 1042727 - RNA, 15 nt, Homo sapiens
ccacagaaauacaug

SEQ ID NO: 1042728 - RNA, 21 nt, Homo sapiens
ccacagacucaaaugcucaga

SEQ ID NO: 1042729 - RNA, 16 nt, Homo sapiens
ccacagaggacucacu

SEQ ID NO: 1042730 - RNA, 23 nt, Homo sapiens
ccacagcaucauuuugcauucaa

SEQ ID NO: 1042731 - RNA, 14 nt, Homo sapiens
ccacagcccuguca

SEQ ID NO: 1042732 - RNA, 18 nt, Homo sapiens
ccacagccgcagcuguaa

SEQ ID NO: 1042733 - RNA, 19 nt, Homo sapiens
ccacagcgcuggccgggac

SEQ ID NO: 1042734 - RNA, 14 nt, Homo sapiens
ccacaggacauuuc

SEQ ID NO: 1042735 - RNA, 16 nt, Homo sapiens
ccacaggcagcauuua

SEQ ID NO: 1042736 - RNA, 11 nt, Homo sapiens
ccacagggaac

SEQ ID NO: 1042737 - RNA, 15 nt, Homo sapiens
ccacagggucugcac

SEQ ID NO: 1042738 - RNA, 18 nt, Homo sapiens
ccacagggucugcacucu

SEQ ID NO: 1042739 - RNA, 12 nt, Homo sapiens
ccacaucuccug

SEQ ID NO: 1042740 - RNA, 18 nt, Homo sapiens
ccacaucucuaucuggcc

SEQ ID NO: 1042741 - RNA, 19 nt, Homo sapiens
ccacaugugacacauaugc

SEQ ID NO: 1042742 - RNA, 16 nt, Homo sapiens
ccacauuuagaacuuu

SEQ ID NO: 1042743 - RNA, 23 nt, Homo sapiens
ccaccaaaagaagaaaccuucau

SEQ ID NO: 1042744 - RNA, 22 nt, Homo sapiens
ccaccaauugccaaagguccaa

SEQ ID NO: 1042745 - RNA, 13 nt, Homo sapiens
uuuaaauguuacu

SEQ ID NO: 1042746 - RNA, 17 nt, Homo sapiens
uuuaaauguuacuggua

SEQ ID NO: 1042747 - RNA, 18 nt, Homo sapiens
uuuaacaggaagaucuua

SEQ ID NO: 1042748 - RNA, 14 nt, Homo sapiens
uuuaaccuaugaua

SEQ ID NO: 1042749 - RNA, 21 nt, Homo sapiens
uuuaacuagaauuuauucaau

SEQ ID NO: 1042750 - RNA, 18 nt, Homo sapiens
uuuaacuauucauaagau

SEQ ID NO: 1042751 - RNA, 18 nt, Homo sapiens
uuuaacuggcuucagccu

SEQ ID NO: 1042752 - RNA, 21 nt, Homo sapiens
uuuaagaaaaaggaugcacag

SEQ ID NO: 1042753 - RNA, 18 nt, Homo sapiens
uuuaagacagucuuuggg

SEQ ID NO: 1042754 - RNA, 17 nt, Homo sapiens
uuuaagaguuacuuaau

SEQ ID NO: 1042755 - RNA, 13 nt, Homo sapiens
uuuaagcaucaaa

SEQ ID NO: 1042756 - RNA, 19 nt, Homo sapiens
uuuaagguuuuuacuguga

SEQ ID NO: 1042757 - RNA, 16 nt, Homo sapiens
uuuaaguuguuugcau

SEQ ID NO: 1042758 - RNA, 15 nt, Homo sapiens
uuuaauacaggguag

SEQ ID NO: 1042759 - RNA, 14 nt, Homo sapiens
uuuaaucacauucg

SEQ ID NO: 1042760 - RNA, 15 nt, Homo sapiens
uuuaauccuagagau

SEQ ID NO: 1042761 - RNA, 18 nt, Homo sapiens
uuuaauguuaaauucaau

SEQ ID NO: 1042762 - RNA, 22 nt, Homo sapiens
uuuaauguuaaauucaauguag

SEQ ID NO: 1042763 - RNA, 12 nt, Homo sapiens
uuuaauuaucuu

SEQ ID NO: 1042764 - RNA, 19 nt, Homo sapiens
uuuaauuuugacacuauau

SEQ ID NO: 1042765 - RNA, 12 nt, Homo sapiens
uuuacaaaguau

SEQ ID NO: 1042766 - RNA, 12 nt, Homo sapiens
uuuacaacuggg

SEQ ID NO: 1042767 - RNA, 23 nt, Homo sapiens
uuuacaauaaaacuuugcugcca

SEQ ID NO: 1042768 - RNA, 20 nt, Homo sapiens
uuuacacgcucauggacuga

SEQ ID NO: 1042769 - RNA, 22 nt, Homo sapiens
uuuacacugggagaggugccag

SEQ ID NO: 1042770 - RNA, 23 nt, Homo sapiens
uuuacagaaucaaaugcaauuuu

SEQ ID NO: 1042771 - RNA, 18 nt, Homo sapiens
uuuacagcugagcacauu

SEQ ID NO: 1042772 - RNA, 13 nt, Homo sapiens
uuuaccagaugau

SEQ ID NO: 1042773 - RNA, 21 nt, Homo sapiens
uuuaccugaaauaaaauucau

SEQ ID NO: 1042774 - RNA, 11 nt, Homo sapiens
uuuacucugcu

SEQ ID NO: 1042775 - RNA, 18 nt, Homo sapiens
uuuagaacuugcagcuga

SEQ ID NO: 1042776 - RNA, 18 nt, Homo sapiens
uuuagacccugcauuuau

SEQ ID NO: 1042777 - RNA, 22 nt, Homo sapiens
uuuagagugaaauauaugcuau

SEQ ID NO: 1042778 - RNA, 18 nt, Homo sapiens
uuuagauaugacauuuau

SEQ ID NO: 1042779 - RNA, 13 nt, Homo sapiens
uuuagauuguuaa

SEQ ID NO: 1042780 - RNA, 19 nt, Homo sapiens
uuuagcguagcuaagugaa

SEQ ID NO: 1042781 - RNA, 18 nt, Homo sapiens
uuuagggcagcuugcccc

SEQ ID NO: 1042782 - RNA, 24 nt, Homo sapiens
uuuagucgguucuguaucuccagu

SEQ ID NO: 1042783 - RNA, 20 nt, Homo sapiens
uuuagugacagcucugccug

SEQ ID NO: 1042784 - RNA, 16 nt, Homo sapiens
uuuagugaucacagca

SEQ ID NO: 1042785 - RNA, 19 nt, Homo sapiens
uuuauaggacgaaugccaa

SEQ ID NO: 1042786 - RNA, 20 nt, Homo sapiens
uuuauagucgaacaauucau

SEQ ID NO: 1042787 - RNA, 13 nt, Homo sapiens
uuuauaucucuca

SEQ ID NO: 1042788 - RNA, 14 nt, Homo sapiens
uuuauauucaacuc

SEQ ID NO: 1042789 - RNA, 14 nt, Homo sapiens
uuuaucaaucagua

SEQ ID NO: 1042790 - RNA, 20 nt, Homo sapiens
uuuaucauucaaguguaaaa

SEQ ID NO: 1042791 - RNA, 22 nt, Homo sapiens
uuuauccacagaaacauuuuca

SEQ ID NO: 1042792 - RNA, 18 nt, Homo sapiens
uuuaucuauggcacccau

SEQ ID NO: 1042793 - RNA, 21 nt, Homo sapiens
uuuaucuauggcacccaugca

SEQ ID NO: 1042794 - RNA, 14 nt, Homo sapiens
uuuaucugugauua

SEQ ID NO: 1042795 - RNA, 14 nt, Homo sapiens
uuuaucugugcaaa

SEQ ID NO: 1042796 - RNA, 14 nt, Homo sapiens
uuuaucuguucuug

SEQ ID NO: 1042797 - RNA, 17 nt, Homo sapiens
uuuaucuugucucuggg

SEQ ID NO: 1042798 - RNA, 22 nt, Homo sapiens
uuuaugagacccauuccuauuu

SEQ ID NO: 1042799 - RNA, 15 nt, Homo sapiens
uuuaugcuaagugaa

SEQ ID NO: 1042800 - RNA, 14 nt, Homo sapiens
uauuuacucauagu

SEQ ID NO: 1042801 - RNA, 18 nt, Homo sapiens
uauuuagacucaucuuac

SEQ ID NO: 1042802 - RNA, 22 nt, Homo sapiens
uauuuagaucuagaaacagauc

SEQ ID NO: 1042803 - RNA, 18 nt, Homo sapiens
uauuuauaagagugccgu

SEQ ID NO: 1042804 - RNA, 16 nt, Homo sapiens
uauuuaucugugcaaa

SEQ ID NO: 1042805 - RNA, 13 nt, Homo sapiens
uauuuaugaaggc

SEQ ID NO: 1042806 - RNA, 21 nt, Homo sapiens
uauuuaugaccuuauaguguu

SEQ ID NO: 1042807 - RNA, 14 nt, Homo sapiens
uauuuaugccucug

SEQ ID NO: 1042808 - RNA, 17 nt, Homo sapiens
uauuuaugccucuguau

SEQ ID NO: 1042809 - RNA, 16 nt, Homo sapiens
uauuucaaaacacauc

SEQ ID NO: 1042810 - RNA, 21 nt, Homo sapiens
uauuucaaaacacaucuuucc

SEQ ID NO: 1042811 - RNA, 17 nt, Homo sapiens
uauuuccuucuccuccu

SEQ ID NO: 1042812 - RNA, 21 nt, Homo sapiens
uauuugaagcaucacauaaaa

SEQ ID NO: 1042813 - RNA, 16 nt, Homo sapiens
uauuugauaacaguua

SEQ ID NO: 1042814 - RNA, 21 nt, Homo sapiens
uauuugauaacaguuacucca

SEQ ID NO: 1042815 - RNA, 14 nt, Homo sapiens
uauuugcauaacaa

SEQ ID NO: 1042816 - RNA, 20 nt, Homo sapiens
uauuugcauauguaugacuc

SEQ ID NO: 1042817 - RNA, 14 nt, Homo sapiens
uauuuguaucacaa

SEQ ID NO: 1042818 - RNA, 17 nt, Homo sapiens
uauuuguuugcaauuuu

SEQ ID NO: 1042819 - RNA, 14 nt, Homo sapiens
uauuuuaucuguga

SEQ ID NO: 1042820 - RNA, 19 nt, Homo sapiens
uauuuuauucccuuucaca

SEQ ID NO: 1042821 - RNA, 20 nt, Homo sapiens
uauuuuauucccuuucacaa

SEQ ID NO: 1042822 - RNA, 16 nt, Homo sapiens
uauuuuccaagugugc

SEQ ID NO: 1042823 - RNA, 19 nt, Homo sapiens
uauuuuccccuagcuuucc

SEQ ID NO: 1042824 - RNA, 13 nt, Homo sapiens
uauuuucuacaca

SEQ ID NO: 1042825 - RNA, 19 nt, Homo sapiens
uauuuucuuuucuuucaac

SEQ ID NO: 1042826 - RNA, 16 nt, Homo sapiens
ugcaguugacagcagg

SEQ ID NO: 1042827 - RNA, 22 nt, Homo sapiens
ugcaguuuccaaucccauagau

SEQ ID NO: 1042828 - RNA, 20 nt, Homo sapiens
ugcauaaaauguuaaguuga

SEQ ID NO: 1042829 - RNA, 19 nt, Homo sapiens
ugcauaaauaugcagugau

SEQ ID NO: 1042830 - RNA, 18 nt, Homo sapiens
ugcauaauaagcuaaaga

SEQ ID NO: 1042831 - RNA, 18 nt, Homo sapiens
ugcauacagagacagaua

SEQ ID NO: 1042832 - RNA, 15 nt, Homo sapiens
ugcaucagcugcuga

SEQ ID NO: 1042833 - RNA, 19 nt, Homo sapiens
ugcauccccuuggcuguga

SEQ ID NO: 1042834 - RNA, 14 nt, Homo sapiens
ugcaucccugguga

SEQ ID NO: 1042835 - RNA, 16 nt, Homo sapiens
ugcauccuuugcacug

SEQ ID NO: 1042836 - RNA, 23 nt, Homo sapiens
ugcaucuaccgcucuugggaaau

SEQ ID NO: 1042837 - RNA, 14 nt, Homo sapiens
ugcaucuucccaca

SEQ ID NO: 1042838 - RNA, 17 nt, Homo sapiens
ugcaugaaguaauaugc

SEQ ID NO: 1042839 - RNA, 11 nt, Homo sapiens
ugcaugccaaa

SEQ ID NO: 1042840 - RNA, 15 nt, Homo sapiens
ugcauggaaauuccc

SEQ ID NO: 1042841 - RNA, 18 nt, Homo sapiens
ugcaugguggcaccagcg

SEQ ID NO: 1042842 - RNA, 15 nt, Homo sapiens
ugcaugugacucuga

SEQ ID NO: 1042843 - RNA, 17 nt, Homo sapiens
ugcaugugugugcucag

SEQ ID NO: 1042844 - RNA, 20 nt, Homo sapiens
ugcaugugugugcucagggg

SEQ ID NO: 1042845 - RNA, 16 nt, Homo sapiens
uauauguauaugcaau

SEQ ID NO: 1042846 - RNA, 18 nt, Homo sapiens
uauauguguuuuucacau

SEQ ID NO: 1042847 - RNA, 17 nt, Homo sapiens
uauauuacaagccuaca

SEQ ID NO: 1042848 - RNA, 15 nt, Homo sapiens
uauauuacuagcaua

SEQ ID NO: 1042849 - RNA, 13 nt, Homo sapiens
uauauuauggaag

SEQ ID NO: 1042850 - RNA, 15 nt, Homo sapiens
uauauucaacucaua

SEQ ID NO: 1042851 - RNA, 21 nt, Homo sapiens
uauauuguaagaaauacugua

SEQ ID NO: 1042852 - RNA, 16 nt, Homo sapiens
uauauuuauugugcuu

SEQ ID NO: 1042853 - RNA, 19 nt, Homo sapiens
uauauuuuugguugucaau

SEQ ID NO: 1042854 - RNA, 21 nt, Homo sapiens
uaucaagccaguacgugcuaa

SEQ ID NO: 1042855 - RNA, 16 nt, Homo sapiens
uaucaagugucuucca

SEQ ID NO: 1042856 - RNA, 13 nt, Homo sapiens
uaucaauagucaa

SEQ ID NO: 1042857 - RNA, 20 nt, Homo sapiens
uaucaaugaguaacaggaaa

SEQ ID NO: 1042858 - RNA, 16 nt, Homo sapiens
uaucacauauuugaua

SEQ ID NO: 1042859 - RNA, 12 nt, Homo sapiens
uaucacauguau

SEQ ID NO: 1042860 - RNA, 20 nt, Homo sapiens
uaucagacuguaggauuuga

SEQ ID NO: 1042861 - RNA, 19 nt, Homo sapiens
uaucagcaucuguccucau

SEQ ID NO: 1042862 - RNA, 22 nt, Homo sapiens
uaucagccugucucuuccauau

SEQ ID NO: 1042863 - RNA, 23 nt, Homo sapiens
uaucagcuuuuuaaaguggguua

SEQ ID NO: 1042864 - RNA, 14 nt, Homo sapiens
uaucaggauacuau

SEQ ID NO: 1042865 - RNA, 15 nt, Homo sapiens
uaucaggguauucca

SEQ ID NO: 1042866 - RNA, 14 nt, Homo sapiens
uaucaucaguauug

SEQ ID NO: 1042867 - RNA, 22 nt, Homo sapiens
uaucauuuuuguacaguuugcu

SEQ ID NO: 1042868 - RNA, 18 nt, Homo sapiens
uauccaauaggcauuuga

SEQ ID NO: 1042869 - RNA, 19 nt, Homo sapiens
uauccauuaucauguguaa

SEQ ID NO: 1042870 - RNA, 15 nt, Homo sapiens
uauccgaacuuuaau

SEQ ID NO: 1042871 - RNA, 20 nt, Homo sapiens
uauccgaacuuuaauuucag

SEQ ID NO: 1042872 - RNA, 20 nt, Homo sapiens
uauccugagccaucggugaa

SEQ ID NO: 1042873 - RNA, 13 nt, Homo sapiens
uauccuguucucu

SEQ ID NO: 1042874 - RNA, 17 nt, Homo sapiens
uaucgggagcagugucu

SEQ ID NO: 1042875 - RNA, 16 nt, Homo sapiens
uaucuagauacuguau

SEQ ID NO: 1042876 - RNA, 21 nt, Homo sapiens
uggccuccucccuuagcuccc

SEQ ID NO: 1042877 - RNA, 16 nt, Homo sapiens
uggccucuggcucuca

SEQ ID NO: 1042878 - RNA, 17 nt, Homo sapiens
uggccucuggcucucau

SEQ ID NO: 1042879 - RNA, 22 nt, Homo sapiens
uggccugaagaguccucugaau

SEQ ID NO: 1042880 - RNA, 12 nt, Homo sapiens
uggccuggcaca

SEQ ID NO: 1042881 - RNA, 18 nt, Homo sapiens
uggccuggcacacaucag

SEQ ID NO: 1042882 - RNA, 21 nt, Homo sapiens
uggccuggggaagcugugaaa

SEQ ID NO: 1042883 - RNA, 14 nt, Homo sapiens
uggccuguaauccc

SEQ ID NO: 1042884 - RNA, 23 nt, Homo sapiens
uggcgccaucgccgggacuccag

SEQ ID NO: 1042885 - RNA, 22 nt, Homo sapiens
uggcuaacuauauuugcuuuuu

SEQ ID NO: 1042886 - RNA, 14 nt, Homo sapiens
uggcuaacuggcga

SEQ ID NO: 1042887 - RNA, 21 nt, Homo sapiens
uggcuaagcaaaaugugauau

SEQ ID NO: 1042888 - RNA, 13 nt, Homo sapiens
uggcuaugcaaca

SEQ ID NO: 1042889 - RNA, 14 nt, Homo sapiens
uggcucaucucuuu

SEQ ID NO: 1042890 - RNA, 19 nt, Homo sapiens
uggcuccaacacugcugcu

SEQ ID NO: 1042891 - RNA, 15 nt, Homo sapiens
uggcucccaugacca

SEQ ID NO: 1042892 - RNA, 14 nt, Homo sapiens
uggcuccuaucugu

SEQ ID NO: 1042893 - RNA, 17 nt, Homo sapiens
uggcugaaggacuguga

SEQ ID NO: 1042894 - RNA, 16 nt, Homo sapiens
uggcugaggauuucaa

SEQ ID NO: 1042895 - RNA, 17 nt, Homo sapiens
uggcugauggaguaaau

SEQ ID NO: 1042896 - RNA, 12 nt, Homo sapiens
uggcugcaguga

SEQ ID NO: 1042897 - RNA, 15 nt, Homo sapiens
uggcugccuuuggaa

SEQ ID NO: 1042898 - RNA, 19 nt, Homo sapiens
uggcugggggccucagugc

SEQ ID NO: 1042899 - RNA, 20 nt, Homo sapiens
uggcuucuuaaucuuuucac

SEQ ID NO: 1042900 - RNA, 17 nt, Homo sapiens
uggcuugccacagcucu

SEQ ID NO: 1042901 - RNA, 22 nt, Homo sapiens
uggcuuugccuuggcuuugcca

SEQ ID NO: 1042902 - RNA, 16 nt, Homo sapiens
ugggaaauaugaaugc

SEQ ID NO: 1042903 - RNA, 22 nt, Homo sapiens
ugggaacagggacgggggagcu

SEQ ID NO: 1042904 - RNA, 13 nt, Homo sapiens
ugggaacuccuaa

SEQ ID NO: 1042905 - RNA, 16 nt, Homo sapiens
gcuguccuuacccauc

SEQ ID NO: 1042906 - RNA, 20 nt, Homo sapiens
gcugucuauguggcuguauc

SEQ ID NO: 1042907 - RNA, 12 nt, Homo sapiens
gcugucugcuca

SEQ ID NO: 1042908 - RNA, 16 nt, Homo sapiens
gcugugaauuagcuca

SEQ ID NO: 1042909 - RNA, 18 nt, Homo sapiens
gcugugacuucuccaggu

SEQ ID NO: 1042910 - RNA, 16 nt, Homo sapiens
gcugugagacaguggg

SEQ ID NO: 1042911 - RNA, 22 nt, Homo sapiens
gcugugagccccugguccugag

SEQ ID NO: 1042912 - RNA, 12 nt, Homo sapiens
gcuguguguucu

SEQ ID NO: 1042913 - RNA, 19 nt, Homo sapiens
gcuguguuugagcuuucau

SEQ ID NO: 1042914 - RNA, 18 nt, Homo sapiens
gcuguugaugaggccucu

SEQ ID NO: 1042915 - RNA, 19 nt, Homo sapiens
gcuguuuuguggauuuuug

SEQ ID NO: 1042916 - RNA, 19 nt, Homo sapiens
gcuguuuuuauauauguga

SEQ ID NO: 1042917 - RNA, 22 nt, Homo sapiens
gcuuaauggcucaugaccugga

SEQ ID NO: 1042918 - RNA, 14 nt, Homo sapiens
gcuuaauguuuauu

SEQ ID NO: 1042919 - RNA, 21 nt, Homo sapiens
gcuuaccauuaaaguucucaa

SEQ ID NO: 1042920 - RNA, 22 nt, Homo sapiens
gcuuaccauuaaaguucucaau

SEQ ID NO: 1042921 - RNA, 12 nt, Homo sapiens
gcuuagcauucc

SEQ ID NO: 1042922 - RNA, 14 nt, Homo sapiens
gcuuagccuccuga

SEQ ID NO: 1042923 - RNA, 15 nt, Homo sapiens
gcuuaggacuuucca

SEQ ID NO: 1042924 - RNA, 18 nt, Homo sapiens
gcuuaggaugugugcaug

SEQ ID NO: 1042925 - RNA, 22 nt, Homo sapiens
gcuuaguccaauuccuugcaca

SEQ ID NO: 1042926 - RNA, 23 nt, Homo sapiens
gcuuaguccaauuccuugcacau

SEQ ID NO: 1042927 - RNA, 18 nt, Homo sapiens
gcuuauaaaaucaaacag

SEQ ID NO: 1042928 - RNA, 21 nt, Homo sapiens
gcuuauucacaagacccaaaa

SEQ ID NO: 1042929 - RNA, 14 nt, Homo sapiens
gcuucaaccuugag

SEQ ID NO: 1042930 - RNA, 21 nt, Homo sapiens
gcuucaccagagcauuuccaa

SEQ ID NO: 1042931 - RNA, 16 nt, Homo sapiens
gcuucaccccaauccc

SEQ ID NO: 1042932 - RNA, 11 nt, Homo sapiens
gcuucacuggu

SEQ ID NO: 1042933 - RNA, 13 nt, Homo sapiens
gcuucagccugag

SEQ ID NO: 1042934 - RNA, 14 nt, Homo sapiens
gcuucaugacauuc

SEQ ID NO: 1042935 - RNA, 18 nt, Homo sapiens
gcuucauuugugucaaug

SEQ ID NO: 1042936 - RNA, 19 nt, Homo sapiens
gcuuccaguccaaucucau

SEQ ID NO: 1042937 - RNA, 23 nt, Homo sapiens
gcuuccauuugugugugugcaag

SEQ ID NO: 1042938 - RNA, 20 nt, Homo sapiens
gcuuccuacccacaccucug

SEQ ID NO: 1042939 - RNA, 17 nt, Homo sapiens
gcuucuagaaccaggca

SEQ ID NO: 1042940 - RNA, 22 nt, Homo sapiens
gcuucuccaggguccacaggaa

SEQ ID NO: 1042941 - RNA, 16 nt, Homo sapiens
gcuucucuccacugaa

SEQ ID NO: 1042942 - RNA, 16 nt, Homo sapiens
gcuucucucucuaaaa

SEQ ID NO: 1042943 - RNA, 19 nt, Homo sapiens
gcuucuuaaaauagccaua

SEQ ID NO: 1042944 - RNA, 14 nt, Homo sapiens
gcuugaacccagga

SEQ ID NO: 1042945 - RNA, 20 nt, Homo sapiens
gcuugacauaauuucacuga

SEQ ID NO: 1042946 - RNA, 13 nt, Homo sapiens
gcuugaguuauau

SEQ ID NO: 1042947 - RNA, 23 nt, Homo sapiens
gcuugauugcguggaauugugcu

SEQ ID NO: 1042948 - RNA, 22 nt, Homo sapiens
gcuugcaacuuagcucacaccu

SEQ ID NO: 1042949 - RNA, 21 nt, Homo sapiens
gcuuggauggagacuccauga

SEQ ID NO: 1042950 - RNA, 16 nt, Homo sapiens
gcuuggcugugcccuc

SEQ ID NO: 1042951 - RNA, 23 nt, Homo sapiens
gcuuggcugugcccucagauucc

SEQ ID NO: 1042952 - RNA, 16 nt, Homo sapiens
gcuugggcuuccauuu

SEQ ID NO: 1042953 - RNA, 16 nt, Homo sapiens
gcuuguaucaacacug

SEQ ID NO: 1042954 - RNA, 13 nt, Homo sapiens
gcuugucaggggg

SEQ ID NO: 1042955 - RNA, 19 nt, Homo sapiens
gcuugugucccuccuggga

SEQ ID NO: 1042956 - RNA, 13 nt, Homo sapiens
gcuuguugcuguu

SEQ ID NO: 1042957 - RNA, 23 nt, Homo sapiens
gcuuguuuacagcacuacucugu

SEQ ID NO: 1042958 - RNA, 21 nt, Homo sapiens
gcuuuaauaagcgagaccuaa

SEQ ID NO: 1042959 - RNA, 16 nt, Homo sapiens
gcuuuaauuucaugaa

SEQ ID NO: 1042960 - RNA, 17 nt, Homo sapiens
gcuuuacuuugcccagg

SEQ ID NO: 1042961 - RNA, 20 nt, Homo sapiens
gcuuuauuuuuuaaguauuu

SEQ ID NO: 1042962 - RNA, 20 nt, Homo sapiens
gcuuucauaaacuucaggga

SEQ ID NO: 1042963 - RNA, 16 nt, Homo sapiens
gcuuucaucuaaucuu

SEQ ID NO: 1042964 - RNA, 20 nt, Homo sapiens
gcuuucauguaaacugugca

SEQ ID NO: 1042965 - RNA, 13 nt, Homo sapiens
gcuuuccaaaacc

SEQ ID NO: 1042966 - RNA, 17 nt, Homo sapiens
gcuuucccugaacuggg

SEQ ID NO: 1042967 - RNA, 15 nt, Homo sapiens
gcuuugcauguucca

SEQ ID NO: 1042968 - RNA, 15 nt, Homo sapiens
gcuuuguacugcugu

SEQ ID NO: 1042969 - RNA, 22 nt, Homo sapiens
gcuuuguacugcuguuguugaa

SEQ ID NO: 1042970 - RNA, 14 nt, Homo sapiens
uuuuccugccaggc

SEQ ID NO: 1042971 - RNA, 22 nt, Homo sapiens
uuuucgcaccuaccaucaggga

SEQ ID NO: 1042972 - RNA, 20 nt, Homo sapiens
uuuucuauuguuguacacag

SEQ ID NO: 1042973 - RNA, 21 nt, Homo sapiens
uuuucucccaggaagcuuuga

SEQ ID NO: 1042974 - RNA, 16 nt, Homo sapiens
uuuucucugugcuuca

SEQ ID NO: 1042975 - RNA, 14 nt, Homo sapiens
uuuucugccaggga

SEQ ID NO: 1042976 - RNA, 19 nt, Homo sapiens
uuuucuggaauacaugaaa

SEQ ID NO: 1042977 - RNA, 19 nt, Homo sapiens
uuuucuggagguugauaac

SEQ ID NO: 1042978 - RNA, 16 nt, Homo sapiens
uuuucuggaugguucc

SEQ ID NO: 1042979 - RNA, 15 nt, Homo sapiens
uuuucuguaguguga

SEQ ID NO: 1042980 - RNA, 15 nt, Homo sapiens
uuuucuugccaauga

SEQ ID NO: 1042981 - RNA, 17 nt, Homo sapiens
uuuugaaauuaaccucu

SEQ ID NO: 1042982 - RNA, 19 nt, Homo sapiens
uuuugaacauaaagccuug

SEQ ID NO: 1042983 - RNA, 16 nt, Homo sapiens
uuuugacacuauaucu

SEQ ID NO: 1042984 - RNA, 23 nt, Homo sapiens
uuuugacaucaaugaugaggcuc

SEQ ID NO: 1042985 - RNA, 15 nt, Homo sapiens
uuuugcaaucugugu

SEQ ID NO: 1042986 - RNA, 20 nt, Homo sapiens
uuuuggauauagguuuccaa

SEQ ID NO: 1042987 - RNA, 21 nt, Homo sapiens
uuuugguugcuuuaauaucau

SEQ ID NO: 1042988 - RNA, 20 nt, Homo sapiens
uuuuguacaauaaccugcua

SEQ ID NO: 1042989 - RNA, 17 nt, Homo sapiens
uuuuguaucuacaucuu

SEQ ID NO: 1042990 - RNA, 13 nt, Homo sapiens
uuuugugauugcc

SEQ ID NO: 1042991 - RNA, 18 nt, Homo sapiens
uuuuguuccacaaguuaa

SEQ ID NO: 1042992 - RNA, 17 nt, Homo sapiens
uuuuuaaacagugucau

SEQ ID NO: 1042993 - RNA, 14 nt, Homo sapiens
uuuuuaaguguucu

SEQ ID NO: 1042994 - RNA, 22 nt, Homo sapiens
uuuuuaaguuauuuuuacauuc

SEQ ID NO: 1042995 - RNA, 18 nt, Homo sapiens
uuuuuaauauaaagccug

SEQ ID NO: 1042996 - RNA, 12 nt, Homo sapiens
uuuuuagcuuua

SEQ ID NO: 1042997 - RNA, 12 nt, Homo sapiens
uuuuucucauga

SEQ ID NO: 1042998 - RNA, 21 nt, Homo sapiens
uuuuugacauuuacuguggau

SEQ ID NO: 1042999 - RNA, 18 nt, Homo sapiens
uuuuugggggaaggucag

SEQ ID NO: 1043000 - RNA, 21 nt, Homo sapiens
aucgucacugcuuaacuucac

SEQ ID NO: 1043001 - RNA, 17 nt, Homo sapiens
aucguuguuuacagugu

SEQ ID NO: 1043002 - RNA, 18 nt, Homo sapiens
aucuaaggaugucacagg

SEQ ID NO: 1043003 - RNA, 15 nt, Homo sapiens
aucuacauacacagu

SEQ ID NO: 1043004 - RNA, 11 nt, Homo sapiens
aucuaccagca

SEQ ID NO: 1043005 - RNA, 22 nt, Homo sapiens
aucuacuccuuguaaagacugu

SEQ ID NO: 1043006 - RNA, 18 nt, Homo sapiens
aucuacuucaacacuuca

SEQ ID NO: 1043007 - RNA, 15 nt, Homo sapiens
aucuagaagacuguc

SEQ ID NO: 1043008 - RNA, 21 nt, Homo sapiens
aucuagacucaagguucccag

SEQ ID NO: 1043009 - RNA, 22 nt, Homo sapiens
aucuagguucaggaagaccaca

SEQ ID NO: 1043010 - RNA, 20 nt, Homo sapiens
aucuauauauguguauguac

SEQ ID NO: 1043011 - RNA, 22 nt, Homo sapiens
aucuauauguacuugucaaaga

SEQ ID NO: 1043012 - RNA, 19 nt, Homo sapiens
aucuaugagcugacaucuc

SEQ ID NO: 1043013 - RNA, 18 nt, Homo sapiens
aucucaagauucaguaga

SEQ ID NO: 1043014 - RNA, 21 nt, Homo sapiens
aucucacuggaugcaaagaaa

SEQ ID NO: 1043015 - RNA, 23 nt, Homo sapiens
aucucagccagccuccagcaccu

SEQ ID NO: 1043016 - RNA, 19 nt, Homo sapiens
aucucaggccaccugcccc

SEQ ID NO: 1043017 - RNA, 23 nt, Homo sapiens
aucucauuggacccuuccauggu

SEQ ID NO: 1043018 - RNA, 21 nt, Homo sapiens
aucuccaggauugaagagcau

SEQ ID NO: 1043019 - RNA, 21 nt, Homo sapiens
aucuccaguuuauagaccaga

SEQ ID NO: 1043020 - RNA, 15 nt, Homo sapiens
aucuccucagcaccc

SEQ ID NO: 1043021 - RNA, 20 nt, Homo sapiens
aucucggcucacugcaagcu

SEQ ID NO: 1043022 - RNA, 14 nt, Homo sapiens
aucucuaucuggcc

SEQ ID NO: 1043023 - RNA, 20 nt, Homo sapiens
aucucugaagcauguuucau

SEQ ID NO: 1043024 - RNA, 19 nt, Homo sapiens
aucucugucccacuuggca

SEQ ID NO: 1043025 - RNA, 13 nt, Homo sapiens
aucucugucucaa

SEQ ID NO: 1043026 - RNA, 21 nt, Homo sapiens
aucucuuccuccgaggccagu

SEQ ID NO: 1043027 - RNA, 17 nt, Homo sapiens
aucugaaaugugauaag

SEQ ID NO: 1043028 - RNA, 21 nt, Homo sapiens
aucugaaggcgugagucugca

SEQ ID NO: 1043029 - RNA, 19 nt, Homo sapiens
aucugacauccccacucac

SEQ ID NO: 1043030 - RNA, 19 nt, Homo sapiens
aucugacaucucugcaauc

SEQ ID NO: 1043031 - RNA, 18 nt, Homo sapiens
aucugcauuuucacccca

SEQ ID NO: 1043032 - RNA, 20 nt, Homo sapiens
aucugcuagggaauaucaau

SEQ ID NO: 1043033 - RNA, 18 nt, Homo sapiens
aucuggccuaauguucca

SEQ ID NO: 1043034 - RNA, 16 nt, Homo sapiens
aucugggauauuucca

SEQ ID NO: 1043035 - RNA, 17 nt, Homo sapiens
aucugggcaaaugaaaa

SEQ ID NO: 1043036 - RNA, 19 nt, Homo sapiens
aucugggcaaaugaaaaug

SEQ ID NO: 1043037 - RNA, 17 nt, Homo sapiens
aucugggggaguggaau

SEQ ID NO: 1043038 - RNA, 17 nt, Homo sapiens
aucuggguucacugcaa

SEQ ID NO: 1043039 - RNA, 16 nt, Homo sapiens
aucuguauauacaaua

SEQ ID NO: 1043040 - RNA, 23 nt, Homo sapiens
aucuguauauacaauaacauaau

SEQ ID NO: 1043041 - RNA, 17 nt, Homo sapiens
aucugugccccaugccu

SEQ ID NO: 1043042 - RNA, 15 nt, Homo sapiens
gggaccgacuuucca

SEQ ID NO: 1043043 - RNA, 16 nt, Homo sapiens
gggacugagagacagg

SEQ ID NO: 1043044 - RNA, 14 nt, Homo sapiens
gggacuucagcuca

SEQ ID NO: 1043045 - RNA, 14 nt, Homo sapiens
gggacuuccuugcu

SEQ ID NO: 1043046 - RNA, 15 nt, Homo sapiens
gggacuugggucuca

SEQ ID NO: 1043047 - RNA, 13 nt, Homo sapiens
gggagaaaugacu

SEQ ID NO: 1043048 - RNA, 19 nt, Homo sapiens
gggagaagguuucauugcc

SEQ ID NO: 1043049 - RNA, 20 nt, Homo sapiens
gggagacacuggccccucaa

SEQ ID NO: 1043050 - RNA, 16 nt, Homo sapiens
gggagagagugcuauu

SEQ ID NO: 1043051 - RNA, 16 nt, Homo sapiens
gggagcaggcgguggg

SEQ ID NO: 1043052 - RNA, 13 nt, Homo sapiens
gggagcagugucu

SEQ ID NO: 1043053 - RNA, 17 nt, Homo sapiens
gggaggccaagugcagg

SEQ ID NO: 1043054 - RNA, 18 nt, Homo sapiens
gggagguauucgugcagc

SEQ ID NO: 1043055 - RNA, 21 nt, Homo sapiens
gggagucugaagcagaugcaa

SEQ ID NO: 1043056 - RNA, 19 nt, Homo sapiens
gggaucugucacaccagcc

SEQ ID NO: 1043057 - RNA, 23 nt, Homo sapiens
gggaucuuccuugggaugaucuu

SEQ ID NO: 1043058 - RNA, 22 nt, Homo sapiens
gggauggcguggucaagcacuc

SEQ ID NO: 1043059 - RNA, 19 nt, Homo sapiens
gggauggcuaaaaccauca

SEQ ID NO: 1043060 - RNA, 14 nt, Homo sapiens
gggauguggcugca

SEQ ID NO: 1043061 - RNA, 15 nt, Homo sapiens
gggauucaggcugcu

SEQ ID NO: 1043062 - RNA, 20 nt, Homo sapiens
gggauucuguacaugcauug

SEQ ID NO: 1043063 - RNA, 22 nt, Homo sapiens
gggcaccacccgcuuucuugcu

SEQ ID NO: 1043064 - RNA, 15 nt, Homo sapiens
gggcagcauagcaag

SEQ ID NO: 1043065 - RNA, 19 nt, Homo sapiens
gggcagucuggcgcccaug

SEQ ID NO: 1043066 - RNA, 22 nt, Homo sapiens
gggcaugcuggggcaagucccu

SEQ ID NO: 1043067 - RNA, 22 nt, Homo sapiens
gggccaguuggucccccuucca

SEQ ID NO: 1043068 - RNA, 21 nt, Homo sapiens
gggcccaaauucuuucagugg

SEQ ID NO: 1043069 - RNA, 22 nt, Homo sapiens
gggcccaaguaagggcacagau

SEQ ID NO: 1043070 - RNA, 18 nt, Homo sapiens
gggccccucaucugcuca

SEQ ID NO: 1043071 - RNA, 14 nt, Homo sapiens
gggcccugagcuga

SEQ ID NO: 1043072 - RNA, 22 nt, Homo sapiens
gggccgaauccccucccuguca

SEQ ID NO: 1043073 - RNA, 12 nt, Homo sapiens
gggccgugacag

SEQ ID NO: 1043074 - RNA, 18 nt, Homo sapiens
gggccuggccaccucucu

SEQ ID NO: 1043075 - RNA, 22 nt, Homo sapiens
gggccuggccugagcugggaug

SEQ ID NO: 1043076 - RNA, 15 nt, Homo sapiens
gggccuggggcuccu

SEQ ID NO: 1043077 - RNA, 15 nt, Homo sapiens
gggccugucacugau

SEQ ID NO: 1043078 - RNA, 15 nt, Homo sapiens
gggcgacagagccag

SEQ ID NO: 1043079 - RNA, 19 nt, Homo sapiens
gggcucaaggaaagggggu

SEQ ID NO: 1043080 - RNA, 12 nt, Homo sapiens
gggcucagcaaa

SEQ ID NO: 1043081 - RNA, 11 nt, Homo sapiens
gggcucaggaa

SEQ ID NO: 1043082 - RNA, 16 nt, Homo sapiens
gggcucauuuugcuca

SEQ ID NO: 1043083 - RNA, 20 nt, Homo sapiens
gggcucccuucccaccucuc

SEQ ID NO: 1043084 - RNA, 18 nt, Homo sapiens
gggcucugugaccaggaa

SEQ ID NO: 1043085 - RNA, 16 nt, Homo sapiens
gggcucuuuagccagu

SEQ ID NO: 1043086 - RNA, 18 nt, Homo sapiens
gggcugaaagaacaugga

SEQ ID NO: 1043087 - RNA, 19 nt, Homo sapiens
gggcugaaagaacauggac

SEQ ID NO: 1043088 - RNA, 16 nt, Homo sapiens
gggcugagaacccugc

SEQ ID NO: 1043089 - RNA, 16 nt, Homo sapiens
gggcugagcccuggca

SEQ ID NO: 1043090 - RNA, 17 nt, Homo sapiens
gggcugaggccucucau

SEQ ID NO: 1043091 - RNA, 19 nt, Homo sapiens
gggcugauuguauuuaccu

SEQ ID NO: 1043092 - RNA, 14 nt, Homo sapiens
gggcugcccugcca

SEQ ID NO: 1043093 - RNA, 16 nt, Homo sapiens
gggcuggcacugacug

SEQ ID NO: 1043094 - RNA, 13 nt, Homo sapiens
ggggaaaggcuug

SEQ ID NO: 1043095 - RNA, 22 nt, Homo sapiens
ggggaaauaauaaagaugcucu

SEQ ID NO: 1043096 - RNA, 12 nt, Homo sapiens
ggggacagggau

SEQ ID NO: 1043097 - RNA, 17 nt, Homo sapiens
ggggagucugaagcaga

SEQ ID NO: 1043098 - RNA, 15 nt, Homo sapiens
ggggaugucucucau

SEQ ID NO: 1043099 - RNA, 14 nt, Homo sapiens
ggggcaggcaguga

SEQ ID NO: 1043100 - RNA, 20 nt, Homo sapiens
ggggcccugcaccugugcag

SEQ ID NO: 1043101 - RNA, 20 nt, Homo sapiens
gggggcuuggcugugcccuc

SEQ ID NO: 1043102 - RNA, 10 nt, Homo sapiens
ggggggcccg

SEQ ID NO: 1043103 - RNA, 23 nt, Homo sapiens
gggggucccagugggaggggcag

SEQ ID NO: 1043104 - RNA, 12 nt, Homo sapiens
ggggguuucuca

SEQ ID NO: 1043105 - RNA, 11 nt, Homo sapiens
ggggucucaga

SEQ ID NO: 1043106 - RNA, 18 nt, Homo sapiens
ggggucuccuauacucua

SEQ ID NO: 1043107 - RNA, 19 nt, Homo sapiens
ggggucuccucugcagcuc

SEQ ID NO: 1043108 - RNA, 11 nt, Homo sapiens
gggguggagca

SEQ ID NO: 1043109 - RNA, 16 nt, Homo sapiens
ggguaacuugcaccuc

SEQ ID NO: 1043110 - RNA, 18 nt, Homo sapiens
ggguaaggaaauggaaua

SEQ ID NO: 1043111 - RNA, 14 nt, Homo sapiens
ggguaucuggugac

SEQ ID NO: 1043112 - RNA, 13 nt, Homo sapiens
gggucaacaucuu

SEQ ID NO: 1043113 - RNA, 22 nt, Homo sapiens
gggucacugaaggccuggccca

SEQ ID NO: 1043114 - RNA, 18 nt, Homo sapiens
ggguccuccacaauaagg

SEQ ID NO: 1043115 - RNA, 16 nt, Homo sapiens
gggucucuagugcugu

SEQ ID NO: 1043116 - RNA, 19 nt, Homo sapiens
gggugacagagcaagugag

SEQ ID NO: 1043117 - RNA, 18 nt, Homo sapiens
gggugacccugaagugag

SEQ ID NO: 1043118 - RNA, 18 nt, Homo sapiens
ggguggugagaaccggag

SEQ ID NO: 1043119 - RNA, 12 nt, Homo sapiens
gggugucucagg

SEQ ID NO: 1043120 - RNA, 14 nt, Homo sapiens
gggugucucugcau

SEQ ID NO: 1043121 - RNA, 19 nt, Homo sapiens
gggugugaaagguuuccaa

SEQ ID NO: 1043122 - RNA, 17 nt, Homo sapiens
ggguguguguagccaag

SEQ ID NO: 1043123 - RNA, 14 nt, Homo sapiens
ggguucaagugauu

SEQ ID NO: 1043124 - RNA, 20 nt, Homo sapiens
ggguucaccaggucagggag

SEQ ID NO: 1043125 - RNA, 20 nt, Homo sapiens
ggguucguggaaagggugcu

SEQ ID NO: 1043126 - RNA, 17 nt, Homo sapiens
ggguugagcuguugccu

SEQ ID NO: 1043127 - RNA, 17 nt, Homo sapiens
ggguuggugcacaguga

SEQ ID NO: 1043128 - RNA, 16 nt, Homo sapiens
ggguuuugaacauaaa

SEQ ID NO: 1043129 - RNA, 17 nt, Homo sapiens
gguaaaaccccaucucu

SEQ ID NO: 1043130 - RNA, 16 nt, Homo sapiens
gguaaaugauguggug

SEQ ID NO: 1043131 - RNA, 23 nt, Homo sapiens
gguaacuuuuuuuuaaagcucau

SEQ ID NO: 1043132 - RNA, 14 nt, Homo sapiens
gguaauuguugcua

SEQ ID NO: 1043133 - RNA, 19 nt, Homo sapiens
gguacauuucccugugcug

SEQ ID NO: 1043134 - RNA, 16 nt, Homo sapiens
gguaggaggaugggcu

SEQ ID NO: 1043135 - RNA, 14 nt, Homo sapiens
gguagguugggaga

SEQ ID NO: 1043136 - RNA, 19 nt, Homo sapiens
gguaguacuccugcaaaau

SEQ ID NO: 1043137 - RNA, 21 nt, Homo sapiens
gguauaaugguugacuggguu

SEQ ID NO: 1043138 - RNA, 18 nt, Homo sapiens
gguauauaaauuuuccca

SEQ ID NO: 1043139 - RNA, 19 nt, Homo sapiens
gguaucaaccaaauggagu

SEQ ID NO: 1043140 - RNA, 14 nt, Homo sapiens
gguauguuuuacca

SEQ ID NO: 1043141 - RNA, 16 nt, Homo sapiens
gguauuacacuguauu

SEQ ID NO: 1043142 - RNA, 21 nt, Homo sapiens
gguauucuuaagggaacuucc

SEQ ID NO: 1043143 - RNA, 17 nt, Homo sapiens
gguauuuaccacagcag

SEQ ID NO: 1043144 - RNA, 17 nt, Homo sapiens
ggucaccccuccaggaa

SEQ ID NO: 1043145 - RNA, 19 nt, Homo sapiens
ggucagaacagagccuuug

SEQ ID NO: 1043146 - RNA, 11 nt, Homo sapiens
ggucauuugcu

SEQ ID NO: 1043147 - RNA, 16 nt, Homo sapiens
gguccaccccauguca

SEQ ID NO: 1043148 - RNA, 22 nt, Homo sapiens
gucacguggaggagcagugcag

SEQ ID NO: 1043149 - RNA, 11 nt, Homo sapiens
gucacuccugg

SEQ ID NO: 1043150 - RNA, 16 nt, Homo sapiens
gucacugcugucauca

SEQ ID NO: 1043151 - RNA, 23 nt, Homo sapiens
gucacuuacuguuucugucagga

SEQ ID NO: 1043152 - RNA, 13 nt, Homo sapiens
gucagaacuagaa

SEQ ID NO: 1043153 - RNA, 20 nt, Homo sapiens
gucagaguuccgacugccau

SEQ ID NO: 1043154 - RNA, 17 nt, Homo sapiens
gucagauacaauguauu

SEQ ID NO: 1043155 - RNA, 20 nt, Homo sapiens
gucagcaggaagcaacgaag

SEQ ID NO: 1043156 - RNA, 21 nt, Homo sapiens
gucagcuacuaaugauguuuu

SEQ ID NO: 1043157 - RNA, 13 nt, Homo sapiens
gucaggacuguga

SEQ ID NO: 1043158 - RNA, 20 nt, Homo sapiens
gucagggaccccugcccuug

SEQ ID NO: 1043159 - RNA, 22 nt, Homo sapiens
gucaggggcggggagggugaca

SEQ ID NO: 1043160 - RNA, 12 nt, Homo sapiens
gucagucaggga

SEQ ID NO: 1043161 - RNA, 14 nt, Homo sapiens
gucagucagggaca

SEQ ID NO: 1043162 - RNA, 23 nt, Homo sapiens
gucaucaggagaaaaagccucca

SEQ ID NO: 1043163 - RNA, 19 nt, Homo sapiens
gucaucucagugcuguaaa

SEQ ID NO: 1043164 - RNA, 14 nt, Homo sapiens
gucaugcaaaggcu

SEQ ID NO: 1043165 - RNA, 20 nt, Homo sapiens
gucaugcauaaauaugcagu

SEQ ID NO: 1043166 - RNA, 19 nt, Homo sapiens
gucaugccaagcauuuaau

SEQ ID NO: 1043167 - RNA, 21 nt, Homo sapiens
gucaugguagagaccgagccu

SEQ ID NO: 1043168 - RNA, 16 nt, Homo sapiens
guccaaacugccuaag

SEQ ID NO: 1043169 - RNA, 19 nt, Homo sapiens
guccaaggaaaccacagcu

SEQ ID NO: 1043170 - RNA, 13 nt, Homo sapiens
guccaagucuucu

SEQ ID NO: 1043171 - RNA, 21 nt, Homo sapiens
guccaagucuucucaagaucc

SEQ ID NO: 1043172 - RNA, 10 nt, Homo sapiens
guccacaggg

SEQ ID NO: 1043173 - RNA, 18 nt, Homo sapiens
guccacccaccuaugugc

SEQ ID NO: 1043174 - RNA, 12 nt, Homo sapiens
guccacucccag

SEQ ID NO: 1043175 - RNA, 18 nt, Homo sapiens
guccagaagaauauucag

SEQ ID NO: 1043176 - RNA, 17 nt, Homo sapiens
guccagauauuucacau

SEQ ID NO: 1043177 - RNA, 14 nt, Homo sapiens
guccagauuuacac

SEQ ID NO: 1043178 - RNA, 18 nt, Homo sapiens
guccagauuuacacuggg

SEQ ID NO: 1043179 - RNA, 18 nt, Homo sapiens
guccagucucuucugcug

SEQ ID NO: 1043180 - RNA, 17 nt, Homo sapiens
guccaugugugugcaag

SEQ ID NO: 1043181 - RNA, 18 nt, Homo sapiens
guccaugugugugcaagu

SEQ ID NO: 1043182 - RNA, 14 nt, Homo sapiens
guccauuuugcccu

SEQ ID NO: 1043183 - RNA, 21 nt, Homo sapiens
gucccaaguuggaaauauuca

SEQ ID NO: 1043184 - RNA, 14 nt, Homo sapiens
gucccagcuacuca

SEQ ID NO: 1043185 - RNA, 17 nt, Homo sapiens
gucccagcuacucagaa

SEQ ID NO: 1043186 - RNA, 17 nt, Homo sapiens
gucccagcuacucagga

SEQ ID NO: 1043187 - RNA, 14 nt, Homo sapiens
guccccaccuggga

SEQ ID NO: 1043188 - RNA, 22 nt, Homo sapiens
guccccuuuucuuuucuacccu

SEQ ID NO: 1043189 - RNA, 14 nt, Homo sapiens
gucccgggguccug

SEQ ID NO: 1043190 - RNA, 13 nt, Homo sapiens
guccgagcuuuga

SEQ ID NO: 1043191 - RNA, 16 nt, Homo sapiens
guccgaggggcgggac

SEQ ID NO: 1043192 - RNA, 19 nt, Homo sapiens
guccuagcaaccuccacau

SEQ ID NO: 1043193 - RNA, 20 nt, Homo sapiens
guccucaguccacugcugag

SEQ ID NO: 1043194 - RNA, 20 nt, Homo sapiens
guccucaucagucuccauac

SEQ ID NO: 1043195 - RNA, 15 nt, Homo sapiens
guccuccaagccagc

SEQ ID NO: 1043196 - RNA, 23 nt, Homo sapiens
guccuccuuguucuacucauaua

SEQ ID NO: 1043197 - RNA, 19 nt, Homo sapiens
guccucgagcaacugcugu

SEQ ID NO: 1043198 - RNA, 20 nt, Homo sapiens
guccuucuuuaucugugaua

SEQ ID NO: 1043199 - RNA, 14 nt, Homo sapiens
guccuugugcauga

SEQ ID NO: 1043200 - RNA, 23 nt, Homo sapiens
guccuuucccuucaguacccucu

SEQ ID NO: 1043201 - RNA, 16 nt, Homo sapiens
guccuuuuguaccaug

SEQ ID NO: 1043202 - RNA, 16 nt, Homo sapiens
gucgaggggcucucag

SEQ ID NO: 1043203 - RNA, 15 nt, Homo sapiens
gucggaaaacaugcu

SEQ ID NO: 1043204 - RNA, 16 nt, Homo sapiens
gucuaaaaacaccaaa

SEQ ID NO: 1043205 - RNA, 13 nt, Homo sapiens
gucuaacugcugu

SEQ ID NO: 1043206 - RNA, 17 nt, Homo sapiens
gucuacguuaccaggca

SEQ ID NO: 1043207 - RNA, 14 nt, Homo sapiens
gucuagccacugau

SEQ ID NO: 1043208 - RNA, 17 nt, Homo sapiens
gucuagccacugaucau

SEQ ID NO: 1043209 - RNA, 13 nt, Homo sapiens
gucuauguguaca

SEQ ID NO: 1043210 - RNA, 15 nt, Homo sapiens
gucucaaacuccuga

SEQ ID NO: 1043211 - RNA, 20 nt, Homo sapiens
gucucaaccccucacaggag

SEQ ID NO: 1043212 - RNA, 17 nt, Homo sapiens
gucucacaguguugccc

SEQ ID NO: 1043213 - RNA, 22 nt, Homo sapiens
gucucacugugggaaggccagc

SEQ ID NO: 1043214 - RNA, 20 nt, Homo sapiens
gucucaguggcuucaucugu

SEQ ID NO: 1043215 - RNA, 16 nt, Homo sapiens
gucuccuuaacacuga

SEQ ID NO: 1043216 - RNA, 18 nt, Homo sapiens
gucuccuuugcacugagg

SEQ ID NO: 1043217 - RNA, 15 nt, Homo sapiens
gucucgaacuccuga

SEQ ID NO: 1043218 - RNA, 18 nt, Homo sapiens
gucucuagugcugugaaa

SEQ ID NO: 1043219 - RNA, 17 nt, Homo sapiens
gucucuccugaugcuca

SEQ ID NO: 1043220 - RNA, 15 nt, Homo sapiens
gucucugccucccuc

SEQ ID NO: 1043221 - RNA, 17 nt, Homo sapiens
gucucugccucccucac

SEQ ID NO: 1043222 - RNA, 11 nt, Homo sapiens
gucucuuuaua

SEQ ID NO: 1043223 - RNA, 20 nt, Homo sapiens
gucucuuuauauggccucaa

SEQ ID NO: 1043224 - RNA, 12 nt, Homo sapiens
gucugacaggca

SEQ ID NO: 1043225 - RNA, 15 nt, Homo sapiens
gucugcaucuuaggg

SEQ ID NO: 1043226 - RNA, 16 nt, Homo sapiens
gucuggaaugcagugg

SEQ ID NO: 1043227 - RNA, 15 nt, Homo sapiens
gucuggcuaugcuca

SEQ ID NO: 1043228 - RNA, 15 nt, Homo sapiens
gucugggacuuccuu

SEQ ID NO: 1043229 - RNA, 18 nt, Homo sapiens
gucuggggucuccuauac

SEQ ID NO: 1043230 - RNA, 21 nt, Homo sapiens
gucugucaugaacauguuccu

SEQ ID NO: 1043231 - RNA, 20 nt, Homo sapiens
gucugugugaugaacuuucu

SEQ ID NO: 1043232 - RNA, 20 nt, Homo sapiens
gucugugugcaagugugugc

SEQ ID NO: 1043233 - RNA, 23 nt, Homo sapiens
gucuuaucaagcagccaagggau

SEQ ID NO: 1043234 - RNA, 22 nt, Homo sapiens
gucuucauaauuucuucacuca

SEQ ID NO: 1043235 - RNA, 12 nt, Homo sapiens
gucuuccauaau

SEQ ID NO: 1043236 - RNA, 13 nt, Homo sapiens
gucuucccuguau

SEQ ID NO: 1043237 - RNA, 20 nt, Homo sapiens
gucuucccuucugauugaug

SEQ ID NO: 1043238 - RNA, 19 nt, Homo sapiens
gucuuccugacacuuuaau

SEQ ID NO: 1043239 - RNA, 15 nt, Homo sapiens
gucuuccugcauuca

SEQ ID NO: 1043240 - RNA, 19 nt, Homo sapiens
gucuucuaauuucaaaaau

SEQ ID NO: 1043241 - RNA, 17 nt, Homo sapiens
uacacugugaacuuggg

SEQ ID NO: 1043242 - RNA, 14 nt, Homo sapiens
uacagaacucuuuc

SEQ ID NO: 1043243 - RNA, 19 nt, Homo sapiens
uacagaaucaaaugcaauu

SEQ ID NO: 1043244 - RNA, 21 nt, Homo sapiens
uacagacacucccacuuggca

SEQ ID NO: 1043245 - RNA, 15 nt, Homo sapiens
uacagacguaugcuu

SEQ ID NO: 1043246 - RNA, 18 nt, Homo sapiens
uacagagaaaagacauaa

SEQ ID NO: 1043247 - RNA, 15 nt, Homo sapiens
uacagauagauauau

SEQ ID NO: 1043248 - RNA, 20 nt, Homo sapiens
uacagauagauauaugcucu

SEQ ID NO: 1043249 - RNA, 18 nt, Homo sapiens
uacagauagucaaaccau

SEQ ID NO: 1043250 - RNA, 13 nt, Homo sapiens
uacagaugggcaa

SEQ ID NO: 1043251 - RNA, 17 nt, Homo sapiens
uacagcagugucaucag

SEQ ID NO: 1043252 - RNA, 23 nt, Homo sapiens
uacaggaagcaccccaugccaaa

SEQ ID NO: 1043253 - RNA, 15 nt, Homo sapiens
uacaggcagcacaga

SEQ ID NO: 1043254 - RNA, 22 nt, Homo sapiens
uacaguauuguggcugcacuug

SEQ ID NO: 1043255 - RNA, 18 nt, Homo sapiens
uacagucuuccauuugca

SEQ ID NO: 1043256 - RNA, 20 nt, Homo sapiens
uacaguguauguacuaagca

SEQ ID NO: 1043257 - RNA, 18 nt, Homo sapiens
uacaguuagagauuuuua

SEQ ID NO: 1043258 - RNA, 20 nt, Homo sapiens
uacaguuugagacuuccaaa

SEQ ID NO: 1043259 - RNA, 16 nt, Homo sapiens
uacaguuugcuguacu

SEQ ID NO: 1043260 - RNA, 18 nt, Homo sapiens
uacaguuugcuguacuag

SEQ ID NO: 1043261 - RNA, 20 nt, Homo sapiens
uacaguuuuuauugcuuguu

SEQ ID NO: 1043262 - RNA, 13 nt, Homo sapiens
uacauaagaccau

SEQ ID NO: 1043263 - RNA, 15 nt, Homo sapiens
uacauaauguauugu

SEQ ID NO: 1043264 - RNA, 12 nt, Homo sapiens
uacauacugcug

SEQ ID NO: 1043265 - RNA, 12 nt, Homo sapiens
uacauagccuau

SEQ ID NO: 1043266 - RNA, 14 nt, Homo sapiens
uacauagcuguuug

SEQ ID NO: 1043267 - RNA, 15 nt, Homo sapiens
uacauauauauguca

SEQ ID NO: 1043268 - RNA, 15 nt, Homo sapiens
uacauaugugaauau

SEQ ID NO: 1043269 - RNA, 16 nt, Homo sapiens
uacauauuugcauaug

SEQ ID NO: 1043270 - RNA, 18 nt, Homo sapiens
uacauccagucacuuugc

SEQ ID NO: 1043271 - RNA, 20 nt, Homo sapiens
uacaucccauguaacagaaa

SEQ ID NO: 1043272 - RNA, 15 nt, Homo sapiens
uacaugaauugcauu

SEQ ID NO: 1043273 - RNA, 14 nt, Homo sapiens
uacaugcaauuuau

SEQ ID NO: 1043274 - RNA, 17 nt, Homo sapiens
uacaugcauugagcucu

SEQ ID NO: 1043275 - RNA, 21 nt, Homo sapiens
uacaugcauugagcucucuca

SEQ ID NO: 1043276 - RNA, 17 nt, Homo sapiens
uacaugggguuuucaau

SEQ ID NO: 1043277 - RNA, 14 nt, Homo sapiens
uacauggucaagua

SEQ ID NO: 1043278 - RNA, 18 nt, Homo sapiens
uacaugguugaaacccca

SEQ ID NO: 1043279 - RNA, 13 nt, Homo sapiens
uacauguaaucca

SEQ ID NO: 1043280 - RNA, 16 nt, Homo sapiens
uacauguaauccauca

SEQ ID NO: 1043281 - RNA, 15 nt, Homo sapiens
uacauguggcccaac

SEQ ID NO: 1043282 - RNA, 18 nt, Homo sapiens
uacauucuuccugauuau

SEQ ID NO: 1043283 - RNA, 18 nt, Homo sapiens
uacauuuccaaauucaca

SEQ ID NO: 1043284 - RNA, 15 nt, Homo sapiens
uacauuucccugugc

SEQ ID NO: 1043285 - RNA, 18 nt, Homo sapiens
uacauuucuuagacuaca

SEQ ID NO: 1043286 - RNA, 16 nt, Homo sapiens
uaccaaggaacaggaa

SEQ ID NO: 1043287 - RNA, 14 nt, Homo sapiens
uaccaaucauuuua

SEQ ID NO: 1043288 - RNA, 15 nt, Homo sapiens
uaccaguucugggca

SEQ ID NO: 1043289 - RNA, 13 nt, Homo sapiens
uaccaucagggac

SEQ ID NO: 1043290 - RNA, 23 nt, Homo sapiens
uacccacacacauacacacauau

SEQ ID NO: 1043291 - RNA, 19 nt, Homo sapiens
uaccccgauggccaagcaa

SEQ ID NO: 1043292 - RNA, 14 nt, Homo sapiens
uacccucaccuguc

SEQ ID NO: 1043293 - RNA, 20 nt, Homo sapiens
uacccucaccugucaggccu

SEQ ID NO: 1043294 - RNA, 17 nt, Homo sapiens
uaccgcugcauaguauu

SEQ ID NO: 1043295 - RNA, 18 nt, Homo sapiens
uaccgugagcgacaaaga

SEQ ID NO: 1043296 - RNA, 16 nt, Homo sapiens
uaccuaaacuauaugc

SEQ ID NO: 1043297 - RNA, 20 nt, Homo sapiens
uaccuacauuuuaaugcacc

SEQ ID NO: 1043298 - RNA, 19 nt, Homo sapiens
uaccuaguagucauuucau

SEQ ID NO: 1043299 - RNA, 13 nt, Homo sapiens
uaccucaaccaau

SEQ ID NO: 1043300 - RNA, 21 nt, Homo sapiens
uaccucaaccaaugccaaaaa

SEQ ID NO: 1043301 - RNA, 22 nt, Homo sapiens
uaccucaaccaaugccaaaaaa

SEQ ID NO: 1043302 - RNA, 19 nt, Homo sapiens
uaccucacagagugcauug

SEQ ID NO: 1043303 - RNA, 23 nt, Homo sapiens
uaccucacagagugcauugugag

SEQ ID NO: 1043304 - RNA, 20 nt, Homo sapiens
uaccuccuccucuggacaaa

SEQ ID NO: 1043305 - RNA, 17 nt, Homo sapiens
uaccuccugucucuggc

SEQ ID NO: 1043306 - RNA, 19 nt, Homo sapiens
uaccucuuggcugccuugu

SEQ ID NO: 1043307 - RNA, 21 nt, Homo sapiens
uaccugaaaacacugugcaca

SEQ ID NO: 1043308 - RNA, 21 nt, Homo sapiens
uaccugcccccaauccaugaa

SEQ ID NO: 1043309 - RNA, 19 nt, Homo sapiens
uaccuugggggaaccugga

SEQ ID NO: 1043310 - RNA, 14 nt, Homo sapiens
uacgcaucagacag

SEQ ID NO: 1043311 - RNA, 13 nt, Homo sapiens
uacgccaggggaa

SEQ ID NO: 1043312 - RNA, 13 nt, Homo sapiens
uacguaucugcuc

SEQ ID NO: 1043313 - RNA, 16 nt, Homo sapiens
uacguugugcauuugg

SEQ ID NO: 1043314 - RNA, 16 nt, Homo sapiens
uacuaaggaaucuuuc

SEQ ID NO: 1043315 - RNA, 19 nt, Homo sapiens
uacuacaguccucccaucu

SEQ ID NO: 1043316 - RNA, 14 nt, Homo sapiens
uacuagcaguguuu

SEQ ID NO: 1043317 - RNA, 15 nt, Homo sapiens
uacuagggaaguuga

SEQ ID NO: 1043318 - RNA, 14 nt, Homo sapiens
uacuauauauguga

SEQ ID NO: 1043319 - RNA, 19 nt, Homo sapiens
uacuauauuuauacuguau

SEQ ID NO: 1043320 - RNA, 16 nt, Homo sapiens
uacuauuuucauucuc

SEQ ID NO: 1043321 - RNA, 16 nt, Homo sapiens
uacuauuuuuacuaau

SEQ ID NO: 1043322 - RNA, 15 nt, Homo sapiens
uacucauacauguua

SEQ ID NO: 1043323 - RNA, 22 nt, Homo sapiens
uacuccaguauaugcugaugga

SEQ ID NO: 1043324 - RNA, 13 nt, Homo sapiens
uacuccagugcca

SEQ ID NO: 1043325 - RNA, 13 nt, Homo sapiens
uacuccucugcag

SEQ ID NO: 1043326 - RNA, 20 nt, Homo sapiens
uacucuaggcagugacagug

SEQ ID NO: 1043327 - RNA, 13 nt, Homo sapiens
uacucugcugcaa

SEQ ID NO: 1043328 - RNA, 18 nt, Homo sapiens
uacucuguuccuucacau

SEQ ID NO: 1043329 - RNA, 20 nt, Homo sapiens
uacucuuaagccaucuuggu

SEQ ID NO: 1043330 - RNA, 23 nt, Homo sapiens
uacugaacaaucaaagcacuugg

SEQ ID NO: 1043331 - RNA, 13 nt, Homo sapiens
uacugaccagcaa

SEQ ID NO: 1043332 - RNA, 12 nt, Homo sapiens
uacugacugaga

SEQ ID NO: 1043333 - RNA, 19 nt, Homo sapiens
uacugaggaaugucuuuca

SEQ ID NO: 1043334 - RNA, 15 nt, Homo sapiens
uacugauucacugca

SEQ ID NO: 1043335 - RNA, 23 nt, Homo sapiens
uacugcagagggacagaugacca

SEQ ID NO: 1043336 - RNA, 17 nt, Homo sapiens
uacugcuaccacaacua

SEQ ID NO: 1043337 - RNA, 22 nt, Homo sapiens
uacugcuggcaguggaacuaag

SEQ ID NO: 1043338 - RNA, 21 nt, Homo sapiens
uacugcuguuguugaaauuga

SEQ ID NO: 1043339 - RNA, 18 nt, Homo sapiens
uacuggucuuguggaauu

SEQ ID NO: 1043340 - RNA, 22 nt, Homo sapiens
uacuguaaagagaccuaccuca

SEQ ID NO: 1043341 - RNA, 12 nt, Homo sapiens
uacuguacuuaa

SEQ ID NO: 1043342 - RNA, 12 nt, Homo sapiens
uacuguauauau

SEQ ID NO: 1043343 - RNA, 17 nt, Homo sapiens
uacugucucacugaaac

SEQ ID NO: 1043344 - RNA, 17 nt, Homo sapiens
uacugugaaacuggcac

SEQ ID NO: 1043345 - RNA, 14 nt, Homo sapiens
uacuguggcuucuu

SEQ ID NO: 1043346 - RNA, 17 nt, Homo sapiens
uacuuauuaaucuguau

SEQ ID NO: 1043347 - RNA, 17 nt, Homo sapiens
uacuucaggggcacuuc

SEQ ID NO: 1043348 - RNA, 16 nt, Homo sapiens
uacuucuggagucuau

SEQ ID NO: 1043349 - RNA, 19 nt, Homo sapiens
uacuucuggagucuauaaa

SEQ ID NO: 1043350 - RNA, 19 nt, Homo sapiens
uacuugggagaccuguaau

SEQ ID NO: 1043351 - RNA, 18 nt, Homo sapiens
uacuugggaggcugaggc

SEQ ID NO: 1043352 - RNA, 20 nt, Homo sapiens
uacuugggaggcugaggcag

SEQ ID NO: 1043353 - RNA, 17 nt, Homo sapiens
uacuuguggacacagcu

SEQ ID NO: 1043354 - RNA, 17 nt, Homo sapiens
uacuuguuuucacuuua

SEQ ID NO: 1043355 - RNA, 17 nt, Homo sapiens
uacuuucuguugccaca

SEQ ID NO: 1043356 - RNA, 17 nt, Homo sapiens
uacuuugacuuuuugca

SEQ ID NO: 1043357 - RNA, 15 nt, Homo sapiens
uacuuuguacaaaga

SEQ ID NO: 1043358 - RNA, 20 nt, Homo sapiens
uagaaacucaggauggucau

SEQ ID NO: 1043359 - RNA, 20 nt, Homo sapiens
uagaaagaaacugcucuaau

SEQ ID NO: 1043360 - RNA, 18 nt, Homo sapiens
uagaaaggaagacagauu

SEQ ID NO: 1043361 - RNA, 20 nt, Homo sapiens
uagaaaggcaguucagguau

SEQ ID NO: 1043362 - RNA, 14 nt, Homo sapiens
uagaaagggucccu

SEQ ID NO: 1043363 - RNA, 16 nt, Homo sapiens
uagaaauaauaugcau

SEQ ID NO: 1043364 - RNA, 13 nt, Homo sapiens
uagaaauggauuu

SEQ ID NO: 1043365 - RNA, 16 nt, Homo sapiens
uagaacacugcauuag

SEQ ID NO: 1043366 - RNA, 19 nt, Homo sapiens
uagaacagugcuugccaca

SEQ ID NO: 1043367 - RNA, 17 nt, Homo sapiens
uagaaccuggagccacu

SEQ ID NO: 1043368 - RNA, 17 nt, Homo sapiens
uagaacguaaccacgga

SEQ ID NO: 1043369 - RNA, 23 nt, Homo sapiens
uagaagagacguuuaaaagccau

SEQ ID NO: 1043370 - RNA, 19 nt, Homo sapiens
uagaagauuuuaugcugcu

SEQ ID NO: 1043371 - RNA, 20 nt, Homo sapiens
uagaagauuuuaugcugcug

SEQ ID NO: 1043372 - RNA, 21 nt, Homo sapiens
uagaagcaaaugacaaaaagc

SEQ ID NO: 1043373 - RNA, 15 nt, Homo sapiens
uagaagcaucacagg

SEQ ID NO: 1043374 - RNA, 23 nt, Homo sapiens
uagaagccugcagaauccagcua

SEQ ID NO: 1043375 - RNA, 21 nt, Homo sapiens
uagaagcuguaguagcccuuu

SEQ ID NO: 1043376 - RNA, 15 nt, Homo sapiens
uagaaggagacagag

SEQ ID NO: 1043377 - RNA, 19 nt, Homo sapiens
uagaaguagcaaaaaguau

SEQ ID NO: 1043378 - RNA, 16 nt, Homo sapiens
uagaagucacacagua

SEQ ID NO: 1043379 - RNA, 23 nt, Homo sapiens
uagaaguguuaacuuagcuugaa

SEQ ID NO: 1043380 - RNA, 17 nt, Homo sapiens
uagaauauuuauuaccu

SEQ ID NO: 1043381 - RNA, 23 nt, Homo sapiens
uagaauauuuauuaccucugaua

SEQ ID NO: 1043382 - RNA, 20 nt, Homo sapiens
uagaaucagccuagggguca

SEQ ID NO: 1043383 - RNA, 19 nt, Homo sapiens
uagaauuaguggcacuugc

SEQ ID NO: 1043384 - RNA, 21 nt, Homo sapiens
uagacaaauacucauguguau

SEQ ID NO: 1043385 - RNA, 16 nt, Homo sapiens
uagacaagcuugucca

SEQ ID NO: 1043386 - RNA, 23 nt, Homo sapiens
uagacacccauuuucacauuccc

SEQ ID NO: 1043387 - RNA, 13 nt, Homo sapiens
uagacaucugccc

SEQ ID NO: 1043388 - RNA, 14 nt, Homo sapiens
uagacuaaggccau

SEQ ID NO: 1043389 - RNA, 19 nt, Homo sapiens
uagagaaauuugccaauuu

SEQ ID NO: 1043390 - RNA, 15 nt, Homo sapiens
uagagaaugauuuca

SEQ ID NO: 1043391 - RNA, 18 nt, Homo sapiens
uagagaucugguuuugcu

SEQ ID NO: 1043392 - RNA, 18 nt, Homo sapiens
uagagauuaccuccugag

SEQ ID NO: 1043393 - RNA, 21 nt, Homo sapiens
uagagauuugguguacaauuc

SEQ ID NO: 1043394 - RNA, 21 nt, Homo sapiens
uagagcagccacaaccaaaaa

SEQ ID NO: 1043395 - RNA, 21 nt, Homo sapiens
uagagccagcccauggcuuua

SEQ ID NO: 1043396 - RNA, 14 nt, Homo sapiens
uagagcugccugug

SEQ ID NO: 1043397 - RNA, 17 nt, Homo sapiens
uagagugcaguggcaug

SEQ ID NO: 1043398 - RNA, 14 nt, Homo sapiens
uagaguuaccacac

SEQ ID NO: 1043399 - RNA, 16 nt, Homo sapiens
uagaguucagacuuuu

SEQ ID NO: 1043400 - RNA, 15 nt, Homo sapiens
uagauaaauuucaau

SEQ ID NO: 1043401 - RNA, 23 nt, Homo sapiens
uagauaaccuguacuucaaguua

SEQ ID NO: 1043402 - RNA, 15 nt, Homo sapiens
uagauauaugcucug

SEQ ID NO: 1043403 - RNA, 21 nt, Homo sapiens
uagauauugugaaguacauau

SEQ ID NO: 1043404 - RNA, 16 nt, Homo sapiens
uagaugguuugagccu

SEQ ID NO: 1043405 - RNA, 20 nt, Homo sapiens
uagcaauuuaauauuuugca

SEQ ID NO: 1043406 - RNA, 12 nt, Homo sapiens
uagcacauacua

SEQ ID NO: 1043407 - RNA, 14 nt, Homo sapiens
uagcacuauuuaca

SEQ ID NO: 1043408 - RNA, 13 nt, Homo sapiens
uagcagaaaucua

SEQ ID NO: 1043409 - RNA, 13 nt, Homo sapiens
uagcauacgguau

SEQ ID NO: 1043410 - RNA, 15 nt, Homo sapiens
uagcaucucaugagu

SEQ ID NO: 1043411 - RNA, 19 nt, Homo sapiens
uagcaugaggccacugcug

SEQ ID NO: 1043412 - RNA, 17 nt, Homo sapiens
uagcauuugucaacaaa

SEQ ID NO: 1043413 - RNA, 18 nt, Homo sapiens
uagccaacacccaucugu

SEQ ID NO: 1043414 - RNA, 22 nt, Homo sapiens
uagccaauauuuuucuuacuga

SEQ ID NO: 1043415 - RNA, 15 nt, Homo sapiens
uagccacuucacuuu

SEQ ID NO: 1043416 - RNA, 17 nt, Homo sapiens
uagccagcacuuguaua

SEQ ID NO: 1043417 - RNA, 16 nt, Homo sapiens
uagccaggauccacaa

SEQ ID NO: 1043418 - RNA, 18 nt, Homo sapiens
uagccaucucucuacucc

SEQ ID NO: 1043419 - RNA, 19 nt, Homo sapiens
uagccaugauaacugcaau

SEQ ID NO: 1043420 - RNA, 16 nt, Homo sapiens
uagccuaauacaacau

SEQ ID NO: 1043421 - RNA, 15 nt, Homo sapiens
uagccuggugugauu

SEQ ID NO: 1043422 - RNA, 17 nt, Homo sapiens
uagccuuagaagucaca

SEQ ID NO: 1043423 - RNA, 16 nt, Homo sapiens
uagccuuauccucuga

SEQ ID NO: 1043424 - RNA, 20 nt, Homo sapiens
uagcuaagaaauaaaacugu

SEQ ID NO: 1043425 - RNA, 18 nt, Homo sapiens
uagcuaccucacuaugcu

SEQ ID NO: 1043426 - RNA, 15 nt, Homo sapiens
uagcuauauccaugu

SEQ ID NO: 1043427 - RNA, 17 nt, Homo sapiens
uagcuauauccauguac

SEQ ID NO: 1043428 - RNA, 13 nt, Homo sapiens
uagcucauugcaa

SEQ ID NO: 1043429 - RNA, 12 nt, Homo sapiens
uagcucuuucag

SEQ ID NO: 1043430 - RNA, 17 nt, Homo sapiens
uagcugggacuacaggu

SEQ ID NO: 1043431 - RNA, 18 nt, Homo sapiens
uagcugggacuacaggug

SEQ ID NO: 1043432 - RNA, 17 nt, Homo sapiens
uagcuggugguuucacg

SEQ ID NO: 1043433 - RNA, 14 nt, Homo sapiens
uagcuuagaccuca

SEQ ID NO: 1043434 - RNA, 16 nt, Homo sapiens
uagcuuagaccucagc

SEQ ID NO: 1043435 - RNA, 15 nt, Homo sapiens
uagcuuggaaacugg

SEQ ID NO: 1043436 - RNA, 13 nt, Homo sapiens
uagcuuucaauuc

SEQ ID NO: 1043437 - RNA, 15 nt, Homo sapiens
uagcuuucagucuuc

SEQ ID NO: 1043438 - RNA, 21 nt, Homo sapiens
uaggaaaauauggguugcauu

SEQ ID NO: 1043439 - RNA, 21 nt, Homo sapiens
uaggaacugcugggcuuggca

SEQ ID NO: 1043440 - RNA, 22 nt, Homo sapiens
uaggaagaauuuuuauauccac

SEQ ID NO: 1043441 - RNA, 16 nt, Homo sapiens
uaggaagaccaagaca

SEQ ID NO: 1043442 - RNA, 16 nt, Homo sapiens
uaggacucugaggcuc

SEQ ID NO: 1043443 - RNA, 21 nt, Homo sapiens
uaggacuuuuauugugaauua

SEQ ID NO: 1043444 - RNA, 17 nt, Homo sapiens
uaggagggagacacugg

SEQ ID NO: 1043445 - RNA, 16 nt, Homo sapiens
uaggaguucacuucau

SEQ ID NO: 1043446 - RNA, 15 nt, Homo sapiens
uaggauaucuuggcu

SEQ ID NO: 1043447 - RNA, 16 nt, Homo sapiens
uaggcaagaagcacag

SEQ ID NO: 1043448 - RNA, 21 nt, Homo sapiens
uaggcauuugcugaauacaga

SEQ ID NO: 1043449 - RNA, 20 nt, Homo sapiens
uaggccagcaccaucucuuu

SEQ ID NO: 1043450 - RNA, 22 nt, Homo sapiens
uaggccuggggacggcuuuuac

SEQ ID NO: 1043451 - RNA, 23 nt, Homo sapiens
uaggcuacaauuuucucccagga

SEQ ID NO: 1043452 - RNA, 12 nt, Homo sapiens
uaggcucugcac

SEQ ID NO: 1043453 - RNA, 15 nt, Homo sapiens
uagggaaguaacauu

SEQ ID NO: 1043454 - RNA, 13 nt, Homo sapiens
uagggagacaaca

SEQ ID NO: 1043455 - RNA, 23 nt, Homo sapiens
uagggaguuagaggcuguacaag

SEQ ID NO: 1043456 - RNA, 22 nt, Homo sapiens
uagggcaguaacauuggguccu

SEQ ID NO: 1043457 - RNA, 14 nt, Homo sapiens
uagggcugagcucu

SEQ ID NO: 1043458 - RNA, 15 nt, Homo sapiens
uagggggugucucag

SEQ ID NO: 1043459 - RNA, 22 nt, Homo sapiens
uaggggucuuguuaagugcagu

SEQ ID NO: 1043460 - RNA, 15 nt, Homo sapiens
uaggguccugaaugu

SEQ ID NO: 1043461 - RNA, 17 nt, Homo sapiens
uagguauauauaugcca

SEQ ID NO: 1043462 - RNA, 19 nt, Homo sapiens
uagguggcacacugggugc

SEQ ID NO: 1043463 - RNA, 15 nt, Homo sapiens
uagguuggacuggaa

SEQ ID NO: 1043464 - RNA, 13 nt, Homo sapiens
uagguuggcagua

SEQ ID NO: 1043465 - RNA, 14 nt, Homo sapiens
uagguugugcaaau

SEQ ID NO: 1043466 - RNA, 22 nt, Homo sapiens
uaguaaagacaggguuucacca

SEQ ID NO: 1043467 - RNA, 22 nt, Homo sapiens
uaguaaagccguuguuuacuua

SEQ ID NO: 1043468 - RNA, 12 nt, Homo sapiens
uaguaacaugug

SEQ ID NO: 1043469 - RNA, 16 nt, Homo sapiens
uaguaagagauuccug

SEQ ID NO: 1043470 - RNA, 13 nt, Homo sapiens
uaguaauucucag

SEQ ID NO: 1043471 - RNA, 21 nt, Homo sapiens
uaguaccugaaaaaaugccaa

SEQ ID NO: 1043472 - RNA, 12 nt, Homo sapiens
uaguacuugaaa

SEQ ID NO: 1043473 - RNA, 13 nt, Homo sapiens
uagucaaaccaua

SEQ ID NO: 1043474 - RNA, 18 nt, Homo sapiens
uagucaaauuauguauug

SEQ ID NO: 1043475 - RNA, 20 nt, Homo sapiens
uagucaagugcguccacgag

SEQ ID NO: 1043476 - RNA, 12 nt, Homo sapiens
uagucacauggc

SEQ ID NO: 1043477 - RNA, 17 nt, Homo sapiens
uagucauuucauggguu

SEQ ID NO: 1043478 - RNA, 21 nt, Homo sapiens
uagucuacuugaggcugcaau

SEQ ID NO: 1043479 - RNA, 17 nt, Homo sapiens
uagugaaucacguaaag

SEQ ID NO: 1043480 - RNA, 20 nt, Homo sapiens
uagugacagcucugccuguu

SEQ ID NO: 1043481 - RNA, 14 nt, Homo sapiens
uagugacuaugaac

SEQ ID NO: 1043482 - RNA, 16 nt, Homo sapiens
uagugacuaugaacuu

SEQ ID NO: 1043483 - RNA, 20 nt, Homo sapiens
uagugggcaccccacugcaa

SEQ ID NO: 1043484 - RNA, 21 nt, Homo sapiens
uaguggggagacuucuuggcu

SEQ ID NO: 1043485 - RNA, 18 nt, Homo sapiens
uaguguccaaauucucac

SEQ ID NO: 1043486 - RNA, 13 nt, Homo sapiens
uaguuaaaguaau

SEQ ID NO: 1043487 - RNA, 14 nt, Homo sapiens
uaguuaaaguaaug

SEQ ID NO: 1043488 - RNA, 15 nt, Homo sapiens
uaguuaacauuucaa

SEQ ID NO: 1043489 - RNA, 13 nt, Homo sapiens
uaguucuaccuca

SEQ ID NO: 1043490 - RNA, 20 nt, Homo sapiens
uaguugcguggacucugcac

SEQ ID NO: 1043491 - RNA, 12 nt, Homo sapiens
uaguugcuguau

SEQ ID NO: 1043492 - RNA, 15 nt, Homo sapiens
uaguugucuuuccug

SEQ ID NO: 1043493 - RNA, 22 nt, Homo sapiens
uaguuugcauuccugauaugau

SEQ ID NO: 1043494 - RNA, 15 nt, Homo sapiens
uaguuugcuguugca

SEQ ID NO: 1043495 - RNA, 16 nt, Homo sapiens
uauaaaagacugacca

SEQ ID NO: 1043496 - RNA, 13 nt, Homo sapiens
uauaaaaguacua

SEQ ID NO: 1043497 - RNA, 22 nt, Homo sapiens
uauaaagaagaacuugcaugga

SEQ ID NO: 1043498 - RNA, 15 nt, Homo sapiens
uauaaagcacuauac

SEQ ID NO: 1043499 - RNA, 22 nt, Homo sapiens
uauaaauaaaacauuuucacac

SEQ ID NO: 1043500 - RNA, 16 nt, Homo sapiens
uauaaaucaaugucac

SEQ ID NO: 1043501 - RNA, 13 nt, Homo sapiens
uauaaaugugauu

SEQ ID NO: 1043502 - RNA, 21 nt, Homo sapiens
uauaaauuuuauaacagaauu

SEQ ID NO: 1043503 - RNA, 20 nt, Homo sapiens
uauaacuaguccuuuacuaa

SEQ ID NO: 1043504 - RNA, 21 nt, Homo sapiens
uauaacuaguccuuuacuaau

SEQ ID NO: 1043505 - RNA, 18 nt, Homo sapiens
uauaacuauguugauaaa

SEQ ID NO: 1043506 - RNA, 20 nt, Homo sapiens
uauaagcagauuuaacaauu

SEQ ID NO: 1043507 - RNA, 12 nt, Homo sapiens
uauaauacugua

SEQ ID NO: 1043508 - RNA, 14 nt, Homo sapiens
uauaauauaccaau

SEQ ID NO: 1043509 - RNA, 14 nt, Homo sapiens
uauaaugguugacu

SEQ ID NO: 1043510 - RNA, 23 nt, Homo sapiens
uauaauucuguacauagccuaua

SEQ ID NO: 1043511 - RNA, 18 nt, Homo sapiens
uauacaauugucauguau

SEQ ID NO: 1043512 - RNA, 21 nt, Homo sapiens
uauacacuauuugugagcaaa

SEQ ID NO: 1043513 - RNA, 23 nt, Homo sapiens
uauacacuuacacuuuaugcaca

SEQ ID NO: 1043514 - RNA, 11 nt, Homo sapiens
uauacagcuca

SEQ ID NO: 1043515 - RNA, 15 nt, Homo sapiens
uauacauuaacuuca

SEQ ID NO: 1043516 - RNA, 21 nt, Homo sapiens
uauacauucuuuaucuugaca

SEQ ID NO: 1043517 - RNA, 10 nt, Homo sapiens
uauacuguaa

SEQ ID NO: 1043518 - RNA, 18 nt, Homo sapiens
uauacuguggcuaugcaa

SEQ ID NO: 1043519 - RNA, 20 nt, Homo sapiens
uauacuucucuauuaucuca

SEQ ID NO: 1043520 - RNA, 23 nt, Homo sapiens
uauacuuugccuuuccauaauca

SEQ ID NO: 1043521 - RNA, 22 nt, Homo sapiens
uauagaacagugcuugccacag

SEQ ID NO: 1043522 - RNA, 21 nt, Homo sapiens
uauagcgauugaaagggcaau

SEQ ID NO: 1043523 - RNA, 13 nt, Homo sapiens
uauagcucaggac

SEQ ID NO: 1043524 - RNA, 19 nt, Homo sapiens
uauagcugcuuuugaugaa

SEQ ID NO: 1043525 - RNA, 12 nt, Homo sapiens
uauagggaugag

SEQ ID NO: 1043526 - RNA, 14 nt, Homo sapiens
uauaguacuggcau

SEQ ID NO: 1043527 - RNA, 17 nt, Homo sapiens
uauaguaugaaugcagu

SEQ ID NO: 1043528 - RNA, 14 nt, Homo sapiens
uauagucacaagag

SEQ ID NO: 1043529 - RNA, 17 nt, Homo sapiens
uauagucacuaguugua

SEQ ID NO: 1043530 - RNA, 22 nt, Homo sapiens
uauagucgaacaauucauauau

SEQ ID NO: 1043531 - RNA, 15 nt, Homo sapiens
uauagucgcagcuac

SEQ ID NO: 1043532 - RNA, 14 nt, Homo sapiens
uauauaaaaauggg

SEQ ID NO: 1043533 - RNA, 18 nt, Homo sapiens
uauauaaaugugauugca

SEQ ID NO: 1043534 - RNA, 17 nt, Homo sapiens
uauauaugugaugaucu

SEQ ID NO: 1043535 - RNA, 13 nt, Homo sapiens
uauauauuacuug

SEQ ID NO: 1043536 - RNA, 19 nt, Homo sapiens
uauauauuuauaacucauc

SEQ ID NO: 1043537 - RNA, 15 nt, Homo sapiens
uauauccauguacug

SEQ ID NO: 1043538 - RNA, 14 nt, Homo sapiens
uauaucgaucucuu

SEQ ID NO: 1043539 - RNA, 16 nt, Homo sapiens
uauaucugaagagcua

SEQ ID NO: 1043540 - RNA, 12 nt, Homo sapiens
uauaugcaauau

SEQ ID NO: 1043541 - RNA, 13 nt, Homo sapiens
uauaugcacuuau

SEQ ID NO: 1043542 - RNA, 20 nt, Homo sapiens
uauaugccgcuacaaaaagg

SEQ ID NO: 1043543 - RNA, 20 nt, Homo sapiens
uauauuaaaauaagcacugu

SEQ ID NO: 1043544 - RNA, 22 nt, Homo sapiens
uauauuaaaauaagcacugugc

SEQ ID NO: 1043545 - RNA, 22 nt, Homo sapiens
uauauuaaacauucuugcugcu

SEQ ID NO: 1043546 - RNA, 17 nt, Homo sapiens
uauauuauaaucuucca

SEQ ID NO: 1043547 - RNA, 15 nt, Homo sapiens
uauauucuuacccua

SEQ ID NO: 1043548 - RNA, 19 nt, Homo sapiens
uauauuguuuucaguguac

SEQ ID NO: 1043549 - RNA, 16 nt, Homo sapiens
uauauuuauacuguau

SEQ ID NO: 1043550 - RNA, 14 nt, Homo sapiens
uauauuuguacaaa

SEQ ID NO: 1043551 - RNA, 15 nt, Homo sapiens
uauauuuuugugcac

SEQ ID NO: 1043552 - RNA, 24 nt, Homo sapiens
uaucaaagagaaguuacauauuag

SEQ ID NO: 1043553 - RNA, 21 nt, Homo sapiens
uaucaaaucagucagugcaaa

SEQ ID NO: 1043554 - RNA, 14 nt, Homo sapiens
uaucaauagucaag

SEQ ID NO: 1043555 - RNA, 15 nt, Homo sapiens
uaucaaucaguauaa

SEQ ID NO: 1043556 - RNA, 14 nt, Homo sapiens
uaucagaauucuca

SEQ ID NO: 1043557 - RNA, 15 nt, Homo sapiens
uaucagaauucucag

SEQ ID NO: 1043558 - RNA, 17 nt, Homo sapiens
uaucagaggccuauaau

SEQ ID NO: 1043559 - RNA, 14 nt, Homo sapiens
uaucaggugcugcc

SEQ ID NO: 1043560 - RNA, 17 nt, Homo sapiens
uaucaguagaaacucua

SEQ ID NO: 1043561 - RNA, 14 nt, Homo sapiens
uaucagucauaacu

SEQ ID NO: 1043562 - RNA, 16 nt, Homo sapiens
uaucaguugcaauaau

SEQ ID NO: 1043563 - RNA, 17 nt, Homo sapiens
uauccacuuaccuagau

SEQ ID NO: 1043564 - RNA, 17 nt, Homo sapiens
uauccaggacucuguca

SEQ ID NO: 1043565 - RNA, 13 nt, Homo sapiens
uauccauccaugg

SEQ ID NO: 1043566 - RNA, 13 nt, Homo sapiens
uauccaucuugaa

SEQ ID NO: 1043567 - RNA, 16 nt, Homo sapiens
uauccccccaaaugga

SEQ ID NO: 1043568 - RNA, 14 nt, Homo sapiens
uaucccuacuguaa

SEQ ID NO: 1043569 - RNA, 14 nt, Homo sapiens
uauccugugcuuga

SEQ ID NO: 1043570 - RNA, 12 nt, Homo sapiens
uauccuguucuc

SEQ ID NO: 1043571 - RNA, 21 nt, Homo sapiens
uaucgggagcagugucuucca

SEQ ID NO: 1043572 - RNA, 23 nt, Homo sapiens
uaucuaaacuggauucacagcuc

SEQ ID NO: 1043573 - RNA, 21 nt, Homo sapiens
uaucuaacccucccauggcac

SEQ ID NO: 1043574 - RNA, 16 nt, Homo sapiens
uaucucaaacuacugg

SEQ ID NO: 1043575 - RNA, 23 nt, Homo sapiens
uaucucaaacuacuggcaauuug

SEQ ID NO: 1043576 - RNA, 21 nt, Homo sapiens
uaucuccagauggaauggggu

SEQ ID NO: 1043577 - RNA, 23 nt, Homo sapiens
uaucucggggagaaaugcaacca

SEQ ID NO: 1043578 - RNA, 23 nt, Homo sapiens
uaucugauuuccuaaugucagag

SEQ ID NO: 1043579 - RNA, 15 nt, Homo sapiens
uaucuggacaagcca

SEQ ID NO: 1043580 - RNA, 18 nt, Homo sapiens
uaucuggucaaccuccug

SEQ ID NO: 1043581 - RNA, 22 nt, Homo sapiens
uaucuguagugagauagcauug

SEQ ID NO: 1043582 - RNA, 15 nt, Homo sapiens
uaucuuggcuuugcc

SEQ ID NO: 1043583 - RNA, 16 nt, Homo sapiens
uaucuuucgugauaaa

SEQ ID NO: 1043584 - RNA, 21 nt, Homo sapiens
uaucuuuuuuuuauuccacau

SEQ ID NO: 1043585 - RNA, 16 nt, Homo sapiens
uaugaacuucucucag

SEQ ID NO: 1043586 - RNA, 13 nt, Homo sapiens
uaugaaugcagug

SEQ ID NO: 1043587 - RNA, 17 nt, Homo sapiens
uaugaauggagauuuga

SEQ ID NO: 1043588 - RNA, 22 nt, Homo sapiens
uaugacuaaagagagaauguag

SEQ ID NO: 1043589 - RNA, 23 nt, Homo sapiens
uaugagcuggggaugucucucau

SEQ ID NO: 1043590 - RNA, 14 nt, Homo sapiens
uaugaggcauuugu

SEQ ID NO: 1043591 - RNA, 22 nt, Homo sapiens
uaugaggcauuuguuugaacug

SEQ ID NO: 1043592 - RNA, 12 nt, Homo sapiens
uaugagggaaaa

SEQ ID NO: 1043593 - RNA, 21 nt, Homo sapiens
uaugagguuucuuugacuuca

SEQ ID NO: 1043594 - RNA, 23 nt, Homo sapiens
uaugaguuuuugauagcuuuauu

SEQ ID NO: 1043595 - RNA, 18 nt, Homo sapiens
uaugaugucccuauggaa

SEQ ID NO: 1043596 - RNA, 17 nt, Homo sapiens
uaugauuccaccuacau

SEQ ID NO: 1043597 - RNA, 12 nt, Homo sapiens
uaugcaaucuga

SEQ ID NO: 1043598 - RNA, 14 nt, Homo sapiens
uaugcaguaugcuu

SEQ ID NO: 1043599 - RNA, 17 nt, Homo sapiens
uaugcaguaugcuuaau

SEQ ID NO: 1043600 - RNA, 14 nt, Homo sapiens
uaugcauacaguaa

SEQ ID NO: 1043601 - RNA, 22 nt, Homo sapiens
uaugcaugaaguaauaugcaca

SEQ ID NO: 1043602 - RNA, 11 nt, Homo sapiens
uaugcauuuga

SEQ ID NO: 1043603 - RNA, 15 nt, Homo sapiens
uaugcauuugcauuu

SEQ ID NO: 1043604 - RNA, 20 nt, Homo sapiens
uaugcauuugcauuugcucu

SEQ ID NO: 1043605 - RNA, 17 nt, Homo sapiens
uaugccuuuuuugauca

SEQ ID NO: 1043606 - RNA, 15 nt, Homo sapiens
uaugcuaagugaaau

SEQ ID NO: 1043607 - RNA, 21 nt, Homo sapiens
uaugcucucgcaccuuuccaa

SEQ ID NO: 1043608 - RNA, 16 nt, Homo sapiens
uaugcugcuguuuaca

SEQ ID NO: 1043609 - RNA, 15 nt, Homo sapiens
uaugcuuuacugcga

SEQ ID NO: 1043610 - RNA, 16 nt, Homo sapiens
uauggacucaguuuuc

SEQ ID NO: 1043611 - RNA, 21 nt, Homo sapiens
uauggacucaguuuucuugca

SEQ ID NO: 1043612 - RNA, 20 nt, Homo sapiens
uauggacuccuguuguugaa

SEQ ID NO: 1043613 - RNA, 12 nt, Homo sapiens
uauggacucugc

SEQ ID NO: 1043614 - RNA, 15 nt, Homo sapiens
uauggacucugcaca

SEQ ID NO: 1043615 - RNA, 19 nt, Homo sapiens
uauggcagugucuuuccac

SEQ ID NO: 1043616 - RNA, 21 nt, Homo sapiens
uauggcuauaggugcuacaaa

SEQ ID NO: 1043617 - RNA, 16 nt, Homo sapiens
uauggcuuaaugacac

SEQ ID NO: 1043618 - RNA, 20 nt, Homo sapiens
uaugguaaaaguuacuuauu

SEQ ID NO: 1043619 - RNA, 20 nt, Homo sapiens
uaugguacaagcaaugccug

SEQ ID NO: 1043620 - RNA, 18 nt, Homo sapiens
uaugguguacauucuucc

SEQ ID NO: 1043621 - RNA, 22 nt, Homo sapiens
uaugguuaauaaguuucacuga

SEQ ID NO: 1043622 - RNA, 18 nt, Homo sapiens
uaugguuuuccaucuuau

SEQ ID NO: 1043623 - RNA, 16 nt, Homo sapiens
uauguaaaguauguaa

SEQ ID NO: 1043624 - RNA, 22 nt, Homo sapiens
uauguaacaaaccugcacuuau

SEQ ID NO: 1043625 - RNA, 19 nt, Homo sapiens
uauguaccauguacaugaa

SEQ ID NO: 1043626 - RNA, 13 nt, Homo sapiens
uauguauggaaua

SEQ ID NO: 1043627 - RNA, 20 nt, Homo sapiens
uaugucacccaaugcauauc

SEQ ID NO: 1043628 - RNA, 16 nt, Homo sapiens
uaugucaguuugcagu

SEQ ID NO: 1043629 - RNA, 13 nt, Homo sapiens
uaugucaucauac

SEQ ID NO: 1043630 - RNA, 13 nt, Homo sapiens
uaugucugcugaa

SEQ ID NO: 1043631 - RNA, 10 nt, Homo sapiens
uaugugcaau

SEQ ID NO: 1043632 - RNA, 11 nt, Homo sapiens
uaugugcaaua

SEQ ID NO: 1043633 - RNA, 20 nt, Homo sapiens
uauguggacguaaucuccac

SEQ ID NO: 1043634 - RNA, 19 nt, Homo sapiens
uaugugggugggaccacag

SEQ ID NO: 1043635 - RNA, 20 nt, Homo sapiens
uauguguggaugaugcugcc

SEQ ID NO: 1043636 - RNA, 13 nt, Homo sapiens
uauuaaacauucu

SEQ ID NO: 1043637 - RNA, 16 nt, Homo sapiens
uauuaaaucuugcaac

SEQ ID NO: 1043638 - RNA, 23 nt, Homo sapiens
uauuaagaggcagaaaauugcac

SEQ ID NO: 1043639 - RNA, 23 nt, Homo sapiens
uauuaagauuuccaagugccaau

SEQ ID NO: 1043640 - RNA, 16 nt, Homo sapiens
uauuaauauucauugu

SEQ ID NO: 1043641 - RNA, 22 nt, Homo sapiens
uauuacaguuuaucuauggcac

SEQ ID NO: 1043642 - RNA, 16 nt, Homo sapiens
uauuacaucuuucaca

SEQ ID NO: 1043643 - RNA, 14 nt, Homo sapiens
uauuagaauuucau

SEQ ID NO: 1043644 - RNA, 18 nt, Homo sapiens
uauuauucuucauaacaa

SEQ ID NO: 1043645 - RNA, 16 nt, Homo sapiens
uauuauuuuuuccaca

SEQ ID NO: 1043646 - RNA, 21 nt, Homo sapiens
uauucagauauaaaacaguuu

SEQ ID NO: 1043647 - RNA, 14 nt, Homo sapiens
uauucaguucccag

SEQ ID NO: 1043648 - RNA, 17 nt, Homo sapiens
uauucauccuaaaaagu

SEQ ID NO: 1043649 - RNA, 15 nt, Homo sapiens
uauucauucauucau

SEQ ID NO: 1043650 - RNA, 13 nt, Homo sapiens
uauuccacaucua

SEQ ID NO: 1043651 - RNA, 18 nt, Homo sapiens
uauucccaagcccaugag

SEQ ID NO: 1043652 - RNA, 18 nt, Homo sapiens
uauucccauuagaccaag

SEQ ID NO: 1043653 - RNA, 23 nt, Homo sapiens
uauuccccccacuuaagacugug

SEQ ID NO: 1043654 - RNA, 17 nt, Homo sapiens
uauucugauuccacuuu

SEQ ID NO: 1043655 - RNA, 15 nt, Homo sapiens
uauucuucauaacaa

SEQ ID NO: 1043656 - RNA, 20 nt, Homo sapiens
uauugaaguuuugacaucaa

SEQ ID NO: 1043657 - RNA, 18 nt, Homo sapiens
uauugacaauaauuucag

SEQ ID NO: 1043658 - RNA, 15 nt, Homo sapiens
uauugcagcuuauau

SEQ ID NO: 1043659 - RNA, 18 nt, Homo sapiens
uauugcagucaaucucuu

SEQ ID NO: 1043660 - RNA, 15 nt, Homo sapiens
uauugcaguuuauca

SEQ ID NO: 1043661 - RNA, 16 nt, Homo sapiens
uauugcauaauuuaua

SEQ ID NO: 1043662 - RNA, 15 nt, Homo sapiens
uauugcauaugcaua

SEQ ID NO: 1043663 - RNA, 19 nt, Homo sapiens
uauugccuugugaauuugc

SEQ ID NO: 1043664 - RNA, 11 nt, Homo sapiens
uauugcugcuc

SEQ ID NO: 1043665 - RNA, 13 nt, Homo sapiens
uauuggacagucu

SEQ ID NO: 1043666 - RNA, 14 nt, Homo sapiens
uauuggcagcucua

SEQ ID NO: 1043667 - RNA, 19 nt, Homo sapiens
uauuguaagaaauacugua

SEQ ID NO: 1043668 - RNA, 22 nt, Homo sapiens
uauuguccccuaaaccaaaaac

SEQ ID NO: 1043669 - RNA, 13 nt, Homo sapiens
uauugugcauaga

SEQ ID NO: 1043670 - RNA, 19 nt, Homo sapiens
uauugugccaauauguauu

SEQ ID NO: 1043671 - RNA, 23 nt, Homo sapiens
uauuguuccaagacauugucaau

SEQ ID NO: 1043672 - RNA, 23 nt, Homo sapiens
uauuuaaaauuuauugcuugaua

SEQ ID NO: 1043673 - RNA, 22 nt, Homo sapiens
uauuuaaagaagaaacgucuau

SEQ ID NO: 1043674 - RNA, 14 nt, Homo sapiens
uauuuaaguucaua

SEQ ID NO: 1043675 - RNA, 13 nt, Homo sapiens
uauuuaccagacc

SEQ ID NO: 1043676 - RNA, 21 nt, Homo sapiens
uauuuacugagcuucucugug

SEQ ID NO: 1043677 - RNA, 18 nt, Homo sapiens
uauuuagauauaacacua

SEQ ID NO: 1043678 - RNA, 15 nt, Homo sapiens
uauuuaugugugagg

SEQ ID NO: 1043679 - RNA, 15 nt, Homo sapiens
uauuucauuauguaa

SEQ ID NO: 1043680 - RNA, 12 nt, Homo sapiens
uauuuccuugcc

SEQ ID NO: 1043681 - RNA, 15 nt, Homo sapiens
uauuucuacauaguc

SEQ ID NO: 1043682 - RNA, 21 nt, Homo sapiens
uauuucucaacaaagcacagu

SEQ ID NO: 1043683 - RNA, 15 nt, Homo sapiens
uauuucucuuugcac

SEQ ID NO: 1043684 - RNA, 12 nt, Homo sapiens
uauuucugaaga

SEQ ID NO: 1043685 - RNA, 21 nt, Homo sapiens
uauuugcaguucaccugcacu

SEQ ID NO: 1043686 - RNA, 18 nt, Homo sapiens
uauuuuaaucuaauucua

SEQ ID NO: 1043687 - RNA, 22 nt, Homo sapiens
uauuuuaaucuaauucuaagga

SEQ ID NO: 1043688 - RNA, 20 nt, Homo sapiens
uauuuuaauuuaaucuucca

SEQ ID NO: 1043689 - RNA, 17 nt, Homo sapiens
uauuuuauagagcagaa

SEQ ID NO: 1043690 - RNA, 18 nt, Homo sapiens
uauuuuaugaucuuggcu

SEQ ID NO: 1043691 - RNA, 21 nt, Homo sapiens
uauuuucccccuuuucugcau

SEQ ID NO: 1043692 - RNA, 16 nt, Homo sapiens
uauuuuuagacagagu

SEQ ID NO: 1043693 - RNA, 14 nt, Homo sapiens
uauuuuuaugugca

SEQ ID NO: 1043694 - RNA, 23 nt, Homo sapiens
uauuuuucaaagauguguugcua

SEQ ID NO: 1043695 - RNA, 22 nt, Homo sapiens
uauuuuuguuucuuccaaagca

SEQ ID NO: 1043696 - RNA, 16 nt, Homo sapiens
uauuuuuuauauauac

SEQ ID NO: 1043697 - RNA, 20 nt, Homo sapiens
ucaaaaaaucugaccaaaac

SEQ ID NO: 1043698 - RNA, 16 nt, Homo sapiens
ucaaaaacacaguguu

SEQ ID NO: 1043699 - RNA, 15 nt, Homo sapiens
ucaaaaacauucuua

SEQ ID NO: 1043700 - RNA, 14 nt, Homo sapiens
ucaaaaaguuccau

SEQ ID NO: 1043701 - RNA, 19 nt, Homo sapiens
ucaaaacagagaugugaua

SEQ ID NO: 1043702 - RNA, 14 nt, Homo sapiens
ucaaaaccuuucaa

SEQ ID NO: 1043703 - RNA, 17 nt, Homo sapiens
ucaaaacugcacuguca

SEQ ID NO: 1043704 - RNA, 20 nt, Homo sapiens
ucaaaacuucagacauagaa

SEQ ID NO: 1043705 - RNA, 12 nt, Homo sapiens
ucaaaagaucaa

SEQ ID NO: 1043706 - RNA, 20 nt, Homo sapiens
ucaaaauaaaaaccaagaag

SEQ ID NO: 1043707 - RNA, 17 nt, Homo sapiens
ucaaaauaaaaaugagg

SEQ ID NO: 1043708 - RNA, 11 nt, Homo sapiens
ucaaacaaagc

SEQ ID NO: 1043709 - RNA, 13 nt, Homo sapiens
ucaaacaaagcca

SEQ ID NO: 1043710 - RNA, 18 nt, Homo sapiens
ucaaaccauaaacuucau

SEQ ID NO: 1043711 - RNA, 17 nt, Homo sapiens
ucaaacuccugaccuca

SEQ ID NO: 1043712 - RNA, 17 nt, Homo sapiens
ucaaacugcaugauuca

SEQ ID NO: 1043713 - RNA, 23 nt, Homo sapiens
ucaaagauguguugcuauccuga

SEQ ID NO: 1043714 - RNA, 18 nt, Homo sapiens
ucaaagcacuuggacucu

SEQ ID NO: 1043715 - RNA, 12 nt, Homo sapiens
ucaaagcaguag

SEQ ID NO: 1043716 - RNA, 21 nt, Homo sapiens
ucaaagcuuuuuccagaggcu

SEQ ID NO: 1043717 - RNA, 20 nt, Homo sapiens
ucaaaggaaaauaguaaugu

SEQ ID NO: 1043718 - RNA, 16 nt, Homo sapiens
ucaaaggcacacagca

SEQ ID NO: 1043719 - RNA, 22 nt, Homo sapiens
ucaaagggagagagugcuauug

SEQ ID NO: 1043720 - RNA, 17 nt, Homo sapiens
ucaaagugacuauucag

SEQ ID NO: 1043721 - RNA, 20 nt, Homo sapiens
ucaaaguuuugaaaagcuau

SEQ ID NO: 1043722 - RNA, 13 nt, Homo sapiens
ucaaauagcauaa

SEQ ID NO: 1043723 - RNA, 21 nt, Homo sapiens
ucaaaucacauggcuuuccac

SEQ ID NO: 1043724 - RNA, 14 nt, Homo sapiens
ucaaaucagucagu

SEQ ID NO: 1043725 - RNA, 22 nt, Homo sapiens
ucaaaugacccaaagaccaaua

SEQ ID NO: 1043726 - RNA, 12 nt, Homo sapiens
ucaaaugcacau

SEQ ID NO: 1043727 - RNA, 16 nt, Homo sapiens
ucaaaugcacaucuca

SEQ ID NO: 1043728 - RNA, 21 nt, Homo sapiens
ucaaauggaagacacauugaa

SEQ ID NO: 1043729 - RNA, 19 nt, Homo sapiens
ucaaauucuucugaacuca

SEQ ID NO: 1043730 - RNA, 16 nt, Homo sapiens
ucaaauuggagcuuca

SEQ ID NO: 1043731 - RNA, 14 nt, Homo sapiens
ucaacaaagucacc

SEQ ID NO: 1043732 - RNA, 16 nt, Homo sapiens
ucaacacccaacuguc

SEQ ID NO: 1043733 - RNA, 12 nt, Homo sapiens
ucaacacuuaag

SEQ ID NO: 1043734 - RNA, 15 nt, Homo sapiens
ucaacagcuccccau

SEQ ID NO: 1043735 - RNA, 14 nt, Homo sapiens
ucaacaugagucaa

SEQ ID NO: 1043736 - RNA, 15 nt, Homo sapiens
ucaaccaaugccaaa

SEQ ID NO: 1043737 - RNA, 18 nt, Homo sapiens
ucaaccaaugccaaaaaa

SEQ ID NO: 1043738 - RNA, 19 nt, Homo sapiens
ucaacccuggagaguucaa

SEQ ID NO: 1043739 - RNA, 15 nt, Homo sapiens
ucaaccuccuggaca

SEQ ID NO: 1043740 - RNA, 18 nt, Homo sapiens
ucaaccugggcaaagccu

SEQ ID NO: 1043741 - RNA, 22 nt, Homo sapiens
ucaacugaaaagacucaguguu

SEQ ID NO: 1043742 - RNA, 10 nt, Homo sapiens
ucaacugagg

SEQ ID NO: 1043743 - RNA, 23 nt, Homo sapiens
ucaacuggagacacuauuuaucu

SEQ ID NO: 1043744 - RNA, 20 nt, Homo sapiens
ucaacuguugauugcaggaa

SEQ ID NO: 1043745 - RNA, 19 nt, Homo sapiens
ucaacuucuggcuccucaa

SEQ ID NO: 1043746 - RNA, 12 nt, Homo sapiens
ucaacuuugaca

SEQ ID NO: 1043747 - RNA, 22 nt, Homo sapiens
ucaagaauggggaucacagaga

SEQ ID NO: 1043748 - RNA, 23 nt, Homo sapiens
ucaagaauggggaucacagagac

SEQ ID NO: 1043749 - RNA, 15 nt, Homo sapiens
ucaagaccauaguga

SEQ ID NO: 1043750 - RNA, 22 nt, Homo sapiens
ucaagcaauucuccugccucag

SEQ ID NO: 1043751 - RNA, 20 nt, Homo sapiens
ucaagcagccaagggaugaa

SEQ ID NO: 1043752 - RNA, 21 nt, Homo sapiens
ucaagcccugcagucacagcu

SEQ ID NO: 1043753 - RNA, 22 nt, Homo sapiens
ucaagcccugcagucacagcua

SEQ ID NO: 1043754 - RNA, 18 nt, Homo sapiens
ucaagcccuuuacuugac

SEQ ID NO: 1043755 - RNA, 18 nt, Homo sapiens
ucaagcuagaaggccaca

SEQ ID NO: 1043756 - RNA, 22 nt, Homo sapiens
ucaaggauagaaguauaccuga

SEQ ID NO: 1043757 - RNA, 12 nt, Homo sapiens
ucaaggcacugc

SEQ ID NO: 1043758 - RNA, 21 nt, Homo sapiens
ucaagggcuagcaucccugag

SEQ ID NO: 1043759 - RNA, 14 nt, Homo sapiens
ucaagggcuuuauu

SEQ ID NO: 1043760 - RNA, 19 nt, Homo sapiens
ucaagggcuuuauuacaga

SEQ ID NO: 1043761 - RNA, 22 nt, Homo sapiens
ucaagguguuuugaaaugcaga

SEQ ID NO: 1043762 - RNA, 17 nt, Homo sapiens
ucaagguucccagagau

SEQ ID NO: 1043763 - RNA, 13 nt, Homo sapiens
ucaaguaauccac

SEQ ID NO: 1043764 - RNA, 18 nt, Homo sapiens
ucaaguacuguaacugug

SEQ ID NO: 1043765 - RNA, 14 nt, Homo sapiens
ucaagucacuccca

SEQ ID NO: 1043766 - RNA, 19 nt, Homo sapiens
ucaagugauucuccugccu

SEQ ID NO: 1043767 - RNA, 18 nt, Homo sapiens
ucaagugucuuccaucau

SEQ ID NO: 1043768 - RNA, 20 nt, Homo sapiens
ucaaguuggcuucuaaucaa

SEQ ID NO: 1043769 - RNA, 15 nt, Homo sapiens
ggugugaacagggaa

SEQ ID NO: 1043770 - RNA, 20 nt, Homo sapiens
ggugugaaccaccacaccca

SEQ ID NO: 1043771 - RNA, 12 nt, Homo sapiens
ggugugcuguau

SEQ ID NO: 1043772 - RNA, 15 nt, Homo sapiens
ggugugggggcugca

SEQ ID NO: 1043773 - RNA, 22 nt, Homo sapiens
gguguuaaucauuucauuuuua

SEQ ID NO: 1043774 - RNA, 16 nt, Homo sapiens
gguuaaccacuguggu

SEQ ID NO: 1043775 - RNA, 20 nt, Homo sapiens
gguuaggauuuaacagucau

SEQ ID NO: 1043776 - RNA, 13 nt, Homo sapiens
gguuauaaugugu

SEQ ID NO: 1043777 - RNA, 15 nt, Homo sapiens
gguuauagacugcca

SEQ ID NO: 1043778 - RNA, 22 nt, Homo sapiens
gguucacagaagcacagcaccc

SEQ ID NO: 1043779 - RNA, 16 nt, Homo sapiens
gguucagaaaugcugc

SEQ ID NO: 1043780 - RNA, 14 nt, Homo sapiens
gguuccaacuguau

SEQ ID NO: 1043781 - RNA, 12 nt, Homo sapiens
gguucugaugau

SEQ ID NO: 1043782 - RNA, 14 nt, Homo sapiens
gguugaggggacca

SEQ ID NO: 1043783 - RNA, 22 nt, Homo sapiens
gguuggaaaacaguauuuucca

SEQ ID NO: 1043784 - RNA, 14 nt, Homo sapiens
gguuuaggucaaga

SEQ ID NO: 1043785 - RNA, 18 nt, Homo sapiens
gguuuaugcucaauccau

SEQ ID NO: 1043786 - RNA, 15 nt, Homo sapiens
gguuuccuuccuugg

SEQ ID NO: 1043787 - RNA, 20 nt, Homo sapiens
gguuucugagcugcucugaa

SEQ ID NO: 1043788 - RNA, 21 nt, Homo sapiens
gguuucuggcagccaguaccu

SEQ ID NO: 1043789 - RNA, 17 nt, Homo sapiens
gguuuguugcagccaaa

SEQ ID NO: 1043790 - RNA, 15 nt, Homo sapiens
gguuuuacugcagcu

SEQ ID NO: 1043791 - RNA, 18 nt, Homo sapiens
gguuuuuguuaccuuuau

SEQ ID NO: 1043792 - RNA, 15 nt, Homo sapiens
guaaaacuauauucu

SEQ ID NO: 1043793 - RNA, 23 nt, Homo sapiens
guaaaacuauauucucaguguag

SEQ ID NO: 1043794 - RNA, 16 nt, Homo sapiens
guaaaaggccaaaccu

SEQ ID NO: 1043795 - RNA, 14 nt, Homo sapiens
guaaaauauacuua

SEQ ID NO: 1043796 - RNA, 13 nt, Homo sapiens
guaaaauauuuau

SEQ ID NO: 1043797 - RNA, 17 nt, Homo sapiens
guaaaauggaggccauu

SEQ ID NO: 1043798 - RNA, 15 nt, Homo sapiens
guaaacaaaggaauu

SEQ ID NO: 1043799 - RNA, 13 nt, Homo sapiens
guaaacugugcac

SEQ ID NO: 1043800 - RNA, 12 nt, Homo sapiens
guaaagacugua

SEQ ID NO: 1043801 - RNA, 22 nt, Homo sapiens
guaaagcauuccaacaaagggu

SEQ ID NO: 1043802 - RNA, 20 nt, Homo sapiens
guaaagccguuguuuacuua

SEQ ID NO: 1043803 - RNA, 19 nt, Homo sapiens
guaaagcguuugcauuugc

SEQ ID NO: 1043804 - RNA, 21 nt, Homo sapiens
guaaauacacauagcauguaa

SEQ ID NO: 1043805 - RNA, 19 nt, Homo sapiens
guaaaucacacaacagguu

SEQ ID NO: 1043806 - RNA, 18 nt, Homo sapiens
guaaaugggggugcauuu

SEQ ID NO: 1043807 - RNA, 19 nt, Homo sapiens
guaacaacuguggucaauc

SEQ ID NO: 1043808 - RNA, 16 nt, Homo sapiens
guaacaguucauguuu

SEQ ID NO: 1043809 - RNA, 23 nt, Homo sapiens
guaacauacuggccuggacuguu

SEQ ID NO: 1043810 - RNA, 15 nt, Homo sapiens
guaacauuugccuua

SEQ ID NO: 1043811 - RNA, 20 nt, Homo sapiens
guaacccgcucaucacugga

SEQ ID NO: 1043812 - RNA, 13 nt, Homo sapiens
guaacgucuguaa

SEQ ID NO: 1043813 - RNA, 19 nt, Homo sapiens
guaacuccagcucugcucc

SEQ ID NO: 1043814 - RNA, 18 nt, Homo sapiens
guaagaaagugaagcaaa

SEQ ID NO: 1043815 - RNA, 18 nt, Homo sapiens
guaagaaaugcugcccau

SEQ ID NO: 1043816 - RNA, 13 nt, Homo sapiens
guaagacaaucca

SEQ ID NO: 1043817 - RNA, 15 nt, Homo sapiens
guaagacgaaugauu

SEQ ID NO: 1043818 - RNA, 18 nt, Homo sapiens
guaagagcuggugucuga

SEQ ID NO: 1043819 - RNA, 22 nt, Homo sapiens
guaagaucguucucugccucac

SEQ ID NO: 1043820 - RNA, 15 nt, Homo sapiens
guaaggaauaccugu

SEQ ID NO: 1043821 - RNA, 15 nt, Homo sapiens
guaaggugagggaau

SEQ ID NO: 1043822 - RNA, 18 nt, Homo sapiens
guaagucaaaugugugcu

SEQ ID NO: 1043823 - RNA, 15 nt, Homo sapiens
guaagugccuuccau

SEQ ID NO: 1043824 - RNA, 23 nt, Homo sapiens
guaaguugaauggccugccuuga

SEQ ID NO: 1043825 - RNA, 18 nt, Homo sapiens
guaaguuuaccuauguaa

SEQ ID NO: 1043826 - RNA, 21 nt, Homo sapiens
guaaguuuaugcauacaguaa

SEQ ID NO: 1043827 - RNA, 12 nt, Homo sapiens
guaaguuuugaa

SEQ ID NO: 1043828 - RNA, 13 nt, Homo sapiens
guaaucacuguug

SEQ ID NO: 1043829 - RNA, 16 nt, Homo sapiens
guaaucccagcacuuu

SEQ ID NO: 1043830 - RNA, 18 nt, Homo sapiens
guaaucuguguacaaaga

SEQ ID NO: 1043831 - RNA, 20 nt, Homo sapiens
guaauuaaguacuauguauc

SEQ ID NO: 1043832 - RNA, 18 nt, Homo sapiens
guaauuuaaaauugugau

SEQ ID NO: 1043833 - RNA, 21 nt, Homo sapiens
guacaaggcccccacugccug

SEQ ID NO: 1043834 - RNA, 17 nt, Homo sapiens
guacacguguccuguag

SEQ ID NO: 1043835 - RNA, 21 nt, Homo sapiens
guacacuguuucaaacuuuac

SEQ ID NO: 1043836 - RNA, 12 nt, Homo sapiens
guacagacaucc

SEQ ID NO: 1043837 - RNA, 14 nt, Homo sapiens
guacagugagccaa

SEQ ID NO: 1043838 - RNA, 15 nt, Homo sapiens
guacaguuugcugua

SEQ ID NO: 1043839 - RNA, 17 nt, Homo sapiens
guacauguuaaacuuac

SEQ ID NO: 1043840 - RNA, 18 nt, Homo sapiens
guacauuagucauucaau

SEQ ID NO: 1043841 - RNA, 22 nt, Homo sapiens
guacauucaauguuuaugcaag

SEQ ID NO: 1043842 - RNA, 21 nt, Homo sapiens
guacauuggcugguaacaguu

SEQ ID NO: 1043843 - RNA, 21 nt, Homo sapiens
guaccacucaggccaacaagc

SEQ ID NO: 1043844 - RNA, 14 nt, Homo sapiens
guacccuucaccca

SEQ ID NO: 1043845 - RNA, 13 nt, Homo sapiens
guaccugugcacg

SEQ ID NO: 1043846 - RNA, 15 nt, Homo sapiens
guacguugugcauuu

SEQ ID NO: 1043847 - RNA, 16 nt, Homo sapiens
guacuauguaucaaug

SEQ ID NO: 1043848 - RNA, 23 nt, Homo sapiens
guacuauucugauuacacaaaac

SEQ ID NO: 1043849 - RNA, 12 nt, Homo sapiens
guacucaaugga

SEQ ID NO: 1043850 - RNA, 15 nt, Homo sapiens
guacugagggacaag

SEQ ID NO: 1043851 - RNA, 21 nt, Homo sapiens
guacuuagcagcuaucucuca

SEQ ID NO: 1043852 - RNA, 21 nt, Homo sapiens
guacuucaaguuaaagugaau

SEQ ID NO: 1043853 - RNA, 17 nt, Homo sapiens
guacuuuguacaaagac

SEQ ID NO: 1043854 - RNA, 19 nt, Homo sapiens
guacuuuuaugauguauau

SEQ ID NO: 1043855 - RNA, 19 nt, Homo sapiens
guagaaaagggaacugaac

SEQ ID NO: 1043856 - RNA, 20 nt, Homo sapiens
guagagacaggguuuugcca

SEQ ID NO: 1043857 - RNA, 14 nt, Homo sapiens
guagagaugugauu

SEQ ID NO: 1043858 - RNA, 15 nt, Homo sapiens
guagagucaucucca

SEQ ID NO: 1043859 - RNA, 13 nt, Homo sapiens
guagauaaggaaa

SEQ ID NO: 1043860 - RNA, 10 nt, Homo sapiens
guagauuccc

SEQ ID NO: 1043861 - RNA, 18 nt, Homo sapiens
guagauuuuaaaagauaa

SEQ ID NO: 1043862 - RNA, 21 nt, Homo sapiens
guagcagauccccagccucug

SEQ ID NO: 1043863 - RNA, 16 nt, Homo sapiens
guagcauccucuuuaa

SEQ ID NO: 1043864 - RNA, 17 nt, Homo sapiens
guagccugugcauguau

SEQ ID NO: 1043865 - RNA, 14 nt, Homo sapiens
guaggaacugcugg

SEQ ID NO: 1043866 - RNA, 14 nt, Homo sapiens
guaggguugccaga

SEQ ID NO: 1043867 - RNA, 19 nt, Homo sapiens
guagguaauauugcaaggc

SEQ ID NO: 1043868 - RNA, 19 nt, Homo sapiens
guuauuaacagcugauaca

SEQ ID NO: 1043869 - RNA, 19 nt, Homo sapiens
guuauuaauuaauauucau

SEQ ID NO: 1043870 - RNA, 20 nt, Homo sapiens
guuauuuauaaucacuuuuu

SEQ ID NO: 1043871 - RNA, 21 nt, Homo sapiens
guuauuuuugcuuguuucuga

SEQ ID NO: 1043872 - RNA, 18 nt, Homo sapiens
guucaagagcacacuugg

SEQ ID NO: 1043873 - RNA, 16 nt, Homo sapiens
guucaauggcugcuga

SEQ ID NO: 1043874 - RNA, 13 nt, Homo sapiens
guucaccagguca

SEQ ID NO: 1043875 - RNA, 14 nt, Homo sapiens
guucagcaugaagg

SEQ ID NO: 1043876 - RNA, 14 nt, Homo sapiens
guucagcucacugu

SEQ ID NO: 1043877 - RNA, 20 nt, Homo sapiens
guucaggagucccaaggaaa

SEQ ID NO: 1043878 - RNA, 16 nt, Homo sapiens
guucagguaacaggca

SEQ ID NO: 1043879 - RNA, 17 nt, Homo sapiens
guucaguggugugaucu

SEQ ID NO: 1043880 - RNA, 21 nt, Homo sapiens
guucaucagacuccugugcaa

SEQ ID NO: 1043881 - RNA, 16 nt, Homo sapiens
guucauguuugcuuca

SEQ ID NO: 1043882 - RNA, 14 nt, Homo sapiens
guuccacugagcuc

SEQ ID NO: 1043883 - RNA, 24 nt, Homo sapiens
guuccauaugugggugucagucag

SEQ ID NO: 1043884 - RNA, 16 nt, Homo sapiens
guucccaauacaaaaa

SEQ ID NO: 1043885 - RNA, 18 nt, Homo sapiens
guucccagaggguuucca

SEQ ID NO: 1043886 - RNA, 14 nt, Homo sapiens
guuccccacugaca

SEQ ID NO: 1043887 - RNA, 14 nt, Homo sapiens
guucccccaaccuc

SEQ ID NO: 1043888 - RNA, 22 nt, Homo sapiens
guucccuuggccucagaauuca

SEQ ID NO: 1043889 - RNA, 15 nt, Homo sapiens
guuccugcgcugcaa

SEQ ID NO: 1043890 - RNA, 13 nt, Homo sapiens
guucgaagcuccg

SEQ ID NO: 1043891 - RNA, 21 nt, Homo sapiens
guucucacagugggagccagg

SEQ ID NO: 1043892 - RNA, 11 nt, Homo sapiens
guucucaggcc

SEQ ID NO: 1043893 - RNA, 19 nt, Homo sapiens
guucuccauuucacuugac

SEQ ID NO: 1043894 - RNA, 16 nt, Homo sapiens
guucuccuccuauuca

SEQ ID NO: 1043895 - RNA, 16 nt, Homo sapiens
guucucuauugcugcu

SEQ ID NO: 1043896 - RNA, 20 nt, Homo sapiens
guucugaauaugcugcucau

SEQ ID NO: 1043897 - RNA, 14 nt, Homo sapiens
guucugaguguuuu

SEQ ID NO: 1043898 - RNA, 19 nt, Homo sapiens
guucuggcucuuccaggcu

SEQ ID NO: 1043899 - RNA, 15 nt, Homo sapiens
guucugggacacagu

SEQ ID NO: 1043900 - RNA, 16 nt, Homo sapiens
guucugucucauauga

SEQ ID NO: 1043901 - RNA, 15 nt, Homo sapiens
guucuucuuccugaa

SEQ ID NO: 1043902 - RNA, 20 nt, Homo sapiens
guucuucuuggucucagugu

SEQ ID NO: 1043903 - RNA, 15 nt, Homo sapiens
guugaaagaucaaaa

SEQ ID NO: 1043904 - RNA, 18 nt, Homo sapiens
guugaagaggugagcacg

SEQ ID NO: 1043905 - RNA, 23 nt, Homo sapiens
guugaggggaccaagguggcacg

SEQ ID NO: 1043906 - RNA, 18 nt, Homo sapiens
guugaggggcuccuggaa

SEQ ID NO: 1043907 - RNA, 15 nt, Homo sapiens
guugaucccaagaca

SEQ ID NO: 1043908 - RNA, 18 nt, Homo sapiens
guugauguuggcugggaa

SEQ ID NO: 1043909 - RNA, 11 nt, Homo sapiens
guugauuuucu

SEQ ID NO: 1043910 - RNA, 22 nt, Homo sapiens
guugcacccagcccuggucuca

SEQ ID NO: 1043911 - RNA, 17 nt, Homo sapiens
guugcacggcugcugag

SEQ ID NO: 1043912 - RNA, 13 nt, Homo sapiens
guugcacugauau

SEQ ID NO: 1043913 - RNA, 19 nt, Homo sapiens
guugcaggaccucagguga

SEQ ID NO: 1043914 - RNA, 14 nt, Homo sapiens
guugcccagugugu

SEQ ID NO: 1043915 - RNA, 20 nt, Homo sapiens
guugcguggacucugcacau

SEQ ID NO: 1043916 - RNA, 15 nt, Homo sapiens
guugcuggacuguca

SEQ ID NO: 1043917 - RNA, 17 nt, Homo sapiens
guugcugugugguuugg

SEQ ID NO: 1043918 - RNA, 16 nt, Homo sapiens
guuggaaaaugugcaa

SEQ ID NO: 1043919 - RNA, 23 nt, Homo sapiens
guuggacaaaccgagugcaauga

SEQ ID NO: 1043920 - RNA, 22 nt, Homo sapiens
guuggacccgcucuggaccaac

SEQ ID NO: 1043921 - RNA, 22 nt, Homo sapiens
guuggccagugugacaaggauu

SEQ ID NO: 1043922 - RNA, 18 nt, Homo sapiens
guuggccugcacuggugu

SEQ ID NO: 1043923 - RNA, 13 nt, Homo sapiens
guugugcgcacau

SEQ ID NO: 1043924 - RNA, 19 nt, Homo sapiens
guuguuaaugaaaauguca

SEQ ID NO: 1043925 - RNA, 23 nt, Homo sapiens
guuguucugcucaauacaucuca

SEQ ID NO: 1043926 - RNA, 17 nt, Homo sapiens
guuuaacauuuccucag

SEQ ID NO: 1043927 - RNA, 17 nt, Homo sapiens
guuuaacucagaucacu

SEQ ID NO: 1043928 - RNA, 18 nt, Homo sapiens
guuuaaugggcacagggu

SEQ ID NO: 1043929 - RNA, 16 nt, Homo sapiens
guuuacagcacuacuc

SEQ ID NO: 1043930 - RNA, 21 nt, Homo sapiens
guuuacccaguauuccauuuu

SEQ ID NO: 1043931 - RNA, 14 nt, Homo sapiens
guuuaccuuuuaau

SEQ ID NO: 1043932 - RNA, 18 nt, Homo sapiens
guuuagccaaaggauaag

SEQ ID NO: 1043933 - RNA, 14 nt, Homo sapiens
guuuagugaucuga

SEQ ID NO: 1043934 - RNA, 22 nt, Homo sapiens
guuuaugcauagauaaucucuc

SEQ ID NO: 1043935 - RNA, 20 nt, Homo sapiens
guuuauguaagagcaccuuc

SEQ ID NO: 1043936 - RNA, 15 nt, Homo sapiens
guuuaugucaucaua

SEQ ID NO: 1043937 - RNA, 23 nt, Homo sapiens
guuucaaaaaaucugaccaaaac

SEQ ID NO: 1043938 - RNA, 16 nt, Homo sapiens
guuucaaguacuguaa

SEQ ID NO: 1043939 - RNA, 21 nt, Homo sapiens
guuucaauugaaggugcuguu

SEQ ID NO: 1043940 - RNA, 21 nt, Homo sapiens
guuucaccaucagucaaugaa

SEQ ID NO: 1043941 - RNA, 19 nt, Homo sapiens
guuucaccauguuagccag

SEQ ID NO: 1043942 - RNA, 19 nt, Homo sapiens
guuucaccauguuggccag

SEQ ID NO: 1043943 - RNA, 19 nt, Homo sapiens
guuucacuguguuagccag

SEQ ID NO: 1043944 - RNA, 22 nt, Homo sapiens
guuuccugccugcggaccagau

SEQ ID NO: 1043945 - RNA, 15 nt, Homo sapiens
guuuccuuucauuua

SEQ ID NO: 1043946 - RNA, 19 nt, Homo sapiens
guuucgaaguugaugcaau

SEQ ID NO: 1043947 - RNA, 20 nt, Homo sapiens
guuucuagcuagaaauauga

SEQ ID NO: 1043948 - RNA, 20 nt, Homo sapiens
guuucuauucuaaguaauuc

SEQ ID NO: 1043949 - RNA, 22 nt, Homo sapiens
guuucucucacauuacuguaua

SEQ ID NO: 1043950 - RNA, 21 nt, Homo sapiens
guuucucuugaagaacugacu

SEQ ID NO: 1043951 - RNA, 22 nt, Homo sapiens
guuucucuugaagaacugacua

SEQ ID NO: 1043952 - RNA, 16 nt, Homo sapiens
guuucuuagcuuuuua

SEQ ID NO: 1043953 - RNA, 15 nt, Homo sapiens
guuucuugugggcua

SEQ ID NO: 1043954 - RNA, 20 nt, Homo sapiens
guuucuuugacuucaaugua

SEQ ID NO: 1043955 - RNA, 16 nt, Homo sapiens
guuucuuuugguucca

SEQ ID NO: 1043956 - RNA, 15 nt, Homo sapiens
guuugaacucaggga

SEQ ID NO: 1043957 - RNA, 15 nt, Homo sapiens
guuugaacucuguaa

SEQ ID NO: 1043958 - RNA, 20 nt, Homo sapiens
guuugaaggaggugagggau

SEQ ID NO: 1043959 - RNA, 17 nt, Homo sapiens
guuugaaucacaguaua

SEQ ID NO: 1043960 - RNA, 18 nt, Homo sapiens
guuugacgacagugcauu

SEQ ID NO: 1043961 - RNA, 23 nt, Homo sapiens
guuugacgacagugcauuugccu

SEQ ID NO: 1043962 - RNA, 21 nt, Homo sapiens
guuugagauggacacacuggu

SEQ ID NO: 1043963 - RNA, 18 nt, Homo sapiens
guuugagcuuagugaaau

SEQ ID NO: 1043964 - RNA, 17 nt, Homo sapiens
guuugauuauucagugu

SEQ ID NO: 1043965 - RNA, 17 nt, Homo sapiens
guuugcagaugacaaaa

SEQ ID NO: 1043966 - RNA, 14 nt, Homo sapiens
guuugcuagcagaa

SEQ ID NO: 1043967 - RNA, 21 nt, Homo sapiens
guuugcuauugacaagucauu

SEQ ID NO: 1043968 - RNA, 23 nt, Homo sapiens
guuuggccgggugcgguggcuca

SEQ ID NO: 1043969 - RNA, 14 nt, Homo sapiens
guuuggcgggccaa

SEQ ID NO: 1043970 - RNA, 17 nt, Homo sapiens
guuuguaagguggucac

SEQ ID NO: 1043971 - RNA, 18 nt, Homo sapiens
guuuuaaagcuugcucac

SEQ ID NO: 1043972 - RNA, 17 nt, Homo sapiens
guuuuaacaguucacuu

SEQ ID NO: 1043973 - RNA, 15 nt, Homo sapiens
guuuuaauguagauu

SEQ ID NO: 1043974 - RNA, 14 nt, Homo sapiens
guuuuacugcagcu

SEQ ID NO: 1043975 - RNA, 14 nt, Homo sapiens
guuuuauuacacau

SEQ ID NO: 1043976 - RNA, 21 nt, Homo sapiens
guuuuauuuugguguccuauu

SEQ ID NO: 1043977 - RNA, 14 nt, Homo sapiens
guuuucaguguaca

SEQ ID NO: 1043978 - RNA, 19 nt, Homo sapiens
guuuucaucaagacuggaa

SEQ ID NO: 1043979 - RNA, 21 nt, Homo sapiens
guuuucccugaccucccucua

SEQ ID NO: 1043980 - RNA, 17 nt, Homo sapiens
guuuuccuaaaugcagu

SEQ ID NO: 1043981 - RNA, 19 nt, Homo sapiens
guuuuccuucucaucugug

SEQ ID NO: 1043982 - RNA, 15 nt, Homo sapiens
guuuucuagaauuua

SEQ ID NO: 1043983 - RNA, 19 nt, Homo sapiens
guuuucugcuuuaauuuca

SEQ ID NO: 1043984 - RNA, 15 nt, Homo sapiens
guuuucuucugugau

SEQ ID NO: 1043985 - RNA, 16 nt, Homo sapiens
guuuucuugccaauga

SEQ ID NO: 1043986 - RNA, 23 nt, Homo sapiens
guuuucuuucuaaugagauauua

SEQ ID NO: 1043987 - RNA, 16 nt, Homo sapiens
guuuugacaucaauga

SEQ ID NO: 1043988 - RNA, 23 nt, Homo sapiens
guuuuguagagauggggucucac

SEQ ID NO: 1043989 - RNA, 15 nt, Homo sapiens
guuuuguauucaucu

SEQ ID NO: 1043990 - RNA, 19 nt, Homo sapiens
guuuuuaaaaaacugcuga

SEQ ID NO: 1043991 - RNA, 16 nt, Homo sapiens
guuuuuaaaacccagu

SEQ ID NO: 1043992 - RNA, 13 nt, Homo sapiens
guuuuuacuguga

SEQ ID NO: 1043993 - RNA, 20 nt, Homo sapiens
guuuuuagauuaaacaaaca

SEQ ID NO: 1043994 - RNA, 19 nt, Homo sapiens
guuuuuccacuacugcuac

SEQ ID NO: 1043995 - RNA, 19 nt, Homo sapiens
guuuuuguucuuaauugca

SEQ ID NO: 1043996 - RNA, 22 nt, Homo sapiens
uaaaaaaaaaacguauugcauu

SEQ ID NO: 1043997 - RNA, 23 nt, Homo sapiens
uaaaaaaaaaacguauugcauuu

SEQ ID NO: 1043998 - RNA, 19 nt, Homo sapiens
uaaaaaaaaaauuacuucc

SEQ ID NO: 1043999 - RNA, 19 nt, Homo sapiens
uaaaaaaauacaugcaucu

SEQ ID NO: 1044000 - RNA, 22 nt, Homo sapiens
uaaaaaacauaaauuucuuuaa

SEQ ID NO: 1044001 - RNA, 22 nt, Homo sapiens
uaaaaacagaaggaaauugaga

SEQ ID NO: 1044002 - RNA, 19 nt, Homo sapiens
uaaaaaccccaaacuguug

SEQ ID NO: 1044003 - RNA, 14 nt, Homo sapiens
uaaaaagcagagcu

SEQ ID NO: 1044004 - RNA, 23 nt, Homo sapiens
uaaaaagcgggcacgggcccgug

SEQ ID NO: 1044005 - RNA, 23 nt, Homo sapiens
uaaaaaggaccagagaauucuua

SEQ ID NO: 1044006 - RNA, 22 nt, Homo sapiens
uaaaaagggcagggcaucuccu

SEQ ID NO: 1044007 - RNA, 13 nt, Homo sapiens
uaaaaagugacac

SEQ ID NO: 1044008 - RNA, 20 nt, Homo sapiens
uaaaaagugacacagcagcu

SEQ ID NO: 1044009 - RNA, 14 nt, Homo sapiens
uaaaaauaaauuca

SEQ ID NO: 1044010 - RNA, 14 nt, Homo sapiens
uaaaaauacacaaa

SEQ ID NO: 1044011 - RNA, 15 nt, Homo sapiens
uacaaucauugcuga

SEQ ID NO: 1044012 - RNA, 14 nt, Homo sapiens
uacaaucucaaauu

SEQ ID NO: 1044013 - RNA, 16 nt, Homo sapiens
uacaaucucaaauucu

SEQ ID NO: 1044014 - RNA, 15 nt, Homo sapiens
uacaauuagccaggu

SEQ ID NO: 1044015 - RNA, 22 nt, Homo sapiens
uacaauuauuuuuacaguucuc

SEQ ID NO: 1044016 - RNA, 12 nt, Homo sapiens
uacaauugugag

SEQ ID NO: 1044017 - RNA, 19 nt, Homo sapiens
uacaauuuucucccaggaa

SEQ ID NO: 1044018 - RNA, 18 nt, Homo sapiens
uacaauuuuuuaucaugc

SEQ ID NO: 1044019 - RNA, 21 nt, Homo sapiens
uacacacacacgcgugcacac

SEQ ID NO: 1044020 - RNA, 18 nt, Homo sapiens
uacacacauaugucauau

SEQ ID NO: 1044021 - RNA, 18 nt, Homo sapiens
uacacacuuuuuaagaaa

SEQ ID NO: 1044022 - RNA, 16 nt, Homo sapiens
uacacauagcauguaa

SEQ ID NO: 1044023 - RNA, 17 nt, Homo sapiens
uacacccacaguggaaa

SEQ ID NO: 1044024 - RNA, 12 nt, Homo sapiens
uacacccagaaa

SEQ ID NO: 1044025 - RNA, 15 nt, Homo sapiens
uacacguguccugua

SEQ ID NO: 1044026 - RNA, 23 nt, Homo sapiens
uacacuaagcgaauguguacaaa

SEQ ID NO: 1044027 - RNA, 19 nt, Homo sapiens
uacagaaaguggugcucag

SEQ ID NO: 1044028 - RNA, 21 nt, Homo sapiens
uacagacauccuagcauuugu

SEQ ID NO: 1044029 - RNA, 14 nt, Homo sapiens
uacagauagucaaa

SEQ ID NO: 1044030 - RNA, 16 nt, Homo sapiens
uacagcaacaauuuau

SEQ ID NO: 1044031 - RNA, 14 nt, Homo sapiens
uacagcacuacucu

SEQ ID NO: 1044032 - RNA, 20 nt, Homo sapiens
uacagcagaaaggagaacua

SEQ ID NO: 1044033 - RNA, 16 nt, Homo sapiens
uacagcaggugcucaa

SEQ ID NO: 1044034 - RNA, 20 nt, Homo sapiens
uacagcuggguggcacugcc

SEQ ID NO: 1044035 - RNA, 19 nt, Homo sapiens
uacaggaagguagaaauau

SEQ ID NO: 1044036 - RNA, 15 nt, Homo sapiens
uacaggacauucuca

SEQ ID NO: 1044037 - RNA, 19 nt, Homo sapiens
uacaggcaacaaugagcag

SEQ ID NO: 1044038 - RNA, 14 nt, Homo sapiens
uacaggcacaaaau

SEQ ID NO: 1044039 - RNA, 14 nt, Homo sapiens
uacaggcacccacc

SEQ ID NO: 1044040 - RNA, 20 nt, Homo sapiens
uacaggcauagaguucagac

SEQ ID NO: 1044041 - RNA, 14 nt, Homo sapiens
uacaggcgugagcc

SEQ ID NO: 1044042 - RNA, 15 nt, Homo sapiens
uacagggaguguagu

SEQ ID NO: 1044043 - RNA, 13 nt, Homo sapiens
uacaggugugaac

SEQ ID NO: 1044044 - RNA, 16 nt, Homo sapiens
uacaggugugagucac

SEQ ID NO: 1044045 - RNA, 16 nt, Homo sapiens
uacaguaucucagggc

SEQ ID NO: 1044046 - RNA, 18 nt, Homo sapiens
uacagucugucaugaaca

SEQ ID NO: 1044047 - RNA, 16 nt, Homo sapiens
uacagucuuguauuaa

SEQ ID NO: 1044048 - RNA, 16 nt, Homo sapiens
uacagugagccaagau

SEQ ID NO: 1044049 - RNA, 13 nt, Homo sapiens
uacagugcuauuu

SEQ ID NO: 1044050 - RNA, 12 nt, Homo sapiens
uacaguguuauu

SEQ ID NO: 1044051 - RNA, 14 nt, Homo sapiens
uacaguuuaucuau

SEQ ID NO: 1044052 - RNA, 13 nt, Homo sapiens
uacauaaacugac

SEQ ID NO: 1044053 - RNA, 20 nt, Homo sapiens
uacauaaaggugguaugugu

SEQ ID NO: 1044054 - RNA, 23 nt, Homo sapiens
uacauagccuauauuuacaguga

SEQ ID NO: 1044055 - RNA, 16 nt, Homo sapiens
uacauaguacauacaa

SEQ ID NO: 1044056 - RNA, 17 nt, Homo sapiens
uacauauauaugucagg

SEQ ID NO: 1044057 - RNA, 21 nt, Homo sapiens
uacauaugcaaaaauauaccu

SEQ ID NO: 1044058 - RNA, 20 nt, Homo sapiens
uacauccagucacuuugcca

SEQ ID NO: 1044059 - RNA, 19 nt, Homo sapiens
uacaucuaguuaaucauag

SEQ ID NO: 1044060 - RNA, 19 nt, Homo sapiens
uacaugcagcccaugccca

SEQ ID NO: 1044061 - RNA, 15 nt, Homo sapiens
uacaugcauacuuca

SEQ ID NO: 1044062 - RNA, 19 nt, Homo sapiens
uacaugccucagugaagga

SEQ ID NO: 1044063 - RNA, 11 nt, Homo sapiens
uacauggaaua

SEQ ID NO: 1044064 - RNA, 20 nt, Homo sapiens
uacauggaauaacauguaau

SEQ ID NO: 1044065 - RNA, 14 nt, Homo sapiens
uacauggcucuaaa

SEQ ID NO: 1044066 - RNA, 15 nt, Homo sapiens
uacauggucaaguau

SEQ ID NO: 1044067 - RNA, 15 nt, Homo sapiens
uacauguaauccauc

SEQ ID NO: 1044068 - RNA, 15 nt, Homo sapiens
uacauuaauuaccuu

SEQ ID NO: 1044069 - RNA, 23 nt, Homo sapiens
uacauuguuugucugucuucaua

SEQ ID NO: 1044070 - RNA, 19 nt, Homo sapiens
uacauuuuugaauguagua

SEQ ID NO: 1044071 - RNA, 15 nt, Homo sapiens
uaccaaaagggccau

SEQ ID NO: 1044072 - RNA, 16 nt, Homo sapiens
uaccaauauuuacuca

SEQ ID NO: 1044073 - RNA, 16 nt, Homo sapiens
uaccacaaacacauua

SEQ ID NO: 1044074 - RNA, 18 nt, Homo sapiens
uaccacagugucuguauc

SEQ ID NO: 1044075 - RNA, 20 nt, Homo sapiens
uaccacaugccaagcacugu

SEQ ID NO: 1044076 - RNA, 17 nt, Homo sapiens
uaccacugcacccagcu

SEQ ID NO: 1044077 - RNA, 14 nt, Homo sapiens
uaccacuuguauua

SEQ ID NO: 1044078 - RNA, 15 nt, Homo sapiens
uaccagacuguguau

SEQ ID NO: 1044079 - RNA, 21 nt, Homo sapiens
uaccauggugaauuaaucacu

SEQ ID NO: 1044080 - RNA, 23 nt, Homo sapiens
uaccauuaaaguucucaaugcaa

SEQ ID NO: 1044081 - RNA, 18 nt, Homo sapiens
uacccagaaauccaucua

SEQ ID NO: 1044082 - RNA, 23 nt, Homo sapiens
uacccagagaauauauacauucu

SEQ ID NO: 1044083 - RNA, 19 nt, Homo sapiens
uacccauagcuuccaugag

SEQ ID NO: 1044084 - RNA, 21 nt, Homo sapiens
uaccccaggagacucugggaa

SEQ ID NO: 1044085 - RNA, 18 nt, Homo sapiens
uacccccuccucucugcc

SEQ ID NO: 1044086 - RNA, 20 nt, Homo sapiens
uaccccugaucugacauccc

SEQ ID NO: 1044087 - RNA, 15 nt, Homo sapiens
uaccccuuuacaaau

SEQ ID NO: 1044088 - RNA, 15 nt, Homo sapiens
uacccucaccuguca

SEQ ID NO: 1044089 - RNA, 11 nt, Homo sapiens
uacccucucag

SEQ ID NO: 1044090 - RNA, 23 nt, Homo sapiens
uacccugcgcccaguccuuccac

SEQ ID NO: 1044091 - RNA, 23 nt, Homo sapiens
uacccuuccuacagauagucaaa

SEQ ID NO: 1044092 - RNA, 18 nt, Homo sapiens
uacccuuuagacuguagc

SEQ ID NO: 1044093 - RNA, 21 nt, Homo sapiens
uaccuaaacuauaugccauaa

SEQ ID NO: 1044094 - RNA, 15 nt, Homo sapiens
uaccuaccacagugu

SEQ ID NO: 1044095 - RNA, 13 nt, Homo sapiens
uaccuacugcuga

SEQ ID NO: 1044096 - RNA, 15 nt, Homo sapiens
uaccuaucaucuuaa

SEQ ID NO: 1044097 - RNA, 12 nt, Homo sapiens
uaccuauuuuca

SEQ ID NO: 1044098 - RNA, 17 nt, Homo sapiens
uaccucaagggggacug

SEQ ID NO: 1044099 - RNA, 18 nt, Homo sapiens
uaccucacuaugcugcuu

SEQ ID NO: 1044100 - RNA, 19 nt, Homo sapiens
uaccugccacucacacagc

SEQ ID NO: 1044101 - RNA, 20 nt, Homo sapiens
uaccuggcccugugccuugg

SEQ ID NO: 1044102 - RNA, 13 nt, Homo sapiens
uaccugggcauuc

SEQ ID NO: 1044103 - RNA, 21 nt, Homo sapiens
uaccugggcauucuuguuuca

SEQ ID NO: 1044104 - RNA, 14 nt, Homo sapiens
uaccuucuaccucu

SEQ ID NO: 1044105 - RNA, 15 nt, Homo sapiens
uaccuucuaccucuu

SEQ ID NO: 1044106 - RNA, 18 nt, Homo sapiens
uaccuucuguaguuuuau

SEQ ID NO: 1044107 - RNA, 21 nt, Homo sapiens
uaccuugguucccccacugau

SEQ ID NO: 1044108 - RNA, 14 nt, Homo sapiens
uaccuuuuuugaua

SEQ ID NO: 1044109 - RNA, 20 nt, Homo sapiens
uacgcuccaucgcugucauc

SEQ ID NO: 1044110 - RNA, 23 nt, Homo sapiens
uacguauuuuuucuaaugugcau

SEQ ID NO: 1044111 - RNA, 12 nt, Homo sapiens
uacgucugggag

SEQ ID NO: 1044112 - RNA, 22 nt, Homo sapiens
uacguuccuauugucauuaaag

SEQ ID NO: 1044113 - RNA, 12 nt, Homo sapiens
uacguugugcau

SEQ ID NO: 1044114 - RNA, 17 nt, Homo sapiens
uacuaaaaaucaugaga

SEQ ID NO: 1044115 - RNA, 20 nt, Homo sapiens
uacuaaggaguaaucugugu

SEQ ID NO: 1044116 - RNA, 23 nt, Homo sapiens
uacuaaggaguaaucuguguaca

SEQ ID NO: 1044117 - RNA, 21 nt, Homo sapiens
uacuaauuuucuagauuuucu

SEQ ID NO: 1044118 - RNA, 15 nt, Homo sapiens
uacuacacauucaau

SEQ ID NO: 1044119 - RNA, 14 nt, Homo sapiens
uacuaccugucaag

SEQ ID NO: 1044120 - RNA, 22 nt, Homo sapiens
uacuaccugucaagguuugugu

SEQ ID NO: 1044121 - RNA, 16 nt, Homo sapiens
uacuagcauaugaguu

SEQ ID NO: 1044122 - RNA, 21 nt, Homo sapiens
uacuagggagaagguuucauu

SEQ ID NO: 1044123 - RNA, 12 nt, Homo sapiens
uacuauaugauu

SEQ ID NO: 1044124 - RNA, 20 nt, Homo sapiens
uacuauauuuauacuguaua

SEQ ID NO: 1044125 - RNA, 14 nt, Homo sapiens
uacuauuuuuacug

SEQ ID NO: 1044126 - RNA, 13 nt, Homo sapiens
uacucaucaucaa

SEQ ID NO: 1044127 - RNA, 13 nt, Homo sapiens
uacucaugaucuu

SEQ ID NO: 1044128 - RNA, 15 nt, Homo sapiens
uacucauucagggau

SEQ ID NO: 1044129 - RNA, 22 nt, Homo sapiens
uacucauucagggauagcacug

SEQ ID NO: 1044130 - RNA, 15 nt, Homo sapiens
uacuccuaccucagc

SEQ ID NO: 1044131 - RNA, 16 nt, Homo sapiens
uacuccuuccaucaaa

SEQ ID NO: 1044132 - RNA, 22 nt, Homo sapiens
uacucugaagggcaucaugcau

SEQ ID NO: 1044133 - RNA, 23 nt, Homo sapiens
uacucugcacauacgcaccacau

SEQ ID NO: 1044134 - RNA, 16 nt, Homo sapiens
uacucugcacuggugu

SEQ ID NO: 1044135 - RNA, 15 nt, Homo sapiens
uacucuuaagccauc

SEQ ID NO: 1044136 - RNA, 16 nt, Homo sapiens
uacucuuccaucuuuc

SEQ ID NO: 1044137 - RNA, 15 nt, Homo sapiens
uacucuuuguagcaa

SEQ ID NO: 1044138 - RNA, 19 nt, Homo sapiens
uacugcaauuaaagugaua

SEQ ID NO: 1044139 - RNA, 17 nt, Homo sapiens
uacugcccugagccuga

SEQ ID NO: 1044140 - RNA, 22 nt, Homo sapiens
uacugcucaucauuccuugaga

SEQ ID NO: 1044141 - RNA, 14 nt, Homo sapiens
uacuggaaggcuuc

SEQ ID NO: 1044142 - RNA, 14 nt, Homo sapiens
uacuggcaauuugu

SEQ ID NO: 1044143 - RNA, 18 nt, Homo sapiens
uacuguaauagugugauu

SEQ ID NO: 1044144 - RNA, 18 nt, Homo sapiens
uacuguaauuugugauac

SEQ ID NO: 1044145 - RNA, 19 nt, Homo sapiens
uacuuauauccacacugca

SEQ ID NO: 1044146 - RNA, 15 nt, Homo sapiens
uacuuaucuuaugcc

SEQ ID NO: 1044147 - RNA, 23 nt, Homo sapiens
uacuuauuauuccagaucugcag

SEQ ID NO: 1044148 - RNA, 17 nt, Homo sapiens
uacuuauucuagauuac

SEQ ID NO: 1044149 - RNA, 20 nt, Homo sapiens
uacuucaaaaguauuuuccu

SEQ ID NO: 1044150 - RNA, 21 nt, Homo sapiens
uacuucaauugcuuugcacuu

SEQ ID NO: 1044151 - RNA, 21 nt, Homo sapiens
uacuucagcucacacaugaga

SEQ ID NO: 1044152 - RNA, 20 nt, Homo sapiens
uacuugagaggcugaggcaa

SEQ ID NO: 1044153 - RNA, 17 nt, Homo sapiens
uacuugaggcugcaauc

SEQ ID NO: 1044154 - RNA, 9 nt, Homo sapiens
uacuuguca

SEQ ID NO: 1044155 - RNA, 14 nt, Homo sapiens
uacuuuguaaagac

SEQ ID NO: 1044156 - RNA, 13 nt, Homo sapiens
uauucccauuaga

SEQ ID NO: 1044157 - RNA, 16 nt, Homo sapiens
uauuccuuucuaucau

SEQ ID NO: 1044158 - RNA, 13 nt, Homo sapiens
uauucgugcagca

SEQ ID NO: 1044159 - RNA, 23 nt, Homo sapiens
uauucuaguuuugucaaacugua

SEQ ID NO: 1044160 - RNA, 16 nt, Homo sapiens
uauucucaguguaggg

SEQ ID NO: 1044161 - RNA, 18 nt, Homo sapiens
uauucucuuccucaucca

SEQ ID NO: 1044162 - RNA, 19 nt, Homo sapiens
uauucugauuacacaaaac

SEQ ID NO: 1044163 - RNA, 15 nt, Homo sapiens
uauucugauuccacu

SEQ ID NO: 1044164 - RNA, 22 nt, Homo sapiens
uauucuguuggccagugugaca

SEQ ID NO: 1044165 - RNA, 23 nt, Homo sapiens
uauucuuaagggaacuuccacau

SEQ ID NO: 1044166 - RNA, 14 nt, Homo sapiens
uauucuugucaaaa

SEQ ID NO: 1044167 - RNA, 16 nt, Homo sapiens
uauucuuuaaauuuca

SEQ ID NO: 1044168 - RNA, 18 nt, Homo sapiens
uauugaaucauguaguau

SEQ ID NO: 1044169 - RNA, 14 nt, Homo sapiens
uauugacaucucuu

SEQ ID NO: 1044170 - RNA, 19 nt, Homo sapiens
uauugcagcuuauauucau

SEQ ID NO: 1044171 - RNA, 21 nt, Homo sapiens
uauugcaucuggguagcugua

SEQ ID NO: 1044172 - RNA, 14 nt, Homo sapiens
uauugccuugugaa

SEQ ID NO: 1044173 - RNA, 17 nt, Homo sapiens
uauugccuugugaauuu

SEQ ID NO: 1044174 - RNA, 19 nt, Homo sapiens
uauuggacugauaaucucu

SEQ ID NO: 1044175 - RNA, 15 nt, Homo sapiens
uauuguauaaacuau

SEQ ID NO: 1044176 - RNA, 22 nt, Homo sapiens
uauuguauuuauuccauauuca

SEQ ID NO: 1044177 - RNA, 17 nt, Homo sapiens
uauuguuccaagacauu

SEQ ID NO: 1044178 - RNA, 18 nt, Homo sapiens
uauuuaaagccuccucau

SEQ ID NO: 1044179 - RNA, 22 nt, Homo sapiens
uauuuaaagccuccucaucccg

SEQ ID NO: 1044180 - RNA, 19 nt, Homo sapiens
uauuuaacuggcuucagcc

SEQ ID NO: 1044181 - RNA, 13 nt, Homo sapiens
uauuuacagugaa

SEQ ID NO: 1044182 - RNA, 15 nt, Homo sapiens
uauuuacauaugaaa

SEQ ID NO: 1044183 - RNA, 18 nt, Homo sapiens
uauuuaccuucuaccucu

SEQ ID NO: 1044184 - RNA, 20 nt, Homo sapiens
uauuuagauauaacacuaug

SEQ ID NO: 1044185 - RNA, 15 nt, Homo sapiens
uauuuauaaucacuu

SEQ ID NO: 1044186 - RNA, 15 nt, Homo sapiens
uauuuauagucacaa

SEQ ID NO: 1044187 - RNA, 21 nt, Homo sapiens
uauuuauagucgaacaauuca

SEQ ID NO: 1044188 - RNA, 19 nt, Homo sapiens
uauuuaucagugacagagu

SEQ ID NO: 1044189 - RNA, 21 nt, Homo sapiens
uauuuaugagaaaguucucau

SEQ ID NO: 1044190 - RNA, 16 nt, Homo sapiens
uauuuauuccauauuc

SEQ ID NO: 1044191 - RNA, 15 nt, Homo sapiens
uauuuauugcugaau

SEQ ID NO: 1044192 - RNA, 17 nt, Homo sapiens
uauuuauuuuauggcaa

SEQ ID NO: 1044193 - RNA, 20 nt, Homo sapiens
uauuucaaaauauacauuca

SEQ ID NO: 1044194 - RNA, 12 nt, Homo sapiens
uauuucaggcau

SEQ ID NO: 1044195 - RNA, 16 nt, Homo sapiens
uauuuccauauggcaa

SEQ ID NO: 1044196 - RNA, 18 nt, Homo sapiens
uauuucccucaccuuucc

SEQ ID NO: 1044197 - RNA, 17 nt, Homo sapiens
uauuucucaacaaagca

SEQ ID NO: 1044198 - RNA, 16 nt, Homo sapiens
uauuugaaucuacaaa

SEQ ID NO: 1044199 - RNA, 12 nt, Homo sapiens
uauuugagacag

SEQ ID NO: 1044200 - RNA, 19 nt, Homo sapiens
uauuugcaguucaccugca

SEQ ID NO: 1044201 - RNA, 19 nt, Homo sapiens
uauuugcauguuaccuccu

SEQ ID NO: 1044202 - RNA, 20 nt, Homo sapiens
uauuuguacaccaauauuca

SEQ ID NO: 1044203 - RNA, 15 nt, Homo sapiens
uauuuguuugugcau

SEQ ID NO: 1044204 - RNA, 13 nt, Homo sapiens
uauuuuaaucacc

SEQ ID NO: 1044205 - RNA, 17 nt, Homo sapiens
uauuuuauaucaauuua

SEQ ID NO: 1044206 - RNA, 14 nt, Homo sapiens
uauuuuccaugaaa

SEQ ID NO: 1044207 - RNA, 13 nt, Homo sapiens
uauuuucuguuga

SEQ ID NO: 1044208 - RNA, 23 nt, Homo sapiens
uauuuugaaaaauuccuauugug

SEQ ID NO: 1044209 - RNA, 22 nt, Homo sapiens
uauuuugcauaguaccaaucau

SEQ ID NO: 1044210 - RNA, 12 nt, Homo sapiens
uauuuugcccag

SEQ ID NO: 1044211 - RNA, 13 nt, Homo sapiens
uauuuugguucuu

SEQ ID NO: 1044212 - RNA, 23 nt, Homo sapiens
uauuuuugcccugaguccaagag

SEQ ID NO: 1044213 - RNA, 13 nt, Homo sapiens
ucaaaaacauucu

SEQ ID NO: 1044214 - RNA, 20 nt, Homo sapiens
ucaaaaauacucacauggcu

SEQ ID NO: 1044215 - RNA, 14 nt, Homo sapiens
ucaaaacucaguau

SEQ ID NO: 1044216 - RNA, 15 nt, Homo sapiens
ucaaaagcacuuugu

SEQ ID NO: 1044217 - RNA, 18 nt, Homo sapiens
ucaaaauaaaaagugaca

SEQ ID NO: 1044218 - RNA, 22 nt, Homo sapiens
ucaaaauaccaugccauuuaaa

SEQ ID NO: 1044219 - RNA, 16 nt, Homo sapiens
ucaaaauauacauuca

SEQ ID NO: 1044220 - RNA, 17 nt, Homo sapiens
ucaaaauauacauucaa

SEQ ID NO: 1044221 - RNA, 23 nt, Homo sapiens
ucaaacaugaaguguguuuccuu

SEQ ID NO: 1044222 - RNA, 19 nt, Homo sapiens
ucaaaccaaaucacugaac

SEQ ID NO: 1044223 - RNA, 18 nt, Homo sapiens
ucaaaccccgaccaccug

SEQ ID NO: 1044224 - RNA, 12 nt, Homo sapiens
ucaaaccuacca

SEQ ID NO: 1044225 - RNA, 14 nt, Homo sapiens
ucaaaccuacuaau

SEQ ID NO: 1044226 - RNA, 22 nt, Homo sapiens
ucaaacgugaaaaugcuguauu

SEQ ID NO: 1044227 - RNA, 14 nt, Homo sapiens
ucaaacuacuggca

SEQ ID NO: 1044228 - RNA, 21 nt, Homo sapiens
ucaaacugcaugauucaugcc

SEQ ID NO: 1044229 - RNA, 20 nt, Homo sapiens
ucaaagauauuuugcuuugu

SEQ ID NO: 1044230 - RNA, 13 nt, Homo sapiens
ucaaagauucaaa

SEQ ID NO: 1044231 - RNA, 15 nt, Homo sapiens
ucaaagcaaguuuca

SEQ ID NO: 1044232 - RNA, 15 nt, Homo sapiens
ucaaagcacacguca

SEQ ID NO: 1044233 - RNA, 21 nt, Homo sapiens
ucaaagcuaaauuccacacua

SEQ ID NO: 1044234 - RNA, 23 nt, Homo sapiens
ucaaagcucuauuaagauuucca

SEQ ID NO: 1044235 - RNA, 20 nt, Homo sapiens
ucaaaggugauugugccagg

SEQ ID NO: 1044236 - RNA, 15 nt, Homo sapiens
ucaaauaaacauguc

SEQ ID NO: 1044237 - RNA, 14 nt, Homo sapiens
ucaaauaacuaaaa

SEQ ID NO: 1044238 - RNA, 20 nt, Homo sapiens
ucaaauagaaccacuaugaa

SEQ ID NO: 1044239 - RNA, 17 nt, Homo sapiens
ucaaauauuagauguga

SEQ ID NO: 1044240 - RNA, 16 nt, Homo sapiens
ucaaaugacccaaaga

SEQ ID NO: 1044241 - RNA, 23 nt, Homo sapiens
ucaaaugcucagaccagcucuuc

SEQ ID NO: 1044242 - RNA, 16 nt, Homo sapiens
ucaaauguauucagau

SEQ ID NO: 1044243 - RNA, 18 nt, Homo sapiens
ucaaaugugacauuauau

SEQ ID NO: 1044244 - RNA, 13 nt, Homo sapiens
ucaaaugugcugu

SEQ ID NO: 1044245 - RNA, 19 nt, Homo sapiens
ucaaauuacuuugugaaua

SEQ ID NO: 1044246 - RNA, 22 nt, Homo sapiens
ucaaauuucuguucucucuucc

SEQ ID NO: 1044247 - RNA, 23 nt, Homo sapiens
ucaaauuuugaugccaagaaagu

SEQ ID NO: 1044248 - RNA, 13 nt, Homo sapiens
ucaacacuguuac

SEQ ID NO: 1044249 - RNA, 16 nt, Homo sapiens
ucaacagcuaugcugg

SEQ ID NO: 1044250 - RNA, 19 nt, Homo sapiens
ucaacaucuuuuacauucu

SEQ ID NO: 1044251 - RNA, 18 nt, Homo sapiens
ucaacauuuacauguauu

SEQ ID NO: 1044252 - RNA, 18 nt, Homo sapiens
ucaaccccccaagucaua

SEQ ID NO: 1044253 - RNA, 16 nt, Homo sapiens
ucaacccccuaccccg

SEQ ID NO: 1044254 - RNA, 23 nt, Homo sapiens
ucaacgcuuaaaggugucuuccu

SEQ ID NO: 1044255 - RNA, 17 nt, Homo sapiens
ucaacucucuuuguaaa

SEQ ID NO: 1044256 - RNA, 17 nt, Homo sapiens
ucaacugaaugagguca

SEQ ID NO: 1044257 - RNA, 11 nt, Homo sapiens
ucaacugccua

SEQ ID NO: 1044258 - RNA, 19 nt, Homo sapiens
ucaacuucagagacuaucu

SEQ ID NO: 1044259 - RNA, 14 nt, Homo sapiens
ucaagaaaauggau

SEQ ID NO: 1044260 - RNA, 15 nt, Homo sapiens
ucaagaaacugagga

SEQ ID NO: 1044261 - RNA, 13 nt, Homo sapiens
ucaagacauuaaa

SEQ ID NO: 1044262 - RNA, 20 nt, Homo sapiens
ucaagacccuuuucuguaug

SEQ ID NO: 1044263 - RNA, 19 nt, Homo sapiens
ucaagccaguacgugcuaa

SEQ ID NO: 1044264 - RNA, 22 nt, Homo sapiens
ucaagcgauucuucugccucag

SEQ ID NO: 1044265 - RNA, 17 nt, Homo sapiens
ucaagcuagaaggccac

SEQ ID NO: 1044266 - RNA, 18 nt, Homo sapiens
ucaaggaauaaugggcuu

SEQ ID NO: 1044267 - RNA, 15 nt, Homo sapiens
ucaaggcaucaugca

SEQ ID NO: 1044268 - RNA, 15 nt, Homo sapiens
ucaaggcugcaguga

SEQ ID NO: 1044269 - RNA, 16 nt, Homo sapiens
ucaaggcugcagugag

SEQ ID NO: 1044270 - RNA, 18 nt, Homo sapiens
ucaaggcugcagugagcc

SEQ ID NO: 1044271 - RNA, 21 nt, Homo sapiens
ucaagggaauguaacugcuga

SEQ ID NO: 1044272 - RNA, 21 nt, Homo sapiens
ucaaguaauccaccugccucg

SEQ ID NO: 1044273 - RNA, 19 nt, Homo sapiens
ucaaguacuguaacugugu

SEQ ID NO: 1044274 - RNA, 20 nt, Homo sapiens
ucaaguaguguaucacagua

SEQ ID NO: 1044275 - RNA, 21 nt, Homo sapiens
ucaaguauuuuugacauuuac

SEQ ID NO: 1044276 - RNA, 19 nt, Homo sapiens
ucaagugggaucugucaca

SEQ ID NO: 1044277 - RNA, 22 nt, Homo sapiens
ucaaguuggcuucuaaucaaag

SEQ ID NO: 1044278 - RNA, 16 nt, Homo sapiens
ucaaguugugcuuguu

SEQ ID NO: 1044279 - RNA, 16 nt, Homo sapiens
ucaauaaaaugugauu

SEQ ID NO: 1044280 - RNA, 17 nt, Homo sapiens
ucaauaauauuagcuua

SEQ ID NO: 1044281 - RNA, 21 nt, Homo sapiens
ucaauaucugaaucaccuuga

SEQ ID NO: 1044282 - RNA, 19 nt, Homo sapiens
ucaaucaaaacucaguauc

SEQ ID NO: 1044283 - RNA, 15 nt, Homo sapiens
ucaaucacguguaua

SEQ ID NO: 1044284 - RNA, 13 nt, Homo sapiens
ucaauccaagagu

SEQ ID NO: 1044285 - RNA, 12 nt, Homo sapiens
ucaauccagcua

SEQ ID NO: 1044286 - RNA, 18 nt, Homo sapiens
ucaaucccagcuacucaa

SEQ ID NO: 1044287 - RNA, 23 nt, Homo sapiens
ucaaugaaaaaaaguacauguau

SEQ ID NO: 1044288 - RNA, 20 nt, Homo sapiens
ucaaugaaguagcugagaaa

SEQ ID NO: 1044289 - RNA, 20 nt, Homo sapiens
ucaaugauuuacucaauauc

SEQ ID NO: 1044290 - RNA, 22 nt, Homo sapiens
ucaaugcuauaacuauguugau

SEQ ID NO: 1044291 - RNA, 16 nt, Homo sapiens
ucaauggaaagcugcu

SEQ ID NO: 1044292 - RNA, 14 nt, Homo sapiens
ucaauggauuugau

SEQ ID NO: 1044293 - RNA, 13 nt, Homo sapiens
ucaaugugcagug

SEQ ID NO: 1044294 - RNA, 17 nt, Homo sapiens
ucaauguucauuguaau

SEQ ID NO: 1044295 - RNA, 23 nt, Homo sapiens
ucacaaaucuuaacuugaaggag

SEQ ID NO: 1044296 - RNA, 23 nt, Homo sapiens
ucacaaaugaucgcuaucuagca

SEQ ID NO: 1044297 - RNA, 21 nt, Homo sapiens
ucacaaauuugucuugccuua

SEQ ID NO: 1044298 - RNA, 23 nt, Homo sapiens
ucacaacagauuauuaccuuaca

SEQ ID NO: 1044299 - RNA, 17 nt, Homo sapiens
ucacaacauuuacuuaa

SEQ ID NO: 1044300 - RNA, 13 nt, Homo sapiens
uuuaugaguacuu

SEQ ID NO: 1044301 - RNA, 13 nt, Homo sapiens
uuuaugcuuuaaa

SEQ ID NO: 1044302 - RNA, 22 nt, Homo sapiens
uuuauggaaaaugucaggccuu

SEQ ID NO: 1044303 - RNA, 17 nt, Homo sapiens
uuuauggcucacuauga

SEQ ID NO: 1044304 - RNA, 21 nt, Homo sapiens
uuuauuacaguuuaucuaugg

SEQ ID NO: 1044305 - RNA, 14 nt, Homo sapiens
uuuauuccauauuc

SEQ ID NO: 1044306 - RNA, 13 nt, Homo sapiens
uuuauugccauga

SEQ ID NO: 1044307 - RNA, 15 nt, Homo sapiens
uuuauuugagacaga

SEQ ID NO: 1044308 - RNA, 16 nt, Homo sapiens
uuuauuugagacagag

SEQ ID NO: 1044309 - RNA, 12 nt, Homo sapiens
uuucaaaacaca

SEQ ID NO: 1044310 - RNA, 23 nt, Homo sapiens
uuucaagacauuaaaucuaugaa

SEQ ID NO: 1044311 - RNA, 23 nt, Homo sapiens
uuucaagaccuucuccccauucu

SEQ ID NO: 1044312 - RNA, 18 nt, Homo sapiens
uuucacacacgugagaau

SEQ ID NO: 1044313 - RNA, 21 nt, Homo sapiens
uuucaccuguuuuuaagcugu

SEQ ID NO: 1044314 - RNA, 23 nt, Homo sapiens
uuucacggggccgugacagugac

SEQ ID NO: 1044315 - RNA, 20 nt, Homo sapiens
uuucacuuuuggcuuguaaa

SEQ ID NO: 1044316 - RNA, 21 nt, Homo sapiens
uuucagaucauauuucacaau

SEQ ID NO: 1044317 - RNA, 18 nt, Homo sapiens
uuucagcuguuucaccau

SEQ ID NO: 1044318 - RNA, 19 nt, Homo sapiens
uuucauaaacuucagggau

SEQ ID NO: 1044319 - RNA, 20 nt, Homo sapiens
uuucauaaacuucagggauc

SEQ ID NO: 1044320 - RNA, 18 nt, Homo sapiens
uuucauaaccuagccuua

SEQ ID NO: 1044321 - RNA, 17 nt, Homo sapiens
uuucauauguugcucag

SEQ ID NO: 1044322 - RNA, 14 nt, Homo sapiens
uuucaucagucaau

SEQ ID NO: 1044323 - RNA, 19 nt, Homo sapiens
uuucauccugacucugccc

SEQ ID NO: 1044324 - RNA, 20 nt, Homo sapiens
uuucaugcuauuucacucua

SEQ ID NO: 1044325 - RNA, 15 nt, Homo sapiens
uuucauuuacugugg

SEQ ID NO: 1044326 - RNA, 13 nt, Homo sapiens
uuucauuugccua

SEQ ID NO: 1044327 - RNA, 16 nt, Homo sapiens
uuucauuugccuauuc

SEQ ID NO: 1044328 - RNA, 15 nt, Homo sapiens
uuuccaaauucacaa

SEQ ID NO: 1044329 - RNA, 16 nt, Homo sapiens
uuuccaauugaacuuu

SEQ ID NO: 1044330 - RNA, 15 nt, Homo sapiens
uuuccacuacugcua

SEQ ID NO: 1044331 - RNA, 15 nt, Homo sapiens
uuuccagauauucaa

SEQ ID NO: 1044332 - RNA, 21 nt, Homo sapiens
uuuccauaaucacucagugau

SEQ ID NO: 1044333 - RNA, 17 nt, Homo sapiens
uuuccauuuaguaacag

SEQ ID NO: 1044334 - RNA, 18 nt, Homo sapiens
uuuccccaccccagcuca

SEQ ID NO: 1044335 - RNA, 23 nt, Homo sapiens
uuuccccaccccagcucaugccc

SEQ ID NO: 1044336 - RNA, 19 nt, Homo sapiens
uuucccuucuuacaaugca

SEQ ID NO: 1044337 - RNA, 13 nt, Homo sapiens
uuuccugccuucu

SEQ ID NO: 1044338 - RNA, 24 nt, Homo sapiens
uuuccuggcacugcuuccagugag

SEQ ID NO: 1044339 - RNA, 21 nt, Homo sapiens
uuuccuuguccccacacuccu

SEQ ID NO: 1044340 - RNA, 20 nt, Homo sapiens
uuuccuuuuuuaaaaaugca

SEQ ID NO: 1044341 - RNA, 13 nt, Homo sapiens
uuucgaacauucu

SEQ ID NO: 1044342 - RNA, 20 nt, Homo sapiens
uuucgagaagcugcucugga

SEQ ID NO: 1044343 - RNA, 22 nt, Homo sapiens
uuucgcaccuaccaucagggac

SEQ ID NO: 1044344 - RNA, 14 nt, Homo sapiens
uuucuacacugagg

SEQ ID NO: 1044345 - RNA, 20 nt, Homo sapiens
uuucuacucuuaaguuucuc

SEQ ID NO: 1044346 - RNA, 14 nt, Homo sapiens
uuucuaugugacaa

SEQ ID NO: 1044347 - RNA, 14 nt, Homo sapiens
uuucucagcuccca

SEQ ID NO: 1044348 - RNA, 21 nt, Homo sapiens
uuucucagcucccaaggcucu

SEQ ID NO: 1044349 - RNA, 14 nt, Homo sapiens
uuucucccaggaag

SEQ ID NO: 1044350 - RNA, 15 nt, Homo sapiens
uuucuccuuagucuu

SEQ ID NO: 1044351 - RNA, 16 nt, Homo sapiens
uuucucuaaaacugcc

SEQ ID NO: 1044352 - RNA, 17 nt, Homo sapiens
uuucucuagggagaaaa

SEQ ID NO: 1044353 - RNA, 19 nt, Homo sapiens
uuucucuguaaacuuccaa

SEQ ID NO: 1044354 - RNA, 14 nt, Homo sapiens
uuucucuuaugcuu

SEQ ID NO: 1044355 - RNA, 22 nt, Homo sapiens
uuucugagaaagacuauucaaa

SEQ ID NO: 1044356 - RNA, 17 nt, Homo sapiens
uuucuggcagccaguac

SEQ ID NO: 1044357 - RNA, 15 nt, Homo sapiens
uuucuggcucuccca

SEQ ID NO: 1044358 - RNA, 22 nt, Homo sapiens
uuucugucacaucagcuccacu

SEQ ID NO: 1044359 - RNA, 13 nt, Homo sapiens
uuucuuaaaaagu

SEQ ID NO: 1044360 - RNA, 18 nt, Homo sapiens
uuucuuaaaacauuauga

SEQ ID NO: 1044361 - RNA, 21 nt, Homo sapiens
uuucuuccaaagcacauugaa

SEQ ID NO: 1044362 - RNA, 23 nt, Homo sapiens
uuucuucccgaaccccaaggagg

SEQ ID NO: 1044363 - RNA, 13 nt, Homo sapiens
uuucuuucugcca

SEQ ID NO: 1044364 - RNA, 16 nt, Homo sapiens
uuucuuuuaucacgau

SEQ ID NO: 1044365 - RNA, 14 nt, Homo sapiens
uuucuuuucacaua

SEQ ID NO: 1044366 - RNA, 15 nt, Homo sapiens
uuucuuuuccauuua

SEQ ID NO: 1044367 - RNA, 15 nt, Homo sapiens
uuugaaacugaaugu

SEQ ID NO: 1044368 - RNA, 17 nt, Homo sapiens
uuugaaacugaauguuu

SEQ ID NO: 1044369 - RNA, 24 nt, Homo sapiens
uuugaaauaauaaaucugguagaa

SEQ ID NO: 1044370 - RNA, 20 nt, Homo sapiens
uuugaaauagucugugugaa

SEQ ID NO: 1044371 - RNA, 14 nt, Homo sapiens
uuugaaaucuauga

SEQ ID NO: 1044372 - RNA, 19 nt, Homo sapiens
uuugaacccuugcuugcaa

SEQ ID NO: 1044373 - RNA, 16 nt, Homo sapiens
uuugaaucacaguaua

SEQ ID NO: 1044374 - RNA, 23 nt, Homo sapiens
uuugaauuucaguaaacaaugaa

SEQ ID NO: 1044375 - RNA, 14 nt, Homo sapiens
uuugacaaccauga

SEQ ID NO: 1044376 - RNA, 22 nt, Homo sapiens
uuugacgacagugcauuugccu

SEQ ID NO: 1044377 - RNA, 18 nt, Homo sapiens
uuugacucuugcaaucca

SEQ ID NO: 1044378 - RNA, 13 nt, Homo sapiens
uuugagaauguuu

SEQ ID NO: 1044379 - RNA, 14 nt, Homo sapiens
uuugagacuuagaa

SEQ ID NO: 1044380 - RNA, 17 nt, Homo sapiens
uuugagagaaauaugaa

SEQ ID NO: 1044381 - RNA, 22 nt, Homo sapiens
uuugagauggacacacuggugu

SEQ ID NO: 1044382 - RNA, 22 nt, Homo sapiens
uuugaggauauauuuucacuuu

SEQ ID NO: 1044383 - RNA, 13 nt, Homo sapiens
uuugagugauccu

SEQ ID NO: 1044384 - RNA, 20 nt, Homo sapiens
uuugauacucccagucuugu

SEQ ID NO: 1044385 - RNA, 20 nt, Homo sapiens
uuugauaguugguguucaaa

SEQ ID NO: 1044386 - RNA, 12 nt, Homo sapiens
uuugaugcauua

SEQ ID NO: 1044387 - RNA, 14 nt, Homo sapiens
uuugauucagacag

SEQ ID NO: 1044388 - RNA, 21 nt, Homo sapiens
uuugcaaaauuuccaguaccu

SEQ ID NO: 1044389 - RNA, 13 nt, Homo sapiens
uuugcaagacaua

SEQ ID NO: 1044390 - RNA, 20 nt, Homo sapiens
uuugcaagggaaaagucucu

SEQ ID NO: 1044391 - RNA, 16 nt, Homo sapiens
uuugcaagucauggcu

SEQ ID NO: 1044392 - RNA, 21 nt, Homo sapiens
uuugcaauggcuauauggcaa

SEQ ID NO: 1044393 - RNA, 18 nt, Homo sapiens
uuugcacacuugugugug

SEQ ID NO: 1044394 - RNA, 20 nt, Homo sapiens
uuugcaggcaugcaugugcu

SEQ ID NO: 1044395 - RNA, 19 nt, Homo sapiens
uuugcauaagugcaugaca

SEQ ID NO: 1044396 - RNA, 11 nt, Homo sapiens
uuugcauuugc

SEQ ID NO: 1044397 - RNA, 19 nt, Homo sapiens
uuugccacccucaugcugu

SEQ ID NO: 1044398 - RNA, 20 nt, Homo sapiens
uuugcccaguguuugugcaa

SEQ ID NO: 1044399 - RNA, 18 nt, Homo sapiens
uuugcccuuuuuaaggaa

SEQ ID NO: 1044400 - RNA, 15 nt, Homo sapiens
uuugcuagcagaaau

SEQ ID NO: 1044401 - RNA, 12 nt, Homo sapiens
uuugcucaacau

SEQ ID NO: 1044402 - RNA, 13 nt, Homo sapiens
uuugcucauggca

SEQ ID NO: 1044403 - RNA, 23 nt, Homo sapiens
uuugcuggggaacuggcgccauc

SEQ ID NO: 1044404 - RNA, 17 nt, Homo sapiens
uuugcuguaaacuugua

SEQ ID NO: 1044405 - RNA, 21 nt, Homo sapiens
uuugcuguaaacuuguagcau

SEQ ID NO: 1044406 - RNA, 17 nt, Homo sapiens
uuugcuguugcauugua

SEQ ID NO: 1044407 - RNA, 21 nt, Homo sapiens
uuugcuguuguuucuaaacaa

SEQ ID NO: 1044408 - RNA, 12 nt, Homo sapiens
uuugcuugccuc

SEQ ID NO: 1044409 - RNA, 22 nt, Homo sapiens
uuuggaaaucacacgucuggcu

SEQ ID NO: 1044410 - RNA, 14 nt, Homo sapiens
uuuggaauuauguc

SEQ ID NO: 1044411 - RNA, 18 nt, Homo sapiens
uuuggaauuaugucugcu

SEQ ID NO: 1044412 - RNA, 19 nt, Homo sapiens
uuuggaguccccucaccuc

SEQ ID NO: 1044413 - RNA, 23 nt, Homo sapiens
uuuggccuaacccucagaaacac

SEQ ID NO: 1044414 - RNA, 15 nt, Homo sapiens
uuuggccuccuccag

SEQ ID NO: 1044415 - RNA, 21 nt, Homo sapiens
uuuggcucuucuaaucagagc

SEQ ID NO: 1044416 - RNA, 22 nt, Homo sapiens
uuuggcugccuuuggaagucca

SEQ ID NO: 1044417 - RNA, 15 nt, Homo sapiens
uuuggcuugugggcu

SEQ ID NO: 1044418 - RNA, 20 nt, Homo sapiens
uuugggaacugcaauaaccu

SEQ ID NO: 1044419 - RNA, 21 nt, Homo sapiens
uuugguuugcagaugacaaaa

SEQ ID NO: 1044420 - RNA, 22 nt, Homo sapiens
uuugguuuguugagccuaauau

SEQ ID NO: 1044421 - RNA, 15 nt, Homo sapiens
uuuguaagaugcugg

SEQ ID NO: 1044422 - RNA, 16 nt, Homo sapiens
uuuguaauauggaaug

SEQ ID NO: 1044423 - RNA, 14 nt, Homo sapiens
uuuguaauugcuua

SEQ ID NO: 1044424 - RNA, 22 nt, Homo sapiens
uuugucccggggcuccacugaa

SEQ ID NO: 1044425 - RNA, 15 nt, Homo sapiens
uuugucuuauauaua

SEQ ID NO: 1044426 - RNA, 13 nt, Homo sapiens
uuugucuugaaug

SEQ ID NO: 1044427 - RNA, 15 nt, Homo sapiens
uuugugcagcacagu

SEQ ID NO: 1044428 - RNA, 19 nt, Homo sapiens
uuuguguaucguaaccagc

SEQ ID NO: 1044429 - RNA, 21 nt, Homo sapiens
uuuguguaucguaaccagcca

SEQ ID NO: 1044430 - RNA, 14 nt, Homo sapiens
uuugugugugugca

SEQ ID NO: 1044431 - RNA, 16 nt, Homo sapiens
uuugugugugugcaag

SEQ ID NO: 1044432 - RNA, 19 nt, Homo sapiens
uuugugugugugcaagugu

SEQ ID NO: 1044433 - RNA, 17 nt, Homo sapiens
uuuguugagccuaauau

SEQ ID NO: 1044434 - RNA, 12 nt, Homo sapiens
uuuguuguaaaa

SEQ ID NO: 1044435 - RNA, 22 nt, Homo sapiens
uuuguuuugauguuuguggccu

SEQ ID NO: 1044436 - RNA, 21 nt, Homo sapiens
uuuuaaaaaaaucccauuuaa

SEQ ID NO: 1044437 - RNA, 21 nt, Homo sapiens
uuuuaagaaaaaggaugcaca

SEQ ID NO: 1044438 - RNA, 20 nt, Homo sapiens
uuuuaaggcuaaaacuuaac

SEQ ID NO: 1044439 - RNA, 15 nt, Homo sapiens
uuuuaaguaauuuca

SEQ ID NO: 1044440 - RNA, 22 nt, Homo sapiens
uuuuaauuuaaucuuccaugga

SEQ ID NO: 1044441 - RNA, 23 nt, Homo sapiens
uuuuacaauaaaacuuugcugcc

SEQ ID NO: 1044442 - RNA, 20 nt, Homo sapiens
uuuuacuccccuugagcuga

SEQ ID NO: 1044443 - RNA, 11 nt, Homo sapiens
uuuuagcucau

SEQ ID NO: 1044444 - RNA, 18 nt, Homo sapiens
aaaaacuaacacccaguc

SEQ ID NO: 1044445 - RNA, 21 nt, Homo sapiens
aaaaagggauccguacauuca

SEQ ID NO: 1044446 - RNA, 23 nt, Homo sapiens
aaaaaguccuugauuuagcacua

SEQ ID NO: 1044447 - RNA, 11 nt, Homo sapiens
aaaaauacuug

SEQ ID NO: 1044448 - RNA, 15 nt, Homo sapiens
aaaaaucccuuaccu

SEQ ID NO: 1044449 - RNA, 15 nt, Homo sapiens
aaaaauccuacaagg

SEQ ID NO: 1044450 - RNA, 21 nt, Homo sapiens
aaaaaucugaaaaugugaaua

SEQ ID NO: 1044451 - RNA, 23 nt, Homo sapiens
aaaaauggauacuggugcaguca

SEQ ID NO: 1044452 - RNA, 14 nt, Homo sapiens
aaaaauguaucaaa

SEQ ID NO: 1044453 - RNA, 21 nt, Homo sapiens
aaaaauuagagugcauuacuu

SEQ ID NO: 1044454 - RNA, 16 nt, Homo sapiens
aaaacaaaaacaccua

SEQ ID NO: 1044455 - RNA, 16 nt, Homo sapiens
aaaacaagcauucaca

SEQ ID NO: 1044456 - RNA, 13 nt, Homo sapiens
aaaacaagccaug

SEQ ID NO: 1044457 - RNA, 16 nt, Homo sapiens
aaaacaccuagcuuua

SEQ ID NO: 1044458 - RNA, 14 nt, Homo sapiens
aaaacacugugcac

SEQ ID NO: 1044459 - RNA, 18 nt, Homo sapiens
aaaacagagaugugauaa

SEQ ID NO: 1044460 - RNA, 13 nt, Homo sapiens
aaaacaucacuga

SEQ ID NO: 1044461 - RNA, 11 nt, Homo sapiens
aaaacauguaa

SEQ ID NO: 1044462 - RNA, 11 nt, Homo sapiens
aaaacauucca

SEQ ID NO: 1044463 - RNA, 12 nt, Homo sapiens
aaaacauuccau

SEQ ID NO: 1044464 - RNA, 18 nt, Homo sapiens
aaaaccacagcaguugaa

SEQ ID NO: 1044465 - RNA, 18 nt, Homo sapiens
aaaaccauuuuuuccuac

SEQ ID NO: 1044466 - RNA, 19 nt, Homo sapiens
aaaacccacaaaaguacaa

SEQ ID NO: 1044467 - RNA, 14 nt, Homo sapiens
aaaaccccaucucu

SEQ ID NO: 1044468 - RNA, 13 nt, Homo sapiens
aaaaccuucccca

SEQ ID NO: 1044469 - RNA, 18 nt, Homo sapiens
aaaacgguggaggccagg

SEQ ID NO: 1044470 - RNA, 17 nt, Homo sapiens
aaaacguuuuauugugu

SEQ ID NO: 1044471 - RNA, 13 nt, Homo sapiens
aaaacuaauuucc

SEQ ID NO: 1044472 - RNA, 15 nt, Homo sapiens
aaaacuacaagccac

SEQ ID NO: 1044473 - RNA, 16 nt, Homo sapiens
aaaacuacaagccacg

SEQ ID NO: 1044474 - RNA, 17 nt, Homo sapiens
aaaacucaguaucauaa

SEQ ID NO: 1044475 - RNA, 21 nt, Homo sapiens
aaaacucgaggacuguauuug

SEQ ID NO: 1044476 - RNA, 11 nt, Homo sapiens
aaaacucuccu

SEQ ID NO: 1044477 - RNA, 23 nt, Homo sapiens
aaaacugaaagugaaaguccaga

SEQ ID NO: 1044478 - RNA, 19 nt, Homo sapiens
aaaacugacaguaaaucuc

SEQ ID NO: 1044479 - RNA, 11 nt, Homo sapiens
aaaacugacuc

SEQ ID NO: 1044480 - RNA, 14 nt, Homo sapiens
aaaacuuaacauuc

SEQ ID NO: 1044481 - RNA, 16 nt, Homo sapiens
aaaacuucaguaagua

SEQ ID NO: 1044482 - RNA, 14 nt, Homo sapiens
aaaagacugaccaa

SEQ ID NO: 1044483 - RNA, 11 nt, Homo sapiens
aaaagcacuua

SEQ ID NO: 1044484 - RNA, 17 nt, Homo sapiens
aaaagcccauucauucc

SEQ ID NO: 1044485 - RNA, 18 nt, Homo sapiens
aaaagcccauucauucca

SEQ ID NO: 1044486 - RNA, 19 nt, Homo sapiens
aaaagcccauucauuccau

SEQ ID NO: 1044487 - RNA, 16 nt, Homo sapiens
aaaagccuuuuccaga

SEQ ID NO: 1044488 - RNA, 16 nt, Homo sapiens
aaaaggauaugcagua

SEQ ID NO: 1044489 - RNA, 18 nt, Homo sapiens
aaaagggaaguugugccu

SEQ ID NO: 1044490 - RNA, 20 nt, Homo sapiens
aaaagggcagggcaucuccu

SEQ ID NO: 1044491 - RNA, 16 nt, Homo sapiens
aaaagguaacuguaca

SEQ ID NO: 1044492 - RNA, 21 nt, Homo sapiens
aaaagguaccccgauggccaa

SEQ ID NO: 1044493 - RNA, 20 nt, Homo sapiens
aaaaggucauagcugagauu

SEQ ID NO: 1044494 - RNA, 18 nt, Homo sapiens
aaaaguauccugcuucug

SEQ ID NO: 1044495 - RNA, 14 nt, Homo sapiens
aaaagucacucuga

SEQ ID NO: 1044496 - RNA, 19 nt, Homo sapiens
aaaaguccuugauuuagca

SEQ ID NO: 1044497 - RNA, 13 nt, Homo sapiens
aaaagucuucacu

SEQ ID NO: 1044498 - RNA, 19 nt, Homo sapiens
aaaaguuacuaccugucaa

SEQ ID NO: 1044499 - RNA, 13 nt, Homo sapiens
aaaaguuacuuau

SEQ ID NO: 1044500 - RNA, 16 nt, Homo sapiens
aaaaguugcauguuau

SEQ ID NO: 1044501 - RNA, 13 nt, Homo sapiens
aaaauacaugaca

SEQ ID NO: 1044502 - RNA, 16 nt, Homo sapiens
aaaauagaaacuugcu

SEQ ID NO: 1044503 - RNA, 18 nt, Homo sapiens
aaaauagagccugaggga

SEQ ID NO: 1044504 - RNA, 22 nt, Homo sapiens
aaaauaguuuggauuacuuaaa

SEQ ID NO: 1044505 - RNA, 15 nt, Homo sapiens
aaaauauacauucaa

SEQ ID NO: 1044506 - RNA, 23 nt, Homo sapiens
aaaauauaccuucagagacuguc

SEQ ID NO: 1044507 - RNA, 22 nt, Homo sapiens
aaaauauuuuuaugugcaauaa

SEQ ID NO: 1044508 - RNA, 15 nt, Homo sapiens
aaaaucauuucugca

SEQ ID NO: 1044509 - RNA, 16 nt, Homo sapiens
aaaaugaaucuucaca

SEQ ID NO: 1044510 - RNA, 21 nt, Homo sapiens
aaaaugaaucuucacaaaaca

SEQ ID NO: 1044511 - RNA, 15 nt, Homo sapiens
aaaaugcaacaacau

SEQ ID NO: 1044512 - RNA, 11 nt, Homo sapiens
aaaaugccaag

SEQ ID NO: 1044513 - RNA, 12 nt, Homo sapiens
aaaaugccuuug

SEQ ID NO: 1044514 - RNA, 19 nt, Homo sapiens
aaaauguaugaccacuggg

SEQ ID NO: 1044515 - RNA, 19 nt, Homo sapiens
aaaaugucauuguucuccc

SEQ ID NO: 1044516 - RNA, 23 nt, Homo sapiens
aaaaugucauuguucuugugaac

SEQ ID NO: 1044517 - RNA, 19 nt, Homo sapiens
aaaauguccaugauggaau

SEQ ID NO: 1044518 - RNA, 20 nt, Homo sapiens
aaaaugucuguuaacuuaau

SEQ ID NO: 1044519 - RNA, 13 nt, Homo sapiens
aaaaugugcaaua

SEQ ID NO: 1044520 - RNA, 23 nt, Homo sapiens
aaaauuagagugcauuacuuuga

SEQ ID NO: 1044521 - RNA, 14 nt, Homo sapiens
aaaauuaugccaua

SEQ ID NO: 1044522 - RNA, 19 nt, Homo sapiens
aaaauuauguuugccacuu

SEQ ID NO: 1044523 - RNA, 17 nt, Homo sapiens
aaaauuccuauugugau

SEQ ID NO: 1044524 - RNA, 20 nt, Homo sapiens
aaaauucuauuacaguaugu

SEQ ID NO: 1044525 - RNA, 17 nt, Homo sapiens
aaaauucuuaaguaugu

SEQ ID NO: 1044526 - RNA, 17 nt, Homo sapiens
aaaauugugaucagacc

SEQ ID NO: 1044527 - RNA, 20 nt, Homo sapiens
aaaauuuaaaggguguacuu

SEQ ID NO: 1044528 - RNA, 22 nt, Homo sapiens
aaacaaaaaaaccucuaugcaa

SEQ ID NO: 1044529 - RNA, 13 nt, Homo sapiens
aaacaaagccaga

SEQ ID NO: 1044530 - RNA, 15 nt, Homo sapiens
aaacaaauucaucaa

SEQ ID NO: 1044531 - RNA, 12 nt, Homo sapiens
aaacaacagcuu

SEQ ID NO: 1044532 - RNA, 12 nt, Homo sapiens
aaacaacucuuu

SEQ ID NO: 1044533 - RNA, 15 nt, Homo sapiens
aaacaagugcuggca

SEQ ID NO: 1044534 - RNA, 17 nt, Homo sapiens
aaacaaugaagacaauu

SEQ ID NO: 1044535 - RNA, 19 nt, Homo sapiens
aaacacagacauucugcca

SEQ ID NO: 1044536 - RNA, 22 nt, Homo sapiens
aaacacaucuggccuaauguuc

SEQ ID NO: 1044537 - RNA, 14 nt, Homo sapiens
aaacaccuccucau

SEQ ID NO: 1044538 - RNA, 21 nt, Homo sapiens
aaacagugaguuaaagcagug

SEQ ID NO: 1044539 - RNA, 13 nt, Homo sapiens
aaacauauacaaa

SEQ ID NO: 1044540 - RNA, 13 nt, Homo sapiens
aaacaucuggaag

SEQ ID NO: 1044541 - RNA, 19 nt, Homo sapiens
aaacaugaccuuccacaau

SEQ ID NO: 1044542 - RNA, 17 nt, Homo sapiens
aaacaugauuguuuaca

SEQ ID NO: 1044543 - RNA, 16 nt, Homo sapiens
aaacaugcacuuccuu

SEQ ID NO: 1044544 - RNA, 23 nt, Homo sapiens
aaacaugggguuggcugggccca

SEQ ID NO: 1044545 - RNA, 18 nt, Homo sapiens
aaacauguaauauaaaga

SEQ ID NO: 1044546 - RNA, 23 nt, Homo sapiens
aaacaugugguuaaugccaugga

SEQ ID NO: 1044547 - RNA, 15 nt, Homo sapiens
aaacauguucacuua

SEQ ID NO: 1044548 - RNA, 23 nt, Homo sapiens
aaacauguuccuuauauuuacuc

SEQ ID NO: 1044549 - RNA, 18 nt, Homo sapiens
aaacauguuugcacuugu

SEQ ID NO: 1044550 - RNA, 16 nt, Homo sapiens
aaacauuccauccuug

SEQ ID NO: 1044551 - RNA, 11 nt, Homo sapiens
aaacauucucu

SEQ ID NO: 1044552 - RNA, 21 nt, Homo sapiens
aaacauugaaguaaugaauuu

SEQ ID NO: 1044553 - RNA, 21 nt, Homo sapiens
aaacauuuaacuuguuuccaa

SEQ ID NO: 1044554 - RNA, 11 nt, Homo sapiens
aaaccaaagcc

SEQ ID NO: 1044555 - RNA, 21 nt, Homo sapiens
aaaccaaaguaaccuuuugca

SEQ ID NO: 1044556 - RNA, 16 nt, Homo sapiens
aaaccaaauauuccag

SEQ ID NO: 1044557 - RNA, 21 nt, Homo sapiens
aaaccaaccgcacaugcagau

SEQ ID NO: 1044558 - RNA, 16 nt, Homo sapiens
aaaccaauagcuuuaa

SEQ ID NO: 1044559 - RNA, 14 nt, Homo sapiens
aaaccagagucaaa

SEQ ID NO: 1044560 - RNA, 11 nt, Homo sapiens
aaaccaucaca

SEQ ID NO: 1044561 - RNA, 22 nt, Homo sapiens
aaaccaucauaguacagguaag

SEQ ID NO: 1044562 - RNA, 22 nt, Homo sapiens
aaacccaguaguggugacugug

SEQ ID NO: 1044563 - RNA, 13 nt, Homo sapiens
aaaccccaucucu

SEQ ID NO: 1044564 - RNA, 21 nt, Homo sapiens
aaaccccccagagcucuuuac

SEQ ID NO: 1044565 - RNA, 18 nt, Homo sapiens
aaaccccuucuuuacuuc

SEQ ID NO: 1044566 - RNA, 13 nt, Homo sapiens
aaaccuccacugc

SEQ ID NO: 1044567 - RNA, 21 nt, Homo sapiens
aaaccugaccccugcucagua

SEQ ID NO: 1044568 - RNA, 22 nt, Homo sapiens
aaaccugcaguuuuguuuguac

SEQ ID NO: 1044569 - RNA, 17 nt, Homo sapiens
aaaccugugugccauuu

SEQ ID NO: 1044570 - RNA, 12 nt, Homo sapiens
aaaccuucaucc

SEQ ID NO: 1044571 - RNA, 13 nt, Homo sapiens
aaaccuuccccag

SEQ ID NO: 1044572 - RNA, 13 nt, Homo sapiens
aaacguauguaaa

SEQ ID NO: 1044573 - RNA, 17 nt, Homo sapiens
aaacguauugcauuuaa

SEQ ID NO: 1044574 - RNA, 16 nt, Homo sapiens
aaacuaaaucucuaau

SEQ ID NO: 1044575 - RNA, 17 nt, Homo sapiens
aaacuaaaucucuaaua

SEQ ID NO: 1044576 - RNA, 16 nt, Homo sapiens
aaacuaacacccaguc

SEQ ID NO: 1044577 - RNA, 18 nt, Homo sapiens
aaacuaagcccccgcugu

SEQ ID NO: 1044578 - RNA, 22 nt, Homo sapiens
aaacuauaugccauaaaccuca

SEQ ID NO: 1044579 - RNA, 13 nt, Homo sapiens
aaacuauauucuc

SEQ ID NO: 1044580 - RNA, 20 nt, Homo sapiens
aaacucaaugagcucuucca

SEQ ID NO: 1044581 - RNA, 15 nt, Homo sapiens
aaacucacugcucaa

SEQ ID NO: 1044582 - RNA, 19 nt, Homo sapiens
aaacucauuacuuuuccau

SEQ ID NO: 1044583 - RNA, 18 nt, Homo sapiens
aaacucuccucugcugcu

SEQ ID NO: 1044584 - RNA, 13 nt, Homo sapiens
aaacucucugaac

SEQ ID NO: 1044585 - RNA, 20 nt, Homo sapiens
aaacucuugaccucagguga

SEQ ID NO: 1044586 - RNA, 20 nt, Homo sapiens
aaacugauuuaucuauuuaa

SEQ ID NO: 1044587 - RNA, 22 nt, Homo sapiens
aaacugcugucccaaacaugca

SEQ ID NO: 1044588 - RNA, 14 nt, Homo sapiens
aaacuggauucaca

SEQ ID NO: 1044589 - RNA, 13 nt, Homo sapiens
aaacuucaauauc

SEQ ID NO: 1044590 - RNA, 13 nt, Homo sapiens
agagaacuggagg

SEQ ID NO: 1044591 - RNA, 15 nt, Homo sapiens
agagaagggacacau

SEQ ID NO: 1044592 - RNA, 15 nt, Homo sapiens
agagaauaccagugu

SEQ ID NO: 1044593 - RNA, 17 nt, Homo sapiens
agagaaucaacauuucu

SEQ ID NO: 1044594 - RNA, 14 nt, Homo sapiens
agagaaucauacuu

SEQ ID NO: 1044595 - RNA, 15 nt, Homo sapiens
agagaauguagccau

SEQ ID NO: 1044596 - RNA, 23 nt, Homo sapiens
agagacagaaagcagaacaguga

SEQ ID NO: 1044597 - RNA, 19 nt, Homo sapiens
agagaccgagccucuguca

SEQ ID NO: 1044598 - RNA, 21 nt, Homo sapiens
agagaccgagccucugucacu

SEQ ID NO: 1044599 - RNA, 12 nt, Homo sapiens
agagaccucaaa

SEQ ID NO: 1044600 - RNA, 16 nt, Homo sapiens
agagacgcagacaugu

SEQ ID NO: 1044601 - RNA, 19 nt, Homo sapiens
agagacuggagcaucugac

SEQ ID NO: 1044602 - RNA, 20 nt, Homo sapiens
agagacuugggacauugccu

SEQ ID NO: 1044603 - RNA, 21 nt, Homo sapiens
agagacuuggggaaauugcuu

SEQ ID NO: 1044604 - RNA, 13 nt, Homo sapiens
agagagauggaau

SEQ ID NO: 1044605 - RNA, 14 nt, Homo sapiens
agagagauggaaua

SEQ ID NO: 1044606 - RNA, 20 nt, Homo sapiens
agagagccauuuugugaaug

SEQ ID NO: 1044607 - RNA, 13 nt, Homo sapiens
agagagccuggug

SEQ ID NO: 1044608 - RNA, 13 nt, Homo sapiens
agagaggaagagc

SEQ ID NO: 1044609 - RNA, 19 nt, Homo sapiens
agagaggaguucaaugauc

SEQ ID NO: 1044610 - RNA, 16 nt, Homo sapiens
agagaggccuuguccc

SEQ ID NO: 1044611 - RNA, 16 nt, Homo sapiens
agagagggcuuucuca

SEQ ID NO: 1044612 - RNA, 23 nt, Homo sapiens
agagagucgcaucucagugcagg

SEQ ID NO: 1044613 - RNA, 19 nt, Homo sapiens
agagaucugguuuugcuau

SEQ ID NO: 1044614 - RNA, 16 nt, Homo sapiens
agagauuccugagcca

SEQ ID NO: 1044615 - RNA, 12 nt, Homo sapiens
agagauuucaag

SEQ ID NO: 1044616 - RNA, 22 nt, Homo sapiens
agagcaacaauccaucucucaa

SEQ ID NO: 1044617 - RNA, 20 nt, Homo sapiens
agagcaagacucugucucaa

SEQ ID NO: 1044618 - RNA, 16 nt, Homo sapiens
agagcacaccuaucuu

SEQ ID NO: 1044619 - RNA, 18 nt, Homo sapiens
agagcagaacccuagucu

SEQ ID NO: 1044620 - RNA, 17 nt, Homo sapiens
agagcaggaagcauuca

SEQ ID NO: 1044621 - RNA, 16 nt, Homo sapiens
agagcaggacugcaca

SEQ ID NO: 1044622 - RNA, 17 nt, Homo sapiens
agagccacccuguguug

SEQ ID NO: 1044623 - RNA, 18 nt, Homo sapiens
agagccagacugucucaa

SEQ ID NO: 1044624 - RNA, 20 nt, Homo sapiens
agagcccggcgccccugcca

SEQ ID NO: 1044625 - RNA, 22 nt, Homo sapiens
agagcccuucaugcauuugcac

SEQ ID NO: 1044626 - RNA, 23 nt, Homo sapiens
agagcccuucaugcauuugcacu

SEQ ID NO: 1044627 - RNA, 13 nt, Homo sapiens
agagccucugggc

SEQ ID NO: 1044628 - RNA, 21 nt, Homo sapiens
agagccugaguguugccuaau

SEQ ID NO: 1044629 - RNA, 17 nt, Homo sapiens
agagccuggugcugcug

SEQ ID NO: 1044630 - RNA, 19 nt, Homo sapiens
agagcgagacuccgucuca

SEQ ID NO: 1044631 - RNA, 15 nt, Homo sapiens
agagcgugcuccagc

SEQ ID NO: 1044632 - RNA, 16 nt, Homo sapiens
agagcugacacaggau

SEQ ID NO: 1044633 - RNA, 16 nt, Homo sapiens
agagcugggugucaag

SEQ ID NO: 1044634 - RNA, 14 nt, Homo sapiens
agagcuucccugac

SEQ ID NO: 1044635 - RNA, 14 nt, Homo sapiens
agagcuugaugcca

SEQ ID NO: 1044636 - RNA, 21 nt, Homo sapiens
agaggacagaucaauggcgca

SEQ ID NO: 1044637 - RNA, 14 nt, Homo sapiens
agaggaucuggaga

SEQ ID NO: 1044638 - RNA, 18 nt, Homo sapiens
agcccugcuuagcucauc

SEQ ID NO: 1044639 - RNA, 20 nt, Homo sapiens
agcccuggagucaugccaag

SEQ ID NO: 1044640 - RNA, 20 nt, Homo sapiens
agcccuggccucugcucaac

SEQ ID NO: 1044641 - RNA, 15 nt, Homo sapiens
agcccuggucucagc

SEQ ID NO: 1044642 - RNA, 18 nt, Homo sapiens
agcccuuaggaagaauuu

SEQ ID NO: 1044643 - RNA, 20 nt, Homo sapiens
agcccuucaugcauuugcac

SEQ ID NO: 1044644 - RNA, 13 nt, Homo sapiens
agccgaccucagc

SEQ ID NO: 1044645 - RNA, 14 nt, Homo sapiens
agccgagauugcac

SEQ ID NO: 1044646 - RNA, 13 nt, Homo sapiens
agccgcagcugua

SEQ ID NO: 1044647 - RNA, 15 nt, Homo sapiens
agccgccauugccac

SEQ ID NO: 1044648 - RNA, 12 nt, Homo sapiens
agccgcugugag

SEQ ID NO: 1044649 - RNA, 13 nt, Homo sapiens
agccgggcaugac

SEQ ID NO: 1044650 - RNA, 13 nt, Homo sapiens
agccgugaugccu

SEQ ID NO: 1044651 - RNA, 15 nt, Homo sapiens
agccgugaugcucag

SEQ ID NO: 1044652 - RNA, 17 nt, Homo sapiens
agccgugaugcucaggc

SEQ ID NO: 1044653 - RNA, 16 nt, Homo sapiens
agccuaggugacagag

SEQ ID NO: 1044654 - RNA, 21 nt, Homo sapiens
agccuauguaugccauggagg

SEQ ID NO: 1044655 - RNA, 12 nt, Homo sapiens
agccucaagucu

SEQ ID NO: 1044656 - RNA, 23 nt, Homo sapiens
agccucaagucuuauuuccucaa

SEQ ID NO: 1044657 - RNA, 14 nt, Homo sapiens
agccucacaguccu

SEQ ID NO: 1044658 - RNA, 23 nt, Homo sapiens
agccucagaaggacccuguugag

SEQ ID NO: 1044659 - RNA, 19 nt, Homo sapiens
agccucagccauucacugc

SEQ ID NO: 1044660 - RNA, 15 nt, Homo sapiens
agccucagggacgac

SEQ ID NO: 1044661 - RNA, 20 nt, Homo sapiens
agccucauugaugucaaaaa

SEQ ID NO: 1044662 - RNA, 14 nt, Homo sapiens
agccuccagcaccu

SEQ ID NO: 1044663 - RNA, 23 nt, Homo sapiens
agccuccagcaccuucccucuca

SEQ ID NO: 1044664 - RNA, 22 nt, Homo sapiens
agccucccaaagugcugagauu

SEQ ID NO: 1044665 - RNA, 19 nt, Homo sapiens
agccucccgaguagcugag

SEQ ID NO: 1044666 - RNA, 18 nt, Homo sapiens
agccucccuguaacucca

SEQ ID NO: 1044667 - RNA, 19 nt, Homo sapiens
agccuccgcgccuugccuc

SEQ ID NO: 1044668 - RNA, 11 nt, Homo sapiens
agccuccucau

SEQ ID NO: 1044669 - RNA, 20 nt, Homo sapiens
agccucuccccugauuacac

SEQ ID NO: 1044670 - RNA, 16 nt, Homo sapiens
agccucuggcuagagg

SEQ ID NO: 1044671 - RNA, 12 nt, Homo sapiens
agccucugucac

SEQ ID NO: 1044672 - RNA, 22 nt, Homo sapiens
agccugaacgcuucugcuuaau

SEQ ID NO: 1044673 - RNA, 13 nt, Homo sapiens
agccugcagucau

SEQ ID NO: 1044674 - RNA, 22 nt, Homo sapiens
agccugccuggcaggcugucug

SEQ ID NO: 1044675 - RNA, 18 nt, Homo sapiens
agccugggcagcauagca

SEQ ID NO: 1044676 - RNA, 20 nt, Homo sapiens
agccugggcgacagagccag

SEQ ID NO: 1044677 - RNA, 12 nt, Homo sapiens
agccuggugggc

SEQ ID NO: 1044678 - RNA, 19 nt, Homo sapiens
agccugugcccugauccaa

SEQ ID NO: 1044679 - RNA, 14 nt, Homo sapiens
agccuuagaaguca

SEQ ID NO: 1044680 - RNA, 17 nt, Homo sapiens
agccuucaauguaccug

SEQ ID NO: 1044681 - RNA, 19 nt, Homo sapiens
agccuucuuugcuugccuc

SEQ ID NO: 1044682 - RNA, 18 nt, Homo sapiens
agccuuggcucuacccug

SEQ ID NO: 1044683 - RNA, 13 nt, Homo sapiens
agccuuuccauaa

SEQ ID NO: 1044684 - RNA, 20 nt, Homo sapiens
agccuuugccuccaccauuc

SEQ ID NO: 1044685 - RNA, 19 nt, Homo sapiens
agcgaauguguacaaagug

SEQ ID NO: 1044686 - RNA, 12 nt, Homo sapiens
agcgacagugag

SEQ ID NO: 1044687 - RNA, 17 nt, Homo sapiens
agcgagagucugucuca

SEQ ID NO: 1044688 - RNA, 22 nt, Homo sapiens
agcgcagguuuaguuuacucaa

SEQ ID NO: 1044689 - RNA, 14 nt, Homo sapiens
agcgcuuucuggaa

SEQ ID NO: 1044690 - RNA, 23 nt, Homo sapiens
agcggagaucgcaucauugcacu

SEQ ID NO: 1044691 - RNA, 23 nt, Homo sapiens
agcggcuggcagcccaccccuca

SEQ ID NO: 1044692 - RNA, 17 nt, Homo sapiens
agcguagcuaagugaaa

SEQ ID NO: 1044693 - RNA, 19 nt, Homo sapiens
agcgucccagucucuggca

SEQ ID NO: 1044694 - RNA, 15 nt, Homo sapiens
agcguggacaggugu

SEQ ID NO: 1044695 - RNA, 16 nt, Homo sapiens
agcgugugacuacucc

SEQ ID NO: 1044696 - RNA, 23 nt, Homo sapiens
agcguuugcauuugcagugcauc

SEQ ID NO: 1044697 - RNA, 18 nt, Homo sapiens
agcuaaaaugauuuuauc

SEQ ID NO: 1044698 - RNA, 15 nt, Homo sapiens
agcuaacacacagcu

SEQ ID NO: 1044699 - RNA, 13 nt, Homo sapiens
agcuaacacuggc

SEQ ID NO: 1044700 - RNA, 21 nt, Homo sapiens
agcuucuucaucuucaccaga

SEQ ID NO: 1044701 - RNA, 17 nt, Homo sapiens
agcuugagcugccucug

SEQ ID NO: 1044702 - RNA, 21 nt, Homo sapiens
agcuugagggugacuauggag

SEQ ID NO: 1044703 - RNA, 16 nt, Homo sapiens
agcuugaucaaaggca

SEQ ID NO: 1044704 - RNA, 14 nt, Homo sapiens
agcuugcaacaaaa

SEQ ID NO: 1044705 - RNA, 22 nt, Homo sapiens
agcuugcucacaucuuggcaca

SEQ ID NO: 1044706 - RNA, 19 nt, Homo sapiens
agcuuggaaaggaccagua

SEQ ID NO: 1044707 - RNA, 18 nt, Homo sapiens
agcuuggacuugcauucc

SEQ ID NO: 1044708 - RNA, 22 nt, Homo sapiens
agcuuggauggagacuccauga

SEQ ID NO: 1044709 - RNA, 17 nt, Homo sapiens
agcuuuaaacucaggga

SEQ ID NO: 1044710 - RNA, 22 nt, Homo sapiens
agcuuuauuuuuuaaguauuua

SEQ ID NO: 1044711 - RNA, 22 nt, Homo sapiens
agcuuucauguaaacugugcac

SEQ ID NO: 1044712 - RNA, 21 nt, Homo sapiens
agcuuucccugccucucauca

SEQ ID NO: 1044713 - RNA, 21 nt, Homo sapiens
agcuuugagcuuaagaauuuu

SEQ ID NO: 1044714 - RNA, 13 nt, Homo sapiens
agcuuugcaggau

SEQ ID NO: 1044715 - RNA, 16 nt, Homo sapiens
agcuuugcugggagag

SEQ ID NO: 1044716 - RNA, 17 nt, Homo sapiens
agcuuugcuucucucuc

SEQ ID NO: 1044717 - RNA, 13 nt, Homo sapiens
agcuuuuuuacac

SEQ ID NO: 1044718 - RNA, 20 nt, Homo sapiens
aggaaaaaccaauagcuuua

SEQ ID NO: 1044719 - RNA, 22 nt, Homo sapiens
aggaaaccacagcugcuggaga

SEQ ID NO: 1044720 - RNA, 19 nt, Homo sapiens
aggaaacuguacuacaucu

SEQ ID NO: 1044721 - RNA, 17 nt, Homo sapiens
aggaaagaaaaaaagua

SEQ ID NO: 1044722 - RNA, 13 nt, Homo sapiens
aggaaauaaagua

SEQ ID NO: 1044723 - RNA, 15 nt, Homo sapiens
aggaaauaccaguuc

SEQ ID NO: 1044724 - RNA, 14 nt, Homo sapiens
aggaacacugcacu

SEQ ID NO: 1044725 - RNA, 16 nt, Homo sapiens
aggaacacugcacucu

SEQ ID NO: 1044726 - RNA, 14 nt, Homo sapiens
aggaaccacugcac

SEQ ID NO: 1044727 - RNA, 16 nt, Homo sapiens
aggaaccccaggagau

SEQ ID NO: 1044728 - RNA, 14 nt, Homo sapiens
aggaaccucagggc

SEQ ID NO: 1044729 - RNA, 20 nt, Homo sapiens
aggaaccuccuccacaccag

SEQ ID NO: 1044730 - RNA, 12 nt, Homo sapiens
aggaacucuggc

SEQ ID NO: 1044731 - RNA, 23 nt, Homo sapiens
aggaagcccuaagacgucccuuu

SEQ ID NO: 1044732 - RNA, 14 nt, Homo sapiens
aggaagccgugccc

SEQ ID NO: 1044733 - RNA, 14 nt, Homo sapiens
aggaagcucagacu

SEQ ID NO: 1044734 - RNA, 17 nt, Homo sapiens
aggaagcuuucugucuc

SEQ ID NO: 1044735 - RNA, 14 nt, Homo sapiens
aggaaggacugugc

SEQ ID NO: 1044736 - RNA, 15 nt, Homo sapiens
aggaaggcucuucuc

SEQ ID NO: 1044737 - RNA, 22 nt, Homo sapiens
aggaaguaccaagaacagucaa

SEQ ID NO: 1044738 - RNA, 15 nt, Homo sapiens
aggaagucagacuuu

SEQ ID NO: 1044739 - RNA, 23 nt, Homo sapiens
aggaagucauccugccaacugau

SEQ ID NO: 1044740 - RNA, 17 nt, Homo sapiens
aggaaguucaacuucca

SEQ ID NO: 1044741 - RNA, 21 nt, Homo sapiens
aggaauauuugcaagacauag

SEQ ID NO: 1044742 - RNA, 15 nt, Homo sapiens
aggaauccacucucc

SEQ ID NO: 1044743 - RNA, 17 nt, Homo sapiens
aggaaugugaaagcacg

SEQ ID NO: 1044744 - RNA, 15 nt, Homo sapiens
aggaauuguuuuuau

SEQ ID NO: 1044745 - RNA, 18 nt, Homo sapiens
aggacaaccauuccagac

SEQ ID NO: 1044746 - RNA, 14 nt, Homo sapiens
aggacaauuucaaa

SEQ ID NO: 1044747 - RNA, 15 nt, Homo sapiens
aggacacagaugaaa

SEQ ID NO: 1044748 - RNA, 21 nt, Homo sapiens
aggacacuagaagauuuugaa

SEQ ID NO: 1044749 - RNA, 14 nt, Homo sapiens
aggacaucagucug

SEQ ID NO: 1044750 - RNA, 22 nt, Homo sapiens
aggacauucuggaaaagcaaaa

SEQ ID NO: 1044751 - RNA, 20 nt, Homo sapiens
aggacauugcggacagccac

SEQ ID NO: 1044752 - RNA, 14 nt, Homo sapiens
aggaccaaggagau

SEQ ID NO: 1044753 - RNA, 13 nt, Homo sapiens
aggaccagagcua

SEQ ID NO: 1044754 - RNA, 17 nt, Homo sapiens
aggacuagaaccuggag

SEQ ID NO: 1044755 - RNA, 19 nt, Homo sapiens
aggacucccuccucaccuc

SEQ ID NO: 1044756 - RNA, 22 nt, Homo sapiens
aggacucccucuaaguggaaua

SEQ ID NO: 1044757 - RNA, 12 nt, Homo sapiens
aggacuguagaa

SEQ ID NO: 1044758 - RNA, 19 nt, Homo sapiens
aggagaaaaaaacuucuuu

SEQ ID NO: 1044759 - RNA, 15 nt, Homo sapiens
aggagaaacacaucu

SEQ ID NO: 1044760 - RNA, 17 nt, Homo sapiens
aggagaaacacaucuuc

SEQ ID NO: 1044761 - RNA, 21 nt, Homo sapiens
aggagaaccacuacaugcagc

SEQ ID NO: 1044762 - RNA, 21 nt, Homo sapiens
aggagaaggacauuuuacugc

SEQ ID NO: 1044763 - RNA, 13 nt, Homo sapiens
aggagaaucacuu

SEQ ID NO: 1044764 - RNA, 12 nt, Homo sapiens
aggagaccaagg

SEQ ID NO: 1044765 - RNA, 15 nt, Homo sapiens
aggagacccacaggu

SEQ ID NO: 1044766 - RNA, 18 nt, Homo sapiens
aggagacccacagguaug

SEQ ID NO: 1044767 - RNA, 20 nt, Homo sapiens
aggagaccuggcacuggaug

SEQ ID NO: 1044768 - RNA, 14 nt, Homo sapiens
cggguugccagcuc

SEQ ID NO: 1044769 - RNA, 12 nt, Homo sapiens
cgguaagcacuu

SEQ ID NO: 1044770 - RNA, 15 nt, Homo sapiens
cgguggucacuggaa

SEQ ID NO: 1044771 - RNA, 18 nt, Homo sapiens
cgguuugaagccuggaac

SEQ ID NO: 1044772 - RNA, 18 nt, Homo sapiens
cgguuuuucucuucaaua

SEQ ID NO: 1044773 - RNA, 16 nt, Homo sapiens
cguaagggaucuuccu

SEQ ID NO: 1044774 - RNA, 20 nt, Homo sapiens
cguaauuaaaggaacagagu

SEQ ID NO: 1044775 - RNA, 16 nt, Homo sapiens
cguaguccgcuuucuc

SEQ ID NO: 1044776 - RNA, 14 nt, Homo sapiens
cgucacagccucaa

SEQ ID NO: 1044777 - RNA, 14 nt, Homo sapiens
cgucauguuucuuc

SEQ ID NO: 1044778 - RNA, 12 nt, Homo sapiens
cgucccuaccuc

SEQ ID NO: 1044779 - RNA, 23 nt, Homo sapiens
cgucccuguuagcauaaugugag

SEQ ID NO: 1044780 - RNA, 23 nt, Homo sapiens
cgucgaggggcucucagcucagc

SEQ ID NO: 1044781 - RNA, 14 nt, Homo sapiens
cgucgcacagucuc

SEQ ID NO: 1044782 - RNA, 12 nt, Homo sapiens
cgugaaacacac

SEQ ID NO: 1044783 - RNA, 14 nt, Homo sapiens
cgugacaacaugcg

SEQ ID NO: 1044784 - RNA, 18 nt, Homo sapiens
cgugaccugccaggcaca

SEQ ID NO: 1044785 - RNA, 17 nt, Homo sapiens
cgugagcagcuuuggaa

SEQ ID NO: 1044786 - RNA, 13 nt, Homo sapiens
cgugauggucuga

SEQ ID NO: 1044787 - RNA, 22 nt, Homo sapiens
cgugauguggagggcacauucc

SEQ ID NO: 1044788 - RNA, 16 nt, Homo sapiens
cgugauuuugcuguag

SEQ ID NO: 1044789 - RNA, 9 nt, Homo sapiens
cgugcaaua

SEQ ID NO: 1044790 - RNA, 16 nt, Homo sapiens
cgugcacacaccagag

SEQ ID NO: 1044791 - RNA, 17 nt, Homo sapiens
cgugccuguuugcuuag

SEQ ID NO: 1044792 - RNA, 13 nt, Homo sapiens
cguggacucugca

SEQ ID NO: 1044793 - RNA, 22 nt, Homo sapiens
cguggacucugcacaugucuug

SEQ ID NO: 1044794 - RNA, 21 nt, Homo sapiens
cguggacuuggggucagagac

SEQ ID NO: 1044795 - RNA, 18 nt, Homo sapiens
cguggcaaauuaacuuga

SEQ ID NO: 1044796 - RNA, 23 nt, Homo sapiens
cgugggacaucuaguaggugcuu

SEQ ID NO: 1044797 - RNA, 19 nt, Homo sapiens
cgugguaggacuguagaaa

SEQ ID NO: 1044798 - RNA, 15 nt, Homo sapiens
cguggucaagcacuc

SEQ ID NO: 1044799 - RNA, 20 nt, Homo sapiens
cgugguggaagaggggacag

SEQ ID NO: 1044800 - RNA, 13 nt, Homo sapiens
cguguagcuauau

SEQ ID NO: 1044801 - RNA, 22 nt, Homo sapiens
cgugugcgugcaugugcacuug

SEQ ID NO: 1044802 - RNA, 23 nt, Homo sapiens
cguguggcucacgugugugacuc

SEQ ID NO: 1044803 - RNA, 16 nt, Homo sapiens
cgugugggcaauguuc

SEQ ID NO: 1044804 - RNA, 12 nt, Homo sapiens
cgugugugcaag

SEQ ID NO: 1044805 - RNA, 17 nt, Homo sapiens
cgugugugcaagugucu

SEQ ID NO: 1044806 - RNA, 18 nt, Homo sapiens
cguguuucugacucugag

SEQ ID NO: 1044807 - RNA, 22 nt, Homo sapiens
cguuaagggaaggaacucuggc

SEQ ID NO: 1044808 - RNA, 13 nt, Homo sapiens
cguuaugguguuu

SEQ ID NO: 1044809 - RNA, 13 nt, Homo sapiens
cguugaggaugag

SEQ ID NO: 1044810 - RNA, 20 nt, Homo sapiens
cguugauguuggcugggaac

SEQ ID NO: 1044811 - RNA, 17 nt, Homo sapiens
cguugcaugucgugacc

SEQ ID NO: 1044812 - RNA, 23 nt, Homo sapiens
cguuuccuuucauuuacuguggc

SEQ ID NO: 1044813 - RNA, 18 nt, Homo sapiens
cuaaaaaacagaggccau

SEQ ID NO: 1044814 - RNA, 14 nt, Homo sapiens
cuaaaaaguuccau

SEQ ID NO: 1044815 - RNA, 17 nt, Homo sapiens
cuaaaaaguuccaugaa

SEQ ID NO: 1044816 - RNA, 15 nt, Homo sapiens
cuaaaaaugcaacuu

SEQ ID NO: 1044817 - RNA, 12 nt, Homo sapiens
cuaaaacuuaac

SEQ ID NO: 1044818 - RNA, 15 nt, Homo sapiens
cuaaaagcacacuca

SEQ ID NO: 1044819 - RNA, 21 nt, Homo sapiens
cuaaaaguuacuuaccacaga

SEQ ID NO: 1044820 - RNA, 14 nt, Homo sapiens
cuaaaaugaguuac

SEQ ID NO: 1044821 - RNA, 19 nt, Homo sapiens
cuaaaaugaguuaccuaca

SEQ ID NO: 1044822 - RNA, 22 nt, Homo sapiens
cuaaaaugauuuuaucugugaa

SEQ ID NO: 1044823 - RNA, 22 nt, Homo sapiens
cuaaaauuguaucaaaugugac

SEQ ID NO: 1044824 - RNA, 19 nt, Homo sapiens
cuaaacaagaaucagucua

SEQ ID NO: 1044825 - RNA, 14 nt, Homo sapiens
cuaaacagauauaa

SEQ ID NO: 1044826 - RNA, 12 nt, Homo sapiens
cuaaaccaaaaa

SEQ ID NO: 1044827 - RNA, 22 nt, Homo sapiens
cuaaagaagguuucagaaagaa

SEQ ID NO: 1044828 - RNA, 21 nt, Homo sapiens
cuaaagguggugaggcaauaa

SEQ ID NO: 1044829 - RNA, 19 nt, Homo sapiens
cuaaaguacagacauccua

SEQ ID NO: 1044830 - RNA, 21 nt, Homo sapiens
cuaaaugaaaaucgugacaac

SEQ ID NO: 1044831 - RNA, 16 nt, Homo sapiens
cuaaauguaacagucu

SEQ ID NO: 1044832 - RNA, 22 nt, Homo sapiens
cuaacaaguagcacccuggauu

SEQ ID NO: 1044833 - RNA, 16 nt, Homo sapiens
cuaacaaugacauuua

SEQ ID NO: 1044834 - RNA, 14 nt, Homo sapiens
cuaacaggaacaaa

SEQ ID NO: 1044835 - RNA, 13 nt, Homo sapiens
auugacucugcau

SEQ ID NO: 1044836 - RNA, 16 nt, Homo sapiens
auugacugauggugaa

SEQ ID NO: 1044837 - RNA, 15 nt, Homo sapiens
auugagaacugcaua

SEQ ID NO: 1044838 - RNA, 23 nt, Homo sapiens
auugagaaguuuuguacagagaa

SEQ ID NO: 1044839 - RNA, 16 nt, Homo sapiens
auugaguuuucagugg

SEQ ID NO: 1044840 - RNA, 23 nt, Homo sapiens
auugauauacacggaugacuuaa

SEQ ID NO: 1044841 - RNA, 17 nt, Homo sapiens
auugauaugcuuauaca

SEQ ID NO: 1044842 - RNA, 11 nt, Homo sapiens
auugauuucaa

SEQ ID NO: 1044843 - RNA, 12 nt, Homo sapiens
auugcacaggga

SEQ ID NO: 1044844 - RNA, 21 nt, Homo sapiens
auugcacgggagaauauacaa

SEQ ID NO: 1044845 - RNA, 19 nt, Homo sapiens
auugcacuuuuaaaccucu

SEQ ID NO: 1044846 - RNA, 22 nt, Homo sapiens
auugcaucuggguagcuguaag

SEQ ID NO: 1044847 - RNA, 17 nt, Homo sapiens
auugccaaagguccaau

SEQ ID NO: 1044848 - RNA, 18 nt, Homo sapiens
auugcccccagggcacuu

SEQ ID NO: 1044849 - RNA, 21 nt, Homo sapiens
auugcccccagggcacuucac

SEQ ID NO: 1044850 - RNA, 20 nt, Homo sapiens
auugccuuuagugaucacag

SEQ ID NO: 1044851 - RNA, 16 nt, Homo sapiens
auugcuaagaagggaa

SEQ ID NO: 1044852 - RNA, 21 nt, Homo sapiens
auugcucucccagcccuugca

SEQ ID NO: 1044853 - RNA, 19 nt, Homo sapiens
auugcugugaauuagcuca

SEQ ID NO: 1044854 - RNA, 21 nt, Homo sapiens
auugcuucaauaauauuagcu

SEQ ID NO: 1044855 - RNA, 15 nt, Homo sapiens
auugcuugugccaca

SEQ ID NO: 1044856 - RNA, 22 nt, Homo sapiens
auugcuuugauuaauccagaau

SEQ ID NO: 1044857 - RNA, 19 nt, Homo sapiens
auuggaacagaauguuuua

SEQ ID NO: 1044858 - RNA, 23 nt, Homo sapiens
auuggacuuaaaaucuaauucaa

SEQ ID NO: 1044859 - RNA, 19 nt, Homo sapiens
auuggagaguaaaaacuga

SEQ ID NO: 1044860 - RNA, 22 nt, Homo sapiens
auuggagccugggcauccucag

SEQ ID NO: 1044861 - RNA, 20 nt, Homo sapiens
auuggcugguaacaguucau

SEQ ID NO: 1044862 - RNA, 18 nt, Homo sapiens
auugguguugacauacau

SEQ ID NO: 1044863 - RNA, 15 nt, Homo sapiens
auuguaaaacuaucu

SEQ ID NO: 1044864 - RNA, 15 nt, Homo sapiens
auuguaacuuaugaa

SEQ ID NO: 1044865 - RNA, 14 nt, Homo sapiens
auuguaccaugaaa

SEQ ID NO: 1044866 - RNA, 19 nt, Homo sapiens
auuguacuuccaggcuugg

SEQ ID NO: 1044867 - RNA, 15 nt, Homo sapiens
auuguaguuaaugau

SEQ ID NO: 1044868 - RNA, 13 nt, Homo sapiens
auuguauaagauu

SEQ ID NO: 1044869 - RNA, 20 nt, Homo sapiens
auuguaucaaaugugacauu

SEQ ID NO: 1044870 - RNA, 21 nt, Homo sapiens
auuguaucagaggccuauaau

SEQ ID NO: 1044871 - RNA, 16 nt, Homo sapiens
auugucagaguucugc

SEQ ID NO: 1044872 - RNA, 18 nt, Homo sapiens
auuguccccuaaaccaaa

SEQ ID NO: 1044873 - RNA, 17 nt, Homo sapiens
auuguccucuuugacua

SEQ ID NO: 1044874 - RNA, 16 nt, Homo sapiens
auugugaaguacauau

SEQ ID NO: 1044875 - RNA, 15 nt, Homo sapiens
auugugagccaccac

SEQ ID NO: 1044876 - RNA, 18 nt, Homo sapiens
auugugauauuuuuacuu

SEQ ID NO: 1044877 - RNA, 18 nt, Homo sapiens
auugugaucagaccauaa

SEQ ID NO: 1044878 - RNA, 10 nt, Homo sapiens
auugugaugu

SEQ ID NO: 1044879 - RNA, 12 nt, Homo sapiens
auugugugaugu

SEQ ID NO: 1044880 - RNA, 20 nt, Homo sapiens
auuguguuuugagguuuccu

SEQ ID NO: 1044881 - RNA, 16 nt, Homo sapiens
auuguuaaaauaacua

SEQ ID NO: 1044882 - RNA, 20 nt, Homo sapiens
auuguucucccuccuaccug

SEQ ID NO: 1044883 - RNA, 18 nt, Homo sapiens
auuguuguuaauaggucu

SEQ ID NO: 1044884 - RNA, 20 nt, Homo sapiens
auuguuucaucccauguaca

SEQ ID NO: 1044885 - RNA, 16 nt, Homo sapiens
auuguuugaaacaaag

SEQ ID NO: 1044886 - RNA, 23 nt, Homo sapiens
auuguuugaacccgggaggcaga

SEQ ID NO: 1044887 - RNA, 14 nt, Homo sapiens
auuguuuucagugu

SEQ ID NO: 1044888 - RNA, 18 nt, Homo sapiens
auuguuuuugcucaaggc

SEQ ID NO: 1044889 - RNA, 12 nt, Homo sapiens
auuuaaaaggga

SEQ ID NO: 1044890 - RNA, 13 nt, Homo sapiens
auuuaaaagggaa

SEQ ID NO: 1044891 - RNA, 18 nt, Homo sapiens
auuuaaacaccuccucau

SEQ ID NO: 1044892 - RNA, 15 nt, Homo sapiens
auuuaaagccuccuc

SEQ ID NO: 1044893 - RNA, 19 nt, Homo sapiens
auuuaacagggucucuagu

SEQ ID NO: 1044894 - RNA, 22 nt, Homo sapiens
auuuaaggaagaaucuucugcc

SEQ ID NO: 1044895 - RNA, 14 nt, Homo sapiens
auuuaaucuuccau

SEQ ID NO: 1044896 - RNA, 19 nt, Homo sapiens
auuuacaaaauuacacagu

SEQ ID NO: 1044897 - RNA, 24 nt, Homo sapiens
auuuacaggucuucucuccaacuc

SEQ ID NO: 1044898 - RNA, 12 nt, Homo sapiens
auuuagacucau

SEQ ID NO: 1044899 - RNA, 17 nt, Homo sapiens
auuuagauauaacacua

SEQ ID NO: 1044900 - RNA, 12 nt, Homo sapiens
auuuauauaugu

SEQ ID NO: 1044901 - RNA, 14 nt, Homo sapiens
auuuaucagugaca

SEQ ID NO: 1044902 - RNA, 13 nt, Homo sapiens
auuuaucccucaa

SEQ ID NO: 1044903 - RNA, 14 nt, Homo sapiens
auuuaucugugcaa

SEQ ID NO: 1044904 - RNA, 16 nt, Homo sapiens
auuuaugaaucacagu

SEQ ID NO: 1044905 - RNA, 23 nt, Homo sapiens
auuuaugaguuuuugauagcuuu

SEQ ID NO: 1044906 - RNA, 19 nt, Homo sapiens
auuuauucuucuuuuccaa

SEQ ID NO: 1044907 - RNA, 16 nt, Homo sapiens
auuuauuuaagcauca

SEQ ID NO: 1044908 - RNA, 15 nt, Homo sapiens
auuuauuuaagcuua

SEQ ID NO: 1044909 - RNA, 17 nt, Homo sapiens
auuuauuuuuuuacuuc

SEQ ID NO: 1044910 - RNA, 19 nt, Homo sapiens
auuucaaaauauacauuca

SEQ ID NO: 1044911 - RNA, 13 nt, Homo sapiens
auuucacugaugu

SEQ ID NO: 1044912 - RNA, 22 nt, Homo sapiens
auuucagauaaacaacaaauaa

SEQ ID NO: 1044913 - RNA, 23 nt, Homo sapiens
auuucaguaguggugaugguugu

SEQ ID NO: 1044914 - RNA, 12 nt, Homo sapiens
auuucaucucuu

SEQ ID NO: 1044915 - RNA, 18 nt, Homo sapiens
auuucauuuuuacccuua

SEQ ID NO: 1044916 - RNA, 16 nt, Homo sapiens
auuuccaaauucacaa

SEQ ID NO: 1044917 - RNA, 15 nt, Homo sapiens
auuuccaacaccaca

SEQ ID NO: 1044918 - RNA, 18 nt, Homo sapiens
auuuccaacaccacagac

SEQ ID NO: 1044919 - RNA, 13 nt, Homo sapiens
auuuccacaaaau

SEQ ID NO: 1044920 - RNA, 17 nt, Homo sapiens
auuuccagccagggcug

SEQ ID NO: 1044921 - RNA, 22 nt, Homo sapiens
auuuccuaaugucagaguagaa

SEQ ID NO: 1044922 - RNA, 18 nt, Homo sapiens
auuucuaaaucuccaaaa

SEQ ID NO: 1044923 - RNA, 20 nt, Homo sapiens
auuucuagcagugaugaaaa

SEQ ID NO: 1044924 - RNA, 18 nt, Homo sapiens
auuucuauuuccuggaau

SEQ ID NO: 1044925 - RNA, 23 nt, Homo sapiens
auuucucauuugaguauuacaau

SEQ ID NO: 1044926 - RNA, 19 nt, Homo sapiens
auuucuccuccaugggaga

SEQ ID NO: 1044927 - RNA, 13 nt, Homo sapiens
auuucucucugac

SEQ ID NO: 1044928 - RNA, 17 nt, Homo sapiens
auuucucuuugucagaa

SEQ ID NO: 1044929 - RNA, 21 nt, Homo sapiens
auuucugauauaacaaacuac

SEQ ID NO: 1044930 - RNA, 18 nt, Homo sapiens
auuucuggaaaacugccu

SEQ ID NO: 1044931 - RNA, 21 nt, Homo sapiens
auuucugggucuuucugacau

SEQ ID NO: 1044932 - RNA, 13 nt, Homo sapiens
auuucuucacuca

SEQ ID NO: 1044933 - RNA, 14 nt, Homo sapiens
auuucuucacucaa

SEQ ID NO: 1044934 - RNA, 20 nt, Homo sapiens
auuugaaaacauaaucugca

SEQ ID NO: 1044935 - RNA, 18 nt, Homo sapiens
auuugaagaaugaacaaa

SEQ ID NO: 1044936 - RNA, 14 nt, Homo sapiens
auuugaaggccagc

SEQ ID NO: 1044937 - RNA, 19 nt, Homo sapiens
auuugaccacggacuccag

SEQ ID NO: 1044938 - RNA, 21 nt, Homo sapiens
auuugacugaagaugcagcuc

SEQ ID NO: 1044939 - RNA, 15 nt, Homo sapiens
auuugagacagaguc

SEQ ID NO: 1044940 - RNA, 17 nt, Homo sapiens
auuugagacagagucuc

SEQ ID NO: 1044941 - RNA, 21 nt, Homo sapiens
auuugcaagggaaaagucucu

SEQ ID NO: 1044942 - RNA, 20 nt, Homo sapiens
auuugcagaguccugcacag

SEQ ID NO: 1044943 - RNA, 14 nt, Homo sapiens
auuugcaguauuca

SEQ ID NO: 1044944 - RNA, 14 nt, Homo sapiens
auuugcccaaaauc

SEQ ID NO: 1044945 - RNA, 18 nt, Homo sapiens
auuugcucuuucaucucu

SEQ ID NO: 1044946 - RNA, 16 nt, Homo sapiens
auuugcugaauacaga

SEQ ID NO: 1044947 - RNA, 14 nt, Homo sapiens
auuugcuucacuca

SEQ ID NO: 1044948 - RNA, 18 nt, Homo sapiens
auuuggaaaauaaaucaa

SEQ ID NO: 1044949 - RNA, 15 nt, Homo sapiens
auuuggccugcacua

SEQ ID NO: 1044950 - RNA, 22 nt, Homo sapiens
auuugguuuguugagccuaaua

SEQ ID NO: 1044951 - RNA, 21 nt, Homo sapiens
auuuguaaagcucacuuuacu

SEQ ID NO: 1044952 - RNA, 16 nt, Homo sapiens
auuuguuugcaauuuu

SEQ ID NO: 1044953 - RNA, 17 nt, Homo sapiens
auuuuaaaacagaagaa

SEQ ID NO: 1044954 - RNA, 16 nt, Homo sapiens
auuuuaaguaauuuca

SEQ ID NO: 1044955 - RNA, 21 nt, Homo sapiens
auuuuaaugaagaaaguggaa

SEQ ID NO: 1044956 - RNA, 14 nt, Homo sapiens
auuuuaauuugaua

SEQ ID NO: 1044957 - RNA, 18 nt, Homo sapiens
auuuuacccacacacaga

SEQ ID NO: 1044958 - RNA, 21 nt, Homo sapiens
auuuuacuuuuuccuggcuca

SEQ ID NO: 1044959 - RNA, 13 nt, Homo sapiens
auuuuagucacac

SEQ ID NO: 1044960 - RNA, 14 nt, Homo sapiens
auuuuauucccaag

SEQ ID NO: 1044961 - RNA, 18 nt, Homo sapiens
auuuuauucccuuucaca

SEQ ID NO: 1044962 - RNA, 14 nt, Homo sapiens
auuuuauuuaaucc

SEQ ID NO: 1044963 - RNA, 15 nt, Homo sapiens
cccagccucaucucu

SEQ ID NO: 1044964 - RNA, 17 nt, Homo sapiens
cccagcguuugaugggu

SEQ ID NO: 1044965 - RNA, 17 nt, Homo sapiens
cccaggaaggacugugc

SEQ ID NO: 1044966 - RNA, 15 nt, Homo sapiens
cccaggacccaucac

SEQ ID NO: 1044967 - RNA, 16 nt, Homo sapiens
cccaggacgcuucuga

SEQ ID NO: 1044968 - RNA, 16 nt, Homo sapiens
cccaggagacucuggg

SEQ ID NO: 1044969 - RNA, 12 nt, Homo sapiens
cccaggaguaca

SEQ ID NO: 1044970 - RNA, 23 nt, Homo sapiens
cccaggcaucugcuuuacucugg

SEQ ID NO: 1044971 - RNA, 17 nt, Homo sapiens
cccaggccgagaagcca

SEQ ID NO: 1044972 - RNA, 19 nt, Homo sapiens
cccaggcuggaguacagug

SEQ ID NO: 1044973 - RNA, 18 nt, Homo sapiens
cccaggcuggagugcaau

SEQ ID NO: 1044974 - RNA, 20 nt, Homo sapiens
cccaggcuggagugcaaugc

SEQ ID NO: 1044975 - RNA, 19 nt, Homo sapiens
cccaggcuggagugcagug

SEQ ID NO: 1044976 - RNA, 19 nt, Homo sapiens
cccaggcuggcgugcagug

SEQ ID NO: 1044977 - RNA, 22 nt, Homo sapiens
cccaggcuucacccugaauggu

SEQ ID NO: 1044978 - RNA, 18 nt, Homo sapiens
cccagggagaggccauga

SEQ ID NO: 1044979 - RNA, 16 nt, Homo sapiens
cccagggcacugaggg

SEQ ID NO: 1044980 - RNA, 13 nt, Homo sapiens
cccagggcuaccc

SEQ ID NO: 1044981 - RNA, 13 nt, Homo sapiens
cccagguccugca

SEQ ID NO: 1044982 - RNA, 20 nt, Homo sapiens
cccaggucuugacaccagcu

SEQ ID NO: 1044983 - RNA, 21 nt, Homo sapiens
cccagugcuugcaagauucca

SEQ ID NO: 1044984 - RNA, 14 nt, Homo sapiens
cccaguggccucaa

SEQ ID NO: 1044985 - RNA, 15 nt, Homo sapiens
cccaguguuugugca

SEQ ID NO: 1044986 - RNA, 23 nt, Homo sapiens
cccaguuaaauuuucauuucaga

SEQ ID NO: 1044987 - RNA, 12 nt, Homo sapiens
cccaguucugcu

SEQ ID NO: 1044988 - RNA, 14 nt, Homo sapiens
cccauaucugugaa

SEQ ID NO: 1044989 - RNA, 23 nt, Homo sapiens
cccauaucugugaaaugcuggca

SEQ ID NO: 1044990 - RNA, 16 nt, Homo sapiens
cccaucagcuccagcu

SEQ ID NO: 1044991 - RNA, 17 nt, Homo sapiens
cccaucagcuccagcug

SEQ ID NO: 1044992 - RNA, 22 nt, Homo sapiens
cccaucccacacccuggaggau

SEQ ID NO: 1044993 - RNA, 15 nt, Homo sapiens
cccaucuccuuucau

SEQ ID NO: 1044994 - RNA, 12 nt, Homo sapiens
cccaucuugaua

SEQ ID NO: 1044995 - RNA, 12 nt, Homo sapiens
cccaugagauuc

SEQ ID NO: 1044996 - RNA, 22 nt, Homo sapiens
cccaugaggcacgaaugaucuu

SEQ ID NO: 1044997 - RNA, 16 nt, Homo sapiens
cccauggacacuccag

SEQ ID NO: 1044998 - RNA, 13 nt, Homo sapiens
cccauggccacuu

SEQ ID NO: 1044999 - RNA, 14 nt, Homo sapiens
cccauucauuccau

SEQ ID NO: 1045000 - RNA, 15 nt, Homo sapiens
cccauucuacacaga

SEQ ID NO: 1045001 - RNA, 12 nt, Homo sapiens
cccauucuugca

SEQ ID NO: 1045002 - RNA, 22 nt, Homo sapiens
cccauuugcuuacuuugcauuu

SEQ ID NO: 1045003 - RNA, 17 nt, Homo sapiens
cccauuuugagugacuc

SEQ ID NO: 1045004 - RNA, 13 nt, Homo sapiens
ccccaaagucuua

SEQ ID NO: 1045005 - RNA, 11 nt, Homo sapiens
ccccaacagca

SEQ ID NO: 1045006 - RNA, 23 nt, Homo sapiens
ccccaacagcacccucuccagau

SEQ ID NO: 1045007 - RNA, 17 nt, Homo sapiens
ccccacacuccauggag

SEQ ID NO: 1045008 - RNA, 23 nt, Homo sapiens
ccccacaggagcccugcagugug

SEQ ID NO: 1045009 - RNA, 22 nt, Homo sapiens
ccccaccugccauuugcacccu

SEQ ID NO: 1045010 - RNA, 14 nt, Homo sapiens
ccccagagcucuuu

SEQ ID NO: 1045011 - RNA, 23 nt, Homo sapiens
ccccagcaccauuuaugagucuc

SEQ ID NO: 1045012 - RNA, 15 nt, Homo sapiens
ccccagcccugugga

SEQ ID NO: 1045013 - RNA, 16 nt, Homo sapiens
ccccagccucuucuag

SEQ ID NO: 1045014 - RNA, 15 nt, Homo sapiens
ccccagugcccacag

SEQ ID NO: 1045015 - RNA, 21 nt, Homo sapiens
ccccagugguauccugugaca

SEQ ID NO: 1045016 - RNA, 21 nt, Homo sapiens
ccccaucaucccagcugcucc

SEQ ID NO: 1045017 - RNA, 20 nt, Homo sapiens
ccccaucugccacguguauu

SEQ ID NO: 1045018 - RNA, 14 nt, Homo sapiens
cccccagagcucuu

SEQ ID NO: 1045019 - RNA, 11 nt, Homo sapiens
ccuaguacaag

SEQ ID NO: 1045020 - RNA, 16 nt, Homo sapiens
ccuaguuccaccauca

SEQ ID NO: 1045021 - RNA, 20 nt, Homo sapiens
ccuauauagaugcagcauuu

SEQ ID NO: 1045022 - RNA, 15 nt, Homo sapiens
ccuauguccuaagga

SEQ ID NO: 1045023 - RNA, 22 nt, Homo sapiens
ccuauguccuaaggacacacua

SEQ ID NO: 1045024 - RNA, 14 nt, Homo sapiens
ccuauugucauuaa

SEQ ID NO: 1045025 - RNA, 15 nt, Homo sapiens
ccuauugucauuaaa

SEQ ID NO: 1045026 - RNA, 13 nt, Homo sapiens
ccuauuuccccac

SEQ ID NO: 1045027 - RNA, 20 nt, Homo sapiens
ccuauuuggggcuugcaugc

SEQ ID NO: 1045028 - RNA, 17 nt, Homo sapiens
ccucaaagcacacguca

SEQ ID NO: 1045029 - RNA, 17 nt, Homo sapiens
ccucaaaugacccaaag

SEQ ID NO: 1045030 - RNA, 18 nt, Homo sapiens
ccucaaaugacccaaaga

SEQ ID NO: 1045031 - RNA, 23 nt, Homo sapiens
ccucaaggguuauagacugccau

SEQ ID NO: 1045032 - RNA, 23 nt, Homo sapiens
ccucacacugggacuugcaaaaa

SEQ ID NO: 1045033 - RNA, 21 nt, Homo sapiens
ccucacaggagcuuacuggca

SEQ ID NO: 1045034 - RNA, 20 nt, Homo sapiens
ccucagcugccucacuuccu

SEQ ID NO: 1045035 - RNA, 19 nt, Homo sapiens
ccucaggaaugggcuguuu

SEQ ID NO: 1045036 - RNA, 19 nt, Homo sapiens
ccucaggccaggugcagug

SEQ ID NO: 1045037 - RNA, 22 nt, Homo sapiens
ccucagguugcugguugcugug

SEQ ID NO: 1045038 - RNA, 15 nt, Homo sapiens
ccucagguuugccug

SEQ ID NO: 1045039 - RNA, 21 nt, Homo sapiens
ccucaguaagacgacaaggaa

SEQ ID NO: 1045040 - RNA, 16 nt, Homo sapiens
ccucagucccaacucc

SEQ ID NO: 1045041 - RNA, 19 nt, Homo sapiens
ccucaguuucccuaucucg

SEQ ID NO: 1045042 - RNA, 13 nt, Homo sapiens
ccucaucugcuca

SEQ ID NO: 1045043 - RNA, 13 nt, Homo sapiens
ccucaugcaucuc

SEQ ID NO: 1045044 - RNA, 22 nt, Homo sapiens
ccucaugugaucacaauuugca

SEQ ID NO: 1045045 - RNA, 19 nt, Homo sapiens
ccucauuagcauuuugcua

SEQ ID NO: 1045046 - RNA, 20 nt, Homo sapiens
ccuccaagcuccaucuccac

SEQ ID NO: 1045047 - RNA, 22 nt, Homo sapiens
ccuccaaggaggggcuguaaaa

SEQ ID NO: 1045048 - RNA, 17 nt, Homo sapiens
ccuccagcuucaggcag

SEQ ID NO: 1045049 - RNA, 21 nt, Homo sapiens
ccucccaaagugcugggauua

SEQ ID NO: 1045050 - RNA, 18 nt, Homo sapiens
ccucccagaacacacucc

SEQ ID NO: 1045051 - RNA, 22 nt, Homo sapiens
ccucccaggaacugggccaacu

SEQ ID NO: 1045052 - RNA, 23 nt, Homo sapiens
ccuccccaaggagacacaacaac

SEQ ID NO: 1045053 - RNA, 13 nt, Homo sapiens
ccuccccacagga

SEQ ID NO: 1045054 - RNA, 20 nt, Homo sapiens
ccuccccuggggacagcaag

SEQ ID NO: 1045055 - RNA, 13 nt, Homo sapiens
ccucccucaggcc

SEQ ID NO: 1045056 - RNA, 17 nt, Homo sapiens
ccuccgcgccuugccuc

SEQ ID NO: 1045057 - RNA, 13 nt, Homo sapiens
ccuccguccagcc

SEQ ID NO: 1045058 - RNA, 13 nt, Homo sapiens
ccuccucaccucu

SEQ ID NO: 1045059 - RNA, 14 nt, Homo sapiens
ccuccucuagcugu

SEQ ID NO: 1045060 - RNA, 22 nt, Homo sapiens
ccuccuguaaaugguguacaua

SEQ ID NO: 1045061 - RNA, 18 nt, Homo sapiens
ccuccugucccucaucca

SEQ ID NO: 1045062 - RNA, 16 nt, Homo sapiens
ccucgagggcagggac

SEQ ID NO: 1045063 - RNA, 15 nt, Homo sapiens
ccucgcuggacucuc

SEQ ID NO: 1045064 - RNA, 17 nt, Homo sapiens
ccucgggugugcuaugg

SEQ ID NO: 1045065 - RNA, 19 nt, Homo sapiens
ccucuaacccaggucuuga

SEQ ID NO: 1045066 - RNA, 13 nt, Homo sapiens
ccucuaagccacu

SEQ ID NO: 1045067 - RNA, 13 nt, Homo sapiens
ccucuaagguugg

SEQ ID NO: 1045068 - RNA, 16 nt, Homo sapiens
ccucuacaauuugcca

SEQ ID NO: 1045069 - RNA, 14 nt, Homo sapiens
ccucucaaccaccu

SEQ ID NO: 1045070 - RNA, 17 nt, Homo sapiens
ccucucaucaguguccu

SEQ ID NO: 1045071 - RNA, 18 nt, Homo sapiens
ccucuccccacugcucau

SEQ ID NO: 1045072 - RNA, 19 nt, Homo sapiens
ccucucucccggagguugg

SEQ ID NO: 1045073 - RNA, 14 nt, Homo sapiens
ccucugaaaaccaa

SEQ ID NO: 1045074 - RNA, 21 nt, Homo sapiens
ccucugggccaagucaaagac

SEQ ID NO: 1045075 - RNA, 17 nt, Homo sapiens
ccucuggguaggaauca

SEQ ID NO: 1045076 - RNA, 10 nt, Homo sapiens
ccucugucac

SEQ ID NO: 1045077 - RNA, 15 nt, Homo sapiens
ccucugucacugcag

SEQ ID NO: 1045078 - RNA, 14 nt, Homo sapiens
ccucuguccaggca

SEQ ID NO: 1045079 - RNA, 13 nt, Homo sapiens
ccucuuagcugag

SEQ ID NO: 1045080 - RNA, 12 nt, Homo sapiens
ccucuuccauca

SEQ ID NO: 1045081 - RNA, 19 nt, Homo sapiens
ccucuucugacgugccuuu

SEQ ID NO: 1045082 - RNA, 13 nt, Homo sapiens
ccucuugcucaaa

SEQ ID NO: 1045083 - RNA, 21 nt, Homo sapiens
ccucuuggaccucugcucuga

SEQ ID NO: 1045084 - RNA, 14 nt, Homo sapiens
ccucuuuaaaaaca

SEQ ID NO: 1045085 - RNA, 24 nt, Homo sapiens
ccucuuugugugcgucacugugaa

SEQ ID NO: 1045086 - RNA, 16 nt, Homo sapiens
ccucuuuuucuagucu

SEQ ID NO: 1045087 - RNA, 20 nt, Homo sapiens
ccugaaacuuacacacaaaa

SEQ ID NO: 1045088 - RNA, 22 nt, Homo sapiens
ccugaagguguuuuucauucac

SEQ ID NO: 1045089 - RNA, 21 nt, Homo sapiens
ccugaaguaagcaaagacuuu

SEQ ID NO: 1045090 - RNA, 22 nt, Homo sapiens
ccugaaguaagcaaagacuuuc

SEQ ID NO: 1045091 - RNA, 14 nt, Homo sapiens
ccugaagucacaca

SEQ ID NO: 1045092 - RNA, 13 nt, Homo sapiens
ccugaaucauucu

SEQ ID NO: 1045093 - RNA, 23 nt, Homo sapiens
ccugaaugugucugcgucccugu

SEQ ID NO: 1045094 - RNA, 19 nt, Homo sapiens
ccugaauguuucagaccac

SEQ ID NO: 1045095 - RNA, 22 nt, Homo sapiens
ccugaauucuuuuucauuugag

SEQ ID NO: 1045096 - RNA, 19 nt, Homo sapiens
ccugacauucacacagaga

SEQ ID NO: 1045097 - RNA, 14 nt, Homo sapiens
ccugagauuuacac

SEQ ID NO: 1045098 - RNA, 20 nt, Homo sapiens
ccuguaaucccagcuacucg

SEQ ID NO: 1045099 - RNA, 20 nt, Homo sapiens
ccuguaaucccagcuacuug

SEQ ID NO: 1045100 - RNA, 21 nt, Homo sapiens
ccuguaugcaacaggcacuca

SEQ ID NO: 1045101 - RNA, 21 nt, Homo sapiens
ccugucaaacaaagccagaag

SEQ ID NO: 1045102 - RNA, 13 nt, Homo sapiens
ccugucccaugga

SEQ ID NO: 1045103 - RNA, 13 nt, Homo sapiens
ccugucucagggu

SEQ ID NO: 1045104 - RNA, 14 nt, Homo sapiens
ccugugaccagcac

SEQ ID NO: 1045105 - RNA, 13 nt, Homo sapiens
ccugugaggugca

SEQ ID NO: 1045106 - RNA, 19 nt, Homo sapiens
ccugugaguacuacagucc

SEQ ID NO: 1045107 - RNA, 18 nt, Homo sapiens
ccuguggucucugaccag

SEQ ID NO: 1045108 - RNA, 22 nt, Homo sapiens
ccuguguaaaacuauauucuca

SEQ ID NO: 1045109 - RNA, 22 nt, Homo sapiens
ccuguuacuugaaauaccagug

SEQ ID NO: 1045110 - RNA, 15 nt, Homo sapiens
ccuguuagacucuua

SEQ ID NO: 1045111 - RNA, 23 nt, Homo sapiens
ccuguuagacucuuacuuuuuaa

SEQ ID NO: 1045112 - RNA, 12 nt, Homo sapiens
ccuguuccagaa

SEQ ID NO: 1045113 - RNA, 11 nt, Homo sapiens
ccuguucucua

SEQ ID NO: 1045114 - RNA, 21 nt, Homo sapiens
ccuguucuguuuugccugaag

SEQ ID NO: 1045115 - RNA, 22 nt, Homo sapiens
ccuguuugacgacagugcauuu

SEQ ID NO: 1045116 - RNA, 22 nt, Homo sapiens
ccuguuuucgcaccuaccauca

SEQ ID NO: 1045117 - RNA, 23 nt, Homo sapiens
ccuuaaugauccguuccauugca

SEQ ID NO: 1045118 - RNA, 22 nt, Homo sapiens
ccuuacauuugaaaucuaugaa

SEQ ID NO: 1045119 - RNA, 16 nt, Homo sapiens
ccuuacuccagagggc

SEQ ID NO: 1045120 - RNA, 22 nt, Homo sapiens
ccuuagauguucuaagucuuuc

SEQ ID NO: 1045121 - RNA, 15 nt, Homo sapiens
ccuuagcuggcauua

SEQ ID NO: 1045122 - RNA, 15 nt, Homo sapiens
ccuuagucucaaggg

SEQ ID NO: 1045123 - RNA, 19 nt, Homo sapiens
ccuuaucaagugucuucca

SEQ ID NO: 1045124 - RNA, 20 nt, Homo sapiens
ccuucaaguuagcucaggag

SEQ ID NO: 1045125 - RNA, 20 nt, Homo sapiens
ccuuccagcacccugcaaaa

SEQ ID NO: 1045126 - RNA, 17 nt, Homo sapiens
ccuuccagcuccuguaa

SEQ ID NO: 1045127 - RNA, 17 nt, Homo sapiens
ccuuccaggggugggac

SEQ ID NO: 1045128 - RNA, 19 nt, Homo sapiens
ccuuccaucccagagggug

SEQ ID NO: 1045129 - RNA, 13 nt, Homo sapiens
ccuucccaugacc

SEQ ID NO: 1045130 - RNA, 17 nt, Homo sapiens
ccuucccaugacccagg

SEQ ID NO: 1045131 - RNA, 14 nt, Homo sapiens
ccuuccccauggga

SEQ ID NO: 1045132 - RNA, 18 nt, Homo sapiens
ccuucccccagcaccauu

SEQ ID NO: 1045133 - RNA, 14 nt, Homo sapiens
ccuuccucauuugc

SEQ ID NO: 1045134 - RNA, 12 nt, Homo sapiens
ccuucuaccucu

SEQ ID NO: 1045135 - RNA, 12 nt, Homo sapiens
ccuucuccaaau

SEQ ID NO: 1045136 - RNA, 20 nt, Homo sapiens
ccuucucccaugaggcacga

SEQ ID NO: 1045137 - RNA, 15 nt, Homo sapiens
ccuucucugcuccac

SEQ ID NO: 1045138 - RNA, 17 nt, Homo sapiens
ccuucuguccugguguc

SEQ ID NO: 1045139 - RNA, 16 nt, Homo sapiens
ccuucuuacaaugcau

SEQ ID NO: 1045140 - RNA, 17 nt, Homo sapiens
ccuucuucuuuuugcug

SEQ ID NO: 1045141 - RNA, 22 nt, Homo sapiens
ccuugaaaacacuguucucugc

SEQ ID NO: 1045142 - RNA, 11 nt, Homo sapiens
ccuugaaccag

SEQ ID NO: 1045143 - RNA, 15 nt, Homo sapiens
ccuugaauguucucu

SEQ ID NO: 1045144 - RNA, 14 nt, Homo sapiens
ccuugaggagucuu

SEQ ID NO: 1045145 - RNA, 21 nt, Homo sapiens
ccuugagucaaaaaaucucaa

SEQ ID NO: 1045146 - RNA, 22 nt, Homo sapiens
ccuugauggagauauuuacaug

SEQ ID NO: 1045147 - RNA, 15 nt, Homo sapiens
ccuugccagacaugu

SEQ ID NO: 1045148 - RNA, 15 nt, Homo sapiens
ccuugccuccucacc

SEQ ID NO: 1045149 - RNA, 11 nt, Homo sapiens
ccuugcucccc

SEQ ID NO: 1045150 - RNA, 20 nt, Homo sapiens
ccuugcucucccucuucuca

SEQ ID NO: 1045151 - RNA, 12 nt, Homo sapiens
ccuugcucugca

SEQ ID NO: 1045152 - RNA, 21 nt, Homo sapiens
ccuugcugccgucaccucucc

SEQ ID NO: 1045153 - RNA, 22 nt, Homo sapiens
ccuuggaaguugcauggcauca

SEQ ID NO: 1045154 - RNA, 18 nt, Homo sapiens
ccuuggcaugccuuccag

SEQ ID NO: 1045155 - RNA, 13 nt, Homo sapiens
ccuuggcugugag

SEQ ID NO: 1045156 - RNA, 15 nt, Homo sapiens
ccuuggugugcugua

SEQ ID NO: 1045157 - RNA, 16 nt, Homo sapiens
ccuuguaaagacugua

SEQ ID NO: 1045158 - RNA, 19 nt, Homo sapiens
ccuuguaauucuaaaugaa

SEQ ID NO: 1045159 - RNA, 13 nt, Homo sapiens
ccuuguccaccca

SEQ ID NO: 1045160 - RNA, 22 nt, Homo sapiens
ccuugugaauuugcugcuauuu

SEQ ID NO: 1045161 - RNA, 15 nt, Homo sapiens
ccuuguggaaccaaa

SEQ ID NO: 1045162 - RNA, 18 nt, Homo sapiens
ccuuguguccacugugac

SEQ ID NO: 1045163 - RNA, 22 nt, Homo sapiens
ccuuguucucuaaguuccacug

SEQ ID NO: 1045164 - RNA, 11 nt, Homo sapiens
ccuuguuguug

SEQ ID NO: 1045165 - RNA, 21 nt, Homo sapiens
ccuuguuguuguuaaauauca

SEQ ID NO: 1045166 - RNA, 19 nt, Homo sapiens
ccuuuacucauagcacuuc

SEQ ID NO: 1045167 - RNA, 18 nt, Homo sapiens
ccuuuagagccagcccau

SEQ ID NO: 1045168 - RNA, 17 nt, Homo sapiens
ccuuucauuuacugugg

SEQ ID NO: 1045169 - RNA, 22 nt, Homo sapiens
ccuuuccaaaugcccagcuuaa

SEQ ID NO: 1045170 - RNA, 11 nt, Homo sapiens
ccuuuccauaa

SEQ ID NO: 1045171 - RNA, 16 nt, Homo sapiens
gacagagcgagacucc

SEQ ID NO: 1045172 - RNA, 14 nt, Homo sapiens
gacagagucucacu

SEQ ID NO: 1045173 - RNA, 17 nt, Homo sapiens
gacagauacuccuccaa

SEQ ID NO: 1045174 - RNA, 19 nt, Homo sapiens
gacagaucaagcugugaga

SEQ ID NO: 1045175 - RNA, 17 nt, Homo sapiens
gacagaucaauggcgca

SEQ ID NO: 1045176 - RNA, 21 nt, Homo sapiens
gacagauuccaggcgaugugc

SEQ ID NO: 1045177 - RNA, 22 nt, Homo sapiens
gacagccacggccaggccagag

SEQ ID NO: 1045178 - RNA, 16 nt, Homo sapiens
gacaggaauacuuaac

SEQ ID NO: 1045179 - RNA, 14 nt, Homo sapiens
gacaggaccaggga

SEQ ID NO: 1045180 - RNA, 22 nt, Homo sapiens
gacaggacccugggaccacaga

SEQ ID NO: 1045181 - RNA, 19 nt, Homo sapiens
gacaggaggaaucauguca

SEQ ID NO: 1045182 - RNA, 23 nt, Homo sapiens
gagacucagggccccagcacuaa

SEQ ID NO: 1045183 - RNA, 19 nt, Homo sapiens
gagacuccgucucaaaaaa

SEQ ID NO: 1045184 - RNA, 16 nt, Homo sapiens
gagacuccgucucaag

SEQ ID NO: 1045185 - RNA, 22 nt, Homo sapiens
gagacuccuaggcaggacaugc

SEQ ID NO: 1045186 - RNA, 11 nt, Homo sapiens
gagacucugaa

SEQ ID NO: 1045187 - RNA, 23 nt, Homo sapiens
uaaaaauugugaucagaccauaa

SEQ ID NO: 1045188 - RNA, 17 nt, Homo sapiens
uaaaaauuguuuuugga

SEQ ID NO: 1045189 - RNA, 16 nt, Homo sapiens
uaaaacaaaagcucau

SEQ ID NO: 1045190 - RNA, 22 nt, Homo sapiens
uaaaacagguggagaaauuccu

SEQ ID NO: 1045191 - RNA, 21 nt, Homo sapiens
uaaaacauguuugcacuuguc

SEQ ID NO: 1045192 - RNA, 16 nt, Homo sapiens
uaaaacccaagugccu

SEQ ID NO: 1045193 - RNA, 18 nt, Homo sapiens
uaaaaccugucaaugaua

SEQ ID NO: 1045194 - RNA, 17 nt, Homo sapiens
uaaaaccugugugccau

SEQ ID NO: 1045195 - RNA, 16 nt, Homo sapiens
uaaaacgcaugugcag

SEQ ID NO: 1045196 - RNA, 23 nt, Homo sapiens
uaaaagaaccgagcaauuuucug

SEQ ID NO: 1045197 - RNA, 22 nt, Homo sapiens
uaaaagaauaaaauugcacuuu

SEQ ID NO: 1045198 - RNA, 15 nt, Homo sapiens
uaaaagaguuaacau

SEQ ID NO: 1045199 - RNA, 23 nt, Homo sapiens
uaaaagaugcauuaucuaugaua

SEQ ID NO: 1045200 - RNA, 14 nt, Homo sapiens
uaaaagcuauggug

SEQ ID NO: 1045201 - RNA, 23 nt, Homo sapiens
uaaaaggacucuccaaauagcau

SEQ ID NO: 1045202 - RNA, 16 nt, Homo sapiens
uaaaagucacucugag

SEQ ID NO: 1045203 - RNA, 20 nt, Homo sapiens
uaaaaguuacuuaccacaga

SEQ ID NO: 1045204 - RNA, 17 nt, Homo sapiens
uaaaauaaaaauucuga

SEQ ID NO: 1045205 - RNA, 20 nt, Homo sapiens
uaaaauaacuuauaucauca

SEQ ID NO: 1045206 - RNA, 16 nt, Homo sapiens
uaaaauagcaauccua

SEQ ID NO: 1045207 - RNA, 22 nt, Homo sapiens
uaaaauagccacuuaccuucaa

SEQ ID NO: 1045208 - RNA, 19 nt, Homo sapiens
uaaaauauuuaugagaaag

SEQ ID NO: 1045209 - RNA, 19 nt, Homo sapiens
uaaaaucuuggcacagaaa

SEQ ID NO: 1045210 - RNA, 19 nt, Homo sapiens
uaaaauggugauauccucu

SEQ ID NO: 1045211 - RNA, 16 nt, Homo sapiens
uaaaauguauucuuaa

SEQ ID NO: 1045212 - RNA, 18 nt, Homo sapiens
uaaaauuagaugaacuca

SEQ ID NO: 1045213 - RNA, 15 nt, Homo sapiens
uaaaauugcacuuuu

SEQ ID NO: 1045214 - RNA, 22 nt, Homo sapiens
uaaaauuguauagaccuaaaau

SEQ ID NO: 1045215 - RNA, 14 nt, Homo sapiens
uaaacaaacaaaca

SEQ ID NO: 1045216 - RNA, 17 nt, Homo sapiens
uaaacaaauaacaaugu

SEQ ID NO: 1045217 - RNA, 18 nt, Homo sapiens
uaaacaaauguaugauua

SEQ ID NO: 1045218 - RNA, 14 nt, Homo sapiens
uaaacaacuaccuc

SEQ ID NO: 1045219 - RNA, 17 nt, Homo sapiens
uaaacacccaugaauca

SEQ ID NO: 1045220 - RNA, 23 nt, Homo sapiens
uaaacacccaugaaucaaagaca

SEQ ID NO: 1045221 - RNA, 17 nt, Homo sapiens
uaaacagauggcacuuu

SEQ ID NO: 1045222 - RNA, 21 nt, Homo sapiens
uaaacaguagugauaguugua

SEQ ID NO: 1045223 - RNA, 15 nt, Homo sapiens
uaaacagugucauau

SEQ ID NO: 1045224 - RNA, 14 nt, Homo sapiens
uaaacauccuucaa

SEQ ID NO: 1045225 - RNA, 21 nt, Homo sapiens
uaaacaugucugcccccaugg

SEQ ID NO: 1045226 - RNA, 12 nt, Homo sapiens
uaaacauucucu

SEQ ID NO: 1045227 - RNA, 12 nt, Homo sapiens
uaaaccaaaaac

SEQ ID NO: 1045228 - RNA, 18 nt, Homo sapiens
uaaacccaguugccaucu

SEQ ID NO: 1045229 - RNA, 17 nt, Homo sapiens
uaaaccuaauaaucuga

SEQ ID NO: 1045230 - RNA, 14 nt, Homo sapiens
uaaaccucaaguua

SEQ ID NO: 1045231 - RNA, 21 nt, Homo sapiens
uaaacucagggacagagccau

SEQ ID NO: 1045232 - RNA, 15 nt, Homo sapiens
uaaacugacuuuauc

SEQ ID NO: 1045233 - RNA, 13 nt, Homo sapiens
uaaacugugcacc

SEQ ID NO: 1045234 - RNA, 11 nt, Homo sapiens
uaaacuuguag

SEQ ID NO: 1045235 - RNA, 22 nt, Homo sapiens
uaaagaaaaagucauccaaucu

SEQ ID NO: 1045236 - RNA, 15 nt, Homo sapiens
uaaagaaauugcaau

SEQ ID NO: 1045237 - RNA, 12 nt, Homo sapiens
uaaagauuuauc

SEQ ID NO: 1045238 - RNA, 17 nt, Homo sapiens
uaaagcacaugccuucu

SEQ ID NO: 1045239 - RNA, 16 nt, Homo sapiens
uaaagcaggugcccag

SEQ ID NO: 1045240 - RNA, 21 nt, Homo sapiens
uaaagccaacacccugucuaa

SEQ ID NO: 1045241 - RNA, 18 nt, Homo sapiens
uaaagcguuugcauuugc

SEQ ID NO: 1045242 - RNA, 16 nt, Homo sapiens
uaaagcugaaaacugc

SEQ ID NO: 1045243 - RNA, 17 nt, Homo sapiens
uaaagcuuugugcagau

SEQ ID NO: 1045244 - RNA, 16 nt, Homo sapiens
uaaaggaauuccccaa

SEQ ID NO: 1045245 - RNA, 23 nt, Homo sapiens
uaaaggcuugauauuuuccaaau

SEQ ID NO: 1045246 - RNA, 14 nt, Homo sapiens
uaaaguaugugcau

SEQ ID NO: 1045247 - RNA, 15 nt, Homo sapiens
uaaagucacagaauu

SEQ ID NO: 1045248 - RNA, 21 nt, Homo sapiens
uaaagugaauaaccacuuaaa

SEQ ID NO: 1045249 - RNA, 15 nt, Homo sapiens
uaaauaaaucauuaa

SEQ ID NO: 1045250 - RNA, 15 nt, Homo sapiens
uaaauaacaaaucuc

SEQ ID NO: 1045251 - RNA, 20 nt, Homo sapiens
uaaauaagauuuaauucaca

SEQ ID NO: 1045252 - RNA, 22 nt, Homo sapiens
uaaauaauauagccugguguga

SEQ ID NO: 1045253 - RNA, 15 nt, Homo sapiens
uaaauagaguuugcu

SEQ ID NO: 1045254 - RNA, 14 nt, Homo sapiens
uaaauagugcagaa

SEQ ID NO: 1045255 - RNA, 18 nt, Homo sapiens
uaaauaguuuaugauucc

SEQ ID NO: 1045256 - RNA, 18 nt, Homo sapiens
uaaauaucacaucacuua

SEQ ID NO: 1045257 - RNA, 17 nt, Homo sapiens
uaaauauuagaagccug

SEQ ID NO: 1045258 - RNA, 18 nt, Homo sapiens
uaaauauuuauguagaug

SEQ ID NO: 1045259 - RNA, 16 nt, Homo sapiens
uaaauauuucaagaca

SEQ ID NO: 1045260 - RNA, 17 nt, Homo sapiens
uaaauauuucaggcaua

SEQ ID NO: 1045261 - RNA, 15 nt, Homo sapiens
uaaaucaagagcuua

SEQ ID NO: 1045262 - RNA, 12 nt, Homo sapiens
uaaaucuaugaa

SEQ ID NO: 1045263 - RNA, 14 nt, Homo sapiens
uaaaucugugauga

SEQ ID NO: 1045264 - RNA, 15 nt, Homo sapiens
uaaaucuugcaacug

SEQ ID NO: 1045265 - RNA, 21 nt, Homo sapiens
uaaaucuuucuuuugauucuu

SEQ ID NO: 1045266 - RNA, 23 nt, Homo sapiens
uaaaugaaauuguaaaaccuguc

SEQ ID NO: 1045267 - RNA, 15 nt, Homo sapiens
uaaaugaagcagcuu

SEQ ID NO: 1045268 - RNA, 15 nt, Homo sapiens
uaaaugagcuaugua

SEQ ID NO: 1045269 - RNA, 19 nt, Homo sapiens
uaaaugccaggccuggcaa

SEQ ID NO: 1045270 - RNA, 15 nt, Homo sapiens
uaaauguaacagucu

SEQ ID NO: 1045271 - RNA, 14 nt, Homo sapiens
uaaauguacauuaa

SEQ ID NO: 1045272 - RNA, 19 nt, Homo sapiens
uaaauguaucuuauucaca

SEQ ID NO: 1045273 - RNA, 18 nt, Homo sapiens
uaaaugucuuaaucauga

SEQ ID NO: 1045274 - RNA, 14 nt, Homo sapiens
uaaaugugaacuua

SEQ ID NO: 1045275 - RNA, 11 nt, Homo sapiens
uaaaugugcag

SEQ ID NO: 1045276 - RNA, 20 nt, Homo sapiens
uaaauguggagaaacuguag

SEQ ID NO: 1045277 - RNA, 16 nt, Homo sapiens
uaaauguuuguguuaa

SEQ ID NO: 1045278 - RNA, 22 nt, Homo sapiens
uaaauuaaaagcccuaccuaaa

SEQ ID NO: 1045279 - RNA, 19 nt, Homo sapiens
uaaauuacuuuuucauucu

SEQ ID NO: 1045280 - RNA, 23 nt, Homo sapiens
uaaauuaugcuuucuauuuugag

SEQ ID NO: 1045281 - RNA, 20 nt, Homo sapiens
uaaauuauuaguuuacauca

SEQ ID NO: 1045282 - RNA, 15 nt, Homo sapiens
uaaauuuaugugaug

SEQ ID NO: 1045283 - RNA, 19 nt, Homo sapiens
uaaauuuccccaacagugu

SEQ ID NO: 1045284 - RNA, 21 nt, Homo sapiens
uaaauuuccccaacaguguga

SEQ ID NO: 1045285 - RNA, 17 nt, Homo sapiens
uaaauuuguguucucaa

SEQ ID NO: 1045286 - RNA, 18 nt, Homo sapiens
uaaauuuuauaacagaau

SEQ ID NO: 1045287 - RNA, 21 nt, Homo sapiens
uaaauuuuauaacagaauuaa

SEQ ID NO: 1045288 - RNA, 14 nt, Homo sapiens
uaacaacuaugauu

SEQ ID NO: 1045289 - RNA, 17 nt, Homo sapiens
uaacaagaccucagugc

SEQ ID NO: 1045290 - RNA, 23 nt, Homo sapiens
uaacaagaccucagugccuuccu

SEQ ID NO: 1045291 - RNA, 18 nt, Homo sapiens
uaacaagucgaugaacua

SEQ ID NO: 1045292 - RNA, 20 nt, Homo sapiens
uaacaagucgaugaacuauu

SEQ ID NO: 1045293 - RNA, 14 nt, Homo sapiens
uaacacaagccaca

SEQ ID NO: 1045294 - RNA, 12 nt, Homo sapiens
uaacacacagcu

SEQ ID NO: 1045295 - RNA, 16 nt, Homo sapiens
uaacagaaauguacag

SEQ ID NO: 1045296 - RNA, 10 nt, Homo sapiens
uaacagaauu

SEQ ID NO: 1045297 - RNA, 19 nt, Homo sapiens
uaacagaauuaaaguagau

SEQ ID NO: 1045298 - RNA, 23 nt, Homo sapiens
uaacagaccacuguauguuuacu

SEQ ID NO: 1045299 - RNA, 20 nt, Homo sapiens
uaacagaugcaaugugcuac

SEQ ID NO: 1045300 - RNA, 18 nt, Homo sapiens
uaacagcuguggcucacg

SEQ ID NO: 1045301 - RNA, 16 nt, Homo sapiens
uaacaggcagauacag

SEQ ID NO: 1045302 - RNA, 18 nt, Homo sapiens
uaacaggucuccucuuaa

SEQ ID NO: 1045303 - RNA, 21 nt, Homo sapiens
uaacaguucauguuugcuuca

SEQ ID NO: 1045304 - RNA, 17 nt, Homo sapiens
uaacaguuuuccaugaa

SEQ ID NO: 1045305 - RNA, 22 nt, Homo sapiens
uaacauaauuuguacauaugua

SEQ ID NO: 1045306 - RNA, 21 nt, Homo sapiens
uaacauguaauuaaguacuau

SEQ ID NO: 1045307 - RNA, 13 nt, Homo sapiens
uaacauuaccuua

SEQ ID NO: 1045308 - RNA, 14 nt, Homo sapiens
uaacauuugccuua

SEQ ID NO: 1045309 - RNA, 22 nt, Homo sapiens
uaaccaaagcccaaagugguau

SEQ ID NO: 1045310 - RNA, 21 nt, Homo sapiens
uaaccacaaagcacaguuuga

SEQ ID NO: 1045311 - RNA, 12 nt, Homo sapiens
uaaccacugugg

SEQ ID NO: 1045312 - RNA, 15 nt, Homo sapiens
uaaccccaaaccucc

SEQ ID NO: 1045313 - RNA, 20 nt, Homo sapiens
uaacccgcucaucacuggau

SEQ ID NO: 1045314 - RNA, 20 nt, Homo sapiens
uaacccuaggcaucacaugc

SEQ ID NO: 1045315 - RNA, 22 nt, Homo sapiens
uaaccgucaauaggcaaagggg

SEQ ID NO: 1045316 - RNA, 19 nt, Homo sapiens
uaaccucagugucauuuau

SEQ ID NO: 1045317 - RNA, 22 nt, Homo sapiens
uaaccugcuagacacauuuuua

SEQ ID NO: 1045318 - RNA, 24 nt, Homo sapiens
uaaccuggguaaaugcagcgugaa

SEQ ID NO: 1045319 - RNA, 16 nt, Homo sapiens
uaacgagaaauagaaa

SEQ ID NO: 1045320 - RNA, 16 nt, Homo sapiens
uaacgcagcacuuaga

SEQ ID NO: 1045321 - RNA, 14 nt, Homo sapiens
uaacgucaugugca

SEQ ID NO: 1045322 - RNA, 18 nt, Homo sapiens
uaacuaaugucucuacaa

SEQ ID NO: 1045323 - RNA, 19 nt, Homo sapiens
uaacuagaaaucugccaau

SEQ ID NO: 1045324 - RNA, 17 nt, Homo sapiens
uaacuagaauuuauuca

SEQ ID NO: 1045325 - RNA, 18 nt, Homo sapiens
uaacuauauuugcuuuuu

SEQ ID NO: 1045326 - RNA, 17 nt, Homo sapiens
uaacucaauauuuucca

SEQ ID NO: 1045327 - RNA, 15 nt, Homo sapiens
uaacucuggugcucu

SEQ ID NO: 1045328 - RNA, 11 nt, Homo sapiens
uaacugagauu

SEQ ID NO: 1045329 - RNA, 11 nt, Homo sapiens
ucucucucuuu

SEQ ID NO: 1045330 - RNA, 21 nt, Homo sapiens
ucucucuggcccucuaccccu

SEQ ID NO: 1045331 - RNA, 19 nt, Homo sapiens
ucucucuugcuuacaaaug

SEQ ID NO: 1045332 - RNA, 9 nt, Homo sapiens
ucucucuuu

SEQ ID NO: 1045333 - RNA, 17 nt, Homo sapiens
ucucugaagcauguuuc

SEQ ID NO: 1045334 - RNA, 16 nt, Homo sapiens
ucucugagcacccaag

SEQ ID NO: 1045335 - RNA, 21 nt, Homo sapiens
ucucugagcacccaagccagg

SEQ ID NO: 1045336 - RNA, 12 nt, Homo sapiens
ucucugcuugca

SEQ ID NO: 1045337 - RNA, 17 nt, Homo sapiens
ucucuggaaagggggga

SEQ ID NO: 1045338 - RNA, 14 nt, Homo sapiens
ucucuggaguauuc

SEQ ID NO: 1045339 - RNA, 17 nt, Homo sapiens
ucucuggcuggggagca

SEQ ID NO: 1045340 - RNA, 13 nt, Homo sapiens
ucucugucucaaa

SEQ ID NO: 1045341 - RNA, 15 nt, Homo sapiens
ucucugucucaaauu

SEQ ID NO: 1045342 - RNA, 16 nt, Homo sapiens
ucucuuauagaauauu

SEQ ID NO: 1045343 - RNA, 14 nt, Homo sapiens
ucucuucuuuaaag

SEQ ID NO: 1045344 - RNA, 15 nt, Homo sapiens
ucucuuuaccuccua

SEQ ID NO: 1045345 - RNA, 22 nt, Homo sapiens
ucucuuuugagcuaaucuucau

SEQ ID NO: 1045346 - RNA, 23 nt, Homo sapiens
ucucuuuuuagagaaauuugcca

SEQ ID NO: 1045347 - RNA, 19 nt, Homo sapiens
ucugaaaauauaaccagcc

SEQ ID NO: 1045348 - RNA, 18 nt, Homo sapiens
ucugaaaauuaacacugc

SEQ ID NO: 1045349 - RNA, 17 nt, Homo sapiens
ucugaagccucacuuau

SEQ ID NO: 1045350 - RNA, 21 nt, Homo sapiens
ucugaaggagccccauuccug

SEQ ID NO: 1045351 - RNA, 13 nt, Homo sapiens
ucugaagucacau

SEQ ID NO: 1045352 - RNA, 18 nt, Homo sapiens
ucugaauacaaagugaug

SEQ ID NO: 1045353 - RNA, 16 nt, Homo sapiens
ucugaaucaaggugau

SEQ ID NO: 1045354 - RNA, 18 nt, Homo sapiens
ucugaauuugagauacaa

SEQ ID NO: 1045355 - RNA, 14 nt, Homo sapiens
ucugacacacagcu

SEQ ID NO: 1045356 - RNA, 22 nt, Homo sapiens
ucugacagaaagcagauaccuc

SEQ ID NO: 1045357 - RNA, 13 nt, Homo sapiens
ucugaccaaaaca

SEQ ID NO: 1045358 - RNA, 13 nt, Homo sapiens
ucugaccauuuca

SEQ ID NO: 1045359 - RNA, 15 nt, Homo sapiens
ucugacucugagcua

SEQ ID NO: 1045360 - RNA, 19 nt, Homo sapiens
ucugagaaagacuauucaa

SEQ ID NO: 1045361 - RNA, 17 nt, Homo sapiens
ucugagaauuccaagga

SEQ ID NO: 1045362 - RNA, 20 nt, Homo sapiens
ucugagcaagagcuggcaaa

SEQ ID NO: 1045363 - RNA, 23 nt, Homo sapiens
ucugagcagugcuugaaugaagu

SEQ ID NO: 1045364 - RNA, 11 nt, Homo sapiens
ucugagcccac

SEQ ID NO: 1045365 - RNA, 16 nt, Homo sapiens
ucugagcuaacuuaua

SEQ ID NO: 1045366 - RNA, 16 nt, Homo sapiens
ucugaggacauuccaa

SEQ ID NO: 1045367 - RNA, 21 nt, Homo sapiens
ucugagggaggaggccaccuc

SEQ ID NO: 1045368 - RNA, 19 nt, Homo sapiens
ucugaggguccacuacuca

SEQ ID NO: 1045369 - RNA, 13 nt, Homo sapiens
ucugaggucauua

SEQ ID NO: 1045370 - RNA, 20 nt, Homo sapiens
ucugaguaagaaacagaauc

SEQ ID NO: 1045371 - RNA, 20 nt, Homo sapiens
ucugaguaagcccucaggag

SEQ ID NO: 1045372 - RNA, 17 nt, Homo sapiens
ucugauaggaaugugaa

SEQ ID NO: 1045373 - RNA, 16 nt, Homo sapiens
ucugauauaacaaacu

SEQ ID NO: 1045374 - RNA, 22 nt, Homo sapiens
ucugaucauccacugugccaug

SEQ ID NO: 1045375 - RNA, 22 nt, Homo sapiens
ucugaucugcaguuuuugccug

SEQ ID NO: 1045376 - RNA, 13 nt, Homo sapiens
ucugaugcaagca

SEQ ID NO: 1045377 - RNA, 12 nt, Homo sapiens
ucugauuacaca

SEQ ID NO: 1045378 - RNA, 14 nt, Homo sapiens
ucugauuggcucac

SEQ ID NO: 1045379 - RNA, 18 nt, Homo sapiens
ucugauuuccuaauguca

SEQ ID NO: 1045380 - RNA, 20 nt, Homo sapiens
ucugauuuuggccaucagga

SEQ ID NO: 1045381 - RNA, 19 nt, Homo sapiens
ucugcaaaggcaccugaau

SEQ ID NO: 1045382 - RNA, 21 nt, Homo sapiens
ucugcaagcacaucugcauuu

SEQ ID NO: 1045383 - RNA, 15 nt, Homo sapiens
ucugcacaugucuug

SEQ ID NO: 1045384 - RNA, 12 nt, Homo sapiens
ucugcacucuaa

SEQ ID NO: 1045385 - RNA, 23 nt, Homo sapiens
ucugcagggggugugucugcuca

SEQ ID NO: 1045386 - RNA, 15 nt, Homo sapiens
ucugcauuuugcuau

SEQ ID NO: 1045387 - RNA, 18 nt, Homo sapiens
ucugccagccagcagcca

SEQ ID NO: 1045388 - RNA, 13 nt, Homo sapiens
ucugcccaggugu

SEQ ID NO: 1045389 - RNA, 21 nt, Homo sapiens
ucugcccuugccaacggagag

SEQ ID NO: 1045390 - RNA, 22 nt, Homo sapiens
ucugccugcaccccugcaguuu

SEQ ID NO: 1045391 - RNA, 18 nt, Homo sapiens
ucugccuugguauagcau

SEQ ID NO: 1045392 - RNA, 23 nt, Homo sapiens
ucugcggcuguguaguaaaucuc

SEQ ID NO: 1045393 - RNA, 20 nt, Homo sapiens
ucugcgugucaccugugcuu

SEQ ID NO: 1045394 - RNA, 18 nt, Homo sapiens
ucugcuaccucacugggg

SEQ ID NO: 1045395 - RNA, 12 nt, Homo sapiens
ucugcuagggaa

SEQ ID NO: 1045396 - RNA, 18 nt, Homo sapiens
ucugcuccucuccaggca

SEQ ID NO: 1045397 - RNA, 12 nt, Homo sapiens
ucugcugaucuc

SEQ ID NO: 1045398 - RNA, 21 nt, Homo sapiens
ucugcuggcagaaagcaaaug

SEQ ID NO: 1045399 - RNA, 19 nt, Homo sapiens
ucugcuggccuggaucucc

SEQ ID NO: 1045400 - RNA, 23 nt, Homo sapiens
ucugcuggggauggccacuguga

SEQ ID NO: 1045401 - RNA, 15 nt, Homo sapiens
ucugcuuaaucugag

SEQ ID NO: 1045402 - RNA, 17 nt, Homo sapiens
ucugcuuaaucugagaa

SEQ ID NO: 1045403 - RNA, 18 nt, Homo sapiens
ucugcuuaaucugagaau

SEQ ID NO: 1045404 - RNA, 19 nt, Homo sapiens
ucugcuuacaauucccugc

SEQ ID NO: 1045405 - RNA, 19 nt, Homo sapiens
ucugcuuuugaaaucugua

SEQ ID NO: 1045406 - RNA, 17 nt, Homo sapiens
ucuggaccccaucugug

SEQ ID NO: 1045407 - RNA, 20 nt, Homo sapiens
ucuggagaagcucccaggaa

SEQ ID NO: 1045408 - RNA, 16 nt, Homo sapiens
ucuggaucuccugacc

SEQ ID NO: 1045409 - RNA, 13 nt, Homo sapiens
ucuggaugcauuu

SEQ ID NO: 1045410 - RNA, 20 nt, Homo sapiens
ucuggcaacccuagucugcu

SEQ ID NO: 1045411 - RNA, 23 nt, Homo sapiens
ucuggcacccuguccgucuccag

SEQ ID NO: 1045412 - RNA, 12 nt, Homo sapiens
ucuggcagcuca

SEQ ID NO: 1045413 - RNA, 19 nt, Homo sapiens
ucuggcccucuaccccuga

SEQ ID NO: 1045414 - RNA, 17 nt, Homo sapiens
ucuggccugaacugagg

SEQ ID NO: 1045415 - RNA, 23 nt, Homo sapiens
ucugggauauuuccauauggcaa

SEQ ID NO: 1045416 - RNA, 18 nt, Homo sapiens
ucugggauucccaccaag

SEQ ID NO: 1045417 - RNA, 17 nt, Homo sapiens
ucugggccaaguuccuc

SEQ ID NO: 1045418 - RNA, 18 nt, Homo sapiens
ucugggcugccaugugaa

SEQ ID NO: 1045419 - RNA, 17 nt, Homo sapiens
ucugggggaguggaaua

SEQ ID NO: 1045420 - RNA, 22 nt, Homo sapiens
ucugggguccauucucugaguc

SEQ ID NO: 1045421 - RNA, 15 nt, Homo sapiens
ucuggguagcuguaa

SEQ ID NO: 1045422 - RNA, 14 nt, Homo sapiens
ucuggguccuugca

SEQ ID NO: 1045423 - RNA, 14 nt, Homo sapiens
ucugggucugaguc

SEQ ID NO: 1045424 - RNA, 16 nt, Homo sapiens
ucuggugacaccagcc

SEQ ID NO: 1045425 - RNA, 18 nt, Homo sapiens
ucugguggucucugcuug

SEQ ID NO: 1045426 - RNA, 22 nt, Homo sapiens
ucuguaaaagcagacccaccuc

SEQ ID NO: 1045427 - RNA, 14 nt, Homo sapiens
ucuguaaacucaaa

SEQ ID NO: 1045428 - RNA, 16 nt, Homo sapiens
ucuguacauagccuau

SEQ ID NO: 1045429 - RNA, 15 nt, Homo sapiens
ucuguagggaacucu

SEQ ID NO: 1045430 - RNA, 15 nt, Homo sapiens
ucuguagugagauag

SEQ ID NO: 1045431 - RNA, 18 nt, Homo sapiens
ucuguagugagauagcau

SEQ ID NO: 1045432 - RNA, 19 nt, Homo sapiens
ucugucacuuaauugcuac

SEQ ID NO: 1045433 - RNA, 11 nt, Homo sapiens
ucugucuucaa

SEQ ID NO: 1045434 - RNA, 15 nt, Homo sapiens
ucugucuucuuugcc

SEQ ID NO: 1045435 - RNA, 14 nt, Homo sapiens
ucugugaaauacug

SEQ ID NO: 1045436 - RNA, 14 nt, Homo sapiens
ucugugaugauccu

SEQ ID NO: 1045437 - RNA, 22 nt, Homo sapiens
ucugugcaaauccuugauacug

SEQ ID NO: 1045438 - RNA, 16 nt, Homo sapiens
ucugugccccaugccu

SEQ ID NO: 1045439 - RNA, 14 nt, Homo sapiens
ucugugccugaaua

SEQ ID NO: 1045440 - RNA, 19 nt, Homo sapiens
ucugugggcuccauguaga

SEQ ID NO: 1045441 - RNA, 19 nt, Homo sapiens
ucuguguguguguaugugg

SEQ ID NO: 1045442 - RNA, 18 nt, Homo sapiens
ucuguguuuuauugacau

SEQ ID NO: 1045443 - RNA, 22 nt, Homo sapiens
ucuguguuuugaaugguguugu

SEQ ID NO: 1045444 - RNA, 15 nt, Homo sapiens
ucuguuaaucaugua

SEQ ID NO: 1045445 - RNA, 15 nt, Homo sapiens
ucuguugucauugcu

SEQ ID NO: 1045446 - RNA, 17 nt, Homo sapiens
ucuguugucauugcugu

SEQ ID NO: 1045447 - RNA, 20 nt, Homo sapiens
ucuguuuauaaacauuguau

SEQ ID NO: 1045448 - RNA, 21 nt, Homo sapiens
ucuguuuauaaacauuguaua

SEQ ID NO: 1045449 - RNA, 18 nt, Homo sapiens
ucuuaaaacacuuuucaa

SEQ ID NO: 1045450 - RNA, 21 nt, Homo sapiens
ucuuaaaaugaauuauguuau

SEQ ID NO: 1045451 - RNA, 22 nt, Homo sapiens
ucuuaaauuuugugauauggag

SEQ ID NO: 1045452 - RNA, 13 nt, Homo sapiens
ucuuaacuugaag

SEQ ID NO: 1045453 - RNA, 20 nt, Homo sapiens
ucuuaagaaaaugaugcugg

SEQ ID NO: 1045454 - RNA, 12 nt, Homo sapiens
ucuuaagccauc

SEQ ID NO: 1045455 - RNA, 22 nt, Homo sapiens
ucuuaaguuguggagagugcaa

SEQ ID NO: 1045456 - RNA, 22 nt, Homo sapiens
ucuuaauauuaaauauaugauu

SEQ ID NO: 1045457 - RNA, 12 nt, Homo sapiens
ucuuaaucuuuu

SEQ ID NO: 1045458 - RNA, 17 nt, Homo sapiens
ucuuaauuuugguugua

SEQ ID NO: 1045459 - RNA, 14 nt, Homo sapiens
ucuuacacuacauu

SEQ ID NO: 1045460 - RNA, 13 nt, Homo sapiens
ucuuacaugcauu

SEQ ID NO: 1045461 - RNA, 16 nt, Homo sapiens
ucuuacaugcauuuga

SEQ ID NO: 1045462 - RNA, 22 nt, Homo sapiens
ucuuacuuugaguuagugccau

SEQ ID NO: 1045463 - RNA, 21 nt, Homo sapiens
ucuuagauguauauauuuccu

SEQ ID NO: 1045464 - RNA, 13 nt, Homo sapiens
ucuuaguucucac

SEQ ID NO: 1045465 - RNA, 12 nt, Homo sapiens
ucuuauugcaaa

SEQ ID NO: 1045466 - RNA, 23 nt, Homo sapiens
ucuuauuuaaugaaagacuguac

SEQ ID NO: 1045467 - RNA, 14 nt, Homo sapiens
ucuuauuuccucaa

SEQ ID NO: 1045468 - RNA, 19 nt, Homo sapiens
ucuuauuuguaaagcucac

SEQ ID NO: 1045469 - RNA, 13 nt, Homo sapiens
ucuucaacagcuc

SEQ ID NO: 1045470 - RNA, 16 nt, Homo sapiens
ucuucaaccucauuga

SEQ ID NO: 1045471 - RNA, 13 nt, Homo sapiens
ucuucaagcagau

SEQ ID NO: 1045472 - RNA, 17 nt, Homo sapiens
ucuucacaaaacacuuc

SEQ ID NO: 1045473 - RNA, 23 nt, Homo sapiens
auuaaaacucauuuuuguuuuca

SEQ ID NO: 1045474 - RNA, 12 nt, Homo sapiens
auuaaaagcccu

SEQ ID NO: 1045475 - RNA, 13 nt, Homo sapiens
auuaaaagcccua

SEQ ID NO: 1045476 - RNA, 17 nt, Homo sapiens
auuaaaagucacucuga

SEQ ID NO: 1045477 - RNA, 17 nt, Homo sapiens
auuaaacguaugcaugu

SEQ ID NO: 1045478 - RNA, 15 nt, Homo sapiens
auuaaauaaaucauu

SEQ ID NO: 1045479 - RNA, 17 nt, Homo sapiens
auuaaauacagacacua

SEQ ID NO: 1045480 - RNA, 14 nt, Homo sapiens
auuaaauauaugau

SEQ ID NO: 1045481 - RNA, 16 nt, Homo sapiens
auuaagccuuccacac

SEQ ID NO: 1045482 - RNA, 13 nt, Homo sapiens
auuaauacugaag

SEQ ID NO: 1045483 - RNA, 20 nt, Homo sapiens
auuaauauggggaugcagca

SEQ ID NO: 1045484 - RNA, 19 nt, Homo sapiens
auuaaugaaauaucuguau

SEQ ID NO: 1045485 - RNA, 18 nt, Homo sapiens
auuaaugccauuaucccu

SEQ ID NO: 1045486 - RNA, 13 nt, Homo sapiens
auuaauguuaauu

SEQ ID NO: 1045487 - RNA, 23 nt, Homo sapiens
auuaauguuaauucagcacugau

SEQ ID NO: 1045488 - RNA, 16 nt, Homo sapiens
auuacaaaaacauggc

SEQ ID NO: 1045489 - RNA, 18 nt, Homo sapiens
auuacauaaucuguacaa

SEQ ID NO: 1045490 - RNA, 22 nt, Homo sapiens
auuacauaaucuguacaaugaa

SEQ ID NO: 1045491 - RNA, 18 nt, Homo sapiens
auuacauggggucuagaa

SEQ ID NO: 1045492 - RNA, 21 nt, Homo sapiens
auuaccacucaggcauuugac

SEQ ID NO: 1045493 - RNA, 13 nt, Homo sapiens
auuaccaguuuuc

SEQ ID NO: 1045494 - RNA, 16 nt, Homo sapiens
auuaccuaguagucau

SEQ ID NO: 1045495 - RNA, 17 nt, Homo sapiens
auuaccucugauaccuc

SEQ ID NO: 1045496 - RNA, 15 nt, Homo sapiens
auuacuagaagauga

SEQ ID NO: 1045497 - RNA, 11 nt, Homo sapiens
auuacuggcaa

SEQ ID NO: 1045498 - RNA, 19 nt, Homo sapiens
cgcaugugcagcuauuuaa

SEQ ID NO: 1045499 - RNA, 20 nt, Homo sapiens
cgccaaggcuggagugcagu

SEQ ID NO: 1045500 - RNA, 21 nt, Homo sapiens
cgccaaggcuggagugcagug

SEQ ID NO: 1045501 - RNA, 19 nt, Homo sapiens
cgccagauucuuuccugag

SEQ ID NO: 1045502 - RNA, 16 nt, Homo sapiens
cgccauugcacuccag

SEQ ID NO: 1045503 - RNA, 15 nt, Homo sapiens
cgcccaaggcccacg

SEQ ID NO: 1045504 - RNA, 21 nt, Homo sapiens
cgcccagucuggaaugcagug

SEQ ID NO: 1045505 - RNA, 14 nt, Homo sapiens
cgcccccaccucca

SEQ ID NO: 1045506 - RNA, 21 nt, Homo sapiens
cgccuaugaucccagcacuuu

SEQ ID NO: 1045507 - RNA, 21 nt, Homo sapiens
cgccugccaguccuagcugca

SEQ ID NO: 1045508 - RNA, 23 nt, Homo sapiens
cgcgugaucaaagccacacucug

SEQ ID NO: 1045509 - RNA, 13 nt, Homo sapiens
cgcguguguacac

SEQ ID NO: 1045510 - RNA, 13 nt, Homo sapiens
cgcuaucuagcaa

SEQ ID NO: 1045511 - RNA, 14 nt, Homo sapiens
cgcugcaaagccau

SEQ ID NO: 1045512 - RNA, 16 nt, Homo sapiens
cgcuggaccuugaacu

SEQ ID NO: 1045513 - RNA, 14 nt, Homo sapiens
cgcugggugguacc

SEQ ID NO: 1045514 - RNA, 16 nt, Homo sapiens
cgcuuaguuaucagcu

SEQ ID NO: 1045515 - RNA, 12 nt, Homo sapiens
cgcuuggcauca

SEQ ID NO: 1045516 - RNA, 21 nt, Homo sapiens
cggaagaacccucaggucaca

SEQ ID NO: 1045517 - RNA, 18 nt, Homo sapiens
cggaagcucacagugaca

SEQ ID NO: 1045518 - RNA, 23 nt, Homo sapiens
cggagacggagucccaccuuggc

SEQ ID NO: 1045519 - RNA, 17 nt, Homo sapiens
cggagccuccucucuca

SEQ ID NO: 1045520 - RNA, 13 nt, Homo sapiens
ccccuaaaccaaa

SEQ ID NO: 1045521 - RNA, 14 nt, Homo sapiens
ccccuaaaccaaaa

SEQ ID NO: 1045522 - RNA, 22 nt, Homo sapiens
ccccuaaguuuuauacuugauu

SEQ ID NO: 1045523 - RNA, 13 nt, Homo sapiens
ccccuacaugaaa

SEQ ID NO: 1045524 - RNA, 15 nt, Homo sapiens
ccccuaguaagugcc

SEQ ID NO: 1045525 - RNA, 20 nt, Homo sapiens
ccccucauuguuuauuaaca

SEQ ID NO: 1045526 - RNA, 17 nt, Homo sapiens
ccccucccagaacacac

SEQ ID NO: 1045527 - RNA, 16 nt, Homo sapiens
ccccucccugcuucaa

SEQ ID NO: 1045528 - RNA, 19 nt, Homo sapiens
ccccuccucucugccgcaa

SEQ ID NO: 1045529 - RNA, 21 nt, Homo sapiens
ccccugcauucuuucuguauu

SEQ ID NO: 1045530 - RNA, 14 nt, Homo sapiens
ccccugcuccagaa

SEQ ID NO: 1045531 - RNA, 17 nt, Homo sapiens
ccccuggacugggaggu

SEQ ID NO: 1045532 - RNA, 20 nt, Homo sapiens
ccccuggcccagcggccccu

SEQ ID NO: 1045533 - RNA, 21 nt, Homo sapiens
ccccuguucucuuccacucuc

SEQ ID NO: 1045534 - RNA, 22 nt, Homo sapiens
cccgaggacgcucccugcucca

SEQ ID NO: 1045535 - RNA, 17 nt, Homo sapiens
cccgaguaacugagauu

SEQ ID NO: 1045536 - RNA, 23 nt, Homo sapiens
cccgaucaucuuuccuguuccag

SEQ ID NO: 1045537 - RNA, 22 nt, Homo sapiens
cccgccgccuccugcaccgaga

SEQ ID NO: 1045538 - RNA, 22 nt, Homo sapiens
cccgccgccugguacucaagcc

SEQ ID NO: 1045539 - RNA, 16 nt, Homo sapiens
cccgggggugaagggg

SEQ ID NO: 1045540 - RNA, 14 nt, Homo sapiens
cccgucauguuccu

SEQ ID NO: 1045541 - RNA, 16 nt, Homo sapiens
cccgucauguuccuca

SEQ ID NO: 1045542 - RNA, 15 nt, Homo sapiens
cccguccacagggca

SEQ ID NO: 1045543 - RNA, 17 nt, Homo sapiens
cccuaaaagcacacuca

SEQ ID NO: 1045544 - RNA, 22 nt, Homo sapiens
cccuaccguccuccugagccac

SEQ ID NO: 1045545 - RNA, 11 nt, Homo sapiens
cccuaccuaaa

SEQ ID NO: 1045546 - RNA, 14 nt, Homo sapiens
cccuaggagaccaa

SEQ ID NO: 1045547 - RNA, 14 nt, Homo sapiens
cccuaggcaucaca

SEQ ID NO: 1045548 - RNA, 14 nt, Homo sapiens
cccuagggccuuca

SEQ ID NO: 1045549 - RNA, 21 nt, Homo sapiens
cccuagucuauucauuauauu

SEQ ID NO: 1045550 - RNA, 22 nt, Homo sapiens
cccuaugugggugggaccacag

SEQ ID NO: 1045551 - RNA, 20 nt, Homo sapiens
cccucaaaaugacagccaug

SEQ ID NO: 1045552 - RNA, 18 nt, Homo sapiens
cccucaacaccucugcac

SEQ ID NO: 1045553 - RNA, 21 nt, Homo sapiens
cccucaaucccagcuacucaa

SEQ ID NO: 1045554 - RNA, 18 nt, Homo sapiens
cccucaugcuguuccacc

SEQ ID NO: 1045555 - RNA, 14 nt, Homo sapiens
cccuccaaaagcac

SEQ ID NO: 1045556 - RNA, 15 nt, Homo sapiens
cccuccccagagcac

SEQ ID NO: 1045557 - RNA, 13 nt, Homo sapiens
cccucccuuugaa

SEQ ID NO: 1045558 - RNA, 21 nt, Homo sapiens
cuuuccgaggccccugucuca

SEQ ID NO: 1045559 - RNA, 16 nt, Homo sapiens
cuuuccucaucaggcc

SEQ ID NO: 1045560 - RNA, 18 nt, Homo sapiens
cuuuccuguuccagagag

SEQ ID NO: 1045561 - RNA, 14 nt, Homo sapiens
cuuuccuugcucaa

SEQ ID NO: 1045562 - RNA, 22 nt, Homo sapiens
cuuuccuuguuccccaucaucu

SEQ ID NO: 1045563 - RNA, 21 nt, Homo sapiens
cuuucucaggaccuaguugcu

SEQ ID NO: 1045564 - RNA, 20 nt, Homo sapiens
cuuucuccauuguaaaccac

SEQ ID NO: 1045565 - RNA, 16 nt, Homo sapiens
cuuucucgauuggugu

SEQ ID NO: 1045566 - RNA, 17 nt, Homo sapiens
cuuucuuuaccugagac

SEQ ID NO: 1045567 - RNA, 18 nt, Homo sapiens
cuuucuuucuaacuccag

SEQ ID NO: 1045568 - RNA, 14 nt, Homo sapiens
cuuugaacuuugaa

SEQ ID NO: 1045569 - RNA, 17 nt, Homo sapiens
cuuugaagaccaguccu

SEQ ID NO: 1045570 - RNA, 19 nt, Homo sapiens
cuuugaaucaaaaauuuau

SEQ ID NO: 1045571 - RNA, 22 nt, Homo sapiens
cuuugauagauuucuacacuga

SEQ ID NO: 1045572 - RNA, 17 nt, Homo sapiens
cuuugcagccccacaga

SEQ ID NO: 1045573 - RNA, 19 nt, Homo sapiens
cuuugccagaaagcauaaa

SEQ ID NO: 1045574 - RNA, 16 nt, Homo sapiens
cuuugccuccaccauu

SEQ ID NO: 1045575 - RNA, 23 nt, Homo sapiens
cuuugccuuuccauaaucacuca

SEQ ID NO: 1045576 - RNA, 15 nt, Homo sapiens
cuuugcucuuuggua

SEQ ID NO: 1045577 - RNA, 21 nt, Homo sapiens
cuuugcuuuaaguguaacugg

SEQ ID NO: 1045578 - RNA, 21 nt, Homo sapiens
cuuuggacagaagcagcucuu

SEQ ID NO: 1045579 - RNA, 22 nt, Homo sapiens
cuuuggacauagcgaauacaaa

SEQ ID NO: 1045580 - RNA, 16 nt, Homo sapiens
cuuuggagaucaagga

SEQ ID NO: 1045581 - RNA, 17 nt, Homo sapiens
cuuuguaggcauugcau

SEQ ID NO: 1045582 - RNA, 17 nt, Homo sapiens
cuuugucccggggcucc

SEQ ID NO: 1045583 - RNA, 21 nt, Homo sapiens
cuuuguuuguugucagcugaa

SEQ ID NO: 1045584 - RNA, 18 nt, Homo sapiens
cuuuuaaaaaaaaauacu

SEQ ID NO: 1045585 - RNA, 22 nt, Homo sapiens
cuuuuaaaaauucaaaugauuu

SEQ ID NO: 1045586 - RNA, 18 nt, Homo sapiens
cuuuuaaaacacuuccau

SEQ ID NO: 1045587 - RNA, 21 nt, Homo sapiens
cuuuuaaacccuauugguaaa

SEQ ID NO: 1045588 - RNA, 15 nt, Homo sapiens
cuuuuaaaugcauaa

SEQ ID NO: 1045589 - RNA, 23 nt, Homo sapiens
cuuuuaaauucaaauuuuaucuc

SEQ ID NO: 1045590 - RNA, 22 nt, Homo sapiens
cuuuuaaggcuaaaacuuaaca

SEQ ID NO: 1045591 - RNA, 13 nt, Homo sapiens
cuuuuaaguugcu

SEQ ID NO: 1045592 - RNA, 23 nt, Homo sapiens
cuuuuaaguugcugaugaacucu

SEQ ID NO: 1045593 - RNA, 13 nt, Homo sapiens
cuuuuaaugcucc

SEQ ID NO: 1045594 - RNA, 13 nt, Homo sapiens
cuuuuacauucug

SEQ ID NO: 1045595 - RNA, 21 nt, Homo sapiens
cuuuuaggacccuucccuuga

SEQ ID NO: 1045596 - RNA, 20 nt, Homo sapiens
cuuuuauaaacuuuaccuuu

SEQ ID NO: 1045597 - RNA, 19 nt, Homo sapiens
cuuuuauccacuuaccuag

SEQ ID NO: 1045598 - RNA, 12 nt, Homo sapiens
cuuuuauuacau

SEQ ID NO: 1045599 - RNA, 12 nt, Homo sapiens
cuuuucacaaau

SEQ ID NO: 1045600 - RNA, 22 nt, Homo sapiens
cuuuucacucccuccaucaaga

SEQ ID NO: 1045601 - RNA, 13 nt, Homo sapiens
cuuuucacugcug

SEQ ID NO: 1045602 - RNA, 23 nt, Homo sapiens
cuuuucagcgauguaugcagcua

SEQ ID NO: 1045603 - RNA, 14 nt, Homo sapiens
cuuuucuccaugag

SEQ ID NO: 1045604 - RNA, 15 nt, Homo sapiens
cuuuucuccaugagu

SEQ ID NO: 1045605 - RNA, 18 nt, Homo sapiens
cuuuugaauuuuugguua

SEQ ID NO: 1045606 - RNA, 20 nt, Homo sapiens
cuuuugcuugaaaccaaaga

SEQ ID NO: 1045607 - RNA, 13 nt, Homo sapiens
cuuuugucccaga

SEQ ID NO: 1045608 - RNA, 18 nt, Homo sapiens
cuuuugugguccuguaaa

SEQ ID NO: 1045609 - RNA, 23 nt, Homo sapiens
cuuuuuauacuuuguaaagacaa

SEQ ID NO: 1045610 - RNA, 19 nt, Homo sapiens
cuuuuucagaaacagugag

SEQ ID NO: 1045611 - RNA, 12 nt, Homo sapiens
cuuuuuccagag

SEQ ID NO: 1045612 - RNA, 20 nt, Homo sapiens
cuuuuuccuggcucaucucu

SEQ ID NO: 1045613 - RNA, 23 nt, Homo sapiens
cuuuuugguuugcagaugacaaa

SEQ ID NO: 1045614 - RNA, 21 nt, Homo sapiens
cuuuuuuccuccuguguacag

SEQ ID NO: 1045615 - RNA, 22 nt, Homo sapiens
gaaaaaaaaaaaaaagccuuug

SEQ ID NO: 1045616 - RNA, 17 nt, Homo sapiens
gaaaaaaagaaguaugu

SEQ ID NO: 1045617 - RNA, 17 nt, Homo sapiens
gaaaaaaaguacaugua

SEQ ID NO: 1045618 - RNA, 18 nt, Homo sapiens
gaaaaaaggacaauuuca

SEQ ID NO: 1045619 - RNA, 15 nt, Homo sapiens
gaaaaagucauccaa

SEQ ID NO: 1045620 - RNA, 19 nt, Homo sapiens
gaaaaaguucugcagauaa

SEQ ID NO: 1045621 - RNA, 20 nt, Homo sapiens
gaaaaaucaccacaccaaac

SEQ ID NO: 1045622 - RNA, 15 nt, Homo sapiens
gaaaacacugugcac

SEQ ID NO: 1045623 - RNA, 17 nt, Homo sapiens
gaaaacacuguucucug

SEQ ID NO: 1045624 - RNA, 13 nt, Homo sapiens
gaaaacauuccau

SEQ ID NO: 1045625 - RNA, 23 nt, Homo sapiens
gaaaacugccuuuuaucugccca

SEQ ID NO: 1045626 - RNA, 15 nt, Homo sapiens
gaaaagaaaccagag

SEQ ID NO: 1045627 - RNA, 18 nt, Homo sapiens
gaaaagauuaugaucuca

SEQ ID NO: 1045628 - RNA, 19 nt, Homo sapiens
gaaaagcaguggcuccauu

SEQ ID NO: 1045629 - RNA, 19 nt, Homo sapiens
gaaaagcggacaucagcug

SEQ ID NO: 1045630 - RNA, 23 nt, Homo sapiens
gaaaagcuauuagccaggaucau

SEQ ID NO: 1045631 - RNA, 17 nt, Homo sapiens
gaaaagcucacuaagaa

SEQ ID NO: 1045632 - RNA, 15 nt, Homo sapiens
gaaaagcugcugaca

SEQ ID NO: 1045633 - RNA, 23 nt, Homo sapiens
gaaaaguaucccggaagcucaca

SEQ ID NO: 1045634 - RNA, 19 nt, Homo sapiens
gaaaauaguggugugauuu

SEQ ID NO: 1045635 - RNA, 17 nt, Homo sapiens
gaaaaucucagcaauga

SEQ ID NO: 1045636 - RNA, 23 nt, Homo sapiens
gaaaaugauugcuuaucaguagu

SEQ ID NO: 1045637 - RNA, 15 nt, Homo sapiens
gaaaauguccucccu

SEQ ID NO: 1045638 - RNA, 12 nt, Homo sapiens
gaaaaugugcaa

SEQ ID NO: 1045639 - RNA, 14 nt, Homo sapiens
gaaaaugugcaaua

SEQ ID NO: 1045640 - RNA, 15 nt, Homo sapiens
gaaaauuaacacugc

SEQ ID NO: 1045641 - RNA, 14 nt, Homo sapiens
gaaaauuauuugca

SEQ ID NO: 1045642 - RNA, 16 nt, Homo sapiens
gaaaauucgaaccagg

SEQ ID NO: 1045643 - RNA, 21 nt, Homo sapiens
gaaaauucuguagguucugug

SEQ ID NO: 1045644 - RNA, 23 nt, Homo sapiens
gaaacaaaacuagguaaaaucua

SEQ ID NO: 1045645 - RNA, 22 nt, Homo sapiens
gaaacaaagaagguuaccaaga

SEQ ID NO: 1045646 - RNA, 20 nt, Homo sapiens
gaaacaaauaagaccauaaa

SEQ ID NO: 1045647 - RNA, 22 nt, Homo sapiens
gaaacaacaauuucuacuuuga

SEQ ID NO: 1045648 - RNA, 23 nt, Homo sapiens
gaaacaacaauuucuacuuugaa

SEQ ID NO: 1045649 - RNA, 23 nt, Homo sapiens
gaaacacaucuucccuagagggu

SEQ ID NO: 1045650 - RNA, 21 nt, Homo sapiens
gaaacaccuucucuggagcca

SEQ ID NO: 1045651 - RNA, 15 nt, Homo sapiens
gaaacacuaaagcau

SEQ ID NO: 1045652 - RNA, 22 nt, Homo sapiens
gaaaccaaaguaaccuuuugca

SEQ ID NO: 1045653 - RNA, 19 nt, Homo sapiens
gaaaccccaucucuacuaa

SEQ ID NO: 1045654 - RNA, 18 nt, Homo sapiens
gaaacccgacagagggaa

SEQ ID NO: 1045655 - RNA, 20 nt, Homo sapiens
gaaaccuuauuguaccucuc

SEQ ID NO: 1045656 - RNA, 21 nt, Homo sapiens
gaaacguuuggaacaaucuaa

SEQ ID NO: 1045657 - RNA, 13 nt, Homo sapiens
gaaacuccauuga

SEQ ID NO: 1045658 - RNA, 17 nt, Homo sapiens
gaaacugcgaggccagu

SEQ ID NO: 1045659 - RNA, 18 nt, Homo sapiens
gaaacuggaugaggucau

SEQ ID NO: 1045660 - RNA, 17 nt, Homo sapiens
gaaacuguagucucagg

SEQ ID NO: 1045661 - RNA, 18 nt, Homo sapiens
gaaacuguagucucagga

SEQ ID NO: 1045662 - RNA, 17 nt, Homo sapiens
gaaacuugcauacagag

SEQ ID NO: 1045663 - RNA, 16 nt, Homo sapiens
gaaagaaaaagcaaua

SEQ ID NO: 1045664 - RNA, 23 nt, Homo sapiens
gaaagaaaguugcacggcugcug

SEQ ID NO: 1045665 - RNA, 18 nt, Homo sapiens
gaaagacagagcugggau

SEQ ID NO: 1045666 - RNA, 12 nt, Homo sapiens
gaaagacaucca

SEQ ID NO: 1045667 - RNA, 17 nt, Homo sapiens
gaaagaggaagcuuucu

SEQ ID NO: 1045668 - RNA, 21 nt, Homo sapiens
gaaagaguaaaggaaaugauu

SEQ ID NO: 1045669 - RNA, 14 nt, Homo sapiens
gaaagauggaacuu

SEQ ID NO: 1045670 - RNA, 13 nt, Homo sapiens
gaaagauuacuuu

SEQ ID NO: 1045671 - RNA, 18 nt, Homo sapiens
gaaagcagggacuugaac

SEQ ID NO: 1045672 - RNA, 18 nt, Homo sapiens
gaaagcaucaccucaggc

SEQ ID NO: 1045673 - RNA, 19 nt, Homo sapiens
gaaagcauuacauuuccaa

SEQ ID NO: 1045674 - RNA, 15 nt, Homo sapiens
gaaagccucagccau

SEQ ID NO: 1045675 - RNA, 20 nt, Homo sapiens
gaaagccucagccauucacu

SEQ ID NO: 1045676 - RNA, 19 nt, Homo sapiens
gaaagccucugcugccaug

SEQ ID NO: 1045677 - RNA, 17 nt, Homo sapiens
gaaagcuggugucugau

SEQ ID NO: 1045678 - RNA, 18 nt, Homo sapiens
gaaagcuucaaacugcau

SEQ ID NO: 1045679 - RNA, 21 nt, Homo sapiens
gaaaggagaacuauccaaaac

SEQ ID NO: 1045680 - RNA, 22 nt, Homo sapiens
gaaaggcaaaugcccaagggaa

SEQ ID NO: 1045681 - RNA, 13 nt, Homo sapiens
gaaaggccaauaa

SEQ ID NO: 1045682 - RNA, 23 nt, Homo sapiens
gaaaggcgcuuggcaucacacau

SEQ ID NO: 1045683 - RNA, 13 nt, Homo sapiens
gaaagguagugua

SEQ ID NO: 1045684 - RNA, 20 nt, Homo sapiens
gaaagguuugagaagcacug

SEQ ID NO: 1045685 - RNA, 22 nt, Homo sapiens
gaaaguaaauauuucaggcaua

SEQ ID NO: 1045686 - RNA, 21 nt, Homo sapiens
gaaaguagaucauguucacug

SEQ ID NO: 1045687 - RNA, 23 nt, Homo sapiens
gaaaguccaauuccaaagccaga

SEQ ID NO: 1045688 - RNA, 19 nt, Homo sapiens
gaaagugcauuaaacugaa

SEQ ID NO: 1045689 - RNA, 22 nt, Homo sapiens
gaaagugcauuaaacugaauca

SEQ ID NO: 1045690 - RNA, 13 nt, Homo sapiens
gaaauaaaacugu

SEQ ID NO: 1045691 - RNA, 19 nt, Homo sapiens
gaaauaaaguuggugacag

SEQ ID NO: 1045692 - RNA, 18 nt, Homo sapiens
gaaauaagcccaacagac

SEQ ID NO: 1045693 - RNA, 17 nt, Homo sapiens
gaaauacauggacaaua

SEQ ID NO: 1045694 - RNA, 19 nt, Homo sapiens
gaaauaccaguucugggca

SEQ ID NO: 1045695 - RNA, 20 nt, Homo sapiens
gaaauacugaggggucucca

SEQ ID NO: 1045696 - RNA, 14 nt, Homo sapiens
gaaauacuguacaa

SEQ ID NO: 1045697 - RNA, 14 nt, Homo sapiens
gaaauagaagcaaa

SEQ ID NO: 1045698 - RNA, 21 nt, Homo sapiens
gaaauauaacaagugggugaa

SEQ ID NO: 1045699 - RNA, 14 nt, Homo sapiens
gaaauauuuggaaa

SEQ ID NO: 1045700 - RNA, 17 nt, Homo sapiens
gaaaucacugauagaau

SEQ ID NO: 1045701 - RNA, 13 nt, Homo sapiens
gaaaucugccaau

SEQ ID NO: 1045702 - RNA, 14 nt, Homo sapiens
gaaaugacuuugaa

SEQ ID NO: 1045703 - RNA, 16 nt, Homo sapiens
gaaaugagaucaggcu

SEQ ID NO: 1045704 - RNA, 13 nt, Homo sapiens
ccuaccucagguu

SEQ ID NO: 1045705 - RNA, 22 nt, Homo sapiens
ccuacuaauccucucugcaagu

SEQ ID NO: 1045706 - RNA, 21 nt, Homo sapiens
ccuagaaguuacugaaugcac

SEQ ID NO: 1045707 - RNA, 21 nt, Homo sapiens
ccuagcacuuugggaggccaa

SEQ ID NO: 1045708 - RNA, 22 nt, Homo sapiens
ccuagcaucucaugagugccaa

SEQ ID NO: 1045709 - RNA, 17 nt, Homo sapiens
ccuagcuccacacccuc

SEQ ID NO: 1045710 - RNA, 17 nt, Homo sapiens
ccuagcugcacagggca

SEQ ID NO: 1045711 - RNA, 13 nt, Homo sapiens
ccuaggcaucaca

SEQ ID NO: 1045712 - RNA, 17 nt, Homo sapiens
ccuaggcauuugcugaa

SEQ ID NO: 1045713 - RNA, 19 nt, Homo sapiens
ccuagggccacugaagaua

SEQ ID NO: 1045714 - RNA, 20 nt, Homo sapiens
ccuagucuuuuaaacaguuu

SEQ ID NO: 1045715 - RNA, 18 nt, Homo sapiens
ccuaguuucccugaagga

SEQ ID NO: 1045716 - RNA, 15 nt, Homo sapiens
ccuauacucuauaac

SEQ ID NO: 1045717 - RNA, 14 nt, Homo sapiens
ccuaucacugauag

SEQ ID NO: 1045718 - RNA, 20 nt, Homo sapiens
ccuaucagaguugcugcaaa

SEQ ID NO: 1045719 - RNA, 14 nt, Homo sapiens
ccuaucuuugccac

SEQ ID NO: 1045720 - RNA, 12 nt, Homo sapiens
ccuaugauccca

SEQ ID NO: 1045721 - RNA, 16 nt, Homo sapiens
ccuaugcacauaugga

SEQ ID NO: 1045722 - RNA, 23 nt, Homo sapiens
ccuauggaagcauauuguuauua

SEQ ID NO: 1045723 - RNA, 14 nt, Homo sapiens
ccuauguaugccau

SEQ ID NO: 1045724 - RNA, 18 nt, Homo sapiens
ccuaugugggugggacca

SEQ ID NO: 1045725 - RNA, 18 nt, Homo sapiens
ccuauuucuuauagucaa

SEQ ID NO: 1045726 - RNA, 12 nt, Homo sapiens
ccuauuugccau

SEQ ID NO: 1045727 - RNA, 21 nt, Homo sapiens
ccucaaacuuccagucaggua

SEQ ID NO: 1045728 - RNA, 15 nt, Homo sapiens
ccucaaccaaugcca

SEQ ID NO: 1045729 - RNA, 18 nt, Homo sapiens
ccucaaccuccugggcua

SEQ ID NO: 1045730 - RNA, 14 nt, Homo sapiens
ccucaaucauagcc

SEQ ID NO: 1045731 - RNA, 23 nt, Homo sapiens
ccucacaugugacaaagggccag

SEQ ID NO: 1045732 - RNA, 16 nt, Homo sapiens
ccucacccgaaucucc

SEQ ID NO: 1045733 - RNA, 12 nt, Homo sapiens
ccucacugaaaa

SEQ ID NO: 1045734 - RNA, 16 nt, Homo sapiens
ccucacugaaaacauc

SEQ ID NO: 1045735 - RNA, 12 nt, Homo sapiens
ccucacugggug

SEQ ID NO: 1045736 - RNA, 17 nt, Homo sapiens
ccucagaauugaucauu

SEQ ID NO: 1045737 - RNA, 12 nt, Homo sapiens
ccucagauuccg

SEQ ID NO: 1045738 - RNA, 16 nt, Homo sapiens
ccucaggaaugggcug

SEQ ID NO: 1045739 - RNA, 17 nt, Homo sapiens
ccucaggcaggugggau

SEQ ID NO: 1045740 - RNA, 22 nt, Homo sapiens
ccucagggaucuugcauuccca

SEQ ID NO: 1045741 - RNA, 10 nt, Homo sapiens
ccucagggcu

SEQ ID NO: 1045742 - RNA, 23 nt, Homo sapiens
ccucagggucccugguggcagcu

SEQ ID NO: 1045743 - RNA, 21 nt, Homo sapiens
ccucagguggccccaguucaa

SEQ ID NO: 1045744 - RNA, 16 nt, Homo sapiens
ccucagugagaagcca

SEQ ID NO: 1045745 - RNA, 13 nt, Homo sapiens
ccucagugccuuc

SEQ ID NO: 1045746 - RNA, 20 nt, Homo sapiens
ccucauauggcccaguguca

SEQ ID NO: 1045747 - RNA, 16 nt, Homo sapiens
ccucaucagucuccau

SEQ ID NO: 1045748 - RNA, 16 nt, Homo sapiens
ccucaugcuguuccac

SEQ ID NO: 1045749 - RNA, 13 nt, Homo sapiens
ccucauuccugaa

SEQ ID NO: 1045750 - RNA, 14 nt, Homo sapiens
ccucauuugcaagg

SEQ ID NO: 1045751 - RNA, 15 nt, Homo sapiens
ccuccaaaagcacuu

SEQ ID NO: 1045752 - RNA, 16 nt, Homo sapiens
ccuccaaaggucugau

SEQ ID NO: 1045753 - RNA, 19 nt, Homo sapiens
ccuccacagcuaccucuuc

SEQ ID NO: 1045754 - RNA, 16 nt, Homo sapiens
ccuccagaauggagcu

SEQ ID NO: 1045755 - RNA, 18 nt, Homo sapiens
ccuccagaggagacauug

SEQ ID NO: 1045756 - RNA, 16 nt, Homo sapiens
ccuccauacucaggac

SEQ ID NO: 1045757 - RNA, 17 nt, Homo sapiens
ccuccauucugaccauu

SEQ ID NO: 1045758 - RNA, 18 nt, Homo sapiens
ccucccaaguagcuggaa

SEQ ID NO: 1045759 - RNA, 18 nt, Homo sapiens
ccucccacugccaaagaa

SEQ ID NO: 1045760 - RNA, 13 nt, Homo sapiens
ccuccccaguuca

SEQ ID NO: 1045761 - RNA, 15 nt, Homo sapiens
ccucccucaccaaca

SEQ ID NO: 1045762 - RNA, 14 nt, Homo sapiens
ccucccucauucca

SEQ ID NO: 1045763 - RNA, 18 nt, Homo sapiens
ccucccucugaggcugua

SEQ ID NO: 1045764 - RNA, 10 nt, Homo sapiens
ccucccugaa

SEQ ID NO: 1045765 - RNA, 13 nt, Homo sapiens
ccucccugcuuca

SEQ ID NO: 1045766 - RNA, 17 nt, Homo sapiens
ccucccuucucuucaca

SEQ ID NO: 1045767 - RNA, 20 nt, Homo sapiens
ccuccuacccuuccagugcc

SEQ ID NO: 1045768 - RNA, 11 nt, Homo sapiens
ccuccucacaa

SEQ ID NO: 1045769 - RNA, 21 nt, Homo sapiens
ccuccucuacaauuugccauu

SEQ ID NO: 1045770 - RNA, 15 nt, Homo sapiens
ccuccugagcucuga

SEQ ID NO: 1045771 - RNA, 19 nt, Homo sapiens
ccuccugcaaggggcucaa

SEQ ID NO: 1045772 - RNA, 15 nt, Homo sapiens
ccuccuguaaauggu

SEQ ID NO: 1045773 - RNA, 21 nt, Homo sapiens
ccuccuuacauaugcaaaaau

SEQ ID NO: 1045774 - RNA, 18 nt, Homo sapiens
ccuccuuccuugaccagc

SEQ ID NO: 1045775 - RNA, 15 nt, Homo sapiens
ccuccuuggugccug

SEQ ID NO: 1045776 - RNA, 14 nt, Homo sapiens
ccucgaaaaccauc

SEQ ID NO: 1045777 - RNA, 18 nt, Homo sapiens
ccucgacguuuacaagcc

SEQ ID NO: 1045778 - RNA, 19 nt, Homo sapiens
ccucgacguuuacaagccc

SEQ ID NO: 1045779 - RNA, 14 nt, Homo sapiens
ccucgcugccagcu

SEQ ID NO: 1045780 - RNA, 23 nt, Homo sapiens
ccucgguucaaaaccuugcacag

SEQ ID NO: 1045781 - RNA, 16 nt, Homo sapiens
ccucguagccaucucu

SEQ ID NO: 1045782 - RNA, 16 nt, Homo sapiens
ccucuacuuaaugaga

SEQ ID NO: 1045783 - RNA, 13 nt, Homo sapiens
ccucuaugaacua

SEQ ID NO: 1045784 - RNA, 13 nt, Homo sapiens
ccucucaugacuu

SEQ ID NO: 1045785 - RNA, 12 nt, Homo sapiens
ccucucauucca

SEQ ID NO: 1045786 - RNA, 20 nt, Homo sapiens
ccucucccgucagggcccaa

SEQ ID NO: 1045787 - RNA, 16 nt, Homo sapiens
ccucuccgcaguuccu

SEQ ID NO: 1045788 - RNA, 17 nt, Homo sapiens
ccucuccuuugugacuu

SEQ ID NO: 1045789 - RNA, 12 nt, Homo sapiens
ccucucugcucu

SEQ ID NO: 1045790 - RNA, 20 nt, Homo sapiens
ccucugagaauuccaaggag

SEQ ID NO: 1045791 - RNA, 21 nt, Homo sapiens
ccucugagggaaagcccagaa

SEQ ID NO: 1045792 - RNA, 19 nt, Homo sapiens
ccucugauacccagagcau

SEQ ID NO: 1045793 - RNA, 15 nt, Homo sapiens
ccucugccugcauuc

SEQ ID NO: 1045794 - RNA, 14 nt, Homo sapiens
ccucugcugaucuc

SEQ ID NO: 1045795 - RNA, 14 nt, Homo sapiens
ccucugcugccaug

SEQ ID NO: 1045796 - RNA, 13 nt, Homo sapiens
ccucugcuucuca

SEQ ID NO: 1045797 - RNA, 13 nt, Homo sapiens
ccucuggacaaag

SEQ ID NO: 1045798 - RNA, 13 nt, Homo sapiens
ccucuggcucuca

SEQ ID NO: 1045799 - RNA, 18 nt, Homo sapiens
ccucuguugccaggcuag

SEQ ID NO: 1045800 - RNA, 18 nt, Homo sapiens
ccucuuaacgcagcacuu

SEQ ID NO: 1045801 - RNA, 17 nt, Homo sapiens
ccucuuaccuauguccc

SEQ ID NO: 1045802 - RNA, 16 nt, Homo sapiens
ccucuuccccuugccc

SEQ ID NO: 1045803 - RNA, 22 nt, Homo sapiens
ccucuuggccacagaggacuca

SEQ ID NO: 1045804 - RNA, 17 nt, Homo sapiens
ccucuuggcugccuugu

SEQ ID NO: 1045805 - RNA, 20 nt, Homo sapiens
ccucuuuauuuuuugauuga

SEQ ID NO: 1045806 - RNA, 18 nt, Homo sapiens
ccucuuuucucugugcuu

SEQ ID NO: 1045807 - RNA, 20 nt, Homo sapiens
ccucuuuuucuagucuucau

SEQ ID NO: 1045808 - RNA, 13 nt, Homo sapiens
ccugaagucacac

SEQ ID NO: 1045809 - RNA, 20 nt, Homo sapiens
ccugaagucacacagugagu

SEQ ID NO: 1045810 - RNA, 18 nt, Homo sapiens
ccugaaguuggagugagu

SEQ ID NO: 1045811 - RNA, 23 nt, Homo sapiens
ccugaauauuuguuauguagaua

SEQ ID NO: 1045812 - RNA, 21 nt, Homo sapiens
ccugaauucuuuuucauuuga

SEQ ID NO: 1045813 - RNA, 15 nt, Homo sapiens
ccugacagaugucag

SEQ ID NO: 1045814 - RNA, 22 nt, Homo sapiens
ccugaccucaaguaauccaccu

SEQ ID NO: 1045815 - RNA, 12 nt, Homo sapiens
ccugaccuguca

SEQ ID NO: 1045816 - RNA, 16 nt, Homo sapiens
ccugaccuugugaucu

SEQ ID NO: 1045817 - RNA, 18 nt, Homo sapiens
ccugacucgucugacugu

SEQ ID NO: 1045818 - RNA, 13 nt, Homo sapiens
ccugagaccaguu

SEQ ID NO: 1045819 - RNA, 15 nt, Homo sapiens
ccugagagggaaccc

SEQ ID NO: 1045820 - RNA, 15 nt, Homo sapiens
ccugagaugguccca

SEQ ID NO: 1045821 - RNA, 20 nt, Homo sapiens
ccugagcgugcuuuccaaaa

SEQ ID NO: 1045822 - RNA, 21 nt, Homo sapiens
ccugaggcuccugugcuacuu

SEQ ID NO: 1045823 - RNA, 15 nt, Homo sapiens
ccugaggguccccac

SEQ ID NO: 1045824 - RNA, 20 nt, Homo sapiens
ccugaggguggagacuaagc

SEQ ID NO: 1045825 - RNA, 20 nt, Homo sapiens
ccugagguuugccagcauuu

SEQ ID NO: 1045826 - RNA, 19 nt, Homo sapiens
ccugauacaggcauggcag

SEQ ID NO: 1045827 - RNA, 23 nt, Homo sapiens
ccugauuagaugacucucagucc

SEQ ID NO: 1045828 - RNA, 18 nt, Homo sapiens
ccugcaaaaacagaggug

SEQ ID NO: 1045829 - RNA, 21 nt, Homo sapiens
ccugcaaccugauugugucuc

SEQ ID NO: 1045830 - RNA, 18 nt, Homo sapiens
ccugcaccccugcaguuu

SEQ ID NO: 1045831 - RNA, 24 nt, Homo sapiens
ccugcaccgagagagauggaauaa

SEQ ID NO: 1045832 - RNA, 14 nt, Homo sapiens
ccugcaccugugca

SEQ ID NO: 1045833 - RNA, 23 nt, Homo sapiens
ccugcacuggggagcccgucuca

SEQ ID NO: 1045834 - RNA, 17 nt, Homo sapiens
ccugcagaauccagcua

SEQ ID NO: 1045835 - RNA, 15 nt, Homo sapiens
ccugcaggugcugcu

SEQ ID NO: 1045836 - RNA, 19 nt, Homo sapiens
ccugcagucaucuugacca

SEQ ID NO: 1045837 - RNA, 15 nt, Homo sapiens
ccugcaucugugaaa

SEQ ID NO: 1045838 - RNA, 16 nt, Homo sapiens
ccugcccccacuuccu

SEQ ID NO: 1045839 - RNA, 18 nt, Homo sapiens
ccugccccccucaucuca

SEQ ID NO: 1045840 - RNA, 22 nt, Homo sapiens
ccugcccuacagaggucucugc

SEQ ID NO: 1045841 - RNA, 19 nt, Homo sapiens
ccugcccugacaugcacac

SEQ ID NO: 1045842 - RNA, 16 nt, Homo sapiens
ccugcccugcugccgc

SEQ ID NO: 1045843 - RNA, 14 nt, Homo sapiens
ccugccuaggaauu

SEQ ID NO: 1045844 - RNA, 12 nt, Homo sapiens
ccugccugcauu

SEQ ID NO: 1045845 - RNA, 14 nt, Homo sapiens
ccugcgauuuugcc

SEQ ID NO: 1045846 - RNA, 19 nt, Homo sapiens
ccugcguggggacagggcu

SEQ ID NO: 1045847 - RNA, 13 nt, Homo sapiens
ccugcuagacaca

SEQ ID NO: 1045848 - RNA, 18 nt, Homo sapiens
ccugcucuccucuugcca

SEQ ID NO: 1045849 - RNA, 13 nt, Homo sapiens
ccugcuggagaaa

SEQ ID NO: 1045850 - RNA, 17 nt, Homo sapiens
ccugcuucaauacccaa

SEQ ID NO: 1045851 - RNA, 13 nt, Homo sapiens
ccuggaagacaga

SEQ ID NO: 1045852 - RNA, 15 nt, Homo sapiens
ccuggaaggugcugu

SEQ ID NO: 1045853 - RNA, 21 nt, Homo sapiens
ccuggacugccuugaauaucc

SEQ ID NO: 1045854 - RNA, 13 nt, Homo sapiens
ccuggacugggag

SEQ ID NO: 1045855 - RNA, 20 nt, Homo sapiens
ccuggacugggagguagaua

SEQ ID NO: 1045856 - RNA, 15 nt, Homo sapiens
ccuggaggcacugaa

SEQ ID NO: 1045857 - RNA, 20 nt, Homo sapiens
ccuggaguaacacaaaguga

SEQ ID NO: 1045858 - RNA, 18 nt, Homo sapiens
ccuggcaagugggugaaa

SEQ ID NO: 1045859 - RNA, 18 nt, Homo sapiens
ccuggcacuaacguugag

SEQ ID NO: 1045860 - RNA, 20 nt, Homo sapiens
ccuggcacuggaugcagaaa

SEQ ID NO: 1045861 - RNA, 20 nt, Homo sapiens
ccuggcagaacugagcuccu

SEQ ID NO: 1045862 - RNA, 21 nt, Homo sapiens
ccuggcccccacccucugcca

SEQ ID NO: 1045863 - RNA, 16 nt, Homo sapiens
ccuggcucugcaaugg

SEQ ID NO: 1045864 - RNA, 19 nt, Homo sapiens
ccuggcugaaggacuguga

SEQ ID NO: 1045865 - RNA, 20 nt, Homo sapiens
ccuggcuggggccuguugaa

SEQ ID NO: 1045866 - RNA, 19 nt, Homo sapiens
ccugggaauguauuauucu

SEQ ID NO: 1045867 - RNA, 21 nt, Homo sapiens
ccugggaggaaauuugaaugg

SEQ ID NO: 1045868 - RNA, 19 nt, Homo sapiens
ccugggaggcggagaguac

SEQ ID NO: 1045869 - RNA, 23 nt, Homo sapiens
ccugggaguuuuguauucaucuu

SEQ ID NO: 1045870 - RNA, 19 nt, Homo sapiens
ccugggcaucagaccuuaa

SEQ ID NO: 1045871 - RNA, 20 nt, Homo sapiens
ccuggggcaggucacuuuac

SEQ ID NO: 1045872 - RNA, 21 nt, Homo sapiens
ccuggggccuggaccugccuc

SEQ ID NO: 1045873 - RNA, 17 nt, Homo sapiens
ccugggguaccaagaga

SEQ ID NO: 1045874 - RNA, 17 nt, Homo sapiens
ccuggguaacuagggaa

SEQ ID NO: 1045875 - RNA, 21 nt, Homo sapiens
ccuggguucugggacuuuuaa

SEQ ID NO: 1045876 - RNA, 15 nt, Homo sapiens
ccugguauauccaaa

SEQ ID NO: 1045877 - RNA, 14 nt, Homo sapiens
ccugguccaugaug

SEQ ID NO: 1045878 - RNA, 19 nt, Homo sapiens
ccuggucccuuggagacaa

SEQ ID NO: 1045879 - RNA, 12 nt, Homo sapiens
ccuggugcccua

SEQ ID NO: 1045880 - RNA, 21 nt, Homo sapiens
ccuguaaaagauacugaggaa

SEQ ID NO: 1045881 - RNA, 13 nt, Homo sapiens
ccuguaaucacag

SEQ ID NO: 1045882 - RNA, 18 nt, Homo sapiens
ccuguaauccuagcacuu

SEQ ID NO: 1045883 - RNA, 15 nt, Homo sapiens
ccuguaauuccagca

SEQ ID NO: 1045884 - RNA, 23 nt, Homo sapiens
ccuguaccacaaacacauuacau

SEQ ID NO: 1045885 - RNA, 20 nt, Homo sapiens
ccuguaccccagcacuugug

SEQ ID NO: 1045886 - RNA, 16 nt, Homo sapiens
ccuguaccugugcacg

SEQ ID NO: 1045887 - RNA, 21 nt, Homo sapiens
ccuguagaugacauggugaaa

SEQ ID NO: 1045888 - RNA, 15 nt, Homo sapiens
ccuguagucccagcu

SEQ ID NO: 1045889 - RNA, 21 nt, Homo sapiens
ccuguaucagcacuccucauc

SEQ ID NO: 1045890 - RNA, 15 nt, Homo sapiens
ccuguauggcacugg

SEQ ID NO: 1045891 - RNA, 17 nt, Homo sapiens
ccugucaaacaaagcca

SEQ ID NO: 1045892 - RNA, 16 nt, Homo sapiens
ccuguccacacccagc

SEQ ID NO: 1045893 - RNA, 16 nt, Homo sapiens
ccugucuaaaaauuca

SEQ ID NO: 1045894 - RNA, 22 nt, Homo sapiens
ccugucugccagccagcagcca

SEQ ID NO: 1045895 - RNA, 18 nt, Homo sapiens
ccugucuguuacacugga

SEQ ID NO: 1045896 - RNA, 20 nt, Homo sapiens
ccugugacauguaacagcca

SEQ ID NO: 1045897 - RNA, 13 nt, Homo sapiens
ccugugagcucaa

SEQ ID NO: 1045898 - RNA, 20 nt, Homo sapiens
ccugugaguacuacaguccu

SEQ ID NO: 1045899 - RNA, 16 nt, Homo sapiens
ccugugccuaacacca

SEQ ID NO: 1045900 - RNA, 12 nt, Homo sapiens
ccugugcugacg

SEQ ID NO: 1045901 - RNA, 16 nt, Homo sapiens
ccugugcuuucccuga

SEQ ID NO: 1045902 - RNA, 17 nt, Homo sapiens
ccugugugccauuuuaa

SEQ ID NO: 1045903 - RNA, 18 nt, Homo sapiens
ccugugugggacugagau

SEQ ID NO: 1045904 - RNA, 22 nt, Homo sapiens
ccugugugggacugaguggcaa

SEQ ID NO: 1045905 - RNA, 14 nt, Homo sapiens
ccuguucaaaaagg

SEQ ID NO: 1045906 - RNA, 21 nt, Homo sapiens
ccuguugaagcucuggugaca

SEQ ID NO: 1045907 - RNA, 13 nt, Homo sapiens
ccuuaaacucagg

SEQ ID NO: 1045908 - RNA, 23 nt, Homo sapiens
ccuuaaacucagggagcauuuau

SEQ ID NO: 1045909 - RNA, 12 nt, Homo sapiens
ccuuaacacuga

SEQ ID NO: 1045910 - RNA, 17 nt, Homo sapiens
ccuuaagucaaaagaga

SEQ ID NO: 1045911 - RNA, 15 nt, Homo sapiens
ccuuagaagucacac

SEQ ID NO: 1045912 - RNA, 22 nt, Homo sapiens
ccuuagauuagcucuggaccag

SEQ ID NO: 1045913 - RNA, 18 nt, Homo sapiens
ccuuagcuuagaccucag

SEQ ID NO: 1045914 - RNA, 13 nt, Homo sapiens
ccuuaguguuucu

SEQ ID NO: 1045915 - RNA, 13 nt, Homo sapiens
ccuucaaacuucc

SEQ ID NO: 1045916 - RNA, 15 nt, Homo sapiens
ccuucaaacuuccag

SEQ ID NO: 1045917 - RNA, 18 nt, Homo sapiens
ccuucacuucugaccaca

SEQ ID NO: 1045918 - RNA, 12 nt, Homo sapiens
ccuuccacugag

SEQ ID NO: 1045919 - RNA, 15 nt, Homo sapiens
ccuucccaugaccca

SEQ ID NO: 1045920 - RNA, 18 nt, Homo sapiens
ccuucccucucaugacuu

SEQ ID NO: 1045921 - RNA, 18 nt, Homo sapiens
ccuuccucaccacuuccc

SEQ ID NO: 1045922 - RNA, 14 nt, Homo sapiens
ccuuccucacuucc

SEQ ID NO: 1045923 - RNA, 16 nt, Homo sapiens
ccuuccuugaccagca

SEQ ID NO: 1045924 - RNA, 15 nt, Homo sapiens
ccuucuccagacaaa

SEQ ID NO: 1045925 - RNA, 16 nt, Homo sapiens
ccuucucccacacugc

SEQ ID NO: 1045926 - RNA, 23 nt, Homo sapiens
ccuucucuguagggaacucuggg

SEQ ID NO: 1045927 - RNA, 13 nt, Homo sapiens
ccuucuggugucu

SEQ ID NO: 1045928 - RNA, 21 nt, Homo sapiens
ccuucugugccggcuuucaag

SEQ ID NO: 1045929 - RNA, 23 nt, Homo sapiens
ccuucuugguuuccaaaggcauu

SEQ ID NO: 1045930 - RNA, 22 nt, Homo sapiens
ccuucuuuugaaggacuccuua

SEQ ID NO: 1045931 - RNA, 19 nt, Homo sapiens
ccuugaaaacacuguucuc

SEQ ID NO: 1045932 - RNA, 13 nt, Homo sapiens
ccuugaaggguuc

SEQ ID NO: 1045933 - RNA, 23 nt, Homo sapiens
ccuugaauauccccucccaguca

SEQ ID NO: 1045934 - RNA, 11 nt, Homo sapiens
ccuugagaaac

SEQ ID NO: 1045935 - RNA, 18 nt, Homo sapiens
ccuugagcuccccaaaaa

SEQ ID NO: 1045936 - RNA, 19 nt, Homo sapiens
ccuugaugugccugugaau

SEQ ID NO: 1045937 - RNA, 18 nt, Homo sapiens
ccuugcaacuucauguca

SEQ ID NO: 1045938 - RNA, 22 nt, Homo sapiens
ccuugcaagcuaauucuuugac

SEQ ID NO: 1045939 - RNA, 18 nt, Homo sapiens
ccuugcccugaccuccca

SEQ ID NO: 1045940 - RNA, 10 nt, Homo sapiens
ccuugcuaau

SEQ ID NO: 1045941 - RNA, 21 nt, Homo sapiens
ccuuggaggcugucuucucag

SEQ ID NO: 1045942 - RNA, 17 nt, Homo sapiens
ccuuggcaugccuucca

SEQ ID NO: 1045943 - RNA, 20 nt, Homo sapiens
ccuuggccuccccugcugaa

SEQ ID NO: 1045944 - RNA, 21 nt, Homo sapiens
ccuugggaugaugccucauga

SEQ ID NO: 1045945 - RNA, 16 nt, Homo sapiens
ccuugggcugcuccuc

SEQ ID NO: 1045946 - RNA, 23 nt, Homo sapiens
ccuuggugugcuguauccaucca

SEQ ID NO: 1045947 - RNA, 24 nt, Homo sapiens
ccuuguccacccaccuaugugcca

SEQ ID NO: 1045948 - RNA, 13 nt, Homo sapiens
ccuugugaaggaa

SEQ ID NO: 1045949 - RNA, 17 nt, Homo sapiens
ccuugugguuuauguca

SEQ ID NO: 1045950 - RNA, 14 nt, Homo sapiens
ccuugugucuguac

SEQ ID NO: 1045951 - RNA, 19 nt, Homo sapiens
ccuuguguguuuugagagu

SEQ ID NO: 1045952 - RNA, 15 nt, Homo sapiens
ccuuuacauccagau

SEQ ID NO: 1045953 - RNA, 13 nt, Homo sapiens
ccuuuauugugau

SEQ ID NO: 1045954 - RNA, 20 nt, Homo sapiens
ccuuucagaugucuucugcc

SEQ ID NO: 1045955 - RNA, 21 nt, Homo sapiens
ccuuucaguggcccuuucaac

SEQ ID NO: 1045956 - RNA, 18 nt, Homo sapiens
ccuuucauuuacuguggc

SEQ ID NO: 1045957 - RNA, 14 nt, Homo sapiens
ccuuucgacuugca

SEQ ID NO: 1045958 - RNA, 15 nt, Homo sapiens
ccuuucucuucucug

SEQ ID NO: 1045959 - RNA, 15 nt, Homo sapiens
ccuuucuguguguga

SEQ ID NO: 1045960 - RNA, 18 nt, Homo sapiens
ccuuucuucagacacuga

SEQ ID NO: 1045961 - RNA, 17 nt, Homo sapiens
ccuuucuuucuuccuuc

SEQ ID NO: 1045962 - RNA, 15 nt, Homo sapiens
ccuuugaaaugaaua

SEQ ID NO: 1045963 - RNA, 16 nt, Homo sapiens
ccuuugaaaugaauau

SEQ ID NO: 1045964 - RNA, 12 nt, Homo sapiens
ccuuugccuugg

SEQ ID NO: 1045965 - RNA, 19 nt, Homo sapiens
ccuuuggaugcacuuuaua

SEQ ID NO: 1045966 - RNA, 20 nt, Homo sapiens
ccuuuggauugacucugcau

SEQ ID NO: 1045967 - RNA, 14 nt, Homo sapiens
ccuuugucccccaa

SEQ ID NO: 1045968 - RNA, 18 nt, Homo sapiens
ccuuuguguauucaucuu

SEQ ID NO: 1045969 - RNA, 14 nt, Homo sapiens
ccuuuuaaaacacu

SEQ ID NO: 1045970 - RNA, 13 nt, Homo sapiens
ccuuuuacauacu

SEQ ID NO: 1045971 - RNA, 17 nt, Homo sapiens
ccuuuuauuucuuaaac

SEQ ID NO: 1045972 - RNA, 15 nt, Homo sapiens
ccuuuuuguuauuag

SEQ ID NO: 1045973 - RNA, 22 nt, Homo sapiens
ccuuuuuuaagauuuuucucaa

SEQ ID NO: 1045974 - RNA, 14 nt, Homo sapiens
cgaaaccccaucuc

SEQ ID NO: 1045975 - RNA, 21 nt, Homo sapiens
cgaaagacgugauucaauuca

SEQ ID NO: 1045976 - RNA, 14 nt, Homo sapiens
cgaacaauucauau

SEQ ID NO: 1045977 - RNA, 19 nt, Homo sapiens
cgaagucgccacguggccu

SEQ ID NO: 1045978 - RNA, 13 nt, Homo sapiens
cgacaaagccaaa

SEQ ID NO: 1045979 - RNA, 22 nt, Homo sapiens
cgacaaagccaaacucugccag

SEQ ID NO: 1045980 - RNA, 17 nt, Homo sapiens
cgacagugcauuugccu

SEQ ID NO: 1045981 - RNA, 13 nt, Homo sapiens
cgaccagacaccu

SEQ ID NO: 1045982 - RNA, 22 nt, Homo sapiens
cgaccuaauugucuuuguucug

SEQ ID NO: 1045983 - RNA, 18 nt, Homo sapiens
cgaccugcggcugcugug

SEQ ID NO: 1045984 - RNA, 14 nt, Homo sapiens
cgacucugaccucu

SEQ ID NO: 1045985 - RNA, 14 nt, Homo sapiens
cgacugaaacugga

SEQ ID NO: 1045986 - RNA, 15 nt, Homo sapiens
cgagaccaucuuggc

SEQ ID NO: 1045987 - RNA, 22 nt, Homo sapiens
cgagaggggaagaguguacugg

SEQ ID NO: 1045988 - RNA, 13 nt, Homo sapiens
cgagagucccugc

SEQ ID NO: 1045989 - RNA, 19 nt, Homo sapiens
cgagaucgcgccacugcac

SEQ ID NO: 1045990 - RNA, 21 nt, Homo sapiens
cgagauugcaccauugcgcuc

SEQ ID NO: 1045991 - RNA, 19 nt, Homo sapiens
cgagccaaguuaagaaugu

SEQ ID NO: 1045992 - RNA, 22 nt, Homo sapiens
cgaggcugcccacuauggucau

SEQ ID NO: 1045993 - RNA, 18 nt, Homo sapiens
cgagucugucucugucau

SEQ ID NO: 1045994 - RNA, 14 nt, Homo sapiens
cgagugugugcaug

SEQ ID NO: 1045995 - RNA, 18 nt, Homo sapiens
cgaucuggguucacugca

SEQ ID NO: 1045996 - RNA, 13 nt, Homo sapiens
cgauguaugcagc

SEQ ID NO: 1045997 - RNA, 23 nt, Homo sapiens
cgaugugcaaguguaugcacgug

SEQ ID NO: 1045998 - RNA, 16 nt, Homo sapiens
cgcaaaccacacugga

SEQ ID NO: 1045999 - RNA, 17 nt, Homo sapiens
cgcacaaggcugaccaa

SEQ ID NO: 1046000 - RNA, 14 nt, Homo sapiens
cgcacagcaguucc

SEQ ID NO: 1046001 - RNA, 13 nt, Homo sapiens
cgcacgcacacac

SEQ ID NO: 1046002 - RNA, 17 nt, Homo sapiens
cgcaggagccauugcuc

SEQ ID NO: 1046003 - RNA, 19 nt, Homo sapiens
gaaaugucuggucugucca

SEQ ID NO: 1046004 - RNA, 13 nt, Homo sapiens
gaaauuaaccaua

SEQ ID NO: 1046005 - RNA, 11 nt, Homo sapiens
gaaauuacuua

SEQ ID NO: 1046006 - RNA, 15 nt, Homo sapiens
gaaauugauguuacu

SEQ ID NO: 1046007 - RNA, 15 nt, Homo sapiens
gaaauuguacauauu

SEQ ID NO: 1046008 - RNA, 19 nt, Homo sapiens
gaaauuuaaauaagauuua

SEQ ID NO: 1046009 - RNA, 23 nt, Homo sapiens
gaaauuugccaauuuacuuuguu

SEQ ID NO: 1046010 - RNA, 15 nt, Homo sapiens
gaacaaaugugaagg

SEQ ID NO: 1046011 - RNA, 19 nt, Homo sapiens
gaacaaguuguuucauuga

SEQ ID NO: 1046012 - RNA, 18 nt, Homo sapiens
gaacaaucaaagcacuug

SEQ ID NO: 1046013 - RNA, 21 nt, Homo sapiens
gaacaaugaauuauccagcau

SEQ ID NO: 1046014 - RNA, 16 nt, Homo sapiens
gaacaauucucucuua

SEQ ID NO: 1046015 - RNA, 14 nt, Homo sapiens
gaacacaaggucau

SEQ ID NO: 1046016 - RNA, 17 nt, Homo sapiens
gaacacugcacucuuaa

SEQ ID NO: 1046017 - RNA, 13 nt, Homo sapiens
gaacagaaggaug

SEQ ID NO: 1046018 - RNA, 19 nt, Homo sapiens
gaacagaaggaugaaugag

SEQ ID NO: 1046019 - RNA, 21 nt, Homo sapiens
gaacagacaacagaagucaug

SEQ ID NO: 1046020 - RNA, 23 nt, Homo sapiens
gaacagccgcuccugucugccag

SEQ ID NO: 1046021 - RNA, 15 nt, Homo sapiens
gaacagcuucagguu

SEQ ID NO: 1046022 - RNA, 20 nt, Homo sapiens
gaacaucaauuccaguggaa

SEQ ID NO: 1046023 - RNA, 18 nt, Homo sapiens
gaacaucccugccagcuc

SEQ ID NO: 1046024 - RNA, 18 nt, Homo sapiens
gaacaucucgaauacaau

SEQ ID NO: 1046025 - RNA, 17 nt, Homo sapiens
gaacauuaaauagcaaa

SEQ ID NO: 1046026 - RNA, 18 nt, Homo sapiens
gaaccaaaagagaucaca

SEQ ID NO: 1046027 - RNA, 19 nt, Homo sapiens
gaaccaauauuuguagaag

SEQ ID NO: 1046028 - RNA, 17 nt, Homo sapiens
gaaccagagcucagaga

SEQ ID NO: 1046029 - RNA, 15 nt, Homo sapiens
gaaccaggcaacuug

SEQ ID NO: 1046030 - RNA, 12 nt, Homo sapiens
gaaccauaucaa

SEQ ID NO: 1046031 - RNA, 23 nt, Homo sapiens
gaaccccgucgaggggcucucag

SEQ ID NO: 1046032 - RNA, 20 nt, Homo sapiens
gaaccgagcuggagccaaca

SEQ ID NO: 1046033 - RNA, 16 nt, Homo sapiens
gaaccugaugcugacu

SEQ ID NO: 1046034 - RNA, 16 nt, Homo sapiens
gaaccuuccaucucgc

SEQ ID NO: 1046035 - RNA, 12 nt, Homo sapiens
gaacgcuuucau

SEQ ID NO: 1046036 - RNA, 21 nt, Homo sapiens
gaacuacaaagcuucuauccc

SEQ ID NO: 1046037 - RNA, 16 nt, Homo sapiens
gaacuagaaccuggag

SEQ ID NO: 1046038 - RNA, 16 nt, Homo sapiens
gaacuaugaacuacaa

SEQ ID NO: 1046039 - RNA, 21 nt, Homo sapiens
gaacucaucccuguuccucaa

SEQ ID NO: 1046040 - RNA, 21 nt, Homo sapiens
gaacucaugagaaguugauau

SEQ ID NO: 1046041 - RNA, 14 nt, Homo sapiens
gaacucucuccacc

SEQ ID NO: 1046042 - RNA, 13 nt, Homo sapiens
gaacucugagcag

SEQ ID NO: 1046043 - RNA, 17 nt, Homo sapiens
gaacucugcccaggugu

SEQ ID NO: 1046044 - RNA, 22 nt, Homo sapiens
gaacucuggggagccugagcca

SEQ ID NO: 1046045 - RNA, 18 nt, Homo sapiens
gaacucuguaaaaccuca

SEQ ID NO: 1046046 - RNA, 16 nt, Homo sapiens
gaacugaacauuccag

SEQ ID NO: 1046047 - RNA, 15 nt, Homo sapiens
gaacuggacucagga

SEQ ID NO: 1046048 - RNA, 20 nt, Homo sapiens
gaacuugcugcugagugcac

SEQ ID NO: 1046049 - RNA, 18 nt, Homo sapiens
gaacuuggcacacucucc

SEQ ID NO: 1046050 - RNA, 15 nt, Homo sapiens
gaacuuucacauagc

SEQ ID NO: 1046051 - RNA, 16 nt, Homo sapiens
gaacuuucaccuucau

SEQ ID NO: 1046052 - RNA, 21 nt, Homo sapiens
gaacuuugaagcuagugcauu

SEQ ID NO: 1046053 - RNA, 13 nt, Homo sapiens
gaagaaaggccau

SEQ ID NO: 1046054 - RNA, 19 nt, Homo sapiens
gaagaaauuccaggaaaau

SEQ ID NO: 1046055 - RNA, 13 nt, Homo sapiens
gaagaacaguaac

SEQ ID NO: 1046056 - RNA, 19 nt, Homo sapiens
gaagaacaguaacugccau

SEQ ID NO: 1046057 - RNA, 11 nt, Homo sapiens
gaagaacugac

SEQ ID NO: 1046058 - RNA, 12 nt, Homo sapiens
gaagaacugacu

SEQ ID NO: 1046059 - RNA, 19 nt, Homo sapiens
gaagaagcaucuuccuuag

SEQ ID NO: 1046060 - RNA, 12 nt, Homo sapiens
gaagaagcuaaa

SEQ ID NO: 1046061 - RNA, 21 nt, Homo sapiens
gaagaagucuaagagugaagu

SEQ ID NO: 1046062 - RNA, 19 nt, Homo sapiens
gaagaauauucaggacuua

SEQ ID NO: 1046063 - RNA, 22 nt, Homo sapiens
gaagacaacagcauaacuaaau

SEQ ID NO: 1046064 - RNA, 12 nt, Homo sapiens
gaagacacugca

SEQ ID NO: 1046065 - RNA, 12 nt, Homo sapiens
gaagacaggaug

SEQ ID NO: 1046066 - RNA, 12 nt, Homo sapiens
gaagacuguggc

SEQ ID NO: 1046067 - RNA, 23 nt, Homo sapiens
gaagagaauauuagcuuuacugu

SEQ ID NO: 1046068 - RNA, 21 nt, Homo sapiens
gaagagacguuuaaaagccau

SEQ ID NO: 1046069 - RNA, 16 nt, Homo sapiens
gaagagaggaguucaa

SEQ ID NO: 1046070 - RNA, 18 nt, Homo sapiens
gaagagauuuuucaugau

SEQ ID NO: 1046071 - RNA, 11 nt, Homo sapiens
gaagagcauug

SEQ ID NO: 1046072 - RNA, 21 nt, Homo sapiens
gaagagccugcaggugcugcu

SEQ ID NO: 1046073 - RNA, 14 nt, Homo sapiens
gaagagggucccuc

SEQ ID NO: 1046074 - RNA, 20 nt, Homo sapiens
gaagauccuaaaacaaaagc

SEQ ID NO: 1046075 - RNA, 18 nt, Homo sapiens
gaagaugggcuucaucca

SEQ ID NO: 1046076 - RNA, 24 nt, Homo sapiens
gaagauuuuaugcugcuguuuaca

SEQ ID NO: 1046077 - RNA, 16 nt, Homo sapiens
gaagcaagugguggga

SEQ ID NO: 1046078 - RNA, 16 nt, Homo sapiens
gaagcaccccaugcca

SEQ ID NO: 1046079 - RNA, 18 nt, Homo sapiens
gaagcaggagaaucacuu

SEQ ID NO: 1046080 - RNA, 16 nt, Homo sapiens
gaagcagucucuuccu

SEQ ID NO: 1046081 - RNA, 18 nt, Homo sapiens
gaagcauuccuucuuuga

SEQ ID NO: 1046082 - RNA, 22 nt, Homo sapiens
gaagcauuuuauaaaucgcuuu

SEQ ID NO: 1046083 - RNA, 22 nt, Homo sapiens
gaagccaagucagcuuugccuu

SEQ ID NO: 1046084 - RNA, 15 nt, Homo sapiens
gaagccggcggccca

SEQ ID NO: 1046085 - RNA, 17 nt, Homo sapiens
gaagccuauguaugcca

SEQ ID NO: 1046086 - RNA, 15 nt, Homo sapiens
gaagcuacagguuac

SEQ ID NO: 1046087 - RNA, 13 nt, Homo sapiens
gaagcucacccaa

SEQ ID NO: 1046088 - RNA, 16 nt, Homo sapiens
gaagcuccacugucac

SEQ ID NO: 1046089 - RNA, 15 nt, Homo sapiens
gaagcucccaggaac

SEQ ID NO: 1046090 - RNA, 15 nt, Homo sapiens
gaagcuuucaguauu

SEQ ID NO: 1046091 - RNA, 12 nt, Homo sapiens
gaaggaaaccag

SEQ ID NO: 1046092 - RNA, 20 nt, Homo sapiens
gaaggaacucuggcuuccag

SEQ ID NO: 1046093 - RNA, 14 nt, Homo sapiens
gaaggaauuauucc

SEQ ID NO: 1046094 - RNA, 21 nt, Homo sapiens
gaaggagaguccccugaaggu

SEQ ID NO: 1046095 - RNA, 19 nt, Homo sapiens
gaaggaggagucagggaga

SEQ ID NO: 1046096 - RNA, 23 nt, Homo sapiens
gaaggaggcuggcuuguccccuc

SEQ ID NO: 1046097 - RNA, 13 nt, Homo sapiens
gaaggaguuuuau

SEQ ID NO: 1046098 - RNA, 15 nt, Homo sapiens
gaaggauccgcauaa

SEQ ID NO: 1046099 - RNA, 14 nt, Homo sapiens
gaaggcaaacccau

SEQ ID NO: 1046100 - RNA, 14 nt, Homo sapiens
gaaggcaaugccau

SEQ ID NO: 1046101 - RNA, 10 nt, Homo sapiens
gaaggccagc

SEQ ID NO: 1046102 - RNA, 20 nt, Homo sapiens
gaaggcgugagucugcaucu

SEQ ID NO: 1046103 - RNA, 19 nt, Homo sapiens
gaagggacacacaagaaga

SEQ ID NO: 1046104 - RNA, 22 nt, Homo sapiens
gaaggguucaccaggucaggga

SEQ ID NO: 1046105 - RNA, 22 nt, Homo sapiens
gaagguauuccuuuuguguaca

SEQ ID NO: 1046106 - RNA, 13 nt, Homo sapiens
gaaggucaccagc

SEQ ID NO: 1046107 - RNA, 19 nt, Homo sapiens
gaaggugaaagugcaguuc

SEQ ID NO: 1046108 - RNA, 20 nt, Homo sapiens
gaagguucuacgccagggga

SEQ ID NO: 1046109 - RNA, 23 nt, Homo sapiens
gaaguaacaaaagaagugacauc

SEQ ID NO: 1046110 - RNA, 18 nt, Homo sapiens
gaaguaaccauuugcacu

SEQ ID NO: 1046111 - RNA, 21 nt, Homo sapiens
gaaguagauuaagagccauau

SEQ ID NO: 1046112 - RNA, 21 nt, Homo sapiens
gaaguagcucuggugaccuug

SEQ ID NO: 1046113 - RNA, 15 nt, Homo sapiens
gaaguagcugagaaa

SEQ ID NO: 1046114 - RNA, 20 nt, Homo sapiens
gaaguaggugugacuugaac

SEQ ID NO: 1046115 - RNA, 15 nt, Homo sapiens
gaaguaugagggaaa

SEQ ID NO: 1046116 - RNA, 22 nt, Homo sapiens
gaaguaugagggaaaaugagua

SEQ ID NO: 1046117 - RNA, 19 nt, Homo sapiens
gaagucacacaguauuacu

SEQ ID NO: 1046118 - RNA, 15 nt, Homo sapiens
gaagucaugcguuua

SEQ ID NO: 1046119 - RNA, 13 nt, Homo sapiens
gaaguccagagcu

SEQ ID NO: 1046120 - RNA, 16 nt, Homo sapiens
gaagucuuccauagag

SEQ ID NO: 1046121 - RNA, 19 nt, Homo sapiens
gaagugaggcauugcacag

SEQ ID NO: 1046122 - RNA, 18 nt, Homo sapiens
gaaguguaagaaacacac

SEQ ID NO: 1046123 - RNA, 22 nt, Homo sapiens
gaagugugucacccuuaggcca

SEQ ID NO: 1046124 - RNA, 13 nt, Homo sapiens
gaagugugugauc

SEQ ID NO: 1046125 - RNA, 22 nt, Homo sapiens
gaaguucaccauuaaaagggau

SEQ ID NO: 1046126 - RNA, 16 nt, Homo sapiens
gaaguuccaguguucu

SEQ ID NO: 1046127 - RNA, 19 nt, Homo sapiens
gaaguuccaguguucucuc

SEQ ID NO: 1046128 - RNA, 24 nt, Homo sapiens
gaaguugaaugggcacagcaacuc

SEQ ID NO: 1046129 - RNA, 21 nt, Homo sapiens
gaauaaaccaucaucuugcca

SEQ ID NO: 1046130 - RNA, 14 nt, Homo sapiens
gaauaaagcccuug

SEQ ID NO: 1046131 - RNA, 15 nt, Homo sapiens
gaauaaauuugccca

SEQ ID NO: 1046132 - RNA, 12 nt, Homo sapiens
gaauaaccacuu

SEQ ID NO: 1046133 - RNA, 13 nt, Homo sapiens
gaauaauaacuuu

SEQ ID NO: 1046134 - RNA, 14 nt, Homo sapiens
gaauaauccagaaa

SEQ ID NO: 1046135 - RNA, 15 nt, Homo sapiens
gaauacauaaaguau

SEQ ID NO: 1046136 - RNA, 22 nt, Homo sapiens
gaauacuuaacucaauaauucu

SEQ ID NO: 1046137 - RNA, 19 nt, Homo sapiens
gaauagcuuugaauguggc

SEQ ID NO: 1046138 - RNA, 22 nt, Homo sapiens
gaauaguguuggaaaaugugca

SEQ ID NO: 1046139 - RNA, 19 nt, Homo sapiens
gaauauaaauuuguguucu

SEQ ID NO: 1046140 - RNA, 13 nt, Homo sapiens
gaauauuaugccc

SEQ ID NO: 1046141 - RNA, 17 nt, Homo sapiens
gaaucaagagcugcccu

SEQ ID NO: 1046142 - RNA, 15 nt, Homo sapiens
gaaucacuugcacuc

SEQ ID NO: 1046143 - RNA, 16 nt, Homo sapiens
gaaucacuugcacucc

SEQ ID NO: 1046144 - RNA, 18 nt, Homo sapiens
gaaucagucuauccacag

SEQ ID NO: 1046145 - RNA, 20 nt, Homo sapiens
gaaucagugaagaugccagu

SEQ ID NO: 1046146 - RNA, 18 nt, Homo sapiens
gaauccagaucauuccuc

SEQ ID NO: 1046147 - RNA, 23 nt, Homo sapiens
gaauccaguccagauauuucaca

SEQ ID NO: 1046148 - RNA, 16 nt, Homo sapiens
gaaucccccuugccac

SEQ ID NO: 1046149 - RNA, 21 nt, Homo sapiens
gaaucccccuugccaccccac

SEQ ID NO: 1046150 - RNA, 19 nt, Homo sapiens
gaaucccuaagccuagcug

SEQ ID NO: 1046151 - RNA, 18 nt, Homo sapiens
gaaucccucuaucucuaa

SEQ ID NO: 1046152 - RNA, 16 nt, Homo sapiens
gaaucccuuaaacuca

SEQ ID NO: 1046153 - RNA, 17 nt, Homo sapiens
gaaucgcuuaaaccugg

SEQ ID NO: 1046154 - RNA, 15 nt, Homo sapiens
gaaucgcuugaacca

SEQ ID NO: 1046155 - RNA, 12 nt, Homo sapiens
gaaucucucuuc

SEQ ID NO: 1046156 - RNA, 22 nt, Homo sapiens
gaaucuucaagaccaaagcaga

SEQ ID NO: 1046157 - RNA, 21 nt, Homo sapiens
gaaugaaagcuccucgagggc

SEQ ID NO: 1046158 - RNA, 16 nt, Homo sapiens
gaaugaacaaagucca

SEQ ID NO: 1046159 - RNA, 17 nt, Homo sapiens
gaaugagaagaaugacu

SEQ ID NO: 1046160 - RNA, 18 nt, Homo sapiens
gaaugagagguuccuaag

SEQ ID NO: 1046161 - RNA, 17 nt, Homo sapiens
gaaugagcaaaaccaaa

SEQ ID NO: 1046162 - RNA, 19 nt, Homo sapiens
gaaugagcaaaaccaaaua

SEQ ID NO: 1046163 - RNA, 17 nt, Homo sapiens
gaaugaggcaauuucaa

SEQ ID NO: 1046164 - RNA, 18 nt, Homo sapiens
gaaugaggucccaggcag

SEQ ID NO: 1046165 - RNA, 14 nt, Homo sapiens
gaaugaucuuggcu

SEQ ID NO: 1046166 - RNA, 13 nt, Homo sapiens
gaaugaucuuucu

SEQ ID NO: 1046167 - RNA, 22 nt, Homo sapiens
gaaugauuuagguacgucaaag

SEQ ID NO: 1046168 - RNA, 22 nt, Homo sapiens
gaaugcaaaguagcaauuucca

SEQ ID NO: 1046169 - RNA, 14 nt, Homo sapiens
gaaugcagggacaa

SEQ ID NO: 1046170 - RNA, 16 nt, Homo sapiens
gaaugcagugguauga

SEQ ID NO: 1046171 - RNA, 14 nt, Homo sapiens
gaaugcggcaagaa

SEQ ID NO: 1046172 - RNA, 19 nt, Homo sapiens
gaaugcuccagucaacaaa

SEQ ID NO: 1046173 - RNA, 21 nt, Homo sapiens
gaaugcucuuuacuucaugga

SEQ ID NO: 1046174 - RNA, 16 nt, Homo sapiens
gaaugggcagcucauc

SEQ ID NO: 1046175 - RNA, 19 nt, Homo sapiens
gaauggggaucacagagac

SEQ ID NO: 1046176 - RNA, 19 nt, Homo sapiens
gaauggggugcaugaaggu

SEQ ID NO: 1046177 - RNA, 15 nt, Homo sapiens
gaauguaaugguggc

SEQ ID NO: 1046178 - RNA, 19 nt, Homo sapiens
gaauguagagaauguagcc

SEQ ID NO: 1046179 - RNA, 14 nt, Homo sapiens
gaauguaugugcac

SEQ ID NO: 1046180 - RNA, 18 nt, Homo sapiens
gaauguggauucuuccca

SEQ ID NO: 1046181 - RNA, 17 nt, Homo sapiens
gaauguuuacacucuuu

SEQ ID NO: 1046182 - RNA, 17 nt, Homo sapiens
gaauguuuuacugugaa

SEQ ID NO: 1046183 - RNA, 17 nt, Homo sapiens
gaauuacaggcacauac

SEQ ID NO: 1046184 - RNA, 15 nt, Homo sapiens
gaauuagacuuguau

SEQ ID NO: 1046185 - RNA, 18 nt, Homo sapiens
gaauuagcucacuuggug

SEQ ID NO: 1046186 - RNA, 23 nt, Homo sapiens
gaauuaguccuugcuuggcugcu

SEQ ID NO: 1046187 - RNA, 19 nt, Homo sapiens
gaauucuaagcuggugccc

SEQ ID NO: 1046188 - RNA, 16 nt, Homo sapiens
gaauucucucaccucu

SEQ ID NO: 1046189 - RNA, 21 nt, Homo sapiens
gaauucugggaauccacagcu

SEQ ID NO: 1046190 - RNA, 23 nt, Homo sapiens
gaauucuuacauguuuucuuugc

SEQ ID NO: 1046191 - RNA, 17 nt, Homo sapiens
gaauuggcauguguaug

SEQ ID NO: 1046192 - RNA, 23 nt, Homo sapiens
gaauuguuuccuuauuugcacuu

SEQ ID NO: 1046193 - RNA, 11 nt, Homo sapiens
gaauuuccucu

SEQ ID NO: 1046194 - RNA, 17 nt, Homo sapiens
gaauuucuguucuucca

SEQ ID NO: 1046195 - RNA, 22 nt, Homo sapiens
gacaaaccagaagcaacagaaa

SEQ ID NO: 1046196 - RNA, 17 nt, Homo sapiens
gacaaaccgagugcaau

SEQ ID NO: 1046197 - RNA, 16 nt, Homo sapiens
gacaaccgaugcucca

SEQ ID NO: 1046198 - RNA, 16 nt, Homo sapiens
gacaaccucauuuuaa

SEQ ID NO: 1046199 - RNA, 16 nt, Homo sapiens
gacaagggaaauguca

SEQ ID NO: 1046200 - RNA, 19 nt, Homo sapiens
gacaaugaagaugaugcua

SEQ ID NO: 1046201 - RNA, 16 nt, Homo sapiens
gacacaccugaacaca

SEQ ID NO: 1046202 - RNA, 21 nt, Homo sapiens
gacacagcagcuucaccagag

SEQ ID NO: 1046203 - RNA, 22 nt, Homo sapiens
gacacagcuuuaucaccagaga

SEQ ID NO: 1046204 - RNA, 15 nt, Homo sapiens
gacacauaugcaccu

SEQ ID NO: 1046205 - RNA, 21 nt, Homo sapiens
gacaccagagcagaugcagag

SEQ ID NO: 1046206 - RNA, 17 nt, Homo sapiens
gacaccuugacagggca

SEQ ID NO: 1046207 - RNA, 16 nt, Homo sapiens
gacacgcaacuggcuc

SEQ ID NO: 1046208 - RNA, 16 nt, Homo sapiens
gacacguggugcauuu

SEQ ID NO: 1046209 - RNA, 15 nt, Homo sapiens
gacacugcaaaggcg

SEQ ID NO: 1046210 - RNA, 21 nt, Homo sapiens
gacagaaagcagaacagugau

SEQ ID NO: 1046211 - RNA, 14 nt, Homo sapiens
gacagaacuaagau

SEQ ID NO: 1046212 - RNA, 13 nt, Homo sapiens
gacagaagcagcu

SEQ ID NO: 1046213 - RNA, 19 nt, Homo sapiens
gacagagcagaacuuucac

SEQ ID NO: 1046214 - RNA, 20 nt, Homo sapiens
gacagagccagacugucuca

SEQ ID NO: 1046215 - RNA, 20 nt, Homo sapiens
gacagagguuaucuguccca

SEQ ID NO: 1046216 - RNA, 20 nt, Homo sapiens
gacagagucuggcucuguca

SEQ ID NO: 1046217 - RNA, 19 nt, Homo sapiens
gacagagugagacucuguc

SEQ ID NO: 1046218 - RNA, 16 nt, Homo sapiens
gacagauacuccucca

SEQ ID NO: 1046219 - RNA, 17 nt, Homo sapiens
gacagaugaccaaagcc

SEQ ID NO: 1046220 - RNA, 21 nt, Homo sapiens
gacagcucccucugccugaac

SEQ ID NO: 1046221 - RNA, 12 nt, Homo sapiens
gacagcucugcc

SEQ ID NO: 1046222 - RNA, 16 nt, Homo sapiens
gacagcucugccuguu

SEQ ID NO: 1046223 - RNA, 17 nt, Homo sapiens
gacagcugccugggauc

SEQ ID NO: 1046224 - RNA, 13 nt, Homo sapiens
gacagcuucucau

SEQ ID NO: 1046225 - RNA, 21 nt, Homo sapiens
gacagcuugaucaaaggcaca

SEQ ID NO: 1046226 - RNA, 23 nt, Homo sapiens
gacaggcacagaugaaugggagu

SEQ ID NO: 1046227 - RNA, 15 nt, Homo sapiens
gacaggguucauuga

SEQ ID NO: 1046228 - RNA, 15 nt, Homo sapiens
gacagugaggcugca

SEQ ID NO: 1046229 - RNA, 14 nt, Homo sapiens
gacagugcauuugc

SEQ ID NO: 1046230 - RNA, 15 nt, Homo sapiens
gacaguuuucugcuu

SEQ ID NO: 1046231 - RNA, 18 nt, Homo sapiens
gacauaauuucacugaau

SEQ ID NO: 1046232 - RNA, 15 nt, Homo sapiens
gacaucaacagauaa

SEQ ID NO: 1046233 - RNA, 20 nt, Homo sapiens
gacauccugagcagugccag

SEQ ID NO: 1046234 - RNA, 18 nt, Homo sapiens
gacaucucaggggccaga

SEQ ID NO: 1046235 - RNA, 17 nt, Homo sapiens
gacauggaauuaccuua

SEQ ID NO: 1046236 - RNA, 21 nt, Homo sapiens
gacauuaacaguuuuccauga

SEQ ID NO: 1046237 - RNA, 22 nt, Homo sapiens
gacauucaaggcauuucuauca

SEQ ID NO: 1046238 - RNA, 16 nt, Homo sapiens
gacauucacacagaga

SEQ ID NO: 1046239 - RNA, 16 nt, Homo sapiens
gacauucucaucacca

SEQ ID NO: 1046240 - RNA, 16 nt, Homo sapiens
gacauucucugaccua

SEQ ID NO: 1046241 - RNA, 16 nt, Homo sapiens
gacauugauacaguga

SEQ ID NO: 1046242 - RNA, 14 nt, Homo sapiens
gacauuuauucaaa

SEQ ID NO: 1046243 - RNA, 21 nt, Homo sapiens
gacauuuuuucagucauauaa

SEQ ID NO: 1046244 - RNA, 14 nt, Homo sapiens
gaccaacuuccugu

SEQ ID NO: 1046245 - RNA, 22 nt, Homo sapiens
gaccaagcaggaagcucagacu

SEQ ID NO: 1046246 - RNA, 17 nt, Homo sapiens
gaccaagcuuguccaac

SEQ ID NO: 1046247 - RNA, 22 nt, Homo sapiens
gaccaauaaccaugcccaagaa

SEQ ID NO: 1046248 - RNA, 14 nt, Homo sapiens
gaccaauaccuccu

SEQ ID NO: 1046249 - RNA, 15 nt, Homo sapiens
gaccacacagacagg

SEQ ID NO: 1046250 - RNA, 20 nt, Homo sapiens
gaccacacgcccccacaggc

SEQ ID NO: 1046251 - RNA, 19 nt, Homo sapiens
gaccacagcaucauuuugc

SEQ ID NO: 1046252 - RNA, 21 nt, Homo sapiens
gaccacgcuuucuagcuguug

SEQ ID NO: 1046253 - RNA, 14 nt, Homo sapiens
gaccacggacucca

SEQ ID NO: 1046254 - RNA, 14 nt, Homo sapiens
gaccacuccccuca

SEQ ID NO: 1046255 - RNA, 21 nt, Homo sapiens
gaccacucuuccugaguucag

SEQ ID NO: 1046256 - RNA, 14 nt, Homo sapiens
gaccagccugggca

SEQ ID NO: 1046257 - RNA, 13 nt, Homo sapiens
gaccagcuuugca

SEQ ID NO: 1046258 - RNA, 15 nt, Homo sapiens
gaccaggagggcacu

SEQ ID NO: 1046259 - RNA, 15 nt, Homo sapiens
gaccaggcaauguga

SEQ ID NO: 1046260 - RNA, 17 nt, Homo sapiens
gaccaggccugggccag

SEQ ID NO: 1046261 - RNA, 21 nt, Homo sapiens
gaccaguaugcuuggacugaa

SEQ ID NO: 1046262 - RNA, 24 nt, Homo sapiens
gaccagucacugacccugugcaga

SEQ ID NO: 1046263 - RNA, 15 nt, Homo sapiens
gaccauaaagggaaa

SEQ ID NO: 1046264 - RNA, 22 nt, Homo sapiens
gaccauaaccccggaagccaaa

SEQ ID NO: 1046265 - RNA, 14 nt, Homo sapiens
gaccauuuggucag

SEQ ID NO: 1046266 - RNA, 15 nt, Homo sapiens
gacccaaaaggcaga

SEQ ID NO: 1046267 - RNA, 23 nt, Homo sapiens
gacccacggagcccuuaugacau

SEQ ID NO: 1046268 - RNA, 19 nt, Homo sapiens
gacccaggcaccugcauuu

SEQ ID NO: 1046269 - RNA, 13 nt, Homo sapiens
gacccaugcaaua

SEQ ID NO: 1046270 - RNA, 19 nt, Homo sapiens
gacccaugcaauauuuccu

SEQ ID NO: 1046271 - RNA, 12 nt, Homo sapiens
gaccccaaagag

SEQ ID NO: 1046272 - RNA, 20 nt, Homo sapiens
gaccccaaauuaagaaucua

SEQ ID NO: 1046273 - RNA, 13 nt, Homo sapiens
gaccccucuaccu

SEQ ID NO: 1046274 - RNA, 21 nt, Homo sapiens
gacccuaagaccggcggccau

SEQ ID NO: 1046275 - RNA, 14 nt, Homo sapiens
gacccuauugcugc

SEQ ID NO: 1046276 - RNA, 17 nt, Homo sapiens
gacccucguggccuucc

SEQ ID NO: 1046277 - RNA, 13 nt, Homo sapiens
gacccugggacca

SEQ ID NO: 1046278 - RNA, 16 nt, Homo sapiens
gaccgagccucuguca

SEQ ID NO: 1046279 - RNA, 17 nt, Homo sapiens
gaccgccccucaccaac

SEQ ID NO: 1046280 - RNA, 20 nt, Homo sapiens
gaccgggaaaagggaaccau

SEQ ID NO: 1046281 - RNA, 16 nt, Homo sapiens
gaccuacucgagggac

SEQ ID NO: 1046282 - RNA, 21 nt, Homo sapiens
gaccucaaaggugauugugcc

SEQ ID NO: 1046283 - RNA, 11 nt, Homo sapiens
gaccucaggug

SEQ ID NO: 1046284 - RNA, 13 nt, Homo sapiens
gaccucccaaagu

SEQ ID NO: 1046285 - RNA, 19 nt, Homo sapiens
gaccugacaagcacugcua

SEQ ID NO: 1046286 - RNA, 14 nt, Homo sapiens
gaccugagaaccuu

SEQ ID NO: 1046287 - RNA, 20 nt, Homo sapiens
gaccugaggcuccugugcua

SEQ ID NO: 1046288 - RNA, 20 nt, Homo sapiens
gaccugccaggcacacugag

SEQ ID NO: 1046289 - RNA, 17 nt, Homo sapiens
gaccuggugcugccucu

SEQ ID NO: 1046290 - RNA, 16 nt, Homo sapiens
gaccuguucaaaaagg

SEQ ID NO: 1046291 - RNA, 14 nt, Homo sapiens
gaccuuccucgcag

SEQ ID NO: 1046292 - RNA, 14 nt, Homo sapiens
gaccuuccugccac

SEQ ID NO: 1046293 - RNA, 19 nt, Homo sapiens
gaccuuccugccaccaguc

SEQ ID NO: 1046294 - RNA, 20 nt, Homo sapiens
gaccuucuccuucaccuuug

SEQ ID NO: 1046295 - RNA, 22 nt, Homo sapiens
gaccuuuguagccacuucacuu

SEQ ID NO: 1046296 - RNA, 17 nt, Homo sapiens
gaccuuuuauccacuua

SEQ ID NO: 1046297 - RNA, 15 nt, Homo sapiens
gacgauggcuuugcc

SEQ ID NO: 1046298 - RNA, 18 nt, Homo sapiens
gacgcagggguugcagug

SEQ ID NO: 1046299 - RNA, 19 nt, Homo sapiens
gacggaggccuacucuucc

SEQ ID NO: 1046300 - RNA, 17 nt, Homo sapiens
gacgugauuuugcugua

SEQ ID NO: 1046301 - RNA, 20 nt, Homo sapiens
gacgugauuuugcuguagaa

SEQ ID NO: 1046302 - RNA, 14 nt, Homo sapiens
gacguguggugugc

SEQ ID NO: 1046303 - RNA, 18 nt, Homo sapiens
gacguugccaucaaaaca

SEQ ID NO: 1046304 - RNA, 16 nt, Homo sapiens
gacuagaggcagggag

SEQ ID NO: 1046305 - RNA, 22 nt, Homo sapiens
gacuaugucacccaaugcauau

SEQ ID NO: 1046306 - RNA, 16 nt, Homo sapiens
gacuauuuaugaaggc

SEQ ID NO: 1046307 - RNA, 22 nt, Homo sapiens
gacucaaaaauagggaaguaac

SEQ ID NO: 1046308 - RNA, 15 nt, Homo sapiens
gacucaauaaaauca

SEQ ID NO: 1046309 - RNA, 12 nt, Homo sapiens
gacucaaugcac

SEQ ID NO: 1046310 - RNA, 14 nt, Homo sapiens
gacucacaagaaga

SEQ ID NO: 1046311 - RNA, 12 nt, Homo sapiens
gacucacauccu

SEQ ID NO: 1046312 - RNA, 15 nt, Homo sapiens
gacucaggacauccc

SEQ ID NO: 1046313 - RNA, 18 nt, Homo sapiens
gacucaggaugcccaggg

SEQ ID NO: 1046314 - RNA, 17 nt, Homo sapiens
gacucagggccaugccu

SEQ ID NO: 1046315 - RNA, 21 nt, Homo sapiens
gacucagggccccagcacuaa

SEQ ID NO: 1046316 - RNA, 22 nt, Homo sapiens
gacucaguuuucuugcagauca

SEQ ID NO: 1046317 - RNA, 19 nt, Homo sapiens
gacuccaggagaggagcgg

SEQ ID NO: 1046318 - RNA, 15 nt, Homo sapiens
gacuccucaaaagca

SEQ ID NO: 1046319 - RNA, 18 nt, Homo sapiens
gacuccucuuugugcaga

SEQ ID NO: 1046320 - RNA, 14 nt, Homo sapiens
gacuccugaggaca

SEQ ID NO: 1046321 - RNA, 16 nt, Homo sapiens
gacucuaggugcccuu

SEQ ID NO: 1046322 - RNA, 19 nt, Homo sapiens
gacucuccagaaagcucau

SEQ ID NO: 1046323 - RNA, 10 nt, Homo sapiens
gacucugcac

SEQ ID NO: 1046324 - RNA, 15 nt, Homo sapiens
gacucugcacauguc

SEQ ID NO: 1046325 - RNA, 20 nt, Homo sapiens
gacucugcacaugucuugua

SEQ ID NO: 1046326 - RNA, 20 nt, Homo sapiens
gacucuucucauccuuccuc

SEQ ID NO: 1046327 - RNA, 22 nt, Homo sapiens
gacucuuugguggcuuugcauu

SEQ ID NO: 1046328 - RNA, 17 nt, Homo sapiens
gacugaauuacucucca

SEQ ID NO: 1046329 - RNA, 13 nt, Homo sapiens
gacugacauuuag

SEQ ID NO: 1046330 - RNA, 22 nt, Homo sapiens
gacugaucgauuugcacccacc

SEQ ID NO: 1046331 - RNA, 21 nt, Homo sapiens
gacugcaacaggcuugugcaa

SEQ ID NO: 1046332 - RNA, 18 nt, Homo sapiens
gacugcugcuagagccag

SEQ ID NO: 1046333 - RNA, 18 nt, Homo sapiens
gacugguuguugccaaac

SEQ ID NO: 1046334 - RNA, 17 nt, Homo sapiens
gacuguaggauuugaag

SEQ ID NO: 1046335 - RNA, 17 nt, Homo sapiens
gacuguggcacacgccu

SEQ ID NO: 1046336 - RNA, 22 nt, Homo sapiens
gacuguucaagagcacacuugg

SEQ ID NO: 1046337 - RNA, 18 nt, Homo sapiens
gacuguucuuuuacaaga

SEQ ID NO: 1046338 - RNA, 22 nt, Homo sapiens
gacuguugcucaaaucuauuca

SEQ ID NO: 1046339 - RNA, 18 nt, Homo sapiens
gacuuaacugguucauau

SEQ ID NO: 1046340 - RNA, 16 nt, Homo sapiens
gacuuagaaaaauccu

SEQ ID NO: 1046341 - RNA, 14 nt, Homo sapiens
gacuucaaugauag

SEQ ID NO: 1046342 - RNA, 21 nt, Homo sapiens
gacuugaacuagauugcaugc

SEQ ID NO: 1046343 - RNA, 18 nt, Homo sapiens
gacuugacagaacacugu

SEQ ID NO: 1046344 - RNA, 14 nt, Homo sapiens
gacuugcaaaaagg

SEQ ID NO: 1046345 - RNA, 20 nt, Homo sapiens
gacuuguauaucccacuggg

SEQ ID NO: 1046346 - RNA, 22 nt, Homo sapiens
gacuuucugaagccucacuuau

SEQ ID NO: 1046347 - RNA, 17 nt, Homo sapiens
gacuuugauagauuucu

SEQ ID NO: 1046348 - RNA, 18 nt, Homo sapiens
gagaaaaaaacuucuuua

SEQ ID NO: 1046349 - RNA, 23 nt, Homo sapiens
gagaaaaaauauuuuccugccag

SEQ ID NO: 1046350 - RNA, 22 nt, Homo sapiens
gagaaaagaaaccagagucaaa

SEQ ID NO: 1046351 - RNA, 18 nt, Homo sapiens
gagaaacacuaaagcauu

SEQ ID NO: 1046352 - RNA, 23 nt, Homo sapiens
gagaaaccagggagccccuuuga

SEQ ID NO: 1046353 - RNA, 20 nt, Homo sapiens
gagaaauaaaaauaccucuu

SEQ ID NO: 1046354 - RNA, 23 nt, Homo sapiens
gagaaauacuuucaggcacuaag

SEQ ID NO: 1046355 - RNA, 16 nt, Homo sapiens
gagaacaaugugcuau

SEQ ID NO: 1046356 - RNA, 19 nt, Homo sapiens
gagaacaccagagaccuca

SEQ ID NO: 1046357 - RNA, 13 nt, Homo sapiens
gagaacacuguga

SEQ ID NO: 1046358 - RNA, 14 nt, Homo sapiens
gagaacacugugaa

SEQ ID NO: 1046359 - RNA, 20 nt, Homo sapiens
gagaacccggcaacaucagu

SEQ ID NO: 1046360 - RNA, 21 nt, Homo sapiens
gagaacccugcguggggacag

SEQ ID NO: 1046361 - RNA, 13 nt, Homo sapiens
gagaacuacucag

SEQ ID NO: 1046362 - RNA, 16 nt, Homo sapiens
gagaacuauccaaaac

SEQ ID NO: 1046363 - RNA, 16 nt, Homo sapiens
gagaagccagugcggc

SEQ ID NO: 1046364 - RNA, 16 nt, Homo sapiens
gagaagccugugcccu

SEQ ID NO: 1046365 - RNA, 16 nt, Homo sapiens
gagaagcugucaggga

SEQ ID NO: 1046366 - RNA, 21 nt, Homo sapiens
gagaagugccccugcugccuc

SEQ ID NO: 1046367 - RNA, 13 nt, Homo sapiens
gagaaucacuuga

SEQ ID NO: 1046368 - RNA, 21 nt, Homo sapiens
gagaauuuacgagcagggaug

SEQ ID NO: 1046369 - RNA, 13 nt, Homo sapiens
gagacaaauggag

SEQ ID NO: 1046370 - RNA, 14 nt, Homo sapiens
gagacacaucuccu

SEQ ID NO: 1046371 - RNA, 23 nt, Homo sapiens
gagacacuauuuaucugugcaaa

SEQ ID NO: 1046372 - RNA, 19 nt, Homo sapiens
gagacagauauacugggag

SEQ ID NO: 1046373 - RNA, 23 nt, Homo sapiens
gagacagauauacugggagaaau

SEQ ID NO: 1046374 - RNA, 17 nt, Homo sapiens
gagacaggguuucacug

SEQ ID NO: 1046375 - RNA, 14 nt, Homo sapiens
gagacaguucaaga

SEQ ID NO: 1046376 - RNA, 15 nt, Homo sapiens
gagaccaucccugaa

SEQ ID NO: 1046377 - RNA, 15 nt, Homo sapiens
gagacccaaccacuu

SEQ ID NO: 1046378 - RNA, 16 nt, Homo sapiens
gagacuccgucacaac

SEQ ID NO: 1046379 - RNA, 13 nt, Homo sapiens
gagacucugucuc

SEQ ID NO: 1046380 - RNA, 16 nt, Homo sapiens
gagacucugucucagu

SEQ ID NO: 1046381 - RNA, 15 nt, Homo sapiens
gagacugcugaguca

SEQ ID NO: 1046382 - RNA, 17 nt, Homo sapiens
gagacuggagcaucuga

SEQ ID NO: 1046383 - RNA, 17 nt, Homo sapiens
gagacuggauacugccc

SEQ ID NO: 1046384 - RNA, 14 nt, Homo sapiens
gagacugucaguag

SEQ ID NO: 1046385 - RNA, 20 nt, Homo sapiens
gagacuuugacucuccagaa

SEQ ID NO: 1046386 - RNA, 13 nt, Homo sapiens
gagagaaaaaaga

SEQ ID NO: 1046387 - RNA, 22 nt, Homo sapiens
gagagcagcuuuaaacucaggg

SEQ ID NO: 1046388 - RNA, 16 nt, Homo sapiens
gagagcaggcuggcag

SEQ ID NO: 1046389 - RNA, 16 nt, Homo sapiens
gagagcauucugcucu

SEQ ID NO: 1046390 - RNA, 16 nt, Homo sapiens
gagagccaccaagagg

SEQ ID NO: 1046391 - RNA, 22 nt, Homo sapiens
gagagcccggcgccccugccac

SEQ ID NO: 1046392 - RNA, 16 nt, Homo sapiens
gagagcgccugccccu

SEQ ID NO: 1046393 - RNA, 21 nt, Homo sapiens
gagaggagggaugcugccuga

SEQ ID NO: 1046394 - RNA, 14 nt, Homo sapiens
gagaggaguucaau

SEQ ID NO: 1046395 - RNA, 20 nt, Homo sapiens
gagaggcaccacggccucac

SEQ ID NO: 1046396 - RNA, 19 nt, Homo sapiens
gagaggccacagugcaauu

SEQ ID NO: 1046397 - RNA, 13 nt, Homo sapiens
gagagggugacaa

SEQ ID NO: 1046398 - RNA, 16 nt, Homo sapiens
gagagggugacaagau

SEQ ID NO: 1046399 - RNA, 17 nt, Homo sapiens
gagagggugcuauccau

SEQ ID NO: 1046400 - RNA, 20 nt, Homo sapiens
gagaggugccagcaacugaa

SEQ ID NO: 1046401 - RNA, 20 nt, Homo sapiens
gagagucccacugccucagg

SEQ ID NO: 1046402 - RNA, 20 nt, Homo sapiens
gagaguccucuggauggcac

SEQ ID NO: 1046403 - RNA, 21 nt, Homo sapiens
gagaucacgccacugcacuau

SEQ ID NO: 1046404 - RNA, 20 nt, Homo sapiens
gagaucauugcaaacucaac

SEQ ID NO: 1046405 - RNA, 16 nt, Homo sapiens
gagaucguuguuuaca

SEQ ID NO: 1046406 - RNA, 19 nt, Homo sapiens
gagaucuaaggaugucaca

SEQ ID NO: 1046407 - RNA, 15 nt, Homo sapiens
gagaugcagcuggaa

SEQ ID NO: 1046408 - RNA, 20 nt, Homo sapiens
gagauggaaguugcagugag

SEQ ID NO: 1046409 - RNA, 17 nt, Homo sapiens
gagauggacacacuggu

SEQ ID NO: 1046410 - RNA, 17 nt, Homo sapiens
gagauggaggaaaguga

SEQ ID NO: 1046411 - RNA, 23 nt, Homo sapiens
gagaugggcuuguuuucuugcca

SEQ ID NO: 1046412 - RNA, 17 nt, Homo sapiens
gagauggguuugacaag

SEQ ID NO: 1046413 - RNA, 21 nt, Homo sapiens
gagauugcaccauugcgcucu

SEQ ID NO: 1046414 - RNA, 17 nt, Homo sapiens
gagauuguuguuugcca

SEQ ID NO: 1046415 - RNA, 15 nt, Homo sapiens
gagauuuuucaugau

SEQ ID NO: 1046416 - RNA, 18 nt, Homo sapiens
gagcaaauguggcuccug

SEQ ID NO: 1046417 - RNA, 17 nt, Homo sapiens
gagcaacuuucuuacac

SEQ ID NO: 1046418 - RNA, 21 nt, Homo sapiens
gagcaacuuucuuacacugaa

SEQ ID NO: 1046419 - RNA, 14 nt, Homo sapiens
gagcaaguccuucc

SEQ ID NO: 1046420 - RNA, 11 nt, Homo sapiens
gagcacacugu

SEQ ID NO: 1046421 - RNA, 16 nt, Homo sapiens
gagcacacuuggccca

SEQ ID NO: 1046422 - RNA, 22 nt, Homo sapiens
gagcagaugcaaugacucagga

SEQ ID NO: 1046423 - RNA, 15 nt, Homo sapiens
gagcagccacaacca

SEQ ID NO: 1046424 - RNA, 19 nt, Homo sapiens
gagcagccacaaccaaaaa

SEQ ID NO: 1046425 - RNA, 15 nt, Homo sapiens
gagcagcuucuggga

SEQ ID NO: 1046426 - RNA, 19 nt, Homo sapiens
gagcagcuucugggaccau

SEQ ID NO: 1046427 - RNA, 22 nt, Homo sapiens
gagcagcuucugggaccauaag

SEQ ID NO: 1046428 - RNA, 22 nt, Homo sapiens
gagcagcuuuaaacucagggac

SEQ ID NO: 1046429 - RNA, 16 nt, Homo sapiens
gagcaggcuacuguca

SEQ ID NO: 1046430 - RNA, 14 nt, Homo sapiens
gagcaguagcugga

SEQ ID NO: 1046431 - RNA, 21 nt, Homo sapiens
gagcagugaaugauucagugu

SEQ ID NO: 1046432 - RNA, 22 nt, Homo sapiens
gagcauaucaaaaaguauuaaa

SEQ ID NO: 1046433 - RNA, 18 nt, Homo sapiens
gagcaugggccuggccac

SEQ ID NO: 1046434 - RNA, 19 nt, Homo sapiens
gagcauuacgugagccagg

SEQ ID NO: 1046435 - RNA, 16 nt, Homo sapiens
gagcauuggcugagag

SEQ ID NO: 1046436 - RNA, 12 nt, Homo sapiens
gagcauuuccaa

SEQ ID NO: 1046437 - RNA, 17 nt, Homo sapiens
gagccaagaucgcacca

SEQ ID NO: 1046438 - RNA, 18 nt, Homo sapiens
gagccauguuaauguaau

SEQ ID NO: 1046439 - RNA, 15 nt, Homo sapiens
gagcccauccagucu

SEQ ID NO: 1046440 - RNA, 17 nt, Homo sapiens
gagcccauccagucucc

SEQ ID NO: 1046441 - RNA, 16 nt, Homo sapiens
gagccccagcuacccu

SEQ ID NO: 1046442 - RNA, 16 nt, Homo sapiens
gagccgagauugcacc

SEQ ID NO: 1046443 - RNA, 12 nt, Homo sapiens
gagccgcuguga

SEQ ID NO: 1046444 - RNA, 15 nt, Homo sapiens
gagccgugaugccuc

SEQ ID NO: 1046445 - RNA, 16 nt, Homo sapiens
gagccugcugcauggg

SEQ ID NO: 1046446 - RNA, 12 nt, Homo sapiens
gagccuggagaa

SEQ ID NO: 1046447 - RNA, 16 nt, Homo sapiens
gagccuggcuccaaac

SEQ ID NO: 1046448 - RNA, 17 nt, Homo sapiens
gagcuagaaacucagga

SEQ ID NO: 1046449 - RNA, 17 nt, Homo sapiens
ggcucucccagccaggu

SEQ ID NO: 1046450 - RNA, 19 nt, Homo sapiens
ggcucugacagaaagcaga

SEQ ID NO: 1046451 - RNA, 12 nt, Homo sapiens
ggcucugaccag

SEQ ID NO: 1046452 - RNA, 13 nt, Homo sapiens
ggcucuuuccuug

SEQ ID NO: 1046453 - RNA, 15 nt, Homo sapiens
ggcugaauugggagu

SEQ ID NO: 1046454 - RNA, 18 nt, Homo sapiens
ggcugacauuguggcaca

SEQ ID NO: 1046455 - RNA, 19 nt, Homo sapiens
ggcugacauuguggcacau

SEQ ID NO: 1046456 - RNA, 12 nt, Homo sapiens
ggcugagcucuu

SEQ ID NO: 1046457 - RNA, 13 nt, Homo sapiens
ggcugagcugaac

SEQ ID NO: 1046458 - RNA, 20 nt, Homo sapiens
ggcugaggccucucauucca

SEQ ID NO: 1046459 - RNA, 17 nt, Homo sapiens
ggcugcacccacccagg

SEQ ID NO: 1046460 - RNA, 11 nt, Homo sapiens
ggcugcucccc

SEQ ID NO: 1046461 - RNA, 13 nt, Homo sapiens
ggcugcugaccau

SEQ ID NO: 1046462 - RNA, 19 nt, Homo sapiens
ggcuggagugcaauggcgu

SEQ ID NO: 1046463 - RNA, 14 nt, Homo sapiens
ggcuggagugcagu

SEQ ID NO: 1046464 - RNA, 19 nt, Homo sapiens
ggcuggagugcaguggcgu

SEQ ID NO: 1046465 - RNA, 16 nt, Homo sapiens
ggcuggaguucagugg

SEQ ID NO: 1046466 - RNA, 13 nt, Homo sapiens
ggcuggcacugac

SEQ ID NO: 1046467 - RNA, 16 nt, Homo sapiens
ggcuggcagcucucca

SEQ ID NO: 1046468 - RNA, 20 nt, Homo sapiens
ggcuggguaccaaugcugca

SEQ ID NO: 1046469 - RNA, 18 nt, Homo sapiens
ggcuggucuuggugaaca

SEQ ID NO: 1046470 - RNA, 22 nt, Homo sapiens
ggcugguuagagguucccuuug

SEQ ID NO: 1046471 - RNA, 18 nt, Homo sapiens
ggcugucaucagccugug

SEQ ID NO: 1046472 - RNA, 13 nt, Homo sapiens
ggcuuacuuccua

SEQ ID NO: 1046473 - RNA, 21 nt, Homo sapiens
ggcuuagaaaguccaauucca

SEQ ID NO: 1046474 - RNA, 21 nt, Homo sapiens
ggcuuagacuucgacucagga

SEQ ID NO: 1046475 - RNA, 18 nt, Homo sapiens
ggcuucacuguauaaaua

SEQ ID NO: 1046476 - RNA, 15 nt, Homo sapiens
ggcuucaucugucaa

SEQ ID NO: 1046477 - RNA, 19 nt, Homo sapiens
ggcuuccagagaguccucu

SEQ ID NO: 1046478 - RNA, 21 nt, Homo sapiens
ggcuuccauuugugugugugc

SEQ ID NO: 1046479 - RNA, 12 nt, Homo sapiens
ggcuuccuccuc

SEQ ID NO: 1046480 - RNA, 14 nt, Homo sapiens
ggcuucucagcccu

SEQ ID NO: 1046481 - RNA, 22 nt, Homo sapiens
ggcuucuuaaucuuuucacaaa

SEQ ID NO: 1046482 - RNA, 15 nt, Homo sapiens
ggcuugccacagcuc

SEQ ID NO: 1046483 - RNA, 13 nt, Homo sapiens
ggcuugcugccaa

SEQ ID NO: 1046484 - RNA, 22 nt, Homo sapiens
ggcuuucuggagaggagggaug

SEQ ID NO: 1046485 - RNA, 22 nt, Homo sapiens
ggcuuuuccucccucagccccu

SEQ ID NO: 1046486 - RNA, 21 nt, Homo sapiens
gggaaaccccccagagcucuu

SEQ ID NO: 1046487 - RNA, 19 nt, Homo sapiens
gggaaagcccagaaaagga

SEQ ID NO: 1046488 - RNA, 15 nt, Homo sapiens
gggaaaucuuauauu

SEQ ID NO: 1046489 - RNA, 23 nt, Homo sapiens
gggaaauggcuugaagccaaguc

SEQ ID NO: 1046490 - RNA, 17 nt, Homo sapiens
gggaacaagcauucucc

SEQ ID NO: 1046491 - RNA, 13 nt, Homo sapiens
gggaagaccagcu

SEQ ID NO: 1046492 - RNA, 14 nt, Homo sapiens
gggaagacuguggc

SEQ ID NO: 1046493 - RNA, 15 nt, Homo sapiens
gggaagagugcauuu

SEQ ID NO: 1046494 - RNA, 20 nt, Homo sapiens
gggaagggugguggagccag

SEQ ID NO: 1046495 - RNA, 15 nt, Homo sapiens
gggaaggucaccagc

SEQ ID NO: 1046496 - RNA, 12 nt, Homo sapiens
gggaaugcugcc

SEQ ID NO: 1046497 - RNA, 15 nt, Homo sapiens
gggaauugcagagua

SEQ ID NO: 1046498 - RNA, 21 nt, Homo sapiens
gggacagagccaugcugggaa

SEQ ID NO: 1046499 - RNA, 21 nt, Homo sapiens
gggacagggcucgccucagga

SEQ ID NO: 1046500 - RNA, 16 nt, Homo sapiens
gggacaucucuuugaa

SEQ ID NO: 1046501 - RNA, 14 nt, Homo sapiens
gggaccggccaggc

SEQ ID NO: 1046502 - RNA, 16 nt, Homo sapiens
gggacucaaugcacug

SEQ ID NO: 1046503 - RNA, 16 nt, Homo sapiens
gggacucagggccaug

SEQ ID NO: 1046504 - RNA, 11 nt, Homo sapiens
gggacuggcac

SEQ ID NO: 1046505 - RNA, 23 nt, Homo sapiens
gggacuuauguauuuaugaccuu

SEQ ID NO: 1046506 - RNA, 18 nt, Homo sapiens
gggacuucugucuucaca

SEQ ID NO: 1046507 - RNA, 13 nt, Homo sapiens
gggaggcuucccc

SEQ ID NO: 1046508 - RNA, 20 nt, Homo sapiens
gggagguggagguugcagug

SEQ ID NO: 1046509 - RNA, 20 nt, Homo sapiens
gggagugcccccaacagcac

SEQ ID NO: 1046510 - RNA, 17 nt, Homo sapiens
gggaucucaggggcugu

SEQ ID NO: 1046511 - RNA, 16 nt, Homo sapiens
gggaucuugcauuccc

SEQ ID NO: 1046512 - RNA, 11 nt, Homo sapiens
gggaugaugau

SEQ ID NO: 1046513 - RNA, 23 nt, Homo sapiens
gggaugucuccgucucugucuca

SEQ ID NO: 1046514 - RNA, 10 nt, Homo sapiens
gggauguuuu

SEQ ID NO: 1046515 - RNA, 18 nt, Homo sapiens
gggauugaagcccuccaa

SEQ ID NO: 1046516 - RNA, 17 nt, Homo sapiens
gggauuggggaagacug

SEQ ID NO: 1046517 - RNA, 16 nt, Homo sapiens
gggcaagucccugacu

SEQ ID NO: 1046518 - RNA, 13 nt, Homo sapiens
gggcacacacugu

SEQ ID NO: 1046519 - RNA, 22 nt, Homo sapiens
gggcacacgccucccacugggg

SEQ ID NO: 1046520 - RNA, 20 nt, Homo sapiens
gggcacccagccucuaggga

SEQ ID NO: 1046521 - RNA, 14 nt, Homo sapiens
gggcaccugaccac

SEQ ID NO: 1046522 - RNA, 22 nt, Homo sapiens
gggcacucccuugguggcaaga

SEQ ID NO: 1046523 - RNA, 18 nt, Homo sapiens
gggcacugaggaccagcc

SEQ ID NO: 1046524 - RNA, 14 nt, Homo sapiens
gggcacugcagggg

SEQ ID NO: 1046525 - RNA, 17 nt, Homo sapiens
gggcagcauagcaagac

SEQ ID NO: 1046526 - RNA, 13 nt, Homo sapiens
gggcagccacgug

SEQ ID NO: 1046527 - RNA, 14 nt, Homo sapiens
gggcagcuugcccc

SEQ ID NO: 1046528 - RNA, 16 nt, Homo sapiens
gggcauggagccagug

SEQ ID NO: 1046529 - RNA, 12 nt, Homo sapiens
gggccagggaag

SEQ ID NO: 1046530 - RNA, 21 nt, Homo sapiens
gggcccacagggaacccugcu

SEQ ID NO: 1046531 - RNA, 14 nt, Homo sapiens
gggcccagggccua

SEQ ID NO: 1046532 - RNA, 16 nt, Homo sapiens
gggccccucaucugcu

SEQ ID NO: 1046533 - RNA, 15 nt, Homo sapiens
gggccgaauccccuc

SEQ ID NO: 1046534 - RNA, 16 nt, Homo sapiens
gggccucgggaccuca

SEQ ID NO: 1046535 - RNA, 15 nt, Homo sapiens
gggccugaugugugu

SEQ ID NO: 1046536 - RNA, 14 nt, Homo sapiens
gggccuggaccugc

SEQ ID NO: 1046537 - RNA, 17 nt, Homo sapiens
gggcgaccccgucacag

SEQ ID NO: 1046538 - RNA, 18 nt, Homo sapiens
gggcgaucgcggcggagc

SEQ ID NO: 1046539 - RNA, 16 nt, Homo sapiens
gggcucagaguggggu

SEQ ID NO: 1046540 - RNA, 21 nt, Homo sapiens
gggcucccuucccaccucucu

SEQ ID NO: 1046541 - RNA, 14 nt, Homo sapiens
gggcucgugcccug

SEQ ID NO: 1046542 - RNA, 14 nt, Homo sapiens
gggcucucucauga

SEQ ID NO: 1046543 - RNA, 14 nt, Homo sapiens
gggcugagacugga

SEQ ID NO: 1046544 - RNA, 22 nt, Homo sapiens
gggcugagcccuggcaggauga

SEQ ID NO: 1046545 - RNA, 18 nt, Homo sapiens
gggcugguagcucaggug

SEQ ID NO: 1046546 - RNA, 22 nt, Homo sapiens
ggggaaaaucucagcaaugauu

SEQ ID NO: 1046547 - RNA, 19 nt, Homo sapiens
ggggacauagcugugcuau

SEQ ID NO: 1046548 - RNA, 19 nt, Homo sapiens
ggggacucgguaagcacuu

SEQ ID NO: 1046549 - RNA, 15 nt, Homo sapiens
ggggacugucuuuca

SEQ ID NO: 1046550 - RNA, 17 nt, Homo sapiens
ggggagacuucuuggcu

SEQ ID NO: 1046551 - RNA, 14 nt, Homo sapiens
ggggaggccaagug

SEQ ID NO: 1046552 - RNA, 19 nt, Homo sapiens
ggggcgggaaagccaguga

SEQ ID NO: 1046553 - RNA, 19 nt, Homo sapiens
ggggcucacaccuguaauc

SEQ ID NO: 1046554 - RNA, 13 nt, Homo sapiens
ggggcucucucau

SEQ ID NO: 1046555 - RNA, 17 nt, Homo sapiens
ggggcuuuuacaccagu

SEQ ID NO: 1046556 - RNA, 15 nt, Homo sapiens
gggggccgugcccag

SEQ ID NO: 1046557 - RNA, 20 nt, Homo sapiens
gggggcugcagcauguugcu

SEQ ID NO: 1046558 - RNA, 20 nt, Homo sapiens
ggggucccauagaggugagg

SEQ ID NO: 1046559 - RNA, 18 nt, Homo sapiens
gggguggugggaaccaug

SEQ ID NO: 1046560 - RNA, 13 nt, Homo sapiens
ggguagaucucaa

SEQ ID NO: 1046561 - RNA, 18 nt, Homo sapiens
ggguagcccgccugccag

SEQ ID NO: 1046562 - RNA, 22 nt, Homo sapiens
ggguaggcgggaaggaggguua

SEQ ID NO: 1046563 - RNA, 23 nt, Homo sapiens
ggguaucagcaucuguccucauc

SEQ ID NO: 1046564 - RNA, 19 nt, Homo sapiens
ggguauuuaccacagcagc

SEQ ID NO: 1046565 - RNA, 19 nt, Homo sapiens
gggucagagaggagucaga

SEQ ID NO: 1046566 - RNA, 14 nt, Homo sapiens
gggucaguaaggaa

SEQ ID NO: 1046567 - RNA, 20 nt, Homo sapiens
ggguccacccagcaaagagu

SEQ ID NO: 1046568 - RNA, 18 nt, Homo sapiens
ggguccucaguccacugc

SEQ ID NO: 1046569 - RNA, 20 nt, Homo sapiens
gggucucacuauguugccca

SEQ ID NO: 1046570 - RNA, 19 nt, Homo sapiens
gggucuuguuaagugcagu

SEQ ID NO: 1046571 - RNA, 12 nt, Homo sapiens
gggucuuucaug

SEQ ID NO: 1046572 - RNA, 16 nt, Homo sapiens
gggucuuugaacccuu

SEQ ID NO: 1046573 - RNA, 20 nt, Homo sapiens
gggugauuacauaaucugua

SEQ ID NO: 1046574 - RNA, 16 nt, Homo sapiens
gggugcgguggcucac

SEQ ID NO: 1046575 - RNA, 16 nt, Homo sapiens
ggguggagaagccauu

SEQ ID NO: 1046576 - RNA, 17 nt, Homo sapiens
ggguggagcaugggccu

SEQ ID NO: 1046577 - RNA, 15 nt, Homo sapiens
ggguggaucaccuga

SEQ ID NO: 1046578 - RNA, 16 nt, Homo sapiens
ggguggaucaccugag

SEQ ID NO: 1046579 - RNA, 21 nt, Homo sapiens
ggguggcccuugcaguucagc

SEQ ID NO: 1046580 - RNA, 23 nt, Homo sapiens
ggguucauuauuggaauuaaccu

SEQ ID NO: 1046581 - RNA, 17 nt, Homo sapiens
ggguuggacaaccucau

SEQ ID NO: 1046582 - RNA, 18 nt, Homo sapiens
ggguuucaccauguuggc

SEQ ID NO: 1046583 - RNA, 12 nt, Homo sapiens
ggguuugcaaga

SEQ ID NO: 1046584 - RNA, 19 nt, Homo sapiens
gguaauaaguacuguguac

SEQ ID NO: 1046585 - RNA, 15 nt, Homo sapiens
gguaaugugaauaaa

SEQ ID NO: 1046586 - RNA, 21 nt, Homo sapiens
gguacagacacucccacuugg

SEQ ID NO: 1046587 - RNA, 16 nt, Homo sapiens
gguacauuucccugug

SEQ ID NO: 1046588 - RNA, 17 nt, Homo sapiens
gguaccaagagacuccu

SEQ ID NO: 1046589 - RNA, 21 nt, Homo sapiens
gguacuauuuagauauaacac

SEQ ID NO: 1046590 - RNA, 21 nt, Homo sapiens
gguacuuuuaugauguauauu

SEQ ID NO: 1046591 - RNA, 14 nt, Homo sapiens
gguagaaaggcagu

SEQ ID NO: 1046592 - RNA, 19 nt, Homo sapiens
gguagagaugggguuucac

SEQ ID NO: 1046593 - RNA, 13 nt, Homo sapiens
gguagcaacugaa

SEQ ID NO: 1046594 - RNA, 20 nt, Homo sapiens
gguauaaugguugacugggu

SEQ ID NO: 1046595 - RNA, 21 nt, Homo sapiens
gguauauucauuucaaaggga

SEQ ID NO: 1046596 - RNA, 21 nt, Homo sapiens
gguaucagcaucuguccucau

SEQ ID NO: 1046597 - RNA, 19 nt, Homo sapiens
gguaucaguugcaauaaua

SEQ ID NO: 1046598 - RNA, 14 nt, Homo sapiens
gguaucuccaggau

SEQ ID NO: 1046599 - RNA, 18 nt, Homo sapiens
ucccagaacacacuccau

SEQ ID NO: 1046600 - RNA, 17 nt, Homo sapiens
ucccagaaggcauauca

SEQ ID NO: 1046601 - RNA, 13 nt, Homo sapiens
ucccagcacuuug

SEQ ID NO: 1046602 - RNA, 22 nt, Homo sapiens
ucccagcacuuugggaggccaa

SEQ ID NO: 1046603 - RNA, 17 nt, Homo sapiens
ucccagccacucgggag

SEQ ID NO: 1046604 - RNA, 20 nt, Homo sapiens
ucccagcccuugcauugcag

SEQ ID NO: 1046605 - RNA, 13 nt, Homo sapiens
ucccagcucaggg

SEQ ID NO: 1046606 - RNA, 14 nt, Homo sapiens
ucccagcugccaug

SEQ ID NO: 1046607 - RNA, 23 nt, Homo sapiens
ucccaggaguacaccccaacagc

SEQ ID NO: 1046608 - RNA, 20 nt, Homo sapiens
ucccaggcuggagugcagug

SEQ ID NO: 1046609 - RNA, 16 nt, Homo sapiens
ucccaucgcugucaca

SEQ ID NO: 1046610 - RNA, 20 nt, Homo sapiens
ucccaucuugauaagaccac

SEQ ID NO: 1046611 - RNA, 15 nt, Homo sapiens
ucccaugaggcacga

SEQ ID NO: 1046612 - RNA, 17 nt, Homo sapiens
ucccauggacacuccag

SEQ ID NO: 1046613 - RNA, 21 nt, Homo sapiens
ucccauggaucaucaagguga

SEQ ID NO: 1046614 - RNA, 15 nt, Homo sapiens
ucccauucuugcaug

SEQ ID NO: 1046615 - RNA, 20 nt, Homo sapiens
ucccauuuccugagaccaca

SEQ ID NO: 1046616 - RNA, 17 nt, Homo sapiens
ucccauuucuacucucc

SEQ ID NO: 1046617 - RNA, 14 nt, Homo sapiens
uccccacacugacc

SEQ ID NO: 1046618 - RNA, 22 nt, Homo sapiens
uccccacaggagcccugcagug

SEQ ID NO: 1046619 - RNA, 14 nt, Homo sapiens
uccccaccacacuu

SEQ ID NO: 1046620 - RNA, 20 nt, Homo sapiens
uccccaccaccaauugccaa

SEQ ID NO: 1046621 - RNA, 13 nt, Homo sapiens
uccccacccuggg

SEQ ID NO: 1046622 - RNA, 16 nt, Homo sapiens
uccccaccugucuuca

SEQ ID NO: 1046623 - RNA, 14 nt, Homo sapiens
uccccagagcacug

SEQ ID NO: 1046624 - RNA, 15 nt, Homo sapiens
uccccagagcacugg

SEQ ID NO: 1046625 - RNA, 16 nt, Homo sapiens
uccccagguguguugg

SEQ ID NO: 1046626 - RNA, 22 nt, Homo sapiens
uccccagguguguuggggccuu

SEQ ID NO: 1046627 - RNA, 17 nt, Homo sapiens
ucccccagcagccuggg

SEQ ID NO: 1046628 - RNA, 15 nt, Homo sapiens
ucccccaggugcagu

SEQ ID NO: 1046629 - RNA, 15 nt, Homo sapiens
ucccccgccacuccu

SEQ ID NO: 1046630 - RNA, 16 nt, Homo sapiens
ucccccgccacuccug

SEQ ID NO: 1046631 - RNA, 15 nt, Homo sapiens
uccccggaguucagu

SEQ ID NO: 1046632 - RNA, 13 nt, Homo sapiens
uccccguccacag

SEQ ID NO: 1046633 - RNA, 14 nt, Homo sapiens
uccccuaaaccaaa

SEQ ID NO: 1046634 - RNA, 15 nt, Homo sapiens
uccccuaaaccaaaa

SEQ ID NO: 1046635 - RNA, 16 nt, Homo sapiens
uccccucagacuagcu

SEQ ID NO: 1046636 - RNA, 17 nt, Homo sapiens
uccccucagagugcaag

SEQ ID NO: 1046637 - RNA, 19 nt, Homo sapiens
uccccucccuggcucccau

SEQ ID NO: 1046638 - RNA, 13 nt, Homo sapiens
uccccucggagaa

SEQ ID NO: 1046639 - RNA, 15 nt, Homo sapiens
uccccuggacuggga

SEQ ID NO: 1046640 - RNA, 20 nt, Homo sapiens
uccccuggggagucugggca

SEQ ID NO: 1046641 - RNA, 21 nt, Homo sapiens
uccccuggggagucugggcac

SEQ ID NO: 1046642 - RNA, 15 nt, Homo sapiens
uccccuuccacugag

SEQ ID NO: 1046643 - RNA, 19 nt, Homo sapiens
uccccuugcccuugcccug

SEQ ID NO: 1046644 - RNA, 15 nt, Homo sapiens
uccccuuggcuguga

SEQ ID NO: 1046645 - RNA, 21 nt, Homo sapiens
uccccuuuguguagaaagcca

SEQ ID NO: 1046646 - RNA, 18 nt, Homo sapiens
ucccgaguaacugagauu

SEQ ID NO: 1046647 - RNA, 20 nt, Homo sapiens
ucccgaguaacugagauuac

SEQ ID NO: 1046648 - RNA, 24 nt, Homo sapiens
ucccggaagcucacagugacauua

SEQ ID NO: 1046649 - RNA, 22 nt, Homo sapiens
ucccuagccagcacuuguauau

SEQ ID NO: 1046650 - RNA, 15 nt, Homo sapiens
ucccucaaagcacac

SEQ ID NO: 1046651 - RNA, 11 nt, Homo sapiens
ucccucaggcc

SEQ ID NO: 1046652 - RNA, 22 nt, Homo sapiens
ucccuccccuccccguccacag

SEQ ID NO: 1046653 - RNA, 14 nt, Homo sapiens
ucccucccuaucua

SEQ ID NO: 1046654 - RNA, 15 nt, Homo sapiens
ucccucuaaguggaa

SEQ ID NO: 1046655 - RNA, 14 nt, Homo sapiens
ucccucucaugacu

SEQ ID NO: 1046656 - RNA, 22 nt, Homo sapiens
ucccucuuuggcuccccuguac

SEQ ID NO: 1046657 - RNA, 18 nt, Homo sapiens
ucccugaagagaagggca

SEQ ID NO: 1046658 - RNA, 20 nt, Homo sapiens
ucccugaagagaagggcagg

SEQ ID NO: 1046659 - RNA, 14 nt, Homo sapiens
ucccuggaccucag

SEQ ID NO: 1046660 - RNA, 13 nt, Homo sapiens
ucccugggcauug

SEQ ID NO: 1046661 - RNA, 21 nt, Homo sapiens
ucccuggggcugcugugcgcu

SEQ ID NO: 1046662 - RNA, 14 nt, Homo sapiens
ucccuguaaccucu

SEQ ID NO: 1046663 - RNA, 18 nt, Homo sapiens
ucccugugcugacggaag

SEQ ID NO: 1046664 - RNA, 19 nt, Homo sapiens
ucccuucucuuaauuuaau

SEQ ID NO: 1046665 - RNA, 22 nt, Homo sapiens
ucccuucuuuuuguucuucauc

SEQ ID NO: 1046666 - RNA, 17 nt, Homo sapiens
ucccuuuuuauauccca

SEQ ID NO: 1046667 - RNA, 23 nt, Homo sapiens
uccgaaaaauccucuuccucuga

SEQ ID NO: 1046668 - RNA, 16 nt, Homo sapiens
uccgacugcuagggag

SEQ ID NO: 1046669 - RNA, 15 nt, Homo sapiens
uccgaggccaguacc

SEQ ID NO: 1046670 - RNA, 20 nt, Homo sapiens
uccgcgccuugccuccucac

SEQ ID NO: 1046671 - RNA, 20 nt, Homo sapiens
uccggccuccugucccucau

SEQ ID NO: 1046672 - RNA, 12 nt, Homo sapiens
uccguacauuca

SEQ ID NO: 1046673 - RNA, 13 nt, Homo sapiens
uccgugccuccac

SEQ ID NO: 1046674 - RNA, 19 nt, Homo sapiens
uccgugccuccaccaccac

SEQ ID NO: 1046675 - RNA, 19 nt, Homo sapiens
uccuaaaacaaaagcucau

SEQ ID NO: 1046676 - RNA, 18 nt, Homo sapiens
uccuaagagagagagaca

SEQ ID NO: 1046677 - RNA, 19 nt, Homo sapiens
uccuaagccaugggagaca

SEQ ID NO: 1046678 - RNA, 19 nt, Homo sapiens
uccuaaugaaugcauaaaa

SEQ ID NO: 1046679 - RNA, 17 nt, Homo sapiens
uccuacccacaccucug

SEQ ID NO: 1046680 - RNA, 14 nt, Homo sapiens
uccuacccuuccag

SEQ ID NO: 1046681 - RNA, 19 nt, Homo sapiens
uccuacucccagacaccca

SEQ ID NO: 1046682 - RNA, 18 nt, Homo sapiens
uccuacuguaugugggaa

SEQ ID NO: 1046683 - RNA, 15 nt, Homo sapiens
uccuagcaaccucca

SEQ ID NO: 1046684 - RNA, 15 nt, Homo sapiens
uccuagggccacuga

SEQ ID NO: 1046685 - RNA, 23 nt, Homo sapiens
uccuaucacugauaguguccaaa

SEQ ID NO: 1046686 - RNA, 14 nt, Homo sapiens
uccuaugaucucag

SEQ ID NO: 1046687 - RNA, 14 nt, Homo sapiens
uccucacaccacaa

SEQ ID NO: 1046688 - RNA, 23 nt, Homo sapiens
uccucacaucuuucacacuucca

SEQ ID NO: 1046689 - RNA, 14 nt, Homo sapiens
uccucaccacuucc

SEQ ID NO: 1046690 - RNA, 12 nt, Homo sapiens
uccucacccacc

SEQ ID NO: 1046691 - RNA, 15 nt, Homo sapiens
uccucaguccacugc

SEQ ID NO: 1046692 - RNA, 15 nt, Homo sapiens
uccucaguucaucca

SEQ ID NO: 1046693 - RNA, 13 nt, Homo sapiens
uccucauuccuga

SEQ ID NO: 1046694 - RNA, 22 nt, Homo sapiens
uccucauuuuugaauacaggca

SEQ ID NO: 1046695 - RNA, 15 nt, Homo sapiens
uccuccacaaauuau

SEQ ID NO: 1046696 - RNA, 22 nt, Homo sapiens
uccuccacaauaaggucaaugc

SEQ ID NO: 1046697 - RNA, 20 nt, Homo sapiens
uccuccagaagccucuggcu

SEQ ID NO: 1046698 - RNA, 14 nt, Homo sapiens
uccuccagaccauu

SEQ ID NO: 1046699 - RNA, 15 nt, Homo sapiens
uccucccucauucca

SEQ ID NO: 1046700 - RNA, 19 nt, Homo sapiens
uccuccugcccaccuguca

SEQ ID NO: 1046701 - RNA, 19 nt, Homo sapiens
uccuccuuguucuacucau

SEQ ID NO: 1046702 - RNA, 20 nt, Homo sapiens
uccucgacacgcaacuggcu

SEQ ID NO: 1046703 - RNA, 18 nt, Homo sapiens
uccucgagcaacugcugu

SEQ ID NO: 1046704 - RNA, 13 nt, Homo sapiens
uccucuauugaug

SEQ ID NO: 1046705 - RNA, 13 nt, Homo sapiens
uccucugacucag

SEQ ID NO: 1046706 - RNA, 15 nt, Homo sapiens
uccucugaucuccau

SEQ ID NO: 1046707 - RNA, 16 nt, Homo sapiens
uccucuguaaacuuuu

SEQ ID NO: 1046708 - RNA, 11 nt, Homo sapiens
uccucuucuau

SEQ ID NO: 1046709 - RNA, 23 nt, Homo sapiens
uccucuuucaaagguagccauca

SEQ ID NO: 1046710 - RNA, 23 nt, Homo sapiens
uccugaagguguuuuucauucac

SEQ ID NO: 1046711 - RNA, 18 nt, Homo sapiens
uccugaccucaggugauc

SEQ ID NO: 1046712 - RNA, 22 nt, Homo sapiens
uccugaccucaggugauccacc

SEQ ID NO: 1046713 - RNA, 20 nt, Homo sapiens
uccugaguaguugggauuac

SEQ ID NO: 1046714 - RNA, 20 nt, Homo sapiens
uccugaucgccaaccuuucc

SEQ ID NO: 1046715 - RNA, 21 nt, Homo sapiens
uccugccaacugauuuaaaag

SEQ ID NO: 1046716 - RNA, 20 nt, Homo sapiens
uccugcccaccugucaaaca

SEQ ID NO: 1046717 - RNA, 17 nt, Homo sapiens
uccugccgcaacaguuu

SEQ ID NO: 1046718 - RNA, 16 nt, Homo sapiens
uccugccgcagugauc

SEQ ID NO: 1046719 - RNA, 22 nt, Homo sapiens
uccugcuacaacuucagcagua

SEQ ID NO: 1046720 - RNA, 17 nt, Homo sapiens
uccugcuauuacuaagg

SEQ ID NO: 1046721 - RNA, 13 nt, Homo sapiens
uccuggacaguuu

SEQ ID NO: 1046722 - RNA, 15 nt, Homo sapiens
uccuggcugagagag

SEQ ID NO: 1046723 - RNA, 16 nt, Homo sapiens
uccuggggaacauaga

SEQ ID NO: 1046724 - RNA, 21 nt, Homo sapiens
uccugguuccuaggugagcag

SEQ ID NO: 1046725 - RNA, 20 nt, Homo sapiens
uccuguaagucaaaugugug

SEQ ID NO: 1046726 - RNA, 14 nt, Homo sapiens
uccuguauucuaca

SEQ ID NO: 1046727 - RNA, 19 nt, Homo sapiens
uccuguauucuacagcaga

SEQ ID NO: 1046728 - RNA, 17 nt, Homo sapiens
uccugucuaacugcugu

SEQ ID NO: 1046729 - RNA, 14 nt, Homo sapiens
uccugugaauuucu

SEQ ID NO: 1046730 - RNA, 23 nt, Homo sapiens
uccugugagcucaacuaaguuca

SEQ ID NO: 1046731 - RNA, 18 nt, Homo sapiens
uccugugcuacuuugccu

SEQ ID NO: 1046732 - RNA, 21 nt, Homo sapiens
uccugugcuugaugcuagaaa

SEQ ID NO: 1046733 - RNA, 22 nt, Homo sapiens
uccugugugugcgccuacagga

SEQ ID NO: 1046734 - RNA, 17 nt, Homo sapiens
uccuguuuuuugaugcu

SEQ ID NO: 1046735 - RNA, 17 nt, Homo sapiens
uccuuaauaacaacaga

SEQ ID NO: 1046736 - RNA, 23 nt, Homo sapiens
uccuuaggucugcccugcuugca

SEQ ID NO: 1046737 - RNA, 15 nt, Homo sapiens
uccuuaucacugaca

SEQ ID NO: 1046738 - RNA, 19 nt, Homo sapiens
uccuucacagaugggugcu

SEQ ID NO: 1046739 - RNA, 17 nt, Homo sapiens
uccuucaccucacugaa

SEQ ID NO: 1046740 - RNA, 16 nt, Homo sapiens
uccuuccaucccuacc

SEQ ID NO: 1046741 - RNA, 16 nt, Homo sapiens
uccuucucaucuguga

SEQ ID NO: 1046742 - RNA, 21 nt, Homo sapiens
uccuucuuguaguagucucau

SEQ ID NO: 1046743 - RNA, 14 nt, Homo sapiens
uccuugaccagcag

SEQ ID NO: 1046744 - RNA, 17 nt, Homo sapiens
uccuugacuccaagaaa

SEQ ID NO: 1046745 - RNA, 15 nt, Homo sapiens
uccuuggauguaguc

SEQ ID NO: 1046746 - RNA, 19 nt, Homo sapiens
uccuugugaagaugauaua

SEQ ID NO: 1046747 - RNA, 14 nt, Homo sapiens
uccuugugcaugag

SEQ ID NO: 1046748 - RNA, 18 nt, Homo sapiens
uccuugugguuuauguca

SEQ ID NO: 1046749 - RNA, 20 nt, Homo sapiens
uccuuuaaauccuuccauga

SEQ ID NO: 1046750 - RNA, 14 nt, Homo sapiens
uccuuucaccacau

SEQ ID NO: 1046751 - RNA, 15 nt, Homo sapiens
uccuuucauuuacug

SEQ ID NO: 1046752 - RNA, 23 nt, Homo sapiens
uccuuucuaucauuuuuguacag

SEQ ID NO: 1046753 - RNA, 16 nt, Homo sapiens
uccuuucuccagccag

SEQ ID NO: 1046754 - RNA, 16 nt, Homo sapiens
uccuuuggccauucca

SEQ ID NO: 1046755 - RNA, 15 nt, Homo sapiens
uccuuuuguguacag

SEQ ID NO: 1046756 - RNA, 19 nt, Homo sapiens
uccuuuuuuaaaaaugcaa

SEQ ID NO: 1046757 - RNA, 19 nt, Homo sapiens
ucgaacuccugaccucagg

SEQ ID NO: 1046758 - RNA, 13 nt, Homo sapiens
ucgaagcucagcc

SEQ ID NO: 1046759 - RNA, 19 nt, Homo sapiens
ucgaagcuccgugagugaa

SEQ ID NO: 1046760 - RNA, 19 nt, Homo sapiens
ucgagcagaugaugccaac

SEQ ID NO: 1046761 - RNA, 15 nt, Homo sapiens
ucgaggggcucucag

SEQ ID NO: 1046762 - RNA, 18 nt, Homo sapiens
ucgauggcucaaucuauc

SEQ ID NO: 1046763 - RNA, 19 nt, Homo sapiens
ucgauggcucaaucuaucc

SEQ ID NO: 1046764 - RNA, 17 nt, Homo sapiens
ucgauguaggcauucug

SEQ ID NO: 1046765 - RNA, 23 nt, Homo sapiens
ucgauuugcacccaccuuucugc

SEQ ID NO: 1046766 - RNA, 19 nt, Homo sapiens
ucgcagagaggccaggugc

SEQ ID NO: 1046767 - RNA, 14 nt, Homo sapiens
ucgcauuugucaau

SEQ ID NO: 1046768 - RNA, 21 nt, Homo sapiens
ucgccaaggcuggagugcagu

SEQ ID NO: 1046769 - RNA, 18 nt, Homo sapiens
ucgcccaggagacauccg

SEQ ID NO: 1046770 - RNA, 20 nt, Homo sapiens
ucgcuagaguucuccagaca

SEQ ID NO: 1046771 - RNA, 15 nt, Homo sapiens
ucgcugucaucucag

SEQ ID NO: 1046772 - RNA, 12 nt, Homo sapiens
ucggacucugcu

SEQ ID NO: 1046773 - RNA, 17 nt, Homo sapiens
ucggcucauugaaccuc

SEQ ID NO: 1046774 - RNA, 20 nt, Homo sapiens
ucggcuccccauguguccug

SEQ ID NO: 1046775 - RNA, 20 nt, Homo sapiens
ucgguagaggauuucuaguu

SEQ ID NO: 1046776 - RNA, 12 nt, Homo sapiens
ucggugugcacc

SEQ ID NO: 1046777 - RNA, 22 nt, Homo sapiens
ucguagagacgggguuucacca

SEQ ID NO: 1046778 - RNA, 10 nt, Homo sapiens
ucguagccaa

SEQ ID NO: 1046779 - RNA, 18 nt, Homo sapiens
ucgucagcuggcacuguc

SEQ ID NO: 1046780 - RNA, 19 nt, Homo sapiens
ucgucggggggacagcucc

SEQ ID NO: 1046781 - RNA, 17 nt, Homo sapiens
ucgucuuagcaagaagu

SEQ ID NO: 1046782 - RNA, 13 nt, Homo sapiens
ucgugaaacccug

SEQ ID NO: 1046783 - RNA, 15 nt, Homo sapiens
ucguucucugccuca

SEQ ID NO: 1046784 - RNA, 15 nt, Homo sapiens
ucguuugaaucacag

SEQ ID NO: 1046785 - RNA, 17 nt, Homo sapiens
ucuaaaaugaguuaccu

SEQ ID NO: 1046786 - RNA, 20 nt, Homo sapiens
ucuaaaaugaguuaccuaca

SEQ ID NO: 1046787 - RNA, 21 nt, Homo sapiens
ucuaaacaagaaucagucuau

SEQ ID NO: 1046788 - RNA, 20 nt, Homo sapiens
ucuaaagccuuaagucuuaa

SEQ ID NO: 1046789 - RNA, 18 nt, Homo sapiens
ucuaaaggcuaccuuugu

SEQ ID NO: 1046790 - RNA, 14 nt, Homo sapiens
ucuaaaggcuugau

SEQ ID NO: 1046791 - RNA, 16 nt, Homo sapiens
ucuaaauaccugcccu

SEQ ID NO: 1046792 - RNA, 17 nt, Homo sapiens
ucuaaaugaagugcaaa

SEQ ID NO: 1046793 - RNA, 19 nt, Homo sapiens
ucuaacuagaaaucugcca

SEQ ID NO: 1046794 - RNA, 18 nt, Homo sapiens
ucuaacucagaaacauca

SEQ ID NO: 1046795 - RNA, 18 nt, Homo sapiens
ucuaaggaauaugagcuu

SEQ ID NO: 1046796 - RNA, 17 nt, Homo sapiens
ucuaaguaaugaugucg

SEQ ID NO: 1046797 - RNA, 20 nt, Homo sapiens
ucuaaguggaaaaaguauua

SEQ ID NO: 1046798 - RNA, 16 nt, Homo sapiens
ucuaauggacuuucag

SEQ ID NO: 1046799 - RNA, 23 nt, Homo sapiens
ucuaaugugguuauuucucugau

SEQ ID NO: 1046800 - RNA, 14 nt, Homo sapiens
ucuaaugugucucu

SEQ ID NO: 1046801 - RNA, 22 nt, Homo sapiens
ucuaauuuuggauggaguccag

SEQ ID NO: 1046802 - RNA, 17 nt, Homo sapiens
ucuacacugagguuuga

SEQ ID NO: 1046803 - RNA, 19 nt, Homo sapiens
ucuacagagugauagccuu

SEQ ID NO: 1046804 - RNA, 13 nt, Homo sapiens
ucuacaguauuau

SEQ ID NO: 1046805 - RNA, 21 nt, Homo sapiens
ucuacaguuaggguugaguua

SEQ ID NO: 1046806 - RNA, 16 nt, Homo sapiens
ucuacauacuauggaa

SEQ ID NO: 1046807 - RNA, 13 nt, Homo sapiens
ucuaccauuugaa

SEQ ID NO: 1046808 - RNA, 16 nt, Homo sapiens
ucuaccauuugaauuu

SEQ ID NO: 1046809 - RNA, 13 nt, Homo sapiens
ucuaccucaggca

SEQ ID NO: 1046810 - RNA, 19 nt, Homo sapiens
ucuaccugccucagccucc

SEQ ID NO: 1046811 - RNA, 14 nt, Homo sapiens
ucuacgccagggga

SEQ ID NO: 1046812 - RNA, 19 nt, Homo sapiens
ucuacuaaaaauacaaaaa

SEQ ID NO: 1046813 - RNA, 20 nt, Homo sapiens
ucuacuacaugugacuggca

SEQ ID NO: 1046814 - RNA, 17 nt, Homo sapiens
ucuacuccuaccucagc

SEQ ID NO: 1046815 - RNA, 18 nt, Homo sapiens
ucuacucuuaagccaucu

SEQ ID NO: 1046816 - RNA, 19 nt, Homo sapiens
ucuacucuuaaguuucuca

SEQ ID NO: 1046817 - RNA, 15 nt, Homo sapiens
ucuacugaggugcua

SEQ ID NO: 1046818 - RNA, 16 nt, Homo sapiens
ucuagauuaagauaug

SEQ ID NO: 1046819 - RNA, 15 nt, Homo sapiens
ucuaggaacauacuu

SEQ ID NO: 1046820 - RNA, 20 nt, Homo sapiens
ucuaggcuggggaaguccuc

SEQ ID NO: 1046821 - RNA, 16 nt, Homo sapiens
ucuagggaaaaaccag

SEQ ID NO: 1046822 - RNA, 19 nt, Homo sapiens
ucuagucaggggaaaagac

SEQ ID NO: 1046823 - RNA, 15 nt, Homo sapiens
ucuagugcugugaaa

SEQ ID NO: 1046824 - RNA, 18 nt, Homo sapiens
ucuagugucuuuugccuu

SEQ ID NO: 1046825 - RNA, 16 nt, Homo sapiens
ucuaguuaacauuuca

SEQ ID NO: 1046826 - RNA, 20 nt, Homo sapiens
ucuaguuucuugugggcuaa

SEQ ID NO: 1046827 - RNA, 16 nt, Homo sapiens
ucuauaggaacauaug

SEQ ID NO: 1046828 - RNA, 19 nt, Homo sapiens
ucuaugaaauaucaugcuc

SEQ ID NO: 1046829 - RNA, 23 nt, Homo sapiens
ucuaugcucucgcaccuuuccaa

SEQ ID NO: 1046830 - RNA, 16 nt, Homo sapiens
ucuauggcacccaugc

SEQ ID NO: 1046831 - RNA, 20 nt, Homo sapiens
ucuauggcacccaugcaccu

SEQ ID NO: 1046832 - RNA, 18 nt, Homo sapiens
ucuaugggacucaaugca

SEQ ID NO: 1046833 - RNA, 14 nt, Homo sapiens
ucuauguggcugua

SEQ ID NO: 1046834 - RNA, 13 nt, Homo sapiens
ucuauguguacag

SEQ ID NO: 1046835 - RNA, 12 nt, Homo sapiens
ucuauuagccag

SEQ ID NO: 1046836 - RNA, 14 nt, Homo sapiens
ucuauuauacugua

SEQ ID NO: 1046837 - RNA, 14 nt, Homo sapiens
ucuauuauagccac

SEQ ID NO: 1046838 - RNA, 13 nt, Homo sapiens
ucuauuaucucaa

SEQ ID NO: 1046839 - RNA, 13 nt, Homo sapiens
ucuauucuaagua

SEQ ID NO: 1046840 - RNA, 20 nt, Homo sapiens
ucuauugagugaacagaauu

SEQ ID NO: 1046841 - RNA, 19 nt, Homo sapiens
ucuauugucuguauuugcc

SEQ ID NO: 1046842 - RNA, 17 nt, Homo sapiens
ucuauuucagugccaau

SEQ ID NO: 1046843 - RNA, 13 nt, Homo sapiens
ucuauuucuauga

SEQ ID NO: 1046844 - RNA, 20 nt, Homo sapiens
ucucaaacuccugaccucag

SEQ ID NO: 1046845 - RNA, 14 nt, Homo sapiens
ucucaaaugcacau

SEQ ID NO: 1046846 - RNA, 23 nt, Homo sapiens
ucucaagggcuagcaucccugag

SEQ ID NO: 1046847 - RNA, 14 nt, Homo sapiens
ucucaauaguaaaa

SEQ ID NO: 1046848 - RNA, 21 nt, Homo sapiens
ucucaauaugcuuacaaaguc

SEQ ID NO: 1046849 - RNA, 15 nt, Homo sapiens
ucucaauucuucccu

SEQ ID NO: 1046850 - RNA, 12 nt, Homo sapiens
ucucacaaauga

SEQ ID NO: 1046851 - RNA, 14 nt, Homo sapiens
ucucacaagaugga

SEQ ID NO: 1046852 - RNA, 18 nt, Homo sapiens
ucucacacaugagcauca

SEQ ID NO: 1046853 - RNA, 20 nt, Homo sapiens
ucucacggcuuguaaaugug

SEQ ID NO: 1046854 - RNA, 15 nt, Homo sapiens
ucucacuaccuuauu

SEQ ID NO: 1046855 - RNA, 12 nt, Homo sapiens
ucucacuccagg

SEQ ID NO: 1046856 - RNA, 19 nt, Homo sapiens
ucucacucuguugcccagg

SEQ ID NO: 1046857 - RNA, 18 nt, Homo sapiens
ucucacuugugcaguguu

SEQ ID NO: 1046858 - RNA, 14 nt, Homo sapiens
ucucagaagguauu

SEQ ID NO: 1046859 - RNA, 19 nt, Homo sapiens
ucucagacccuuuagccaa

SEQ ID NO: 1046860 - RNA, 16 nt, Homo sapiens
ucucagcucccauuuc

SEQ ID NO: 1046861 - RNA, 17 nt, Homo sapiens
ucucagcucccauuucu

SEQ ID NO: 1046862 - RNA, 17 nt, Homo sapiens
ucucaugaccaaaugcu

SEQ ID NO: 1046863 - RNA, 21 nt, Homo sapiens
ucucaugagugccaagcaaaa

SEQ ID NO: 1046864 - RNA, 18 nt, Homo sapiens
ucucauguuuuccauugu

SEQ ID NO: 1046865 - RNA, 18 nt, Homo sapiens
ucucauuuagaacuugca

SEQ ID NO: 1046866 - RNA, 21 nt, Homo sapiens
ucuccaaacagucaccauaca

SEQ ID NO: 1046867 - RNA, 17 nt, Homo sapiens
ucuccaccugccaggga

SEQ ID NO: 1046868 - RNA, 16 nt, Homo sapiens
ucuccagaaagcucau

SEQ ID NO: 1046869 - RNA, 20 nt, Homo sapiens
ucuccagcaauaauguuuuc

SEQ ID NO: 1046870 - RNA, 22 nt, Homo sapiens
ucuccagcaauaauguuuucua

SEQ ID NO: 1046871 - RNA, 22 nt, Homo sapiens
ucuccagccagcaaugaugucc

SEQ ID NO: 1046872 - RNA, 13 nt, Homo sapiens
ucuccaggucuca

SEQ ID NO: 1046873 - RNA, 22 nt, Homo sapiens
ucuccauguuugauguaucuga

SEQ ID NO: 1046874 - RNA, 21 nt, Homo sapiens
ucucccagccagguucugacu

SEQ ID NO: 1046875 - RNA, 22 nt, Homo sapiens
ucuccccacugcucauuuggau

SEQ ID NO: 1046876 - RNA, 18 nt, Homo sapiens
ucuccccucagagugcaa

SEQ ID NO: 1046877 - RNA, 19 nt, Homo sapiens
ucucccuccccugccauuu

SEQ ID NO: 1046878 - RNA, 20 nt, Homo sapiens
ucuccuguuuuuugaugcuu

SEQ ID NO: 1046879 - RNA, 14 nt, Homo sapiens
ucuccuuugagcaa

SEQ ID NO: 1046880 - RNA, 17 nt, Homo sapiens
ucuccuuugcacugagg

SEQ ID NO: 1046881 - RNA, 18 nt, Homo sapiens
ucuccuuugcacugaggg

SEQ ID NO: 1046882 - RNA, 14 nt, Homo sapiens
ucuccuuugcugag

SEQ ID NO: 1046883 - RNA, 13 nt, Homo sapiens
ucuccuuuggcca

SEQ ID NO: 1046884 - RNA, 19 nt, Homo sapiens
ucucgaacucccgaccuca

SEQ ID NO: 1046885 - RNA, 19 nt, Homo sapiens
ucucgaacuccugaccuca

SEQ ID NO: 1046886 - RNA, 15 nt, Homo sapiens
ucucgacucacugca

SEQ ID NO: 1046887 - RNA, 18 nt, Homo sapiens
ucucgugguaggacugua

SEQ ID NO: 1046888 - RNA, 22 nt, Homo sapiens
ucucuaauuggaagaaauuccu

SEQ ID NO: 1046889 - RNA, 21 nt, Homo sapiens
ucucuacuaaaaacacaaaag

SEQ ID NO: 1046890 - RNA, 17 nt, Homo sapiens
ucucucacggcuuguaa

SEQ ID NO: 1046891 - RNA, 18 nt, Homo sapiens
ucucucagacuuacuuua

SEQ ID NO: 1046892 - RNA, 21 nt, Homo sapiens
ucucucagugaacugugaggg

SEQ ID NO: 1046893 - RNA, 14 nt, Homo sapiens
ucucuccagccuga

SEQ ID NO: 1046894 - RNA, 13 nt, Homo sapiens
ucucuccauauac

SEQ ID NO: 1046895 - RNA, 13 nt, Homo sapiens
ucucucccaugga

SEQ ID NO: 1046896 - RNA, 20 nt, Homo sapiens
ucucucggcuccccaugugu

SEQ ID NO: 1046897 - RNA, 20 nt, Homo sapiens
gguaucuguuuaacauuucc

SEQ ID NO: 1046898 - RNA, 21 nt, Homo sapiens
gguauuaaauugauguugcug

SEQ ID NO: 1046899 - RNA, 15 nt, Homo sapiens
ggucaaaggcucaaa

SEQ ID NO: 1046900 - RNA, 17 nt, Homo sapiens
ggucaaccuccuggaca

SEQ ID NO: 1046901 - RNA, 16 nt, Homo sapiens
ggucaaguaagaagac

SEQ ID NO: 1046902 - RNA, 15 nt, Homo sapiens
ggucacauucaggaa

SEQ ID NO: 1046903 - RNA, 21 nt, Homo sapiens
ggucacugaaggccuggccca

SEQ ID NO: 1046904 - RNA, 21 nt, Homo sapiens
ggucagaguuccgacugccau

SEQ ID NO: 1046905 - RNA, 19 nt, Homo sapiens
ggucagguguucaagacca

SEQ ID NO: 1046906 - RNA, 16 nt, Homo sapiens
ggucauuguaaucacu

SEQ ID NO: 1046907 - RNA, 20 nt, Homo sapiens
gguccucaguccacugcuga

SEQ ID NO: 1046908 - RNA, 21 nt, Homo sapiens
gguccucuacuuaaugagaua

SEQ ID NO: 1046909 - RNA, 14 nt, Homo sapiens
ggucgugaggccag

SEQ ID NO: 1046910 - RNA, 24 nt, Homo sapiens
ggucuaggaacauacuucagcuca

SEQ ID NO: 1046911 - RNA, 17 nt, Homo sapiens
ggucuccucugcagcuc

SEQ ID NO: 1046912 - RNA, 18 nt, Homo sapiens
ggucugcaagucagagga

SEQ ID NO: 1046913 - RNA, 19 nt, Homo sapiens
ggucuguguucgacucagc

SEQ ID NO: 1046914 - RNA, 15 nt, Homo sapiens
ggucuguuggggucu

SEQ ID NO: 1046915 - RNA, 13 nt, Homo sapiens
ggucuucuuacau

SEQ ID NO: 1046916 - RNA, 20 nt, Homo sapiens
ggucuuucauggggugaugc

SEQ ID NO: 1046917 - RNA, 17 nt, Homo sapiens
ggugaaaauccaucuca

SEQ ID NO: 1046918 - RNA, 19 nt, Homo sapiens
ggugaaacacuuugguauu

SEQ ID NO: 1046919 - RNA, 22 nt, Homo sapiens
ggugaaacuaacagauaagcaa

SEQ ID NO: 1046920 - RNA, 15 nt, Homo sapiens
ggugagaugcagcug

SEQ ID NO: 1046921 - RNA, 19 nt, Homo sapiens
ggugagccgagauugcacc

SEQ ID NO: 1046922 - RNA, 12 nt, Homo sapiens
ggugagugcaag

SEQ ID NO: 1046923 - RNA, 19 nt, Homo sapiens
ggugaucuaccugccucag

SEQ ID NO: 1046924 - RNA, 24 nt, Homo sapiens
ggugaucucauuuaauccucucaa

SEQ ID NO: 1046925 - RNA, 14 nt, Homo sapiens
ggugcaaaucaaug

SEQ ID NO: 1046926 - RNA, 18 nt, Homo sapiens
ggugcaaauccuacugaa

SEQ ID NO: 1046927 - RNA, 16 nt, Homo sapiens
ggugccagcaacugaa

SEQ ID NO: 1046928 - RNA, 18 nt, Homo sapiens
ggugccuaggauugugcc

SEQ ID NO: 1046929 - RNA, 22 nt, Homo sapiens
ggugccuccagacaugugcaca

SEQ ID NO: 1046930 - RNA, 23 nt, Homo sapiens
ggugcuacacccuuuuccagcug

SEQ ID NO: 1046931 - RNA, 17 nt, Homo sapiens
gguggagguugcaguga

SEQ ID NO: 1046932 - RNA, 22 nt, Homo sapiens
gguggauauuaaaaaucuguaa

SEQ ID NO: 1046933 - RNA, 22 nt, Homo sapiens
gguggaugaaaugucaguggaa

SEQ ID NO: 1046934 - RNA, 13 nt, Homo sapiens
gguggcacacugg

SEQ ID NO: 1046935 - RNA, 13 nt, Homo sapiens
gguggcacuuuuu

SEQ ID NO: 1046936 - RNA, 15 nt, Homo sapiens
gguggcgcgcaccug

SEQ ID NO: 1046937 - RNA, 14 nt, Homo sapiens
ggugggacagggac

SEQ ID NO: 1046938 - RNA, 20 nt, Homo sapiens
ggugggcacccacccuggga

SEQ ID NO: 1046939 - RNA, 19 nt, Homo sapiens
ggugggccuccucugucca

SEQ ID NO: 1046940 - RNA, 15 nt, Homo sapiens
gguggggacagggau

SEQ ID NO: 1046941 - RNA, 24 nt, Homo sapiens
gguguacuuauauccacacugcac

SEQ ID NO: 1046942 - RNA, 15 nt, Homo sapiens
ggugugaaagucaga

SEQ ID NO: 1046943 - RNA, 14 nt, Homo sapiens
ggugugaccacugc

SEQ ID NO: 1046944 - RNA, 12 nt, Homo sapiens
ggugugcugcuu

SEQ ID NO: 1046945 - RNA, 17 nt, Homo sapiens
gguguuguaugccuuua

SEQ ID NO: 1046946 - RNA, 18 nt, Homo sapiens
gguuacaaucauugcuga

SEQ ID NO: 1046947 - RNA, 17 nt, Homo sapiens
gguuaccuuuguuccca

SEQ ID NO: 1046948 - RNA, 19 nt, Homo sapiens
gguuaccuuuguucccaaa

SEQ ID NO: 1046949 - RNA, 18 nt, Homo sapiens
gguuaucaaaaauuucau

SEQ ID NO: 1046950 - RNA, 19 nt, Homo sapiens
gguucagcuaagcuaggaa

SEQ ID NO: 1046951 - RNA, 20 nt, Homo sapiens
gguucuucuuccugaagcug

SEQ ID NO: 1046952 - RNA, 20 nt, Homo sapiens
gguucuugguagagauucau

SEQ ID NO: 1046953 - RNA, 18 nt, Homo sapiens
gguugaucacacucuggg

SEQ ID NO: 1046954 - RNA, 18 nt, Homo sapiens
gguugguccucuugccuc

SEQ ID NO: 1046955 - RNA, 18 nt, Homo sapiens
gguuuaaacuucucugaa

SEQ ID NO: 1046956 - RNA, 14 nt, Homo sapiens
gguuuaugcucaau

SEQ ID NO: 1046957 - RNA, 22 nt, Homo sapiens
gguuugagaauguuuuuagcug

SEQ ID NO: 1046958 - RNA, 17 nt, Homo sapiens
gguuuuccuguugagau

SEQ ID NO: 1046959 - RNA, 16 nt, Homo sapiens
guaaaagugugagcag

SEQ ID NO: 1046960 - RNA, 23 nt, Homo sapiens
guaaaauugaaaggcauucucug

SEQ ID NO: 1046961 - RNA, 22 nt, Homo sapiens
guaaacagaggaguacagguga

SEQ ID NO: 1046962 - RNA, 13 nt, Homo sapiens
guaaacauaauuc

SEQ ID NO: 1046963 - RNA, 16 nt, Homo sapiens
guaaacauguguuuua

SEQ ID NO: 1046964 - RNA, 15 nt, Homo sapiens
guaaagaaguuugau

SEQ ID NO: 1046965 - RNA, 19 nt, Homo sapiens
guaaagccagccaugcauu

SEQ ID NO: 1046966 - RNA, 18 nt, Homo sapiens
guaaaggcuauacuuguc

SEQ ID NO: 1046967 - RNA, 22 nt, Homo sapiens
guaaagguuuuuggaauuaugu

SEQ ID NO: 1046968 - RNA, 17 nt, Homo sapiens
guaaauagcauucucua

SEQ ID NO: 1046969 - RNA, 15 nt, Homo sapiens
guaaauuaaccaaaa

SEQ ID NO: 1046970 - RNA, 15 nt, Homo sapiens
guaaauucaaccacu

SEQ ID NO: 1046971 - RNA, 14 nt, Homo sapiens
guaacaacuguggu

SEQ ID NO: 1046972 - RNA, 18 nt, Homo sapiens
guaacaacuguggucaau

SEQ ID NO: 1046973 - RNA, 20 nt, Homo sapiens
guaaccuugucgacaaagag

SEQ ID NO: 1046974 - RNA, 19 nt, Homo sapiens
guaacuauuacaccaaaua

SEQ ID NO: 1046975 - RNA, 19 nt, Homo sapiens
guaacuguuaaauugcugu

SEQ ID NO: 1046976 - RNA, 14 nt, Homo sapiens
guaagacucauucc

SEQ ID NO: 1046977 - RNA, 15 nt, Homo sapiens
guaagacucauuccc

SEQ ID NO: 1046978 - RNA, 18 nt, Homo sapiens
guaagcaaagacuuuccu

SEQ ID NO: 1046979 - RNA, 15 nt, Homo sapiens
guaagcauaacuuau

SEQ ID NO: 1046980 - RNA, 14 nt, Homo sapiens
guaagcuguuuauu

SEQ ID NO: 1046981 - RNA, 14 nt, Homo sapiens
guaaggaaauggaa

SEQ ID NO: 1046982 - RNA, 17 nt, Homo sapiens
guaagggaaacugccag

SEQ ID NO: 1046983 - RNA, 14 nt, Homo sapiens
guaaguaaugauac

SEQ ID NO: 1046984 - RNA, 18 nt, Homo sapiens
guaaguuuaugcauacag

SEQ ID NO: 1046985 - RNA, 14 nt, Homo sapiens
guaaguuucaggug

SEQ ID NO: 1046986 - RNA, 19 nt, Homo sapiens
guaaguuucaggugacaug

SEQ ID NO: 1046987 - RNA, 20 nt, Homo sapiens
guaauaaaaggugucuuucc

SEQ ID NO: 1046988 - RNA, 21 nt, Homo sapiens
guaauaauacagccaaagaua

SEQ ID NO: 1046989 - RNA, 18 nt, Homo sapiens
guaaucccagaacuuugg

SEQ ID NO: 1046990 - RNA, 23 nt, Homo sapiens
guaaucuauguauauacauuuau

SEQ ID NO: 1046991 - RNA, 20 nt, Homo sapiens
guaaucucauaacuuuccaa

SEQ ID NO: 1046992 - RNA, 19 nt, Homo sapiens
guaauuuuaaguaauuuca

SEQ ID NO: 1046993 - RNA, 23 nt, Homo sapiens
guaauuuuuuuaucgucacugcu

SEQ ID NO: 1046994 - RNA, 12 nt, Homo sapiens
guacaaucucaa

SEQ ID NO: 1046995 - RNA, 20 nt, Homo sapiens
guacaaugaacccccaugau

SEQ ID NO: 1046996 - RNA, 12 nt, Homo sapiens
guacaaugacuu

SEQ ID NO: 1046997 - RNA, 19 nt, Homo sapiens
guacacugacaccuuugca

SEQ ID NO: 1046998 - RNA, 18 nt, Homo sapiens
guacagaaagcugccugg

SEQ ID NO: 1046999 - RNA, 22 nt, Homo sapiens
guacagaauucugcuaccucac

SEQ ID NO: 1047000 - RNA, 22 nt, Homo sapiens
guacagacauccuagcauuugu

SEQ ID NO: 1047001 - RNA, 13 nt, Homo sapiens
guacagaugaaug

SEQ ID NO: 1047002 - RNA, 18 nt, Homo sapiens
guacaggcagcacagaga

SEQ ID NO: 1047003 - RNA, 18 nt, Homo sapiens
guacaguuugcuguacua

SEQ ID NO: 1047004 - RNA, 13 nt, Homo sapiens
guacauagccuau

SEQ ID NO: 1047005 - RNA, 17 nt, Homo sapiens
guacaucccauguaaca

SEQ ID NO: 1047006 - RNA, 12 nt, Homo sapiens
guacaucuggcc

SEQ ID NO: 1047007 - RNA, 13 nt, Homo sapiens
guacaucuuugga

SEQ ID NO: 1047008 - RNA, 22 nt, Homo sapiens
guacauggaauaacauguaauu

SEQ ID NO: 1047009 - RNA, 10 nt, Homo sapiens
guacauguau

SEQ ID NO: 1047010 - RNA, 20 nt, Homo sapiens
guacauuucccugugcugac

SEQ ID NO: 1047011 - RNA, 21 nt, Homo sapiens
guacauuucccugugcugacg

SEQ ID NO: 1047012 - RNA, 12 nt, Homo sapiens
guaccucucuuu

SEQ ID NO: 1047013 - RNA, 14 nt, Homo sapiens
guacuaaaaauaca

SEQ ID NO: 1047014 - RNA, 18 nt, Homo sapiens
guacuaagauugugcuca

SEQ ID NO: 1047015 - RNA, 21 nt, Homo sapiens
guacuaauacagacuauguca

SEQ ID NO: 1047016 - RNA, 13 nt, Homo sapiens
guacuacaguccu

SEQ ID NO: 1047017 - RNA, 18 nt, Homo sapiens
guacuacaguccucccau

SEQ ID NO: 1047018 - RNA, 15 nt, Homo sapiens
guacuaguccaucau

SEQ ID NO: 1047019 - RNA, 13 nt, Homo sapiens
guacucuccugga

SEQ ID NO: 1047020 - RNA, 15 nt, Homo sapiens
guacuuagcagcuau

SEQ ID NO: 1047021 - RNA, 15 nt, Homo sapiens
guacuuuuuccagac

SEQ ID NO: 1047022 - RNA, 14 nt, Homo sapiens
guagaaagccaaau

SEQ ID NO: 1047023 - RNA, 17 nt, Homo sapiens
guagaagccacuauuac

SEQ ID NO: 1047024 - RNA, 15 nt, Homo sapiens
guagaauagauaucc

SEQ ID NO: 1047025 - RNA, 21 nt, Homo sapiens
guagaccuagggaggaccuua

SEQ ID NO: 1047026 - RNA, 18 nt, Homo sapiens
guagagguuuuguuguuu

SEQ ID NO: 1047027 - RNA, 22 nt, Homo sapiens
guagaguuugaaggaggugagg

SEQ ID NO: 1047028 - RNA, 15 nt, Homo sapiens
guagccacuucacuu

SEQ ID NO: 1047029 - RNA, 20 nt, Homo sapiens
guagcuaagugaaaagguca

SEQ ID NO: 1047030 - RNA, 17 nt, Homo sapiens
guagcuauaucuauaua

SEQ ID NO: 1047031 - RNA, 19 nt, Homo sapiens
guagcugggacuacaggca

SEQ ID NO: 1047032 - RNA, 21 nt, Homo sapiens
guagcuuaccagaagcuucca

SEQ ID NO: 1047033 - RNA, 15 nt, Homo sapiens
guaggaagacuuugg

SEQ ID NO: 1047034 - RNA, 13 nt, Homo sapiens
guaggacauacca

SEQ ID NO: 1047035 - RNA, 16 nt, Homo sapiens
guaggugugacuugaa

SEQ ID NO: 1047036 - RNA, 13 nt, Homo sapiens
guaguacuugaaa

SEQ ID NO: 1047037 - RNA, 22 nt, Homo sapiens
guaguuaggaaauaaaaccuuu

SEQ ID NO: 1047038 - RNA, 13 nt, Homo sapiens
guaguucuugucu

SEQ ID NO: 1047039 - RNA, 19 nt, Homo sapiens
guauaaugguugacugggu

SEQ ID NO: 1047040 - RNA, 21 nt, Homo sapiens
guauaauucaaagcaccaaaa

SEQ ID NO: 1047041 - RNA, 16 nt, Homo sapiens
guauaauuuaacuuca

SEQ ID NO: 1047042 - RNA, 12 nt, Homo sapiens
guauacaguccu

SEQ ID NO: 1047043 - RNA, 20 nt, Homo sapiens
guauacccuguccuuucuca

SEQ ID NO: 1047044 - RNA, 15 nt, Homo sapiens
guauaguacuggcau

SEQ ID NO: 1047045 - RNA, 21 nt, Homo sapiens
guauauaaauuuucccaaaac

SEQ ID NO: 1047046 - RNA, 15 nt, Homo sapiens
guauauacaauaaca

SEQ ID NO: 1047047 - RNA, 13 nt, Homo sapiens
guauauccaaaag

SEQ ID NO: 1047048 - RNA, 13 nt, Homo sapiens
guauaugcaauau

SEQ ID NO: 1047049 - RNA, 10 nt, Homo sapiens
guauaugcac

SEQ ID NO: 1047050 - RNA, 13 nt, Homo sapiens
guauaugcugaug

SEQ ID NO: 1047051 - RNA, 20 nt, Homo sapiens
guauauucugguuacugugg

SEQ ID NO: 1047052 - RNA, 14 nt, Homo sapiens
guauauugucagau

SEQ ID NO: 1047053 - RNA, 17 nt, Homo sapiens
guauauuugguacugua

SEQ ID NO: 1047054 - RNA, 14 nt, Homo sapiens
guaucaaaugugac

SEQ ID NO: 1047055 - RNA, 15 nt, Homo sapiens
guaucaaaugugaca

SEQ ID NO: 1047056 - RNA, 21 nt, Homo sapiens
guaucaaaugugacauuauau

SEQ ID NO: 1047057 - RNA, 20 nt, Homo sapiens
guaucagcaucuguccucau

SEQ ID NO: 1047058 - RNA, 19 nt, Homo sapiens
guauccauuaucaugugua

SEQ ID NO: 1047059 - RNA, 18 nt, Homo sapiens
guauccuuucaguguuau

SEQ ID NO: 1047060 - RNA, 21 nt, Homo sapiens
guaucucuuuugaauccaugc

SEQ ID NO: 1047061 - RNA, 23 nt, Homo sapiens
guaugacucccaaauuuucacau

SEQ ID NO: 1047062 - RNA, 14 nt, Homo sapiens
guaugaggcauuug

SEQ ID NO: 1047063 - RNA, 15 nt, Homo sapiens
guaugagucaaugug

SEQ ID NO: 1047064 - RNA, 19 nt, Homo sapiens
guaugauccuaaugaaugc

SEQ ID NO: 1047065 - RNA, 12 nt, Homo sapiens
guaugccaagug

SEQ ID NO: 1047066 - RNA, 18 nt, Homo sapiens
guauggaauacaguguua

SEQ ID NO: 1047067 - RNA, 17 nt, Homo sapiens
guauguacuaagcagua

SEQ ID NO: 1047068 - RNA, 18 nt, Homo sapiens
guaugugcgugugugcaa

SEQ ID NO: 1047069 - RNA, 20 nt, Homo sapiens
guauuacaaaaacauggccu

SEQ ID NO: 1047070 - RNA, 14 nt, Homo sapiens
guauuacacuguau

SEQ ID NO: 1047071 - RNA, 18 nt, Homo sapiens
guauuccuuuuguguaca

SEQ ID NO: 1047072 - RNA, 18 nt, Homo sapiens
guauucugcugaugcuac

SEQ ID NO: 1047073 - RNA, 19 nt, Homo sapiens
guauuugaaaacucacaga

SEQ ID NO: 1047074 - RNA, 19 nt, Homo sapiens
guauuuuaacucauaccuu

SEQ ID NO: 1047075 - RNA, 20 nt, Homo sapiens
guauuuuguuuuugucuuaa

SEQ ID NO: 1047076 - RNA, 16 nt, Homo sapiens
guauuuuuaguagaga

SEQ ID NO: 1047077 - RNA, 19 nt, Homo sapiens
guauuuuuucuaaugugca

SEQ ID NO: 1047078 - RNA, 20 nt, Homo sapiens
guauuuuuucuaaugugcau

SEQ ID NO: 1047079 - RNA, 14 nt, Homo sapiens
gucaaaaaguucca

SEQ ID NO: 1047080 - RNA, 15 nt, Homo sapiens
gucaaaaaguuccau

SEQ ID NO: 1047081 - RNA, 16 nt, Homo sapiens
gucaaagcaaguuuca

SEQ ID NO: 1047082 - RNA, 12 nt, Homo sapiens
gucaaagcagua

SEQ ID NO: 1047083 - RNA, 19 nt, Homo sapiens
gucaaccugccugacauuu

SEQ ID NO: 1047084 - RNA, 18 nt, Homo sapiens
gucaagugggaucuguca

SEQ ID NO: 1047085 - RNA, 17 nt, Homo sapiens
gucaauaggcaaagggg

SEQ ID NO: 1047086 - RNA, 21 nt, Homo sapiens
gucaauauuaaauacagacac

SEQ ID NO: 1047087 - RNA, 21 nt, Homo sapiens
gucaauccaagagucugauga

SEQ ID NO: 1047088 - RNA, 19 nt, Homo sapiens
gucaaugaacuuuccacau

SEQ ID NO: 1047089 - RNA, 21 nt, Homo sapiens
gucaaugaauuuugcuuggug

SEQ ID NO: 1047090 - RNA, 14 nt, Homo sapiens
gucacaauccuaac

SEQ ID NO: 1047091 - RNA, 18 nt, Homo sapiens
gucacacacuuuggcuau

SEQ ID NO: 1047092 - RNA, 11 nt, Homo sapiens
gucacacuggu

SEQ ID NO: 1047093 - RNA, 13 nt, Homo sapiens
gucacagccacuu

SEQ ID NO: 1047094 - RNA, 13 nt, Homo sapiens
gucacagggccaa

SEQ ID NO: 1047095 - RNA, 18 nt, Homo sapiens
gucacauuguaacugaac

SEQ ID NO: 1047096 - RNA, 15 nt, Homo sapiens
gucaccaucucaggc

SEQ ID NO: 1047097 - RNA, 22 nt, Homo sapiens
gucacccaggcuggagugcagu

SEQ ID NO: 1047098 - RNA, 21 nt, Homo sapiens
gucaccccucacugugacuga

SEQ ID NO: 1047099 - RNA, 18 nt, Homo sapiens
gucacuauaggucauaca

SEQ ID NO: 1047100 - RNA, 17 nt, Homo sapiens
gucagaacucuguguug

SEQ ID NO: 1047101 - RNA, 20 nt, Homo sapiens
gucagaggcuaauucugcag

SEQ ID NO: 1047102 - RNA, 20 nt, Homo sapiens
gucagcguugcaugucguga

SEQ ID NO: 1047103 - RNA, 14 nt, Homo sapiens
gucaggaacagaag

SEQ ID NO: 1047104 - RNA, 20 nt, Homo sapiens
gucaggacccaccaugucug

SEQ ID NO: 1047105 - RNA, 14 nt, Homo sapiens
gucaggacugugac

SEQ ID NO: 1047106 - RNA, 15 nt, Homo sapiens
gucaggccuugaggg

SEQ ID NO: 1047107 - RNA, 21 nt, Homo sapiens
gucaguaacuuacccuuaggg

SEQ ID NO: 1047108 - RNA, 15 nt, Homo sapiens
gucaguauguggaag

SEQ ID NO: 1047109 - RNA, 11 nt, Homo sapiens
gucagugcagc

SEQ ID NO: 1047110 - RNA, 14 nt, Homo sapiens
gucauacaauccau

SEQ ID NO: 1047111 - RNA, 20 nt, Homo sapiens
gucaucgcgccacuaagcca

SEQ ID NO: 1047112 - RNA, 18 nt, Homo sapiens
gucaugcguuuaaucaca

SEQ ID NO: 1047113 - RNA, 16 nt, Homo sapiens
gucauuguaaucacug

SEQ ID NO: 1047114 - RNA, 14 nt, Homo sapiens
gucauuucaaagac

SEQ ID NO: 1047115 - RNA, 21 nt, Homo sapiens
gucauuuuuauaaaacuuuga

SEQ ID NO: 1047116 - RNA, 19 nt, Homo sapiens
guccaagugugugugcgug

SEQ ID NO: 1047117 - RNA, 22 nt, Homo sapiens
guccaagugugugugcgugugu

SEQ ID NO: 1047118 - RNA, 19 nt, Homo sapiens
guccaauuccaaagccaga

SEQ ID NO: 1047119 - RNA, 13 nt, Homo sapiens
guccacacccagc

SEQ ID NO: 1047120 - RNA, 11 nt, Homo sapiens
guccacagggc

SEQ ID NO: 1047121 - RNA, 20 nt, Homo sapiens
guccagagcuggaucucuca

SEQ ID NO: 1047122 - RNA, 16 nt, Homo sapiens
guccaggcacugagau

SEQ ID NO: 1047123 - RNA, 23 nt, Homo sapiens
guccaggccugugaggugcagag

SEQ ID NO: 1047124 - RNA, 17 nt, Homo sapiens
guccaggguugaucaca

SEQ ID NO: 1047125 - RNA, 11 nt, Homo sapiens
guccauucucu

SEQ ID NO: 1047126 - RNA, 17 nt, Homo sapiens
guccauuguccaauccu

SEQ ID NO: 1047127 - RNA, 14 nt, Homo sapiens
gucccacacuggug

SEQ ID NO: 1047128 - RNA, 17 nt, Homo sapiens
gucccacuaucugggug

SEQ ID NO: 1047129 - RNA, 15 nt, Homo sapiens
gucccagcuacucag

SEQ ID NO: 1047130 - RNA, 20 nt, Homo sapiens
gucccagugggaggcgcgag

SEQ ID NO: 1047131 - RNA, 17 nt, Homo sapiens
gucccauggacacucca

SEQ ID NO: 1047132 - RNA, 17 nt, Homo sapiens
guccccuaaaccaaaaa

SEQ ID NO: 1047133 - RNA, 15 nt, Homo sapiens
guccccuccacuguc

SEQ ID NO: 1047134 - RNA, 17 nt, Homo sapiens
guccccuccacugucac

SEQ ID NO: 1047135 - RNA, 23 nt, Homo sapiens
guccccuccacugucacauugua

SEQ ID NO: 1047136 - RNA, 16 nt, Homo sapiens
gucccggguguguaca

SEQ ID NO: 1047137 - RNA, 17 nt, Homo sapiens
gucccuugcugugagca

SEQ ID NO: 1047138 - RNA, 13 nt, Homo sapiens
gucccuuggagac

SEQ ID NO: 1047139 - RNA, 15 nt, Homo sapiens
guccgaucuuugacu

SEQ ID NO: 1047140 - RNA, 17 nt, Homo sapiens
guccgcgcgccagcaca

SEQ ID NO: 1047141 - RNA, 18 nt, Homo sapiens
guccuacucugugucagg

SEQ ID NO: 1047142 - RNA, 19 nt, Homo sapiens
guccucaguccacugcuga

SEQ ID NO: 1047143 - RNA, 19 nt, Homo sapiens
guccucauguguugaugua

SEQ ID NO: 1047144 - RNA, 19 nt, Homo sapiens
guccucuacuuaaugagau

SEQ ID NO: 1047145 - RNA, 17 nt, Homo sapiens
guccucuucugcaucuu

SEQ ID NO: 1047146 - RNA, 21 nt, Homo sapiens
guccucuucugcaucuugggg

SEQ ID NO: 1047147 - RNA, 15 nt, Homo sapiens
guccucuugcucaaa

SEQ ID NO: 1047148 - RNA, 12 nt, Homo sapiens
guccugaccacc

SEQ ID NO: 1047149 - RNA, 17 nt, Homo sapiens
guccugccaggauuaaa

SEQ ID NO: 1047150 - RNA, 18 nt, Homo sapiens
guccuucaccucacugaa

SEQ ID NO: 1047151 - RNA, 18 nt, Homo sapiens
guccuuucuaaguauuuu

SEQ ID NO: 1047152 - RNA, 16 nt, Homo sapiens
gucgucuuaacucacc

SEQ ID NO: 1047153 - RNA, 16 nt, Homo sapiens
gucguugacuuuaggg

SEQ ID NO: 1047154 - RNA, 18 nt, Homo sapiens
gucuaaaaacaccaaaaa

SEQ ID NO: 1047155 - RNA, 22 nt, Homo sapiens
gucuaacuggggauauaauacu

SEQ ID NO: 1047156 - RNA, 23 nt, Homo sapiens
gucuaacuggggauauaauacua

SEQ ID NO: 1047157 - RNA, 13 nt, Homo sapiens
gucuaagucauga

SEQ ID NO: 1047158 - RNA, 18 nt, Homo sapiens
gucuauguaaaugcaucu

SEQ ID NO: 1047159 - RNA, 19 nt, Homo sapiens
gucuauuugagacuuagaa

SEQ ID NO: 1047160 - RNA, 16 nt, Homo sapiens
gucucaaaccaagcaa

SEQ ID NO: 1047161 - RNA, 21 nt, Homo sapiens
gucucaaacuccugaccucaa

SEQ ID NO: 1047162 - RNA, 18 nt, Homo sapiens
gucucaccucauagcuaa

SEQ ID NO: 1047163 - RNA, 23 nt, Homo sapiens
gucucacgggcaugggcacuccc

SEQ ID NO: 1047164 - RNA, 10 nt, Homo sapiens
gucucaggcc

SEQ ID NO: 1047165 - RNA, 21 nt, Homo sapiens
gucucauaugauugugcacau

SEQ ID NO: 1047166 - RNA, 18 nt, Homo sapiens
gucucauuccuccaccug

SEQ ID NO: 1047167 - RNA, 13 nt, Homo sapiens
gucucauuuagaa

SEQ ID NO: 1047168 - RNA, 23 nt, Homo sapiens
gucucgugguaggacuguagaaa

SEQ ID NO: 1047169 - RNA, 14 nt, Homo sapiens
gucucuggcgugug

SEQ ID NO: 1047170 - RNA, 22 nt, Homo sapiens
gucucuuccuggucugaacucc

SEQ ID NO: 1047171 - RNA, 22 nt, Homo sapiens
gucucuuguaauccgaaucucu

SEQ ID NO: 1047172 - RNA, 21 nt, Homo sapiens
gucucuuuaaugucacaggca

SEQ ID NO: 1047173 - RNA, 19 nt, Homo sapiens
gucugaacucccgccacau

SEQ ID NO: 1047174 - RNA, 12 nt, Homo sapiens
gucugaugacac

SEQ ID NO: 1047175 - RNA, 12 nt, Homo sapiens
gucugcacucua

SEQ ID NO: 1047176 - RNA, 16 nt, Homo sapiens
gucugcuagccaggau

SEQ ID NO: 1047177 - RNA, 17 nt, Homo sapiens
gucuggaaugcauggga

SEQ ID NO: 1047178 - RNA, 19 nt, Homo sapiens
gucuggcugaggauuucaa

SEQ ID NO: 1047179 - RNA, 16 nt, Homo sapiens
gucugggcacagucag

SEQ ID NO: 1047180 - RNA, 23 nt, Homo sapiens
gucuggggucuccuauacucuau

SEQ ID NO: 1047181 - RNA, 18 nt, Homo sapiens
gucuggucuccucagccu

SEQ ID NO: 1047182 - RNA, 15 nt, Homo sapiens
gucuguacacguguc

SEQ ID NO: 1047183 - RNA, 15 nt, Homo sapiens
gucuguccaccccau

SEQ ID NO: 1047184 - RNA, 18 nt, Homo sapiens
gucuguggcuuucagccu

SEQ ID NO: 1047185 - RNA, 20 nt, Homo sapiens
gucuguguagaguguuauac

SEQ ID NO: 1047186 - RNA, 19 nt, Homo sapiens
gucuguguguuuaugugug

SEQ ID NO: 1047187 - RNA, 15 nt, Homo sapiens
gucuguuacacugga

SEQ ID NO: 1047188 - RNA, 17 nt, Homo sapiens
gucuucugccuguuaua

SEQ ID NO: 1047189 - RNA, 14 nt, Homo sapiens
gucuucuguauuca

SEQ ID NO: 1047190 - RNA, 16 nt, Homo sapiens
gucuucuguauucacu

SEQ ID NO: 1047191 - RNA, 18 nt, Homo sapiens
gucuuggacacuguacaa

SEQ ID NO: 1047192 - RNA, 20 nt, Homo sapiens
gucuuggcuuucauguuauu

SEQ ID NO: 1047193 - RNA, 21 nt, Homo sapiens
gucuuucauggggugaugcug

SEQ ID NO: 1047194 - RNA, 20 nt, Homo sapiens
gugaaaccccgucuguacua

SEQ ID NO: 1047195 - RNA, 20 nt, Homo sapiens
gugaaagcaucacuugggau

SEQ ID NO: 1047196 - RNA, 21 nt, Homo sapiens
gugaaaggaagcuccacuguc

SEQ ID NO: 1047197 - RNA, 18 nt, Homo sapiens
gugaaauauaugcuauau

SEQ ID NO: 1047198 - RNA, 12 nt, Homo sapiens
gugaacagggaa

SEQ ID NO: 1047199 - RNA, 12 nt, Homo sapiens
gugaaccaaaga

SEQ ID NO: 1047200 - RNA, 23 nt, Homo sapiens
gugaagacaaugacuuacuguac

SEQ ID NO: 1047201 - RNA, 20 nt, Homo sapiens
gugaagagggagaagcauga

SEQ ID NO: 1047202 - RNA, 23 nt, Homo sapiens
gugaaggcagagaggagccagga

SEQ ID NO: 1047203 - RNA, 15 nt, Homo sapiens
gugaauaaaccauca

SEQ ID NO: 1047204 - RNA, 14 nt, Homo sapiens
gugaauagaacucu

SEQ ID NO: 1047205 - RNA, 16 nt, Homo sapiens
gugaaugauucagugu

SEQ ID NO: 1047206 - RNA, 20 nt, Homo sapiens
gugaauguggauucuuccca

SEQ ID NO: 1047207 - RNA, 18 nt, Homo sapiens
gugaauugccugcagaga

SEQ ID NO: 1047208 - RNA, 15 nt, Homo sapiens
gugaauuucuucacu

SEQ ID NO: 1047209 - RNA, 19 nt, Homo sapiens
gugacaaggccccagagac

SEQ ID NO: 1047210 - RNA, 12 nt, Homo sapiens
gugacacauaug

SEQ ID NO: 1047211 - RNA, 20 nt, Homo sapiens
gugacaucucuuugauguca

SEQ ID NO: 1047212 - RNA, 16 nt, Homo sapiens
gugacauuuccaugca

SEQ ID NO: 1047213 - RNA, 15 nt, Homo sapiens
gugaccaaaucagug

SEQ ID NO: 1047214 - RNA, 14 nt, Homo sapiens
gugacgaacugccc

SEQ ID NO: 1047215 - RNA, 21 nt, Homo sapiens
gugacuccuaugaucucaggu

SEQ ID NO: 1047216 - RNA, 14 nt, Homo sapiens
gugacuguggcaca

SEQ ID NO: 1047217 - RNA, 16 nt, Homo sapiens
gugacuuaguguacau

SEQ ID NO: 1047218 - RNA, 21 nt, Homo sapiens
gugacuugaacuagauugcau

SEQ ID NO: 1047219 - RNA, 22 nt, Homo sapiens
gugagacaguccagccuggaga

SEQ ID NO: 1047220 - RNA, 17 nt, Homo sapiens
gugagcugagauugcac

SEQ ID NO: 1047221 - RNA, 16 nt, Homo sapiens
gugaggcauugcacag

SEQ ID NO: 1047222 - RNA, 17 nt, Homo sapiens
gugaggggcucucucau

SEQ ID NO: 1047223 - RNA, 18 nt, Homo sapiens
gugaggugcuugagucuc

SEQ ID NO: 1047224 - RNA, 12 nt, Homo sapiens
gugagugcaagg

SEQ ID NO: 1047225 - RNA, 15 nt, Homo sapiens
gugagugugugcaag

SEQ ID NO: 1047226 - RNA, 14 nt, Homo sapiens
gugaguuaauuuaa

SEQ ID NO: 1047227 - RNA, 14 nt, Homo sapiens
gugaguucucaggg

SEQ ID NO: 1047228 - RNA, 13 nt, Homo sapiens
gugauacaaugcu

SEQ ID NO: 1047229 - RNA, 20 nt, Homo sapiens
gugauacuguacauagcugu

SEQ ID NO: 1047230 - RNA, 19 nt, Homo sapiens
gugauagagcuaacccuua

SEQ ID NO: 1047231 - RNA, 16 nt, Homo sapiens
gugauauggagcccug

SEQ ID NO: 1047232 - RNA, 14 nt, Homo sapiens
gugaucacagcagc

SEQ ID NO: 1047233 - RNA, 13 nt, Homo sapiens
gugauccucccac

SEQ ID NO: 1047234 - RNA, 13 nt, Homo sapiens
gugaucuaccugc

SEQ ID NO: 1047235 - RNA, 22 nt, Homo sapiens
gugaugccagguucuauuugga

SEQ ID NO: 1047236 - RNA, 19 nt, Homo sapiens
gugauguugguugaggcag

SEQ ID NO: 1047237 - RNA, 20 nt, Homo sapiens
gugauuacauaaucuguaca

SEQ ID NO: 1047238 - RNA, 18 nt, Homo sapiens
gugauuagccauuugacu

SEQ ID NO: 1047239 - RNA, 13 nt, Homo sapiens
gugauuucagaga

SEQ ID NO: 1047240 - RNA, 19 nt, Homo sapiens
gugauuucagagagggcag

SEQ ID NO: 1047241 - RNA, 16 nt, Homo sapiens
gugcaagugugugcac

SEQ ID NO: 1047242 - RNA, 20 nt, Homo sapiens
gugcacaacauuacagggaa

SEQ ID NO: 1047243 - RNA, 17 nt, Homo sapiens
gugcacugucacuuugc

SEQ ID NO: 1047244 - RNA, 20 nt, Homo sapiens
gugcaguggcccccacagaa

SEQ ID NO: 1047245 - RNA, 20 nt, Homo sapiens
gugcaugcagcaucuaagua

SEQ ID NO: 1047246 - RNA, 13 nt, Homo sapiens
gugcaugugcacu

SEQ ID NO: 1047247 - RNA, 15 nt, Homo sapiens
gugcaugugcacuug

SEQ ID NO: 1047248 - RNA, 16 nt, Homo sapiens
gugcaugugcacuugc

SEQ ID NO: 1047249 - RNA, 19 nt, Homo sapiens
gugcauuaaacugaaucac

SEQ ID NO: 1047250 - RNA, 22 nt, Homo sapiens
gugcauuggaagaccccaccca

SEQ ID NO: 1047251 - RNA, 12 nt, Homo sapiens
gugccaauguau

SEQ ID NO: 1047252 - RNA, 22 nt, Homo sapiens
gugccaauuuauuuacauuuaa

SEQ ID NO: 1047253 - RNA, 21 nt, Homo sapiens
gugccacugcccgagcuggug

SEQ ID NO: 1047254 - RNA, 17 nt, Homo sapiens
gugccaguuauggcuau

SEQ ID NO: 1047255 - RNA, 21 nt, Homo sapiens
gugcccagggcucuaaugugu

SEQ ID NO: 1047256 - RNA, 21 nt, Homo sapiens
gugcccaggggcccacaggga

SEQ ID NO: 1047257 - RNA, 13 nt, Homo sapiens
gugccccaugccu

SEQ ID NO: 1047258 - RNA, 14 nt, Homo sapiens
gugcccuguucucu

SEQ ID NO: 1047259 - RNA, 18 nt, Homo sapiens
gugccguaacaacugugg

SEQ ID NO: 1047260 - RNA, 21 nt, Homo sapiens
gugccuccaccaccacuggcc

SEQ ID NO: 1047261 - RNA, 20 nt, Homo sapiens
gugccuccuuccaccucccu

SEQ ID NO: 1047262 - RNA, 15 nt, Homo sapiens
gugccuggacauuug

SEQ ID NO: 1047263 - RNA, 16 nt, Homo sapiens
gugccuguaaucacag

SEQ ID NO: 1047264 - RNA, 14 nt, Homo sapiens
gugccuuccauaau

SEQ ID NO: 1047265 - RNA, 18 nt, Homo sapiens
gugccuuggugugcugua

SEQ ID NO: 1047266 - RNA, 16 nt, Homo sapiens
gugcgugcaugugcac

SEQ ID NO: 1047267 - RNA, 14 nt, Homo sapiens
gugcgugugugcaa

SEQ ID NO: 1047268 - RNA, 19 nt, Homo sapiens
gugcguguuuccugugcaa

SEQ ID NO: 1047269 - RNA, 18 nt, Homo sapiens
gugcuacaaaaacacagc

SEQ ID NO: 1047270 - RNA, 23 nt, Homo sapiens
gugcuaggaacacuccuucacag

SEQ ID NO: 1047271 - RNA, 20 nt, Homo sapiens
gugcuaucgcaccacugugu

SEQ ID NO: 1047272 - RNA, 15 nt, Homo sapiens
gugcuccgugccucc

SEQ ID NO: 1047273 - RNA, 15 nt, Homo sapiens
gugcugggauuacag

SEQ ID NO: 1047274 - RNA, 18 nt, Homo sapiens
gugcuguggccugggcaa

SEQ ID NO: 1047275 - RNA, 21 nt, Homo sapiens
gugcuuaagcagaagcauuaa

SEQ ID NO: 1047276 - RNA, 17 nt, Homo sapiens
gugcuuacacaucucag

SEQ ID NO: 1047277 - RNA, 14 nt, Homo sapiens
gugcuugagucucc

SEQ ID NO: 1047278 - RNA, 14 nt, Homo sapiens
gugcuuguuuacag

SEQ ID NO: 1047279 - RNA, 20 nt, Homo sapiens
gugcuuuuaaaaaaaaauac

SEQ ID NO: 1047280 - RNA, 15 nt, Homo sapiens
guggaaaguguaaag

SEQ ID NO: 1047281 - RNA, 20 nt, Homo sapiens
guggaaggcaucagucccua

SEQ ID NO: 1047282 - RNA, 12 nt, Homo sapiens
guggacaggugu

SEQ ID NO: 1047283 - RNA, 17 nt, Homo sapiens
guggagaaacuguaguc

SEQ ID NO: 1047284 - RNA, 16 nt, Homo sapiens
guggagaaagcacuga

SEQ ID NO: 1047285 - RNA, 17 nt, Homo sapiens
guggagaugcagaggua

SEQ ID NO: 1047286 - RNA, 20 nt, Homo sapiens
guggagcauuggcugagaga

SEQ ID NO: 1047287 - RNA, 22 nt, Homo sapiens
guggaggguggggggcgcugag

SEQ ID NO: 1047288 - RNA, 16 nt, Homo sapiens
guggagguugcaguga

SEQ ID NO: 1047289 - RNA, 12 nt, Homo sapiens
guggaucacuug

SEQ ID NO: 1047290 - RNA, 21 nt, Homo sapiens
guggauccucaaacaacacug

SEQ ID NO: 1047291 - RNA, 17 nt, Homo sapiens
guggaugccugcugcau

SEQ ID NO: 1047292 - RNA, 14 nt, Homo sapiens
guggauuaaccugc

SEQ ID NO: 1047293 - RNA, 22 nt, Homo sapiens
guggcaagcugugacuucucca

SEQ ID NO: 1047294 - RNA, 22 nt, Homo sapiens
guggcagaauggggugcaugaa

SEQ ID NO: 1047295 - RNA, 17 nt, Homo sapiens
guggcagcucaccucuc

SEQ ID NO: 1047296 - RNA, 22 nt, Homo sapiens
guggcaucucuaauuggaagaa

SEQ ID NO: 1047297 - RNA, 14 nt, Homo sapiens
guggcccaacacaa

SEQ ID NO: 1047298 - RNA, 18 nt, Homo sapiens
guggcccaagggugguga

SEQ ID NO: 1047299 - RNA, 18 nt, Homo sapiens
guggcccagagaagccaa

SEQ ID NO: 1047300 - RNA, 14 nt, Homo sapiens
guggcgacucuaua

SEQ ID NO: 1047301 - RNA, 18 nt, Homo sapiens
guggcucacccuguccag

SEQ ID NO: 1047302 - RNA, 15 nt, Homo sapiens
guggcuucacagacc

SEQ ID NO: 1047303 - RNA, 20 nt, Homo sapiens
gugggaucugucacaccagc

SEQ ID NO: 1047304 - RNA, 19 nt, Homo sapiens
gugggcagagguucauuuc

SEQ ID NO: 1047305 - RNA, 18 nt, Homo sapiens
gugggcccagggccuagg

SEQ ID NO: 1047306 - RNA, 12 nt, Homo sapiens
gugggcugugag

SEQ ID NO: 1047307 - RNA, 11 nt, Homo sapiens
guggguggugg

SEQ ID NO: 1047308 - RNA, 14 nt, Homo sapiens
gugguacagcacug

SEQ ID NO: 1047309 - RNA, 13 nt, Homo sapiens
guggucaagcacu

SEQ ID NO: 1047310 - RNA, 17 nt, Homo sapiens
gugguccuuugggguga

SEQ ID NO: 1047311 - RNA, 20 nt, Homo sapiens
gugguggcacacaccuguag

SEQ ID NO: 1047312 - RNA, 13 nt, Homo sapiens
gugguggcacuga

SEQ ID NO: 1047313 - RNA, 18 nt, Homo sapiens
gugguggcgugagccugu

SEQ ID NO: 1047314 - RNA, 17 nt, Homo sapiens
gugguuucccaucucca

SEQ ID NO: 1047315 - RNA, 14 nt, Homo sapiens
guguaagaaacaca

SEQ ID NO: 1047316 - RNA, 14 nt, Homo sapiens
guguaaguaauuau

SEQ ID NO: 1047317 - RNA, 19 nt, Homo sapiens
guguacagucuuguauuaa

SEQ ID NO: 1047318 - RNA, 16 nt, Homo sapiens
guguaguaaaguauca

SEQ ID NO: 1047319 - RNA, 22 nt, Homo sapiens
guguaugugcgugugugcaagu

SEQ ID NO: 1047320 - RNA, 16 nt, Homo sapiens
guguauucauucucau

SEQ ID NO: 1047321 - RNA, 21 nt, Homo sapiens
gugucacuacucacagucucu

SEQ ID NO: 1047322 - RNA, 15 nt, Homo sapiens
gugucccaugaccca

SEQ ID NO: 1047323 - RNA, 16 nt, Homo sapiens
guguccccuccacugu

SEQ ID NO: 1047324 - RNA, 15 nt, Homo sapiens
gugucuuaauuauua

SEQ ID NO: 1047325 - RNA, 22 nt, Homo sapiens
gugugaccacugcagaagacag

SEQ ID NO: 1047326 - RNA, 14 nt, Homo sapiens
gugugacucauuaa

SEQ ID NO: 1047327 - RNA, 14 nt, Homo sapiens
gugugccauuuuaa

SEQ ID NO: 1047328 - RNA, 12 nt, Homo sapiens
gugugcgugcaa

SEQ ID NO: 1047329 - RNA, 13 nt, Homo sapiens
gugugcgugcaug

SEQ ID NO: 1047330 - RNA, 16 nt, Homo sapiens
gugugcguguuugcac

SEQ ID NO: 1047331 - RNA, 19 nt, Homo sapiens
gugugcuuuguacugcugu

SEQ ID NO: 1047332 - RNA, 16 nt, Homo sapiens
gugugggaguguguaa

SEQ ID NO: 1047333 - RNA, 19 nt, Homo sapiens
guguggugagaucaugcca

SEQ ID NO: 1047334 - RNA, 21 nt, Homo sapiens
guguguauauaguaugaaugc

SEQ ID NO: 1047335 - RNA, 23 nt, Homo sapiens
guguguaugugcgugugugcaag

SEQ ID NO: 1047336 - RNA, 20 nt, Homo sapiens
guguguccaugugugugcaa

SEQ ID NO: 1047337 - RNA, 23 nt, Homo sapiens
guguguccaugugugugcaagug

SEQ ID NO: 1047338 - RNA, 20 nt, Homo sapiens
gugugugcaaguaugugagu

SEQ ID NO: 1047339 - RNA, 13 nt, Homo sapiens
gugugugccucau

SEQ ID NO: 1047340 - RNA, 13 nt, Homo sapiens
guguguguguaug

SEQ ID NO: 1047341 - RNA, 21 nt, Homo sapiens
guguuccuaaaauggugauau

SEQ ID NO: 1047342 - RNA, 19 nt, Homo sapiens
guguucuacacucaucuua

SEQ ID NO: 1047343 - RNA, 18 nt, Homo sapiens
guguucuccuccuauuca

SEQ ID NO: 1047344 - RNA, 15 nt, Homo sapiens
ucauccugacucugc

SEQ ID NO: 1047345 - RNA, 16 nt, Homo sapiens
ucauccuuuccagcau

SEQ ID NO: 1047346 - RNA, 14 nt, Homo sapiens
ucaucucauuccaa

SEQ ID NO: 1047347 - RNA, 20 nt, Homo sapiens
ucaucugccaagcuccucaa

SEQ ID NO: 1047348 - RNA, 12 nt, Homo sapiens
ucaucugggaaa

SEQ ID NO: 1047349 - RNA, 18 nt, Homo sapiens
ucaucuuggucacauaca

SEQ ID NO: 1047350 - RNA, 14 nt, Homo sapiens
ucaugaaauaugca

SEQ ID NO: 1047351 - RNA, 22 nt, Homo sapiens
ucaugaaauuacuuaucaucca

SEQ ID NO: 1047352 - RNA, 23 nt, Homo sapiens
ucaugaagaaccuugacggcauu

SEQ ID NO: 1047353 - RNA, 16 nt, Homo sapiens
ucaugaauuccuuaaa

SEQ ID NO: 1047354 - RNA, 13 nt, Homo sapiens
ucaugacauuccu

SEQ ID NO: 1047355 - RNA, 16 nt, Homo sapiens
ucaugauaugucaggg

SEQ ID NO: 1047356 - RNA, 14 nt, Homo sapiens
ucaugaucaucaca

SEQ ID NO: 1047357 - RNA, 17 nt, Homo sapiens
ucaugauccaacuaaug

SEQ ID NO: 1047358 - RNA, 16 nt, Homo sapiens
ucaugauuucauuuca

SEQ ID NO: 1047359 - RNA, 24 nt, Homo sapiens
ucaugcaaaggcugggaccacgug

SEQ ID NO: 1047360 - RNA, 22 nt, Homo sapiens
ucaugcagccgugaucaaggga

SEQ ID NO: 1047361 - RNA, 19 nt, Homo sapiens
ucaugcaucuccaccugcu

SEQ ID NO: 1047362 - RNA, 23 nt, Homo sapiens
ucauggacugaguuuauacucac

SEQ ID NO: 1047363 - RNA, 19 nt, Homo sapiens
ucauggauucauuacagcu

SEQ ID NO: 1047364 - RNA, 17 nt, Homo sapiens
ucauggcagcuaagcca

SEQ ID NO: 1047365 - RNA, 20 nt, Homo sapiens
ucauggcagcuaagccacau

SEQ ID NO: 1047366 - RNA, 17 nt, Homo sapiens
ucauggggugaugcugg

SEQ ID NO: 1047367 - RNA, 14 nt, Homo sapiens
ucaugucaugugua

SEQ ID NO: 1047368 - RNA, 14 nt, Homo sapiens
ucaugugaacccgg

SEQ ID NO: 1047369 - RNA, 18 nt, Homo sapiens
ucauguuauuaaacguau

SEQ ID NO: 1047370 - RNA, 22 nt, Homo sapiens
ucauuaagcccucuuccaucau

SEQ ID NO: 1047371 - RNA, 12 nt, Homo sapiens
ucauuacagcuu

SEQ ID NO: 1047372 - RNA, 20 nt, Homo sapiens
ucauuauagaucccccagac

SEQ ID NO: 1047373 - RNA, 20 nt, Homo sapiens
ucauuaucucaaaacugcac

SEQ ID NO: 1047374 - RNA, 17 nt, Homo sapiens
ucauuauuggaauuaac

SEQ ID NO: 1047375 - RNA, 15 nt, Homo sapiens
ucauuauuugcagag

SEQ ID NO: 1047376 - RNA, 20 nt, Homo sapiens
ucauuauuuuuccacuuugu

SEQ ID NO: 1047377 - RNA, 17 nt, Homo sapiens
ucauuccaccuucccau

SEQ ID NO: 1047378 - RNA, 15 nt, Homo sapiens
ucauuccuaacacag

SEQ ID NO: 1047379 - RNA, 20 nt, Homo sapiens
ucauuccuaacacagcaugu

SEQ ID NO: 1047380 - RNA, 17 nt, Homo sapiens
ucauuccugccugucuc

SEQ ID NO: 1047381 - RNA, 15 nt, Homo sapiens
ucauucucauucuca

SEQ ID NO: 1047382 - RNA, 21 nt, Homo sapiens
ucauucuuguuaauuauacca

SEQ ID NO: 1047383 - RNA, 21 nt, Homo sapiens
ucauugaaccucuuggguuca

SEQ ID NO: 1047384 - RNA, 14 nt, Homo sapiens
ucauugauugaaua

SEQ ID NO: 1047385 - RNA, 18 nt, Homo sapiens
ucauuguucucccuccua

SEQ ID NO: 1047386 - RNA, 21 nt, Homo sapiens
ucauuuacuguggcuucuuaa

SEQ ID NO: 1047387 - RNA, 15 nt, Homo sapiens
ucauuuaucccucaa

SEQ ID NO: 1047388 - RNA, 12 nt, Homo sapiens
ucauuucacuuu

SEQ ID NO: 1047389 - RNA, 13 nt, Homo sapiens
ucauuucuggaaa

SEQ ID NO: 1047390 - RNA, 22 nt, Homo sapiens
ucauuucuggaaagugcaauua

SEQ ID NO: 1047391 - RNA, 14 nt, Homo sapiens
ucauuugcucuaau

SEQ ID NO: 1047392 - RNA, 21 nt, Homo sapiens
uccaaaacuaauuuccucuga

SEQ ID NO: 1047393 - RNA, 15 nt, Homo sapiens
uccaaaagcacuuac

SEQ ID NO: 1047394 - RNA, 22 nt, Homo sapiens
uccaaaagcacuuacggauucu

SEQ ID NO: 1047395 - RNA, 18 nt, Homo sapiens
uccaaacauuaaugcaau

SEQ ID NO: 1047396 - RNA, 19 nt, Homo sapiens
uccaaacuaccuuccaguu

SEQ ID NO: 1047397 - RNA, 14 nt, Homo sapiens
uccaaacugccuaa

SEQ ID NO: 1047398 - RNA, 21 nt, Homo sapiens
uccaaagaaauguaagggaaa

SEQ ID NO: 1047399 - RNA, 20 nt, Homo sapiens
uccaaagcacauugaaagag

SEQ ID NO: 1047400 - RNA, 21 nt, Homo sapiens
uccaaagggcauggguuuuau

SEQ ID NO: 1047401 - RNA, 19 nt, Homo sapiens
uccaaaguacacuguuuca

SEQ ID NO: 1047402 - RNA, 18 nt, Homo sapiens
uccaaagugccacucauu

SEQ ID NO: 1047403 - RNA, 14 nt, Homo sapiens
uccaaauagcauua

SEQ ID NO: 1047404 - RNA, 15 nt, Homo sapiens
uccaaauggacauaa

SEQ ID NO: 1047405 - RNA, 13 nt, Homo sapiens
uccaaauucacaa

SEQ ID NO: 1047406 - RNA, 16 nt, Homo sapiens
uccaacaugugcucag

SEQ ID NO: 1047407 - RNA, 19 nt, Homo sapiens
uccaaccccccaccugcca

SEQ ID NO: 1047408 - RNA, 23 nt, Homo sapiens
uccaacggcaagggaacaaguac

SEQ ID NO: 1047409 - RNA, 23 nt, Homo sapiens
uccaacuaacguacauucaacag

SEQ ID NO: 1047410 - RNA, 14 nt, Homo sapiens
uccaacuccaggau

SEQ ID NO: 1047411 - RNA, 12 nt, Homo sapiens
uccaacuguaua

SEQ ID NO: 1047412 - RNA, 15 nt, Homo sapiens
uccaagaaaugcaaa

SEQ ID NO: 1047413 - RNA, 15 nt, Homo sapiens
uccaagagacaugcu

SEQ ID NO: 1047414 - RNA, 19 nt, Homo sapiens
uccaaggauggaccacaca

SEQ ID NO: 1047415 - RNA, 14 nt, Homo sapiens
uccaaggguacuaa

SEQ ID NO: 1047416 - RNA, 19 nt, Homo sapiens
uccaagguguaacucuaau

SEQ ID NO: 1047417 - RNA, 17 nt, Homo sapiens
uccaaguugcuaauaca

SEQ ID NO: 1047418 - RNA, 14 nt, Homo sapiens
uccaauaaauguga

SEQ ID NO: 1047419 - RNA, 24 nt, Homo sapiens
uccaauuaaggauuuuaugcuuua

SEQ ID NO: 1047420 - RNA, 22 nt, Homo sapiens
uccaauugaacuuucacauagc

SEQ ID NO: 1047421 - RNA, 22 nt, Homo sapiens
uccacacacagcugggcugugg

SEQ ID NO: 1047422 - RNA, 17 nt, Homo sapiens
uccacacccucacugcu

SEQ ID NO: 1047423 - RNA, 15 nt, Homo sapiens
uccacagugacucca

SEQ ID NO: 1047424 - RNA, 14 nt, Homo sapiens
uccaccccccagaa

SEQ ID NO: 1047425 - RNA, 16 nt, Homo sapiens
uccaccgccacugggc

SEQ ID NO: 1047426 - RNA, 16 nt, Homo sapiens
uccaccuagacuguaa

SEQ ID NO: 1047427 - RNA, 15 nt, Homo sapiens
uccaccugccaggga

SEQ ID NO: 1047428 - RNA, 23 nt, Homo sapiens
uccacggagccacuccucugacu

SEQ ID NO: 1047429 - RNA, 19 nt, Homo sapiens
uccacguucugcucaucau

SEQ ID NO: 1047430 - RNA, 14 nt, Homo sapiens
uccacuacugcuac

SEQ ID NO: 1047431 - RNA, 19 nt, Homo sapiens
uccacuaggguccaccagg

SEQ ID NO: 1047432 - RNA, 16 nt, Homo sapiens
uccacuccacuuugua

SEQ ID NO: 1047433 - RNA, 15 nt, Homo sapiens
uccacucuccuugcu

SEQ ID NO: 1047434 - RNA, 21 nt, Homo sapiens
uccacugcguuguccacaaga

SEQ ID NO: 1047435 - RNA, 14 nt, Homo sapiens
uccacugugccaug

SEQ ID NO: 1047436 - RNA, 21 nt, Homo sapiens
uccacuuaccuagauucuaca

SEQ ID NO: 1047437 - RNA, 22 nt, Homo sapiens
uccacuuaccuagauucuacau

SEQ ID NO: 1047438 - RNA, 23 nt, Homo sapiens
uccacuucuuguuccccacugac

SEQ ID NO: 1047439 - RNA, 13 nt, Homo sapiens
uccacuucuuuca

SEQ ID NO: 1047440 - RNA, 12 nt, Homo sapiens
uccagaauucac

SEQ ID NO: 1047441 - RNA, 21 nt, Homo sapiens
uccagacaaugccagcauaaa

SEQ ID NO: 1047442 - RNA, 12 nt, Homo sapiens
uccagacacaug

SEQ ID NO: 1047443 - RNA, 18 nt, Homo sapiens
uccagaccauucaggaca

SEQ ID NO: 1047444 - RNA, 17 nt, Homo sapiens
uccagauagcagggcau

SEQ ID NO: 1047445 - RNA, 15 nt, Homo sapiens
uccagauauuucaca

SEQ ID NO: 1047446 - RNA, 17 nt, Homo sapiens
uccagauccuucaaaga

SEQ ID NO: 1047447 - RNA, 19 nt, Homo sapiens
uccagauccuucaaagagu

SEQ ID NO: 1047448 - RNA, 12 nt, Homo sapiens
uccagauggcaa

SEQ ID NO: 1047449 - RNA, 13 nt, Homo sapiens
uccagccccugga

SEQ ID NO: 1047450 - RNA, 19 nt, Homo sapiens
uccagccgcugcacaucac

SEQ ID NO: 1047451 - RNA, 20 nt, Homo sapiens
uccagccugggcaacagagc

SEQ ID NO: 1047452 - RNA, 23 nt, Homo sapiens
uccagcuggaagggucaacaucu

SEQ ID NO: 1047453 - RNA, 19 nt, Homo sapiens
uccaggcgaugugcaagug

SEQ ID NO: 1047454 - RNA, 19 nt, Homo sapiens
uccagggaauggagcucag

SEQ ID NO: 1047455 - RNA, 12 nt, Homo sapiens
uccagggcuccc

SEQ ID NO: 1047456 - RNA, 23 nt, Homo sapiens
uccaggggccacaagaccaucua

SEQ ID NO: 1047457 - RNA, 18 nt, Homo sapiens
uccaggguccacaggaag

SEQ ID NO: 1047458 - RNA, 21 nt, Homo sapiens
uccaggugguaagcaccagga

SEQ ID NO: 1047459 - RNA, 17 nt, Homo sapiens
uccaguauucuugucaa

SEQ ID NO: 1047460 - RNA, 15 nt, Homo sapiens
uccaguccaaggaaa

SEQ ID NO: 1047461 - RNA, 11 nt, Homo sapiens
uccagugcagg

SEQ ID NO: 1047462 - RNA, 13 nt, Homo sapiens
uccagugucucac

SEQ ID NO: 1047463 - RNA, 15 nt, Homo sapiens
uccaguucaugagaa

SEQ ID NO: 1047464 - RNA, 12 nt, Homo sapiens
uccaguuugcaa

SEQ ID NO: 1047465 - RNA, 21 nt, Homo sapiens
uccauaaacacccaugaauca

SEQ ID NO: 1047466 - RNA, 22 nt, Homo sapiens
uccauagccuaaucccugggca

SEQ ID NO: 1047467 - RNA, 21 nt, Homo sapiens
uccauagggccuccuuagauc

SEQ ID NO: 1047468 - RNA, 20 nt, Homo sapiens
uccauauggcaauaggugug

SEQ ID NO: 1047469 - RNA, 13 nt, Homo sapiens
uccauauguuaua

SEQ ID NO: 1047470 - RNA, 13 nt, Homo sapiens
uccaucccaggcu

SEQ ID NO: 1047471 - RNA, 19 nt, Homo sapiens
uccauccuucaaauaaaca

SEQ ID NO: 1047472 - RNA, 15 nt, Homo sapiens
uccaucucaaaaaau

SEQ ID NO: 1047473 - RNA, 15 nt, Homo sapiens
uccaucuccacucca

SEQ ID NO: 1047474 - RNA, 22 nt, Homo sapiens
uccaugaaguuugaacuucaua

SEQ ID NO: 1047475 - RNA, 15 nt, Homo sapiens
uccaugaauucuuga

SEQ ID NO: 1047476 - RNA, 19 nt, Homo sapiens
uccauugguuuaccuguga

SEQ ID NO: 1047477 - RNA, 20 nt, Homo sapiens
uccauuuauucuuugaucuu

SEQ ID NO: 1047478 - RNA, 22 nt, Homo sapiens
ucccaaaagcccauucauucca

SEQ ID NO: 1047479 - RNA, 23 nt, Homo sapiens
ucccaaaagcccauucauuccau

SEQ ID NO: 1047480 - RNA, 16 nt, Homo sapiens
ucccaaguggugccua

SEQ ID NO: 1047481 - RNA, 18 nt, Homo sapiens
ucccacacccuguuuuac

SEQ ID NO: 1047482 - RNA, 23 nt, Homo sapiens
ucccacccccacccccagcucaa

SEQ ID NO: 1047483 - RNA, 13 nt, Homo sapiens
ucccacuaucugg

SEQ ID NO: 1047484 - RNA, 15 nt, Homo sapiens
ucccacucaagccaa

SEQ ID NO: 1047485 - RNA, 17 nt, Homo sapiens
ucccacucaggugaaaa

SEQ ID NO: 1047486 - RNA, 12 nt, Homo sapiens
ucccacugccaa

SEQ ID NO: 1047487 - RNA, 21 nt, Homo sapiens
ucccacugcccccuccacugg

SEQ ID NO: 1047488 - RNA, 22 nt, Homo sapiens
ucccacugcccccuccacugga

SEQ ID NO: 1047489 - RNA, 22 nt, Homo sapiens
ucccacugggagcacuuuguag

SEQ ID NO: 1047490 - RNA, 22 nt, Homo sapiens
ucccacuuggaggccuuucauc

SEQ ID NO: 1047491 - RNA, 23 nt, Homo sapiens
ucccagaaauuagaaaccuuaau

SEQ ID NO: 1047492 - RNA, 19 nt, Homo sapiens
cuucccugguaccuagcaa

SEQ ID NO: 1047493 - RNA, 18 nt, Homo sapiens
cuucccuucuccaucucu

SEQ ID NO: 1047494 - RNA, 22 nt, Homo sapiens
cuucccuugcuggaaaacccaa

SEQ ID NO: 1047495 - RNA, 14 nt, Homo sapiens
cuuccgacaccucu

SEQ ID NO: 1047496 - RNA, 13 nt, Homo sapiens
cuuccucacacca

SEQ ID NO: 1047497 - RNA, 23 nt, Homo sapiens
cuuccucacaccacaaaucugaa

SEQ ID NO: 1047498 - RNA, 14 nt, Homo sapiens
cuuccucuucuuca

SEQ ID NO: 1047499 - RNA, 15 nt, Homo sapiens
cuuccugacacuuua

SEQ ID NO: 1047500 - RNA, 15 nt, Homo sapiens
cuuccuggaagcaga

SEQ ID NO: 1047501 - RNA, 20 nt, Homo sapiens
cuuccuguaacacaagccac

SEQ ID NO: 1047502 - RNA, 18 nt, Homo sapiens
cuuccuuccucucugcaa

SEQ ID NO: 1047503 - RNA, 17 nt, Homo sapiens
cuuccuucuagggagca

SEQ ID NO: 1047504 - RNA, 15 nt, Homo sapiens
cuuccuugaccagca

SEQ ID NO: 1047505 - RNA, 13 nt, Homo sapiens
cuuccuugcuaau

SEQ ID NO: 1047506 - RNA, 14 nt, Homo sapiens
cuucggacaacuca

SEQ ID NO: 1047507 - RNA, 23 nt, Homo sapiens
cuucgggaagagaggaguucaau

SEQ ID NO: 1047508 - RNA, 16 nt, Homo sapiens
cuucgggcccugccug

SEQ ID NO: 1047509 - RNA, 14 nt, Homo sapiens
cuucguacaguucu

SEQ ID NO: 1047510 - RNA, 17 nt, Homo sapiens
cuucuaccugccacuca

SEQ ID NO: 1047511 - RNA, 13 nt, Homo sapiens
cuucuagaaccag

SEQ ID NO: 1047512 - RNA, 20 nt, Homo sapiens
cuucuagggagacaacagcc

SEQ ID NO: 1047513 - RNA, 15 nt, Homo sapiens
cuucucagcucccau

SEQ ID NO: 1047514 - RNA, 11 nt, Homo sapiens
cuucucaggaa

SEQ ID NO: 1047515 - RNA, 12 nt, Homo sapiens
cuucucaggcau

SEQ ID NO: 1047516 - RNA, 15 nt, Homo sapiens
cuucucaugauccaa

SEQ ID NO: 1047517 - RNA, 15 nt, Homo sapiens
cuucuccaaaugaga

SEQ ID NO: 1047518 - RNA, 13 nt, Homo sapiens
cuucuccaucucu

SEQ ID NO: 1047519 - RNA, 21 nt, Homo sapiens
cuucugaggcgcugcuuuguc

SEQ ID NO: 1047520 - RNA, 18 nt, Homo sapiens
cuucugccccagcuuugc

SEQ ID NO: 1047521 - RNA, 16 nt, Homo sapiens
cuucugcccuugccaa

SEQ ID NO: 1047522 - RNA, 19 nt, Homo sapiens
cuucugcuuaaucugagaa

SEQ ID NO: 1047523 - RNA, 16 nt, Homo sapiens
cuucuggagucuccag

SEQ ID NO: 1047524 - RNA, 19 nt, Homo sapiens
cuucuggagucuccagugg

SEQ ID NO: 1047525 - RNA, 20 nt, Homo sapiens
cuucuggagucuccaguggu

SEQ ID NO: 1047526 - RNA, 22 nt, Homo sapiens
cuucuggccucccacagacuca

SEQ ID NO: 1047527 - RNA, 16 nt, Homo sapiens
cuucuguauucacuua

SEQ ID NO: 1047528 - RNA, 15 nt, Homo sapiens
cuucugucagcagua

SEQ ID NO: 1047529 - RNA, 15 nt, Homo sapiens
cuucuguccuacucu

SEQ ID NO: 1047530 - RNA, 15 nt, Homo sapiens
cuucugugugaccau

SEQ ID NO: 1047531 - RNA, 19 nt, Homo sapiens
cuucuuaaucuuuucacaa

SEQ ID NO: 1047532 - RNA, 14 nt, Homo sapiens
cuucuucagaagac

SEQ ID NO: 1047533 - RNA, 19 nt, Homo sapiens
cuucuucagagcugacaca

SEQ ID NO: 1047534 - RNA, 19 nt, Homo sapiens
cuucuuguaguagucucau

SEQ ID NO: 1047535 - RNA, 18 nt, Homo sapiens
cuucuuuaaaaaaacaca

SEQ ID NO: 1047536 - RNA, 18 nt, Homo sapiens
cuucuuucuacaguauua

SEQ ID NO: 1047537 - RNA, 12 nt, Homo sapiens
cuucuuugccca

SEQ ID NO: 1047538 - RNA, 19 nt, Homo sapiens
cuucuuuuauaacuagucc

SEQ ID NO: 1047539 - RNA, 14 nt, Homo sapiens
cuucuuuuccaauu

SEQ ID NO: 1047540 - RNA, 18 nt, Homo sapiens
cuugaaaaaugugcaaaa

SEQ ID NO: 1047541 - RNA, 15 nt, Homo sapiens
cuugaaaagacauca

SEQ ID NO: 1047542 - RNA, 21 nt, Homo sapiens
cuugaaaagacaucaagcaca

SEQ ID NO: 1047543 - RNA, 18 nt, Homo sapiens
cuugaaacaagcaacaga

SEQ ID NO: 1047544 - RNA, 17 nt, Homo sapiens
cuugaaagaaaauacca

SEQ ID NO: 1047545 - RNA, 15 nt, Homo sapiens
cuugaaaguagcaau

SEQ ID NO: 1047546 - RNA, 13 nt, Homo sapiens
cuugaaaguuuuc

SEQ ID NO: 1047547 - RNA, 12 nt, Homo sapiens
cuugaaaucuga

SEQ ID NO: 1047548 - RNA, 20 nt, Homo sapiens
cuugaacacucaugcugaaa

SEQ ID NO: 1047549 - RNA, 13 nt, Homo sapiens
cuugaagaacuga

SEQ ID NO: 1047550 - RNA, 15 nt, Homo sapiens
cuugaagacacugaa

SEQ ID NO: 1047551 - RNA, 15 nt, Homo sapiens
cuugaagggcccaga

SEQ ID NO: 1047552 - RNA, 20 nt, Homo sapiens
cuugacaguaaaucacacaa

SEQ ID NO: 1047553 - RNA, 16 nt, Homo sapiens
cuugaccagcagaucc

SEQ ID NO: 1047554 - RNA, 24 nt, Homo sapiens
cuugaccagcagaucccagcucac

SEQ ID NO: 1047555 - RNA, 16 nt, Homo sapiens
cuugaggcaacucauc

SEQ ID NO: 1047556 - RNA, 14 nt, Homo sapiens
cuugagguugguga

SEQ ID NO: 1047557 - RNA, 19 nt, Homo sapiens
cuugagucuccaacggcaa

SEQ ID NO: 1047558 - RNA, 18 nt, Homo sapiens
cuugauaaagggccaaua

SEQ ID NO: 1047559 - RNA, 21 nt, Homo sapiens
cuugauaagaccaccaccuca

SEQ ID NO: 1047560 - RNA, 22 nt, Homo sapiens
cuugauaaugggaugaauggaa

SEQ ID NO: 1047561 - RNA, 17 nt, Homo sapiens
cuugaugugccugugaa

SEQ ID NO: 1047562 - RNA, 16 nt, Homo sapiens
cuugauucacaaugaa

SEQ ID NO: 1047563 - RNA, 16 nt, Homo sapiens
cuugcaaauccacuag

SEQ ID NO: 1047564 - RNA, 17 nt, Homo sapiens
cuugcacgcccaugugu

SEQ ID NO: 1047565 - RNA, 20 nt, Homo sapiens
cuugcacgcccaugugugag

SEQ ID NO: 1047566 - RNA, 15 nt, Homo sapiens
cuugcauacagagac

SEQ ID NO: 1047567 - RNA, 23 nt, Homo sapiens
cuugcauccccaacuuagcuguc

SEQ ID NO: 1047568 - RNA, 14 nt, Homo sapiens
cuugcgcauucuca

SEQ ID NO: 1047569 - RNA, 18 nt, Homo sapiens
cuugcucugcacccccau

SEQ ID NO: 1047570 - RNA, 18 nt, Homo sapiens
cuugcugccaaaagccuu

SEQ ID NO: 1047571 - RNA, 13 nt, Homo sapiens
cuugcugccugaa

SEQ ID NO: 1047572 - RNA, 23 nt, Homo sapiens
cuugcuuguugggauuccugacc

SEQ ID NO: 1047573 - RNA, 21 nt, Homo sapiens
cuugcuuugcagccccacaga

SEQ ID NO: 1047574 - RNA, 22 nt, Homo sapiens
cuuggaaagcaucaccucaggc

SEQ ID NO: 1047575 - RNA, 23 nt, Homo sapiens
cuuggaagagaaugucugaucua

SEQ ID NO: 1047576 - RNA, 20 nt, Homo sapiens
cuuggaauucucucaccucu

SEQ ID NO: 1047577 - RNA, 19 nt, Homo sapiens
cuuggaggccagccaguga

SEQ ID NO: 1047578 - RNA, 23 nt, Homo sapiens
cuuggaggcugucuucucaggcu

SEQ ID NO: 1047579 - RNA, 21 nt, Homo sapiens
cuuggagggcaugaagacaga

SEQ ID NO: 1047580 - RNA, 13 nt, Homo sapiens
cuuggaucugcca

SEQ ID NO: 1047581 - RNA, 23 nt, Homo sapiens
cuuggcacacagcaggcuuucaa

SEQ ID NO: 1047582 - RNA, 24 nt, Homo sapiens
cuuggcacauuuaagagacaguca

SEQ ID NO: 1047583 - RNA, 19 nt, Homo sapiens
cuuggcaugccuuccagca

SEQ ID NO: 1047584 - RNA, 22 nt, Homo sapiens
cuuggccagaagggggccauga

SEQ ID NO: 1047585 - RNA, 13 nt, Homo sapiens
cuuggccucccaa

SEQ ID NO: 1047586 - RNA, 16 nt, Homo sapiens
cuuggccucccaaagu

SEQ ID NO: 1047587 - RNA, 17 nt, Homo sapiens
cuuggcuacacagggau

SEQ ID NO: 1047588 - RNA, 18 nt, Homo sapiens
cuuggcuccaccacugau

SEQ ID NO: 1047589 - RNA, 17 nt, Homo sapiens
cuugggaaauaugucaa

SEQ ID NO: 1047590 - RNA, 18 nt, Homo sapiens
cuugggagaccuguaauc

SEQ ID NO: 1047591 - RNA, 19 nt, Homo sapiens
cuugggaggcugaggcaga

SEQ ID NO: 1047592 - RNA, 14 nt, Homo sapiens
cuugggaugaucuu

SEQ ID NO: 1047593 - RNA, 23 nt, Homo sapiens
cuugggcguuugaacucagggag

SEQ ID NO: 1047594 - RNA, 23 nt, Homo sapiens
cuugggggaggaggaacaaauaa

SEQ ID NO: 1047595 - RNA, 17 nt, Homo sapiens
cuuggguucaagugauu

SEQ ID NO: 1047596 - RNA, 16 nt, Homo sapiens
cuugguguaguugaac

SEQ ID NO: 1047597 - RNA, 19 nt, Homo sapiens
cuuguaaaauuucacuuaa

SEQ ID NO: 1047598 - RNA, 15 nt, Homo sapiens
cuuguaaagacugua

SEQ ID NO: 1047599 - RNA, 23 nt, Homo sapiens
cuuguaaaugugguaaagaguua

SEQ ID NO: 1047600 - RNA, 21 nt, Homo sapiens
cuuguacauaaugcgugcaua

SEQ ID NO: 1047601 - RNA, 15 nt, Homo sapiens
cuuguccauguaaua

SEQ ID NO: 1047602 - RNA, 23 nt, Homo sapiens
cuugucccacucaagccaagcag

SEQ ID NO: 1047603 - RNA, 23 nt, Homo sapiens
cuugucuaaauaaguuugcaauu

SEQ ID NO: 1047604 - RNA, 16 nt, Homo sapiens
cuugucucacuugugc

SEQ ID NO: 1047605 - RNA, 16 nt, Homo sapiens
cuugucugucuaguua

SEQ ID NO: 1047606 - RNA, 14 nt, Homo sapiens
cuugucugugcauc

SEQ ID NO: 1047607 - RNA, 15 nt, Homo sapiens
cuugugaacccaaag

SEQ ID NO: 1047608 - RNA, 11 nt, Homo sapiens
cuugugccaua

SEQ ID NO: 1047609 - RNA, 20 nt, Homo sapiens
cuugugccucagccucccaa

SEQ ID NO: 1047610 - RNA, 23 nt, Homo sapiens
cuugugccuggcucagagccagu

SEQ ID NO: 1047611 - RNA, 21 nt, Homo sapiens
cuuguggaaccaaauguaucc

SEQ ID NO: 1047612 - RNA, 17 nt, Homo sapiens
cuuguguccacugugac

SEQ ID NO: 1047613 - RNA, 19 nt, Homo sapiens
cuugugugugggcugugag

SEQ ID NO: 1047614 - RNA, 15 nt, Homo sapiens
cuuguuaagugcagu

SEQ ID NO: 1047615 - RNA, 13 nt, Homo sapiens
cuuguuagauuca

SEQ ID NO: 1047616 - RNA, 14 nt, Homo sapiens
cuuguuuacagcac

SEQ ID NO: 1047617 - RNA, 21 nt, Homo sapiens
cuuguuuuuccacuacugcua

SEQ ID NO: 1047618 - RNA, 23 nt, Homo sapiens
cuuguuuuuccacuacugcuacc

SEQ ID NO: 1047619 - RNA, 19 nt, Homo sapiens
cuuuaaaacuuauccucca

SEQ ID NO: 1047620 - RNA, 19 nt, Homo sapiens
cuuuaaagccugccucuuc

SEQ ID NO: 1047621 - RNA, 20 nt, Homo sapiens
cuuuaaagggauggcaagau

SEQ ID NO: 1047622 - RNA, 15 nt, Homo sapiens
cuuuaaauccuucca

SEQ ID NO: 1047623 - RNA, 15 nt, Homo sapiens
cuuuaaauggcuuua

SEQ ID NO: 1047624 - RNA, 19 nt, Homo sapiens
cuuuaaucuucaguuuuau

SEQ ID NO: 1047625 - RNA, 22 nt, Homo sapiens
cuuuaaugaauaaacauuugua

SEQ ID NO: 1047626 - RNA, 17 nt, Homo sapiens
cuuuaauugacaguuuc

SEQ ID NO: 1047627 - RNA, 22 nt, Homo sapiens
cuuuaauuguuaagauaugaug

SEQ ID NO: 1047628 - RNA, 11 nt, Homo sapiens
cuuuaauuuca

SEQ ID NO: 1047629 - RNA, 18 nt, Homo sapiens
cuuuacaaaaguauuauc

SEQ ID NO: 1047630 - RNA, 18 nt, Homo sapiens
cuuuacuguuagucauuu

SEQ ID NO: 1047631 - RNA, 19 nt, Homo sapiens
cuuuagcaguuuugugaua

SEQ ID NO: 1047632 - RNA, 15 nt, Homo sapiens
cuuuagcgcccaguu

SEQ ID NO: 1047633 - RNA, 18 nt, Homo sapiens
cuuuauauggaugauuca

SEQ ID NO: 1047634 - RNA, 19 nt, Homo sapiens
cuuuauauggccucaagau

SEQ ID NO: 1047635 - RNA, 14 nt, Homo sapiens
cuuuaucugugaua

SEQ ID NO: 1047636 - RNA, 22 nt, Homo sapiens
cuuuaugcuaguuugaccucau

SEQ ID NO: 1047637 - RNA, 15 nt, Homo sapiens
cuuuauugugaucua

SEQ ID NO: 1047638 - RNA, 19 nt, Homo sapiens
cuuuauuuauaauacauuu

SEQ ID NO: 1047639 - RNA, 19 nt, Homo sapiens
cuuucaagaagugccaguu

SEQ ID NO: 1047640 - RNA, 17 nt, Homo sapiens
cuggugccccacugaau

SEQ ID NO: 1047641 - RNA, 18 nt, Homo sapiens
cuggugguggcaccaucu

SEQ ID NO: 1047642 - RNA, 12 nt, Homo sapiens
cugguguccuga

SEQ ID NO: 1047643 - RNA, 14 nt, Homo sapiens
cugguguccugacc

SEQ ID NO: 1047644 - RNA, 18 nt, Homo sapiens
cugguuccggcucugcac

SEQ ID NO: 1047645 - RNA, 19 nt, Homo sapiens
cugguugucauuuuugcag

SEQ ID NO: 1047646 - RNA, 12 nt, Homo sapiens
cugguuuuaaca

SEQ ID NO: 1047647 - RNA, 18 nt, Homo sapiens
cuguaaaaacugugggau

SEQ ID NO: 1047648 - RNA, 16 nt, Homo sapiens
cuguaaacuuccaagc

SEQ ID NO: 1047649 - RNA, 14 nt, Homo sapiens
cuguaaccucuuca

SEQ ID NO: 1047650 - RNA, 20 nt, Homo sapiens
cuguaaucccagcacuuugg

SEQ ID NO: 1047651 - RNA, 23 nt, Homo sapiens
cuguacaaaguagaagucuuaga

SEQ ID NO: 1047652 - RNA, 21 nt, Homo sapiens
cuguacaaugaacccccauga

SEQ ID NO: 1047653 - RNA, 23 nt, Homo sapiens
cuguacaaugacuuuauugcauc

SEQ ID NO: 1047654 - RNA, 14 nt, Homo sapiens
cuguacaugcauug

SEQ ID NO: 1047655 - RNA, 16 nt, Homo sapiens
cuguaccuguuccuua

SEQ ID NO: 1047656 - RNA, 13 nt, Homo sapiens
cuguacucaggag

SEQ ID NO: 1047657 - RNA, 22 nt, Homo sapiens
cuguacuccagccugggugaca

SEQ ID NO: 1047658 - RNA, 20 nt, Homo sapiens
cuguacuguucugugucuuu

SEQ ID NO: 1047659 - RNA, 22 nt, Homo sapiens
cuguagaaugauuucaugcuau

SEQ ID NO: 1047660 - RNA, 15 nt, Homo sapiens
cuguaggaagucauc

SEQ ID NO: 1047661 - RNA, 21 nt, Homo sapiens
cuguagucccagccacucggg

SEQ ID NO: 1047662 - RNA, 22 nt, Homo sapiens
cuguagucccagcuacucagga

SEQ ID NO: 1047663 - RNA, 19 nt, Homo sapiens
cuguagucccagcuacucg

SEQ ID NO: 1047664 - RNA, 14 nt, Homo sapiens
cuguagucucagga

SEQ ID NO: 1047665 - RNA, 18 nt, Homo sapiens
cuguagugagauagcauu

SEQ ID NO: 1047666 - RNA, 16 nt, Homo sapiens
cuguauaguacuggca

SEQ ID NO: 1047667 - RNA, 16 nt, Homo sapiens
cuguauauaacuaugg

SEQ ID NO: 1047668 - RNA, 14 nt, Homo sapiens
cuguaucaugacaa

SEQ ID NO: 1047669 - RNA, 16 nt, Homo sapiens
cuguaugauuccuuga

SEQ ID NO: 1047670 - RNA, 22 nt, Homo sapiens
cuguauuugccggugccuagga

SEQ ID NO: 1047671 - RNA, 23 nt, Homo sapiens
cuguauuuguaucucugaagcau

SEQ ID NO: 1047672 - RNA, 18 nt, Homo sapiens
cugucaucagccugugua

SEQ ID NO: 1047673 - RNA, 14 nt, Homo sapiens
cuguccacacccag

SEQ ID NO: 1047674 - RNA, 14 nt, Homo sapiens
cuguccaguuccca

SEQ ID NO: 1047675 - RNA, 19 nt, Homo sapiens
cugucccucaaaugaccca

SEQ ID NO: 1047676 - RNA, 20 nt, Homo sapiens
cuguccugaccugucucacc

SEQ ID NO: 1047677 - RNA, 22 nt, Homo sapiens
cuguccuuuuggcacugagaua

SEQ ID NO: 1047678 - RNA, 23 nt, Homo sapiens
cugucuagggcgaagacccuuau

SEQ ID NO: 1047679 - RNA, 14 nt, Homo sapiens
cugucucagccucc

SEQ ID NO: 1047680 - RNA, 14 nt, Homo sapiens
cugucucaggguga

SEQ ID NO: 1047681 - RNA, 19 nt, Homo sapiens
cugucuccuuaacacugag

SEQ ID NO: 1047682 - RNA, 16 nt, Homo sapiens
cugucuggcugaggau

SEQ ID NO: 1047683 - RNA, 18 nt, Homo sapiens
cugucuguuacacuggag

SEQ ID NO: 1047684 - RNA, 23 nt, Homo sapiens
cugucuuagagugggaccaacuu

SEQ ID NO: 1047685 - RNA, 17 nt, Homo sapiens
cugucuucaacagcucc

SEQ ID NO: 1047686 - RNA, 20 nt, Homo sapiens
cugucuuuauaaucuacucc

SEQ ID NO: 1047687 - RNA, 14 nt, Homo sapiens
cugucuuucacuga

SEQ ID NO: 1047688 - RNA, 19 nt, Homo sapiens
cugugaaagaaccaaaaga

SEQ ID NO: 1047689 - RNA, 18 nt, Homo sapiens
cugugagcucaacuaagu

SEQ ID NO: 1047690 - RNA, 23 nt, Homo sapiens
cugugagcuggagagaacccaga

SEQ ID NO: 1047691 - RNA, 21 nt, Homo sapiens
cugugaggggcucucucauga

SEQ ID NO: 1047692 - RNA, 13 nt, Homo sapiens
cugugaguguaag

SEQ ID NO: 1047693 - RNA, 13 nt, Homo sapiens
cugugauggggcc

SEQ ID NO: 1047694 - RNA, 15 nt, Homo sapiens
cugugauuagccauu

SEQ ID NO: 1047695 - RNA, 18 nt, Homo sapiens
cugugcaaauccuugaua

SEQ ID NO: 1047696 - RNA, 21 nt, Homo sapiens
cuuucaaguuugucacuaaac

SEQ ID NO: 1047697 - RNA, 20 nt, Homo sapiens
cuuucacacuuccaccagcc

SEQ ID NO: 1047698 - RNA, 21 nt, Homo sapiens
cuuucacacuuccaccagccu

SEQ ID NO: 1047699 - RNA, 17 nt, Homo sapiens
cuuucacauagcacaga

SEQ ID NO: 1047700 - RNA, 18 nt, Homo sapiens
cuuucaugaguuucccag

SEQ ID NO: 1047701 - RNA, 12 nt, Homo sapiens
cuuucauuuacu

SEQ ID NO: 1047702 - RNA, 14 nt, Homo sapiens
cuuucauuucuuga

SEQ ID NO: 1047703 - RNA, 19 nt, Homo sapiens
cuuuccaagcuccaccacu

SEQ ID NO: 1047704 - RNA, 20 nt, Homo sapiens
cuuuccaagcuccaccacuu

SEQ ID NO: 1047705 - RNA, 22 nt, Homo sapiens
cuuucccagaaaaaaaaaaacu

SEQ ID NO: 1047706 - RNA, 13 nt, Homo sapiens
cuuuccccaaaga

SEQ ID NO: 1047707 - RNA, 17 nt, Homo sapiens
cuuucccugaacuggga

SEQ ID NO: 1047708 - RNA, 19 nt, Homo sapiens
cuuucccuucaguacccuc

SEQ ID NO: 1047709 - RNA, 19 nt, Homo sapiens
cuuucccuuuaucaguuug

SEQ ID NO: 1047710 - RNA, 14 nt, Homo sapiens
cuuuccuacucuca

SEQ ID NO: 1047711 - RNA, 16 nt, Homo sapiens
cuuuccugaauccaaa

SEQ ID NO: 1047712 - RNA, 13 nt, Homo sapiens
cuuuccuguucca

SEQ ID NO: 1047713 - RNA, 16 nt, Homo sapiens
cuuucuacaggccagc

SEQ ID NO: 1047714 - RNA, 21 nt, Homo sapiens
cuuucuacaggccagcagggg

SEQ ID NO: 1047715 - RNA, 22 nt, Homo sapiens
cuuucuaggagggagacacugg

SEQ ID NO: 1047716 - RNA, 15 nt, Homo sapiens
cuuucucagccacaa

SEQ ID NO: 1047717 - RNA, 21 nt, Homo sapiens
cuuucucccaggccaggcucc

SEQ ID NO: 1047718 - RNA, 12 nt, Homo sapiens
cuuucucuaaaa

SEQ ID NO: 1047719 - RNA, 15 nt, Homo sapiens
cuuucugaaauaaca

SEQ ID NO: 1047720 - RNA, 20 nt, Homo sapiens
cuuucugaaauaacauggcc

SEQ ID NO: 1047721 - RNA, 18 nt, Homo sapiens
cuuucugccaacuuuguu

SEQ ID NO: 1047722 - RNA, 18 nt, Homo sapiens
cuuucugcuaucaaagag

SEQ ID NO: 1047723 - RNA, 16 nt, Homo sapiens
cuuucuggaaaagagg

SEQ ID NO: 1047724 - RNA, 16 nt, Homo sapiens
cuuucuguugucauug

SEQ ID NO: 1047725 - RNA, 19 nt, Homo sapiens
cuuugaagcaguuguguca

SEQ ID NO: 1047726 - RNA, 13 nt, Homo sapiens
cuuugaagucuga

SEQ ID NO: 1047727 - RNA, 22 nt, Homo sapiens
cuuugaagugacuucacagaga

SEQ ID NO: 1047728 - RNA, 14 nt, Homo sapiens
cuuugaaugacaaa

SEQ ID NO: 1047729 - RNA, 20 nt, Homo sapiens
cuuugaccucaaccugugau

SEQ ID NO: 1047730 - RNA, 17 nt, Homo sapiens
cuuugacucaccuguua

SEQ ID NO: 1047731 - RNA, 19 nt, Homo sapiens
cuuugacucaccuguuacu

SEQ ID NO: 1047732 - RNA, 13 nt, Homo sapiens
cuuugacuugugu

SEQ ID NO: 1047733 - RNA, 16 nt, Homo sapiens
cuuugagugacugggu

SEQ ID NO: 1047734 - RNA, 18 nt, Homo sapiens
cuuugaugucauauggaa

SEQ ID NO: 1047735 - RNA, 18 nt, Homo sapiens
cuuugcagccccacagac

SEQ ID NO: 1047736 - RNA, 16 nt, Homo sapiens
cuuugcaggcaugcau

SEQ ID NO: 1047737 - RNA, 21 nt, Homo sapiens
cuuugcccacaaugcuuugcc

SEQ ID NO: 1047738 - RNA, 23 nt, Homo sapiens
cuuugccccugagacaaauggag

SEQ ID NO: 1047739 - RNA, 18 nt, Homo sapiens
cuuugccuuggcuuugcc

SEQ ID NO: 1047740 - RNA, 19 nt, Homo sapiens
cuuugccuuuccauaauca

SEQ ID NO: 1047741 - RNA, 15 nt, Homo sapiens
cuuugcuucccauug

SEQ ID NO: 1047742 - RNA, 18 nt, Homo sapiens
cuuugcuucucucucuaa

SEQ ID NO: 1047743 - RNA, 20 nt, Homo sapiens
cuuuggaaacaauaugcaau

SEQ ID NO: 1047744 - RNA, 14 nt, Homo sapiens
cuuuggaaguccag

SEQ ID NO: 1047745 - RNA, 18 nt, Homo sapiens
cuuuggaagugaggcauu

SEQ ID NO: 1047746 - RNA, 22 nt, Homo sapiens
cuuuggaagugaggcauugcac

SEQ ID NO: 1047747 - RNA, 19 nt, Homo sapiens
cuuuggaccacuccccuca

SEQ ID NO: 1047748 - RNA, 20 nt, Homo sapiens
cuuuggagcagcuucuggga

SEQ ID NO: 1047749 - RNA, 14 nt, Homo sapiens
cuuuggcacugggg

SEQ ID NO: 1047750 - RNA, 13 nt, Homo sapiens
cuuugucccagaa

SEQ ID NO: 1047751 - RNA, 23 nt, Homo sapiens
cuuugucccggggcuccacugaa

SEQ ID NO: 1047752 - RNA, 15 nt, Homo sapiens
cuuugucucaccuca

SEQ ID NO: 1047753 - RNA, 15 nt, Homo sapiens
cuuugugacuucaag

SEQ ID NO: 1047754 - RNA, 19 nt, Homo sapiens
cuuugugcagauucuuuac

SEQ ID NO: 1047755 - RNA, 20 nt, Homo sapiens
cuuugugugcgucacuguga

SEQ ID NO: 1047756 - RNA, 19 nt, Homo sapiens
cuuuguucacuagacugug

SEQ ID NO: 1047757 - RNA, 15 nt, Homo sapiens
cuuuguucugugauu

SEQ ID NO: 1047758 - RNA, 18 nt, Homo sapiens
cuuuuaaaauacauuugg

SEQ ID NO: 1047759 - RNA, 15 nt, Homo sapiens
cuuuuaacaccugau

SEQ ID NO: 1047760 - RNA, 23 nt, Homo sapiens
cuuuuaaugcuccaaaugcugac

SEQ ID NO: 1047761 - RNA, 16 nt, Homo sapiens
cuuuuacauacugcug

SEQ ID NO: 1047762 - RNA, 12 nt, Homo sapiens
cuuuuacauucu

SEQ ID NO: 1047763 - RNA, 16 nt, Homo sapiens
cuuuuaguuguaucuc

SEQ ID NO: 1047764 - RNA, 19 nt, Homo sapiens
cuuuuaucuuggacugaca

SEQ ID NO: 1047765 - RNA, 20 nt, Homo sapiens
cuuuuaugagacccauuccu

SEQ ID NO: 1047766 - RNA, 21 nt, Homo sapiens
cuuuuaugauauauauaugcu

SEQ ID NO: 1047767 - RNA, 14 nt, Homo sapiens
cuuuuaugccuuca

SEQ ID NO: 1047768 - RNA, 14 nt, Homo sapiens
cuuuucacaaauaa

SEQ ID NO: 1047769 - RNA, 15 nt, Homo sapiens
cuuuucauaaccuag

SEQ ID NO: 1047770 - RNA, 18 nt, Homo sapiens
cuuuucauaaccuagccu

SEQ ID NO: 1047771 - RNA, 12 nt, Homo sapiens
cuuuuccagaag

SEQ ID NO: 1047772 - RNA, 14 nt, Homo sapiens
cuuuucccauuuca

SEQ ID NO: 1047773 - RNA, 16 nt, Homo sapiens
cuuuucugaucugcag

SEQ ID NO: 1047774 - RNA, 21 nt, Homo sapiens
cuuuucugcauuuugcuauug

SEQ ID NO: 1047775 - RNA, 21 nt, Homo sapiens
cuuuucuguccgagcuuugaa

SEQ ID NO: 1047776 - RNA, 14 nt, Homo sapiens
cuuuugucccagaa

SEQ ID NO: 1047777 - RNA, 13 nt, Homo sapiens
cuuuugugcauua

SEQ ID NO: 1047778 - RNA, 13 nt, Homo sapiens
cuuuuguguacag

SEQ ID NO: 1047779 - RNA, 21 nt, Homo sapiens
gcccuucccacaggacauuuc

SEQ ID NO: 1047780 - RNA, 21 nt, Homo sapiens
gcccuucccacuggaggucac

SEQ ID NO: 1047781 - RNA, 21 nt, Homo sapiens
gcccuugcccugaccucccag

SEQ ID NO: 1047782 - RNA, 20 nt, Homo sapiens
gcccuuuauuuauaauacau

SEQ ID NO: 1047783 - RNA, 21 nt, Homo sapiens
gccgagaucgcgccacugcac

SEQ ID NO: 1047784 - RNA, 17 nt, Homo sapiens
gccggaguccacuccca

SEQ ID NO: 1047785 - RNA, 23 nt, Homo sapiens
gccggcaaccccaguucugcucc

SEQ ID NO: 1047786 - RNA, 18 nt, Homo sapiens
gccggcucuuuccuugcu

SEQ ID NO: 1047787 - RNA, 21 nt, Homo sapiens
gccguacucuuuggggcagcu

SEQ ID NO: 1047788 - RNA, 16 nt, Homo sapiens
gccuacaugcuuugug

SEQ ID NO: 1047789 - RNA, 21 nt, Homo sapiens
gccuacuuucacacuaagaaa

SEQ ID NO: 1047790 - RNA, 20 nt, Homo sapiens
gccuaggggucagggaccaa

SEQ ID NO: 1047791 - RNA, 16 nt, Homo sapiens
gccuaucagcauuuua

SEQ ID NO: 1047792 - RNA, 18 nt, Homo sapiens
gccucagccauucacugc

SEQ ID NO: 1047793 - RNA, 16 nt, Homo sapiens
gccucaggaaugggcu

SEQ ID NO: 1047794 - RNA, 17 nt, Homo sapiens
gccucagugaaggacua

SEQ ID NO: 1047795 - RNA, 11 nt, Homo sapiens
gccucaucucu

SEQ ID NO: 1047796 - RNA, 16 nt, Homo sapiens
gccuccaagcuccauc

SEQ ID NO: 1047797 - RNA, 16 nt, Homo sapiens
gccuccaccaccacug

SEQ ID NO: 1047798 - RNA, 23 nt, Homo sapiens
gccuccaucucauguaucaucug

SEQ ID NO: 1047799 - RNA, 12 nt, Homo sapiens
gccucccaaagu

SEQ ID NO: 1047800 - RNA, 19 nt, Homo sapiens
gccucccacccccaucucu

SEQ ID NO: 1047801 - RNA, 15 nt, Homo sapiens
gccuccccagcucac

SEQ ID NO: 1047802 - RNA, 17 nt, Homo sapiens
gccucccccaauggcaa

SEQ ID NO: 1047803 - RNA, 19 nt, Homo sapiens
gccucccgcguugggcaac

SEQ ID NO: 1047804 - RNA, 16 nt, Homo sapiens
gccuccucacaacaug

SEQ ID NO: 1047805 - RNA, 22 nt, Homo sapiens
gccuccucccugggcagaaagu

SEQ ID NO: 1047806 - RNA, 14 nt, Homo sapiens
gccuccugaccuga

SEQ ID NO: 1047807 - RNA, 19 nt, Homo sapiens
gccuccuggaaaaaacaaa

SEQ ID NO: 1047808 - RNA, 18 nt, Homo sapiens
gccucgggaccucaggug

SEQ ID NO: 1047809 - RNA, 14 nt, Homo sapiens
gccucuguggcacu

SEQ ID NO: 1047810 - RNA, 22 nt, Homo sapiens
gccucuuccgugacgucacugg

SEQ ID NO: 1047811 - RNA, 13 nt, Homo sapiens
gccucuuggcagu

SEQ ID NO: 1047812 - RNA, 14 nt, Homo sapiens
gccugaaagcaaga

SEQ ID NO: 1047813 - RNA, 14 nt, Homo sapiens
gccugaaccuucca

SEQ ID NO: 1047814 - RNA, 13 nt, Homo sapiens
gccugaacugagg

SEQ ID NO: 1047815 - RNA, 18 nt, Homo sapiens
gccugaagaguccucuga

SEQ ID NO: 1047816 - RNA, 12 nt, Homo sapiens
gccugacauuca

SEQ ID NO: 1047817 - RNA, 22 nt, Homo sapiens
gccugacggggaggaaccacug

SEQ ID NO: 1047818 - RNA, 20 nt, Homo sapiens
gccugaggaugagcuggaag

SEQ ID NO: 1047819 - RNA, 21 nt, Homo sapiens
gccugagguuugccagcauuu

SEQ ID NO: 1047820 - RNA, 19 nt, Homo sapiens
gccugagucacccaugaag

SEQ ID NO: 1047821 - RNA, 22 nt, Homo sapiens
gccugaucagcgccgcaccagc

SEQ ID NO: 1047822 - RNA, 15 nt, Homo sapiens
gccugcaucugugaa

SEQ ID NO: 1047823 - RNA, 16 nt, Homo sapiens
gccugcaucugugaaa

SEQ ID NO: 1047824 - RNA, 22 nt, Homo sapiens
gccugcaugaaacauguucuca

SEQ ID NO: 1047825 - RNA, 16 nt, Homo sapiens
gccugccacugagcag

SEQ ID NO: 1047826 - RNA, 14 nt, Homo sapiens
gccugccucuucca

SEQ ID NO: 1047827 - RNA, 13 nt, Homo sapiens
gccugccuugaag

SEQ ID NO: 1047828 - RNA, 14 nt, Homo sapiens
gccugcggaccaga

SEQ ID NO: 1047829 - RNA, 23 nt, Homo sapiens
gccugcuuccugucuuugggaga

SEQ ID NO: 1047830 - RNA, 19 nt, Homo sapiens
gccuggacacuguaccgac

SEQ ID NO: 1047831 - RNA, 22 nt, Homo sapiens
gccuggacacuguaccgacuuu

SEQ ID NO: 1047832 - RNA, 22 nt, Homo sapiens
gccuggacuagagggaccucuc

SEQ ID NO: 1047833 - RNA, 21 nt, Homo sapiens
gccuggcagaacugagcuccu

SEQ ID NO: 1047834 - RNA, 23 nt, Homo sapiens
gccuggcuccaaacccucgaggc

SEQ ID NO: 1047835 - RNA, 15 nt, Homo sapiens
gccuggcuucuggag

SEQ ID NO: 1047836 - RNA, 16 nt, Homo sapiens
gccugggcaacaacag

SEQ ID NO: 1047837 - RNA, 21 nt, Homo sapiens
gccuggggcaggucacuuuac

SEQ ID NO: 1047838 - RNA, 13 nt, Homo sapiens
gccuguaauccca

SEQ ID NO: 1047839 - RNA, 20 nt, Homo sapiens
gccuguaaucccagcacuuu

SEQ ID NO: 1047840 - RNA, 19 nt, Homo sapiens
gccugucccauggacacuc

SEQ ID NO: 1047841 - RNA, 14 nt, Homo sapiens
gccugucuccuuug

SEQ ID NO: 1047842 - RNA, 16 nt, Homo sapiens
gccugucugaagccaa

SEQ ID NO: 1047843 - RNA, 14 nt, Homo sapiens
gccugugacuuuca

SEQ ID NO: 1047844 - RNA, 20 nt, Homo sapiens
gccugugcauguaugucuug

SEQ ID NO: 1047845 - RNA, 18 nt, Homo sapiens
gccugugccugccuggga

SEQ ID NO: 1047846 - RNA, 14 nt, Homo sapiens
gccuguuccaugaa

SEQ ID NO: 1047847 - RNA, 20 nt, Homo sapiens
gccuguugaagaugcuugua

SEQ ID NO: 1047848 - RNA, 21 nt, Homo sapiens
gccuucacuccggugugccug

SEQ ID NO: 1047849 - RNA, 14 nt, Homo sapiens
gccuucauaagccu

SEQ ID NO: 1047850 - RNA, 18 nt, Homo sapiens
gccuucccaggaguacac

SEQ ID NO: 1047851 - RNA, 18 nt, Homo sapiens
gccuucccugacuuacaa

SEQ ID NO: 1047852 - RNA, 16 nt, Homo sapiens
gccuuccucugcagcu

SEQ ID NO: 1047853 - RNA, 13 nt, Homo sapiens
gccuucucaggaa

SEQ ID NO: 1047854 - RNA, 15 nt, Homo sapiens
gccuucuucacccag

SEQ ID NO: 1047855 - RNA, 15 nt, Homo sapiens
gccuugccuccucac

SEQ ID NO: 1047856 - RNA, 14 nt, Homo sapiens
gccuugggcuucau

SEQ ID NO: 1047857 - RNA, 13 nt, Homo sapiens
gccuuucucccag

SEQ ID NO: 1047858 - RNA, 23 nt, Homo sapiens
gccuuuggauugacucugcauuu

SEQ ID NO: 1047859 - RNA, 22 nt, Homo sapiens
gccuuuugcucacaaaaccugg

SEQ ID NO: 1047860 - RNA, 17 nt, Homo sapiens
gcgaaaaaaucagugaa

SEQ ID NO: 1047861 - RNA, 14 nt, Homo sapiens
gcgacagagccaga

SEQ ID NO: 1047862 - RNA, 15 nt, Homo sapiens
gcgagacuccgucuc

SEQ ID NO: 1047863 - RNA, 19 nt, Homo sapiens
gcgagacuccgucucaaaa

SEQ ID NO: 1047864 - RNA, 16 nt, Homo sapiens
gcgauuacaggcauga

SEQ ID NO: 1047865 - RNA, 16 nt, Homo sapiens
gcgauucuggauaaag

SEQ ID NO: 1047866 - RNA, 21 nt, Homo sapiens
gcgauucuggauaaagccacu

SEQ ID NO: 1047867 - RNA, 17 nt, Homo sapiens
gcgauugaaagggcaau

SEQ ID NO: 1047868 - RNA, 15 nt, Homo sapiens
gcgccacugcacucc

SEQ ID NO: 1047869 - RNA, 23 nt, Homo sapiens
gcgccccugccaccucccugacc

SEQ ID NO: 1047870 - RNA, 23 nt, Homo sapiens
gcgcccugcaccugacagcuuua

SEQ ID NO: 1047871 - RNA, 20 nt, Homo sapiens
gcgccgcaaaccacacugga

SEQ ID NO: 1047872 - RNA, 15 nt, Homo sapiens
gcgcuuggcaucaca

SEQ ID NO: 1047873 - RNA, 13 nt, Homo sapiens
gcggccugcugga

SEQ ID NO: 1047874 - RNA, 12 nt, Homo sapiens
gcggcucuccag

SEQ ID NO: 1047875 - RNA, 16 nt, Homo sapiens
gcguaguccgcuuucu

SEQ ID NO: 1047876 - RNA, 12 nt, Homo sapiens
gcgucacuguga

SEQ ID NO: 1047877 - RNA, 22 nt, Homo sapiens
gcgugaucucggcucacugcaa

SEQ ID NO: 1047878 - RNA, 12 nt, Homo sapiens
gcgugcacacac

SEQ ID NO: 1047879 - RNA, 13 nt, Homo sapiens
gcgugguggcaca

SEQ ID NO: 1047880 - RNA, 16 nt, Homo sapiens
gcguguguacacggga

SEQ ID NO: 1047881 - RNA, 14 nt, Homo sapiens
gcgugugugcaagu

SEQ ID NO: 1047882 - RNA, 13 nt, Homo sapiens
gcuaacacacagc

SEQ ID NO: 1047883 - RNA, 19 nt, Homo sapiens
gcuaacacacagcucccau

SEQ ID NO: 1047884 - RNA, 20 nt, Homo sapiens
gcuaacccccuucuacugag

SEQ ID NO: 1047885 - RNA, 20 nt, Homo sapiens
gcuaacuauauuugcuuuuu

SEQ ID NO: 1047886 - RNA, 21 nt, Homo sapiens
gcuaagauuuagagaugaauu

SEQ ID NO: 1047887 - RNA, 19 nt, Homo sapiens
gcuaaggaguaguggcccu

SEQ ID NO: 1047888 - RNA, 17 nt, Homo sapiens
gcuacccaugacuuuau

SEQ ID NO: 1047889 - RNA, 15 nt, Homo sapiens
gcuacccgcagaguu

SEQ ID NO: 1047890 - RNA, 14 nt, Homo sapiens
aaaugacccaaaga

SEQ ID NO: 1047891 - RNA, 12 nt, Homo sapiens
aaaugagacaaa

SEQ ID NO: 1047892 - RNA, 24 nt, Homo sapiens
aaaugagagaagggacacauucaa

SEQ ID NO: 1047893 - RNA, 14 nt, Homo sapiens
aaaugcagugaauu

SEQ ID NO: 1047894 - RNA, 20 nt, Homo sapiens
aaaugcauauccugagccau

SEQ ID NO: 1047895 - RNA, 13 nt, Homo sapiens
aaaugcauggugc

SEQ ID NO: 1047896 - RNA, 17 nt, Homo sapiens
aaaugcauggugcaguu

SEQ ID NO: 1047897 - RNA, 21 nt, Homo sapiens
aaaugcccaucuaugucccuu

SEQ ID NO: 1047898 - RNA, 16 nt, Homo sapiens
aaaugcugguuuuuca

SEQ ID NO: 1047899 - RNA, 16 nt, Homo sapiens
aaaugcuuuuccucaa

SEQ ID NO: 1047900 - RNA, 20 nt, Homo sapiens
aaauggagaagaaaggccau

SEQ ID NO: 1047901 - RNA, 15 nt, Homo sapiens
aaauggaggccuguc

SEQ ID NO: 1047902 - RNA, 15 nt, Homo sapiens
aaauguaaagccagc

SEQ ID NO: 1047903 - RNA, 17 nt, Homo sapiens
aaauguagguaugaaua

SEQ ID NO: 1047904 - RNA, 17 nt, Homo sapiens
aaauguaugcuuuguac

SEQ ID NO: 1047905 - RNA, 19 nt, Homo sapiens
aaaugucaucagaacuuuu

SEQ ID NO: 1047906 - RNA, 13 nt, Homo sapiens
aaauguccaugau

SEQ ID NO: 1047907 - RNA, 19 nt, Homo sapiens
aaaugucuaagguccccac

SEQ ID NO: 1047908 - RNA, 21 nt, Homo sapiens
aaaugucuucuguauucacuu

SEQ ID NO: 1047909 - RNA, 23 nt, Homo sapiens
aaaugucuuuccuuuugcucuua

SEQ ID NO: 1047910 - RNA, 14 nt, Homo sapiens
aaaugugcuuaugu

SEQ ID NO: 1047911 - RNA, 18 nt, Homo sapiens
aaauguggcccccagugg

SEQ ID NO: 1047912 - RNA, 22 nt, Homo sapiens
aaauguguaauuuuguuuauau

SEQ ID NO: 1047913 - RNA, 19 nt, Homo sapiens
aaauguucagaagguugcu

SEQ ID NO: 1047914 - RNA, 23 nt, Homo sapiens
aaauguuccauauguggguguca

SEQ ID NO: 1047915 - RNA, 12 nt, Homo sapiens
aaauguuucuca

SEQ ID NO: 1047916 - RNA, 19 nt, Homo sapiens
aaauuaaaacaugcacaaa

SEQ ID NO: 1047917 - RNA, 15 nt, Homo sapiens
aaauuaaaagcccua

SEQ ID NO: 1047918 - RNA, 18 nt, Homo sapiens
aaauuaaauugcagaugg

SEQ ID NO: 1047919 - RNA, 21 nt, Homo sapiens
aaauuacuucccccacuacuu

SEQ ID NO: 1047920 - RNA, 20 nt, Homo sapiens
aaauuagaaaguagccacgu

SEQ ID NO: 1047921 - RNA, 17 nt, Homo sapiens
aaauuagaaucugagua

SEQ ID NO: 1047922 - RNA, 12 nt, Homo sapiens
aaauuagcaaaa

SEQ ID NO: 1047923 - RNA, 17 nt, Homo sapiens
aaauuagcugugugaaa

SEQ ID NO: 1047924 - RNA, 13 nt, Homo sapiens
aaauuagcuugag

SEQ ID NO: 1047925 - RNA, 17 nt, Homo sapiens
aaauuauguauguuuac

SEQ ID NO: 1047926 - RNA, 18 nt, Homo sapiens
aaauuauguauguuuaca

SEQ ID NO: 1047927 - RNA, 21 nt, Homo sapiens
aaauuauuuuaaaaacuaaaa

SEQ ID NO: 1047928 - RNA, 14 nt, Homo sapiens
aaauucaaacugcc

SEQ ID NO: 1047929 - RNA, 17 nt, Homo sapiens
aaauucaaccacuguaa

SEQ ID NO: 1047930 - RNA, 23 nt, Homo sapiens
aaauucauacauaguacauacaa

SEQ ID NO: 1047931 - RNA, 20 nt, Homo sapiens
aaauucaucaaauggaagac

SEQ ID NO: 1047932 - RNA, 20 nt, Homo sapiens
aaauucauggugcacugagc

SEQ ID NO: 1047933 - RNA, 17 nt, Homo sapiens
aaauucccuucaucugg

SEQ ID NO: 1047934 - RNA, 18 nt, Homo sapiens
aaauucucaaccuaccac

SEQ ID NO: 1047935 - RNA, 24 nt, Homo sapiens
aaauucucagucaguaauugccaa

SEQ ID NO: 1047936 - RNA, 21 nt, Homo sapiens
aaauucuguuuuucuaggccu

SEQ ID NO: 1047937 - RNA, 12 nt, Homo sapiens
aaauucuuucag

SEQ ID NO: 1047938 - RNA, 13 nt, Homo sapiens
aaauugaacucuu

SEQ ID NO: 1047939 - RNA, 20 nt, Homo sapiens
aaauugcacuuuuaaaccuc

SEQ ID NO: 1047940 - RNA, 15 nt, Homo sapiens
aaauugccuaaagag

SEQ ID NO: 1047941 - RNA, 15 nt, Homo sapiens
aaauuguauuaucaa

SEQ ID NO: 1047942 - RNA, 22 nt, Homo sapiens
aaauuguauuaucaacagcauu

SEQ ID NO: 1047943 - RNA, 18 nt, Homo sapiens
aaauuuaauauagcuauu

SEQ ID NO: 1047944 - RNA, 12 nt, Homo sapiens
aaauuuacuuuu

SEQ ID NO: 1047945 - RNA, 20 nt, Homo sapiens
aaauuuauuuauauuucaag

SEQ ID NO: 1047946 - RNA, 23 nt, Homo sapiens
aaauuucaccauugcugucaagu

SEQ ID NO: 1047947 - RNA, 13 nt, Homo sapiens
aaauuuccagaga

SEQ ID NO: 1047948 - RNA, 19 nt, Homo sapiens
aaauuuccagugagcuuau

SEQ ID NO: 1047949 - RNA, 16 nt, Homo sapiens
aaauuugagagacaaa

SEQ ID NO: 1047950 - RNA, 16 nt, Homo sapiens
aaauuugcuauuccca

SEQ ID NO: 1047951 - RNA, 13 nt, Homo sapiens
aaauuuguaaguu

SEQ ID NO: 1047952 - RNA, 21 nt, Homo sapiens
aacaaaaaaaccucuaugcaa

SEQ ID NO: 1047953 - RNA, 20 nt, Homo sapiens
aacaaaaauguaaugaucau

SEQ ID NO: 1047954 - RNA, 20 nt, Homo sapiens
aacaaaaauuaaaauccuca

SEQ ID NO: 1047955 - RNA, 13 nt, Homo sapiens
aacaaagaagaca

SEQ ID NO: 1047956 - RNA, 16 nt, Homo sapiens
aacaaagucacccacu

SEQ ID NO: 1047957 - RNA, 16 nt, Homo sapiens
aacaaauguauuucaa

SEQ ID NO: 1047958 - RNA, 18 nt, Homo sapiens
aacaaauuagguuuugua

SEQ ID NO: 1047959 - RNA, 22 nt, Homo sapiens
aacaaauuagguuuuguacaau

SEQ ID NO: 1047960 - RNA, 23 nt, Homo sapiens
aacaaauucauauucugucugga

SEQ ID NO: 1047961 - RNA, 14 nt, Homo sapiens
aacaacaaauaauu

SEQ ID NO: 1047962 - RNA, 16 nt, Homo sapiens
aacaacagaucugcag

SEQ ID NO: 1047963 - RNA, 12 nt, Homo sapiens
aacaacuguggu

SEQ ID NO: 1047964 - RNA, 15 nt, Homo sapiens
aacaacuucuuugua

SEQ ID NO: 1047965 - RNA, 14 nt, Homo sapiens
aacaagaauuggaa

SEQ ID NO: 1047966 - RNA, 16 nt, Homo sapiens
aacaagcaagcuccca

SEQ ID NO: 1047967 - RNA, 22 nt, Homo sapiens
aacaagccaacgacaaagccaa

SEQ ID NO: 1047968 - RNA, 12 nt, Homo sapiens
aacaaguagcua

SEQ ID NO: 1047969 - RNA, 17 nt, Homo sapiens
aacaaguuuuucuguca

SEQ ID NO: 1047970 - RNA, 21 nt, Homo sapiens
aacaauacaugcugcuaauuc

SEQ ID NO: 1047971 - RNA, 14 nt, Homo sapiens
aacaauccaucucu

SEQ ID NO: 1047972 - RNA, 22 nt, Homo sapiens
aacaauuccaaaggaaucucca

SEQ ID NO: 1047973 - RNA, 21 nt, Homo sapiens
aacaauucuuauugacucaua

SEQ ID NO: 1047974 - RNA, 14 nt, Homo sapiens
aacacaagccacag

SEQ ID NO: 1047975 - RNA, 14 nt, Homo sapiens
aacacacugaggca

SEQ ID NO: 1047976 - RNA, 19 nt, Homo sapiens
aacacagacauucugccag

SEQ ID NO: 1047977 - RNA, 14 nt, Homo sapiens
aacacauacaggaa

SEQ ID NO: 1047978 - RNA, 20 nt, Homo sapiens
aacacauuuuguauaauugu

SEQ ID NO: 1047979 - RNA, 15 nt, Homo sapiens
aacacccaugaauca

SEQ ID NO: 1047980 - RNA, 13 nt, Homo sapiens
aacaccuccucau

SEQ ID NO: 1047981 - RNA, 17 nt, Homo sapiens
aacaccugauguguaca

SEQ ID NO: 1047982 - RNA, 19 nt, Homo sapiens
aacacguuuuuucacuauu

SEQ ID NO: 1047983 - RNA, 19 nt, Homo sapiens
aacacuaguuuugugccag

SEQ ID NO: 1047984 - RNA, 14 nt, Homo sapiens
aacagaacuaugga

SEQ ID NO: 1047985 - RNA, 18 nt, Homo sapiens
aacagagacuucuagaca

SEQ ID NO: 1047986 - RNA, 19 nt, Homo sapiens
aacagaggaguacagguga

SEQ ID NO: 1047987 - RNA, 12 nt, Homo sapiens
aacagaguaaau

SEQ ID NO: 1047988 - RNA, 16 nt, Homo sapiens
aacagaucuugaaauc

SEQ ID NO: 1047989 - RNA, 22 nt, Homo sapiens
aacagauggauagucuguccaa

SEQ ID NO: 1047990 - RNA, 17 nt, Homo sapiens
aacagauggcacuuuga

SEQ ID NO: 1047991 - RNA, 15 nt, Homo sapiens
aacagaugugucagc

SEQ ID NO: 1047992 - RNA, 13 nt, Homo sapiens
aacagcacccucu

SEQ ID NO: 1047993 - RNA, 18 nt, Homo sapiens
aacagcacuggcucucuc

SEQ ID NO: 1047994 - RNA, 19 nt, Homo sapiens
aacagccaaaaaggacuuu

SEQ ID NO: 1047995 - RNA, 15 nt, Homo sapiens
aacagccaaaugcau

SEQ ID NO: 1047996 - RNA, 20 nt, Homo sapiens
aacagccacuacauuacuuc

SEQ ID NO: 1047997 - RNA, 22 nt, Homo sapiens
aacagcguguucuaaguauuug

SEQ ID NO: 1047998 - RNA, 19 nt, Homo sapiens
aacagggcaucuccaggaa

SEQ ID NO: 1047999 - RNA, 16 nt, Homo sapiens
aacaguaacugccauc

SEQ ID NO: 1048000 - RNA, 14 nt, Homo sapiens
aacaguccuucaaa

SEQ ID NO: 1048001 - RNA, 14 nt, Homo sapiens
aacagucucaggaa

SEQ ID NO: 1048002 - RNA, 14 nt, Homo sapiens
aacaguuacuccag

SEQ ID NO: 1048003 - RNA, 16 nt, Homo sapiens
aacauacuucagcuca

SEQ ID NO: 1048004 - RNA, 22 nt, Homo sapiens
aacauagugaaaccccaucucu

SEQ ID NO: 1048005 - RNA, 21 nt, Homo sapiens
aacaucaauuccaguggaaca

SEQ ID NO: 1048006 - RNA, 20 nt, Homo sapiens
aacaucccugccagcucuuc

SEQ ID NO: 1048007 - RNA, 19 nt, Homo sapiens
aacauccuucaagaacucu

SEQ ID NO: 1048008 - RNA, 21 nt, Homo sapiens
aacaucuuggucagauuugaa

SEQ ID NO: 1048009 - RNA, 18 nt, Homo sapiens
aacaucuuuuacauucug

SEQ ID NO: 1048010 - RNA, 15 nt, Homo sapiens
aacauggacuuguau

SEQ ID NO: 1048011 - RNA, 14 nt, Homo sapiens
aacauggccuuugc

SEQ ID NO: 1048012 - RNA, 16 nt, Homo sapiens
aacauggccuuugcuu

SEQ ID NO: 1048013 - RNA, 16 nt, Homo sapiens
aacaugguaaaacccc

SEQ ID NO: 1048014 - RNA, 23 nt, Homo sapiens
aacauggugaaaccucaucucua

SEQ ID NO: 1048015 - RNA, 21 nt, Homo sapiens
aacaugguuacaaucauugcu

SEQ ID NO: 1048016 - RNA, 15 nt, Homo sapiens
aacauguacacuggu

SEQ ID NO: 1048017 - RNA, 13 nt, Homo sapiens
aacaugugcucag

SEQ ID NO: 1048018 - RNA, 21 nt, Homo sapiens
aacauguuagaagcaaugaau

SEQ ID NO: 1048019 - RNA, 14 nt, Homo sapiens
aacauguucacuua

SEQ ID NO: 1048020 - RNA, 22 nt, Homo sapiens
aacauguuccugggaucacuga

SEQ ID NO: 1048021 - RNA, 22 nt, Homo sapiens
aacauguuuugugcagcacagu

SEQ ID NO: 1048022 - RNA, 14 nt, Homo sapiens
aacauuuacaugua

SEQ ID NO: 1048023 - RNA, 14 nt, Homo sapiens
aacauuuucuugaa

SEQ ID NO: 1048024 - RNA, 23 nt, Homo sapiens
aaccaaaaaaguuacaacuuccu

SEQ ID NO: 1048025 - RNA, 15 nt, Homo sapiens
aaccaagggggauga

SEQ ID NO: 1048026 - RNA, 22 nt, Homo sapiens
aaccaagggggaugacauguga

SEQ ID NO: 1048027 - RNA, 15 nt, Homo sapiens
aaccaauagcuuuaa

SEQ ID NO: 1048028 - RNA, 11 nt, Homo sapiens
aaccacaucaa

SEQ ID NO: 1048029 - RNA, 11 nt, Homo sapiens
aaccacugugg

SEQ ID NO: 1048030 - RNA, 18 nt, Homo sapiens
aaccacuucauucuugaa

SEQ ID NO: 1048031 - RNA, 14 nt, Homo sapiens
aaccacuucccuca

SEQ ID NO: 1048032 - RNA, 21 nt, Homo sapiens
aaccagagccugaguguugcc

SEQ ID NO: 1048033 - RNA, 19 nt, Homo sapiens
aaccagcaucccuugacca

SEQ ID NO: 1048034 - RNA, 20 nt, Homo sapiens
aaccaggaauccacucucca

SEQ ID NO: 1048035 - RNA, 18 nt, Homo sapiens
aaccaguuaugugaauga

SEQ ID NO: 1048036 - RNA, 20 nt, Homo sapiens
aaccauuucagcuguuucac

SEQ ID NO: 1048037 - RNA, 21 nt, Homo sapiens
aacccacugaaccuucugagc

SEQ ID NO: 1048038 - RNA, 20 nt, Homo sapiens
aacccaggagauggaaguug

SEQ ID NO: 1048039 - RNA, 15 nt, Homo sapiens
gcuaccucaaccaau

SEQ ID NO: 1048040 - RNA, 19 nt, Homo sapiens
gcuaccucacuaugcugcu

SEQ ID NO: 1048041 - RNA, 14 nt, Homo sapiens
gcuaccucuucuau

SEQ ID NO: 1048042 - RNA, 13 nt, Homo sapiens
gcuacgugugauu

SEQ ID NO: 1048043 - RNA, 18 nt, Homo sapiens
gcuacucagaagccugag

SEQ ID NO: 1048044 - RNA, 15 nt, Homo sapiens
gcuagaaauaagccc

SEQ ID NO: 1048045 - RNA, 13 nt, Homo sapiens
gcuagaaccugga

SEQ ID NO: 1048046 - RNA, 13 nt, Homo sapiens
gcuagaaggccac

SEQ ID NO: 1048047 - RNA, 18 nt, Homo sapiens
gcuagacaagcuugucca

SEQ ID NO: 1048048 - RNA, 18 nt, Homo sapiens
gcuagaggacuucuggca

SEQ ID NO: 1048049 - RNA, 19 nt, Homo sapiens
gcuagagugcaguggcaug

SEQ ID NO: 1048050 - RNA, 12 nt, Homo sapiens
gcuagaugggca

SEQ ID NO: 1048051 - RNA, 21 nt, Homo sapiens
gcuagcugcaagugacaucuc

SEQ ID NO: 1048052 - RNA, 17 nt, Homo sapiens
gcuaggaaugaaauccu

SEQ ID NO: 1048053 - RNA, 16 nt, Homo sapiens
gcuaguuugaccucau

SEQ ID NO: 1048054 - RNA, 14 nt, Homo sapiens
gcuauagcuacagg

SEQ ID NO: 1048055 - RNA, 15 nt, Homo sapiens
gcuauauccauguac

SEQ ID NO: 1048056 - RNA, 23 nt, Homo sapiens
gcuaucccuuuccaaaggccaug

SEQ ID NO: 1048057 - RNA, 17 nt, Homo sapiens
gcuaucgcaccacugug

SEQ ID NO: 1048058 - RNA, 13 nt, Homo sapiens
gcuaugcauuuga

SEQ ID NO: 1048059 - RNA, 14 nt, Homo sapiens
gcuauucaccaaua

SEQ ID NO: 1048060 - RNA, 15 nt, Homo sapiens
gcuauuuccauucca

SEQ ID NO: 1048061 - RNA, 11 nt, Homo sapiens
gcuauuugccu

SEQ ID NO: 1048062 - RNA, 21 nt, Homo sapiens
gcucaaagcguggacaggugu

SEQ ID NO: 1048063 - RNA, 16 nt, Homo sapiens
gcucaacuagcagaua

SEQ ID NO: 1048064 - RNA, 19 nt, Homo sapiens
gcucaauauuccugaauga

SEQ ID NO: 1048065 - RNA, 18 nt, Homo sapiens
gcucaauuuaauuuugca

SEQ ID NO: 1048066 - RNA, 19 nt, Homo sapiens
gcucacaaaccaugcaaau

SEQ ID NO: 1048067 - RNA, 17 nt, Homo sapiens
gcucacacaugagaucu

SEQ ID NO: 1048068 - RNA, 17 nt, Homo sapiens
aaccuuccaucucgcca

SEQ ID NO: 1048069 - RNA, 20 nt, Homo sapiens
aaccuucgccucccagguuc

SEQ ID NO: 1048070 - RNA, 15 nt, Homo sapiens
aaccuuuacauccag

SEQ ID NO: 1048071 - RNA, 16 nt, Homo sapiens
aaccuuucaaauuuca

SEQ ID NO: 1048072 - RNA, 21 nt, Homo sapiens
aacgcacacaguaucuaguca

SEQ ID NO: 1048073 - RNA, 13 nt, Homo sapiens
aacggcaagggaa

SEQ ID NO: 1048074 - RNA, 14 nt, Homo sapiens
aacggcccucuuga

SEQ ID NO: 1048075 - RNA, 21 nt, Homo sapiens
aacguagcuucuaccaugaac

SEQ ID NO: 1048076 - RNA, 22 nt, Homo sapiens
aacguagcuucuaccaugaaca

SEQ ID NO: 1048077 - RNA, 12 nt, Homo sapiens
aacguggcccag

SEQ ID NO: 1048078 - RNA, 14 nt, Homo sapiens
aacuaaacuuucac

SEQ ID NO: 1048079 - RNA, 17 nt, Homo sapiens
aacuaagaaauaugcac

SEQ ID NO: 1048080 - RNA, 19 nt, Homo sapiens
aacuaagaaauaugcacaa

SEQ ID NO: 1048081 - RNA, 17 nt, Homo sapiens
aacuaagaugcugccug

SEQ ID NO: 1048082 - RNA, 22 nt, Homo sapiens
aacuaagcccccgcuguaauga

SEQ ID NO: 1048083 - RNA, 17 nt, Homo sapiens
aacuaccuccucagucu

SEQ ID NO: 1048084 - RNA, 14 nt, Homo sapiens
aacuacucagggaa

SEQ ID NO: 1048085 - RNA, 15 nt, Homo sapiens
aacuacuggcaauuu

SEQ ID NO: 1048086 - RNA, 21 nt, Homo sapiens
aacuacuguguuccuggcaau

SEQ ID NO: 1048087 - RNA, 17 nt, Homo sapiens
aacuagaaaucugccaa

SEQ ID NO: 1048088 - RNA, 17 nt, Homo sapiens
aacuagaauuuauucaa

SEQ ID NO: 1048089 - RNA, 17 nt, Homo sapiens
aacuagacauucugucg

SEQ ID NO: 1048090 - RNA, 14 nt, Homo sapiens
aacuagccaaucag

SEQ ID NO: 1048091 - RNA, 18 nt, Homo sapiens
aacuagcuuggaaacugg

SEQ ID NO: 1048092 - RNA, 19 nt, Homo sapiens
aacuagggaagauaauauu

SEQ ID NO: 1048093 - RNA, 16 nt, Homo sapiens
aacuaguguugcuugg

SEQ ID NO: 1048094 - RNA, 14 nt, Homo sapiens
aacuauauucucag

SEQ ID NO: 1048095 - RNA, 15 nt, Homo sapiens
aacuaucagaggaaa

SEQ ID NO: 1048096 - RNA, 14 nt, Homo sapiens
aacuaucugaacca

SEQ ID NO: 1048097 - RNA, 10 nt, Homo sapiens
aacuauuuau

SEQ ID NO: 1048098 - RNA, 16 nt, Homo sapiens
aacucaaacucuuaaa

SEQ ID NO: 1048099 - RNA, 20 nt, Homo sapiens
aacucaaacucuuaaaaccc

SEQ ID NO: 1048100 - RNA, 16 nt, Homo sapiens
aacucaacuuugacaa

SEQ ID NO: 1048101 - RNA, 19 nt, Homo sapiens
aacucaauauuuuccauga

SEQ ID NO: 1048102 - RNA, 14 nt, Homo sapiens
aacucagagccucc

SEQ ID NO: 1048103 - RNA, 22 nt, Homo sapiens
aacucagagucggaacggagaa

SEQ ID NO: 1048104 - RNA, 17 nt, Homo sapiens
aacucagaucugucuga

SEQ ID NO: 1048105 - RNA, 12 nt, Homo sapiens
aacucaguguga

SEQ ID NO: 1048106 - RNA, 13 nt, Homo sapiens
aacuccaucucaa

SEQ ID NO: 1048107 - RNA, 16 nt, Homo sapiens
aacuccuauaauuccc

SEQ ID NO: 1048108 - RNA, 13 nt, Homo sapiens
aacucucauuucu

SEQ ID NO: 1048109 - RNA, 21 nt, Homo sapiens
aacucuccaucuuauuuucau

SEQ ID NO: 1048110 - RNA, 13 nt, Homo sapiens
aacucuccuccau

SEQ ID NO: 1048111 - RNA, 16 nt, Homo sapiens
aacucugcacuacucc

SEQ ID NO: 1048112 - RNA, 18 nt, Homo sapiens
aacucugggcugccaugu

SEQ ID NO: 1048113 - RNA, 20 nt, Homo sapiens
aacucugucuucaccugauu

SEQ ID NO: 1048114 - RNA, 22 nt, Homo sapiens
aacucugucuucaccugauuca

SEQ ID NO: 1048115 - RNA, 13 nt, Homo sapiens
aacucuuaucuca

SEQ ID NO: 1048116 - RNA, 14 nt, Homo sapiens
aacucuugaccuca

SEQ ID NO: 1048117 - RNA, 20 nt, Homo sapiens
aacugaaaauacuuaggaag

SEQ ID NO: 1048118 - RNA, 14 nt, Homo sapiens
aacugaagccagaa

SEQ ID NO: 1048119 - RNA, 20 nt, Homo sapiens
aacugaccagccuccaugcu

SEQ ID NO: 1048120 - RNA, 13 nt, Homo sapiens
aacugacugccuu

SEQ ID NO: 1048121 - RNA, 14 nt, Homo sapiens
aacugacuuuaucc

SEQ ID NO: 1048122 - RNA, 23 nt, Homo sapiens
aacugagauuacaggcacccacc

SEQ ID NO: 1048123 - RNA, 14 nt, Homo sapiens
aacugcacugucaa

SEQ ID NO: 1048124 - RNA, 12 nt, Homo sapiens
aacugccagcaa

SEQ ID NO: 1048125 - RNA, 18 nt, Homo sapiens
aacugcugcugugcacau

SEQ ID NO: 1048126 - RNA, 22 nt, Homo sapiens
aacugcugcugugcacauuuau

SEQ ID NO: 1048127 - RNA, 16 nt, Homo sapiens
aacuggaugaggucau

SEQ ID NO: 1048128 - RNA, 17 nt, Homo sapiens
aacuggcaguuuuccau

SEQ ID NO: 1048129 - RNA, 11 nt, Homo sapiens
aacuggcugca

SEQ ID NO: 1048130 - RNA, 14 nt, Homo sapiens
aacuguacuacauc

SEQ ID NO: 1048131 - RNA, 20 nt, Homo sapiens
aacuguacuacaucuaguua

SEQ ID NO: 1048132 - RNA, 15 nt, Homo sapiens
aacugugcuccucac

SEQ ID NO: 1048133 - RNA, 14 nt, Homo sapiens
aacuguguuuacuc

SEQ ID NO: 1048134 - RNA, 22 nt, Homo sapiens
aacuuaagcugggauaaucaca

SEQ ID NO: 1048135 - RNA, 20 nt, Homo sapiens
aacuuaccgugagcgacaaa

SEQ ID NO: 1048136 - RNA, 16 nt, Homo sapiens
aacuuagcucacaccu

SEQ ID NO: 1048137 - RNA, 19 nt, Homo sapiens
aacuuauaucaucagcaua

SEQ ID NO: 1048138 - RNA, 14 nt, Homo sapiens
aacuuaucaucaca

SEQ ID NO: 1048139 - RNA, 13 nt, Homo sapiens
aacuucaagcaaa

SEQ ID NO: 1048140 - RNA, 15 nt, Homo sapiens
aacuucagccagcua

SEQ ID NO: 1048141 - RNA, 20 nt, Homo sapiens
aacuuccagugcaacacuga

SEQ ID NO: 1048142 - RNA, 21 nt, Homo sapiens
aacuuccagugcaacacugaa

SEQ ID NO: 1048143 - RNA, 22 nt, Homo sapiens
aacuuccuuggacucauuuuaa

SEQ ID NO: 1048144 - RNA, 20 nt, Homo sapiens
aacuucuacuucugcccuug

SEQ ID NO: 1048145 - RNA, 19 nt, Homo sapiens
aacuucuuuaaaaaaacac

SEQ ID NO: 1048146 - RNA, 18 nt, Homo sapiens
aacuucuuuuaaaccuca

SEQ ID NO: 1048147 - RNA, 20 nt, Homo sapiens
aacuugauguguuaucucuu

SEQ ID NO: 1048148 - RNA, 20 nt, Homo sapiens
aacuuggagccccagugcca

SEQ ID NO: 1048149 - RNA, 15 nt, Homo sapiens
aacuuggcacacucu

SEQ ID NO: 1048150 - RNA, 18 nt, Homo sapiens
aacuugggggaggaggaa

SEQ ID NO: 1048151 - RNA, 17 nt, Homo sapiens
aacuuucuuacacugaa

SEQ ID NO: 1048152 - RNA, 23 nt, Homo sapiens
aacuuugacaaccaugagaccac

SEQ ID NO: 1048153 - RNA, 15 nt, Homo sapiens
aacuuuguaugucau

SEQ ID NO: 1048154 - RNA, 22 nt, Homo sapiens
aacuuuguggaugucuuccuug

SEQ ID NO: 1048155 - RNA, 20 nt, Homo sapiens
aacuuuuaauuaaaugcuca

SEQ ID NO: 1048156 - RNA, 13 nt, Homo sapiens
aacuuuugugcuc

SEQ ID NO: 1048157 - RNA, 16 nt, Homo sapiens
aacuuuugugcucccc

SEQ ID NO: 1048158 - RNA, 19 nt, Homo sapiens
aagaaaagugggccagugu

SEQ ID NO: 1048159 - RNA, 15 nt, Homo sapiens
aagaaaauaccaagg

SEQ ID NO: 1048160 - RNA, 17 nt, Homo sapiens
aagaaaauaccaaggaa

SEQ ID NO: 1048161 - RNA, 18 nt, Homo sapiens
aagaaaauaugcaucuaa

SEQ ID NO: 1048162 - RNA, 15 nt, Homo sapiens
aagaaaaugauugcu

SEQ ID NO: 1048163 - RNA, 22 nt, Homo sapiens
aagaaaccuucagauuuguguu

SEQ ID NO: 1048164 - RNA, 13 nt, Homo sapiens
aagaaaccuucau

SEQ ID NO: 1048165 - RNA, 18 nt, Homo sapiens
aagaaacugcucuaauau

SEQ ID NO: 1048166 - RNA, 17 nt, Homo sapiens
aagaaaguguuggcuaa

SEQ ID NO: 1048167 - RNA, 18 nt, Homo sapiens
aagaaauauauacuugag

SEQ ID NO: 1048168 - RNA, 19 nt, Homo sapiens
aagaaauuaugucagcuua

SEQ ID NO: 1048169 - RNA, 17 nt, Homo sapiens
aagaaauuccuguagca

SEQ ID NO: 1048170 - RNA, 21 nt, Homo sapiens
aagaaauuccuguagcaucuu

SEQ ID NO: 1048171 - RNA, 13 nt, Homo sapiens
aagaaauucugca

SEQ ID NO: 1048172 - RNA, 23 nt, Homo sapiens
aagaaauucugcaagcuuuucaa

SEQ ID NO: 1048173 - RNA, 17 nt, Homo sapiens
aagaacaguaacugcca

SEQ ID NO: 1048174 - RNA, 18 nt, Homo sapiens
aagaacauggacuuguau

SEQ ID NO: 1048175 - RNA, 17 nt, Homo sapiens
aagaaccaaaagagauc

SEQ ID NO: 1048176 - RNA, 16 nt, Homo sapiens
aagaaccgagcaauuu

SEQ ID NO: 1048177 - RNA, 21 nt, Homo sapiens
aagaacuuggcacacucucca

SEQ ID NO: 1048178 - RNA, 16 nt, Homo sapiens
aagaagacauggagac

SEQ ID NO: 1048179 - RNA, 13 nt, Homo sapiens
aagaagaccagac

SEQ ID NO: 1048180 - RNA, 15 nt, Homo sapiens
aagaagcucucuccu

SEQ ID NO: 1048181 - RNA, 22 nt, Homo sapiens
aagaagcugcuguucuuagcaa

SEQ ID NO: 1048182 - RNA, 16 nt, Homo sapiens
aagaagcuuuaauauu

SEQ ID NO: 1048183 - RNA, 17 nt, Homo sapiens
aagaagguuaccaagaa

SEQ ID NO: 1048184 - RNA, 17 nt, Homo sapiens
aagaagugggacuuccc

SEQ ID NO: 1048185 - RNA, 15 nt, Homo sapiens
aagaaucaagcuaga

SEQ ID NO: 1048186 - RNA, 12 nt, Homo sapiens
aagaaugcugaa

SEQ ID NO: 1048187 - RNA, 16 nt, Homo sapiens
aagaaugcugaaacca

SEQ ID NO: 1048188 - RNA, 18 nt, Homo sapiens
aagaauggggaucacaga

SEQ ID NO: 1048189 - RNA, 23 nt, Homo sapiens
aagaauuuuuauauccacuaaaa

SEQ ID NO: 1048190 - RNA, 14 nt, Homo sapiens
aagacaacauuucu

SEQ ID NO: 1048191 - RNA, 14 nt, Homo sapiens
aagacacagacugc

SEQ ID NO: 1048192 - RNA, 16 nt, Homo sapiens
aagacagaugccccag

SEQ ID NO: 1048193 - RNA, 16 nt, Homo sapiens
aagacagucuuugggu

SEQ ID NO: 1048194 - RNA, 16 nt, Homo sapiens
gcuucauauaccagca

SEQ ID NO: 1048195 - RNA, 16 nt, Homo sapiens
gcuucauuuccugugu

SEQ ID NO: 1048196 - RNA, 16 nt, Homo sapiens
gcuuccgccgucucaa

SEQ ID NO: 1048197 - RNA, 17 nt, Homo sapiens
gcuuccggcuccugugc

SEQ ID NO: 1048198 - RNA, 20 nt, Homo sapiens
gcuucuauuagccagucuuu

SEQ ID NO: 1048199 - RNA, 20 nt, Homo sapiens
gcuucucuuuggaaacaaua

SEQ ID NO: 1048200 - RNA, 14 nt, Homo sapiens
gcuucugauaugca

SEQ ID NO: 1048201 - RNA, 21 nt, Homo sapiens
gcuucuggggguagaucucaa

SEQ ID NO: 1048202 - RNA, 13 nt, Homo sapiens
gcuucuuaaucuu

SEQ ID NO: 1048203 - RNA, 23 nt, Homo sapiens
gcuucuuuucacuucagagcaca

SEQ ID NO: 1048204 - RNA, 19 nt, Homo sapiens
gcuugaaaaaugugcaaaa

SEQ ID NO: 1048205 - RNA, 21 nt, Homo sapiens
gcuugagcaaccuggcuaaga

SEQ ID NO: 1048206 - RNA, 20 nt, Homo sapiens
gcuugaucaaaggcacacag

SEQ ID NO: 1048207 - RNA, 15 nt, Homo sapiens
gcuugcaagauucca

SEQ ID NO: 1048208 - RNA, 21 nt, Homo sapiens
gcuugccccacccaacaagcc

SEQ ID NO: 1048209 - RNA, 21 nt, Homo sapiens
gcuugcccuguuaaaagauga

SEQ ID NO: 1048210 - RNA, 10 nt, Homo sapiens
gcuugcucuu

SEQ ID NO: 1048211 - RNA, 23 nt, Homo sapiens
gcuuggaaacuggaugaggucau

SEQ ID NO: 1048212 - RNA, 13 nt, Homo sapiens
gcuuggaaaggac

SEQ ID NO: 1048213 - RNA, 21 nt, Homo sapiens
ggaguucacuucaucuucuca

SEQ ID NO: 1048214 - RNA, 18 nt, Homo sapiens
ggaguucucccaccaccu

SEQ ID NO: 1048215 - RNA, 16 nt, Homo sapiens
ggauaacacauuugau

SEQ ID NO: 1048216 - RNA, 17 nt, Homo sapiens
ggauacuggugcaguca

SEQ ID NO: 1048217 - RNA, 20 nt, Homo sapiens
ggauaguccaaagacuuaac

SEQ ID NO: 1048218 - RNA, 23 nt, Homo sapiens
ggauagugggcaccccacugcaa

SEQ ID NO: 1048219 - RNA, 22 nt, Homo sapiens
ggauauaggucagugaggccca

SEQ ID NO: 1048220 - RNA, 20 nt, Homo sapiens
ggauauuaacaacaauaaca

SEQ ID NO: 1048221 - RNA, 20 nt, Homo sapiens
ggaucaucuauugcuggcaa

SEQ ID NO: 1048222 - RNA, 17 nt, Homo sapiens
ggaucaugguguaauaa

SEQ ID NO: 1048223 - RNA, 14 nt, Homo sapiens
ggaucccaccccau

SEQ ID NO: 1048224 - RNA, 17 nt, Homo sapiens
ggaucgcaagagccaug

SEQ ID NO: 1048225 - RNA, 13 nt, Homo sapiens
ggaucuaccagca

SEQ ID NO: 1048226 - RNA, 17 nt, Homo sapiens
ggaucuaccagcauaaa

SEQ ID NO: 1048227 - RNA, 15 nt, Homo sapiens
ggaucuaccccagga

SEQ ID NO: 1048228 - RNA, 13 nt, Homo sapiens
ggaucugggcaaa

SEQ ID NO: 1048229 - RNA, 13 nt, Homo sapiens
ggaugaggucaua

SEQ ID NO: 1048230 - RNA, 19 nt, Homo sapiens
ggaugaucuugauuguggg

SEQ ID NO: 1048231 - RNA, 20 nt, Homo sapiens
ggaugauuauuuucuguucu

SEQ ID NO: 1048232 - RNA, 22 nt, Homo sapiens
ggaugauuauuuucuguucuau

SEQ ID NO: 1048233 - RNA, 22 nt, Homo sapiens
ggaugucuccgucucugucuca

SEQ ID NO: 1048234 - RNA, 15 nt, Homo sapiens
ggaugucucucauga

SEQ ID NO: 1048235 - RNA, 16 nt, Homo sapiens
ggauguucugggacac

SEQ ID NO: 1048236 - RNA, 21 nt, Homo sapiens
ggauguuuuuucccuguuuaa

SEQ ID NO: 1048237 - RNA, 13 nt, Homo sapiens
ggauuaugaagug

SEQ ID NO: 1048238 - RNA, 19 nt, Homo sapiens
ggauucuguacaugcauug

SEQ ID NO: 1048239 - RNA, 18 nt, Homo sapiens
ggauuuaacagucauuua

SEQ ID NO: 1048240 - RNA, 19 nt, Homo sapiens
ggauuuccagccagggcug

SEQ ID NO: 1048241 - RNA, 18 nt, Homo sapiens
ggcaaaaacuuccaucac

SEQ ID NO: 1048242 - RNA, 20 nt, Homo sapiens
ggcaaaacuuuggcacuggg

SEQ ID NO: 1048243 - RNA, 13 nt, Homo sapiens
ggcaaaaugucau

SEQ ID NO: 1048244 - RNA, 22 nt, Homo sapiens
ggcaaagagagucgcaucucag

SEQ ID NO: 1048245 - RNA, 15 nt, Homo sapiens
ggcaaagccuaguga

SEQ ID NO: 1048246 - RNA, 20 nt, Homo sapiens
ggcaaaggcucucacuccag

SEQ ID NO: 1048247 - RNA, 17 nt, Homo sapiens
ggcaacaauaaaauagc

SEQ ID NO: 1048248 - RNA, 21 nt, Homo sapiens
ggcaagcugugacuucuccag

SEQ ID NO: 1048249 - RNA, 22 nt, Homo sapiens
ggcaauaggugugaacagggaa

SEQ ID NO: 1048250 - RNA, 16 nt, Homo sapiens
ggcaauaguguguucu

SEQ ID NO: 1048251 - RNA, 15 nt, Homo sapiens
ggcacaacaucaagc

SEQ ID NO: 1048252 - RNA, 21 nt, Homo sapiens
ggcacaauuuuaauucaaaag

SEQ ID NO: 1048253 - RNA, 21 nt, Homo sapiens
ggcacacaucaggaguucaau

SEQ ID NO: 1048254 - RNA, 19 nt, Homo sapiens
ggcacacgccucccacugg

SEQ ID NO: 1048255 - RNA, 20 nt, Homo sapiens
ggcacagcauggagucacag

SEQ ID NO: 1048256 - RNA, 15 nt, Homo sapiens
ggcacauccuaugca

SEQ ID NO: 1048257 - RNA, 15 nt, Homo sapiens
ggcacauuccuugcc

SEQ ID NO: 1048258 - RNA, 19 nt, Homo sapiens
ggcacccggccccugcugg

SEQ ID NO: 1048259 - RNA, 13 nt, Homo sapiens
ggcaccugaccac

SEQ ID NO: 1048260 - RNA, 14 nt, Homo sapiens
ggcacgguggcuca

SEQ ID NO: 1048261 - RNA, 11 nt, Homo sapiens
ggcacgguggu

SEQ ID NO: 1048262 - RNA, 22 nt, Homo sapiens
ggcacucaauaaauauuuuugc

SEQ ID NO: 1048263 - RNA, 19 nt, Homo sapiens
ggcacucagaagacacuga

SEQ ID NO: 1048264 - RNA, 20 nt, Homo sapiens
ggcacucagaagacacugau

SEQ ID NO: 1048265 - RNA, 13 nt, Homo sapiens
ggcacucaggggg

SEQ ID NO: 1048266 - RNA, 13 nt, Homo sapiens
ggcacuucauuga

SEQ ID NO: 1048267 - RNA, 16 nt, Homo sapiens
ggcagaaaaaugucau

SEQ ID NO: 1048268 - RNA, 23 nt, Homo sapiens
ggcagacacuguuugcccagugu

SEQ ID NO: 1048269 - RNA, 13 nt, Homo sapiens
ggcagagccuuug

SEQ ID NO: 1048270 - RNA, 20 nt, Homo sapiens
ggcagagguugcaguguggu

SEQ ID NO: 1048271 - RNA, 19 nt, Homo sapiens
ggcagaguucuauaaugua

SEQ ID NO: 1048272 - RNA, 16 nt, Homo sapiens
ggcagcaggguggccu

SEQ ID NO: 1048273 - RNA, 14 nt, Homo sapiens
ggcagcaucuucac

SEQ ID NO: 1048274 - RNA, 12 nt, Homo sapiens
ggcagcauuuag

SEQ ID NO: 1048275 - RNA, 16 nt, Homo sapiens
ggcagcauuuagcaca

SEQ ID NO: 1048276 - RNA, 14 nt, Homo sapiens
ggcagccaccagcg

SEQ ID NO: 1048277 - RNA, 20 nt, Homo sapiens
ggcagccuggacauagagag

SEQ ID NO: 1048278 - RNA, 14 nt, Homo sapiens
ggcagcucagagag

SEQ ID NO: 1048279 - RNA, 14 nt, Homo sapiens
ggcagcucaucucu

SEQ ID NO: 1048280 - RNA, 17 nt, Homo sapiens
ggcagcuguugcaguga

SEQ ID NO: 1048281 - RNA, 19 nt, Homo sapiens
ggcagcuucuauuagccag

SEQ ID NO: 1048282 - RNA, 20 nt, Homo sapiens
ggcaggagaaucacuugaac

SEQ ID NO: 1048283 - RNA, 20 nt, Homo sapiens
ggcaggagaaucgcuugaac

SEQ ID NO: 1048284 - RNA, 24 nt, Homo sapiens
ggcauaggcugacuuuugcagaug

SEQ ID NO: 1048285 - RNA, 13 nt, Homo sapiens
ggcaucacagcua

SEQ ID NO: 1048286 - RNA, 22 nt, Homo sapiens
ggcaucuuugccuugggcugcu

SEQ ID NO: 1048287 - RNA, 15 nt, Homo sapiens
ggcaugcaugugcuu

SEQ ID NO: 1048288 - RNA, 18 nt, Homo sapiens
ggcauggagccagugccu

SEQ ID NO: 1048289 - RNA, 14 nt, Homo sapiens
ggcaugguggccca

SEQ ID NO: 1048290 - RNA, 23 nt, Homo sapiens
ggcauucuguggccagccaaaag

SEQ ID NO: 1048291 - RNA, 12 nt, Homo sapiens
ggcauuggccau

SEQ ID NO: 1048292 - RNA, 15 nt, Homo sapiens
ggcauuguaguuaau

SEQ ID NO: 1048293 - RNA, 20 nt, Homo sapiens
ggcauuugcaccuaccucac

SEQ ID NO: 1048294 - RNA, 22 nt, Homo sapiens
ggccaacauggugaaacccugu

SEQ ID NO: 1048295 - RNA, 18 nt, Homo sapiens
ggccaagcaccuagccuc

SEQ ID NO: 1048296 - RNA, 12 nt, Homo sapiens
ggccacacagaa

SEQ ID NO: 1048297 - RNA, 15 nt, Homo sapiens
ggccacaccaucucc

SEQ ID NO: 1048298 - RNA, 18 nt, Homo sapiens
ggccacagugcaauuuua

SEQ ID NO: 1048299 - RNA, 14 nt, Homo sapiens
ggccaccaggcugg

SEQ ID NO: 1048300 - RNA, 23 nt, Homo sapiens
ggccacugcugcuucuccauggc

SEQ ID NO: 1048301 - RNA, 18 nt, Homo sapiens
ggccagagggagugacag

SEQ ID NO: 1048302 - RNA, 17 nt, Homo sapiens
ggccagagucuguuuca

SEQ ID NO: 1048303 - RNA, 16 nt, Homo sapiens
ggccagcaccaucucu

SEQ ID NO: 1048304 - RNA, 15 nt, Homo sapiens
ggccagcccggcugg

SEQ ID NO: 1048305 - RNA, 17 nt, Homo sapiens
ggccaguaccuuuccau

SEQ ID NO: 1048306 - RNA, 23 nt, Homo sapiens
ggccaguaucuauauauguguau

SEQ ID NO: 1048307 - RNA, 11 nt, Homo sapiens
ggccagugucu

SEQ ID NO: 1048308 - RNA, 17 nt, Homo sapiens
ggccaugagcuccagac

SEQ ID NO: 1048309 - RNA, 22 nt, Homo sapiens
ggccauggaagguucucugugc

SEQ ID NO: 1048310 - RNA, 16 nt, Homo sapiens
ggcccaggaccagcug

SEQ ID NO: 1048311 - RNA, 16 nt, Homo sapiens
ggcccauaucugugaa

SEQ ID NO: 1048312 - RNA, 17 nt, Homo sapiens
ggccccaccggggucua

SEQ ID NO: 1048313 - RNA, 16 nt, Homo sapiens
ggcccccagugggcau

SEQ ID NO: 1048314 - RNA, 22 nt, Homo sapiens
ggccccucccgccccuucccac

SEQ ID NO: 1048315 - RNA, 15 nt, Homo sapiens
ggccccugcaucccc

SEQ ID NO: 1048316 - RNA, 21 nt, Homo sapiens
ggcccuucuugccuacuaugc

SEQ ID NO: 1048317 - RNA, 19 nt, Homo sapiens
ggccgcagcucuugcccuu

SEQ ID NO: 1048318 - RNA, 17 nt, Homo sapiens
ggccuaugcacauaugg

SEQ ID NO: 1048319 - RNA, 20 nt, Homo sapiens
ggccucaagggaugucucac

SEQ ID NO: 1048320 - RNA, 16 nt, Homo sapiens
ggccuccccugcugaa

SEQ ID NO: 1048321 - RNA, 23 nt, Homo sapiens
ggccucgaaaaccaucacaugac

SEQ ID NO: 1048322 - RNA, 19 nt, Homo sapiens
ggccucugcccuucagaag

SEQ ID NO: 1048323 - RNA, 16 nt, Homo sapiens
ggccucuggcucucau

SEQ ID NO: 1048324 - RNA, 23 nt, Homo sapiens
ggccugacggggaggaaccacug

SEQ ID NO: 1048325 - RNA, 20 nt, Homo sapiens
ggccuggaguaacacaaagu

SEQ ID NO: 1048326 - RNA, 22 nt, Homo sapiens
ggccuuggacaacugcauggag

SEQ ID NO: 1048327 - RNA, 20 nt, Homo sapiens
ggccuuucugugugugaugu

SEQ ID NO: 1048328 - RNA, 23 nt, Homo sapiens
ggcgcacuuuccuccuggcagaa

SEQ ID NO: 1048329 - RNA, 13 nt, Homo sapiens
ggcgcagugcuuc

SEQ ID NO: 1048330 - RNA, 20 nt, Homo sapiens
ggcgccccugccaccucccu

SEQ ID NO: 1048331 - RNA, 22 nt, Homo sapiens
ggcggaucuuuggacagaagca

SEQ ID NO: 1048332 - RNA, 17 nt, Homo sapiens
ggcgggaaagccaguga

SEQ ID NO: 1048333 - RNA, 22 nt, Homo sapiens
ggcggugggcacccacccuggg

SEQ ID NO: 1048334 - RNA, 14 nt, Homo sapiens
ggcgucccuaccuc

SEQ ID NO: 1048335 - RNA, 15 nt, Homo sapiens
ggcguggagcugccu

SEQ ID NO: 1048336 - RNA, 22 nt, Homo sapiens
ggcgugguagcgggcgccugua

SEQ ID NO: 1048337 - RNA, 22 nt, Homo sapiens
ggcuaagcacgggccauaugaa

SEQ ID NO: 1048338 - RNA, 13 nt, Homo sapiens
ggcuaauucugca

SEQ ID NO: 1048339 - RNA, 22 nt, Homo sapiens
ggcuacaauuuucucccaggaa

SEQ ID NO: 1048340 - RNA, 13 nt, Homo sapiens
ggcuacacaggga

SEQ ID NO: 1048341 - RNA, 15 nt, Homo sapiens
ggcuacacagggaug

SEQ ID NO: 1048342 - RNA, 17 nt, Homo sapiens
ggcuacacugacacugg

SEQ ID NO: 1048343 - RNA, 13 nt, Homo sapiens
ggcuaccuacaua

SEQ ID NO: 1048344 - RNA, 17 nt, Homo sapiens
ggcuagaaucuggagag

SEQ ID NO: 1048345 - RNA, 21 nt, Homo sapiens
ggcuagacacccauuuucaca

SEQ ID NO: 1048346 - RNA, 22 nt, Homo sapiens
ggcuauuguccccuaaaccaaa

SEQ ID NO: 1048347 - RNA, 21 nt, Homo sapiens
ggcuauuuuucccccugcauu

SEQ ID NO: 1048348 - RNA, 16 nt, Homo sapiens
ggcucaugaccuggaa

SEQ ID NO: 1048349 - RNA, 22 nt, Homo sapiens
ggcuccaccccauccaguucau

SEQ ID NO: 1048350 - RNA, 23 nt, Homo sapiens
aaggagcucacuguggugucugu

SEQ ID NO: 1048351 - RNA, 20 nt, Homo sapiens
aaggaggcugaucccugaga

SEQ ID NO: 1048352 - RNA, 17 nt, Homo sapiens
aaggaguaaucugugua

SEQ ID NO: 1048353 - RNA, 18 nt, Homo sapiens
aaggaguaaucuguguac

SEQ ID NO: 1048354 - RNA, 19 nt, Homo sapiens
aaggauccucuugacuccu

SEQ ID NO: 1048355 - RNA, 21 nt, Homo sapiens
aaggaugcggcaggugcucug

SEQ ID NO: 1048356 - RNA, 19 nt, Homo sapiens
agacgugauuuugcuguag

SEQ ID NO: 1048357 - RNA, 20 nt, Homo sapiens
agacgugcacugagagugaa

SEQ ID NO: 1048358 - RNA, 12 nt, Homo sapiens
agacguguacau

SEQ ID NO: 1048359 - RNA, 14 nt, Homo sapiens
agacguguacauag

SEQ ID NO: 1048360 - RNA, 18 nt, Homo sapiens
agacuauucccuucuaac

SEQ ID NO: 1048361 - RNA, 17 nt, Homo sapiens
agacucaaaugcucaga

SEQ ID NO: 1048362 - RNA, 17 nt, Homo sapiens
agacucccaagcuggac

SEQ ID NO: 1048363 - RNA, 13 nt, Homo sapiens
agacucugggaac

SEQ ID NO: 1048364 - RNA, 14 nt, Homo sapiens
agacucugucucag

SEQ ID NO: 1048365 - RNA, 10 nt, Homo sapiens
agacugcugc

SEQ ID NO: 1048366 - RNA, 17 nt, Homo sapiens
agacuggaagcacagcu

SEQ ID NO: 1048367 - RNA, 14 nt, Homo sapiens
agacuggcuuuuau

SEQ ID NO: 1048368 - RNA, 21 nt, Homo sapiens
agacugggucucgcuuuguug

SEQ ID NO: 1048369 - RNA, 15 nt, Homo sapiens
agacuguugcucaaa

SEQ ID NO: 1048370 - RNA, 17 nt, Homo sapiens
agacuuauguauuagcu

SEQ ID NO: 1048371 - RNA, 23 nt, Homo sapiens
agacuuggcuccaccacugauau

SEQ ID NO: 1048372 - RNA, 20 nt, Homo sapiens
agacuuuacauggaugccaa

SEQ ID NO: 1048373 - RNA, 23 nt, Homo sapiens
agacuuuuccaacccucaucacc

SEQ ID NO: 1048374 - RNA, 18 nt, Homo sapiens
agagaaagaaguaggcau

SEQ ID NO: 1048375 - RNA, 21 nt, Homo sapiens
agagaaagagagagaauucuu

SEQ ID NO: 1048376 - RNA, 12 nt, Homo sapiens
agagaagacaaa

SEQ ID NO: 1048377 - RNA, 14 nt, Homo sapiens
agagaagaggcugg

SEQ ID NO: 1048378 - RNA, 17 nt, Homo sapiens
agagaaugcccagugac

SEQ ID NO: 1048379 - RNA, 20 nt, Homo sapiens
agagaauucucuuauccaac

SEQ ID NO: 1048380 - RNA, 21 nt, Homo sapiens
agagacagcuugaucaaaggc

SEQ ID NO: 1048381 - RNA, 21 nt, Homo sapiens
agagacaggguuucacugugu

SEQ ID NO: 1048382 - RNA, 12 nt, Homo sapiens
agagacaucaaa

SEQ ID NO: 1048383 - RNA, 19 nt, Homo sapiens
agagaccucaaauuacuuu

SEQ ID NO: 1048384 - RNA, 18 nt, Homo sapiens
agagacgcagacaugugc

SEQ ID NO: 1048385 - RNA, 19 nt, Homo sapiens
agagagcaacucugagauc

SEQ ID NO: 1048386 - RNA, 21 nt, Homo sapiens
agagagcagcuuuaaacucag

SEQ ID NO: 1048387 - RNA, 20 nt, Homo sapiens
agagagccuuuuucuaggcc

SEQ ID NO: 1048388 - RNA, 15 nt, Homo sapiens
agagaggaguucaau

SEQ ID NO: 1048389 - RNA, 13 nt, Homo sapiens
agagagggagaag

SEQ ID NO: 1048390 - RNA, 22 nt, Homo sapiens
agagagucgcaucucagugcag

SEQ ID NO: 1048391 - RNA, 14 nt, Homo sapiens
agagagugcuauug

SEQ ID NO: 1048392 - RNA, 17 nt, Homo sapiens
agagaguuaagugaaug

SEQ ID NO: 1048393 - RNA, 15 nt, Homo sapiens
agagaucuauguacu

SEQ ID NO: 1048394 - RNA, 19 nt, Homo sapiens
agagauggaauaaagcccu

SEQ ID NO: 1048395 - RNA, 21 nt, Homo sapiens
agagauggaauaaagcccuug

SEQ ID NO: 1048396 - RNA, 16 nt, Homo sapiens
agagaugggguuucac

SEQ ID NO: 1048397 - RNA, 20 nt, Homo sapiens
agagaugggguuucacugug

SEQ ID NO: 1048398 - RNA, 16 nt, Homo sapiens
agagauugauggguua

SEQ ID NO: 1048399 - RNA, 17 nt, Homo sapiens
agagcaaaucuaugaga

SEQ ID NO: 1048400 - RNA, 21 nt, Homo sapiens
agagcaacucugagaucuaag

SEQ ID NO: 1048401 - RNA, 19 nt, Homo sapiens
agagcaagacucugucuca

SEQ ID NO: 1048402 - RNA, 15 nt, Homo sapiens
agagcacacuguagc

SEQ ID NO: 1048403 - RNA, 14 nt, Homo sapiens
agagcagaugcaga

SEQ ID NO: 1048404 - RNA, 20 nt, Homo sapiens
agagcaggaagcauucagag

SEQ ID NO: 1048405 - RNA, 19 nt, Homo sapiens
agagcaggcguucagcuca

SEQ ID NO: 1048406 - RNA, 23 nt, Homo sapiens
agagcaggcuggcagcucuccag

SEQ ID NO: 1048407 - RNA, 15 nt, Homo sapiens
agagcccccuugaca

SEQ ID NO: 1048408 - RNA, 19 nt, Homo sapiens
agagccucuggcaucucuu

SEQ ID NO: 1048409 - RNA, 20 nt, Homo sapiens
agagcgcaagcugggagcac

SEQ ID NO: 1048410 - RNA, 19 nt, Homo sapiens
agagcuacccgcagaguuc

SEQ ID NO: 1048411 - RNA, 23 nt, Homo sapiens
agagcugccugugccuuuugcca

SEQ ID NO: 1048412 - RNA, 13 nt, Homo sapiens
agagcuggaggca

SEQ ID NO: 1048413 - RNA, 22 nt, Homo sapiens
agagcuuugcuucucucucuaa

SEQ ID NO: 1048414 - RNA, 12 nt, Homo sapiens
agagcuuuggua

SEQ ID NO: 1048415 - RNA, 14 nt, Homo sapiens
agaggaacugucca

SEQ ID NO: 1048416 - RNA, 17 nt, Homo sapiens
agaggacaggcuacccc

SEQ ID NO: 1048417 - RNA, 23 nt, Homo sapiens
agaggagaaaaaaacuucuuuaa

SEQ ID NO: 1048418 - RNA, 15 nt, Homo sapiens
agaggagaaggaggg

SEQ ID NO: 1048419 - RNA, 13 nt, Homo sapiens
agaggagguuugg

SEQ ID NO: 1048420 - RNA, 20 nt, Homo sapiens
uagaauuugggggaaaauuu

SEQ ID NO: 1048421 - RNA, 14 nt, Homo sapiens
uagacaaaaaccau

SEQ ID NO: 1048422 - RNA, 19 nt, Homo sapiens
uagacacguguuguuccac

SEQ ID NO: 1048423 - RNA, 16 nt, Homo sapiens
uagacagagucucacu

SEQ ID NO: 1048424 - RNA, 20 nt, Homo sapiens
uagaccagaaccagagcuca

SEQ ID NO: 1048425 - RNA, 13 nt, Homo sapiens
uagacuacauuua

SEQ ID NO: 1048426 - RNA, 23 nt, Homo sapiens
uagacuauaagcagaagcacaua

SEQ ID NO: 1048427 - RNA, 23 nt, Homo sapiens
uagacugccaugcuagacaagcu

SEQ ID NO: 1048428 - RNA, 17 nt, Homo sapiens
uagacuuaaacagcaga

SEQ ID NO: 1048429 - RNA, 17 nt, Homo sapiens
uagacuucccacucuag

SEQ ID NO: 1048430 - RNA, 19 nt, Homo sapiens
uagagaaacacuaaagcau

SEQ ID NO: 1048431 - RNA, 22 nt, Homo sapiens
uagagacgggguuucaccaugu

SEQ ID NO: 1048432 - RNA, 16 nt, Homo sapiens
uagagacuucacccgg

SEQ ID NO: 1048433 - RNA, 17 nt, Homo sapiens
uagagacuuugugaaaa

SEQ ID NO: 1048434 - RNA, 18 nt, Homo sapiens
uagagaucuauguacugu

SEQ ID NO: 1048435 - RNA, 14 nt, Homo sapiens
uagagcacacugua

SEQ ID NO: 1048436 - RNA, 22 nt, Homo sapiens
uagagcaggcguucagcucacu

SEQ ID NO: 1048437 - RNA, 21 nt, Homo sapiens
uagaggggcucugggagacuu

SEQ ID NO: 1048438 - RNA, 15 nt, Homo sapiens
uagagggggucucag

SEQ ID NO: 1048439 - RNA, 16 nt, Homo sapiens
uagagguacuuuccac

SEQ ID NO: 1048440 - RNA, 14 nt, Homo sapiens
uagaggugagggaa

SEQ ID NO: 1048441 - RNA, 21 nt, Homo sapiens
uagagguuuuaaagugauuaa

SEQ ID NO: 1048442 - RNA, 20 nt, Homo sapiens
uagagugcauuacuuugaau

SEQ ID NO: 1048443 - RNA, 18 nt, Homo sapiens
uagaguguuaucagucau

SEQ ID NO: 1048444 - RNA, 15 nt, Homo sapiens
uagaguucagacuuu

SEQ ID NO: 1048445 - RNA, 14 nt, Homo sapiens
uagaguugauacua

SEQ ID NO: 1048446 - RNA, 16 nt, Homo sapiens
uagauaaacucagaaa

SEQ ID NO: 1048447 - RNA, 20 nt, Homo sapiens
uagauaaucucuccauuccc

SEQ ID NO: 1048448 - RNA, 16 nt, Homo sapiens
uagauauuauucauuc

SEQ ID NO: 1048449 - RNA, 16 nt, Homo sapiens
uagaugacauggugaa

SEQ ID NO: 1048450 - RNA, 18 nt, Homo sapiens
uagaugcauguacccuaa

SEQ ID NO: 1048451 - RNA, 11 nt, Homo sapiens
uagaugggcau

SEQ ID NO: 1048452 - RNA, 19 nt, Homo sapiens
uagauguauaaaucuuucu

SEQ ID NO: 1048453 - RNA, 17 nt, Homo sapiens
uagauguauauauuucc

SEQ ID NO: 1048454 - RNA, 12 nt, Homo sapiens
uagaugugcauu

SEQ ID NO: 1048455 - RNA, 15 nt, Homo sapiens
uagauuaaacaaaca

SEQ ID NO: 1048456 - RNA, 23 nt, Homo sapiens
uagauuuuagacccuauugcugc

SEQ ID NO: 1048457 - RNA, 21 nt, Homo sapiens
uagcaaacuuuguaugucauu

SEQ ID NO: 1048458 - RNA, 17 nt, Homo sapiens
uagcaagacacaucccu

SEQ ID NO: 1048459 - RNA, 15 nt, Homo sapiens
uagcaccauuaacuc

SEQ ID NO: 1048460 - RNA, 17 nt, Homo sapiens
uagcacuauuuacauac

SEQ ID NO: 1048461 - RNA, 17 nt, Homo sapiens
uagcagcuaucucucag

SEQ ID NO: 1048462 - RNA, 18 nt, Homo sapiens
uagccaaacccuugucag

SEQ ID NO: 1048463 - RNA, 17 nt, Homo sapiens
uagccaagaucccaucu

SEQ ID NO: 1048464 - RNA, 14 nt, Homo sapiens
uagcccaaaaccaa

SEQ ID NO: 1048465 - RNA, 14 nt, Homo sapiens
uagccgaccucagc

SEQ ID NO: 1048466 - RNA, 13 nt, Homo sapiens
uagcggucaauuu

SEQ ID NO: 1048467 - RNA, 22 nt, Homo sapiens
uagcuaccucacuaugcugcuu

SEQ ID NO: 1048468 - RNA, 17 nt, Homo sapiens
uagcucuggaccagccu

SEQ ID NO: 1048469 - RNA, 17 nt, Homo sapiens
uagcucuggugaccuug

SEQ ID NO: 1048470 - RNA, 17 nt, Homo sapiens
uagcugagcgugguggc

SEQ ID NO: 1048471 - RNA, 15 nt, Homo sapiens
uagcugcagagccac

SEQ ID NO: 1048472 - RNA, 15 nt, Homo sapiens
uagcugggacuacag

SEQ ID NO: 1048473 - RNA, 16 nt, Homo sapiens
uagcugggacuacagg

SEQ ID NO: 1048474 - RNA, 17 nt, Homo sapiens
uagcugggacuacaggc

SEQ ID NO: 1048475 - RNA, 18 nt, Homo sapiens
uagcugggacuacagggg

SEQ ID NO: 1048476 - RNA, 17 nt, Homo sapiens
uagcuguaaggcaugaa

SEQ ID NO: 1048477 - RNA, 15 nt, Homo sapiens
uagcugucugcucag

SEQ ID NO: 1048478 - RNA, 19 nt, Homo sapiens
uagcuuagaccucagccug

SEQ ID NO: 1048479 - RNA, 20 nt, Homo sapiens
uagcuuguauaguguaaaau

SEQ ID NO: 1048480 - RNA, 22 nt, Homo sapiens
uagcuuuagggcaauauugcca

SEQ ID NO: 1048481 - RNA, 23 nt, Homo sapiens
uagcuuuagggcaauauugccau

SEQ ID NO: 1048482 - RNA, 20 nt, Homo sapiens
uagcuuucccaaauaaacuc

SEQ ID NO: 1048483 - RNA, 23 nt, Homo sapiens
uaggaaagaccauuuuuccucca

SEQ ID NO: 1048484 - RNA, 14 nt, Homo sapiens
uaggaaaugaauga

SEQ ID NO: 1048485 - RNA, 16 nt, Homo sapiens
uaggaacgguaaauuu

SEQ ID NO: 1048486 - RNA, 16 nt, Homo sapiens
uaggaagagaaaccag

SEQ ID NO: 1048487 - RNA, 15 nt, Homo sapiens
uaggaagaguagcau

SEQ ID NO: 1048488 - RNA, 19 nt, Homo sapiens
uaggaagguuaauguucau

SEQ ID NO: 1048489 - RNA, 13 nt, Homo sapiens
uaggaauuggugu

SEQ ID NO: 1048490 - RNA, 18 nt, Homo sapiens
uaggacuuuuauugugaa

SEQ ID NO: 1048491 - RNA, 20 nt, Homo sapiens
uaggagggcuggcaacuuag

SEQ ID NO: 1048492 - RNA, 14 nt, Homo sapiens
uaggaguucacuuc

SEQ ID NO: 1048493 - RNA, 13 nt, Homo sapiens
uaggauuacccac

SEQ ID NO: 1048494 - RNA, 17 nt, Homo sapiens
uaggccagcaccaucuc

SEQ ID NO: 1048495 - RNA, 14 nt, Homo sapiens
uaggcuauucacaa

SEQ ID NO: 1048496 - RNA, 22 nt, Homo sapiens
uaggcuccugccaguguggaac

SEQ ID NO: 1048497 - RNA, 17 nt, Homo sapiens
uagggaaaacauuccau

SEQ ID NO: 1048498 - RNA, 22 nt, Homo sapiens
uagggacucagggccaugccug

SEQ ID NO: 1048499 - RNA, 13 nt, Homo sapiens
uaggggcaaaaau

SEQ ID NO: 1048500 - RNA, 16 nt, Homo sapiens
uaggggucaggcucca

SEQ ID NO: 1048501 - RNA, 16 nt, Homo sapiens
agccaggcugccaagg

SEQ ID NO: 1048502 - RNA, 15 nt, Homo sapiens
agccagguucugacu

SEQ ID NO: 1048503 - RNA, 22 nt, Homo sapiens
agccauacuuaucucucugugc

SEQ ID NO: 1048504 - RNA, 17 nt, Homo sapiens
agccauaugaaugucag

SEQ ID NO: 1048505 - RNA, 16 nt, Homo sapiens
agccaucaaacacaau

SEQ ID NO: 1048506 - RNA, 18 nt, Homo sapiens
agccaucuugaucugugu

SEQ ID NO: 1048507 - RNA, 19 nt, Homo sapiens
agccaugugcugcgugccu

SEQ ID NO: 1048508 - RNA, 22 nt, Homo sapiens
agccauuuguuggggcaguggu

SEQ ID NO: 1048509 - RNA, 13 nt, Homo sapiens
agcccacaaagcc

SEQ ID NO: 1048510 - RNA, 14 nt, Homo sapiens
agcccacacuugag

SEQ ID NO: 1048511 - RNA, 19 nt, Homo sapiens
agcccaccccucaacaccu

SEQ ID NO: 1048512 - RNA, 16 nt, Homo sapiens
agcccaccuuggcuca

SEQ ID NO: 1048513 - RNA, 15 nt, Homo sapiens
agcccauggcacucu

SEQ ID NO: 1048514 - RNA, 14 nt, Homo sapiens
agcccauggcuuua

SEQ ID NO: 1048515 - RNA, 16 nt, Homo sapiens
agccccagaguggcuc

SEQ ID NO: 1048516 - RNA, 15 nt, Homo sapiens
agccccaucagcucc

SEQ ID NO: 1048517 - RNA, 15 nt, Homo sapiens
agcccccccuuccac

SEQ ID NO: 1048518 - RNA, 16 nt, Homo sapiens
agcccccgcuguaaug

SEQ ID NO: 1048519 - RNA, 23 nt, Homo sapiens
agccccuccaaaggucugauguc

SEQ ID NO: 1048520 - RNA, 16 nt, Homo sapiens
agccccugcuccagaa

SEQ ID NO: 1048521 - RNA, 15 nt, Homo sapiens
agccccugguccuga

SEQ ID NO: 1048522 - RNA, 13 nt, Homo sapiens
agcccgucucagu

SEQ ID NO: 1048523 - RNA, 13 nt, Homo sapiens
agcccucaucccg

SEQ ID NO: 1048524 - RNA, 19 nt, Homo sapiens
agcccuccaaaagcacuua

SEQ ID NO: 1048525 - RNA, 19 nt, Homo sapiens
agcccucccccagcaguug

SEQ ID NO: 1048526 - RNA, 19 nt, Homo sapiens
agcccuccgccauucucaa

SEQ ID NO: 1048527 - RNA, 20 nt, Homo sapiens
agcccuccgccauucucaag

SEQ ID NO: 1048528 - RNA, 13 nt, Homo sapiens
agcccucuuccau

SEQ ID NO: 1048529 - RNA, 15 nt, Homo sapiens
agcccugagcuuucu

SEQ ID NO: 1048530 - RNA, 18 nt, Homo sapiens
agcccugcagucacagcu

SEQ ID NO: 1048531 - RNA, 16 nt, Homo sapiens
agcccuggcugaagga

SEQ ID NO: 1048532 - RNA, 21 nt, Homo sapiens
agccgagaucgcgccacugca

SEQ ID NO: 1048533 - RNA, 20 nt, Homo sapiens
agccgagauugcaccacugc

SEQ ID NO: 1048534 - RNA, 16 nt, Homo sapiens
agccgcuucugacugc

SEQ ID NO: 1048535 - RNA, 21 nt, Homo sapiens
agccuaacacacuccaagaua

SEQ ID NO: 1048536 - RNA, 16 nt, Homo sapiens
agccuacgcugaagau

SEQ ID NO: 1048537 - RNA, 19 nt, Homo sapiens
agccuagaagagcuucuga

SEQ ID NO: 1048538 - RNA, 18 nt, Homo sapiens
agccuaggugacagagug

SEQ ID NO: 1048539 - RNA, 23 nt, Homo sapiens
agccuaugaggggguuuggcacc

SEQ ID NO: 1048540 - RNA, 23 nt, Homo sapiens
agccuauguaugccauggaggca

SEQ ID NO: 1048541 - RNA, 22 nt, Homo sapiens
agccucacugcaagcacugcau

SEQ ID NO: 1048542 - RNA, 12 nt, Homo sapiens
agccucaucucu

SEQ ID NO: 1048543 - RNA, 13 nt, Homo sapiens
agccucaucucuu

SEQ ID NO: 1048544 - RNA, 16 nt, Homo sapiens
agccuccagguuuccu

SEQ ID NO: 1048545 - RNA, 17 nt, Homo sapiens
agccucccaaguagcug

SEQ ID NO: 1048546 - RNA, 17 nt, Homo sapiens
agccucccucugaccug

SEQ ID NO: 1048547 - RNA, 14 nt, Homo sapiens
agccuccugaccug

SEQ ID NO: 1048548 - RNA, 13 nt, Homo sapiens
agccucgucuuca

SEQ ID NO: 1048549 - RNA, 14 nt, Homo sapiens
agccucuccaggaa

SEQ ID NO: 1048550 - RNA, 17 nt, Homo sapiens
agccucuccccugauua

SEQ ID NO: 1048551 - RNA, 18 nt, Homo sapiens
agccucuccccugauuac

SEQ ID NO: 1048552 - RNA, 14 nt, Homo sapiens
agccucugcugcca

SEQ ID NO: 1048553 - RNA, 15 nt, Homo sapiens
agccucugggucuga

SEQ ID NO: 1048554 - RNA, 18 nt, Homo sapiens
agccugcaaacucacugc

SEQ ID NO: 1048555 - RNA, 23 nt, Homo sapiens
agccugcaaacucacugcucaag

SEQ ID NO: 1048556 - RNA, 14 nt, Homo sapiens
agccugcugcaugg

SEQ ID NO: 1048557 - RNA, 14 nt, Homo sapiens
agccugcuggucac

SEQ ID NO: 1048558 - RNA, 14 nt, Homo sapiens
agccuggacccugu

SEQ ID NO: 1048559 - RNA, 17 nt, Homo sapiens
agccuggccaacaugau

SEQ ID NO: 1048560 - RNA, 14 nt, Homo sapiens
agccuggcuccaaa

SEQ ID NO: 1048561 - RNA, 20 nt, Homo sapiens
agccuggcuccaaacccucg

SEQ ID NO: 1048562 - RNA, 15 nt, Homo sapiens
agccugggcaaugug

SEQ ID NO: 1048563 - RNA, 22 nt, Homo sapiens
agccugggcgacagagccagac

SEQ ID NO: 1048564 - RNA, 16 nt, Homo sapiens
agccuggugcugcugc

SEQ ID NO: 1048565 - RNA, 22 nt, Homo sapiens
agccugugcauguaugucuugg

SEQ ID NO: 1048566 - RNA, 17 nt, Homo sapiens
agccuugggaacaugcg

SEQ ID NO: 1048567 - RNA, 20 nt, Homo sapiens
agccuuuuccagaagaucug

SEQ ID NO: 1048568 - RNA, 15 nt, Homo sapiens
agcgagacuccgucu

SEQ ID NO: 1048569 - RNA, 16 nt, Homo sapiens
agcgagcuaugaucgc

SEQ ID NO: 1048570 - RNA, 15 nt, Homo sapiens
agcgauuaauaacag

SEQ ID NO: 1048571 - RNA, 16 nt, Homo sapiens
agcggaaagcagcuca

SEQ ID NO: 1048572 - RNA, 11 nt, Homo sapiens
agcggacauca

SEQ ID NO: 1048573 - RNA, 15 nt, Homo sapiens
agcguagcuaaguga

SEQ ID NO: 1048574 - RNA, 13 nt, Homo sapiens
agcgucaguauuu

SEQ ID NO: 1048575 - RNA, 16 nt, Homo sapiens
agcgugagccacugca

SEQ ID NO: 1048576 - RNA, 24 nt, Homo sapiens
agcgugcauaaguuaacuuccaau

SEQ ID NO: 1048577 - RNA, 16 nt, Homo sapiens
agcuaacuuauuuucc

SEQ ID NO: 1048578 - RNA, 14 nt, Homo sapiens
agcuaagauuaucu

SEQ ID NO: 1048579 - RNA, 13 nt, Homo sapiens
agcuaagccacau

SEQ ID NO: 1048580 - RNA, 19 nt, Homo sapiens
agcuaagugaaaaggucau

SEQ ID NO: 1048581 - RNA, 21 nt, Homo sapiens
agcuaccucaaacuuccaguc

SEQ ID NO: 1048582 - RNA, 23 nt, Homo sapiens
uauuuuauguaaacccucaaggg

SEQ ID NO: 1048583 - RNA, 18 nt, Homo sapiens
uauuuugcauaguaccaa

SEQ ID NO: 1048584 - RNA, 12 nt, Homo sapiens
uauuuuuacuaa

SEQ ID NO: 1048585 - RNA, 13 nt, Homo sapiens
uauuuuucaugau

SEQ ID NO: 1048586 - RNA, 14 nt, Homo sapiens
uauuuuugugcaca

SEQ ID NO: 1048587 - RNA, 22 nt, Homo sapiens
uauuuuuuaaaauaacuucaau

SEQ ID NO: 1048588 - RNA, 14 nt, Homo sapiens
ucaaaaacauucuu

SEQ ID NO: 1048589 - RNA, 13 nt, Homo sapiens
ucaaaaaguucca

SEQ ID NO: 1048590 - RNA, 16 nt, Homo sapiens
ucaaaaauacucacau

SEQ ID NO: 1048591 - RNA, 13 nt, Homo sapiens
ucaaaacaaucaa

SEQ ID NO: 1048592 - RNA, 17 nt, Homo sapiens
ucaaaacucaguaucau

SEQ ID NO: 1048593 - RNA, 13 nt, Homo sapiens
ucaaaacuuggaa

SEQ ID NO: 1048594 - RNA, 15 nt, Homo sapiens
ucaaaagacaauucu

SEQ ID NO: 1048595 - RNA, 13 nt, Homo sapiens
ucaaaagaucaaa

SEQ ID NO: 1048596 - RNA, 22 nt, Homo sapiens
ucaaaagcacuuugugcugugu

SEQ ID NO: 1048597 - RNA, 22 nt, Homo sapiens
ucaaaagguuaauaaaguaauu

SEQ ID NO: 1048598 - RNA, 22 nt, Homo sapiens
ucaaaauaaaaaugagguacuc

SEQ ID NO: 1048599 - RNA, 18 nt, Homo sapiens
ucaaaauauacauucaaa

SEQ ID NO: 1048600 - RNA, 18 nt, Homo sapiens
ucaaaccuacuaauccag

SEQ ID NO: 1048601 - RNA, 14 nt, Homo sapiens
ucaaacugccuugg

SEQ ID NO: 1048602 - RNA, 13 nt, Homo sapiens
ucaaagcaguagu

SEQ ID NO: 1048603 - RNA, 10 nt, Homo sapiens
ucaaagccag

SEQ ID NO: 1048604 - RNA, 15 nt, Homo sapiens
ucaaaggcacaguga

SEQ ID NO: 1048605 - RNA, 22 nt, Homo sapiens
ucaaaggugauugugccaggcu

SEQ ID NO: 1048606 - RNA, 15 nt, Homo sapiens
ucaaaguaaaacuug

SEQ ID NO: 1048607 - RNA, 18 nt, Homo sapiens
ucaaaguaaaacuugcug

SEQ ID NO: 1048608 - RNA, 20 nt, Homo sapiens
ucaaaguguaaacaccauag

SEQ ID NO: 1048609 - RNA, 22 nt, Homo sapiens
ucaaaguuuugaaaagcuauua

SEQ ID NO: 1048610 - RNA, 14 nt, Homo sapiens
ucaaauagcauaag

SEQ ID NO: 1048611 - RNA, 21 nt, Homo sapiens
ucaaauaugcaaagcacugac

SEQ ID NO: 1048612 - RNA, 17 nt, Homo sapiens
ucaaaucuauucagaca

SEQ ID NO: 1048613 - RNA, 12 nt, Homo sapiens
ucaaaucuccag

SEQ ID NO: 1048614 - RNA, 15 nt, Homo sapiens
ucaaaugacccaaag

SEQ ID NO: 1048615 - RNA, 17 nt, Homo sapiens
ucaaaugacccaaagac

SEQ ID NO: 1048616 - RNA, 17 nt, Homo sapiens
ucaaaugcacaucucau

SEQ ID NO: 1048617 - RNA, 23 nt, Homo sapiens
ucaaauuauuuccaagagagauu

SEQ ID NO: 1048618 - RNA, 19 nt, Homo sapiens
ucaacaaagcacaguguua

SEQ ID NO: 1048619 - RNA, 17 nt, Homo sapiens
ucaacaagaguugucuu

SEQ ID NO: 1048620 - RNA, 20 nt, Homo sapiens
ucaacaccaggagagcuucu

SEQ ID NO: 1048621 - RNA, 12 nt, Homo sapiens
ucaacagaauug

SEQ ID NO: 1048622 - RNA, 22 nt, Homo sapiens
ucaacagcauuuucaagcaguu

SEQ ID NO: 1048623 - RNA, 22 nt, Homo sapiens
ucaacaucuuggucagauuuga

SEQ ID NO: 1048624 - RNA, 17 nt, Homo sapiens
ucaacauuucucaauaa

SEQ ID NO: 1048625 - RNA, 17 nt, Homo sapiens
ucaaccccucacaggag

SEQ ID NO: 1048626 - RNA, 15 nt, Homo sapiens
ucaaccugugaugag

SEQ ID NO: 1048627 - RNA, 16 nt, Homo sapiens
ucaagaagaagaugga

SEQ ID NO: 1048628 - RNA, 17 nt, Homo sapiens
ucaagaauaaaguacua

SEQ ID NO: 1048629 - RNA, 20 nt, Homo sapiens
ucaagaauggggaucacaga

SEQ ID NO: 1048630 - RNA, 19 nt, Homo sapiens
ucaagacaagccuggccua

SEQ ID NO: 1048631 - RNA, 18 nt, Homo sapiens
ucaagaugagagaacugg

SEQ ID NO: 1048632 - RNA, 21 nt, Homo sapiens
ucaagauuuucauacuuuuac

SEQ ID NO: 1048633 - RNA, 22 nt, Homo sapiens
ucaagccuagcccuucucucau

SEQ ID NO: 1048634 - RNA, 21 nt, Homo sapiens
ucaagcgauucuucugccuca

SEQ ID NO: 1048635 - RNA, 15 nt, Homo sapiens
ucaagcuagaaggcc

SEQ ID NO: 1048636 - RNA, 15 nt, Homo sapiens
ucaagcugugagaca

SEQ ID NO: 1048637 - RNA, 14 nt, Homo sapiens
ucaaggaauuugca

SEQ ID NO: 1048638 - RNA, 18 nt, Homo sapiens
ucaaggacuuucugaagc

SEQ ID NO: 1048639 - RNA, 23 nt, Homo sapiens
ucaaggugggccuugcuaccuca

SEQ ID NO: 1048640 - RNA, 14 nt, Homo sapiens
ucaagguucccaga

SEQ ID NO: 1048641 - RNA, 16 nt, Homo sapiens
ucaaguaauucugcug

SEQ ID NO: 1048642 - RNA, 16 nt, Homo sapiens
ucaaguaauugugaaa

SEQ ID NO: 1048643 - RNA, 23 nt, Homo sapiens
ucaaguacuguaacugugucaug

SEQ ID NO: 1048644 - RNA, 19 nt, Homo sapiens
ucaaguccuacaagcuaaa

SEQ ID NO: 1048645 - RNA, 21 nt, Homo sapiens
ucaagugauucuccugccuca

SEQ ID NO: 1048646 - RNA, 14 nt, Homo sapiens
auuugagacagagu

SEQ ID NO: 1048647 - RNA, 23 nt, Homo sapiens
auuugcaaggugaacacuuccuu

SEQ ID NO: 1048648 - RNA, 23 nt, Homo sapiens
auuugcauuugcucuuucaucuc

SEQ ID NO: 1048649 - RNA, 17 nt, Homo sapiens
auuugccaauuuacuuu

SEQ ID NO: 1048650 - RNA, 15 nt, Homo sapiens
auuugcuuuuugcua

SEQ ID NO: 1048651 - RNA, 23 nt, Homo sapiens
auuugguuuguugagccuaauau

SEQ ID NO: 1048652 - RNA, 17 nt, Homo sapiens
auuugucaacaaaguca

SEQ ID NO: 1048653 - RNA, 13 nt, Homo sapiens
auuugugaacuca

SEQ ID NO: 1048654 - RNA, 19 nt, Homo sapiens
auuugugucaaugggcaau

SEQ ID NO: 1048655 - RNA, 17 nt, Homo sapiens
auuugugugugugcaag

SEQ ID NO: 1048656 - RNA, 20 nt, Homo sapiens
auuuguuuucuucuguaugu

SEQ ID NO: 1048657 - RNA, 14 nt, Homo sapiens
auuuuaaggacugc

SEQ ID NO: 1048658 - RNA, 14 nt, Homo sapiens
auuuuaauuaucuu

SEQ ID NO: 1048659 - RNA, 20 nt, Homo sapiens
auuuuaauugauuauucuga

SEQ ID NO: 1048660 - RNA, 23 nt, Homo sapiens
auuuuacaauuuuuuaucaugca

SEQ ID NO: 1048661 - RNA, 16 nt, Homo sapiens
auuuuaggauuaccca

SEQ ID NO: 1048662 - RNA, 16 nt, Homo sapiens
ugccaaaccuguguag

SEQ ID NO: 1048663 - RNA, 14 nt, Homo sapiens
ugccaaagaacuug

SEQ ID NO: 1048664 - RNA, 16 nt, Homo sapiens
ugccaagaaaguauuu

SEQ ID NO: 1048665 - RNA, 16 nt, Homo sapiens
ugccaagacaugauua

SEQ ID NO: 1048666 - RNA, 17 nt, Homo sapiens
ugccaagcacagugccu

SEQ ID NO: 1048667 - RNA, 15 nt, Homo sapiens
ugccacccuaccugu

SEQ ID NO: 1048668 - RNA, 14 nt, Homo sapiens
ugccacugccucuu

SEQ ID NO: 1048669 - RNA, 12 nt, Homo sapiens
ugccacuuugca

SEQ ID NO: 1048670 - RNA, 18 nt, Homo sapiens
ugccagaaagcauaaaau

SEQ ID NO: 1048671 - RNA, 17 nt, Homo sapiens
ugccagaugcaauacaa

SEQ ID NO: 1048672 - RNA, 20 nt, Homo sapiens
ugccagcuuaucucaggggu

SEQ ID NO: 1048673 - RNA, 19 nt, Homo sapiens
ugccaggauuaaaagccau

SEQ ID NO: 1048674 - RNA, 16 nt, Homo sapiens
ugccaggcacacugag

SEQ ID NO: 1048675 - RNA, 15 nt, Homo sapiens
ugccaggccuggcaa

SEQ ID NO: 1048676 - RNA, 20 nt, Homo sapiens
ugccagguucuauuuggaau

SEQ ID NO: 1048677 - RNA, 15 nt, Homo sapiens
ugccaguaggcucaa

SEQ ID NO: 1048678 - RNA, 16 nt, Homo sapiens
ugccaguuucccaaaa

SEQ ID NO: 1048679 - RNA, 23 nt, Homo sapiens
ugccaugccagcuuaucucaggg

SEQ ID NO: 1048680 - RNA, 22 nt, Homo sapiens
ugcccaauuagggccuagccuu

SEQ ID NO: 1048681 - RNA, 18 nt, Homo sapiens
ugcccaccugucaaacaa

SEQ ID NO: 1048682 - RNA, 19 nt, Homo sapiens
ugcccacgcuggagugcag

SEQ ID NO: 1048683 - RNA, 14 nt, Homo sapiens
ugcccacucuccac

SEQ ID NO: 1048684 - RNA, 18 nt, Homo sapiens
ugcccagaauaaguuauu

SEQ ID NO: 1048685 - RNA, 20 nt, Homo sapiens
ugcccaggcuggcgugcagu

SEQ ID NO: 1048686 - RNA, 20 nt, Homo sapiens
ugcccagggcucagccuggu

SEQ ID NO: 1048687 - RNA, 14 nt, Homo sapiens
ugccccacugaauu

SEQ ID NO: 1048688 - RNA, 13 nt, Homo sapiens
ugcccccaacagc

SEQ ID NO: 1048689 - RNA, 14 nt, Homo sapiens
ugcccccaacagca

SEQ ID NO: 1048690 - RNA, 14 nt, Homo sapiens
ugcccccccagugg

SEQ ID NO: 1048691 - RNA, 18 nt, Homo sapiens
ugcccccuucucccacac

SEQ ID NO: 1048692 - RNA, 12 nt, Homo sapiens
ugccccugagac

SEQ ID NO: 1048693 - RNA, 17 nt, Homo sapiens
ugccccugcacuccagc

SEQ ID NO: 1048694 - RNA, 22 nt, Homo sapiens
ugcccggggcagcugccagaga

SEQ ID NO: 1048695 - RNA, 17 nt, Homo sapiens
ugcccuaaaguguauuu

SEQ ID NO: 1048696 - RNA, 19 nt, Homo sapiens
ugcccucgggcgagucacu

SEQ ID NO: 1048697 - RNA, 14 nt, Homo sapiens
ugcccugacaugca

SEQ ID NO: 1048698 - RNA, 17 nt, Homo sapiens
ugcccugacaugcacac

SEQ ID NO: 1048699 - RNA, 17 nt, Homo sapiens
ugcccugaguccaagag

SEQ ID NO: 1048700 - RNA, 18 nt, Homo sapiens
ugcccugauccaaguuua

SEQ ID NO: 1048701 - RNA, 17 nt, Homo sapiens
ugcccugcccaugggag

SEQ ID NO: 1048702 - RNA, 18 nt, Homo sapiens
ugcccugguagggcagua

SEQ ID NO: 1048703 - RNA, 16 nt, Homo sapiens
ugcccugguccaggga

SEQ ID NO: 1048704 - RNA, 19 nt, Homo sapiens
ugcccuguaccugugcacg

SEQ ID NO: 1048705 - RNA, 21 nt, Homo sapiens
ugcccuuggaggccagccagu

SEQ ID NO: 1048706 - RNA, 12 nt, Homo sapiens
ugccgcauuugg

SEQ ID NO: 1048707 - RNA, 16 nt, Homo sapiens
ugccgcuacaaaaagg

SEQ ID NO: 1048708 - RNA, 19 nt, Homo sapiens
ugccggguucuagucuccu

SEQ ID NO: 1048709 - RNA, 23 nt, Homo sapiens
ugccgucaccucuccgcucauac

SEQ ID NO: 1048710 - RNA, 16 nt, Homo sapiens
ugccucaagccccaga

SEQ ID NO: 1048711 - RNA, 17 nt, Homo sapiens
ugccucaaugugaccag

SEQ ID NO: 1048712 - RNA, 22 nt, Homo sapiens
ugccucagccucccaaagugcu

SEQ ID NO: 1048713 - RNA, 22 nt, Homo sapiens
ugccucagccuccugaguaguu

SEQ ID NO: 1048714 - RNA, 17 nt, Homo sapiens
ugccuccaccccccaga

SEQ ID NO: 1048715 - RNA, 20 nt, Homo sapiens
ugccucugacacacagcucu

SEQ ID NO: 1048716 - RNA, 15 nt, Homo sapiens
ugccugaaccuucca

SEQ ID NO: 1048717 - RNA, 18 nt, Homo sapiens
ugccugaagccaggccau

SEQ ID NO: 1048718 - RNA, 13 nt, Homo sapiens
ugccugauuagau

SEQ ID NO: 1048719 - RNA, 18 nt, Homo sapiens
ugccugcaggcaugaguc

SEQ ID NO: 1048720 - RNA, 19 nt, Homo sapiens
ugccugcaggcaugaguca

SEQ ID NO: 1048721 - RNA, 14 nt, Homo sapiens
ugccugccacugag

SEQ ID NO: 1048722 - RNA, 20 nt, Homo sapiens
ugccugcuggagaaaaaaca

SEQ ID NO: 1048723 - RNA, 15 nt, Homo sapiens
ugccuggacacugua

SEQ ID NO: 1048724 - RNA, 15 nt, Homo sapiens
ugccuggccuggcac

SEQ ID NO: 1048725 - RNA, 20 nt, Homo sapiens
ugccuucaauaaaugguaua

SEQ ID NO: 1048726 - RNA, 16 nt, Homo sapiens
ugccuucacuuuacaa

SEQ ID NO: 1048727 - RNA, 16 nt, Homo sapiens
ugccuuccacaauuca

SEQ ID NO: 1048728 - RNA, 14 nt, Homo sapiens
ugccuucucaggaa

SEQ ID NO: 1048729 - RNA, 21 nt, Homo sapiens
ugccuucuguccuggugucac

SEQ ID NO: 1048730 - RNA, 16 nt, Homo sapiens
ugccuucuuauugcuu

SEQ ID NO: 1048731 - RNA, 21 nt, Homo sapiens
ugccuucuuauugcuuuuaug

SEQ ID NO: 1048732 - RNA, 16 nt, Homo sapiens
ugccuuggugugcugu

SEQ ID NO: 1048733 - RNA, 16 nt, Homo sapiens
ugccuuuagugaucac

SEQ ID NO: 1048734 - RNA, 13 nt, Homo sapiens
ugccuuugcuccu

SEQ ID NO: 1048735 - RNA, 20 nt, Homo sapiens
ugccuuuucaucuaauguga

SEQ ID NO: 1048736 - RNA, 22 nt, Homo sapiens
ugcgaauaagcuuuuaaugcuc

SEQ ID NO: 1048737 - RNA, 21 nt, Homo sapiens
ugcgaucuggguucacugcaa

SEQ ID NO: 1048738 - RNA, 17 nt, Homo sapiens
ugcgcauucucauggag

SEQ ID NO: 1048739 - RNA, 21 nt, Homo sapiens
ugcgcccaccccgcucugcau

SEQ ID NO: 1048740 - RNA, 17 nt, Homo sapiens
ugcgcccaguccuucca

SEQ ID NO: 1048741 - RNA, 22 nt, Homo sapiens
ugcgccgccgccggaguccacu

SEQ ID NO: 1048742 - RNA, 11 nt, Homo sapiens
ugcggcugugc

SEQ ID NO: 1048743 - RNA, 13 nt, Homo sapiens
ugcgugcaugugc

SEQ ID NO: 1048744 - RNA, 13 nt, Homo sapiens
ugcguggggacag

SEQ ID NO: 1048745 - RNA, 14 nt, Homo sapiens
ugcgugugugcaag

SEQ ID NO: 1048746 - RNA, 22 nt, Homo sapiens
ugcuaaauggucgcccaggaga

SEQ ID NO: 1048747 - RNA, 13 nt, Homo sapiens
ugcuaagugaaau

SEQ ID NO: 1048748 - RNA, 22 nt, Homo sapiens
ugcuaauccucuuuuucuaguc

SEQ ID NO: 1048749 - RNA, 17 nt, Homo sapiens
ugcuaauucaaagcucu

SEQ ID NO: 1048750 - RNA, 18 nt, Homo sapiens
ugcuaauucaaagcucua

SEQ ID NO: 1048751 - RNA, 17 nt, Homo sapiens
ugcuacaaaaacacagc

SEQ ID NO: 1048752 - RNA, 17 nt, Homo sapiens
ugcuacacauacaggau

SEQ ID NO: 1048753 - RNA, 15 nt, Homo sapiens
ugcuacgugugauuu

SEQ ID NO: 1048754 - RNA, 20 nt, Homo sapiens
ugcuagacaagcuuguccau

SEQ ID NO: 1048755 - RNA, 16 nt, Homo sapiens
ugcuagcugcaaguga

SEQ ID NO: 1048756 - RNA, 21 nt, Homo sapiens
ugcuauaacuauguugauaaa

SEQ ID NO: 1048757 - RNA, 19 nt, Homo sapiens
ugcuaugaagcguugaugg

SEQ ID NO: 1048758 - RNA, 16 nt, Homo sapiens
ugcucaauacaucuca

SEQ ID NO: 1048759 - RNA, 15 nt, Homo sapiens
ugcuccaaaugcuga

SEQ ID NO: 1048760 - RNA, 18 nt, Homo sapiens
ugcuccagugcaggagac

SEQ ID NO: 1048761 - RNA, 14 nt, Homo sapiens
ugcuccccugugaa

SEQ ID NO: 1048762 - RNA, 17 nt, Homo sapiens
ugcucccggguccugcu

SEQ ID NO: 1048763 - RNA, 22 nt, Homo sapiens
ugcuccgucuaagucaugagcu

SEQ ID NO: 1048764 - RNA, 17 nt, Homo sapiens
ugcuccuggagccuuug

SEQ ID NO: 1048765 - RNA, 18 nt, Homo sapiens
ugcucuggaaaaugugac

SEQ ID NO: 1048766 - RNA, 14 nt, Homo sapiens
ugcucuucuuuaga

SEQ ID NO: 1048767 - RNA, 18 nt, Homo sapiens
ugcucuugggaagaccag

SEQ ID NO: 1048768 - RNA, 15 nt, Homo sapiens
ugcugaaacaacaaa

SEQ ID NO: 1048769 - RNA, 12 nt, Homo sapiens
ugcugaagccaa

SEQ ID NO: 1048770 - RNA, 18 nt, Homo sapiens
ugcugaccuccacagcuu

SEQ ID NO: 1048771 - RNA, 23 nt, Homo sapiens
ugcugacggaagccaacuuggcu

SEQ ID NO: 1048772 - RNA, 15 nt, Homo sapiens
ugcugccauccucac

SEQ ID NO: 1048773 - RNA, 16 nt, Homo sapiens
ugcugcuccagugcag

SEQ ID NO: 1048774 - RNA, 15 nt, Homo sapiens
ugcugcugacccagc

SEQ ID NO: 1048775 - RNA, 17 nt, Homo sapiens
ugcugcuggaaguagaa

SEQ ID NO: 1048776 - RNA, 19 nt, Homo sapiens
ugcugcuucuccauggcca

SEQ ID NO: 1048777 - RNA, 19 nt, Homo sapiens
ugcugcuugaggcaacuca

SEQ ID NO: 1048778 - RNA, 14 nt, Homo sapiens
ugcuggagacacuc

SEQ ID NO: 1048779 - RNA, 14 nt, Homo sapiens
ugcuggcagaaagc

SEQ ID NO: 1048780 - RNA, 15 nt, Homo sapiens
ugcuggcauuugcac

SEQ ID NO: 1048781 - RNA, 21 nt, Homo sapiens
ugcugggcugacggugcaguc

SEQ ID NO: 1048782 - RNA, 14 nt, Homo sapiens
ugcugugugccuuc

SEQ ID NO: 1048783 - RNA, 22 nt, Homo sapiens
ugcuguuuuuguucuacucuag

SEQ ID NO: 1048784 - RNA, 22 nt, Homo sapiens
ugcuuaagguaugguacaagca

SEQ ID NO: 1048785 - RNA, 16 nt, Homo sapiens
ugcuuaaucugagaau

SEQ ID NO: 1048786 - RNA, 13 nt, Homo sapiens
ugcuuacaaaguc

SEQ ID NO: 1048787 - RNA, 12 nt, Homo sapiens
ugcuuacauuuu

SEQ ID NO: 1048788 - RNA, 19 nt, Homo sapiens
ugcuuagacauaacaaaac

SEQ ID NO: 1048789 - RNA, 16 nt, Homo sapiens
ugcuuagcucaucuua

SEQ ID NO: 1048790 - RNA, 18 nt, Homo sapiens
ugcuuaguguacuuggag

SEQ ID NO: 1048791 - RNA, 22 nt, Homo sapiens
uggccuguaaucccagcuacuu

SEQ ID NO: 1048792 - RNA, 23 nt, Homo sapiens
uggccuuccccagccucuucuag

SEQ ID NO: 1048793 - RNA, 17 nt, Homo sapiens
uggccuugaaaccaccu

SEQ ID NO: 1048794 - RNA, 12 nt, Homo sapiens
uggccuuucaua

SEQ ID NO: 1048795 - RNA, 16 nt, Homo sapiens
uggccuuugcuugaaa

SEQ ID NO: 1048796 - RNA, 16 nt, Homo sapiens
uggcuaagaguguccu

SEQ ID NO: 1048797 - RNA, 15 nt, Homo sapiens
uggcuacacagggau

SEQ ID NO: 1048798 - RNA, 19 nt, Homo sapiens
uggcuagugguggguacuc

SEQ ID NO: 1048799 - RNA, 15 nt, Homo sapiens
uggcucacaaacagu

SEQ ID NO: 1048800 - RNA, 12 nt, Homo sapiens
uggcucaucucu

SEQ ID NO: 1048801 - RNA, 14 nt, Homo sapiens
uggcuccaaacccu

SEQ ID NO: 1048802 - RNA, 16 nt, Homo sapiens
uggcuccuaucugugu

SEQ ID NO: 1048803 - RNA, 15 nt, Homo sapiens
uggcucucagaaggu

SEQ ID NO: 1048804 - RNA, 21 nt, Homo sapiens
uggcucucuccaggauccaga

SEQ ID NO: 1048805 - RNA, 23 nt, Homo sapiens
uggcucuggugugaaguuugcuu

SEQ ID NO: 1048806 - RNA, 19 nt, Homo sapiens
uggcugaaccgagcuggag

SEQ ID NO: 1048807 - RNA, 20 nt, Homo sapiens
uggcugaacgcguguguaca

SEQ ID NO: 1048808 - RNA, 15 nt, Homo sapiens
uggcugaccccaaag

SEQ ID NO: 1048809 - RNA, 19 nt, Homo sapiens
uggcugauuaucaccaucc

SEQ ID NO: 1048810 - RNA, 15 nt, Homo sapiens
uggcuggccacugca

SEQ ID NO: 1048811 - RNA, 12 nt, Homo sapiens
uggcuggcugcc

SEQ ID NO: 1048812 - RNA, 15 nt, Homo sapiens
uggcugggcccagaa

SEQ ID NO: 1048813 - RNA, 19 nt, Homo sapiens
uggcugguaacaguucaug

SEQ ID NO: 1048814 - RNA, 11 nt, Homo sapiens
uggcugugagg

SEQ ID NO: 1048815 - RNA, 18 nt, Homo sapiens
uggcuguuauucuuccac

SEQ ID NO: 1048816 - RNA, 19 nt, Homo sapiens
uggcuuaaugcuucuuuca

SEQ ID NO: 1048817 - RNA, 20 nt, Homo sapiens
uggcuuaaugcuucuuucau

SEQ ID NO: 1048818 - RNA, 14 nt, Homo sapiens
uggcuuacuccagg

SEQ ID NO: 1048819 - RNA, 21 nt, Homo sapiens
caacaaauuagguuuuguaca

SEQ ID NO: 1048820 - RNA, 12 nt, Homo sapiens
caacaacaugua

SEQ ID NO: 1048821 - RNA, 22 nt, Homo sapiens
caacaaccggccaccagauguc

SEQ ID NO: 1048822 - RNA, 19 nt, Homo sapiens
caacaauacaugcugcuaa

SEQ ID NO: 1048823 - RNA, 22 nt, Homo sapiens
caacacgagcaggcuacuguca

SEQ ID NO: 1048824 - RNA, 23 nt, Homo sapiens
caacacgagcaggcuacugucag

SEQ ID NO: 1048825 - RNA, 24 nt, Homo sapiens
caacacucacauuuauucugcuca

SEQ ID NO: 1048826 - RNA, 14 nt, Homo sapiens
caacacugcugcuc

SEQ ID NO: 1048827 - RNA, 23 nt, Homo sapiens
caacacugcugcuccagugcagg

SEQ ID NO: 1048828 - RNA, 17 nt, Homo sapiens
caacacugggaaacaga

SEQ ID NO: 1048829 - RNA, 19 nt, Homo sapiens
caacacuggugugaccuga

SEQ ID NO: 1048830 - RNA, 21 nt, Homo sapiens
caacagacuucucaauaauca

SEQ ID NO: 1048831 - RNA, 22 nt, Homo sapiens
caacagacuucucaauaaucaa

SEQ ID NO: 1048832 - RNA, 14 nt, Homo sapiens
caacagaucugcag

SEQ ID NO: 1048833 - RNA, 22 nt, Homo sapiens
caacagauggauagucugucca

SEQ ID NO: 1048834 - RNA, 12 nt, Homo sapiens
caacagaugugu

SEQ ID NO: 1048835 - RNA, 14 nt, Homo sapiens
caacagauguguca

SEQ ID NO: 1048836 - RNA, 17 nt, Homo sapiens
caacagcaaaucacgac

SEQ ID NO: 1048837 - RNA, 14 nt, Homo sapiens
caacagcacccucu

SEQ ID NO: 1048838 - RNA, 16 nt, Homo sapiens
caacagcauaacuaaa

SEQ ID NO: 1048839 - RNA, 15 nt, Homo sapiens
caacagcauuuucaa

SEQ ID NO: 1048840 - RNA, 20 nt, Homo sapiens
caacaggagcugggauccua

SEQ ID NO: 1048841 - RNA, 18 nt, Homo sapiens
caacaggaggacaauuca

SEQ ID NO: 1048842 - RNA, 17 nt, Homo sapiens
caacaucaagccuguga

SEQ ID NO: 1048843 - RNA, 15 nt, Homo sapiens
caacaucuugcaaaa

SEQ ID NO: 1048844 - RNA, 13 nt, Homo sapiens
caacaugagucaa

SEQ ID NO: 1048845 - RNA, 17 nt, Homo sapiens
caacaugugcucaggga

SEQ ID NO: 1048846 - RNA, 20 nt, Homo sapiens
caacauguuacugaccagca

SEQ ID NO: 1048847 - RNA, 11 nt, Homo sapiens
caacauugugu

SEQ ID NO: 1048848 - RNA, 17 nt, Homo sapiens
caacauuuacauguauu

SEQ ID NO: 1048849 - RNA, 16 nt, Homo sapiens
caaccagggagacugc

SEQ ID NO: 1048850 - RNA, 19 nt, Homo sapiens
caacccaaauguucaucaa

SEQ ID NO: 1048851 - RNA, 17 nt, Homo sapiens
caaccccccaccugcca

SEQ ID NO: 1048852 - RNA, 20 nt, Homo sapiens
caaccccuucgcuccugugu

SEQ ID NO: 1048853 - RNA, 15 nt, Homo sapiens
caacccuaaaaagca

SEQ ID NO: 1048854 - RNA, 22 nt, Homo sapiens
caaccuacuaauccucucugca

SEQ ID NO: 1048855 - RNA, 19 nt, Homo sapiens
caaccucauugacaagaac

SEQ ID NO: 1048856 - RNA, 19 nt, Homo sapiens
caaccugcuuggguggaga

SEQ ID NO: 1048857 - RNA, 20 nt, Homo sapiens
caacuagggagugagugcaa

SEQ ID NO: 1048858 - RNA, 13 nt, Homo sapiens
caacucaucuuag

SEQ ID NO: 1048859 - RNA, 20 nt, Homo sapiens
caacuccugucuaacugcug

SEQ ID NO: 1048860 - RNA, 15 nt, Homo sapiens
caacucuuugagaaa

SEQ ID NO: 1048861 - RNA, 13 nt, Homo sapiens
caacugaccagcc

SEQ ID NO: 1048862 - RNA, 18 nt, Homo sapiens
caacugcugcugugcaca

SEQ ID NO: 1048863 - RNA, 22 nt, Homo sapiens
caacugcuguucauguuacuca

SEQ ID NO: 1048864 - RNA, 15 nt, Homo sapiens
caacuggaaacccuu

SEQ ID NO: 1048865 - RNA, 20 nt, Homo sapiens
caacuucagcaguaccuaua

SEQ ID NO: 1048866 - RNA, 21 nt, Homo sapiens
caacuucauuugaugcuaaau

SEQ ID NO: 1048867 - RNA, 15 nt, Homo sapiens
caacuuccuguugau

SEQ ID NO: 1048868 - RNA, 20 nt, Homo sapiens
caacuugaauaauacaccag

SEQ ID NO: 1048869 - RNA, 20 nt, Homo sapiens
caacuuguauuaaagacaga

SEQ ID NO: 1048870 - RNA, 16 nt, Homo sapiens
caagaaacugagacca

SEQ ID NO: 1048871 - RNA, 15 nt, Homo sapiens
caagaagugccaguu

SEQ ID NO: 1048872 - RNA, 11 nt, Homo sapiens
caagaaugaga

SEQ ID NO: 1048873 - RNA, 14 nt, Homo sapiens
caagaaugcugaaa

SEQ ID NO: 1048874 - RNA, 18 nt, Homo sapiens
caagaauggggaucacag

SEQ ID NO: 1048875 - RNA, 17 nt, Homo sapiens
caagacaagccuggccu

SEQ ID NO: 1048876 - RNA, 13 nt, Homo sapiens
caagacaugauua

SEQ ID NO: 1048877 - RNA, 16 nt, Homo sapiens
caagaccuucucccca

SEQ ID NO: 1048878 - RNA, 22 nt, Homo sapiens
caagaccuucuccccauucugc

SEQ ID NO: 1048879 - RNA, 20 nt, Homo sapiens
caagacucuuuggacacuca

SEQ ID NO: 1048880 - RNA, 23 nt, Homo sapiens
caagagagaaagaaguaggcaug

SEQ ID NO: 1048881 - RNA, 23 nt, Homo sapiens
caagagauuguuguuugccauac

SEQ ID NO: 1048882 - RNA, 14 nt, Homo sapiens
caagagcacacuug

SEQ ID NO: 1048883 - RNA, 16 nt, Homo sapiens
caagagccauguagaa

SEQ ID NO: 1048884 - RNA, 16 nt, Homo sapiens
caagaggcuguuccca

SEQ ID NO: 1048885 - RNA, 22 nt, Homo sapiens
caagaggguccuuuaguaccug

SEQ ID NO: 1048886 - RNA, 14 nt, Homo sapiens
caagagucugauga

SEQ ID NO: 1048887 - RNA, 21 nt, Homo sapiens
caagaguuuauuuccaaauaa

SEQ ID NO: 1048888 - RNA, 14 nt, Homo sapiens
caagauauggacac

SEQ ID NO: 1048889 - RNA, 21 nt, Homo sapiens
caagaucacgccauugcacuc

SEQ ID NO: 1048890 - RNA, 21 nt, Homo sapiens
caagaucauagcucauugcaa

SEQ ID NO: 1048891 - RNA, 13 nt, Homo sapiens
caagauccuuaau

SEQ ID NO: 1048892 - RNA, 13 nt, Homo sapiens
caagaucuuucag

SEQ ID NO: 1048893 - RNA, 16 nt, Homo sapiens
caagaucuuucaggaa

SEQ ID NO: 1048894 - RNA, 17 nt, Homo sapiens
caagaucuuucaggaaa

SEQ ID NO: 1048895 - RNA, 21 nt, Homo sapiens
caagaugcgcacugcauucca

SEQ ID NO: 1048896 - RNA, 20 nt, Homo sapiens
caagauugcgccauugcacu

SEQ ID NO: 1048897 - RNA, 21 nt, Homo sapiens
caagcaagcucccaagggaug

SEQ ID NO: 1048898 - RNA, 20 nt, Homo sapiens
caagcacagugccugcaugu

SEQ ID NO: 1048899 - RNA, 13 nt, Homo sapiens
caagcagccaagg

SEQ ID NO: 1048900 - RNA, 15 nt, Homo sapiens
caagcagccaaggga

SEQ ID NO: 1048901 - RNA, 14 nt, Homo sapiens
caagcaguagacaa

SEQ ID NO: 1048902 - RNA, 11 nt, Homo sapiens
caagcauuaag

SEQ ID NO: 1048903 - RNA, 18 nt, Homo sapiens
caagccaguacgugcuaa

SEQ ID NO: 1048904 - RNA, 17 nt, Homo sapiens
caagccgagcucuccuu

SEQ ID NO: 1048905 - RNA, 20 nt, Homo sapiens
caagccuaaaauuguauaga

SEQ ID NO: 1048906 - RNA, 15 nt, Homo sapiens
caagccucaugucca

SEQ ID NO: 1048907 - RNA, 18 nt, Homo sapiens
caagccugugauuguguu

SEQ ID NO: 1048908 - RNA, 22 nt, Homo sapiens
caagcuaaaauuagaugaacuc

SEQ ID NO: 1048909 - RNA, 23 nt, Homo sapiens
caagcuagaaggccacaugucac

SEQ ID NO: 1048910 - RNA, 15 nt, Homo sapiens
caagcuccaccacuu

SEQ ID NO: 1048911 - RNA, 15 nt, Homo sapiens
caagcucuucacuga

SEQ ID NO: 1048912 - RNA, 20 nt, Homo sapiens
caagcugugacuucuccagg

SEQ ID NO: 1048913 - RNA, 16 nt, Homo sapiens
caagcuucaguuuccu

SEQ ID NO: 1048914 - RNA, 20 nt, Homo sapiens
caaggaaagccccagcacua

SEQ ID NO: 1048915 - RNA, 13 nt, Homo sapiens
caaggaagucaaa

SEQ ID NO: 1048916 - RNA, 16 nt, Homo sapiens
caaggaggccacguga

SEQ ID NO: 1048917 - RNA, 18 nt, Homo sapiens
caaggagggugagugcaa

SEQ ID NO: 1048918 - RNA, 19 nt, Homo sapiens
caaggagggugagugcaag

SEQ ID NO: 1048919 - RNA, 20 nt, Homo sapiens
caaggagggugagugcaagg

SEQ ID NO: 1048920 - RNA, 14 nt, Homo sapiens
caaggcacugccug

SEQ ID NO: 1048921 - RNA, 16 nt, Homo sapiens
caaggcaggugccucc

SEQ ID NO: 1048922 - RNA, 17 nt, Homo sapiens
caaggcaggugccucca

SEQ ID NO: 1048923 - RNA, 19 nt, Homo sapiens
caaggcccauaucugugaa

SEQ ID NO: 1048924 - RNA, 15 nt, Homo sapiens
caaggccccagagac

SEQ ID NO: 1048925 - RNA, 18 nt, Homo sapiens
caaggcccccacugccug

SEQ ID NO: 1048926 - RNA, 14 nt, Homo sapiens
caagggaaucugua

SEQ ID NO: 1048927 - RNA, 21 nt, Homo sapiens
caagggaauucggugugcacc

SEQ ID NO: 1048928 - RNA, 16 nt, Homo sapiens
caaggggugggccaca

SEQ ID NO: 1048929 - RNA, 17 nt, Homo sapiens
caaggugacauuuccau

SEQ ID NO: 1048930 - RNA, 21 nt, Homo sapiens
caagguuuaaacuucucugaa

SEQ ID NO: 1048931 - RNA, 21 nt, Homo sapiens
caaguaagaaagugaagcaaa

SEQ ID NO: 1048932 - RNA, 14 nt, Homo sapiens
caaguaauugugaa

SEQ ID NO: 1048933 - RNA, 15 nt, Homo sapiens
caaguagcacccugg

SEQ ID NO: 1048934 - RNA, 23 nt, Homo sapiens
caaguauucauuuuuucuacccu

SEQ ID NO: 1048935 - RNA, 13 nt, Homo sapiens
caucucugcaauc

SEQ ID NO: 1048936 - RNA, 18 nt, Homo sapiens
caucucuggaugccugau

SEQ ID NO: 1048937 - RNA, 16 nt, Homo sapiens
caucucuuuaccuccu

SEQ ID NO: 1048938 - RNA, 23 nt, Homo sapiens
caucucuuuaccuccuaauucca

SEQ ID NO: 1048939 - RNA, 20 nt, Homo sapiens
caucugacucacaagaagac

SEQ ID NO: 1048940 - RNA, 19 nt, Homo sapiens
caucugcccugacugaaug

SEQ ID NO: 1048941 - RNA, 12 nt, Homo sapiens
caucugcuuaca

SEQ ID NO: 1048942 - RNA, 18 nt, Homo sapiens
caucuggaaccaucagaa

SEQ ID NO: 1048943 - RNA, 22 nt, Homo sapiens
caucuggccuaauguuccagau

SEQ ID NO: 1048944 - RNA, 20 nt, Homo sapiens
caucugggaaagacauccau

SEQ ID NO: 1048945 - RNA, 19 nt, Homo sapiens
caucuuaagagaugccuca

SEQ ID NO: 1048946 - RNA, 17 nt, Homo sapiens
caucuuaguauuugcau

SEQ ID NO: 1048947 - RNA, 16 nt, Homo sapiens
caucuucccacagugg

SEQ ID NO: 1048948 - RNA, 18 nt, Homo sapiens
caucuucccacaguggcu

SEQ ID NO: 1048949 - RNA, 18 nt, Homo sapiens
caucuuccuggaagcaga

SEQ ID NO: 1048950 - RNA, 20 nt, Homo sapiens
caucuucuaggccaagcauu

SEQ ID NO: 1048951 - RNA, 12 nt, Homo sapiens
caucuuuccauc

SEQ ID NO: 1048952 - RNA, 21 nt, Homo sapiens
caucuuucuucuauuuuauuc

SEQ ID NO: 1048953 - RNA, 14 nt, Homo sapiens
caucuuugauacuu

SEQ ID NO: 1048954 - RNA, 14 nt, Homo sapiens
caugaaaagauuau

SEQ ID NO: 1048955 - RNA, 19 nt, Homo sapiens
caugaaaauagcucuuuca

SEQ ID NO: 1048956 - RNA, 17 nt, Homo sapiens
caugaaacauguucuca

SEQ ID NO: 1048957 - RNA, 22 nt, Homo sapiens
caugaaaugucuggucugucca

SEQ ID NO: 1048958 - RNA, 22 nt, Homo sapiens
caugaacaucuuuaggagacua

SEQ ID NO: 1048959 - RNA, 18 nt, Homo sapiens
caugaagcccaagugaaa

SEQ ID NO: 1048960 - RNA, 13 nt, Homo sapiens
caugaaugcacac

SEQ ID NO: 1048961 - RNA, 13 nt, Homo sapiens
caugaauguauca

SEQ ID NO: 1048962 - RNA, 15 nt, Homo sapiens
caugaauuccuuaaa

SEQ ID NO: 1048963 - RNA, 20 nt, Homo sapiens
caugacauauuuuugcuuua

SEQ ID NO: 1048964 - RNA, 13 nt, Homo sapiens
caugacauuccua

SEQ ID NO: 1048965 - RNA, 20 nt, Homo sapiens
caugacggcucaugccugua

SEQ ID NO: 1048966 - RNA, 23 nt, Homo sapiens
caugacuuuauauggaugauuca

SEQ ID NO: 1048967 - RNA, 17 nt, Homo sapiens
caugagaaguugauaua

SEQ ID NO: 1048968 - RNA, 18 nt, Homo sapiens
caugagaccacuguuauc

SEQ ID NO: 1048969 - RNA, 21 nt, Homo sapiens
caugagagaauuguaucauuu

SEQ ID NO: 1048970 - RNA, 19 nt, Homo sapiens
caugagaucuaggugagga

SEQ ID NO: 1048971 - RNA, 13 nt, Homo sapiens
caugagauuuaua

SEQ ID NO: 1048972 - RNA, 15 nt, Homo sapiens
caugagucccagugg

SEQ ID NO: 1048973 - RNA, 15 nt, Homo sapiens
caugaguccuugaaa

SEQ ID NO: 1048974 - RNA, 20 nt, Homo sapiens
caugagugcgugcucaguuc

SEQ ID NO: 1048975 - RNA, 17 nt, Homo sapiens
caugaugaaaccccauc

SEQ ID NO: 1048976 - RNA, 14 nt, Homo sapiens
caugaugagaguuu

SEQ ID NO: 1048977 - RNA, 19 nt, Homo sapiens
caugauggagcgcaccugc

SEQ ID NO: 1048978 - RNA, 19 nt, Homo sapiens
caugauggagucagguuug

SEQ ID NO: 1048979 - RNA, 23 nt, Homo sapiens
caugauggcaccacugcacucca

SEQ ID NO: 1048980 - RNA, 23 nt, Homo sapiens
caugauuauuuuuuuaaaaagcg

SEQ ID NO: 1048981 - RNA, 16 nt, Homo sapiens
caugauuucauuucaa

SEQ ID NO: 1048982 - RNA, 21 nt, Homo sapiens
caugcacacacacacaucuca

SEQ ID NO: 1048983 - RNA, 22 nt, Homo sapiens
caugcacacacacacaucucau

SEQ ID NO: 1048984 - RNA, 19 nt, Homo sapiens
caugcauaaauaugcagug

SEQ ID NO: 1048985 - RNA, 16 nt, Homo sapiens
caugcauaaaugcgau

SEQ ID NO: 1048986 - RNA, 18 nt, Homo sapiens
caugcauguccuguaaag

SEQ ID NO: 1048987 - RNA, 14 nt, Homo sapiens
caugccaagcauuu

SEQ ID NO: 1048988 - RNA, 19 nt, Homo sapiens
caugccacccuguuuucag

SEQ ID NO: 1048989 - RNA, 16 nt, Homo sapiens
caugcccucaauccca

SEQ ID NO: 1048990 - RNA, 14 nt, Homo sapiens
caugccucagugaa

SEQ ID NO: 1048991 - RNA, 17 nt, Homo sapiens
caugccuggauggggcu

SEQ ID NO: 1048992 - RNA, 15 nt, Homo sapiens
caugcgagugcucau

SEQ ID NO: 1048993 - RNA, 17 nt, Homo sapiens
caugcguuuaaucacau

SEQ ID NO: 1048994 - RNA, 13 nt, Homo sapiens
caugcuacugcca

SEQ ID NO: 1048995 - RNA, 22 nt, Homo sapiens
caugcugcuaauucaaagcucu

SEQ ID NO: 1048996 - RNA, 17 nt, Homo sapiens
caugcuguuccaccucc

SEQ ID NO: 1048997 - RNA, 15 nt, Homo sapiens
cauggaaauucccuu

SEQ ID NO: 1048998 - RNA, 13 nt, Homo sapiens
cauggacacucca

SEQ ID NO: 1048999 - RNA, 18 nt, Homo sapiens
cauggagagcuggagccu

SEQ ID NO: 1049000 - RNA, 13 nt, Homo sapiens
cauggagccagug

SEQ ID NO: 1049001 - RNA, 14 nt, Homo sapiens
cauggagugaccau

SEQ ID NO: 1049002 - RNA, 15 nt, Homo sapiens
cauggauaacacauu

SEQ ID NO: 1049003 - RNA, 19 nt, Homo sapiens
cauggaucaucaaggugaa

SEQ ID NO: 1049004 - RNA, 19 nt, Homo sapiens
cauggauucauuacagcuu

SEQ ID NO: 1049005 - RNA, 23 nt, Homo sapiens
cauggcagaguuuguguguuguc

SEQ ID NO: 1049006 - RNA, 17 nt, Homo sapiens
cauggccuaugcacaua

SEQ ID NO: 1049007 - RNA, 21 nt, Homo sapiens
cauggcuauaaacaauuacau

SEQ ID NO: 1049008 - RNA, 16 nt, Homo sapiens
cauggcucuaaaaagu

SEQ ID NO: 1049009 - RNA, 14 nt, Homo sapiens
cauggcugaacgcg

SEQ ID NO: 1049010 - RNA, 21 nt, Homo sapiens
cauggcugaaggaaaccagug

SEQ ID NO: 1049011 - RNA, 21 nt, Homo sapiens
cauggcuuaaugcuucuuuca

SEQ ID NO: 1049012 - RNA, 19 nt, Homo sapiens
cauggcuugccacagcucu

SEQ ID NO: 1049013 - RNA, 13 nt, Homo sapiens
caugggcucugac

SEQ ID NO: 1049014 - RNA, 19 nt, Homo sapiens
cauggggugggccucuggu

SEQ ID NO: 1049015 - RNA, 16 nt, Homo sapiens
caugguacuaguguuu

SEQ ID NO: 1049016 - RNA, 17 nt, Homo sapiens
caugguggguccauggg

SEQ ID NO: 1049017 - RNA, 20 nt, Homo sapiens
cauguaaaauaugucuuucu

SEQ ID NO: 1049018 - RNA, 19 nt, Homo sapiens
cauguaauuaaguacuaug

SEQ ID NO: 1049019 - RNA, 17 nt, Homo sapiens
cauguacauacccuggc

SEQ ID NO: 1049020 - RNA, 16 nt, Homo sapiens
cauguauuuguuugca

SEQ ID NO: 1049021 - RNA, 21 nt, Homo sapiens
cauguauuuuuaauauaugca

SEQ ID NO: 1049022 - RNA, 18 nt, Homo sapiens
caugucagcaucagcuca

SEQ ID NO: 1049023 - RNA, 16 nt, Homo sapiens
caugucgccucugcau

SEQ ID NO: 1049024 - RNA, 22 nt, Homo sapiens
caugugacacauaugcaccuug

SEQ ID NO: 1049025 - RNA, 14 nt, Homo sapiens
caugugcacuugaa

SEQ ID NO: 1049026 - RNA, 16 nt, Homo sapiens
caugugcagcuauuua

SEQ ID NO: 1049027 - RNA, 16 nt, Homo sapiens
caugugccgaaugugc

SEQ ID NO: 1049028 - RNA, 15 nt, Homo sapiens
caugugcgcacacac

SEQ ID NO: 1049029 - RNA, 13 nt, Homo sapiens
caugugcuugugu

SEQ ID NO: 1049030 - RNA, 21 nt, Homo sapiens
cauguggagaaaggagugaaa

SEQ ID NO: 1049031 - RNA, 21 nt, Homo sapiens
caugugugagugugugcaagu

SEQ ID NO: 1049032 - RNA, 17 nt, Homo sapiens
caugugugcgugugcgu

SEQ ID NO: 1049033 - RNA, 20 nt, Homo sapiens
caugugugcgugugcgugca

SEQ ID NO: 1049034 - RNA, 15 nt, Homo sapiens
caugugugugcaagu

SEQ ID NO: 1049035 - RNA, 19 nt, Homo sapiens
caugugugugcaagugugu

SEQ ID NO: 1049036 - RNA, 22 nt, Homo sapiens
caugugugugcaagugugugca

SEQ ID NO: 1049037 - RNA, 23 nt, Homo sapiens
caugugugugcaagugugugcau

SEQ ID NO: 1049038 - RNA, 14 nt, Homo sapiens
cauguucacugcaa

SEQ ID NO: 1049039 - RNA, 14 nt, Homo sapiens
cauguuccucaaaa

SEQ ID NO: 1049040 - RNA, 24 nt, Homo sapiens
cauguuggccaggcuggucucaaa

SEQ ID NO: 1049041 - RNA, 19 nt, Homo sapiens
cauguuucccuacaccucu

SEQ ID NO: 1049042 - RNA, 22 nt, Homo sapiens
cauguuuuccagcuccucaucc

SEQ ID NO: 1049043 - RNA, 22 nt, Homo sapiens
cauuaaaaaaauuagaaaguag

SEQ ID NO: 1049044 - RNA, 20 nt, Homo sapiens
cauuaaauauaauaugcaca

SEQ ID NO: 1049045 - RNA, 14 nt, Homo sapiens
cauuaaaucuauga

SEQ ID NO: 1049046 - RNA, 16 nt, Homo sapiens
cauuaaaucuaugaag

SEQ ID NO: 1049047 - RNA, 21 nt, Homo sapiens
cauuaacaguuuuccaugaaa

SEQ ID NO: 1049048 - RNA, 13 nt, Homo sapiens
cauuaacuucucu

SEQ ID NO: 1049049 - RNA, 15 nt, Homo sapiens
cauuaacuucucugg

SEQ ID NO: 1049050 - RNA, 14 nt, Homo sapiens
cauuaagcccucuu

SEQ ID NO: 1049051 - RNA, 19 nt, Homo sapiens
cauuaauauugcagucaau

SEQ ID NO: 1049052 - RNA, 16 nt, Homo sapiens
cauuaauauuugcuga

SEQ ID NO: 1049053 - RNA, 23 nt, Homo sapiens
cauuacgcuaguuaucaugcaug

SEQ ID NO: 1049054 - RNA, 19 nt, Homo sapiens
cauuagaacacugcauuag

SEQ ID NO: 1049055 - RNA, 13 nt, Homo sapiens
cauuagagucagc

SEQ ID NO: 1049056 - RNA, 15 nt, Homo sapiens
cauuaguuguuauua

SEQ ID NO: 1049057 - RNA, 15 nt, Homo sapiens
cauuauacauuugau

SEQ ID NO: 1049058 - RNA, 20 nt, Homo sapiens
cauuauaugcacuagcaaua

SEQ ID NO: 1049059 - RNA, 15 nt, Homo sapiens
cauuauauuuaggga

SEQ ID NO: 1049060 - RNA, 20 nt, Homo sapiens
cauuaucagccugugccacg

SEQ ID NO: 1049061 - RNA, 13 nt, Homo sapiens
cauuaucagucca

SEQ ID NO: 1049062 - RNA, 16 nt, Homo sapiens
cauuaucauguguaau

SEQ ID NO: 1049063 - RNA, 13 nt, Homo sapiens
cauuauccuugcu

SEQ ID NO: 1049064 - RNA, 18 nt, Homo sapiens
cauuaucgggagcagugu

SEQ ID NO: 1049065 - RNA, 22 nt, Homo sapiens
cauuaucucaaaacugcacugu

SEQ ID NO: 1049066 - RNA, 17 nt, Homo sapiens
cauuauuaaauguuucu

SEQ ID NO: 1049067 - RNA, 19 nt, Homo sapiens
cauuauuuuucacugcccc

SEQ ID NO: 1049068 - RNA, 17 nt, Homo sapiens
cauucacccagacagcu

SEQ ID NO: 1049069 - RNA, 17 nt, Homo sapiens
cauucacuugcauuucu

SEQ ID NO: 1049070 - RNA, 19 nt, Homo sapiens
cauucagggauagcacuga

SEQ ID NO: 1049071 - RNA, 14 nt, Homo sapiens
cauuccaccuuccc

SEQ ID NO: 1049072 - RNA, 22 nt, Homo sapiens
cauuccauccuugagucaaaaa

SEQ ID NO: 1049073 - RNA, 16 nt, Homo sapiens
cauuccauucuggaag

SEQ ID NO: 1049074 - RNA, 17 nt, Homo sapiens
cauuccuaaacuaucuu

SEQ ID NO: 1049075 - RNA, 22 nt, Homo sapiens
augcuucugacuucauagauuu

SEQ ID NO: 1049076 - RNA, 14 nt, Homo sapiens
augcuucuuucauu

SEQ ID NO: 1049077 - RNA, 15 nt, Homo sapiens
augcuugcauuauau

SEQ ID NO: 1049078 - RNA, 17 nt, Homo sapiens
augcuuggcuaacuaua

SEQ ID NO: 1049079 - RNA, 18 nt, Homo sapiens
augcuuguauuuuacuuu

SEQ ID NO: 1049080 - RNA, 23 nt, Homo sapiens
augcuuguauuuuacuuuuccau

SEQ ID NO: 1049081 - RNA, 12 nt, Homo sapiens
augcuuugcccc

SEQ ID NO: 1049082 - RNA, 23 nt, Homo sapiens
augcuuuugguccagguacugag

SEQ ID NO: 1049083 - RNA, 17 nt, Homo sapiens
auggaaauucccuucau

SEQ ID NO: 1049084 - RNA, 20 nt, Homo sapiens
auggaacacacuuggaugca

SEQ ID NO: 1049085 - RNA, 18 nt, Homo sapiens
auggaacaggcucagauc

SEQ ID NO: 1049086 - RNA, 13 nt, Homo sapiens
auggaacauaaaa

SEQ ID NO: 1049087 - RNA, 23 nt, Homo sapiens
auggaaccuccuuucucuucucu

SEQ ID NO: 1049088 - RNA, 22 nt, Homo sapiens
auggaagguucucugugcuccu

SEQ ID NO: 1049089 - RNA, 17 nt, Homo sapiens
auggaauacugaagggc

SEQ ID NO: 1049090 - RNA, 15 nt, Homo sapiens
auggaauuacaugua

SEQ ID NO: 1049091 - RNA, 15 nt, Homo sapiens
auggacaagauuacc

SEQ ID NO: 1049092 - RNA, 12 nt, Homo sapiens
auggacacucca

SEQ ID NO: 1049093 - RNA, 17 nt, Homo sapiens
auggagacuccaugaga

SEQ ID NO: 1049094 - RNA, 18 nt, Homo sapiens
auggagccagcucugcau

SEQ ID NO: 1049095 - RNA, 17 nt, Homo sapiens
auggaggaauuucuuga

SEQ ID NO: 1049096 - RNA, 14 nt, Homo sapiens
auggagugacuuag

SEQ ID NO: 1049097 - RNA, 18 nt, Homo sapiens
auggaguucuugugccau

SEQ ID NO: 1049098 - RNA, 14 nt, Homo sapiens
auggauagucuguc

SEQ ID NO: 1049099 - RNA, 17 nt, Homo sapiens
auggaucaucaagguga

SEQ ID NO: 1049100 - RNA, 21 nt, Homo sapiens
auggauugauaauugcauuca

SEQ ID NO: 1049101 - RNA, 17 nt, Homo sapiens
auggcaauuucacugau

SEQ ID NO: 1049102 - RNA, 23 nt, Homo sapiens
auggcaccccaaccccagugaua

SEQ ID NO: 1049103 - RNA, 13 nt, Homo sapiens
augaaaaugucau

SEQ ID NO: 1049104 - RNA, 15 nt, Homo sapiens
augaaacaccuucuc

SEQ ID NO: 1049105 - RNA, 16 nt, Homo sapiens
augaaacauuuuguca

SEQ ID NO: 1049106 - RNA, 14 nt, Homo sapiens
augaaacuggaaaa

SEQ ID NO: 1049107 - RNA, 15 nt, Homo sapiens
augaaagcacugcau

SEQ ID NO: 1049108 - RNA, 17 nt, Homo sapiens
augaaauaucaugcucc

SEQ ID NO: 1049109 - RNA, 22 nt, Homo sapiens
augaaauccugcuucaguguau

SEQ ID NO: 1049110 - RNA, 17 nt, Homo sapiens
augaaaugucaguggaa

SEQ ID NO: 1049111 - RNA, 20 nt, Homo sapiens
augaaaugucuggucugucc

SEQ ID NO: 1049112 - RNA, 13 nt, Homo sapiens
augaaauuacuua

SEQ ID NO: 1049113 - RNA, 16 nt, Homo sapiens
augaaauugcugaaag

SEQ ID NO: 1049114 - RNA, 13 nt, Homo sapiens
augaacacuuaau

SEQ ID NO: 1049115 - RNA, 22 nt, Homo sapiens
augaacauaaucuaccaacgaa

SEQ ID NO: 1049116 - RNA, 14 nt, Homo sapiens
augaacggugagca

SEQ ID NO: 1049117 - RNA, 18 nt, Homo sapiens
augaagaaaaucacuuag

SEQ ID NO: 1049118 - RNA, 14 nt, Homo sapiens
augaagacagauac

SEQ ID NO: 1049119 - RNA, 15 nt, Homo sapiens
augaagaucauauac

SEQ ID NO: 1049120 - RNA, 21 nt, Homo sapiens
augaagaugucuaauaguuau

SEQ ID NO: 1049121 - RNA, 21 nt, Homo sapiens
augaagauucuccugugcuag

SEQ ID NO: 1049122 - RNA, 20 nt, Homo sapiens
augaagcuaccucaaacuuc

SEQ ID NO: 1049123 - RNA, 21 nt, Homo sapiens
augaagcuuuauacguguagc

SEQ ID NO: 1049124 - RNA, 16 nt, Homo sapiens
augaaggcagagccau

SEQ ID NO: 1049125 - RNA, 18 nt, Homo sapiens
augaaguagcugagaaaa

SEQ ID NO: 1049126 - RNA, 14 nt, Homo sapiens
augaaucaaagaca

SEQ ID NO: 1049127 - RNA, 21 nt, Homo sapiens
augaaucccacccacauguga

SEQ ID NO: 1049128 - RNA, 21 nt, Homo sapiens
augaaucucaagauucaguag

SEQ ID NO: 1049129 - RNA, 21 nt, Homo sapiens
augaaucuucacaaaacacuu

SEQ ID NO: 1049130 - RNA, 18 nt, Homo sapiens
augaaugggcaaaacuga

SEQ ID NO: 1049131 - RNA, 23 nt, Homo sapiens
augaauguuuacacucuuuguaa

SEQ ID NO: 1049132 - RNA, 12 nt, Homo sapiens
augaauucuuga

SEQ ID NO: 1049133 - RNA, 23 nt, Homo sapiens
augaauucuugauuuccuuucag

SEQ ID NO: 1049134 - RNA, 14 nt, Homo sapiens
augacaaagacuga

SEQ ID NO: 1049135 - RNA, 19 nt, Homo sapiens
augacacaggcugacucau

SEQ ID NO: 1049136 - RNA, 13 nt, Homo sapiens
augacaucacuug

SEQ ID NO: 1049137 - RNA, 19 nt, Homo sapiens
augacaucagcaauacaga

SEQ ID NO: 1049138 - RNA, 14 nt, Homo sapiens
augacaucuucaaa

SEQ ID NO: 1049139 - RNA, 21 nt, Homo sapiens
augacaugcacucagcucuug

SEQ ID NO: 1049140 - RNA, 16 nt, Homo sapiens
augacauggugaaaau

SEQ ID NO: 1049141 - RNA, 12 nt, Homo sapiens
augacaugugac

SEQ ID NO: 1049142 - RNA, 12 nt, Homo sapiens
augacauguuau

SEQ ID NO: 1049143 - RNA, 15 nt, Homo sapiens
augacauuuauucaa

SEQ ID NO: 1049144 - RNA, 15 nt, Homo sapiens
augaccaugcugaua

SEQ ID NO: 1049145 - RNA, 13 nt, Homo sapiens
augacccaaagac

SEQ ID NO: 1049146 - RNA, 17 nt, Homo sapiens
augacccaccccugugc

SEQ ID NO: 1049147 - RNA, 23 nt, Homo sapiens
augacccccaaccaaguggcucc

SEQ ID NO: 1049148 - RNA, 22 nt, Homo sapiens
augacguccucucaacucucuu

SEQ ID NO: 1049149 - RNA, 10 nt, Homo sapiens
augacuaugc

SEQ ID NO: 1049150 - RNA, 20 nt, Homo sapiens
augacuauguuucuauucua

SEQ ID NO: 1049151 - RNA, 13 nt, Homo sapiens
augacucagcaua

SEQ ID NO: 1049152 - RNA, 15 nt, Homo sapiens
augacucagcauacc

SEQ ID NO: 1049153 - RNA, 17 nt, Homo sapiens
augacucagcauaccug

SEQ ID NO: 1049154 - RNA, 15 nt, Homo sapiens
augacuccuuucucu

SEQ ID NO: 1049155 - RNA, 20 nt, Homo sapiens
augagaaucagaucauuuca

SEQ ID NO: 1049156 - RNA, 16 nt, Homo sapiens
augagaccacuguuau

SEQ ID NO: 1049157 - RNA, 19 nt, Homo sapiens
augagagggugcuauccau

SEQ ID NO: 1049158 - RNA, 22 nt, Homo sapiens
augagcaauucuccugccucag

SEQ ID NO: 1049159 - RNA, 12 nt, Homo sapiens
augagcauuuag

SEQ ID NO: 1049160 - RNA, 14 nt, Homo sapiens
augagcuauuucca

SEQ ID NO: 1049161 - RNA, 13 nt, Homo sapiens
augagcuccagac

SEQ ID NO: 1049162 - RNA, 14 nt, Homo sapiens
augagcuccagacc

SEQ ID NO: 1049163 - RNA, 16 nt, Homo sapiens
augagcugacaucuca

SEQ ID NO: 1049164 - RNA, 23 nt, Homo sapiens
augagcuuuauguaauaauguga

SEQ ID NO: 1049165 - RNA, 13 nt, Homo sapiens
augaggaaacuuu

SEQ ID NO: 1049166 - RNA, 15 nt, Homo sapiens
augaggcaaugucag

SEQ ID NO: 1049167 - RNA, 14 nt, Homo sapiens
augaggcuucucag

SEQ ID NO: 1049168 - RNA, 15 nt, Homo sapiens
augagggcgcaagaa

SEQ ID NO: 1049169 - RNA, 14 nt, Homo sapiens
augaggggccucag

SEQ ID NO: 1049170 - RNA, 15 nt, Homo sapiens
augagguacucuccu

SEQ ID NO: 1049171 - RNA, 22 nt, Homo sapiens
augagguuucuuugacuucaau

SEQ ID NO: 1049172 - RNA, 15 nt, Homo sapiens
augagucaaugugca

SEQ ID NO: 1049173 - RNA, 14 nt, Homo sapiens
augaguccuugaaa

SEQ ID NO: 1049174 - RNA, 21 nt, Homo sapiens
augaguuuuugauagcuuuau

SEQ ID NO: 1049175 - RNA, 22 nt, Homo sapiens
augaucgcgccacuacacucca

SEQ ID NO: 1049176 - RNA, 20 nt, Homo sapiens
augaucuuugcagacaggca

SEQ ID NO: 1049177 - RNA, 17 nt, Homo sapiens
augaugacguccucuca

SEQ ID NO: 1049178 - RNA, 22 nt, Homo sapiens
augaugagguuuucuuaacuua

SEQ ID NO: 1049179 - RNA, 14 nt, Homo sapiens
augaugaugaucuu

SEQ ID NO: 1049180 - RNA, 15 nt, Homo sapiens
augaugauguggaag

SEQ ID NO: 1049181 - RNA, 20 nt, Homo sapiens
augauggcuuuaccuuuauu

SEQ ID NO: 1049182 - RNA, 17 nt, Homo sapiens
augauggugcugaccuc

SEQ ID NO: 1049183 - RNA, 22 nt, Homo sapiens
augaugucccuauggaagcaua

SEQ ID NO: 1049184 - RNA, 19 nt, Homo sapiens
augaugucguuugaaucac

SEQ ID NO: 1049185 - RNA, 11 nt, Homo sapiens
augauguuucg

SEQ ID NO: 1049186 - RNA, 14 nt, Homo sapiens
augauuaacuaauu

SEQ ID NO: 1049187 - RNA, 16 nt, Homo sapiens
augauugugcacauac

SEQ ID NO: 1049188 - RNA, 18 nt, Homo sapiens
augauuuagguacgucaa

SEQ ID NO: 1049189 - RNA, 21 nt, Homo sapiens
augauuucaaaugcuguaacu

SEQ ID NO: 1049190 - RNA, 13 nt, Homo sapiens
augauuucauuca

SEQ ID NO: 1049191 - RNA, 19 nt, Homo sapiens
augauuuuuuuuucauaca

SEQ ID NO: 1049192 - RNA, 14 nt, Homo sapiens
augcaaagcacuga

SEQ ID NO: 1049193 - RNA, 18 nt, Homo sapiens
augcaaaguagcaauuuc

SEQ ID NO: 1049194 - RNA, 16 nt, Homo sapiens
augcaaagucaugcaa

SEQ ID NO: 1049195 - RNA, 17 nt, Homo sapiens
augcaaauccuauguga

SEQ ID NO: 1049196 - RNA, 15 nt, Homo sapiens
augcaacaacaugua

SEQ ID NO: 1049197 - RNA, 15 nt, Homo sapiens
augcaaggucauuuu

SEQ ID NO: 1049198 - RNA, 16 nt, Homo sapiens
augcaaugaacacuua

SEQ ID NO: 1049199 - RNA, 20 nt, Homo sapiens
augcacacacacacaucuca

SEQ ID NO: 1049200 - RNA, 21 nt, Homo sapiens
augcacacacacacaucucau

SEQ ID NO: 1049201 - RNA, 14 nt, Homo sapiens
augcacauauggac

SEQ ID NO: 1049202 - RNA, 13 nt, Homo sapiens
augcacaucucau

SEQ ID NO: 1049203 - RNA, 16 nt, Homo sapiens
augcaccauggucaaa

SEQ ID NO: 1049204 - RNA, 14 nt, Homo sapiens
augcacgaucucag

SEQ ID NO: 1049205 - RNA, 14 nt, Homo sapiens
augcacguagcuga

SEQ ID NO: 1049206 - RNA, 15 nt, Homo sapiens
augcagcccaugccc

SEQ ID NO: 1049207 - RNA, 18 nt, Homo sapiens
augcagccccaucuccuc

SEQ ID NO: 1049208 - RNA, 18 nt, Homo sapiens
augcaguauugagcacug

SEQ ID NO: 1049209 - RNA, 18 nt, Homo sapiens
augcagugguaugaucac

SEQ ID NO: 1049210 - RNA, 15 nt, Homo sapiens
augcauaaaauguua

SEQ ID NO: 1049211 - RNA, 21 nt, Homo sapiens
augcauaaauaugcagugaua

SEQ ID NO: 1049212 - RNA, 14 nt, Homo sapiens
augcauaaaugcga

SEQ ID NO: 1049213 - RNA, 20 nt, Homo sapiens
augcauaggaaguauggcau

SEQ ID NO: 1049214 - RNA, 20 nt, Homo sapiens
augcauauuguauuacuaga

SEQ ID NO: 1049215 - RNA, 21 nt, Homo sapiens
augcauauuguauuacuagaa

SEQ ID NO: 1049216 - RNA, 21 nt, Homo sapiens
augccaagcacugugcucagg

SEQ ID NO: 1049217 - RNA, 21 nt, Homo sapiens
augccaauaaaguuugcccau

SEQ ID NO: 1049218 - RNA, 17 nt, Homo sapiens
augccacccuguuuuca

SEQ ID NO: 1049219 - RNA, 21 nt, Homo sapiens
augccagagacggaagccuuu

SEQ ID NO: 1049220 - RNA, 14 nt, Homo sapiens
augccagcuacuuc

SEQ ID NO: 1049221 - RNA, 17 nt, Homo sapiens
augccagcuuaucucag

SEQ ID NO: 1049222 - RNA, 19 nt, Homo sapiens
augccagcuuaucucaggg

SEQ ID NO: 1049223 - RNA, 19 nt, Homo sapiens
augccagggacugacaaaa

SEQ ID NO: 1049224 - RNA, 17 nt, Homo sapiens
augccagugaaacuuca

SEQ ID NO: 1049225 - RNA, 22 nt, Homo sapiens
augccagugaaacuucaagcaa

SEQ ID NO: 1049226 - RNA, 17 nt, Homo sapiens
augcccucaaucccagc

SEQ ID NO: 1049227 - RNA, 21 nt, Homo sapiens
augcccucaggggacuugaau

SEQ ID NO: 1049228 - RNA, 20 nt, Homo sapiens
augccgggcgcaguggcuca

SEQ ID NO: 1049229 - RNA, 13 nt, Homo sapiens
augccucaaccac

SEQ ID NO: 1049230 - RNA, 19 nt, Homo sapiens
augccucagccuacuuuca

SEQ ID NO: 1049231 - RNA, 22 nt, Homo sapiens
augccucauuaccuugugcuaa

SEQ ID NO: 1049232 - RNA, 20 nt, Homo sapiens
augccuccccaccaccaauu

SEQ ID NO: 1049233 - RNA, 16 nt, Homo sapiens
augccucuguauuuaa

SEQ ID NO: 1049234 - RNA, 16 nt, Homo sapiens
augccugauugccaag

SEQ ID NO: 1049235 - RNA, 17 nt, Homo sapiens
augccugauugccaagc

SEQ ID NO: 1049236 - RNA, 21 nt, Homo sapiens
augccugccccccucaucuca

SEQ ID NO: 1049237 - RNA, 12 nt, Homo sapiens
augccuuacucu

SEQ ID NO: 1049238 - RNA, 20 nt, Homo sapiens
augcggcccaggauggcuuu

SEQ ID NO: 1049239 - RNA, 22 nt, Homo sapiens
augcuagaaaggaagacagauu

SEQ ID NO: 1049240 - RNA, 20 nt, Homo sapiens
augcuaguagcagugagcaa

SEQ ID NO: 1049241 - RNA, 22 nt, Homo sapiens
augcuaguuugaccucauuugu

SEQ ID NO: 1049242 - RNA, 15 nt, Homo sapiens
augcuaucucugugu

SEQ ID NO: 1049243 - RNA, 19 nt, Homo sapiens
augcucagaccagcucuuc

SEQ ID NO: 1049244 - RNA, 18 nt, Homo sapiens
augcugcccgcucugcag

SEQ ID NO: 1049245 - RNA, 15 nt, Homo sapiens
augcuggacacuaca

SEQ ID NO: 1049246 - RNA, 20 nt, Homo sapiens
augcuggacggcauuccugc

SEQ ID NO: 1049247 - RNA, 18 nt, Homo sapiens
augcugggaaugagacau

SEQ ID NO: 1049248 - RNA, 22 nt, Homo sapiens
augcugucugguugcgccauuu

SEQ ID NO: 1049249 - RNA, 22 nt, Homo sapiens
augcuguuaugaguggcuuuaa

SEQ ID NO: 1049250 - RNA, 20 nt, Homo sapiens
augcuguuugacaaaguuac

SEQ ID NO: 1049251 - RNA, 16 nt, Homo sapiens
augcuucugacuucau

SEQ ID NO: 1049252 - RNA, 15 nt, Homo sapiens
auccccucucuuccu

SEQ ID NO: 1049253 - RNA, 19 nt, Homo sapiens
auccccuggacugggaggu

SEQ ID NO: 1049254 - RNA, 16 nt, Homo sapiens
auccccuucugcaauc

SEQ ID NO: 1049255 - RNA, 14 nt, Homo sapiens
aucccguguugcca

SEQ ID NO: 1049256 - RNA, 14 nt, Homo sapiens
aucccuacaaaaaa

SEQ ID NO: 1049257 - RNA, 14 nt, Homo sapiens
aucccucauccuca

SEQ ID NO: 1049258 - RNA, 12 nt, Homo sapiens
aucccugagauc

SEQ ID NO: 1049259 - RNA, 13 nt, Homo sapiens
aucccuuccccag

SEQ ID NO: 1049260 - RNA, 13 nt, Homo sapiens
auccgaaguauga

SEQ ID NO: 1049261 - RNA, 22 nt, Homo sapiens
auccggacuccugccgcaguga

SEQ ID NO: 1049262 - RNA, 20 nt, Homo sapiens
auccggcagccuggauguuu

SEQ ID NO: 1049263 - RNA, 13 nt, Homo sapiens
auccguacauuca

SEQ ID NO: 1049264 - RNA, 20 nt, Homo sapiens
auccguacauucaauguuua

SEQ ID NO: 1049265 - RNA, 22 nt, Homo sapiens
auccgucuaguuaacauuucaa

SEQ ID NO: 1049266 - RNA, 11 nt, Homo sapiens
auccuacccca

SEQ ID NO: 1049267 - RNA, 12 nt, Homo sapiens
auccuauggcag

SEQ ID NO: 1049268 - RNA, 13 nt, Homo sapiens
auccuauggcaga

SEQ ID NO: 1049269 - RNA, 19 nt, Homo sapiens
auccugcaauuccacuuau

SEQ ID NO: 1049270 - RNA, 21 nt, Homo sapiens
auccuggcucuuuggagauca

SEQ ID NO: 1049271 - RNA, 22 nt, Homo sapiens
auccuggguggucugcaggcag

SEQ ID NO: 1049272 - RNA, 19 nt, Homo sapiens
auccuguucucugaagaug

SEQ ID NO: 1049273 - RNA, 13 nt, Homo sapiens
auccuuauuccuc

SEQ ID NO: 1049274 - RNA, 20 nt, Homo sapiens
auccuuccuuuugagggagc

SEQ ID NO: 1049275 - RNA, 15 nt, Homo sapiens
auccuuuacuguuag

SEQ ID NO: 1049276 - RNA, 13 nt, Homo sapiens
aucgauuugcacc

SEQ ID NO: 1049277 - RNA, 15 nt, Homo sapiens
aucgcgccacugcac

SEQ ID NO: 1049278 - RNA, 16 nt, Homo sapiens
aucgcugucaucucag

SEQ ID NO: 1049279 - RNA, 22 nt, Homo sapiens
aucgcugucaucucagcuggau

SEQ ID NO: 1049280 - RNA, 23 nt, Homo sapiens
aucggaucuggggcucugggaua

SEQ ID NO: 1049281 - RNA, 16 nt, Homo sapiens
aucgggagcagugucu

SEQ ID NO: 1049282 - RNA, 20 nt, Homo sapiens
aucgucacugcuuaacuuca

SEQ ID NO: 1049283 - RNA, 22 nt, Homo sapiens
aucguccagcgaccuuccucau

SEQ ID NO: 1049284 - RNA, 20 nt, Homo sapiens
aucguuccaguucccacuug

SEQ ID NO: 1049285 - RNA, 15 nt, Homo sapiens
aucuaaaaucugcua

SEQ ID NO: 1049286 - RNA, 15 nt, Homo sapiens
aucuaagcagcauuu

SEQ ID NO: 1049287 - RNA, 18 nt, Homo sapiens
aucuaagccuuuccauaa

SEQ ID NO: 1049288 - RNA, 22 nt, Homo sapiens
aucuacaaaaaacaacaaauaa

SEQ ID NO: 1049289 - RNA, 12 nt, Homo sapiens
aucuacacucca

SEQ ID NO: 1049290 - RNA, 15 nt, Homo sapiens
aucuagauacuguau

SEQ ID NO: 1049291 - RNA, 18 nt, Homo sapiens
aucuagugcuagauguau

SEQ ID NO: 1049292 - RNA, 17 nt, Homo sapiens
aucuaucaauagucaag

SEQ ID NO: 1049293 - RNA, 22 nt, Homo sapiens
aucuaugaaauaucaugcucca

SEQ ID NO: 1049294 - RNA, 15 nt, Homo sapiens
aucucaaacuacugg

SEQ ID NO: 1049295 - RNA, 14 nt, Homo sapiens
aucucaauucuucc

SEQ ID NO: 1049296 - RNA, 16 nt, Homo sapiens
aucucaccccauccca

SEQ ID NO: 1049297 - RNA, 16 nt, Homo sapiens
aucucacuaccuuauu

SEQ ID NO: 1049298 - RNA, 21 nt, Homo sapiens
aucucacuuuucuccaugagu

SEQ ID NO: 1049299 - RNA, 16 nt, Homo sapiens
aucucagcaaugauua

SEQ ID NO: 1049300 - RNA, 17 nt, Homo sapiens
aucucagccagccucca

SEQ ID NO: 1049301 - RNA, 15 nt, Homo sapiens
aucucagccuaccau

SEQ ID NO: 1049302 - RNA, 23 nt, Homo sapiens
aucucagcuccugaaaaaugccu

SEQ ID NO: 1049303 - RNA, 19 nt, Homo sapiens
aucucagcuggaucuccau

SEQ ID NO: 1049304 - RNA, 18 nt, Homo sapiens
aucucaggccucccucaa

SEQ ID NO: 1049305 - RNA, 20 nt, Homo sapiens
aucucaugagugccaagcaa

SEQ ID NO: 1049306 - RNA, 20 nt, Homo sapiens
aucucauggagaagcagaaa

SEQ ID NO: 1049307 - RNA, 20 nt, Homo sapiens
aucucauuggacccuuccau

SEQ ID NO: 1049308 - RNA, 17 nt, Homo sapiens
aucucauuuaauccucu

SEQ ID NO: 1049309 - RNA, 20 nt, Homo sapiens
aucuccaaaauaaaacuuuu

SEQ ID NO: 1049310 - RNA, 20 nt, Homo sapiens
aucuccagauggaauggggu

SEQ ID NO: 1049311 - RNA, 22 nt, Homo sapiens
aucuccagggaguccccucccc

SEQ ID NO: 1049312 - RNA, 17 nt, Homo sapiens
aucuccauauguuacac

SEQ ID NO: 1049313 - RNA, 16 nt, Homo sapiens
aucuccccuucacaug

SEQ ID NO: 1049314 - RNA, 14 nt, Homo sapiens
aucucgacucacug

SEQ ID NO: 1049315 - RNA, 17 nt, Homo sapiens
aucucggcucacugcaa

SEQ ID NO: 1049316 - RNA, 17 nt, Homo sapiens
aucucuccuccaagaca

SEQ ID NO: 1049317 - RNA, 16 nt, Homo sapiens
aucucugaggccucag

SEQ ID NO: 1049318 - RNA, 22 nt, Homo sapiens
aucucugauucugucaaugucu

SEQ ID NO: 1049319 - RNA, 17 nt, Homo sapiens
aucucuggaugccugau

SEQ ID NO: 1049320 - RNA, 16 nt, Homo sapiens
aucucuuccuacccaa

SEQ ID NO: 1049321 - RNA, 17 nt, Homo sapiens
aucugacaucucugcaa

SEQ ID NO: 1049322 - RNA, 14 nt, Homo sapiens
aucugacauucuca

SEQ ID NO: 1049323 - RNA, 16 nt, Homo sapiens
aucugacucacaagaa

SEQ ID NO: 1049324 - RNA, 23 nt, Homo sapiens
aucugacucacaagaagaccaga

SEQ ID NO: 1049325 - RNA, 17 nt, Homo sapiens
aucugagaggccacagu

SEQ ID NO: 1049326 - RNA, 16 nt, Homo sapiens
aucugagcuaacuuau

SEQ ID NO: 1049327 - RNA, 20 nt, Homo sapiens
aucugauuuccuaaugucag

SEQ ID NO: 1049328 - RNA, 14 nt, Homo sapiens
aucugcagcuaacu

SEQ ID NO: 1049329 - RNA, 23 nt, Homo sapiens
aucugcagggccccgcaccaguu

SEQ ID NO: 1049330 - RNA, 22 nt, Homo sapiens
aucugcauccagccuccugcua

SEQ ID NO: 1049331 - RNA, 18 nt, Homo sapiens
aucugccaagcuccucaa

SEQ ID NO: 1049332 - RNA, 15 nt, Homo sapiens
aucugccacguguau

SEQ ID NO: 1049333 - RNA, 21 nt, Homo sapiens
aucugccuccccuucacuccc

SEQ ID NO: 1049334 - RNA, 17 nt, Homo sapiens
aucugcuuuugguuaua

SEQ ID NO: 1049335 - RNA, 23 nt, Homo sapiens
aucuggagaaccucauccagcuc

SEQ ID NO: 1049336 - RNA, 19 nt, Homo sapiens
aucugggaaaauaccccau

SEQ ID NO: 1049337 - RNA, 18 nt, Homo sapiens
aucugggaaagacaucca

SEQ ID NO: 1049338 - RNA, 17 nt, Homo sapiens
aucugguccaacaugaa

SEQ ID NO: 1049339 - RNA, 21 nt, Homo sapiens
aucugugcuuuccagcucacc

SEQ ID NO: 1049340 - RNA, 22 nt, Homo sapiens
aucuguguuuuauugacaucuc

SEQ ID NO: 1049341 - RNA, 15 nt, Homo sapiens
aucuguucuugcuac

SEQ ID NO: 1049342 - RNA, 21 nt, Homo sapiens
aucuguuugaucccuguuacc

SEQ ID NO: 1049343 - RNA, 14 nt, Homo sapiens
aucuuacugaaggu

SEQ ID NO: 1049344 - RNA, 23 nt, Homo sapiens
aucuucacuucuaaaugcauauc

SEQ ID NO: 1049345 - RNA, 21 nt, Homo sapiens
aucuucagggaacugcauaga

SEQ ID NO: 1049346 - RNA, 20 nt, Homo sapiens
aucuucucagcucccauuuc

SEQ ID NO: 1049347 - RNA, 24 nt, Homo sapiens
aucuucucagcucccauuucuacu

SEQ ID NO: 1049348 - RNA, 16 nt, Homo sapiens
aucuucuucaccauuu

SEQ ID NO: 1049349 - RNA, 15 nt, Homo sapiens
aucuucuuccaagaa

SEQ ID NO: 1049350 - RNA, 22 nt, Homo sapiens
aucuucuuuauaauucuacuuu

SEQ ID NO: 1049351 - RNA, 19 nt, Homo sapiens
aucuugaccaagcaggaag

SEQ ID NO: 1049352 - RNA, 20 nt, Homo sapiens
aucuugcuucugcuucucau

SEQ ID NO: 1049353 - RNA, 14 nt, Homo sapiens
aucuuggacugaca

SEQ ID NO: 1049354 - RNA, 19 nt, Homo sapiens
aucuuggacugacauuuag

SEQ ID NO: 1049355 - RNA, 18 nt, Homo sapiens
aucuuggagggaccaagg

SEQ ID NO: 1049356 - RNA, 19 nt, Homo sapiens
aucuuggauuaugaaguga

SEQ ID NO: 1049357 - RNA, 15 nt, Homo sapiens
aucuuuaucuguucu

SEQ ID NO: 1049358 - RNA, 12 nt, Homo sapiens
aucuuucaggaa

SEQ ID NO: 1049359 - RNA, 21 nt, Homo sapiens
aucuuucuacagggcugacau

SEQ ID NO: 1049360 - RNA, 12 nt, Homo sapiens
aucuuugcagac

SEQ ID NO: 1049361 - RNA, 12 nt, Homo sapiens
aucuuuggacag

SEQ ID NO: 1049362 - RNA, 21 nt, Homo sapiens
aucuuuggacagaagcagcuc

SEQ ID NO: 1049363 - RNA, 16 nt, Homo sapiens
aucuuuucacaaauaa

SEQ ID NO: 1049364 - RNA, 16 nt, Homo sapiens
aucuuuuuuagcauaa

SEQ ID NO: 1049365 - RNA, 13 nt, Homo sapiens
augaaaacaauuc

SEQ ID NO: 1049366 - RNA, 23 nt, Homo sapiens
augaaaacucauuacuuuuccau

SEQ ID NO: 1049367 - RNA, 18 nt, Homo sapiens
ccacauuuagaacuuugg

SEQ ID NO: 1049368 - RNA, 23 nt, Homo sapiens
ccaccaauccccgccacagcagg

SEQ ID NO: 1049369 - RNA, 13 nt, Homo sapiens
ccaccacauuuag

SEQ ID NO: 1049370 - RNA, 18 nt, Homo sapiens
ccaccaccaucaccagac

SEQ ID NO: 1049371 - RNA, 16 nt, Homo sapiens
ccaccaccucaccagu

SEQ ID NO: 1049372 - RNA, 18 nt, Homo sapiens
ccaccacggccacuggcc

SEQ ID NO: 1049373 - RNA, 18 nt, Homo sapiens
ccaccagccugcacuacu

SEQ ID NO: 1049374 - RNA, 21 nt, Homo sapiens
ccaccaucuccagcugaucac

SEQ ID NO: 1049375 - RNA, 18 nt, Homo sapiens
ccacccaccuaugugcca

SEQ ID NO: 1049376 - RNA, 22 nt, Homo sapiens
ccacccagaugggggaaagcac

SEQ ID NO: 1049377 - RNA, 13 nt, Homo sapiens
ccaccccacacuu

SEQ ID NO: 1049378 - RNA, 13 nt, Homo sapiens
ccacccuaguccc

SEQ ID NO: 1049379 - RNA, 15 nt, Homo sapiens
ccacccucaugcugu

SEQ ID NO: 1049380 - RNA, 17 nt, Homo sapiens
ccaccuauaccaauauu

SEQ ID NO: 1049381 - RNA, 17 nt, Homo sapiens
ccaccuccccagccuuu

SEQ ID NO: 1049382 - RNA, 18 nt, Homo sapiens
ccaccuccccucagacua

SEQ ID NO: 1049383 - RNA, 15 nt, Homo sapiens
ccaccuccuucucug

SEQ ID NO: 1049384 - RNA, 24 nt, Homo sapiens
ccaccugccugcaucugugaaaag

SEQ ID NO: 1049385 - RNA, 15 nt, Homo sapiens
ccaccuuccccagaa

SEQ ID NO: 1049386 - RNA, 17 nt, Homo sapiens
ccaccuuggcucaaguc

SEQ ID NO: 1049387 - RNA, 21 nt, Homo sapiens
ccacgagggucaggacuguga

SEQ ID NO: 1049388 - RNA, 15 nt, Homo sapiens
ccacggccaggccag

SEQ ID NO: 1049389 - RNA, 16 nt, Homo sapiens
ccacggcucuaggugg

SEQ ID NO: 1049390 - RNA, 13 nt, Homo sapiens
ccacguaucuuuc

SEQ ID NO: 1049391 - RNA, 22 nt, Homo sapiens
ccacguccagcuggaaggguca

SEQ ID NO: 1049392 - RNA, 12 nt, Homo sapiens
ccacuaagccaa

SEQ ID NO: 1049393 - RNA, 20 nt, Homo sapiens
ccacuagggcucuuguguuu

SEQ ID NO: 1049394 - RNA, 18 nt, Homo sapiens
ccacuaucugggugcaug

SEQ ID NO: 1049395 - RNA, 15 nt, Homo sapiens
ccacucaggccaaca

SEQ ID NO: 1049396 - RNA, 14 nt, Homo sapiens
ccacucccaggcag

SEQ ID NO: 1049397 - RNA, 14 nt, Homo sapiens
ccacucuccuugcu

SEQ ID NO: 1049398 - RNA, 21 nt, Homo sapiens
ccacugagaagugcacuuuaa

SEQ ID NO: 1049399 - RNA, 14 nt, Homo sapiens
ccacugccaaagaa

SEQ ID NO: 1049400 - RNA, 14 nt, Homo sapiens
ccacugccuuugac

SEQ ID NO: 1049401 - RNA, 18 nt, Homo sapiens
ccacugcguuguccacaa

SEQ ID NO: 1049402 - RNA, 15 nt, Homo sapiens
ccacuggccaucucc

SEQ ID NO: 1049403 - RNA, 14 nt, Homo sapiens
ccacuguguauaga

SEQ ID NO: 1049404 - RNA, 15 nt, Homo sapiens
ccacuguguauuuaa

SEQ ID NO: 1049405 - RNA, 22 nt, Homo sapiens
ccacuucccugggcaaaugaau

SEQ ID NO: 1049406 - RNA, 18 nt, Homo sapiens
ccacuuccuaaaucuuaa

SEQ ID NO: 1049407 - RNA, 13 nt, Homo sapiens
ccacuucuuucag

SEQ ID NO: 1049408 - RNA, 13 nt, Homo sapiens
ccagaaacuguuc

SEQ ID NO: 1049409 - RNA, 15 nt, Homo sapiens
ccagaacacacucca

SEQ ID NO: 1049410 - RNA, 21 nt, Homo sapiens
ccagaaccuguccuugcacac

SEQ ID NO: 1049411 - RNA, 21 nt, Homo sapiens
ccagaauaaaacgcaaagggc

SEQ ID NO: 1049412 - RNA, 16 nt, Homo sapiens
ccagaauaacuagcac

SEQ ID NO: 1049413 - RNA, 18 nt, Homo sapiens
ccagaauaacuagcacca

SEQ ID NO: 1049414 - RNA, 13 nt, Homo sapiens
ccagacacagaag

SEQ ID NO: 1049415 - RNA, 13 nt, Homo sapiens
ccagacacagugc

SEQ ID NO: 1049416 - RNA, 16 nt, Homo sapiens
ccagacacauguccaa

SEQ ID NO: 1049417 - RNA, 13 nt, Homo sapiens
ccagaccuuuuau

SEQ ID NO: 1049418 - RNA, 16 nt, Homo sapiens
ccagacuggcacaguu

SEQ ID NO: 1049419 - RNA, 18 nt, Homo sapiens
ccagacuuccuccuuucc

SEQ ID NO: 1049420 - RNA, 13 nt, Homo sapiens
ccagagaagccaa

SEQ ID NO: 1049421 - RNA, 14 nt, Homo sapiens
ccagagaauucuua

SEQ ID NO: 1049422 - RNA, 21 nt, Homo sapiens
ccagagcauuuccaacaccac

SEQ ID NO: 1049423 - RNA, 20 nt, Homo sapiens
ccagagcugggaggcauggc

SEQ ID NO: 1049424 - RNA, 19 nt, Homo sapiens
ccagagcuguggacuuugu

SEQ ID NO: 1049425 - RNA, 20 nt, Homo sapiens
ccagaggaagggacaccaag

SEQ ID NO: 1049426 - RNA, 13 nt, Homo sapiens
ccagaggacaaag

SEQ ID NO: 1049427 - RNA, 14 nt, Homo sapiens
ccagaggacaaagc

SEQ ID NO: 1049428 - RNA, 20 nt, Homo sapiens
ccagaggauugcugccccau

SEQ ID NO: 1049429 - RNA, 14 nt, Homo sapiens
ccagaggcugcaga

SEQ ID NO: 1049430 - RNA, 16 nt, Homo sapiens
ccagagggaauugcag

SEQ ID NO: 1049431 - RNA, 18 nt, Homo sapiens
ccagaggucuggcccuau

SEQ ID NO: 1049432 - RNA, 13 nt, Homo sapiens
ccagagugcugcc

SEQ ID NO: 1049433 - RNA, 23 nt, Homo sapiens
ccagaucagauucuucucuuaau

SEQ ID NO: 1049434 - RNA, 15 nt, Homo sapiens
ccagaucugcaguca

SEQ ID NO: 1049435 - RNA, 15 nt, Homo sapiens
ccagaugcauguuca

SEQ ID NO: 1049436 - RNA, 12 nt, Homo sapiens
ccagauugcaac

SEQ ID NO: 1049437 - RNA, 12 nt, Homo sapiens
ccagauuuacac

SEQ ID NO: 1049438 - RNA, 15 nt, Homo sapiens
ccagauuuacacugg

SEQ ID NO: 1049439 - RNA, 15 nt, Homo sapiens
ccagcaacugaauaa

SEQ ID NO: 1049440 - RNA, 23 nt, Homo sapiens
ccagcaacugaauaaauaccucu

SEQ ID NO: 1049441 - RNA, 16 nt, Homo sapiens
ccagcaagcucuucac

SEQ ID NO: 1049442 - RNA, 12 nt, Homo sapiens
ccagcacuuugg

SEQ ID NO: 1049443 - RNA, 16 nt, Homo sapiens
ccagcacuuugggagg

SEQ ID NO: 1049444 - RNA, 15 nt, Homo sapiens
ccagcagaucccagc

SEQ ID NO: 1049445 - RNA, 17 nt, Homo sapiens
ccagcccauggcuuuag

SEQ ID NO: 1049446 - RNA, 20 nt, Homo sapiens
ccagccgugaugcucaggcu

SEQ ID NO: 1049447 - RNA, 15 nt, Homo sapiens
ccagccuggccaaca

SEQ ID NO: 1049448 - RNA, 12 nt, Homo sapiens
ccagccuugacc

SEQ ID NO: 1049449 - RNA, 18 nt, Homo sapiens
ccagcgagggagaggucg

SEQ ID NO: 1049450 - RNA, 21 nt, Homo sapiens
ccagcuacucaagaggcugag

SEQ ID NO: 1049451 - RNA, 19 nt, Homo sapiens
ccagcuagcugcagagcca

SEQ ID NO: 1049452 - RNA, 15 nt, Homo sapiens
ccagcucagucccau

SEQ ID NO: 1049453 - RNA, 15 nt, Homo sapiens
ccagcugacauggaa

SEQ ID NO: 1049454 - RNA, 15 nt, Homo sapiens
ccagcugacucccua

SEQ ID NO: 1049455 - RNA, 13 nt, Homo sapiens
ccagcugaucaca

SEQ ID NO: 1049456 - RNA, 16 nt, Homo sapiens
ccagcugcaccugcca

SEQ ID NO: 1049457 - RNA, 18 nt, Homo sapiens
ccagcugcaccugccagc

SEQ ID NO: 1049458 - RNA, 23 nt, Homo sapiens
ccagcugcgccugcgcugcagga

SEQ ID NO: 1049459 - RNA, 18 nt, Homo sapiens
ccagcugcucccaaauaa

SEQ ID NO: 1049460 - RNA, 18 nt, Homo sapiens
ccagcuggggcgugggga

SEQ ID NO: 1049461 - RNA, 19 nt, Homo sapiens
ccagcuuguggagccccac

SEQ ID NO: 1049462 - RNA, 17 nt, Homo sapiens
ccagcuuuccucaucag

SEQ ID NO: 1049463 - RNA, 17 nt, Homo sapiens
ccaggaagccgugcccu

SEQ ID NO: 1049464 - RNA, 12 nt, Homo sapiens
ccaggaccaguc

SEQ ID NO: 1049465 - RNA, 19 nt, Homo sapiens
ccaggacgcccucacugca

SEQ ID NO: 1049466 - RNA, 13 nt, Homo sapiens
ccaggagcucuuc

SEQ ID NO: 1049467 - RNA, 23 nt, Homo sapiens
ccaggagcugggcagaaggccaa

SEQ ID NO: 1049468 - RNA, 19 nt, Homo sapiens
ccaggaggcuuaguccagu

SEQ ID NO: 1049469 - RNA, 18 nt, Homo sapiens
ccaggaguuugagaccag

SEQ ID NO: 1049470 - RNA, 18 nt, Homo sapiens
ccaggauugaccuuugca

SEQ ID NO: 1049471 - RNA, 14 nt, Homo sapiens
ccaggcacugcugc

SEQ ID NO: 1049472 - RNA, 13 nt, Homo sapiens
ccaggcaggcuaa

SEQ ID NO: 1049473 - RNA, 18 nt, Homo sapiens
ccaggcaggucuugaacu

SEQ ID NO: 1049474 - RNA, 15 nt, Homo sapiens
ccaggccccaggaag

SEQ ID NO: 1049475 - RNA, 15 nt, Homo sapiens
ccaggccugccuguu

SEQ ID NO: 1049476 - RNA, 15 nt, Homo sapiens
ccaggcgaugugcaa

SEQ ID NO: 1049477 - RNA, 17 nt, Homo sapiens
ccaggcgugguggcaca

SEQ ID NO: 1049478 - RNA, 14 nt, Homo sapiens
ccaggcuagaggca

SEQ ID NO: 1049479 - RNA, 15 nt, Homo sapiens
ccaggcuagagugca

SEQ ID NO: 1049480 - RNA, 17 nt, Homo sapiens
ccaggcuggagugcaau

SEQ ID NO: 1049481 - RNA, 19 nt, Homo sapiens
ccaggcuggagugcaaugg

SEQ ID NO: 1049482 - RNA, 20 nt, Homo sapiens
ccaggcuggcgugcaguggu

SEQ ID NO: 1049483 - RNA, 16 nt, Homo sapiens
ccaggcuggucucaaa

SEQ ID NO: 1049484 - RNA, 15 nt, Homo sapiens
ccagggaagugcucu

SEQ ID NO: 1049485 - RNA, 17 nt, Homo sapiens
ccagggaagugcucuga

SEQ ID NO: 1049486 - RNA, 15 nt, Homo sapiens
ccagggaugacaugu

SEQ ID NO: 1049487 - RNA, 16 nt, Homo sapiens
ccaggguuaaccacug

SEQ ID NO: 1049488 - RNA, 18 nt, Homo sapiens
ccaggguucaguccucaa

SEQ ID NO: 1049489 - RNA, 13 nt, Homo sapiens
ccaggucagggag

SEQ ID NO: 1049490 - RNA, 23 nt, Homo sapiens
ccagguguggcggcguaauccca

SEQ ID NO: 1049491 - RNA, 20 nt, Homo sapiens
ccagguuuuuggucugaccc

SEQ ID NO: 1049492 - RNA, 15 nt, Homo sapiens
ccaguaaacagagga

SEQ ID NO: 1049493 - RNA, 23 nt, Homo sapiens
ccaguaguggugacugugggcuc

SEQ ID NO: 1049494 - RNA, 19 nt, Homo sapiens
ccaguccucccagcugcca

SEQ ID NO: 1049495 - RNA, 20 nt, Homo sapiens
ccaguccuggggagcuucac

SEQ ID NO: 1049496 - RNA, 19 nt, Homo sapiens
ccagucuuccugacacuuu

SEQ ID NO: 1049497 - RNA, 21 nt, Homo sapiens
ccagucuuccugacacuuuaa

SEQ ID NO: 1049498 - RNA, 20 nt, Homo sapiens
ccagucuugucauugccagc

SEQ ID NO: 1049499 - RNA, 15 nt, Homo sapiens
ccagugaccagucac

SEQ ID NO: 1049500 - RNA, 19 nt, Homo sapiens
ccagugagauuacagagga

SEQ ID NO: 1049501 - RNA, 11 nt, Homo sapiens
aagcucucuuu

SEQ ID NO: 1049502 - RNA, 20 nt, Homo sapiens
aagcucuggugacaccagcc

SEQ ID NO: 1049503 - RNA, 13 nt, Homo sapiens
aagcucuucuaaa

SEQ ID NO: 1049504 - RNA, 20 nt, Homo sapiens
aagcucuugaagacacugaa

SEQ ID NO: 1049505 - RNA, 17 nt, Homo sapiens
aagcugaaguuucacuc

SEQ ID NO: 1049506 - RNA, 15 nt, Homo sapiens
aagcugaauccagau

SEQ ID NO: 1049507 - RNA, 21 nt, Homo sapiens
aagcugccugcuuuucacugc

SEQ ID NO: 1049508 - RNA, 14 nt, Homo sapiens
aagcuggaagcaca

SEQ ID NO: 1049509 - RNA, 21 nt, Homo sapiens
aagcuggauuauuuagaucua

SEQ ID NO: 1049510 - RNA, 19 nt, Homo sapiens
aagcuggcuuuucccauuu

SEQ ID NO: 1049511 - RNA, 22 nt, Homo sapiens
aagcugguaaacuauuugucuu

SEQ ID NO: 1049512 - RNA, 14 nt, Homo sapiens
aagcugucuuagag

SEQ ID NO: 1049513 - RNA, 12 nt, Homo sapiens
aagcuuauguca

SEQ ID NO: 1049514 - RNA, 21 nt, Homo sapiens
aagcuuccaguccaaucucau

SEQ ID NO: 1049515 - RNA, 12 nt, Homo sapiens
aagcuucuaucc

SEQ ID NO: 1049516 - RNA, 13 nt, Homo sapiens
aagcuuugcccuc

SEQ ID NO: 1049517 - RNA, 12 nt, Homo sapiens
aaggaaacuggg

SEQ ID NO: 1049518 - RNA, 18 nt, Homo sapiens
aaggaaacuggguuccug

SEQ ID NO: 1049519 - RNA, 23 nt, Homo sapiens
aaggaaacuggguuccugcaaug

SEQ ID NO: 1049520 - RNA, 15 nt, Homo sapiens
aaggaaaucucaccc

SEQ ID NO: 1049521 - RNA, 23 nt, Homo sapiens
aaggaacagagugagagacauca

SEQ ID NO: 1049522 - RNA, 22 nt, Homo sapiens
aaggaacauuccuuagucucaa

SEQ ID NO: 1049523 - RNA, 15 nt, Homo sapiens
aaggaagccacagcu

SEQ ID NO: 1049524 - RNA, 13 nt, Homo sapiens
aaggaagguucug

SEQ ID NO: 1049525 - RNA, 23 nt, Homo sapiens
aaggaagguucuggugugaacua

SEQ ID NO: 1049526 - RNA, 18 nt, Homo sapiens
aaggacacuagaagauuu

SEQ ID NO: 1049527 - RNA, 19 nt, Homo sapiens
aaggacagcugaaugacgg

SEQ ID NO: 1049528 - RNA, 11 nt, Homo sapiens
aaggacucuca

SEQ ID NO: 1049529 - RNA, 15 nt, Homo sapiens
aaggagaacuaucca

SEQ ID NO: 1049530 - RNA, 18 nt, Homo sapiens
aaggagaacuauccaaaa

SEQ ID NO: 1049531 - RNA, 24 nt, Homo sapiens
aaggagccaauugauuucaacaga

SEQ ID NO: 1049532 - RNA, 16 nt, Homo sapiens
aaggagccccauuccu

SEQ ID NO: 1049533 - RNA, 16 nt, Homo sapiens
aaggaggccacgugau

SEQ ID NO: 1049534 - RNA, 18 nt, Homo sapiens
aaggaggccacgugaugu

SEQ ID NO: 1049535 - RNA, 17 nt, Homo sapiens
aaggaggggaaccagau

SEQ ID NO: 1049536 - RNA, 20 nt, Homo sapiens
aaggaguaaucuguguacaa

SEQ ID NO: 1049537 - RNA, 15 nt, Homo sapiens
aaggagucugcacau

SEQ ID NO: 1049538 - RNA, 21 nt, Homo sapiens
aaggaucuuaggcaugacugu

SEQ ID NO: 1049539 - RNA, 22 nt, Homo sapiens
aaggaucuugccugcaugaaac

SEQ ID NO: 1049540 - RNA, 12 nt, Homo sapiens
aaggaugaauga

SEQ ID NO: 1049541 - RNA, 23 nt, Homo sapiens
aaggaugaucuaggaagacuuug

SEQ ID NO: 1049542 - RNA, 14 nt, Homo sapiens
aaggaugggaagga

SEQ ID NO: 1049543 - RNA, 19 nt, Homo sapiens
aaggaugucacagggccaa

SEQ ID NO: 1049544 - RNA, 14 nt, Homo sapiens
aaggcaaaugccca

SEQ ID NO: 1049545 - RNA, 22 nt, Homo sapiens
aaggcacacagcaagucagggu

SEQ ID NO: 1049546 - RNA, 14 nt, Homo sapiens
aaggcacagugaag

SEQ ID NO: 1049547 - RNA, 15 nt, Homo sapiens
aaggcaccuauaaaa

SEQ ID NO: 1049548 - RNA, 14 nt, Homo sapiens
aaggccacauguca

SEQ ID NO: 1049549 - RNA, 19 nt, Homo sapiens
aaggccacaugucaccgug

SEQ ID NO: 1049550 - RNA, 22 nt, Homo sapiens
aaggccagcgccagaacccaga

SEQ ID NO: 1049551 - RNA, 23 nt, Homo sapiens
aaggccucccugucuaaaauccc

SEQ ID NO: 1049552 - RNA, 13 nt, Homo sapiens
aaggcucagucuc

SEQ ID NO: 1049553 - RNA, 16 nt, Homo sapiens
aaggcucucacuccag

SEQ ID NO: 1049554 - RNA, 17 nt, Homo sapiens
aaggcugaccaagagag

SEQ ID NO: 1049555 - RNA, 18 nt, Homo sapiens
aaggcuggagugcagugg

SEQ ID NO: 1049556 - RNA, 18 nt, Homo sapiens
aaggcuggcagugacaga

SEQ ID NO: 1049557 - RNA, 16 nt, Homo sapiens
aagggacauauucauu

SEQ ID NO: 1049558 - RNA, 19 nt, Homo sapiens
aagggacuaggagcacugu

SEQ ID NO: 1049559 - RNA, 22 nt, Homo sapiens
aagggagagaacaaaagcuaua

SEQ ID NO: 1049560 - RNA, 15 nt, Homo sapiens
aagggauaguccaaa

SEQ ID NO: 1049561 - RNA, 16 nt, Homo sapiens
aagggaucuuccuugg

SEQ ID NO: 1049562 - RNA, 16 nt, Homo sapiens
aagggauggugcccug

SEQ ID NO: 1049563 - RNA, 20 nt, Homo sapiens
aagggccagcuggaggugaa

SEQ ID NO: 1049564 - RNA, 15 nt, Homo sapiens
aagggcuccagacac

SEQ ID NO: 1049565 - RNA, 17 nt, Homo sapiens
aaggggacuggauccca

SEQ ID NO: 1049566 - RNA, 13 nt, Homo sapiens
aaggguacugaaa

SEQ ID NO: 1049567 - RNA, 23 nt, Homo sapiens
aaggguuauagacugccaugcua

SEQ ID NO: 1049568 - RNA, 17 nt, Homo sapiens
aagguaguaacuuucca

SEQ ID NO: 1049569 - RNA, 12 nt, Homo sapiens
aagguaugcaau

SEQ ID NO: 1049570 - RNA, 16 nt, Homo sapiens
aagguaugcaaucaaa

SEQ ID NO: 1049571 - RNA, 15 nt, Homo sapiens
aaggucucugaacuc

SEQ ID NO: 1049572 - RNA, 14 nt, Homo sapiens
aaggucugaugucu

SEQ ID NO: 1049573 - RNA, 15 nt, Homo sapiens
aaggugccucaagaa

SEQ ID NO: 1049574 - RNA, 21 nt, Homo sapiens
aaggugggaaggaugguccag

SEQ ID NO: 1049575 - RNA, 22 nt, Homo sapiens
aaggugggccuugcuaccucaa

SEQ ID NO: 1049576 - RNA, 17 nt, Homo sapiens
aagguggggacagggau

SEQ ID NO: 1049577 - RNA, 19 nt, Homo sapiens
aagguggggacagggauga

SEQ ID NO: 1049578 - RNA, 14 nt, Homo sapiens
aagguggucacugu

SEQ ID NO: 1049579 - RNA, 15 nt, Homo sapiens
aagguggucacuguu

SEQ ID NO: 1049580 - RNA, 16 nt, Homo sapiens
aagguuccaacuguau

SEQ ID NO: 1049581 - RNA, 11 nt, Homo sapiens
aagguucucug

SEQ ID NO: 1049582 - RNA, 22 nt, Homo sapiens
aagguugcugaggcucugaccc

SEQ ID NO: 1049583 - RNA, 20 nt, Homo sapiens
aagguuugagaagcacuguu

SEQ ID NO: 1049584 - RNA, 12 nt, Homo sapiens
aaguaagcccuu

SEQ ID NO: 1049585 - RNA, 13 nt, Homo sapiens
aaguaagcccuug

SEQ ID NO: 1049586 - RNA, 15 nt, Homo sapiens
aaguaaggcaugguu

SEQ ID NO: 1049587 - RNA, 17 nt, Homo sapiens
aaguaaguuugauuuca

SEQ ID NO: 1049588 - RNA, 13 nt, Homo sapiens
aaguaaugaauuu

SEQ ID NO: 1049589 - RNA, 17 nt, Homo sapiens
aaguaauguuaauucuu

SEQ ID NO: 1049590 - RNA, 12 nt, Homo sapiens
aaguacucauac

SEQ ID NO: 1049591 - RNA, 17 nt, Homo sapiens
aaguacuguaacugugu

SEQ ID NO: 1049592 - RNA, 21 nt, Homo sapiens
aaguagaauagugguugccaa

SEQ ID NO: 1049593 - RNA, 14 nt, Homo sapiens
aaguagaauccuaa

SEQ ID NO: 1049594 - RNA, 18 nt, Homo sapiens
aaguagauuuuaaaagau

SEQ ID NO: 1049595 - RNA, 12 nt, Homo sapiens
aaguagcaauuu

SEQ ID NO: 1049596 - RNA, 14 nt, Homo sapiens
aaguaggaaaugaa

SEQ ID NO: 1049597 - RNA, 17 nt, Homo sapiens
aaguaggaaaugaauga

SEQ ID NO: 1049598 - RNA, 19 nt, Homo sapiens
aaguaggugugacuugaac

SEQ ID NO: 1049599 - RNA, 21 nt, Homo sapiens
aaguaggugugacuugaacua

SEQ ID NO: 1049600 - RNA, 13 nt, Homo sapiens
aaguaucaugcau

SEQ ID NO: 1049601 - RNA, 16 nt, Homo sapiens
aaguaugagggaaaau

SEQ ID NO: 1049602 - RNA, 17 nt, Homo sapiens
aaguaugagggaaaaug

SEQ ID NO: 1049603 - RNA, 18 nt, Homo sapiens
aaguauguaaacaggaga

SEQ ID NO: 1049604 - RNA, 14 nt, Homo sapiens
aaguaugugcauau

SEQ ID NO: 1049605 - RNA, 12 nt, Homo sapiens
aaguauuugaaa

SEQ ID NO: 1049606 - RNA, 14 nt, Homo sapiens
aagucaaagacauu

SEQ ID NO: 1049607 - RNA, 20 nt, Homo sapiens
aagucaggacaucagucuga

SEQ ID NO: 1049608 - RNA, 20 nt, Homo sapiens
aagucauagggggcucaagu

SEQ ID NO: 1049609 - RNA, 20 nt, Homo sapiens
aagucaucauaauucagcuc

SEQ ID NO: 1049610 - RNA, 18 nt, Homo sapiens
aaguccaagcauaccaac

SEQ ID NO: 1049611 - RNA, 14 nt, Homo sapiens
aaguccaauuccaa

SEQ ID NO: 1049612 - RNA, 14 nt, Homo sapiens
aagucccagcauug

SEQ ID NO: 1049613 - RNA, 17 nt, Homo sapiens
aagucccuuugugacuu

SEQ ID NO: 1049614 - RNA, 20 nt, Homo sapiens
aagucccuuugugacuucaa

SEQ ID NO: 1049615 - RNA, 17 nt, Homo sapiens
aaguccuuucuaaguau

SEQ ID NO: 1049616 - RNA, 14 nt, Homo sapiens
aagucgaugaacua

SEQ ID NO: 1049617 - RNA, 23 nt, Homo sapiens
aagucuaaauaaaugaaguauuu

SEQ ID NO: 1049618 - RNA, 20 nt, Homo sapiens
aagucuccagucaccuacaa

SEQ ID NO: 1049619 - RNA, 16 nt, Homo sapiens
aagucuucagggaagg

SEQ ID NO: 1049620 - RNA, 23 nt, Homo sapiens
aagucuuccauagagacuuugug

SEQ ID NO: 1049621 - RNA, 18 nt, Homo sapiens
aagugacucucacaagau

SEQ ID NO: 1049622 - RNA, 15 nt, Homo sapiens
aagugacuugcccag

SEQ ID NO: 1049623 - RNA, 19 nt, Homo sapiens
aagugagacccugucucaa

SEQ ID NO: 1049624 - RNA, 21 nt, Homo sapiens
aagugagcugagauugcacca

SEQ ID NO: 1049625 - RNA, 19 nt, Homo sapiens
aagugauccucccaccuca

SEQ ID NO: 1049626 - RNA, 22 nt, Homo sapiens
aagugcacaacauuacagggaa

SEQ ID NO: 1049627 - RNA, 13 nt, Homo sapiens
aagugcacuuuaa

SEQ ID NO: 1049628 - RNA, 17 nt, Homo sapiens
aagugcaugaaauguau

SEQ ID NO: 1049629 - RNA, 11 nt, Homo sapiens
aagugccccug

SEQ ID NO: 1049630 - RNA, 20 nt, Homo sapiens
aagugcugggauuacaggca

SEQ ID NO: 1049631 - RNA, 17 nt, Homo sapiens
aagugggaucugucaca

SEQ ID NO: 1049632 - RNA, 22 nt, Homo sapiens
aagugggaucugucacaccagc

SEQ ID NO: 1049633 - RNA, 19 nt, Homo sapiens
aaguggggaaguguuccag

SEQ ID NO: 1049634 - RNA, 21 nt, Homo sapiens
aagugucaccccucacuguga

SEQ ID NO: 1049635 - RNA, 22 nt, Homo sapiens
aagugucaccccucacugugac

SEQ ID NO: 1049636 - RNA, 11 nt, Homo sapiens
aagugugagua

SEQ ID NO: 1049637 - RNA, 11 nt, Homo sapiens
aagugugcaua

SEQ ID NO: 1049638 - RNA, 13 nt, Homo sapiens
aagugugugcaug

SEQ ID NO: 1049639 - RNA, 21 nt, Homo sapiens
aaguguuaauacuaguuguga

SEQ ID NO: 1049640 - RNA, 14 nt, Homo sapiens
aaguucaacuucca

SEQ ID NO: 1049641 - RNA, 23 nt, Homo sapiens
aaguuccaugaauucuugauuuc

SEQ ID NO: 1049642 - RNA, 15 nt, Homo sapiens
aaguuccucuagugc

SEQ ID NO: 1049643 - RNA, 22 nt, Homo sapiens
aaguucuucuccaauccuauca

SEQ ID NO: 1049644 - RNA, 18 nt, Homo sapiens
aaguugaaugggcacagc

SEQ ID NO: 1049645 - RNA, 23 nt, Homo sapiens
aaguugauauagaacagugcuug

SEQ ID NO: 1049646 - RNA, 18 nt, Homo sapiens
accccaacagcacccucu

SEQ ID NO: 1049647 - RNA, 19 nt, Homo sapiens
accccagucccagcuaacu

SEQ ID NO: 1049648 - RNA, 11 nt, Homo sapiens
accccaucucu

SEQ ID NO: 1049649 - RNA, 17 nt, Homo sapiens
accccaugcuguugauu

SEQ ID NO: 1049650 - RNA, 14 nt, Homo sapiens
acccccagcucaau

SEQ ID NO: 1049651 - RNA, 15 nt, Homo sapiens
acccccagcucaaug

SEQ ID NO: 1049652 - RNA, 18 nt, Homo sapiens
accccccuauugcugcug

SEQ ID NO: 1049653 - RNA, 19 nt, Homo sapiens
acccccguguccaccguga

SEQ ID NO: 1049654 - RNA, 17 nt, Homo sapiens
acccccuuugugcugug

SEQ ID NO: 1049655 - RNA, 15 nt, Homo sapiens
accccguagauuccc

SEQ ID NO: 1049656 - RNA, 17 nt, Homo sapiens
accccgucacagccuca

SEQ ID NO: 1049657 - RNA, 16 nt, Homo sapiens
accccuccuuccuuga

SEQ ID NO: 1049658 - RNA, 18 nt, Homo sapiens
accccuccuuccuugacc

SEQ ID NO: 1049659 - RNA, 18 nt, Homo sapiens
accccucucugcaucuga

SEQ ID NO: 1049660 - RNA, 12 nt, Homo sapiens
accccucuggcc

SEQ ID NO: 1049661 - RNA, 13 nt, Homo sapiens
accccugcucagu

SEQ ID NO: 1049662 - RNA, 20 nt, Homo sapiens
accccugcuccccugagcug

SEQ ID NO: 1049663 - RNA, 15 nt, Homo sapiens
accccuuagccuccc

SEQ ID NO: 1049664 - RNA, 20 nt, Homo sapiens
accccuugccggugaaggau

SEQ ID NO: 1049665 - RNA, 22 nt, Homo sapiens
accccuugcucucaacccagga

SEQ ID NO: 1049666 - RNA, 16 nt, Homo sapiens
acccgcagaguucuca

SEQ ID NO: 1049667 - RNA, 22 nt, Homo sapiens
acccggcaggcuagaaccuggc

SEQ ID NO: 1049668 - RNA, 21 nt, Homo sapiens
acccgggaggcagagguugca

SEQ ID NO: 1049669 - RNA, 18 nt, Homo sapiens
acccuaggcaucacaugc

SEQ ID NO: 1049670 - RNA, 20 nt, Homo sapiens
acccuaggcaucacaugcuc

SEQ ID NO: 1049671 - RNA, 17 nt, Homo sapiens
acccuagucuuuuaaac

SEQ ID NO: 1049672 - RNA, 20 nt, Homo sapiens
acccuaguucuaccucaggc

SEQ ID NO: 1049673 - RNA, 17 nt, Homo sapiens
acccuaguuucccugaa

SEQ ID NO: 1049674 - RNA, 18 nt, Homo sapiens
acccuauacaacuggaca

SEQ ID NO: 1049675 - RNA, 15 nt, Homo sapiens
acccucaggacaaug

SEQ ID NO: 1049676 - RNA, 18 nt, Homo sapiens
acccucaggucacaagag

SEQ ID NO: 1049677 - RNA, 16 nt, Homo sapiens
acccucccacugccaa

SEQ ID NO: 1049678 - RNA, 19 nt, Homo sapiens
acccucuuagaaaaaccac

SEQ ID NO: 1049679 - RNA, 18 nt, Homo sapiens
acccugccccugccuuga

SEQ ID NO: 1049680 - RNA, 15 nt, Homo sapiens
acccugcgauuuugc

SEQ ID NO: 1049681 - RNA, 16 nt, Homo sapiens
acccugcgauuuugcc

SEQ ID NO: 1049682 - RNA, 17 nt, Homo sapiens
acccugcucuccgacca

SEQ ID NO: 1049683 - RNA, 23 nt, Homo sapiens
acccuggagcccauccagucucc

SEQ ID NO: 1049684 - RNA, 19 nt, Homo sapiens
acccugucuaaaaaacaua

SEQ ID NO: 1049685 - RNA, 14 nt, Homo sapiens
acccuuaggccagc

SEQ ID NO: 1049686 - RNA, 15 nt, Homo sapiens
acccuuccucaccac

SEQ ID NO: 1049687 - RNA, 12 nt, Homo sapiens
acccuucugccu

SEQ ID NO: 1049688 - RNA, 20 nt, Homo sapiens
acccuuguguccacugugac

SEQ ID NO: 1049689 - RNA, 16 nt, Homo sapiens
accgaaaccuugccuu

SEQ ID NO: 1049690 - RNA, 13 nt, Homo sapiens
accgagacaccac

SEQ ID NO: 1049691 - RNA, 13 nt, Homo sapiens
accgagcaauuuu

SEQ ID NO: 1049692 - RNA, 15 nt, Homo sapiens
accgagccucuguca

SEQ ID NO: 1049693 - RNA, 16 nt, Homo sapiens
accgagccucugucac

SEQ ID NO: 1049694 - RNA, 13 nt, Homo sapiens
accgagugcaaug

SEQ ID NO: 1049695 - RNA, 19 nt, Homo sapiens
accgcaggauuugggcucu

SEQ ID NO: 1049696 - RNA, 22 nt, Homo sapiens
accgcagucgucgcacagucuc

SEQ ID NO: 1049697 - RNA, 21 nt, Homo sapiens
accgcauccucagcuucuucc

SEQ ID NO: 1049698 - RNA, 19 nt, Homo sapiens
accgcgccuggccaggcug

SEQ ID NO: 1049699 - RNA, 23 nt, Homo sapiens
accgcugauucucagggucucug

SEQ ID NO: 1049700 - RNA, 15 nt, Homo sapiens
accgggcugggagcu

SEQ ID NO: 1049701 - RNA, 14 nt, Homo sapiens
accguacuguggaa

SEQ ID NO: 1049702 - RNA, 14 nt, Homo sapiens
accguggaccuucc

SEQ ID NO: 1049703 - RNA, 19 nt, Homo sapiens
accguuauuauaauuguau

SEQ ID NO: 1049704 - RNA, 23 nt, Homo sapiens
accguuuccuuucauuuacugug

SEQ ID NO: 1049705 - RNA, 17 nt, Homo sapiens
accuaaaagagauuuca

SEQ ID NO: 1049706 - RNA, 17 nt, Homo sapiens
accuaagggcccaaagg

SEQ ID NO: 1049707 - RNA, 19 nt, Homo sapiens
accuacaugagguacugag

SEQ ID NO: 1049708 - RNA, 20 nt, Homo sapiens
accuaccaccccuuccuguc

SEQ ID NO: 1049709 - RNA, 13 nt, Homo sapiens
accuaccaucagg

SEQ ID NO: 1049710 - RNA, 18 nt, Homo sapiens
accuagaaauacauggac

SEQ ID NO: 1049711 - RNA, 21 nt, Homo sapiens
accuagccuuagaagucacac

SEQ ID NO: 1049712 - RNA, 16 nt, Homo sapiens
accuagcgucaguauu

SEQ ID NO: 1049713 - RNA, 13 nt, Homo sapiens
accuaggauuuca

SEQ ID NO: 1049714 - RNA, 14 nt, Homo sapiens
accuagggauguuc

SEQ ID NO: 1049715 - RNA, 15 nt, Homo sapiens
accuaucacuuccac

SEQ ID NO: 1049716 - RNA, 17 nt, Homo sapiens
accuaugucccuucuca

SEQ ID NO: 1049717 - RNA, 13 nt, Homo sapiens
accuaugugccaa

SEQ ID NO: 1049718 - RNA, 22 nt, Homo sapiens
accucaacugccuacuccaaaa

SEQ ID NO: 1049719 - RNA, 16 nt, Homo sapiens
accucaccaguuucca

SEQ ID NO: 1049720 - RNA, 12 nt, Homo sapiens
accucacugggg

SEQ ID NO: 1049721 - RNA, 12 nt, Homo sapiens
accucacuuuag

SEQ ID NO: 1049722 - RNA, 11 nt, Homo sapiens
accucagggcu

SEQ ID NO: 1049723 - RNA, 20 nt, Homo sapiens
accucaggugagaagcagag

SEQ ID NO: 1049724 - RNA, 16 nt, Homo sapiens
accucaggugauccac

SEQ ID NO: 1049725 - RNA, 12 nt, Homo sapiens
accucaguuuua

SEQ ID NO: 1049726 - RNA, 16 nt, Homo sapiens
accucaucucuacuaa

SEQ ID NO: 1049727 - RNA, 12 nt, Homo sapiens
accucauuauca

SEQ ID NO: 1049728 - RNA, 15 nt, Homo sapiens
accuccacauguuca

SEQ ID NO: 1049729 - RNA, 14 nt, Homo sapiens
accucccacugccc

SEQ ID NO: 1049730 - RNA, 22 nt, Homo sapiens
accucccccaagcagagcuucc

SEQ ID NO: 1049731 - RNA, 15 nt, Homo sapiens
accucccccaggugc

SEQ ID NO: 1049732 - RNA, 21 nt, Homo sapiens
accucccccugaacacuguga

SEQ ID NO: 1049733 - RNA, 20 nt, Homo sapiens
accuccuccucuggacaaag

SEQ ID NO: 1049734 - RNA, 23 nt, Homo sapiens
accuccugaccugucaccgugag

SEQ ID NO: 1049735 - RNA, 14 nt, Homo sapiens
accuccugucucug

SEQ ID NO: 1049736 - RNA, 17 nt, Homo sapiens
accucgaccugaugcag

SEQ ID NO: 1049737 - RNA, 15 nt, Homo sapiens
accucugcacaagcu

SEQ ID NO: 1049738 - RNA, 17 nt, Homo sapiens
accucugccugaaguca

SEQ ID NO: 1049739 - RNA, 12 nt, Homo sapiens
accucuguggac

SEQ ID NO: 1049740 - RNA, 12 nt, Homo sapiens
accucuucacuc

SEQ ID NO: 1049741 - RNA, 14 nt, Homo sapiens
accucuucucuucc

SEQ ID NO: 1049742 - RNA, 20 nt, Homo sapiens
accucuucugggaacuuccu

SEQ ID NO: 1049743 - RNA, 17 nt, Homo sapiens
accucuuggcugccuug

SEQ ID NO: 1049744 - RNA, 21 nt, Homo sapiens
accucuuuauuuuuugauuga

SEQ ID NO: 1049745 - RNA, 22 nt, Homo sapiens
accucuuuauuuuuugauugaa

SEQ ID NO: 1049746 - RNA, 20 nt, Homo sapiens
accugaaaaaaaguuuacaa

SEQ ID NO: 1049747 - RNA, 18 nt, Homo sapiens
accugaaaacacugugca

SEQ ID NO: 1049748 - RNA, 20 nt, Homo sapiens
accugaacacaucgugauga

SEQ ID NO: 1049749 - RNA, 14 nt, Homo sapiens
accugaacugaugg

SEQ ID NO: 1049750 - RNA, 13 nt, Homo sapiens
accugaauguguc

SEQ ID NO: 1049751 - RNA, 11 nt, Homo sapiens
accugaugcug

SEQ ID NO: 1049752 - RNA, 24 nt, Homo sapiens
accugcccugacaugcacaccucc

SEQ ID NO: 1049753 - RNA, 20 nt, Homo sapiens
accugccucccuucaugcau

SEQ ID NO: 1049754 - RNA, 16 nt, Homo sapiens
accugcugaagggcag

SEQ ID NO: 1049755 - RNA, 20 nt, Homo sapiens
accugcugagggaccagcca

SEQ ID NO: 1049756 - RNA, 23 nt, Homo sapiens
accuggagggcuggaaucuggag

SEQ ID NO: 1049757 - RNA, 16 nt, Homo sapiens
accuggcacaauggcu

SEQ ID NO: 1049758 - RNA, 23 nt, Homo sapiens
accuggcauuccuucugaccaca

SEQ ID NO: 1049759 - RNA, 19 nt, Homo sapiens
accuggcccugugccuugg

SEQ ID NO: 1049760 - RNA, 22 nt, Homo sapiens
accugggcugaggcauccuucc

SEQ ID NO: 1049761 - RNA, 19 nt, Homo sapiens
accugguacccuccuggcu

SEQ ID NO: 1049762 - RNA, 20 nt, Homo sapiens
accugguuccggcucugcac

SEQ ID NO: 1049763 - RNA, 18 nt, Homo sapiens
accuguaauccuagcacu

SEQ ID NO: 1049764 - RNA, 20 nt, Homo sapiens
accuguuacuugaaauacca

SEQ ID NO: 1049765 - RNA, 19 nt, Homo sapiens
accuguuuuuaagcuguuu

SEQ ID NO: 1049766 - RNA, 15 nt, Homo sapiens
accuuaguggcuuuu

SEQ ID NO: 1049767 - RNA, 16 nt, Homo sapiens
accuuaucugugcgug

SEQ ID NO: 1049768 - RNA, 18 nt, Homo sapiens
accuuccccagcguccca

SEQ ID NO: 1049769 - RNA, 16 nt, Homo sapiens
accuugaacacugggg

SEQ ID NO: 1049770 - RNA, 16 nt, Homo sapiens
accuugaugugccugu

SEQ ID NO: 1049771 - RNA, 17 nt, Homo sapiens
accuugaugugccugug

SEQ ID NO: 1049772 - RNA, 19 nt, Homo sapiens
accuugaugugccugugaa

SEQ ID NO: 1049773 - RNA, 13 nt, Homo sapiens
accuugcaucuca

SEQ ID NO: 1049774 - RNA, 19 nt, Homo sapiens
accuuggaucagaugaacu

SEQ ID NO: 1049775 - RNA, 12 nt, Homo sapiens
accuugugagag

SEQ ID NO: 1049776 - RNA, 15 nt, Homo sapiens
accuugugucuguac

SEQ ID NO: 1049777 - RNA, 19 nt, Homo sapiens
accuuguuggagccugcag

SEQ ID NO: 1049778 - RNA, 21 nt, Homo sapiens
accuuuauugugaucuaucaa

SEQ ID NO: 1049779 - RNA, 15 nt, Homo sapiens
accuuuccugaggaa

SEQ ID NO: 1049780 - RNA, 20 nt, Homo sapiens
accuuuuaacaccugaugug

SEQ ID NO: 1049781 - RNA, 22 nt, Homo sapiens
accuuuugaggagccccagcua

SEQ ID NO: 1049782 - RNA, 22 nt, Homo sapiens
acgaauauagaggguuuugcuc

SEQ ID NO: 1049783 - RNA, 17 nt, Homo sapiens
acgaauauuaugcccag

SEQ ID NO: 1049784 - RNA, 13 nt, Homo sapiens
acgaccacagggu

SEQ ID NO: 1049785 - RNA, 19 nt, Homo sapiens
acgacucugaccucuuggc

SEQ ID NO: 1049786 - RNA, 15 nt, Homo sapiens
acgaucuuccuggcu

SEQ ID NO: 1049787 - RNA, 18 nt, Homo sapiens
acgcaucagacagaugga

SEQ ID NO: 1049788 - RNA, 11 nt, Homo sapiens
acgccacugca

SEQ ID NO: 1049789 - RNA, 15 nt, Homo sapiens
acgccacugcacucc

SEQ ID NO: 1049790 - RNA, 20 nt, Homo sapiens
acgccagauucuuuccugag

SEQ ID NO: 1049791 - RNA, 18 nt, Homo sapiens
agccaguuguugccaacc

SEQ ID NO: 1049792 - RNA, 21 nt, Homo sapiens
agccaguuguugccaaccuua

SEQ ID NO: 1049793 - RNA, 21 nt, Homo sapiens
agccauauaaguuugaaggaa

SEQ ID NO: 1049794 - RNA, 15 nt, Homo sapiens
agccaucuugguaaa

SEQ ID NO: 1049795 - RNA, 20 nt, Homo sapiens
agcccaacagacaccaucuu

SEQ ID NO: 1049796 - RNA, 17 nt, Homo sapiens
agcccaauguaaugcau

SEQ ID NO: 1049797 - RNA, 15 nt, Homo sapiens
agcccacacuugaga

SEQ ID NO: 1049798 - RNA, 21 nt, Homo sapiens
agcccacccuccugucuuccc

SEQ ID NO: 1049799 - RNA, 20 nt, Homo sapiens
agcccacuguuaauauucua

SEQ ID NO: 1049800 - RNA, 18 nt, Homo sapiens
agcccagaauagcuuuga

SEQ ID NO: 1049801 - RNA, 15 nt, Homo sapiens
agcccauucauucca

SEQ ID NO: 1049802 - RNA, 12 nt, Homo sapiens
agccccagcuga

SEQ ID NO: 1049803 - RNA, 20 nt, Homo sapiens
agccccagugccaagcacag

SEQ ID NO: 1049804 - RNA, 13 nt, Homo sapiens
agccccaucagcu

SEQ ID NO: 1049805 - RNA, 22 nt, Homo sapiens
agccccauucugccugcccagg

SEQ ID NO: 1049806 - RNA, 20 nt, Homo sapiens
agccccuggaugcagccuca

SEQ ID NO: 1049807 - RNA, 23 nt, Homo sapiens
agcccgggucaucuguaccucug

SEQ ID NO: 1049808 - RNA, 17 nt, Homo sapiens
agcccucaggucagggu

SEQ ID NO: 1049809 - RNA, 18 nt, Homo sapiens
agcccucaggucagggug

SEQ ID NO: 1049810 - RNA, 13 nt, Homo sapiens
agcccugacuggu

SEQ ID NO: 1049811 - RNA, 14 nt, Homo sapiens
agcccugcagugug

SEQ ID NO: 1049812 - RNA, 18 nt, Homo sapiens
agcccugcuuaccagaua

SEQ ID NO: 1049813 - RNA, 18 nt, Homo sapiens
agcccugucgagacacuu

SEQ ID NO: 1049814 - RNA, 16 nt, Homo sapiens
agcccuuagcagggaa

SEQ ID NO: 1049815 - RNA, 15 nt, Homo sapiens
agcccuugaaccagc

SEQ ID NO: 1049816 - RNA, 18 nt, Homo sapiens
agcccuugaagauaucuu

SEQ ID NO: 1049817 - RNA, 21 nt, Homo sapiens
agccgagaucacgccacugca

SEQ ID NO: 1049818 - RNA, 23 nt, Homo sapiens
agccgagaucgcgccacugcacu

SEQ ID NO: 1049819 - RNA, 21 nt, Homo sapiens
agccguacuuugcuaacugug

SEQ ID NO: 1049820 - RNA, 14 nt, Homo sapiens
agccgugaugcuca

SEQ ID NO: 1049821 - RNA, 19 nt, Homo sapiens
agccuaauacaacauguag

SEQ ID NO: 1049822 - RNA, 16 nt, Homo sapiens
agccuaccaauguaga

SEQ ID NO: 1049823 - RNA, 22 nt, Homo sapiens
agccuacuuucacacuaagaaa

SEQ ID NO: 1049824 - RNA, 17 nt, Homo sapiens
agccuagcccuucucuc

SEQ ID NO: 1049825 - RNA, 17 nt, Homo sapiens
agccuagccgaccucag

SEQ ID NO: 1049826 - RNA, 15 nt, Homo sapiens
agccuauauuuacag

SEQ ID NO: 1049827 - RNA, 16 nt, Homo sapiens
agccucaagaugaagg

SEQ ID NO: 1049828 - RNA, 18 nt, Homo sapiens
agccucaagucacuccca

SEQ ID NO: 1049829 - RNA, 18 nt, Homo sapiens
agccucacugcaagcacu

SEQ ID NO: 1049830 - RNA, 14 nt, Homo sapiens
agccucagggacga

SEQ ID NO: 1049831 - RNA, 18 nt, Homo sapiens
agccucccaaguagcugg

SEQ ID NO: 1049832 - RNA, 19 nt, Homo sapiens
agccuccccaccuucuuca

SEQ ID NO: 1049833 - RNA, 17 nt, Homo sapiens
agccucccgaguagcug

SEQ ID NO: 1049834 - RNA, 20 nt, Homo sapiens
agccucccugaagaccaaaa

SEQ ID NO: 1049835 - RNA, 20 nt, Homo sapiens
agccucccugucggccuggu

SEQ ID NO: 1049836 - RNA, 18 nt, Homo sapiens
agccucggcagauguggc

SEQ ID NO: 1049837 - RNA, 17 nt, Homo sapiens
agccucugaauaugaac

SEQ ID NO: 1049838 - RNA, 17 nt, Homo sapiens
agccugagcagagacau

SEQ ID NO: 1049839 - RNA, 21 nt, Homo sapiens
agccugagcagagacaugacu

SEQ ID NO: 1049840 - RNA, 13 nt, Homo sapiens
agccugagccaca

SEQ ID NO: 1049841 - RNA, 15 nt, Homo sapiens
agccugaguuugcuu

SEQ ID NO: 1049842 - RNA, 19 nt, Homo sapiens
agccugcacuacucccuca

SEQ ID NO: 1049843 - RNA, 14 nt, Homo sapiens
agccugcagucauc

SEQ ID NO: 1049844 - RNA, 17 nt, Homo sapiens
agccuggaacaucauca

SEQ ID NO: 1049845 - RNA, 18 nt, Homo sapiens
agccuggcuccaaacccu

SEQ ID NO: 1049846 - RNA, 21 nt, Homo sapiens
agccugggcagcauagcaaga

SEQ ID NO: 1049847 - RNA, 15 nt, Homo sapiens
agccuggugcugcug

SEQ ID NO: 1049848 - RNA, 15 nt, Homo sapiens
agccugucccaugga

SEQ ID NO: 1049849 - RNA, 23 nt, Homo sapiens
agccugucccauggacacuccag

SEQ ID NO: 1049850 - RNA, 18 nt, Homo sapiens
agccuuaagucuuaauau

SEQ ID NO: 1049851 - RNA, 19 nt, Homo sapiens
agccuuagaagucacacag

SEQ ID NO: 1049852 - RNA, 21 nt, Homo sapiens
agccuuagccaggaggccagg

SEQ ID NO: 1049853 - RNA, 14 nt, Homo sapiens
agccuuauccucug

SEQ ID NO: 1049854 - RNA, 14 nt, Homo sapiens
agccuucauugccu

SEQ ID NO: 1049855 - RNA, 20 nt, Homo sapiens
agccuucugaggacauucca

SEQ ID NO: 1049856 - RNA, 17 nt, Homo sapiens
agccuuuccuguagccu

SEQ ID NO: 1049857 - RNA, 19 nt, Homo sapiens
agccuuucuaaaaguugca

SEQ ID NO: 1049858 - RNA, 16 nt, Homo sapiens
agcgaggacauucucu

SEQ ID NO: 1049859 - RNA, 22 nt, Homo sapiens
agcgaggacauucucugaccua

SEQ ID NO: 1049860 - RNA, 19 nt, Homo sapiens
agcgaggaggcuccagagg

SEQ ID NO: 1049861 - RNA, 18 nt, Homo sapiens
agcgaugaauuuggagac

SEQ ID NO: 1049862 - RNA, 18 nt, Homo sapiens
agcgauguaugcagcuau

SEQ ID NO: 1049863 - RNA, 19 nt, Homo sapiens
agcgcagguuuaguuuacu

SEQ ID NO: 1049864 - RNA, 18 nt, Homo sapiens
agcgcaucaggccuggca

SEQ ID NO: 1049865 - RNA, 21 nt, Homo sapiens
agcggccacacuguacucugc

SEQ ID NO: 1049866 - RNA, 13 nt, Homo sapiens
agcgugagccacu

SEQ ID NO: 1049867 - RNA, 15 nt, Homo sapiens
agcuaaagaggcuga

SEQ ID NO: 1049868 - RNA, 13 nt, Homo sapiens
agcuaacaccaga

SEQ ID NO: 1049869 - RNA, 12 nt, Homo sapiens
agcuaagugaaa

SEQ ID NO: 1049870 - RNA, 15 nt, Homo sapiens
agcuaccucaaccaa

SEQ ID NO: 1049871 - RNA, 23 nt, Homo sapiens
agcuaccucaaccaaugccaaaa

SEQ ID NO: 1049872 - RNA, 18 nt, Homo sapiens
agcuacucaggaggcuga

SEQ ID NO: 1049873 - RNA, 14 nt, Homo sapiens
agcuacugacuaug

SEQ ID NO: 1049874 - RNA, 15 nt, Homo sapiens
agcuacuugaaggac

SEQ ID NO: 1049875 - RNA, 20 nt, Homo sapiens
agcuacuugggaggcugaga

SEQ ID NO: 1049876 - RNA, 12 nt, Homo sapiens
agcuagaaccua

SEQ ID NO: 1049877 - RNA, 14 nt, Homo sapiens
agcuagaaccugga

SEQ ID NO: 1049878 - RNA, 15 nt, Homo sapiens
agcuagaaccuggag

SEQ ID NO: 1049879 - RNA, 14 nt, Homo sapiens
agcuagaaggccac

SEQ ID NO: 1049880 - RNA, 19 nt, Homo sapiens
agcuagaggacuucuggca

SEQ ID NO: 1049881 - RNA, 22 nt, Homo sapiens
agcuaggccuggccagaugcac

SEQ ID NO: 1049882 - RNA, 15 nt, Homo sapiens
agcuauaacuuacuu

SEQ ID NO: 1049883 - RNA, 23 nt, Homo sapiens
agcuaugaaaacagcuaucucac

SEQ ID NO: 1049884 - RNA, 16 nt, Homo sapiens
agcuaugaucgcgcca

SEQ ID NO: 1049885 - RNA, 17 nt, Homo sapiens
agcuaugggagccccag

SEQ ID NO: 1049886 - RNA, 16 nt, Homo sapiens
agcuauuagccaggau

SEQ ID NO: 1049887 - RNA, 18 nt, Homo sapiens
agcucacagugacauuac

SEQ ID NO: 1049888 - RNA, 12 nt, Homo sapiens
agcucacgucac

SEQ ID NO: 1049889 - RNA, 18 nt, Homo sapiens
agcucagcauuuccacac

SEQ ID NO: 1049890 - RNA, 22 nt, Homo sapiens
agcucagggacuggcacacugg

SEQ ID NO: 1049891 - RNA, 15 nt, Homo sapiens
agcucagggcuucau

SEQ ID NO: 1049892 - RNA, 16 nt, Homo sapiens
agcuccaccacuuccu

SEQ ID NO: 1049893 - RNA, 13 nt, Homo sapiens
agcuccacuguca

SEQ ID NO: 1049894 - RNA, 21 nt, Homo sapiens
agcucccauguaccagcagcu

SEQ ID NO: 1049895 - RNA, 15 nt, Homo sapiens
agcucccauuucuac

SEQ ID NO: 1049896 - RNA, 19 nt, Homo sapiens
agcucccauuucuacucuu

SEQ ID NO: 1049897 - RNA, 18 nt, Homo sapiens
agcucccuaggagaccaa

SEQ ID NO: 1049898 - RNA, 18 nt, Homo sapiens
agcuccgcuuucuaccca

SEQ ID NO: 1049899 - RNA, 21 nt, Homo sapiens
agcuccucccacaaugcugaa

SEQ ID NO: 1049900 - RNA, 13 nt, Homo sapiens
agcuccugccucu

SEQ ID NO: 1049901 - RNA, 18 nt, Homo sapiens
agcuccuucaaugcaaag

SEQ ID NO: 1049902 - RNA, 13 nt, Homo sapiens
agcuccuugacuc

SEQ ID NO: 1049903 - RNA, 13 nt, Homo sapiens
agcucgaaaacaa

SEQ ID NO: 1049904 - RNA, 14 nt, Homo sapiens
agcucuacugaggu

SEQ ID NO: 1049905 - RNA, 19 nt, Homo sapiens
agcucuccccaaacuugcu

SEQ ID NO: 1049906 - RNA, 14 nt, Homo sapiens
agcucucuuuccca

SEQ ID NO: 1049907 - RNA, 13 nt, Homo sapiens
agcucugaaguca

SEQ ID NO: 1049908 - RNA, 14 nt, Homo sapiens
agcucugccuguua

SEQ ID NO: 1049909 - RNA, 14 nt, Homo sapiens
agcucuggaccagc

SEQ ID NO: 1049910 - RNA, 15 nt, Homo sapiens
agcucuguuuuacaa

SEQ ID NO: 1049911 - RNA, 17 nt, Homo sapiens
agcucuucaggccuccc

SEQ ID NO: 1049912 - RNA, 21 nt, Homo sapiens
agcucuucaggccucccucuc

SEQ ID NO: 1049913 - RNA, 20 nt, Homo sapiens
agcugaacagccaaaugcau

SEQ ID NO: 1049914 - RNA, 12 nt, Homo sapiens
agcugaacccau

SEQ ID NO: 1049915 - RNA, 14 nt, Homo sapiens
agcugaagaacuug

SEQ ID NO: 1049916 - RNA, 15 nt, Homo sapiens
agcugaauacauucu

SEQ ID NO: 1049917 - RNA, 18 nt, Homo sapiens
agcugacacaggaugaag

SEQ ID NO: 1049918 - RNA, 15 nt, Homo sapiens
agcugagauggaacc

SEQ ID NO: 1049919 - RNA, 18 nt, Homo sapiens
agcugaguuuaacaugug

SEQ ID NO: 1049920 - RNA, 19 nt, Homo sapiens
agcugauccagagcacaga

SEQ ID NO: 1049921 - RNA, 18 nt, Homo sapiens
agcugauuuuaacaauaa

SEQ ID NO: 1049922 - RNA, 14 nt, Homo sapiens
agcugcaacggaau

SEQ ID NO: 1049923 - RNA, 15 nt, Homo sapiens
agcugcaccugccag

SEQ ID NO: 1049924 - RNA, 14 nt, Homo sapiens
agcugcacuacagc

SEQ ID NO: 1049925 - RNA, 23 nt, Homo sapiens
agcugcaugggugccugcugcug

SEQ ID NO: 1049926 - RNA, 14 nt, Homo sapiens
agcugccucacuuc

SEQ ID NO: 1049927 - RNA, 16 nt, Homo sapiens
agcugccucacuuccu

SEQ ID NO: 1049928 - RNA, 14 nt, Homo sapiens
agcugcuccgugcu

SEQ ID NO: 1049929 - RNA, 21 nt, Homo sapiens
agcugcugaaacaacaaauag

SEQ ID NO: 1049930 - RNA, 21 nt, Homo sapiens
agcugcugcuggaucacagcu

SEQ ID NO: 1049931 - RNA, 17 nt, Homo sapiens
agcugcuguucuuagca

SEQ ID NO: 1049932 - RNA, 23 nt, Homo sapiens
agcugcuugugucccuccuggga

SEQ ID NO: 1049933 - RNA, 21 nt, Homo sapiens
agcuggaauuacaggcacaua

SEQ ID NO: 1049934 - RNA, 13 nt, Homo sapiens
agcuggagggacc

SEQ ID NO: 1049935 - RNA, 17 nt, Homo sapiens
agcuggauuacaggcau

SEQ ID NO: 1049936 - RNA, 21 nt, Homo sapiens
caaacauguaagcauaacuua

SEQ ID NO: 1049937 - RNA, 20 nt, Homo sapiens
caaacauguuccugggauca

SEQ ID NO: 1049938 - RNA, 15 nt, Homo sapiens
caaaccagacaccug

SEQ ID NO: 1049939 - RNA, 20 nt, Homo sapiens
caaaccccagggcacugagg

SEQ ID NO: 1049940 - RNA, 12 nt, Homo sapiens
caaaccugugua

SEQ ID NO: 1049941 - RNA, 22 nt, Homo sapiens
caaacuaacaggaacaaaauga

SEQ ID NO: 1049942 - RNA, 14 nt, Homo sapiens
caaacuaccuucca

SEQ ID NO: 1049943 - RNA, 18 nt, Homo sapiens
caaacucacugcucaaga

SEQ ID NO: 1049944 - RNA, 23 nt, Homo sapiens
caaacucagucauacuuuuauaa

SEQ ID NO: 1049945 - RNA, 13 nt, Homo sapiens
caaacugccaguu

SEQ ID NO: 1049946 - RNA, 21 nt, Homo sapiens
caaacuggggccucccugguc

SEQ ID NO: 1049947 - RNA, 20 nt, Homo sapiens
caaacuguagaaaugaugau

SEQ ID NO: 1049948 - RNA, 14 nt, Homo sapiens
caaacuuccaguca

SEQ ID NO: 1049949 - RNA, 15 nt, Homo sapiens
caaacuugcuuuaug

SEQ ID NO: 1049950 - RNA, 18 nt, Homo sapiens
caaagaaaugcugaugga

SEQ ID NO: 1049951 - RNA, 20 nt, Homo sapiens
caaagaaggaauucuaggca

SEQ ID NO: 1049952 - RNA, 20 nt, Homo sapiens
caaagaagguuaccaagaag

SEQ ID NO: 1049953 - RNA, 13 nt, Homo sapiens
caaagacauucug

SEQ ID NO: 1049954 - RNA, 13 nt, Homo sapiens
caaagaggugacu

SEQ ID NO: 1049955 - RNA, 17 nt, Homo sapiens
caaagaguguagaucag

SEQ ID NO: 1049956 - RNA, 22 nt, Homo sapiens
caaagaguguagaucagagcag

SEQ ID NO: 1049957 - RNA, 17 nt, Homo sapiens
caaagauauauacacag

SEQ ID NO: 1049958 - RNA, 19 nt, Homo sapiens
caaagaugaucaguaugaa

SEQ ID NO: 1049959 - RNA, 22 nt, Homo sapiens
caaagauuuuggaggagaagga

SEQ ID NO: 1049960 - RNA, 21 nt, Homo sapiens
caaagcaaguuucaucaguca

SEQ ID NO: 1049961 - RNA, 16 nt, Homo sapiens
caaagcacaguuugaa

SEQ ID NO: 1049962 - RNA, 13 nt, Homo sapiens
caaagcaccagcu

SEQ ID NO: 1049963 - RNA, 18 nt, Homo sapiens
caaagcacgaaauguuau

SEQ ID NO: 1049964 - RNA, 20 nt, Homo sapiens
caaagcauugagcaaagggg

SEQ ID NO: 1049965 - RNA, 23 nt, Homo sapiens
caaagccuccuccagccgccaug

SEQ ID NO: 1049966 - RNA, 20 nt, Homo sapiens
caaagccuucauugccuuaa

SEQ ID NO: 1049967 - RNA, 13 nt, Homo sapiens
caaagcguggaca

SEQ ID NO: 1049968 - RNA, 17 nt, Homo sapiens
caaagcugaauacauuc

SEQ ID NO: 1049969 - RNA, 17 nt, Homo sapiens
caaagcuguugauggua

SEQ ID NO: 1049970 - RNA, 18 nt, Homo sapiens
caaaggaaggacccugag

SEQ ID NO: 1049971 - RNA, 18 nt, Homo sapiens
caaaggacagaguaugaa

SEQ ID NO: 1049972 - RNA, 21 nt, Homo sapiens
caaaggacuugacuugcaauu

SEQ ID NO: 1049973 - RNA, 18 nt, Homo sapiens
caaaggcacagugaaggc

SEQ ID NO: 1049974 - RNA, 18 nt, Homo sapiens
caaaggcugagaacacug

SEQ ID NO: 1049975 - RNA, 20 nt, Homo sapiens
caaaggcugagaacacugug

SEQ ID NO: 1049976 - RNA, 17 nt, Homo sapiens
caaagggccagcagucu

SEQ ID NO: 1049977 - RNA, 20 nt, Homo sapiens
caaagggccagcagucuacc

SEQ ID NO: 1049978 - RNA, 19 nt, Homo sapiens
caaagguuccaacuguaua

SEQ ID NO: 1049979 - RNA, 14 nt, Homo sapiens
caaaguacauguau

SEQ ID NO: 1049980 - RNA, 15 nt, Homo sapiens
caaaguagaagucuu

SEQ ID NO: 1049981 - RNA, 23 nt, Homo sapiens
caaagucaauuaaaggcuuucag

SEQ ID NO: 1049982 - RNA, 18 nt, Homo sapiens
caaagucugcaacuuuaa

SEQ ID NO: 1049983 - RNA, 22 nt, Homo sapiens
caaagugaggggaaaccagggc

SEQ ID NO: 1049984 - RNA, 17 nt, Homo sapiens
caaagugcugagauuau

SEQ ID NO: 1049985 - RNA, 16 nt, Homo sapiens
caaaguguuaaucuua

SEQ ID NO: 1049986 - RNA, 20 nt, Homo sapiens
caaaguuugcucaaggagaa

SEQ ID NO: 1049987 - RNA, 14 nt, Homo sapiens
caaauaaacauguc

SEQ ID NO: 1049988 - RNA, 14 nt, Homo sapiens
caaauaaauggagu

SEQ ID NO: 1049989 - RNA, 14 nt, Homo sapiens
caaauaagaaaccu

SEQ ID NO: 1049990 - RNA, 22 nt, Homo sapiens
caaauagaaccacuaugaagcu

SEQ ID NO: 1049991 - RNA, 13 nt, Homo sapiens
caaaucaaagcag

SEQ ID NO: 1049992 - RNA, 17 nt, Homo sapiens
caaaucacgaccacuga

SEQ ID NO: 1049993 - RNA, 16 nt, Homo sapiens
caaaucagccaugugc

SEQ ID NO: 1049994 - RNA, 17 nt, Homo sapiens
caaaucagucagugcaa

SEQ ID NO: 1049995 - RNA, 17 nt, Homo sapiens
caaauccauaauuauua

SEQ ID NO: 1049996 - RNA, 16 nt, Homo sapiens
caaauccuaugugauu

SEQ ID NO: 1049997 - RNA, 19 nt, Homo sapiens
caaauccuugaauguucuc

SEQ ID NO: 1049998 - RNA, 20 nt, Homo sapiens
caaauccuugaauguucucu

SEQ ID NO: 1049999 - RNA, 22 nt, Homo sapiens
caaaucguccagcgaccuuccu

SEQ ID NO: 1050000 - RNA, 22 nt, Homo sapiens
caaaucuccaguauucuuguca

SEQ ID NO: 1050001 - RNA, 15 nt, Homo sapiens
caaaugacaaaaagc

SEQ ID NO: 1050002 - RNA, 13 nt, Homo sapiens
caaaugcaauuuu

SEQ ID NO: 1050003 - RNA, 15 nt, Homo sapiens
caaaugcacaucuca

SEQ ID NO: 1050004 - RNA, 18 nt, Homo sapiens
caaaugcacaucucaugg

SEQ ID NO: 1050005 - RNA, 14 nt, Homo sapiens
caaaugcugaccca

SEQ ID NO: 1050006 - RNA, 20 nt, Homo sapiens
caaauggaagacacauugaa

SEQ ID NO: 1050007 - RNA, 13 nt, Homo sapiens
caaauguauuuca

SEQ ID NO: 1050008 - RNA, 13 nt, Homo sapiens
caaaugugacauu

SEQ ID NO: 1050009 - RNA, 16 nt, Homo sapiens
caaaugugcugucaaa

SEQ ID NO: 1050010 - RNA, 23 nt, Homo sapiens
caaauucauuuuuuucacuggag

SEQ ID NO: 1050011 - RNA, 22 nt, Homo sapiens
caaauucgcugcaaccuguuga

SEQ ID NO: 1050012 - RNA, 14 nt, Homo sapiens
caaauugcagacug

SEQ ID NO: 1050013 - RNA, 19 nt, Homo sapiens
caaauuguaguucuugucu

SEQ ID NO: 1050014 - RNA, 19 nt, Homo sapiens
caaauuuggggguuucuca

SEQ ID NO: 1050015 - RNA, 16 nt, Homo sapiens
caaauuuuaucuccag

SEQ ID NO: 1050016 - RNA, 18 nt, Homo sapiens
caaauuuuaucuccagau

SEQ ID NO: 1050017 - RNA, 15 nt, Homo sapiens
caacaaagucaccca

SEQ ID NO: 1050018 - RNA, 17 nt, Homo sapiens
caacaaagucacccacu

SEQ ID NO: 1050019 - RNA, 23 nt, Homo sapiens
caacaaauuagguuuuguacaau

SEQ ID NO: 1050020 - RNA, 22 nt, Homo sapiens
caacaagcaagcucccaaggga

SEQ ID NO: 1050021 - RNA, 17 nt, Homo sapiens
caacaauuugagaugua

SEQ ID NO: 1050022 - RNA, 15 nt, Homo sapiens
caacacccaacuguc

SEQ ID NO: 1050023 - RNA, 12 nt, Homo sapiens
caacagcacugg

SEQ ID NO: 1050024 - RNA, 15 nt, Homo sapiens
caacaggaggacaau

SEQ ID NO: 1050025 - RNA, 16 nt, Homo sapiens
caacaggcuugugcaa

SEQ ID NO: 1050026 - RNA, 17 nt, Homo sapiens
caacagugagucuguca

SEQ ID NO: 1050027 - RNA, 12 nt, Homo sapiens
caacagugugaa

SEQ ID NO: 1050028 - RNA, 14 nt, Homo sapiens
caacaguuccuuca

SEQ ID NO: 1050029 - RNA, 16 nt, Homo sapiens
caacaugcgaccguga

SEQ ID NO: 1050030 - RNA, 21 nt, Homo sapiens
caacauggugaaaccucaucu

SEQ ID NO: 1050031 - RNA, 23 nt, Homo sapiens
caacauggugaaaccucaucucu

SEQ ID NO: 1050032 - RNA, 15 nt, Homo sapiens
caacauuacagggaa

SEQ ID NO: 1050033 - RNA, 18 nt, Homo sapiens
caaccaagucaugugcau

SEQ ID NO: 1050034 - RNA, 19 nt, Homo sapiens
caaccacaggcagcauuua

SEQ ID NO: 1050035 - RNA, 15 nt, Homo sapiens
caaccacucauucaa

SEQ ID NO: 1050036 - RNA, 14 nt, Homo sapiens
caaccccaacucca

SEQ ID NO: 1050037 - RNA, 18 nt, Homo sapiens
caacccucucaggugacc

SEQ ID NO: 1050038 - RNA, 14 nt, Homo sapiens
caacccugccccug

SEQ ID NO: 1050039 - RNA, 22 nt, Homo sapiens
caacccuuugccccaccuuuau

SEQ ID NO: 1050040 - RNA, 13 nt, Homo sapiens
caaccuaugguau

SEQ ID NO: 1050041 - RNA, 18 nt, Homo sapiens
caaccucauuuuaacuca

SEQ ID NO: 1050042 - RNA, 20 nt, Homo sapiens
caaccugcucuccucuugcc

SEQ ID NO: 1050043 - RNA, 23 nt, Homo sapiens
caaccuggucacaggacucugcc

SEQ ID NO: 1050044 - RNA, 14 nt, Homo sapiens
caaccugugaugag

SEQ ID NO: 1050045 - RNA, 16 nt, Homo sapiens
caaccuguuaccuacu

SEQ ID NO: 1050046 - RNA, 14 nt, Homo sapiens
caacgaguacuuca

SEQ ID NO: 1050047 - RNA, 17 nt, Homo sapiens
caacuaacguacauuca

SEQ ID NO: 1050048 - RNA, 20 nt, Homo sapiens
caacuauauuaucaugcaaa

SEQ ID NO: 1050049 - RNA, 16 nt, Homo sapiens
caacucauuugcucua

SEQ ID NO: 1050050 - RNA, 20 nt, Homo sapiens
caacugcagaaaauguccuc

SEQ ID NO: 1050051 - RNA, 23 nt, Homo sapiens
caacugcccaggaaggacugugc

SEQ ID NO: 1050052 - RNA, 15 nt, Homo sapiens
caacugcgacuguga

SEQ ID NO: 1050053 - RNA, 16 nt, Homo sapiens
caacuguggucaaucc

SEQ ID NO: 1050054 - RNA, 18 nt, Homo sapiens
caacuuaaaugaaaugca

SEQ ID NO: 1050055 - RNA, 16 nt, Homo sapiens
caacuuaagcugggau

SEQ ID NO: 1050056 - RNA, 13 nt, Homo sapiens
caacuuagcucac

SEQ ID NO: 1050057 - RNA, 21 nt, Homo sapiens
caacuucuacuucugcccuug

SEQ ID NO: 1050058 - RNA, 17 nt, Homo sapiens
caacuugggaacuagac

SEQ ID NO: 1050059 - RNA, 20 nt, Homo sapiens
caacuugggaacuagacucc

SEQ ID NO: 1050060 - RNA, 13 nt, Homo sapiens
caacuuucuguaa

SEQ ID NO: 1050061 - RNA, 12 nt, Homo sapiens
caacuuugacaa

SEQ ID NO: 1050062 - RNA, 20 nt, Homo sapiens
caacuuuguggaugucuucc

SEQ ID NO: 1050063 - RNA, 21 nt, Homo sapiens
caacuuuguggaugucuuccu

SEQ ID NO: 1050064 - RNA, 15 nt, Homo sapiens
caacuuuguuuucca

SEQ ID NO: 1050065 - RNA, 18 nt, Homo sapiens
caagaaaaguaagcccuu

SEQ ID NO: 1050066 - RNA, 19 nt, Homo sapiens
caagaaagccucagccauu

SEQ ID NO: 1050067 - RNA, 23 nt, Homo sapiens
caagaaaucugugccugagaaca

SEQ ID NO: 1050068 - RNA, 12 nt, Homo sapiens
caagaaauuacu

SEQ ID NO: 1050069 - RNA, 15 nt, Homo sapiens
caagaagccuuuccu

SEQ ID NO: 1050070 - RNA, 17 nt, Homo sapiens
caagaaggaauugacuu

SEQ ID NO: 1050071 - RNA, 17 nt, Homo sapiens
caagaagucaaaguaaa

SEQ ID NO: 1050072 - RNA, 14 nt, Homo sapiens
caagaaucagucua

SEQ ID NO: 1050073 - RNA, 15 nt, Homo sapiens
caagaaucagugcaa

SEQ ID NO: 1050074 - RNA, 16 nt, Homo sapiens
caagaaucagugcaaa

SEQ ID NO: 1050075 - RNA, 13 nt, Homo sapiens
caagaaugcugaa

SEQ ID NO: 1050076 - RNA, 22 nt, Homo sapiens
caagacaauucuucuucuucca

SEQ ID NO: 1050077 - RNA, 18 nt, Homo sapiens
caagacacaucccuacaa

SEQ ID NO: 1050078 - RNA, 10 nt, Homo sapiens
caagacauag

SEQ ID NO: 1050079 - RNA, 11 nt, Homo sapiens
caagaccaaag

SEQ ID NO: 1050080 - RNA, 18 nt, Homo sapiens
caagaccaucuacauaca

SEQ ID NO: 1050081 - RNA, 14 nt, Homo sapiens
cagcugcccugugu

SEQ ID NO: 1050082 - RNA, 21 nt, Homo sapiens
cagcuggaagggucaacaucu

SEQ ID NO: 1050083 - RNA, 18 nt, Homo sapiens
cagcuggagguugagcuc

SEQ ID NO: 1050084 - RNA, 14 nt, Homo sapiens
cagcuggcacuguc

SEQ ID NO: 1050085 - RNA, 11 nt, Homo sapiens
cagcugggcuc

SEQ ID NO: 1050086 - RNA, 17 nt, Homo sapiens
cagcuggguggcacugc

SEQ ID NO: 1050087 - RNA, 16 nt, Homo sapiens
cagcuguacauacuca

SEQ ID NO: 1050088 - RNA, 13 nt, Homo sapiens
cagcuguuuaugc

SEQ ID NO: 1050089 - RNA, 20 nt, Homo sapiens
cagcuguuuaugcauagaua

SEQ ID NO: 1050090 - RNA, 17 nt, Homo sapiens
cagcuuauauucaucca

SEQ ID NO: 1050091 - RNA, 13 nt, Homo sapiens
cagcuucagguua

SEQ ID NO: 1050092 - RNA, 14 nt, Homo sapiens
cagcuucuacggug

SEQ ID NO: 1050093 - RNA, 21 nt, Homo sapiens
cagcuugagcugccucugaga

SEQ ID NO: 1050094 - RNA, 20 nt, Homo sapiens
cagcuuuucccaaaagccca

SEQ ID NO: 1050095 - RNA, 15 nt, Homo sapiens
caggaaaaucugcac

SEQ ID NO: 1050096 - RNA, 23 nt, Homo sapiens
caggaaaauuguuugaacccagg

SEQ ID NO: 1050097 - RNA, 21 nt, Homo sapiens
caggaaagcuggugucugauu

SEQ ID NO: 1050098 - RNA, 15 nt, Homo sapiens
caggaaccucagggc

SEQ ID NO: 1050099 - RNA, 23 nt, Homo sapiens
caggaaccucagggcugugugua

SEQ ID NO: 1050100 - RNA, 22 nt, Homo sapiens
caggaaccuccuccacaccagc

SEQ ID NO: 1050101 - RNA, 17 nt, Homo sapiens
caggaagcauucagaga

SEQ ID NO: 1050102 - RNA, 12 nt, Homo sapiens
caggaagcuuug

SEQ ID NO: 1050103 - RNA, 21 nt, Homo sapiens
caggaaggcggggcuucaacc

SEQ ID NO: 1050104 - RNA, 21 nt, Homo sapiens
caggaagggcaggaaggagag

SEQ ID NO: 1050105 - RNA, 18 nt, Homo sapiens
caggaagucuucagggaa

SEQ ID NO: 1050106 - RNA, 14 nt, Homo sapiens
caggacaaugucug

SEQ ID NO: 1050107 - RNA, 14 nt, Homo sapiens
caggacuccaucuc

SEQ ID NO: 1050108 - RNA, 19 nt, Homo sapiens
caggacuccaucucuuaaa

SEQ ID NO: 1050109 - RNA, 20 nt, Homo sapiens
caggacuccaucucuuaaaa

SEQ ID NO: 1050110 - RNA, 16 nt, Homo sapiens
caggacuguggagucc

SEQ ID NO: 1050111 - RNA, 22 nt, Homo sapiens
caggacuguuuuauaaacugcu

SEQ ID NO: 1050112 - RNA, 18 nt, Homo sapiens
caggagaccuggcacugg

SEQ ID NO: 1050113 - RNA, 19 nt, Homo sapiens
caggagaccuggcacugga

SEQ ID NO: 1050114 - RNA, 22 nt, Homo sapiens
caggagaccuggcacuggaugc

SEQ ID NO: 1050115 - RNA, 19 nt, Homo sapiens
caggagagacagugaggcu

SEQ ID NO: 1050116 - RNA, 19 nt, Homo sapiens
caggagcugggauccuaag

SEQ ID NO: 1050117 - RNA, 18 nt, Homo sapiens
caggaggaaggcuuacac

SEQ ID NO: 1050118 - RNA, 18 nt, Homo sapiens
caggaggcuuaguccagu

SEQ ID NO: 1050119 - RNA, 17 nt, Homo sapiens
caggaggugcuaucgca

SEQ ID NO: 1050120 - RNA, 22 nt, Homo sapiens
caggagguggaggcugcaguga

SEQ ID NO: 1050121 - RNA, 23 nt, Homo sapiens
caggagguggagguugcagugag

SEQ ID NO: 1050122 - RNA, 23 nt, Homo sapiens
caggaguguuaagcguucaguga

SEQ ID NO: 1050123 - RNA, 17 nt, Homo sapiens
caggaguuagaggccag

SEQ ID NO: 1050124 - RNA, 22 nt, Homo sapiens
caggaguuugaggcugcagcga

SEQ ID NO: 1050125 - RNA, 22 nt, Homo sapiens
caggaucaaaccccgaccaccu

SEQ ID NO: 1050126 - RNA, 15 nt, Homo sapiens
caggaucuguacaau

SEQ ID NO: 1050127 - RNA, 23 nt, Homo sapiens
caggaucuguacaauaauaauua

SEQ ID NO: 1050128 - RNA, 14 nt, Homo sapiens
caggaugauuuugg

SEQ ID NO: 1050129 - RNA, 14 nt, Homo sapiens
caggauggcacugu

SEQ ID NO: 1050130 - RNA, 15 nt, Homo sapiens
caggauggcacuguu

SEQ ID NO: 1050131 - RNA, 16 nt, Homo sapiens
caggauuaaaagccau

SEQ ID NO: 1050132 - RNA, 17 nt, Homo sapiens
caggauuaaaagccaug

SEQ ID NO: 1050133 - RNA, 19 nt, Homo sapiens
caggauuaaaagccaugag

SEQ ID NO: 1050134 - RNA, 22 nt, Homo sapiens
caggauuaaugguccugugaug

SEQ ID NO: 1050135 - RNA, 14 nt, Homo sapiens
caggcacacgccac

SEQ ID NO: 1050136 - RNA, 13 nt, Homo sapiens
caggcacacugag

SEQ ID NO: 1050137 - RNA, 20 nt, Homo sapiens
caggcacccaccaccaugcc

SEQ ID NO: 1050138 - RNA, 23 nt, Homo sapiens
caggcaccugcacuuacaggccu

SEQ ID NO: 1050139 - RNA, 12 nt, Homo sapiens
caggcacugaga

SEQ ID NO: 1050140 - RNA, 14 nt, Homo sapiens
caggcagcauuuag

SEQ ID NO: 1050141 - RNA, 14 nt, Homo sapiens
caggcaugcaugug

SEQ ID NO: 1050142 - RNA, 13 nt, Homo sapiens
caggcauugccaa

SEQ ID NO: 1050143 - RNA, 18 nt, Homo sapiens
caggcauuugacugaaga

SEQ ID NO: 1050144 - RNA, 16 nt, Homo sapiens
caggccagcaagcucu

SEQ ID NO: 1050145 - RNA, 15 nt, Homo sapiens
caggccaggccagcu

SEQ ID NO: 1050146 - RNA, 17 nt, Homo sapiens
caggccaggugcagugg

SEQ ID NO: 1050147 - RNA, 15 nt, Homo sapiens
caggccauacuuuac

SEQ ID NO: 1050148 - RNA, 15 nt, Homo sapiens
caggccauggaggca

SEQ ID NO: 1050149 - RNA, 18 nt, Homo sapiens
caggcccggcuccaggcu

SEQ ID NO: 1050150 - RNA, 18 nt, Homo sapiens
caggccuuaccgcucugu

SEQ ID NO: 1050151 - RNA, 20 nt, Homo sapiens
caggcgauccaccugucuca

SEQ ID NO: 1050152 - RNA, 23 nt, Homo sapiens
caggcgugaccugccaggcacac

SEQ ID NO: 1050153 - RNA, 20 nt, Homo sapiens
caggcgugagccaccgcgcc

SEQ ID NO: 1050154 - RNA, 13 nt, Homo sapiens
caggcuacacuga

SEQ ID NO: 1050155 - RNA, 15 nt, Homo sapiens
caggcucagaucuca

SEQ ID NO: 1050156 - RNA, 23 nt, Homo sapiens
caggcucugcccugcccuagcuc

SEQ ID NO: 1050157 - RNA, 16 nt, Homo sapiens
caggcuggagugcaau

SEQ ID NO: 1050158 - RNA, 16 nt, Homo sapiens
caggcuggagugcagu

SEQ ID NO: 1050159 - RNA, 18 nt, Homo sapiens
caggcuggucucgaacuc

SEQ ID NO: 1050160 - RNA, 15 nt, Homo sapiens
caggcuugugcaaca

SEQ ID NO: 1050161 - RNA, 20 nt, Homo sapiens
cagggaaaucaggguuacaa

SEQ ID NO: 1050162 - RNA, 21 nt, Homo sapiens
cagggaaugccugagugccug

SEQ ID NO: 1050163 - RNA, 13 nt, Homo sapiens
cagggaauuucag

SEQ ID NO: 1050164 - RNA, 13 nt, Homo sapiens
cagggacaccagc

SEQ ID NO: 1050165 - RNA, 15 nt, Homo sapiens
cagggacccacuuca

SEQ ID NO: 1050166 - RNA, 17 nt, Homo sapiens
cagggaccccugcccuu

SEQ ID NO: 1050167 - RNA, 14 nt, Homo sapiens
cagggaccucugaa

SEQ ID NO: 1050168 - RNA, 18 nt, Homo sapiens
cagggcccaagucccugu

SEQ ID NO: 1050169 - RNA, 21 nt, Homo sapiens
cagggcucagccuggugggcc

SEQ ID NO: 1050170 - RNA, 12 nt, Homo sapiens
cagggcucccug

SEQ ID NO: 1050171 - RNA, 20 nt, Homo sapiens
cagggcucugugaccaggaa

SEQ ID NO: 1050172 - RNA, 14 nt, Homo sapiens
cagggcuggucuuu

SEQ ID NO: 1050173 - RNA, 20 nt, Homo sapiens
cagggcuggucuuuuaggac

SEQ ID NO: 1050174 - RNA, 14 nt, Homo sapiens
cagggcugucuucg

SEQ ID NO: 1050175 - RNA, 13 nt, Homo sapiens
cagggcugugauc

SEQ ID NO: 1050176 - RNA, 18 nt, Homo sapiens
caggggaaaaugaagguu

SEQ ID NO: 1050177 - RNA, 21 nt, Homo sapiens
caggggcucacaccuguaauc

SEQ ID NO: 1050178 - RNA, 20 nt, Homo sapiens
cagggggugugucugcucag

SEQ ID NO: 1050179 - RNA, 21 nt, Homo sapiens
caggggucgucaccaccucuc

SEQ ID NO: 1050180 - RNA, 18 nt, Homo sapiens
cagggucccugcuguguu

SEQ ID NO: 1050181 - RNA, 20 nt, Homo sapiens
cagggucucacuauguugcc

SEQ ID NO: 1050182 - RNA, 21 nt, Homo sapiens
cagggucucacuauguugccc

SEQ ID NO: 1050183 - RNA, 19 nt, Homo sapiens
cagggucucacucugucgc

SEQ ID NO: 1050184 - RNA, 14 nt, Homo sapiens
cagggugucccagg

SEQ ID NO: 1050185 - RNA, 20 nt, Homo sapiens
caggguugaucacacucugg

SEQ ID NO: 1050186 - RNA, 21 nt, Homo sapiens
caggguuucaccauauuggcc

SEQ ID NO: 1050187 - RNA, 21 nt, Homo sapiens
caggucaacuucagagacuau

SEQ ID NO: 1050188 - RNA, 22 nt, Homo sapiens
cagguccucuacuuaaugagau

SEQ ID NO: 1050189 - RNA, 14 nt, Homo sapiens
cagguccuuuccac

SEQ ID NO: 1050190 - RNA, 21 nt, Homo sapiens
caggucucacgggcaugggca

SEQ ID NO: 1050191 - RNA, 21 nt, Homo sapiens
caggucuugacaccagcuguu

SEQ ID NO: 1050192 - RNA, 15 nt, Homo sapiens
caggugaaaauccau

SEQ ID NO: 1050193 - RNA, 19 nt, Homo sapiens
caggugaaaauccaucuca

SEQ ID NO: 1050194 - RNA, 15 nt, Homo sapiens
caggugccuaccacc

SEQ ID NO: 1050195 - RNA, 16 nt, Homo sapiens
caggugcucuguggau

SEQ ID NO: 1050196 - RNA, 14 nt, Homo sapiens
caggugcugccauc

SEQ ID NO: 1050197 - RNA, 15 nt, Homo sapiens
caggugggaaauggu

SEQ ID NO: 1050198 - RNA, 17 nt, Homo sapiens
caggugguggcacugag

SEQ ID NO: 1050199 - RNA, 14 nt, Homo sapiens
cagguguuuauaca

SEQ ID NO: 1050200 - RNA, 16 nt, Homo sapiens
cagguuccaaucagaa

SEQ ID NO: 1050201 - RNA, 21 nt, Homo sapiens
cagguucugacucuuggcaca

SEQ ID NO: 1050202 - RNA, 15 nt, Homo sapiens
cagguugcuuugccc

SEQ ID NO: 1050203 - RNA, 15 nt, Homo sapiens
cagguuggugggggc

SEQ ID NO: 1050204 - RNA, 16 nt, Homo sapiens
cagguuuagacaguau

SEQ ID NO: 1050205 - RNA, 14 nt, Homo sapiens
cagguuuguuacau

SEQ ID NO: 1050206 - RNA, 15 nt, Homo sapiens
cagguuuuuggucug

SEQ ID NO: 1050207 - RNA, 23 nt, Homo sapiens
caguaaacagaggaguacaggug

SEQ ID NO: 1050208 - RNA, 22 nt, Homo sapiens
caguaacggaacaguauccagu

SEQ ID NO: 1050209 - RNA, 18 nt, Homo sapiens
caguaagacgacaaggaa

SEQ ID NO: 1050210 - RNA, 20 nt, Homo sapiens
caguaccuccugccccaugc

SEQ ID NO: 1050211 - RNA, 23 nt, Homo sapiens
caguagagcaaaucuaugagauu

SEQ ID NO: 1050212 - RNA, 11 nt, Homo sapiens
caguaguggug

SEQ ID NO: 1050213 - RNA, 17 nt, Homo sapiens
caguaguggugacugug

SEQ ID NO: 1050214 - RNA, 14 nt, Homo sapiens
caguauacaguccu

SEQ ID NO: 1050215 - RNA, 20 nt, Homo sapiens
caguauauuuauagucacaa

SEQ ID NO: 1050216 - RNA, 15 nt, Homo sapiens
caguauccaguacuc

SEQ ID NO: 1050217 - RNA, 21 nt, Homo sapiens
caguaucuauauauguguaug

SEQ ID NO: 1050218 - RNA, 17 nt, Homo sapiens
caguaugaaaaugucau

SEQ ID NO: 1050219 - RNA, 14 nt, Homo sapiens
caguaugacauuuc

SEQ ID NO: 1050220 - RNA, 21 nt, Homo sapiens
caguaugagucaaugugcagu

SEQ ID NO: 1050221 - RNA, 12 nt, Homo sapiens
caguaugcuugg

SEQ ID NO: 1050222 - RNA, 18 nt, Homo sapiens
cagucaaggauggaugca

SEQ ID NO: 1050223 - RNA, 17 nt, Homo sapiens
cagucacauuccaagcc

SEQ ID NO: 1050224 - RNA, 17 nt, Homo sapiens
cagucagaguugugcac

SEQ ID NO: 1050225 - RNA, 13 nt, Homo sapiens
ccaucaagccacc

SEQ ID NO: 1050226 - RNA, 14 nt, Homo sapiens
ccaucaccagacag

SEQ ID NO: 1050227 - RNA, 16 nt, Homo sapiens
ccaucauacacuuccu

SEQ ID NO: 1050228 - RNA, 22 nt, Homo sapiens
ccaucauucaugcuacugccaa

SEQ ID NO: 1050229 - RNA, 14 nt, Homo sapiens
ccauccccuggacu

SEQ ID NO: 1050230 - RNA, 20 nt, Homo sapiens
ccauccuaccaaugcaugca

SEQ ID NO: 1050231 - RNA, 13 nt, Homo sapiens
ccauccuauuuaa

SEQ ID NO: 1050232 - RNA, 22 nt, Homo sapiens
ccauccuauuuaacuggcuuca

SEQ ID NO: 1050233 - RNA, 17 nt, Homo sapiens
ccauccucaaacacugc

SEQ ID NO: 1050234 - RNA, 15 nt, Homo sapiens
ccauccuugagucaa

SEQ ID NO: 1050235 - RNA, 17 nt, Homo sapiens
ccaucgcaggaugacag

SEQ ID NO: 1050236 - RNA, 19 nt, Homo sapiens
ccaucggugaaacuaacag

SEQ ID NO: 1050237 - RNA, 14 nt, Homo sapiens
ccaucuaugagcug

SEQ ID NO: 1050238 - RNA, 19 nt, Homo sapiens
ccaucuccaagaaugcuga

SEQ ID NO: 1050239 - RNA, 20 nt, Homo sapiens
ccaucuccaagaaugcugaa

SEQ ID NO: 1050240 - RNA, 17 nt, Homo sapiens
ccaucuccucagcaccc

SEQ ID NO: 1050241 - RNA, 14 nt, Homo sapiens
ccaucucuacuaaa

SEQ ID NO: 1050242 - RNA, 14 nt, Homo sapiens
ccaucucuacugaa

SEQ ID NO: 1050243 - RNA, 14 nt, Homo sapiens
ccaucucuccauau

SEQ ID NO: 1050244 - RNA, 16 nt, Homo sapiens
ccaucucugauuuuca

SEQ ID NO: 1050245 - RNA, 18 nt, Homo sapiens
ccaucugugcacgcagug

SEQ ID NO: 1050246 - RNA, 15 nt, Homo sapiens
ccaucuuuugugaga

SEQ ID NO: 1050247 - RNA, 17 nt, Homo sapiens
ccaugaaaaugcaacaa

SEQ ID NO: 1050248 - RNA, 15 nt, Homo sapiens
ccaugaacuuaaaau

SEQ ID NO: 1050249 - RNA, 14 nt, Homo sapiens
ccaugaagaccaca

SEQ ID NO: 1050250 - RNA, 14 nt, Homo sapiens
ccaugaaucaaaga

SEQ ID NO: 1050251 - RNA, 15 nt, Homo sapiens
ccaugaaucaaagac

SEQ ID NO: 1050252 - RNA, 16 nt, Homo sapiens
ccaugaaucaaagaca

SEQ ID NO: 1050253 - RNA, 21 nt, Homo sapiens
ccaugacccaccccugugcuc

SEQ ID NO: 1050254 - RNA, 21 nt, Homo sapiens
ccaugagcaccccaaggcugc

SEQ ID NO: 1050255 - RNA, 20 nt, Homo sapiens
ccaugaggcaaugucaggaa

SEQ ID NO: 1050256 - RNA, 21 nt, Homo sapiens
ccaugaggccucaguggacuu

SEQ ID NO: 1050257 - RNA, 22 nt, Homo sapiens
ccaugauggugcugaccucugg

SEQ ID NO: 1050258 - RNA, 19 nt, Homo sapiens
ccaugcagagcgccgugag

SEQ ID NO: 1050259 - RNA, 16 nt, Homo sapiens
ccaugcagugccccua

SEQ ID NO: 1050260 - RNA, 20 nt, Homo sapiens
ccaugccacccuguuuucag

SEQ ID NO: 1050261 - RNA, 21 nt, Homo sapiens
ccauggacagaagaaggcagc

SEQ ID NO: 1050262 - RNA, 16 nt, Homo sapiens
ccauggaggcaugcca

SEQ ID NO: 1050263 - RNA, 16 nt, Homo sapiens
ccauggugugaucguc

SEQ ID NO: 1050264 - RNA, 19 nt, Homo sapiens
ccaugucgccucugcauuc

SEQ ID NO: 1050265 - RNA, 16 nt, Homo sapiens
ccaugugugagugugu

SEQ ID NO: 1050266 - RNA, 19 nt, Homo sapiens
ccaugugugagugugugca

SEQ ID NO: 1050267 - RNA, 15 nt, Homo sapiens
ccauuagaccaagcu

SEQ ID NO: 1050268 - RNA, 22 nt, Homo sapiens
ccauuagcauuugucaacaaag

SEQ ID NO: 1050269 - RNA, 12 nt, Homo sapiens
ccauucaggaca

SEQ ID NO: 1050270 - RNA, 21 nt, Homo sapiens
ccauucuacauacuauggaau

SEQ ID NO: 1050271 - RNA, 18 nt, Homo sapiens
ccauucuccugccucagc

SEQ ID NO: 1050272 - RNA, 13 nt, Homo sapiens
ccauucugaccau

SEQ ID NO: 1050273 - RNA, 13 nt, Homo sapiens
ccauuuccugaga

SEQ ID NO: 1050274 - RNA, 23 nt, Homo sapiens
ccauuuuuuucauuguguucucu

SEQ ID NO: 1050275 - RNA, 13 nt, Homo sapiens
cccaaaaggcaga

SEQ ID NO: 1050276 - RNA, 12 nt, Homo sapiens
cccaaagagccu

SEQ ID NO: 1050277 - RNA, 10 nt, Homo sapiens
cccaacagca

SEQ ID NO: 1050278 - RNA, 21 nt, Homo sapiens
cccaacucuccuggacugccu

SEQ ID NO: 1050279 - RNA, 16 nt, Homo sapiens
cccaagccugcaguca

SEQ ID NO: 1050280 - RNA, 18 nt, Homo sapiens
cccaaguuauugggaugu

SEQ ID NO: 1050281 - RNA, 15 nt, Homo sapiens
cccaaucaccuuucc

SEQ ID NO: 1050282 - RNA, 16 nt, Homo sapiens
cccacaaaaguacaau

SEQ ID NO: 1050283 - RNA, 19 nt, Homo sapiens
cccacacccucccuuaccc

SEQ ID NO: 1050284 - RNA, 15 nt, Homo sapiens
cccacaccucugcca

SEQ ID NO: 1050285 - RNA, 13 nt, Homo sapiens
cccacacuccaug

SEQ ID NO: 1050286 - RNA, 19 nt, Homo sapiens
cccacaugugacacauaug

SEQ ID NO: 1050287 - RNA, 17 nt, Homo sapiens
cccaccagugacuuuuu

SEQ ID NO: 1050288 - RNA, 17 nt, Homo sapiens
cccacccaacaagccau

SEQ ID NO: 1050289 - RNA, 22 nt, Homo sapiens
cccacgagggucaggacuguga

SEQ ID NO: 1050290 - RNA, 17 nt, Homo sapiens
cccacugaaccuucuga

SEQ ID NO: 1050291 - RNA, 21 nt, Homo sapiens
cccacugccaaagaacuugga

SEQ ID NO: 1050292 - RNA, 10 nt, Homo sapiens
cccacuuccu

SEQ ID NO: 1050293 - RNA, 11 nt, Homo sapiens
cccacuugaag

SEQ ID NO: 1050294 - RNA, 14 nt, Homo sapiens
cccacuuggcauca

SEQ ID NO: 1050295 - RNA, 19 nt, Homo sapiens
cccagaacuggacucagga

SEQ ID NO: 1050296 - RNA, 18 nt, Homo sapiens
cccagacuuuacaugaca

SEQ ID NO: 1050297 - RNA, 14 nt, Homo sapiens
cccagagaagccaa

SEQ ID NO: 1050298 - RNA, 13 nt, Homo sapiens
cccagagcacugg

SEQ ID NO: 1050299 - RNA, 14 nt, Homo sapiens
cccagaguggcuca

SEQ ID NO: 1050300 - RNA, 12 nt, Homo sapiens
cccagcaaagag

SEQ ID NO: 1050301 - RNA, 21 nt, Homo sapiens
cccagcacuuugggaggccaa

SEQ ID NO: 1050302 - RNA, 15 nt, Homo sapiens
cccagcagggccuca

SEQ ID NO: 1050303 - RNA, 14 nt, Homo sapiens
cccagccccuccaa

SEQ ID NO: 1050304 - RNA, 13 nt, Homo sapiens
cccagcccggcuc

SEQ ID NO: 1050305 - RNA, 17 nt, Homo sapiens
cccagcccuauggaugu

SEQ ID NO: 1050306 - RNA, 13 nt, Homo sapiens
cccagccucuggc

SEQ ID NO: 1050307 - RNA, 15 nt, Homo sapiens
cccagcuacucagga

SEQ ID NO: 1050308 - RNA, 16 nt, Homo sapiens
cccagcuacucaggag

SEQ ID NO: 1050309 - RNA, 23 nt, Homo sapiens
cccaggaggcagcuguugcagug

SEQ ID NO: 1050310 - RNA, 14 nt, Homo sapiens
cccaggaguuugag

SEQ ID NO: 1050311 - RNA, 17 nt, Homo sapiens
cccaggcaaacuugcac

SEQ ID NO: 1050312 - RNA, 20 nt, Homo sapiens
cccaggcuggagugcaauga

SEQ ID NO: 1050313 - RNA, 16 nt, Homo sapiens
cccaggcuggucuuga

SEQ ID NO: 1050314 - RNA, 15 nt, Homo sapiens
cccagggcacuucac

SEQ ID NO: 1050315 - RNA, 18 nt, Homo sapiens
cccaggucccuuguccca

SEQ ID NO: 1050316 - RNA, 23 nt, Homo sapiens
cccaggugcagugugacauuauu

SEQ ID NO: 1050317 - RNA, 23 nt, Homo sapiens
cccaggugguggcugcaaggugg

SEQ ID NO: 1050318 - RNA, 22 nt, Homo sapiens
cccagucagaguugugcacaug

SEQ ID NO: 1050319 - RNA, 13 nt, Homo sapiens
cccagugcuugca

SEQ ID NO: 1050320 - RNA, 14 nt, Homo sapiens
cccagugcuugcaa

SEQ ID NO: 1050321 - RNA, 16 nt, Homo sapiens
cccaguuagcucucaa

SEQ ID NO: 1050322 - RNA, 18 nt, Homo sapiens
cccaguucaacucaugga

SEQ ID NO: 1050323 - RNA, 17 nt, Homo sapiens
cccauaauuuucuucau

SEQ ID NO: 1050324 - RNA, 20 nt, Homo sapiens
cccaucacgccugugcagug

SEQ ID NO: 1050325 - RNA, 11 nt, Homo sapiens
cccaucugcag

SEQ ID NO: 1050326 - RNA, 13 nt, Homo sapiens
cccaucugugaau

SEQ ID NO: 1050327 - RNA, 15 nt, Homo sapiens
cccaugaaucaaaga

SEQ ID NO: 1050328 - RNA, 21 nt, Homo sapiens
cccaugaaucaaagacaugga

SEQ ID NO: 1050329 - RNA, 18 nt, Homo sapiens
cccaugcagacaugagug

SEQ ID NO: 1050330 - RNA, 15 nt, Homo sapiens
cccaugccaccgcuu

SEQ ID NO: 1050331 - RNA, 20 nt, Homo sapiens
cccaugcccuggauccauca

SEQ ID NO: 1050332 - RNA, 22 nt, Homo sapiens
cccaugugugagugugugcaag

SEQ ID NO: 1050333 - RNA, 23 nt, Homo sapiens
cccauuccauuuaucuuucuaca

SEQ ID NO: 1050334 - RNA, 22 nt, Homo sapiens
cccauugaaacaaaacauugau

SEQ ID NO: 1050335 - RNA, 12 nt, Homo sapiens
ccccaaccugcu

SEQ ID NO: 1050336 - RNA, 16 nt, Homo sapiens
ccccaacuuagcuguc

SEQ ID NO: 1050337 - RNA, 15 nt, Homo sapiens
ccccaccaccugguu

SEQ ID NO: 1050338 - RNA, 21 nt, Homo sapiens
ccccaccugggacccuugaga

SEQ ID NO: 1050339 - RNA, 22 nt, Homo sapiens
ccccacuggggaaauaacagcu

SEQ ID NO: 1050340 - RNA, 15 nt, Homo sapiens
ccccagcaguugaau

SEQ ID NO: 1050341 - RNA, 22 nt, Homo sapiens
ccccagcucuggcuuccagaaa

SEQ ID NO: 1050342 - RNA, 13 nt, Homo sapiens
ccccagcuuugca

SEQ ID NO: 1050343 - RNA, 15 nt, Homo sapiens
ccccaggcauugcca

SEQ ID NO: 1050344 - RNA, 22 nt, Homo sapiens
ccccaggcccagugggguggcc

SEQ ID NO: 1050345 - RNA, 18 nt, Homo sapiens
ccccagugauagaaagaa

SEQ ID NO: 1050346 - RNA, 23 nt, Homo sapiens
ccccaguucaaucucccgcugcu

SEQ ID NO: 1050347 - RNA, 15 nt, Homo sapiens
ccccauuccugggaa

SEQ ID NO: 1050348 - RNA, 11 nt, Homo sapiens
cccccaacagc

SEQ ID NO: 1050349 - RNA, 12 nt, Homo sapiens
cccccacagugc

SEQ ID NO: 1050350 - RNA, 20 nt, Homo sapiens
cccccagggcacuucacaga

SEQ ID NO: 1050351 - RNA, 17 nt, Homo sapiens
ccccccaacacugugcc

SEQ ID NO: 1050352 - RNA, 21 nt, Homo sapiens
cccccgugaggaugucacuca

SEQ ID NO: 1050353 - RNA, 23 nt, Homo sapiens
cccccgugaggaugucacucaga

SEQ ID NO: 1050354 - RNA, 17 nt, Homo sapiens
cccccucuguugcacau

SEQ ID NO: 1050355 - RNA, 22 nt, Homo sapiens
ccccgagcugggggccaugagc

SEQ ID NO: 1050356 - RNA, 12 nt, Homo sapiens
ccccgcucugca

SEQ ID NO: 1050357 - RNA, 18 nt, Homo sapiens
ccccucaacaccucugca

SEQ ID NO: 1050358 - RNA, 12 nt, Homo sapiens
ccccuccacugg

SEQ ID NO: 1050359 - RNA, 12 nt, Homo sapiens
ccccuccacugu

SEQ ID NO: 1050360 - RNA, 15 nt, Homo sapiens
ccccuccacugucac

SEQ ID NO: 1050361 - RNA, 15 nt, Homo sapiens
ccccuccaggaauga

SEQ ID NO: 1050362 - RNA, 19 nt, Homo sapiens
ccccucccacagcgcuggc

SEQ ID NO: 1050363 - RNA, 15 nt, Homo sapiens
ccccucccugcuuca

SEQ ID NO: 1050364 - RNA, 21 nt, Homo sapiens
ccccugcucaguaaagcacuu

SEQ ID NO: 1050365 - RNA, 18 nt, Homo sapiens
ccccuggaucuaccagca

SEQ ID NO: 1050366 - RNA, 19 nt, Homo sapiens
ccccuggaucuaccagcau

SEQ ID NO: 1050367 - RNA, 14 nt, Homo sapiens
ccccuguaccuuuu

SEQ ID NO: 1050368 - RNA, 14 nt, Homo sapiens
ccccugucucaggg

SEQ ID NO: 1050369 - RNA, 16 nt, Homo sapiens
ccccuuuucugcauuu

SEQ ID NO: 1050370 - RNA, 18 nt, Homo sapiens
cccgaggacaguggcaga

SEQ ID NO: 1050371 - RNA, 14 nt, Homo sapiens
gaauauacauuguc

SEQ ID NO: 1050372 - RNA, 17 nt, Homo sapiens
gaauauacuaaacauca

SEQ ID NO: 1050373 - RNA, 22 nt, Homo sapiens
gaauauacuaaacaucauugau

SEQ ID NO: 1050374 - RNA, 18 nt, Homo sapiens
gaauaucugggauucuac

SEQ ID NO: 1050375 - RNA, 21 nt, Homo sapiens
gaauaugggguugguguucuc

SEQ ID NO: 1050376 - RNA, 22 nt, Homo sapiens
gaauaugggguugguguucuca

SEQ ID NO: 1050377 - RNA, 23 nt, Homo sapiens
gaauauggugggcacagaaguag

SEQ ID NO: 1050378 - RNA, 21 nt, Homo sapiens
gaauauuaugcccaguuucug

SEQ ID NO: 1050379 - RNA, 18 nt, Homo sapiens
gaauauuuauuaccucug

SEQ ID NO: 1050380 - RNA, 16 nt, Homo sapiens
gaaucaaaugcaauuu

SEQ ID NO: 1050381 - RNA, 17 nt, Homo sapiens
gaaucaacauuucucaa

SEQ ID NO: 1050382 - RNA, 13 nt, Homo sapiens
gaaucaagcuaga

SEQ ID NO: 1050383 - RNA, 16 nt, Homo sapiens
gaaucaccuugauuca

SEQ ID NO: 1050384 - RNA, 17 nt, Homo sapiens
gaaucagaucauuucaa

SEQ ID NO: 1050385 - RNA, 23 nt, Homo sapiens
gaaucagugaagaugccagugaa

SEQ ID NO: 1050386 - RNA, 17 nt, Homo sapiens
gaaucauguaguaucaa

SEQ ID NO: 1050387 - RNA, 13 nt, Homo sapiens
gaauccacagcuc

SEQ ID NO: 1050388 - RNA, 12 nt, Homo sapiens
gaauccaugcuu

SEQ ID NO: 1050389 - RNA, 23 nt, Homo sapiens
gaaucuggaccccaucugugaau

SEQ ID NO: 1050390 - RNA, 15 nt, Homo sapiens
gaaucuguuaccaga

SEQ ID NO: 1050391 - RNA, 22 nt, Homo sapiens
gaaucuuuuucagaaacaguga

SEQ ID NO: 1050392 - RNA, 11 nt, Homo sapiens
gaaugacaaag

SEQ ID NO: 1050393 - RNA, 18 nt, Homo sapiens
gaaugacggcaaacucag

SEQ ID NO: 1050394 - RNA, 20 nt, Homo sapiens
gaaugauuuagguacgucaa

SEQ ID NO: 1050395 - RNA, 19 nt, Homo sapiens
gaaugcaaaguagcaauuu

SEQ ID NO: 1050396 - RNA, 19 nt, Homo sapiens
gaaugcaccauggucaaaa

SEQ ID NO: 1050397 - RNA, 15 nt, Homo sapiens
gaaugcagggacaaa

SEQ ID NO: 1050398 - RNA, 17 nt, Homo sapiens
gaaugccucaaugugac

SEQ ID NO: 1050399 - RNA, 15 nt, Homo sapiens
gaaugcuucuucuca

SEQ ID NO: 1050400 - RNA, 18 nt, Homo sapiens
gaaugcuucuucucaggc

SEQ ID NO: 1050401 - RNA, 17 nt, Homo sapiens
gaauggagcucaggucc

SEQ ID NO: 1050402 - RNA, 17 nt, Homo sapiens
gaauggauuuaucagaa

SEQ ID NO: 1050403 - RNA, 20 nt, Homo sapiens
gaauggcucacuauggugcc

SEQ ID NO: 1050404 - RNA, 15 nt, Homo sapiens
gaauggggaucacag

SEQ ID NO: 1050405 - RNA, 16 nt, Homo sapiens
gaauggguuugcuaga

SEQ ID NO: 1050406 - RNA, 19 nt, Homo sapiens
gaauguaaaaugcaaaauc

SEQ ID NO: 1050407 - RNA, 17 nt, Homo sapiens
gaauguagcagaucccc

SEQ ID NO: 1050408 - RNA, 17 nt, Homo sapiens
gaaugugauauuugaag

SEQ ID NO: 1050409 - RNA, 21 nt, Homo sapiens
gaaugugucugcguuccuguu

SEQ ID NO: 1050410 - RNA, 16 nt, Homo sapiens
gaauuaacacaugauc

SEQ ID NO: 1050411 - RNA, 14 nt, Homo sapiens
gaauuaaccuggug

SEQ ID NO: 1050412 - RNA, 13 nt, Homo sapiens
gaauuaaucacuu

SEQ ID NO: 1050413 - RNA, 14 nt, Homo sapiens
gaauuaaucacuuu

SEQ ID NO: 1050414 - RNA, 20 nt, Homo sapiens
gaauuauaauuaguuccuca

SEQ ID NO: 1050415 - RNA, 15 nt, Homo sapiens
gaauuaugucugcug

SEQ ID NO: 1050416 - RNA, 17 nt, Homo sapiens
gaauuaugucugcugaa

SEQ ID NO: 1050417 - RNA, 19 nt, Homo sapiens
gaauucgagaccagccuga

SEQ ID NO: 1050418 - RNA, 22 nt, Homo sapiens
gaauucugcuaccucacugggg

SEQ ID NO: 1050419 - RNA, 17 nt, Homo sapiens
gaauucugucauuucaa

SEQ ID NO: 1050420 - RNA, 18 nt, Homo sapiens
gaauucuuuccccaaaga

SEQ ID NO: 1050421 - RNA, 19 nt, Homo sapiens
gaauucuuuuucauuugag

SEQ ID NO: 1050422 - RNA, 13 nt, Homo sapiens
gaauugcagagua

SEQ ID NO: 1050423 - RNA, 19 nt, Homo sapiens
gaauugcucgaacuuggag

SEQ ID NO: 1050424 - RNA, 18 nt, Homo sapiens
gaauuucauaugacauuc

SEQ ID NO: 1050425 - RNA, 18 nt, Homo sapiens
gaauuuccucuauugaug

SEQ ID NO: 1050426 - RNA, 16 nt, Homo sapiens
gaauuugcugcuauuu

SEQ ID NO: 1050427 - RNA, 17 nt, Homo sapiens
gaauuuggccugcacua

SEQ ID NO: 1050428 - RNA, 13 nt, Homo sapiens
gaauuuuguugcu

SEQ ID NO: 1050429 - RNA, 18 nt, Homo sapiens
gaauuuuguuuguugaug

SEQ ID NO: 1050430 - RNA, 19 nt, Homo sapiens
gaauuuuuuuuaacauucc

SEQ ID NO: 1050431 - RNA, 17 nt, Homo sapiens
gacaaaaauucaacuca

SEQ ID NO: 1050432 - RNA, 16 nt, Homo sapiens
gacaaaccgagugcaa

SEQ ID NO: 1050433 - RNA, 21 nt, Homo sapiens
gacaaacuaacaggaacaaaa

SEQ ID NO: 1050434 - RNA, 21 nt, Homo sapiens
gacaaagccaaacucugccag

SEQ ID NO: 1050435 - RNA, 16 nt, Homo sapiens
gacaaagcuacuugaa

SEQ ID NO: 1050436 - RNA, 21 nt, Homo sapiens
gacaaagggccagcagucuac

SEQ ID NO: 1050437 - RNA, 21 nt, Homo sapiens
gacaaagguuuuccucuucua

SEQ ID NO: 1050438 - RNA, 17 nt, Homo sapiens
gacaaagugagacuccg

SEQ ID NO: 1050439 - RNA, 17 nt, Homo sapiens
gacaaauacucaugugu

SEQ ID NO: 1050440 - RNA, 20 nt, Homo sapiens
gacaacacagcaggacucca

SEQ ID NO: 1050441 - RNA, 21 nt, Homo sapiens
gacaacauuucucaaaugcac

SEQ ID NO: 1050442 - RNA, 17 nt, Homo sapiens
gacaacucagaggccag

SEQ ID NO: 1050443 - RNA, 21 nt, Homo sapiens
gacaagcugcaaaucagccau

SEQ ID NO: 1050444 - RNA, 20 nt, Homo sapiens
gacaaucaugaaauaugcau

SEQ ID NO: 1050445 - RNA, 23 nt, Homo sapiens
gacaaugaaaguuugcacuguau

SEQ ID NO: 1050446 - RNA, 16 nt, Homo sapiens
gacaauuucauuccau

SEQ ID NO: 1050447 - RNA, 12 nt, Homo sapiens
gacaauuugaau

SEQ ID NO: 1050448 - RNA, 13 nt, Homo sapiens
gacacaaaccugc

SEQ ID NO: 1050449 - RNA, 16 nt, Homo sapiens
gacacagcagugguau

SEQ ID NO: 1050450 - RNA, 19 nt, Homo sapiens
gacacauuuuuaaaaugca

SEQ ID NO: 1050451 - RNA, 23 nt, Homo sapiens
gacacauuuuuaaaaugcaacau

SEQ ID NO: 1050452 - RNA, 22 nt, Homo sapiens
gacaccucuguuuccucuuccc

SEQ ID NO: 1050453 - RNA, 22 nt, Homo sapiens
gacacuucuaaaugaagugcaa

SEQ ID NO: 1050454 - RNA, 20 nt, Homo sapiens
gacacuugccuucuucaccc

SEQ ID NO: 1050455 - RNA, 17 nt, Homo sapiens
gacacuuuaauuaccaa

SEQ ID NO: 1050456 - RNA, 13 nt, Homo sapiens
gacagaaagcaga

SEQ ID NO: 1050457 - RNA, 15 nt, Homo sapiens
gacagaacgagacuc

SEQ ID NO: 1050458 - RNA, 15 nt, Homo sapiens
gacagagcaagugag

SEQ ID NO: 1050459 - RNA, 14 nt, Homo sapiens
gacagagcugggau

SEQ ID NO: 1050460 - RNA, 20 nt, Homo sapiens
gacagaucaauggcgcagug

SEQ ID NO: 1050461 - RNA, 18 nt, Homo sapiens
gacagauggaaaagggag

SEQ ID NO: 1050462 - RNA, 15 nt, Homo sapiens
gacaggaauacuuaa

SEQ ID NO: 1050463 - RNA, 18 nt, Homo sapiens
gacaggcagccuggacau

SEQ ID NO: 1050464 - RNA, 23 nt, Homo sapiens
gacaggcccaagagaugaagagu

SEQ ID NO: 1050465 - RNA, 18 nt, Homo sapiens
gacaggcuccucugggga

SEQ ID NO: 1050466 - RNA, 19 nt, Homo sapiens
gacagggucccugcugugu

SEQ ID NO: 1050467 - RNA, 15 nt, Homo sapiens
gacaguaaaucucac

SEQ ID NO: 1050468 - RNA, 20 nt, Homo sapiens
gacaguccaaaccacuccac

SEQ ID NO: 1050469 - RNA, 15 nt, Homo sapiens
gacagugaccccagu

SEQ ID NO: 1050470 - RNA, 15 nt, Homo sapiens
gacagugcauuugcc

SEQ ID NO: 1050471 - RNA, 19 nt, Homo sapiens
gacagugcauuugccuugu

SEQ ID NO: 1050472 - RNA, 16 nt, Homo sapiens
gacagugggaaauauu

SEQ ID NO: 1050473 - RNA, 22 nt, Homo sapiens
gacauagcuggaaaauuccuau

SEQ ID NO: 1050474 - RNA, 21 nt, Homo sapiens
gacauagcugugcuaugaggu

SEQ ID NO: 1050475 - RNA, 12 nt, Homo sapiens
gacaucaucaag

SEQ ID NO: 1050476 - RNA, 15 nt, Homo sapiens
gacauccccacucac

SEQ ID NO: 1050477 - RNA, 19 nt, Homo sapiens
gacauccccccgccaaaag

SEQ ID NO: 1050478 - RNA, 20 nt, Homo sapiens
gacauccccccgccaaaagc

SEQ ID NO: 1050479 - RNA, 18 nt, Homo sapiens
gacaucgguucauauuaa

SEQ ID NO: 1050480 - RNA, 24 nt, Homo sapiens
gacaucgguucauauuaagacaua

SEQ ID NO: 1050481 - RNA, 18 nt, Homo sapiens
gacaugucuagccacuga

SEQ ID NO: 1050482 - RNA, 16 nt, Homo sapiens
gacaugugaaaccuuu

SEQ ID NO: 1050483 - RNA, 23 nt, Homo sapiens
gacauuaacaguuuuccaugaaa

SEQ ID NO: 1050484 - RNA, 13 nt, Homo sapiens
gacauucaugccu

SEQ ID NO: 1050485 - RNA, 18 nt, Homo sapiens
gacauuccaaguuuuuca

SEQ ID NO: 1050486 - RNA, 18 nt, Homo sapiens
gacauugcggacagccac

SEQ ID NO: 1050487 - RNA, 16 nt, Homo sapiens
gacauuguuggccaaa

SEQ ID NO: 1050488 - RNA, 14 nt, Homo sapiens
gacauuuaagacag

SEQ ID NO: 1050489 - RNA, 21 nt, Homo sapiens
gacauuuauuuuucucaugaa

SEQ ID NO: 1050490 - RNA, 15 nt, Homo sapiens
gaccaacugggccca

SEQ ID NO: 1050491 - RNA, 22 nt, Homo sapiens
gaccaauucaacccuuugcccc

SEQ ID NO: 1050492 - RNA, 16 nt, Homo sapiens
gaccacagacucacau

SEQ ID NO: 1050493 - RNA, 19 nt, Homo sapiens
gaccacagagggcaggaac

SEQ ID NO: 1050494 - RNA, 18 nt, Homo sapiens
gaccacaggugccuacca

SEQ ID NO: 1050495 - RNA, 18 nt, Homo sapiens
gaccacuccccucaaaac

SEQ ID NO: 1050496 - RNA, 24 nt, Homo sapiens
gaccacugggcaaugauggcaauu

SEQ ID NO: 1050497 - RNA, 22 nt, Homo sapiens
gaccagaaccagagcucagaga

SEQ ID NO: 1050498 - RNA, 14 nt, Homo sapiens
gaccagaaguggac

SEQ ID NO: 1050499 - RNA, 19 nt, Homo sapiens
gaccaggcaaagcaaguga

SEQ ID NO: 1050500 - RNA, 21 nt, Homo sapiens
gaccauaaccccggaagccaa

SEQ ID NO: 1050501 - RNA, 13 nt, Homo sapiens
gaccaucccugaa

SEQ ID NO: 1050502 - RNA, 15 nt, Homo sapiens
gaccauuagcauuug

SEQ ID NO: 1050503 - RNA, 20 nt, Homo sapiens
gacccaaagaccaauauuca

SEQ ID NO: 1050504 - RNA, 15 nt, Homo sapiens
gacccaggcaccugc

SEQ ID NO: 1050505 - RNA, 16 nt, Homo sapiens
gacccagggaugacau

SEQ ID NO: 1050506 - RNA, 18 nt, Homo sapiens
gacccagggaugacaugu

SEQ ID NO: 1050507 - RNA, 16 nt, Homo sapiens
gacccaggucauggaa

SEQ ID NO: 1050508 - RNA, 16 nt, Homo sapiens
gaccccacacuccaug

SEQ ID NO: 1050509 - RNA, 16 nt, Homo sapiens
gaccccacccaagcuu

SEQ ID NO: 1050510 - RNA, 16 nt, Homo sapiens
gaccccaucugugaau

SEQ ID NO: 1050511 - RNA, 23 nt, Homo sapiens
gaccccgucacagccucaaguca

SEQ ID NO: 1050512 - RNA, 16 nt, Homo sapiens
gaccccugcccaccuc

SEQ ID NO: 1050513 - RNA, 17 nt, Homo sapiens
gacccgcucuggaccaa

SEQ ID NO: 1050514 - RNA, 21 nt, Homo sapiens
gacccucugaaugguccaggg

SEQ ID NO: 1050515 - RNA, 13 nt, Homo sapiens
gcaaggugcucac

SEQ ID NO: 1050516 - RNA, 16 nt, Homo sapiens
gcaagucccuuuguga

SEQ ID NO: 1050517 - RNA, 17 nt, Homo sapiens
gcaagugguagcaagaa

SEQ ID NO: 1050518 - RNA, 17 nt, Homo sapiens
gcaagugugugcacaug

SEQ ID NO: 1050519 - RNA, 21 nt, Homo sapiens
gcaagugugugcacaugugug

SEQ ID NO: 1050520 - RNA, 21 nt, Homo sapiens
gcaaguuggaaaauauguaac

SEQ ID NO: 1050521 - RNA, 17 nt, Homo sapiens
gcaauaaauaccagaca

SEQ ID NO: 1050522 - RNA, 17 nt, Homo sapiens
gcaauacagacuacuuc

SEQ ID NO: 1050523 - RNA, 23 nt, Homo sapiens
gcaaucaaguccuacaagcuaaa

SEQ ID NO: 1050524 - RNA, 16 nt, Homo sapiens
gcaaucacugaucuca

SEQ ID NO: 1050525 - RNA, 18 nt, Homo sapiens
gcaaucagugcuccugua

SEQ ID NO: 1050526 - RNA, 21 nt, Homo sapiens
gcaaucuucucagaaggcaaa

SEQ ID NO: 1050527 - RNA, 20 nt, Homo sapiens
gcaaugacucaggacauccc

SEQ ID NO: 1050528 - RNA, 17 nt, Homo sapiens
gcaaugggcacugggau

SEQ ID NO: 1050529 - RNA, 15 nt, Homo sapiens
gcaaugugacuuaau

SEQ ID NO: 1050530 - RNA, 18 nt, Homo sapiens
gcaauucuccugccucag

SEQ ID NO: 1050531 - RNA, 18 nt, Homo sapiens
gcaauuuucgaacauucu

SEQ ID NO: 1050532 - RNA, 22 nt, Homo sapiens
gcacaaaccaauuaaacccagu

SEQ ID NO: 1050533 - RNA, 13 nt, Homo sapiens
gcacaauaguaac

SEQ ID NO: 1050534 - RNA, 18 nt, Homo sapiens
gcacaauaguaaccuggg

SEQ ID NO: 1050535 - RNA, 17 nt, Homo sapiens
gcacacacacaaacaca

SEQ ID NO: 1050536 - RNA, 23 nt, Homo sapiens
gcacacacacacacacacacuca

SEQ ID NO: 1050537 - RNA, 23 nt, Homo sapiens
gcacacacaccacacauacacac

SEQ ID NO: 1050538 - RNA, 21 nt, Homo sapiens
gcacacacuguguacaguaaa

SEQ ID NO: 1050539 - RNA, 22 nt, Homo sapiens
gcacacugccagucucacugug

SEQ ID NO: 1050540 - RNA, 12 nt, Homo sapiens
gcacacuggccu

SEQ ID NO: 1050541 - RNA, 18 nt, Homo sapiens
gcacagacccugcccugu

SEQ ID NO: 1050542 - RNA, 21 nt, Homo sapiens
gcacagaucugcuugaucaau

SEQ ID NO: 1050543 - RNA, 22 nt, Homo sapiens
gcacagaucugcuugaucaauu

SEQ ID NO: 1050544 - RNA, 20 nt, Homo sapiens
gcacagccauacggcacuga

SEQ ID NO: 1050545 - RNA, 15 nt, Homo sapiens
gcacaugaauccaua

SEQ ID NO: 1050546 - RNA, 12 nt, Homo sapiens
gcacaugcagau

SEQ ID NO: 1050547 - RNA, 20 nt, Homo sapiens
gcacaugucuuguacaugug

SEQ ID NO: 1050548 - RNA, 12 nt, Homo sapiens
gcacaugugugc

SEQ ID NO: 1050549 - RNA, 15 nt, Homo sapiens
gcacaugugugcgug

SEQ ID NO: 1050550 - RNA, 14 nt, Homo sapiens
gcaccacccuaguc

SEQ ID NO: 1050551 - RNA, 20 nt, Homo sapiens
gcaccacugcucuccagccu

SEQ ID NO: 1050552 - RNA, 22 nt, Homo sapiens
gcacccaccaccaugcccagcu

SEQ ID NO: 1050553 - RNA, 18 nt, Homo sapiens
gcacccagccucuaggga

SEQ ID NO: 1050554 - RNA, 13 nt, Homo sapiens
gcaccccacugca

SEQ ID NO: 1050555 - RNA, 13 nt, Homo sapiens
gcaccccaugcca

SEQ ID NO: 1050556 - RNA, 17 nt, Homo sapiens
gcaccccccaagcuguu

SEQ ID NO: 1050557 - RNA, 16 nt, Homo sapiens
gcaccccugucucuag

SEQ ID NO: 1050558 - RNA, 17 nt, Homo sapiens
gcacccuccacccuguc

SEQ ID NO: 1050559 - RNA, 17 nt, Homo sapiens
gcacccugauccucacc

SEQ ID NO: 1050560 - RNA, 12 nt, Homo sapiens
gcacccuggauu

SEQ ID NO: 1050561 - RNA, 21 nt, Homo sapiens
gcacccuguaucacagacugg

SEQ ID NO: 1050562 - RNA, 15 nt, Homo sapiens
gcaccuacaguguac

SEQ ID NO: 1050563 - RNA, 18 nt, Homo sapiens
gcaccuaccaucagggac

SEQ ID NO: 1050564 - RNA, 13 nt, Homo sapiens
gcaccuaccucac

SEQ ID NO: 1050565 - RNA, 21 nt, Homo sapiens
gcaccuagaauuggcugaacu

SEQ ID NO: 1050566 - RNA, 14 nt, Homo sapiens
gcaccucugaccua

SEQ ID NO: 1050567 - RNA, 17 nt, Homo sapiens
gcaccuguacucaggag

SEQ ID NO: 1050568 - RNA, 12 nt, Homo sapiens
gcaccugugcag

SEQ ID NO: 1050569 - RNA, 14 nt, Homo sapiens
gcaccuucagacuu

SEQ ID NO: 1050570 - RNA, 15 nt, Homo sapiens
gcacgcccaugugug

SEQ ID NO: 1050571 - RNA, 15 nt, Homo sapiens
gcacucacacaggac

SEQ ID NO: 1050572 - RNA, 20 nt, Homo sapiens
gcacucacacgcgaaaguau

SEQ ID NO: 1050573 - RNA, 20 nt, Homo sapiens
gcacucacccaugugccaag

SEQ ID NO: 1050574 - RNA, 22 nt, Homo sapiens
gcacuccagccugggcaacaag

SEQ ID NO: 1050575 - RNA, 19 nt, Homo sapiens
gcacugagcaaagcauuga

SEQ ID NO: 1050576 - RNA, 16 nt, Homo sapiens
gcacugaggaccagcc

SEQ ID NO: 1050577 - RNA, 16 nt, Homo sapiens
gcacuggcucucucca

SEQ ID NO: 1050578 - RNA, 15 nt, Homo sapiens
gcacugucacuuugc

SEQ ID NO: 1050579 - RNA, 21 nt, Homo sapiens
gcacuuugaaggggccucacc

SEQ ID NO: 1050580 - RNA, 13 nt, Homo sapiens
gcacuuuggacau

SEQ ID NO: 1050581 - RNA, 17 nt, Homo sapiens
gcagaagagaaaagcug

SEQ ID NO: 1050582 - RNA, 19 nt, Homo sapiens
gcagaauagcaaggugcuc

SEQ ID NO: 1050583 - RNA, 21 nt, Homo sapiens
gcagaaucuguuaccagagga

SEQ ID NO: 1050584 - RNA, 22 nt, Homo sapiens
gcagacaggaggaaucauguca

SEQ ID NO: 1050585 - RNA, 18 nt, Homo sapiens
gcagaccccucuaccucc

SEQ ID NO: 1050586 - RNA, 19 nt, Homo sapiens
gcagaccugacucucuuaa

SEQ ID NO: 1050587 - RNA, 23 nt, Homo sapiens
gcagacugcugcuagagccagca

SEQ ID NO: 1050588 - RNA, 23 nt, Homo sapiens
gcagagaccagcccaccccugug

SEQ ID NO: 1050589 - RNA, 22 nt, Homo sapiens
gcagagagccauuuugugaaug

SEQ ID NO: 1050590 - RNA, 19 nt, Homo sapiens
gcagagccacccuguguug

SEQ ID NO: 1050591 - RNA, 20 nt, Homo sapiens
gcagagccacccuguguuga

SEQ ID NO: 1050592 - RNA, 22 nt, Homo sapiens
gcagagcuugaacacagucuca

SEQ ID NO: 1050593 - RNA, 16 nt, Homo sapiens
gcagaguucuauaaug

SEQ ID NO: 1050594 - RNA, 15 nt, Homo sapiens
gcagauaaacaguag

SEQ ID NO: 1050595 - RNA, 19 nt, Homo sapiens
gcagauacaggaaaagcug

SEQ ID NO: 1050596 - RNA, 21 nt, Homo sapiens
gcagauugaaaaggacaccuu

SEQ ID NO: 1050597 - RNA, 16 nt, Homo sapiens
gcagccacaaccaaaa

SEQ ID NO: 1050598 - RNA, 14 nt, Homo sapiens
gcagcccaugccca

SEQ ID NO: 1050599 - RNA, 23 nt, Homo sapiens
gcagcccaugcccaccugcccau

SEQ ID NO: 1050600 - RNA, 14 nt, Homo sapiens
gcagcucaucucug

SEQ ID NO: 1050601 - RNA, 24 nt, Homo sapiens
gcagcucuugcuaaucagugucuc

SEQ ID NO: 1050602 - RNA, 20 nt, Homo sapiens
gcagcuuagacuaaggccau

SEQ ID NO: 1050603 - RNA, 15 nt, Homo sapiens
gcagcuucaccagag

SEQ ID NO: 1050604 - RNA, 21 nt, Homo sapiens
gcagcuucaccagagcauuuc

SEQ ID NO: 1050605 - RNA, 14 nt, Homo sapiens
gcagcuucugggac

SEQ ID NO: 1050606 - RNA, 18 nt, Homo sapiens
gcaggaaaugaaaauguc

SEQ ID NO: 1050607 - RNA, 23 nt, Homo sapiens
gcaggaagcauucagagagcagc

SEQ ID NO: 1050608 - RNA, 19 nt, Homo sapiens
gcaggaagcucagacuggu

SEQ ID NO: 1050609 - RNA, 21 nt, Homo sapiens
gcaggagaaucacuugcacuc

SEQ ID NO: 1050610 - RNA, 17 nt, Homo sapiens
gcaggaggauugcuuga

SEQ ID NO: 1050611 - RNA, 23 nt, Homo sapiens
gcaggcaugagucagucugauga

SEQ ID NO: 1050612 - RNA, 13 nt, Homo sapiens
gcaggcuuucaag

SEQ ID NO: 1050613 - RNA, 15 nt, Homo sapiens
gcagggacuuuccug

SEQ ID NO: 1050614 - RNA, 14 nt, Homo sapiens
gcagggauucuucc

SEQ ID NO: 1050615 - RNA, 19 nt, Homo sapiens
gcagggguccuugguguga

SEQ ID NO: 1050616 - RNA, 22 nt, Homo sapiens
gcaggugaccuucugggaaaug

SEQ ID NO: 1050617 - RNA, 21 nt, Homo sapiens
gcagguuaacagcugucuaug

SEQ ID NO: 1050618 - RNA, 21 nt, Homo sapiens
gcaguaacuccccaacucccu

SEQ ID NO: 1050619 - RNA, 20 nt, Homo sapiens
gcaguagaaauaauaugcau

SEQ ID NO: 1050620 - RNA, 20 nt, Homo sapiens
gcaguagacuauaagcagaa

SEQ ID NO: 1050621 - RNA, 24 nt, Homo sapiens
gcaguagccuaacacacuccaaga

SEQ ID NO: 1050622 - RNA, 18 nt, Homo sapiens
gcagugacgugcaccugu

SEQ ID NO: 1050623 - RNA, 13 nt, Homo sapiens
gcagugaugucac

SEQ ID NO: 1050624 - RNA, 19 nt, Homo sapiens
gcagugcuugaaugaaguu

SEQ ID NO: 1050625 - RNA, 17 nt, Homo sapiens
gcaguuccugucccuuc

SEQ ID NO: 1050626 - RNA, 20 nt, Homo sapiens
gcaguucuggaauggaaggg

SEQ ID NO: 1050627 - RNA, 23 nt, Homo sapiens
gcauaaagucagggguucccuuu

SEQ ID NO: 1050628 - RNA, 16 nt, Homo sapiens
gcauaaauaugcagug

SEQ ID NO: 1050629 - RNA, 19 nt, Homo sapiens
gcauaaauaugcagugaua

SEQ ID NO: 1050630 - RNA, 19 nt, Homo sapiens
gcauaacaaaaagaugacc

SEQ ID NO: 1050631 - RNA, 21 nt, Homo sapiens
gcauaaguuucugggaccuca

SEQ ID NO: 1050632 - RNA, 13 nt, Homo sapiens
gcauacaguuugc

SEQ ID NO: 1050633 - RNA, 15 nt, Homo sapiens
gcauacaguuugcac

SEQ ID NO: 1050634 - RNA, 19 nt, Homo sapiens
gcauacaguuugcacuuau

SEQ ID NO: 1050635 - RNA, 12 nt, Homo sapiens
gcauaccuuuau

SEQ ID NO: 1050636 - RNA, 19 nt, Homo sapiens
gcauagauugaucaaagug

SEQ ID NO: 1050637 - RNA, 20 nt, Homo sapiens
gcauaguucccauguuaaau

SEQ ID NO: 1050638 - RNA, 18 nt, Homo sapiens
gcauaucaaaaaguauua

SEQ ID NO: 1050639 - RNA, 12 nt, Homo sapiens
gcaucagaccuu

SEQ ID NO: 1050640 - RNA, 15 nt, Homo sapiens
gcaucagcucagggc

SEQ ID NO: 1050641 - RNA, 15 nt, Homo sapiens
gcaucauuaguacau

SEQ ID NO: 1050642 - RNA, 17 nt, Homo sapiens
gcaucauuaguacaucu

SEQ ID NO: 1050643 - RNA, 22 nt, Homo sapiens
gcaucccaggaucgcaagagcc

SEQ ID NO: 1050644 - RNA, 14 nt, Homo sapiens
gcaucccaggggac

SEQ ID NO: 1050645 - RNA, 17 nt, Homo sapiens
gcaucgcuccucuccag

SEQ ID NO: 1050646 - RNA, 15 nt, Homo sapiens
gcaucucagugcagg

SEQ ID NO: 1050647 - RNA, 17 nt, Homo sapiens
gcaucucccaguucaua

SEQ ID NO: 1050648 - RNA, 18 nt, Homo sapiens
gcaugaaguaauaugcac

SEQ ID NO: 1050649 - RNA, 21 nt, Homo sapiens
gcaugcauuuugcagcaguga

SEQ ID NO: 1050650 - RNA, 12 nt, Homo sapiens
gcaugcggccca

SEQ ID NO: 1050651 - RNA, 14 nt, Homo sapiens
gcauggugcaguug

SEQ ID NO: 1050652 - RNA, 24 nt, Homo sapiens
gcauguaugucuuggacacuguac

SEQ ID NO: 1050653 - RNA, 23 nt, Homo sapiens
gcaugucgugaccaacuagacau

SEQ ID NO: 1050654 - RNA, 16 nt, Homo sapiens
gcaugugcgcacacac

SEQ ID NO: 1050655 - RNA, 16 nt, Homo sapiens
gcauguuuuccagcuc

SEQ ID NO: 1050656 - RNA, 14 nt, Homo sapiens
gcauuaaacugaau

SEQ ID NO: 1050657 - RNA, 20 nt, Homo sapiens
gcauuauguccacuguguau

SEQ ID NO: 1050658 - RNA, 16 nt, Homo sapiens
ggaaagaaaugcccau

SEQ ID NO: 1050659 - RNA, 18 nt, Homo sapiens
ggaaagacagcuucucau

SEQ ID NO: 1050660 - RNA, 15 nt, Homo sapiens
ggaaagcagcucaaa

SEQ ID NO: 1050661 - RNA, 22 nt, Homo sapiens
ggaaaggcaaaugcccaaggga

SEQ ID NO: 1050662 - RNA, 15 nt, Homo sapiens
ggaaaggggguccca

SEQ ID NO: 1050663 - RNA, 19 nt, Homo sapiens
ggaaagguuugagaagcac

SEQ ID NO: 1050664 - RNA, 13 nt, Homo sapiens
ggaaaguguaaag

SEQ ID NO: 1050665 - RNA, 17 nt, Homo sapiens
ggaaaguguaaagcauu

SEQ ID NO: 1050666 - RNA, 22 nt, Homo sapiens
ggaaauaaaauuuaggaccaau

SEQ ID NO: 1050667 - RNA, 18 nt, Homo sapiens
ggaaauagugauuuccac

SEQ ID NO: 1050668 - RNA, 14 nt, Homo sapiens
ggaaauaugucaaa

SEQ ID NO: 1050669 - RNA, 13 nt, Homo sapiens
ggaacacacuugg

SEQ ID NO: 1050670 - RNA, 13 nt, Homo sapiens
ggaacacugcacu

SEQ ID NO: 1050671 - RNA, 14 nt, Homo sapiens
ggaacacugcacuc

SEQ ID NO: 1050672 - RNA, 18 nt, Homo sapiens
ggaacagacaacagaagu

SEQ ID NO: 1050673 - RNA, 20 nt, Homo sapiens
ggaacagauucacacugucu

SEQ ID NO: 1050674 - RNA, 23 nt, Homo sapiens
ggaaccgcaggaagcugcuccgu

SEQ ID NO: 1050675 - RNA, 19 nt, Homo sapiens
ggaacuuuuauuacugggg

SEQ ID NO: 1050676 - RNA, 14 nt, Homo sapiens
ggaagaccaagaca

SEQ ID NO: 1050677 - RNA, 19 nt, Homo sapiens
ggaagacuagaggcuugca

SEQ ID NO: 1050678 - RNA, 19 nt, Homo sapiens
ggaagagcugcaacggaau

SEQ ID NO: 1050679 - RNA, 15 nt, Homo sapiens
ggaagaugaaagagg

SEQ ID NO: 1050680 - RNA, 16 nt, Homo sapiens
ggaagcacauguuuau

SEQ ID NO: 1050681 - RNA, 16 nt, Homo sapiens
ggaagccccacuugaa

SEQ ID NO: 1050682 - RNA, 17 nt, Homo sapiens
ggaagccccacuugaag

SEQ ID NO: 1050683 - RNA, 22 nt, Homo sapiens
ggaagcccccaaguugauauuu

SEQ ID NO: 1050684 - RNA, 16 nt, Homo sapiens
ggaagcccuugccuga

SEQ ID NO: 1050685 - RNA, 20 nt, Homo sapiens
ggaagccggaggguguuuau

SEQ ID NO: 1050686 - RNA, 14 nt, Homo sapiens
ggaagcuccacugu

SEQ ID NO: 1050687 - RNA, 15 nt, Homo sapiens
ggaagcuccacuguc

SEQ ID NO: 1050688 - RNA, 22 nt, Homo sapiens
ggaaggagaggagaggggcaca

SEQ ID NO: 1050689 - RNA, 19 nt, Homo sapiens
ggaagggccuacagcccau

SEQ ID NO: 1050690 - RNA, 13 nt, Homo sapiens
ggaaguauacuuu

SEQ ID NO: 1050691 - RNA, 14 nt, Homo sapiens
ggaagucagacuuu

SEQ ID NO: 1050692 - RNA, 14 nt, Homo sapiens
ggaauaaagcccuu

SEQ ID NO: 1050693 - RNA, 14 nt, Homo sapiens
ggaauaauccagaa

SEQ ID NO: 1050694 - RNA, 20 nt, Homo sapiens
ggaauauuugcaagacauag

SEQ ID NO: 1050695 - RNA, 12 nt, Homo sapiens
ggaaugccugag

SEQ ID NO: 1050696 - RNA, 19 nt, Homo sapiens
ggaaugggcagcucaucuc

SEQ ID NO: 1050697 - RNA, 21 nt, Homo sapiens
ggaauuaggaagaccaagaca

SEQ ID NO: 1050698 - RNA, 18 nt, Homo sapiens
ggaauuaugucugcugaa

SEQ ID NO: 1050699 - RNA, 15 nt, Homo sapiens
ggaauuuucuuccaa

SEQ ID NO: 1050700 - RNA, 20 nt, Homo sapiens
ggacaaacagcucaguucua

SEQ ID NO: 1050701 - RNA, 19 nt, Homo sapiens
ggacaaacugccaguuuug

SEQ ID NO: 1050702 - RNA, 15 nt, Homo sapiens
ggacaacauccuuaa

SEQ ID NO: 1050703 - RNA, 22 nt, Homo sapiens
ggacaaugucugaacucuccag

SEQ ID NO: 1050704 - RNA, 11 nt, Homo sapiens
ggacacuguac

SEQ ID NO: 1050705 - RNA, 15 nt, Homo sapiens
ggacagaagcagcuc

SEQ ID NO: 1050706 - RNA, 16 nt, Homo sapiens
ggacagaagcagcucu

SEQ ID NO: 1050707 - RNA, 15 nt, Homo sapiens
ggacaggaugaccug

SEQ ID NO: 1050708 - RNA, 22 nt, Homo sapiens
ggacaucuaguaggugcuugac

SEQ ID NO: 1050709 - RNA, 17 nt, Homo sapiens
ggacaugaagauucuuu

SEQ ID NO: 1050710 - RNA, 21 nt, Homo sapiens
ggacauugccuuuucuagccc

SEQ ID NO: 1050711 - RNA, 18 nt, Homo sapiens
ggacauugcggacagcca

SEQ ID NO: 1050712 - RNA, 19 nt, Homo sapiens
ggacauuuuuucagucaua

SEQ ID NO: 1050713 - RNA, 21 nt, Homo sapiens
ggaccaacccuguuuccugag

SEQ ID NO: 1050714 - RNA, 18 nt, Homo sapiens
ggaccaaggggugggcca

SEQ ID NO: 1050715 - RNA, 13 nt, Homo sapiens
ggaccacauuuua

SEQ ID NO: 1050716 - RNA, 20 nt, Homo sapiens
ggaccacgugagaucauuca

SEQ ID NO: 1050717 - RNA, 18 nt, Homo sapiens
ggacccaggcaccugcau

SEQ ID NO: 1050718 - RNA, 19 nt, Homo sapiens
ggacccaggcaccugcauu

SEQ ID NO: 1050719 - RNA, 20 nt, Homo sapiens
ggacccuguugaggguccuc

SEQ ID NO: 1050720 - RNA, 14 nt, Homo sapiens
ggaccucaguuuua

SEQ ID NO: 1050721 - RNA, 13 nt, Homo sapiens
ggaccucugcucu

SEQ ID NO: 1050722 - RNA, 19 nt, Homo sapiens
ggacuaaguguaccagaga

SEQ ID NO: 1050723 - RNA, 18 nt, Homo sapiens
ggacuauuacauccacau

SEQ ID NO: 1050724 - RNA, 22 nt, Homo sapiens
ggacuauuauaauuuaaugcau

SEQ ID NO: 1050725 - RNA, 19 nt, Homo sapiens
ggacuauuuaugaaggcaa

SEQ ID NO: 1050726 - RNA, 14 nt, Homo sapiens
ggacucaaacugcc

SEQ ID NO: 1050727 - RNA, 12 nt, Homo sapiens
ggacucaaugca

SEQ ID NO: 1050728 - RNA, 13 nt, Homo sapiens
ggacucugcacau

SEQ ID NO: 1050729 - RNA, 13 nt, Homo sapiens
ggacucuugcucu

SEQ ID NO: 1050730 - RNA, 14 nt, Homo sapiens
ggacucuugcucuu

SEQ ID NO: 1050731 - RNA, 19 nt, Homo sapiens
ggacugaauuacucuccaa

SEQ ID NO: 1050732 - RNA, 20 nt, Homo sapiens
ggacuggaaggggaagggac

SEQ ID NO: 1050733 - RNA, 17 nt, Homo sapiens
ggacuggcacacuggcc

SEQ ID NO: 1050734 - RNA, 16 nt, Homo sapiens
ggacuuacuauuuauu

SEQ ID NO: 1050735 - RNA, 19 nt, Homo sapiens
ggacuuccuccccauguga

SEQ ID NO: 1050736 - RNA, 18 nt, Homo sapiens
ggacuuccuugcucuccc

SEQ ID NO: 1050737 - RNA, 17 nt, Homo sapiens
ggacuugacuugcaauu

SEQ ID NO: 1050738 - RNA, 15 nt, Homo sapiens
ggacuuggaagcucc

SEQ ID NO: 1050739 - RNA, 18 nt, Homo sapiens
ggacuuucugaagccuca

SEQ ID NO: 1050740 - RNA, 16 nt, Homo sapiens
ggagaaucacuugaac

SEQ ID NO: 1050741 - RNA, 14 nt, Homo sapiens
ggagaccuggcacu

SEQ ID NO: 1050742 - RNA, 13 nt, Homo sapiens
ggagacugcugag

SEQ ID NO: 1050743 - RNA, 16 nt, Homo sapiens
ggagacuuuacaugga

SEQ ID NO: 1050744 - RNA, 13 nt, Homo sapiens
ggagagaaguuuc

SEQ ID NO: 1050745 - RNA, 14 nt, Homo sapiens
ggagagagacucca

SEQ ID NO: 1050746 - RNA, 18 nt, Homo sapiens
ggagaggggaagggccag

SEQ ID NO: 1050747 - RNA, 21 nt, Homo sapiens
ggagaguacagugagccaaga

SEQ ID NO: 1050748 - RNA, 17 nt, Homo sapiens
ggagauuuacaacuggg

SEQ ID NO: 1050749 - RNA, 16 nt, Homo sapiens
ggagcagaugcaauga

SEQ ID NO: 1050750 - RNA, 15 nt, Homo sapiens
ggagcagaugccucc

SEQ ID NO: 1050751 - RNA, 15 nt, Homo sapiens
ggagcaucugacuca

SEQ ID NO: 1050752 - RNA, 18 nt, Homo sapiens
ggagcauuggcugagaga

SEQ ID NO: 1050753 - RNA, 20 nt, Homo sapiens
ggagccaacagaugugucag

SEQ ID NO: 1050754 - RNA, 17 nt, Homo sapiens
ggagccccagugccaag

SEQ ID NO: 1050755 - RNA, 13 nt, Homo sapiens
ggagcgcaccugc

SEQ ID NO: 1050756 - RNA, 12 nt, Homo sapiens
ggagcucagaga

SEQ ID NO: 1050757 - RNA, 18 nt, Homo sapiens
ggagcugcucucucauga

SEQ ID NO: 1050758 - RNA, 16 nt, Homo sapiens
ggagcuggcccucucc

SEQ ID NO: 1050759 - RNA, 22 nt, Homo sapiens
ggagcuugcagugagccgagau

SEQ ID NO: 1050760 - RNA, 17 nt, Homo sapiens
ggaggaacacugcacuc

SEQ ID NO: 1050761 - RNA, 18 nt, Homo sapiens
ggaggaacacugcacucu

SEQ ID NO: 1050762 - RNA, 13 nt, Homo sapiens
ggaggaagugaua

SEQ ID NO: 1050763 - RNA, 20 nt, Homo sapiens
ggaggauguucugggacaca

SEQ ID NO: 1050764 - RNA, 23 nt, Homo sapiens
ggaggauugcagguggaacucag

SEQ ID NO: 1050765 - RNA, 20 nt, Homo sapiens
ggaggcagcuguugcaguga

SEQ ID NO: 1050766 - RNA, 17 nt, Homo sapiens
ggaggccaccucuccaa

SEQ ID NO: 1050767 - RNA, 19 nt, Homo sapiens
ggaggcggagcuugcagug

SEQ ID NO: 1050768 - RNA, 17 nt, Homo sapiens
ggaggcgggaguggagu

SEQ ID NO: 1050769 - RNA, 15 nt, Homo sapiens
ggaggcugaggcaag

SEQ ID NO: 1050770 - RNA, 14 nt, Homo sapiens
ggaggcugcaguga

SEQ ID NO: 1050771 - RNA, 19 nt, Homo sapiens
ggaggcugucuucucaggc

SEQ ID NO: 1050772 - RNA, 15 nt, Homo sapiens
ggagggcuccagaca

SEQ ID NO: 1050773 - RNA, 22 nt, Homo sapiens
ggagggcuccagacacaugucc

SEQ ID NO: 1050774 - RNA, 23 nt, Homo sapiens
ggagggguuuuggugauacccaa

SEQ ID NO: 1050775 - RNA, 14 nt, Homo sapiens
ggaggucgacccca

SEQ ID NO: 1050776 - RNA, 19 nt, Homo sapiens
ggaggugaccaaaucagug

SEQ ID NO: 1050777 - RNA, 19 nt, Homo sapiens
ggagguggaggcugcagug

SEQ ID NO: 1050778 - RNA, 20 nt, Homo sapiens
ggagguggaggcugcaguga

SEQ ID NO: 1050779 - RNA, 20 nt, Homo sapiens
ggagguugcagugagccaag

SEQ ID NO: 1050780 - RNA, 18 nt, Homo sapiens
ggaguacaccccaacagc

SEQ ID NO: 1050781 - RNA, 16 nt, Homo sapiens
ggaguaggacauacca

SEQ ID NO: 1050782 - RNA, 19 nt, Homo sapiens
ggagucagaaacuguuucu

SEQ ID NO: 1050783 - RNA, 16 nt, Homo sapiens
ggagucagacauuuua

SEQ ID NO: 1050784 - RNA, 12 nt, Homo sapiens
ggaguccacucc

SEQ ID NO: 1050785 - RNA, 21 nt, Homo sapiens
ggaguccuugaccgcucucug

SEQ ID NO: 1050786 - RNA, 17 nt, Homo sapiens
ggagugaagaggggcag

SEQ ID NO: 1050787 - RNA, 18 nt, Homo sapiens
ggagugagaucauuuucu

SEQ ID NO: 1050788 - RNA, 23 nt, Homo sapiens
ggagugaggaugucugggccacu

SEQ ID NO: 1050789 - RNA, 18 nt, Homo sapiens
ggaguggcguggggccaa

SEQ ID NO: 1050790 - RNA, 11 nt, Homo sapiens
ggauagcacug

SEQ ID NO: 1050791 - RNA, 14 nt, Homo sapiens
ggauagucugucca

SEQ ID NO: 1050792 - RNA, 12 nt, Homo sapiens
ggauaugcagua

SEQ ID NO: 1050793 - RNA, 20 nt, Homo sapiens
ggauauuugguuuggccauc

SEQ ID NO: 1050794 - RNA, 19 nt, Homo sapiens
ggauccccccacagccccu

SEQ ID NO: 1050795 - RNA, 15 nt, Homo sapiens
ggaucccucucugga

SEQ ID NO: 1050796 - RNA, 17 nt, Homo sapiens
ggauccggggcuuguac

SEQ ID NO: 1050797 - RNA, 24 nt, Homo sapiens
ggauccuccaggugcacaagcucc

SEQ ID NO: 1050798 - RNA, 16 nt, Homo sapiens
ggaucuguccaaggaa

SEQ ID NO: 1050799 - RNA, 20 nt, Homo sapiens
ggaugaagauucuccugugc

SEQ ID NO: 1050800 - RNA, 14 nt, Homo sapiens
ggaugacugugauu

SEQ ID NO: 1050801 - RNA, 16 nt, Homo sapiens
ggaugaugguugcaaa

SEQ ID NO: 1050802 - RNA, 13 nt, Homo sapiens
ggaugauguuucg

SEQ ID NO: 1050803 - RNA, 20 nt, Homo sapiens
ggcuuuaugcuaguuugacc

SEQ ID NO: 1050804 - RNA, 14 nt, Homo sapiens
gggaaaacauucca

SEQ ID NO: 1050805 - RNA, 13 nt, Homo sapiens
gggaaagccagug

SEQ ID NO: 1050806 - RNA, 13 nt, Homo sapiens
gggaacucaccug

SEQ ID NO: 1050807 - RNA, 23 nt, Homo sapiens
gggaagcuggcuuucuggcugcu

SEQ ID NO: 1050808 - RNA, 22 nt, Homo sapiens
gggaaggucagcccagccccuc

SEQ ID NO: 1050809 - RNA, 22 nt, Homo sapiens
gggaaggugaccacauccaccu

SEQ ID NO: 1050810 - RNA, 14 nt, Homo sapiens
gggacagagccaug

SEQ ID NO: 1050811 - RNA, 20 nt, Homo sapiens
gggacaggaugaccuggaua

SEQ ID NO: 1050812 - RNA, 15 nt, Homo sapiens
gggacaggucccuca

SEQ ID NO: 1050813 - RNA, 13 nt, Homo sapiens
gggaccgccagau

SEQ ID NO: 1050814 - RNA, 18 nt, Homo sapiens
gggacugaaaaccucucc

SEQ ID NO: 1050815 - RNA, 12 nt, Homo sapiens
gggacuugcaaa

SEQ ID NO: 1050816 - RNA, 19 nt, Homo sapiens
gggagaagaagucagagag

SEQ ID NO: 1050817 - RNA, 16 nt, Homo sapiens
gggagaaugucaguau

SEQ ID NO: 1050818 - RNA, 13 nt, Homo sapiens
gggagacacugau

SEQ ID NO: 1050819 - RNA, 19 nt, Homo sapiens
gggagacugggcugaggga

SEQ ID NO: 1050820 - RNA, 15 nt, Homo sapiens
gggagagccuuccag

SEQ ID NO: 1050821 - RNA, 18 nt, Homo sapiens
gggagauggaucaaucaa

SEQ ID NO: 1050822 - RNA, 21 nt, Homo sapiens
gggaggcagagguugugguga

SEQ ID NO: 1050823 - RNA, 20 nt, Homo sapiens
gggaggcggagcuugcagug

SEQ ID NO: 1050824 - RNA, 20 nt, Homo sapiens
gggaggucaaggcugcagug

SEQ ID NO: 1050825 - RNA, 20 nt, Homo sapiens
gggaguaggacauaccagcu

SEQ ID NO: 1050826 - RNA, 12 nt, Homo sapiens
gggagucugggc

SEQ ID NO: 1050827 - RNA, 14 nt, Homo sapiens
gggaguguguaauu

SEQ ID NO: 1050828 - RNA, 23 nt, Homo sapiens
gggauaaguaaguuugauuucau

SEQ ID NO: 1050829 - RNA, 15 nt, Homo sapiens
gggaucacuaaggga

SEQ ID NO: 1050830 - RNA, 17 nt, Homo sapiens
gggauccguacauucaa

SEQ ID NO: 1050831 - RNA, 19 nt, Homo sapiens
gggaugacuggcuuugaga

SEQ ID NO: 1050832 - RNA, 13 nt, Homo sapiens
gggaugcuugccu

SEQ ID NO: 1050833 - RNA, 17 nt, Homo sapiens
gggauguuucugucaca

SEQ ID NO: 1050834 - RNA, 22 nt, Homo sapiens
gggauuacccaagcaaaaucau

SEQ ID NO: 1050835 - RNA, 21 nt, Homo sapiens
gggcaacaauacaugcugcua

SEQ ID NO: 1050836 - RNA, 12 nt, Homo sapiens
gggcaacagagc

SEQ ID NO: 1050837 - RNA, 17 nt, Homo sapiens
gggcaacagagcaagau

SEQ ID NO: 1050838 - RNA, 23 nt, Homo sapiens
gggcacagauccccccacaaagu

SEQ ID NO: 1050839 - RNA, 20 nt, Homo sapiens
gggcaggagggcccuaccug

SEQ ID NO: 1050840 - RNA, 14 nt, Homo sapiens
gggcagucauuauc

SEQ ID NO: 1050841 - RNA, 11 nt, Homo sapiens
gggcaucuccu

SEQ ID NO: 1050842 - RNA, 21 nt, Homo sapiens
gggcaugacggcucaugccug

SEQ ID NO: 1050843 - RNA, 22 nt, Homo sapiens
gggccacucaggggucauucau

SEQ ID NO: 1050844 - RNA, 19 nt, Homo sapiens
gggccagaggaacugucca

SEQ ID NO: 1050845 - RNA, 21 nt, Homo sapiens
gggcccagcugggcucugcca

SEQ ID NO: 1050846 - RNA, 16 nt, Homo sapiens
gggcccaggaccagcu

SEQ ID NO: 1050847 - RNA, 13 nt, Homo sapiens
gggccgggaacuu

SEQ ID NO: 1050848 - RNA, 22 nt, Homo sapiens
gggccgugacagugacgccuuu

SEQ ID NO: 1050849 - RNA, 17 nt, Homo sapiens
gggccgugagggguccc

SEQ ID NO: 1050850 - RNA, 12 nt, Homo sapiens
gggcgcgguggc

SEQ ID NO: 1050851 - RNA, 18 nt, Homo sapiens
gggcguggagagcccggc

SEQ ID NO: 1050852 - RNA, 17 nt, Homo sapiens
gggcuaucccuuuccaa

SEQ ID NO: 1050853 - RNA, 14 nt, Homo sapiens
gggcucagccuggu

SEQ ID NO: 1050854 - RNA, 19 nt, Homo sapiens
gggcucucucaugauagaa

SEQ ID NO: 1050855 - RNA, 11 nt, Homo sapiens
gggcugugauc

SEQ ID NO: 1050856 - RNA, 19 nt, Homo sapiens
gggcugugucguagccaag

SEQ ID NO: 1050857 - RNA, 16 nt, Homo sapiens
gggcuuuuacaccagu

SEQ ID NO: 1050858 - RNA, 20 nt, Homo sapiens
ggggacagcuccacucugac

SEQ ID NO: 1050859 - RNA, 22 nt, Homo sapiens
ggggaggccaagugcaggcugg

SEQ ID NO: 1050860 - RNA, 19 nt, Homo sapiens
ggggaugacaugcacucag

SEQ ID NO: 1050861 - RNA, 22 nt, Homo sapiens
ggggcuggccucuggcucucau

SEQ ID NO: 1050862 - RNA, 24 nt, Homo sapiens
ggggcugggcagcguacucaucau

SEQ ID NO: 1050863 - RNA, 23 nt, Homo sapiens
ggggcugggcugggcgcgguggu

SEQ ID NO: 1050864 - RNA, 10 nt, Homo sapiens
ggggcuuccu

SEQ ID NO: 1050865 - RNA, 12 nt, Homo sapiens
gggggaaggugg

SEQ ID NO: 1050866 - RNA, 20 nt, Homo sapiens
ggggucgucaccaccucucc

SEQ ID NO: 1050867 - RNA, 13 nt, Homo sapiens
gggguggagcaug

SEQ ID NO: 1050868 - RNA, 12 nt, Homo sapiens
ggggugggccac

SEQ ID NO: 1050869 - RNA, 21 nt, Homo sapiens
ggggugugccugucuguuaca

SEQ ID NO: 1050870 - RNA, 17 nt, Homo sapiens
gggguuucuggggucca

SEQ ID NO: 1050871 - RNA, 22 nt, Homo sapiens
gggucccauagaggugagggaa

SEQ ID NO: 1050872 - RNA, 15 nt, Homo sapiens
ggguccccaccuggg

SEQ ID NO: 1050873 - RNA, 23 nt, Homo sapiens
gggucccccugcuugucuucacc

SEQ ID NO: 1050874 - RNA, 19 nt, Homo sapiens
gggucucacaguguugccc

SEQ ID NO: 1050875 - RNA, 20 nt, Homo sapiens
gggucucacaguguugccca

SEQ ID NO: 1050876 - RNA, 10 nt, Homo sapiens
gggucugugu

SEQ ID NO: 1050877 - RNA, 16 nt, Homo sapiens
gggugauuucagagag

SEQ ID NO: 1050878 - RNA, 22 nt, Homo sapiens
gggugcucccuaccaccucccc

SEQ ID NO: 1050879 - RNA, 18 nt, Homo sapiens
ggguggcaggugaccuuc

SEQ ID NO: 1050880 - RNA, 14 nt, Homo sapiens
gggugguacccucu

SEQ ID NO: 1050881 - RNA, 11 nt, Homo sapiens
gggugugcuau

SEQ ID NO: 1050882 - RNA, 21 nt, Homo sapiens
ggguguggcgcagcauauuca

SEQ ID NO: 1050883 - RNA, 14 nt, Homo sapiens
ggguuacuuucaca

SEQ ID NO: 1050884 - RNA, 21 nt, Homo sapiens
ggguuaguuuacaaucagcca

SEQ ID NO: 1050885 - RNA, 13 nt, Homo sapiens
ggguucacugcaa

SEQ ID NO: 1050886 - RNA, 14 nt, Homo sapiens
ggguucucacagug

SEQ ID NO: 1050887 - RNA, 12 nt, Homo sapiens
ggguuuugcucu

SEQ ID NO: 1050888 - RNA, 14 nt, Homo sapiens
gguaaacauucucu

SEQ ID NO: 1050889 - RNA, 20 nt, Homo sapiens
gguaauauaaaguguaauag

SEQ ID NO: 1050890 - RNA, 14 nt, Homo sapiens
gguacauauuucuu

SEQ ID NO: 1050891 - RNA, 20 nt, Homo sapiens
gguacuucaggggcacuuca

SEQ ID NO: 1050892 - RNA, 20 nt, Homo sapiens
gguagaaaaggcuagguaca

SEQ ID NO: 1050893 - RNA, 20 nt, Homo sapiens
gguagaggcugggggcucca

SEQ ID NO: 1050894 - RNA, 18 nt, Homo sapiens
gguagguggcacacuggg

SEQ ID NO: 1050895 - RNA, 13 nt, Homo sapiens
gguaguguaucau

SEQ ID NO: 1050896 - RNA, 13 nt, Homo sapiens
gguaucaggugcu

SEQ ID NO: 1050897 - RNA, 12 nt, Homo sapiens
gguaugagcuga

SEQ ID NO: 1050898 - RNA, 14 nt, Homo sapiens
gguaugauauugca

SEQ ID NO: 1050899 - RNA, 18 nt, Homo sapiens
gguaugaucacggcucac

SEQ ID NO: 1050900 - RNA, 23 nt, Homo sapiens
gguaugcuugaaaguagcaauua

SEQ ID NO: 1050901 - RNA, 22 nt, Homo sapiens
gguauguguggaugaugcugcc

SEQ ID NO: 1050902 - RNA, 20 nt, Homo sapiens
gguauguuuuaccaucugca

SEQ ID NO: 1050903 - RNA, 20 nt, Homo sapiens
ggucaauuuuguuauguaua

SEQ ID NO: 1050904 - RNA, 17 nt, Homo sapiens
ggucacauugugccuuu

SEQ ID NO: 1050905 - RNA, 15 nt, Homo sapiens
ggucacuggaacuca

SEQ ID NO: 1050906 - RNA, 20 nt, Homo sapiens
ggucagagacugcuguguuu

SEQ ID NO: 1050907 - RNA, 23 nt, Homo sapiens
ggucaggaaggaugagcauuuag

SEQ ID NO: 1050908 - RNA, 21 nt, Homo sapiens
ggucauagcccagaucagcuc

SEQ ID NO: 1050909 - RNA, 15 nt, Homo sapiens
ggucaugguggugca

SEQ ID NO: 1050910 - RNA, 18 nt, Homo sapiens
gguccacccagcaaagag

SEQ ID NO: 1050911 - RNA, 15 nt, Homo sapiens
gguccuggcuccuga

SEQ ID NO: 1050912 - RNA, 17 nt, Homo sapiens
ggucuagggaaugagac

SEQ ID NO: 1050913 - RNA, 18 nt, Homo sapiens
ggucuauugucuguauuu

SEQ ID NO: 1050914 - RNA, 20 nt, Homo sapiens
ggucucgcuuuguugcccag

SEQ ID NO: 1050915 - RNA, 20 nt, Homo sapiens
ggucuuugcaagaaucauua

SEQ ID NO: 1050916 - RNA, 18 nt, Homo sapiens
ggugaaaccucaucucua

SEQ ID NO: 1050917 - RNA, 14 nt, Homo sapiens
ggugaaagugcagu

SEQ ID NO: 1050918 - RNA, 23 nt, Homo sapiens
ggugaaaguuaauccacugugac

SEQ ID NO: 1050919 - RNA, 19 nt, Homo sapiens
ggugaagggagagccagcu

SEQ ID NO: 1050920 - RNA, 15 nt, Homo sapiens
ggugacccaaugauu

SEQ ID NO: 1050921 - RNA, 23 nt, Homo sapiens
ggugagaauaagagagucauaaa

SEQ ID NO: 1050922 - RNA, 19 nt, Homo sapiens
ggugaucaauuaaauguag

SEQ ID NO: 1050923 - RNA, 17 nt, Homo sapiens
ggugcucuuucccuuua

SEQ ID NO: 1050924 - RNA, 19 nt, Homo sapiens
gguggaaacuccugugucu

SEQ ID NO: 1050925 - RNA, 17 nt, Homo sapiens
gguggaggcugcaguga

SEQ ID NO: 1050926 - RNA, 20 nt, Homo sapiens
gguggaggguggggggcgcu

SEQ ID NO: 1050927 - RNA, 23 nt, Homo sapiens
gguggcagaaucuguuaccagag

SEQ ID NO: 1050928 - RNA, 20 nt, Homo sapiens
ggugggagugggcccaaugc

SEQ ID NO: 1050929 - RNA, 23 nt, Homo sapiens
ggugggcggcacagccuucucca

SEQ ID NO: 1050930 - RNA, 14 nt, Homo sapiens
gguggucacuggaa

SEQ ID NO: 1050931 - RNA, 15 nt, Homo sapiens
gguggucugaauguu

SEQ ID NO: 1050932 - RNA, 17 nt, Homo sapiens
gguggugggaaccauga

SEQ ID NO: 1050933 - RNA, 23 nt, Homo sapiens
gguguacuuauauccacacugca

SEQ ID NO: 1050934 - RNA, 20 nt, Homo sapiens
ggugucaaugaauuuugcuu

SEQ ID NO: 1050935 - RNA, 19 nt, Homo sapiens
ggugugagggccccugccu

SEQ ID NO: 1050936 - RNA, 13 nt, Homo sapiens
gguguugacaugu

SEQ ID NO: 1050937 - RNA, 23 nt, Homo sapiens
gguuaagacaaacugcauaugua

SEQ ID NO: 1050938 - RNA, 19 nt, Homo sapiens
gguuaauaaguuucacuga

SEQ ID NO: 1050939 - RNA, 23 nt, Homo sapiens
gguuaccaguaacggaacaguau

SEQ ID NO: 1050940 - RNA, 19 nt, Homo sapiens
gguuagggaaaacauucca

SEQ ID NO: 1050941 - RNA, 19 nt, Homo sapiens
gguucaaaaccuugcacag

SEQ ID NO: 1050942 - RNA, 13 nt, Homo sapiens
gguucaagugauu

SEQ ID NO: 1050943 - RNA, 17 nt, Homo sapiens
gguugagcucuucuuaa

SEQ ID NO: 1050944 - RNA, 18 nt, Homo sapiens
gguuggcugggcccagaa

SEQ ID NO: 1050945 - RNA, 21 nt, Homo sapiens
gguuggcugggcccagaaggu

SEQ ID NO: 1050946 - RNA, 19 nt, Homo sapiens
gguugggggcagaggccca

SEQ ID NO: 1050947 - RNA, 16 nt, Homo sapiens
ucaguccaagucuucu

SEQ ID NO: 1050948 - RNA, 16 nt, Homo sapiens
ucaguccacugcugag

SEQ ID NO: 1050949 - RNA, 20 nt, Homo sapiens
ucagucccuaaaaacacaga

SEQ ID NO: 1050950 - RNA, 15 nt, Homo sapiens
ucagucuauccacag

SEQ ID NO: 1050951 - RNA, 15 nt, Homo sapiens
ucagucucuaaggaa

SEQ ID NO: 1050952 - RNA, 20 nt, Homo sapiens
ucagucuuuuccaugaacuu

SEQ ID NO: 1050953 - RNA, 15 nt, Homo sapiens
ucagugaacugugag

SEQ ID NO: 1050954 - RNA, 22 nt, Homo sapiens
ucagugacagaguucacuauaa

SEQ ID NO: 1050955 - RNA, 19 nt, Homo sapiens
ucagugcaaagauuugcuu

SEQ ID NO: 1050956 - RNA, 21 nt, Homo sapiens
ucagugcaaagauuugcuuua

SEQ ID NO: 1050957 - RNA, 21 nt, Homo sapiens
ucagugccuacccaccuguga

SEQ ID NO: 1050958 - RNA, 21 nt, Homo sapiens
ucagugcuucgcagauguccu

SEQ ID NO: 1050959 - RNA, 15 nt, Homo sapiens
ucaguguuaaaugug

SEQ ID NO: 1050960 - RNA, 22 nt, Homo sapiens
ucaguuaugauuuuuuuuucau

SEQ ID NO: 1050961 - RNA, 18 nt, Homo sapiens
ucaguucauccauucuau

SEQ ID NO: 1050962 - RNA, 14 nt, Homo sapiens
ucaguucccagaau

SEQ ID NO: 1050963 - RNA, 20 nt, Homo sapiens
ucaguucccuuggccucaga

SEQ ID NO: 1050964 - RNA, 13 nt, Homo sapiens
ucaguucuagucu

SEQ ID NO: 1050965 - RNA, 16 nt, Homo sapiens
ucaguuucccuaucuc

SEQ ID NO: 1050966 - RNA, 17 nt, Homo sapiens
ucaguuuuaccagauga

SEQ ID NO: 1050967 - RNA, 21 nt, Homo sapiens
ucaguuuuacucugcugcaaa

SEQ ID NO: 1050968 - RNA, 22 nt, Homo sapiens
ucaguuuuaucuuuaaucuccu

SEQ ID NO: 1050969 - RNA, 18 nt, Homo sapiens
ucauaaaaagacaacuca

SEQ ID NO: 1050970 - RNA, 12 nt, Homo sapiens
ucauaagauauu

SEQ ID NO: 1050971 - RNA, 13 nt, Homo sapiens
ucauaagauauuu

SEQ ID NO: 1050972 - RNA, 15 nt, Homo sapiens
ucauaaucacaaccc

SEQ ID NO: 1050973 - RNA, 17 nt, Homo sapiens
ucauacagcauuacaaa

SEQ ID NO: 1050974 - RNA, 17 nt, Homo sapiens
ucauacaggaaugaagc

SEQ ID NO: 1050975 - RNA, 12 nt, Homo sapiens
ucauacauccua

SEQ ID NO: 1050976 - RNA, 14 nt, Homo sapiens
ucauacaugacuca

SEQ ID NO: 1050977 - RNA, 16 nt, Homo sapiens
ucauaccuaucaucuu

SEQ ID NO: 1050978 - RNA, 14 nt, Homo sapiens
ucauagcugagauu

SEQ ID NO: 1050979 - RNA, 22 nt, Homo sapiens
ucauaguggcuuaaaacaacac

SEQ ID NO: 1050980 - RNA, 18 nt, Homo sapiens
ucauauacaauugucaug

SEQ ID NO: 1050981 - RNA, 18 nt, Homo sapiens
ucauaugauugugcacau

SEQ ID NO: 1050982 - RNA, 18 nt, Homo sapiens
ucauauggcccaguguca

SEQ ID NO: 1050983 - RNA, 22 nt, Homo sapiens
ucauaugguugacaguaugcau

SEQ ID NO: 1050984 - RNA, 15 nt, Homo sapiens
ucauauugaauguuu

SEQ ID NO: 1050985 - RNA, 10 nt, Homo sapiens
ucauauugau

SEQ ID NO: 1050986 - RNA, 14 nt, Homo sapiens
ucauauuggacuga

SEQ ID NO: 1050987 - RNA, 15 nt, Homo sapiens
ucauauugugccaau

SEQ ID NO: 1050988 - RNA, 17 nt, Homo sapiens
ucaucaaaaacuuugga

SEQ ID NO: 1050989 - RNA, 20 nt, Homo sapiens
ucaucaaauggaagacacau

SEQ ID NO: 1050990 - RNA, 15 nt, Homo sapiens
ucaucaaugaaugaa

SEQ ID NO: 1050991 - RNA, 16 nt, Homo sapiens
ucaucacacaacucag

SEQ ID NO: 1050992 - RNA, 16 nt, Homo sapiens
ucaucaccacagggau

SEQ ID NO: 1050993 - RNA, 18 nt, Homo sapiens
ucaucagcauaccuuuau

SEQ ID NO: 1050994 - RNA, 19 nt, Homo sapiens
ucaucaggagaaaaagccu

SEQ ID NO: 1050995 - RNA, 13 nt, Homo sapiens
ucaucaggaugaa

SEQ ID NO: 1050996 - RNA, 12 nt, Homo sapiens
ucaucaggccau

SEQ ID NO: 1050997 - RNA, 18 nt, Homo sapiens
ucaucauacaugacucag

SEQ ID NO: 1050998 - RNA, 13 nt, Homo sapiens
ucauccaaucuaa

SEQ ID NO: 1050999 - RNA, 16 nt, Homo sapiens
ucauccacugugccau

SEQ ID NO: 1051000 - RNA, 13 nt, Homo sapiens
ucauccauuugcg

SEQ ID NO: 1051001 - RNA, 18 nt, Homo sapiens
ucaucccacaaucuuaag

SEQ ID NO: 1051002 - RNA, 19 nt, Homo sapiens
ucauccuaaaaaguuccau

SEQ ID NO: 1051003 - RNA, 13 nt, Homo sapiens
ucauccugcaggc

SEQ ID NO: 1051004 - RNA, 20 nt, Homo sapiens
ucaucgcgccacuaagccaa

SEQ ID NO: 1051005 - RNA, 20 nt, Homo sapiens
ucaucuauaaagaagaacuu

SEQ ID NO: 1051006 - RNA, 21 nt, Homo sapiens
ucaucuauuuuuggcagucug

SEQ ID NO: 1051007 - RNA, 13 nt, Homo sapiens
ucaucucuacuaa

SEQ ID NO: 1051008 - RNA, 16 nt, Homo sapiens
ucaucugaaaaucugg

SEQ ID NO: 1051009 - RNA, 12 nt, Homo sapiens
ucaucugcucag

SEQ ID NO: 1051010 - RNA, 15 nt, Homo sapiens
ucaucuguaccucug

SEQ ID NO: 1051011 - RNA, 14 nt, Homo sapiens
ucaucuucucagcu

SEQ ID NO: 1051012 - RNA, 15 nt, Homo sapiens
ucaucuucucagcuc

SEQ ID NO: 1051013 - RNA, 19 nt, Homo sapiens
ucaucuuggucacauacaa

SEQ ID NO: 1051014 - RNA, 16 nt, Homo sapiens
ucaugaaagcaucuga

SEQ ID NO: 1051015 - RNA, 18 nt, Homo sapiens
ucaugaguuucccagaga

SEQ ID NO: 1051016 - RNA, 13 nt, Homo sapiens
ucaugcauuugca

SEQ ID NO: 1051017 - RNA, 14 nt, Homo sapiens
ucaugcauuugcac

SEQ ID NO: 1051018 - RNA, 22 nt, Homo sapiens
ucaugcccccuuucagaugucu

SEQ ID NO: 1051019 - RNA, 23 nt, Homo sapiens
ucaugcucagcccugacuggugc

SEQ ID NO: 1051020 - RNA, 18 nt, Homo sapiens
ucaugcugugugacucaa

SEQ ID NO: 1051021 - RNA, 17 nt, Homo sapiens
ucauggcaccaaagcca

SEQ ID NO: 1051022 - RNA, 15 nt, Homo sapiens
ucaugguuuccucca

SEQ ID NO: 1051023 - RNA, 17 nt, Homo sapiens
ucauguaaacugugcac

SEQ ID NO: 1051024 - RNA, 15 nt, Homo sapiens
ucaugugauccuuuu

SEQ ID NO: 1051025 - RNA, 24 nt, Homo sapiens
ucauuauagaucccccagacuuua

SEQ ID NO: 1051026 - RNA, 17 nt, Homo sapiens
ucauuaucaguccaaag

SEQ ID NO: 1051027 - RNA, 19 nt, Homo sapiens
ucauuaucucaaaacugca

SEQ ID NO: 1051028 - RNA, 12 nt, Homo sapiens
ucauucagggau

SEQ ID NO: 1051029 - RNA, 20 nt, Homo sapiens
ucauucagggauagcacuga

SEQ ID NO: 1051030 - RNA, 16 nt, Homo sapiens
ucauuccaccuuccca

SEQ ID NO: 1051031 - RNA, 18 nt, Homo sapiens
ucauucuuauuucaugaa

SEQ ID NO: 1051032 - RNA, 15 nt, Homo sapiens
ucauugaaguauuuu

SEQ ID NO: 1051033 - RNA, 18 nt, Homo sapiens
ucauugacugauggugaa

SEQ ID NO: 1051034 - RNA, 16 nt, Homo sapiens
ucauugcaagcucaag

SEQ ID NO: 1051035 - RNA, 14 nt, Homo sapiens
ucauugcacuuuga

SEQ ID NO: 1051036 - RNA, 23 nt, Homo sapiens
ucauugcccccagggcacuucac

SEQ ID NO: 1051037 - RNA, 14 nt, Homo sapiens
ucauuguguucucu

SEQ ID NO: 1051038 - RNA, 14 nt, Homo sapiens
ucauuuacuguggc

SEQ ID NO: 1051039 - RNA, 21 nt, Homo sapiens
ucauuuauucuucuuuuccaa

SEQ ID NO: 1051040 - RNA, 23 nt, Homo sapiens
ucauuucaggagcagccucagaa

SEQ ID NO: 1051041 - RNA, 23 nt, Homo sapiens
ucauuucauuguaugauguguug

SEQ ID NO: 1051042 - RNA, 12 nt, Homo sapiens
ucauuugaacaa

SEQ ID NO: 1051043 - RNA, 14 nt, Homo sapiens
ucauuuuauugcua

SEQ ID NO: 1051044 - RNA, 17 nt, Homo sapiens
ucauuuucugcauuuaa

SEQ ID NO: 1051045 - RNA, 16 nt, Homo sapiens
ucauuuugcauucaaa

SEQ ID NO: 1051046 - RNA, 14 nt, Homo sapiens
ucauuuuguugcuu

SEQ ID NO: 1051047 - RNA, 21 nt, Homo sapiens
ucauuuuuguacaguuugcug

SEQ ID NO: 1051048 - RNA, 19 nt, Homo sapiens
ucauuuuuuccagucuucc

SEQ ID NO: 1051049 - RNA, 17 nt, Homo sapiens
ucauuuuuuucacugga

SEQ ID NO: 1051050 - RNA, 18 nt, Homo sapiens
ucauuuuuuucacuggag

SEQ ID NO: 1051051 - RNA, 22 nt, Homo sapiens
uccaaaacuccugccccuguuc

SEQ ID NO: 1051052 - RNA, 17 nt, Homo sapiens
uccaaaggucugauguc

SEQ ID NO: 1051053 - RNA, 16 nt, Homo sapiens
uccaaaugaaugaccu

SEQ ID NO: 1051054 - RNA, 13 nt, Homo sapiens
uccaaaugccaac

SEQ ID NO: 1051055 - RNA, 19 nt, Homo sapiens
uccaacagugagucuguca

SEQ ID NO: 1051056 - RNA, 20 nt, Homo sapiens
uccaacaugugcucagggaa

SEQ ID NO: 1051057 - RNA, 19 nt, Homo sapiens
uccaacggcaagggaacaa

SEQ ID NO: 1051058 - RNA, 15 nt, Homo sapiens
uccaacuccaggaua

SEQ ID NO: 1051059 - RNA, 13 nt, Homo sapiens
uccaagauaugga

SEQ ID NO: 1051060 - RNA, 18 nt, Homo sapiens
uccaagccucauguccac

SEQ ID NO: 1051061 - RNA, 23 nt, Homo sapiens
uccaagccugaccacgcuuucua

SEQ ID NO: 1051062 - RNA, 18 nt, Homo sapiens
uccaaggaaaccacagcu

SEQ ID NO: 1051063 - RNA, 20 nt, Homo sapiens
uccaaggaggggcuguaaaa

SEQ ID NO: 1051064 - RNA, 15 nt, Homo sapiens
uccaagucucagugg

SEQ ID NO: 1051065 - RNA, 16 nt, Homo sapiens
uccaauaaaaugccuc

SEQ ID NO: 1051066 - RNA, 15 nt, Homo sapiens
uccaauaggcauuug

SEQ ID NO: 1051067 - RNA, 12 nt, Homo sapiens
uccaauaugaug

SEQ ID NO: 1051068 - RNA, 17 nt, Homo sapiens
uccaauauuggagcaua

SEQ ID NO: 1051069 - RNA, 13 nt, Homo sapiens
uccaaugcucaag

SEQ ID NO: 1051070 - RNA, 17 nt, Homo sapiens
uccaauuccuugcacau

SEQ ID NO: 1051071 - RNA, 17 nt, Homo sapiens
uccacaaaaucugucca

SEQ ID NO: 1051072 - RNA, 12 nt, Homo sapiens
uccacaccaagc

SEQ ID NO: 1051073 - RNA, 14 nt, Homo sapiens
uccacacccagcuc

SEQ ID NO: 1051074 - RNA, 16 nt, Homo sapiens
uccacacccucuccca

SEQ ID NO: 1051075 - RNA, 16 nt, Homo sapiens
uccacaccuggucuga

SEQ ID NO: 1051076 - RNA, 14 nt, Homo sapiens
uccacacuaccaca

SEQ ID NO: 1051077 - RNA, 18 nt, Homo sapiens
uccacagaaauacaugaa

SEQ ID NO: 1051078 - RNA, 13 nt, Homo sapiens
uccacagugacuc

SEQ ID NO: 1051079 - RNA, 17 nt, Homo sapiens
uccacagugacuccacu

SEQ ID NO: 1051080 - RNA, 16 nt, Homo sapiens
uccacauguucaacua

SEQ ID NO: 1051081 - RNA, 18 nt, Homo sapiens
uccacauuauacauuuga

SEQ ID NO: 1051082 - RNA, 19 nt, Homo sapiens
uccacauuauacauuugau

SEQ ID NO: 1051083 - RNA, 10 nt, Homo sapiens
uccaccagcc

SEQ ID NO: 1051084 - RNA, 17 nt, Homo sapiens
uccaccagccugcacua

SEQ ID NO: 1051085 - RNA, 13 nt, Homo sapiens
uccaccugucuca

SEQ ID NO: 1051086 - RNA, 16 nt, Homo sapiens
uccaccuuccaaagga

SEQ ID NO: 1051087 - RNA, 22 nt, Homo sapiens
uccaccuuuaaacacggggcuu

SEQ ID NO: 1051088 - RNA, 17 nt, Homo sapiens
uccacgucaacagaauu

SEQ ID NO: 1051089 - RNA, 13 nt, Homo sapiens
uccacuacugcua

SEQ ID NO: 1051090 - RNA, 15 nt, Homo sapiens
uccacucccaggcag

SEQ ID NO: 1051091 - RNA, 20 nt, Homo sapiens
uccacugcugaggacacuca

SEQ ID NO: 1051092 - RNA, 19 nt, Homo sapiens
uccacuggaaaaguguaau

SEQ ID NO: 1051093 - RNA, 14 nt, Homo sapiens
ucugcucaucauuc

SEQ ID NO: 1051094 - RNA, 22 nt, Homo sapiens
ucugcuccccugugaacccacu

SEQ ID NO: 1051095 - RNA, 17 nt, Homo sapiens
ucugcucgucaucauuu

SEQ ID NO: 1051096 - RNA, 22 nt, Homo sapiens
ucugcuuacaauucccugcugu

SEQ ID NO: 1051097 - RNA, 23 nt, Homo sapiens
ucugcuuuuuaaagaaugcucuu

SEQ ID NO: 1051098 - RNA, 11 nt, Homo sapiens
ucuggacacag

SEQ ID NO: 1051099 - RNA, 14 nt, Homo sapiens
ucuggacacagccc

SEQ ID NO: 1051100 - RNA, 16 nt, Homo sapiens
ucuggaguauucuaua

SEQ ID NO: 1051101 - RNA, 17 nt, Homo sapiens
ucuggagucuccagugg

SEQ ID NO: 1051102 - RNA, 21 nt, Homo sapiens
ucuggauggauuugaagcaaa

SEQ ID NO: 1051103 - RNA, 17 nt, Homo sapiens
ucuggcuaugcauuuga

SEQ ID NO: 1051104 - RNA, 19 nt, Homo sapiens
ucuggcugccccaaccugc

SEQ ID NO: 1051105 - RNA, 23 nt, Homo sapiens
ucuggcugccccaaccugcugaa

SEQ ID NO: 1051106 - RNA, 20 nt, Homo sapiens
ucugggauucccaccaaggu

SEQ ID NO: 1051107 - RNA, 11 nt, Homo sapiens
ucugggcuccc

SEQ ID NO: 1051108 - RNA, 21 nt, Homo sapiens
ucugggguccauucucugagu

SEQ ID NO: 1051109 - RNA, 23 nt, Homo sapiens
ucugggguccauucucugaguca

SEQ ID NO: 1051110 - RNA, 19 nt, Homo sapiens
ucugggugaccucacuuua

SEQ ID NO: 1051111 - RNA, 17 nt, Homo sapiens
ucuggucacauggcugu

SEQ ID NO: 1051112 - RNA, 14 nt, Homo sapiens
ucuggucuguccac

SEQ ID NO: 1051113 - RNA, 16 nt, Homo sapiens
ucugguggucucugcu

SEQ ID NO: 1051114 - RNA, 23 nt, Homo sapiens
ucuguacaaugaacccccaugau

SEQ ID NO: 1051115 - RNA, 19 nt, Homo sapiens
ucuguagcuuguucccugu

SEQ ID NO: 1051116 - RNA, 22 nt, Homo sapiens
ucuguaguuuuaucacauguau

SEQ ID NO: 1051117 - RNA, 14 nt, Homo sapiens
ucuguauucacuua

SEQ ID NO: 1051118 - RNA, 15 nt, Homo sapiens
ucugucaaugucuug

SEQ ID NO: 1051119 - RNA, 14 nt, Homo sapiens
ucugucacaccagc

SEQ ID NO: 1051120 - RNA, 15 nt, Homo sapiens
ucugucccacuuggc

SEQ ID NO: 1051121 - RNA, 18 nt, Homo sapiens
ucugucgccuuagcaugu

SEQ ID NO: 1051122 - RNA, 16 nt, Homo sapiens
ucugucucauaugauu

SEQ ID NO: 1051123 - RNA, 19 nt, Homo sapiens
ucugucuccuuaacacuga

SEQ ID NO: 1051124 - RNA, 13 nt, Homo sapiens
ucugucucuguca

SEQ ID NO: 1051125 - RNA, 21 nt, Homo sapiens
ucugucuucagcuguacauac

SEQ ID NO: 1051126 - RNA, 22 nt, Homo sapiens
ucugugaaaagggaucugcucc

SEQ ID NO: 1051127 - RNA, 21 nt, Homo sapiens
ucugugagacccccacaccuc

SEQ ID NO: 1051128 - RNA, 21 nt, Homo sapiens
ucugugaggggcucucucaug

SEQ ID NO: 1051129 - RNA, 22 nt, Homo sapiens
ucugugcaugguggcaccagcg

SEQ ID NO: 1051130 - RNA, 14 nt, Homo sapiens
ucugugcuguggaa

SEQ ID NO: 1051131 - RNA, 23 nt, Homo sapiens
ucugugcuuugacucaccuguua

SEQ ID NO: 1051132 - RNA, 17 nt, Homo sapiens
ucuguggcacucagaua

SEQ ID NO: 1051133 - RNA, 19 nt, Homo sapiens
ucugugggccccacccacu

SEQ ID NO: 1051134 - RNA, 21 nt, Homo sapiens
ucuguguagcaagcuauucaa

SEQ ID NO: 1051135 - RNA, 15 nt, Homo sapiens
ucuguguauauuaca

SEQ ID NO: 1051136 - RNA, 14 nt, Homo sapiens
ucuguguuaggggu

SEQ ID NO: 1051137 - RNA, 15 nt, Homo sapiens
ucuguguuaggggua

SEQ ID NO: 1051138 - RNA, 14 nt, Homo sapiens
ucuguuaccagagg

SEQ ID NO: 1051139 - RNA, 16 nt, Homo sapiens
ucuguuauuaacaaac

SEQ ID NO: 1051140 - RNA, 13 nt, Homo sapiens
ucuguucacuuuu

SEQ ID NO: 1051141 - RNA, 17 nt, Homo sapiens
ucuguuccccauggcca

SEQ ID NO: 1051142 - RNA, 18 nt, Homo sapiens
ucuguucugggccagguc

SEQ ID NO: 1051143 - RNA, 15 nt, Homo sapiens
ucuguucuuccauca

SEQ ID NO: 1051144 - RNA, 16 nt, Homo sapiens
ucuguucuugaagcag

SEQ ID NO: 1051145 - RNA, 14 nt, Homo sapiens
ucuguuuaacauuu

SEQ ID NO: 1051146 - RNA, 16 nt, Homo sapiens
ucuuaaaauaacuuau

SEQ ID NO: 1051147 - RNA, 20 nt, Homo sapiens
ucuuaauuuugguuguauuc

SEQ ID NO: 1051148 - RNA, 19 nt, Homo sapiens
ucuuacaaugcauucugag

SEQ ID NO: 1051149 - RNA, 19 nt, Homo sapiens
ucuuaccuguaugucucca

SEQ ID NO: 1051150 - RNA, 23 nt, Homo sapiens
ucuuacuguaccuguuccuuaga

SEQ ID NO: 1051151 - RNA, 20 nt, Homo sapiens
ucuuacuucccuaaugaagu

SEQ ID NO: 1051152 - RNA, 20 nt, Homo sapiens
ucuuagacuucugcuuucca

SEQ ID NO: 1051153 - RNA, 14 nt, Homo sapiens
ucuuagagcaaaga

SEQ ID NO: 1051154 - RNA, 16 nt, Homo sapiens
ucuuagcugucugcuc

SEQ ID NO: 1051155 - RNA, 17 nt, Homo sapiens
ucuuauagaaaguucaa

SEQ ID NO: 1051156 - RNA, 16 nt, Homo sapiens
ucuuaucucagucaug

SEQ ID NO: 1051157 - RNA, 16 nt, Homo sapiens
ucuuaugcaggacuga

SEQ ID NO: 1051158 - RNA, 18 nt, Homo sapiens
ucuuauuagaacaggcaa

SEQ ID NO: 1051159 - RNA, 16 nt, Homo sapiens
ucuuauugacucauac

SEQ ID NO: 1051160 - RNA, 16 nt, Homo sapiens
ucuuauuuaacuuaac

SEQ ID NO: 1051161 - RNA, 18 nt, Homo sapiens
ucuuauuugaaggccagc

SEQ ID NO: 1051162 - RNA, 15 nt, Homo sapiens
ucuucaaaugucuaa

SEQ ID NO: 1051163 - RNA, 19 nt, Homo sapiens
ucuucaacuuuugugcucc

SEQ ID NO: 1051164 - RNA, 18 nt, Homo sapiens
ucuucacaacagauuauu

SEQ ID NO: 1051165 - RNA, 18 nt, Homo sapiens
ucuucaccugauucaacu

SEQ ID NO: 1051166 - RNA, 22 nt, Homo sapiens
ucuucaccuuaggaauaaucuc

SEQ ID NO: 1051167 - RNA, 20 nt, Homo sapiens
ucuucacggaaagugccugc

SEQ ID NO: 1051168 - RNA, 15 nt, Homo sapiens
ucuucacucucugaa

SEQ ID NO: 1051169 - RNA, 21 nt, Homo sapiens
ucuucacuucuaaaugcauau

SEQ ID NO: 1051170 - RNA, 22 nt, Homo sapiens
ucuucacuucuaaaugcauauc

SEQ ID NO: 1051171 - RNA, 12 nt, Homo sapiens
ucuucagccuag

SEQ ID NO: 1051172 - RNA, 21 nt, Homo sapiens
ucuucagggaacugcauagau

SEQ ID NO: 1051173 - RNA, 16 nt, Homo sapiens
ucuucauaauuucuuc

SEQ ID NO: 1051174 - RNA, 21 nt, Homo sapiens
ucuucauaauuucuucacuca

SEQ ID NO: 1051175 - RNA, 14 nt, Homo sapiens
ucuucauaccuaca

SEQ ID NO: 1051176 - RNA, 12 nt, Homo sapiens
ucuucaugcaau

SEQ ID NO: 1051177 - RNA, 12 nt, Homo sapiens
ucuucauuaccu

SEQ ID NO: 1051178 - RNA, 16 nt, Homo sapiens
ucuuccagaaguguga

SEQ ID NO: 1051179 - RNA, 18 nt, Homo sapiens
ucuuccagaagugugauu

SEQ ID NO: 1051180 - RNA, 17 nt, Homo sapiens
ucuuccauuugcaaggg

SEQ ID NO: 1051181 - RNA, 18 nt, Homo sapiens
ucuucccuaccucaggca

SEQ ID NO: 1051182 - RNA, 20 nt, Homo sapiens
ucuucccuaucuuugccacc

SEQ ID NO: 1051183 - RNA, 19 nt, Homo sapiens
ucuucccuuuuacauacug

SEQ ID NO: 1051184 - RNA, 14 nt, Homo sapiens
ucuuccucccugga

SEQ ID NO: 1051185 - RNA, 16 nt, Homo sapiens
ucuuccucccuggaau

SEQ ID NO: 1051186 - RNA, 21 nt, Homo sapiens
ucuuccuuggaggggggagcc

SEQ ID NO: 1051187 - RNA, 20 nt, Homo sapiens
ucuucgagccggcaacggca

SEQ ID NO: 1051188 - RNA, 23 nt, Homo sapiens
ucuucugcuggcagaaagcaaau

SEQ ID NO: 1051189 - RNA, 16 nt, Homo sapiens
ucuucugggaacuucc

SEQ ID NO: 1051190 - RNA, 14 nt, Homo sapiens
ucuucuucauugca

SEQ ID NO: 1051191 - RNA, 13 nt, Homo sapiens
ucuucuuccugaa

SEQ ID NO: 1051192 - RNA, 19 nt, Homo sapiens
ucuucuuucuacaguauua

SEQ ID NO: 1051193 - RNA, 24 nt, Homo sapiens
ucuucuuugcccacaaugcuuugc

SEQ ID NO: 1051194 - RNA, 19 nt, Homo sapiens
ucuucuuuuuuugugaugu

SEQ ID NO: 1051195 - RNA, 22 nt, Homo sapiens
ucuugaauaaauuugcccaaaa

SEQ ID NO: 1051196 - RNA, 20 nt, Homo sapiens
ucuugaaucucugaauuuga

SEQ ID NO: 1051197 - RNA, 12 nt, Homo sapiens
ucuugacauuca

SEQ ID NO: 1051198 - RNA, 22 nt, Homo sapiens
ucuugaccucaggugauccacc

SEQ ID NO: 1051199 - RNA, 19 nt, Homo sapiens
ucuugacuacagucaggaa

SEQ ID NO: 1051200 - RNA, 15 nt, Homo sapiens
ucuugaggccaggag

SEQ ID NO: 1051201 - RNA, 22 nt, Homo sapiens
ucuugaguucuggaagggacuu

SEQ ID NO: 1051202 - RNA, 13 nt, Homo sapiens
ucuugcagaucaa

SEQ ID NO: 1051203 - RNA, 16 nt, Homo sapiens
ucuugcuaauucucag

SEQ ID NO: 1051204 - RNA, 21 nt, Homo sapiens
ucuugcuauggggagaaaaga

SEQ ID NO: 1051205 - RNA, 13 nt, Homo sapiens
ucuugcucaaaaa

SEQ ID NO: 1051206 - RNA, 15 nt, Homo sapiens
ucuuggaucugccau

SEQ ID NO: 1051207 - RNA, 15 nt, Homo sapiens
ucuuggcuuugccac

SEQ ID NO: 1051208 - RNA, 20 nt, Homo sapiens
ucuugggaauuuucuuccaa

SEQ ID NO: 1051209 - RNA, 19 nt, Homo sapiens
ucuugggucccccacguga

SEQ ID NO: 1051210 - RNA, 18 nt, Homo sapiens
ucuuggguucaagugauu

SEQ ID NO: 1051211 - RNA, 17 nt, Homo sapiens
ucuuggucucaguguca

SEQ ID NO: 1051212 - RNA, 22 nt, Homo sapiens
ucuuguuucaauuccaccugca

SEQ ID NO: 1051213 - RNA, 18 nt, Homo sapiens
ucuuuaaauuucaucuca

SEQ ID NO: 1051214 - RNA, 19 nt, Homo sapiens
ucuuuaacuuaauugcuau

SEQ ID NO: 1051215 - RNA, 17 nt, Homo sapiens
ucuuuaaugucacaggc

SEQ ID NO: 1051216 - RNA, 12 nt, Homo sapiens
ucuuuaccuccu

SEQ ID NO: 1051217 - RNA, 17 nt, Homo sapiens
ucuuuccauuaugauuc

SEQ ID NO: 1051218 - RNA, 17 nt, Homo sapiens
ucuuucccaauucacau

SEQ ID NO: 1051219 - RNA, 23 nt, Homo sapiens
ucuuucguuuguuuguuucaaua

SEQ ID NO: 1051220 - RNA, 13 nt, Homo sapiens
ucuuucuuucugc

SEQ ID NO: 1051221 - RNA, 20 nt, Homo sapiens
ucuuugccuguucaguuaca

SEQ ID NO: 1051222 - RNA, 16 nt, Homo sapiens
ucuuuggacaaccaug

SEQ ID NO: 1051223 - RNA, 21 nt, Homo sapiens
ucuuuggggguuagaccacuu

SEQ ID NO: 1051224 - RNA, 17 nt, Homo sapiens
ucuuuuaagcccaucaa

SEQ ID NO: 1051225 - RNA, 21 nt, Homo sapiens
ucuuuucuggaauguaaucaa

SEQ ID NO: 1051226 - RNA, 19 nt, Homo sapiens
ucuuuucuugcaugaggcu

SEQ ID NO: 1051227 - RNA, 20 nt, Homo sapiens
ucuuuuucagaaacagugag

SEQ ID NO: 1051228 - RNA, 18 nt, Homo sapiens
ucuuuuuucccaagagca

SEQ ID NO: 1051229 - RNA, 17 nt, Homo sapiens
ucuuuuuugugugauuu

SEQ ID NO: 1051230 - RNA, 19 nt, Homo sapiens
ugaaaaaaaguacauguau

SEQ ID NO: 1051231 - RNA, 18 nt, Homo sapiens
ugaaaaaacaccuagcuu

SEQ ID NO: 1051232 - RNA, 23 nt, Homo sapiens
ugaaaaaguauaaauaaaaugag

SEQ ID NO: 1051233 - RNA, 18 nt, Homo sapiens
ugaaaaaucggcuuacca

SEQ ID NO: 1051234 - RNA, 21 nt, Homo sapiens
ugaaaaaugguaauuguugcu

SEQ ID NO: 1051235 - RNA, 22 nt, Homo sapiens
ugaaaaaugguaauuguugcua

SEQ ID NO: 1051236 - RNA, 20 nt, Homo sapiens
uggaaaccugcccugccuga

SEQ ID NO: 1051237 - RNA, 17 nt, Homo sapiens
uggaaagaaucuaauag

SEQ ID NO: 1051238 - RNA, 18 nt, Homo sapiens
uggaaagaguaggaagac

SEQ ID NO: 1051239 - RNA, 14 nt, Homo sapiens
uggaaaguguaaag

SEQ ID NO: 1051240 - RNA, 21 nt, Homo sapiens
uggaaaugaaacugcugugaa

SEQ ID NO: 1051241 - RNA, 23 nt, Homo sapiens
uggaaaugaaacugcugugaaug

SEQ ID NO: 1051242 - RNA, 23 nt, Homo sapiens
uggaacacaaugacuaaagacau

SEQ ID NO: 1051243 - RNA, 16 nt, Homo sapiens
uggaacaggcucagau

SEQ ID NO: 1051244 - RNA, 22 nt, Homo sapiens
uggaacaucaucaaggcacugc

SEQ ID NO: 1051245 - RNA, 18 nt, Homo sapiens
uggaagacacauugaaag

SEQ ID NO: 1051246 - RNA, 14 nt, Homo sapiens
uggaagcacauguu

SEQ ID NO: 1051247 - RNA, 17 nt, Homo sapiens
uggaagcauauuguuau

SEQ ID NO: 1051248 - RNA, 19 nt, Homo sapiens
uggaagguggggacaggga

SEQ ID NO: 1051249 - RNA, 20 nt, Homo sapiens
uggaagguggggacagggau

SEQ ID NO: 1051250 - RNA, 14 nt, Homo sapiens
uggaauaaagcccu

SEQ ID NO: 1051251 - RNA, 14 nt, Homo sapiens
uggaauaacaugua

SEQ ID NO: 1051252 - RNA, 15 nt, Homo sapiens
uggaauaacucugug

SEQ ID NO: 1051253 - RNA, 14 nt, Homo sapiens
uggaauaguauccu

SEQ ID NO: 1051254 - RNA, 22 nt, Homo sapiens
uggaauauaaggaaagcaauaa

SEQ ID NO: 1051255 - RNA, 20 nt, Homo sapiens
uggaaucauauaguauguaa

SEQ ID NO: 1051256 - RNA, 17 nt, Homo sapiens
uggaaugcuucuucuca

SEQ ID NO: 1051257 - RNA, 14 nt, Homo sapiens
uggaauucucucac

SEQ ID NO: 1051258 - RNA, 15 nt, Homo sapiens
uggacaauaaucuca

SEQ ID NO: 1051259 - RNA, 24 nt, Homo sapiens
uggacaauaaucucacuaccuuau

SEQ ID NO: 1051260 - RNA, 22 nt, Homo sapiens
uggacaauaugaaucuuuucca

SEQ ID NO: 1051261 - RNA, 19 nt, Homo sapiens
uggacaccccugcuauaua

SEQ ID NO: 1051262 - RNA, 17 nt, Homo sapiens
uggacacguggugcauu

SEQ ID NO: 1051263 - RNA, 20 nt, Homo sapiens
uggacacguggugcauuuug

SEQ ID NO: 1051264 - RNA, 18 nt, Homo sapiens
uggacagucucaccuccu

SEQ ID NO: 1051265 - RNA, 21 nt, Homo sapiens
uggacaguuuucugcuuuaau

SEQ ID NO: 1051266 - RNA, 17 nt, Homo sapiens
uggacauaagacagaca

SEQ ID NO: 1051267 - RNA, 14 nt, Homo sapiens
uggacauggcucac

SEQ ID NO: 1051268 - RNA, 18 nt, Homo sapiens
uggacauuuuuucaguca

SEQ ID NO: 1051269 - RNA, 13 nt, Homo sapiens
uggaccagccugu

SEQ ID NO: 1051270 - RNA, 23 nt, Homo sapiens
uggaccauaaccccggaagccaa

SEQ ID NO: 1051271 - RNA, 15 nt, Homo sapiens
uggaccugccuccug

SEQ ID NO: 1051272 - RNA, 20 nt, Homo sapiens
uggacucgccuguaaucuca

SEQ ID NO: 1051273 - RNA, 14 nt, Homo sapiens
uggacucuugcucu

SEQ ID NO: 1051274 - RNA, 20 nt, Homo sapiens
uggacugaguuuauacucac

SEQ ID NO: 1051275 - RNA, 15 nt, Homo sapiens
uggacuggaugcaug

SEQ ID NO: 1051276 - RNA, 17 nt, Homo sapiens
uggacuuggucaccagc

SEQ ID NO: 1051277 - RNA, 20 nt, Homo sapiens
uggacuuggucaccagcucc

SEQ ID NO: 1051278 - RNA, 22 nt, Homo sapiens
uggacuuguauauuuguacaaa

SEQ ID NO: 1051279 - RNA, 18 nt, Homo sapiens
uggacuuuccacccccuc

SEQ ID NO: 1051280 - RNA, 16 nt, Homo sapiens
uggagacagggcauuu

SEQ ID NO: 1051281 - RNA, 12 nt, Homo sapiens
uggagaccauua

SEQ ID NO: 1051282 - RNA, 15 nt, Homo sapiens
uggagagcacaccua

SEQ ID NO: 1051283 - RNA, 19 nt, Homo sapiens
uggagagcuagaaccugga

SEQ ID NO: 1051284 - RNA, 21 nt, Homo sapiens
uggagaugucuucguacaguu

SEQ ID NO: 1051285 - RNA, 17 nt, Homo sapiens
uggagcaucugacucac

SEQ ID NO: 1051286 - RNA, 15 nt, Homo sapiens
uggagccaacagaug

SEQ ID NO: 1051287 - RNA, 17 nt, Homo sapiens
uggagccccagugccaa

SEQ ID NO: 1051288 - RNA, 22 nt, Homo sapiens
uggagccccagugccaagcaca

SEQ ID NO: 1051289 - RNA, 20 nt, Homo sapiens
uggagccugggcauccucag

SEQ ID NO: 1051290 - RNA, 12 nt, Homo sapiens
uggagccuuuga

SEQ ID NO: 1051291 - RNA, 18 nt, Homo sapiens
uggaggagagaagaauga

SEQ ID NO: 1051292 - RNA, 21 nt, Homo sapiens
uggaggcacugaagugcuuag

SEQ ID NO: 1051293 - RNA, 23 nt, Homo sapiens
uggaggccuguccugaccugucu

SEQ ID NO: 1051294 - RNA, 20 nt, Homo sapiens
uggagggcuagaaccuggca

SEQ ID NO: 1051295 - RNA, 19 nt, Homo sapiens
uggagggcuggaaucugga

SEQ ID NO: 1051296 - RNA, 13 nt, Homo sapiens
uggaggggggagc

SEQ ID NO: 1051297 - RNA, 17 nt, Homo sapiens
uggaggguaaaugaugu

SEQ ID NO: 1051298 - RNA, 12 nt, Homo sapiens
uggaggguccca

SEQ ID NO: 1051299 - RNA, 16 nt, Homo sapiens
uggaguauaauauuca

SEQ ID NO: 1051300 - RNA, 19 nt, Homo sapiens
uggagugaccauagcuccu

SEQ ID NO: 1051301 - RNA, 23 nt, Homo sapiens
uggagugagggguaaaagcugau

SEQ ID NO: 1051302 - RNA, 15 nt, Homo sapiens
uggaguggagcauug

SEQ ID NO: 1051303 - RNA, 18 nt, Homo sapiens
uggaguggagcauuggcu

SEQ ID NO: 1051304 - RNA, 13 nt, Homo sapiens
uggaguuaucuaa

SEQ ID NO: 1051305 - RNA, 17 nt, Homo sapiens
uggauaaagccacugaa

SEQ ID NO: 1051306 - RNA, 14 nt, Homo sapiens
uggauagucugucc

SEQ ID NO: 1051307 - RNA, 15 nt, Homo sapiens
uggauccuagccuua

SEQ ID NO: 1051308 - RNA, 19 nt, Homo sapiens
uggaucuccauucucucag

SEQ ID NO: 1051309 - RNA, 11 nt, Homo sapiens
uggaucugcca

SEQ ID NO: 1051310 - RNA, 20 nt, Homo sapiens
uggaugauucagaaauugga

SEQ ID NO: 1051311 - RNA, 19 nt, Homo sapiens
uggaugcagaaacaguuca

SEQ ID NO: 1051312 - RNA, 14 nt, Homo sapiens
uggaugcaggguuu

SEQ ID NO: 1051313 - RNA, 17 nt, Homo sapiens
uggaugccaaccgguca

SEQ ID NO: 1051314 - RNA, 21 nt, Homo sapiens
uggauuacaggcaugugccac

SEQ ID NO: 1051315 - RNA, 21 nt, Homo sapiens
uggauuccaaccccaacucca

SEQ ID NO: 1051316 - RNA, 15 nt, Homo sapiens
uggauugacucugca

SEQ ID NO: 1051317 - RNA, 18 nt, Homo sapiens
uggauuuauaaaugcuau

SEQ ID NO: 1051318 - RNA, 17 nt, Homo sapiens
uggauuuauucugccaa

SEQ ID NO: 1051319 - RNA, 22 nt, Homo sapiens
uggauuuuacauguggcccaac

SEQ ID NO: 1051320 - RNA, 18 nt, Homo sapiens
uggauuuucaucaggggc

SEQ ID NO: 1051321 - RNA, 15 nt, Homo sapiens
uggcaaaaacggcca

SEQ ID NO: 1051322 - RNA, 11 nt, Homo sapiens
uggcaaagaca

SEQ ID NO: 1051323 - RNA, 14 nt, Homo sapiens
uggcaaagccuuca

SEQ ID NO: 1051324 - RNA, 22 nt, Homo sapiens
uggcaaaucucuauuaggaaau

SEQ ID NO: 1051325 - RNA, 19 nt, Homo sapiens
uggcacaguuuucugagaa

SEQ ID NO: 1051326 - RNA, 15 nt, Homo sapiens
uggcacccaugcacc

SEQ ID NO: 1051327 - RNA, 13 nt, Homo sapiens
uggcaccucucaa

SEQ ID NO: 1051328 - RNA, 11 nt, Homo sapiens
uggcacuauuu

SEQ ID NO: 1051329 - RNA, 16 nt, Homo sapiens
uggcacuggaugcaga

SEQ ID NO: 1051330 - RNA, 17 nt, Homo sapiens
uggcacuggaugcagaa

SEQ ID NO: 1051331 - RNA, 17 nt, Homo sapiens
uggcagcauacacagau

SEQ ID NO: 1051332 - RNA, 20 nt, Homo sapiens
uggcagcgccucaucuucaa

SEQ ID NO: 1051333 - RNA, 19 nt, Homo sapiens
uggcagucugaauuuuuaa

SEQ ID NO: 1051334 - RNA, 15 nt, Homo sapiens
uggcaucacagggca

SEQ ID NO: 1051335 - RNA, 18 nt, Homo sapiens
uggcaucucuuucugcaa

SEQ ID NO: 1051336 - RNA, 12 nt, Homo sapiens
uggcaugccuuc

SEQ ID NO: 1051337 - RNA, 16 nt, Homo sapiens
uggccaacaugaugaa

SEQ ID NO: 1051338 - RNA, 23 nt, Homo sapiens
uggccacucagcuuccuacccac

SEQ ID NO: 1051339 - RNA, 21 nt, Homo sapiens
uggccaggccucuuggcaguc

SEQ ID NO: 1051340 - RNA, 13 nt, Homo sapiens
uggccaucuccac

SEQ ID NO: 1051341 - RNA, 19 nt, Homo sapiens
uggcccagggaagccaaaa

SEQ ID NO: 1051342 - RNA, 17 nt, Homo sapiens
uggcccccacagaaaga

SEQ ID NO: 1051343 - RNA, 17 nt, Homo sapiens
uggccccugcccggcug

SEQ ID NO: 1051344 - RNA, 24 nt, Homo sapiens
uggccccuucacuucugaccacac

SEQ ID NO: 1051345 - RNA, 14 nt, Homo sapiens
uggcccuaugcuuc

SEQ ID NO: 1051346 - RNA, 13 nt, Homo sapiens
uggccgggacccc

SEQ ID NO: 1051347 - RNA, 17 nt, Homo sapiens
uggccuccccugcugaa

SEQ ID NO: 1051348 - RNA, 23 nt, Homo sapiens
uggccucugcaaaggaaauacca

SEQ ID NO: 1051349 - RNA, 14 nt, Homo sapiens
uggccugcacuggu

SEQ ID NO: 1051350 - RNA, 22 nt, Homo sapiens
uggccuguucuucuauggguug

SEQ ID NO: 1051351 - RNA, 23 nt, Homo sapiens
uggcgacagagggagacuccauc

SEQ ID NO: 1051352 - RNA, 22 nt, Homo sapiens
uggcgagucugcuuucuucuac

SEQ ID NO: 1051353 - RNA, 14 nt, Homo sapiens
uggcgccucugcaa

SEQ ID NO: 1051354 - RNA, 16 nt, Homo sapiens
uggcgucugucuucaa

SEQ ID NO: 1051355 - RNA, 15 nt, Homo sapiens
uggcgugagccuguc

SEQ ID NO: 1051356 - RNA, 22 nt, Homo sapiens
uggcuaauucccagagugugaa

SEQ ID NO: 1051357 - RNA, 15 nt, Homo sapiens
uggcuauaaauauau

SEQ ID NO: 1051358 - RNA, 16 nt, Homo sapiens
uggcucaacauugugu

SEQ ID NO: 1051359 - RNA, 16 nt, Homo sapiens
uggcucacgccuguaa

SEQ ID NO: 1051360 - RNA, 17 nt, Homo sapiens
uggcucacuauggugcc

SEQ ID NO: 1051361 - RNA, 12 nt, Homo sapiens
uggcucagggag

SEQ ID NO: 1051362 - RNA, 14 nt, Homo sapiens
uggcuccacuggga

SEQ ID NO: 1051363 - RNA, 23 nt, Homo sapiens
uggcucccucuuggucuucccag

SEQ ID NO: 1051364 - RNA, 13 nt, Homo sapiens
uggcuccuaucug

SEQ ID NO: 1051365 - RNA, 15 nt, Homo sapiens
uggcucuacuuucag

SEQ ID NO: 1051366 - RNA, 14 nt, Homo sapiens
uggcucuucugccc

SEQ ID NO: 1051367 - RNA, 14 nt, Homo sapiens
uggcugauggagua

SEQ ID NO: 1051368 - RNA, 14 nt, Homo sapiens
uggcugcaaggugg

SEQ ID NO: 1051369 - RNA, 12 nt, Homo sapiens
uggcugccuuug

SEQ ID NO: 1051370 - RNA, 15 nt, Homo sapiens
uggcugcuagcacuu

SEQ ID NO: 1051371 - RNA, 21 nt, Homo sapiens
uggcugggaauaagugccagg

SEQ ID NO: 1051372 - RNA, 21 nt, Homo sapiens
uggcuuaauguuuauuccuga

SEQ ID NO: 1051373 - RNA, 18 nt, Homo sapiens
uggcuuagaaaguccaau

SEQ ID NO: 1051374 - RNA, 21 nt, Homo sapiens
uggcuucacagaugugugauu

SEQ ID NO: 1051375 - RNA, 22 nt, Homo sapiens
uggcuuccagguaucuccagga

SEQ ID NO: 1051376 - RNA, 11 nt, Homo sapiens
uggcuucuuac

SEQ ID NO: 1051377 - RNA, 15 nt, Homo sapiens
uggcuucuuacugaa

SEQ ID NO: 1051378 - RNA, 16 nt, Homo sapiens
uggcuuucuggcugcu

SEQ ID NO: 1051379 - RNA, 21 nt, Homo sapiens
uggcuuugaaugcggcccaac

SEQ ID NO: 1051380 - RNA, 15 nt, Homo sapiens
uggcuuuugugcauu

SEQ ID NO: 1051381 - RNA, 22 nt, Homo sapiens
uuacauuauuaaauguuucuca

SEQ ID NO: 1051382 - RNA, 19 nt, Homo sapiens
uuaccaacuuucuguaaac

SEQ ID NO: 1051383 - RNA, 19 nt, Homo sapiens
uuacccacacacagauaaa

SEQ ID NO: 1051384 - RNA, 20 nt, Homo sapiens
uuacccccugggagccccaa

SEQ ID NO: 1051385 - RNA, 14 nt, Homo sapiens
uuaccuaguacaag

SEQ ID NO: 1051386 - RNA, 16 nt, Homo sapiens
uuaccuuuguucccaa

SEQ ID NO: 1051387 - RNA, 22 nt, Homo sapiens
uuaccuuuuauuuuaauguuuc

SEQ ID NO: 1051388 - RNA, 20 nt, Homo sapiens
uuacgauggcacccagugag

SEQ ID NO: 1051389 - RNA, 18 nt, Homo sapiens
uuacuaaaguacagacau

SEQ ID NO: 1051390 - RNA, 13 nt, Homo sapiens
uuacuaaucuuuc

SEQ ID NO: 1051391 - RNA, 22 nt, Homo sapiens
uuacuauuuauugcugaaugac

SEQ ID NO: 1051392 - RNA, 20 nt, Homo sapiens
uuacugcccaauaugcaguu

SEQ ID NO: 1051393 - RNA, 17 nt, Homo sapiens
uuacugugaaacuggca

SEQ ID NO: 1051394 - RNA, 14 nt, Homo sapiens
uuacuguggauaaa

SEQ ID NO: 1051395 - RNA, 21 nt, Homo sapiens
uuacuguuugucuucucccca

SEQ ID NO: 1051396 - RNA, 17 nt, Homo sapiens
uuacuuaccuaaacaga

SEQ ID NO: 1051397 - RNA, 14 nt, Homo sapiens
uuacuuuuucauuc

SEQ ID NO: 1051398 - RNA, 23 nt, Homo sapiens
uuagaaaauaaaauuuaacucac

SEQ ID NO: 1051399 - RNA, 12 nt, Homo sapiens
uuagaacuugca

SEQ ID NO: 1051400 - RNA, 18 nt, Homo sapiens
uuagaaucugaguauaaa

SEQ ID NO: 1051401 - RNA, 17 nt, Homo sapiens
uuagaauuccuucaggg

SEQ ID NO: 1051402 - RNA, 18 nt, Homo sapiens
uuagaauuccuucagggu

SEQ ID NO: 1051403 - RNA, 15 nt, Homo sapiens
uuagacagucccugc

SEQ ID NO: 1051404 - RNA, 18 nt, Homo sapiens
uuagacauaacaaaacac

SEQ ID NO: 1051405 - RNA, 20 nt, Homo sapiens
uuagaccaagcuuguccaac

SEQ ID NO: 1051406 - RNA, 13 nt, Homo sapiens
uuagacuugaaau

SEQ ID NO: 1051407 - RNA, 13 nt, Homo sapiens
uuagagaauguuc

SEQ ID NO: 1051408 - RNA, 22 nt, Homo sapiens
uuagauacagagacuuggggaa

SEQ ID NO: 1051409 - RNA, 13 nt, Homo sapiens
uuagaucagggga

SEQ ID NO: 1051410 - RNA, 22 nt, Homo sapiens
uuagcaaacuuuguaugucauu

SEQ ID NO: 1051411 - RNA, 17 nt, Homo sapiens
uuagcaauugacuguca

SEQ ID NO: 1051412 - RNA, 18 nt, Homo sapiens
uuagcacuauuuacauac

SEQ ID NO: 1051413 - RNA, 23 nt, Homo sapiens
uuagcauuccuauugacaacucu

SEQ ID NO: 1051414 - RNA, 15 nt, Homo sapiens
uuagccagugaugcu

SEQ ID NO: 1051415 - RNA, 17 nt, Homo sapiens
uuagccauuugacuaau

SEQ ID NO: 1051416 - RNA, 15 nt, Homo sapiens
uuagcccaaaaccaa

SEQ ID NO: 1051417 - RNA, 13 nt, Homo sapiens
uuagcuaccucac

SEQ ID NO: 1051418 - RNA, 15 nt, Homo sapiens
uuagcuguccccuga

SEQ ID NO: 1051419 - RNA, 15 nt, Homo sapiens
uuagcugucugcuca

SEQ ID NO: 1051420 - RNA, 14 nt, Homo sapiens
uuagcuuuacaaau

SEQ ID NO: 1051421 - RNA, 18 nt, Homo sapiens
uuagggaaaacauuccau

SEQ ID NO: 1051422 - RNA, 21 nt, Homo sapiens
uuaggugcuucuucacuucag

SEQ ID NO: 1051423 - RNA, 14 nt, Homo sapiens
uuagguuuuguaca

SEQ ID NO: 1051424 - RNA, 16 nt, Homo sapiens
uuagguuuuguacaau

SEQ ID NO: 1051425 - RNA, 12 nt, Homo sapiens
uuaguaauuucu

SEQ ID NO: 1051426 - RNA, 16 nt, Homo sapiens
uuaguaauuucuugcu

SEQ ID NO: 1051427 - RNA, 11 nt, Homo sapiens
uuaguauuuau

SEQ ID NO: 1051428 - RNA, 20 nt, Homo sapiens
uuaguggcucaacauugugu

SEQ ID NO: 1051429 - RNA, 13 nt, Homo sapiens
uuaguuguuauua

SEQ ID NO: 1051430 - RNA, 22 nt, Homo sapiens
uuaguuuuuguucuuaauugca

SEQ ID NO: 1051431 - RNA, 16 nt, Homo sapiens
uuauaaaauuaagcaa

SEQ ID NO: 1051432 - RNA, 14 nt, Homo sapiens
uuauaaauaugaag

SEQ ID NO: 1051433 - RNA, 15 nt, Homo sapiens
uuauaaaucgcuuuu

SEQ ID NO: 1051434 - RNA, 14 nt, Homo sapiens
uuauaacagaauua

SEQ ID NO: 1051435 - RNA, 12 nt, Homo sapiens
uuauaagcuaca

SEQ ID NO: 1051436 - RNA, 11 nt, Homo sapiens
uuauacuguau

SEQ ID NO: 1051437 - RNA, 12 nt, Homo sapiens
uuauacuguaua

SEQ ID NO: 1051438 - RNA, 21 nt, Homo sapiens
uuauacuucucuauuaucuca

SEQ ID NO: 1051439 - RNA, 12 nt, Homo sapiens
uuauacuuucag

SEQ ID NO: 1051440 - RNA, 20 nt, Homo sapiens
uuauagaccagaaccagagc

SEQ ID NO: 1051441 - RNA, 18 nt, Homo sapiens
uuauaggacgaaugccaa

SEQ ID NO: 1051442 - RNA, 16 nt, Homo sapiens
uuauaguuugcuguug

SEQ ID NO: 1051443 - RNA, 16 nt, Homo sapiens
uuauauaauuacauau

SEQ ID NO: 1051444 - RNA, 14 nt, Homo sapiens
uuauaucagccuga

SEQ ID NO: 1051445 - RNA, 16 nt, Homo sapiens
uuauauggaugauuca

SEQ ID NO: 1051446 - RNA, 13 nt, Homo sapiens
uuauauucaucca

SEQ ID NO: 1051447 - RNA, 19 nt, Homo sapiens
uuauauuguuucaucccau

SEQ ID NO: 1051448 - RNA, 17 nt, Homo sapiens
uuaucaagugucuucca

SEQ ID NO: 1051449 - RNA, 14 nt, Homo sapiens
uuaucaccagagag

SEQ ID NO: 1051450 - RNA, 14 nt, Homo sapiens
uuaucagccugugc

SEQ ID NO: 1051451 - RNA, 14 nt, Homo sapiens
uuaucaguaagaaa

SEQ ID NO: 1051452 - RNA, 12 nt, Homo sapiens
uuaucaguccaa

SEQ ID NO: 1051453 - RNA, 12 nt, Homo sapiens
uuaucaucugaa

SEQ ID NO: 1051454 - RNA, 16 nt, Homo sapiens
uuaucaugcauguccu

SEQ ID NO: 1051455 - RNA, 16 nt, Homo sapiens
uuaucuaucaacuaua

SEQ ID NO: 1051456 - RNA, 13 nt, Homo sapiens
uuaucucaggggu

SEQ ID NO: 1051457 - RNA, 16 nt, Homo sapiens
uuaugaaacauuacag

SEQ ID NO: 1051458 - RNA, 23 nt, Homo sapiens
uuaugaaauaaagaaauugcaau

SEQ ID NO: 1051459 - RNA, 16 nt, Homo sapiens
uuaugaaccuuuacau

SEQ ID NO: 1051460 - RNA, 16 nt, Homo sapiens
uuaugacuucauuaau

SEQ ID NO: 1051461 - RNA, 18 nt, Homo sapiens
uuaugagaaaguucucau

SEQ ID NO: 1051462 - RNA, 23 nt, Homo sapiens
uuaugccauagcaagauugcuua

SEQ ID NO: 1051463 - RNA, 17 nt, Homo sapiens
uuaugccuucacuuuac

SEQ ID NO: 1051464 - RNA, 17 nt, Homo sapiens
uuaugcuaccuacugau

SEQ ID NO: 1051465 - RNA, 18 nt, Homo sapiens
uuauggcuuuugugcauu

SEQ ID NO: 1051466 - RNA, 17 nt, Homo sapiens
uuauguauuuaugaccu

SEQ ID NO: 1051467 - RNA, 23 nt, Homo sapiens
uuauguauuugaaaacucacaga

SEQ ID NO: 1051468 - RNA, 19 nt, Homo sapiens
uuaugucaucauacaugac

SEQ ID NO: 1051469 - RNA, 20 nt, Homo sapiens
uuaugugagagaaaguguga

SEQ ID NO: 1051470 - RNA, 12 nt, Homo sapiens
uuaugugcaaua

SEQ ID NO: 1051471 - RNA, 23 nt, Homo sapiens
uuauguggaaaacagaacaucau

SEQ ID NO: 1051472 - RNA, 10 nt, Homo sapiens
uuauguuugc

SEQ ID NO: 1051473 - RNA, 13 nt, Homo sapiens
uuauguuugccac

SEQ ID NO: 1051474 - RNA, 19 nt, Homo sapiens
uuauuaauaaacauucuau

SEQ ID NO: 1051475 - RNA, 14 nt, Homo sapiens
uuauuaaugccauu

SEQ ID NO: 1051476 - RNA, 19 nt, Homo sapiens
uuauuacauggggucuaga

SEQ ID NO: 1051477 - RNA, 15 nt, Homo sapiens
uuauuaccucugaua

SEQ ID NO: 1051478 - RNA, 13 nt, Homo sapiens
uuauuauaacauc

SEQ ID NO: 1051479 - RNA, 15 nt, Homo sapiens
uuauuauaugacuag

SEQ ID NO: 1051480 - RNA, 18 nt, Homo sapiens
uuauuauuguucuuuaag

SEQ ID NO: 1051481 - RNA, 18 nt, Homo sapiens
uuauucaagaaaaguaag

SEQ ID NO: 1051482 - RNA, 15 nt, Homo sapiens
uuauuccuuugcaua

SEQ ID NO: 1051483 - RNA, 22 nt, Homo sapiens
uuauugacaucucuuuugagcu

SEQ ID NO: 1051484 - RNA, 16 nt, Homo sapiens
uuauugacucauacac

SEQ ID NO: 1051485 - RNA, 13 nt, Homo sapiens
uuauugcaguuua

SEQ ID NO: 1051486 - RNA, 15 nt, Homo sapiens
uuauuggcugagaua

SEQ ID NO: 1051487 - RNA, 18 nt, Homo sapiens
uuauugguguuuacccag

SEQ ID NO: 1051488 - RNA, 12 nt, Homo sapiens
uuauugugaauu

SEQ ID NO: 1051489 - RNA, 23 nt, Homo sapiens
uuauuguuuauuuaucagugaca

SEQ ID NO: 1051490 - RNA, 14 nt, Homo sapiens
uuauuuaaagaaga

SEQ ID NO: 1051491 - RNA, 15 nt, Homo sapiens
uuauuuaauaacauu

SEQ ID NO: 1051492 - RNA, 17 nt, Homo sapiens
uuauuugaaaacauaua

SEQ ID NO: 1051493 - RNA, 17 nt, Homo sapiens
uuauuuuccccaaccuc

SEQ ID NO: 1051494 - RNA, 20 nt, Homo sapiens
uuauuuuugcuuguuucuga

SEQ ID NO: 1051495 - RNA, 21 nt, Homo sapiens
uucaaaaauacucacauggcu

SEQ ID NO: 1051496 - RNA, 18 nt, Homo sapiens
uucaaaagguuauauacc

SEQ ID NO: 1051497 - RNA, 18 nt, Homo sapiens
uucaaaauauacauucaa

SEQ ID NO: 1051498 - RNA, 12 nt, Homo sapiens
uucaaacagaac

SEQ ID NO: 1051499 - RNA, 24 nt, Homo sapiens
uucaaacagaacugcagucagcau

SEQ ID NO: 1051500 - RNA, 19 nt, Homo sapiens
uucaaacagucucaggaaa

SEQ ID NO: 1051501 - RNA, 20 nt, Homo sapiens
uucaaaccuacuaauccagc

SEQ ID NO: 1051502 - RNA, 22 nt, Homo sapiens
uucaaagagucauauugcccag

SEQ ID NO: 1051503 - RNA, 13 nt, Homo sapiens
uucaaaguuaaaa

SEQ ID NO: 1051504 - RNA, 22 nt, Homo sapiens
uucaacaaugucuuuuuuccca

SEQ ID NO: 1051505 - RNA, 20 nt, Homo sapiens
uucaacaggagaauuuuacu

SEQ ID NO: 1051506 - RNA, 19 nt, Homo sapiens
uucaacauuuacauguauu

SEQ ID NO: 1051507 - RNA, 11 nt, Homo sapiens
uucaaccacug

SEQ ID NO: 1051508 - RNA, 21 nt, Homo sapiens
uucaacccuggagaguucaau

SEQ ID NO: 1051509 - RNA, 13 nt, Homo sapiens
uucaagcaauucu

SEQ ID NO: 1051510 - RNA, 21 nt, Homo sapiens
uucaaggcauuucuaucacau

SEQ ID NO: 1051511 - RNA, 22 nt, Homo sapiens
uucaaguaaaaaucaauacccu

SEQ ID NO: 1051512 - RNA, 14 nt, Homo sapiens
uucaaguacuguaa

SEQ ID NO: 1051513 - RNA, 13 nt, Homo sapiens
uucaaguguacag

SEQ ID NO: 1051514 - RNA, 16 nt, Homo sapiens
uucaaguuaaagugaa

SEQ ID NO: 1051515 - RNA, 14 nt, Homo sapiens
uucaaucuguaaac

SEQ ID NO: 1051516 - RNA, 18 nt, Homo sapiens
uucaaucuguaaacugug

SEQ ID NO: 1051517 - RNA, 17 nt, Homo sapiens
uucaauugcaucuccca

SEQ ID NO: 1051518 - RNA, 22 nt, Homo sapiens
uucacaccuagcgucaguauuu

SEQ ID NO: 1051519 - RNA, 19 nt, Homo sapiens
uucacacuuccaccagccu

SEQ ID NO: 1051520 - RNA, 17 nt, Homo sapiens
uucacagaugugugauu

SEQ ID NO: 1051521 - RNA, 16 nt, Homo sapiens
uucacaugagcuauuu

SEQ ID NO: 1051522 - RNA, 16 nt, Homo sapiens
uucaccacauucguca

SEQ ID NO: 1051523 - RNA, 14 nt, Homo sapiens
uucaccagagcauu

SEQ ID NO: 1051524 - RNA, 15 nt, Homo sapiens
uucaccagagcauuu

SEQ ID NO: 1051525 - RNA, 15 nt, Homo sapiens
uucacccuguccaaa

SEQ ID NO: 1051526 - RNA, 20 nt, Homo sapiens
uucaccuuccagugucucgg

SEQ ID NO: 1051527 - RNA, 20 nt, Homo sapiens
gcaaaggcugagaacacugu

SEQ ID NO: 1051528 - RNA, 23 nt, Homo sapiens
gcaaaggcugagaacacugugaa

SEQ ID NO: 1051529 - RNA, 17 nt, Homo sapiens
gcaaagggagcacuggg

SEQ ID NO: 1051530 - RNA, 18 nt, Homo sapiens
gcaaagguggcucuccag

SEQ ID NO: 1051531 - RNA, 16 nt, Homo sapiens
gcaaagucaucaaaga

SEQ ID NO: 1051532 - RNA, 16 nt, Homo sapiens
gcaaauccacuagcac

SEQ ID NO: 1051533 - RNA, 23 nt, Homo sapiens
gcaaaugcuguauucuucuuugg

SEQ ID NO: 1051534 - RNA, 16 nt, Homo sapiens
gcaaauguuaugcaua

SEQ ID NO: 1051535 - RNA, 14 nt, Homo sapiens
gcaaauuugauaca

SEQ ID NO: 1051536 - RNA, 20 nt, Homo sapiens
gcaacaaugagcagaccaac

SEQ ID NO: 1051537 - RNA, 20 nt, Homo sapiens
gcaacagaagugguuuccca

SEQ ID NO: 1051538 - RNA, 22 nt, Homo sapiens
gcaacagcaaaucacgaccacu

SEQ ID NO: 1051539 - RNA, 14 nt, Homo sapiens
gcaacaguagcaua

SEQ ID NO: 1051540 - RNA, 22 nt, Homo sapiens
gcaacaucaguuuaaacaaagg

SEQ ID NO: 1051541 - RNA, 13 nt, Homo sapiens
gcaaccccaguuc

SEQ ID NO: 1051542 - RNA, 17 nt, Homo sapiens
gcaacccuaacaguaag

SEQ ID NO: 1051543 - RNA, 18 nt, Homo sapiens
gcaaccuccacauguuca

SEQ ID NO: 1051544 - RNA, 23 nt, Homo sapiens
gcaaccuuuuugauuucuuccag

SEQ ID NO: 1051545 - RNA, 13 nt, Homo sapiens
gcaacugaauaaa

SEQ ID NO: 1051546 - RNA, 15 nt, Homo sapiens
gcaacugaggcagac

SEQ ID NO: 1051547 - RNA, 22 nt, Homo sapiens
gcaacugaggcagacagcagcu

SEQ ID NO: 1051548 - RNA, 20 nt, Homo sapiens
gcaacuggcucaaagacaau

SEQ ID NO: 1051549 - RNA, 22 nt, Homo sapiens
gcaacuuaagcugggauaauca

SEQ ID NO: 1051550 - RNA, 15 nt, Homo sapiens
gcaacuuucuuacac

SEQ ID NO: 1051551 - RNA, 18 nt, Homo sapiens
gcaagaagucaaaguaaa

SEQ ID NO: 1051552 - RNA, 16 nt, Homo sapiens
gcaagcucccaaggga

SEQ ID NO: 1051553 - RNA, 23 nt, Homo sapiens
gcaaggaaacuauguaacaugua

SEQ ID NO: 1051554 - RNA, 23 nt, Homo sapiens
gcaaggacacagaugaaacacaa

SEQ ID NO: 1051555 - RNA, 14 nt, Homo sapiens
gcaagucacuggcc

SEQ ID NO: 1051556 - RNA, 17 nt, Homo sapiens
gcaagugagacccuguc

SEQ ID NO: 1051557 - RNA, 13 nt, Homo sapiens
gcaagugugugca

SEQ ID NO: 1051558 - RNA, 19 nt, Homo sapiens
gcaaguuucaucagucaau

SEQ ID NO: 1051559 - RNA, 20 nt, Homo sapiens
gcaauaaccucaaagugacu

SEQ ID NO: 1051560 - RNA, 21 nt, Homo sapiens
gcaauauaucugaagagcuau

SEQ ID NO: 1051561 - RNA, 21 nt, Homo sapiens
gcaauccacaaucugacauuc

SEQ ID NO: 1051562 - RNA, 17 nt, Homo sapiens
gcaaucugcccauucau

SEQ ID NO: 1051563 - RNA, 14 nt, Homo sapiens
gcaaugauuacucu

SEQ ID NO: 1051564 - RNA, 16 nt, Homo sapiens
gcaauggcgugaucuc

SEQ ID NO: 1051565 - RNA, 17 nt, Homo sapiens
gcaauuagacaagaacu

SEQ ID NO: 1051566 - RNA, 18 nt, Homo sapiens
gcaauuccucugaacaaa

SEQ ID NO: 1051567 - RNA, 21 nt, Homo sapiens
gcaauugaauuaaauuaggaa

SEQ ID NO: 1051568 - RNA, 13 nt, Homo sapiens
gcacacacugugu

SEQ ID NO: 1051569 - RNA, 19 nt, Homo sapiens
gcacacagcaggcuuucaa

SEQ ID NO: 1051570 - RNA, 19 nt, Homo sapiens
gcacacuccccugcacugg

SEQ ID NO: 1051571 - RNA, 20 nt, Homo sapiens
gcacagcguccuguccacac

SEQ ID NO: 1051572 - RNA, 17 nt, Homo sapiens
gcacagggucucuacca

SEQ ID NO: 1051573 - RNA, 19 nt, Homo sapiens
gcacaguagagcaaaucua

SEQ ID NO: 1051574 - RNA, 14 nt, Homo sapiens
gcacaguuagcaaa

SEQ ID NO: 1051575 - RNA, 17 nt, Homo sapiens
gcacauaccacugcacc

SEQ ID NO: 1051576 - RNA, 18 nt, Homo sapiens
gcacauagcuaucaagug

SEQ ID NO: 1051577 - RNA, 17 nt, Homo sapiens
gcacaucacaacauuua

SEQ ID NO: 1051578 - RNA, 12 nt, Homo sapiens
gcacaugccuuc

SEQ ID NO: 1051579 - RNA, 23 nt, Homo sapiens
gcacauucuuagaguuaccacac

SEQ ID NO: 1051580 - RNA, 19 nt, Homo sapiens
aaaacugaaaaucuaauau

SEQ ID NO: 1051581 - RNA, 17 nt, Homo sapiens
aaaacugauuuuuagcu

SEQ ID NO: 1051582 - RNA, 20 nt, Homo sapiens
aaaacugccuuuuaucugcc

SEQ ID NO: 1051583 - RNA, 22 nt, Homo sapiens
aaaacuguggguagagacuuug

SEQ ID NO: 1051584 - RNA, 14 nt, Homo sapiens
aaaacuucaauauc

SEQ ID NO: 1051585 - RNA, 22 nt, Homo sapiens
aaaacuugauguguuaucucuu

SEQ ID NO: 1051586 - RNA, 17 nt, Homo sapiens
aaaacuugcugccugaa

SEQ ID NO: 1051587 - RNA, 21 nt, Homo sapiens
aaaacuuuggaguccccucac

SEQ ID NO: 1051588 - RNA, 18 nt, Homo sapiens
aaaagaaccgagcaauuu

SEQ ID NO: 1051589 - RNA, 14 nt, Homo sapiens
aaaagauuauagaa

SEQ ID NO: 1051590 - RNA, 22 nt, Homo sapiens
aaaagcaagacuguugcucaaa

SEQ ID NO: 1051591 - RNA, 11 nt, Homo sapiens
aaaagccaaaa

SEQ ID NO: 1051592 - RNA, 12 nt, Homo sapiens
aaaagccaaaaa

SEQ ID NO: 1051593 - RNA, 20 nt, Homo sapiens
aaaagcuuauucaucuguuu

SEQ ID NO: 1051594 - RNA, 20 nt, Homo sapiens
aaaaggacucucaggaccaa

SEQ ID NO: 1051595 - RNA, 23 nt, Homo sapiens
aaaaggauaugcaguaugcuuaa

SEQ ID NO: 1051596 - RNA, 21 nt, Homo sapiens
aaaagggauccguacauucaa

SEQ ID NO: 1051597 - RNA, 22 nt, Homo sapiens
aaaagggucuugggaaauauga

SEQ ID NO: 1051598 - RNA, 17 nt, Homo sapiens
aaaaguaaggugcaguu

SEQ ID NO: 1051599 - RNA, 14 nt, Homo sapiens
aaaaguacauguau

SEQ ID NO: 1051600 - RNA, 14 nt, Homo sapiens
aaaagucuucacuc

SEQ ID NO: 1051601 - RNA, 10 nt, Homo sapiens
aaaagugaug

SEQ ID NO: 1051602 - RNA, 13 nt, Homo sapiens
aaaagugggccag

SEQ ID NO: 1051603 - RNA, 17 nt, Homo sapiens
aaaauaaaaaacauaua

SEQ ID NO: 1051604 - RNA, 14 nt, Homo sapiens
aaaauaauuguucc

SEQ ID NO: 1051605 - RNA, 17 nt, Homo sapiens
aaaauacaugcaucuca

SEQ ID NO: 1051606 - RNA, 16 nt, Homo sapiens
aaaauaccagccagua

SEQ ID NO: 1051607 - RNA, 14 nt, Homo sapiens
aaaauaccaugcca

SEQ ID NO: 1051608 - RNA, 12 nt, Homo sapiens
aaaauaccucuu

SEQ ID NO: 1051609 - RNA, 20 nt, Homo sapiens
aaaauaccuuuguaacggcu

SEQ ID NO: 1051610 - RNA, 15 nt, Homo sapiens
aaaauacugccagau

SEQ ID NO: 1051611 - RNA, 18 nt, Homo sapiens
aaaauacugccagaugcu

SEQ ID NO: 1051612 - RNA, 17 nt, Homo sapiens
aaaauagccacuuaccu

SEQ ID NO: 1051613 - RNA, 14 nt, Homo sapiens
aaaauauauuucag

SEQ ID NO: 1051614 - RNA, 12 nt, Homo sapiens
aaaauaugccuu

SEQ ID NO: 1051615 - RNA, 14 nt, Homo sapiens
aaaauauggcuaua

SEQ ID NO: 1051616 - RNA, 22 nt, Homo sapiens
aaaauauuuguaucacaaaucu

SEQ ID NO: 1051617 - RNA, 16 nt, Homo sapiens
aaaaucaaacagagac

SEQ ID NO: 1051618 - RNA, 16 nt, Homo sapiens
aaaaucauaguacucu

SEQ ID NO: 1051619 - RNA, 13 nt, Homo sapiens
aaaaugaacugaa

SEQ ID NO: 1051620 - RNA, 15 nt, Homo sapiens
aaaaugacacaacuu

SEQ ID NO: 1051621 - RNA, 18 nt, Homo sapiens
aaaaugaugggacaauaa

SEQ ID NO: 1051622 - RNA, 15 nt, Homo sapiens
aaaaugcaacaugug

SEQ ID NO: 1051623 - RNA, 13 nt, Homo sapiens
aaaaugcauuuaa

SEQ ID NO: 1051624 - RNA, 15 nt, Homo sapiens
aaaaugccuuugaga

SEQ ID NO: 1051625 - RNA, 19 nt, Homo sapiens
aaaaugcugaacauugcau

SEQ ID NO: 1051626 - RNA, 19 nt, Homo sapiens
aaaauggaggccauugugu

SEQ ID NO: 1051627 - RNA, 21 nt, Homo sapiens
aaaauguuuuuaaacaguguc

SEQ ID NO: 1051628 - RNA, 22 nt, Homo sapiens
aaaauguuuuuaaacaguguca

SEQ ID NO: 1051629 - RNA, 16 nt, Homo sapiens
aaaauuaaauugcaga

SEQ ID NO: 1051630 - RNA, 15 nt, Homo sapiens
aaaauuaauacugaa

SEQ ID NO: 1051631 - RNA, 21 nt, Homo sapiens
aaaauuauuugaaaacauaua

SEQ ID NO: 1051632 - RNA, 21 nt, Homo sapiens
aaaauucuauuacaguauguc

SEQ ID NO: 1051633 - RNA, 21 nt, Homo sapiens
aaaauuuaggaccaauaccuc

SEQ ID NO: 1051634 - RNA, 14 nt, Homo sapiens
aaacaaaagcucau

SEQ ID NO: 1051635 - RNA, 14 nt, Homo sapiens
aaacaaauaugcaa

SEQ ID NO: 1051636 - RNA, 15 nt, Homo sapiens
aaacaacuaccuccu

SEQ ID NO: 1051637 - RNA, 16 nt, Homo sapiens
aaacaagcaacagaug

SEQ ID NO: 1051638 - RNA, 15 nt, Homo sapiens
aaacacaaccugccu

SEQ ID NO: 1051639 - RNA, 19 nt, Homo sapiens
aaacacccucacacuggga

SEQ ID NO: 1051640 - RNA, 17 nt, Homo sapiens
aaacagaacugcaguca

SEQ ID NO: 1051641 - RNA, 15 nt, Homo sapiens
aaacagagaugugau

SEQ ID NO: 1051642 - RNA, 19 nt, Homo sapiens
aaacagauggcacuuugaa

SEQ ID NO: 1051643 - RNA, 21 nt, Homo sapiens
aaacagcagauuucagaucau

SEQ ID NO: 1051644 - RNA, 19 nt, Homo sapiens
aaacagguggagaaauucc

SEQ ID NO: 1051645 - RNA, 14 nt, Homo sapiens
aaacaguagugaua

SEQ ID NO: 1051646 - RNA, 14 nt, Homo sapiens
aaacagugacauuu

SEQ ID NO: 1051647 - RNA, 18 nt, Homo sapiens
aaacauaaucuucugccu

SEQ ID NO: 1051648 - RNA, 16 nt, Homo sapiens
aaacauccagauacac

SEQ ID NO: 1051649 - RNA, 16 nt, Homo sapiens
aaacaugauuguuuac

SEQ ID NO: 1051650 - RNA, 20 nt, Homo sapiens
aaacaugguggguccauggg

SEQ ID NO: 1051651 - RNA, 15 nt, Homo sapiens
aaacauuaaugcaau

SEQ ID NO: 1051652 - RNA, 11 nt, Homo sapiens
aaacauuccau

SEQ ID NO: 1051653 - RNA, 23 nt, Homo sapiens
aaacauuuaaauuauacaaucau

SEQ ID NO: 1051654 - RNA, 17 nt, Homo sapiens
aaacauuuaacuuguuu

SEQ ID NO: 1051655 - RNA, 20 nt, Homo sapiens
aaacauuuucacacaauaca

SEQ ID NO: 1051656 - RNA, 23 nt, Homo sapiens
aaacauuuucuugaauggcaugc

SEQ ID NO: 1051657 - RNA, 18 nt, Homo sapiens
aaaccaaccgcacaugca

SEQ ID NO: 1051658 - RNA, 15 nt, Homo sapiens
aaaccacuagaacuc

SEQ ID NO: 1051659 - RNA, 15 nt, Homo sapiens
aaaccccaaacuguu

SEQ ID NO: 1051660 - RNA, 13 nt, Homo sapiens
aaacccucaaggg

SEQ ID NO: 1051661 - RNA, 20 nt, Homo sapiens
aaaccggguugccagcuccc

SEQ ID NO: 1051662 - RNA, 15 nt, Homo sapiens
aaaccucaucucuac

SEQ ID NO: 1051663 - RNA, 14 nt, Homo sapiens
aaaccugugugcca

SEQ ID NO: 1051664 - RNA, 21 nt, Homo sapiens
aaaccuuaguacugaguuaca

SEQ ID NO: 1051665 - RNA, 19 nt, Homo sapiens
aaaccuucaguuaugauuu

SEQ ID NO: 1051666 - RNA, 15 nt, Homo sapiens
aaaccuugcacaggu

SEQ ID NO: 1051667 - RNA, 16 nt, Homo sapiens
aaacguccuacuguau

SEQ ID NO: 1051668 - RNA, 23 nt, Homo sapiens
aaacuagguaaaaucuacaguac

SEQ ID NO: 1051669 - RNA, 13 nt, Homo sapiens
aaacucaaaauau

SEQ ID NO: 1051670 - RNA, 20 nt, Homo sapiens
aaacucagggacagagccau

SEQ ID NO: 1051671 - RNA, 12 nt, Homo sapiens
aaacucuugaga

SEQ ID NO: 1051672 - RNA, 16 nt, Homo sapiens
aaacucuugagaucuu

SEQ ID NO: 1051673 - RNA, 17 nt, Homo sapiens
aaacugaaaaucuaaua

SEQ ID NO: 1051674 - RNA, 15 nt, Homo sapiens
aaacugaaucacaau

SEQ ID NO: 1051675 - RNA, 21 nt, Homo sapiens
aaacugagaugugaacacauc

SEQ ID NO: 1051676 - RNA, 22 nt, Homo sapiens
aaacugagaugugaacacauca

SEQ ID NO: 1051677 - RNA, 23 nt, Homo sapiens
aaacugauacccuuugaaaaagu

SEQ ID NO: 1051678 - RNA, 19 nt, Homo sapiens
aaacugauuuuuagcuuua

SEQ ID NO: 1051679 - RNA, 19 nt, Homo sapiens
aaacugcacugucaagaug

SEQ ID NO: 1051680 - RNA, 23 nt, Homo sapiens
gcaguauccaauaggcauuugau

SEQ ID NO: 1051681 - RNA, 23 nt, Homo sapiens
gcagucaucuugaccaagcagga

SEQ ID NO: 1051682 - RNA, 17 nt, Homo sapiens
gcagugccccuagcuua

SEQ ID NO: 1051683 - RNA, 20 nt, Homo sapiens
gcaguggacucaaaacccau

SEQ ID NO: 1051684 - RNA, 17 nt, Homo sapiens
gcaguggcgugaucucg

SEQ ID NO: 1051685 - RNA, 21 nt, Homo sapiens
gcaguguuucccguauugaca

SEQ ID NO: 1051686 - RNA, 17 nt, Homo sapiens
gcaguucuaguuugcau

SEQ ID NO: 1051687 - RNA, 19 nt, Homo sapiens
gcaguucugggugcucccu

SEQ ID NO: 1051688 - RNA, 22 nt, Homo sapiens
gcaguugaaacaagaagccaca

SEQ ID NO: 1051689 - RNA, 18 nt, Homo sapiens
gcaguuugggaggcugag

SEQ ID NO: 1051690 - RNA, 22 nt, Homo sapiens
gcauaaauccauccauccaaag

SEQ ID NO: 1051691 - RNA, 14 nt, Homo sapiens
gcauaacaaaaaga

SEQ ID NO: 1051692 - RNA, 16 nt, Homo sapiens
gcauaacuguucucau

SEQ ID NO: 1051693 - RNA, 20 nt, Homo sapiens
gcauacgguaugauauugca

SEQ ID NO: 1051694 - RNA, 23 nt, Homo sapiens
gcauacgguaugauauugcagcu

SEQ ID NO: 1051695 - RNA, 18 nt, Homo sapiens
gcauagaguucagacuuu

SEQ ID NO: 1051696 - RNA, 14 nt, Homo sapiens
gcauagauugauca

SEQ ID NO: 1051697 - RNA, 14 nt, Homo sapiens
gcauagcaaacaga

SEQ ID NO: 1051698 - RNA, 16 nt, Homo sapiens
gcauaguauuccauug

SEQ ID NO: 1051699 - RNA, 14 nt, Homo sapiens
gcauauaacuuaua

SEQ ID NO: 1051700 - RNA, 18 nt, Homo sapiens
gcauaugaggaugcagag

SEQ ID NO: 1051701 - RNA, 13 nt, Homo sapiens
gcauaugucuaua

SEQ ID NO: 1051702 - RNA, 14 nt, Homo sapiens
gcauauuguauuac

SEQ ID NO: 1051703 - RNA, 15 nt, Homo sapiens
gcaucaaauauuugu

SEQ ID NO: 1051704 - RNA, 15 nt, Homo sapiens
gcaucaaugcugagu

SEQ ID NO: 1051705 - RNA, 15 nt, Homo sapiens
gcaucaucaaaaacu

SEQ ID NO: 1051706 - RNA, 13 nt, Homo sapiens
gcaucucagccua

SEQ ID NO: 1051707 - RNA, 13 nt, Homo sapiens
gcaucuccugugc

SEQ ID NO: 1051708 - RNA, 14 nt, Homo sapiens
gcaucugacucaca

SEQ ID NO: 1051709 - RNA, 23 nt, Homo sapiens
gcaucugggauucccaccaaggu

SEQ ID NO: 1051710 - RNA, 17 nt, Homo sapiens
gcaucuggguagcugua

SEQ ID NO: 1051711 - RNA, 17 nt, Homo sapiens
gcaucuucccacagugg

SEQ ID NO: 1051712 - RNA, 15 nt, Homo sapiens
gcaugaaacauguuc

SEQ ID NO: 1051713 - RNA, 23 nt, Homo sapiens
gcaugaccugugaccagcacugu

SEQ ID NO: 1051714 - RNA, 22 nt, Homo sapiens
gcaugacggcucaugccuguaa

SEQ ID NO: 1051715 - RNA, 19 nt, Homo sapiens
gcaugagucagucugauga

SEQ ID NO: 1051716 - RNA, 21 nt, Homo sapiens
gcauggacaccccuuauccag

SEQ ID NO: 1051717 - RNA, 15 nt, Homo sapiens
gcauggagcauggga

SEQ ID NO: 1051718 - RNA, 18 nt, Homo sapiens
gcaugucucaauaguaaa

SEQ ID NO: 1051719 - RNA, 10 nt, Homo sapiens
gcaugugcag

SEQ ID NO: 1051720 - RNA, 20 nt, Homo sapiens
gcaugugugcgagugugugc

SEQ ID NO: 1051721 - RNA, 17 nt, Homo sapiens
gcauuauguccacugug

SEQ ID NO: 1051722 - RNA, 12 nt, Homo sapiens
gcauucacccag

SEQ ID NO: 1051723 - RNA, 16 nt, Homo sapiens
gcauucauaacagaac

SEQ ID NO: 1051724 - RNA, 14 nt, Homo sapiens
gcauugcacaggga

SEQ ID NO: 1051725 - RNA, 15 nt, Homo sapiens
aaggauggaugcaga

SEQ ID NO: 1051726 - RNA, 18 nt, Homo sapiens
aaggaugugggggaagac

SEQ ID NO: 1051727 - RNA, 14 nt, Homo sapiens
aaggauugugauau

SEQ ID NO: 1051728 - RNA, 12 nt, Homo sapiens
aaggcaaaaaga

SEQ ID NO: 1051729 - RNA, 15 nt, Homo sapiens
aaggcacugccugau

SEQ ID NO: 1051730 - RNA, 22 nt, Homo sapiens
aaggccaagaggcuguucccac

SEQ ID NO: 1051731 - RNA, 16 nt, Homo sapiens
aaggcgugagucugca

SEQ ID NO: 1051732 - RNA, 17 nt, Homo sapiens
aaggcuagaucaugaag

SEQ ID NO: 1051733 - RNA, 21 nt, Homo sapiens
aaggcuuacacccacagugga

SEQ ID NO: 1051734 - RNA, 20 nt, Homo sapiens
aagggaauucggugugcacc

SEQ ID NO: 1051735 - RNA, 17 nt, Homo sapiens
aagggacauauucauuu

SEQ ID NO: 1051736 - RNA, 16 nt, Homo sapiens
aagggauaguccaaag

SEQ ID NO: 1051737 - RNA, 19 nt, Homo sapiens
aagggauggaaaaggaaga

SEQ ID NO: 1051738 - RNA, 14 nt, Homo sapiens
aagggauggcaaga

SEQ ID NO: 1051739 - RNA, 19 nt, Homo sapiens
aagggcccaaaggccuugg

SEQ ID NO: 1051740 - RNA, 17 nt, Homo sapiens
aagggcuagaaccugga

SEQ ID NO: 1051741 - RNA, 18 nt, Homo sapiens
aagggcucacgcauucag

SEQ ID NO: 1051742 - RNA, 18 nt, Homo sapiens
aagggcuucugcacccuc

SEQ ID NO: 1051743 - RNA, 20 nt, Homo sapiens
aaggggccuuugucuuguca

SEQ ID NO: 1051744 - RNA, 21 nt, Homo sapiens
aaggggccuuugucuugucaa

SEQ ID NO: 1051745 - RNA, 22 nt, Homo sapiens
aaggguaccuugaacacugggg

SEQ ID NO: 1051746 - RNA, 23 nt, Homo sapiens
aaggguaccuugaacacuggggg

SEQ ID NO: 1051747 - RNA, 14 nt, Homo sapiens
aagggucacaauac

SEQ ID NO: 1051748 - RNA, 18 nt, Homo sapiens
aaggguucaccaggucag

SEQ ID NO: 1051749 - RNA, 22 nt, Homo sapiens
aaggguucaccaggucagggag

SEQ ID NO: 1051750 - RNA, 14 nt, Homo sapiens
aagguaacuguaca

SEQ ID NO: 1051751 - RNA, 16 nt, Homo sapiens
aagguaguguaucauu

SEQ ID NO: 1051752 - RNA, 13 nt, Homo sapiens
aaggucaccagca

SEQ ID NO: 1051753 - RNA, 21 nt, Homo sapiens
aaggucauaagggagcaugau

SEQ ID NO: 1051754 - RNA, 22 nt, Homo sapiens
aaggucuugcuauguugcccag

SEQ ID NO: 1051755 - RNA, 16 nt, Homo sapiens
aaggugaagagaccaa

SEQ ID NO: 1051756 - RNA, 17 nt, Homo sapiens
aaggugagcaaagggcu

SEQ ID NO: 1051757 - RNA, 18 nt, Homo sapiens
aagguggggauugcccau

SEQ ID NO: 1051758 - RNA, 20 nt, Homo sapiens
aagguggguggaucacuuga

SEQ ID NO: 1051759 - RNA, 13 nt, Homo sapiens
aagguuaaaccca

SEQ ID NO: 1051760 - RNA, 17 nt, Homo sapiens
aagguuccaacuguaua

SEQ ID NO: 1051761 - RNA, 18 nt, Homo sapiens
aagguucccucugagaau

SEQ ID NO: 1051762 - RNA, 17 nt, Homo sapiens
aagguuuuuacugugag

SEQ ID NO: 1051763 - RNA, 14 nt, Homo sapiens
aaguaacauuugcc

SEQ ID NO: 1051764 - RNA, 18 nt, Homo sapiens
aaguaaguaccacucagg

SEQ ID NO: 1051765 - RNA, 22 nt, Homo sapiens
aaguaauuccucucacuaaacu

SEQ ID NO: 1051766 - RNA, 13 nt, Homo sapiens
aaguacagacuuu

SEQ ID NO: 1051767 - RNA, 18 nt, Homo sapiens
aaguacauguuaaacuua

SEQ ID NO: 1051768 - RNA, 19 nt, Homo sapiens
aaguacuagcuuacuuuug

SEQ ID NO: 1051769 - RNA, 22 nt, Homo sapiens
aaguacuguaacugugucauga

SEQ ID NO: 1051770 - RNA, 15 nt, Homo sapiens
aaguagaauaguggu

SEQ ID NO: 1051771 - RNA, 17 nt, Homo sapiens
aaguagcacccuggauu

SEQ ID NO: 1051772 - RNA, 18 nt, Homo sapiens
aaguagcucuggugaccu

SEQ ID NO: 1051773 - RNA, 12 nt, Homo sapiens
aaguagcuggaa

SEQ ID NO: 1051774 - RNA, 17 nt, Homo sapiens
aaguagguuuacauuca

SEQ ID NO: 1051775 - RNA, 19 nt, Homo sapiens
aaguauaucuuuaauucug

SEQ ID NO: 1051776 - RNA, 13 nt, Homo sapiens
aaguaugagggaa

SEQ ID NO: 1051777 - RNA, 19 nt, Homo sapiens
aaguauuauuuauuugaau

SEQ ID NO: 1051778 - RNA, 13 nt, Homo sapiens
aaguauugaauua

SEQ ID NO: 1051779 - RNA, 13 nt, Homo sapiens
aagucacucccaa

SEQ ID NO: 1051780 - RNA, 15 nt, Homo sapiens
aagucacuggccagu

SEQ ID NO: 1051781 - RNA, 20 nt, Homo sapiens
aagucacuggccaguggcug

SEQ ID NO: 1051782 - RNA, 17 nt, Homo sapiens
aagucagcaugccucua

SEQ ID NO: 1051783 - RNA, 17 nt, Homo sapiens
aagucaggguuggagca

SEQ ID NO: 1051784 - RNA, 21 nt, Homo sapiens
aaguccaauuccaaagccaga

SEQ ID NO: 1051785 - RNA, 19 nt, Homo sapiens
aaguccagagcuggaucuc

SEQ ID NO: 1051786 - RNA, 16 nt, Homo sapiens
aaguccuucaccucac

SEQ ID NO: 1051787 - RNA, 17 nt, Homo sapiens
aagucuaaauaaaugaa

SEQ ID NO: 1051788 - RNA, 21 nt, Homo sapiens
aagucuguuuuaugacuucau

SEQ ID NO: 1051789 - RNA, 20 nt, Homo sapiens
aagucuuaaucauuugugac

SEQ ID NO: 1051790 - RNA, 11 nt, Homo sapiens
aagucuuccau

SEQ ID NO: 1051791 - RNA, 17 nt, Homo sapiens
aagugaaaaacauccag

SEQ ID NO: 1051792 - RNA, 17 nt, Homo sapiens
aagugaaauaagccaga

SEQ ID NO: 1051793 - RNA, 21 nt, Homo sapiens
aagugaagagggagaagggau

SEQ ID NO: 1051794 - RNA, 15 nt, Homo sapiens
aagugacuucacaga

SEQ ID NO: 1051795 - RNA, 14 nt, Homo sapiens
aagugacuugccca

SEQ ID NO: 1051796 - RNA, 20 nt, Homo sapiens
aagugagacccugucucaaa

SEQ ID NO: 1051797 - RNA, 19 nt, Homo sapiens
aagugccugcaaaaacaga

SEQ ID NO: 1051798 - RNA, 10 nt, Homo sapiens
aagugccuua

SEQ ID NO: 1051799 - RNA, 15 nt, Homo sapiens
aagugcgaguccucc

SEQ ID NO: 1051800 - RNA, 16 nt, Homo sapiens
aagugcgaguccucca

SEQ ID NO: 1051801 - RNA, 23 nt, Homo sapiens
aagugcugggauuacagguguga

SEQ ID NO: 1051802 - RNA, 23 nt, Homo sapiens
aagugggaucugucacaccagcc

SEQ ID NO: 1051803 - RNA, 12 nt, Homo sapiens
aagugucuucca

SEQ ID NO: 1051804 - RNA, 15 nt, Homo sapiens
aaguuaaagugaaua

SEQ ID NO: 1051805 - RNA, 17 nt, Homo sapiens
aaguuaauccacuguga

SEQ ID NO: 1051806 - RNA, 15 nt, Homo sapiens
aaguuacaacuuccu

SEQ ID NO: 1051807 - RNA, 14 nt, Homo sapiens
aaguuacuucacuu

SEQ ID NO: 1051808 - RNA, 17 nt, Homo sapiens
aaguuagaaaacauaau

SEQ ID NO: 1051809 - RNA, 21 nt, Homo sapiens
aaguuauaguauaucuggaca

SEQ ID NO: 1051810 - RNA, 14 nt, Homo sapiens
aaguuauugauguu

SEQ ID NO: 1051811 - RNA, 14 nt, Homo sapiens
aaguucauaggguc

SEQ ID NO: 1051812 - RNA, 22 nt, Homo sapiens
aaguucgaagcuccgugaguga

SEQ ID NO: 1051813 - RNA, 18 nt, Homo sapiens
aaguucuuaguugcugua

SEQ ID NO: 1051814 - RNA, 19 nt, Homo sapiens
aaguucuuaugccauguua

SEQ ID NO: 1051815 - RNA, 21 nt, Homo sapiens
aaguugauauagaacagugcu

SEQ ID NO: 1051816 - RNA, 16 nt, Homo sapiens
aaguugcaccaacuuu

SEQ ID NO: 1051817 - RNA, 12 nt, Homo sapiens
aaguuuaugcau

SEQ ID NO: 1051818 - RNA, 18 nt, Homo sapiens
aaguuucaggauacaugu

SEQ ID NO: 1051819 - RNA, 17 nt, Homo sapiens
aaguuucaucagucaau

SEQ ID NO: 1051820 - RNA, 12 nt, Homo sapiens
aaguuugaacuu

SEQ ID NO: 1051821 - RNA, 16 nt, Homo sapiens
aaguuugucacuaaac

SEQ ID NO: 1051822 - RNA, 13 nt, Homo sapiens
aauaaaaacugac

SEQ ID NO: 1051823 - RNA, 18 nt, Homo sapiens
aauaaacauuuguagcau

SEQ ID NO: 1051824 - RNA, 20 nt, Homo sapiens
aauaaaccaucaucuugcca

SEQ ID NO: 1051825 - RNA, 12 nt, Homo sapiens
aauaaagacagg

SEQ ID NO: 1051826 - RNA, 13 nt, Homo sapiens
aauaaagcccuug

SEQ ID NO: 1051827 - RNA, 14 nt, Homo sapiens
aauaaagcuugcaa

SEQ ID NO: 1051828 - RNA, 18 nt, Homo sapiens
aauaaaguucuguacuca

SEQ ID NO: 1051829 - RNA, 15 nt, Homo sapiens
aauaaauaaacgagc

SEQ ID NO: 1051830 - RNA, 22 nt, Homo sapiens
aauaaauagcuauauccaugua

SEQ ID NO: 1051831 - RNA, 14 nt, Homo sapiens
aauaaauauaugau

SEQ ID NO: 1051832 - RNA, 22 nt, Homo sapiens
aauaaauucccuggccuuucau

SEQ ID NO: 1051833 - RNA, 18 nt, Homo sapiens
aauaaauuggaacaccuc

SEQ ID NO: 1051834 - RNA, 22 nt, Homo sapiens
aauaaauuggaacaccuccuca

SEQ ID NO: 1051835 - RNA, 20 nt, Homo sapiens
aauaacuaaugucucuacaa

SEQ ID NO: 1051836 - RNA, 23 nt, Homo sapiens
aauaagcaggcgugaccugccag

SEQ ID NO: 1051837 - RNA, 19 nt, Homo sapiens
aauaagggcagagucacac

SEQ ID NO: 1051838 - RNA, 12 nt, Homo sapiens
aauaagugccag

SEQ ID NO: 1051839 - RNA, 14 nt, Homo sapiens
aauaauaaacagug

SEQ ID NO: 1051840 - RNA, 16 nt, Homo sapiens
aauaauacaccagaga

SEQ ID NO: 1051841 - RNA, 15 nt, Homo sapiens
aauaauauuagcuua

SEQ ID NO: 1051842 - RNA, 18 nt, Homo sapiens
aauacaaacaccuggacu

SEQ ID NO: 1051843 - RNA, 14 nt, Homo sapiens
aauacaacauguag

SEQ ID NO: 1051844 - RNA, 16 nt, Homo sapiens
aauacacaacacacac

SEQ ID NO: 1051845 - RNA, 20 nt, Homo sapiens
aauacagauagauauaugcu

SEQ ID NO: 1051846 - RNA, 23 nt, Homo sapiens
aauacagauagauauaugcucug

SEQ ID NO: 1051847 - RNA, 14 nt, Homo sapiens
aauacaguaucuca

SEQ ID NO: 1051848 - RNA, 17 nt, Homo sapiens
aauacaguaucucaggg

SEQ ID NO: 1051849 - RNA, 20 nt, Homo sapiens
aauacagucuuccauuugca

SEQ ID NO: 1051850 - RNA, 22 nt, Homo sapiens
aauacauaaaguaugugcauau

SEQ ID NO: 1051851 - RNA, 11 nt, Homo sapiens
aauacauauuu

SEQ ID NO: 1051852 - RNA, 17 nt, Homo sapiens
aauaccagugaaccaaa

SEQ ID NO: 1051853 - RNA, 22 nt, Homo sapiens
aauaccagugaaccaaagagac

SEQ ID NO: 1051854 - RNA, 17 nt, Homo sapiens
aauaccccucaacucau

SEQ ID NO: 1051855 - RNA, 20 nt, Homo sapiens
aauaccucaaccuaugguau

SEQ ID NO: 1051856 - RNA, 19 nt, Homo sapiens
aauaccuccuccagaucag

SEQ ID NO: 1051857 - RNA, 23 nt, Homo sapiens
aauaccugcccugacaugcacac

SEQ ID NO: 1051858 - RNA, 16 nt, Homo sapiens
aauacugccagaugcu

SEQ ID NO: 1051859 - RNA, 15 nt, Homo sapiens
aauacuguauuugag

SEQ ID NO: 1051860 - RNA, 15 nt, Homo sapiens
aauagaaacauugaa

SEQ ID NO: 1051861 - RNA, 20 nt, Homo sapiens
aauagaagaacauccaagga

SEQ ID NO: 1051862 - RNA, 19 nt, Homo sapiens
aauagaaggauguacauuu

SEQ ID NO: 1051863 - RNA, 14 nt, Homo sapiens
aauagaagggcaaa

SEQ ID NO: 1051864 - RNA, 23 nt, Homo sapiens
aauagaucaaaguccagcaggca

SEQ ID NO: 1051865 - RNA, 20 nt, Homo sapiens
aauagcaaccuuuuuaucuc

SEQ ID NO: 1051866 - RNA, 19 nt, Homo sapiens
aauagcaacguagcuucua

SEQ ID NO: 1051867 - RNA, 14 nt, Homo sapiens
aauagcaaggugcu

SEQ ID NO: 1051868 - RNA, 13 nt, Homo sapiens
ggcuccacuggga

SEQ ID NO: 1051869 - RNA, 21 nt, Homo sapiens
ggcuccccuccucggcuuccu

SEQ ID NO: 1051870 - RNA, 16 nt, Homo sapiens
ggugaaagauggaacu

SEQ ID NO: 1051871 - RNA, 23 nt, Homo sapiens
ggugaaggaugcggcaggugcuc

SEQ ID NO: 1051872 - RNA, 20 nt, Homo sapiens
aauagcuauauccauguacu

SEQ ID NO: 1051873 - RNA, 19 nt, Homo sapiens
aauaggugugaacagggaa

SEQ ID NO: 1051874 - RNA, 19 nt, Homo sapiens
aauagugauuuccacagug

SEQ ID NO: 1051875 - RNA, 22 nt, Homo sapiens
aauaguguuggaaaaugugcaa

SEQ ID NO: 1051876 - RNA, 15 nt, Homo sapiens
aauauaauacuguau

SEQ ID NO: 1051877 - RNA, 16 nt, Homo sapiens
aauauaauuugaucuu

SEQ ID NO: 1051878 - RNA, 12 nt, Homo sapiens
aauauacauuca

SEQ ID NO: 1051879 - RNA, 17 nt, Homo sapiens
aauauaccuucagagac

SEQ ID NO: 1051880 - RNA, 13 nt, Homo sapiens
aauauagugacua

SEQ ID NO: 1051881 - RNA, 20 nt, Homo sapiens
aauaugacggaagaacauag

SEQ ID NO: 1051882 - RNA, 19 nt, Homo sapiens
aauaugcacaauagcaguu

SEQ ID NO: 1051883 - RNA, 13 nt, Homo sapiens
aauaugcagugau

SEQ ID NO: 1051884 - RNA, 23 nt, Homo sapiens
aauauguaaauagaaacguguau

SEQ ID NO: 1051885 - RNA, 14 nt, Homo sapiens
aauaugucaguuug

SEQ ID NO: 1051886 - RNA, 15 nt, Homo sapiens
aauauuaaauauaug

SEQ ID NO: 1051887 - RNA, 15 nt, Homo sapiens
aauauucagauauaa

SEQ ID NO: 1051888 - RNA, 14 nt, Homo sapiens
aauauucauuguau

SEQ ID NO: 1051889 - RNA, 15 nt, Homo sapiens
aauauuuauaagcua

SEQ ID NO: 1051890 - RNA, 20 nt, Homo sapiens
aauauuuauuaccucugaua

SEQ ID NO: 1051891 - RNA, 20 nt, Homo sapiens
aauauuucccucaccuuucc

SEQ ID NO: 1051892 - RNA, 15 nt, Homo sapiens
aauauuuuccaugaa

SEQ ID NO: 1051893 - RNA, 23 nt, Homo sapiens
aauauuuuccaugaaaaugcaac

SEQ ID NO: 1051894 - RNA, 20 nt, Homo sapiens
aauauuuuucuguaguguga

SEQ ID NO: 1051895 - RNA, 12 nt, Homo sapiens
aaucaaagacau

SEQ ID NO: 1051896 - RNA, 20 nt, Homo sapiens
aaucaaagcagauauauuaa

SEQ ID NO: 1051897 - RNA, 22 nt, Homo sapiens
aaucaaaggaaaauaguaaugu

SEQ ID NO: 1051898 - RNA, 12 nt, Homo sapiens
aaucaacucuaa

SEQ ID NO: 1051899 - RNA, 18 nt, Homo sapiens
aaucaaguuggcuucuaa

SEQ ID NO: 1051900 - RNA, 22 nt, Homo sapiens
aaucaaguuggcuucuaaucaa

SEQ ID NO: 1051901 - RNA, 16 nt, Homo sapiens
aaucaauaaagaccac

SEQ ID NO: 1051902 - RNA, 12 nt, Homo sapiens
aaucaaugaagu

SEQ ID NO: 1051903 - RNA, 21 nt, Homo sapiens
aaucaaugaaguagcugagaa

SEQ ID NO: 1051904 - RNA, 20 nt, Homo sapiens
aaucacacgucuggcuucac

SEQ ID NO: 1051905 - RNA, 12 nt, Homo sapiens
aaucacaguaua

SEQ ID NO: 1051906 - RNA, 14 nt, Homo sapiens
aaucacuugcacuc

SEQ ID NO: 1051907 - RNA, 18 nt, Homo sapiens
aaucagagagcucacuaa

SEQ ID NO: 1051908 - RNA, 15 nt, Homo sapiens
aaucagaucauuuca

SEQ ID NO: 1051909 - RNA, 18 nt, Homo sapiens
aaucagcaagaagauccu

SEQ ID NO: 1051910 - RNA, 18 nt, Homo sapiens
aaucagguccucagagaa

SEQ ID NO: 1051911 - RNA, 19 nt, Homo sapiens
aaucaguauaauucuguac

SEQ ID NO: 1051912 - RNA, 21 nt, Homo sapiens
aaucagucuauccacagagag

SEQ ID NO: 1051913 - RNA, 13 nt, Homo sapiens
aaucaguguuacc

SEQ ID NO: 1051914 - RNA, 19 nt, Homo sapiens
aaucauaaaacuugaugug

SEQ ID NO: 1051915 - RNA, 14 nt, Homo sapiens
aaucauagccaaga

SEQ ID NO: 1051916 - RNA, 22 nt, Homo sapiens
aaucauaugguugacaguaugc

SEQ ID NO: 1051917 - RNA, 14 nt, Homo sapiens
aaucauccaucacu

SEQ ID NO: 1051918 - RNA, 21 nt, Homo sapiens
aaucaugaaauaugcaucuca

SEQ ID NO: 1051919 - RNA, 13 nt, Homo sapiens
aaucaugagauaa

SEQ ID NO: 1051920 - RNA, 15 nt, Homo sapiens
aaucaugcugagaga

SEQ ID NO: 1051921 - RNA, 20 nt, Homo sapiens
aaucauuucugcaucagcug

SEQ ID NO: 1051922 - RNA, 14 nt, Homo sapiens
aauccacucuccau

SEQ ID NO: 1051923 - RNA, 20 nt, Homo sapiens
aauccacucuccauuucuau

SEQ ID NO: 1051924 - RNA, 21 nt, Homo sapiens
aauccaucuaaauaccugccc

SEQ ID NO: 1051925 - RNA, 21 nt, Homo sapiens
aauccauucuuaaaguacuug

SEQ ID NO: 1051926 - RNA, 22 nt, Homo sapiens
aauccauucuuaaaguacuugu

SEQ ID NO: 1051927 - RNA, 12 nt, Homo sapiens
aaucccagcugg

SEQ ID NO: 1051928 - RNA, 22 nt, Homo sapiens
aaucccgauucacccuguccaa

SEQ ID NO: 1051929 - RNA, 18 nt, Homo sapiens
aauccuggcccucugugu

SEQ ID NO: 1051930 - RNA, 15 nt, Homo sapiens
aauccuuccaugaaa

SEQ ID NO: 1051931 - RNA, 14 nt, Homo sapiens
aaucgaacuaugaa

SEQ ID NO: 1051932 - RNA, 21 nt, Homo sapiens
aaucguccagcgaccuuccuc

SEQ ID NO: 1051933 - RNA, 13 nt, Homo sapiens
aaucuaaauggaa

SEQ ID NO: 1051934 - RNA, 17 nt, Homo sapiens
aaucuaggaagcucaga

SEQ ID NO: 1051935 - RNA, 16 nt, Homo sapiens
aaucuauuauacugua

SEQ ID NO: 1051936 - RNA, 18 nt, Homo sapiens
aaucucaaauaacuaaaa

SEQ ID NO: 1051937 - RNA, 17 nt, Homo sapiens
aaucucaauucuucccu

SEQ ID NO: 1051938 - RNA, 16 nt, Homo sapiens
aaucucacaaaugauc

SEQ ID NO: 1051939 - RNA, 18 nt, Homo sapiens
aaucucaccccaucccac

SEQ ID NO: 1051940 - RNA, 14 nt, Homo sapiens
aaucucacuacaca

SEQ ID NO: 1051941 - RNA, 14 nt, Homo sapiens
aaucucggcucacu

SEQ ID NO: 1051942 - RNA, 18 nt, Homo sapiens
aaucucggcucacugcaa

SEQ ID NO: 1051943 - RNA, 16 nt, Homo sapiens
aaucucggcucauuga

SEQ ID NO: 1051944 - RNA, 13 nt, Homo sapiens
aaucucguuucaa

SEQ ID NO: 1051945 - RNA, 17 nt, Homo sapiens
aaucucugugaaauacu

SEQ ID NO: 1051946 - RNA, 14 nt, Homo sapiens
aaucucuugcacuc

SEQ ID NO: 1051947 - RNA, 16 nt, Homo sapiens
aaucucuugcacucaa

SEQ ID NO: 1051948 - RNA, 21 nt, Homo sapiens
aaucugaccaaaacaaacaaa

SEQ ID NO: 1051949 - RNA, 22 nt, Homo sapiens
aaucugaggccuccucucucag

SEQ ID NO: 1051950 - RNA, 12 nt, Homo sapiens
aaucugaguaua

SEQ ID NO: 1051951 - RNA, 13 nt, Homo sapiens
aaucugcacugug

SEQ ID NO: 1051952 - RNA, 15 nt, Homo sapiens
aaucugcccauucau

SEQ ID NO: 1051953 - RNA, 14 nt, Homo sapiens
aaucuguguacaaa

SEQ ID NO: 1051954 - RNA, 16 nt, Homo sapiens
aaucuuaccagucugu

SEQ ID NO: 1051955 - RNA, 20 nt, Homo sapiens
aaucuucugccuucucauga

SEQ ID NO: 1051956 - RNA, 21 nt, Homo sapiens
aaucuucugccuucucaugau

SEQ ID NO: 1051957 - RNA, 20 nt, Homo sapiens
aaucuucuugauccacuucu

SEQ ID NO: 1051958 - RNA, 20 nt, Homo sapiens
aaucuuucugcagaaacaga

SEQ ID NO: 1051959 - RNA, 19 nt, Homo sapiens
aaucuuuggguaacuucaa

SEQ ID NO: 1051960 - RNA, 13 nt, Homo sapiens
aaucuuuucacaa

SEQ ID NO: 1051961 - RNA, 22 nt, Homo sapiens
aaucuuuuucagaaacagugag

SEQ ID NO: 1051962 - RNA, 21 nt, Homo sapiens
aaugaaaaaaaguacauguau

SEQ ID NO: 1051963 - RNA, 16 nt, Homo sapiens
aaugaaccuucuggcc

SEQ ID NO: 1051964 - RNA, 12 nt, Homo sapiens
aaugaagcuuua

SEQ ID NO: 1051965 - RNA, 13 nt, Homo sapiens
aaugaagugcaaa

SEQ ID NO: 1051966 - RNA, 17 nt, Homo sapiens
aaugaaugaauggcuaa

SEQ ID NO: 1051967 - RNA, 17 nt, Homo sapiens
aaugaaugaucuuggcu

SEQ ID NO: 1051968 - RNA, 23 nt, Homo sapiens
aaugacaucuucaaagcuugaag

SEQ ID NO: 1051969 - RNA, 16 nt, Homo sapiens
aaugaccaauauuaua

SEQ ID NO: 1051970 - RNA, 14 nt, Homo sapiens
aaugacccaaagac

SEQ ID NO: 1051971 - RNA, 17 nt, Homo sapiens
aaugacccaaagaccaa

SEQ ID NO: 1051972 - RNA, 19 nt, Homo sapiens
aaugacucaggacaucccc

SEQ ID NO: 1051973 - RNA, 21 nt, Homo sapiens
aaugacuuacuguacaugaaa

SEQ ID NO: 1051974 - RNA, 20 nt, Homo sapiens
aaugacuuugaaaaccuggc

SEQ ID NO: 1051975 - RNA, 21 nt, Homo sapiens
aaugagaagaaugacuaugca

SEQ ID NO: 1051976 - RNA, 19 nt, Homo sapiens
aaugagaaggagucagaaa

SEQ ID NO: 1051977 - RNA, 20 nt, Homo sapiens
aaugagaucguuguuuacag

SEQ ID NO: 1051978 - RNA, 16 nt, Homo sapiens
aaugagggccaagaaa

SEQ ID NO: 1051979 - RNA, 21 nt, Homo sapiens
aaugauacaguugcauguuau

SEQ ID NO: 1051980 - RNA, 20 nt, Homo sapiens
aaugauccguuccauugcaa

SEQ ID NO: 1051981 - RNA, 16 nt, Homo sapiens
aaugaucuagguuuaa

SEQ ID NO: 1051982 - RNA, 16 nt, Homo sapiens
aaugaugaagcuuccu

SEQ ID NO: 1051983 - RNA, 21 nt, Homo sapiens
aaugaugucguuugaaucaca

SEQ ID NO: 1051984 - RNA, 16 nt, Homo sapiens
aaugauuguuugucaa

SEQ ID NO: 1051985 - RNA, 20 nt, Homo sapiens
aaugauuguuugucaauaua

SEQ ID NO: 1051986 - RNA, 14 nt, Homo sapiens
aaugauuuuaucug

SEQ ID NO: 1051987 - RNA, 18 nt, Homo sapiens
aaugcaaaauccugguga

SEQ ID NO: 1051988 - RNA, 18 nt, Homo sapiens
aaugcacauagcuaucaa

SEQ ID NO: 1051989 - RNA, 13 nt, Homo sapiens
aaugcacaucuca

SEQ ID NO: 1051990 - RNA, 14 nt, Homo sapiens
aaugcacaucucau

SEQ ID NO: 1051991 - RNA, 13 nt, Homo sapiens
aaugcaccuggaa

SEQ ID NO: 1051992 - RNA, 18 nt, Homo sapiens
aaugcagaauucuugagu

SEQ ID NO: 1051993 - RNA, 10 nt, Homo sapiens
aaugcagugg

SEQ ID NO: 1051994 - RNA, 21 nt, Homo sapiens
aaugcauuauaggaucauuug

SEQ ID NO: 1051995 - RNA, 16 nt, Homo sapiens
aaugcauugcuaaaau

SEQ ID NO: 1051996 - RNA, 21 nt, Homo sapiens
aaugcauuuuggaaagcuccu

SEQ ID NO: 1051997 - RNA, 19 nt, Homo sapiens
aaugccaaaauucauucag

SEQ ID NO: 1051998 - RNA, 13 nt, Homo sapiens
aaugccacaaaac

SEQ ID NO: 1051999 - RNA, 23 nt, Homo sapiens
aaugccacaaaacugacaguaaa

SEQ ID NO: 1052000 - RNA, 13 nt, Homo sapiens
aaugccagcauaa

SEQ ID NO: 1052001 - RNA, 23 nt, Homo sapiens
aaugccagcauaaauccauccau

SEQ ID NO: 1052002 - RNA, 21 nt, Homo sapiens
aaugcccagccccuucugacc

SEQ ID NO: 1052003 - RNA, 22 nt, Homo sapiens
aaugcccucaggggacuugaau

SEQ ID NO: 1052004 - RNA, 22 nt, Homo sapiens
aaugcccuuacacuuacuguug

SEQ ID NO: 1052005 - RNA, 20 nt, Homo sapiens
aaugccugagugccuggcca

SEQ ID NO: 1052006 - RNA, 13 nt, Homo sapiens
aaugcuacuuuau

SEQ ID NO: 1052007 - RNA, 21 nt, Homo sapiens
aaugcuagcugcaagugacau

SEQ ID NO: 1052008 - RNA, 17 nt, Homo sapiens
aaugcuauaacuauguu

SEQ ID NO: 1052009 - RNA, 15 nt, Homo sapiens
aaugcucaagaaaca

SEQ ID NO: 1052010 - RNA, 19 nt, Homo sapiens
aaugcucagaccagcucuu

SEQ ID NO: 1052011 - RNA, 17 nt, Homo sapiens
aaugcugaacauugcau

SEQ ID NO: 1052012 - RNA, 15 nt, Homo sapiens
aaugcugcuacuuaa

SEQ ID NO: 1052013 - RNA, 15 nt, Homo sapiens
aaugcuucuuucauu

SEQ ID NO: 1052014 - RNA, 12 nt, Homo sapiens
aauggagcucag

SEQ ID NO: 1052015 - RNA, 18 nt, Homo sapiens
guauggcaugaacaucuu

SEQ ID NO: 1052016 - RNA, 17 nt, Homo sapiens
guauguaacuacaggaa

SEQ ID NO: 1052017 - RNA, 15 nt, Homo sapiens
guauguuauugcaua

SEQ ID NO: 1052018 - RNA, 14 nt, Homo sapiens
guauguugccuuua

SEQ ID NO: 1052019 - RNA, 15 nt, Homo sapiens
guauguuugggagac

SEQ ID NO: 1052020 - RNA, 13 nt, Homo sapiens
guauuaaagacag

SEQ ID NO: 1052021 - RNA, 17 nt, Homo sapiens
guauuaagugugcuuau

SEQ ID NO: 1052022 - RNA, 20 nt, Homo sapiens
guauuaggugucauuuccau

SEQ ID NO: 1052023 - RNA, 12 nt, Homo sapiens
guauuagucaca

SEQ ID NO: 1052024 - RNA, 16 nt, Homo sapiens
guauucacuuauaugu

SEQ ID NO: 1052025 - RNA, 13 nt, Homo sapiens
aauguaaaaugca

SEQ ID NO: 1052026 - RNA, 13 nt, Homo sapiens
aauguaacugcug

SEQ ID NO: 1052027 - RNA, 20 nt, Homo sapiens
aauguaagggaaacugccag

SEQ ID NO: 1052028 - RNA, 19 nt, Homo sapiens
aauguauucuuaaauucau

SEQ ID NO: 1052029 - RNA, 20 nt, Homo sapiens
aauguauuuguuugcaauuu

SEQ ID NO: 1052030 - RNA, 12 nt, Homo sapiens
aaugucacuuaa

SEQ ID NO: 1052031 - RNA, 16 nt, Homo sapiens
aaugucagaaaccagu

SEQ ID NO: 1052032 - RNA, 22 nt, Homo sapiens
aauguccuucuuuaucugugau

SEQ ID NO: 1052033 - RNA, 19 nt, Homo sapiens
aaugucuuaaucaugagau

SEQ ID NO: 1052034 - RNA, 21 nt, Homo sapiens
aaugucuuaaucaugagauaa

SEQ ID NO: 1052035 - RNA, 17 nt, Homo sapiens
aaugucuucuguauuca

SEQ ID NO: 1052036 - RNA, 22 nt, Homo sapiens
aaugucuuuccuuuugcucuua

SEQ ID NO: 1052037 - RNA, 23 nt, Homo sapiens
aaugucuuuuuuuuaaugugcug

SEQ ID NO: 1052038 - RNA, 15 nt, Homo sapiens
aaugugacgaacugc

SEQ ID NO: 1052039 - RNA, 21 nt, Homo sapiens
aaugugauauuugaagcauca

SEQ ID NO: 1052040 - RNA, 18 nt, Homo sapiens
aaugugcaaagucaucaa

SEQ ID NO: 1052041 - RNA, 19 nt, Homo sapiens
aauguuaaggaaacucuua

SEQ ID NO: 1052042 - RNA, 15 nt, Homo sapiens
aauguuacauuauua

SEQ ID NO: 1052043 - RNA, 20 nt, Homo sapiens
aauguuacugaucaugcauu

SEQ ID NO: 1052044 - RNA, 16 nt, Homo sapiens
aauguugggacugcua

SEQ ID NO: 1052045 - RNA, 23 nt, Homo sapiens
aauguuuccaaccuggaguauaa

SEQ ID NO: 1052046 - RNA, 22 nt, Homo sapiens
aauguuuuacugugaaacuggc

SEQ ID NO: 1052047 - RNA, 22 nt, Homo sapiens
aauguuuucuagucacuuccuc

SEQ ID NO: 1052048 - RNA, 20 nt, Homo sapiens
aauuaaaacaugcacaaaaa

SEQ ID NO: 1052049 - RNA, 12 nt, Homo sapiens
aauuaaaacuga

SEQ ID NO: 1052050 - RNA, 14 nt, Homo sapiens
aauuaacacaugau

SEQ ID NO: 1052051 - RNA, 12 nt, Homo sapiens
aauuaacacugc

SEQ ID NO: 1052052 - RNA, 11 nt, Homo sapiens
aauuaacuggg

SEQ ID NO: 1052053 - RNA, 16 nt, Homo sapiens
aauuacaggcacauac

SEQ ID NO: 1052054 - RNA, 13 nt, Homo sapiens
aauuacuuuguga

SEQ ID NO: 1052055 - RNA, 22 nt, Homo sapiens
aauuacuuugugaauagaacuc

SEQ ID NO: 1052056 - RNA, 17 nt, Homo sapiens
aauuacuuuuucauucu

SEQ ID NO: 1052057 - RNA, 18 nt, Homo sapiens
aauuacuuuuucauucuu

SEQ ID NO: 1052058 - RNA, 14 nt, Homo sapiens
aauuagaugaacuc

SEQ ID NO: 1052059 - RNA, 21 nt, Homo sapiens
aauuaggagaggcagagauag

SEQ ID NO: 1052060 - RNA, 12 nt, Homo sapiens
aauuagugucau

SEQ ID NO: 1052061 - RNA, 21 nt, Homo sapiens
aauuauauuaaagaaccaaaa

SEQ ID NO: 1052062 - RNA, 18 nt, Homo sapiens
aauuaucggaagcagugc

SEQ ID NO: 1052063 - RNA, 20 nt, Homo sapiens
aauuaucggaagcagugccu

SEQ ID NO: 1052064 - RNA, 21 nt, Homo sapiens
aauuaucuaaaguaugaagca

SEQ ID NO: 1052065 - RNA, 14 nt, Homo sapiens
aauucaagccuuag

SEQ ID NO: 1052066 - RNA, 19 nt, Homo sapiens
aauucagcacugauuucac

SEQ ID NO: 1052067 - RNA, 18 nt, Homo sapiens
aauucagggagugggcua

SEQ ID NO: 1052068 - RNA, 21 nt, Homo sapiens
aauucauacauaguacauaca

SEQ ID NO: 1052069 - RNA, 12 nt, Homo sapiens
aauucauguuuc

SEQ ID NO: 1052070 - RNA, 23 nt, Homo sapiens
aauucauucucugugguauccaa

SEQ ID NO: 1052071 - RNA, 15 nt, Homo sapiens
aauuccaaacauaca

SEQ ID NO: 1052072 - RNA, 18 nt, Homo sapiens
aauucccauuuugcaaaa

SEQ ID NO: 1052073 - RNA, 15 nt, Homo sapiens
aauuccuguauucua

SEQ ID NO: 1052074 - RNA, 23 nt, Homo sapiens
aauuccuuagcuuagaccucagc

SEQ ID NO: 1052075 - RNA, 15 nt, Homo sapiens
aauuccuugcacaua

SEQ ID NO: 1052076 - RNA, 13 nt, Homo sapiens
aauuccuuugugu

SEQ ID NO: 1052077 - RNA, 15 nt, Homo sapiens
aauucgcugcaaccu

SEQ ID NO: 1052078 - RNA, 15 nt, Homo sapiens
aauucggugugcacc

SEQ ID NO: 1052079 - RNA, 12 nt, Homo sapiens
aauucuauuaca

SEQ ID NO: 1052080 - RNA, 19 nt, Homo sapiens
aauucuauuacgugcaaua

SEQ ID NO: 1052081 - RNA, 16 nt, Homo sapiens
aauucucaaccuacca

SEQ ID NO: 1052082 - RNA, 15 nt, Homo sapiens
aauucugcugucuca

SEQ ID NO: 1052083 - RNA, 19 nt, Homo sapiens
aauucuuacaaacaugugg

SEQ ID NO: 1052084 - RNA, 20 nt, Homo sapiens
aauucuuauugacucauaca

SEQ ID NO: 1052085 - RNA, 18 nt, Homo sapiens
aauucuuuccccaaagac

SEQ ID NO: 1052086 - RNA, 14 nt, Homo sapiens
aauugacacuuaaa

SEQ ID NO: 1052087 - RNA, 17 nt, Homo sapiens
aauugauguuacuguau

SEQ ID NO: 1052088 - RNA, 12 nt, Homo sapiens
aauugauuucaa

SEQ ID NO: 1052089 - RNA, 22 nt, Homo sapiens
aauugcagaugguuaaauauca

SEQ ID NO: 1052090 - RNA, 21 nt, Homo sapiens
aauuguugacaguucugaaga

SEQ ID NO: 1052091 - RNA, 23 nt, Homo sapiens
aauuuaaaaauaagaaaauacau

SEQ ID NO: 1052092 - RNA, 17 nt, Homo sapiens
aauuuaaaacacagaga

SEQ ID NO: 1052093 - RNA, 18 nt, Homo sapiens
aauuuaaaggguguacuu

SEQ ID NO: 1052094 - RNA, 15 nt, Homo sapiens
aauuuaauauagcua

SEQ ID NO: 1052095 - RNA, 17 nt, Homo sapiens
aauuuaaucacuuucau

SEQ ID NO: 1052096 - RNA, 12 nt, Homo sapiens
aauuuacuuugu

SEQ ID NO: 1052097 - RNA, 19 nt, Homo sapiens
aauuuagaaauauaauuga

SEQ ID NO: 1052098 - RNA, 14 nt, Homo sapiens
aauuuagggagaaa

SEQ ID NO: 1052099 - RNA, 21 nt, Homo sapiens
aauuuauuuauauuucaagaa

SEQ ID NO: 1052100 - RNA, 15 nt, Homo sapiens
aauuuauuucaaaaa

SEQ ID NO: 1052101 - RNA, 15 nt, Homo sapiens
aauuucaguaaacaa

SEQ ID NO: 1052102 - RNA, 20 nt, Homo sapiens
aauuucauaccuaucaucuu

SEQ ID NO: 1052103 - RNA, 19 nt, Homo sapiens
aauuucuaaaaaacagagg

SEQ ID NO: 1052104 - RNA, 20 nt, Homo sapiens
aauuucucccagucauuuaa

SEQ ID NO: 1052105 - RNA, 19 nt, Homo sapiens
aauuucuggaaaacugccu

SEQ ID NO: 1052106 - RNA, 19 nt, Homo sapiens
aauuuuaaauuauaacuua

SEQ ID NO: 1052107 - RNA, 13 nt, Homo sapiens
aauuuuaaccuau

SEQ ID NO: 1052108 - RNA, 20 nt, Homo sapiens
aauuuuauaacagaauuaaa

SEQ ID NO: 1052109 - RNA, 20 nt, Homo sapiens
aauuuuauaugcuuacugau

SEQ ID NO: 1052110 - RNA, 24 nt, Homo sapiens
aauuuucuucaugcaaugacaucu

SEQ ID NO: 1052111 - RNA, 20 nt, Homo sapiens
aauuuuuaaaacccauuuaa

SEQ ID NO: 1052112 - RNA, 14 nt, Homo sapiens
aauuuuuccaugaa

SEQ ID NO: 1052113 - RNA, 21 nt, Homo sapiens
aauuuuuuaaaguuacuuugu

SEQ ID NO: 1052114 - RNA, 23 nt, Homo sapiens
aauuuuuuuuuuuuaacuuuaag

SEQ ID NO: 1052115 - RNA, 21 nt, Homo sapiens
acaaaaaauuugagaaagccu

SEQ ID NO: 1052116 - RNA, 19 nt, Homo sapiens
acaaaaagccuuuuccaga

SEQ ID NO: 1052117 - RNA, 16 nt, Homo sapiens
acaaaaaugaacugaa

SEQ ID NO: 1052118 - RNA, 15 nt, Homo sapiens
acaaaagcccaaugu

SEQ ID NO: 1052119 - RNA, 11 nt, Homo sapiens
acaaaagcuau

SEQ ID NO: 1052120 - RNA, 12 nt, Homo sapiens
acaaaaucacac

SEQ ID NO: 1052121 - RNA, 18 nt, Homo sapiens
acaaaaugauuuugaaga

SEQ ID NO: 1052122 - RNA, 14 nt, Homo sapiens
acaaacaaacagaa

SEQ ID NO: 1052123 - RNA, 14 nt, Homo sapiens
acaaacauauuugu

SEQ ID NO: 1052124 - RNA, 17 nt, Homo sapiens
acaaacauguaagcaua

SEQ ID NO: 1052125 - RNA, 18 nt, Homo sapiens
acaaaccgagugcaauga

SEQ ID NO: 1052126 - RNA, 18 nt, Homo sapiens
acaaaccugcacuuauac

SEQ ID NO: 1052127 - RNA, 12 nt, Homo sapiens
acaaacuaacag

SEQ ID NO: 1052128 - RNA, 13 nt, Homo sapiens
acaaacucaccau

SEQ ID NO: 1052129 - RNA, 21 nt, Homo sapiens
acaaacucuugguuucuucaa

SEQ ID NO: 1052130 - RNA, 14 nt, Homo sapiens
acaaacugccaguu

SEQ ID NO: 1052131 - RNA, 17 nt, Homo sapiens
acaaagcacaguuugaa

SEQ ID NO: 1052132 - RNA, 15 nt, Homo sapiens
acaaagcccuuccau

SEQ ID NO: 1052133 - RNA, 19 nt, Homo sapiens
acaaaggacagaguaugaa

SEQ ID NO: 1052134 - RNA, 17 nt, Homo sapiens
acaaagggccagcaguc

SEQ ID NO: 1052135 - RNA, 21 nt, Homo sapiens
acaaagugcccaagucuuucc

SEQ ID NO: 1052136 - RNA, 23 nt, Homo sapiens
acaaaguggaugccugcugcauc

SEQ ID NO: 1052137 - RNA, 22 nt, Homo sapiens
acaaauaauuuuuaaauauaag

SEQ ID NO: 1052138 - RNA, 15 nt, Homo sapiens
acaaauaugucaguu

SEQ ID NO: 1052139 - RNA, 13 nt, Homo sapiens
acaaauguaugau

SEQ ID NO: 1052140 - RNA, 17 nt, Homo sapiens
acaaauuagcuaggcau

SEQ ID NO: 1052141 - RNA, 16 nt, Homo sapiens
acaaauucaagccuua

SEQ ID NO: 1052142 - RNA, 21 nt, Homo sapiens
acaacagauuugugaacucag

SEQ ID NO: 1052143 - RNA, 17 nt, Homo sapiens
acaacagcccugucuca

SEQ ID NO: 1052144 - RNA, 23 nt, Homo sapiens
acaacaguugcacagugccucaa

SEQ ID NO: 1052145 - RNA, 19 nt, Homo sapiens
acaacaucaagccugugau

SEQ ID NO: 1052146 - RNA, 13 nt, Homo sapiens
acaacaugguguc

SEQ ID NO: 1052147 - RNA, 15 nt, Homo sapiens
acaacuaccuccuca

SEQ ID NO: 1052148 - RNA, 22 nt, Homo sapiens
acaacuccugucuaacugcugu

SEQ ID NO: 1052149 - RNA, 13 nt, Homo sapiens
acaacucugaaag

SEQ ID NO: 1052150 - RNA, 18 nt, Homo sapiens
acaacuguggucaauccg

SEQ ID NO: 1052151 - RNA, 12 nt, Homo sapiens
acaagaagccac

SEQ ID NO: 1052152 - RNA, 22 nt, Homo sapiens
acaagaagccacagaccuagga

SEQ ID NO: 1052153 - RNA, 23 nt, Homo sapiens
acaagaaucagucuauccacaga

SEQ ID NO: 1052154 - RNA, 22 nt, Homo sapiens
acaagacaggacccugggacca

SEQ ID NO: 1052155 - RNA, 15 nt, Homo sapiens
acaagaccucagugc

SEQ ID NO: 1052156 - RNA, 15 nt, Homo sapiens
acaagagggacaagu

SEQ ID NO: 1052157 - RNA, 18 nt, Homo sapiens
acaagcccccccuuccac

SEQ ID NO: 1052158 - RNA, 20 nt, Homo sapiens
acaagcgugagccacugcac

SEQ ID NO: 1052159 - RNA, 23 nt, Homo sapiens
acaaggcauucaaguguacagug

SEQ ID NO: 1052160 - RNA, 12 nt, Homo sapiens
gucuugaacucc

SEQ ID NO: 1052161 - RNA, 14 nt, Homo sapiens
gucuugcuugggaa

SEQ ID NO: 1052162 - RNA, 15 nt, Homo sapiens
gucuuggacacugua

SEQ ID NO: 1052163 - RNA, 12 nt, Homo sapiens
gucuuggcucac

SEQ ID NO: 1052164 - RNA, 13 nt, Homo sapiens
gucuuguguuucu

SEQ ID NO: 1052165 - RNA, 14 nt, Homo sapiens
gucuuugaacccuu

SEQ ID NO: 1052166 - RNA, 21 nt, Homo sapiens
gugaaaaaguuaaacauugaa

SEQ ID NO: 1052167 - RNA, 21 nt, Homo sapiens
gugaaaccucaucucuacuaa

SEQ ID NO: 1052168 - RNA, 19 nt, Homo sapiens
gugaaagaaaauucuugga

SEQ ID NO: 1052169 - RNA, 15 nt, Homo sapiens
gugaaaugcagaguc

SEQ ID NO: 1052170 - RNA, 14 nt, Homo sapiens
gugaacacaucagc

SEQ ID NO: 1052171 - RNA, 15 nt, Homo sapiens
gugaaccaucauuau

SEQ ID NO: 1052172 - RNA, 15 nt, Homo sapiens
gugaagcaccaagcu

SEQ ID NO: 1052173 - RNA, 23 nt, Homo sapiens
gugaagcauucgagacagaaccu

SEQ ID NO: 1052174 - RNA, 23 nt, Homo sapiens
gugaagucgucuuaacucaccau

SEQ ID NO: 1052175 - RNA, 16 nt, Homo sapiens
gugaauaaccacuuaa

SEQ ID NO: 1052176 - RNA, 15 nt, Homo sapiens
gugaaugaaucucaa

SEQ ID NO: 1052177 - RNA, 13 nt, Homo sapiens
gugaaugaucucu

SEQ ID NO: 1052178 - RNA, 14 nt, Homo sapiens
acaauccuguggau

SEQ ID NO: 1052179 - RNA, 21 nt, Homo sapiens
acaaugaacccccaugaugua

SEQ ID NO: 1052180 - RNA, 18 nt, Homo sapiens
acaaugaagaugaugcua

SEQ ID NO: 1052181 - RNA, 21 nt, Homo sapiens
acaaugauacaguugcauguu

SEQ ID NO: 1052182 - RNA, 17 nt, Homo sapiens
acaauggcuuacuccag

SEQ ID NO: 1052183 - RNA, 23 nt, Homo sapiens
acaauguaaauauuacacaucaa

SEQ ID NO: 1052184 - RNA, 21 nt, Homo sapiens
acaauuauuuuuacaguucuc

SEQ ID NO: 1052185 - RNA, 17 nt, Homo sapiens
acaauugucauguaugu

SEQ ID NO: 1052186 - RNA, 15 nt, Homo sapiens
acaauuuaugaauug

SEQ ID NO: 1052187 - RNA, 17 nt, Homo sapiens
acacaaaacaaaugcca

SEQ ID NO: 1052188 - RNA, 22 nt, Homo sapiens
acacaaaacguuaagugaugaa

SEQ ID NO: 1052189 - RNA, 12 nt, Homo sapiens
acacaaggucau

SEQ ID NO: 1052190 - RNA, 14 nt, Homo sapiens
acacacacacacuc

SEQ ID NO: 1052191 - RNA, 13 nt, Homo sapiens
acacacacacuca

SEQ ID NO: 1052192 - RNA, 14 nt, Homo sapiens
acacacacaucuca

SEQ ID NO: 1052193 - RNA, 11 nt, Homo sapiens
acacacucacu

SEQ ID NO: 1052194 - RNA, 22 nt, Homo sapiens
acacagagcaggacugcacagc

SEQ ID NO: 1052195 - RNA, 18 nt, Homo sapiens
acacagaugaaacacaaa

SEQ ID NO: 1052196 - RNA, 14 nt, Homo sapiens
acacagaugaaggu

SEQ ID NO: 1052197 - RNA, 17 nt, Homo sapiens
acacagcaggacuccau

SEQ ID NO: 1052198 - RNA, 19 nt, Homo sapiens
acacagcaggacuccaucu

SEQ ID NO: 1052199 - RNA, 11 nt, Homo sapiens
acacagccaca

SEQ ID NO: 1052200 - RNA, 17 nt, Homo sapiens
acacagcucccauaacc

SEQ ID NO: 1052201 - RNA, 21 nt, Homo sapiens
acacagcucuucuccaggcug

SEQ ID NO: 1052202 - RNA, 14 nt, Homo sapiens
acacaggcaaaauc

SEQ ID NO: 1052203 - RNA, 16 nt, Homo sapiens
acacaguucaauucuc

SEQ ID NO: 1052204 - RNA, 15 nt, Homo sapiens
acacauagauaccuu

SEQ ID NO: 1052205 - RNA, 17 nt, Homo sapiens
acacauuaagccuucca

SEQ ID NO: 1052206 - RNA, 19 nt, Homo sapiens
acacauuaagccuuccaca

SEQ ID NO: 1052207 - RNA, 23 nt, Homo sapiens
acacauuaagccuuccacacuca

SEQ ID NO: 1052208 - RNA, 18 nt, Homo sapiens
acaccaagugucugcaag

SEQ ID NO: 1052209 - RNA, 17 nt, Homo sapiens
acaccacgguagugccu

SEQ ID NO: 1052210 - RNA, 21 nt, Homo sapiens
acaccacgguagugccugaaa

SEQ ID NO: 1052211 - RNA, 19 nt, Homo sapiens
acaccagagcagaugcaga

SEQ ID NO: 1052212 - RNA, 22 nt, Homo sapiens
acaccagagcagaugcagagag

SEQ ID NO: 1052213 - RNA, 22 nt, Homo sapiens
acaccagcuguucugucccuug

SEQ ID NO: 1052214 - RNA, 18 nt, Homo sapiens
acaccaggccguccuccc

SEQ ID NO: 1052215 - RNA, 21 nt, Homo sapiens
acaccaucuuuccaucccagg

SEQ ID NO: 1052216 - RNA, 19 nt, Homo sapiens
acaccauucaggucuuucu

SEQ ID NO: 1052217 - RNA, 23 nt, Homo sapiens
acaccauuccuucugcccugcuu

SEQ ID NO: 1052218 - RNA, 17 nt, Homo sapiens
acacccgacuccucaaa

SEQ ID NO: 1052219 - RNA, 16 nt, Homo sapiens
acaccgcugcacucaa

SEQ ID NO: 1052220 - RNA, 23 nt, Homo sapiens
acaccguguaaaccaaagcccua

SEQ ID NO: 1052221 - RNA, 19 nt, Homo sapiens
acaccuagcgucaguauuu

SEQ ID NO: 1052222 - RNA, 17 nt, Homo sapiens
acaccuggaugucuggg

SEQ ID NO: 1052223 - RNA, 23 nt, Homo sapiens
acaccuggcacugcugugcugug

SEQ ID NO: 1052224 - RNA, 18 nt, Homo sapiens
acaccuguagucccagcu

SEQ ID NO: 1052225 - RNA, 23 nt, Homo sapiens
acacgggggcagcugauacaaau

SEQ ID NO: 1052226 - RNA, 18 nt, Homo sapiens
acacguacaaaauccagc

SEQ ID NO: 1052227 - RNA, 17 nt, Homo sapiens
acacguaccucucauca

SEQ ID NO: 1052228 - RNA, 12 nt, Homo sapiens
acacgugacaga

SEQ ID NO: 1052229 - RNA, 15 nt, Homo sapiens
acacguguccuguag

SEQ ID NO: 1052230 - RNA, 19 nt, Homo sapiens
acacguguuguuccaccuu

SEQ ID NO: 1052231 - RNA, 18 nt, Homo sapiens
acacuaacauauaauguu

SEQ ID NO: 1052232 - RNA, 20 nt, Homo sapiens
acacuaaccuggguucccuu

SEQ ID NO: 1052233 - RNA, 15 nt, Homo sapiens
acacuaauacaccag

SEQ ID NO: 1052234 - RNA, 16 nt, Homo sapiens
acacuaccacauuaaa

SEQ ID NO: 1052235 - RNA, 20 nt, Homo sapiens
acacuauuuaucugugcaaa

SEQ ID NO: 1052236 - RNA, 15 nt, Homo sapiens
acacucacauuuauu

SEQ ID NO: 1052237 - RNA, 19 nt, Homo sapiens
acacucaucuuagugccug

SEQ ID NO: 1052238 - RNA, 14 nt, Homo sapiens
acacucaugcugaa

SEQ ID NO: 1052239 - RNA, 23 nt, Homo sapiens
acacuccagugccagcaaugaca

SEQ ID NO: 1052240 - RNA, 17 nt, Homo sapiens
acacucccacuuggcau

SEQ ID NO: 1052241 - RNA, 17 nt, Homo sapiens
acacucuccaaacaguc

SEQ ID NO: 1052242 - RNA, 22 nt, Homo sapiens
acacucuccaaacagucaccau

SEQ ID NO: 1052243 - RNA, 15 nt, Homo sapiens
acacugaaauauaca

SEQ ID NO: 1052244 - RNA, 22 nt, Homo sapiens
acacugaaauauacacacagca

SEQ ID NO: 1052245 - RNA, 22 nt, Homo sapiens
acacugaggaacucacaauucc

SEQ ID NO: 1052246 - RNA, 20 nt, Homo sapiens
acacugcauguuugugauug

SEQ ID NO: 1052247 - RNA, 19 nt, Homo sapiens
acacugcuaggugggccag

SEQ ID NO: 1052248 - RNA, 20 nt, Homo sapiens
acacugcuaggugggccagc

SEQ ID NO: 1052249 - RNA, 16 nt, Homo sapiens
acacuggagccaucuc

SEQ ID NO: 1052250 - RNA, 19 nt, Homo sapiens
acacugggagaggugccag

SEQ ID NO: 1052251 - RNA, 20 nt, Homo sapiens
acacugggagaggugccagc

SEQ ID NO: 1052252 - RNA, 16 nt, Homo sapiens
acacugggugcccaag

SEQ ID NO: 1052253 - RNA, 13 nt, Homo sapiens
acacuguacucug

SEQ ID NO: 1052254 - RNA, 16 nt, Homo sapiens
acacugugggacucuu

SEQ ID NO: 1052255 - RNA, 18 nt, Homo sapiens
acacuguuacuuucguac

SEQ ID NO: 1052256 - RNA, 22 nt, Homo sapiens
acacuguucugaaagugacuca

SEQ ID NO: 1052257 - RNA, 17 nt, Homo sapiens
acacuguugucaaaaag

SEQ ID NO: 1052258 - RNA, 15 nt, Homo sapiens
acacuuacacuuuau

SEQ ID NO: 1052259 - RNA, 20 nt, Homo sapiens
acacuuaugggccaagccca

SEQ ID NO: 1052260 - RNA, 16 nt, Homo sapiens
acacuuccaccagccu

SEQ ID NO: 1052261 - RNA, 16 nt, Homo sapiens
acacuuccauuaacuu

SEQ ID NO: 1052262 - RNA, 23 nt, Homo sapiens
acacuugguccauccauuuccaa

SEQ ID NO: 1052263 - RNA, 21 nt, Homo sapiens
acacuuuuuuggggauaugcu

SEQ ID NO: 1052264 - RNA, 15 nt, Homo sapiens
acagaaacauuuuca

SEQ ID NO: 1052265 - RNA, 18 nt, Homo sapiens
acagaaagacugagcuca

SEQ ID NO: 1052266 - RNA, 19 nt, Homo sapiens
acagaaagacugagcucaa

SEQ ID NO: 1052267 - RNA, 19 nt, Homo sapiens
acagaaagcagauaccuca

SEQ ID NO: 1052268 - RNA, 16 nt, Homo sapiens
acagaacccauuccau

SEQ ID NO: 1052269 - RNA, 21 nt, Homo sapiens
acagaacgagacuccaccuca

SEQ ID NO: 1052270 - RNA, 22 nt, Homo sapiens
acagaagcacagcacccauggg

SEQ ID NO: 1052271 - RNA, 15 nt, Homo sapiens
acagaaggauguccc

SEQ ID NO: 1052272 - RNA, 12 nt, Homo sapiens
acagaagguccu

SEQ ID NO: 1052273 - RNA, 20 nt, Homo sapiens
acagaauguuuuacugugaa

SEQ ID NO: 1052274 - RNA, 15 nt, Homo sapiens
acagacacucccacu

SEQ ID NO: 1052275 - RNA, 23 nt, Homo sapiens
acagacacucccacuuggcauca

SEQ ID NO: 1052276 - RNA, 17 nt, Homo sapiens
acagacuaugucaccca

SEQ ID NO: 1052277 - RNA, 14 nt, Homo sapiens
acagacuccugagg

SEQ ID NO: 1052278 - RNA, 17 nt, Homo sapiens
acagagacaggcccaag

SEQ ID NO: 1052279 - RNA, 20 nt, Homo sapiens
acagagauaauucuagcuuu

SEQ ID NO: 1052280 - RNA, 23 nt, Homo sapiens
acagagcugguugggaagacaug

SEQ ID NO: 1052281 - RNA, 17 nt, Homo sapiens
acagagggcaggcacuc

SEQ ID NO: 1052282 - RNA, 15 nt, Homo sapiens
acagaggucucugcc

SEQ ID NO: 1052283 - RNA, 21 nt, Homo sapiens
acagaguaaauagcauucucu

SEQ ID NO: 1052284 - RNA, 21 nt, Homo sapiens
acagagucucacucuguugcc

SEQ ID NO: 1052285 - RNA, 17 nt, Homo sapiens
acagagucuggcucugu

SEQ ID NO: 1052286 - RNA, 13 nt, Homo sapiens
acagaugccccag

SEQ ID NO: 1052287 - RNA, 21 nt, Homo sapiens
acagauuccaggcgaugugca

SEQ ID NO: 1052288 - RNA, 20 nt, Homo sapiens
acagcaaaacuccaucucaa

SEQ ID NO: 1052289 - RNA, 14 nt, Homo sapiens
acagcaaaagaaga

SEQ ID NO: 1052290 - RNA, 17 nt, Homo sapiens
acagcaggacuccaucu

SEQ ID NO: 1052291 - RNA, 12 nt, Homo sapiens
acagcagguggg

SEQ ID NO: 1052292 - RNA, 12 nt, Homo sapiens
acagcaguagca

SEQ ID NO: 1052293 - RNA, 15 nt, Homo sapiens
acagcccccucugcc

SEQ ID NO: 1052294 - RNA, 18 nt, Homo sapiens
acagcccugucucaaaac

SEQ ID NO: 1052295 - RNA, 23 nt, Homo sapiens
acagccucccacccccaucucuc

SEQ ID NO: 1052296 - RNA, 20 nt, Homo sapiens
acagcgagacuccgucucaa

SEQ ID NO: 1052297 - RNA, 19 nt, Homo sapiens
acagcgcuggccgggaccc

SEQ ID NO: 1052298 - RNA, 18 nt, Homo sapiens
acagcuacacagaucaca

SEQ ID NO: 1052299 - RNA, 19 nt, Homo sapiens
acagcuacacagaucacag

SEQ ID NO: 1052300 - RNA, 13 nt, Homo sapiens
acagcucucaccu

SEQ ID NO: 1052301 - RNA, 15 nt, Homo sapiens
acagcucuggcuuug

SEQ ID NO: 1052302 - RNA, 21 nt, Homo sapiens
acagcugagcacauucuggcu

SEQ ID NO: 1052303 - RNA, 23 nt, Homo sapiens
acagcugcuuucuguugucauug

SEQ ID NO: 1052304 - RNA, 22 nt, Homo sapiens
cacacaauuacuaaaguacaga

SEQ ID NO: 1052305 - RNA, 15 nt, Homo sapiens
cacacacacacacuc

SEQ ID NO: 1052306 - RNA, 15 nt, Homo sapiens
cacacacacacgcac

SEQ ID NO: 1052307 - RNA, 12 nt, Homo sapiens
cacacacacuca

SEQ ID NO: 1052308 - RNA, 13 nt, Homo sapiens
cacacacauacac

SEQ ID NO: 1052309 - RNA, 15 nt, Homo sapiens
cacacaccacacaua

SEQ ID NO: 1052310 - RNA, 22 nt, Homo sapiens
cacacacuguucugaaagugac

SEQ ID NO: 1052311 - RNA, 19 nt, Homo sapiens
cacacagaaaauauacugu

SEQ ID NO: 1052312 - RNA, 16 nt, Homo sapiens
cacacagcaguagcag

SEQ ID NO: 1052313 - RNA, 20 nt, Homo sapiens
cacacaguauuacuucugcu

SEQ ID NO: 1052314 - RNA, 12 nt, Homo sapiens
cacacaucucau

SEQ ID NO: 1052315 - RNA, 12 nt, Homo sapiens
cacacaugcaua

SEQ ID NO: 1052316 - RNA, 18 nt, Homo sapiens
cacacauuauuaccccac

SEQ ID NO: 1052317 - RNA, 21 nt, Homo sapiens
cacuagcaauaaaaugcuaau

SEQ ID NO: 1052318 - RNA, 22 nt, Homo sapiens
cacuagccaugauaacugcaau

SEQ ID NO: 1052319 - RNA, 21 nt, Homo sapiens
cacuauagccuaggugacaga

SEQ ID NO: 1052320 - RNA, 16 nt, Homo sapiens
cacuauaucuguauau

SEQ ID NO: 1052321 - RNA, 19 nt, Homo sapiens
cacuaugaagauguuucaa

SEQ ID NO: 1052322 - RNA, 14 nt, Homo sapiens
cacuauuuacauac

SEQ ID NO: 1052323 - RNA, 17 nt, Homo sapiens
cacucaagccaagcagc

SEQ ID NO: 1052324 - RNA, 23 nt, Homo sapiens
cacucacacagccaggugccuug

SEQ ID NO: 1052325 - RNA, 13 nt, Homo sapiens
cacucagcucuug

SEQ ID NO: 1052326 - RNA, 20 nt, Homo sapiens
cacucagcucuuggcuccac

SEQ ID NO: 1052327 - RNA, 16 nt, Homo sapiens
cacucauacaucuggc

SEQ ID NO: 1052328 - RNA, 13 nt, Homo sapiens
cacucaugcugaa

SEQ ID NO: 1052329 - RNA, 21 nt, Homo sapiens
cacuccagccugggugacaga

SEQ ID NO: 1052330 - RNA, 19 nt, Homo sapiens
cacuccauggagucuggaa

SEQ ID NO: 1052331 - RNA, 14 nt, Homo sapiens
cacucccaguccaa

SEQ ID NO: 1052332 - RNA, 15 nt, Homo sapiens
cacucccuccaucaa

SEQ ID NO: 1052333 - RNA, 14 nt, Homo sapiens
cacuccugaacccc

SEQ ID NO: 1052334 - RNA, 13 nt, Homo sapiens
cacucuacuacau

SEQ ID NO: 1052335 - RNA, 20 nt, Homo sapiens
cacucuagggcaguggaguc

SEQ ID NO: 1052336 - RNA, 17 nt, Homo sapiens
cacucuauuaaaucuug

SEQ ID NO: 1052337 - RNA, 14 nt, Homo sapiens
cacucuccaaacag

SEQ ID NO: 1052338 - RNA, 12 nt, Homo sapiens
cacucuccuugc

SEQ ID NO: 1052339 - RNA, 18 nt, Homo sapiens
cacugaauuaaucaucua

SEQ ID NO: 1052340 - RNA, 23 nt, Homo sapiens
cacugacuucuaaguaaaaccac

SEQ ID NO: 1052341 - RNA, 15 nt, Homo sapiens
cacugagagugaagu

SEQ ID NO: 1052342 - RNA, 15 nt, Homo sapiens
cacugagcaaagcau

SEQ ID NO: 1052343 - RNA, 20 nt, Homo sapiens
cacugagcuauaacuuacuu

SEQ ID NO: 1052344 - RNA, 15 nt, Homo sapiens
cacugaggaacucac

SEQ ID NO: 1052345 - RNA, 17 nt, Homo sapiens
cacugaggaccagccau

SEQ ID NO: 1052346 - RNA, 13 nt, Homo sapiens
cacugagggccac

SEQ ID NO: 1052347 - RNA, 18 nt, Homo sapiens
cacugaugggcaaccccc

SEQ ID NO: 1052348 - RNA, 21 nt, Homo sapiens
cacugcaccgggccacagaga

SEQ ID NO: 1052349 - RNA, 16 nt, Homo sapiens
cacugcagaagacagu

SEQ ID NO: 1052350 - RNA, 19 nt, Homo sapiens
cacugcaggcaucacagcu

SEQ ID NO: 1052351 - RNA, 13 nt, Homo sapiens
cacugcauacaau

SEQ ID NO: 1052352 - RNA, 18 nt, Homo sapiens
cacugcauuccacaggug

SEQ ID NO: 1052353 - RNA, 21 nt, Homo sapiens
cacugccaaagaacuuggaaa

SEQ ID NO: 1052354 - RNA, 19 nt, Homo sapiens
cacugccagucucacugug

SEQ ID NO: 1052355 - RNA, 17 nt, Homo sapiens
cacugcccgagcuggug

SEQ ID NO: 1052356 - RNA, 18 nt, Homo sapiens
cacugccgagaacagcau

SEQ ID NO: 1052357 - RNA, 14 nt, Homo sapiens
cacugcucauuugg

SEQ ID NO: 1052358 - RNA, 21 nt, Homo sapiens
cacugcugaggacacucagug

SEQ ID NO: 1052359 - RNA, 16 nt, Homo sapiens
cacugcuuaacuucac

SEQ ID NO: 1052360 - RNA, 23 nt, Homo sapiens
cacuggaggggucuccucugcag

SEQ ID NO: 1052361 - RNA, 14 nt, Homo sapiens
cacuggaggucaca

SEQ ID NO: 1052362 - RNA, 16 nt, Homo sapiens
cacuggaguccagucu

SEQ ID NO: 1052363 - RNA, 15 nt, Homo sapiens
cacugggaaacagag

SEQ ID NO: 1052364 - RNA, 17 nt, Homo sapiens
cacugggccugucacug

SEQ ID NO: 1052365 - RNA, 22 nt, Homo sapiens
cacugggcuucuagaaccaggc

SEQ ID NO: 1052366 - RNA, 14 nt, Homo sapiens
cacugguaauccca

SEQ ID NO: 1052367 - RNA, 23 nt, Homo sapiens
cacugguguggauuaaccugcca

SEQ ID NO: 1052368 - RNA, 14 nt, Homo sapiens
cacugucacuuugc

SEQ ID NO: 1052369 - RNA, 22 nt, Homo sapiens
cacuguccugggcgcccuggaa

SEQ ID NO: 1052370 - RNA, 15 nt, Homo sapiens
cacugugaaaccccc

SEQ ID NO: 1052371 - RNA, 22 nt, Homo sapiens
cacugugcugagucugaaggcu

SEQ ID NO: 1052372 - RNA, 23 nt, Homo sapiens
cacugugggaaggccagcugccc

SEQ ID NO: 1052373 - RNA, 18 nt, Homo sapiens
cacuuacacuuuaugcac

SEQ ID NO: 1052374 - RNA, 13 nt, Homo sapiens
cacuuacagaauu

SEQ ID NO: 1052375 - RNA, 22 nt, Homo sapiens
cacuuagacacguguuguucca

SEQ ID NO: 1052376 - RNA, 17 nt, Homo sapiens
cacuuaucccaagagaa

SEQ ID NO: 1052377 - RNA, 16 nt, Homo sapiens
cacuuauucucaagaa

SEQ ID NO: 1052378 - RNA, 12 nt, Homo sapiens
cacuucacuuuu

SEQ ID NO: 1052379 - RNA, 19 nt, Homo sapiens
cacuucccccauuggacac

SEQ ID NO: 1052380 - RNA, 17 nt, Homo sapiens
cacuucccuacauggag

SEQ ID NO: 1052381 - RNA, 16 nt, Homo sapiens
cacuuccucuucuuca

SEQ ID NO: 1052382 - RNA, 19 nt, Homo sapiens
cacuucuaaaugaagugca

SEQ ID NO: 1052383 - RNA, 15 nt, Homo sapiens
cacuucucucaggau

SEQ ID NO: 1052384 - RNA, 19 nt, Homo sapiens
cacuucugagaacucaucc

SEQ ID NO: 1052385 - RNA, 22 nt, Homo sapiens
cacuucugagaacucaucccua

SEQ ID NO: 1052386 - RNA, 19 nt, Homo sapiens
cacuugaaggaagaagucu

SEQ ID NO: 1052387 - RNA, 18 nt, Homo sapiens
cacuugaaugugucacua

SEQ ID NO: 1052388 - RNA, 23 nt, Homo sapiens
cacuugaccccugcccaccucuc

SEQ ID NO: 1052389 - RNA, 19 nt, Homo sapiens
cacuugcacgcccaugugu

SEQ ID NO: 1052390 - RNA, 21 nt, Homo sapiens
cacuugcagacucuacagagg

SEQ ID NO: 1052391 - RNA, 19 nt, Homo sapiens
cacuuggugauauguccua

SEQ ID NO: 1052392 - RNA, 22 nt, Homo sapiens
cacuuguaagaaaaugagacaa

SEQ ID NO: 1052393 - RNA, 21 nt, Homo sapiens
cacuugugcaguguugacagu

SEQ ID NO: 1052394 - RNA, 15 nt, Homo sapiens
cacuuuaaagcccuu

SEQ ID NO: 1052395 - RNA, 18 nt, Homo sapiens
cacuuuacaaaaguauua

SEQ ID NO: 1052396 - RNA, 14 nt, Homo sapiens
cacuuugcucuggg

SEQ ID NO: 1052397 - RNA, 21 nt, Homo sapiens
cagaaaaaaaaaaaaaagccu

SEQ ID NO: 1052398 - RNA, 20 nt, Homo sapiens
cagaaaaacucugggaaaua

SEQ ID NO: 1052399 - RNA, 13 nt, Homo sapiens
cagaaaacauguu

SEQ ID NO: 1052400 - RNA, 15 nt, Homo sapiens
cagaaaauugcacaa

SEQ ID NO: 1052401 - RNA, 18 nt, Homo sapiens
cagaaacaaaaacacuaa

SEQ ID NO: 1052402 - RNA, 22 nt, Homo sapiens
cagaaacagaggagagucccag

SEQ ID NO: 1052403 - RNA, 19 nt, Homo sapiens
cagaaacaguucaccuuga

SEQ ID NO: 1052404 - RNA, 12 nt, Homo sapiens
cagaaagcauua

SEQ ID NO: 1052405 - RNA, 16 nt, Homo sapiens
cagaaagcucaucuca

SEQ ID NO: 1052406 - RNA, 19 nt, Homo sapiens
cagaaaguggccaugccac

SEQ ID NO: 1052407 - RNA, 15 nt, Homo sapiens
cagaaauacaugaaa

SEQ ID NO: 1052408 - RNA, 19 nt, Homo sapiens
cagaaaucuagaagacugu

SEQ ID NO: 1052409 - RNA, 17 nt, Homo sapiens
cagaaaugagaucaggc

SEQ ID NO: 1052410 - RNA, 19 nt, Homo sapiens
cagaaaugccuuacccuca

SEQ ID NO: 1052411 - RNA, 14 nt, Homo sapiens
cagaaauguguuau

SEQ ID NO: 1052412 - RNA, 20 nt, Homo sapiens
cagaacaagaccccgucuca

SEQ ID NO: 1052413 - RNA, 18 nt, Homo sapiens
cagaacacacuccaucag

SEQ ID NO: 1052414 - RNA, 15 nt, Homo sapiens
cagaaccagagcuca

SEQ ID NO: 1052415 - RNA, 23 nt, Homo sapiens
cagaaccauccauaguaguauga

SEQ ID NO: 1052416 - RNA, 18 nt, Homo sapiens
cagaaccccuacaugaaa

SEQ ID NO: 1052417 - RNA, 17 nt, Homo sapiens
cagaaccgcagaagccu

SEQ ID NO: 1052418 - RNA, 20 nt, Homo sapiens
cagaaccucuuccccagaaa

SEQ ID NO: 1052419 - RNA, 14 nt, Homo sapiens
cagaacucuuucaa

SEQ ID NO: 1052420 - RNA, 13 nt, Homo sapiens
cagaacugaaccg

SEQ ID NO: 1052421 - RNA, 20 nt, Homo sapiens
cagaacugcuugaacccagg

SEQ ID NO: 1052422 - RNA, 11 nt, Homo sapiens
cagaagaucug

SEQ ID NO: 1052423 - RNA, 18 nt, Homo sapiens
cagaagccuccccagcuc

SEQ ID NO: 1052424 - RNA, 14 nt, Homo sapiens
cagaaggcucuucu

SEQ ID NO: 1052425 - RNA, 16 nt, Homo sapiens
cagaagugguuuccca

SEQ ID NO: 1052426 - RNA, 14 nt, Homo sapiens
cagaauauacuaaa

SEQ ID NO: 1052427 - RNA, 17 nt, Homo sapiens
cagaaucaaaugcaauu

SEQ ID NO: 1052428 - RNA, 17 nt, Homo sapiens
cagaaucucaaauaacu

SEQ ID NO: 1052429 - RNA, 17 nt, Homo sapiens
cagaaucuguuaccaga

SEQ ID NO: 1052430 - RNA, 17 nt, Homo sapiens
cagaaugacuucugaca

SEQ ID NO: 1052431 - RNA, 18 nt, Homo sapiens
cagaaugcuagcucugag

SEQ ID NO: 1052432 - RNA, 17 nt, Homo sapiens
cagaauucuaagcuggu

SEQ ID NO: 1052433 - RNA, 12 nt, Homo sapiens
cagacaaaugga

SEQ ID NO: 1052434 - RNA, 15 nt, Homo sapiens
cagacaaaugugguu

SEQ ID NO: 1052435 - RNA, 19 nt, Homo sapiens
cagacaacacugggaaaca

SEQ ID NO: 1052436 - RNA, 12 nt, Homo sapiens
cagacaccagca

SEQ ID NO: 1052437 - RNA, 18 nt, Homo sapiens
cagacaccgccacauggc

SEQ ID NO: 1052438 - RNA, 18 nt, Homo sapiens
cagacaggguucauugaa

SEQ ID NO: 1052439 - RNA, 16 nt, Homo sapiens
cagacaucaacagaua

SEQ ID NO: 1052440 - RNA, 17 nt, Homo sapiens
cagacauguggugggac

SEQ ID NO: 1052441 - RNA, 12 nt, Homo sapiens
cagaccacugau

SEQ ID NO: 1052442 - RNA, 16 nt, Homo sapiens
cagaccauucaggaca

SEQ ID NO: 1052443 - RNA, 18 nt, Homo sapiens
cagaccuuaaccaccagg

SEQ ID NO: 1052444 - RNA, 18 nt, Homo sapiens
cagaccuuuuauccacuu

SEQ ID NO: 1052445 - RNA, 17 nt, Homo sapiens
cagacucacauccugac

SEQ ID NO: 1052446 - RNA, 16 nt, Homo sapiens
cagacucaguuuguca

SEQ ID NO: 1052447 - RNA, 20 nt, Homo sapiens
cagacucuacagaggccaug

SEQ ID NO: 1052448 - RNA, 21 nt, Homo sapiens
cagacuguuagaaaauggaca

SEQ ID NO: 1052449 - RNA, 18 nt, Homo sapiens
cagacuuuggaaaaugca

SEQ ID NO: 1052450 - RNA, 19 nt, Homo sapiens
cagacuuuggaaaaugcau

SEQ ID NO: 1052451 - RNA, 23 nt, Homo sapiens
cagacuuuggaaaaugcauugua

SEQ ID NO: 1052452 - RNA, 13 nt, Homo sapiens
cagagaagccaaa

SEQ ID NO: 1052453 - RNA, 21 nt, Homo sapiens
cagagaaguucuggcugaaca

SEQ ID NO: 1052454 - RNA, 18 nt, Homo sapiens
cagagaauauauacauuc

SEQ ID NO: 1052455 - RNA, 15 nt, Homo sapiens
cagagaccaucccug

SEQ ID NO: 1052456 - RNA, 14 nt, Homo sapiens
cagagacuaucuga

SEQ ID NO: 1052457 - RNA, 18 nt, Homo sapiens
caaaagggugucugagcc

SEQ ID NO: 1052458 - RNA, 18 nt, Homo sapiens
caaaaguuucuuacucaa

SEQ ID NO: 1052459 - RNA, 21 nt, Homo sapiens
caaaaguuucuuacucaagga

SEQ ID NO: 1052460 - RNA, 18 nt, Homo sapiens
caaaauaaaaagugacac

SEQ ID NO: 1052461 - RNA, 19 nt, Homo sapiens
caaaauagagaaucccacu

SEQ ID NO: 1052462 - RNA, 15 nt, Homo sapiens
caaaaugauuuugaa

SEQ ID NO: 1052463 - RNA, 17 nt, Homo sapiens
caaaauguaaagccagc

SEQ ID NO: 1052464 - RNA, 18 nt, Homo sapiens
caaaauuacacaguuaau

SEQ ID NO: 1052465 - RNA, 18 nt, Homo sapiens
caaaauucuuaaguaugu

SEQ ID NO: 1052466 - RNA, 12 nt, Homo sapiens
caaacagaacua

SEQ ID NO: 1052467 - RNA, 19 nt, Homo sapiens
caaacagccccucuggaca

SEQ ID NO: 1052468 - RNA, 21 nt, Homo sapiens
caaacagccccucuggacaca

SEQ ID NO: 1052469 - RNA, 22 nt, Homo sapiens
caaacagccccucuggacacag

SEQ ID NO: 1052470 - RNA, 15 nt, Homo sapiens
caaacaugaagugug

SEQ ID NO: 1052471 - RNA, 23 nt, Homo sapiens
caaaccaaccgcacaugcagaug

SEQ ID NO: 1052472 - RNA, 16 nt, Homo sapiens
caaaccaagcaaagga

SEQ ID NO: 1052473 - RNA, 18 nt, Homo sapiens
caaaccauaaacuucaug

SEQ ID NO: 1052474 - RNA, 19 nt, Homo sapiens
caaaccccagggcacugag

SEQ ID NO: 1052475 - RNA, 17 nt, Homo sapiens
caaaccuccacugcugc

SEQ ID NO: 1052476 - RNA, 14 nt, Homo sapiens
caaaccuguuuaaa

SEQ ID NO: 1052477 - RNA, 16 nt, Homo sapiens
caaaccuugaugugcc

SEQ ID NO: 1052478 - RNA, 19 nt, Homo sapiens
caaacguuuugaacuaaua

SEQ ID NO: 1052479 - RNA, 19 nt, Homo sapiens
caaacuaacaggaacaaaa

SEQ ID NO: 1052480 - RNA, 14 nt, Homo sapiens
caaacuacauguaa

SEQ ID NO: 1052481 - RNA, 19 nt, Homo sapiens
caaacucuugguuucuuca

SEQ ID NO: 1052482 - RNA, 22 nt, Homo sapiens
caaacugccuauauugauaaaa

SEQ ID NO: 1052483 - RNA, 21 nt, Homo sapiens
caaacugccuuggcuucaggg

SEQ ID NO: 1052484 - RNA, 22 nt, Homo sapiens
caaacugcugucccaaacaugc

SEQ ID NO: 1052485 - RNA, 16 nt, Homo sapiens
caaacuuccagugcaa

SEQ ID NO: 1052486 - RNA, 14 nt, Homo sapiens
caaagacuauuccc

SEQ ID NO: 1052487 - RNA, 16 nt, Homo sapiens
caaagacuauucccuu

SEQ ID NO: 1052488 - RNA, 14 nt, Homo sapiens
caaagagguauuua

SEQ ID NO: 1052489 - RNA, 16 nt, Homo sapiens
caaagaguguagauca

SEQ ID NO: 1052490 - RNA, 23 nt, Homo sapiens
caaagcaaguuucaucagucaau

SEQ ID NO: 1052491 - RNA, 18 nt, Homo sapiens
caaagcacaguuugaaca

SEQ ID NO: 1052492 - RNA, 11 nt, Homo sapiens
caaagcacuug

SEQ ID NO: 1052493 - RNA, 23 nt, Homo sapiens
caaagcagggucugggcaggacu

SEQ ID NO: 1052494 - RNA, 10 nt, Homo sapiens
caaagccaaa

SEQ ID NO: 1052495 - RNA, 18 nt, Homo sapiens
caaagccaaacucugcca

SEQ ID NO: 1052496 - RNA, 18 nt, Homo sapiens
caaagccaccacauuuag

SEQ ID NO: 1052497 - RNA, 20 nt, Homo sapiens
caaagccuuuggcucuucua

SEQ ID NO: 1052498 - RNA, 20 nt, Homo sapiens
caaaggagggucaggaagga

SEQ ID NO: 1052499 - RNA, 19 nt, Homo sapiens
caaaggcaccugaaugugu

SEQ ID NO: 1052500 - RNA, 23 nt, Homo sapiens
caaaggcacugaggcccagggag

SEQ ID NO: 1052501 - RNA, 23 nt, Homo sapiens
caaaggcccccuacgccaaucaa

SEQ ID NO: 1052502 - RNA, 20 nt, Homo sapiens
caaaggcucucacuccagga

SEQ ID NO: 1052503 - RNA, 22 nt, Homo sapiens
caaaggcugagaacacugugaa

SEQ ID NO: 1052504 - RNA, 16 nt, Homo sapiens
caaagggggaggcuaa

SEQ ID NO: 1052505 - RNA, 17 nt, Homo sapiens
caaaggugauugugcca

SEQ ID NO: 1052506 - RNA, 13 nt, Homo sapiens
caaaguacaugua

SEQ ID NO: 1052507 - RNA, 15 nt, Homo sapiens
caaaguagcaauuuc

SEQ ID NO: 1052508 - RNA, 16 nt, Homo sapiens
caaagucaugcaaagg

SEQ ID NO: 1052509 - RNA, 20 nt, Homo sapiens
caaagugagacuccgucaca

SEQ ID NO: 1052510 - RNA, 17 nt, Homo sapiens
caaagugcugagauuac

SEQ ID NO: 1052511 - RNA, 17 nt, Homo sapiens
caaagugcugcgauuac

SEQ ID NO: 1052512 - RNA, 21 nt, Homo sapiens
caaagugcugcuggaaguaga

SEQ ID NO: 1052513 - RNA, 19 nt, Homo sapiens
caaagugcugggauuacag

SEQ ID NO: 1052514 - RNA, 22 nt, Homo sapiens
caaaguuacugauucacugcau

SEQ ID NO: 1052515 - RNA, 17 nt, Homo sapiens
caaauaaacucuaaaca

SEQ ID NO: 1052516 - RNA, 20 nt, Homo sapiens
caaauaagaagggauggauu

SEQ ID NO: 1052517 - RNA, 22 nt, Homo sapiens
caaauaauaaaaacagaaggaa

SEQ ID NO: 1052518 - RNA, 16 nt, Homo sapiens
caaauacuguguuuca

SEQ ID NO: 1052519 - RNA, 15 nt, Homo sapiens
caaauaugcaaagca

SEQ ID NO: 1052520 - RNA, 18 nt, Homo sapiens
caaaucagaaacuuguga

SEQ ID NO: 1052521 - RNA, 15 nt, Homo sapiens
caaaucagcugcuac

SEQ ID NO: 1052522 - RNA, 17 nt, Homo sapiens
caaauccuaugugauuu

SEQ ID NO: 1052523 - RNA, 18 nt, Homo sapiens
caaaucuuaacuugaagg

SEQ ID NO: 1052524 - RNA, 14 nt, Homo sapiens
caaaugacccaaag

SEQ ID NO: 1052525 - RNA, 16 nt, Homo sapiens
caaaugacccaaagac

SEQ ID NO: 1052526 - RNA, 14 nt, Homo sapiens
caaaugcacaucuc

SEQ ID NO: 1052527 - RNA, 20 nt, Homo sapiens
caaaugccaaaauucauuca

SEQ ID NO: 1052528 - RNA, 15 nt, Homo sapiens
caaaugccacacggc

SEQ ID NO: 1052529 - RNA, 15 nt, Homo sapiens
caaaugcccaaggga

SEQ ID NO: 1052530 - RNA, 16 nt, Homo sapiens
caaaugcuauuugaua

SEQ ID NO: 1052531 - RNA, 13 nt, Homo sapiens
caaaugucaucag

SEQ ID NO: 1052532 - RNA, 14 nt, Homo sapiens
caaauguccuccag

SEQ ID NO: 1052533 - RNA, 13 nt, Homo sapiens
caaaugucuaagg

SEQ ID NO: 1052534 - RNA, 15 nt, Homo sapiens
caaauuaagaaucua

SEQ ID NO: 1052535 - RNA, 18 nt, Homo sapiens
caaauucauauucugucu

SEQ ID NO: 1052536 - RNA, 16 nt, Homo sapiens
caaauucauggugcac

SEQ ID NO: 1052537 - RNA, 19 nt, Homo sapiens
caaauucuguuucuugaga

SEQ ID NO: 1052538 - RNA, 18 nt, Homo sapiens
caaauucuucugaacuca

SEQ ID NO: 1052539 - RNA, 19 nt, Homo sapiens
caaauugcugggauuacag

SEQ ID NO: 1052540 - RNA, 19 nt, Homo sapiens
caaauuugugguccacuga

SEQ ID NO: 1052541 - RNA, 22 nt, Homo sapiens
caacaaaauaaugcacuuccuu

SEQ ID NO: 1052542 - RNA, 19 nt, Homo sapiens
caacaaacuucaaggguuu

SEQ ID NO: 1052543 - RNA, 14 nt, Homo sapiens
caacaagccauagu

SEQ ID NO: 1052544 - RNA, 17 nt, Homo sapiens
caacaauccaucucuca

SEQ ID NO: 1052545 - RNA, 21 nt, Homo sapiens
caacacaauucuucuuccaac

SEQ ID NO: 1052546 - RNA, 22 nt, Homo sapiens
caacaccucugcacaagcugca

SEQ ID NO: 1052547 - RNA, 11 nt, Homo sapiens
caacacuuaag

SEQ ID NO: 1052548 - RNA, 18 nt, Homo sapiens
caacagaagcuuccauuc

SEQ ID NO: 1052549 - RNA, 11 nt, Homo sapiens
caacagcauuu

SEQ ID NO: 1052550 - RNA, 22 nt, Homo sapiens
caacagcccucaggucagggug

SEQ ID NO: 1052551 - RNA, 19 nt, Homo sapiens
caacagcccugucucaaaa

SEQ ID NO: 1052552 - RNA, 17 nt, Homo sapiens
caacaggaggacaauuc

SEQ ID NO: 1052553 - RNA, 22 nt, Homo sapiens
caacagguggcaggaccaggac

SEQ ID NO: 1052554 - RNA, 18 nt, Homo sapiens
caacaguuuuuuaugcua

SEQ ID NO: 1052555 - RNA, 15 nt, Homo sapiens
caacaucaguuuaaa

SEQ ID NO: 1052556 - RNA, 21 nt, Homo sapiens
caacaugaugaaaccccaucu

SEQ ID NO: 1052557 - RNA, 17 nt, Homo sapiens
caacaugcgaccgugac

SEQ ID NO: 1052558 - RNA, 21 nt, Homo sapiens
caacaugguaaaaccccaucu

SEQ ID NO: 1052559 - RNA, 18 nt, Homo sapiens
caacaugugcucagggaa

SEQ ID NO: 1052560 - RNA, 22 nt, Homo sapiens
caacauuacagggaaugccuga

SEQ ID NO: 1052561 - RNA, 18 nt, Homo sapiens
caacauugcuugugccac

SEQ ID NO: 1052562 - RNA, 18 nt, Homo sapiens
caacauuuguuccaugag

SEQ ID NO: 1052563 - RNA, 20 nt, Homo sapiens
caaccaaauggagugacuua

SEQ ID NO: 1052564 - RNA, 20 nt, Homo sapiens
caacccaauaguuguugauu

SEQ ID NO: 1052565 - RNA, 12 nt, Homo sapiens
caaccccaacuc

SEQ ID NO: 1052566 - RNA, 15 nt, Homo sapiens
caacccuguuuccug

SEQ ID NO: 1052567 - RNA, 15 nt, Homo sapiens
caacccuuugcccca

SEQ ID NO: 1052568 - RNA, 12 nt, Homo sapiens
caaccucaguga

SEQ ID NO: 1052569 - RNA, 20 nt, Homo sapiens
caaccucgcuggacucucag

SEQ ID NO: 1052570 - RNA, 21 nt, Homo sapiens
caaccugcucuccucuugcca

SEQ ID NO: 1052571 - RNA, 22 nt, Homo sapiens
caaccugcugaagggcagaggu

SEQ ID NO: 1052572 - RNA, 16 nt, Homo sapiens
caacggcuuagacuuc

SEQ ID NO: 1052573 - RNA, 18 nt, Homo sapiens
caacuaaugccuuacucu

SEQ ID NO: 1052574 - RNA, 17 nt, Homo sapiens
caacuaccuagacugga

SEQ ID NO: 1052575 - RNA, 15 nt, Homo sapiens
caacuacugugauca

SEQ ID NO: 1052576 - RNA, 17 nt, Homo sapiens
caacuauauuaucaugc

SEQ ID NO: 1052577 - RNA, 20 nt, Homo sapiens
caacucugagaucuaaggau

SEQ ID NO: 1052578 - RNA, 20 nt, Homo sapiens
caacugaaaagacucagugu

SEQ ID NO: 1052579 - RNA, 17 nt, Homo sapiens
caacugcugcugugcac

SEQ ID NO: 1052580 - RNA, 21 nt, Homo sapiens
caacuuaagcugggauaauca

SEQ ID NO: 1052581 - RNA, 17 nt, Homo sapiens
caacuuauuauaugacu

SEQ ID NO: 1052582 - RNA, 16 nt, Homo sapiens
caacuugagggcccag

SEQ ID NO: 1052583 - RNA, 13 nt, Homo sapiens
caacuuggcuuuc

SEQ ID NO: 1052584 - RNA, 13 nt, Homo sapiens
caacuuucuuaca

SEQ ID NO: 1052585 - RNA, 17 nt, Homo sapiens
caagaaaguauuuggua

SEQ ID NO: 1052586 - RNA, 23 nt, Homo sapiens
auaguguuggaaaaugugcaaua

SEQ ID NO: 1052587 - RNA, 20 nt, Homo sapiens
auaguucccuagucuauuca

SEQ ID NO: 1052588 - RNA, 15 nt, Homo sapiens
auaguuguaccgcaa

SEQ ID NO: 1052589 - RNA, 20 nt, Homo sapiens
auaguuuaaacugcauuaua

SEQ ID NO: 1052590 - RNA, 14 nt, Homo sapiens
auaguuuaccugaa

SEQ ID NO: 1052591 - RNA, 19 nt, Homo sapiens
auaguuuuucauuguacca

SEQ ID NO: 1052592 - RNA, 15 nt, Homo sapiens
auauaaaguguaaua

SEQ ID NO: 1052593 - RNA, 20 nt, Homo sapiens
auauaacaagugggugaaug

SEQ ID NO: 1052594 - RNA, 16 nt, Homo sapiens
auauaaggaaagcaau

SEQ ID NO: 1052595 - RNA, 11 nt, Homo sapiens
auauaauacug

SEQ ID NO: 1052596 - RNA, 15 nt, Homo sapiens
auauaauacugacug

SEQ ID NO: 1052597 - RNA, 14 nt, Homo sapiens
auauaauacuguau

SEQ ID NO: 1052598 - RNA, 15 nt, Homo sapiens
auauaauacuguauu

SEQ ID NO: 1052599 - RNA, 20 nt, Homo sapiens
auauacaggccucaagggga

SEQ ID NO: 1052600 - RNA, 12 nt, Homo sapiens
auauaccaagcu

SEQ ID NO: 1052601 - RNA, 12 nt, Homo sapiens
auauacuaugag

SEQ ID NO: 1052602 - RNA, 18 nt, Homo sapiens
auauacuauuuucauucu

SEQ ID NO: 1052603 - RNA, 21 nt, Homo sapiens
auauacuauuuucauucucuu

SEQ ID NO: 1052604 - RNA, 15 nt, Homo sapiens
auauagaacagugcu

SEQ ID NO: 1052605 - RNA, 22 nt, Homo sapiens
auauaugacugcuucaugacau

SEQ ID NO: 1052606 - RNA, 23 nt, Homo sapiens
auauauuuuugguugucaauauu

SEQ ID NO: 1052607 - RNA, 17 nt, Homo sapiens
auaucaaaaaguauuaa

SEQ ID NO: 1052608 - RNA, 20 nt, Homo sapiens
auaucaguuuuuacuuucuc

SEQ ID NO: 1052609 - RNA, 14 nt, Homo sapiens
auaucaucagcaua

SEQ ID NO: 1052610 - RNA, 23 nt, Homo sapiens
auaucaugccccuguacuccagc

SEQ ID NO: 1052611 - RNA, 14 nt, Homo sapiens
auaucaugcuccau

SEQ ID NO: 1052612 - RNA, 16 nt, Homo sapiens
auaucugaaaauguau

SEQ ID NO: 1052613 - RNA, 20 nt, Homo sapiens
auaucugaagagcuauuaua

SEQ ID NO: 1052614 - RNA, 21 nt, Homo sapiens
auaucugggauucuacuuuaa

SEQ ID NO: 1052615 - RNA, 18 nt, Homo sapiens
auaugaacuggaccugca

SEQ ID NO: 1052616 - RNA, 14 nt, Homo sapiens
auaugaagacauaa

SEQ ID NO: 1052617 - RNA, 17 nt, Homo sapiens
auaugaaugucaguagu

SEQ ID NO: 1052618 - RNA, 15 nt, Homo sapiens
auaugauugugcaca

SEQ ID NO: 1052619 - RNA, 11 nt, Homo sapiens
auaugcaauau

SEQ ID NO: 1052620 - RNA, 22 nt, Homo sapiens
auaugcagugauauggcagaag

SEQ ID NO: 1052621 - RNA, 18 nt, Homo sapiens
auaugccauaaaccucaa

SEQ ID NO: 1052622 - RNA, 18 nt, Homo sapiens
auaugcuaauauauguau

SEQ ID NO: 1052623 - RNA, 14 nt, Homo sapiens
auaugcugccaaau

SEQ ID NO: 1052624 - RNA, 20 nt, Homo sapiens
auaugcuuggcuaacuauau

SEQ ID NO: 1052625 - RNA, 21 nt, Homo sapiens
auauggacucugcacaugaau

SEQ ID NO: 1052626 - RNA, 23 nt, Homo sapiens
auauggaugauucagaaauugga

SEQ ID NO: 1052627 - RNA, 20 nt, Homo sapiens
auaugggguugguguucuca

SEQ ID NO: 1052628 - RNA, 19 nt, Homo sapiens
auauguaaauagugcagaa

SEQ ID NO: 1052629 - RNA, 14 nt, Homo sapiens
auauguaccaugua

SEQ ID NO: 1052630 - RNA, 17 nt, Homo sapiens
auaugucaaaggucuaa

SEQ ID NO: 1052631 - RNA, 14 nt, Homo sapiens
auaugugcuugccu

SEQ ID NO: 1052632 - RNA, 17 nt, Homo sapiens
auauguguauguacguu

SEQ ID NO: 1052633 - RNA, 21 nt, Homo sapiens
auauguucacaccuagcguca

SEQ ID NO: 1052634 - RNA, 22 nt, Homo sapiens
auauguugaugaaaaauagcaa

SEQ ID NO: 1052635 - RNA, 23 nt, Homo sapiens
auauguugaugaaaaauagcaac

SEQ ID NO: 1052636 - RNA, 21 nt, Homo sapiens
auauguuuuaagaggcagggu

SEQ ID NO: 1052637 - RNA, 19 nt, Homo sapiens
auauuaaaagucacucuga

SEQ ID NO: 1052638 - RNA, 22 nt, Homo sapiens
auauuacacaucaagcgaugaa

SEQ ID NO: 1052639 - RNA, 14 nt, Homo sapiens
auauuagaugugau

SEQ ID NO: 1052640 - RNA, 16 nt, Homo sapiens
auauuagaugugauuu

SEQ ID NO: 1052641 - RNA, 18 nt, Homo sapiens
auauucauuucaaaggga

SEQ ID NO: 1052642 - RNA, 13 nt, Homo sapiens
auauucauuugga

SEQ ID NO: 1052643 - RNA, 22 nt, Homo sapiens
auauuccauauauuagcauuua

SEQ ID NO: 1052644 - RNA, 23 nt, Homo sapiens
auauugaacuuuuuuccacugaa

SEQ ID NO: 1052645 - RNA, 19 nt, Homo sapiens
auauugauaaaaccauaca

SEQ ID NO: 1052646 - RNA, 15 nt, Homo sapiens
auauuggacugauaa

SEQ ID NO: 1052647 - RNA, 14 nt, Homo sapiens
auauuuacagugaa

SEQ ID NO: 1052648 - RNA, 20 nt, Homo sapiens
auauuuauuuaacuauucau

SEQ ID NO: 1052649 - RNA, 13 nt, Homo sapiens
auauuucaggcau

SEQ ID NO: 1052650 - RNA, 14 nt, Homo sapiens
auauuucaggcaua

SEQ ID NO: 1052651 - RNA, 15 nt, Homo sapiens
auauuuucaccauuu

SEQ ID NO: 1052652 - RNA, 14 nt, Homo sapiens
auauuuucugugcc

SEQ ID NO: 1052653 - RNA, 19 nt, Homo sapiens
auauuuugcuuugugauuu

SEQ ID NO: 1052654 - RNA, 18 nt, Homo sapiens
aucaaaagcuuauucauc

SEQ ID NO: 1052655 - RNA, 23 nt, Homo sapiens
aucaaaucugcuuuuuaaagaau

SEQ ID NO: 1052656 - RNA, 22 nt, Homo sapiens
aucaaaugugacauuauaugca

SEQ ID NO: 1052657 - RNA, 18 nt, Homo sapiens
aucaacaucuuggucaga

SEQ ID NO: 1052658 - RNA, 14 nt, Homo sapiens
aucaacucuaauag

SEQ ID NO: 1052659 - RNA, 19 nt, Homo sapiens
aucaacuuauuauaugacu

SEQ ID NO: 1052660 - RNA, 14 nt, Homo sapiens
aucaaguccuacaa

SEQ ID NO: 1052661 - RNA, 14 nt, Homo sapiens
aucaagugucuucc

SEQ ID NO: 1052662 - RNA, 15 nt, Homo sapiens
aucaagugucuucca

SEQ ID NO: 1052663 - RNA, 21 nt, Homo sapiens
aucaagugugcuuuagcuuga

SEQ ID NO: 1052664 - RNA, 19 nt, Homo sapiens
aucaauagaaggauguaca

SEQ ID NO: 1052665 - RNA, 18 nt, Homo sapiens
aucaaugaaaugauguca

SEQ ID NO: 1052666 - RNA, 23 nt, Homo sapiens
aucaauggcgcagugccucuggu

SEQ ID NO: 1052667 - RNA, 11 nt, Homo sapiens
aucaaugucac

SEQ ID NO: 1052668 - RNA, 16 nt, Homo sapiens
aucaaugucacuuaaa

SEQ ID NO: 1052669 - RNA, 19 nt, Homo sapiens
aucacaacauuuacuuaac

SEQ ID NO: 1052670 - RNA, 23 nt, Homo sapiens
aucacaccguccuccacgccauu

SEQ ID NO: 1052671 - RNA, 23 nt, Homo sapiens
aucacacgucuggcuucacagau

SEQ ID NO: 1052672 - RNA, 16 nt, Homo sapiens
aucacagccucugaaa

SEQ ID NO: 1052673 - RNA, 21 nt, Homo sapiens
aucacagcuaacaauugugaa

SEQ ID NO: 1052674 - RNA, 23 nt, Homo sapiens
aucacaguuuugguugcuuuaau

SEQ ID NO: 1052675 - RNA, 21 nt, Homo sapiens
aucacaugaccacauagcaug

SEQ ID NO: 1052676 - RNA, 18 nt, Homo sapiens
aucacaugcucaaugacu

SEQ ID NO: 1052677 - RNA, 19 nt, Homo sapiens
aucacauguuuucucugga

SEQ ID NO: 1052678 - RNA, 15 nt, Homo sapiens
aucacauuaucaucu

SEQ ID NO: 1052679 - RNA, 18 nt, Homo sapiens
aucacauuaucaucugaa

SEQ ID NO: 1052680 - RNA, 21 nt, Homo sapiens
aucacauuauuugcauguuac

SEQ ID NO: 1052681 - RNA, 19 nt, Homo sapiens
aucacauucgaguguuuca

SEQ ID NO: 1052682 - RNA, 11 nt, Homo sapiens
aucaccagaca

SEQ ID NO: 1052683 - RNA, 13 nt, Homo sapiens
aucaccagagguc

SEQ ID NO: 1052684 - RNA, 14 nt, Homo sapiens
aucacccuuaccau

SEQ ID NO: 1052685 - RNA, 17 nt, Homo sapiens
aucaccuccaccauacu

SEQ ID NO: 1052686 - RNA, 18 nt, Homo sapiens
aucaccuuaggcagggaa

SEQ ID NO: 1052687 - RNA, 15 nt, Homo sapiens
aucacgccacugcac

SEQ ID NO: 1052688 - RNA, 16 nt, Homo sapiens
aucacgccauugcacu

SEQ ID NO: 1052689 - RNA, 21 nt, Homo sapiens
aucacgccauugcacuccagc

SEQ ID NO: 1052690 - RNA, 17 nt, Homo sapiens
aucacgccugugcagug

SEQ ID NO: 1052691 - RNA, 19 nt, Homo sapiens
aucacuaagggauggggca

SEQ ID NO: 1052692 - RNA, 12 nt, Homo sapiens
aucacuacugca

SEQ ID NO: 1052693 - RNA, 23 nt, Homo sapiens
aucacuagccaugauaacugcaa

SEQ ID NO: 1052694 - RNA, 20 nt, Homo sapiens
aucacugauagaauccaguu

SEQ ID NO: 1052695 - RNA, 12 nt, Homo sapiens
aucacuuccacu

SEQ ID NO: 1052696 - RNA, 18 nt, Homo sapiens
aucacuucccuacaugga

SEQ ID NO: 1052697 - RNA, 19 nt, Homo sapiens
aucacuucugagaacucau

SEQ ID NO: 1052698 - RNA, 23 nt, Homo sapiens
aucacuugaacccgggaggcaga

SEQ ID NO: 1052699 - RNA, 20 nt, Homo sapiens
aucacuuucucaguuuucau

SEQ ID NO: 1052700 - RNA, 17 nt, Homo sapiens
aucagaaucauugaagu

SEQ ID NO: 1052701 - RNA, 16 nt, Homo sapiens
aucagagagcucacua

SEQ ID NO: 1052702 - RNA, 12 nt, Homo sapiens
aucagaguugcu

SEQ ID NO: 1052703 - RNA, 22 nt, Homo sapiens
aucagaugcuuuccugcacauu

SEQ ID NO: 1052704 - RNA, 22 nt, Homo sapiens
aucagauugcaugugacucuga

SEQ ID NO: 1052705 - RNA, 22 nt, Homo sapiens
aucagcacuccucaucaucacu

SEQ ID NO: 1052706 - RNA, 18 nt, Homo sapiens
aucagcagagaacuggaa

SEQ ID NO: 1052707 - RNA, 15 nt, Homo sapiens
aucagcauuuuacua

SEQ ID NO: 1052708 - RNA, 14 nt, Homo sapiens
aucagccaugugcu

SEQ ID NO: 1052709 - RNA, 18 nt, Homo sapiens
aucagcggccccuugacu

SEQ ID NO: 1052710 - RNA, 16 nt, Homo sapiens
aucagcuuaggggcug

SEQ ID NO: 1052711 - RNA, 18 nt, Homo sapiens
aucagcuucagaauggca

SEQ ID NO: 1052712 - RNA, 15 nt, Homo sapiens
aucaggacccagagg

SEQ ID NO: 1052713 - RNA, 18 nt, Homo sapiens
aucaguauaauucuguac

SEQ ID NO: 1052714 - RNA, 22 nt, Homo sapiens
aucaguauaauucuguacugau

SEQ ID NO: 1052715 - RNA, 20 nt, Homo sapiens
aucaguguccucuugcucaa

SEQ ID NO: 1052716 - RNA, 21 nt, Homo sapiens
aucaguuagagcugacacaaa

SEQ ID NO: 1052717 - RNA, 12 nt, Homo sapiens
aucaguuugacu

SEQ ID NO: 1052718 - RNA, 16 nt, Homo sapiens
aucauaaaacuugaug

SEQ ID NO: 1052719 - RNA, 21 nt, Homo sapiens
aucauacaugacucagcauac

SEQ ID NO: 1052720 - RNA, 22 nt, Homo sapiens
aucauaugguugacaguaugca

SEQ ID NO: 1052721 - RNA, 13 nt, Homo sapiens
aucaucacucauc

SEQ ID NO: 1052722 - RNA, 14 nt, Homo sapiens
aucaucauucucau

SEQ ID NO: 1052723 - RNA, 19 nt, Homo sapiens
aucauccagaaguuccuca

SEQ ID NO: 1052724 - RNA, 14 nt, Homo sapiens
aucaucuguggaac

SEQ ID NO: 1052725 - RNA, 12 nt, Homo sapiens
aucaugagauaa

SEQ ID NO: 1052726 - RNA, 19 nt, Homo sapiens
aucaugcaaaugcuguauu

SEQ ID NO: 1052727 - RNA, 20 nt, Homo sapiens
aucauguccccaaaccugca

SEQ ID NO: 1052728 - RNA, 15 nt, Homo sapiens
aucauguguguccac

SEQ ID NO: 1052729 - RNA, 12 nt, Homo sapiens
aucauuagaaca

SEQ ID NO: 1052730 - RNA, 15 nt, Homo sapiens
aucauuaucagccug

SEQ ID NO: 1052731 - RNA, 17 nt, Homo sapiens
aucauucaaguguaaaa

SEQ ID NO: 1052732 - RNA, 16 nt, Homo sapiens
aucauucucauucuca

SEQ ID NO: 1052733 - RNA, 17 nt, Homo sapiens
auccaaagcugaauaca

SEQ ID NO: 1052734 - RNA, 15 nt, Homo sapiens
auccacaaucugaca

SEQ ID NO: 1052735 - RNA, 15 nt, Homo sapiens
auccacacugcacac

SEQ ID NO: 1052736 - RNA, 22 nt, Homo sapiens
auccacagagagucccacugcc

SEQ ID NO: 1052737 - RNA, 14 nt, Homo sapiens
auccacaugggagc

SEQ ID NO: 1052738 - RNA, 15 nt, Homo sapiens
auccaccaccucccu

SEQ ID NO: 1052739 - RNA, 11 nt, Homo sapiens
auccacccacc

SEQ ID NO: 1052740 - RNA, 14 nt, Homo sapiens
auccacccaccuca

SEQ ID NO: 1052741 - RNA, 23 nt, Homo sapiens
auccaccgccacugggccuguca

SEQ ID NO: 1052742 - RNA, 12 nt, Homo sapiens
auccaccugccu

SEQ ID NO: 1052743 - RNA, 13 nt, Homo sapiens
auccacugugcca

SEQ ID NO: 1052744 - RNA, 15 nt, Homo sapiens
auccacugugccaug

SEQ ID NO: 1052745 - RNA, 15 nt, Homo sapiens
auccacuucucucag

SEQ ID NO: 1052746 - RNA, 15 nt, Homo sapiens
auccacuucuuucag

SEQ ID NO: 1052747 - RNA, 17 nt, Homo sapiens
auccagcuccccuucug

SEQ ID NO: 1052748 - RNA, 17 nt, Homo sapiens
auccaggacucugucaa

SEQ ID NO: 1052749 - RNA, 19 nt, Homo sapiens
auccaggcgugguggcaca

SEQ ID NO: 1052750 - RNA, 16 nt, Homo sapiens
auccagugauccuuac

SEQ ID NO: 1052751 - RNA, 20 nt, Homo sapiens
auccauaaagaagcaauaaa

SEQ ID NO: 1052752 - RNA, 15 nt, Homo sapiens
auccauaauuauuaa

SEQ ID NO: 1052753 - RNA, 22 nt, Homo sapiens
auccaucacuagccaugauaac

SEQ ID NO: 1052754 - RNA, 13 nt, Homo sapiens
auccauccaaagg

SEQ ID NO: 1052755 - RNA, 23 nt, Homo sapiens
auccaugcaccccaccagcaaua

SEQ ID NO: 1052756 - RNA, 18 nt, Homo sapiens
auccauguguggacucaa

SEQ ID NO: 1052757 - RNA, 21 nt, Homo sapiens
auccauguuaguuuuuacuuu

SEQ ID NO: 1052758 - RNA, 16 nt, Homo sapiens
auccauuaucaugugu

SEQ ID NO: 1052759 - RNA, 20 nt, Homo sapiens
auccauucuuaaaguacuug

SEQ ID NO: 1052760 - RNA, 14 nt, Homo sapiens
aucccacaaucuua

SEQ ID NO: 1052761 - RNA, 21 nt, Homo sapiens
aucccacugggagcacuuugu

SEQ ID NO: 1052762 - RNA, 15 nt, Homo sapiens
aucccagcuacucaa

SEQ ID NO: 1052763 - RNA, 15 nt, Homo sapiens
aucccaugagccuca

SEQ ID NO: 1052764 - RNA, 18 nt, Homo sapiens
auccccaagugugaacaa

SEQ ID NO: 1052765 - RNA, 15 nt, Homo sapiens
aucccccagccucaa

SEQ ID NO: 1052766 - RNA, 22 nt, Homo sapiens
auccccuaagcagaccacugau

SEQ ID NO: 1052767 - RNA, 20 nt, Homo sapiens
auuguugaaagguaauuuga

SEQ ID NO: 1052768 - RNA, 22 nt, Homo sapiens
auuguuggcacauccuaugcaa

SEQ ID NO: 1052769 - RNA, 19 nt, Homo sapiens
auuguuguuaauaggucuu

SEQ ID NO: 1052770 - RNA, 17 nt, Homo sapiens
auuguuuucaguguaca

SEQ ID NO: 1052771 - RNA, 22 nt, Homo sapiens
auuguuuucaguguacauggaa

SEQ ID NO: 1052772 - RNA, 21 nt, Homo sapiens
auuuaaaacagacacuggcau

SEQ ID NO: 1052773 - RNA, 14 nt, Homo sapiens
auuuaaaacuugcc

SEQ ID NO: 1052774 - RNA, 18 nt, Homo sapiens
auuuaaaagcaucucagc

SEQ ID NO: 1052775 - RNA, 17 nt, Homo sapiens
auuuaacagucauuuaa

SEQ ID NO: 1052776 - RNA, 22 nt, Homo sapiens
auuuaaccaaccuaagggccca

SEQ ID NO: 1052777 - RNA, 14 nt, Homo sapiens
auuuaacuauucau

SEQ ID NO: 1052778 - RNA, 12 nt, Homo sapiens
auuuaauaacau

SEQ ID NO: 1052779 - RNA, 15 nt, Homo sapiens
auuuaauccucucaa

SEQ ID NO: 1052780 - RNA, 17 nt, Homo sapiens
auuuacaacaaacaccu

SEQ ID NO: 1052781 - RNA, 21 nt, Homo sapiens
auuuacaugaauugcauuuua

SEQ ID NO: 1052782 - RNA, 12 nt, Homo sapiens
auuuacauguau

SEQ ID NO: 1052783 - RNA, 12 nt, Homo sapiens
auuuacuguggc

SEQ ID NO: 1052784 - RNA, 17 nt, Homo sapiens
auuuacuguggcuucuu

SEQ ID NO: 1052785 - RNA, 21 nt, Homo sapiens
auuuacuguggcuucuuaauc

SEQ ID NO: 1052786 - RNA, 23 nt, Homo sapiens
auuuacuguggcuucuuaaucuu

SEQ ID NO: 1052787 - RNA, 18 nt, Homo sapiens
auuuagaacuguauguca

SEQ ID NO: 1052788 - RNA, 21 nt, Homo sapiens
auuuagacucaucuuacugua

SEQ ID NO: 1052789 - RNA, 21 nt, Homo sapiens
auuuagccaccaucuuugcag

SEQ ID NO: 1052790 - RNA, 18 nt, Homo sapiens
auuuaguaacaguuguga

SEQ ID NO: 1052791 - RNA, 17 nt, Homo sapiens
auuuauaaucacuuuuu

SEQ ID NO: 1052792 - RNA, 13 nt, Homo sapiens
auuuauacuguau

SEQ ID NO: 1052793 - RNA, 12 nt, Homo sapiens
auuuaugaaggc

SEQ ID NO: 1052794 - RNA, 14 nt, Homo sapiens
auuuaugagucuca

SEQ ID NO: 1052795 - RNA, 13 nt, Homo sapiens
auuuaugugaugg

SEQ ID NO: 1052796 - RNA, 17 nt, Homo sapiens
auuuauuaccucugaua

SEQ ID NO: 1052797 - RNA, 16 nt, Homo sapiens
auuuauuccauauuca

SEQ ID NO: 1052798 - RNA, 16 nt, Homo sapiens
auuuauuuauggagga

SEQ ID NO: 1052799 - RNA, 14 nt, Homo sapiens
auuucaauuccugu

SEQ ID NO: 1052800 - RNA, 19 nt, Homo sapiens
auuucagaucauauuucac

SEQ ID NO: 1052801 - RNA, 23 nt, Homo sapiens
auuucagguuuuguaaagaugcc

SEQ ID NO: 1052802 - RNA, 20 nt, Homo sapiens
auuucaugauuucauuucaa

SEQ ID NO: 1052803 - RNA, 14 nt, Homo sapiens
auuucaugugucaa

SEQ ID NO: 1052804 - RNA, 22 nt, Homo sapiens
auuuccaaaccuccacugcugc

SEQ ID NO: 1052805 - RNA, 14 nt, Homo sapiens
auuuccaacaccac

SEQ ID NO: 1052806 - RNA, 16 nt, Homo sapiens
auuuccaacaccacag

SEQ ID NO: 1052807 - RNA, 23 nt, Homo sapiens
auuuccccaccccagcucaugcc

SEQ ID NO: 1052808 - RNA, 21 nt, Homo sapiens
auuuccuaggcugacuaagaa

SEQ ID NO: 1052809 - RNA, 13 nt, Homo sapiens
auuuccucugggc

SEQ ID NO: 1052810 - RNA, 13 nt, Homo sapiens
auuuccuugccuu

SEQ ID NO: 1052811 - RNA, 12 nt, Homo sapiens
auuucuauucaa

SEQ ID NO: 1052812 - RNA, 16 nt, Homo sapiens
auuucuccuccauggg

SEQ ID NO: 1052813 - RNA, 15 nt, Homo sapiens
auuucugaccuugua

SEQ ID NO: 1052814 - RNA, 21 nt, Homo sapiens
auuucugaccuuguaccucuc

SEQ ID NO: 1052815 - RNA, 15 nt, Homo sapiens
auuucugcaucagcu

SEQ ID NO: 1052816 - RNA, 14 nt, Homo sapiens
auuucuguucuucc

SEQ ID NO: 1052817 - RNA, 19 nt, Homo sapiens
auuucuucacucaaucucu

SEQ ID NO: 1052818 - RNA, 16 nt, Homo sapiens
auuucuuguugcucaa

SEQ ID NO: 1052819 - RNA, 19 nt, Homo sapiens
auuugaacucuucaaucuc

SEQ ID NO: 1052820 - RNA, 17 nt, Homo sapiens
auuugaaggucugcaag

SEQ ID NO: 1052821 - RNA, 11 nt, Homo sapiens
auuugagacag

SEQ ID NO: 1052822 - RNA, 19 nt, Homo sapiens
auuugaggucaaguaagaa

SEQ ID NO: 1052823 - RNA, 13 nt, Homo sapiens
auuugagugcucu

SEQ ID NO: 1052824 - RNA, 17 nt, Homo sapiens
auuugaguuuauaucuc

SEQ ID NO: 1052825 - RNA, 15 nt, Homo sapiens
auuugauaguauugu

SEQ ID NO: 1052826 - RNA, 14 nt, Homo sapiens
auuugcaagacaua

SEQ ID NO: 1052827 - RNA, 23 nt, Homo sapiens
auuugcacccaccuuucugcaca

SEQ ID NO: 1052828 - RNA, 11 nt, Homo sapiens
auuugcacuau

SEQ ID NO: 1052829 - RNA, 14 nt, Homo sapiens
auuugcagagacag

SEQ ID NO: 1052830 - RNA, 19 nt, Homo sapiens
auuugcauaacaauuccuc

SEQ ID NO: 1052831 - RNA, 12 nt, Homo sapiens
auuugcugcuau

SEQ ID NO: 1052832 - RNA, 15 nt, Homo sapiens
auuugguguacaauu

SEQ ID NO: 1052833 - RNA, 20 nt, Homo sapiens
auuuguaaauuuaugugaug

SEQ ID NO: 1052834 - RNA, 17 nt, Homo sapiens
auuuguaauugaacuua

SEQ ID NO: 1052835 - RNA, 20 nt, Homo sapiens
auuuguaauugaacuuaucc

SEQ ID NO: 1052836 - RNA, 21 nt, Homo sapiens
auuugucaacaaagucaccca

SEQ ID NO: 1052837 - RNA, 20 nt, Homo sapiens
auuugucccuaugcauauca

SEQ ID NO: 1052838 - RNA, 21 nt, Homo sapiens
auuugugguccacugagcuau

SEQ ID NO: 1052839 - RNA, 14 nt, Homo sapiens
auuuguuugugcau

SEQ ID NO: 1052840 - RNA, 18 nt, Homo sapiens
auuuuaaaaacuaaaaag

SEQ ID NO: 1052841 - RNA, 18 nt, Homo sapiens
auuuuaaaucauuaggaa

SEQ ID NO: 1052842 - RNA, 14 nt, Homo sapiens
auuuuaacucuguc

SEQ ID NO: 1052843 - RNA, 22 nt, Homo sapiens
auuuuaacuuccuuggacucau

SEQ ID NO: 1052844 - RNA, 13 nt, Homo sapiens
auuuuaagugcuu

SEQ ID NO: 1052845 - RNA, 16 nt, Homo sapiens
auuuuaauguuuccuu

SEQ ID NO: 1052846 - RNA, 13 nt, Homo sapiens
auuuuaauuaucu

SEQ ID NO: 1052847 - RNA, 17 nt, Homo sapiens
auuuuacccuuuagacu

SEQ ID NO: 1052848 - RNA, 21 nt, Homo sapiens
auuuuagccguacuuugcuaa

SEQ ID NO: 1052849 - RNA, 15 nt, Homo sapiens
auuuuagcuacuaua

SEQ ID NO: 1052850 - RNA, 14 nt, Homo sapiens
auuuuauacauuaa

SEQ ID NO: 1052851 - RNA, 13 nt, Homo sapiens
auuuuaugcugcu

SEQ ID NO: 1052852 - RNA, 15 nt, Homo sapiens
auuuuaugcuuuaaa

SEQ ID NO: 1052853 - RNA, 18 nt, Homo sapiens
auuuuauuacaucuuuca

SEQ ID NO: 1052854 - RNA, 20 nt, Homo sapiens
auuuuauuuuuuucuaccuu

SEQ ID NO: 1052855 - RNA, 18 nt, Homo sapiens
auuuucaaauucuacuga

SEQ ID NO: 1052856 - RNA, 24 nt, Homo sapiens
auuuucaagaauaaucacgcuuuc

SEQ ID NO: 1052857 - RNA, 14 nt, Homo sapiens
auuuucaguauaau

SEQ ID NO: 1052858 - RNA, 21 nt, Homo sapiens
auuuuccgcccucaaaaugac

SEQ ID NO: 1052859 - RNA, 18 nt, Homo sapiens
auuuuccugcauaaucau

SEQ ID NO: 1052860 - RNA, 23 nt, Homo sapiens
auuuucucccaggaagcuuugau

SEQ ID NO: 1052861 - RNA, 21 nt, Homo sapiens
auuuucucuaaaauuucaaca

SEQ ID NO: 1052862 - RNA, 15 nt, Homo sapiens
auuuucugcauuuaa

SEQ ID NO: 1052863 - RNA, 23 nt, Homo sapiens
auuuugacacuauaucuguauau

SEQ ID NO: 1052864 - RNA, 17 nt, Homo sapiens
auuuugcauaguaccaa

SEQ ID NO: 1052865 - RNA, 18 nt, Homo sapiens
auuuugccauaaagucaa

SEQ ID NO: 1052866 - RNA, 11 nt, Homo sapiens
auuuugcccag

SEQ ID NO: 1052867 - RNA, 20 nt, Homo sapiens
auuuugcccaggcaacagua

SEQ ID NO: 1052868 - RNA, 11 nt, Homo sapiens
auuuugcucaa

SEQ ID NO: 1052869 - RNA, 12 nt, Homo sapiens
auuuugcucaac

SEQ ID NO: 1052870 - RNA, 20 nt, Homo sapiens
auuuugggguacccacugcu

SEQ ID NO: 1052871 - RNA, 15 nt, Homo sapiens
auuuuguaccagugg

SEQ ID NO: 1052872 - RNA, 16 nt, Homo sapiens
auuuuguauuuuccaa

SEQ ID NO: 1052873 - RNA, 16 nt, Homo sapiens
auuuuguggucauuaa

SEQ ID NO: 1052874 - RNA, 19 nt, Homo sapiens
auuuuguuuuugucuuaaa

SEQ ID NO: 1052875 - RNA, 16 nt, Homo sapiens
auuuuuagacagaguc

SEQ ID NO: 1052876 - RNA, 17 nt, Homo sapiens
auuuuucagcuccuuca

SEQ ID NO: 1052877 - RNA, 23 nt, Homo sapiens
auuuuuccccaaaaagaauggga

SEQ ID NO: 1052878 - RNA, 16 nt, Homo sapiens
auuuuucucuaacuca

SEQ ID NO: 1052879 - RNA, 14 nt, Homo sapiens
auuuuugucuuaua

SEQ ID NO: 1052880 - RNA, 17 nt, Homo sapiens
auuuuuuaaggaaacaa

SEQ ID NO: 1052881 - RNA, 21 nt, Homo sapiens
caaaaaaaguucagcaugaag

SEQ ID NO: 1052882 - RNA, 16 nt, Homo sapiens
caaaaaacugcaguga

SEQ ID NO: 1052883 - RNA, 22 nt, Homo sapiens
caaaaaaucucaauucuucccu

SEQ ID NO: 1052884 - RNA, 21 nt, Homo sapiens
caaaaacaaaaaacugcagug

SEQ ID NO: 1052885 - RNA, 13 nt, Homo sapiens
caaaaacaagcaa

SEQ ID NO: 1052886 - RNA, 14 nt, Homo sapiens
caaaaacacagugu

SEQ ID NO: 1052887 - RNA, 14 nt, Homo sapiens
caaaaacauggccu

SEQ ID NO: 1052888 - RNA, 12 nt, Homo sapiens
caaaaacugaaa

SEQ ID NO: 1052889 - RNA, 13 nt, Homo sapiens
caaaaagacauua

SEQ ID NO: 1052890 - RNA, 14 nt, Homo sapiens
caaaaagacugugg

SEQ ID NO: 1052891 - RNA, 13 nt, Homo sapiens
caaaaaguuccau

SEQ ID NO: 1052892 - RNA, 17 nt, Homo sapiens
caaaaauagacaacugu

SEQ ID NO: 1052893 - RNA, 21 nt, Homo sapiens
caaaaauauaccuucagagac

SEQ ID NO: 1052894 - RNA, 21 nt, Homo sapiens
agucagagagggugacaagau

SEQ ID NO: 1052895 - RNA, 14 nt, Homo sapiens
agucagaugcccag

SEQ ID NO: 1052896 - RNA, 23 nt, Homo sapiens
agucaggccuuaauuuucaguau

SEQ ID NO: 1052897 - RNA, 18 nt, Homo sapiens
agucaucuccaucagcug

SEQ ID NO: 1052898 - RNA, 18 nt, Homo sapiens
agucaucuugaccaagca

SEQ ID NO: 1052899 - RNA, 20 nt, Homo sapiens
agucaugagcugagcaggga

SEQ ID NO: 1052900 - RNA, 20 nt, Homo sapiens
agucaugcguuuaaucacau

SEQ ID NO: 1052901 - RNA, 21 nt, Homo sapiens
aguccaagaggguccuuuagu

SEQ ID NO: 1052902 - RNA, 14 nt, Homo sapiens
aguccaauuccuug

SEQ ID NO: 1052903 - RNA, 13 nt, Homo sapiens
aguccacucccag

SEQ ID NO: 1052904 - RNA, 19 nt, Homo sapiens
aguccagauuuacacuggg

SEQ ID NO: 1052905 - RNA, 14 nt, Homo sapiens
aguccauauuucaa

SEQ ID NO: 1052906 - RNA, 21 nt, Homo sapiens
agucccucaugcaaaucaauu

SEQ ID NO: 1052907 - RNA, 13 nt, Homo sapiens
agucccugacucu

SEQ ID NO: 1052908 - RNA, 23 nt, Homo sapiens
agucccugacucucugugaccug

SEQ ID NO: 1052909 - RNA, 18 nt, Homo sapiens
agucccuuugugacuuca

SEQ ID NO: 1052910 - RNA, 14 nt, Homo sapiens
aguccuauuugcac

SEQ ID NO: 1052911 - RNA, 12 nt, Homo sapiens
aguccucugaau

SEQ ID NO: 1052912 - RNA, 12 nt, Homo sapiens
aguccucugcau

SEQ ID NO: 1052913 - RNA, 15 nt, Homo sapiens
aguccuucccuuuca

SEQ ID NO: 1052914 - RNA, 22 nt, Homo sapiens
aguccuuuacuaauccaaccca

SEQ ID NO: 1052915 - RNA, 12 nt, Homo sapiens
aguccuuuccaa

SEQ ID NO: 1052916 - RNA, 15 nt, Homo sapiens
agucgaacaauucau

SEQ ID NO: 1052917 - RNA, 17 nt, Homo sapiens
agucgagcuuuucuaaa

SEQ ID NO: 1052918 - RNA, 19 nt, Homo sapiens
agucuaccccugcuaagga

SEQ ID NO: 1052919 - RNA, 16 nt, Homo sapiens
agucucacucugucac

SEQ ID NO: 1052920 - RNA, 23 nt, Homo sapiens
agucucacugugggaaggccagc

SEQ ID NO: 1052921 - RNA, 22 nt, Homo sapiens
agucucucuggggccacacaga

SEQ ID NO: 1052922 - RNA, 21 nt, Homo sapiens
agucugauuaaagguggugcc

SEQ ID NO: 1052923 - RNA, 17 nt, Homo sapiens
agucugauucccaagcu

SEQ ID NO: 1052924 - RNA, 19 nt, Homo sapiens
agucuggcucugucaccca

SEQ ID NO: 1052925 - RNA, 15 nt, Homo sapiens
agucuguuucaggag

SEQ ID NO: 1052926 - RNA, 17 nt, Homo sapiens
agucuguuuuaugacuu

SEQ ID NO: 1052927 - RNA, 22 nt, Homo sapiens
agucuuaaaaaaauaugccuuu

SEQ ID NO: 1052928 - RNA, 17 nt, Homo sapiens
agucuuauuuccucaac

SEQ ID NO: 1052929 - RNA, 22 nt, Homo sapiens
agucuucauaauuucuucacuc

SEQ ID NO: 1052930 - RNA, 13 nt, Homo sapiens
agucuucccauuu

SEQ ID NO: 1052931 - RNA, 21 nt, Homo sapiens
agucuugcucuuucgccaagg

SEQ ID NO: 1052932 - RNA, 21 nt, Homo sapiens
agugaaaagucucccuuucca

SEQ ID NO: 1052933 - RNA, 18 nt, Homo sapiens
agugaaaccccaucucua

SEQ ID NO: 1052934 - RNA, 19 nt, Homo sapiens
agugaacacucuacuacau

SEQ ID NO: 1052935 - RNA, 13 nt, Homo sapiens
agugaaccaaaga

SEQ ID NO: 1052936 - RNA, 15 nt, Homo sapiens
auaaagagaacucug

SEQ ID NO: 1052937 - RNA, 14 nt, Homo sapiens
auaaagaugaucua

SEQ ID NO: 1052938 - RNA, 22 nt, Homo sapiens
auaaagcacccuguaucacaga

SEQ ID NO: 1052939 - RNA, 18 nt, Homo sapiens
auaaaggcugagcucuua

SEQ ID NO: 1052940 - RNA, 13 nt, Homo sapiens
auaaauaccucuu

SEQ ID NO: 1052941 - RNA, 13 nt, Homo sapiens
auaaauaugcagu

SEQ ID NO: 1052942 - RNA, 13 nt, Homo sapiens
auaaaucauaaaa

SEQ ID NO: 1052943 - RNA, 22 nt, Homo sapiens
auaaauccauccauccaaaggc

SEQ ID NO: 1052944 - RNA, 20 nt, Homo sapiens
auaaaugaaguauuucucac

SEQ ID NO: 1052945 - RNA, 18 nt, Homo sapiens
auaaaugauggcaaaaac

SEQ ID NO: 1052946 - RNA, 13 nt, Homo sapiens
auaaaugccucau

SEQ ID NO: 1052947 - RNA, 20 nt, Homo sapiens
auaaauguaaauauguacac

SEQ ID NO: 1052948 - RNA, 21 nt, Homo sapiens
auaaauuauaucaauuuccuc

SEQ ID NO: 1052949 - RNA, 17 nt, Homo sapiens
auaaauuuuauaaucau

SEQ ID NO: 1052950 - RNA, 19 nt, Homo sapiens
auaacaagugggugaaugu

SEQ ID NO: 1052951 - RNA, 14 nt, Homo sapiens
auaacaauguuaag

SEQ ID NO: 1052952 - RNA, 13 nt, Homo sapiens
auaacagaauuaa

SEQ ID NO: 1052953 - RNA, 15 nt, Homo sapiens
auaacagugcauauu

SEQ ID NO: 1052954 - RNA, 22 nt, Homo sapiens
auaacauggccuuggagggcau

SEQ ID NO: 1052955 - RNA, 12 nt, Homo sapiens
auaaccacuuaa

SEQ ID NO: 1052956 - RNA, 22 nt, Homo sapiens
auaaccguuuccuuucauuuac

SEQ ID NO: 1052957 - RNA, 17 nt, Homo sapiens
auaacucugcacuacuc

SEQ ID NO: 1052958 - RNA, 21 nt, Homo sapiens
auaacuuauaucaucagcaua

SEQ ID NO: 1052959 - RNA, 21 nt, Homo sapiens
auaacuuuuuuuuaaguuaca

SEQ ID NO: 1052960 - RNA, 13 nt, Homo sapiens
auaagacauaacg

SEQ ID NO: 1052961 - RNA, 18 nt, Homo sapiens
auaagauggaagcuucca

SEQ ID NO: 1052962 - RNA, 17 nt, Homo sapiens
auaagcaaagacuauga

SEQ ID NO: 1052963 - RNA, 19 nt, Homo sapiens
auaagcagaagcacauaug

SEQ ID NO: 1052964 - RNA, 18 nt, Homo sapiens
auaagcuaaagaggcuga

SEQ ID NO: 1052965 - RNA, 18 nt, Homo sapiens
auaagcuuuuaaugcucc

SEQ ID NO: 1052966 - RNA, 19 nt, Homo sapiens
auaaggaucagaacagcag

SEQ ID NO: 1052967 - RNA, 15 nt, Homo sapiens
auaaguagagacuga

SEQ ID NO: 1052968 - RNA, 15 nt, Homo sapiens
auaagugcaugacau

SEQ ID NO: 1052969 - RNA, 16 nt, Homo sapiens
auaaguuaacuuccaa

SEQ ID NO: 1052970 - RNA, 19 nt, Homo sapiens
auaaguucuaguugcuugu

SEQ ID NO: 1052971 - RNA, 17 nt, Homo sapiens
auaauaaagaugcucuu

SEQ ID NO: 1052972 - RNA, 20 nt, Homo sapiens
auaaucacauuaucaucuga

SEQ ID NO: 1052973 - RNA, 19 nt, Homo sapiens
auaauguuaacauggacau

SEQ ID NO: 1052974 - RNA, 17 nt, Homo sapiens
auaauuacauauuugca

SEQ ID NO: 1052975 - RNA, 20 nt, Homo sapiens
auaauucuguacauagccua

SEQ ID NO: 1052976 - RNA, 16 nt, Homo sapiens
auaauucuguacugau

SEQ ID NO: 1052977 - RNA, 13 nt, Homo sapiens
auaauuugaucuu

SEQ ID NO: 1052978 - RNA, 16 nt, Homo sapiens
auacaagaaagcaaug

SEQ ID NO: 1052979 - RNA, 13 nt, Homo sapiens
auacaauuccaaa

SEQ ID NO: 1052980 - RNA, 19 nt, Homo sapiens
auacacacacacacacagc

SEQ ID NO: 1052981 - RNA, 22 nt, Homo sapiens
auacacacacacgcgugcacac

SEQ ID NO: 1052982 - RNA, 13 nt, Homo sapiens
auacacuuacacu

SEQ ID NO: 1052983 - RNA, 15 nt, Homo sapiens
auacacuuacacuuu

SEQ ID NO: 1052984 - RNA, 23 nt, Homo sapiens
auacagccaaagauaaucucuca

SEQ ID NO: 1052985 - RNA, 22 nt, Homo sapiens
auacaggacauucucaucacca

SEQ ID NO: 1052986 - RNA, 14 nt, Homo sapiens
auacauccuaguga

SEQ ID NO: 1052987 - RNA, 16 nt, Homo sapiens
auacaugacucagcau

SEQ ID NO: 1052988 - RNA, 18 nt, Homo sapiens
auacaugcugcuaauuca

SEQ ID NO: 1052989 - RNA, 18 nt, Homo sapiens
auacaugcuuuuuaauga

SEQ ID NO: 1052990 - RNA, 21 nt, Homo sapiens
auacaugugccgaaugugcag

SEQ ID NO: 1052991 - RNA, 14 nt, Homo sapiens
auaccacagcuuuu

SEQ ID NO: 1052992 - RNA, 12 nt, Homo sapiens
auaccagcaaua

SEQ ID NO: 1052993 - RNA, 19 nt, Homo sapiens
auaccauuuuuuaaggaaa

SEQ ID NO: 1052994 - RNA, 15 nt, Homo sapiens
auacccacuaacaaa

SEQ ID NO: 1052995 - RNA, 15 nt, Homo sapiens
auacccuguccuuuc

SEQ ID NO: 1052996 - RNA, 23 nt, Homo sapiens
auaccgcugcauaguauuccauu

SEQ ID NO: 1052997 - RNA, 19 nt, Homo sapiens
auaccucuuagcugagugg

SEQ ID NO: 1052998 - RNA, 17 nt, Homo sapiens
auaccugggauacugug

SEQ ID NO: 1052999 - RNA, 17 nt, Homo sapiens
auaccugucccccugac

SEQ ID NO: 1053000 - RNA, 17 nt, Homo sapiens
auaccuuuauugugauc

SEQ ID NO: 1053001 - RNA, 18 nt, Homo sapiens
auaccuuuauugugaucu

SEQ ID NO: 1053002 - RNA, 18 nt, Homo sapiens
auacgcaccacaucucua

SEQ ID NO: 1053003 - RNA, 13 nt, Homo sapiens
auacgcaucagac

SEQ ID NO: 1053004 - RNA, 20 nt, Homo sapiens
auacgcaucagacagaugga

SEQ ID NO: 1053005 - RNA, 14 nt, Homo sapiens
auacguccaccaug

SEQ ID NO: 1053006 - RNA, 14 nt, Homo sapiens
auacuacaaccuca

SEQ ID NO: 1053007 - RNA, 19 nt, Homo sapiens
auacuauauuuauacugua

SEQ ID NO: 1053008 - RNA, 22 nt, Homo sapiens
auacuauuuaaagccuccucau

SEQ ID NO: 1053009 - RNA, 22 nt, Homo sapiens
auacucaggacuccucuccgca

SEQ ID NO: 1053010 - RNA, 16 nt, Homo sapiens
auacucccaucuguga

SEQ ID NO: 1053011 - RNA, 15 nt, Homo sapiens
auacucuucaaggac

SEQ ID NO: 1053012 - RNA, 19 nt, Homo sapiens
auacugacacuuugccaga

SEQ ID NO: 1053013 - RNA, 19 nt, Homo sapiens
auacuggccuggacuguuu

SEQ ID NO: 1053014 - RNA, 17 nt, Homo sapiens
auacuguacauagcugu

SEQ ID NO: 1053015 - RNA, 19 nt, Homo sapiens
auacuucucuauuaucuca

SEQ ID NO: 1053016 - RNA, 13 nt, Homo sapiens
auacuuuacaugg

SEQ ID NO: 1053017 - RNA, 14 nt, Homo sapiens
auacuuucagucaa

SEQ ID NO: 1053018 - RNA, 18 nt, Homo sapiens
auacuuuuuuucacaguu

SEQ ID NO: 1053019 - RNA, 14 nt, Homo sapiens
auagaaaacugaaa

SEQ ID NO: 1053020 - RNA, 20 nt, Homo sapiens
auagaacucugggcugccau

SEQ ID NO: 1053021 - RNA, 21 nt, Homo sapiens
auagaacugaaugagaaccaa

SEQ ID NO: 1053022 - RNA, 17 nt, Homo sapiens
auagaaguagcaaaaag

SEQ ID NO: 1053023 - RNA, 16 nt, Homo sapiens
auagaauuuccaauau

SEQ ID NO: 1053024 - RNA, 20 nt, Homo sapiens
auagacugccaugcuagaca

SEQ ID NO: 1053025 - RNA, 13 nt, Homo sapiens
auagagguacaug

SEQ ID NO: 1053026 - RNA, 19 nt, Homo sapiens
auagauuucuacacugagg

SEQ ID NO: 1053027 - RNA, 14 nt, Homo sapiens
auagcaauuucgcc

SEQ ID NO: 1053028 - RNA, 14 nt, Homo sapiens
auagccaacugcug

SEQ ID NO: 1053029 - RNA, 20 nt, Homo sapiens
auagccaagaucccaucucu

SEQ ID NO: 1053030 - RNA, 18 nt, Homo sapiens
auagccacuuaccuucaa

SEQ ID NO: 1053031 - RNA, 17 nt, Homo sapiens
auagccuaggugacaga

SEQ ID NO: 1053032 - RNA, 15 nt, Homo sapiens
auagcgaauacaaaa

SEQ ID NO: 1053033 - RNA, 22 nt, Homo sapiens
auagcuugcgcauucucaugga

SEQ ID NO: 1053034 - RNA, 22 nt, Homo sapiens
auaggaaaccacacagacuugg

SEQ ID NO: 1053035 - RNA, 20 nt, Homo sapiens
auaggacucuagacggcauc

SEQ ID NO: 1053036 - RNA, 14 nt, Homo sapiens
auaggucacuccug

SEQ ID NO: 1053037 - RNA, 19 nt, Homo sapiens
auaggugcuacaaaaacac

SEQ ID NO: 1053038 - RNA, 20 nt, Homo sapiens
auaguacucuuuguagcaaa

SEQ ID NO: 1053039 - RNA, 11 nt, Homo sapiens
auaguacuggc

SEQ ID NO: 1053040 - RNA, 15 nt, Homo sapiens
auaguauugugcaua

SEQ ID NO: 1053041 - RNA, 16 nt, Homo sapiens
auagucgcagcuacua

SEQ ID NO: 1053042 - RNA, 19 nt, Homo sapiens
auagugaaaccccaucucu

SEQ ID NO: 1053043 - RNA, 23 nt, Homo sapiens
auagugacuaugaacuucucuca

SEQ ID NO: 1053044 - RNA, 23 nt, Homo sapiens
auagugauugauagaguguuauc

SEQ ID NO: 1053045 - RNA, 21 nt, Homo sapiens
auagugggcaccccacugcaa

SEQ ID NO: 1053046 - RNA, 13 nt, Homo sapiens
gaucauauuucac

SEQ ID NO: 1053047 - RNA, 14 nt, Homo sapiens
gaucaugcauuguu

SEQ ID NO: 1053048 - RNA, 18 nt, Homo sapiens
gaucauuaucagccugug

SEQ ID NO: 1053049 - RNA, 23 nt, Homo sapiens
gaucauuaucagccugugccacg

SEQ ID NO: 1053050 - RNA, 14 nt, Homo sapiens
gauccacuucucuc

SEQ ID NO: 1053051 - RNA, 15 nt, Homo sapiens
gauccacuucucuca

SEQ ID NO: 1053052 - RNA, 18 nt, Homo sapiens
gauccacuucucucagga

SEQ ID NO: 1053053 - RNA, 19 nt, Homo sapiens
gaucccaggggaguguuca

SEQ ID NO: 1053054 - RNA, 16 nt, Homo sapiens
gaucccaucuugauaa

SEQ ID NO: 1053055 - RNA, 23 nt, Homo sapiens
gaucccccagacuuuacaugaca

SEQ ID NO: 1053056 - RNA, 14 nt, Homo sapiens
gaucccucugggca

SEQ ID NO: 1053057 - RNA, 21 nt, Homo sapiens
gauccgucuuuggccuccucc

SEQ ID NO: 1053058 - RNA, 16 nt, Homo sapiens
gauccuaaaacaaaag

SEQ ID NO: 1053059 - RNA, 14 nt, Homo sapiens
gauccuucaaagag

SEQ ID NO: 1053060 - RNA, 18 nt, Homo sapiens
gaucgagaccaucuuggc

SEQ ID NO: 1053061 - RNA, 14 nt, Homo sapiens
gaucgauuugcacc

SEQ ID NO: 1053062 - RNA, 15 nt, Homo sapiens
gaucgauuugcaccc

SEQ ID NO: 1053063 - RNA, 17 nt, Homo sapiens
gaucgcgccacugcacu

SEQ ID NO: 1053064 - RNA, 20 nt, Homo sapiens
gaucgcgccacugcacuccg

SEQ ID NO: 1053065 - RNA, 16 nt, Homo sapiens
gaucuaccugccucag

SEQ ID NO: 1053066 - RNA, 17 nt, Homo sapiens
gaucuaggaagacuuug

SEQ ID NO: 1053067 - RNA, 18 nt, Homo sapiens
gaucuaucaauagucaag

SEQ ID NO: 1053068 - RNA, 18 nt, Homo sapiens
gaucuccaaggaccaggu

SEQ ID NO: 1053069 - RNA, 14 nt, Homo sapiens
gaucugcaguuuuu

SEQ ID NO: 1053070 - RNA, 11 nt, Homo sapiens
gaucuggagaa

SEQ ID NO: 1053071 - RNA, 17 nt, Homo sapiens
gaucuggucccuugcag

SEQ ID NO: 1053072 - RNA, 18 nt, Homo sapiens
gaucugguuuugcuauua

SEQ ID NO: 1053073 - RNA, 21 nt, Homo sapiens
gaucuguuuuuaaaaaucaua

SEQ ID NO: 1053074 - RNA, 17 nt, Homo sapiens
gaucuuccucacaccac

SEQ ID NO: 1053075 - RNA, 18 nt, Homo sapiens
gaucuuccucacaccaca

SEQ ID NO: 1053076 - RNA, 16 nt, Homo sapiens
gaucuugcauucccag

SEQ ID NO: 1053077 - RNA, 20 nt, Homo sapiens
gaucuugcauucccaguggu

SEQ ID NO: 1053078 - RNA, 15 nt, Homo sapiens
gaucuuugacucuuu

SEQ ID NO: 1053079 - RNA, 19 nt, Homo sapiens
gaugaaaaugaaucuucac

SEQ ID NO: 1053080 - RNA, 20 nt, Homo sapiens
gaugaaaaugaaucuucaca

SEQ ID NO: 1053081 - RNA, 13 nt, Homo sapiens
gaugaaacuggaa

SEQ ID NO: 1053082 - RNA, 20 nt, Homo sapiens
gaugaaacuggaaaacuaca

SEQ ID NO: 1053083 - RNA, 23 nt, Homo sapiens
gaugaaauaacuccuucuuguag

SEQ ID NO: 1053084 - RNA, 21 nt, Homo sapiens
gaugaagauucuccugugcua

SEQ ID NO: 1053085 - RNA, 16 nt, Homo sapiens
gaugaggcagaugccu

SEQ ID NO: 1053086 - RNA, 21 nt, Homo sapiens
gaugaggucauagcagugcuu

SEQ ID NO: 1053087 - RNA, 15 nt, Homo sapiens
gaugaguacccaaaa

SEQ ID NO: 1053088 - RNA, 13 nt, Homo sapiens
gaugauaaaacac

SEQ ID NO: 1053089 - RNA, 13 nt, Homo sapiens
gaugauuuuggcc

SEQ ID NO: 1053090 - RNA, 15 nt, Homo sapiens
gaugcaauacaagau

SEQ ID NO: 1053091 - RNA, 23 nt, Homo sapiens
gaugcaaucgguuuaaacauggc

SEQ ID NO: 1053092 - RNA, 18 nt, Homo sapiens
gaugccguucccugaaca

SEQ ID NO: 1053093 - RNA, 18 nt, Homo sapiens
gaugcgcacugcauucca

SEQ ID NO: 1053094 - RNA, 19 nt, Homo sapiens
gaugcuaccuugugaccca

SEQ ID NO: 1053095 - RNA, 21 nt, Homo sapiens
gaugcugccugcccagugcac

SEQ ID NO: 1053096 - RNA, 16 nt, Homo sapiens
gauggaaacucuuuaa

SEQ ID NO: 1053097 - RNA, 16 nt, Homo sapiens
gauggaauaaagcccu

SEQ ID NO: 1053098 - RNA, 18 nt, Homo sapiens
gauggaauaaagcccuug

SEQ ID NO: 1053099 - RNA, 20 nt, Homo sapiens
gauggaauaaagcccuugaa

SEQ ID NO: 1053100 - RNA, 23 nt, Homo sapiens
gauggaauaaagcccuugaacca

SEQ ID NO: 1053101 - RNA, 19 nt, Homo sapiens
gauggagauauuuacauga

SEQ ID NO: 1053102 - RNA, 18 nt, Homo sapiens
gauggagccagcucugca

SEQ ID NO: 1053103 - RNA, 9 nt, Homo sapiens
gauggagcu

SEQ ID NO: 1053104 - RNA, 17 nt, Homo sapiens
gauggaggggugguccu

SEQ ID NO: 1053105 - RNA, 19 nt, Homo sapiens
gauggaggggugguccuga

SEQ ID NO: 1053106 - RNA, 19 nt, Homo sapiens
gauggaggucacacuggua

SEQ ID NO: 1053107 - RNA, 17 nt, Homo sapiens
gauggagucagguuugg

SEQ ID NO: 1053108 - RNA, 13 nt, Homo sapiens
gauggauuuccag

SEQ ID NO: 1053109 - RNA, 17 nt, Homo sapiens
gauggcaaaaacaaagg

SEQ ID NO: 1053110 - RNA, 18 nt, Homo sapiens
gauggcaccacugcacuc

SEQ ID NO: 1053111 - RNA, 14 nt, Homo sapiens
gauggcagcuguuu

SEQ ID NO: 1053112 - RNA, 17 nt, Homo sapiens
gauggcauccugugaag

SEQ ID NO: 1053113 - RNA, 21 nt, Homo sapiens
gauggcauccugugaaguccu

SEQ ID NO: 1053114 - RNA, 19 nt, Homo sapiens
gauggccaagcaauuccuc

SEQ ID NO: 1053115 - RNA, 14 nt, Homo sapiens
gauggccacuguga

SEQ ID NO: 1053116 - RNA, 15 nt, Homo sapiens
gauggccaggccaga

SEQ ID NO: 1053117 - RNA, 20 nt, Homo sapiens
gaugggagaaucacuugaac

SEQ ID NO: 1053118 - RNA, 20 nt, Homo sapiens
gaugggagugcccccaacag

SEQ ID NO: 1053119 - RNA, 13 nt, Homo sapiens
gaugguccacugu

SEQ ID NO: 1053120 - RNA, 17 nt, Homo sapiens
gauggugcccuguucuc

SEQ ID NO: 1053121 - RNA, 16 nt, Homo sapiens
gauggugcugaccucu

SEQ ID NO: 1053122 - RNA, 14 nt, Homo sapiens
gauguaugcagcua

SEQ ID NO: 1053123 - RNA, 20 nt, Homo sapiens
gaugucaaaaacuucaauau

SEQ ID NO: 1053124 - RNA, 18 nt, Homo sapiens
gaugucguuugaaucaca

SEQ ID NO: 1053125 - RNA, 15 nt, Homo sapiens
gaugucucacauccu

SEQ ID NO: 1053126 - RNA, 23 nt, Homo sapiens
gaugucucacauccucugucuau

SEQ ID NO: 1053127 - RNA, 14 nt, Homo sapiens
gaugugaacacauc

SEQ ID NO: 1053128 - RNA, 17 nt, Homo sapiens
gauguuacaucacagug

SEQ ID NO: 1053129 - RNA, 13 nt, Homo sapiens
gauguuacuguau

SEQ ID NO: 1053130 - RNA, 20 nt, Homo sapiens
gauguucugacccugcuuca

SEQ ID NO: 1053131 - RNA, 15 nt, Homo sapiens
gauguuucugucaca

SEQ ID NO: 1053132 - RNA, 20 nt, Homo sapiens
gauguuuuaacucuaucugu

SEQ ID NO: 1053133 - RNA, 22 nt, Homo sapiens
gauguuuuaaguuuaucuuuca

SEQ ID NO: 1053134 - RNA, 23 nt, Homo sapiens
gauguuuugugaccagguuugug

SEQ ID NO: 1053135 - RNA, 20 nt, Homo sapiens
gauguuuuuaaaaguuucaa

SEQ ID NO: 1053136 - RNA, 20 nt, Homo sapiens
gauuaaacaaacaaacaauu

SEQ ID NO: 1053137 - RNA, 13 nt, Homo sapiens
gauuaaacuuaau

SEQ ID NO: 1053138 - RNA, 19 nt, Homo sapiens
gauuaaagguggugccaau

SEQ ID NO: 1053139 - RNA, 17 nt, Homo sapiens
gauuacaccagccucgu

SEQ ID NO: 1053140 - RNA, 17 nt, Homo sapiens
gauuagaugacucucag

SEQ ID NO: 1053141 - RNA, 21 nt, Homo sapiens
gauuauaggcaugagccacca

SEQ ID NO: 1053142 - RNA, 16 nt, Homo sapiens
gauuaugaagugacuc

SEQ ID NO: 1053143 - RNA, 20 nt, Homo sapiens
gauuaugaagugacucucac

SEQ ID NO: 1053144 - RNA, 22 nt, Homo sapiens
gauuaugaagugacucucacaa

SEQ ID NO: 1053145 - RNA, 19 nt, Homo sapiens
gauuauucccuguacaaua

SEQ ID NO: 1053146 - RNA, 20 nt, Homo sapiens
gauucacaaugaaaugcucu

SEQ ID NO: 1053147 - RNA, 22 nt, Homo sapiens
gauucagaaauuggaacagaau

SEQ ID NO: 1053148 - RNA, 21 nt, Homo sapiens
gauucauauuuacuucuuaua

SEQ ID NO: 1053149 - RNA, 14 nt, Homo sapiens
gauucaugccaauu

SEQ ID NO: 1053150 - RNA, 13 nt, Homo sapiens
gauuccugaccca

SEQ ID NO: 1053151 - RNA, 22 nt, Homo sapiens
gauucgaaacuccauugaguca

SEQ ID NO: 1053152 - RNA, 11 nt, Homo sapiens
gauucucaggg

SEQ ID NO: 1053153 - RNA, 15 nt, Homo sapiens
gauucuccugccuca

SEQ ID NO: 1053154 - RNA, 16 nt, Homo sapiens
gauucuccugccucag

SEQ ID NO: 1053155 - RNA, 21 nt, Homo sapiens
gauucuguggagguauugccu

SEQ ID NO: 1053156 - RNA, 15 nt, Homo sapiens
gauucuucucuuaau

SEQ ID NO: 1053157 - RNA, 23 nt, Homo sapiens
gauucuucucuuaauuucauaga

SEQ ID NO: 1053158 - RNA, 16 nt, Homo sapiens
gauucuucugccucag

SEQ ID NO: 1053159 - RNA, 14 nt, Homo sapiens
gauucuuuguuaca

SEQ ID NO: 1053160 - RNA, 15 nt, Homo sapiens
gauugcaauuugcac

SEQ ID NO: 1053161 - RNA, 18 nt, Homo sapiens
gauugcuuaaaauagcaa

SEQ ID NO: 1053162 - RNA, 20 nt, Homo sapiens
gauuggauuauucauuuaaa

SEQ ID NO: 1053163 - RNA, 17 nt, Homo sapiens
gauuggcucacccaagc

SEQ ID NO: 1053164 - RNA, 13 nt, Homo sapiens
gauuuaaaaggga

SEQ ID NO: 1053165 - RNA, 14 nt, Homo sapiens
gauuucaaaugcug

SEQ ID NO: 1053166 - RNA, 13 nt, Homo sapiens
gauuucaggauac

SEQ ID NO: 1053167 - RNA, 23 nt, Homo sapiens
gauuuccugcugccauccucacc

SEQ ID NO: 1053168 - RNA, 23 nt, Homo sapiens
gauuuggaagggaaacuuucaaa

SEQ ID NO: 1053169 - RNA, 17 nt, Homo sapiens
gauuugggcucuuggaa

SEQ ID NO: 1053170 - RNA, 18 nt, Homo sapiens
gauuuuaaaaagucuuca

SEQ ID NO: 1053171 - RNA, 15 nt, Homo sapiens
gauuuuaacaauaac

SEQ ID NO: 1053172 - RNA, 16 nt, Homo sapiens
gauuuuauuugacaaa

SEQ ID NO: 1053173 - RNA, 19 nt, Homo sapiens
gauuuugcaaucuguguuc

SEQ ID NO: 1053174 - RNA, 16 nt, Homo sapiens
gauuuugcuguagaag

SEQ ID NO: 1053175 - RNA, 23 nt, Homo sapiens
gauuuuggccaucaggacucuga

SEQ ID NO: 1053176 - RNA, 21 nt, Homo sapiens
gauuuuucucaaaguuuugaa

SEQ ID NO: 1053177 - RNA, 18 nt, Homo sapiens
gcaaaaacggccagguac

SEQ ID NO: 1053178 - RNA, 22 nt, Homo sapiens
gcaaaaccaaauauuccagaga

SEQ ID NO: 1053179 - RNA, 15 nt, Homo sapiens
gcaaaacuacaaugu

SEQ ID NO: 1053180 - RNA, 18 nt, Homo sapiens
gcaaaauacaugacauuu

SEQ ID NO: 1053181 - RNA, 16 nt, Homo sapiens
gcaaaauucccaggga

SEQ ID NO: 1053182 - RNA, 17 nt, Homo sapiens
gcaaaauuuaugcaaau

SEQ ID NO: 1053183 - RNA, 20 nt, Homo sapiens
gcaaaauuugaugccaggac

SEQ ID NO: 1053184 - RNA, 15 nt, Homo sapiens
gcaaacagauggcag

SEQ ID NO: 1053185 - RNA, 24 nt, Homo sapiens
gcaaacuuucuuaaaacauuauga

SEQ ID NO: 1053186 - RNA, 21 nt, Homo sapiens
gcaaagaguguagaucagagc

SEQ ID NO: 1053187 - RNA, 17 nt, Homo sapiens
gcaaagaugaucaguau

SEQ ID NO: 1053188 - RNA, 16 nt, Homo sapiens
gcaaagauuugcuuua

SEQ ID NO: 1053189 - RNA, 21 nt, Homo sapiens
gcaaagcauugagcaaagggg

SEQ ID NO: 1053190 - RNA, 18 nt, Homo sapiens
gcaaaggaaauaccaguu

SEQ ID NO: 1053191 - RNA, 16 nt, Homo sapiens
gcaaaggcgucugaau

SEQ ID NO: 1053192 - RNA, 18 nt, Homo sapiens
gcaaaggcucucacucca

SEQ ID NO: 1053193 - RNA, 19 nt, Homo sapiens
gcaaaggcucucacuccag

SEQ ID NO: 1053194 - RNA, 23 nt, Homo sapiens
cugacucaacauguuacugacca

SEQ ID NO: 1053195 - RNA, 21 nt, Homo sapiens
cugacucucugugaccugccc

SEQ ID NO: 1053196 - RNA, 15 nt, Homo sapiens
cugacugaugcuuuc

SEQ ID NO: 1053197 - RNA, 23 nt, Homo sapiens
cugagaacccugcguggggacag

SEQ ID NO: 1053198 - RNA, 16 nt, Homo sapiens
cugagaauuccaagga

SEQ ID NO: 1053199 - RNA, 18 nt, Homo sapiens
cugagagacaggacuagc

SEQ ID NO: 1053200 - RNA, 21 nt, Homo sapiens
cugagaguuuaguuguagcag

SEQ ID NO: 1053201 - RNA, 22 nt, Homo sapiens
cugagauuauaggcaugagcca

SEQ ID NO: 1053202 - RNA, 21 nt, Homo sapiens
cugagcaaagggaacagugag

SEQ ID NO: 1053203 - RNA, 22 nt, Homo sapiens
cugagcagugaaugauucagug

SEQ ID NO: 1053204 - RNA, 16 nt, Homo sapiens
cugagcagugccagcu

SEQ ID NO: 1053205 - RNA, 17 nt, Homo sapiens
cugagcagugccagcuu

SEQ ID NO: 1053206 - RNA, 15 nt, Homo sapiens
cugagcgacagugag

SEQ ID NO: 1053207 - RNA, 13 nt, Homo sapiens
cugagcugugcag

SEQ ID NO: 1053208 - RNA, 22 nt, Homo sapiens
cugaggaauuucaccuguaaac

SEQ ID NO: 1053209 - RNA, 13 nt, Homo sapiens
cugaggaccagcc

SEQ ID NO: 1053210 - RNA, 17 nt, Homo sapiens
cugaggcagacagcagc

SEQ ID NO: 1053211 - RNA, 14 nt, Homo sapiens
cugaggcagggaag

SEQ ID NO: 1053212 - RNA, 14 nt, Homo sapiens
cugaggcuguagga

SEQ ID NO: 1053213 - RNA, 22 nt, Homo sapiens
cugagggcagaaagguucugcc

SEQ ID NO: 1053214 - RNA, 19 nt, Homo sapiens
cugagguuugccagcauuu

SEQ ID NO: 1053215 - RNA, 19 nt, Homo sapiens
cugaguaagaaaugcugcc

SEQ ID NO: 1053216 - RNA, 18 nt, Homo sapiens
cugaguaguugggauuac

SEQ ID NO: 1053217 - RNA, 15 nt, Homo sapiens
cugagugcaccacuu

SEQ ID NO: 1053218 - RNA, 22 nt, Homo sapiens
cugagugcaccacuucaaguga

SEQ ID NO: 1053219 - RNA, 20 nt, Homo sapiens
cugagugccuggccaaaggg

SEQ ID NO: 1053220 - RNA, 10 nt, Homo sapiens
cugaguucag

SEQ ID NO: 1053221 - RNA, 14 nt, Homo sapiens
cugaguugcuuuua

SEQ ID NO: 1053222 - RNA, 18 nt, Homo sapiens
cugauaagagaaucaaca

SEQ ID NO: 1053223 - RNA, 12 nt, Homo sapiens
cugauaccucaa

SEQ ID NO: 1053224 - RNA, 23 nt, Homo sapiens
cugauauaacaaacuacauguaa

SEQ ID NO: 1053225 - RNA, 19 nt, Homo sapiens
cugauauuuuaccucuuau

SEQ ID NO: 1053226 - RNA, 21 nt, Homo sapiens
cugaucauccacugugccaug

SEQ ID NO: 1053227 - RNA, 14 nt, Homo sapiens
cugaucaugcauug

SEQ ID NO: 1053228 - RNA, 17 nt, Homo sapiens
cugaucauuaaagccug

SEQ ID NO: 1053229 - RNA, 14 nt, Homo sapiens
cugauccugugaag

SEQ ID NO: 1053230 - RNA, 14 nt, Homo sapiens
cugaucgugcuaaa

SEQ ID NO: 1053231 - RNA, 20 nt, Homo sapiens
cugaucgugcuaaauuuuca

SEQ ID NO: 1053232 - RNA, 21 nt, Homo sapiens
cugaucugacauccccacuca

SEQ ID NO: 1053233 - RNA, 21 nt, Homo sapiens
cugaucugguuugacuccgcu

SEQ ID NO: 1053234 - RNA, 18 nt, Homo sapiens
cugaucugugcuuuccag

SEQ ID NO: 1053235 - RNA, 19 nt, Homo sapiens
cugaucuuauucuguggug

SEQ ID NO: 1053236 - RNA, 21 nt, Homo sapiens
cugaugacacaggcugacuca

SEQ ID NO: 1053237 - RNA, 19 nt, Homo sapiens
cugaugucuccacuuucac

SEQ ID NO: 1053238 - RNA, 17 nt, Homo sapiens
cugauguuaaaauucca

SEQ ID NO: 1053239 - RNA, 22 nt, Homo sapiens
cugauuaaugauuguuugucaa

SEQ ID NO: 1053240 - RNA, 15 nt, Homo sapiens
cugauuacacaaaac

SEQ ID NO: 1053241 - RNA, 13 nt, Homo sapiens
cugauucauaaua

SEQ ID NO: 1053242 - RNA, 19 nt, Homo sapiens
cugauucccaagcucugcu

SEQ ID NO: 1053243 - RNA, 22 nt, Homo sapiens
cugauucugucaaugucuugaa

SEQ ID NO: 1053244 - RNA, 17 nt, Homo sapiens
cugauuuuaacaauaac

SEQ ID NO: 1053245 - RNA, 16 nt, Homo sapiens
cugauuuuugucccag

SEQ ID NO: 1053246 - RNA, 16 nt, Homo sapiens
cugcaaaaacagaggu

SEQ ID NO: 1053247 - RNA, 22 nt, Homo sapiens
cugcaaaggcgucugaaugugu

SEQ ID NO: 1053248 - RNA, 13 nt, Homo sapiens
cugcaacggaauu

SEQ ID NO: 1053249 - RNA, 14 nt, Homo sapiens
cugcaagauucuga

SEQ ID NO: 1053250 - RNA, 16 nt, Homo sapiens
cugcaaguaaguauga

SEQ ID NO: 1053251 - RNA, 20 nt, Homo sapiens
cugcaaugcuggacacuaca

SEQ ID NO: 1053252 - RNA, 19 nt, Homo sapiens
cugcacaaacucaccaucu

SEQ ID NO: 1053253 - RNA, 21 nt, Homo sapiens
cugcacaaagcccuuccaugu

SEQ ID NO: 1053254 - RNA, 13 nt, Homo sapiens
cugcacacugccu

SEQ ID NO: 1053255 - RNA, 20 nt, Homo sapiens
cugcacauaaguuaugguuu

SEQ ID NO: 1053256 - RNA, 17 nt, Homo sapiens
cugcacaugucuuguac

SEQ ID NO: 1053257 - RNA, 19 nt, Homo sapiens
cugcacaugucuuguacau

SEQ ID NO: 1053258 - RNA, 16 nt, Homo sapiens
cugcacccacccagga

SEQ ID NO: 1053259 - RNA, 19 nt, Homo sapiens
cugcaccccugcaguuuga

SEQ ID NO: 1053260 - RNA, 15 nt, Homo sapiens
cugcacccucgauga

SEQ ID NO: 1053261 - RNA, 13 nt, Homo sapiens
cugcaccgagaga

SEQ ID NO: 1053262 - RNA, 20 nt, Homo sapiens
cugcaccgagagagauggaa

SEQ ID NO: 1053263 - RNA, 22 nt, Homo sapiens
cugcaccgagagagauggaaua

SEQ ID NO: 1053264 - RNA, 23 nt, Homo sapiens
cugcacuauagccuaggugacag

SEQ ID NO: 1053265 - RNA, 14 nt, Homo sapiens
cugcacuccagccu

SEQ ID NO: 1053266 - RNA, 20 nt, Homo sapiens
cugcacuccagccugggcaa

SEQ ID NO: 1053267 - RNA, 16 nt, Homo sapiens
cugcacuuaacaagcu

SEQ ID NO: 1053268 - RNA, 18 nt, Homo sapiens
cugcacuuauacccauga

SEQ ID NO: 1053269 - RNA, 14 nt, Homo sapiens
cugcacuugcagac

SEQ ID NO: 1053270 - RNA, 20 nt, Homo sapiens
cugcagaagacaguauggca

SEQ ID NO: 1053271 - RNA, 15 nt, Homo sapiens
cugcagcauguugcu

SEQ ID NO: 1053272 - RNA, 21 nt, Homo sapiens
cugcagccccgcgccuccuuc

SEQ ID NO: 1053273 - RNA, 23 nt, Homo sapiens
cugcagcucagggacuggcacac

SEQ ID NO: 1053274 - RNA, 23 nt, Homo sapiens
cugcaggagagaaugcccaguga

SEQ ID NO: 1053275 - RNA, 15 nt, Homo sapiens
cugcaggcagggcug

SEQ ID NO: 1053276 - RNA, 13 nt, Homo sapiens
cugcaggccaaga

SEQ ID NO: 1053277 - RNA, 14 nt, Homo sapiens
cugcaggugcugcu

SEQ ID NO: 1053278 - RNA, 20 nt, Homo sapiens
cugcagucaucuugaccaag

SEQ ID NO: 1053279 - RNA, 16 nt, Homo sapiens
cugcagucuggcugag

SEQ ID NO: 1053280 - RNA, 15 nt, Homo sapiens
cugcaucugugaaaa

SEQ ID NO: 1053281 - RNA, 18 nt, Homo sapiens
cugcaugcgagugcucau

SEQ ID NO: 1053282 - RNA, 23 nt, Homo sapiens
cugcaugcuggguucugcacagc

SEQ ID NO: 1053283 - RNA, 15 nt, Homo sapiens
cugcauucacccaga

SEQ ID NO: 1053284 - RNA, 11 nt, Homo sapiens
cugccagagaa

SEQ ID NO: 1053285 - RNA, 22 nt, Homo sapiens
cugccagaugcugauguucagu

SEQ ID NO: 1053286 - RNA, 15 nt, Homo sapiens
cugccaguguggaac

SEQ ID NO: 1053287 - RNA, 19 nt, Homo sapiens
cugccauauucuguuggcc

SEQ ID NO: 1053288 - RNA, 13 nt, Homo sapiens
cagagcaagugag

SEQ ID NO: 1053289 - RNA, 15 nt, Homo sapiens
cagagcagaugcaga

SEQ ID NO: 1053290 - RNA, 22 nt, Homo sapiens
cagagcagaugcagagagccau

SEQ ID NO: 1053291 - RNA, 15 nt, Homo sapiens
cagagcccaagggaa

SEQ ID NO: 1053292 - RNA, 13 nt, Homo sapiens
cagagcucacaau

SEQ ID NO: 1053293 - RNA, 14 nt, Homo sapiens
cagagcuuccucag

SEQ ID NO: 1053294 - RNA, 20 nt, Homo sapiens
cagagcuugaacacagucuc

SEQ ID NO: 1053295 - RNA, 12 nt, Homo sapiens
cagaggacucac

SEQ ID NO: 1053296 - RNA, 22 nt, Homo sapiens
cagaggcagcgaguuguggaaa

SEQ ID NO: 1053297 - RNA, 16 nt, Homo sapiens
cagagggaaacacagc

SEQ ID NO: 1053298 - RNA, 23 nt, Homo sapiens
cagagggaaaguaaauauuucag

SEQ ID NO: 1053299 - RNA, 17 nt, Homo sapiens
cagagggagacuccauc

SEQ ID NO: 1053300 - RNA, 15 nt, Homo sapiens
cagaggguacuuuaa

SEQ ID NO: 1053301 - RNA, 20 nt, Homo sapiens
cagagggugggcuucagggc

SEQ ID NO: 1053302 - RNA, 18 nt, Homo sapiens
cagagguaaaagugugag

SEQ ID NO: 1053303 - RNA, 23 nt, Homo sapiens
cagagguaaaagugugagcagug

SEQ ID NO: 1053304 - RNA, 15 nt, Homo sapiens
cagagguugugguga

SEQ ID NO: 1053305 - RNA, 12 nt, Homo sapiens
cagagucucacu

SEQ ID NO: 1053306 - RNA, 16 nt, Homo sapiens
cagagugagagacauc

SEQ ID NO: 1053307 - RNA, 12 nt, Homo sapiens
cagagugcaagc

SEQ ID NO: 1053308 - RNA, 18 nt, Homo sapiens
cagaguuccgacugccau

SEQ ID NO: 1053309 - RNA, 15 nt, Homo sapiens
cagaguucugcucua

SEQ ID NO: 1053310 - RNA, 14 nt, Homo sapiens
cagaguuguugcuu

SEQ ID NO: 1053311 - RNA, 12 nt, Homo sapiens
cagauacuuggg

SEQ ID NO: 1053312 - RNA, 18 nt, Homo sapiens
cagauagauauaugcucu

SEQ ID NO: 1053313 - RNA, 13 nt, Homo sapiens
cagauauuucaca

SEQ ID NO: 1053314 - RNA, 16 nt, Homo sapiens
cagaucacuacugcag

SEQ ID NO: 1053315 - RNA, 15 nt, Homo sapiens
cagaucccacuugca

SEQ ID NO: 1053316 - RNA, 19 nt, Homo sapiens
cagauccucacaaccaccu

SEQ ID NO: 1053317 - RNA, 19 nt, Homo sapiens
cagaucuaccccuuacuua

SEQ ID NO: 1053318 - RNA, 11 nt, Homo sapiens
cagaugacaaa

SEQ ID NO: 1053319 - RNA, 17 nt, Homo sapiens
cagaugaccaaagccac

SEQ ID NO: 1053320 - RNA, 21 nt, Homo sapiens
cagaugcagaaaauugccuaa

SEQ ID NO: 1053321 - RNA, 17 nt, Homo sapiens
cagauggaaaagggaga

SEQ ID NO: 1053322 - RNA, 22 nt, Homo sapiens
cagauggaaugggguccuagca

SEQ ID NO: 1053323 - RNA, 16 nt, Homo sapiens
cagauggcacuuugaa

SEQ ID NO: 1053324 - RNA, 21 nt, Homo sapiens
cagauggcaggaugggcacug

SEQ ID NO: 1053325 - RNA, 19 nt, Homo sapiens
cagaugggggaaagcacag

SEQ ID NO: 1053326 - RNA, 17 nt, Homo sapiens
cagaugguuaaauauca

SEQ ID NO: 1053327 - RNA, 20 nt, Homo sapiens
cagauguccuugaugcucau

SEQ ID NO: 1053328 - RNA, 15 nt, Homo sapiens
cagauucacacuguc

SEQ ID NO: 1053329 - RNA, 21 nt, Homo sapiens
cagauuccaggcgaugugcaa

SEQ ID NO: 1053330 - RNA, 15 nt, Homo sapiens
cagauucccagagca

SEQ ID NO: 1053331 - RNA, 18 nt, Homo sapiens
cagauuccgcaccaauaa

SEQ ID NO: 1053332 - RNA, 16 nt, Homo sapiens
cagauuuaaagcacau

SEQ ID NO: 1053333 - RNA, 18 nt, Homo sapiens
cagauuuacacugggaga

SEQ ID NO: 1053334 - RNA, 16 nt, Homo sapiens
cagauuucagaucaua

SEQ ID NO: 1053335 - RNA, 19 nt, Homo sapiens
cagauuuccuaacucuggu

SEQ ID NO: 1053336 - RNA, 14 nt, Homo sapiens
cagauuuguguuau

SEQ ID NO: 1053337 - RNA, 23 nt, Homo sapiens
cagcaaaagaagacaacauuucu

SEQ ID NO: 1053338 - RNA, 14 nt, Homo sapiens
cagcaaaucacgac

SEQ ID NO: 1053339 - RNA, 17 nt, Homo sapiens
cagcaacccuccuauca

SEQ ID NO: 1053340 - RNA, 23 nt, Homo sapiens
cagcaacugaauaaauaccucuu

SEQ ID NO: 1053341 - RNA, 16 nt, Homo sapiens
cagcaagucaggguug

SEQ ID NO: 1053342 - RNA, 15 nt, Homo sapiens
cagcaauacaaagac

SEQ ID NO: 1053343 - RNA, 21 nt, Homo sapiens
cagcaaugacaucucaggggc

SEQ ID NO: 1053344 - RNA, 15 nt, Homo sapiens
cagcacacgucauuu

SEQ ID NO: 1053345 - RNA, 21 nt, Homo sapiens
cagcaccaucucuuuaccucc

SEQ ID NO: 1053346 - RNA, 15 nt, Homo sapiens
cagcacccaugggaa

SEQ ID NO: 1053347 - RNA, 17 nt, Homo sapiens
cagcacccucuccagau

SEQ ID NO: 1053348 - RNA, 15 nt, Homo sapiens
cagcaccuacagugu

SEQ ID NO: 1053349 - RNA, 19 nt, Homo sapiens
cagcaccuucccucucacc

SEQ ID NO: 1053350 - RNA, 13 nt, Homo sapiens
cagcacuccucau

SEQ ID NO: 1053351 - RNA, 14 nt, Homo sapiens
cagcacuccucauc

SEQ ID NO: 1053352 - RNA, 15 nt, Homo sapiens
cagcacuccucauca

SEQ ID NO: 1053353 - RNA, 18 nt, Homo sapiens
cagcacuuagguuuuccu

SEQ ID NO: 1053354 - RNA, 12 nt, Homo sapiens
cagcacuuguau

SEQ ID NO: 1053355 - RNA, 14 nt, Homo sapiens
cagcagacuaugaa

SEQ ID NO: 1053356 - RNA, 23 nt, Homo sapiens
cagcagcccuaaggaucucucag

SEQ ID NO: 1053357 - RNA, 16 nt, Homo sapiens
cagcagccucccugaa

SEQ ID NO: 1053358 - RNA, 12 nt, Homo sapiens
cagcagcugaac

SEQ ID NO: 1053359 - RNA, 22 nt, Homo sapiens
cagcaguggacucaaaacccau

SEQ ID NO: 1053360 - RNA, 21 nt, Homo sapiens
cagcaguugaaaagacuccaa

SEQ ID NO: 1053361 - RNA, 22 nt, Homo sapiens
cagcauaccuuuauugugaucu

SEQ ID NO: 1053362 - RNA, 23 nt, Homo sapiens
cagcaucucccucacugaaacca

SEQ ID NO: 1053363 - RNA, 15 nt, Homo sapiens
cagcaucugcuaaua

SEQ ID NO: 1053364 - RNA, 16 nt, Homo sapiens
cagcaucuguccucau

SEQ ID NO: 1053365 - RNA, 16 nt, Homo sapiens
cagcauggagucacag

SEQ ID NO: 1053366 - RNA, 14 nt, Homo sapiens
cagcauuuccacac

SEQ ID NO: 1053367 - RNA, 18 nt, Homo sapiens
cagccaaacccugucuga

SEQ ID NO: 1053368 - RNA, 17 nt, Homo sapiens
cagccaaagauaaucuc

SEQ ID NO: 1053369 - RNA, 18 nt, Homo sapiens
cagccaagccaagaggau

SEQ ID NO: 1053370 - RNA, 20 nt, Homo sapiens
cagccaagccagucaaggau

SEQ ID NO: 1053371 - RNA, 13 nt, Homo sapiens
cagccacauucua

SEQ ID NO: 1053372 - RNA, 20 nt, Homo sapiens
cagccaccauccuauugcaa

SEQ ID NO: 1053373 - RNA, 17 nt, Homo sapiens
cagcccaagaugcuuua

SEQ ID NO: 1053374 - RNA, 21 nt, Homo sapiens
cagcccagccccuccaaaggu

SEQ ID NO: 1053375 - RNA, 15 nt, Homo sapiens
cagcccauggcuuua

SEQ ID NO: 1053376 - RNA, 16 nt, Homo sapiens
cagccccagugcccac

SEQ ID NO: 1053377 - RNA, 19 nt, Homo sapiens
cagccccugauccugugaa

SEQ ID NO: 1053378 - RNA, 18 nt, Homo sapiens
cagcccuagagccugccu

SEQ ID NO: 1053379 - RNA, 12 nt, Homo sapiens
cagcccuggauu

SEQ ID NO: 1053380 - RNA, 20 nt, Homo sapiens
cagccucaagucacucccaa

SEQ ID NO: 1053381 - RNA, 15 nt, Homo sapiens
cagccucacaguccu

SEQ ID NO: 1053382 - RNA, 17 nt, Homo sapiens
cagccucccaaagugcu

SEQ ID NO: 1053383 - RNA, 14 nt, Homo sapiens
cagccucccaagua

SEQ ID NO: 1053384 - RNA, 20 nt, Homo sapiens
cagccuccccaccuucuuca

SEQ ID NO: 1053385 - RNA, 18 nt, Homo sapiens
cagccucccgaguagcug

SEQ ID NO: 1053386 - RNA, 19 nt, Homo sapiens
cagccucccgaguagcuga

SEQ ID NO: 1053387 - RNA, 20 nt, Homo sapiens
cagccucccgaguagcugag

SEQ ID NO: 1053388 - RNA, 22 nt, Homo sapiens
cagccugagcaacagagugaga

SEQ ID NO: 1053389 - RNA, 15 nt, Homo sapiens
cagccuggacauaga

SEQ ID NO: 1053390 - RNA, 20 nt, Homo sapiens
cagccugggcaacacagcga

SEQ ID NO: 1053391 - RNA, 18 nt, Homo sapiens
cagccugggcaaugugau

SEQ ID NO: 1053392 - RNA, 20 nt, Homo sapiens
cagccugggcgacagagcca

SEQ ID NO: 1053393 - RNA, 20 nt, Homo sapiens
cagccugggugacagagcaa

SEQ ID NO: 1053394 - RNA, 19 nt, Homo sapiens
cagccuguuggacccgcuc

SEQ ID NO: 1053395 - RNA, 12 nt, Homo sapiens
cagccuuucuaa

SEQ ID NO: 1053396 - RNA, 22 nt, Homo sapiens
cagccuuucuaaaaguugcaug

SEQ ID NO: 1053397 - RNA, 18 nt, Homo sapiens
cagcgaccucggugggcc

SEQ ID NO: 1053398 - RNA, 19 nt, Homo sapiens
cagcgaccuuccucaucca

SEQ ID NO: 1053399 - RNA, 23 nt, Homo sapiens
cagcgagaggcagagaaagaaga

SEQ ID NO: 1053400 - RNA, 16 nt, Homo sapiens
cagcgagcccuggugg

SEQ ID NO: 1053401 - RNA, 17 nt, Homo sapiens
cagcgauguaugcagcu

SEQ ID NO: 1053402 - RNA, 22 nt, Homo sapiens
cagcguuucuaugacacaugca

SEQ ID NO: 1053403 - RNA, 13 nt, Homo sapiens
cagcuaaagcaau

SEQ ID NO: 1053404 - RNA, 16 nt, Homo sapiens
cagcuaacaauuguga

SEQ ID NO: 1053405 - RNA, 21 nt, Homo sapiens
cagcuaacucugaccugggag

SEQ ID NO: 1053406 - RNA, 17 nt, Homo sapiens
cagcuaacuuaucauca

SEQ ID NO: 1053407 - RNA, 15 nt, Homo sapiens
cagcucaaaggcaca

SEQ ID NO: 1053408 - RNA, 17 nt, Homo sapiens
cagcucagcgccagccu

SEQ ID NO: 1053409 - RNA, 11 nt, Homo sapiens
cagcucaggga

SEQ ID NO: 1053410 - RNA, 12 nt, Homo sapiens
cagcucagggac

SEQ ID NO: 1053411 - RNA, 11 nt, Homo sapiens
cagcucagggc

SEQ ID NO: 1053412 - RNA, 17 nt, Homo sapiens
cagcuccccagaguccu

SEQ ID NO: 1053413 - RNA, 19 nt, Homo sapiens
cagcuccccagaguccucu

SEQ ID NO: 1053414 - RNA, 17 nt, Homo sapiens
cagcucccucugccuga

SEQ ID NO: 1053415 - RNA, 15 nt, Homo sapiens
cagcucccuucucug

SEQ ID NO: 1053416 - RNA, 21 nt, Homo sapiens
cagcuccuguaacauacuggc

SEQ ID NO: 1053417 - RNA, 19 nt, Homo sapiens
cagcucgggcccucuguga

SEQ ID NO: 1053418 - RNA, 19 nt, Homo sapiens
cagcucuuccgaaaaccag

SEQ ID NO: 1053419 - RNA, 24 nt, Homo sapiens
cagcucuugcuaaucagugucuca

SEQ ID NO: 1053420 - RNA, 22 nt, Homo sapiens
cagcucuuggcuccacugggau

SEQ ID NO: 1053421 - RNA, 24 nt, Homo sapiens
cagcugacuuuucuguccgagcuu

SEQ ID NO: 1053422 - RNA, 19 nt, Homo sapiens
cagcugaucacagacacca

SEQ ID NO: 1053423 - RNA, 19 nt, Homo sapiens
cagcugauugggcaccuga

SEQ ID NO: 1053424 - RNA, 20 nt, Homo sapiens
cagcugcauacaguuugcac

SEQ ID NO: 1053425 - RNA, 19 nt, Homo sapiens
cagcugcgguccacccagg

SEQ ID NO: 1053426 - RNA, 17 nt, Homo sapiens
cagcugcucccaaauaa

SEQ ID NO: 1053427 - RNA, 17 nt, Homo sapiens
cagcuggcgaacccugg

SEQ ID NO: 1053428 - RNA, 22 nt, Homo sapiens
cagcuggcgaacccugggccau

SEQ ID NO: 1053429 - RNA, 23 nt, Homo sapiens
cagcuggcgucaugcaaagucau

SEQ ID NO: 1053430 - RNA, 21 nt, Homo sapiens
cagcuggucaaacaaacucuc

SEQ ID NO: 1053431 - RNA, 16 nt, Homo sapiens
caugcuacacacugca

SEQ ID NO: 1053432 - RNA, 15 nt, Homo sapiens
caugcugcccuguga

SEQ ID NO: 1053433 - RNA, 22 nt, Homo sapiens
caugcugugugacucaaaccaa

SEQ ID NO: 1053434 - RNA, 21 nt, Homo sapiens
caugcugugugcuggagacac

SEQ ID NO: 1053435 - RNA, 21 nt, Homo sapiens
caugcuuccuccuuugcucuu

SEQ ID NO: 1053436 - RNA, 12 nt, Homo sapiens
cauggaaauucc

SEQ ID NO: 1053437 - RNA, 21 nt, Homo sapiens
cauggacacuccagugccagc

SEQ ID NO: 1053438 - RNA, 17 nt, Homo sapiens
cauggagcugcacucua

SEQ ID NO: 1053439 - RNA, 19 nt, Homo sapiens
cauggcacucuauguucua

SEQ ID NO: 1053440 - RNA, 20 nt, Homo sapiens
cauggcuccagaaaugucua

SEQ ID NO: 1053441 - RNA, 21 nt, Homo sapiens
caugggaaggguccaucucag

SEQ ID NO: 1053442 - RNA, 19 nt, Homo sapiens
caugggagacacugaugua

SEQ ID NO: 1053443 - RNA, 15 nt, Homo sapiens
cauggggguauugua

SEQ ID NO: 1053444 - RNA, 20 nt, Homo sapiens
caugguaaaaccccaucucu

SEQ ID NO: 1053445 - RNA, 12 nt, Homo sapiens
cauggucaagua

SEQ ID NO: 1053446 - RNA, 18 nt, Homo sapiens
cauggugaaaauguacug

SEQ ID NO: 1053447 - RNA, 19 nt, Homo sapiens
cauggugaauuaaucacuu

SEQ ID NO: 1053448 - RNA, 20 nt, Homo sapiens
caugguuacaaucauugcug

SEQ ID NO: 1053449 - RNA, 18 nt, Homo sapiens
caugguugaaaccccauc

SEQ ID NO: 1053450 - RNA, 16 nt, Homo sapiens
caugguuuugaaaugc

SEQ ID NO: 1053451 - RNA, 16 nt, Homo sapiens
cauguaaacugugcac

SEQ ID NO: 1053452 - RNA, 22 nt, Homo sapiens
cauguacacggccucaagggau

SEQ ID NO: 1053453 - RNA, 16 nt, Homo sapiens
cauguacuguucucuu

SEQ ID NO: 1053454 - RNA, 17 nt, Homo sapiens
cauguaguaguacuuga

SEQ ID NO: 1053455 - RNA, 13 nt, Homo sapiens
cauguaugucuug

SEQ ID NO: 1053456 - RNA, 23 nt, Homo sapiens
caugucaacuucuggcuccucaa

SEQ ID NO: 1053457 - RNA, 23 nt, Homo sapiens
caugucagcaucagcucagggcu

SEQ ID NO: 1053458 - RNA, 12 nt, Homo sapiens
caugucagcucc

SEQ ID NO: 1053459 - RNA, 12 nt, Homo sapiens
caugucugcaaa

SEQ ID NO: 1053460 - RNA, 15 nt, Homo sapiens
caugugacacauaug

SEQ ID NO: 1053461 - RNA, 18 nt, Homo sapiens
caugugacacauaugcac

SEQ ID NO: 1053462 - RNA, 19 nt, Homo sapiens
caugugacacauaugcacc

SEQ ID NO: 1053463 - RNA, 20 nt, Homo sapiens
caugugacacauaugcaccu

SEQ ID NO: 1053464 - RNA, 19 nt, Homo sapiens
caugugacuggcaguauua

SEQ ID NO: 1053465 - RNA, 17 nt, Homo sapiens
caugugcacaugcacgu

SEQ ID NO: 1053466 - RNA, 13 nt, Homo sapiens
cauguguauuucc

SEQ ID NO: 1053467 - RNA, 19 nt, Homo sapiens
caugugugagugugugcaa

SEQ ID NO: 1053468 - RNA, 17 nt, Homo sapiens
caugugugcgagugugu

SEQ ID NO: 1053469 - RNA, 23 nt, Homo sapiens
caugugugcgugugcgugcaugu

SEQ ID NO: 1053470 - RNA, 12 nt, Homo sapiens
caugugugugca

SEQ ID NO: 1053471 - RNA, 14 nt, Homo sapiens
caugugugugcaag

SEQ ID NO: 1053472 - RNA, 16 nt, Homo sapiens
cauguuacucaugacu

SEQ ID NO: 1053473 - RNA, 22 nt, Homo sapiens
cauguuggccaggcuggucuca

SEQ ID NO: 1053474 - RNA, 22 nt, Homo sapiens
cauguuucaagaaaauggauuu

SEQ ID NO: 1053475 - RNA, 19 nt, Homo sapiens
cauguuuuaacaaaaacca

SEQ ID NO: 1053476 - RNA, 20 nt, Homo sapiens
cauuaaaacugaagucugaa

SEQ ID NO: 1053477 - RNA, 14 nt, Homo sapiens
cauuaaacugaauc

SEQ ID NO: 1053478 - RNA, 15 nt, Homo sapiens
cauuaaacuuaccug

SEQ ID NO: 1053479 - RNA, 12 nt, Homo sapiens
cauuaaagccau

SEQ ID NO: 1053480 - RNA, 14 nt, Homo sapiens
cauuaauacaaaga

SEQ ID NO: 1053481 - RNA, 12 nt, Homo sapiens
cauuaccacuca

SEQ ID NO: 1053482 - RNA, 17 nt, Homo sapiens
cauuaccauggagacaa

SEQ ID NO: 1053483 - RNA, 12 nt, Homo sapiens
cauuacccucag

SEQ ID NO: 1053484 - RNA, 17 nt, Homo sapiens
cauuaccuucucccuca

SEQ ID NO: 1053485 - RNA, 18 nt, Homo sapiens
cauuagaccaagcuuguc

SEQ ID NO: 1053486 - RNA, 19 nt, Homo sapiens
cauuagaccaagcuugucc

SEQ ID NO: 1053487 - RNA, 23 nt, Homo sapiens
cauuagagcaggcguucagcuca

SEQ ID NO: 1053488 - RNA, 20 nt, Homo sapiens
cauuagccuaugugcaugca

SEQ ID NO: 1053489 - RNA, 14 nt, Homo sapiens
cauuauacauuuga

SEQ ID NO: 1053490 - RNA, 19 nt, Homo sapiens
cauuauuaaauguuucuca

SEQ ID NO: 1053491 - RNA, 18 nt, Homo sapiens
cauuauuucucucugacc

SEQ ID NO: 1053492 - RNA, 19 nt, Homo sapiens
cauuauuuuuccacuuugu

SEQ ID NO: 1053493 - RNA, 20 nt, Homo sapiens
cauucacucauacaucuggc

SEQ ID NO: 1053494 - RNA, 12 nt, Homo sapiens
cauucacuuguu

SEQ ID NO: 1053495 - RNA, 17 nt, Homo sapiens
cauucagagagcagcuu

SEQ ID NO: 1053496 - RNA, 20 nt, Homo sapiens
cauucaggauucuguuccuu

SEQ ID NO: 1053497 - RNA, 17 nt, Homo sapiens
cauucagggauagcacu

SEQ ID NO: 1053498 - RNA, 16 nt, Homo sapiens
cauucaucucauucca

SEQ ID NO: 1053499 - RNA, 17 nt, Homo sapiens
cauucauuuauucauuc

SEQ ID NO: 1053500 - RNA, 21 nt, Homo sapiens
cauucccguggaacguuuuuc

SEQ ID NO: 1053501 - RNA, 12 nt, Homo sapiens
cauuccuaacac

SEQ ID NO: 1053502 - RNA, 21 nt, Homo sapiens
cauuccugaaagaaacaguua

SEQ ID NO: 1053503 - RNA, 15 nt, Homo sapiens
cauucgaguguuuca

SEQ ID NO: 1053504 - RNA, 17 nt, Homo sapiens
cauucuaguacuuggga

SEQ ID NO: 1053505 - RNA, 19 nt, Homo sapiens
cauucuccuuguguuacua

SEQ ID NO: 1053506 - RNA, 16 nt, Homo sapiens
cauucuggcucaggga

SEQ ID NO: 1053507 - RNA, 13 nt, Homo sapiens
cauugaauuugcc

SEQ ID NO: 1053508 - RNA, 23 nt, Homo sapiens
cauugagaacugcauauguuucg

SEQ ID NO: 1053509 - RNA, 10 nt, Homo sapiens
cauugcacag

SEQ ID NO: 1053510 - RNA, 13 nt, Homo sapiens
cauugcacuccag

SEQ ID NO: 1053511 - RNA, 18 nt, Homo sapiens
cauugcacuccagccugg

SEQ ID NO: 1053512 - RNA, 12 nt, Homo sapiens
uugcacuugucu

SEQ ID NO: 1053513 - RNA, 14 nt, Homo sapiens
uugcagacaggcaa

SEQ ID NO: 1053514 - RNA, 15 nt, Homo sapiens
uugcagaugacaaaa

SEQ ID NO: 1053515 - RNA, 16 nt, Homo sapiens
uugcagccccacagac

SEQ ID NO: 1053516 - RNA, 17 nt, Homo sapiens
uugcagcuggacuucuc

SEQ ID NO: 1053517 - RNA, 21 nt, Homo sapiens
uugcagcuuauauucauccau

SEQ ID NO: 1053518 - RNA, 14 nt, Homo sapiens
uugcaggcaugcau

SEQ ID NO: 1053519 - RNA, 15 nt, Homo sapiens
uugcaggcaugcaug

SEQ ID NO: 1053520 - RNA, 23 nt, Homo sapiens
uugcaggggauugaagcccucca

SEQ ID NO: 1053521 - RNA, 20 nt, Homo sapiens
uugcagguugcuuugcccug

SEQ ID NO: 1053522 - RNA, 20 nt, Homo sapiens
uugcagugagccaagaucac

SEQ ID NO: 1053523 - RNA, 17 nt, Homo sapiens
uugcauauguaaggaag

SEQ ID NO: 1053524 - RNA, 17 nt, Homo sapiens
uugcauauguaugacuc

SEQ ID NO: 1053525 - RNA, 20 nt, Homo sapiens
uugcaucguggagacagggc

SEQ ID NO: 1053526 - RNA, 21 nt, Homo sapiens
uugcaucguggagacagggca

SEQ ID NO: 1053527 - RNA, 19 nt, Homo sapiens
uugcaucuggguagcugua

SEQ ID NO: 1053528 - RNA, 12 nt, Homo sapiens
uugcaugggcua

SEQ ID NO: 1053529 - RNA, 17 nt, Homo sapiens
uugcaugugacucugaa

SEQ ID NO: 1053530 - RNA, 14 nt, Homo sapiens
uugcauuaauauug

SEQ ID NO: 1053531 - RNA, 23 nt, Homo sapiens
uugcauuuaauuuauugaggcuu

SEQ ID NO: 1053532 - RNA, 17 nt, Homo sapiens
uugccaaagguccaaua

SEQ ID NO: 1053533 - RNA, 23 nt, Homo sapiens
uugccaagcucaggaccaggcaa

SEQ ID NO: 1053534 - RNA, 16 nt, Homo sapiens
uugccacuacccccuc

SEQ ID NO: 1053535 - RNA, 15 nt, Homo sapiens
uugccauaaagucaa

SEQ ID NO: 1053536 - RNA, 14 nt, Homo sapiens
uugccauguuggcc

SEQ ID NO: 1053537 - RNA, 19 nt, Homo sapiens
uugccauuaaacuuaccug

SEQ ID NO: 1053538 - RNA, 19 nt, Homo sapiens
uugccauuacucaauugau

SEQ ID NO: 1053539 - RNA, 21 nt, Homo sapiens
uugcccaggcuggagugcaau

SEQ ID NO: 1053540 - RNA, 19 nt, Homo sapiens
uugcccugaguggaucucc

SEQ ID NO: 1053541 - RNA, 17 nt, Homo sapiens
uugcccuucacaguguu

SEQ ID NO: 1053542 - RNA, 14 nt, Homo sapiens
uugccuaaacccua

SEQ ID NO: 1053543 - RNA, 13 nt, Homo sapiens
uugccuccucacc

SEQ ID NO: 1053544 - RNA, 21 nt, Homo sapiens
uugccugaaguuggagugagu

SEQ ID NO: 1053545 - RNA, 23 nt, Homo sapiens
uugccugcacaaacucaccaucu

SEQ ID NO: 1053546 - RNA, 17 nt, Homo sapiens
uugccugcaugaaacau

SEQ ID NO: 1053547 - RNA, 17 nt, Homo sapiens
uugcgcauucucaugga

SEQ ID NO: 1053548 - RNA, 15 nt, Homo sapiens
uugcuaaaauauuau

SEQ ID NO: 1053549 - RNA, 21 nt, Homo sapiens
uugcuaaauguaacagucuga

SEQ ID NO: 1053550 - RNA, 20 nt, Homo sapiens
uugcuacccagaaauccauc

SEQ ID NO: 1053551 - RNA, 17 nt, Homo sapiens
uugcuacugguucagca

SEQ ID NO: 1053552 - RNA, 18 nt, Homo sapiens
uugcuauucccaugcauu

SEQ ID NO: 1053553 - RNA, 11 nt, Homo sapiens
uugcucaaggc

SEQ ID NO: 1053554 - RNA, 22 nt, Homo sapiens
uugcuccuggcuggggccuguu

SEQ ID NO: 1053555 - RNA, 12 nt, Homo sapiens
uugcugccacau

SEQ ID NO: 1053556 - RNA, 21 nt, Homo sapiens
uugcugucauaagaaugaaua

SEQ ID NO: 1053557 - RNA, 13 nt, Homo sapiens
uugcuguuuccuu

SEQ ID NO: 1053558 - RNA, 15 nt, Homo sapiens
uugcuguuugcaauu

SEQ ID NO: 1053559 - RNA, 12 nt, Homo sapiens
uugcuucacuca

SEQ ID NO: 1053560 - RNA, 19 nt, Homo sapiens
uugcuugcacaaaccaauu

SEQ ID NO: 1053561 - RNA, 21 nt, Homo sapiens
uugcuuguaaaauuucacuua

SEQ ID NO: 1053562 - RNA, 23 nt, Homo sapiens
uuggaagagccugcaggugcugc

SEQ ID NO: 1053563 - RNA, 15 nt, Homo sapiens
uuggaaugcuguauu

SEQ ID NO: 1053564 - RNA, 20 nt, Homo sapiens
uuggaauuaugucugcugaa

SEQ ID NO: 1053565 - RNA, 23 nt, Homo sapiens
uuggaauuaugucugcugaauaa

SEQ ID NO: 1053566 - RNA, 19 nt, Homo sapiens
uuggacagaagcagcucuu

SEQ ID NO: 1053567 - RNA, 19 nt, Homo sapiens
uuggaccuguucaaaaagg

SEQ ID NO: 1053568 - RNA, 21 nt, Homo sapiens
uuggacucaagcaagauuuca

SEQ ID NO: 1053569 - RNA, 23 nt, Homo sapiens
uuggagggguauuuuugcccuga

SEQ ID NO: 1053570 - RNA, 17 nt, Homo sapiens
uuggagggugucccaaa

SEQ ID NO: 1053571 - RNA, 18 nt, Homo sapiens
uuggauuauucauuuaaa

SEQ ID NO: 1053572 - RNA, 15 nt, Homo sapiens
uuggauuguccccga

SEQ ID NO: 1053573 - RNA, 17 nt, Homo sapiens
uuggauuuauucugcca

SEQ ID NO: 1053574 - RNA, 13 nt, Homo sapiens
uuggcaacagaag

SEQ ID NO: 1053575 - RNA, 18 nt, Homo sapiens
ccagagacggaagccuuu

SEQ ID NO: 1053576 - RNA, 19 nt, Homo sapiens
ccagagaggguggugaccu

SEQ ID NO: 1053577 - RNA, 15 nt, Homo sapiens
ccagagcagaugcag

SEQ ID NO: 1053578 - RNA, 16 nt, Homo sapiens
ccagagcagaugcaga

SEQ ID NO: 1053579 - RNA, 15 nt, Homo sapiens
ccagagccauggacu

SEQ ID NO: 1053580 - RNA, 16 nt, Homo sapiens
ccagagcuacugacua

SEQ ID NO: 1053581 - RNA, 17 nt, Homo sapiens
ccagaggaaacuugcau

SEQ ID NO: 1053582 - RNA, 18 nt, Homo sapiens
ccagaggcuuaaucacac

SEQ ID NO: 1053583 - RNA, 15 nt, Homo sapiens
ccagagggcacucug

SEQ ID NO: 1053584 - RNA, 22 nt, Homo sapiens
ccagagggugggcuucagggcg

SEQ ID NO: 1053585 - RNA, 20 nt, Homo sapiens
ccagaguggccuggccagga

SEQ ID NO: 1053586 - RNA, 21 nt, Homo sapiens
ccagaguuccccaugcagaca

SEQ ID NO: 1053587 - RNA, 15 nt, Homo sapiens
ccagauauuucacau

SEQ ID NO: 1053588 - RNA, 22 nt, Homo sapiens
ccagaugccuucuccagacaaa

SEQ ID NO: 1053589 - RNA, 19 nt, Homo sapiens
ccagaugucgcccuacuca

SEQ ID NO: 1053590 - RNA, 16 nt, Homo sapiens
ccagauguuagaucag

SEQ ID NO: 1053591 - RNA, 20 nt, Homo sapiens
ccagauucuaccacacagca

SEQ ID NO: 1053592 - RNA, 18 nt, Homo sapiens
ccagauuuacacugggag

SEQ ID NO: 1053593 - RNA, 16 nt, Homo sapiens
ccagcaacacaagcug

SEQ ID NO: 1053594 - RNA, 17 nt, Homo sapiens
ccagcaaugacaucuca

SEQ ID NO: 1053595 - RNA, 17 nt, Homo sapiens
ccagcacccugcaaaau

SEQ ID NO: 1053596 - RNA, 16 nt, Homo sapiens
ccagcacugcccaaag

SEQ ID NO: 1053597 - RNA, 21 nt, Homo sapiens
ccagcacuuugggaggcugag

SEQ ID NO: 1053598 - RNA, 19 nt, Homo sapiens
ccagcagcuggaaucugaa

SEQ ID NO: 1053599 - RNA, 16 nt, Homo sapiens
ccagcaggacagugac

SEQ ID NO: 1053600 - RNA, 19 nt, Homo sapiens
ccagcauccccaacugcga

SEQ ID NO: 1053601 - RNA, 12 nt, Homo sapiens
ccagcaucuccc

SEQ ID NO: 1053602 - RNA, 15 nt, Homo sapiens
ccagccagauccucu

SEQ ID NO: 1053603 - RNA, 14 nt, Homo sapiens
ccagccaugcauug

SEQ ID NO: 1053604 - RNA, 14 nt, Homo sapiens
ccagccuccaugcu

SEQ ID NO: 1053605 - RNA, 16 nt, Homo sapiens
ccagccugccuggcag

SEQ ID NO: 1053606 - RNA, 22 nt, Homo sapiens
ccagccugcuaauuccccagau

SEQ ID NO: 1053607 - RNA, 13 nt, Homo sapiens
ccagccuggaucu

SEQ ID NO: 1053608 - RNA, 20 nt, Homo sapiens
ccagccugggugacagagca

SEQ ID NO: 1053609 - RNA, 17 nt, Homo sapiens
ccagccuuccucugcag

SEQ ID NO: 1053610 - RNA, 21 nt, Homo sapiens
ccagccuuccucugcagcuga

SEQ ID NO: 1053611 - RNA, 15 nt, Homo sapiens
ccagcgucccagucu

SEQ ID NO: 1053612 - RNA, 12 nt, Homo sapiens
ccagcuacucag

SEQ ID NO: 1053613 - RNA, 20 nt, Homo sapiens
ccagcuauugauauaaauaa

SEQ ID NO: 1053614 - RNA, 18 nt, Homo sapiens
ccagcucacgucacacuu

SEQ ID NO: 1053615 - RNA, 17 nt, Homo sapiens
ccagcucagggcucuuu

SEQ ID NO: 1053616 - RNA, 15 nt, Homo sapiens
ccagcuccucaucca

SEQ ID NO: 1053617 - RNA, 13 nt, Homo sapiens
ccagcugcuccca

SEQ ID NO: 1053618 - RNA, 14 nt, Homo sapiens
ccagcuggccugua

SEQ ID NO: 1053619 - RNA, 14 nt, Homo sapiens
ccagcuucaggcag

SEQ ID NO: 1053620 - RNA, 19 nt, Homo sapiens
ccagcuugggcccagcugg

SEQ ID NO: 1053621 - RNA, 19 nt, Homo sapiens
ccagcuuucccugccucuc

SEQ ID NO: 1053622 - RNA, 14 nt, Homo sapiens
ccagcuuugcagug

SEQ ID NO: 1053623 - RNA, 23 nt, Homo sapiens
ccaggaggcagcuguugcaguga

SEQ ID NO: 1053624 - RNA, 22 nt, Homo sapiens
ccaggagguggaggcugcagug

SEQ ID NO: 1053625 - RNA, 15 nt, Homo sapiens
ccaggaucauggugu

SEQ ID NO: 1053626 - RNA, 19 nt, Homo sapiens
ccaggaucaugguguaaua

SEQ ID NO: 1053627 - RNA, 20 nt, Homo sapiens
ccaggaucaugguguaauaa

SEQ ID NO: 1053628 - RNA, 13 nt, Homo sapiens
ccaggcaaagcaa

SEQ ID NO: 1053629 - RNA, 17 nt, Homo sapiens
ccaggcaggugccugga

SEQ ID NO: 1053630 - RNA, 18 nt, Homo sapiens
ccaggccgggguggagca

SEQ ID NO: 1053631 - RNA, 16 nt, Homo sapiens
ccaggcuggagugcaa

SEQ ID NO: 1053632 - RNA, 18 nt, Homo sapiens
ccaggcuggagugcaaug

SEQ ID NO: 1053633 - RNA, 20 nt, Homo sapiens
ccaggcuggagugcaauggc

SEQ ID NO: 1053634 - RNA, 18 nt, Homo sapiens
ccaggcuggagugcagug

SEQ ID NO: 1053635 - RNA, 20 nt, Homo sapiens
ccaggcuggagugcagugga

SEQ ID NO: 1053636 - RNA, 13 nt, Homo sapiens
ccagggcacugag

SEQ ID NO: 1053637 - RNA, 18 nt, Homo sapiens
ccagggccacucugccuc

SEQ ID NO: 1053638 - RNA, 10 nt, Homo sapiens
ccaggggaug

SEQ ID NO: 1053639 - RNA, 13 nt, Homo sapiens
ccagggucucacu

SEQ ID NO: 1053640 - RNA, 15 nt, Homo sapiens
ccaggucucacgggc

SEQ ID NO: 1053641 - RNA, 16 nt, Homo sapiens
ccaguaauugguccga

SEQ ID NO: 1053642 - RNA, 12 nt, Homo sapiens
ccaguccaugag

SEQ ID NO: 1053643 - RNA, 20 nt, Homo sapiens
ccaguccuguuugcagggaa

SEQ ID NO: 1053644 - RNA, 14 nt, Homo sapiens
ccagucucuggcag

SEQ ID NO: 1053645 - RNA, 11 nt, Homo sapiens
ccagucuuccu

SEQ ID NO: 1053646 - RNA, 13 nt, Homo sapiens
ccagugaaccaaa

SEQ ID NO: 1053647 - RNA, 14 nt, Homo sapiens
ccagugaaccaaag

SEQ ID NO: 1053648 - RNA, 17 nt, Homo sapiens
ccagugaaccaaagaga

SEQ ID NO: 1053649 - RNA, 13 nt, Homo sapiens
ccagugacacuuc

SEQ ID NO: 1053650 - RNA, 19 nt, Homo sapiens
ccagugagacagcucugca

SEQ ID NO: 1053651 - RNA, 20 nt, Homo sapiens
ccagugcaacacugaagcuc

SEQ ID NO: 1053652 - RNA, 21 nt, Homo sapiens
ccaguggcuggaucugugagg

SEQ ID NO: 1053653 - RNA, 19 nt, Homo sapiens
ccaguggugaagaaaacuc

SEQ ID NO: 1053654 - RNA, 22 nt, Homo sapiens
ccaguguccccuccacugucac

SEQ ID NO: 1053655 - RNA, 23 nt, Homo sapiens
ccaguguccccuccacugucaca

SEQ ID NO: 1053656 - RNA, 20 nt, Homo sapiens
ccaguguguuucugaucuga

SEQ ID NO: 1053657 - RNA, 13 nt, Homo sapiens
ccaguguuuacaa

SEQ ID NO: 1053658 - RNA, 19 nt, Homo sapiens
ccaguucauugcacuuuga

SEQ ID NO: 1053659 - RNA, 20 nt, Homo sapiens
ccaguucauugcacuuugau

SEQ ID NO: 1053660 - RNA, 20 nt, Homo sapiens
ccaguuggagcagaugccuc

SEQ ID NO: 1053661 - RNA, 13 nt, Homo sapiens
ccaguuucagggc

SEQ ID NO: 1053662 - RNA, 21 nt, Homo sapiens
ccauaaaggggagggacucau

SEQ ID NO: 1053663 - RNA, 18 nt, Homo sapiens
ccauacacacuguuguca

SEQ ID NO: 1053664 - RNA, 20 nt, Homo sapiens
ccauacacacuguugucaaa

SEQ ID NO: 1053665 - RNA, 19 nt, Homo sapiens
ccauaccacccaaugcuga

SEQ ID NO: 1053666 - RNA, 14 nt, Homo sapiens
ccauagcaccucca

SEQ ID NO: 1053667 - RNA, 21 nt, Homo sapiens
ccauaguaguaugaugauaca

SEQ ID NO: 1053668 - RNA, 16 nt, Homo sapiens
ccauagugaccaacau

SEQ ID NO: 1053669 - RNA, 21 nt, Homo sapiens
ccauauacucuucaaggacuu

SEQ ID NO: 1053670 - RNA, 18 nt, Homo sapiens
ccauaugaccucaugcau

SEQ ID NO: 1053671 - RNA, 12 nt, Homo sapiens
ccauauuuucac

SEQ ID NO: 1053672 - RNA, 19 nt, Homo sapiens
ccaucaacaagucuugaaa

SEQ ID NO: 1053673 - RNA, 11 nt, Homo sapiens
uuugcuuuaau

SEQ ID NO: 1053674 - RNA, 22 nt, Homo sapiens
uuuggaagugaggcauugcaca

SEQ ID NO: 1053675 - RNA, 17 nt, Homo sapiens
uuuggaauauuguccau

SEQ ID NO: 1053676 - RNA, 19 nt, Homo sapiens
uuuggacauggcucacaaa

SEQ ID NO: 1053677 - RNA, 17 nt, Homo sapiens
uuuggaugaccagaaca

SEQ ID NO: 1053678 - RNA, 19 nt, Homo sapiens
uuuggccuaacccucagaa

SEQ ID NO: 1053679 - RNA, 17 nt, Homo sapiens
uuugggacaaaacagaa

SEQ ID NO: 1053680 - RNA, 21 nt, Homo sapiens
uuugggagaaaacgucuugcu

SEQ ID NO: 1053681 - RNA, 19 nt, Homo sapiens
uuugggguguggaugucga

SEQ ID NO: 1053682 - RNA, 22 nt, Homo sapiens
uuuggguucacagaagcacagc

SEQ ID NO: 1053683 - RNA, 16 nt, Homo sapiens
uuugguuaaacccaug

SEQ ID NO: 1053684 - RNA, 13 nt, Homo sapiens
uuugguugcuuua

SEQ ID NO: 1053685 - RNA, 22 nt, Homo sapiens
uuuguaaucucauaacuuucca

SEQ ID NO: 1053686 - RNA, 21 nt, Homo sapiens
uuuguagagccagggucucac

SEQ ID NO: 1053687 - RNA, 16 nt, Homo sapiens
uuuguaggcauugcau

SEQ ID NO: 1053688 - RNA, 22 nt, Homo sapiens
uuuguauucucuuccucaucca

SEQ ID NO: 1053689 - RNA, 15 nt, Homo sapiens
uuugucucaccucau

SEQ ID NO: 1053690 - RNA, 23 nt, Homo sapiens
uuugugaaaugaaaacauguaau

SEQ ID NO: 1053691 - RNA, 22 nt, Homo sapiens
uuuguuaguaugaggcauuugu

SEQ ID NO: 1053692 - RNA, 18 nt, Homo sapiens
uuuguuauuuuuccccaa

SEQ ID NO: 1053693 - RNA, 14 nt, Homo sapiens
uuuguugagccuaa

SEQ ID NO: 1053694 - RNA, 15 nt, Homo sapiens
uuuguugcagccaaa

SEQ ID NO: 1053695 - RNA, 14 nt, Homo sapiens
uuuguuuuaaauac

SEQ ID NO: 1053696 - RNA, 20 nt, Homo sapiens
uuuguuuuguaucauuauga

SEQ ID NO: 1053697 - RNA, 21 nt, Homo sapiens
uuuuaaaaguuucaaugugau

SEQ ID NO: 1053698 - RNA, 22 nt, Homo sapiens
uuuuaaaaguuucaaugugauu

SEQ ID NO: 1053699 - RNA, 23 nt, Homo sapiens
uuuuaaaaugagagucacuugau

SEQ ID NO: 1053700 - RNA, 22 nt, Homo sapiens
uuuuaaaguauguuauugcaua

SEQ ID NO: 1053701 - RNA, 13 nt, Homo sapiens
uuuuaaccaguuc

SEQ ID NO: 1053702 - RNA, 17 nt, Homo sapiens
uuuuaaccccauuugca

SEQ ID NO: 1053703 - RNA, 12 nt, Homo sapiens
uuuuaacucugu

SEQ ID NO: 1053704 - RNA, 17 nt, Homo sapiens
uuuuaacucugucuuca

SEQ ID NO: 1053705 - RNA, 14 nt, Homo sapiens
uuuuaagacuauaa

SEQ ID NO: 1053706 - RNA, 20 nt, Homo sapiens
uuuuaauuuuuugucaagac

SEQ ID NO: 1053707 - RNA, 17 nt, Homo sapiens
uuuuacagugcuauuua

SEQ ID NO: 1053708 - RNA, 16 nt, Homo sapiens
uuuuacauacugcugu

SEQ ID NO: 1053709 - RNA, 17 nt, Homo sapiens
uuuuacauguggcccaa

SEQ ID NO: 1053710 - RNA, 17 nt, Homo sapiens
uuuuacucaugaucuug

SEQ ID NO: 1053711 - RNA, 14 nt, Homo sapiens
uuuuauacuuucag

SEQ ID NO: 1053712 - RNA, 18 nt, Homo sapiens
uuuuaugaaacauuacag

SEQ ID NO: 1053713 - RNA, 16 nt, Homo sapiens
uuuuaugaaagcacug

SEQ ID NO: 1053714 - RNA, 15 nt, Homo sapiens
uuuuaugaucuuggc

SEQ ID NO: 1053715 - RNA, 23 nt, Homo sapiens
uuuuauggaggcuuugcauagau

SEQ ID NO: 1053716 - RNA, 23 nt, Homo sapiens
uuuuauguguggcccaagacaau

SEQ ID NO: 1053717 - RNA, 18 nt, Homo sapiens
uuuucaaagauguguugc

SEQ ID NO: 1053718 - RNA, 17 nt, Homo sapiens
uuuucauugauaugaaa

SEQ ID NO: 1053719 - RNA, 16 nt, Homo sapiens
cggagcuugcagugag

SEQ ID NO: 1053720 - RNA, 16 nt, Homo sapiens
cggagucucgcucugu

SEQ ID NO: 1053721 - RNA, 21 nt, Homo sapiens
cggaucuggggcucugggaua

SEQ ID NO: 1053722 - RNA, 19 nt, Homo sapiens
cggaucuuuggacagaagc

SEQ ID NO: 1053723 - RNA, 17 nt, Homo sapiens
cggcaaccccaguucug

SEQ ID NO: 1053724 - RNA, 15 nt, Homo sapiens
cggcagccuggaugu

SEQ ID NO: 1053725 - RNA, 21 nt, Homo sapiens
cggcagggugucccaggagcc

SEQ ID NO: 1053726 - RNA, 19 nt, Homo sapiens
cggcaggugcucuguggau

SEQ ID NO: 1053727 - RNA, 20 nt, Homo sapiens
cggcaguucugggugcuccc

SEQ ID NO: 1053728 - RNA, 18 nt, Homo sapiens
cggccacuggccaucucc

SEQ ID NO: 1053729 - RNA, 15 nt, Homo sapiens
cggccagguacaaca

SEQ ID NO: 1053730 - RNA, 23 nt, Homo sapiens
cggcucaugccuguaaucccagc

SEQ ID NO: 1053731 - RNA, 19 nt, Homo sapiens
cggcuccucggacucugcu

SEQ ID NO: 1053732 - RNA, 17 nt, Homo sapiens
cggcucucaccaguggc

SEQ ID NO: 1053733 - RNA, 16 nt, Homo sapiens
cggcuuguaaauguga

SEQ ID NO: 1053734 - RNA, 12 nt, Homo sapiens
cggcuuuaccaa

SEQ ID NO: 1053735 - RNA, 13 nt, Homo sapiens
cgggaacaguguu

SEQ ID NO: 1053736 - RNA, 21 nt, Homo sapiens
cgggaagcgaugaauuuggag

SEQ ID NO: 1053737 - RNA, 14 nt, Homo sapiens
cgggaccccgagcc

SEQ ID NO: 1053738 - RNA, 21 nt, Homo sapiens
cgggcugagaacccugcgugg

SEQ ID NO: 1053739 - RNA, 20 nt, Homo sapiens
cggggcuugcaacuuagcuc

SEQ ID NO: 1053740 - RNA, 23 nt, Homo sapiens
cgggggcuuggcugugcccucag

SEQ ID NO: 1053741 - RNA, 21 nt, Homo sapiens
cggguccccaaaccuguuccc

SEQ ID NO: 1053742 - RNA, 19 nt, Homo sapiens
cgggugggcggcacagccu

SEQ ID NO: 1053743 - RNA, 23 nt, Homo sapiens
cgguccgcagaagcagaccucau

SEQ ID NO: 1053744 - RNA, 13 nt, Homo sapiens
cggugagaacucu

SEQ ID NO: 1053745 - RNA, 16 nt, Homo sapiens
cggugagaacucugcc

SEQ ID NO: 1053746 - RNA, 13 nt, Homo sapiens
cggugagcauugu

SEQ ID NO: 1053747 - RNA, 19 nt, Homo sapiens
cggugguucacgccuguaa

SEQ ID NO: 1053748 - RNA, 22 nt, Homo sapiens
cgguuggaaauagaaauuucca

SEQ ID NO: 1053749 - RNA, 19 nt, Homo sapiens
cguagcuucuaccaugaac

SEQ ID NO: 1053750 - RNA, 21 nt, Homo sapiens
cguauuuuuucuaaugugcau

SEQ ID NO: 1053751 - RNA, 17 nt, Homo sapiens
cgucaaagcaguaguca

SEQ ID NO: 1053752 - RNA, 13 nt, Homo sapiens
cguccuacuguau

SEQ ID NO: 1053753 - RNA, 15 nt, Homo sapiens
cgucgcacagucucu

SEQ ID NO: 1053754 - RNA, 17 nt, Homo sapiens
cgucuaagucaugagcu

SEQ ID NO: 1053755 - RNA, 20 nt, Homo sapiens
cgucucuacuaaaaauacaa

SEQ ID NO: 1053756 - RNA, 15 nt, Homo sapiens
cgucuucuguauacu

SEQ ID NO: 1053757 - RNA, 16 nt, Homo sapiens
cgugacuguggcacac

SEQ ID NO: 1053758 - RNA, 15 nt, Homo sapiens
cgugaggaugggaag

SEQ ID NO: 1053759 - RNA, 16 nt, Homo sapiens
cgugagucugcaucuu

SEQ ID NO: 1053760 - RNA, 16 nt, Homo sapiens
cgugaucaaagccaca

SEQ ID NO: 1053761 - RNA, 19 nt, Homo sapiens
cgugaugaaaacuuucuaa

SEQ ID NO: 1053762 - RNA, 22 nt, Homo sapiens
cgugcuuuucugcggcugugua

SEQ ID NO: 1053763 - RNA, 17 nt, Homo sapiens
cguggacucugcacaug

SEQ ID NO: 1053764 - RNA, 21 nt, Homo sapiens
cguggacucugcacaugucuu

SEQ ID NO: 1053765 - RNA, 14 nt, Homo sapiens
cguggagcugccug

SEQ ID NO: 1053766 - RNA, 13 nt, Homo sapiens
cgugggcucccug

SEQ ID NO: 1053767 - RNA, 21 nt, Homo sapiens
cguggucacugcugucaucaa

SEQ ID NO: 1053768 - RNA, 20 nt, Homo sapiens
cgugucucagacugcaugua

SEQ ID NO: 1053769 - RNA, 14 nt, Homo sapiens
cgugugcgugcaug

SEQ ID NO: 1053770 - RNA, 19 nt, Homo sapiens
cgugugcgugcaugugcac

SEQ ID NO: 1053771 - RNA, 15 nt, Homo sapiens
cguguguagaguuaa

SEQ ID NO: 1053772 - RNA, 15 nt, Homo sapiens
cguguguccaugugu

SEQ ID NO: 1053773 - RNA, 15 nt, Homo sapiens
cguuagaaguugaau

SEQ ID NO: 1053774 - RNA, 23 nt, Homo sapiens
cguuccuguuagcauaaugugag

SEQ ID NO: 1053775 - RNA, 20 nt, Homo sapiens
cguugaagaggaagggcaaa

SEQ ID NO: 1053776 - RNA, 14 nt, Homo sapiens
cguugugcauuugg

SEQ ID NO: 1053777 - RNA, 23 nt, Homo sapiens
cguuuacaagcccccccuuccac

SEQ ID NO: 1053778 - RNA, 17 nt, Homo sapiens
cguuuccuuucauuuac

SEQ ID NO: 1053779 - RNA, 22 nt, Homo sapiens
cguuucuccaccuagacuguaa

SEQ ID NO: 1053780 - RNA, 16 nt, Homo sapiens
cguuugaacucaggga

SEQ ID NO: 1053781 - RNA, 18 nt, Homo sapiens
cguuuguuuguuucaaua

SEQ ID NO: 1053782 - RNA, 13 nt, Homo sapiens
cuaaaaaucauga

SEQ ID NO: 1053783 - RNA, 17 nt, Homo sapiens
cuaaaaaucaugagauc

SEQ ID NO: 1053784 - RNA, 17 nt, Homo sapiens
cuaaaacaaaagcucau

SEQ ID NO: 1053785 - RNA, 13 nt, Homo sapiens
cuaaaacaguccu

SEQ ID NO: 1053786 - RNA, 14 nt, Homo sapiens
cuaaaaccaucaua

SEQ ID NO: 1053787 - RNA, 15 nt, Homo sapiens
cuaaaaccugagcua

SEQ ID NO: 1053788 - RNA, 17 nt, Homo sapiens
cuaaaacuuaacauuca

SEQ ID NO: 1053789 - RNA, 16 nt, Homo sapiens
cuaaaagguaugcaau

SEQ ID NO: 1053790 - RNA, 21 nt, Homo sapiens
cuaaaaggugaccaaugaugg

SEQ ID NO: 1053791 - RNA, 23 nt, Homo sapiens
cuaaaaugauuuuaucugugaau

SEQ ID NO: 1053792 - RNA, 17 nt, Homo sapiens
cuaaacuauaugccaua

SEQ ID NO: 1053793 - RNA, 14 nt, Homo sapiens
cuaaagaguuuauu

SEQ ID NO: 1053794 - RNA, 15 nt, Homo sapiens
cuaaagcaauaugca

SEQ ID NO: 1053795 - RNA, 16 nt, Homo sapiens
cuaaagguuguauugc

SEQ ID NO: 1053796 - RNA, 17 nt, Homo sapiens
cuaaaguauaucuuuaa

SEQ ID NO: 1053797 - RNA, 16 nt, Homo sapiens
cuaaaguaucuguauu

SEQ ID NO: 1053798 - RNA, 22 nt, Homo sapiens
cuaaaguuaaauaggauauuaa

SEQ ID NO: 1053799 - RNA, 20 nt, Homo sapiens
cuaaauaauguuaucugugu

SEQ ID NO: 1053800 - RNA, 21 nt, Homo sapiens
cuaaauaauguuaucugugua

SEQ ID NO: 1053801 - RNA, 17 nt, Homo sapiens
cuaaaucaauucuauua

SEQ ID NO: 1053802 - RNA, 18 nt, Homo sapiens
cuaaauccuuuacuguua

SEQ ID NO: 1053803 - RNA, 15 nt, Homo sapiens
cuaaaugaagugcaa

SEQ ID NO: 1053804 - RNA, 18 nt, Homo sapiens
cuaaaugaauguuuacac

SEQ ID NO: 1053805 - RNA, 15 nt, Homo sapiens
cuaacaccaacauaa

SEQ ID NO: 1053806 - RNA, 23 nt, Homo sapiens
cuaacacccagucuguuccccau

SEQ ID NO: 1053807 - RNA, 22 nt, Homo sapiens
cuaacccuaggcaucacaugcu

SEQ ID NO: 1053808 - RNA, 21 nt, Homo sapiens
cuaacuggggauauaauacua

SEQ ID NO: 1053809 - RNA, 17 nt, Homo sapiens
cuaacuucaaggcccau

SEQ ID NO: 1053810 - RNA, 20 nt, Homo sapiens
cuaagaagcgagcacugacc

SEQ ID NO: 1053811 - RNA, 23 nt, Homo sapiens
cuaagagggagggagggcuccag

SEQ ID NO: 1053812 - RNA, 17 nt, Homo sapiens
cuaagcacgggccauau

SEQ ID NO: 1053813 - RNA, 13 nt, Homo sapiens
cuaagcagcauuu

SEQ ID NO: 1053814 - RNA, 22 nt, Homo sapiens
cuaagcaguaagcuaucuucaa

SEQ ID NO: 1053815 - RNA, 11 nt, Homo sapiens
cuaagccuuuc

SEQ ID NO: 1053816 - RNA, 22 nt, Homo sapiens
cuaagcgaauguguacaaagug

SEQ ID NO: 1053817 - RNA, 18 nt, Homo sapiens
cuaagcuauucaguaaua

SEQ ID NO: 1053818 - RNA, 20 nt, Homo sapiens
cuaagcucaaggcgugagga

SEQ ID NO: 1053819 - RNA, 22 nt, Homo sapiens
cuaagcuggugccccacugaau

SEQ ID NO: 1053820 - RNA, 21 nt, Homo sapiens
cuaaggaauaugagcuuuaug

SEQ ID NO: 1053821 - RNA, 13 nt, Homo sapiens
cuaaggaguaauc

SEQ ID NO: 1053822 - RNA, 19 nt, Homo sapiens
cuaaggaguaaucugugua

SEQ ID NO: 1053823 - RNA, 21 nt, Homo sapiens
cuaagguaguaacuuuccaua

SEQ ID NO: 1053824 - RNA, 22 nt, Homo sapiens
cuaaguaaaaccacagcaguug

SEQ ID NO: 1053825 - RNA, 16 nt, Homo sapiens
cuaaguguaccagaga

SEQ ID NO: 1053826 - RNA, 19 nt, Homo sapiens
cuaauacagacuaugucac

SEQ ID NO: 1053827 - RNA, 18 nt, Homo sapiens
cuaauagaauuaauggaa

SEQ ID NO: 1053828 - RNA, 17 nt, Homo sapiens
cuaauauguaacaagcc

SEQ ID NO: 1053829 - RNA, 16 nt, Homo sapiens
cuaaucagugucucac

SEQ ID NO: 1053830 - RNA, 20 nt, Homo sapiens
cuaaucuuaccagucugucu

SEQ ID NO: 1053831 - RNA, 12 nt, Homo sapiens
cuaaugggacac

SEQ ID NO: 1053832 - RNA, 11 nt, Homo sapiens
cuaaugugcau

SEQ ID NO: 1053833 - RNA, 23 nt, Homo sapiens
cuaauuaaaaaacacaucuggcc

SEQ ID NO: 1053834 - RNA, 22 nt, Homo sapiens
cuaauuuguuuucccuucuuac

SEQ ID NO: 1053835 - RNA, 20 nt, Homo sapiens
cuaauuuuuaccgauguuaa

SEQ ID NO: 1053836 - RNA, 22 nt, Homo sapiens
cuaauuuuucagcuccuucaau

SEQ ID NO: 1053837 - RNA, 13 nt, Homo sapiens
cuacaaaaacaca

SEQ ID NO: 1053838 - RNA, 14 nt, Homo sapiens
cuacaaaggccaug

SEQ ID NO: 1053839 - RNA, 22 nt, Homo sapiens
cuacaagucaucauaauucagc

SEQ ID NO: 1053840 - RNA, 13 nt, Homo sapiens
cuacaauuugcca

SEQ ID NO: 1053841 - RNA, 14 nt, Homo sapiens
cuacaauuugccau

SEQ ID NO: 1053842 - RNA, 20 nt, Homo sapiens
cuacaauuuucucccaggaa

SEQ ID NO: 1053843 - RNA, 18 nt, Homo sapiens
cuacacagaucacagcuu

SEQ ID NO: 1053844 - RNA, 15 nt, Homo sapiens
cuacacugacacugg

SEQ ID NO: 1053845 - RNA, 17 nt, Homo sapiens
accaaggagaugaagca

SEQ ID NO: 1053846 - RNA, 21 nt, Homo sapiens
accaaggcgggagcaucucuu

SEQ ID NO: 1053847 - RNA, 15 nt, Homo sapiens
accaaguggcuccca

SEQ ID NO: 1053848 - RNA, 19 nt, Homo sapiens
accaauagggcugagcucu

SEQ ID NO: 1053849 - RNA, 16 nt, Homo sapiens
accaauauuguacagu

SEQ ID NO: 1053850 - RNA, 20 nt, Homo sapiens
accaauauuguacaguuuuu

SEQ ID NO: 1053851 - RNA, 22 nt, Homo sapiens
accaaugccaaaaaaagacagg

SEQ ID NO: 1053852 - RNA, 20 nt, Homo sapiens
accacaaaaauugacucaaa

SEQ ID NO: 1053853 - RNA, 14 nt, Homo sapiens
accacaaaucugaa

SEQ ID NO: 1053854 - RNA, 19 nt, Homo sapiens
accacacgcccccacaggc

SEQ ID NO: 1053855 - RNA, 12 nt, Homo sapiens
accacagacugu

SEQ ID NO: 1053856 - RNA, 18 nt, Homo sapiens
accacaggcagcauuuag

SEQ ID NO: 1053857 - RNA, 18 nt, Homo sapiens
accacagggucugcacuc

SEQ ID NO: 1053858 - RNA, 15 nt, Homo sapiens
accacagugucugua

SEQ ID NO: 1053859 - RNA, 13 nt, Homo sapiens
accacaugccaag

SEQ ID NO: 1053860 - RNA, 12 nt, Homo sapiens
accacauggcuu

SEQ ID NO: 1053861 - RNA, 13 nt, Homo sapiens
accaccucaccag

SEQ ID NO: 1053862 - RNA, 15 nt, Homo sapiens
accaccucaccaguu

SEQ ID NO: 1053863 - RNA, 11 nt, Homo sapiens
accaccugguu

SEQ ID NO: 1053864 - RNA, 23 nt, Homo sapiens
accaccugguuccggcucugcac

SEQ ID NO: 1053865 - RNA, 12 nt, Homo sapiens
accaccuuucag

SEQ ID NO: 1053866 - RNA, 22 nt, Homo sapiens
accacggccacuggccaucucc

SEQ ID NO: 1053867 - RNA, 21 nt, Homo sapiens
accacgugagaucauucacuc

SEQ ID NO: 1053868 - RNA, 21 nt, Homo sapiens
accacuacaugcagcccaugc

SEQ ID NO: 1053869 - RNA, 23 nt, Homo sapiens
accacuacaugcagcccaugccc

SEQ ID NO: 1053870 - RNA, 18 nt, Homo sapiens
accacuagaacucuccau

SEQ ID NO: 1053871 - RNA, 13 nt, Homo sapiens
accacucaggaau

SEQ ID NO: 1053872 - RNA, 21 nt, Homo sapiens
accacucaggcauuugacuga

SEQ ID NO: 1053873 - RNA, 21 nt, Homo sapiens
guguuauuguauuagguguca

SEQ ID NO: 1053874 - RNA, 15 nt, Homo sapiens
guguucauacauuug

SEQ ID NO: 1053875 - RNA, 16 nt, Homo sapiens
guguucgauggcucaa

SEQ ID NO: 1053876 - RNA, 17 nt, Homo sapiens
guguugacaugugcuuu

SEQ ID NO: 1053877 - RNA, 20 nt, Homo sapiens
guguuggaaaaugugcaaua

SEQ ID NO: 1053878 - RNA, 23 nt, Homo sapiens
guguuuccuggcacugcuuccag

SEQ ID NO: 1053879 - RNA, 13 nt, Homo sapiens
guguuucuuacag

SEQ ID NO: 1053880 - RNA, 21 nt, Homo sapiens
guguuuuuuuucuucugcuau

SEQ ID NO: 1053881 - RNA, 20 nt, Homo sapiens
guuaaauagaguauaugcac

SEQ ID NO: 1053882 - RNA, 19 nt, Homo sapiens
guuaaccucagugucauuu

SEQ ID NO: 1053883 - RNA, 19 nt, Homo sapiens
guuaacuuaauaguauuua

SEQ ID NO: 1053884 - RNA, 20 nt, Homo sapiens
guuaauaaauuaaaacaugc

SEQ ID NO: 1053885 - RNA, 14 nt, Homo sapiens
guuaauauggugua

SEQ ID NO: 1053886 - RNA, 11 nt, Homo sapiens
guuacauauua

SEQ ID NO: 1053887 - RNA, 16 nt, Homo sapiens
guuacaucacaguguu

SEQ ID NO: 1053888 - RNA, 15 nt, Homo sapiens
guuacaugcauacuu

SEQ ID NO: 1053889 - RNA, 17 nt, Homo sapiens
guuacauugucauuuau

SEQ ID NO: 1053890 - RNA, 12 nt, Homo sapiens
guuaccaagaag

SEQ ID NO: 1053891 - RNA, 22 nt, Homo sapiens
guuaccaguaacggaacaguau

SEQ ID NO: 1053892 - RNA, 19 nt, Homo sapiens
guuaccguucaccaguugc

SEQ ID NO: 1053893 - RNA, 22 nt, Homo sapiens
guuaccugaaaacacugugcac

SEQ ID NO: 1053894 - RNA, 23 nt, Homo sapiens
guuacuauaugccgcuacaaaaa

SEQ ID NO: 1053895 - RNA, 16 nt, Homo sapiens
guuacuccagugccaa

SEQ ID NO: 1053896 - RNA, 19 nt, Homo sapiens
guuacuguggccaguauuu

SEQ ID NO: 1053897 - RNA, 20 nt, Homo sapiens
guuacuguggccaguauuuu

SEQ ID NO: 1053898 - RNA, 15 nt, Homo sapiens
guuacuucacuuuaa

SEQ ID NO: 1053899 - RNA, 13 nt, Homo sapiens
guuagaccacuuu

SEQ ID NO: 1053900 - RNA, 22 nt, Homo sapiens
guuagcaccauuaacuccuccu

SEQ ID NO: 1053901 - RNA, 18 nt, Homo sapiens
guuaggaaauaaaaccuu

SEQ ID NO: 1053902 - RNA, 15 nt, Homo sapiens
guuaggauagcauuu

SEQ ID NO: 1053903 - RNA, 22 nt, Homo sapiens
guuagucuacucuuaagccauc

SEQ ID NO: 1053904 - RNA, 19 nt, Homo sapiens
guuaguggauuacugccau

SEQ ID NO: 1053905 - RNA, 14 nt, Homo sapiens
guuaguuccuucau

SEQ ID NO: 1053906 - RNA, 22 nt, Homo sapiens
guuauaaaucaaugucacuuaa

SEQ ID NO: 1053907 - RNA, 19 nt, Homo sapiens
guuauaacucugcacuacu

SEQ ID NO: 1053908 - RNA, 21 nt, Homo sapiens
guuauaacucugcacuacucc

SEQ ID NO: 1053909 - RNA, 14 nt, Homo sapiens
guuauagacugcca

SEQ ID NO: 1053910 - RNA, 15 nt, Homo sapiens
guuauagacugccau

SEQ ID NO: 1053911 - RNA, 21 nt, Homo sapiens
guuaucaguaagaaaaagaag

SEQ ID NO: 1053912 - RNA, 17 nt, Homo sapiens
guuaugcggucuaggga

SEQ ID NO: 1053913 - RNA, 17 nt, Homo sapiens
guuauuauauaauuaca

SEQ ID NO: 1053914 - RNA, 19 nt, Homo sapiens
guuauuuaugccucuguau

SEQ ID NO: 1053915 - RNA, 19 nt, Homo sapiens
guuauuucucugauuugca

SEQ ID NO: 1053916 - RNA, 23 nt, Homo sapiens
guucaaaccaaucaaaugguguu

SEQ ID NO: 1053917 - RNA, 12 nt, Homo sapiens
guucaaagccag

SEQ ID NO: 1053918 - RNA, 20 nt, Homo sapiens
guucaaucucccgcugcugc

SEQ ID NO: 1053919 - RNA, 16 nt, Homo sapiens
guucacggcaaaaugu

SEQ ID NO: 1053920 - RNA, 11 nt, Homo sapiens
guucacuccca

SEQ ID NO: 1053921 - RNA, 14 nt, Homo sapiens
guucacugcaaugc

SEQ ID NO: 1053922 - RNA, 13 nt, Homo sapiens
guucacuucaucu

SEQ ID NO: 1053923 - RNA, 21 nt, Homo sapiens
guucagaaucacuucugagaa

SEQ ID NO: 1053924 - RNA, 14 nt, Homo sapiens
guucagaugcuucu

SEQ ID NO: 1053925 - RNA, 16 nt, Homo sapiens
guuccaagacauuguc

SEQ ID NO: 1053926 - RNA, 17 nt, Homo sapiens
guuccaugaagaccaca

SEQ ID NO: 1053927 - RNA, 20 nt, Homo sapiens
guuccccacugacagccucc

SEQ ID NO: 1053928 - RNA, 14 nt, Homo sapiens
guucccccugugca

SEQ ID NO: 1053929 - RNA, 16 nt, Homo sapiens
guucccuuggccucag

SEQ ID NO: 1053930 - RNA, 20 nt, Homo sapiens
guucgagaccagccuggcca

SEQ ID NO: 1053931 - RNA, 17 nt, Homo sapiens
guucuacacucaucuua

SEQ ID NO: 1053932 - RNA, 22 nt, Homo sapiens
guucucaaauauuugcuaugaa

SEQ ID NO: 1053933 - RNA, 16 nt, Homo sapiens
guucucacagugggag

SEQ ID NO: 1053934 - RNA, 19 nt, Homo sapiens
guucucccaccaccucacc

SEQ ID NO: 1053935 - RNA, 17 nt, Homo sapiens
guucucuauugcugcuc

SEQ ID NO: 1053936 - RNA, 13 nt, Homo sapiens
guucucugccuca

SEQ ID NO: 1053937 - RNA, 16 nt, Homo sapiens
guucucuuuaagccag

SEQ ID NO: 1053938 - RNA, 23 nt, Homo sapiens
guucugacauuaacaguuuucca

SEQ ID NO: 1053939 - RNA, 19 nt, Homo sapiens
guucuguaaaauauacuua

SEQ ID NO: 1053940 - RNA, 11 nt, Homo sapiens
guucuuaccug

SEQ ID NO: 1053941 - RNA, 17 nt, Homo sapiens
guucuuaguuugcaguu

SEQ ID NO: 1053942 - RNA, 16 nt, Homo sapiens
guucuucauuaccuca

SEQ ID NO: 1053943 - RNA, 17 nt, Homo sapiens
guucuucuuaaagucaa

SEQ ID NO: 1053944 - RNA, 22 nt, Homo sapiens
guucuuggguaaggaaauggaa

SEQ ID NO: 1053945 - RNA, 23 nt, Homo sapiens
guucuuggguaaggaaauggaau

SEQ ID NO: 1053946 - RNA, 18 nt, Homo sapiens
guugaaccguuucuuuaa

SEQ ID NO: 1053947 - RNA, 16 nt, Homo sapiens
guugaagcucugguga

SEQ ID NO: 1053948 - RNA, 19 nt, Homo sapiens
guugagaguugcuggugua

SEQ ID NO: 1053949 - RNA, 19 nt, Homo sapiens
guugagucgucaucacuuu

SEQ ID NO: 1053950 - RNA, 19 nt, Homo sapiens
guugauguaaccgauucau

SEQ ID NO: 1053951 - RNA, 20 nt, Homo sapiens
guugcaaauacauggauaac

SEQ ID NO: 1053952 - RNA, 19 nt, Homo sapiens
guugcaauagaacagagaa

SEQ ID NO: 1053953 - RNA, 15 nt, Homo sapiens
guugcagugagccgu

SEQ ID NO: 1053954 - RNA, 18 nt, Homo sapiens
guugccagcucccaugua

SEQ ID NO: 1053955 - RNA, 19 nt, Homo sapiens
guugccuuuauauccaaaa

SEQ ID NO: 1053956 - RNA, 15 nt, Homo sapiens
guugcuguaugucuc

SEQ ID NO: 1053957 - RNA, 21 nt, Homo sapiens
guuggacaaaccgagugcaau

SEQ ID NO: 1053958 - RNA, 21 nt, Homo sapiens
guuggagagcuagaaccugga

SEQ ID NO: 1053959 - RNA, 19 nt, Homo sapiens
guuggaugcggaacccaaa

SEQ ID NO: 1053960 - RNA, 12 nt, Homo sapiens
guuggcuucuaa

SEQ ID NO: 1053961 - RNA, 14 nt, Homo sapiens
guuguauugcauau

SEQ ID NO: 1053962 - RNA, 13 nt, Homo sapiens
guugucaaaaagu

SEQ ID NO: 1053963 - RNA, 17 nt, Homo sapiens
guugugccccuuuccaa

SEQ ID NO: 1053964 - RNA, 21 nt, Homo sapiens
guuguuaauaaaaguacaugu

SEQ ID NO: 1053965 - RNA, 23 nt, Homo sapiens
guuguucucuucuuuaaagggau

SEQ ID NO: 1053966 - RNA, 20 nt, Homo sapiens
guuguugauugacugcauga

SEQ ID NO: 1053967 - RNA, 11 nt, Homo sapiens
guuguugccaa

SEQ ID NO: 1053968 - RNA, 20 nt, Homo sapiens
guuuaaaagccaucaaacac

SEQ ID NO: 1053969 - RNA, 22 nt, Homo sapiens
guuuaaaagccaucaaacacaa

SEQ ID NO: 1053970 - RNA, 21 nt, Homo sapiens
guuuaacucagaucacuacug

SEQ ID NO: 1053971 - RNA, 16 nt, Homo sapiens
guuuaagggugauagu

SEQ ID NO: 1053972 - RNA, 17 nt, Homo sapiens
guuuacagcacuacucu

SEQ ID NO: 1053973 - RNA, 21 nt, Homo sapiens
guuuagacaguaugagucaau

SEQ ID NO: 1053974 - RNA, 18 nt, Homo sapiens
guuuaguauuaugucuua

SEQ ID NO: 1053975 - RNA, 18 nt, Homo sapiens
guuuauaaaagaugcauu

SEQ ID NO: 1053976 - RNA, 19 nt, Homo sapiens
guuuauuuaucagugacag

SEQ ID NO: 1053977 - RNA, 21 nt, Homo sapiens
guuucaacaaaauaaugcacu

SEQ ID NO: 1053978 - RNA, 20 nt, Homo sapiens
guuucaccaucagucaauga

SEQ ID NO: 1053979 - RNA, 20 nt, Homo sapiens
guuucagcggaagaccugaa

SEQ ID NO: 1053980 - RNA, 17 nt, Homo sapiens
guuucaucccauguaca

SEQ ID NO: 1053981 - RNA, 20 nt, Homo sapiens
guuucauguuuugugacuau

SEQ ID NO: 1053982 - RNA, 16 nt, Homo sapiens
guuuccuuucauuuac

SEQ ID NO: 1053983 - RNA, 22 nt, Homo sapiens
guuucuaauaaagaaagcagcu

SEQ ID NO: 1053984 - RNA, 13 nt, Homo sapiens
guuucuccaagca

SEQ ID NO: 1053985 - RNA, 17 nt, Homo sapiens
guuucuccagagggaau

SEQ ID NO: 1053986 - RNA, 12 nt, Homo sapiens
guuucugauuaa

SEQ ID NO: 1053987 - RNA, 23 nt, Homo sapiens
guuucuggcagccaguaccuccu

SEQ ID NO: 1053988 - RNA, 22 nt, Homo sapiens
guuucuguauacaacccuggca

SEQ ID NO: 1053989 - RNA, 21 nt, Homo sapiens
ucccucaaagcacacgucaug

SEQ ID NO: 1053990 - RNA, 21 nt, Homo sapiens
ucccucacugaaaccaggugg

SEQ ID NO: 1053991 - RNA, 19 nt, Homo sapiens
ucccucaggccgaaggagg

SEQ ID NO: 1053992 - RNA, 13 nt, Homo sapiens
ucccucauccuca

SEQ ID NO: 1053993 - RNA, 15 nt, Homo sapiens
ucccucaucuguccc

SEQ ID NO: 1053994 - RNA, 19 nt, Homo sapiens
ucccucucaugacuugcag

SEQ ID NO: 1053995 - RNA, 21 nt, Homo sapiens
ucccucucaugacuugcaggg

SEQ ID NO: 1053996 - RNA, 21 nt, Homo sapiens
ucccugccugugacuuucaag

SEQ ID NO: 1053997 - RNA, 15 nt, Homo sapiens
ucccuggaccucaga

SEQ ID NO: 1053998 - RNA, 16 nt, Homo sapiens
ucccugguucugauga

SEQ ID NO: 1053999 - RNA, 16 nt, Homo sapiens
ucccuguccuagucuu

SEQ ID NO: 1054000 - RNA, 21 nt, Homo sapiens
ucccuguguauucuagugaau

SEQ ID NO: 1054001 - RNA, 14 nt, Homo sapiens
ucccuguuccucaa

SEQ ID NO: 1054002 - RNA, 18 nt, Homo sapiens
ucccuguuuaaugauuga

SEQ ID NO: 1054003 - RNA, 16 nt, Homo sapiens
ucccuuaaucugccag

SEQ ID NO: 1054004 - RNA, 18 nt, Homo sapiens
ucccuuacccuccuccag

SEQ ID NO: 1054005 - RNA, 15 nt, Homo sapiens
ucccuucaucuggaa

SEQ ID NO: 1054006 - RNA, 17 nt, Homo sapiens
ucccuucaugcauggaa

SEQ ID NO: 1054007 - RNA, 20 nt, Homo sapiens
ucccuucuaccugccacuca

SEQ ID NO: 1054008 - RNA, 19 nt, Homo sapiens
ucccuucucuucacaguca

SEQ ID NO: 1054009 - RNA, 13 nt, Homo sapiens
ucccuugaaauuu

SEQ ID NO: 1054010 - RNA, 20 nt, Homo sapiens
ucccuugaggaaacaacagc

SEQ ID NO: 1054011 - RNA, 21 nt, Homo sapiens
ucccuugcuggaaaacccaaa

SEQ ID NO: 1054012 - RNA, 16 nt, Homo sapiens
ucccuuggccucagaa

SEQ ID NO: 1054013 - RNA, 16 nt, Homo sapiens
ucccuuucuuggccag

SEQ ID NO: 1054014 - RNA, 18 nt, Homo sapiens
ucccuuugaaaugaauau

SEQ ID NO: 1054015 - RNA, 12 nt, Homo sapiens
ucccuuuuacau

SEQ ID NO: 1054016 - RNA, 19 nt, Homo sapiens
uccgaggccccugucucag

SEQ ID NO: 1054017 - RNA, 20 nt, Homo sapiens
uccgcaguuccugucccuuc

SEQ ID NO: 1054018 - RNA, 17 nt, Homo sapiens
uccgcuuucucuugcug

SEQ ID NO: 1054019 - RNA, 15 nt, Homo sapiens
uccggcagccuggau

SEQ ID NO: 1054020 - RNA, 13 nt, Homo sapiens
uccgggaucaaag

SEQ ID NO: 1054021 - RNA, 18 nt, Homo sapiens
uccguccaggagccugug

SEQ ID NO: 1054022 - RNA, 20 nt, Homo sapiens
uccguggcacugcauacaau

SEQ ID NO: 1054023 - RNA, 16 nt, Homo sapiens
uccuaaaacaaaagcu

SEQ ID NO: 1054024 - RNA, 16 nt, Homo sapiens
uccuaaggacacacua

SEQ ID NO: 1054025 - RNA, 19 nt, Homo sapiens
uccuaauauuuugauucau

SEQ ID NO: 1054026 - RNA, 17 nt, Homo sapiens
uccuaauuuuagugaca

SEQ ID NO: 1054027 - RNA, 16 nt, Homo sapiens
uccuacccacaccucu

SEQ ID NO: 1054028 - RNA, 13 nt, Homo sapiens
uccuagcacuuug

SEQ ID NO: 1054029 - RNA, 17 nt, Homo sapiens
uccuaguuccaccauca

SEQ ID NO: 1054030 - RNA, 12 nt, Homo sapiens
uccuaugugauu

SEQ ID NO: 1054031 - RNA, 13 nt, Homo sapiens
uccuauugucauu

SEQ ID NO: 1054032 - RNA, 13 nt, Homo sapiens
uccucaaaccuac

SEQ ID NO: 1054033 - RNA, 22 nt, Homo sapiens
uccucaaagggagagagugcua

SEQ ID NO: 1054034 - RNA, 19 nt, Homo sapiens
uccucaagggccaggacuu

SEQ ID NO: 1054035 - RNA, 20 nt, Homo sapiens
uccucaccucuggacuggcu

SEQ ID NO: 1054036 - RNA, 15 nt, Homo sapiens
uccucagccuccuca

SEQ ID NO: 1054037 - RNA, 20 nt, Homo sapiens
uccucagccuccucaucugg

SEQ ID NO: 1054038 - RNA, 23 nt, Homo sapiens
uccucagcuucuuccccgagaaa

SEQ ID NO: 1054039 - RNA, 19 nt, Homo sapiens
uccucaucaucacucaucu

SEQ ID NO: 1054040 - RNA, 12 nt, Homo sapiens
uccuccaggugc

SEQ ID NO: 1054041 - RNA, 22 nt, Homo sapiens
uccuccaugaauaucaguuauu

SEQ ID NO: 1054042 - RNA, 12 nt, Homo sapiens
uccuccccaugu

SEQ ID NO: 1054043 - RNA, 22 nt, Homo sapiens
uccucccuuguggcuuccucag

SEQ ID NO: 1054044 - RNA, 14 nt, Homo sapiens
uccuccuguguaca

SEQ ID NO: 1054045 - RNA, 14 nt, Homo sapiens
uccucguuugagaa

SEQ ID NO: 1054046 - RNA, 19 nt, Homo sapiens
uccucuccccagcaaguga

SEQ ID NO: 1054047 - RNA, 13 nt, Homo sapiens
uccucucugcaag

SEQ ID NO: 1054048 - RNA, 18 nt, Homo sapiens
uccucugaggcuggaucc

SEQ ID NO: 1054049 - RNA, 19 nt, Homo sapiens
uccucugugaccaaugucu

SEQ ID NO: 1054050 - RNA, 15 nt, Homo sapiens
uccucuugaaccaca

SEQ ID NO: 1054051 - RNA, 14 nt, Homo sapiens
uccucuugccacug

SEQ ID NO: 1054052 - RNA, 19 nt, Homo sapiens
uccugaauccaaacuaauc

SEQ ID NO: 1054053 - RNA, 20 nt, Homo sapiens
uccugagcagugccagcuuu

SEQ ID NO: 1054054 - RNA, 22 nt, Homo sapiens
uccugaggaagagggacuguuc

SEQ ID NO: 1054055 - RNA, 19 nt, Homo sapiens
uccugaggggcaucugccc

SEQ ID NO: 1054056 - RNA, 18 nt, Homo sapiens
uccugauguuccacucca

SEQ ID NO: 1054057 - RNA, 12 nt, Homo sapiens
uccugcaaugaa

SEQ ID NO: 1054058 - RNA, 15 nt, Homo sapiens
uccugcagucuggcu

SEQ ID NO: 1054059 - RNA, 19 nt, Homo sapiens
uccugcauucacccagaca

SEQ ID NO: 1054060 - RNA, 15 nt, Homo sapiens
uccugccaacugauu

SEQ ID NO: 1054061 - RNA, 19 nt, Homo sapiens
uccugccaccagucacugu

SEQ ID NO: 1054062 - RNA, 16 nt, Homo sapiens
uccugccccuguucuc

SEQ ID NO: 1054063 - RNA, 20 nt, Homo sapiens
uccugccucagccuccugag

SEQ ID NO: 1054064 - RNA, 23 nt, Homo sapiens
uccuggcaaagaugaucaguaug

SEQ ID NO: 1054065 - RNA, 13 nt, Homo sapiens
uccuggcacuaac

SEQ ID NO: 1054066 - RNA, 16 nt, Homo sapiens
uccuggccucaaguga

SEQ ID NO: 1054067 - RNA, 18 nt, Homo sapiens
uccugggagaaccucagg

SEQ ID NO: 1054068 - RNA, 17 nt, Homo sapiens
uccugggcuaagugauc

SEQ ID NO: 1054069 - RNA, 16 nt, Homo sapiens
uccugggcuacaagga

SEQ ID NO: 1054070 - RNA, 23 nt, Homo sapiens
uccuggggaacauagaacucaug

SEQ ID NO: 1054071 - RNA, 12 nt, Homo sapiens
uccuggugaugu

SEQ ID NO: 1054072 - RNA, 18 nt, Homo sapiens
uccuggugccaauuucaa

SEQ ID NO: 1054073 - RNA, 14 nt, Homo sapiens
uccuggugugaagg

SEQ ID NO: 1054074 - RNA, 21 nt, Homo sapiens
uccuguacuuuuuccagacac

SEQ ID NO: 1054075 - RNA, 19 nt, Homo sapiens
uccugucccaccaugcagu

SEQ ID NO: 1054076 - RNA, 12 nt, Homo sapiens
uccugucuuccc

SEQ ID NO: 1054077 - RNA, 18 nt, Homo sapiens
uccugugacauguaacag

SEQ ID NO: 1054078 - RNA, 11 nt, Homo sapiens
uccugugcaac

SEQ ID NO: 1054079 - RNA, 12 nt, Homo sapiens
uccugugcuacu

SEQ ID NO: 1054080 - RNA, 18 nt, Homo sapiens
uccuguggucucugacca

SEQ ID NO: 1054081 - RNA, 20 nt, Homo sapiens
uccugugucuugcaauggca

SEQ ID NO: 1054082 - RNA, 18 nt, Homo sapiens
uccuguugagauggggga

SEQ ID NO: 1054083 - RNA, 14 nt, Homo sapiens
uccuuaagggacaa

SEQ ID NO: 1054084 - RNA, 13 nt, Homo sapiens
uccuuaaugcaga

SEQ ID NO: 1054085 - RNA, 19 nt, Homo sapiens
uccuuacauaugcaaaaau

SEQ ID NO: 1054086 - RNA, 16 nt, Homo sapiens
uccuuagagacaucaa

SEQ ID NO: 1054087 - RNA, 22 nt, Homo sapiens
uccuuagccuuugucccagaau

SEQ ID NO: 1054088 - RNA, 18 nt, Homo sapiens
uccuuagcuuagaccuca

SEQ ID NO: 1054089 - RNA, 19 nt, Homo sapiens
uccuuagcuuagaccucag

SEQ ID NO: 1054090 - RNA, 20 nt, Homo sapiens
uccuuagcuuagaccucagc

SEQ ID NO: 1054091 - RNA, 15 nt, Homo sapiens
uccuucaagaacucu

SEQ ID NO: 1054092 - RNA, 14 nt, Homo sapiens
uccuucaaugcaaa

SEQ ID NO: 1054093 - RNA, 19 nt, Homo sapiens
uccuucccucucaugacuu

SEQ ID NO: 1054094 - RNA, 22 nt, Homo sapiens
uccuucccucucaugacuugca

SEQ ID NO: 1054095 - RNA, 20 nt, Homo sapiens
uccuuccuuaucacugacac

SEQ ID NO: 1054096 - RNA, 18 nt, Homo sapiens
uccuuccuugaccagcag

SEQ ID NO: 1054097 - RNA, 19 nt, Homo sapiens
uccuucuaauuuuucagcu

SEQ ID NO: 1054098 - RNA, 16 nt, Homo sapiens
uccuucugaccacagc

SEQ ID NO: 1054099 - RNA, 15 nt, Homo sapiens
uccuucugcuggaua

SEQ ID NO: 1054100 - RNA, 13 nt, Homo sapiens
uccuucuuugaua

SEQ ID NO: 1054101 - RNA, 21 nt, Homo sapiens
uccuucuuugauaauguuaaa

SEQ ID NO: 1054102 - RNA, 17 nt, Homo sapiens
uccuugaccgcucucug

SEQ ID NO: 1054103 - RNA, 12 nt, Homo sapiens
uccuugcacacu

SEQ ID NO: 1054104 - RNA, 16 nt, Homo sapiens
auaaaauguaugacca

SEQ ID NO: 1054105 - RNA, 20 nt, Homo sapiens
auaaaauguuuuuaaacagu

SEQ ID NO: 1054106 - RNA, 15 nt, Homo sapiens
auaaaauuaugccau

SEQ ID NO: 1054107 - RNA, 15 nt, Homo sapiens
auaaaauuauuccuu

SEQ ID NO: 1054108 - RNA, 16 nt, Homo sapiens
auaaaauucauuaguu

SEQ ID NO: 1054109 - RNA, 14 nt, Homo sapiens
auaaaauugcacuu

SEQ ID NO: 1054110 - RNA, 15 nt, Homo sapiens
auaaaauuuaacuca

SEQ ID NO: 1054111 - RNA, 23 nt, Homo sapiens
auaaacacccaugaaucaaagac

SEQ ID NO: 1054112 - RNA, 15 nt, Homo sapiens
auaaacauccuucaa

SEQ ID NO: 1054113 - RNA, 18 nt, Homo sapiens
auaaacaugcuugcauua

SEQ ID NO: 1054114 - RNA, 17 nt, Homo sapiens
auaaacguccuacugua

SEQ ID NO: 1054115 - RNA, 16 nt, Homo sapiens
auaaacucagaaauuu

SEQ ID NO: 1054116 - RNA, 16 nt, Homo sapiens
auaaacugauuuaucu

SEQ ID NO: 1054117 - RNA, 15 nt, Homo sapiens
auaaagaaauugcaa

SEQ ID NO: 1054118 - RNA, 14 nt, Homo sapiens
auaaagcagcguuu

SEQ ID NO: 1054119 - RNA, 15 nt, Homo sapiens
auaaagcccuugaac

SEQ ID NO: 1054120 - RNA, 20 nt, Homo sapiens
auaaaggggagggacucauc

SEQ ID NO: 1054121 - RNA, 13 nt, Homo sapiens
auaaagugacaga

SEQ ID NO: 1054122 - RNA, 17 nt, Homo sapiens
auaaauauagagaugug

SEQ ID NO: 1054123 - RNA, 19 nt, Homo sapiens
auaaauguaaauauguaca

SEQ ID NO: 1054124 - RNA, 21 nt, Homo sapiens
auaaaugucuuaaucaugaga

SEQ ID NO: 1054125 - RNA, 21 nt, Homo sapiens
auaaauuacuuuuucauucuu

SEQ ID NO: 1054126 - RNA, 17 nt, Homo sapiens
auaaauucagauauauu

SEQ ID NO: 1054127 - RNA, 22 nt, Homo sapiens
auaaauucuauaggaacauaug

SEQ ID NO: 1054128 - RNA, 21 nt, Homo sapiens
auaaauuggaacaccuccuca

SEQ ID NO: 1054129 - RNA, 20 nt, Homo sapiens
auaacaagaucuuucaggaa

SEQ ID NO: 1054130 - RNA, 12 nt, Homo sapiens
auaacagaauua

SEQ ID NO: 1054131 - RNA, 13 nt, Homo sapiens
auaacagccucau

SEQ ID NO: 1054132 - RNA, 14 nt, Homo sapiens
auaaccuagccuua

SEQ ID NO: 1054133 - RNA, 15 nt, Homo sapiens
auaacuauguugaua

SEQ ID NO: 1054134 - RNA, 21 nt, Homo sapiens
auauuaacaacaauaacacug

SEQ ID NO: 1054135 - RNA, 21 nt, Homo sapiens
auauuaaggaagacaauguga

SEQ ID NO: 1054136 - RNA, 17 nt, Homo sapiens
auauuauacagaccgaa

SEQ ID NO: 1054137 - RNA, 21 nt, Homo sapiens
auauuaugcccaguuucugcc

SEQ ID NO: 1054138 - RNA, 17 nt, Homo sapiens
auauuccuuucuaucau

SEQ ID NO: 1054139 - RNA, 21 nt, Homo sapiens
auauucucaguguagggcaga

SEQ ID NO: 1054140 - RNA, 18 nt, Homo sapiens
auauucugguuacugugg

SEQ ID NO: 1054141 - RNA, 19 nt, Homo sapiens
auauugcagcuuauauuca

SEQ ID NO: 1054142 - RNA, 14 nt, Homo sapiens
auauugcagucaau

SEQ ID NO: 1054143 - RNA, 11 nt, Homo sapiens
auauugcccag

SEQ ID NO: 1054144 - RNA, 13 nt, Homo sapiens
auauuguccugcu

SEQ ID NO: 1054145 - RNA, 17 nt, Homo sapiens
auauuuaccagaccaca

SEQ ID NO: 1054146 - RNA, 14 nt, Homo sapiens
auauuuacucauag

SEQ ID NO: 1054147 - RNA, 16 nt, Homo sapiens
auauuuauaacucauc

SEQ ID NO: 1054148 - RNA, 21 nt, Homo sapiens
auauuuaugagaaaguucuca

SEQ ID NO: 1054149 - RNA, 21 nt, Homo sapiens
auauuucugggagacagaaaa

SEQ ID NO: 1054150 - RNA, 16 nt, Homo sapiens
auauuugguuuggcca

SEQ ID NO: 1054151 - RNA, 21 nt, Homo sapiens
auauuuguuaaauauuuacau

SEQ ID NO: 1054152 - RNA, 21 nt, Homo sapiens
auauuuuaaauaucuuucaug

SEQ ID NO: 1054153 - RNA, 22 nt, Homo sapiens
auauuuuuaguagagacagggu

SEQ ID NO: 1054154 - RNA, 23 nt, Homo sapiens
auauuuuuuaugaaacauuacag

SEQ ID NO: 1054155 - RNA, 21 nt, Homo sapiens
aucaaagacauggaauuaccu

SEQ ID NO: 1054156 - RNA, 13 nt, Homo sapiens
aucaaagcacuug

SEQ ID NO: 1054157 - RNA, 20 nt, Homo sapiens
aucaaauaugcaaagcacug

SEQ ID NO: 1054158 - RNA, 21 nt, Homo sapiens
aucaaauauuagaugugauuu

SEQ ID NO: 1054159 - RNA, 22 nt, Homo sapiens
aucaaauggaagacacauugaa

SEQ ID NO: 1054160 - RNA, 13 nt, Homo sapiens
aucaacagcauuu

SEQ ID NO: 1054161 - RNA, 17 nt, Homo sapiens
aucaacauuuguuccau

SEQ ID NO: 1054162 - RNA, 14 nt, Homo sapiens
aucaaccaaaugga

SEQ ID NO: 1054163 - RNA, 16 nt, Homo sapiens
aucaacgaguacuuca

SEQ ID NO: 1054164 - RNA, 20 nt, Homo sapiens
aucaacuuauuauaugacua

SEQ ID NO: 1054165 - RNA, 20 nt, Homo sapiens
aucaagaauggggaucacag

SEQ ID NO: 1054166 - RNA, 17 nt, Homo sapiens
aucaagcccuuuacuug

SEQ ID NO: 1054167 - RNA, 13 nt, Homo sapiens
aucaagccuguga

SEQ ID NO: 1054168 - RNA, 20 nt, Homo sapiens
aucaagcgaugaaacuggaa

SEQ ID NO: 1054169 - RNA, 14 nt, Homo sapiens
aucaagcugugaga

SEQ ID NO: 1054170 - RNA, 22 nt, Homo sapiens
aucaagcugugagacaguggga

SEQ ID NO: 1054171 - RNA, 20 nt, Homo sapiens
aucaaguauuuuugacauuu

SEQ ID NO: 1054172 - RNA, 20 nt, Homo sapiens
aucaauaaagaccacuuuac

SEQ ID NO: 1054173 - RNA, 20 nt, Homo sapiens
aucaaugaaguagcugagaa

SEQ ID NO: 1054174 - RNA, 18 nt, Homo sapiens
aucaauggcgcagugccu

SEQ ID NO: 1054175 - RNA, 13 nt, Homo sapiens
aucaaugucacuu

SEQ ID NO: 1054176 - RNA, 15 nt, Homo sapiens
aucaaugucacuuaa

SEQ ID NO: 1054177 - RNA, 20 nt, Homo sapiens
aucaauuacugguccaaaag

SEQ ID NO: 1054178 - RNA, 15 nt, Homo sapiens
aucaauucccuugaa

SEQ ID NO: 1054179 - RNA, 23 nt, Homo sapiens
aucaauucuauuacgugcaauac

SEQ ID NO: 1054180 - RNA, 17 nt, Homo sapiens
aucaauuuguaauugcu

SEQ ID NO: 1054181 - RNA, 23 nt, Homo sapiens
aucacaaggcauucaaguguaca

SEQ ID NO: 1054182 - RNA, 17 nt, Homo sapiens
aucacaguguuugcaau

SEQ ID NO: 1054183 - RNA, 20 nt, Homo sapiens
aucacaguguuugcaauggu

SEQ ID NO: 1054184 - RNA, 21 nt, Homo sapiens
aucacaguguuugcaauggug

SEQ ID NO: 1054185 - RNA, 21 nt, Homo sapiens
aucacaugcucaaugacucuc

SEQ ID NO: 1054186 - RNA, 14 nt, Homo sapiens
aucaccaaggcuga

SEQ ID NO: 1054187 - RNA, 21 nt, Homo sapiens
aucaccuccccuccuugccuc

SEQ ID NO: 1054188 - RNA, 21 nt, Homo sapiens
aucaccuugauaaugggauga

SEQ ID NO: 1054189 - RNA, 21 nt, Homo sapiens
aucacgccacugcacuccagc

SEQ ID NO: 1054190 - RNA, 14 nt, Homo sapiens
aucacguugcaaug

SEQ ID NO: 1054191 - RNA, 17 nt, Homo sapiens
aucacuagccaugauaa

SEQ ID NO: 1054192 - RNA, 11 nt, Homo sapiens
aucacuuccac

SEQ ID NO: 1054193 - RNA, 17 nt, Homo sapiens
aucacuuccuauaugca

SEQ ID NO: 1054194 - RNA, 18 nt, Homo sapiens
aucacuuuaaagcccuuu

SEQ ID NO: 1054195 - RNA, 16 nt, Homo sapiens
aucagaaugaaagcuc

SEQ ID NO: 1054196 - RNA, 22 nt, Homo sapiens
aucagaccauaauguuacauua

SEQ ID NO: 1054197 - RNA, 16 nt, Homo sapiens
aucagacuagugacaa

SEQ ID NO: 1054198 - RNA, 12 nt, Homo sapiens
aucagacuguag

SEQ ID NO: 1054199 - RNA, 15 nt, Homo sapiens
aucagagagcucacu

SEQ ID NO: 1054200 - RNA, 23 nt, Homo sapiens
aucagaggugaaagcuauaucaa

SEQ ID NO: 1054201 - RNA, 18 nt, Homo sapiens
aucagaugcuuuccugca

SEQ ID NO: 1054202 - RNA, 17 nt, Homo sapiens
aucagcauuuuacuacu

SEQ ID NO: 1054203 - RNA, 21 nt, Homo sapiens
aucagccugggcaaugugaua

SEQ ID NO: 1054204 - RNA, 17 nt, Homo sapiens
aucagcggccccuugac

SEQ ID NO: 1054205 - RNA, 13 nt, Homo sapiens
aucaggacgagaa

SEQ ID NO: 1054206 - RNA, 20 nt, Homo sapiens
aucaggccuggcacgguggc

SEQ ID NO: 1054207 - RNA, 17 nt, Homo sapiens
aucagugaagaugccag

SEQ ID NO: 1054208 - RNA, 23 nt, Homo sapiens
aucagugacagaguucacuauaa

SEQ ID NO: 1054209 - RNA, 15 nt, Homo sapiens
aucaguguuaccguu

SEQ ID NO: 1054210 - RNA, 14 nt, Homo sapiens
aucaguuacucuga

SEQ ID NO: 1054211 - RNA, 16 nt, Homo sapiens
aucauacaugacucag

SEQ ID NO: 1054212 - RNA, 21 nt, Homo sapiens
aucauauugguauucacuaau

SEQ ID NO: 1054213 - RNA, 15 nt, Homo sapiens
aucaucaacccuaaa

SEQ ID NO: 1054214 - RNA, 17 nt, Homo sapiens
aucaucacucaucugcc

SEQ ID NO: 1054215 - RNA, 18 nt, Homo sapiens
aucaucacucaucugcca

SEQ ID NO: 1054216 - RNA, 17 nt, Homo sapiens
aucaucaguggagccau

SEQ ID NO: 1054217 - RNA, 22 nt, Homo sapiens
aucaucccagcugcucccaaau

SEQ ID NO: 1054218 - RNA, 14 nt, Homo sapiens
aucauccuuuccag

SEQ ID NO: 1054219 - RNA, 13 nt, Homo sapiens
aucaucuccaguu

SEQ ID NO: 1054220 - RNA, 18 nt, Homo sapiens
aucaucuccugccuuccu

SEQ ID NO: 1054221 - RNA, 15 nt, Homo sapiens
aucaucuuuccuguu

SEQ ID NO: 1054222 - RNA, 14 nt, Homo sapiens
aucaugcauuguug

SEQ ID NO: 1054223 - RNA, 14 nt, Homo sapiens
aucaugcugagaga

SEQ ID NO: 1054224 - RNA, 13 nt, Homo sapiens
aucauguauuuau

SEQ ID NO: 1054225 - RNA, 17 nt, Homo sapiens
aucauguucacugcaau

SEQ ID NO: 1054226 - RNA, 22 nt, Homo sapiens
aucauuucuauuucuccuccau

SEQ ID NO: 1054227 - RNA, 17 nt, Homo sapiens
auccaaaggugcucaga

SEQ ID NO: 1054228 - RNA, 19 nt, Homo sapiens
auccaaccccccaccugcc

SEQ ID NO: 1054229 - RNA, 16 nt, Homo sapiens
auccaacuccaggaua

SEQ ID NO: 1054230 - RNA, 23 nt, Homo sapiens
auccaagcaucccuuugcccaga

SEQ ID NO: 1054231 - RNA, 18 nt, Homo sapiens
auccaauccucacugggu

SEQ ID NO: 1054232 - RNA, 15 nt, Homo sapiens
auccaaugcucaaga

SEQ ID NO: 1054233 - RNA, 16 nt, Homo sapiens
auccacacugagcuga

SEQ ID NO: 1054234 - RNA, 12 nt, Homo sapiens
auccacauggga

SEQ ID NO: 1054235 - RNA, 18 nt, Homo sapiens
auccaccuccuucucugu

SEQ ID NO: 1054236 - RNA, 15 nt, Homo sapiens
auccagacccggcug

SEQ ID NO: 1054237 - RNA, 16 nt, Homo sapiens
auccagaucauuccuc

SEQ ID NO: 1054238 - RNA, 22 nt, Homo sapiens
auccagcuccccuucugaauca

SEQ ID NO: 1054239 - RNA, 16 nt, Homo sapiens
auccagucuucacugg

SEQ ID NO: 1054240 - RNA, 14 nt, Homo sapiens
auccauccauccaa

SEQ ID NO: 1054241 - RNA, 18 nt, Homo sapiens
auccaucuaaauaccugc

SEQ ID NO: 1054242 - RNA, 24 nt, Homo sapiens
auccaucugcuuacaauucccugc

SEQ ID NO: 1054243 - RNA, 17 nt, Homo sapiens
aucccacccacauguga

SEQ ID NO: 1054244 - RNA, 12 nt, Homo sapiens
aucccagccuug

SEQ ID NO: 1054245 - RNA, 16 nt, Homo sapiens
aucccagcuaccucaa

SEQ ID NO: 1054246 - RNA, 12 nt, Homo sapiens
aucccaucucuc

SEQ ID NO: 1054247 - RNA, 15 nt, Homo sapiens
aucccauguauuuau

SEQ ID NO: 1054248 - RNA, 19 nt, Homo sapiens
aucccccgcugguggcaga

SEQ ID NO: 1054249 - RNA, 16 nt, Homo sapiens
auccccuggacuggga

SEQ ID NO: 1054250 - RNA, 18 nt, Homo sapiens
aucccucugggcacuggu

SEQ ID NO: 1054251 - RNA, 18 nt, Homo sapiens
aucccucugucaggguca

SEQ ID NO: 1054252 - RNA, 22 nt, Homo sapiens
aucccuggugaaggaucuugcc

SEQ ID NO: 1054253 - RNA, 13 nt, Homo sapiens
aucccuuacucca

SEQ ID NO: 1054254 - RNA, 20 nt, Homo sapiens
auccgaaccuccucugugaa

SEQ ID NO: 1054255 - RNA, 17 nt, Homo sapiens
auccuaaaaaguuccau

SEQ ID NO: 1054256 - RNA, 23 nt, Homo sapiens
auccuaaaugaguaaacccagcu

SEQ ID NO: 1054257 - RNA, 15 nt, Homo sapiens
auccuaggcauuugc

SEQ ID NO: 1054258 - RNA, 13 nt, Homo sapiens
auccuaugcaaua

SEQ ID NO: 1054259 - RNA, 11 nt, Homo sapiens
auccuauuuau

SEQ ID NO: 1054260 - RNA, 15 nt, Homo sapiens
auccucacaaccacc

SEQ ID NO: 1054261 - RNA, 15 nt, Homo sapiens
ucucuugcugccaca

SEQ ID NO: 1054262 - RNA, 21 nt, Homo sapiens
ucucuuuauauggccucaaga

SEQ ID NO: 1054263 - RNA, 22 nt, Homo sapiens
ucucuuucacggggccgugaca

SEQ ID NO: 1054264 - RNA, 20 nt, Homo sapiens
ucugaaaaaguauccugcuu

SEQ ID NO: 1054265 - RNA, 21 nt, Homo sapiens
ucugaaagagaaaucaaugaa

SEQ ID NO: 1054266 - RNA, 18 nt, Homo sapiens
ucugaaccccucccucca

SEQ ID NO: 1054267 - RNA, 19 nt, Homo sapiens
ucugaacucaaacugagga

SEQ ID NO: 1054268 - RNA, 21 nt, Homo sapiens
ucugaagcagaugcaaagagg

SEQ ID NO: 1054269 - RNA, 23 nt, Homo sapiens
ucugaagucacaucacaggacac

SEQ ID NO: 1054270 - RNA, 19 nt, Homo sapiens
ucugaauccucaugaggcu

SEQ ID NO: 1054271 - RNA, 14 nt, Homo sapiens
ucugaccacagcau

SEQ ID NO: 1054272 - RNA, 14 nt, Homo sapiens
ucugacgucucuuu

SEQ ID NO: 1054273 - RNA, 17 nt, Homo sapiens
ucugacucagggcuccu

SEQ ID NO: 1054274 - RNA, 19 nt, Homo sapiens
ucugagcacccaagccagg

SEQ ID NO: 1054275 - RNA, 23 nt, Homo sapiens
ucugagcagugaaugauucagug

SEQ ID NO: 1054276 - RNA, 21 nt, Homo sapiens
ucugagcccccacugcuucua

SEQ ID NO: 1054277 - RNA, 14 nt, Homo sapiens
ucugagcugugcag

SEQ ID NO: 1054278 - RNA, 17 nt, Homo sapiens
ucuuucauggggugaug

SEQ ID NO: 1054279 - RNA, 14 nt, Homo sapiens
ucuuucccagacuu

SEQ ID NO: 1054280 - RNA, 18 nt, Homo sapiens
ucuuucccagaugcccca

SEQ ID NO: 1054281 - RNA, 20 nt, Homo sapiens
ucuuucccuuuaucaguuug

SEQ ID NO: 1054282 - RNA, 14 nt, Homo sapiens
ucuuuccuggcacu

SEQ ID NO: 1054283 - RNA, 23 nt, Homo sapiens
ucuuuccuggcacuaacguugag

SEQ ID NO: 1054284 - RNA, 19 nt, Homo sapiens
ucuuucuaaaauacaguuc

SEQ ID NO: 1054285 - RNA, 18 nt, Homo sapiens
ucuuucuaacuccaguga

SEQ ID NO: 1054286 - RNA, 17 nt, Homo sapiens
ucuuucuuacaaggaag

SEQ ID NO: 1054287 - RNA, 22 nt, Homo sapiens
ucuuugcucauggcaacaguua

SEQ ID NO: 1054288 - RNA, 13 nt, Homo sapiens
ucuuuggacagaa

SEQ ID NO: 1054289 - RNA, 20 nt, Homo sapiens
ucuuuggacagaagcagcuc

SEQ ID NO: 1054290 - RNA, 14 nt, Homo sapiens
ucuuuggacccuga

SEQ ID NO: 1054291 - RNA, 16 nt, Homo sapiens
ucuuuuacauucugca

SEQ ID NO: 1054292 - RNA, 13 nt, Homo sapiens
ucuuuucacaaau

SEQ ID NO: 1054293 - RNA, 11 nt, Homo sapiens
ucuuuugcucu

SEQ ID NO: 1054294 - RNA, 14 nt, Homo sapiens
ucuuuuugaaauca

SEQ ID NO: 1054295 - RNA, 22 nt, Homo sapiens
ugaaaaaaaauuuuauaguguc

SEQ ID NO: 1054296 - RNA, 14 nt, Homo sapiens
ugaaaaaaauuguc

SEQ ID NO: 1054297 - RNA, 21 nt, Homo sapiens
ugaaaaaaugccaagacauga

SEQ ID NO: 1054298 - RNA, 17 nt, Homo sapiens
ugaaaaacagaaagcau

SEQ ID NO: 1054299 - RNA, 22 nt, Homo sapiens
ugaaaaacagaaagcauccuaa

SEQ ID NO: 1054300 - RNA, 17 nt, Homo sapiens
ugaaaacacugugcaca

SEQ ID NO: 1054301 - RNA, 12 nt, Homo sapiens
ugaaaacagcua

SEQ ID NO: 1054302 - RNA, 17 nt, Homo sapiens
ugaaaacauaaucugca

SEQ ID NO: 1054303 - RNA, 17 nt, Homo sapiens
ugaaaacaucuggaagg

SEQ ID NO: 1054304 - RNA, 20 nt, Homo sapiens
ugaaaacaucuggaagggga

SEQ ID NO: 1054305 - RNA, 16 nt, Homo sapiens
ugaaaacuuagucugu

SEQ ID NO: 1054306 - RNA, 11 nt, Homo sapiens
ugaaaauaacu

SEQ ID NO: 1054307 - RNA, 16 nt, Homo sapiens
ugaaaauaauguugua

SEQ ID NO: 1054308 - RNA, 17 nt, Homo sapiens
ugaaaaucuacacucca

SEQ ID NO: 1054309 - RNA, 23 nt, Homo sapiens
ugaaaaucuacacuccagugaga

SEQ ID NO: 1054310 - RNA, 18 nt, Homo sapiens
ugaaaauguaagcuguuu

SEQ ID NO: 1054311 - RNA, 12 nt, Homo sapiens
ugaaaauguacu

SEQ ID NO: 1054312 - RNA, 22 nt, Homo sapiens
ugaaaauguauguguaaguauu

SEQ ID NO: 1054313 - RNA, 16 nt, Homo sapiens
ugaaaauuaacacugc

SEQ ID NO: 1054314 - RNA, 20 nt, Homo sapiens
ugaaaauucgaaccaggaaa

SEQ ID NO: 1054315 - RNA, 20 nt, Homo sapiens
ugaaaauugucuucuucugu

SEQ ID NO: 1054316 - RNA, 20 nt, Homo sapiens
ugaaacaagauaacugagaa

SEQ ID NO: 1054317 - RNA, 16 nt, Homo sapiens
ugaaacauuacaguua

SEQ ID NO: 1054318 - RNA, 16 nt, Homo sapiens
ugaaacauuugcaaaa

SEQ ID NO: 1054319 - RNA, 20 nt, Homo sapiens
ugaaaccccaucucuacuga

SEQ ID NO: 1054320 - RNA, 14 nt, Homo sapiens
ugaaacuaacagau

SEQ ID NO: 1054321 - RNA, 15 nt, Homo sapiens
ugaaacugcugugaa

SEQ ID NO: 1054322 - RNA, 19 nt, Homo sapiens
ugaaacuggaaaacuacaa

SEQ ID NO: 1054323 - RNA, 17 nt, Homo sapiens
ugaaagaaccaaaagag

SEQ ID NO: 1054324 - RNA, 21 nt, Homo sapiens
ugaaagaaccaaaagagauca

SEQ ID NO: 1054325 - RNA, 23 nt, Homo sapiens
ugaaagaaccaaaagagaucaca

SEQ ID NO: 1054326 - RNA, 14 nt, Homo sapiens
ugaaagaccuucuc

SEQ ID NO: 1054327 - RNA, 14 nt, Homo sapiens
ugaaagcuauauca

SEQ ID NO: 1054328 - RNA, 21 nt, Homo sapiens
ugaaagcuauaucaaucucuc

SEQ ID NO: 1054329 - RNA, 22 nt, Homo sapiens
ugaaaggaagcuccacugucac

SEQ ID NO: 1054330 - RNA, 23 nt, Homo sapiens
ugaaaggaagcuccacugucacc

SEQ ID NO: 1054331 - RNA, 16 nt, Homo sapiens
ugaaaguuaauccacu

SEQ ID NO: 1054332 - RNA, 19 nt, Homo sapiens
ugaaauaacauggccuugg

SEQ ID NO: 1054333 - RNA, 12 nt, Homo sapiens
ugaaauaagaaa

SEQ ID NO: 1054334 - RNA, 13 nt, Homo sapiens
ugaaaucuuuuaa

SEQ ID NO: 1054335 - RNA, 11 nt, Homo sapiens
ugaaaugcuag

SEQ ID NO: 1054336 - RNA, 18 nt, Homo sapiens
ugaaaugcuggcauuugc

SEQ ID NO: 1054337 - RNA, 20 nt, Homo sapiens
ugaaaugucuggucugucca

SEQ ID NO: 1054338 - RNA, 17 nt, Homo sapiens
ugaaauguuugcauaaa

SEQ ID NO: 1054339 - RNA, 21 nt, Homo sapiens
ugaaauugauguuacuguaua

SEQ ID NO: 1054340 - RNA, 19 nt, Homo sapiens
ugaaauuuaauauagcuau

SEQ ID NO: 1054341 - RNA, 19 nt, Homo sapiens
ugaaauuuuccaaugucug

SEQ ID NO: 1054342 - RNA, 21 nt, Homo sapiens
ugaacaaaauguaaagccagc

SEQ ID NO: 1054343 - RNA, 19 nt, Homo sapiens
ugaacaaucaaagcacuug

SEQ ID NO: 1054344 - RNA, 17 nt, Homo sapiens
ugaacaauucucucuua

SEQ ID NO: 1054345 - RNA, 21 nt, Homo sapiens
ugaacacguuuuuucacuauu

SEQ ID NO: 1054346 - RNA, 12 nt, Homo sapiens
ugaacacuguga

SEQ ID NO: 1054347 - RNA, 11 nt, Homo sapiens
ugaacagaauu

SEQ ID NO: 1054348 - RNA, 21 nt, Homo sapiens
ugaacccaggaggcagcuguu

SEQ ID NO: 1054349 - RNA, 12 nt, Homo sapiens
ugaacccugugc

SEQ ID NO: 1054350 - RNA, 17 nt, Homo sapiens
ugaaccgaggggcucag

SEQ ID NO: 1054351 - RNA, 20 nt, Homo sapiens
ugaaccgaggggcucaggaa

SEQ ID NO: 1054352 - RNA, 19 nt, Homo sapiens
ugaacuauuagagcugccu

SEQ ID NO: 1054353 - RNA, 15 nt, Homo sapiens
ugaacucuccagcuu

SEQ ID NO: 1054354 - RNA, 18 nt, Homo sapiens
ugaacucuuugaaugaca

SEQ ID NO: 1054355 - RNA, 17 nt, Homo sapiens
ugaacugaaguuucaca

SEQ ID NO: 1054356 - RNA, 22 nt, Homo sapiens
ugaacuggguacuuguggacac

SEQ ID NO: 1054357 - RNA, 23 nt, Homo sapiens
ugaacuucgcaucaaaagacaau

SEQ ID NO: 1054358 - RNA, 15 nt, Homo sapiens
ugaacuucucucaga

SEQ ID NO: 1054359 - RNA, 16 nt, Homo sapiens
ugaacuuucacauagc

SEQ ID NO: 1054360 - RNA, 19 nt, Homo sapiens
ugaagaaaaaauacauuuu

SEQ ID NO: 1054361 - RNA, 23 nt, Homo sapiens
ugaagaagagacucuuugcauau

SEQ ID NO: 1054362 - RNA, 16 nt, Homo sapiens
ugaagaaugagcaaga

SEQ ID NO: 1054363 - RNA, 15 nt, Homo sapiens
ugaagacaacagcau

SEQ ID NO: 1054364 - RNA, 15 nt, Homo sapiens
ugaagacacugaaau

SEQ ID NO: 1054365 - RNA, 20 nt, Homo sapiens
ugaagacagauacuccucca

SEQ ID NO: 1054366 - RNA, 15 nt, Homo sapiens
ugaagaccacaucca

SEQ ID NO: 1054367 - RNA, 15 nt, Homo sapiens
ugaagaguccucuga

SEQ ID NO: 1054368 - RNA, 15 nt, Homo sapiens
ugaagauacaggaca

SEQ ID NO: 1054369 - RNA, 19 nt, Homo sapiens
ugaagaucauauacgugaa

SEQ ID NO: 1054370 - RNA, 16 nt, Homo sapiens
ugaagcaaacacauua

SEQ ID NO: 1054371 - RNA, 21 nt, Homo sapiens
ugaagcccuccaaaagcacuu

SEQ ID NO: 1054372 - RNA, 12 nt, Homo sapiens
ugaagcuuuaua

SEQ ID NO: 1054373 - RNA, 13 nt, Homo sapiens
ugaaggacuguga

SEQ ID NO: 1054374 - RNA, 22 nt, Homo sapiens
ugaaggaggugagggaugugaa

SEQ ID NO: 1054375 - RNA, 14 nt, Homo sapiens
ugaaggaucuugcc

SEQ ID NO: 1054376 - RNA, 13 nt, Homo sapiens
ugaaggaugccau

SEQ ID NO: 1054377 - RNA, 15 nt, Homo sapiens
ugaaggcaaugccau

SEQ ID NO: 1054378 - RNA, 21 nt, Homo sapiens
ugaagggagguggggaugaga

SEQ ID NO: 1054379 - RNA, 23 nt, Homo sapiens
ugaaggguucaccaggucaggga

SEQ ID NO: 1054380 - RNA, 14 nt, Homo sapiens
ugaaggucugcaag

SEQ ID NO: 1054381 - RNA, 13 nt, Homo sapiens
ugaaguaagcaac

SEQ ID NO: 1054382 - RNA, 13 nt, Homo sapiens
ugaaguagaaucc

SEQ ID NO: 1054383 - RNA, 16 nt, Homo sapiens
ugaaguagaauccuaa

SEQ ID NO: 1054384 - RNA, 15 nt, Homo sapiens
ugaaguauuucucac

SEQ ID NO: 1054385 - RNA, 22 nt, Homo sapiens
ugaagucaugcguuuaaucaca

SEQ ID NO: 1054386 - RNA, 16 nt, Homo sapiens
ugaaguccuucaccuc

SEQ ID NO: 1054387 - RNA, 22 nt, Homo sapiens
ugaaguccuucaccucacugaa

SEQ ID NO: 1054388 - RNA, 22 nt, Homo sapiens
ugaagugcaaauuugauacaua

SEQ ID NO: 1054389 - RNA, 17 nt, Homo sapiens
ugaaguggugagcuuaa

SEQ ID NO: 1054390 - RNA, 20 nt, Homo sapiens
ugaauaaaaauauguacaag

SEQ ID NO: 1054391 - RNA, 16 nt, Homo sapiens
ugaauaaauaccucuu

SEQ ID NO: 1054392 - RNA, 19 nt, Homo sapiens
ugaauaaauaccucuuagc

SEQ ID NO: 1054393 - RNA, 13 nt, Homo sapiens
ugaauaauacagu

SEQ ID NO: 1054394 - RNA, 22 nt, Homo sapiens
ugaauaauacaguaucucaggg

SEQ ID NO: 1054395 - RNA, 14 nt, Homo sapiens
ugaauacaggcaua

SEQ ID NO: 1054396 - RNA, 15 nt, Homo sapiens
ugaauagaacucuga

SEQ ID NO: 1054397 - RNA, 15 nt, Homo sapiens
ugaauagugaggcug

SEQ ID NO: 1054398 - RNA, 21 nt, Homo sapiens
ugaauauuuguuauguagaua

SEQ ID NO: 1054399 - RNA, 12 nt, Homo sapiens
ugaaucacagua

SEQ ID NO: 1054400 - RNA, 14 nt, Homo sapiens
ugaaucauguagua

SEQ ID NO: 1054401 - RNA, 21 nt, Homo sapiens
ugaauccagaucauuccucag

SEQ ID NO: 1054402 - RNA, 18 nt, Homo sapiens
ugaauccucuucuuuaua

SEQ ID NO: 1054403 - RNA, 16 nt, Homo sapiens
ugaaugagagguuccu

SEQ ID NO: 1054404 - RNA, 15 nt, Homo sapiens
ugaaugauaaacucu

SEQ ID NO: 1054405 - RNA, 15 nt, Homo sapiens
ugaaugauacccuga

SEQ ID NO: 1054406 - RNA, 12 nt, Homo sapiens
ugaaugaugcuu

SEQ ID NO: 1054407 - RNA, 14 nt, Homo sapiens
ugaaugcagggaca

SEQ ID NO: 1054408 - RNA, 19 nt, Homo sapiens
ugaaugccucaaugugacc

SEQ ID NO: 1054409 - RNA, 15 nt, Homo sapiens
ugaaugcggcccaac

SEQ ID NO: 1054410 - RNA, 15 nt, Homo sapiens
ugaaugcuccaguca

SEQ ID NO: 1054411 - RNA, 16 nt, Homo sapiens
ugaaugguuccaugcc

SEQ ID NO: 1054412 - RNA, 20 nt, Homo sapiens
ugaauguaaaaauuggucac

SEQ ID NO: 1054413 - RNA, 13 nt, Homo sapiens
ugaaugugucacu

SEQ ID NO: 1054414 - RNA, 18 nt, Homo sapiens
ugaaugugucacuacuca

SEQ ID NO: 1054415 - RNA, 13 nt, Homo sapiens
ugaauguuuccaa

SEQ ID NO: 1054416 - RNA, 21 nt, Homo sapiens
ugaauuauguuauuugcucua

SEQ ID NO: 1054417 - RNA, 12 nt, Homo sapiens
ugaauucuggga

SEQ ID NO: 1054418 - RNA, 18 nt, Homo sapiens
augaugcuauuaauacug

SEQ ID NO: 1054419 - RNA, 19 nt, Homo sapiens
augauggcaccacugcacu

SEQ ID NO: 1054420 - RNA, 14 nt, Homo sapiens
augauggugcugac

SEQ ID NO: 1054421 - RNA, 18 nt, Homo sapiens
augaugugggucaaggaa

SEQ ID NO: 1054422 - RNA, 22 nt, Homo sapiens
augauugcuaugucaggcuuuc

SEQ ID NO: 1054423 - RNA, 19 nt, Homo sapiens
cacauggccuaugcacaua

SEQ ID NO: 1054424 - RNA, 14 nt, Homo sapiens
cacauggcugggau

SEQ ID NO: 1054425 - RNA, 19 nt, Homo sapiens
cacauggggcugggcagcu

SEQ ID NO: 1054426 - RNA, 19 nt, Homo sapiens
cacauguccaagaagccca

SEQ ID NO: 1054427 - RNA, 16 nt, Homo sapiens
cacaugucuuguacau

SEQ ID NO: 1054428 - RNA, 19 nt, Homo sapiens
cacaugucuuguacaugug

SEQ ID NO: 1054429 - RNA, 20 nt, Homo sapiens
cacaugucuuguacaugugu

SEQ ID NO: 1054430 - RNA, 17 nt, Homo sapiens
cacaugugacacauaug

SEQ ID NO: 1054431 - RNA, 13 nt, Homo sapiens
cacauuaagccuu

SEQ ID NO: 1054432 - RNA, 23 nt, Homo sapiens
cacauuaucgggagcagugucuu

SEQ ID NO: 1054433 - RNA, 18 nt, Homo sapiens
cacauucccaucugucac

SEQ ID NO: 1054434 - RNA, 15 nt, Homo sapiens
cacauugugccuuuu

SEQ ID NO: 1054435 - RNA, 15 nt, Homo sapiens
cacauuuaugaauca

SEQ ID NO: 1054436 - RNA, 20 nt, Homo sapiens
caccaagcagcaacagcaaa

SEQ ID NO: 1054437 - RNA, 14 nt, Homo sapiens
caccaagcccaguu

SEQ ID NO: 1054438 - RNA, 15 nt, Homo sapiens
caccaagcucugucc

SEQ ID NO: 1054439 - RNA, 20 nt, Homo sapiens
caccaagcucuguccaauca

SEQ ID NO: 1054440 - RNA, 17 nt, Homo sapiens
caccaauaucaguccuc

SEQ ID NO: 1054441 - RNA, 16 nt, Homo sapiens
caccacaaaucugaau

SEQ ID NO: 1054442 - RNA, 16 nt, Homo sapiens
caccacaccuggcuaa

SEQ ID NO: 1054443 - RNA, 23 nt, Homo sapiens
caccacacuuuccgcuuucacuu

SEQ ID NO: 1054444 - RNA, 19 nt, Homo sapiens
caccaccaggcaccucaca

SEQ ID NO: 1054445 - RNA, 22 nt, Homo sapiens
caccacgccuggccagaugcau

SEQ ID NO: 1054446 - RNA, 20 nt, Homo sapiens
caccagagcauuuccaacac

SEQ ID NO: 1054447 - RNA, 18 nt, Homo sapiens
caccagaggcugcagaag

SEQ ID NO: 1054448 - RNA, 22 nt, Homo sapiens
caccagccaggcucugugcuga

SEQ ID NO: 1054449 - RNA, 13 nt, Homo sapiens
caccagugacuuu

SEQ ID NO: 1054450 - RNA, 14 nt, Homo sapiens
caccagugacuuuu

SEQ ID NO: 1054451 - RNA, 14 nt, Homo sapiens
cacccaaugcauau

SEQ ID NO: 1054452 - RNA, 12 nt, Homo sapiens
cacccacaugug

SEQ ID NO: 1054453 - RNA, 16 nt, Homo sapiens
cacccacucuguccug

SEQ ID NO: 1054454 - RNA, 22 nt, Homo sapiens
cacccagaugggggaaagcaca

SEQ ID NO: 1054455 - RNA, 18 nt, Homo sapiens
caccccacccucccugga

SEQ ID NO: 1054456 - RNA, 20 nt, Homo sapiens
cacccccuucucugcuccac

SEQ ID NO: 1054457 - RNA, 17 nt, Homo sapiens
caccccuccuuccuuga

SEQ ID NO: 1054458 - RNA, 13 nt, Homo sapiens
caccccugcaguu

SEQ ID NO: 1054459 - RNA, 22 nt, Homo sapiens
caccccuugcucucaacccagg

SEQ ID NO: 1054460 - RNA, 17 nt, Homo sapiens
cacccgacuccucaaaa

SEQ ID NO: 1054461 - RNA, 19 nt, Homo sapiens
cacccuccccucucuugca

SEQ ID NO: 1054462 - RNA, 15 nt, Homo sapiens
cacccugaaagcccu

SEQ ID NO: 1054463 - RNA, 17 nt, Homo sapiens
uguaggcauugcaugaa

SEQ ID NO: 1054464 - RNA, 20 nt, Homo sapiens
uguaguauaauaauuacugg

SEQ ID NO: 1054465 - RNA, 14 nt, Homo sapiens
uguagucucaggac

SEQ ID NO: 1054466 - RNA, 21 nt, Homo sapiens
uguaguuuuucuucaacauca

SEQ ID NO: 1054467 - RNA, 12 nt, Homo sapiens
uguauacugugg

SEQ ID NO: 1054468 - RNA, 24 nt, Homo sapiens
uguauagacaucugcccugacuga

SEQ ID NO: 1054469 - RNA, 15 nt, Homo sapiens
uguaucaaaugugac

SEQ ID NO: 1054470 - RNA, 12 nt, Homo sapiens
uguaucaugaca

SEQ ID NO: 1054471 - RNA, 19 nt, Homo sapiens
uguauccauccauggggcu

SEQ ID NO: 1054472 - RNA, 14 nt, Homo sapiens
uguauccauuauca

SEQ ID NO: 1054473 - RNA, 19 nt, Homo sapiens
uguaucccaacuccuauaa

SEQ ID NO: 1054474 - RNA, 14 nt, Homo sapiens
uguaugacuaaaga

SEQ ID NO: 1054475 - RNA, 23 nt, Homo sapiens
uguaugacucccaaauuuucaca

SEQ ID NO: 1054476 - RNA, 22 nt, Homo sapiens
uguaugcacgugugcacacaca

SEQ ID NO: 1054477 - RNA, 19 nt, Homo sapiens
uguaugccaagugaaaaaa

SEQ ID NO: 1054478 - RNA, 16 nt, Homo sapiens
uguaugugcgugugug

SEQ ID NO: 1054479 - RNA, 17 nt, Homo sapiens
uguauguguguagacaa

SEQ ID NO: 1054480 - RNA, 23 nt, Homo sapiens
uguauguuuacauaucaccucau

SEQ ID NO: 1054481 - RNA, 17 nt, Homo sapiens
uguauuagucacagaga

SEQ ID NO: 1054482 - RNA, 17 nt, Homo sapiens
uguauucacccguccag

SEQ ID NO: 1054483 - RNA, 21 nt, Homo sapiens
uguauucucugagcugugcag

SEQ ID NO: 1054484 - RNA, 19 nt, Homo sapiens
uguauuguucccagugaca

SEQ ID NO: 1054485 - RNA, 20 nt, Homo sapiens
uguauuuaccuucuaccucu

SEQ ID NO: 1054486 - RNA, 18 nt, Homo sapiens
uguauuuuccaagugugc

SEQ ID NO: 1054487 - RNA, 18 nt, Homo sapiens
uguauuuuuaaugggggu

SEQ ID NO: 1054488 - RNA, 17 nt, Homo sapiens
ugucaaacaaagccaga

SEQ ID NO: 1054489 - RNA, 16 nt, Homo sapiens
ugucaaaggucuaaaa

SEQ ID NO: 1054490 - RNA, 12 nt, Homo sapiens
ugucaaugauac

SEQ ID NO: 1054491 - RNA, 12 nt, Homo sapiens
ugucaaugucuu

SEQ ID NO: 1054492 - RNA, 15 nt, Homo sapiens
ugucacagggccaac

SEQ ID NO: 1054493 - RNA, 15 nt, Homo sapiens
ugucacccaaugcau

SEQ ID NO: 1054494 - RNA, 18 nt, Homo sapiens
ugucaccccucacuguga

SEQ ID NO: 1054495 - RNA, 22 nt, Homo sapiens
ugucacuacucacagucucuuu

SEQ ID NO: 1054496 - RNA, 23 nt, Homo sapiens
ugucacuucgcgugcccucgcug

SEQ ID NO: 1054497 - RNA, 21 nt, Homo sapiens
ugucagaaaccaguuauguga

SEQ ID NO: 1054498 - RNA, 17 nt, Homo sapiens
ugucagaguagaagauu

SEQ ID NO: 1054499 - RNA, 16 nt, Homo sapiens
ugucagcuacuaauga

SEQ ID NO: 1054500 - RNA, 16 nt, Homo sapiens
ugucagucagggacaa

SEQ ID NO: 1054501 - RNA, 16 nt, Homo sapiens
ugucauaaaaagacaa

SEQ ID NO: 1054502 - RNA, 17 nt, Homo sapiens
ugucauauaagauucau

SEQ ID NO: 1054503 - RNA, 13 nt, Homo sapiens
ugucauauauuac

SEQ ID NO: 1054504 - RNA, 21 nt, Homo sapiens
ugucauauauuacuagcauau

SEQ ID NO: 1054505 - RNA, 15 nt, Homo sapiens
ugucaugucagcucc

SEQ ID NO: 1054506 - RNA, 23 nt, Homo sapiens
ugucauuaaauggggcucacaaa

SEQ ID NO: 1054507 - RNA, 17 nt, Homo sapiens
uguccaggcacugagau

SEQ ID NO: 1054508 - RNA, 14 nt, Homo sapiens
uguccaguucccag

SEQ ID NO: 1054509 - RNA, 21 nt, Homo sapiens
uguccaugugugugcaagugu

SEQ ID NO: 1054510 - RNA, 15 nt, Homo sapiens
ugucccaaguuccac

SEQ ID NO: 1054511 - RNA, 17 nt, Homo sapiens
ugucccacuaucugggu

SEQ ID NO: 1054512 - RNA, 23 nt, Homo sapiens
ugucccacuaucugggugcauga

SEQ ID NO: 1054513 - RNA, 22 nt, Homo sapiens
ugucccacucaagccaagcagc

SEQ ID NO: 1054514 - RNA, 21 nt, Homo sapiens
ugucccagaaugccuccugca

SEQ ID NO: 1054515 - RNA, 14 nt, Homo sapiens
ugucccccuugugg

SEQ ID NO: 1054516 - RNA, 19 nt, Homo sapiens
uguccccuaaaccaaaaac

SEQ ID NO: 1054517 - RNA, 19 nt, Homo sapiens
uguccccuccacugucaca

SEQ ID NO: 1054518 - RNA, 16 nt, Homo sapiens
ugucccucacuguuga

SEQ ID NO: 1054519 - RNA, 19 nt, Homo sapiens
uguccggucccugucccag

SEQ ID NO: 1054520 - RNA, 17 nt, Homo sapiens
uguccuaugggagucaa

SEQ ID NO: 1054521 - RNA, 15 nt, Homo sapiens
uguccuccaagccag

SEQ ID NO: 1054522 - RNA, 16 nt, Homo sapiens
uguccucuugcucaaa

SEQ ID NO: 1054523 - RNA, 13 nt, Homo sapiens
uguccugcuacaa

SEQ ID NO: 1054524 - RNA, 17 nt, Homo sapiens
ugucgucuuagcaagaa

SEQ ID NO: 1054525 - RNA, 20 nt, Homo sapiens
ugucuaagguccccacugcc

SEQ ID NO: 1054526 - RNA, 16 nt, Homo sapiens
ugucuauguauguuau

SEQ ID NO: 1054527 - RNA, 13 nt, Homo sapiens
ugucucacacugg

SEQ ID NO: 1054528 - RNA, 13 nt, Homo sapiens
ugucucagccucc

SEQ ID NO: 1054529 - RNA, 16 nt, Homo sapiens
ugucucaguccaugaa

SEQ ID NO: 1054530 - RNA, 19 nt, Homo sapiens
ugucucccagcucagggcu

SEQ ID NO: 1054531 - RNA, 23 nt, Homo sapiens
ugucucgugguaggacuguagaa

SEQ ID NO: 1054532 - RNA, 20 nt, Homo sapiens
ugucucuacuaaaaaugcaa

SEQ ID NO: 1054533 - RNA, 12 nt, Homo sapiens
ugucucucauga

SEQ ID NO: 1054534 - RNA, 15 nt, Homo sapiens
ugucucucaugacca

SEQ ID NO: 1054535 - RNA, 18 nt, Homo sapiens
ugucucuuuaaugucaca

SEQ ID NO: 1054536 - RNA, 16 nt, Homo sapiens
ugucugacaaccucuu

SEQ ID NO: 1054537 - RNA, 19 nt, Homo sapiens
ugucugccagccagcagcc

SEQ ID NO: 1054538 - RNA, 17 nt, Homo sapiens
ugucugcucaguaauuu

SEQ ID NO: 1054539 - RNA, 16 nt, Homo sapiens
ugucugcuuucuccau

SEQ ID NO: 1054540 - RNA, 19 nt, Homo sapiens
ugucuggauucccaggaug

SEQ ID NO: 1054541 - RNA, 15 nt, Homo sapiens
ugucuggugguggca

SEQ ID NO: 1054542 - RNA, 14 nt, Homo sapiens
ugucugugugcaag

SEQ ID NO: 1054543 - RNA, 23 nt, Homo sapiens
ugucuguguuccaaccacugaau

SEQ ID NO: 1054544 - RNA, 21 nt, Homo sapiens
ugucuuaauuaaaagaauauu

SEQ ID NO: 1054545 - RNA, 16 nt, Homo sapiens
ugucuuaguuguacaa

SEQ ID NO: 1054546 - RNA, 13 nt, Homo sapiens
ugucuucaccuga

SEQ ID NO: 1054547 - RNA, 19 nt, Homo sapiens
ugucuucguacaguucuuc

SEQ ID NO: 1054548 - RNA, 23 nt, Homo sapiens
ugugaaagaaccaaaagagauca

SEQ ID NO: 1054549 - RNA, 21 nt, Homo sapiens
ugugaaaggaagcuccacugu

SEQ ID NO: 1054550 - RNA, 17 nt, Homo sapiens
ugugaacaagucccugu

SEQ ID NO: 1054551 - RNA, 19 nt, Homo sapiens
ugugaacacaucagcuugc

SEQ ID NO: 1054552 - RNA, 15 nt, Homo sapiens
ugugaaccaccacac

SEQ ID NO: 1054553 - RNA, 15 nt, Homo sapiens
ugugaaccccaaagu

SEQ ID NO: 1054554 - RNA, 23 nt, Homo sapiens
ugugaaccgaggggcucaggaaa

SEQ ID NO: 1054555 - RNA, 14 nt, Homo sapiens
ugugaagaaagggu

SEQ ID NO: 1054556 - RNA, 23 nt, Homo sapiens
ugugaaggaauuauucccaugag

SEQ ID NO: 1054557 - RNA, 16 nt, Homo sapiens
ugugaaguggaaaugu

SEQ ID NO: 1054558 - RNA, 18 nt, Homo sapiens
ugugaaguuugcuuugua

SEQ ID NO: 1054559 - RNA, 19 nt, Homo sapiens
ugugaaguuugcuuuguac

SEQ ID NO: 1054560 - RNA, 13 nt, Homo sapiens
ugugaauggauug

SEQ ID NO: 1054561 - RNA, 22 nt, Homo sapiens
ugugacaauggcaacaauuuga

SEQ ID NO: 1054562 - RNA, 14 nt, Homo sapiens
ugugacacauaugc

SEQ ID NO: 1054563 - RNA, 15 nt, Homo sapiens
ugugacacauaugca

SEQ ID NO: 1054564 - RNA, 20 nt, Homo sapiens
ugugaccaaugucuugaugc

SEQ ID NO: 1054565 - RNA, 15 nt, Homo sapiens
ugugacuggcaguau

SEQ ID NO: 1054566 - RNA, 22 nt, Homo sapiens
ugugacuugaacuagauugcau

SEQ ID NO: 1054567 - RNA, 18 nt, Homo sapiens
uguuuuauugacaucucu

SEQ ID NO: 1054568 - RNA, 14 nt, Homo sapiens
uguuuuccuauaau

SEQ ID NO: 1054569 - RNA, 13 nt, Homo sapiens
uguuuucuuaugc

SEQ ID NO: 1054570 - RNA, 21 nt, Homo sapiens
uuaaaaaaaaaccugagcccc

SEQ ID NO: 1054571 - RNA, 16 nt, Homo sapiens
uuaaaaaaacacauaa

SEQ ID NO: 1054572 - RNA, 17 nt, Homo sapiens
uuaaaaaaacacauaau

SEQ ID NO: 1054573 - RNA, 18 nt, Homo sapiens
uuaaaaaaauaugccuuu

SEQ ID NO: 1054574 - RNA, 23 nt, Homo sapiens
uuaaaaaaguuggguuuucucca

SEQ ID NO: 1054575 - RNA, 23 nt, Homo sapiens
uuaaaaauaaaaaacauauacaa

SEQ ID NO: 1054576 - RNA, 20 nt, Homo sapiens
uuaaaacaacacucacauuu

SEQ ID NO: 1054577 - RNA, 22 nt, Homo sapiens
uuaaaacaacacucacauuuau

SEQ ID NO: 1054578 - RNA, 16 nt, Homo sapiens
uuaaaacagacacugg

SEQ ID NO: 1054579 - RNA, 16 nt, Homo sapiens
uuaaaacaugcacaaa

SEQ ID NO: 1054580 - RNA, 20 nt, Homo sapiens
uuaaaagccaucaaacacaa

SEQ ID NO: 1054581 - RNA, 18 nt, Homo sapiens
uuaaaagcccuaccuaaa

SEQ ID NO: 1054582 - RNA, 19 nt, Homo sapiens
uuaaaaguugugauuccag

SEQ ID NO: 1054583 - RNA, 16 nt, Homo sapiens
uuaaaauaagcacugu

SEQ ID NO: 1054584 - RNA, 17 nt, Homo sapiens
uuaaacaaauguaugau

SEQ ID NO: 1054585 - RNA, 13 nt, Homo sapiens
uuaaacagcagau

SEQ ID NO: 1054586 - RNA, 18 nt, Homo sapiens
uuaaacguaugcauguga

SEQ ID NO: 1054587 - RNA, 13 nt, Homo sapiens
uuaaacucaggga

SEQ ID NO: 1054588 - RNA, 21 nt, Homo sapiens
uuaaacucagggacagagcca

SEQ ID NO: 1054589 - RNA, 20 nt, Homo sapiens
uuaaacugaaucacaaugua

SEQ ID NO: 1054590 - RNA, 19 nt, Homo sapiens
uuaaagcauuuacuuugaa

SEQ ID NO: 1054591 - RNA, 19 nt, Homo sapiens
uuaaagcugaaaacugcaa

SEQ ID NO: 1054592 - RNA, 20 nt, Homo sapiens
uuaaagcuuauuaaaacuca

SEQ ID NO: 1054593 - RNA, 19 nt, Homo sapiens
uuaaagcuugcucacaucu

SEQ ID NO: 1054594 - RNA, 19 nt, Homo sapiens
uuaaaggguguacuuauau

SEQ ID NO: 1054595 - RNA, 16 nt, Homo sapiens
uuaaagguagucaaga

SEQ ID NO: 1054596 - RNA, 21 nt, Homo sapiens
uuaaaucaagagcuuacauaa

SEQ ID NO: 1054597 - RNA, 12 nt, Homo sapiens
uuaaaucaauaa

SEQ ID NO: 1054598 - RNA, 24 nt, Homo sapiens
uuaaaucagccguguaaccaugga

SEQ ID NO: 1054599 - RNA, 16 nt, Homo sapiens
uuaaaucuaugaagua

SEQ ID NO: 1054600 - RNA, 14 nt, Homo sapiens
uuaaauggcuuuau

SEQ ID NO: 1054601 - RNA, 19 nt, Homo sapiens
uuaaauugcagaugguuaa

SEQ ID NO: 1054602 - RNA, 15 nt, Homo sapiens
uuaaauuucaucuca

SEQ ID NO: 1054603 - RNA, 23 nt, Homo sapiens
uuaacaaauuauguuacaucugu

SEQ ID NO: 1054604 - RNA, 17 nt, Homo sapiens
uuaacaauaacuacugu

SEQ ID NO: 1054605 - RNA, 15 nt, Homo sapiens
uuaacaguuuuccau

SEQ ID NO: 1054606 - RNA, 23 nt, Homo sapiens
uuaacuauuuuauuuucuaaugu

SEQ ID NO: 1054607 - RNA, 19 nt, Homo sapiens
uuaacucuaucugucauac

SEQ ID NO: 1054608 - RNA, 19 nt, Homo sapiens
uuaagaacacuuuuaauaa

SEQ ID NO: 1054609 - RNA, 16 nt, Homo sapiens
uuaagaagaaacuagg

SEQ ID NO: 1054610 - RNA, 23 nt, Homo sapiens
uuaagaagaaauacccacuaaca

SEQ ID NO: 1054611 - RNA, 20 nt, Homo sapiens
uuaagaauguucuuauguug

SEQ ID NO: 1054612 - RNA, 14 nt, Homo sapiens
uuaagacuacugaa

SEQ ID NO: 1054613 - RNA, 15 nt, Homo sapiens
uuaagaguuacuuaa

SEQ ID NO: 1054614 - RNA, 12 nt, Homo sapiens
uuaagccuuaaa

SEQ ID NO: 1054615 - RNA, 19 nt, Homo sapiens
uuaagcugggauaaucaca

SEQ ID NO: 1054616 - RNA, 23 nt, Homo sapiens
uuaagcugggauaaucacauuau

SEQ ID NO: 1054617 - RNA, 15 nt, Homo sapiens
uuaaggauugugaua

SEQ ID NO: 1054618 - RNA, 16 nt, Homo sapiens
uuaagggaaggaacuc

SEQ ID NO: 1054619 - RNA, 18 nt, Homo sapiens
cagacuccugugcaacuu

SEQ ID NO: 1054620 - RNA, 16 nt, Homo sapiens
cagacucuggucuucu

SEQ ID NO: 1054621 - RNA, 13 nt, Homo sapiens
cagacugucucaa

SEQ ID NO: 1054622 - RNA, 17 nt, Homo sapiens
cagacugucucaaauaa

SEQ ID NO: 1054623 - RNA, 23 nt, Homo sapiens
cagacuguguauucauugaaguc

SEQ ID NO: 1054624 - RNA, 17 nt, Homo sapiens
cagagaaagaagagaca

SEQ ID NO: 1054625 - RNA, 14 nt, Homo sapiens
cagagaaaguacuu

SEQ ID NO: 1054626 - RNA, 18 nt, Homo sapiens
cagagaaccugcuuuacu

SEQ ID NO: 1054627 - RNA, 18 nt, Homo sapiens
cagagacaggcccaagag

SEQ ID NO: 1054628 - RNA, 22 nt, Homo sapiens
cagagacgcagacaugugcacu

SEQ ID NO: 1054629 - RNA, 17 nt, Homo sapiens
cagagacggaagccuuu

SEQ ID NO: 1054630 - RNA, 20 nt, Homo sapiens
cagagacuaucugauuuccu

SEQ ID NO: 1054631 - RNA, 15 nt, Homo sapiens
cagagagcaacucug

SEQ ID NO: 1054632 - RNA, 19 nt, Homo sapiens
cagagagccuggugcugcu

SEQ ID NO: 1054633 - RNA, 17 nt, Homo sapiens
cagagagggacugacac

SEQ ID NO: 1054634 - RNA, 18 nt, Homo sapiens
cagagagucccacugccu

SEQ ID NO: 1054635 - RNA, 19 nt, Homo sapiens
cagagagucccacugccuc

SEQ ID NO: 1054636 - RNA, 17 nt, Homo sapiens
cagagaguccucuggau

SEQ ID NO: 1054637 - RNA, 19 nt, Homo sapiens
cagagauaauucuagcuuu

SEQ ID NO: 1054638 - RNA, 11 nt, Homo sapiens
cagagcacugg

SEQ ID NO: 1054639 - RNA, 22 nt, Homo sapiens
cagagcauucagaaugucaaug

SEQ ID NO: 1054640 - RNA, 23 nt, Homo sapiens
cagagcauuuccaacaccacaga

SEQ ID NO: 1054641 - RNA, 20 nt, Homo sapiens
cagagcgcaagcugggagca

SEQ ID NO: 1054642 - RNA, 12 nt, Homo sapiens
cagagcucccuc

SEQ ID NO: 1054643 - RNA, 14 nt, Homo sapiens
cagaggaaguggaa

SEQ ID NO: 1054644 - RNA, 20 nt, Homo sapiens
cagaggcacagagagaguca

SEQ ID NO: 1054645 - RNA, 18 nt, Homo sapiens
cagaggcugcagaaggcc

SEQ ID NO: 1054646 - RNA, 18 nt, Homo sapiens
cagagggaucuuguguac

SEQ ID NO: 1054647 - RNA, 15 nt, Homo sapiens
cagagggcccaggca

SEQ ID NO: 1054648 - RNA, 20 nt, Homo sapiens
cagaggugggcagguggugg

SEQ ID NO: 1054649 - RNA, 21 nt, Homo sapiens
cagagguucauuucaaauaca

SEQ ID NO: 1054650 - RNA, 20 nt, Homo sapiens
cagagguugcagugagccga

SEQ ID NO: 1054651 - RNA, 18 nt, Homo sapiens
cagaguacuggcugaugg

SEQ ID NO: 1054652 - RNA, 22 nt, Homo sapiens
cagaguaguccagguguucucc

SEQ ID NO: 1054653 - RNA, 19 nt, Homo sapiens
cagagucaaugaacuuucc

SEQ ID NO: 1054654 - RNA, 15 nt, Homo sapiens
cagaguccuuuccaa

SEQ ID NO: 1054655 - RNA, 18 nt, Homo sapiens
cagagucucacuguugcc

SEQ ID NO: 1054656 - RNA, 19 nt, Homo sapiens
cagagucucacuguugccc

SEQ ID NO: 1054657 - RNA, 16 nt, Homo sapiens
cagagucuggcucugu

SEQ ID NO: 1054658 - RNA, 16 nt, Homo sapiens
cagagucuguuucagg

SEQ ID NO: 1054659 - RNA, 19 nt, Homo sapiens
cagagucuucagagacuuc

SEQ ID NO: 1054660 - RNA, 22 nt, Homo sapiens
cagagugagacccagcccucau

SEQ ID NO: 1054661 - RNA, 23 nt, Homo sapiens
cagagugagacccagcccucauc

SEQ ID NO: 1054662 - RNA, 11 nt, Homo sapiens
cagagugcaag

SEQ ID NO: 1054663 - RNA, 18 nt, Homo sapiens
cagaguggggaugacaug

SEQ ID NO: 1054664 - RNA, 21 nt, Homo sapiens
cagaguuccugcggagugaag

SEQ ID NO: 1054665 - RNA, 18 nt, Homo sapiens
cagauaaacaacaaauaa

SEQ ID NO: 1054666 - RNA, 13 nt, Homo sapiens
cagauaaugugaa

SEQ ID NO: 1054667 - RNA, 21 nt, Homo sapiens
cagauacuucccauuuuggaa

SEQ ID NO: 1054668 - RNA, 17 nt, Homo sapiens
cagauagauauaugcuc

SEQ ID NO: 1054669 - RNA, 11 nt, Homo sapiens
cagauagucaa

SEQ ID NO: 1054670 - RNA, 15 nt, Homo sapiens
cagaucaauuuguaa

SEQ ID NO: 1054671 - RNA, 22 nt, Homo sapiens
cagaucacccggggcuuacuua

SEQ ID NO: 1054672 - RNA, 15 nt, Homo sapiens
cagaucacuacugca

SEQ ID NO: 1054673 - RNA, 16 nt, Homo sapiens
cagaucauauuucaca

SEQ ID NO: 1054674 - RNA, 18 nt, Homo sapiens
cagaucccacuugcagcc

SEQ ID NO: 1054675 - RNA, 20 nt, Homo sapiens
cagaucccacuugcagccuc

SEQ ID NO: 1054676 - RNA, 14 nt, Homo sapiens
cagaucccagcuca

SEQ ID NO: 1054677 - RNA, 14 nt, Homo sapiens
cagauccucacaac

SEQ ID NO: 1054678 - RNA, 23 nt, Homo sapiens
cagaucuguuucgugcauuggaa

SEQ ID NO: 1054679 - RNA, 12 nt, Homo sapiens
cagaugcaauac

SEQ ID NO: 1054680 - RNA, 19 nt, Homo sapiens
cagaugccccagagcuguu

SEQ ID NO: 1054681 - RNA, 21 nt, Homo sapiens
cagaugccucagccuacuuuc

SEQ ID NO: 1054682 - RNA, 17 nt, Homo sapiens
cagaugcugauguucag

SEQ ID NO: 1054683 - RNA, 19 nt, Homo sapiens
cagaugcuuuccugcacau

SEQ ID NO: 1054684 - RNA, 22 nt, Homo sapiens
cagaugcuuuccugcacauuaa

SEQ ID NO: 1054685 - RNA, 18 nt, Homo sapiens
cagaugcuuuucugucuc

SEQ ID NO: 1054686 - RNA, 22 nt, Homo sapiens
cagauggcaggaugggcacugc

SEQ ID NO: 1054687 - RNA, 22 nt, Homo sapiens
cagaugggagugcccccaacag

SEQ ID NO: 1054688 - RNA, 17 nt, Homo sapiens
cagauguggcugaaccg

SEQ ID NO: 1054689 - RNA, 12 nt, Homo sapiens
cagaugugguaa

SEQ ID NO: 1054690 - RNA, 13 nt, Homo sapiens
cagaugugugauu

SEQ ID NO: 1054691 - RNA, 22 nt, Homo sapiens
cagauguuuuacgucugggaga

SEQ ID NO: 1054692 - RNA, 22 nt, Homo sapiens
cagauuccaggcgaugugcaag

SEQ ID NO: 1054693 - RNA, 17 nt, Homo sapiens
cagauuguuaucuauca

SEQ ID NO: 1054694 - RNA, 15 nt, Homo sapiens
cagauuuacacuggg

SEQ ID NO: 1054695 - RNA, 17 nt, Homo sapiens
cagauuugggcuggaac

SEQ ID NO: 1054696 - RNA, 18 nt, Homo sapiens
cagcaaaacuccaucuca

SEQ ID NO: 1054697 - RNA, 16 nt, Homo sapiens
cagcaaaagaagacaa

SEQ ID NO: 1054698 - RNA, 21 nt, Homo sapiens
cagcaaaagaagacaacauuu

SEQ ID NO: 1054699 - RNA, 13 nt, Homo sapiens
cagcaagucucuu

SEQ ID NO: 1054700 - RNA, 18 nt, Homo sapiens
cagcaagugagagcuggg

SEQ ID NO: 1054701 - RNA, 17 nt, Homo sapiens
cagcaaugacaucucag

SEQ ID NO: 1054702 - RNA, 20 nt, Homo sapiens
cagcaaugacaucucagggg

SEQ ID NO: 1054703 - RNA, 12 nt, Homo sapiens
cagcaaugauua

SEQ ID NO: 1054704 - RNA, 20 nt, Homo sapiens
cagcacccugaugucccugg

SEQ ID NO: 1054705 - RNA, 16 nt, Homo sapiens
cagcacuuguguuguc

SEQ ID NO: 1054706 - RNA, 18 nt, Homo sapiens
cagcacuuguguugucug

SEQ ID NO: 1054707 - RNA, 22 nt, Homo sapiens
cagcagaaaggagaacuaucca

SEQ ID NO: 1054708 - RNA, 13 nt, Homo sapiens
cagcagaggcacu

SEQ ID NO: 1054709 - RNA, 17 nt, Homo sapiens
cagcagaucccagcuca

SEQ ID NO: 1054710 - RNA, 15 nt, Homo sapiens
uuauaaaugcuauuu

SEQ ID NO: 1054711 - RNA, 12 nt, Homo sapiens
uuauaaucuuuu

SEQ ID NO: 1054712 - RNA, 18 nt, Homo sapiens
uuauacauaacacauauc

SEQ ID NO: 1054713 - RNA, 13 nt, Homo sapiens
uuauacauuugau

SEQ ID NO: 1054714 - RNA, 23 nt, Homo sapiens
uuauaccugcucuuguucuacug

SEQ ID NO: 1054715 - RNA, 16 nt, Homo sapiens
uuauagaaguagcaaa

SEQ ID NO: 1054716 - RNA, 20 nt, Homo sapiens
uuauagaaguagcaaaaagu

SEQ ID NO: 1054717 - RNA, 18 nt, Homo sapiens
uuauauagguugugcaaa

SEQ ID NO: 1054718 - RNA, 23 nt, Homo sapiens
uuauauuuguaaauuuaugugau

SEQ ID NO: 1054719 - RNA, 18 nt, Homo sapiens
uuauauuuugugcuauca

SEQ ID NO: 1054720 - RNA, 17 nt, Homo sapiens
uuaucagaauucucaga

SEQ ID NO: 1054721 - RNA, 13 nt, Homo sapiens
uuaucaguaguau

SEQ ID NO: 1054722 - RNA, 15 nt, Homo sapiens
uuaucaucaccucaa

SEQ ID NO: 1054723 - RNA, 19 nt, Homo sapiens
uuaucaugcaaaugcugua

SEQ ID NO: 1054724 - RNA, 16 nt, Homo sapiens
uuaucaugcauguuau

SEQ ID NO: 1054725 - RNA, 16 nt, Homo sapiens
uuauccucugaucucc

SEQ ID NO: 1054726 - RNA, 17 nt, Homo sapiens
uuaucgaaauaacaaug

SEQ ID NO: 1054727 - RNA, 17 nt, Homo sapiens
uuaucuguaaguuuuga

SEQ ID NO: 1054728 - RNA, 23 nt, Homo sapiens
uuaucugucccagguuaucuggg

SEQ ID NO: 1054729 - RNA, 23 nt, Homo sapiens
uuaucugugcgugaaacacacca

SEQ ID NO: 1054730 - RNA, 13 nt, Homo sapiens
uuaucuuaugcca

SEQ ID NO: 1054731 - RNA, 15 nt, Homo sapiens
uuaucuugucucugg

SEQ ID NO: 1054732 - RNA, 20 nt, Homo sapiens
uuaugaaccuuuacauccag

SEQ ID NO: 1054733 - RNA, 20 nt, Homo sapiens
uuaugagaugccugaagcca

SEQ ID NO: 1054734 - RNA, 14 nt, Homo sapiens
uuaugauugcauaa

SEQ ID NO: 1054735 - RNA, 21 nt, Homo sapiens
uuaugcagaauccaaaguaaa

SEQ ID NO: 1054736 - RNA, 16 nt, Homo sapiens
uuaugcuaagugaaau

SEQ ID NO: 1054737 - RNA, 11 nt, Homo sapiens
uuaugcugcug

SEQ ID NO: 1054738 - RNA, 23 nt, Homo sapiens
uuauggaaggacuacagcagcau

SEQ ID NO: 1054739 - RNA, 16 nt, Homo sapiens
uuauguaauaauguga

SEQ ID NO: 1054740 - RNA, 22 nt, Homo sapiens
uuauguaugugaaaguuacaaa

SEQ ID NO: 1054741 - RNA, 22 nt, Homo sapiens
uuaugucaucauacaugacuca

SEQ ID NO: 1054742 - RNA, 17 nt, Homo sapiens
uuauuacauggggucua

SEQ ID NO: 1054743 - RNA, 12 nt, Homo sapiens
uuauuaccucug

SEQ ID NO: 1054744 - RNA, 19 nt, Homo sapiens
uuauuagagugucuuucca

SEQ ID NO: 1054745 - RNA, 15 nt, Homo sapiens
uuauuauaauuguau

SEQ ID NO: 1054746 - RNA, 17 nt, Homo sapiens
uuauuauggcacaucag

SEQ ID NO: 1054747 - RNA, 14 nt, Homo sapiens
uuauuccacaucua

SEQ ID NO: 1054748 - RNA, 14 nt, Homo sapiens
uuauucugauucca

SEQ ID NO: 1054749 - RNA, 16 nt, Homo sapiens
uuauucugauuccacu

SEQ ID NO: 1054750 - RNA, 18 nt, Homo sapiens
uuauucugccaaaccugu

SEQ ID NO: 1054751 - RNA, 16 nt, Homo sapiens
uuauugugaucuauca

SEQ ID NO: 1054752 - RNA, 13 nt, Homo sapiens
uuauugugccuca

SEQ ID NO: 1054753 - RNA, 12 nt, Homo sapiens
uuauuguuccaa

SEQ ID NO: 1054754 - RNA, 13 nt, Homo sapiens
uuauuuagauccc

SEQ ID NO: 1054755 - RNA, 23 nt, Homo sapiens
uuauuuagauccccccuuuccuu

SEQ ID NO: 1054756 - RNA, 19 nt, Homo sapiens
uuauuuagggaacugcuug

SEQ ID NO: 1054757 - RNA, 17 nt, Homo sapiens
uuauuuaucaaguguau

SEQ ID NO: 1054758 - RNA, 12 nt, Homo sapiens
uuauuucacuuu

SEQ ID NO: 1054759 - RNA, 16 nt, Homo sapiens
uuauuugaaggccagc

SEQ ID NO: 1054760 - RNA, 22 nt, Homo sapiens
uuauuuuucauauugugccaau

SEQ ID NO: 1054761 - RNA, 17 nt, Homo sapiens
uucaaaauuggacuuaa

SEQ ID NO: 1054762 - RNA, 22 nt, Homo sapiens
uucaaaccaaucaaaugguguu

SEQ ID NO: 1054763 - RNA, 12 nt, Homo sapiens
uucaaacuuaaa

SEQ ID NO: 1054764 - RNA, 12 nt, Homo sapiens
uucaaacuuuac

SEQ ID NO: 1054765 - RNA, 15 nt, Homo sapiens
uucaaagagucauau

SEQ ID NO: 1054766 - RNA, 18 nt, Homo sapiens
uucaaaguuaaaagcaaa

SEQ ID NO: 1054767 - RNA, 15 nt, Homo sapiens
uucaaccacuguaaa

SEQ ID NO: 1054768 - RNA, 16 nt, Homo sapiens
uucaaccuugagacag

SEQ ID NO: 1054769 - RNA, 11 nt, Homo sapiens
uucaacuggag

SEQ ID NO: 1054770 - RNA, 16 nt, Homo sapiens
uucaacuugcauccaa

SEQ ID NO: 1054771 - RNA, 23 nt, Homo sapiens
uucaagaagugccaguugaucaa

SEQ ID NO: 1054772 - RNA, 14 nt, Homo sapiens
cagcugacacaucu

SEQ ID NO: 1054773 - RNA, 13 nt, Homo sapiens
cagcugaucacag

SEQ ID NO: 1054774 - RNA, 19 nt, Homo sapiens
cagcuggaagggucaacau

SEQ ID NO: 1054775 - RNA, 19 nt, Homo sapiens
cagcuggaaucugaaggcg

SEQ ID NO: 1054776 - RNA, 15 nt, Homo sapiens
cagcuggaucuccau

SEQ ID NO: 1054777 - RNA, 18 nt, Homo sapiens
cagcuggcacugucucug

SEQ ID NO: 1054778 - RNA, 18 nt, Homo sapiens
cagcugggcucugcaauu

SEQ ID NO: 1054779 - RNA, 23 nt, Homo sapiens
cagcuggguuggaaaacaguauu

SEQ ID NO: 1054780 - RNA, 22 nt, Homo sapiens
cagcuguaagaagagacuggga

SEQ ID NO: 1054781 - RNA, 19 nt, Homo sapiens
cagcugugauuuggaaggg

SEQ ID NO: 1054782 - RNA, 14 nt, Homo sapiens
cagcuguugcagug

SEQ ID NO: 1054783 - RNA, 20 nt, Homo sapiens
cagcuuaggggcugcugacc

SEQ ID NO: 1054784 - RNA, 13 nt, Homo sapiens
cagcuuaucucag

SEQ ID NO: 1054785 - RNA, 19 nt, Homo sapiens
cagcuucaccagagcauuu

SEQ ID NO: 1054786 - RNA, 20 nt, Homo sapiens
cagcuucaccagagcauuuc

SEQ ID NO: 1054787 - RNA, 20 nt, Homo sapiens
cagcuucccgaguaacugag

SEQ ID NO: 1054788 - RNA, 16 nt, Homo sapiens
cagcuucuauuagcca

SEQ ID NO: 1054789 - RNA, 17 nt, Homo sapiens
cagcuucucuccacuga

SEQ ID NO: 1054790 - RNA, 13 nt, Homo sapiens
cagcuucugggac

SEQ ID NO: 1054791 - RNA, 20 nt, Homo sapiens
cagcuugaguggguucucug

SEQ ID NO: 1054792 - RNA, 23 nt, Homo sapiens
cagcuuguaaugguucuuuacac

SEQ ID NO: 1054793 - RNA, 20 nt, Homo sapiens
cagcuuuccucaucaggcca

SEQ ID NO: 1054794 - RNA, 19 nt, Homo sapiens
cagcuuugcuaccaaagca

SEQ ID NO: 1054795 - RNA, 23 nt, Homo sapiens
cagcuuuguuuguugucagcuga

SEQ ID NO: 1054796 - RNA, 19 nt, Homo sapiens
caggaaaucaaauaugcaa

SEQ ID NO: 1054797 - RNA, 16 nt, Homo sapiens
caggaagccgugcccu

SEQ ID NO: 1054798 - RNA, 15 nt, Homo sapiens
caggaaggacugugc

SEQ ID NO: 1054799 - RNA, 18 nt, Homo sapiens
caggaagugucuagagga

SEQ ID NO: 1054800 - RNA, 22 nt, Homo sapiens
caggacacagggaaaucagggu

SEQ ID NO: 1054801 - RNA, 13 nt, Homo sapiens
caggacauucuca

SEQ ID NO: 1054802 - RNA, 14 nt, Homo sapiens
caggacauucucau

SEQ ID NO: 1054803 - RNA, 12 nt, Homo sapiens
caggaccagcug

SEQ ID NO: 1054804 - RNA, 22 nt, Homo sapiens
caggacucugccuccucuucaa

SEQ ID NO: 1054805 - RNA, 20 nt, Homo sapiens
caggacuuccauuugcuuug

SEQ ID NO: 1054806 - RNA, 14 nt, Homo sapiens
caggagacaguuca

SEQ ID NO: 1054807 - RNA, 17 nt, Homo sapiens
caggagaccuggcacug

SEQ ID NO: 1054808 - RNA, 19 nt, Homo sapiens
caggagaggagcgggaccu

SEQ ID NO: 1054809 - RNA, 22 nt, Homo sapiens
caggagaggggcagaacagccg

SEQ ID NO: 1054810 - RNA, 11 nt, Homo sapiens
caggagcucuu

SEQ ID NO: 1054811 - RNA, 18 nt, Homo sapiens
caggagggcacuggagcu

SEQ ID NO: 1054812 - RNA, 21 nt, Homo sapiens
caggagguaaagaaauagcca

SEQ ID NO: 1054813 - RNA, 23 nt, Homo sapiens
caggagguggaggcugcagugag

SEQ ID NO: 1054814 - RNA, 14 nt, Homo sapiens
caggaucugaguua

SEQ ID NO: 1054815 - RNA, 23 nt, Homo sapiens
caggaucugaguuauuuugcuaa

SEQ ID NO: 1054816 - RNA, 14 nt, Homo sapiens
caggaugggcacug

SEQ ID NO: 1054817 - RNA, 12 nt, Homo sapiens
caggauggucau

SEQ ID NO: 1054818 - RNA, 18 nt, Homo sapiens
caggauuaaaagccauga

SEQ ID NO: 1054819 - RNA, 15 nt, Homo sapiens
caggcaaaauugaua

SEQ ID NO: 1054820 - RNA, 16 nt, Homo sapiens
caggcaagcaccuccu

SEQ ID NO: 1054821 - RNA, 14 nt, Homo sapiens
caggcaagugaaga

SEQ ID NO: 1054822 - RNA, 23 nt, Homo sapiens
caggcaaugugacuuugcaucag

SEQ ID NO: 1054823 - RNA, 13 nt, Homo sapiens
caggcaccugcca

SEQ ID NO: 1054824 - RNA, 15 nt, Homo sapiens
caggcacugcugccc

SEQ ID NO: 1054825 - RNA, 13 nt, Homo sapiens
caggcagcucaag

SEQ ID NO: 1054826 - RNA, 20 nt, Homo sapiens
caggcagcuuuuucucuccc

SEQ ID NO: 1054827 - RNA, 16 nt, Homo sapiens
caggcagguccagggu

SEQ ID NO: 1054828 - RNA, 22 nt, Homo sapiens
caggcaucugcuuuacucugga

SEQ ID NO: 1054829 - RNA, 18 nt, Homo sapiens
caggcaugaacauguacu

SEQ ID NO: 1054830 - RNA, 16 nt, Homo sapiens
caggcauuuccugcuu

SEQ ID NO: 1054831 - RNA, 18 nt, Homo sapiens
caggccagagugcugcca

SEQ ID NO: 1054832 - RNA, 14 nt, Homo sapiens
caggccaucaucag

SEQ ID NO: 1054833 - RNA, 14 nt, Homo sapiens
caggcccaagagau

SEQ ID NO: 1054834 - RNA, 14 nt, Homo sapiens
caggccccugccac

SEQ ID NO: 1054835 - RNA, 17 nt, Homo sapiens
caggccgggguggagca

SEQ ID NO: 1054836 - RNA, 19 nt, Homo sapiens
caggccuugggcuccugau

SEQ ID NO: 1054837 - RNA, 15 nt, Homo sapiens
caggcgugguggcac

SEQ ID NO: 1054838 - RNA, 13 nt, Homo sapiens
caggcucugacca

SEQ ID NO: 1054839 - RNA, 20 nt, Homo sapiens
caggcuggagugcaaugaca

SEQ ID NO: 1054840 - RNA, 20 nt, Homo sapiens
caggcugggcuucaguggca

SEQ ID NO: 1054841 - RNA, 14 nt, Homo sapiens
caggcugugggccu

SEQ ID NO: 1054842 - RNA, 13 nt, Homo sapiens
caggcuguucacc

SEQ ID NO: 1054843 - RNA, 13 nt, Homo sapiens
caggcuugugcaa

SEQ ID NO: 1054844 - RNA, 19 nt, Homo sapiens
cagggaacaagcauucucc

SEQ ID NO: 1054845 - RNA, 13 nt, Homo sapiens
cagggaagccaaa

SEQ ID NO: 1054846 - RNA, 17 nt, Homo sapiens
cagggaagugcucugau

SEQ ID NO: 1054847 - RNA, 14 nt, Homo sapiens
cagggaauggagcu

SEQ ID NO: 1054848 - RNA, 23 nt, Homo sapiens
cagggaauggagcucagguccca

SEQ ID NO: 1054849 - RNA, 11 nt, Homo sapiens
cagggacccac

SEQ ID NO: 1054850 - RNA, 17 nt, Homo sapiens
cagggacccacuucaca

SEQ ID NO: 1054851 - RNA, 19 nt, Homo sapiens
cagggagaccgagcgcuuu

SEQ ID NO: 1054852 - RNA, 14 nt, Homo sapiens
cagggaggugaccc

SEQ ID NO: 1054853 - RNA, 15 nt, Homo sapiens
cagggauagcacuga

SEQ ID NO: 1054854 - RNA, 12 nt, Homo sapiens
cagggcacuuca

SEQ ID NO: 1054855 - RNA, 17 nt, Homo sapiens
cagggcagggcucugau

SEQ ID NO: 1054856 - RNA, 16 nt, Homo sapiens
gaaagguuauguuagc

SEQ ID NO: 1054857 - RNA, 17 nt, Homo sapiens
gaaaguaagugguagcu

SEQ ID NO: 1054858 - RNA, 15 nt, Homo sapiens
gaaaguauaacugag

SEQ ID NO: 1054859 - RNA, 15 nt, Homo sapiens
gaaagugaccauguu

SEQ ID NO: 1054860 - RNA, 12 nt, Homo sapiens
gaaagugauauc

SEQ ID NO: 1054861 - RNA, 18 nt, Homo sapiens
gaaagugcgaguccucca

SEQ ID NO: 1054862 - RNA, 23 nt, Homo sapiens
gaaaguggccaugccacccuguu

SEQ ID NO: 1054863 - RNA, 16 nt, Homo sapiens
gaaaguguaaagcauu

SEQ ID NO: 1054864 - RNA, 18 nt, Homo sapiens
gaaaguuaauccacugug

SEQ ID NO: 1054865 - RNA, 15 nt, Homo sapiens
gaaauaaaaauaccu

SEQ ID NO: 1054866 - RNA, 18 nt, Homo sapiens
gaaauaaaguuggugaca

SEQ ID NO: 1054867 - RNA, 20 nt, Homo sapiens
gaaauaccaguucugggcaa

SEQ ID NO: 1054868 - RNA, 13 nt, Homo sapiens
gaaauacuuucag

SEQ ID NO: 1054869 - RNA, 16 nt, Homo sapiens
gaaauaugaaugcccc

SEQ ID NO: 1054870 - RNA, 21 nt, Homo sapiens
gaaaucauaguuuaaacugca

SEQ ID NO: 1054871 - RNA, 23 nt, Homo sapiens
gaaaucauuuuacccuuggcuca

SEQ ID NO: 1054872 - RNA, 12 nt, Homo sapiens
gaaauccaucua

SEQ ID NO: 1054873 - RNA, 18 nt, Homo sapiens
gaaaucuagaagacuguc

SEQ ID NO: 1054874 - RNA, 19 nt, Homo sapiens
gaaaucuagaagacuguca

SEQ ID NO: 1054875 - RNA, 13 nt, Homo sapiens
gaaaucuaugaaa

SEQ ID NO: 1054876 - RNA, 12 nt, Homo sapiens
gaaaucugccaa

SEQ ID NO: 1054877 - RNA, 22 nt, Homo sapiens
gaaaucuuguuggcaaaucaga

SEQ ID NO: 1054878 - RNA, 21 nt, Homo sapiens
gaaaugacuuugaaaaccugg

SEQ ID NO: 1054879 - RNA, 13 nt, Homo sapiens
gaaaugcaaccaa

SEQ ID NO: 1054880 - RNA, 23 nt, Homo sapiens
gaaaugcccaucuaugucccuug

SEQ ID NO: 1054881 - RNA, 19 nt, Homo sapiens
gaaaugcugcccaugccac

SEQ ID NO: 1054882 - RNA, 15 nt, Homo sapiens
gaaauggggaacuac

SEQ ID NO: 1054883 - RNA, 19 nt, Homo sapiens
gaaauugauguuacuguau

SEQ ID NO: 1054884 - RNA, 11 nt, Homo sapiens
gaaauugcaau

SEQ ID NO: 1054885 - RNA, 16 nt, Homo sapiens
gaaauuguacuuccag

SEQ ID NO: 1054886 - RNA, 14 nt, Homo sapiens
gaacaaaaugaauu

SEQ ID NO: 1054887 - RNA, 20 nt, Homo sapiens
gaacaaaauguaaagccagc

SEQ ID NO: 1054888 - RNA, 19 nt, Homo sapiens
gaacaaaguccacaguuua

SEQ ID NO: 1054889 - RNA, 16 nt, Homo sapiens
gaacaagcauuaguuu

SEQ ID NO: 1054890 - RNA, 15 nt, Homo sapiens
gaacacacauuauua

SEQ ID NO: 1054891 - RNA, 14 nt, Homo sapiens
gaacacaucagcuu

SEQ ID NO: 1054892 - RNA, 16 nt, Homo sapiens
gaacaccaagugucug

SEQ ID NO: 1054893 - RNA, 23 nt, Homo sapiens
gaacaccuccucaaaccuaccac

SEQ ID NO: 1054894 - RNA, 15 nt, Homo sapiens
gaacacucaugcuga

SEQ ID NO: 1054895 - RNA, 23 nt, Homo sapiens
gaacacucaugcugaaagcccaa

SEQ ID NO: 1054896 - RNA, 18 nt, Homo sapiens
gaacacucuacuacaugu

SEQ ID NO: 1054897 - RNA, 21 nt, Homo sapiens
gaacacuggcaacaacaaagc

SEQ ID NO: 1054898 - RNA, 12 nt, Homo sapiens
gaacacuggggg

SEQ ID NO: 1054899 - RNA, 23 nt, Homo sapiens
gaacaggcucagaucucauggga

SEQ ID NO: 1054900 - RNA, 16 nt, Homo sapiens
gaacaguaacugccau

SEQ ID NO: 1054901 - RNA, 23 nt, Homo sapiens
gaacauaaagccuuggauguaua

SEQ ID NO: 1054902 - RNA, 21 nt, Homo sapiens
gaaccacgucugcuaacuugg

SEQ ID NO: 1054903 - RNA, 21 nt, Homo sapiens
gaaccagagccauggacucua

SEQ ID NO: 1054904 - RNA, 16 nt, Homo sapiens
gaaccaggcaacuugg

SEQ ID NO: 1054905 - RNA, 12 nt, Homo sapiens
gaaccaggggag

SEQ ID NO: 1054906 - RNA, 23 nt, Homo sapiens
gaaccaucauuggaaaugaaacu

SEQ ID NO: 1054907 - RNA, 14 nt, Homo sapiens
gaaccccaggagau

SEQ ID NO: 1054908 - RNA, 21 nt, Homo sapiens
gaacccugcuugcacuuugua

SEQ ID NO: 1054909 - RNA, 22 nt, Homo sapiens
gaacccugggccauccucacau

SEQ ID NO: 1054910 - RNA, 19 nt, Homo sapiens
gaaccgaggggcucaggaa

SEQ ID NO: 1054911 - RNA, 15 nt, Homo sapiens
gaaccucacugaaaa

SEQ ID NO: 1054912 - RNA, 17 nt, Homo sapiens
gaaccuccucugugaag

SEQ ID NO: 1054913 - RNA, 13 nt, Homo sapiens
gaaccuggagcca

SEQ ID NO: 1054914 - RNA, 16 nt, Homo sapiens
gaaccuggagggcuag

SEQ ID NO: 1054915 - RNA, 22 nt, Homo sapiens
gaaccuguccuugcacacuccc

SEQ ID NO: 1054916 - RNA, 11 nt, Homo sapiens
gaaccuuccau

SEQ ID NO: 1054917 - RNA, 14 nt, Homo sapiens
gaaccuuccaucuc

SEQ ID NO: 1054918 - RNA, 22 nt, Homo sapiens
gaacgcuucugcuuaaucugag

SEQ ID NO: 1054919 - RNA, 22 nt, Homo sapiens
gaacguuacuuugugucgugau

SEQ ID NO: 1054920 - RNA, 19 nt, Homo sapiens
gaacuagccaccaacucuu

SEQ ID NO: 1054921 - RNA, 14 nt, Homo sapiens
gaacuauaugugaa

SEQ ID NO: 1054922 - RNA, 14 nt, Homo sapiens
gaacuauguacuuu

SEQ ID NO: 1054923 - RNA, 11 nt, Homo sapiens
gaacucaggga

SEQ ID NO: 1054924 - RNA, 13 nt, Homo sapiens
gaacucaguguga

SEQ ID NO: 1054925 - RNA, 11 nt, Homo sapiens
gaacucuccau

SEQ ID NO: 1054926 - RNA, 16 nt, Homo sapiens
gaacuggacucaggau

SEQ ID NO: 1054927 - RNA, 22 nt, Homo sapiens
gaacugggagcagcucugugac

SEQ ID NO: 1054928 - RNA, 21 nt, Homo sapiens
gaacuuaccgugagcgacaaa

SEQ ID NO: 1054929 - RNA, 20 nt, Homo sapiens
gaacuuugcugagccuguaa

SEQ ID NO: 1054930 - RNA, 14 nt, Homo sapiens
gaagaaaaaauaca

SEQ ID NO: 1054931 - RNA, 20 nt, Homo sapiens
gaagaaagagcaacaaucca

SEQ ID NO: 1054932 - RNA, 17 nt, Homo sapiens
gaagaacauccaaggag

SEQ ID NO: 1054933 - RNA, 17 nt, Homo sapiens
gaagaacugacuaguga

SEQ ID NO: 1054934 - RNA, 23 nt, Homo sapiens
gaagacauccugagcagugccag

SEQ ID NO: 1054935 - RNA, 21 nt, Homo sapiens
uugugcauuaucuagauacug

SEQ ID NO: 1054936 - RNA, 20 nt, Homo sapiens
uugugguuuaugucaucaua

SEQ ID NO: 1054937 - RNA, 15 nt, Homo sapiens
uugugucuguacacg

SEQ ID NO: 1054938 - RNA, 15 nt, Homo sapiens
uugugugaguguacc

SEQ ID NO: 1054939 - RNA, 16 nt, Homo sapiens
uugugugguggcaccu

SEQ ID NO: 1054940 - RNA, 22 nt, Homo sapiens
uuguguguguguguugauccca

SEQ ID NO: 1054941 - RNA, 13 nt, Homo sapiens
uuguguucucaaa

SEQ ID NO: 1054942 - RNA, 20 nt, Homo sapiens
uuguguuuuguuuuguauca

SEQ ID NO: 1054943 - RNA, 23 nt, Homo sapiens
uuguguuuuuuuuuuaaauagac

SEQ ID NO: 1054944 - RNA, 18 nt, Homo sapiens
uuguuaagugcagucuga

SEQ ID NO: 1054945 - RNA, 18 nt, Homo sapiens
uuguuaccuuuaugguuu

SEQ ID NO: 1054946 - RNA, 18 nt, Homo sapiens
uuguucacuagacugugc

SEQ ID NO: 1054947 - RNA, 12 nt, Homo sapiens
uuguucuacucu

SEQ ID NO: 1054948 - RNA, 16 nt, Homo sapiens
uuguugcaggcugugg

SEQ ID NO: 1054949 - RNA, 13 nt, Homo sapiens
uuguuguuauuaa

SEQ ID NO: 1054950 - RNA, 15 nt, Homo sapiens
uuguuucuuuucaca

SEQ ID NO: 1054951 - RNA, 16 nt, Homo sapiens
uuguuugucaucuuca

SEQ ID NO: 1054952 - RNA, 16 nt, Homo sapiens
uuuaaaaagaaacaag

SEQ ID NO: 1054953 - RNA, 18 nt, Homo sapiens
uuuaaaacgcaugugcag

SEQ ID NO: 1054954 - RNA, 18 nt, Homo sapiens
uuuaaaauacacacucaa

SEQ ID NO: 1054955 - RNA, 21 nt, Homo sapiens
uuuaaaaucauuucugcauca

SEQ ID NO: 1054956 - RNA, 21 nt, Homo sapiens
uuuaaacacggggcuugcaac

SEQ ID NO: 1054957 - RNA, 14 nt, Homo sapiens
uuuaaacaguuuag

SEQ ID NO: 1054958 - RNA, 14 nt, Homo sapiens
uuuaaacucaggga

SEQ ID NO: 1054959 - RNA, 12 nt, Homo sapiens
uuuaaacugcau

SEQ ID NO: 1054960 - RNA, 17 nt, Homo sapiens
uuuaaagcacaugccuu

SEQ ID NO: 1054961 - RNA, 14 nt, Homo sapiens
uuuaaagccuccuc

SEQ ID NO: 1054962 - RNA, 21 nt, Homo sapiens
uuuaaagcuuauuaaaacuca

SEQ ID NO: 1054963 - RNA, 23 nt, Homo sapiens
uuuaaauacagucuuccauuugc

SEQ ID NO: 1054964 - RNA, 22 nt, Homo sapiens
uuuaaaucaacgaguacuucaa

SEQ ID NO: 1054965 - RNA, 15 nt, Homo sapiens
uuuaaauccuuccau

SEQ ID NO: 1054966 - RNA, 12 nt, Homo sapiens
uuuaaaucugag

SEQ ID NO: 1054967 - RNA, 14 nt, Homo sapiens
uuuaaauuagauaa

SEQ ID NO: 1054968 - RNA, 16 nt, Homo sapiens
uuuaagauaaacagaa

SEQ ID NO: 1054969 - RNA, 15 nt, Homo sapiens
uuuaagccaggagca

SEQ ID NO: 1054970 - RNA, 12 nt, Homo sapiens
uuuaaggauaaa

SEQ ID NO: 1054971 - RNA, 14 nt, Homo sapiens
uuuaagguaacaaa

SEQ ID NO: 1054972 - RNA, 18 nt, Homo sapiens
uuuaagugcguguguaga

SEQ ID NO: 1054973 - RNA, 13 nt, Homo sapiens
uuuaauauaugca

SEQ ID NO: 1054974 - RNA, 14 nt, Homo sapiens
uuuaauauaugcau

SEQ ID NO: 1054975 - RNA, 23 nt, Homo sapiens
uuuaauguuuucagcccaucucc

SEQ ID NO: 1054976 - RNA, 14 nt, Homo sapiens
uuuaauuaugccuu

SEQ ID NO: 1054977 - RNA, 15 nt, Homo sapiens
uuuaauuaugccuuu

SEQ ID NO: 1054978 - RNA, 15 nt, Homo sapiens
uuuaauucacaucaa

SEQ ID NO: 1054979 - RNA, 20 nt, Homo sapiens
uuuaauucucaugugauccu

SEQ ID NO: 1054980 - RNA, 15 nt, Homo sapiens
uuuaauugugaauua

SEQ ID NO: 1054981 - RNA, 14 nt, Homo sapiens
uuuaauuuaaucuu

SEQ ID NO: 1054982 - RNA, 19 nt, Homo sapiens
uuuacagcacuacucugug

SEQ ID NO: 1054983 - RNA, 13 nt, Homo sapiens
uuuacagcugccu

SEQ ID NO: 1054984 - RNA, 21 nt, Homo sapiens
uuuacauaucaccucauggcc

SEQ ID NO: 1054985 - RNA, 10 nt, Homo sapiens
uuuacauuca

SEQ ID NO: 1054986 - RNA, 14 nt, Homo sapiens
uuuacccucaggca

SEQ ID NO: 1054987 - RNA, 17 nt, Homo sapiens
uuuaccugagaccaguu

SEQ ID NO: 1054988 - RNA, 17 nt, Homo sapiens
uuuacugcgaauaagcu

SEQ ID NO: 1054989 - RNA, 19 nt, Homo sapiens
uuuacuuaucuuaugccac

SEQ ID NO: 1054990 - RNA, 18 nt, Homo sapiens
uuuacuugccauuacuca

SEQ ID NO: 1054991 - RNA, 11 nt, Homo sapiens
uuuacuuuguu

SEQ ID NO: 1054992 - RNA, 18 nt, Homo sapiens
uuuagaaagaauauucau

SEQ ID NO: 1054993 - RNA, 20 nt, Homo sapiens
uuuagccaccaucuuugcag

SEQ ID NO: 1054994 - RNA, 19 nt, Homo sapiens
uuuaggaccaauaccuccu

SEQ ID NO: 1054995 - RNA, 23 nt, Homo sapiens
uuuaguaagagauuccugagcca

SEQ ID NO: 1054996 - RNA, 17 nt, Homo sapiens
uuuaguguuuuuaccuc

SEQ ID NO: 1054997 - RNA, 23 nt, Homo sapiens
uuuauaaagggagauaacaaucu

SEQ ID NO: 1054998 - RNA, 16 nt, Homo sapiens
uuuauaagagugccgu

SEQ ID NO: 1054999 - RNA, 15 nt, Homo sapiens
uuuauacuguuuacu

SEQ ID NO: 1055000 - RNA, 14 nt, Homo sapiens
uuuaugauuccacc

SEQ ID NO: 1055001 - RNA, 13 nt, Homo sapiens
uuuaugcauacag

SEQ ID NO: 1055002 - RNA, 13 nt, Homo sapiens
uuuauggccucag

SEQ ID NO: 1055003 - RNA, 11 nt, Homo sapiens
uuuaugguucu

SEQ ID NO: 1055004 - RNA, 16 nt, Homo sapiens
uuuauguaaucuaugu

SEQ ID NO: 1055005 - RNA, 21 nt, Homo sapiens
uuuaugucaucauacaugacu

SEQ ID NO: 1055006 - RNA, 23 nt, Homo sapiens
uuuauguguuugacgggaaacaa

SEQ ID NO: 1055007 - RNA, 21 nt, Homo sapiens
uuuauuaacauugauuggcau

SEQ ID NO: 1055008 - RNA, 13 nt, Homo sapiens
uuuauuaccucug

SEQ ID NO: 1055009 - RNA, 22 nt, Homo sapiens
uuuauuaguuaauauaucccag

SEQ ID NO: 1055010 - RNA, 17 nt, Homo sapiens
uuuauuauuuucaccug

SEQ ID NO: 1055011 - RNA, 14 nt, Homo sapiens
uuuauuccuguaug

SEQ ID NO: 1055012 - RNA, 21 nt, Homo sapiens
uuuauugugaauuacaguuga

SEQ ID NO: 1055013 - RNA, 18 nt, Homo sapiens
uuugagacagagucucac

SEQ ID NO: 1055014 - RNA, 16 nt, Homo sapiens
uuugagacagagucug

SEQ ID NO: 1055015 - RNA, 14 nt, Homo sapiens
uuugagacaggaga

SEQ ID NO: 1055016 - RNA, 21 nt, Homo sapiens
uuugagcaagccgagcucucc

SEQ ID NO: 1055017 - RNA, 23 nt, Homo sapiens
uuugagcccacaaagccuuauca

SEQ ID NO: 1055018 - RNA, 15 nt, Homo sapiens
uuugaguugaauuua

SEQ ID NO: 1055019 - RNA, 21 nt, Homo sapiens
uuugauauacuauuuucauuc

SEQ ID NO: 1055020 - RNA, 20 nt, Homo sapiens
uuugaugauuaauucaccuu

SEQ ID NO: 1055021 - RNA, 14 nt, Homo sapiens
uuugaugauugcua

SEQ ID NO: 1055022 - RNA, 22 nt, Homo sapiens
uuugaugccaagaaaguauuug

SEQ ID NO: 1055023 - RNA, 16 nt, Homo sapiens
uuugauuuugauuuua

SEQ ID NO: 1055024 - RNA, 14 nt, Homo sapiens
uuugcagacaggca

SEQ ID NO: 1055025 - RNA, 19 nt, Homo sapiens
uuugcaggcucauagggaa

SEQ ID NO: 1055026 - RNA, 23 nt, Homo sapiens
uuugccauauuuucaccauuuga

SEQ ID NO: 1055027 - RNA, 22 nt, Homo sapiens
uuugccuuuccauaaucacuca

SEQ ID NO: 1055028 - RNA, 19 nt, Homo sapiens
uuugcuaaaugugaaugau

SEQ ID NO: 1055029 - RNA, 17 nt, Homo sapiens
uuugcuaucacacagug

SEQ ID NO: 1055030 - RNA, 16 nt, Homo sapiens
uuugcuauuagacugu

SEQ ID NO: 1055031 - RNA, 19 nt, Homo sapiens
uuugcuauuagagcauuga

SEQ ID NO: 1055032 - RNA, 12 nt, Homo sapiens
uuugcuguagaa

SEQ ID NO: 1055033 - RNA, 20 nt, Homo sapiens
uuuggaagggaaacuuucaa

SEQ ID NO: 1055034 - RNA, 16 nt, Homo sapiens
uuuggaauacauuucu

SEQ ID NO: 1055035 - RNA, 23 nt, Homo sapiens
uuuggaaugcuucuucucaggca

SEQ ID NO: 1055036 - RNA, 16 nt, Homo sapiens
uuuggauauagguuuc

SEQ ID NO: 1055037 - RNA, 22 nt, Homo sapiens
uuugggagcccaugggggagcu

SEQ ID NO: 1055038 - RNA, 21 nt, Homo sapiens
uuugggcccagggacaccagc

SEQ ID NO: 1055039 - RNA, 23 nt, Homo sapiens
uuugggcccagggacaccagcca

SEQ ID NO: 1055040 - RNA, 12 nt, Homo sapiens
uuugggcugugg

SEQ ID NO: 1055041 - RNA, 15 nt, Homo sapiens
uuuggggagcagaga

SEQ ID NO: 1055042 - RNA, 11 nt, Homo sapiens
uuuggggcuca

SEQ ID NO: 1055043 - RNA, 20 nt, Homo sapiens
uuuggggcucagaguggggu

SEQ ID NO: 1055044 - RNA, 15 nt, Homo sapiens
uuuggguaacuucaa

SEQ ID NO: 1055045 - RNA, 17 nt, Homo sapiens
uuuggguuuugggucuu

SEQ ID NO: 1055046 - RNA, 12 nt, Homo sapiens
uuuguacagaga

SEQ ID NO: 1055047 - RNA, 18 nt, Homo sapiens
uuuguaggcauugcauga

SEQ ID NO: 1055048 - RNA, 12 nt, Homo sapiens
uuuguagugcca

SEQ ID NO: 1055049 - RNA, 20 nt, Homo sapiens
uuuguaucauuaugaaguca

SEQ ID NO: 1055050 - RNA, 19 nt, Homo sapiens
uuuguauuuuuacuuuuaa

SEQ ID NO: 1055051 - RNA, 19 nt, Homo sapiens
uuuguauuuuuaguagaga

SEQ ID NO: 1055052 - RNA, 14 nt, Homo sapiens
uuugucaacaaagu

SEQ ID NO: 1055053 - RNA, 19 nt, Homo sapiens
uuugucacuaaacucucau

SEQ ID NO: 1055054 - RNA, 23 nt, Homo sapiens
uuugucagaggcacaaaaggguu

SEQ ID NO: 1055055 - RNA, 21 nt, Homo sapiens
uuugucauauaagauucauau

SEQ ID NO: 1055056 - RNA, 22 nt, Homo sapiens
uuugucuuggcuuuucuuuggg

SEQ ID NO: 1055057 - RNA, 13 nt, Homo sapiens
uuuguggccucag

SEQ ID NO: 1055058 - RNA, 14 nt, Homo sapiens
uuugugugcgucac

SEQ ID NO: 1055059 - RNA, 17 nt, Homo sapiens
uuugugugcgucacugu

SEQ ID NO: 1055060 - RNA, 12 nt, Homo sapiens
uuuguugcccag

SEQ ID NO: 1055061 - RNA, 17 nt, Homo sapiens
uuuuaaaacccauuuaa

SEQ ID NO: 1055062 - RNA, 15 nt, Homo sapiens
uuuuaaaaguuucaa

SEQ ID NO: 1055063 - RNA, 23 nt, Homo sapiens
uuuuaaauaggguuguacuaugc

SEQ ID NO: 1055064 - RNA, 15 nt, Homo sapiens
uuuuaaaugcaccug

SEQ ID NO: 1055065 - RNA, 13 nt, Homo sapiens
uuuuaacauucca

SEQ ID NO: 1055066 - RNA, 17 nt, Homo sapiens
uuuuaacucaccucuca

SEQ ID NO: 1055067 - RNA, 15 nt, Homo sapiens
uuuuaagugccuuua

SEQ ID NO: 1055068 - RNA, 20 nt, Homo sapiens
uuuuaauuaaugaaauaucu

SEQ ID NO: 1055069 - RNA, 21 nt, Homo sapiens
uuuuaauuuaaacaccuccuc

SEQ ID NO: 1055070 - RNA, 12 nt, Homo sapiens
uuuuacaccagu

SEQ ID NO: 1055071 - RNA, 17 nt, Homo sapiens
uuuuacccacacacaga

SEQ ID NO: 1055072 - RNA, 20 nt, Homo sapiens
uuuuacugugaaacuggcac

SEQ ID NO: 1055073 - RNA, 19 nt, Homo sapiens
uuuuagacccuauugcugc

SEQ ID NO: 1055074 - RNA, 15 nt, Homo sapiens
uuuuauagucugaaa

SEQ ID NO: 1055075 - RNA, 19 nt, Homo sapiens
uuuuauccacuuaccuaga

SEQ ID NO: 1055076 - RNA, 11 nt, Homo sapiens
uuuuaucucca

SEQ ID NO: 1055077 - RNA, 21 nt, Homo sapiens
uuuuaucuuuaaucuccucuu

SEQ ID NO: 1055078 - RNA, 21 nt, Homo sapiens
uuuuaugccuucacuuuacaa

SEQ ID NO: 1055079 - RNA, 16 nt, Homo sapiens
uuuuauuuacauucuu

SEQ ID NO: 1055080 - RNA, 21 nt, Homo sapiens
uuuucaaagauguguugcuau

SEQ ID NO: 1055081 - RNA, 13 nt, Homo sapiens
uuuucaccccacc

SEQ ID NO: 1055082 - RNA, 23 nt, Homo sapiens
uuuucagaucauggcauccaaga

SEQ ID NO: 1055083 - RNA, 19 nt, Homo sapiens
uuuuccagcuccucaucca

SEQ ID NO: 1055084 - RNA, 23 nt, Homo sapiens
uuuuccauuuuuauuucaaaaua

SEQ ID NO: 1055085 - RNA, 23 nt, Homo sapiens
uuuucccaagagcauaacuguuc

SEQ ID NO: 1055086 - RNA, 14 nt, Homo sapiens
uuuucccauuucaa

SEQ ID NO: 1055087 - RNA, 17 nt, Homo sapiens
uguagaagccacuauua

SEQ ID NO: 1055088 - RNA, 15 nt, Homo sapiens
uguagaaugauuuca

SEQ ID NO: 1055089 - RNA, 20 nt, Homo sapiens
uguagagauggggucucaca

SEQ ID NO: 1055090 - RNA, 16 nt, Homo sapiens
uguagagcuucuggca

SEQ ID NO: 1055091 - RNA, 18 nt, Homo sapiens
uguagaguuguuucuuaa

SEQ ID NO: 1055092 - RNA, 17 nt, Homo sapiens
uguagauaaacucagaa

SEQ ID NO: 1055093 - RNA, 12 nt, Homo sapiens
uguagauauugu

SEQ ID NO: 1055094 - RNA, 13 nt, Homo sapiens
uguagaugugcau

SEQ ID NO: 1055095 - RNA, 13 nt, Homo sapiens
uguagcagugaga

SEQ ID NO: 1055096 - RNA, 17 nt, Homo sapiens
uguagccacuucacuuu

SEQ ID NO: 1055097 - RNA, 20 nt, Homo sapiens
uguagccucgccgucuguga

SEQ ID NO: 1055098 - RNA, 14 nt, Homo sapiens
uguagccugugcau

SEQ ID NO: 1055099 - RNA, 17 nt, Homo sapiens
uguagcuccucaacuca

SEQ ID NO: 1055100 - RNA, 15 nt, Homo sapiens
uguagcuuugcucuu

SEQ ID NO: 1055101 - RNA, 23 nt, Homo sapiens
uguagcuuugcucuuugguagaa

SEQ ID NO: 1055102 - RNA, 21 nt, Homo sapiens
uguaggaugugucacuguugg

SEQ ID NO: 1055103 - RNA, 14 nt, Homo sapiens
uguaguagucucau

SEQ ID NO: 1055104 - RNA, 22 nt, Homo sapiens
uguagucccagcuacucaggag

SEQ ID NO: 1055105 - RNA, 20 nt, Homo sapiens
uguagucccagcuacuugag

SEQ ID NO: 1055106 - RNA, 15 nt, Homo sapiens
uguaguuaaugaugg

SEQ ID NO: 1055107 - RNA, 17 nt, Homo sapiens
uguauaaguccuugcaa

SEQ ID NO: 1055108 - RNA, 14 nt, Homo sapiens
uguauacaugccag

SEQ ID NO: 1055109 - RNA, 17 nt, Homo sapiens
uguauauuuguacaaaa

SEQ ID NO: 1055110 - RNA, 21 nt, Homo sapiens
uguauauuuuauaucaauuua

SEQ ID NO: 1055111 - RNA, 19 nt, Homo sapiens
uguaucguaaccagccaga

SEQ ID NO: 1055112 - RNA, 14 nt, Homo sapiens
uguaugauguguug

SEQ ID NO: 1055113 - RNA, 15 nt, Homo sapiens
uguaugcacgugugc

SEQ ID NO: 1055114 - RNA, 20 nt, Homo sapiens
uguaugugcgugugugcaag

SEQ ID NO: 1055115 - RNA, 17 nt, Homo sapiens
uguauucucuuccucau

SEQ ID NO: 1055116 - RNA, 17 nt, Homo sapiens
uguauucuucaaccuca

SEQ ID NO: 1055117 - RNA, 18 nt, Homo sapiens
uguauucuucaaccucau

SEQ ID NO: 1055118 - RNA, 16 nt, Homo sapiens
uguauuguucccagug

SEQ ID NO: 1055119 - RNA, 22 nt, Homo sapiens
uguauuuauccaauaaauguga

SEQ ID NO: 1055120 - RNA, 16 nt, Homo sapiens
uguauuucaacuuguc

SEQ ID NO: 1055121 - RNA, 17 nt, Homo sapiens
uguauuuccagugcaau

SEQ ID NO: 1055122 - RNA, 20 nt, Homo sapiens
uguauuuccagugcaauugu

SEQ ID NO: 1055123 - RNA, 17 nt, Homo sapiens
uguauuuuauuacaucu

SEQ ID NO: 1055124 - RNA, 23 nt, Homo sapiens
uguauuuuauuacaucuuucaca

SEQ ID NO: 1055125 - RNA, 19 nt, Homo sapiens
uguauuuuuaauauaugca

SEQ ID NO: 1055126 - RNA, 22 nt, Homo sapiens
ugucaagacaaggucuugcuau

SEQ ID NO: 1055127 - RNA, 16 nt, Homo sapiens
ugucaauauaagcuca

SEQ ID NO: 1055128 - RNA, 16 nt, Homo sapiens
ugucaaugacaguuuc

SEQ ID NO: 1055129 - RNA, 18 nt, Homo sapiens
ugucaaugaguaauucau

SEQ ID NO: 1055130 - RNA, 18 nt, Homo sapiens
ugucacaugaaacauuug

SEQ ID NO: 1055131 - RNA, 16 nt, Homo sapiens
ugucacuaaacucuca

SEQ ID NO: 1055132 - RNA, 18 nt, Homo sapiens
ugucacuaaacucucauu

SEQ ID NO: 1055133 - RNA, 19 nt, Homo sapiens
ugucacuacgugacugugg

SEQ ID NO: 1055134 - RNA, 21 nt, Homo sapiens
ugucacuauaggucauacaau

SEQ ID NO: 1055135 - RNA, 16 nt, Homo sapiens
ugucagugacaguauu

SEQ ID NO: 1055136 - RNA, 12 nt, Homo sapiens
ugucagugcagc

SEQ ID NO: 1055137 - RNA, 16 nt, Homo sapiens
ugucagugcugccagu

SEQ ID NO: 1055138 - RNA, 13 nt, Homo sapiens
ugucauacauccu

SEQ ID NO: 1055139 - RNA, 17 nt, Homo sapiens
ugucauauacaauuguc

SEQ ID NO: 1055140 - RNA, 21 nt, Homo sapiens
ugucaucucagcuggaucucc

SEQ ID NO: 1055141 - RNA, 21 nt, Homo sapiens
ugucaucuuccuggaagcaga

SEQ ID NO: 1055142 - RNA, 15 nt, Homo sapiens
ugucauuucaaagac

SEQ ID NO: 1055143 - RNA, 21 nt, Homo sapiens
uguccacccaccuaugugcca

SEQ ID NO: 1055144 - RNA, 15 nt, Homo sapiens
uguccaguugcagcu

SEQ ID NO: 1055145 - RNA, 17 nt, Homo sapiens
ugucccaaacaugcacu

SEQ ID NO: 1055146 - RNA, 18 nt, Homo sapiens
uguccccuccacugucac

SEQ ID NO: 1055147 - RNA, 20 nt, Homo sapiens
ugucccggggcuccacugaa

SEQ ID NO: 1055148 - RNA, 22 nt, Homo sapiens
ugucccucauccauagcaccuc

SEQ ID NO: 1055149 - RNA, 20 nt, Homo sapiens
ugucccuccugggaucugcu

SEQ ID NO: 1055150 - RNA, 15 nt, Homo sapiens
uguccucaucagucu

SEQ ID NO: 1055151 - RNA, 15 nt, Homo sapiens
uguccucuucugcau

SEQ ID NO: 1055152 - RNA, 15 nt, Homo sapiens
uguccucuugcucaa

SEQ ID NO: 1055153 - RNA, 14 nt, Homo sapiens
uguccugaccaccc

SEQ ID NO: 1055154 - RNA, 21 nt, Homo sapiens
uguccuucuuuaucugugaua

SEQ ID NO: 1055155 - RNA, 13 nt, Homo sapiens
uguccuugcacac

SEQ ID NO: 1055156 - RNA, 15 nt, Homo sapiens
uguccuugcacacuc

SEQ ID NO: 1055157 - RNA, 16 nt, Homo sapiens
ugucgccucugcauuc

SEQ ID NO: 1055158 - RNA, 18 nt, Homo sapiens
ugucgucuuagcaagaag

SEQ ID NO: 1055159 - RNA, 16 nt, Homo sapiens
ugucucaaauucaugg

SEQ ID NO: 1055160 - RNA, 23 nt, Homo sapiens
ugucucugccucccucacccuga

SEQ ID NO: 1055161 - RNA, 21 nt, Homo sapiens
ugucugaguaagcccucagga

SEQ ID NO: 1055162 - RNA, 14 nt, Homo sapiens
ugucugcacccagg

SEQ ID NO: 1055163 - RNA, 19 nt, Homo sapiens
ugucugcuuucuccauugu

SEQ ID NO: 1055164 - RNA, 19 nt, Homo sapiens
ugucuggagugacagacca

SEQ ID NO: 1055165 - RNA, 15 nt, Homo sapiens
ugucuggccaggccu

SEQ ID NO: 1055166 - RNA, 22 nt, Homo sapiens
ugucuguaucggagacagugau

SEQ ID NO: 1055167 - RNA, 18 nt, Homo sapiens
ugucugucccgggguccu

SEQ ID NO: 1055168 - RNA, 17 nt, Homo sapiens
ugucugugugcaagugu

SEQ ID NO: 1055169 - RNA, 23 nt, Homo sapiens
ugucuuacagagaaaagacauaa

SEQ ID NO: 1055170 - RNA, 12 nt, Homo sapiens
ugucuuccauaa

SEQ ID NO: 1055171 - RNA, 15 nt, Homo sapiens
ugucuuguucaccuu

SEQ ID NO: 1055172 - RNA, 18 nt, Homo sapiens
ugucuuuuuaagcuuauu

SEQ ID NO: 1055173 - RNA, 12 nt, Homo sapiens
ugugaacaaguc

SEQ ID NO: 1055174 - RNA, 15 nt, Homo sapiens
ugugaacacaucagc

SEQ ID NO: 1055175 - RNA, 20 nt, Homo sapiens
ugugaacagggaacucagaa

SEQ ID NO: 1055176 - RNA, 16 nt, Homo sapiens
ugugaacccaaagugu

SEQ ID NO: 1055177 - RNA, 18 nt, Homo sapiens
ugugaaguuuaauugacu

SEQ ID NO: 1055178 - RNA, 22 nt, Homo sapiens
ugugacauuauaugcacuagca

SEQ ID NO: 1055179 - RNA, 21 nt, Homo sapiens
ugugaccaaugucuugaugca

SEQ ID NO: 1055180 - RNA, 20 nt, Homo sapiens
ugugacucccccucuuucac

SEQ ID NO: 1055181 - RNA, 20 nt, Homo sapiens
ugugacuugaacuagauugc

SEQ ID NO: 1055182 - RNA, 13 nt, Homo sapiens
ugugacuuuccua

SEQ ID NO: 1055183 - RNA, 15 nt, Homo sapiens
ugugagagaaagugu

SEQ ID NO: 1055184 - RNA, 17 nt, Homo sapiens
ugugagcagugaguuac

SEQ ID NO: 1055185 - RNA, 19 nt, Homo sapiens
ugugaguaagagcuggugu

SEQ ID NO: 1055186 - RNA, 13 nt, Homo sapiens
ugugauauggagc

SEQ ID NO: 1055187 - RNA, 18 nt, Homo sapiens
ugugaucggccuggggaa

SEQ ID NO: 1055188 - RNA, 12 nt, Homo sapiens
ugugaugugcau

SEQ ID NO: 1055189 - RNA, 16 nt, Homo sapiens
ugugauguuuguccug

SEQ ID NO: 1055190 - RNA, 22 nt, Homo sapiens
ugugcaagugugugcaugugug

SEQ ID NO: 1055191 - RNA, 18 nt, Homo sapiens
ugugcacacacaccacac

SEQ ID NO: 1055192 - RNA, 11 nt, Homo sapiens
ugugcacauuu

SEQ ID NO: 1055193 - RNA, 19 nt, Homo sapiens
ugugcacauuuaugaauca

SEQ ID NO: 1055194 - RNA, 17 nt, Homo sapiens
ugugcacugucacuuug

SEQ ID NO: 1055195 - RNA, 23 nt, Homo sapiens
ugugugcaagugugugcaugugu

SEQ ID NO: 1055196 - RNA, 15 nt, Homo sapiens
ugugugcguguuugc

SEQ ID NO: 1055197 - RNA, 14 nt, Homo sapiens
uguguguaccugug

SEQ ID NO: 1055198 - RNA, 16 nt, Homo sapiens
uguguguguguauaca

SEQ ID NO: 1055199 - RNA, 21 nt, Homo sapiens
uguguguucuggggcaaccua

SEQ ID NO: 1055200 - RNA, 15 nt, Homo sapiens
uguguucgacucagc

SEQ ID NO: 1055201 - RNA, 15 nt, Homo sapiens
uguguuggcacaugc

SEQ ID NO: 1055202 - RNA, 19 nt, Homo sapiens
uguguuucagccauguauu

SEQ ID NO: 1055203 - RNA, 18 nt, Homo sapiens
uguguuucuauugacuuc

SEQ ID NO: 1055204 - RNA, 21 nt, Homo sapiens
uguguuuuuaauaaagacagg

SEQ ID NO: 1055205 - RNA, 14 nt, Homo sapiens
uguguuuuuaauua

SEQ ID NO: 1055206 - RNA, 14 nt, Homo sapiens
uguguuuuucacau

SEQ ID NO: 1055207 - RNA, 21 nt, Homo sapiens
uguuaaauauuuacauaugaa

SEQ ID NO: 1055208 - RNA, 13 nt, Homo sapiens
uguuaaaucaaua

SEQ ID NO: 1055209 - RNA, 13 nt, Homo sapiens
uguuaaguugaug

SEQ ID NO: 1055210 - RNA, 20 nt, Homo sapiens
uguuaauaaaaguacauguu

SEQ ID NO: 1055211 - RNA, 13 nt, Homo sapiens
uguuaaucaucca

SEQ ID NO: 1055212 - RNA, 16 nt, Homo sapiens
uguuaaucauccauca

SEQ ID NO: 1055213 - RNA, 18 nt, Homo sapiens
uguuaauucagcacugau

SEQ ID NO: 1055214 - RNA, 22 nt, Homo sapiens
uguuacauagguauauauaugc

SEQ ID NO: 1055215 - RNA, 23 nt, Homo sapiens
uguuaccugaaaacacugugcac

SEQ ID NO: 1055216 - RNA, 20 nt, Homo sapiens
uguuacgcacacguacuuaa

SEQ ID NO: 1055217 - RNA, 22 nt, Homo sapiens
uguuacugguagaaaggcaguu

SEQ ID NO: 1055218 - RNA, 15 nt, Homo sapiens
uguuacugucuucag

SEQ ID NO: 1055219 - RNA, 20 nt, Homo sapiens
uguuacuugaaauaccagug

SEQ ID NO: 1055220 - RNA, 21 nt, Homo sapiens
uguuacuugaaauaccaguga

SEQ ID NO: 1055221 - RNA, 15 nt, Homo sapiens
uguuagaucagggga

SEQ ID NO: 1055222 - RNA, 16 nt, Homo sapiens
uguuagcauaauguga

SEQ ID NO: 1055223 - RNA, 20 nt, Homo sapiens
uguuaucagucauaacuaaa

SEQ ID NO: 1055224 - RNA, 18 nt, Homo sapiens
uguuaucuuccacuggaa

SEQ ID NO: 1055225 - RNA, 18 nt, Homo sapiens
uguuauguaaaaggccaa

SEQ ID NO: 1055226 - RNA, 14 nt, Homo sapiens
uguuauuauauaau

SEQ ID NO: 1055227 - RNA, 17 nt, Homo sapiens
uguuauucaauggaauc

SEQ ID NO: 1055228 - RNA, 23 nt, Homo sapiens
uguuauuuaaagaagaaacgucu

SEQ ID NO: 1055229 - RNA, 15 nt, Homo sapiens
uguuauuuagacuca

SEQ ID NO: 1055230 - RNA, 15 nt, Homo sapiens
uguuauuugcucuaa

SEQ ID NO: 1055231 - RNA, 22 nt, Homo sapiens
uguuauuuguuuuuauuauuac

SEQ ID NO: 1055232 - RNA, 12 nt, Homo sapiens
uguucaaaaagg

SEQ ID NO: 1055233 - RNA, 12 nt, Homo sapiens
uguucaagagca

SEQ ID NO: 1055234 - RNA, 18 nt, Homo sapiens
uguucagaauggauuuau

SEQ ID NO: 1055235 - RNA, 17 nt, Homo sapiens
uguucagcuccagcuca

SEQ ID NO: 1055236 - RNA, 13 nt, Homo sapiens
uguuccaccuccc

SEQ ID NO: 1055237 - RNA, 22 nt, Homo sapiens
uguuccagauccuucaaagagu

SEQ ID NO: 1055238 - RNA, 14 nt, Homo sapiens
uguuccccacugac

SEQ ID NO: 1055239 - RNA, 19 nt, Homo sapiens
uguuccuaaaauggugaua

SEQ ID NO: 1055240 - RNA, 15 nt, Homo sapiens
uguucuaaguauuug

SEQ ID NO: 1055241 - RNA, 20 nt, Homo sapiens
uguucuauucaucucaagga

SEQ ID NO: 1055242 - RNA, 19 nt, Homo sapiens
uguucuauuucagugccaa

SEQ ID NO: 1055243 - RNA, 16 nt, Homo sapiens
uguucucugaggacac

SEQ ID NO: 1055244 - RNA, 13 nt, Homo sapiens
uguucugauuaga

SEQ ID NO: 1055245 - RNA, 12 nt, Homo sapiens
uguucuugugaa

SEQ ID NO: 1055246 - RNA, 16 nt, Homo sapiens
uguugaagugagcuga

SEQ ID NO: 1055247 - RNA, 14 nt, Homo sapiens
uguugaaguuuaca

SEQ ID NO: 1055248 - RNA, 16 nt, Homo sapiens
uguugaggguccucag

SEQ ID NO: 1055249 - RNA, 20 nt, Homo sapiens
uguugauaaauuccacugga

SEQ ID NO: 1055250 - RNA, 17 nt, Homo sapiens
uguugcgcucccaccuc

SEQ ID NO: 1055251 - RNA, 20 nt, Homo sapiens
uguugcucucuaguuuccag

SEQ ID NO: 1055252 - RNA, 21 nt, Homo sapiens
uguugcuggacugucauagaa

SEQ ID NO: 1055253 - RNA, 19 nt, Homo sapiens
uguuggacccgcucuggac

SEQ ID NO: 1055254 - RNA, 18 nt, Homo sapiens
uguuggcuccagucuucc

SEQ ID NO: 1055255 - RNA, 12 nt, Homo sapiens
uguuggcugugg

SEQ ID NO: 1055256 - RNA, 21 nt, Homo sapiens
uguugggggggggguuugcaa

SEQ ID NO: 1055257 - RNA, 14 nt, Homo sapiens
uguugucaaaaagu

SEQ ID NO: 1055258 - RNA, 19 nt, Homo sapiens
uguuuaaauaaaguaucau

SEQ ID NO: 1055259 - RNA, 19 nt, Homo sapiens
uguuuaagaaaaaauaaca

SEQ ID NO: 1055260 - RNA, 21 nt, Homo sapiens
uguuuacuucucaccauuuga

SEQ ID NO: 1055261 - RNA, 17 nt, Homo sapiens
uguuuagaaagaauauu

SEQ ID NO: 1055262 - RNA, 14 nt, Homo sapiens
uguuuaugagccag

SEQ ID NO: 1055263 - RNA, 18 nt, Homo sapiens
uguuucaaaaaaucugac

SEQ ID NO: 1055264 - RNA, 14 nt, Homo sapiens
uguuucccguauug

SEQ ID NO: 1055265 - RNA, 16 nt, Homo sapiens
uguuuccugugcaagu

SEQ ID NO: 1055266 - RNA, 13 nt, Homo sapiens
uguuucuguuauu

SEQ ID NO: 1055267 - RNA, 18 nt, Homo sapiens
uguuugcuggggccgaaa

SEQ ID NO: 1055268 - RNA, 21 nt, Homo sapiens
uguuuggguauauucauuuca

SEQ ID NO: 1055269 - RNA, 22 nt, Homo sapiens
uguuugguggggguagagcuga

SEQ ID NO: 1055270 - RNA, 12 nt, Homo sapiens
uguuugugauug

SEQ ID NO: 1055271 - RNA, 14 nt, Homo sapiens
uguuuugcacuuuu

SEQ ID NO: 1055272 - RNA, 23 nt, Homo sapiens
uguuuuuacccugccccugccuu

SEQ ID NO: 1055273 - RNA, 22 nt, Homo sapiens
uuaaaaaaaaaggcauauugcu

SEQ ID NO: 1055274 - RNA, 13 nt, Homo sapiens
uuaaaaaaacaca

SEQ ID NO: 1055275 - RNA, 15 nt, Homo sapiens
uuaaaaaaacacaua

SEQ ID NO: 1055276 - RNA, 19 nt, Homo sapiens
uuaaaaagauguauguucc

SEQ ID NO: 1055277 - RNA, 15 nt, Homo sapiens
uuaaaacauguaaua

SEQ ID NO: 1055278 - RNA, 22 nt, Homo sapiens
uuaaaacccacaaaaguacaau

SEQ ID NO: 1055279 - RNA, 24 nt, Homo sapiens
uuaaaacuaaaaaggaccagagaa

SEQ ID NO: 1055280 - RNA, 12 nt, Homo sapiens
uuaaaagaauuu

SEQ ID NO: 1055281 - RNA, 15 nt, Homo sapiens
uuaaaagccaucaaa

SEQ ID NO: 1055282 - RNA, 19 nt, Homo sapiens
uuaaaagugacauuugucu

SEQ ID NO: 1055283 - RNA, 15 nt, Homo sapiens
uuaaaauaacuucaa

SEQ ID NO: 1055284 - RNA, 16 nt, Homo sapiens
uuaaaauagccauaaa

SEQ ID NO: 1055285 - RNA, 23 nt, Homo sapiens
uuaaaauauuuuuaugugcaaua

SEQ ID NO: 1055286 - RNA, 19 nt, Homo sapiens
uuaaaaugagagucacuug

SEQ ID NO: 1055287 - RNA, 14 nt, Homo sapiens
uuaaaaugagaucg

SEQ ID NO: 1055288 - RNA, 12 nt, Homo sapiens
uuaaaaugauug

SEQ ID NO: 1055289 - RNA, 20 nt, Homo sapiens
uuaaacacggggcuugcaac

SEQ ID NO: 1055290 - RNA, 14 nt, Homo sapiens
uuaaacccacagcc

SEQ ID NO: 1055291 - RNA, 18 nt, Homo sapiens
uuaaacccacagccaaac

SEQ ID NO: 1055292 - RNA, 18 nt, Homo sapiens
uuaaaccucucuucuacc

SEQ ID NO: 1055293 - RNA, 14 nt, Homo sapiens
uuaaacucagggac

SEQ ID NO: 1055294 - RNA, 18 nt, Homo sapiens
uuaaacuuaccugggcau

SEQ ID NO: 1055295 - RNA, 20 nt, Homo sapiens
uuaaagaaagucgaauuaau

SEQ ID NO: 1055296 - RNA, 14 nt, Homo sapiens
uuaaagaaccaaaa

SEQ ID NO: 1055297 - RNA, 18 nt, Homo sapiens
uuaaagaagagaacugcc

SEQ ID NO: 1055298 - RNA, 22 nt, Homo sapiens
uauuuugccagugggaacuccu

SEQ ID NO: 1055299 - RNA, 21 nt, Homo sapiens
uauuuuuagacagagucucac

SEQ ID NO: 1055300 - RNA, 15 nt, Homo sapiens
uauuuuuaugugcaa

SEQ ID NO: 1055301 - RNA, 14 nt, Homo sapiens
uauuuuucucauga

SEQ ID NO: 1055302 - RNA, 17 nt, Homo sapiens
uauuuuuuaaguauuua

SEQ ID NO: 1055303 - RNA, 22 nt, Homo sapiens
uauuuuuuaugaaacauuacag

SEQ ID NO: 1055304 - RNA, 17 nt, Homo sapiens
ucaaaaaaucugaccaa

SEQ ID NO: 1055305 - RNA, 15 nt, Homo sapiens
ucaaaaagacugugg

SEQ ID NO: 1055306 - RNA, 14 nt, Homo sapiens
ucaaaaaguguuua

SEQ ID NO: 1055307 - RNA, 13 nt, Homo sapiens
ucaaaaauacuca

SEQ ID NO: 1055308 - RNA, 23 nt, Homo sapiens
ucaaaaauagggaaguaacagua

SEQ ID NO: 1055309 - RNA, 17 nt, Homo sapiens
ucaaaacagagauguga

SEQ ID NO: 1055310 - RNA, 14 nt, Homo sapiens
ucaaaagacaauuc

SEQ ID NO: 1055311 - RNA, 18 nt, Homo sapiens
ucaaaauaaaaaccaaga

SEQ ID NO: 1055312 - RNA, 22 nt, Homo sapiens
ucaaaauaaaaagugacacagc

SEQ ID NO: 1055313 - RNA, 12 nt, Homo sapiens
ucaaaaugacag

SEQ ID NO: 1055314 - RNA, 17 nt, Homo sapiens
ucaaacaaacucucuga

SEQ ID NO: 1055315 - RNA, 15 nt, Homo sapiens
ucaaacaaagccaga

SEQ ID NO: 1055316 - RNA, 15 nt, Homo sapiens
ucaaacaacauucca

SEQ ID NO: 1055317 - RNA, 22 nt, Homo sapiens
ucaaacaacauuccaccccagc

SEQ ID NO: 1055318 - RNA, 19 nt, Homo sapiens
ucaaaccccagggcacuga

SEQ ID NO: 1055319 - RNA, 20 nt, Homo sapiens
ucaaaccuaccacucaggaa

SEQ ID NO: 1055320 - RNA, 19 nt, Homo sapiens
ucaaacucuugaccucagg

SEQ ID NO: 1055321 - RNA, 14 nt, Homo sapiens
ucaaagacauggaa

SEQ ID NO: 1055322 - RNA, 13 nt, Homo sapiens
ucaaagacauucu

SEQ ID NO: 1055323 - RNA, 12 nt, Homo sapiens
ucaaagcacuug

SEQ ID NO: 1055324 - RNA, 17 nt, Homo sapiens
ucaaagccacacucugg

SEQ ID NO: 1055325 - RNA, 20 nt, Homo sapiens
ucaaagggagagagugcuau

SEQ ID NO: 1055326 - RNA, 16 nt, Homo sapiens
ucaaaguaaaacuugc

SEQ ID NO: 1055327 - RNA, 13 nt, Homo sapiens
ucaaagugagcuc

SEQ ID NO: 1055328 - RNA, 22 nt, Homo sapiens
ucaaagugagcuccuaagccau

SEQ ID NO: 1055329 - RNA, 13 nt, Homo sapiens
ucaaauacaucuu

SEQ ID NO: 1055330 - RNA, 18 nt, Homo sapiens
ucaaauacuuuaaaggaa

SEQ ID NO: 1055331 - RNA, 14 nt, Homo sapiens
ucaaauaugcaaag

SEQ ID NO: 1055332 - RNA, 15 nt, Homo sapiens
ucaaaucguccagcg

SEQ ID NO: 1055333 - RNA, 20 nt, Homo sapiens
ucaaauggaagacacauuga

SEQ ID NO: 1055334 - RNA, 14 nt, Homo sapiens
ucaaaugugugcuu

SEQ ID NO: 1055335 - RNA, 16 nt, Homo sapiens
ucaaauguuguucucu

SEQ ID NO: 1055336 - RNA, 22 nt, Homo sapiens
ucaacaaaauaaugcacuuccu

SEQ ID NO: 1055337 - RNA, 16 nt, Homo sapiens
ucaacaaagucaccca

SEQ ID NO: 1055338 - RNA, 16 nt, Homo sapiens
ucaacaccucugcaca

SEQ ID NO: 1055339 - RNA, 14 nt, Homo sapiens
ucaacagcuaugcu

SEQ ID NO: 1055340 - RNA, 20 nt, Homo sapiens
ucaacaucuuuuacauucug

SEQ ID NO: 1055341 - RNA, 13 nt, Homo sapiens
ucaacaugaguca

SEQ ID NO: 1055342 - RNA, 13 nt, Homo sapiens
ucaacauuucuca

SEQ ID NO: 1055343 - RNA, 23 nt, Homo sapiens
ucaaccauccccuccguggcauc

SEQ ID NO: 1055344 - RNA, 21 nt, Homo sapiens
ucaaccuccugggcuaaguga

SEQ ID NO: 1055345 - RNA, 19 nt, Homo sapiens
ucaacuagcagauacaggg

SEQ ID NO: 1055346 - RNA, 13 nt, Homo sapiens
ucaacuaugauau

SEQ ID NO: 1055347 - RNA, 17 nt, Homo sapiens
ucaacugaaaagacuca

SEQ ID NO: 1055348 - RNA, 16 nt, Homo sapiens
ucaagaacucugggcu

SEQ ID NO: 1055349 - RNA, 15 nt, Homo sapiens
ucaagaauaaucacg

SEQ ID NO: 1055350 - RNA, 19 nt, Homo sapiens
ucaagaauggggaucacag

SEQ ID NO: 1055351 - RNA, 19 nt, Homo sapiens
ucaagaccauagugaccaa

SEQ ID NO: 1055352 - RNA, 19 nt, Homo sapiens
ucaagaugaugaugaucuu

SEQ ID NO: 1055353 - RNA, 18 nt, Homo sapiens
ucaagcaguagacaagca

SEQ ID NO: 1055354 - RNA, 20 nt, Homo sapiens
ucaagccccacgaugacugc

SEQ ID NO: 1055355 - RNA, 21 nt, Homo sapiens
ucaagccuagcccuucucuca

SEQ ID NO: 1055356 - RNA, 21 nt, Homo sapiens
ucaaggcccauaucugugaaa

SEQ ID NO: 1055357 - RNA, 13 nt, Homo sapiens
ucaaggugggccu

SEQ ID NO: 1055358 - RNA, 16 nt, Homo sapiens
ucaagucuucccugau

SEQ ID NO: 1055359 - RNA, 23 nt, Homo sapiens
ucaagucuucccugaucaaguca

SEQ ID NO: 1055360 - RNA, 22 nt, Homo sapiens
ucaagugauccuccugacucag

SEQ ID NO: 1055361 - RNA, 18 nt, Homo sapiens
ucaaguggagagaaauca

SEQ ID NO: 1055362 - RNA, 14 nt, Homo sapiens
ucaagugucuucca

SEQ ID NO: 1055363 - RNA, 16 nt, Homo sapiens
ucaaguuggcuucuaa

SEQ ID NO: 1055364 - RNA, 15 nt, Homo sapiens
ucaaguugugcuugu

SEQ ID NO: 1055365 - RNA, 20 nt, Homo sapiens
ucaaguuuuauuauugcaau

SEQ ID NO: 1055366 - RNA, 16 nt, Homo sapiens
ucaaguuuuucagaaa

SEQ ID NO: 1055367 - RNA, 20 nt, Homo sapiens
ucaaguuuuucagaaagcau

SEQ ID NO: 1055368 - RNA, 18 nt, Homo sapiens
ucaauaauauauuuucug

SEQ ID NO: 1055369 - RNA, 14 nt, Homo sapiens
ucaauaaucaauga

SEQ ID NO: 1055370 - RNA, 17 nt, Homo sapiens
ucaauauuaaauacaga

SEQ ID NO: 1055371 - RNA, 15 nt, Homo sapiens
ucaaucauagccaag

SEQ ID NO: 1055372 - RNA, 20 nt, Homo sapiens
ucaauccaagagucugauga

SEQ ID NO: 1055373 - RNA, 15 nt, Homo sapiens
ucaaucucucuuaga

SEQ ID NO: 1055374 - RNA, 19 nt, Homo sapiens
ucaaugaaaugaugucaua

SEQ ID NO: 1055375 - RNA, 11 nt, Homo sapiens
ucaaugaucua

SEQ ID NO: 1055376 - RNA, 23 nt, Homo sapiens
ucaaugaucuagguuuaacucag

SEQ ID NO: 1055377 - RNA, 12 nt, Homo sapiens
ucaaugcuauaa

SEQ ID NO: 1055378 - RNA, 15 nt, Homo sapiens
ucaauggacuggaag

SEQ ID NO: 1055379 - RNA, 14 nt, Homo sapiens
ucaauggcugcuga

SEQ ID NO: 1055380 - RNA, 15 nt, Homo sapiens
ucaaugucacuuaaa

SEQ ID NO: 1055381 - RNA, 22 nt, Homo sapiens
ucaauucccacguagacucuua

SEQ ID NO: 1055382 - RNA, 15 nt, Homo sapiens
ucaauuccugugauu

SEQ ID NO: 1055383 - RNA, 21 nt, Homo sapiens
ucaauuuaaaaaaaaaccuga

SEQ ID NO: 1055384 - RNA, 13 nt, Homo sapiens
ucaauuucuacaa

SEQ ID NO: 1055385 - RNA, 14 nt, Homo sapiens
ucaauuucucccca
